United States Patent 10,706,955 (BIOINFORMATIC PROCESSES FOR DETERMINATION OF PEPTIDE BINDING) - sequence listing, part 66

SEQ ID NO: 2515423 - protein, 25 aa, Entamoeba dispar
NNVYRHIPSIFGLMILFDTNGFPLC

SEQ ID NO: 2515424 - protein, 18 aa, Entamoeba dispar
NNYFFKWQFNDTITCKLG

SEQ ID NO: 2515425 - protein, 17 aa, Entamoeba dispar
NPCLFERGADGWKFVKE

SEQ ID NO: 2515426 - protein, 18 aa, Entamoeba dispar
NPCLFSRIFSLDFDNPYN

SEQ ID NO: 2515427 - protein, 22 aa, Entamoeba dispar
NPEWKFPVVVLHKIEFSPFEID

SEQ ID NO: 2515428 - protein, 19 aa, Entamoeba dispar
NPFLVKKCRCFLNDNEKKE

SEQ ID NO: 2515429 - protein, 17 aa, Entamoeba dispar
NPIMLWYSEHRYRETYI

SEQ ID NO: 2515430 - protein, 19 aa, Entamoeba dispar
NPIRCVLCDFGLCSEYNSH

SEQ ID NO: 2515431 - protein, 25 aa, Entamoeba dispar
NPIYQRLWFALGICCLQISDISGAK

SEQ ID NO: 2515432 - protein, 20 aa, Entamoeba dispar
NPRFKYGRMMTDEDWEAEKR

SEQ ID NO: 2515433 - protein, 25 aa, Entamoeba dispar
NPTFKSQVYTFVWCKQVATFFNSPH

SEQ ID NO: 2515434 - protein, 22 aa, Entamoeba dispar
NPWIEWGKILNLRCMENQKNEK

SEQ ID NO: 2515435 - protein, 19 aa, Entamoeba dispar
NQFKCVLTKQVIEKMLYCC

SEQ ID NO: 2515436 - protein, 20 aa, Entamoeba dispar
NQFKLLLDFVKTFFSSDQSN

SEQ ID NO: 2515437 - protein, 22 aa, Entamoeba dispar
NQKDRIMHLFSVFVPKEKTGIV

SEQ ID NO: 2515438 - protein, 21 aa, Entamoeba dispar
NQLNFPLCFTIFGATHYSFKN

SEQ ID NO: 2515439 - protein, 22 aa, Entamoeba dispar
NQLWASKILQIFKFLNGKDTFE

SEQ ID NO: 2515440 - protein, 17 aa, Entamoeba dispar
NQVLRFYRRIVRDYLTR

SEQ ID NO: 2515441 - protein, 23 aa, Entamoeba dispar
NRCCKACVFNNFIPGYDCKISDA

SEQ ID NO: 2515442 - protein, 18 aa, Entamoeba dispar
NRCGHSFCKQCILEQILT

SEQ ID NO: 2515443 - protein, 20 aa, Entamoeba dispar
NRHVMCFCFDITKKASFSSI

SEQ ID NO: 2515444 - protein, 20 aa, Entamoeba dispar
NRIGHQFFWFLKAELHDNRV

SEQ ID NO: 2515445 - protein, 26 aa, Entamoeba dispar
NRIKSHSWFKGFDWEGLFQKKLSPPF

SEQ ID NO: 2515446 - protein, 19 aa, Entamoeba dispar
NRILYIYRVIRPFRLIEVD

SEQ ID NO: 2515447 - protein, 23 aa, Entamoeba dispar
NRIPSWCDRVLWKTENRHFVDAK

SEQ ID NO: 2515448 - protein, 22 aa, Entamoeba dispar
NRIPSWCDRVLWKTENRHYVEV

SEQ ID NO: 2515449 - protein, 19 aa, Entamoeba dispar
NRISDEWITLGIRDYLAEQ

SEQ ID NO: 2515450 - protein, 20 aa, Entamoeba dispar
NRITVGFPIKGYKEALVLDI

SEQ ID NO: 2515451 - protein, 22 aa, Entamoeba dispar
NRKEINTTIGFLFEIETNKIIE

SEQ ID NO: 2515452 - protein, 20 aa, Entamoeba dispar
NRKKEWRVIGALFNDSFEVG

SEQ ID NO: 2515453 - protein, 19 aa, Entamoeba dispar
NRKRIVNEFLLKNKNHQLL

SEQ ID NO: 2515454 - protein, 17 aa, Entamoeba dispar
NRLKMFLQFISKEGEFN

SEQ ID NO: 2515455 - protein, 18 aa, Entamoeba dispar
NRLMKLCYRISLNHDDTQ

SEQ ID NO: 2515456 - protein, 17 aa, Entamoeba dispar
NRLNWCIPPLVFALLKA

SEQ ID NO: 2515457 - protein, 17 aa, Entamoeba dispar
NRLRLVLLIEEYMITSS

SEQ ID NO: 2515458 - protein, 20 aa, Entamoeba dispar
NRMMGGFGMMGGFPHNNMPM

SEQ ID NO: 2515459 - protein, 21 aa, Entamoeba dispar
NRPCFICGEIGHLDRDCPHKN

SEQ ID NO: 2515460 - protein, 22 aa, Entamoeba dispar
NRSKEFFKYILSFITDNEIVIG

SEQ ID NO: 2515461 - protein, 20 aa, Entamoeba dispar
NRVRILFKFIVSILKVKSYD

SEQ ID NO: 2515462 - protein, 18 aa, Entamoeba dispar
NRVVELWKQQGVYTQLNK

SEQ ID NO: 2515463 - protein, 19 aa, Entamoeba dispar
NRWSNLIIHNLIFYGITVK

SEQ ID NO: 2515464 - protein, 17 aa, Entamoeba dispar
NSADLFWSNQQQSIPQQ

SEQ ID NO: 2515465 - protein, 17 aa, Entamoeba dispar
NSAICFATFRRDLRSNS

SEQ ID NO: 2515466 - protein, 18 aa, Entamoeba dispar
NSFSKPTLVQVFALSKNF

SEQ ID NO: 2515467 - protein, 20 aa, Entamoeba dispar
NSNECILCYNGYQLQNKKCI

SEQ ID NO: 2515468 - protein, 23 aa, Entamoeba dispar
NSNGFKGMLLVSAKTGFHVEETM

SEQ ID NO: 2515469 - protein, 25 aa, Entamoeba dispar
NSWKLCPIRCVMCSNVSIPTHELSK

SEQ ID NO: 2515470 - protein, 18 aa, Entamoeba dispar
NTCLPQRRIVKLTQSNLK

SEQ ID NO: 2515471 - protein, 19 aa, Entamoeba dispar
NTEIPFKVNISISDGIILF

SEQ ID NO: 2515472 - protein, 17 aa, Entamoeba dispar
NTFILKSFISFHTLSPY

SEQ ID NO: 2515473 - protein, 26 aa, Entamoeba dispar
NTFLTLFFLRYCFRPFSKVPSILKIL

SEQ ID NO: 2515474 - protein, 18 aa, Entamoeba dispar
NTKRNMLICFARIGEEVP

SEQ ID NO: 2515475 - protein, 20 aa, Entamoeba dispar
NTLKLMFRRYLKLENPLVAF

SEQ ID NO: 2515476 - protein, 19 aa, Entamoeba dispar
NTLLYEWYELRKLKAIDYR

SEQ ID NO: 2515477 - protein, 18 aa, Entamoeba dispar
NTLRCLFASILNERRVVI

SEQ ID NO: 2515478 - protein, 20 aa, Entamoeba dispar
NTRFCLICNYISRILPPISS

SEQ ID NO: 2515479 - protein, 17 aa, Entamoeba dispar
NTTCLRKKCKLGIRCKT

SEQ ID NO: 2515480 - protein, 18 aa, Entamoeba dispar
NTVCTFLKIFNPIDINHE

SEQ ID NO: 2515481 - protein, 21 aa, Entamoeba dispar
NVAKVLLRWHIDLEKTNKYGF

SEQ ID NO: 2515482 - protein, 18 aa, Entamoeba dispar
NVFFKWSCFEYNYNHQPI

SEQ ID NO: 2515483 - protein, 17 aa, Entamoeba dispar
NVIDFIHNGEWTLDNDK

SEQ ID NO: 2515484 - protein, 17 aa, Entamoeba dispar
NVIEIRKQFAIDSVSRE

SEQ ID NO: 2515485 - protein, 19 aa, Entamoeba dispar
NVIPVQRISSTLVFVKSTN

SEQ ID NO: 2515486 - protein, 17 aa, Entamoeba dispar
NVISWQYICRVIFYCLS

SEQ ID NO: 2515487 - protein, 18 aa, Entamoeba dispar
NVKEGIDLIGIFDGHNGS

SEQ ID NO: 2515488 - protein, 22 aa, Entamoeba dispar
NVKMCKDFKAILTLLDGIFTFQ

SEQ ID NO: 2515489 - protein, 19 aa, Entamoeba dispar
NVRDIFKFLSVHWDILSHL

SEQ ID NO: 2515490 - protein, 18 aa, Entamoeba dispar
NVRIHLCHAIYLISSKYP

SEQ ID NO: 2515491 - protein, 26 aa, Entamoeba dispar
NVSLLHLIRWGKYVGNYGIESLKEGF

SEQ ID NO: 2515492 - protein, 22 aa, Entamoeba dispar
NVWPYIRFSIDYNIAQSELKFL

SEQ ID NO: 2515493 - protein, 17 aa, Entamoeba dispar
NVYCDLMKVGIIDPTKV

SEQ ID NO: 2515494 - protein, 23 aa, Entamoeba dispar
NWEKEFKKWLGVERIPVQTGSSD

SEQ ID NO: 2515495 - protein, 21 aa, Entamoeba dispar
NYFILFLLCINFLYRQNNYAF

SEQ ID NO: 2515496 - protein, 18 aa, Entamoeba dispar
NYGWSLTCELSFLQSLYQ

SEQ ID NO: 2515497 - protein, 22 aa, Entamoeba dispar
NYHAICGIVFAFVRIPEIEQLK

SEQ ID NO: 2515498 - protein, 19 aa, Entamoeba dispar
NYIKLASCLLKLKDYAGAV

SEQ ID NO: 2515499 - protein, 18 aa, Entamoeba dispar
NYLKELGCSTIFLSPIYK

SEQ ID NO: 2515500 - protein, 17 aa, Entamoeba dispar
NYNTFAISYNCRHNSNY

SEQ ID NO: 2515501 - protein, 23 aa, Entamoeba dispar
NYPKLPILFVWMGDLFHTNELPV

SEQ ID NO: 2515502 - protein, 20 aa, Entamoeba dispar
NYVFCVPYAFAIVGSGKSAV

SEQ ID NO: 2515503 - protein, 18 aa, Entamoeba dispar
NYYLSFDFIDEEGMKYNC

SEQ ID NO: 2515504 - protein, 18 aa, Entamoeba dispar
PALFEGWGKKQGGSVKTW

SEQ ID NO: 2515505 - protein, 18 aa, Entamoeba dispar
PALRGCPFCYNYATVHHS

SEQ ID NO: 2515506 - protein, 19 aa, Entamoeba dispar
PATCKMWKNWQELMQRDGL

SEQ ID NO: 2515507 - protein, 20 aa, Entamoeba dispar
PAVMFCDSIGFLSANFYSKN

SEQ ID NO: 2515508 - protein, 21 aa, Entamoeba dispar
PAVMFCDSIGFLSANFYSKNL

SEQ ID NO: 2515509 - protein, 23 aa, Entamoeba dispar
PAYKEFVEGLGWTLDIKTHSGFL

SEQ ID NO: 2515510 - protein, 18 aa, Entamoeba dispar
PCFKELICRVTPVLVDGI

SEQ ID NO: 2515511 - protein, 18 aa, Entamoeba dispar
PCIAEILPQYVFNDRNPI

SEQ ID NO: 2515512 - protein, 22 aa, Entamoeba dispar
PCILPMIFRLFLRKDYTYEVFG

SEQ ID NO: 2515513 - protein, 17 aa, Entamoeba dispar
PCMKCNRYPLLPLGLYD

SEQ ID NO: 2515514 - protein, 19 aa, Entamoeba dispar
PCPWLDGKHVVFGQVVEGY

SEQ ID NO: 2515515 - protein, 17 aa, Entamoeba dispar
PCYKCLYPVMPSTTLNA

SEQ ID NO: 2515516 - protein, 21 aa, Entamoeba dispar
PDDWKLNGLDIIHYVSDDELQ

SEQ ID NO: 2515517 - protein, 21 aa, Entamoeba dispar
PDFPNRLAIYLSIALEPNELC

SEQ ID NO: 2515518 - protein, 18 aa, Entamoeba dispar
PDLAIPLWYSYGTVVILL

SEQ ID NO: 2515519 - protein, 18 aa, Entamoeba dispar
PDMNEFYRNILIKQNTII

SEQ ID NO: 2515520 - protein, 20 aa, Entamoeba dispar
PDVKISYGLVKKVLEQQALL

SEQ ID NO: 2515521 - protein, 19 aa, Entamoeba dispar
PDYQLRPNFLITLVEAPNL

SEQ ID NO: 2515522 - protein, 17 aa, Entamoeba dispar
PEALAFLKKQAIKFNAI

SEQ ID NO: 2515523 - protein, 17 aa, Entamoeba dispar
PECEVMLIGSKSDLSYR

SEQ ID NO: 2515524 - protein, 20 aa, Entamoeba dispar
PECLKEVFDLIKLVSQKNEI

SEQ ID NO: 2515525 - protein, 22 aa, Entamoeba dispar
PEECTSKCCCFYVSLNHQQLPM

SEQ ID NO: 2515526 - protein, 18 aa, Entamoeba dispar
PEHCIAWASQIAWENPTI

SEQ ID NO: 2515527 - protein, 24 aa, Entamoeba dispar
PEHLTCLKYLVSFCSHLVKSEKSK

SEQ ID NO: 2515528 - protein, 17 aa, Entamoeba dispar
PEIFPGVVYRLADPKMV

SEQ ID NO: 2515529 - protein, 19 aa, Entamoeba dispar
PEIKLALIFEKCLSEIQKK

SEQ ID NO: 2515530 - protein, 17 aa, Entamoeba dispar
PEKTCPFILSYLLSEQS

SEQ ID NO: 2515531 - protein, 17 aa, Entamoeba dispar
PELIGWIRKGFKIVKDS

SEQ ID NO: 2515532 - protein, 17 aa, Entamoeba dispar
PELLVGICGEHGGEPSS

SEQ ID NO: 2515533 - protein, 18 aa, Entamoeba dispar
PELLVGICGEHGGEPSSI

SEQ ID NO: 2515534 - protein, 20 aa, Entamoeba dispar
PEMYSWFPLFFPLISPIEVK

SEQ ID NO: 2515535 - protein, 20 aa, Entamoeba dispar
PENKRVLFNFAFESLTSDEE

SEQ ID NO: 2515536 - protein, 22 aa, Entamoeba dispar
PESNGRYIVRFGTLEVVGQYIN

SEQ ID NO: 2515537 - protein, 17 aa, Entamoeba dispar
PESVFKFNMAFKPKMTK

SEQ ID NO: 2515538 - protein, 18 aa, Entamoeba dispar
PETAQGIFTMFKRNLEFN

SEQ ID NO: 2515539 - protein, 23 aa, Entamoeba dispar
PETYIKDLLRLGAEMLPQDYLQR

SEQ ID NO: 2515540 - protein, 17 aa, Entamoeba dispar
PEVLWGLMMSELVDIIK

SEQ ID NO: 2515541 - protein, 19 aa, Entamoeba dispar
PEYIKNLYIYSSDQKLIIN

SEQ ID NO: 2515542 - protein, 19 aa, Entamoeba dispar
PEYRRAYATVAFHGTYLPK

SEQ ID NO: 2515543 - protein, 18 aa, Entamoeba dispar
PFALPAIQDFHSNKMTID

SEQ ID NO: 2515544 - protein, 18 aa, Entamoeba dispar
PFCGGCVLCSTFNCTTLK

SEQ ID NO: 2515545 - protein, 24 aa, Entamoeba dispar
PFDIKGKCILPKFQIEISPKKFLI

SEQ ID NO: 2515546 - protein, 18 aa, Entamoeba dispar
PFELELMYKDGWERSCDV

SEQ ID NO: 2515547 - protein, 21 aa, Entamoeba dispar
PFFMFGWHYTWFINAFNFELV

SEQ ID NO: 2515548 - protein, 17 aa, Entamoeba dispar
PFIISVLNICFEFLKID

SEQ ID NO: 2515549 - protein, 19 aa, Entamoeba dispar
PFIMVVLKFIRLIYKSTPQ

SEQ ID NO: 2515550 - protein, 18 aa, Entamoeba dispar
PFIPLILKYIEAMTFYSN

SEQ ID NO: 2515551 - protein, 24 aa, Entamoeba dispar
PFLKRNLCVCLGRIALRKPELIIP

SEQ ID NO: 2515552 - protein, 22 aa, Entamoeba dispar
PFLPEYLTSIFVYVAPLFTSLE

SEQ ID NO: 2515553 - protein, 19 aa, Entamoeba dispar
PFLRQCGFSDIYSIPISGF

SEQ ID NO: 2515554 - protein, 20 aa, Entamoeba dispar
PFQREMRGVISTAIDENIDA

SEQ ID NO: 2515555 - protein, 20 aa, Entamoeba dispar
PFRLTREILDPMGVLKYDGP

SEQ ID NO: 2515556 - protein, 22 aa, Entamoeba dispar
PFSDFWKHVCIVWTKCYCYTPK

SEQ ID NO: 2515557 - protein, 19 aa, Entamoeba dispar
PFYKTCGIIRNIIHFYNEA

SEQ ID NO: 2515558 - protein, 23 aa, Entamoeba dispar
PGEGFLQCLHRLLSTRIGYESFV

SEQ ID NO: 2515559 - protein, 24 aa, Entamoeba dispar
PGKRLRPLSLLLFFIGGGGKIEER

SEQ ID NO: 2515560 - protein, 18 aa, Entamoeba dispar
PGKYFIKYMRNIPIHFQW

SEQ ID NO: 2515561 - protein, 18 aa, Entamoeba dispar
PGLLRYSKGITMNEVVVL

SEQ ID NO: 2515562 - protein, 19 aa, Entamoeba dispar
PGMLFCNSLAKDVLSKYQE

SEQ ID NO: 2515563 - protein, 25 aa, Entamoeba dispar
PGYFKAYEFRLALKSQISRYNEIIQ

SEQ ID NO: 2515564 - protein, 23 aa, Entamoeba dispar
PHFLFRSGTSFDIIFIDSNLFRF

SEQ ID NO: 2515565 - protein, 20 aa, Entamoeba dispar
PHGGYGLGVERLVMWLLGED

SEQ ID NO: 2515566 - protein, 19 aa, Entamoeba dispar
PHIFYKFIIMLVNRSEVQP

SEQ ID NO: 2515567 - protein, 20 aa, Entamoeba dispar
PHPIEVFALIAALRILCPLN

SEQ ID NO: 2515568 - protein, 17 aa, Entamoeba dispar
PHQRTGIKWLWEHHNET

SEQ ID NO: 2515569 - protein, 21 aa, Entamoeba dispar
PHTIKCLICQELIDIDSVISH

SEQ ID NO: 2515570 - protein, 17 aa, Entamoeba dispar
PIIDECYPLWVYKSTPG

SEQ ID NO: 2515571 - protein, 17 aa, Entamoeba dispar
PIIKHFFIILGYPNQPY

SEQ ID NO: 2515572 - protein, 24 aa, Entamoeba dispar
PILKEYLTHFLLYIHFPWERNIEN

SEQ ID NO: 2515573 - protein, 24 aa, Entamoeba dispar
PIMGRRADYMWGLGYRKALMIEKL

SEQ ID NO: 2515574 - protein, 19 aa, Entamoeba dispar
PIMLVCQDCFWRCTLQGGC

SEQ ID NO: 2515575 - protein, 17 aa, Entamoeba dispar
PIPEIIQNPSLGKEGIE

SEQ ID NO: 2515576 - protein, 17 aa, Entamoeba dispar
PIPIDNLHTFRGSTRTV

SEQ ID NO: 2515577 - protein, 19 aa, Entamoeba dispar
PIPPPRPGNRDALSHHHSD

SEQ ID NO: 2515578 - protein, 18 aa, Entamoeba dispar
PIRSIFNCFHRTSVDYFT

SEQ ID NO: 2515579 - protein, 22 aa, Entamoeba dispar
PITDFWRHVCVVWTKCYCYIPK

SEQ ID NO: 2515580 - protein, 18 aa, Entamoeba dispar
PIVFKFFFKDDVKLGNVI

SEQ ID NO: 2515581 - protein, 26 aa, Entamoeba dispar
PIVQRFRWSILILFRVITNLYDCLDK

SEQ ID NO: 2515582 - protein, 20 aa, Entamoeba dispar
PKAAMLLDCYDICYLWIGKD

SEQ ID NO: 2515583 - protein, 17 aa, Entamoeba dispar
PKCGHSFCLSCISEHAK

SEQ ID NO: 2515584 - protein, 18 aa, Entamoeba dispar
PKCYKMIAKLCGGYNLEG

SEQ ID NO: 2515585 - protein, 20 aa, Entamoeba dispar
PKDIKGHVTVSTWHVPCECL

SEQ ID NO: 2515586 - protein, 19 aa, Entamoeba dispar
PKEFCKMSQMKVLIMNNNK

SEQ ID NO: 2515587 - protein, 19 aa, Entamoeba dispar
PKFSFDLSEFISLTSLSLI

SEQ ID NO: 2515588 - protein, 17 aa, Entamoeba dispar
PKGYPIIPLKPSYLPYP

SEQ ID NO: 2515589 - protein, 20 aa, Entamoeba dispar
PKIYNILCAINYVLEISNDQ

SEQ ID NO: 2515590 - protein, 26 aa, Entamoeba dispar
PKKFFSLKGDMLWFVVDHWFLFGKLY

SEQ ID NO: 2515591 - protein, 23 aa, Entamoeba dispar
PKKVPIGGVPLFGGFNPGKVALK

SEQ ID NO: 2515592 - protein, 20 aa, Entamoeba dispar
PKKWWKYAFNVILEDVRKKN

SEQ ID NO: 2515593 - protein, 20 aa, Entamoeba dispar
PKLAKIICAIGFKKIEGITV

SEQ ID NO: 2515594 - protein, 21 aa, Entamoeba dispar
PKLLCNFSYCIVYLLTSFYPV

SEQ ID NO: 2515595 - protein, 25 aa, Entamoeba dispar
PKLSNIAELSFRGSSPLLSIAPSVD

SEQ ID NO: 2515596 - protein, 18 aa, Entamoeba dispar
PKMLKFILENGGRVEQLN

SEQ ID NO: 2515597 - protein, 19 aa, Entamoeba dispar
PKMRIVFVGTFGVGKTSLI

SEQ ID NO: 2515598 - protein, 19 aa, Entamoeba dispar
PKNIITFGICFNKEEIKEK

SEQ ID NO: 2515599 - protein, 17 aa, Entamoeba dispar
PKNKGASFSAVFKRISL

SEQ ID NO: 2515600 - protein, 19 aa, Entamoeba dispar
PKNKLDVIFLHFPDVQSMN

SEQ ID NO: 2515601 - protein, 20 aa, Entamoeba dispar
PKNTITFGICFNKEEIKEKF

SEQ ID NO: 2515602 - protein, 18 aa, Entamoeba dispar
PKQCRLLMRSFEELHDSV

SEQ ID NO: 2515603 - protein, 25 aa, Entamoeba dispar
PKQETSLLFGIAFDRRLEKLKEQYA

SEQ ID NO: 2515604 - protein, 25 aa, Entamoeba dispar
PKRDIIMGVAYLEWARNKYSQILKN

SEQ ID NO: 2515605 - protein, 20 aa, Entamoeba dispar
PKRWWKFAFDSLLIEVKKKN

SEQ ID NO: 2515606 - protein, 18 aa, Entamoeba dispar
PKSFKARPIINHADGTKQ

SEQ ID NO: 2515607 - protein, 22 aa, Entamoeba dispar
PKSNRFVAPFSFKRLIETTKKG

SEQ ID NO: 2515608 - protein, 19 aa, Entamoeba dispar
PKTNCVICFNMSIYFQSDE

SEQ ID NO: 2515609 - protein, 18 aa, Entamoeba dispar
PKVAWYCYHLMKERKNMS

SEQ ID NO: 2515610 - protein, 20 aa, Entamoeba dispar
PKYSFARYWILDSIRAQHFM

SEQ ID NO: 2515611 - protein, 25 aa, Entamoeba dispar
PLCEKKCYYCSLIVDRSLMEIIKGA

SEQ ID NO: 2515612 - protein, 24 aa, Entamoeba dispar
PLCLPFKPLFFFNRENYLVLLNEK

SEQ ID NO: 2515613 - protein, 21 aa, Entamoeba dispar
PLCSDWEQWKSLSITSNLSFR

SEQ ID NO: 2515614 - protein, 18 aa, Entamoeba dispar
PLELKAKFETFIRPRKSQ

SEQ ID NO: 2515615 - protein, 19 aa, Entamoeba dispar
PLELPQMFYMPFTVEDIQQ

SEQ ID NO: 2515616 - protein, 17 aa, Entamoeba dispar
PLFPLFLCDAGLIIISR

SEQ ID NO: 2515617 - protein, 17 aa, Entamoeba dispar
PLFPLFLCDAGLVIISR

SEQ ID NO: 2515618 - protein, 17 aa, Entamoeba dispar
PLGCAVSKSGWRYPIPI

SEQ ID NO: 2515619 - protein, 17 aa, Entamoeba dispar
PLGCNFSLLTHLDLSQN

SEQ ID NO: 2515620 - protein, 20 aa, Entamoeba dispar
PLKCFSFCFGLSTVVNLGNL

SEQ ID NO: 2515621 - protein, 18 aa, Entamoeba dispar
PLKTLYLKNLCQYQDLEY

SEQ ID NO: 2515622 - protein, 20 aa, Entamoeba dispar
PLLDCVKGQIAWDLHILATP

SEQ ID NO: 2515623 - protein, 24 aa, Entamoeba dispar
PLLKLRPYELLQHMIIITDDLPQI

SEQ ID NO: 2515624 - protein, 17 aa, Entamoeba dispar
PLLLKPSLFLLFNEAAT

SEQ ID NO: 2515625 - protein, 18 aa, Entamoeba dispar
PLLRKLRNIIGINNRIKV

SEQ ID NO: 2515626 - protein, 17 aa, Entamoeba dispar
PLLTPGYEAVIHIHTSQ

SEQ ID NO: 2515627 - protein, 25 aa, Entamoeba dispar
PLNCFFEISHLIAIDLYKYVTSQYS

SEQ ID NO: 2515628 - protein, 20 aa, Entamoeba dispar
PLNYRINFIGTFYISKDNVK

SEQ ID NO: 2515629 - protein, 25 aa, Entamoeba dispar
PLPECKMLPKGWGIGMDRGEMYFIN

SEQ ID NO: 2515630 - protein, 19 aa, Entamoeba dispar
PLPSSKDSHCWWINHRSHY

SEQ ID NO: 2515631 - protein, 17 aa, Entamoeba dispar
PLRLCDLSLPFGVLSQS

SEQ ID NO: 2515632 - protein, 19 aa, Entamoeba dispar
PLRLKIMNFVRTWMKNAWK

SEQ ID NO: 2515633 - protein, 17 aa, Entamoeba dispar
PLVKGKPSWSIKSIFLG

SEQ ID NO: 2515634 - protein, 21 aa, Entamoeba dispar
PLVKGKPSWSIKSIFLGKKSY

SEQ ID NO: 2515635 - protein, 18 aa, Entamoeba dispar
PLYQARALFDFESKNAEC

SEQ ID NO: 2515636 - protein, 23 aa, Entamoeba dispar
PLYYKIRACIGLVQHQELMPMLL

SEQ ID NO: 2515637 - protein, 19 aa, Entamoeba dispar
PMVKWQVPDTFTFKYKELE

SEQ ID NO: 2515638 - protein, 17 aa, Entamoeba dispar
PNCLSFMKFNFNHTITF

SEQ ID NO: 2515639 - protein, 18 aa, Entamoeba dispar
PNDKGLFVCRAFSNNNSA

SEQ ID NO: 2515640 - protein, 24 aa, Entamoeba dispar
PNFIPTVIVALVFNYLYPKETIEF

SEQ ID NO: 2515641 - protein, 20 aa, Entamoeba dispar
PNFMMKFFFRPAEKVSDEIE

SEQ ID NO: 2515642 - protein, 18 aa, Entamoeba dispar
PNFPELFLPYTLPKSSAA

SEQ ID NO: 2515643 - protein, 20 aa, Entamoeba dispar
PNILPRNSFQPIIISENDFN

SEQ ID NO: 2515644 - protein, 17 aa, Entamoeba dispar
PNKCKYGSYIFKKVRSL

SEQ ID NO: 2515645 - protein, 21 aa, Entamoeba dispar
PNLIKMIGCWLFGNQVFISME

SEQ ID NO: 2515646 - protein, 17 aa, Entamoeba dispar
PNLYFKGYLTFDVTDIH

SEQ ID NO: 2515647 - protein, 19 aa, Entamoeba dispar
PNPQCGRAIIVLSSERASD

SEQ ID NO: 2515648 - protein, 19 aa, Entamoeba dispar
PNSLHCFRILSLSSSEVDI

SEQ ID NO: 2515649 - protein, 24 aa, Entamoeba dispar
PNSSARKFICCGPVFAIQNMNDFP

SEQ ID NO: 2515650 - protein, 17 aa, Entamoeba dispar
PNYPYFAQLCESYNQCL

SEQ ID NO: 2515651 - protein, 18 aa, Entamoeba dispar
PPAIPKLKGNWLVDKEKS

SEQ ID NO: 2515652 - protein, 20 aa, Entamoeba dispar
PPCYTRERCGLGLLEKEEFI

SEQ ID NO: 2515653 - protein, 17 aa, Entamoeba dispar
PPFFDGFIDLLKRFKEQ

SEQ ID NO: 2515654 - protein, 25 aa, Entamoeba dispar
PPFLNSSWMKKGFGFEDFMLKKLIN

SEQ ID NO: 2515655 - protein, 18 aa, Entamoeba dispar
PPGGLGRLQFIIAKHGDA

SEQ ID NO: 2515656 - protein, 21 aa, Entamoeba dispar
PPKIWSSAILRHFFQHAFDGS

SEQ ID NO: 2515657 - protein, 17 aa, Entamoeba dispar
PPLYPYERIRLEEYKSI

SEQ ID NO: 2515658 - protein, 19 aa, Entamoeba dispar
PPPSLNFAYLLQVQQQSTC

SEQ ID NO: 2515659 - protein, 18 aa, Entamoeba dispar
PQAWIICAQYFQRRGNIE

SEQ ID NO: 2515660 - protein, 22 aa, Entamoeba dispar
PQFKCCLCSICGIKLHEECISL

SEQ ID NO: 2515661 - protein, 19 aa, Entamoeba dispar
PQGKCYCLFEYQNPEYKEK

SEQ ID NO: 2515662 - protein, 24 aa, Entamoeba dispar
PQIRYCYYFYYYLSVFPREVPFKP

SEQ ID NO: 2515663 - protein, 21 aa, Entamoeba dispar
PQLFLLRWVRILFCQMFNTNE

SEQ ID NO: 2515664 - protein, 27 aa, Entamoeba dispar
PQMQALRFPIFPSFHKFGVRYCNAKVT

SEQ ID NO: 2515665 - protein, 18 aa, Entamoeba dispar
PQPIIKNKYDILAQIQLE

SEQ ID NO: 2515666 - protein, 22 aa, Entamoeba dispar
PQRLTSICLMSFSNILLSEKKS

SEQ ID NO: 2515667 - protein, 20 aa, Entamoeba dispar
PQSPFHFYNLFSLYGSIIKV

SEQ ID NO: 2515668 - protein, 19 aa, Entamoeba dispar
PQTGVNCNLFLNGDAVTSI

SEQ ID NO: 2515669 - protein, 18 aa, Entamoeba dispar
PQVKSCNVFDNIALQNPQ

SEQ ID NO: 2515670 - protein, 20 aa, Entamoeba dispar
PQVVIKPEFSEFGVDDSSSD

SEQ ID NO: 2515671 - protein, 18 aa, Entamoeba dispar
PRCEICNLPGTMGTFCPN

SEQ ID NO: 2515672 - protein, 17 aa, Entamoeba dispar
PRFNGRYPYDFTAQTNL

SEQ ID NO: 2515673 - protein, 20 aa, Entamoeba dispar
PRIGCCMKGHPCCKRIDGQY

SEQ ID NO: 2515674 - protein, 19 aa, Entamoeba dispar
PRLHLKWFEKIAEEQSVRQ

SEQ ID NO: 2515675 - protein, 17 aa, Entamoeba dispar
PRLICQWIQGIKRIDLD

SEQ ID NO: 2515676 - protein, 20 aa, Entamoeba dispar
PRLKTIYCSFQLLCSLPSLS

SEQ ID NO: 2515677 - protein, 21 aa, Entamoeba dispar
PRLPEYIKYLCVHSINSNIVI

SEQ ID NO: 2515678 - protein, 21 aa, Entamoeba dispar
PRLPEYIKYLCVYSTNSNIVI

SEQ ID NO: 2515679 - protein, 23 aa, Entamoeba dispar
PRQFPKFTCQWIELFSHRSLLLS

SEQ ID NO: 2515680 - protein, 23 aa, Entamoeba dispar
PRSPRKFIPWGLSPSPTFSRSPS

SEQ ID NO: 2515681 - protein, 23 aa, Entamoeba dispar
PRVFKLLPSFEEWIPLLQMTNPS

SEQ ID NO: 2515682 - protein, 24 aa, Entamoeba dispar
PRVFKLLPSFEEWIPLLQMTNPSQ

SEQ ID NO: 2515683 - protein, 21 aa, Entamoeba dispar
PRYLPYIIETCIPFLESITCF

SEQ ID NO: 2515684 - protein, 23 aa, Entamoeba dispar
PRYVMLVKDLCKWTQRNQWSNNL

SEQ ID NO: 2515685 - protein, 21 aa, Entamoeba dispar
PSAIHRLRLPTGYPFLMTKPI

SEQ ID NO: 2515686 - protein, 20 aa, Entamoeba dispar
PSAVARLFLPSGVPRVMNKP

SEQ ID NO: 2515687 - protein, 18 aa, Entamoeba dispar
PSFARFALECSEYKCVGS

SEQ ID NO: 2515688 - protein, 19 aa, Entamoeba dispar
PSGCLPRSIDVILRGENVE

SEQ ID NO: 2515689 - protein, 17 aa, Entamoeba dispar
PSGDCAFNITINYKVAL

SEQ ID NO: 2515690 - protein, 20 aa, Entamoeba dispar
PSGICGVALYLAGRLHGEPR

SEQ ID NO: 2515691 - protein, 19 aa, Entamoeba dispar
PSIELIQFIYLLKTQTHFY

SEQ ID NO: 2515692 - protein, 20 aa, Entamoeba dispar
PSKCNPEYLFDYALKQHFYT

SEQ ID NO: 2515693 - protein, 20 aa, Entamoeba dispar
PSKLCYMTSVLVQLLSIEEF

SEQ ID NO: 2515694 - protein, 24 aa, Entamoeba dispar
PSLFKRVVSGFSYNLLSTHFYYSV

SEQ ID NO: 2515695 - protein, 21 aa, Entamoeba dispar
PSLHLKGGVGVRYRLQAKLQI

SEQ ID NO: 2515696 - protein, 19 aa, Entamoeba dispar
PSLVSFFTIRACHCIENGR

SEQ ID NO: 2515697 - protein, 18 aa, Entamoeba dispar
PSRKCFRLVNGVMVERTA

SEQ ID NO: 2515698 - protein, 22 aa, Entamoeba dispar
PSSIISFGWGCFSECGCKEELM

SEQ ID NO: 2515699 - protein, 21 aa, Entamoeba dispar
PSSKFFKKWFEKYSMLSNFPF

SEQ ID NO: 2515700 - protein, 20 aa, Entamoeba dispar
PSSLPFLKLVLSIPPSLAQQ

SEQ ID NO: 2515701 - protein, 21 aa, Entamoeba dispar
PSSTISFGWRCFTECNKVLHE

SEQ ID NO: 2515702 - protein, 23 aa, Entamoeba dispar
PSTHWKCCVCCTKGIREREDVLR

SEQ ID NO: 2515703 - protein, 17 aa, Entamoeba dispar
PSTIRWFISKQIYSVGI

SEQ ID NO: 2515704 - protein, 17 aa, Entamoeba dispar
PSVPAWELSEQRLPQPP

SEQ ID NO: 2515705 - protein, 19 aa, Entamoeba dispar
PTCDWEFEFPYFQLALCSV

SEQ ID NO: 2515706 - protein, 18 aa, Entamoeba dispar
PTEILKSILFFIFKEKKE

SEQ ID NO: 2515707 - protein, 19 aa, Entamoeba dispar
PTFACPFCGTDMGNSSKLQ

SEQ ID NO: 2515708 - protein, 17 aa, Entamoeba dispar
PTHPIRLGLALNFSVFY

SEQ ID NO: 2515709 - protein, 18 aa, Entamoeba dispar
PTILPAHLLALFDVTKTD

SEQ ID NO: 2515710 - protein, 21 aa, Entamoeba dispar
PTIRCFKCLECFTSISSVIQH

SEQ ID NO: 2515711 - protein, 19 aa, Entamoeba dispar
PTKYLLMWLDFLIKDIESN

SEQ ID NO: 2515712 - protein, 19 aa, Entamoeba dispar
PTKYLLMWLDFLIKDVDSN

SEQ ID NO: 2515713 - protein, 20 aa, Entamoeba dispar
PTLIKLFLQNGMFKEFFEKH

SEQ ID NO: 2515714 - protein, 23 aa, Entamoeba dispar
PTLLRLLYKGYFGDFIVSQTIEN

SEQ ID NO: 2515715 - protein, 17 aa, Entamoeba dispar
PTLQRYAAWRGGAMIAN

SEQ ID NO: 2515716 - protein, 18 aa, Entamoeba dispar
PTNSCWNCQIFLEDLSDE

SEQ ID NO: 2515717 - protein, 21 aa, Entamoeba dispar
PTSLKLCFCPLCDKQQMLLER

SEQ ID NO: 2515718 - protein, 18 aa, Entamoeba dispar
PVGYGGKLINGFSIPPPQ

SEQ ID NO: 2515719 - protein, 18 aa, Entamoeba dispar
PVQRFPRYILLLESLIKA

SEQ ID NO: 2515720 - protein, 17 aa, Entamoeba dispar
PVQRIPRYVLLLKDLLK

SEQ ID NO: 2515721 - protein, 20 aa, Entamoeba dispar
PVQRLPRYVLLFTDLIKHTP

SEQ ID NO: 2515722 - protein, 23 aa, Entamoeba dispar
PWCLRFEYWKQILPMSASIVEKV

SEQ ID NO: 2515723 - protein, 23 aa, Entamoeba dispar
PWIKDTPTYCNITLDSFKKQNET

SEQ ID NO: 2515724 - protein, 20 aa, Entamoeba dispar
PWKERLQIAISIAKGMTVFT

SEQ ID NO: 2515725 - protein, 24 aa, Entamoeba dispar
PWKQLKKLALRNCGITKIPPKVFN

SEQ ID NO: 2515726 - protein, 17 aa, Entamoeba dispar
PYCKDCFIAKFAKICAR

SEQ ID NO: 2515727 - protein, 17 aa, Entamoeba dispar
PYCNGHIKKANFKIHEL

SEQ ID NO: 2515728 - protein, 27 aa, Entamoeba dispar
PYFKTSIFWKLCCVYDHIVVHTLIRYC

SEQ ID NO: 2515729 - protein, 19 aa, Entamoeba dispar
PYKFFPIYTPFIVSKYQGR

SEQ ID NO: 2515730 - protein, 19 aa, Entamoeba dispar
PYNEFHVFESLFSLFENYL

SEQ ID NO: 2515731 - protein, 20 aa, Entamoeba dispar
PYSNLYCKLLIKKWNKMPNM

SEQ ID NO: 2515732 - protein, 23 aa, Entamoeba dispar
QAEELARLWGISFIETSAKKKSN

SEQ ID NO: 2515733 - protein, 18 aa, Entamoeba dispar
QAFWKFMNLIASKVTLEG

SEQ ID NO: 2515734 - protein, 23 aa, Entamoeba dispar
QARAEIYYVQMLKEIEFLVGTDY

SEQ ID NO: 2515735 - protein, 18 aa, Entamoeba dispar
QARITFCYAATVALNTSL

SEQ ID NO: 2515736 - protein, 18 aa, Entamoeba dispar
QARITFCYAATVALNTTL

SEQ ID NO: 2515737 - protein, 19 aa, Entamoeba dispar
QAYELLKKDAINFMNAYDS

SEQ ID NO: 2515738 - protein, 18 aa, Entamoeba dispar
QCDIKIRMLIVGDQSVGK

SEQ ID NO: 2515739 - protein, 19 aa, Entamoeba dispar
QCFSCKMFQVHIKNKLKKF

SEQ ID NO: 2515740 - protein, 19 aa, Entamoeba dispar
QCGLDLCVVMYVFKGLSDA

SEQ ID NO: 2515741 - protein, 21 aa, Entamoeba dispar
QCIRLIPCLIFGRGDEECISY

SEQ ID NO: 2515742 - protein, 20 aa, Entamoeba dispar
QCISCKLVIHKSCDPYKHNI

SEQ ID NO: 2515743 - protein, 17 aa, Entamoeba dispar
QCLSFSLVQIFKRLLTE

SEQ ID NO: 2515744 - protein, 17 aa, Entamoeba dispar
QCMSIRPSNEFITVATN

SEQ ID NO: 2515745 - protein, 24 aa, Entamoeba dispar
QCPGFLFEWYMVWFCRILPCDFCY

SEQ ID NO: 2515746 - protein, 19 aa, Entamoeba dispar
QCVICGFPSSTHCPDCTTP

SEQ ID NO: 2515747 - protein, 17 aa, Entamoeba dispar
QDCYWRETVSLIMNNSG

SEQ ID NO: 2515748 - protein, 18 aa, Entamoeba dispar
QDILNEFGYFVEVEIETI

SEQ ID NO: 2515749 - protein, 19 aa, Entamoeba dispar
QDINIFSGRVFDPFNYVDD

SEQ ID NO: 2515750 - protein, 21 aa, Entamoeba dispar
QDVVIKICWLIDKFGPDIKWK

SEQ ID NO: 2515751 - protein, 21 aa, Entamoeba dispar
QEAKLRFAFQVYDVDNDGFIS

SEQ ID NO: 2515752 - protein, 18 aa, Entamoeba dispar
QECGKRFCIKCYKKTHKG

SEQ ID NO: 2515753 - protein, 17 aa, Entamoeba dispar
QEFKRIKECGGYTERGR

SEQ ID NO: 2515754 - protein, 23 aa, Entamoeba dispar
QEGRIKARWMRKNARRIDMEQYT

SEQ ID NO: 2515755 - protein, 23 aa, Entamoeba dispar
QEIDLRTGAAFTRFQTTLLKNKS

SEQ ID NO: 2515756 - protein, 23 aa, Entamoeba dispar
QEIDLRVGVAFTRLQTKFLKERF

SEQ ID NO: 2515757 - protein, 19 aa, Entamoeba dispar
QEILYSVAWKSFLKGSYKK

SEQ ID NO: 2515758 - protein, 17 aa, Entamoeba dispar
QEKRLSPFDGLYLSKYD

SEQ ID NO: 2515759 - protein, 21 aa, Entamoeba dispar
QELKELIPVIPKKSMGYIEMK

SEQ ID NO: 2515760 - protein, 24 aa, Entamoeba dispar
QELMKRLLLIYAIKHPASGYVQGM

SEQ ID NO: 2515761 - protein, 19 aa, Entamoeba dispar
QELRLKQQFFFTSASLQDI

SEQ ID NO: 2515762 - protein, 18 aa, Entamoeba dispar
QELYICFNDSEYLPMSWT

SEQ ID NO: 2515763 - protein, 17 aa, Entamoeba dispar
QEMWDRWICFIQQTTKS

SEQ ID NO: 2515764 - protein, 17 aa, Entamoeba dispar
QEMYKSVALQFLTRELP

SEQ ID NO: 2515765 - protein, 17 aa, Entamoeba dispar
QESIKMSVCQPNESVEI

SEQ ID NO: 2515766 - protein, 23 aa, Entamoeba dispar
QETWRHVLGINVPWCIDCWQRVY

SEQ ID NO: 2515767 - protein, 22 aa, Entamoeba dispar
QEWFKMLWYKGLFTYYREDLHL

SEQ ID NO: 2515768 - protein, 17 aa, Entamoeba dispar
QFIKICIGTPVESFDDF

SEQ ID NO: 2515769 - protein, 18 aa, Entamoeba dispar
QFKRLGIPSNLIIPLYHK

SEQ ID NO: 2515770 - protein, 21 aa, Entamoeba dispar
QFRKSICKFIKRRDGTAPSPD

SEQ ID NO: 2515771 - protein, 17 aa, Entamoeba dispar
QFVFYCWQDIPGNVKQL

SEQ ID NO: 2515772 - protein, 22 aa, Entamoeba dispar
QGEIGVKFHVIWNNSPSMKTVS

SEQ ID NO: 2515773 - protein, 21 aa, Entamoeba dispar
QGETLVAFVIVKSGSSFTNLE

SEQ ID NO: 2515774 - protein, 24 aa, Entamoeba dispar
QGFLKEMLLWFGWEEIESTPPATF

SEQ ID NO: 2515775 - protein, 17 aa, Entamoeba dispar
QGKTGKCYADFEDEETW

SEQ ID NO: 2515776 - protein, 17 aa, Entamoeba dispar
QGNFEWKEKVVVVGVDM

SEQ ID NO: 2515777 - protein, 18 aa, Entamoeba dispar
QHGACLGVGLAGIATENY

SEQ ID NO: 2515778 - protein, 17 aa, Entamoeba dispar
QHIKRLSVQNVIATIGR

SEQ ID NO: 2515779 - protein, 22 aa, Entamoeba dispar
QHLNEWIDLIFGFKQTGEPAIK

SEQ ID NO: 2515780 - protein, 17 aa, Entamoeba dispar
QHQSFYPPYGYNTSPYC

SEQ ID NO: 2515781 - protein, 20 aa, Entamoeba dispar
QHVSRIIVIFNMVYPEDLID

SEQ ID NO: 2515782 - protein, 23 aa, Entamoeba dispar
QIDELYLRMAITSFEDLQPDLVA

SEQ ID NO: 2515783 - protein, 24 aa, Entamoeba dispar
QIECPFWLAPEIFKGEQWTKASDV

SEQ ID NO: 2515784 - protein, 24 aa, Entamoeba dispar
QIEEVKRLKGLILKQEEAQTEIVS

SEQ ID NO: 2515785 - protein, 17 aa, Entamoeba dispar
QIFLRAGHLLGCTDMKQ

SEQ ID NO: 2515786 - protein, 19 aa, Entamoeba dispar
QIFWKLGMKNFDDFIEKLK

SEQ ID NO: 2515787 - protein, 20 aa, Entamoeba dispar
QIGLCKLVIPHWLSLEELKE

SEQ ID NO: 2515788 - protein, 18 aa, Entamoeba dispar
QIIIPRRYYIGGDIMAYN

SEQ ID NO: 2515789 - protein, 23 aa, Entamoeba dispar
QIIQRICLYWLKYDESTEEVIME

SEQ ID NO: 2515790 - protein, 23 aa, Entamoeba dispar
QIIRSASITTCFELERLRKLMEN

SEQ ID NO: 2515791 - protein, 26 aa, Entamoeba dispar
QILICYKEQWYLISFNQNILESLQRE

SEQ ID NO: 2515792 - protein, 24 aa, Entamoeba dispar
QILKDPKLVLVFKVNTPIDEKWGF

SEQ ID NO: 2515793 - protein, 18 aa, Entamoeba dispar
QINVCLLISVFPFYENSH

SEQ ID NO: 2515794 - protein, 27 aa, Entamoeba dispar
QIQHCILNIFSLTRFNLITGLLSIELF

SEQ ID NO: 2515795 - protein, 18 aa, Entamoeba dispar
QISSFSFFFSNEFSNHLG

SEQ ID NO: 2515796 - protein, 20 aa, Entamoeba dispar
QITKLPWKAAISYFKAAFIS

SEQ ID NO: 2515797 - protein, 18 aa, Entamoeba dispar
QIVKDLKIVFGIEDDLKC

SEQ ID NO: 2515798 - protein, 17 aa, Entamoeba dispar
QKALMLLKQKKQHEQHR

SEQ ID NO: 2515799 - protein, 19 aa, Entamoeba dispar
QKGWELRLWFGDITESGYS

SEQ ID NO: 2515800 - protein, 26 aa, Entamoeba dispar
QKIFKFRISNFYSVYVYKGYDEDPDF

SEQ ID NO: 2515801 - protein, 17 aa, Entamoeba dispar
QKISHCFIFDDSKYRQF

SEQ ID NO: 2515802 - protein, 19 aa, Entamoeba dispar
QKKLSEFIVRSEGIIKNSS

SEQ ID NO: 2515803 - protein, 26 aa, Entamoeba dispar
QKLIKFKWIDPFNEYGFYAFGAAVIE

SEQ ID NO: 2515804 - protein, 22 aa, Entamoeba dispar
QKLINEFKICFASRGEALTQKI

SEQ ID NO: 2515805 - protein, 23 aa, Entamoeba dispar
QKLWKLSDVIILWGNCSENTQQW

SEQ ID NO: 2515806 - protein, 20 aa, Entamoeba dispar
QKNYEGFCAFVINTFYYNDI

SEQ ID NO: 2515807 - protein, 22 aa, Entamoeba dispar
QKRVYEIFNRFFGDNVNFTQCD

SEQ ID NO: 2515808 - protein, 20 aa, Entamoeba dispar
QKTYNWKKSFGVIKKTKKIV

SEQ ID NO: 2515809 - protein, 25 aa, Entamoeba dispar
QKVYNFVMGFGFDKFVLIDGVKKNE

SEQ ID NO: 2515810 - protein, 19 aa, Entamoeba dispar
QKWILKLKEMMLFVVDLTE

SEQ ID NO: 2515811 - protein, 23 aa, Entamoeba dispar
QKYCPPNLFSIVFKGFNDVYRIN

SEQ ID NO: 2515812 - protein, 18 aa, Entamoeba dispar
QLCGIVIFMFAKPEIVPL

SEQ ID NO: 2515813 - protein, 19 aa, Entamoeba dispar
QLFLLRWVRLLFCQVYPIN

SEQ ID NO: 2515814 - protein, 18 aa, Entamoeba dispar
QLICVKWKGLSYLHIEWI

SEQ ID NO: 2515815 - protein, 21 aa, Entamoeba dispar
QLIDCRFPYEFAGGRIHGAIN

SEQ ID NO: 2515816 - protein, 19 aa, Entamoeba dispar
QLIFHPIKFFTPTEKKVGE

SEQ ID NO: 2515817 - protein, 19 aa, Entamoeba dispar
QLLCRSILYSLSIVNAPRV

SEQ ID NO: 2515818 - protein, 23 aa, Entamoeba dispar
QLLIRLKKRFYFRDRNVNDTDQQ

SEQ ID NO: 2515819 - protein, 18 aa, Entamoeba dispar
QLNYKCGYIPLTHQQGYV

SEQ ID NO: 2515820 - protein, 21 aa, Entamoeba dispar
QLRRVGKIFAVLSEDRKKDIL

SEQ ID NO: 2515821 - protein, 20 aa, Entamoeba dispar
QLTFTVPKVYGWVDVELIHK

SEQ ID NO: 2515822 - protein, 19 aa, Entamoeba dispar
QLVIFKIYNIFCSKYLDND

SEQ ID NO: 2515823 - protein, 19 aa, Entamoeba dispar
QLVLQICILFLCPFNQNVI

SEQ ID NO: 2515824 - protein, 21 aa, Entamoeba dispar
QLVPVECKFLLLKRINKTKIN

SEQ ID NO: 2515825 - protein, 24 aa, Entamoeba dispar
QLWEIKGSIEWNRIGVAYELSFRH

SEQ ID NO: 2515826 - protein, 17 aa, Entamoeba dispar
QLYHFLAYYVLDTLFTQ

SEQ ID NO: 2515827 - protein, 20 aa, Entamoeba dispar
QMLTSLWIKRMKSLDLLLLN

SEQ ID NO: 2515828 - protein, 31 aa, Entamoeba dispar
QMNGVPRFDQMPGYSQMGGMPSYGTQPYPGY

SEQ ID NO: 2515829 - protein, 18 aa, Entamoeba dispar
QNALRLYIDWDKANLKEV

SEQ ID NO: 2515830 - protein, 17 aa, Entamoeba dispar
QNFLHCISIPKASTPVA

SEQ ID NO: 2515831 - protein, 17 aa, Entamoeba dispar
QNFRIIWKRIKFTSHDH

SEQ ID NO: 2515832 - protein, 24 aa, Entamoeba dispar
QNIFSDICPITFGSFFYFIEKVVS

SEQ ID NO: 2515833 - protein, 24 aa, Entamoeba dispar
QNISLKIAAFVRRLADETGHLGTY

SEQ ID NO: 2515834 - protein, 24 aa, Entamoeba dispar
QNPELRPNYKWILNALNDFSRNYT

SEQ ID NO: 2515835 - protein, 19 aa, Entamoeba dispar
QNRVVKMIHDYAFSQTTES

SEQ ID NO: 2515836 - protein, 26 aa, Entamoeba dispar
QNTPCCLAAFYLRVSLEIAQGVCESL

SEQ ID NO: 2515837 - protein, 17 aa, Entamoeba dispar
QNYRFILFDDINYDRNL

SEQ ID NO: 2515838 - protein, 18 aa, Entamoeba dispar
QNYYFFKEKVSFRVIRCL

SEQ ID NO: 2515839 - protein, 22 aa, Entamoeba dispar
QPHSFAKLCHWTETTELLYNIS

SEQ ID NO: 2515840 - protein, 23 aa, Entamoeba dispar
QPKKWWKFAFIATRDYLREREEE

SEQ ID NO: 2515841 - protein, 19 aa, Entamoeba dispar
QPLFLRRFNQTFNSPYRGN

SEQ ID NO: 2515842 - protein, 24 aa, Entamoeba dispar
QPLQCVSGFLVLRVICPAIMQPHK

SEQ ID NO: 2515843 - protein, 22 aa, Entamoeba dispar
QPNALCSYGVFILLTPKTKFIW

SEQ ID NO: 2515844 - protein, 22 aa, Entamoeba dispar
QPNNIFGGFSFNSLGTTDKKKE

SEQ ID NO: 2515845 - protein, 23 aa, Entamoeba dispar
QPPFPYPNWRSVVLPQGYVMYYY

SEQ ID NO: 2515846 - protein, 20 aa, Entamoeba dispar
QPSLRVCERLHLIKEGIQRE

SEQ ID NO: 2515847 - protein, 17 aa, Entamoeba dispar
QPYCLSEAITPEAALEH

SEQ ID NO: 2515848 - protein, 25 aa, Entamoeba dispar
QQFEFKKLFALCVFLAWHYKMPLKK

SEQ ID NO: 2515849 - protein, 23 aa, Entamoeba dispar
QQHLLPKRCLLNFQQQNFEIATP

SEQ ID NO: 2515850 - protein, 17 aa, Entamoeba dispar
QQITFKFIRIYRLFINF

SEQ ID NO: 2515851 - protein, 17 aa, Entamoeba dispar
QQLFFVRFLFPLLENPL

SEQ ID NO: 2515852 - protein, 17 aa, Entamoeba dispar
QQLFPFVDPEIIKTALI

SEQ ID NO: 2515853 - protein, 23 aa, Entamoeba dispar
QQLIKHFCIMRELSLISFISCKR

SEQ ID NO: 2515854 - protein, 17 aa, Entamoeba dispar
QQNRMMGGFGMMGGFPH

SEQ ID NO: 2515855 - protein, 20 aa, Entamoeba dispar
QQQSLGWGFRFWNSSPKASD

SEQ ID NO: 2515856 - protein, 23 aa, Entamoeba dispar
QQRILECVNILSSIALNNKVTSS

SEQ ID NO: 2515857 - protein, 20 aa, Entamoeba dispar
QQRIVWCINRLSSIALNGRI

SEQ ID NO: 2515858 - protein, 17 aa, Entamoeba dispar
QQYPGYNVPQGMQQYGQ

SEQ ID NO: 2515859 - protein, 21 aa, Entamoeba dispar
QRERLPLPAARDFENASDNYL

SEQ ID NO: 2515860 - protein, 19 aa, Entamoeba dispar
QRFASLTGMNVEWDFVELP

SEQ ID NO: 2515861 - protein, 19 aa, Entamoeba dispar
QRFKEYRIMPTIGNIPVIE

SEQ ID NO: 2515862 - protein, 25 aa, Entamoeba dispar
QRFNYKLRLGRGFTLKELRAAKIDK

SEQ ID NO: 2515863 - protein, 20 aa, Entamoeba dispar
QRIGVKWMYELFKQHAGGIV

SEQ ID NO: 2515864 - protein, 17 aa, Entamoeba dispar
QRIPRYVLLISDLLRNI

SEQ ID NO: 2515865 - protein, 19 aa, Entamoeba dispar
QRIQTEILRFGMFVEQIED

SEQ ID NO: 2515866 - protein, 19 aa, Entamoeba dispar
QRKFSFHSFFILGMTKNQI

SEQ ID NO: 2515867 - protein, 20 aa, Entamoeba dispar
QRKFSFHSFFILGMTKNQII

SEQ ID NO: 2515868 - protein, 20 aa, Entamoeba dispar
QRLFFLFYLSCMTKIIRCKR

SEQ ID NO: 2515869 - protein, 20 aa, Entamoeba dispar
QRLISIFSFNLFAGMVGGCK

SEQ ID NO: 2515870 - protein, 19 aa, Entamoeba dispar
QRLKEAVQWPLRFKEQLDK

SEQ ID NO: 2515871 - protein, 20 aa, Entamoeba dispar
QRLPRYRLLLKDLLKHLRPS

SEQ ID NO: 2515872 - protein, 19 aa, Entamoeba dispar
QRLPVPLLRRRNVSQERPE

SEQ ID NO: 2515873 - protein, 17 aa, Entamoeba dispar
QRLSAEFPNMFANCNLF

SEQ ID NO: 2515874 - protein, 17 aa, Entamoeba dispar
QRLYILLWRIFGLTEYC

SEQ ID NO: 2515875 - protein, 19 aa, Entamoeba dispar
QRNFFGLCAIIFALHKIQD

SEQ ID NO: 2515876 - protein, 22 aa, Entamoeba dispar
QRPKGCGFVKFMTHEDAKLCVE

SEQ ID NO: 2515877 - protein, 23 aa, Entamoeba dispar
QRPLCPRYMLLLNEIIRLSLLIE

SEQ ID NO: 2515878 - protein, 21 aa, Entamoeba dispar
QRRIELCYARLINLTANVRIN

SEQ ID NO: 2515879 - protein, 19 aa, Entamoeba dispar
QRRIKVIDMCWVKGDIPVV

SEQ ID NO: 2515880 - protein, 18 aa, Entamoeba dispar
QRVIGKCWLIFNKPKYIE

SEQ ID NO: 2515881 - protein, 22 aa, Entamoeba dispar
QRYGIDFDSVFKIVKEFRKNKK

SEQ ID NO: 2515882 - protein, 19 aa, Entamoeba dispar
QSCAIFYSFIKPFNTNQIE

SEQ ID NO: 2515883 - protein, 22 aa, Entamoeba dispar
QSDGGWFSSWWKTDKDEVNMIK

SEQ ID NO: 2515884 - protein, 18 aa, Entamoeba dispar
QSFMCWKELNTILQDEEF

SEQ ID NO: 2515885 - protein, 24 aa, Entamoeba dispar
QSNSLICWSEPLKGTAICVNNPVQ

SEQ ID NO: 2515886 - protein, 20 aa, Entamoeba dispar
QSRNEFWCVFKGTNYEFSRY

SEQ ID NO: 2515887 - protein, 18 aa, Entamoeba dispar
QSSELMEIDSTFNFDNKK

SEQ ID NO: 2515888 - protein, 17 aa, Entamoeba dispar
QSSFKFIQWVSSSNDVE

SEQ ID NO: 2515889 - protein, 24 aa, Entamoeba dispar
QSSFPCLELKVIKEIWKKNNYNMV

SEQ ID NO: 2515890 - protein, 21 aa, Entamoeba dispar
QSVSKIGDWCFYDCTSLTNTD

SEQ ID NO: 2515891 - protein, 24 aa, Entamoeba dispar
QSVSVFRLKVSWEILQQSTKNIFK

SEQ ID NO: 2515892 - protein, 23 aa, Entamoeba dispar
QSWRYCLYYGWLLINSPTTLSFA

SEQ ID NO: 2515893 - protein, 18 aa, Entamoeba dispar
QTALHWAVYMQRVDLLSI

SEQ ID NO: 2515894 - protein, 23 aa, Entamoeba dispar
QTFPQCFWCDPTAFFTDGPLMNM

SEQ ID NO: 2515895 - protein, 17 aa, Entamoeba dispar
QTFREIKFLQQLRHEKI

SEQ ID NO: 2515896 - protein, 19 aa, Entamoeba dispar
QTIGWKLVFDLAIQIIDAI

SEQ ID NO: 2515897 - protein, 19 aa, Entamoeba dispar
QTIKGFCFGSSFETSTLLI

SEQ ID NO: 2515898 - protein, 19 aa, Entamoeba dispar
QTLGKKCCVFCHKANISTK

SEQ ID NO: 2515899 - protein, 17 aa, Entamoeba dispar
QTMFRFVFNNTLIESNF

SEQ ID NO: 2515900 - protein, 17 aa, Entamoeba dispar
QTSCCLVYKCLNCGDDV

SEQ ID NO: 2515901 - protein, 20 aa, Entamoeba dispar
QVCLKICKFIAQNDLMKNVD

SEQ ID NO: 2515902 - protein, 23 aa, Entamoeba dispar
QVFSSLFFLRYCFLPLVKYPSLL

SEQ ID NO: 2515903 - protein, 19 aa, Entamoeba dispar
QVGYRFGYVPIKYLEKVNL

SEQ ID NO: 2515904 - protein, 20 aa, Entamoeba dispar
QVHLKYPIKKCVLQAPVSDR

SEQ ID NO: 2515905 - protein, 18 aa, Entamoeba dispar
QVKKRLSEVMSRDIEQLR

SEQ ID NO: 2515906 - protein, 19 aa, Entamoeba dispar
QVLEHYSYIGSEPFQQLNK

SEQ ID NO: 2515907 - protein, 22 aa, Entamoeba dispar
QVNELGKWCFYGCMLLTSINIP

SEQ ID NO: 2515908 - protein, 26 aa, Entamoeba dispar
QVNKKCKRAICSLRYSQWYNEGSNKI

SEQ ID NO: 2515909 - protein, 23 aa, Entamoeba dispar
QVRLRIGNILIYRTILEDAAVQR

SEQ ID NO: 2515910 - protein, 23 aa, Entamoeba dispar
QVVKRPRASTVFTEQRVDKNLSK

SEQ ID NO: 2515911 - protein, 23 aa, Entamoeba dispar
QVYYKIRCSLTFLDNDEETHDEL

SEQ ID NO: 2515912 - protein, 21 aa, Entamoeba dispar
QWKSKMCNIIEMFSKKKLDYK

SEQ ID NO: 2515913 - protein, 22 aa, Entamoeba dispar
QYFDYFSVFILYKLVIKQLSLI

SEQ ID NO: 2515914 - protein, 18 aa, Entamoeba dispar
QYGLRFCGMRVFNKDINM

SEQ ID NO: 2515915 - protein, 23 aa, Entamoeba dispar
QYNCYGLYFAHCMALPQYKDVVC

SEQ ID NO: 2515916 - protein, 17 aa, Entamoeba dispar
QYPGYGINPEIQQYNQI

SEQ ID NO: 2515917 - protein, 19 aa, Entamoeba dispar
RAARCLGELVDLFESKIVQ

SEQ ID NO: 2515918 - protein, 23 aa, Entamoeba dispar
RAEFGDKCLLKFFKNEALRDMFL

SEQ ID NO: 2515919 - protein, 23 aa, Entamoeba dispar
RAESLRPVLGFDLLEYLSKLPIE

SEQ ID NO: 2515920 - protein, 21 aa, Entamoeba dispar
RAFCDGCLRVTKQIYSWLFNK

SEQ ID NO: 2515921 - protein, 21 aa, Entamoeba dispar
RAGIEFFNRFDVFNASYKIAG

SEQ ID NO: 2515922 - protein, 21 aa, Entamoeba dispar
RAIKESVCYVALDYEAEMKKK

SEQ ID NO: 2515923 - protein, 23 aa, Entamoeba dispar
RAIRFSGKMGFVLDEELEQEMKT

SEQ ID NO: 2515924 - protein, 23 aa, Entamoeba dispar
RAKGRFPVISWVGPMNQCLSRSA

SEQ ID NO: 2515925 - protein, 23 aa, Entamoeba dispar
RALAAKCVFRLLKVLDSGKMKEI

SEQ ID NO: 2515926 - protein, 18 aa, Entamoeba dispar
RATHIVCHNFGRTIKMLK

SEQ ID NO: 2515927 - protein, 18 aa, Entamoeba dispar
RATSIGIEICKYLNNSIK

SEQ ID NO: 2515928 - protein, 20 aa, Entamoeba dispar
RATTFQKRRHGLIKKAMELS

SEQ ID NO: 2515929 - protein, 17 aa, Entamoeba dispar
RAYNCIIKRGWERLEKS

SEQ ID NO: 2515930 - protein, 21 aa, Entamoeba dispar
RAYYPGARWGITRRLIASSLQ

SEQ ID NO: 2515931 - protein, 17 aa, Entamoeba dispar
RCCCSILANVGPYIINL

SEQ ID NO: 2515932 - protein, 21 aa, Entamoeba dispar
RCCKACVFNNFISGHDCKIAD

SEQ ID NO: 2515933 - protein, 20 aa, Entamoeba dispar
RCFKCGKPLDGKYLVVDDHN

SEQ ID NO: 2515934 - protein, 23 aa, Entamoeba dispar
RCHPLCSWVYMLLGHLINNYKDD

SEQ ID NO: 2515935 - protein, 17 aa, Entamoeba dispar
RCIKSVVDSANWKVNDI

SEQ ID NO: 2515936 - protein, 17 aa, Entamoeba dispar
RCIWCSLFVHNTCQPKL

SEQ ID NO: 2515937 - protein, 18 aa, Entamoeba dispar
RCKCFKSTQLVISEICTD

SEQ ID NO: 2515938 - protein, 20 aa, Entamoeba dispar
RCKCLYIPYVGNLVLEAVQL

SEQ ID NO: 2515939 - protein, 20 aa, Entamoeba dispar
RCLSFSYGIEEFWENYNRQD

SEQ ID NO: 2515940 - protein, 20 aa, Entamoeba dispar
RCMDCQAIGPVYVVTDFGTF

SEQ ID NO: 2515941 - protein, 19 aa, Entamoeba dispar
RCSEPLVIILVDHFVCIYQ

SEQ ID NO: 2515942 - protein, 17 aa, Entamoeba dispar
RCSNCFHSIEAHTLPVE

SEQ ID NO: 2515943 - protein, 17 aa, Entamoeba dispar
RDDLVVCWYSRITRSIG

SEQ ID NO: 2515944 - protein, 18 aa, Entamoeba dispar
RDEISVIFCSKIGDVGLD

SEQ ID NO: 2515945 - protein, 19 aa, Entamoeba dispar
RDGYKWFAIQKVINKKQTS

SEQ ID NO: 2515946 - protein, 20 aa, Entamoeba dispar
RDHYMCIICFKRMSRGYACC

SEQ ID NO: 2515947 - protein, 17 aa, Entamoeba dispar
RDIEEIDNILSLLRIEK

SEQ ID NO: 2515948 - protein, 20 aa, Entamoeba dispar
RDVLRTYALYNWRIGYGQGM

SEQ ID NO: 2515949 - protein, 20 aa, Entamoeba dispar
REAAFSFVIDCFFKYGEQEQ

SEQ ID NO: 2515950 - protein, 19 aa, Entamoeba dispar
REDLLSFSILYGLINRLVK

SEQ ID NO: 2515951 - protein, 19 aa, Entamoeba dispar
REEKILCKIFPLYFSYIQE

SEQ ID NO: 2515952 - protein, 18 aa, Entamoeba dispar
REEYVCALKVLAKLQIYK

SEQ ID NO: 2515953 - protein, 19 aa, Entamoeba dispar
REFILRKAINGERTAMFST

SEQ ID NO: 2515954 - protein, 19 aa, Entamoeba dispar
REFYPLPVIEEFDKQQKMT

SEQ ID NO: 2515955 - protein, 22 aa, Entamoeba dispar
REGWQKLCWYCMQLPEHYKTSQ

SEQ ID NO: 2515956 - protein, 23 aa, Entamoeba dispar
REHFRYIIKYIFSFISKDKQHEQ

SEQ ID NO: 2515957 - protein, 18 aa, Entamoeba dispar
REIDVMINFVDFIMTDAR

SEQ ID NO: 2515958 - protein, 20 aa, Entamoeba dispar
REIFKKLCFIVSQKKNGVGI

SEQ ID NO: 2515959 - protein, 20 aa, Entamoeba dispar
REIICKIILELIDVIVILHK

SEQ ID NO: 2515960 - protein, 21 aa, Entamoeba dispar
REIKMSPSLICINKNKEYLTP

SEQ ID NO: 2515961 - protein, 19 aa, Entamoeba dispar
RELKTIVGRMFILDEEWEY

SEQ ID NO: 2515962 - protein, 18 aa, Entamoeba dispar
RERYLIGIIKGIRKENKY

SEQ ID NO: 2515963 - protein, 18 aa, Entamoeba dispar
RESHKLYAIKIIKNSSVK

SEQ ID NO: 2515964 - protein, 17 aa, Entamoeba dispar
RETDRWYYGGGLYMGKK

SEQ ID NO: 2515965 - protein, 19 aa, Entamoeba dispar
REWCPLSKEIGYYCIDLIL

SEQ ID NO: 2515966 - protein, 23 aa, Entamoeba dispar
REYPEIKISYGLVKKVLEQQGLL

SEQ ID NO: 2515967 - protein, 18 aa, Entamoeba dispar
REYWRIVNNKVRIWDRSG

SEQ ID NO: 2515968 - protein, 20 aa, Entamoeba dispar
RFDMCLKVVFRLICVHVALC

SEQ ID NO: 2515969 - protein, 19 aa, Entamoeba dispar
RFDYQKEFIKWCLKVPGYY

SEQ ID NO: 2515970 - protein, 20 aa, Entamoeba dispar
RFFQEWYFDLLLSHTDKVLS

SEQ ID NO: 2515971 - protein, 19 aa, Entamoeba dispar
RFGQELSLFKNRKITLLTK

SEQ ID NO: 2515972 - protein, 24 aa, Entamoeba dispar
RFGRFCLWFSYVCDFLMIYENYIY

SEQ ID NO: 2515973 - protein, 20 aa, Entamoeba dispar
RFHLTEGFLFYPNSKYIPFT

SEQ ID NO: 2515974 - protein, 20 aa, Entamoeba dispar
RFKIKLCDFGSCKCLNQKES

SEQ ID NO: 2515975 - protein, 24 aa, Entamoeba dispar
RFLCHKSEILGVVLHKIFEFVNDP

SEQ ID NO: 2515976 - protein, 18 aa, Entamoeba dispar
RFNPKCIVCVGDPMQLDP

SEQ ID NO: 2515977 - protein, 22 aa, Entamoeba dispar
RFPPHFKCCIEDFELGKIDIEI

SEQ ID NO: 2515978 - protein, 20 aa, Entamoeba dispar
RFRMLKDIKQLPGLYVLMLL

SEQ ID NO: 2515979 - protein, 17 aa, Entamoeba dispar
RFSYIPIRRMKSCFDYL

SEQ ID NO: 2515980 - protein, 23 aa, Entamoeba dispar
RFVFTCFSAFWVLSDGIAYIHQG

SEQ ID NO: 2515981 - protein, 17 aa, Entamoeba dispar
RFWFEKFHWFLSSENFI

SEQ ID NO: 2515982 - protein, 20 aa, Entamoeba dispar
RFYEEWTHFKCQLEFWNKMP

SEQ ID NO: 2515983 - protein, 18 aa, Entamoeba dispar
RGCPFCYNYATVHHSEIF

SEQ ID NO: 2515984 - protein, 20 aa, Entamoeba dispar
RGEEFWVIFGQLLNYSDTLP

SEQ ID NO: 2515985 - protein, 21 aa, Entamoeba dispar
RGEWKVPLPIYRAIQYLLEGD

SEQ ID NO: 2515986 - protein, 19 aa, Entamoeba dispar
RGGKKCICVLCDDKYYVED

SEQ ID NO: 2515987 - protein, 18 aa, Entamoeba dispar
RGHFKPMMMKCSARMNYG

SEQ ID NO: 2515988 - protein, 18 aa, Entamoeba dispar
RGKMFEWVPNIAKEDVKQ

SEQ ID NO: 2515989 - protein, 17 aa, Entamoeba dispar
RGLFCYCPNVVAFPLAS

SEQ ID NO: 2515990 - protein, 17 aa, Entamoeba dispar
RGLILFNDCILLTKKEE

SEQ ID NO: 2515991 - protein, 21 aa, Entamoeba dispar
RGNGMVPLIRPSYINNPTQRQ

SEQ ID NO: 2515992 - protein, 18 aa, Entamoeba dispar
RGNIKLVILNSGICKIQR

SEQ ID NO: 2515993 - protein, 19 aa, Entamoeba dispar
RGQTAWAHRQMIIYNGEFI

SEQ ID NO: 2515994 - protein, 21 aa, Entamoeba dispar
RGQTAWARRDMIIFNGLFVLY

SEQ ID NO: 2515995 - protein, 20 aa, Entamoeba dispar
RGRFDGRRGLSRIGRRHMNH

SEQ ID NO: 2515996 - protein, 18 aa, Entamoeba dispar
RGRRSTLRRQAFGNFASA

SEQ ID NO: 2515997 - protein, 20 aa, Entamoeba dispar
RGRYSSVFKGVMTEGLYPCA

SEQ ID NO: 2515998 - protein, 20 aa, Entamoeba dispar
RGTYCFICGYNGYIYLFTLS

SEQ ID NO: 2515999 - protein, 17 aa, Entamoeba dispar
RGYKRVGIMVGGYKMYH

SEQ ID NO: 2516000 - protein, 19 aa, Entamoeba dispar
RGYLTRRVFGLKLMIKRKA

SEQ ID NO: 2516001 - protein, 18 aa, Entamoeba dispar
RHHCRACGRCICGECSKW

SEQ ID NO: 2516002 - protein, 22 aa, Entamoeba dispar
RHHCRRCGKVFCGSCCVDSVLM

SEQ ID NO: 2516003 - protein, 19 aa, Entamoeba dispar
RHTRACFIVDLYIGNKNQL

SEQ ID NO: 2516004 - protein, 17 aa, Entamoeba dispar
RIAEGSLHILTCLHQNM

SEQ ID NO: 2516005 - protein, 23 aa, Entamoeba dispar
RIDEWKLCLSFAEYLENQEDIGG

SEQ ID NO: 2516006 - protein, 20 aa, Entamoeba dispar
RIDFKCIVYGKGFHVGITCD

SEQ ID NO: 2516007 - protein, 17 aa, Entamoeba dispar
RIFKYVIWYTIDYSTYL

SEQ ID NO: 2516008 - protein, 24 aa, Entamoeba dispar
RIFNEYVQLCFVKGMSLLMKGYEE

SEQ ID NO: 2516009 - protein, 21 aa, Entamoeba dispar
RIFNIPFTWKEHDVLEYFKEF

SEQ ID NO: 2516010 - protein, 17 aa, Entamoeba dispar
RIFPAFVQYIISDTNLI

SEQ ID NO: 2516011 - protein, 19 aa, Entamoeba dispar
RIFPASFEFVCRTTKDNDF

SEQ ID NO: 2516012 - protein, 21 aa, Entamoeba dispar
RIFPWKKRSKLVFCVPGAFII

SEQ ID NO: 2516013 - protein, 23 aa, Entamoeba dispar
RIFSTLCSFKPYPIVTANNTIQF

SEQ ID NO: 2516014 - protein, 18 aa, Entamoeba dispar
RIGFLNSFFFTKLSKNWS

SEQ ID NO: 2516015 - protein, 19 aa, Entamoeba dispar
RIGILYGIFKEDRVQVEAI

SEQ ID NO: 2516016 - protein, 24 aa, Entamoeba dispar
RIGKAEILPGVLFIDEVHMLDLEC

SEQ ID NO: 2516017 - protein, 25 aa, Entamoeba dispar
RIIDFSKWIKCILKINNPLFDLKTE

SEQ ID NO: 2516018 - protein, 17 aa, Entamoeba dispar
RIIKLLIWYTVNYSTYL

SEQ ID NO: 2516019 - protein, 17 aa, Entamoeba dispar
RIIKWLNNIYVIEKNKE

SEQ ID NO: 2516020 - protein, 23 aa, Entamoeba dispar
RIIPELISGIFLYLNKPLLDTVI

SEQ ID NO: 2516021 - protein, 17 aa, Entamoeba dispar
RIIPFPSKIIVVGTKLD

SEQ ID NO: 2516022 - protein, 20 aa, Entamoeba dispar
RIKESGGMIFSGRVNGVIAI

SEQ ID NO: 2516023 - protein, 18 aa, Entamoeba dispar
RIKKIAIFICCDEYLFGV

SEQ ID NO: 2516024 - protein, 19 aa, Entamoeba dispar
RILNWLMAFFDAHITLLIT

SEQ ID NO: 2516025 - protein, 17 aa, Entamoeba dispar
RILTIRFLKNCIAVCDI

SEQ ID NO: 2516026 - protein, 17 aa, Entamoeba dispar
RILYWKRILGIEEISQE

SEQ ID NO: 2516027 - protein, 19 aa, Entamoeba dispar
RINFSGVFPCLGDNLELVN

SEQ ID NO: 2516028 - protein, 21 aa, Entamoeba dispar
RIPRYRLLLKELMKTVPQQHN

SEQ ID NO: 2516029 - protein, 19 aa, Entamoeba dispar
RIPRYRLLLQELLKTLPPQ

SEQ ID NO: 2516030 - protein, 20 aa, Entamoeba dispar
RIRHTFKILTGILMSEAGDQ

SEQ ID NO: 2516031 - protein, 19 aa, Entamoeba dispar
RISRRAELTLSGFDEKCNG

SEQ ID NO: 2516032 - protein, 23 aa, Entamoeba dispar
RIVMQYKKIHIMGSYANIKIARD

SEQ ID NO: 2516033 - protein, 18 aa, Entamoeba dispar
RIVVFSLWMKDMISLQEI

SEQ ID NO: 2516034 - protein, 24 aa, Entamoeba dispar
RKAALDCWDVIAIIVREYAMTLDN

SEQ ID NO: 2516035 - protein, 24 aa, Entamoeba dispar
RKAFYDFLKRILVWNPHHRLRPIQ

SEQ ID NO: 2516036 - protein, 20 aa, Entamoeba dispar
RKATKCCFCQNDLVIGYNDG

SEQ ID NO: 2516037 - protein, 20 aa, Entamoeba dispar
RKATVGLGFVDRSNAFDFSA

SEQ ID NO: 2516038 - protein, 19 aa, Entamoeba dispar
RKCYYGVIFVLKYMMILDL

SEQ ID NO: 2516039 - protein, 21 aa, Entamoeba dispar
RKDHRGLCVMTGYTIGDGMRL

SEQ ID NO: 2516040 - protein, 20 aa, Entamoeba dispar
RKFLCCGPLFIVEKVTEIPQ

SEQ ID NO: 2516041 - protein, 24 aa, Entamoeba dispar
RKGYKSGGVQLVLLIGGTSKIPKI

SEQ ID NO: 2516042 - protein, 29 aa, Entamoeba dispar
RKHHCRKCGLCICSNCSKQTIIINGKKER

SEQ ID NO: 2516043 - protein, 19 aa, Entamoeba dispar
RKHVRRIAAMPSLPLTDIQ

SEQ ID NO: 2516044 - protein, 20 aa, Entamoeba dispar
RKIGKFFCCHGGISPEINKI

SEQ ID NO: 2516045 - protein, 17 aa, Entamoeba dispar
RKIIKRMRVNSSVVRNT

SEQ ID NO: 2516046 - protein, 22 aa, Entamoeba dispar
RKITISLVESWNGVMKGYIEQT

SEQ ID NO: 2516047 - protein, 18 aa, Entamoeba dispar
RKKKVIKKSVNFEDSDEE

SEQ ID NO: 2516048 - protein, 19 aa, Entamoeba dispar
RKKLTLIILYRGVVVTDIP

SEQ ID NO: 2516049 - protein, 23 aa, Entamoeba dispar
RKKRIAIGIAKVMMKWCDRRIKL

SEQ ID NO: 2516050 - protein, 19 aa, Entamoeba dispar
RKLLFNYVALGVKLMNASN

SEQ ID NO: 2516051 - protein, 17 aa, Entamoeba dispar
RKLLPRLSKKVDIKSYE

SEQ ID NO: 2516052 - protein, 17 aa, Entamoeba dispar
RKMFIKHLWEVFTTSLF

SEQ ID NO: 2516053 - protein, 19 aa, Entamoeba dispar
RKPISWLVGRKVKRGTDWK

SEQ ID NO: 2516054 - protein, 19 aa, Entamoeba dispar
RKPNCSKQLLTRIESKYFD

SEQ ID NO: 2516055 - protein, 20 aa, Entamoeba dispar
RKPYSVILFDEIEKAHPQVF

SEQ ID NO: 2516056 - protein, 24 aa, Entamoeba dispar
RKSRLTRLLICWIKIFKEIIPNVY

SEQ ID NO: 2516057 - protein, 18 aa, Entamoeba dispar
RKYNELYLTVFKKMLFEL

SEQ ID NO: 2516058 - protein, 22 aa, Entamoeba dispar
RKYPKKYLPVIAKLCDNLNTLD

SEQ ID NO: 2516059 - protein, 18 aa, Entamoeba dispar
RLAIYDGEFQHINNLKLE

SEQ ID NO: 2516060 - protein, 24 aa, Entamoeba dispar
RLCALGFGRSQCLQAYIACDKNEQ

SEQ ID NO: 2516061 - protein, 19 aa, Entamoeba dispar
RLEDCLACSGCITSAETVL

SEQ ID NO: 2516062 - protein, 18 aa, Entamoeba dispar
RLFFKSTIIYVGENDMSV

SEQ ID NO: 2516063 - protein, 20 aa, Entamoeba dispar
RLGEFPLHWDRFNKKDVEII

SEQ ID NO: 2516064 - protein, 17 aa, Entamoeba dispar
RLIPRIIPIITKFQSLQ

SEQ ID NO: 2516065 - protein, 19 aa, Entamoeba dispar
RLKCFSDKEIMLFSRIKDI

SEQ ID NO: 2516066 - protein, 20 aa, Entamoeba dispar
RLKEAVLFAYRFPQKAEDVR

SEQ ID NO: 2516067 - protein, 19 aa, Entamoeba dispar
RLKGLMLLFMSIGGVIEVK

SEQ ID NO: 2516068 - protein, 21 aa, Entamoeba dispar
RLKHPFIVHLEWDFETPFYYI

SEQ ID NO: 2516069 - protein, 18 aa, Entamoeba dispar
RLKIEKYPALKVWIQQLC

SEQ ID NO: 2516070 - protein, 21 aa, Entamoeba dispar
RLKRLRPLLEISVKKVDSNIC

SEQ ID NO: 2516071 - protein, 21 aa, Entamoeba dispar
RLLSQFKRSLCSSKYSYSTLL

SEQ ID NO: 2516072 - protein, 18 aa, Entamoeba dispar
RLMKKNCQFSYSMLLMKL

SEQ ID NO: 2516073 - protein, 21 aa, Entamoeba dispar
RLMLRRLVDVIIRLHKKRSLL

SEQ ID NO: 2516074 - protein, 19 aa, Entamoeba dispar
RLNKIIGCGGGERLVSASD

SEQ ID NO: 2516075 - protein, 18 aa, Entamoeba dispar
RLNLPILDVFWLSQYPAV

SEQ ID NO: 2516076 - protein, 17 aa, Entamoeba dispar
RLPALSCEGFVMDDSQH

SEQ ID NO: 2516077 - protein, 18 aa, Entamoeba dispar
RLPKEILNELKLTEETTL

SEQ ID NO: 2516078 - protein, 17 aa, Entamoeba dispar
RLRDMLMALNISPLLVP

SEQ ID NO: 2516079 - protein, 17 aa, Entamoeba dispar
RLREMKANFKAEKEVRL

SEQ ID NO: 2516080 - protein, 20 aa, Entamoeba dispar
RLSPCLCQFALCVPNQVCWK

SEQ ID NO: 2516081 - protein, 20 aa, Entamoeba dispar
RLSYNSDLLWAINTVEKQLI

SEQ ID NO: 2516082 - protein, 18 aa, Entamoeba dispar
RLTGSFVELSLHMYGCRV

SEQ ID NO: 2516083 - protein, 21 aa, Entamoeba dispar
RLTLHMYGCRVVQKAVEYASV

SEQ ID NO: 2516084 - protein, 21 aa, Entamoeba dispar
RLTLHMYGCRVVQKAVEYVSM

SEQ ID NO: 2516085 - protein, 17 aa, Entamoeba dispar
RLVPLFQMIGCSVCSLY

SEQ ID NO: 2516086 - protein, 25 aa, Entamoeba dispar
RLYGEYCHLCLLPYLRAVTKEVIQL

SEQ ID NO: 2516087 - protein, 19 aa, Entamoeba dispar
RMEASILLDEFNKFNENEH

SEQ ID NO: 2516088 - protein, 17 aa, Entamoeba dispar
RMLKEKFCYVGYDLAVE

SEQ ID NO: 2516089 - protein, 18 aa, Entamoeba dispar
RMLLETFRIIKLIKENDL

SEQ ID NO: 2516090 - protein, 23 aa, Entamoeba dispar
RMPSLPFDFHFEFGRSLTNKVGI

SEQ ID NO: 2516091 - protein, 18 aa, Entamoeba dispar
RMRARGVFLPNVKWNEDD

SEQ ID NO: 2516092 - protein, 18 aa, Entamoeba dispar
RMRFEVLKYINSVTSLKE

SEQ ID NO: 2516093 - protein, 20 aa, Entamoeba dispar
RMRVDWFFKECIFKRVNISG

SEQ ID NO: 2516094 - protein, 18 aa, Entamoeba dispar
RMVYKLGYVERIMEILKR

SEQ ID NO: 2516095 - protein, 19 aa, Entamoeba dispar
RNAKMVFSSDVLKQKLGER

SEQ ID NO: 2516096 - protein, 17 aa, Entamoeba dispar
RNGEGWIHINGKTYSPT

SEQ ID NO: 2516097 - protein, 18 aa, Entamoeba dispar
RNGWDKIIEEWRSFDEEN

SEQ ID NO: 2516098 - protein, 19 aa, Entamoeba dispar
RNIEVPKYIPLPVANEEYD

SEQ ID NO: 2516099 - protein, 18 aa, Entamoeba dispar
RNIPREFYDSVSYEEYVH

SEQ ID NO: 2516100 - protein, 17 aa, Entamoeba dispar
RNLSVFLFPCFAINNKI

SEQ ID NO: 2516101 - protein, 18 aa, Entamoeba dispar
RNNWWWNLVQSISVTQFN

SEQ ID NO: 2516102 - protein, 18 aa, Entamoeba dispar
RNPPCLVELSLFLYQCDQ

SEQ ID NO: 2516103 - protein, 17 aa, Entamoeba dispar
RNTHLLERIYIYLESHP

SEQ ID NO: 2516104 - protein, 24 aa, Entamoeba dispar
RNTLKCPACLGVTGGLFSRFKRGE

SEQ ID NO: 2516105 - protein, 18 aa, Entamoeba dispar
RNVFPCYSISQNSFIQPP

SEQ ID NO: 2516106 - protein, 18 aa, Entamoeba dispar
RNVIWMICEYCNHYDEVI

SEQ ID NO: 2516107 - protein, 23 aa, Entamoeba dispar
RNVPIRLCFDLKKIQSIDISCNN

SEQ ID NO: 2516108 - protein, 19 aa, Entamoeba dispar
RNVSLPSLFVFSMKDQYIP

SEQ ID NO: 2516109 - protein, 18 aa, Entamoeba dispar
RNYYIPCWIKIRYYQSFT

SEQ ID NO: 2516110 - protein, 19 aa, Entamoeba dispar
RPALFEGWGKKQGGSVKTW

SEQ ID NO: 2516111 - protein, 20 aa, Entamoeba dispar
RPEMFWKMCSELRKYTEGKK

SEQ ID NO: 2516112 - protein, 19 aa, Entamoeba dispar
RPGQCYRLYTEKGFNESLP

SEQ ID NO: 2516113 - protein, 18 aa, Entamoeba dispar
RPLIIPLLKLRPYELLQH

SEQ ID NO: 2516114 - protein, 19 aa, Entamoeba dispar
RPLLDFTPRNTLSHSIKNS

SEQ ID NO: 2516115 - protein, 18 aa, Entamoeba dispar
RPPEIWFGAIIYGPAVDV

SEQ ID NO: 2516116 - protein, 18 aa, Entamoeba dispar
RPRHGYKYGYGEESHQWK

SEQ ID NO: 2516117 - protein, 19 aa, Entamoeba dispar
RPTGSFMFLGPSGVGKTEL

SEQ ID NO: 2516118 - protein, 24 aa, Entamoeba dispar
RPVGCMRCALHVLGMFDGGNNIWL

SEQ ID NO: 2516119 - protein, 22 aa, Entamoeba dispar
RQDICYACLPLEFLKKEEYLTL

SEQ ID NO: 2516120 - protein, 17 aa, Entamoeba dispar
RQFCSLFDSLPLVCIVH

SEQ ID NO: 2516121 - protein, 17 aa, Entamoeba dispar
RQKCLTFGDVVGVSLKD

SEQ ID NO: 2516122 - protein, 17 aa, Entamoeba dispar
RQNAPCVIFFDEIDGML

SEQ ID NO: 2516123 - protein, 18 aa, Entamoeba dispar
RQNKAWKRLVTKATFVGE

SEQ ID NO: 2516124 - protein, 19 aa, Entamoeba dispar
RQTRCAACGQEFKDTEADY

SEQ ID NO: 2516125 - protein, 22 aa, Entamoeba dispar
RQYELFPHFGLILIHGGSGVGK

SEQ ID NO: 2516126 - protein, 19 aa, Entamoeba dispar
RQYQKICIRDCVYIPEKKY

SEQ ID NO: 2516127 - protein, 17 aa, Entamoeba dispar
RRDSCGVVRGMMSSVMN

SEQ ID NO: 2516128 - protein, 18 aa, Entamoeba dispar
RREVLKKRMELFAPKTRA

SEQ ID NO: 2516129 - protein, 17 aa, Entamoeba dispar
RRFASIFVIVGFDDEEN

SEQ ID NO: 2516130 - protein, 17 aa, Entamoeba dispar
RRFSFHSFFIIGMTKNQ

SEQ ID NO: 2516131 - protein, 19 aa, Entamoeba dispar
RRGRRGTLRRQAFGNFASA

SEQ ID NO: 2516132 - protein, 19 aa, Entamoeba dispar
RRIDFFSRPPICFKGTSST

SEQ ID NO: 2516133 - protein, 30 aa, Entamoeba dispar
RRIWPGLIDVALRYLLLFAGYSNENSKKIP

SEQ ID NO: 2516134 - protein, 19 aa, Entamoeba dispar
RRLLRLAEYLKQFDFTPQE

SEQ ID NO: 2516135 - protein, 18 aa, Entamoeba dispar
RRLMKFPPVFALRPLIDM

SEQ ID NO: 2516136 - protein, 18 aa, Entamoeba dispar
RRMFSILARNGWWEKLGG

SEQ ID NO: 2516137 - protein, 17 aa, Entamoeba dispar
RRNCPVIAYTYNEPTVF

SEQ ID NO: 2516138 - protein, 18 aa, Entamoeba dispar
RRRFEKRIYIGLPDASAR

SEQ ID NO: 2516139 - protein, 20 aa, Entamoeba dispar
RRRGRRGTLRRQAFGNFASA

SEQ ID NO: 2516140 - protein, 18 aa, Entamoeba dispar
RRRLEWHYLFIACSYIGA

SEQ ID NO: 2516141 - protein, 24 aa, Entamoeba dispar
RRTCFKYFFQLCFEDYIQVVNSTG

SEQ ID NO: 2516142 - protein, 18 aa, Entamoeba dispar
RRVSICVAPKFSIPSRAS

SEQ ID NO: 2516143 - protein, 19 aa, Entamoeba dispar
RRVVIALKYFCSDALDECN

SEQ ID NO: 2516144 - protein, 17 aa, Entamoeba dispar
RRYIICGPRIKRREFVN

SEQ ID NO: 2516145 - protein, 20 aa, Entamoeba dispar
RSAIEYKTKILFVFETKSGV

SEQ ID NO: 2516146 - protein, 20 aa, Entamoeba dispar
RSEGYYAFCILLKGIDLNLF

SEQ ID NO: 2516147 - protein, 20 aa, Entamoeba dispar
RSEYKIILIKAIVRTAIDYG

SEQ ID NO: 2516148 - protein, 17 aa, Entamoeba dispar
RSFIIVGIILKLDKELK

SEQ ID NO: 2516149 - protein, 17 aa, Entamoeba dispar
RSHCIFTVFISKLENGI

SEQ ID NO: 2516150 - protein, 19 aa, Entamoeba dispar
RSKEWKKTQKLLGRTNQLI

SEQ ID NO: 2516151 - protein, 18 aa, Entamoeba dispar
RSKGRFPVLTWYNKKNGT

SEQ ID NO: 2516152 - protein, 22 aa, Entamoeba dispar
RSKKSVTISICFNTIATVGLTG

SEQ ID NO: 2516153 - protein, 17 aa, Entamoeba dispar
RSKKTECPFRINLNYRA

SEQ ID NO: 2516154 - protein, 23 aa, Entamoeba dispar
RSKKTECPFRINLNYRTKTKTWN

SEQ ID NO: 2516155 - protein, 20 aa, Entamoeba dispar
RSKSILKHWFMNHLQYPYPS

SEQ ID NO: 2516156 - protein, 17 aa, Entamoeba dispar
RSLPRPHLELMKEMNKN

SEQ ID NO: 2516157 - protein, 17 aa, Entamoeba dispar
RSLQHFGRTLGLTPSQS

SEQ ID NO: 2516158 - protein, 17 aa, Entamoeba dispar
RSMLNHRIDLWKQEANK

SEQ ID NO: 2516159 - protein, 23 aa, Entamoeba dispar
RSMYCMYHYYAGMTMLIKNKPSD

SEQ ID NO: 2516160 - protein, 18 aa, Entamoeba dispar
RSNCPCHVPSNFCDNYNE

SEQ ID NO: 2516161 - protein, 18 aa, Entamoeba dispar
RSNIKLAKLLSSKLGFPH

SEQ ID NO: 2516162 - protein, 17 aa, Entamoeba dispar
RSPYIIRYYTSVLRQEE

SEQ ID NO: 2516163 - protein, 18 aa, Entamoeba dispar
RSSPMLMQFTPRFTSGPS

SEQ ID NO: 2516164 - protein, 17 aa, Entamoeba dispar
RSWACYMGEKFSKQTSN

SEQ ID NO: 2516165 - protein, 21 aa, Entamoeba dispar
RTAGNFVDLTWVFEMLKSQHF

SEQ ID NO: 2516166 - protein, 20 aa, Entamoeba dispar
RTAKKLDHFFPIQKIWNQNG

SEQ ID NO: 2516167 - protein, 18 aa, Entamoeba dispar
RTCHYPCWIEGDVKDGCA

SEQ ID NO: 2516168 - protein, 17 aa, Entamoeba dispar
RTCHYPCYIKGDMKKNC

SEQ ID NO: 2516169 - protein, 22 aa, Entamoeba dispar
RTEIPILPLFFLQYCAIEELQF

SEQ ID NO: 2516170 - protein, 17 aa, Entamoeba dispar
RTGLKFFNDHCEDLGYL

SEQ ID NO: 2516171 - protein, 22 aa, Entamoeba dispar
RTKPRLRGIYNFVKFLEQADNV

SEQ ID NO: 2516172 - protein, 19 aa, Entamoeba dispar
RTLLCKGNLLILFEGNEGN

SEQ ID NO: 2516173 - protein, 18 aa, Entamoeba dispar
RTQVCAFSGFKIPVAKGR

SEQ ID NO: 2516174 - protein, 18 aa, Entamoeba dispar
RTRIEGLYATFIRMCNTI

SEQ ID NO: 2516175 - protein, 27 aa, Entamoeba dispar
RTTKNEIVESFSFLHWYISDGSSVLNE

SEQ ID NO: 2516176 - protein, 19 aa, Entamoeba dispar
RTVCFEWLDHFYEVLSNNA

SEQ ID NO: 2516177 - protein, 19 aa, Entamoeba dispar
RVEGFFGYLKKIINHSNLH

SEQ ID NO: 2516178 - protein, 19 aa, Entamoeba dispar
RVFCFYFEFLMNAFKNKSS

SEQ ID NO: 2516179 - protein, 19 aa, Entamoeba dispar
RVGGKICCFCPCIEQIQKS

SEQ ID NO: 2516180 - protein, 17 aa, Entamoeba dispar
RVHVKLLLGDSVIGSIY

SEQ ID NO: 2516181 - protein, 20 aa, Entamoeba dispar
RVIQIPQFRSGRMNEQLALG

SEQ ID NO: 2516182 - protein, 17 aa, Entamoeba dispar
RVLKMVLVWCKKCDSLW

SEQ ID NO: 2516183 - protein, 19 aa, Entamoeba dispar
RVLRPGGVFFFRDYGEGDM

SEQ ID NO: 2516184 - protein, 17 aa, Entamoeba dispar
RVLSSTVKPHFDFKYTT

SEQ ID NO: 2516185 - protein, 19 aa, Entamoeba dispar
RVMKIRLSPYIVITSTVKE

SEQ ID NO: 2516186 - protein, 19 aa, Entamoeba dispar
RVNEVIEDFPLLRDEYNKI

SEQ ID NO: 2516187 - protein, 17 aa, Entamoeba dispar
RVPAFSVTLSFLTSLPK

SEQ ID NO: 2516188 - protein, 20 aa, Entamoeba dispar
RVPFELYTKFYLENKPNKPA

SEQ ID NO: 2516189 - protein, 17 aa, Entamoeba dispar
RVPYWKLVYSLADKLRF

SEQ ID NO: 2516190 - protein, 21 aa, Entamoeba dispar
RVVCFPGKFFKFYLLSCPCLF

SEQ ID NO: 2516191 - protein, 17 aa, Entamoeba dispar
RVWKELVFKPNIFEIIN

SEQ ID NO: 2516192 - protein, 17 aa, Entamoeba dispar
RVYDLRKGLIISDDIKK

SEQ ID NO: 2516193 - protein, 19 aa, Entamoeba dispar
RVYPLKLGYIGVVNRSQQD

SEQ ID NO: 2516194 - protein, 24 aa, Entamoeba dispar
RVYVLREFRCCFILYYGDTTIISK

SEQ ID NO: 2516195 - protein, 18 aa, Entamoeba dispar
RWEVFGILACSFFNVQWE

SEQ ID NO: 2516196 - protein, 18 aa, Entamoeba dispar
RWKCFVCSCCEPTAMNRN

SEQ ID NO: 2516197 - protein, 24 aa, Entamoeba dispar
RWRVPNIIYRCIEFLKNHDAINVE

SEQ ID NO: 2516198 - protein, 17 aa, Entamoeba dispar
RYFCFIGNYELPNWTNE

SEQ ID NO: 2516199 - protein, 20 aa, Entamoeba dispar
RYICPAIIRPLEWGLVYDIP

SEQ ID NO: 2516200 - protein, 26 aa, Entamoeba dispar
RYIELRTESIWKFLIPFISRILDCLE

SEQ ID NO: 2516201 - protein, 18 aa, Entamoeba dispar
RYLRPGEYIQMSGRAGRR

SEQ ID NO: 2516202 - protein, 19 aa, Entamoeba dispar
RYMKEYKDQLVIVQWIARD

SEQ ID NO: 2516203 - protein, 18 aa, Entamoeba dispar
RYMVRSCGSEEAYSTYCD

SEQ ID NO: 2516204 - protein, 18 aa, Entamoeba dispar
RYSYLSIIIPEFKTISEM

SEQ ID NO: 2516205 - protein, 19 aa, Entamoeba dispar
RYVISIKEFARFVVGKSNR

SEQ ID NO: 2516206 - protein, 17 aa, Entamoeba dispar
SACAICDGAVPIFRNKV

SEQ ID NO: 2516207 - protein, 20 aa, Entamoeba dispar
SADQLECAQVLFDHVRMSYN

SEQ ID NO: 2516208 - protein, 24 aa, Entamoeba dispar
SAEELWNYVELFGSLELENGKEGN

SEQ ID NO: 2516209 - protein, 23 aa, Entamoeba dispar
SAFVPFCFELKLVIIQQLICCNN

SEQ ID NO: 2516210 - protein, 17 aa, Entamoeba dispar
SAKLCKRYMKYLMKKYL

SEQ ID NO: 2516211 - protein, 19 aa, Entamoeba dispar
SALCLLFVKGEFNIEYNPT

SEQ ID NO: 2516212 - protein, 17 aa, Entamoeba dispar
SALPVLCMNQLVNGGLI

SEQ ID NO: 2516213 - protein, 21 aa, Entamoeba dispar
SALRGLFFIRLLGNYFVTNLE

SEQ ID NO: 2516214 - protein, 18 aa, Entamoeba dispar
SAMKEWYDGGAVQMSPMK

SEQ ID NO: 2516215 - protein, 22 aa, Entamoeba dispar
SAPKRLTRKRCNSASKIDRHLN

SEQ ID NO: 2516216 - protein, 23 aa, Entamoeba dispar
SAPPRLRSIPDLGFIDSEIPSPK

SEQ ID NO: 2516217 - protein, 18 aa, Entamoeba dispar
SATLSFEELISWITPLQH

SEQ ID NO: 2516218 - protein, 23 aa, Entamoeba dispar
SAYKEFVEGLGWTIDMETHSGFV

SEQ ID NO: 2516219 - protein, 20 aa, Entamoeba dispar
SCCWGWRRGFNMTFREKNEF

SEQ ID NO: 2516220 - protein, 19 aa, Entamoeba dispar
SCFALGCLHFNKGLEFNHI

SEQ ID NO: 2516221 - protein, 17 aa, Entamoeba dispar
SCFRGCGCEEVLRQNER

SEQ ID NO: 2516222 - protein, 18 aa, Entamoeba dispar
SCFYGCGCIEKLKQNKTI

SEQ ID NO: 2516223 - protein, 18 aa, Entamoeba dispar
SCFYRVIKNTVIQGGDIV

SEQ ID NO: 2516224 - protein, 17 aa, Entamoeba dispar
SCGCVLAEMIIRNYPLF

SEQ ID NO: 2516225 - protein, 18 aa, Entamoeba dispar
SCGLLKMKLKKRDVMERT

SEQ ID NO: 2516226 - protein, 26 aa, Entamoeba dispar
SCHCVECLYWLAPEVIETSTFELESD

SEQ ID NO: 2516227 - protein, 17 aa, Entamoeba dispar
SCINLYFDEIFFKANKE

SEQ ID NO: 2516228 - protein, 22 aa, Entamoeba dispar
SCITKSVLVTGRIPCCKTTHTM

SEQ ID NO: 2516229 - protein, 20 aa, Entamoeba dispar
SCLELAWSQIQTFLIKVLNN

SEQ ID NO: 2516230 - protein, 17 aa, Entamoeba dispar
SCLQQGFGYEVFDEGLG

SEQ ID NO: 2516231 - protein, 18 aa, Entamoeba dispar
SCTLMICLDSFIVKKGNE

SEQ ID NO: 2516232 - protein, 21 aa, Entamoeba dispar
SCVLAGCDYCKNISKVGIKKA

SEQ ID NO: 2516233 - protein, 17 aa, Entamoeba dispar
SCVMIAFGTAMTMGNGV

SEQ ID NO: 2516234 - protein, 20 aa, Entamoeba dispar
SCYFCNFVAAVSFITQMNEN

SEQ ID NO: 2516235 - protein, 19 aa, Entamoeba dispar
SDCIERLRLERAIHTQFKL

SEQ ID NO: 2516236 - protein, 20 aa, Entamoeba dispar
SDCVYPVFKQMGLLDSLQTG

SEQ ID NO: 2516237 - protein, 22 aa, Entamoeba dispar
SDEFKGKCVLAINSKDKKGDRR

SEQ ID NO: 2516238 - protein, 24 aa, Entamoeba dispar
SDESYRFYQLLLFNFSQFIADEDF

SEQ ID NO: 2516239 - protein, 17 aa, Entamoeba dispar
SDFEFKKEIGWLVTNCI

SEQ ID NO: 2516240 - protein, 17 aa, Entamoeba dispar
SDGLALFISTILYLQSL

SEQ ID NO: 2516241 - protein, 23 aa, Entamoeba dispar
SDINWTNRWGRFIGYSDTASITL

SEQ ID NO: 2516242 - protein, 17 aa, Entamoeba dispar
SDKQLHCVFIFNKKNGK

SEQ ID NO: 2516243 - protein, 19 aa, Entamoeba dispar
SDLNLDWLTERIILSYLEY

SEQ ID NO: 2516244 - protein, 20 aa, Entamoeba dispar
SDRIGCSVSFSFRDQTKIAI

SEQ ID NO: 2516245 - protein, 24 aa, Entamoeba dispar
SDVIKMTICGGSYPPDIEKVKSIS

SEQ ID NO: 2516246 - protein, 24 aa, Entamoeba dispar
SEADISICDKIMCRIGAGDNIVEG

SEQ ID NO: 2516247 - protein, 20 aa, Entamoeba dispar
SEATFTWVLPRILDKTQFTF

SEQ ID NO: 2516248 - protein, 19 aa, Entamoeba dispar
SECKVSICYYQLLKQLVYS

SEQ ID NO: 2516249 - protein, 18 aa, Entamoeba dispar
SECLWKYNRNVYMEFINL

SEQ ID NO: 2516250 - protein, 25 aa, Entamoeba dispar
SECRAFYWDDMRLRKPNTMVVPMEK

SEQ ID NO: 2516251 - protein, 21 aa, Entamoeba dispar
SEDFIDLLLEKKVEAKEKKPT

SEQ ID NO: 2516252 - protein, 22 aa, Entamoeba dispar
SEDIPIGWGLKENVYKEIMDKD

SEQ ID NO: 2516253 - protein, 21 aa, Entamoeba dispar
SEDKWKWLTVFRDAFYHSAKD

SEQ ID NO: 2516254 - protein, 19 aa, Entamoeba dispar
SEEIKRFLFKIGLIVTDGY

SEQ ID NO: 2516255 - protein, 24 aa, Entamoeba dispar
SEEIMNFVALCLIKNSRQRATINQ

SEQ ID NO: 2516256 - protein, 18 aa, Entamoeba dispar
SEFEYCVVLPFKMIKDEQ

SEQ ID NO: 2516257 - protein, 17 aa, Entamoeba dispar
SEFILGIELIKKRQINE

SEQ ID NO: 2516258 - protein, 22 aa, Entamoeba dispar
SEGECFIHSFALQQEDLDEKEE

SEQ ID NO: 2516259 - protein, 24 aa, Entamoeba dispar
SEGEMYNVLVLTDFVAQKSPQFRT

SEQ ID NO: 2516260 - protein, 17 aa, Entamoeba dispar
SEIALPFGEIMQMEKVK

SEQ ID NO: 2516261 - protein, 22 aa, Entamoeba dispar
SEICSGLWYLHFNKHLLHRDLK

SEQ ID NO: 2516262 - protein, 24 aa, Entamoeba dispar
SEIIKSRLTGLGFIGATQCTVDIL

SEQ ID NO: 2516263 - protein, 18 aa, Entamoeba dispar
SEILIARYALHKLYPDVE

SEQ ID NO: 2516264 - protein, 25 aa, Entamoeba dispar
SEIRSSIEFLELLFVDLLFGDKEIP

SEQ ID NO: 2516265 - protein, 23 aa, Entamoeba dispar
SEKIFKKRIEQMWGSIQTTTITL

SEQ ID NO: 2516266 - protein, 19 aa, Entamoeba dispar
SEKSWKLVWVVIKYTFIFV

SEQ ID NO: 2516267 - protein, 23 aa, Entamoeba dispar
SELFPERWFDLIVVLRTDNTVLY

SEQ ID NO: 2516268 - protein, 22 aa, Entamoeba dispar
SELFYHFRISEIIDIWSEIIVS

SEQ ID NO: 2516269 - protein, 17 aa, Entamoeba dispar
SELRTAAFYVYSTIYQN

SEQ ID NO: 2516270 - protein, 24 aa, Entamoeba dispar
SENILCFAGAFLISGNCGENEESR

SEQ ID NO: 2516271 - protein, 22 aa, Entamoeba dispar
SEPTDVVYICFDNGQSAHQFIQ

SEQ ID NO: 2516272 - protein, 23 aa, Entamoeba dispar
SERLFKWFIKRNEIIKKQNKKGG

SEQ ID NO: 2516273 - protein, 21 aa, Entamoeba dispar
SERLFVGSCCDLLRKDLTKRY

SEQ ID NO: 2516274 - protein, 18 aa, Entamoeba dispar
SEVKSIVFFCFSNCGELE

SEQ ID NO: 2516275 - protein, 22 aa, Entamoeba dispar
SEVKSLGAWCFNRCKSLTTINI

SEQ ID NO: 2516276 - protein, 20 aa, Entamoeba dispar
SEVKSLGAWCFSKCSSLTSI

SEQ ID NO: 2516277 - protein, 17 aa, Entamoeba dispar
SEWYVELFVDYVRNGKM

SEQ ID NO: 2516278 - protein, 22 aa, Entamoeba dispar
SEYKEKCVFMIKYSLELRQWKE

SEQ ID NO: 2516279 - protein, 17 aa, Entamoeba dispar
SEYLRPYMHGYFMHIKL

SEQ ID NO: 2516280 - protein, 19 aa, Entamoeba dispar
SFEELISWITPLQHQFFEV

SEQ ID NO: 2516281 - protein, 23 aa, Entamoeba dispar
SFERINGLILIRFIEEISHSKCN

SEQ ID NO: 2516282 - protein, 18 aa, Entamoeba dispar
SFFSDVDCAIFVTSLAEY

SEQ ID NO: 2516283 - protein, 23 aa, Entamoeba dispar
SFFSWNAWNGWIPHWCVNKATKT

SEQ ID NO: 2516284 - protein, 21 aa, Entamoeba dispar
SFGNIDFGKGLNFGTSSNVEK

SEQ ID NO: 2516285 - protein, 22 aa, Entamoeba dispar
SFGRSCFYGCGCVEELTQNKRI

SEQ ID NO: 2516286 - protein, 19 aa, Entamoeba dispar
SFGSLSLKGIESLFTNKIL

SEQ ID NO: 2516287 - protein, 20 aa, Entamoeba dispar
SFIMGYSFRSSFTSGNNHSM

SEQ ID NO: 2516288 - protein, 26 aa, Entamoeba dispar
SFKGKIPQLLSWRLNGELSLWNLGQK

SEQ ID NO: 2516289 - protein, 23 aa, Entamoeba dispar
SFKGKRIGGKIGIESNWNCNIKK

SEQ ID NO: 2516290 - protein, 18 aa, Entamoeba dispar
SFLLFFRITKVIQRLIDS

SEQ ID NO: 2516291 - protein, 25 aa, Entamoeba dispar
SFLLKLFDGQTWKSLFSNLFNFLYS

SEQ ID NO: 2516292 - protein, 23 aa, Entamoeba dispar
SFRTPCLFCKEFLDIDFLLKHMN

SEQ ID NO: 2516293 - protein, 25 aa, Entamoeba dispar
SFSSFAIGMKVMFPKTLGKISKRGG

SEQ ID NO: 2516294 - protein, 19 aa, Entamoeba dispar
SFVCICCNTLFFAEKNVLR

SEQ ID NO: 2516295 - protein, 19 aa, Entamoeba dispar
SFYGVSAWAYLNGVQKIKL

SEQ ID NO: 2516296 - protein, 18 aa, Entamoeba dispar
SGARYGAPVVREQPPPQL

SEQ ID NO: 2516297 - protein, 17 aa, Entamoeba dispar
SGEGCLFVFSKTQTNYF

SEQ ID NO: 2516298 - protein, 22 aa, Entamoeba dispar
SGELKLIIEYGYLFPNIELIHI

SEQ ID NO: 2516299 - protein, 17 aa, Entamoeba dispar
SGFISHLLCCPRLDDWT

SEQ ID NO: 2516300 - protein, 18 aa, Entamoeba dispar
SGGFFSSFGSFLAGAVNY

SEQ ID NO: 2516301 - protein, 18 aa, Entamoeba dispar
SGHIWKGTITLVRPRTLK

SEQ ID NO: 2516302 - protein, 20 aa, Entamoeba dispar
SGKAPLMWRYDEINAPTYFE

SEQ ID NO: 2516303 - protein, 21 aa, Entamoeba dispar
SGKTWKCCLCGHINTQLTERY

SEQ ID NO: 2516304 - protein, 18 aa, Entamoeba dispar
SGKYFNFIKEYILSRKLL

SEQ ID NO: 2516305 - protein, 20 aa, Entamoeba dispar
SGLFKWKYMTHWTIDYGITT

SEQ ID NO: 2516306 - protein, 18 aa, Entamoeba dispar
SGLLMSICCNLIYDPTDQ

SEQ ID NO: 2516307 - protein, 19 aa, Entamoeba dispar
SGLLPKIILVVIEELTSET

SEQ ID NO: 2516308 - protein, 24 aa, Entamoeba dispar
SGSFLSYGTLCFIKENLGENDVAM

SEQ ID NO: 2516309 - protein, 23 aa, Entamoeba dispar
SGSFLSYGTLCFVKENLGENDVA

SEQ ID NO: 2516310 - protein, 24 aa, Entamoeba dispar
SGSIEWVVYHVNFKNGELVEDDTG

SEQ ID NO: 2516311 - protein, 20 aa, Entamoeba dispar
SGSTALHWAVRGDIQIVQMM

SEQ ID NO: 2516312 - protein, 26 aa, Entamoeba dispar
SGWIYYRWLLGTGMKCYNELNKKEEW

SEQ ID NO: 2516313 - protein, 18 aa, Entamoeba dispar
SHAVYIYWRAKEMVKTKE

SEQ ID NO: 2516314 - protein, 19 aa, Entamoeba dispar
SHGIRVWDCDDITKNEEVF

SEQ ID NO: 2516315 - protein, 25 aa, Entamoeba dispar
SHPFIKCCLELGILEYLIDYLKDNQ

SEQ ID NO: 2516316 - protein, 19 aa, Entamoeba dispar
SHQSFPCIPFFGVYLQDLT

SEQ ID NO: 2516317 - protein, 17 aa, Entamoeba dispar
SHRIWLWIVNMPQIIHA

SEQ ID NO: 2516318 - protein, 21 aa, Entamoeba dispar
SICPEGIDVVWLWVNGSDPGF

SEQ ID NO: 2516319 - protein, 24 aa, Entamoeba dispar
SIFKLELPQIISFTINCSILAIST

SEQ ID NO: 2516320 - protein, 26 aa, Entamoeba dispar
SIFYLECFRCSQLRFEYITDYLDDSV

SEQ ID NO: 2516321 - protein, 22 aa, Entamoeba dispar
SIGELFLNFSPFFIVYRNFLIN

SEQ ID NO: 2516322 - protein, 24 aa, Entamoeba dispar
SIGIIADGCGWGFRSKKASNNAVS

SEQ ID NO: 2516323 - protein, 18 aa, Entamoeba dispar
SIHFRFLMYYSEENCILL

SEQ ID NO: 2516324 - protein, 17 aa, Entamoeba dispar
SIIDWNTCLIKDAIKKI

SEQ ID NO: 2516325 - protein, 19 aa, Entamoeba dispar
SIITPNCRLFFSSKTVLLE

SEQ ID NO: 2516326 - protein, 17 aa, Entamoeba dispar
SIKTLKIHMCIKLMSIQ

SEQ ID NO: 2516327 - protein, 17 aa, Entamoeba dispar
SIKTLSVAFQWFVGDST

SEQ ID NO: 2516328 - protein, 17 aa, Entamoeba dispar
SILAANCGLEFQKAALC

SEQ ID NO: 2516329 - protein, 20 aa, Entamoeba dispar
SILTICFCKSPLCSQMIIQF

SEQ ID NO: 2516330 - protein, 18 aa, Entamoeba dispar
SILYKTKLPLIIVFTKTD

SEQ ID NO: 2516331 - protein, 21 aa, Entamoeba dispar
SILYRYCIGIGTLIIISQNYL

SEQ ID NO: 2516332 - protein, 22 aa, Entamoeba dispar
SIPFRRKRMALLDFCRTEVEPI

SEQ ID NO: 2516333 - protein, 18 aa, Entamoeba dispar
SIPQRLNVSITRAKYGLV

SEQ ID NO: 2516334 - protein, 19 aa, Entamoeba dispar
SIQCDWLFDSICSNCQLET

SEQ ID NO: 2516335 - protein, 19 aa, Entamoeba dispar
SIRKFSTIYLFNFPETDLS

SEQ ID NO: 2516336 - protein, 19 aa, Entamoeba dispar
SISDLGDWCRFNGCTSLTS

SEQ ID NO: 2516337 - protein, 18 aa, Entamoeba dispar
SITLPLLRPELFKKGSLT

SEQ ID NO: 2516338 - protein, 17 aa, Entamoeba dispar
SIVHKWRVQGYFYDFVG

SEQ ID NO: 2516339 - protein, 22 aa, Entamoeba dispar
SIYCKKRGSSILIEKILIDKDI

SEQ ID NO: 2516340 - protein, 18 aa, Entamoeba dispar
SIYSYGFEKPSAIQQRAI

SEQ ID NO: 2516341 - protein, 21 aa, Entamoeba dispar
SKALRPLAWKIFLKVIKPQAS

SEQ ID NO: 2516342 - protein, 22 aa, Entamoeba dispar
SKCCKELIIGGGERKFKIEVNE

SEQ ID NO: 2516343 - protein, 20 aa, Entamoeba dispar
SKCRCALCRYQQLCEVLTQP

SEQ ID NO: 2516344 - protein, 18 aa, Entamoeba dispar
SKCYTRLFEIINLKFHKA

SEQ ID NO: 2516345 - protein, 19 aa, Entamoeba dispar
SKDESIHFGDTVISTQPSF

SEQ ID NO: 2516346 - protein, 18 aa, Entamoeba dispar
SKDSHCWWINHRSHYPKL

SEQ ID NO: 2516347 - protein, 26 aa, Entamoeba dispar
SKDWKMCILCTDILIIARPFAFGKKT

SEQ ID NO: 2516348 - protein, 19 aa, Entamoeba dispar
SKEELKCFDGIEYHYIAFS

SEQ ID NO: 2516349 - protein, 20 aa, Entamoeba dispar
SKELFKYVLMYLTKGEIICN

SEQ ID NO: 2516350 - protein, 17 aa, Entamoeba dispar
SKFGKAFSRFHQCLNSH

SEQ ID NO: 2516351 - protein, 21 aa, Entamoeba dispar
SKIESYWGYFPLKEEFGSPQL

SEQ ID NO: 2516352 - protein, 19 aa, Entamoeba dispar
SKILPEFNIKKALNIYFVC

SEQ ID NO: 2516353 - protein, 25 aa, Entamoeba dispar
SKIRKLRININFSIKFELKHPEYFT

SEQ ID NO: 2516354 - protein, 25 aa, Entamoeba dispar
SKIRKLRISIDFCMKFQLKHPEYFT

SEQ ID NO: 2516355 - protein, 21 aa, Entamoeba dispar
SKISPFYACSSVNCSDTTMDL

SEQ ID NO: 2516356 - protein, 19 aa, Entamoeba dispar
SKLGFPHELLLHINKEVAD

SEQ ID NO: 2516357 - protein, 21 aa, Entamoeba dispar
SKLKLDVIEFNKRIATSVKEI

SEQ ID NO: 2516358 - protein, 24 aa, Entamoeba dispar
SKLLKEWILRIEIDKYIIKERQEF

SEQ ID NO: 2516359 - protein, 17 aa, Entamoeba dispar
SKNGLLACCSFDSTVSL

SEQ ID NO: 2516360 - protein, 17 aa, Entamoeba dispar
SKPWKRRYCTKCWMPLT

SEQ ID NO: 2516361 - protein, 18 aa, Entamoeba dispar
SKQLPEMIEVMILLILET

SEQ ID NO: 2516362 - protein, 22 aa, Entamoeba dispar
SKRISKETICFVYNGEIVDPLL

SEQ ID NO: 2516363 - protein, 24 aa, Entamoeba dispar
SKRPVSWILICRIIIYSLMEIHKG

SEQ ID NO: 2516364 - protein, 20 aa, Entamoeba dispar
SKSLSWPTILYVVGSIVKGW

SEQ ID NO: 2516365 - protein, 24 aa, Entamoeba dispar
SKTIICYLLRFGTKIDEENMILFN

SEQ ID NO: 2516366 - protein, 22 aa, Entamoeba dispar
SKVECPYWLAPEVINGNTFTQK

SEQ ID NO: 2516367 - protein, 19 aa, Entamoeba dispar
SKVGLIYICVIVKERIEKR

SEQ ID NO: 2516368 - protein, 21 aa, Entamoeba dispar
SKVYWKWFLALDEIPRRSGAR

SEQ ID NO: 2516369 - protein, 17 aa, Entamoeba dispar
SKYISCKIINYFTNNSV

SEQ ID NO: 2516370 - protein, 24 aa, Entamoeba dispar
SKYPKFRFGTLTSRISGNQLLVLT

SEQ ID NO: 2516371 - protein, 17 aa, Entamoeba dispar
SKYPVLARWCSRKIQFV

SEQ ID NO: 2516372 - protein, 26 aa, Entamoeba dispar
SKYQCPKCNILYCSIDCYKAHKINCK

SEQ ID NO: 2516373 - protein, 18 aa, Entamoeba dispar
SLCDVIRSFLSLNITRQF

SEQ ID NO: 2516374 - protein, 17 aa, Entamoeba dispar
SLCIRFNQVLGMMEKYL

SEQ ID NO: 2516375 - protein, 20 aa, Entamoeba dispar
SLFREFHCSCGRTLNVELKP

SEQ ID NO: 2516376 - protein, 20 aa, Entamoeba dispar
SLFSEIKWDDEISCLKEIAI

SEQ ID NO: 2516377 - protein, 20 aa, Entamoeba dispar
SLGVQWEEFISLFKYSTPED

SEQ ID NO: 2516378 - protein, 21 aa, Entamoeba dispar
SLGYDCFRECYSLTTINIPSS

SEQ ID NO: 2516379 - protein, 19 aa, Entamoeba dispar
SLHKFKLFRCNELKTLTIP

SEQ ID NO: 2516380 - protein, 23 aa, Entamoeba dispar
SLISDWKKLCFIKDELDYSNIFD

SEQ ID NO: 2516381 - protein, 24 aa, Entamoeba dispar
SLISIYKSAKWIGVDAIWKTKTKE

SEQ ID NO: 2516382 - protein, 18 aa, Entamoeba dispar
SLISLFTIRACHCIENGR

SEQ ID NO: 2516383 - protein, 20 aa, Entamoeba dispar
SLIYERLCKICEGISKHAPI

SEQ ID NO: 2516384 - protein, 19 aa, Entamoeba dispar
SLKNCKTEEIIPFQQKVEE

SEQ ID NO: 2516385 - protein, 20 aa, Entamoeba dispar
SLKRLEMEECYLIDIDNDMK

SEQ ID NO: 2516386 - protein, 19 aa, Entamoeba dispar
SLKTFQCMRCMKLTKIELP

SEQ ID NO: 2516387 - protein, 18 aa, Entamoeba dispar
SLKTVSVVLSWFAEPIEE

SEQ ID NO: 2516388 - protein, 24 aa, Entamoeba dispar
SLLDLFRIILIYRYHFYKESVKDI

SEQ ID NO: 2516389 - protein, 23 aa, Entamoeba dispar
SLLKRIICLPDVFFERRKLWEQL

SEQ ID NO: 2516390 - protein, 20 aa, Entamoeba dispar
SLLLKFNIYGGWTFIYQILY

SEQ ID NO: 2516391 - protein, 20 aa, Entamoeba dispar
SLLMKEYHVITVFMGNPENK

SEQ ID NO: 2516392 - protein, 18 aa, Entamoeba dispar
SLLSRFDLIFIILDSSTE

SEQ ID NO: 2516393 - protein, 23 aa, Entamoeba dispar
SLNALCKIASLFNQSKKETEEAN

SEQ ID NO: 2516394 - protein, 23 aa, Entamoeba dispar
SLNILCFRTCYKIIKKGENDIYL

SEQ ID NO: 2516395 - protein, 19 aa, Entamoeba dispar
SLPAFLPKRIKSISKEEEE

SEQ ID NO: 2516396 - protein, 19 aa, Entamoeba dispar
SLPFLFKPYCNCISGMIIQ

SEQ ID NO: 2516397 - protein, 26 aa, Entamoeba dispar
SLPRQIKYLFCLNNQYPILITNKKSL

SEQ ID NO: 2516398 - protein, 19 aa, Entamoeba dispar
SLPTVWKYFFLFSDILVVT

SEQ ID NO: 2516399 - protein, 25 aa, Entamoeba dispar
SLQVKYKVCLELSSYQGIFVLLKNF

SEQ ID NO: 2516400 - protein, 20 aa, Entamoeba dispar
SLRYRIIDILTQIIQIYPDV

SEQ ID NO: 2516401 - protein, 21 aa, Entamoeba dispar
SLSCLFINCDILIKKITKKGC

SEQ ID NO: 2516402 - protein, 22 aa, Entamoeba dispar
SLSSQCPQGFSISKRERMTKKL

SEQ ID NO: 2516403 - protein, 17 aa, Entamoeba dispar
SLTTKVIEDMLFYKRYY

SEQ ID NO: 2516404 - protein, 20 aa, Entamoeba dispar
SLYFDCLKSFLIQNQSNQMI

SEQ ID NO: 2516405 - protein, 17 aa, Entamoeba dispar
SMEAFKVLLDPSVGGNE

SEQ ID NO: 2516406 - protein, 21 aa, Entamoeba dispar
SMLKKRCNAVIYLLIRGGLKN

SEQ ID NO: 2516407 - protein, 20 aa, Entamoeba dispar
SMLNKWVLIKSIQFNKYSSF

SEQ ID NO: 2516408 - protein, 21 aa, Entamoeba dispar
SMRVREWYGWHFPELSKYIND

SEQ ID NO: 2516409 - protein, 19 aa, Entamoeba dispar
SNDNCKLCGGAQIQRVLKI

SEQ ID NO: 2516410 - protein, 18 aa, Entamoeba dispar
SNDRCPIMLVCQDCFWRC

SEQ ID NO: 2516411 - protein, 23 aa, Entamoeba dispar
SNECKMCLQALFDAAFMLAEKMK

SEQ ID NO: 2516412 - protein, 26 aa, Entamoeba dispar
SNEIFIGLTLLRFGIHLEDVLNYVKP

SEQ ID NO: 2516413 - protein, 17 aa, Entamoeba dispar
SNFFKRYIIQELIGRGS

SEQ ID NO: 2516414 - protein, 17 aa, Entamoeba dispar
SNGEGLMYIGVMNKAER

SEQ ID NO: 2516415 - protein, 20 aa, Entamoeba dispar
SNGIKWVFWDVCGQAKFRSL

SEQ ID NO: 2516416 - protein, 24 aa, Entamoeba dispar
SNIEMMNTVLFEWVEVLQQILDTP

SEQ ID NO: 2516417 - protein, 19 aa, Entamoeba dispar
SNILPCVMVAFATTMTLGN

SEQ ID NO: 2516418 - protein, 19 aa, Entamoeba dispar
SNLIPEFSKYLPSKCNPEY

SEQ ID NO: 2516419 - protein, 19 aa, Entamoeba dispar
SNLLRCFRTLGLFAGNQHA

SEQ ID NO: 2516420 - protein, 24 aa, Entamoeba dispar
SNLWRYWCPWLMWFVSPFFKIFWK

SEQ ID NO: 2516421 - protein, 22 aa, Entamoeba dispar
SNLWTCCFCLTRNQLQYQNLPE

SEQ ID NO: 2516422 - protein, 17 aa, Entamoeba dispar
SNMALCWLKLENWNETK

SEQ ID NO: 2516423 - protein, 24 aa, Entamoeba dispar
SNNCCIGVLCPYQYQNQLINFINK

SEQ ID NO: 2516424 - protein, 21 aa, Entamoeba dispar
SNPWFKWKLTTSFENHRIQLK

SEQ ID NO: 2516425 - protein, 18 aa, Entamoeba dispar
SNRISLSLSRIIEDEIHS

SEQ ID NO: 2516426 - protein, 21 aa, Entamoeba dispar
SNRLKKQFGFELKEIKSGNSG

SEQ ID NO: 2516427 - protein, 21 aa, Entamoeba dispar
SNSGVCPLPPAGTTGQQPNYE

SEQ ID NO: 2516428 - protein, 26 aa, Entamoeba dispar
SNVLATKEFISWIMFRMFHLFEKLNQ

SEQ ID NO: 2516429 - protein, 18 aa, Entamoeba dispar
SNYPFAFLSEYQFNSQFI

SEQ ID NO: 2516430 - protein, 17 aa, Entamoeba dispar
SNYWPKYVEYYLFCCEK

SEQ ID NO: 2516431 - protein, 21 aa, Entamoeba dispar
SPDLRWIWRTNTFEMKATTLK

SEQ ID NO: 2516432 - protein, 21 aa, Entamoeba dispar
SPEHPPRFSITKAPALSEKEL

SEQ ID NO: 2516433 - protein, 18 aa, Entamoeba dispar
SPEIIKKLIIKRLLQRTK

SEQ ID NO: 2516434 - protein, 19 aa, Entamoeba dispar
SPELKEILKDAGVKPKHLA

SEQ ID NO: 2516435 - protein, 19 aa, Entamoeba dispar
SPFAKRRLLELSKRIGPYI

SEQ ID NO: 2516436 - protein, 17 aa, Entamoeba dispar
SPFSIPVARNFFKQLLS

SEQ ID NO: 2516437 - protein, 17 aa, Entamoeba dispar
SPGECDLIKSMYPECKN

SEQ ID NO: 2516438 - protein, 23 aa, Entamoeba dispar
SPKELLKLLSIKDFYLMFMLFFD

SEQ ID NO: 2516439 - protein, 21 aa, Entamoeba dispar
SPKLWLQNDILNFMIHKLGIL

SEQ ID NO: 2516440 - protein, 23 aa, Entamoeba dispar
SPLCPRSSVLLSLSAKVVTIKSL

SEQ ID NO: 2516441 - protein, 17 aa, Entamoeba dispar
SPLEIVEAYNFVRCQSS

SEQ ID NO: 2516442 - protein, 17 aa, Entamoeba dispar
SPPTGELERSWKALVNE

SEQ ID NO: 2516443 - protein, 20 aa, Entamoeba dispar
SPPVLRIVKQMYFEPVNIPC

SEQ ID NO: 2516444 - protein, 24 aa, Entamoeba dispar
SPSSKMKLSFAIRMSKKLPYVKQM

SEQ ID NO: 2516445 - protein, 18 aa, Entamoeba dispar
SPYCGFVLEYPRKQTIVT

SEQ ID NO: 2516446 - protein, 17 aa, Entamoeba dispar
SPYKRYSLYFDYSACII

SEQ ID NO: 2516447 - protein, 21 aa, Entamoeba dispar
SPYYRDICLSYGFFNSFLRLY

SEQ ID NO: 2516448 - protein, 22 aa, Entamoeba dispar
SQARKGDCQIAIIGDEDSVTGF

SEQ ID NO: 2516449 - protein, 20 aa, Entamoeba dispar
SQFFSFVTFHLWAYGEYTIN

SEQ ID NO: 2516450 - protein, 20 aa, Entamoeba dispar
SQKNCIFCINILEQGIKEKP

SEQ ID NO: 2516451 - protein, 18 aa, Entamoeba dispar
SQLFGSGMIKYTHHPHVI

SEQ ID NO: 2516452 - protein, 20 aa, Entamoeba dispar
SQLLCCICGDGSSFPLYCVV

SEQ ID NO: 2516453 - protein, 24 aa, Entamoeba dispar
SQMMVFKRMVNFDGQDLDPRDVLD

SEQ ID NO: 2516454 - protein, 21 aa, Entamoeba dispar
SQYEMIRWIASTINFSGKEIV

SEQ ID NO: 2516455 - protein, 17 aa, Entamoeba dispar
SRAKCLGLGITVFEGLM

SEQ ID NO: 2516456 - protein, 21 aa, Entamoeba dispar
SRALLTWLFDLMIEVSKNRET

SEQ ID NO: 2516457 - protein, 17 aa, Entamoeba dispar
SRCGRPVYENGIKANRC

SEQ ID NO: 2516458 - protein, 25 aa, Entamoeba dispar
SRCSEFKRKLSLVGKKIGEETEHQI

SEQ ID NO: 2516459 - protein, 22 aa, Entamoeba dispar
SRDRLSQILIYFINNKIQDASD

SEQ ID NO: 2516460 - protein, 18 aa, Entamoeba dispar
SREIAIQNIELWKQNDEL

SEQ ID NO: 2516461 - protein, 17 aa, Entamoeba dispar
SRELLQFPIREKMFHSI

SEQ ID NO: 2516462 - protein, 23 aa, Entamoeba dispar
SRFCARFLGDYGFSIGISDVTPS

SEQ ID NO: 2516463 - protein, 17 aa, Entamoeba dispar
SRFSLIYERLCKICEGI

SEQ ID NO: 2516464 - protein, 18 aa, Entamoeba dispar
SRGLECIIGVLTLIIEYP

SEQ ID NO: 2516465 - protein, 19 aa, Entamoeba dispar
SRGYKRVGIMVGGYKMYHK

SEQ ID NO: 2516466 - protein, 25 aa, Entamoeba dispar
SRIACLRLIIFLLRKDIKMFKFVYA

SEQ ID NO: 2516467 - protein, 18 aa, Entamoeba dispar
SRIAQLIGQYEQLEAKKQ

SEQ ID NO: 2516468 - protein, 18 aa, Entamoeba dispar
SRIGKWCFYECRSLINVN

SEQ ID NO: 2516469 - protein, 23 aa, Entamoeba dispar
SRIRAVYLCKWFIKNGSNQNVIS

SEQ ID NO: 2516470 - protein, 20 aa, Entamoeba dispar
SRITPDWMALIFKTIQYPGC

SEQ ID NO: 2516471 - protein, 17 aa, Entamoeba dispar
SRLLKKWFNSRMFSNYF

SEQ ID NO: 2516472 - protein, 17 aa, Entamoeba dispar
SRLPFIQLTGLKQLEVY

SEQ ID NO: 2516473 - protein, 20 aa, Entamoeba dispar
SRLSGNFKREYEDNGQTIID

SEQ ID NO: 2516474 - protein, 19 aa, Entamoeba dispar
SRLSIGLMWWMLTREILRY

SEQ ID NO: 2516475 - protein, 20 aa, Entamoeba dispar
SRLSIGLMWWMLTREILRYQ

SEQ ID NO: 2516476 - protein, 20 aa, Entamoeba dispar
SRNSLEFLSHFPGVEDKVSP

SEQ ID NO: 2516477 - protein, 18 aa, Entamoeba dispar
SRRYKKWLPFILAVLDAE

SEQ ID NO: 2516478 - protein, 20 aa, Entamoeba dispar
SRSIMNWDLKGMFYLINNND

SEQ ID NO: 2516479 - protein, 21 aa, Entamoeba dispar
SRYIPFIKEIVLRMANNDVPD

SEQ ID NO: 2516480 - protein, 18 aa, Entamoeba dispar
SRYLKAHFIIIYDSPINC

SEQ ID NO: 2516481 - protein, 21 aa, Entamoeba dispar
SRYQFKYGLRPGEDIQQFGQM

SEQ ID NO: 2516482 - protein, 17 aa, Entamoeba dispar
SSCRVYTFTVKRFMRIT

SEQ ID NO: 2516483 - protein, 19 aa, Entamoeba dispar
SSCSNVFCAECQRVIADIT

SEQ ID NO: 2516484 - protein, 18 aa, Entamoeba dispar
SSEIKMKLLFPPKLDNDE

SEQ ID NO: 2516485 - protein, 24 aa, Entamoeba dispar
SSEKARCALRWGVPVLNFQWLFDC

SEQ ID NO: 2516486 - protein, 17 aa, Entamoeba dispar
SSFCVKGALTLLNNEIT

SEQ ID NO: 2516487 - protein, 23 aa, Entamoeba dispar
SSFDIKPSPSFSLFGDTASDTKK

SEQ ID NO: 2516488 - protein, 25 aa, Entamoeba dispar
SSFLQRIRIILKYCYPDGSFNDNTL

SEQ ID NO: 2516489 - protein, 20 aa, Entamoeba dispar
SSFNLPVIISKGILKTLEVE

SEQ ID NO: 2516490 - protein, 21 aa, Entamoeba dispar
SSFRCLCHYIRLFCENPLCSD

SEQ ID NO: 2516491 - protein, 19 aa, Entamoeba dispar
SSFSKVLQCLSFYETEKSD

SEQ ID NO: 2516492 - protein, 21 aa, Entamoeba dispar
SSFYRKSCGIFLVFDLSDEES

SEQ ID NO: 2516493 - protein, 21 aa, Entamoeba dispar
SSFYRKSCGIFLVFDLTDETS

SEQ ID NO: 2516494 - protein, 19 aa, Entamoeba dispar
SSILSRSIMNWDLKGMFYL

SEQ ID NO: 2516495 - protein, 24 aa, Entamoeba dispar
SSILSRSIMNWDLKGMFYLINNND

SEQ ID NO: 2516496 - protein, 35 aa, Entamoeba dispar
SSIQKEAELLFSRAKTLGLDDCIEEWNKDLQSDIK

SEQ ID NO: 2516497 - protein, 19 aa, Entamoeba dispar
SSITKLGYRCFNGCISLTS

SEQ ID NO: 2516498 - protein, 19 aa, Entamoeba dispar
SSKMIKFFGTQALKKLIVV

SEQ ID NO: 2516499 - protein, 17 aa, Entamoeba dispar
SSLALKLSVIFLICADF

SEQ ID NO: 2516500 - protein, 18 aa, Entamoeba dispar
SSLCACGIHCVINQNVDY

SEQ ID NO: 2516501 - protein, 22 aa, Entamoeba dispar
SSLFRNKASFAFKEPVDPQLTG

SEQ ID NO: 2516502 - protein, 17 aa, Entamoeba dispar
SSLLVCYTKYLKSVSKE

SEQ ID NO: 2516503 - protein, 18 aa, Entamoeba dispar
SSLVQFVIELLKYFENGE

SEQ ID NO: 2516504 - protein, 23 aa, Entamoeba dispar
SSNLKFIGSYAFVGCAFNKVILP

SEQ ID NO: 2516505 - protein, 21 aa, Entamoeba dispar
SSQQILNRIKWVAGGKKQNWE

SEQ ID NO: 2516506 - protein, 22 aa, Entamoeba dispar
SSRANEVFKIFSDYLRTHKLMK

SEQ ID NO: 2516507 - protein, 17 aa, Entamoeba dispar
SSRDWSDLATLYIILKY

SEQ ID NO: 2516508 - protein, 23 aa, Entamoeba dispar
SSRRLKTEFLVRLDGAGTDDERI

SEQ ID NO: 2516509 - protein, 21 aa, Entamoeba dispar
SSSWDRLNFCVAFGNKCLSCS

SEQ ID NO: 2516510 - protein, 19 aa, Entamoeba dispar
SSVIFSFTLTEIVYLVELQ

SEQ ID NO: 2516511 - protein, 20 aa, Entamoeba dispar
SSVSKIGRWCFNDCSSLNNV

SEQ ID NO: 2516512 - protein, 17 aa, Entamoeba dispar
SSWNSLMNFEWNVYKLN

SEQ ID NO: 2516513 - protein, 17 aa, Entamoeba dispar
SSYEILGGLALDDDQFI

SEQ ID NO: 2516514 - protein, 19 aa, Entamoeba dispar
SSYKSINFMSQFKNKSLIE

SEQ ID NO: 2516515 - protein, 19 aa, Entamoeba dispar
STAKALRVVNEIKEKLIKI

SEQ ID NO: 2516516 - protein, 17 aa, Entamoeba dispar
STCFYKLDDERSWMDQL

SEQ ID NO: 2516517 - protein, 19 aa, Entamoeba dispar
STFWPQMSIDLYKRYQDTY

SEQ ID NO: 2516518 - protein, 21 aa, Entamoeba dispar
STIMPCVMVAFATTMTLGNGT

SEQ ID NO: 2516519 - protein, 23 aa, Entamoeba dispar
STIRALRFIECIIQTIKASKLTQ

SEQ ID NO: 2516520 - protein, 22 aa, Entamoeba dispar
STITSIGYRWFYGCKSLKSINI

SEQ ID NO: 2516521 - protein, 22 aa, Entamoeba dispar
STKNIYCLKQFFMILYYCFKSS

SEQ ID NO: 2516522 - protein, 22 aa, Entamoeba dispar
STKQEIFNTFSFDQPIENKIPT

SEQ ID NO: 2516523 - protein, 20 aa, Entamoeba dispar
STLFPHCYQYCGVQTNTFDC

SEQ ID NO: 2516524 - protein, 21 aa, Entamoeba dispar
STPMRVGTLLLKKEVPLDSLE

SEQ ID NO: 2516525 - protein, 19 aa, Entamoeba dispar
STYSYTFELWFIFKNEDNS

SEQ ID NO: 2516526 - protein, 20 aa, Entamoeba dispar
STYYPYWRFEIIYMSHNNSF

SEQ ID NO: 2516527 - protein, 20 aa, Entamoeba dispar
SVCAQCKKVIYKKDKETETR

SEQ ID NO: 2516528 - protein, 22 aa, Entamoeba dispar
SVDIIACLLKCFLQKMPTHIID

SEQ ID NO: 2516529 - protein, 23 aa, Entamoeba dispar
SVDRFPPQIGFLFYTLRLKIING

SEQ ID NO: 2516530 - protein, 24 aa, Entamoeba dispar
SVEISTLIPLRFGAERCILIGDPQ

SEQ ID NO: 2516531 - protein, 19 aa, Entamoeba dispar
SVFGIRWIKMLFACEFHIE

SEQ ID NO: 2516532 - protein, 18 aa, Entamoeba dispar
SVKECVRFILQQSEDIQQ

SEQ ID NO: 2516533 - protein, 19 aa, Entamoeba dispar
SVKPIIIFWGLRICGLMLY

SEQ ID NO: 2516534 - protein, 18 aa, Entamoeba dispar
SVKRKLLPIVGYIYDDID

SEQ ID NO: 2516535 - protein, 24 aa, Entamoeba dispar
SVLRLCVFNNIYLPEKFIEEIKQS

SEQ ID NO: 2516536 - protein, 19 aa, Entamoeba dispar
SVMPEFRRSIFIDCPLFKS

SEQ ID NO: 2516537 - protein, 17 aa, Entamoeba dispar
SVNFFKGYLEVIKQNCD

SEQ ID NO: 2516538 - protein, 21 aa, Entamoeba dispar
SVRGCSYCYGFAAVRRFLIKN

SEQ ID NO: 2516539 - protein, 20 aa, Entamoeba dispar
SVRWQMARNFILWVPLTAIA

SEQ ID NO: 2516540 - protein, 23 aa, Entamoeba dispar
SVTYTFHCPLSFSEIIPNELNGK

SEQ ID NO: 2516541 - protein, 17 aa, Entamoeba dispar
SVVKRPDMDQHQLERFI

SEQ ID NO: 2516542 - protein, 17 aa, Entamoeba dispar
SVWKRFNATFAYLPILA

SEQ ID NO: 2516543 - protein, 22 aa, Entamoeba dispar
SWFSLTVIDHWVCMKPQQIPLE

SEQ ID NO: 2516544 - protein, 17 aa, Entamoeba dispar
SWGWGWDTVDSWKVTRV

SEQ ID NO: 2516545 - protein, 21 aa, Entamoeba dispar
SYFIPEFMYMTGLSSKMKSDK

SEQ ID NO: 2516546 - protein, 21 aa, Entamoeba dispar
SYGILRFRILSNIVINKQPLF

SEQ ID NO: 2516547 - protein, 23 aa, Entamoeba dispar
SYHKRVLEPLGFYNMMLRTKQQK

SEQ ID NO: 2516548 - protein, 19 aa, Entamoeba dispar
SYILKVMGYITVRFKQLRT

SEQ ID NO: 2516549 - protein, 22 aa, Entamoeba dispar
SYKINNCWFCLSNSNSELKLII

SEQ ID NO: 2516550 - protein, 17 aa, Entamoeba dispar
SYKLNDHTLCITAHRQD

SEQ ID NO: 2516551 - protein, 25 aa, Entamoeba dispar
SYLDAIRIGMCFFWHSKVDLPFRIV

SEQ ID NO: 2516552 - protein, 20 aa, Entamoeba dispar
SYLLSCIEILIKCFKSINEL

SEQ ID NO: 2516553 - protein, 18 aa, Entamoeba dispar
SYMFSIRFPEIFYEMLSR

SEQ ID NO: 2516554 - protein, 17 aa, Entamoeba dispar
SYPFWILRLVWKKQNKS

SEQ ID NO: 2516555 - protein, 24 aa, Entamoeba dispar
SYQKEGKCTIKFVFVTPERITQSK

SEQ ID NO: 2516556 - protein, 23 aa, Entamoeba dispar
SYSEMRVAYELSDKLKINVFIGS

SEQ ID NO: 2516557 - protein, 19 aa, Entamoeba dispar
SYYRGVLGIAMIYDVTSKD

SEQ ID NO: 2516558 - protein, 18 aa, Entamoeba dispar
TAAMFLPFVMQFLENFEN

SEQ ID NO: 2516559 - protein, 17 aa, Entamoeba dispar
TAFGSRAGIFVKAICMF

SEQ ID NO: 2516560 - protein, 20 aa, Entamoeba dispar
TAFQEMLRLLSVHPFGNKEE

SEQ ID NO: 2516561 - protein, 19 aa, Entamoeba dispar
TASISGLWISILLVMKTGG

SEQ ID NO: 2516562 - protein, 18 aa, Entamoeba dispar
TASLPIHRVFALNHLLSI

SEQ ID NO: 2516563 - protein, 20 aa, Entamoeba dispar
TATVRPSLLLARNQLEQKQK

SEQ ID NO: 2516564 - protein, 20 aa, Entamoeba dispar
TAYFLLYIDIEFVKPYIRNT

SEQ ID NO: 2516565 - protein, 18 aa, Entamoeba dispar
TCCYPCYISGDVKDGCYC

SEQ ID NO: 2516566 - protein, 17 aa, Entamoeba dispar
TCESFCCNRLASKKDGK

SEQ ID NO: 2516567 - protein, 18 aa, Entamoeba dispar
TCFGDGGIVHFFIEKEKL

SEQ ID NO: 2516568 - protein, 17 aa, Entamoeba dispar
TCHYPCYIEGDIKDGCY

SEQ ID NO: 2516569 - protein, 21 aa, Entamoeba dispar
TCKCGYEFCWLCGVKYTPEHW

SEQ ID NO: 2516570 - protein, 22 aa, Entamoeba dispar
TCKCGYQFCWLCMQPYTKTHWK

SEQ ID NO: 2516571 - protein, 17 aa, Entamoeba dispar
TCLICKNTLFDGQPVTI

SEQ ID NO: 2516572 - protein, 21 aa, Entamoeba dispar
TCLKYLVALLYELSKNPKSKM

SEQ ID NO: 2516573 - protein, 18 aa, Entamoeba dispar
TCNKTLCNNCFNSSEHEN

SEQ ID NO: 2516574 - protein, 17 aa, Entamoeba dispar
TCNWCYRTVCFPEDSIK

SEQ ID NO: 2516575 - protein, 17 aa, Entamoeba dispar
TCRWFFYIREKDSSISS

SEQ ID NO: 2516576 - protein, 24 aa, Entamoeba dispar
TCSEIFRLLPGMCQSLLLRIIFLK

SEQ ID NO: 2516577 - protein, 17 aa, Entamoeba dispar
TCSLRFPGQLNQDLRKL

SEQ ID NO: 2516578 - protein, 18 aa, Entamoeba dispar
TCVAPSRAAPRPVKHLVQ

SEQ ID NO: 2516579 - protein, 18 aa, Entamoeba dispar
TCVTDLFKTAGVALADEF

SEQ ID NO: 2516580 - protein, 20 aa, Entamoeba dispar
TCYPLEIDLWLAYSEYATMG

SEQ ID NO: 2516581 - protein, 24 aa, Entamoeba dispar
TDDFIYKFIRVCVMNNIGLSGPAL

SEQ ID NO: 2516582 - protein, 17 aa, Entamoeba dispar
TDEFYRYKMPDLIHKIE

SEQ ID NO: 2516583 - protein, 19 aa, Entamoeba dispar
TDISEQFCRFMVAIGEHKD

SEQ ID NO: 2516584 - protein, 17 aa, Entamoeba dispar
TDKPCNMFQAFLIRLVI

SEQ ID NO: 2516585 - protein, 23 aa, Entamoeba dispar
TDLPSCVKFSCDFRQSVLELLLW

SEQ ID NO: 2516586 - protein, 21 aa, Entamoeba dispar
TDMCIVLGCDGVWDVLSNSKV

SEQ ID NO: 2516587 - protein, 20 aa, Entamoeba dispar
TDPCRFMGCGPSSSTSSGYR

SEQ ID NO: 2516588 - protein, 18 aa, Entamoeba dispar
TECPICGEHSVNLIEYPY

SEQ ID NO: 2516589 - protein, 23 aa, Entamoeba dispar
TEECQRMAFLIGLLNYRGVGLII

SEQ ID NO: 2516590 - protein, 18 aa, Entamoeba dispar
TEELYEWLRVCSGAIILQ

SEQ ID NO: 2516591 - protein, 22 aa, Entamoeba dispar
TEFNKRLALWFTQQDIWNRMDV

SEQ ID NO: 2516592 - protein, 18 aa, Entamoeba dispar
TEIKGLYGIFGLGDGFVI

SEQ ID NO: 2516593 - protein, 18 aa, Entamoeba dispar
TELLYRFICKLINRPYVR

SEQ ID NO: 2516594 - protein, 29 aa, Entamoeba dispar
TENGSICLISFYCWEIFFRRIVIRSQTYW

SEQ ID NO: 2516595 - protein, 18 aa, Entamoeba dispar
TEPRIVVFSLWMKDMISL

SEQ ID NO: 2516596 - protein, 17 aa, Entamoeba dispar
TEPSDWILFYLFNCVDR

SEQ ID NO: 2516597 - protein, 19 aa, Entamoeba dispar
TERLIRITSIFKDGKIFGR

SEQ ID NO: 2516598 - protein, 20 aa, Entamoeba dispar
TERLIRITSIFKDGKIFGRD

SEQ ID NO: 2516599 - protein, 23 aa, Entamoeba dispar
TESCGGCTTCLPGMNDPQILSCG

SEQ ID NO: 2516600 - protein, 21 aa, Entamoeba dispar
TESKWKLLVFDKFCSELIENH

SEQ ID NO: 2516601 - protein, 21 aa, Entamoeba dispar
TEVKPIICAPVIQDKASAKED

SEQ ID NO: 2516602 - protein, 19 aa, Entamoeba dispar
TEVTKAIVIKGVIQIEING

SEQ ID NO: 2516603 - protein, 24 aa, Entamoeba dispar
TEYKRIRENGGFVIGNRTNGGLAV

SEQ ID NO: 2516604 - protein, 23 aa, Entamoeba dispar
TFFAIKAADAWILQNIQAAYAQD

SEQ ID NO: 2516605 - protein, 18 aa, Entamoeba dispar
TFFFKIIYFISIASFGEI

SEQ ID NO: 2516606 - protein, 22 aa, Entamoeba dispar
TFGDLWVEFLLRESGSLDAQKP

SEQ ID NO: 2516607 - protein, 21 aa, Entamoeba dispar
TFGIVYRAEWRGVDVAVKLMK

SEQ ID NO: 2516608 - protein, 22 aa, Entamoeba dispar
TFHLGMCYRKGMGVYENSIKSA

SEQ ID NO: 2516609 - protein, 19 aa, Entamoeba dispar
TFKTFGFKSNESCVLLLRN

SEQ ID NO: 2516610 - protein, 26 aa, Entamoeba dispar
TFKTSLKRFSYCPVLFSNNDENIKEI

SEQ ID NO: 2516611 - protein, 22 aa, Entamoeba dispar
TFLCNACGLKALKKKKREQQMA

SEQ ID NO: 2516612 - protein, 24 aa, Entamoeba dispar
TFSDLWDIFDIILINVEGEYKEIY

SEQ ID NO: 2516613 - protein, 26 aa, Entamoeba dispar
TGDKEILDILGFRPPHHIDLTEFQPK

SEQ ID NO: 2516614 - protein, 21 aa, Entamoeba dispar
TGKFPSVIICDYCRRQKYDNP

SEQ ID NO: 2516615 - protein, 22 aa, Entamoeba dispar
TGLKKLRIAGGLKQTQQLGTSI

SEQ ID NO: 2516616 - protein, 24 aa, Entamoeba dispar
TGLVCSCVLIGLGIYSNAKEAMEF

SEQ ID NO: 2516617 - protein, 22 aa, Entamoeba dispar
TGNDGRCALCFGYNNKKPIYIC

SEQ ID NO: 2516618 - protein, 20 aa, Entamoeba dispar
TGVACGLAYMELRDKFQHPA

SEQ ID NO: 2516619 - protein, 23 aa, Entamoeba dispar
THANWKGACWVPTEKTTIVTISD

SEQ ID NO: 2516620 - protein, 18 aa, Entamoeba dispar
THCQSPCHCSWIMEIIGA

SEQ ID NO: 2516621 - protein, 20 aa, Entamoeba dispar
THEECIKKICINNNENYLDL

SEQ ID NO: 2516622 - protein, 23 aa, Entamoeba dispar
THEPCLMCGMALLHSRFGRVFFI

SEQ ID NO: 2516623 - protein, 22 aa, Entamoeba dispar
THPEILTTLALDFKIARSCPNG

SEQ ID NO: 2516624 - protein, 27 aa, Entamoeba dispar
THPFNFPGLILHDIILRFIPEQNEFFL

SEQ ID NO: 2516625 - protein, 17 aa, Entamoeba dispar
THPTLLFIQNWFSYDPF

SEQ ID NO: 2516626 - protein, 18 aa, Entamoeba dispar
THRGLRKVACVGAWHPAR

SEQ ID NO: 2516627 - protein, 25 aa, Entamoeba dispar
THWICPHSRYYCCVCHQIVADQPRR

SEQ ID NO: 2516628 - protein, 18 aa, Entamoeba dispar
THWLPRFGIEVDLVDTSD

SEQ ID NO: 2516629 - protein, 20 aa, Entamoeba dispar
THYPCEFCCIPPHVSTINIT

SEQ ID NO: 2516630 - protein, 18 aa, Entamoeba dispar
TIAEFKKNVELFGVLDED

SEQ ID NO: 2516631 - protein, 22 aa, Entamoeba dispar
TICNNNIWLAMPMFNQIGIVSF

SEQ ID NO: 2516632 - protein, 22 aa, Entamoeba dispar
TIDCMRFFFSLCDVDNDNSLNE

SEQ ID NO: 2516633 - protein, 23 aa, Entamoeba dispar
TIEIKEIPDYVGYLTDGIDDDMC

SEQ ID NO: 2516634 - protein, 21 aa, Entamoeba dispar
TIELKSGMILTGTIVGVDNYM

SEQ ID NO: 2516635 - protein, 17 aa, Entamoeba dispar
TIERYGLDMLKRIGDYK

SEQ ID NO: 2516636 - protein, 18 aa, Entamoeba dispar
TIHIFASTLLRYFDDQIK

SEQ ID NO: 2516637 - protein, 18 aa, Entamoeba dispar
TIIFRLNWLRDEDIPIIQ

SEQ ID NO: 2516638 - protein, 17 aa, Entamoeba dispar
TIIVKFPVTVGWGKGTF

SEQ ID NO: 2516639 - protein, 20 aa, Entamoeba dispar
TIIYCFRYSFSLLGEGEQNN

SEQ ID NO: 2516640 - protein, 20 aa, Entamoeba dispar
TILCYQRLLTLQFIIIFNNK

SEQ ID NO: 2516641 - protein, 18 aa, Entamoeba dispar
TILKKICDPYAININELK

SEQ ID NO: 2516642 - protein, 17 aa, Entamoeba dispar
TILMFKKMSSITVYHTQ

SEQ ID NO: 2516643 - protein, 24 aa, Entamoeba dispar
TINITIFWHRLHLFNEEIIEGITS

SEQ ID NO: 2516644 - protein, 22 aa, Entamoeba dispar
TIPKSVCCSLNMVYEVDNSMIN

SEQ ID NO: 2516645 - protein, 17 aa, Entamoeba dispar
TIPRVCHLHLSKITAKM

SEQ ID NO: 2516646 - protein, 21 aa, Entamoeba dispar
TIPSGLCWGCVMLTEVILPSC

SEQ ID NO: 2516647 - protein, 27 aa, Entamoeba dispar
TIPYLLCIICQVPVILPNYFDTIKEKK

SEQ ID NO: 2516648 - protein, 19 aa, Entamoeba dispar
TIRALRFIECIIQTIKASK

SEQ ID NO: 2516649 - protein, 24 aa, Entamoeba dispar
TITLPLKRSELFFSKLTQGAKGVL

SEQ ID NO: 2516650 - protein, 22 aa, Entamoeba dispar
TITLRYANPYSFIPKNTYKLSI

SEQ ID NO: 2516651 - protein, 22 aa, Entamoeba dispar
TIYLRKLFYLYALKYPFDSVDI

SEQ ID NO: 2516652 - protein, 18 aa, Entamoeba dispar
TIYYWKYYLNLVLPQQMS

SEQ ID NO: 2516653 - protein, 22 aa, Entamoeba dispar
TKAFEFAKGWFGTAVASMTVKD

SEQ ID NO: 2516654 - protein, 20 aa, Entamoeba dispar
TKALPFLQIRSINFGNGDVF

SEQ ID NO: 2516655 - protein, 22 aa, Entamoeba dispar
TKCFRCCCCAKILEGNKLANCE

SEQ ID NO: 2516656 - protein, 19 aa, Entamoeba dispar
TKEGSGLIFTEWNNKPSYT

SEQ ID NO: 2516657 - protein, 17 aa, Entamoeba dispar
TKFTCCHFFNGRTKKYE

SEQ ID NO: 2516658 - protein, 18 aa, Entamoeba dispar
TKGGFSYGYVDSMKQENR

SEQ ID NO: 2516659 - protein, 17 aa, Entamoeba dispar
TKHPFVFVCPATRISMC

SEQ ID NO: 2516660 - protein, 23 aa, Entamoeba dispar
TKIGEKMIKEWIRQPLIDKDKIN

SEQ ID NO: 2516661 - protein, 26 aa, Entamoeba dispar
TKKSKGCGFVKFVYRDDAVSCYNYHK

SEQ ID NO: 2516662 - protein, 19 aa, Entamoeba dispar
TKLGIRFIVIRSLSDVPSE

SEQ ID NO: 2516663 - protein, 17 aa, Entamoeba dispar
TKLICCWVEKNTCNNLI

SEQ ID NO: 2516664 - protein, 24 aa, Entamoeba dispar
TKLVDCVHLLPSHFHQLLRFISVE

SEQ ID NO: 2516665 - protein, 18 aa, Entamoeba dispar
TKPSFGMLMRFTHNTKTS

SEQ ID NO: 2516666 - protein, 20 aa, Entamoeba dispar
TKQFLWKWFNEQFIKKVNQT

SEQ ID NO: 2516667 - protein, 18 aa, Entamoeba dispar
TKSILSFKSPLKLRKLLL

SEQ ID NO: 2516668 - protein, 18 aa, Entamoeba dispar
TKSYLKKELELIKANISY

SEQ ID NO: 2516669 - protein, 18 aa, Entamoeba dispar
TKVIYHWQGKKSNRMEKG

SEQ ID NO: 2516670 - protein, 23 aa, Entamoeba dispar
TKWKEIFEKFVLKEYVPTVLIPN

SEQ ID NO: 2516671 - protein, 22 aa, Entamoeba dispar
TLDEFARRLTVRKVDTDAKEEK

SEQ ID NO: 2516672 - protein, 24 aa, Entamoeba dispar
TLENLRFWPSILLHVVIKNIGEKK

SEQ ID NO: 2516673 - protein, 18 aa, Entamoeba dispar
TLERLIEIYFRFKDVKHW

SEQ ID NO: 2516674 - protein, 17 aa, Entamoeba dispar
TLFPRLSNEIIYKLLSN

SEQ ID NO: 2516675 - protein, 21 aa, Entamoeba dispar
TLFRKEYKGVFATSLEEEGEY

SEQ ID NO: 2516676 - protein, 19 aa, Entamoeba dispar
TLIKRRVVIALKYFCSDAL

SEQ ID NO: 2516677 - protein, 19 aa, Entamoeba dispar
TLIPFSFRNGGSFFIIIGG

SEQ ID NO: 2516678 - protein, 17 aa, Entamoeba dispar
TLIPRFYGMFRIKPQKD

SEQ ID NO: 2516679 - protein, 23 aa, Entamoeba dispar
TLMNFKVCFIKSISLQVSTDNGS

SEQ ID NO: 2516680 - protein, 19 aa, Entamoeba dispar
TLNCFDCSSLEYINNLPNL

SEQ ID NO: 2516681 - protein, 18 aa, Entamoeba dispar
TLRLPIKQAKVFEQILVV

SEQ ID NO: 2516682 - protein, 24 aa, Entamoeba dispar
TLSCGHSFCLVCLRQIFKKDNICP

SEQ ID NO: 2516683 - protein, 19 aa, Entamoeba dispar
TLSSSWAFIIMWKGSDNEA

SEQ ID NO: 2516684 - protein, 24 aa, Entamoeba dispar
TLSSSWPFLIMWKGSDNEAYIQLQ

SEQ ID NO: 2516685 - protein, 21 aa, Entamoeba dispar
TLSSSWPFLIMWKGSDSEAYI

SEQ ID NO: 2516686 - protein, 19 aa, Entamoeba dispar
TLWGKEVWMKTSVLRDDGI

SEQ ID NO: 2516687 - protein, 23 aa, Entamoeba dispar
TLYLRWLQIQTFFPLFRGNGEIN

SEQ ID NO: 2516688 - protein, 23 aa, Entamoeba dispar
TMEKEDFLSIGFEMMKMNVVMDD

SEQ ID NO: 2516689 - protein, 18 aa, Entamoeba dispar
TMFVKRSLLASGLSEEEA

SEQ ID NO: 2516690 - protein, 18 aa, Entamoeba dispar
TMKGCLGLVFGNESNGLN

SEQ ID NO: 2516691 - protein, 23 aa, Entamoeba dispar
TMMCCLCQQLVPFLGYFELPYSL

SEQ ID NO: 2516692 - protein, 17 aa, Entamoeba dispar
TMTCLKKSIVIAGVDKD

SEQ ID NO: 2516693 - protein, 20 aa, Entamoeba dispar
TMYRVKWPGTFELFISEEPD

SEQ ID NO: 2516694 - protein, 17 aa, Entamoeba dispar
TNAVDWWGLGILIYEML

SEQ ID NO: 2516695 - protein, 18 aa, Entamoeba dispar
TNCGAPIQGSYMIKNGKI

SEQ ID NO: 2516696 - protein, 18 aa, Entamoeba dispar
TNCGPIRFEVWDTAGQEK

SEQ ID NO: 2516697 - protein, 18 aa, Entamoeba dispar
TNCLYYSFINEFKNLLTE

SEQ ID NO: 2516698 - protein, 20 aa, Entamoeba dispar
TNFAGLLWRPQPTNIIKPEM

SEQ ID NO: 2516699 - protein, 19 aa, Entamoeba dispar
TNFNSFCKCFKRVKIDKAL

SEQ ID NO: 2516700 - protein, 24 aa, Entamoeba dispar
TNGIEFRKRFAFIDYMMFEYCKNI

SEQ ID NO: 2516701 - protein, 17 aa, Entamoeba dispar
TNGRTASISGLWISILL

SEQ ID NO: 2516702 - protein, 18 aa, Entamoeba dispar
TNICLISSFELFIIDSTN

SEQ ID NO: 2516703 - protein, 17 aa, Entamoeba dispar
TNICPHLSLAKITSILE

SEQ ID NO: 2516704 - protein, 24 aa, Entamoeba dispar
TNIISLRCPLSFCPITTPIKGVLC

SEQ ID NO: 2516705 - protein, 17 aa, Entamoeba dispar
TNIWNCPFCLMKSYYYD

SEQ ID NO: 2516706 - protein, 20 aa, Entamoeba dispar
TNKQGYEWYRFMSKTSPVLT

SEQ ID NO: 2516707 - protein, 23 aa, Entamoeba dispar
TNLFCTRILYLIICITPVQYRLH

SEQ ID NO: 2516708 - protein, 18 aa, Entamoeba dispar
TNLFTIFGCYQIGQFECS

SEQ ID NO: 2516709 - protein, 18 aa, Entamoeba dispar
TNLSICWTPVLFDMTTFL

SEQ ID NO: 2516710 - protein, 17 aa, Entamoeba dispar
TNMISSFRFLRLDDLDK

SEQ ID NO: 2516711 - protein, 19 aa, Entamoeba dispar
TNMRERARFIPLRITQPER

SEQ ID NO: 2516712 - protein, 23 aa, Entamoeba dispar
TNQLDCFKKFFVFDDGYSSLKEV

SEQ ID NO: 2516713 - protein, 25 aa, Entamoeba dispar
TNQPLSLKAQRYFNSVICDKFEPHY

SEQ ID NO: 2516714 - protein, 18 aa, Entamoeba dispar
TNSCKWCQESLLSVISEE

SEQ ID NO: 2516715 - protein, 21 aa, Entamoeba dispar
TNSRPCPSCGAFIEKNGGCQW

SEQ ID NO: 2516716 - protein, 18 aa, Entamoeba dispar
TPEGCKIREKMLYSATKA

SEQ ID NO: 2516717 - protein, 23 aa, Entamoeba dispar
TPENFFFFRMPKFTPFDGKLLDP

SEQ ID NO: 2516718 - protein, 22 aa, Entamoeba dispar
TPERLNLFFIDFYRSQAIQQLL

SEQ ID NO: 2516719 - protein, 18 aa, Entamoeba dispar
TPETFDFNSSIPKPQPAS

SEQ ID NO: 2516720 - protein, 19 aa, Entamoeba dispar
TPIDEKWGFAKPFFSNDEE

SEQ ID NO: 2516721 - protein, 21 aa, Entamoeba dispar
TPKCPTRFVFKNGYYSGTPDG

SEQ ID NO: 2516722 - protein, 19 aa, Entamoeba dispar
TPKIHPIYSYKTNLSYHTS

SEQ ID NO: 2516723 - protein, 17 aa, Entamoeba dispar
TPLELSMVIPMNDLKQQ

SEQ ID NO: 2516724 - protein, 24 aa, Entamoeba dispar
TPPVPVEIQILWKLENDDLVPAIM

SEQ ID NO: 2516725 - protein, 17 aa, Entamoeba dispar
TPRRAAVSLKELIAQQH

SEQ ID NO: 2516726 - protein, 21 aa, Entamoeba dispar
TPRSLFCSEIGFLSANLYATT

SEQ ID NO: 2516727 - protein, 23 aa, Entamoeba dispar
TPSLCKIGGLLLCVVGEDVAFSL

SEQ ID NO: 2516728 - protein, 24 aa, Entamoeba dispar
TPSLLFKYNVNFIFGNNPYLRNNP

SEQ ID NO: 2516729 - protein, 19 aa, Entamoeba dispar
TQCILWEFYQSISKIDPRI

SEQ ID NO: 2516730 - protein, 20 aa, Entamoeba dispar
TQCKCKRLFGKSLETYMKEN

SEQ ID NO: 2516731 - protein, 18 aa, Entamoeba dispar
TQCLSIWKGLENKNNQIV

SEQ ID NO: 2516732 - protein, 18 aa, Entamoeba dispar
TQHIPICLVGNKSDLESE

SEQ ID NO: 2516733 - protein, 18 aa, Entamoeba dispar
TQICCTDCEALLKDALIN

SEQ ID NO: 2516734 - protein, 17 aa, Entamoeba dispar
TQIVRYMVRSCGSEEAY

SEQ ID NO: 2516735 - protein, 25 aa, Entamoeba dispar
TQKEIRLPFCIKILEIFVEYLTDIE

SEQ ID NO: 2516736 - protein, 19 aa, Entamoeba dispar
TQLKRLAIYDGEFQHINNL

SEQ ID NO: 2516737 - protein, 24 aa, Entamoeba dispar
TQLKRLHVFGEIFAENGYLVRSDA

SEQ ID NO: 2516738 - protein, 17 aa, Entamoeba dispar
TQPRFSGLVAQPQQSTL

SEQ ID NO: 2516739 - protein, 24 aa, Entamoeba dispar
TQRPKGCGFVKFMTHEDAKLCVEE

SEQ ID NO: 2516740 - protein, 23 aa, Entamoeba dispar
TQSKRGRRAQSIDITSLVESQNQ

SEQ ID NO: 2516741 - protein, 18 aa, Entamoeba dispar
TRCFKRHGAVTIDTPVFE

SEQ ID NO: 2516742 - protein, 19 aa, Entamoeba dispar
TREAMALGIYGIVKIHIPK

SEQ ID NO: 2516743 - protein, 18 aa, Entamoeba dispar
TRGIPLRSIFCVKDLTKK

SEQ ID NO: 2516744 - protein, 20 aa, Entamoeba dispar
TRIFYLKKYEYFEISYKSNI

SEQ ID NO: 2516745 - protein, 17 aa, Entamoeba dispar
TRIPHKRVRSIGATGKS

SEQ ID NO: 2516746 - protein, 22 aa, Entamoeba dispar
TRKCGYKFCWLCCVKYTPEQWM

SEQ ID NO: 2516747 - protein, 19 aa, Entamoeba dispar
TRLKGINIYDGIKGEKERK

SEQ ID NO: 2516748 - protein, 17 aa, Entamoeba dispar
TRLPVSYSPVLYSDFPH

SEQ ID NO: 2516749 - protein, 17 aa, Entamoeba dispar
TRNGFTFNSPRETWKVS

SEQ ID NO: 2516750 - protein, 17 aa, Entamoeba dispar
TRPCHITTRLVRVSSLT

SEQ ID NO: 2516751 - protein, 19 aa, Entamoeba dispar
TRRLPVKLISKFVGTRTPV

SEQ ID NO: 2516752 - protein, 25 aa, Entamoeba dispar
TRSWTIKSGRMFLGDRWLRFDPPLG

SEQ ID NO: 2516753 - protein, 20 aa, Entamoeba dispar
TRYEILGGLLAFIRTMDREV

SEQ ID NO: 2516754 - protein, 20 aa, Entamoeba dispar
TSELKKSRCIGEMDQTVSSP

SEQ ID NO: 2516755 - protein, 19 aa, Entamoeba dispar
TSFGRGCFYGCGCEEELMK

SEQ ID NO: 2516756 - protein, 17 aa, Entamoeba dispar
TSFGRKCFKGCGCEEEL

SEQ ID NO: 2516757 - protein, 23 aa, Entamoeba dispar
TSFGRSCFYGCGCVEELTQNKRI

SEQ ID NO: 2516758 - protein, 17 aa, Entamoeba dispar
TSFNLKTAVSWLFVNII

SEQ ID NO: 2516759 - protein, 18 aa, Entamoeba dispar
TSGRRPRYIDPFTQEVHQ

SEQ ID NO: 2516760 - protein, 18 aa, Entamoeba dispar
TSISFIRDLLCFFEGKNK

SEQ ID NO: 2516761 - protein, 25 aa, Entamoeba dispar
TSISKLGNWCFSRCYSLISLHLPTT

SEQ ID NO: 2516762 - protein, 26 aa, Entamoeba dispar
TSLKILLRFQECQSFFKKTLENPNVR

SEQ ID NO: 2516763 - protein, 25 aa, Entamoeba dispar
TSLQPCFPRYLSLLFPNDLPTTFWQ

SEQ ID NO: 2516764 - protein, 19 aa, Entamoeba dispar
TSLRLLLRMIKILQFIHKE

SEQ ID NO: 2516765 - protein, 17 aa, Entamoeba dispar
TSPIRLALFKQPDFLNN

SEQ ID NO: 2516766 - protein, 21 aa, Entamoeba dispar
TSPRIAVCHEVSPTLGNVEEL

SEQ ID NO: 2516767 - protein, 19 aa, Entamoeba dispar
TSRDICKIYSLFAETIIST

SEQ ID NO: 2516768 - protein, 17 aa, Entamoeba dispar
TSRFCLINGPNMGGKST

SEQ ID NO: 2516769 - protein, 25 aa, Entamoeba dispar
TSWICLGGFIFLRYICPAIIRPLEW

SEQ ID NO: 2516770 - protein, 17 aa, Entamoeba dispar
TSYFPFSGVHGVFLVYR

SEQ ID NO: 2516771 - protein, 18 aa, Entamoeba dispar
TSYFPFSGVHGVFLVYRN

SEQ ID NO: 2516772 - protein, 19 aa, Entamoeba dispar
TTIRWRITFISGNTRLAPY

SEQ ID NO: 2516773 - protein, 24 aa, Entamoeba dispar
TTISKLGGWCFFGSTSLTSIDIPT

SEQ ID NO: 2516774 - protein, 17 aa, Entamoeba dispar
TTKENRLDCTFDISIIN

SEQ ID NO: 2516775 - protein, 18 aa, Entamoeba dispar
TTKNEIVESFSFLHWYIS

SEQ ID NO: 2516776 - protein, 25 aa, Entamoeba dispar
TTKNEIVESFSFLHWYISDGSSVLN

SEQ ID NO: 2516777 - protein, 26 aa, Entamoeba dispar
TTKNEIVESFSFLHWYISDGSSVLNE

SEQ ID NO: 2516778 - protein, 17 aa, Entamoeba dispar
TTLSILFQHEFELQVMI

SEQ ID NO: 2516779 - protein, 17 aa, Entamoeba dispar
TTPKRFSEFEAFHNLIK

SEQ ID NO: 2516780 - protein, 25 aa, Entamoeba dispar
TTQPQFGTTPSFGGFNTNQTSGTTN

SEQ ID NO: 2516781 - protein, 22 aa, Entamoeba dispar
TTQTGLFSYFFGKTDEYDEPPK

SEQ ID NO: 2516782 - protein, 18 aa, Entamoeba dispar
TTVCFSSCNCMMMGGMGN

SEQ ID NO: 2516783 - protein, 17 aa, Entamoeba dispar
TTWEICDSFSLRVLGPL

SEQ ID NO: 2516784 - protein, 33 aa, Entamoeba dispar
TVCDPEILSKIAWLFSNFCRFKPSIPEQQLEPF

SEQ ID NO: 2516785 - protein, 17 aa, Entamoeba dispar
TVCNIYLHEKKCIDKFR

SEQ ID NO: 2516786 - protein, 18 aa, Entamoeba dispar
TVCWALFFVVTRAAKQNP

SEQ ID NO: 2516787 - protein, 20 aa, Entamoeba dispar
TVDMVNEWACEKGTNQRKNI

SEQ ID NO: 2516788 - protein, 21 aa, Entamoeba dispar
TVEACGLFSAVFTVTVGDIAE

SEQ ID NO: 2516789 - protein, 27 aa, Entamoeba dispar
TVELIKKIPCFWGRIMNVADLNYNNLG

SEQ ID NO: 2516790 - protein, 23 aa, Entamoeba dispar
TVGCWGEKGIVCISKENKVTFFN

SEQ ID NO: 2516791 - protein, 19 aa, Entamoeba dispar
TVHFLRLPYFFNYLQIAAG

SEQ ID NO: 2516792 - protein, 17 aa, Entamoeba dispar
TVIEFPFTVKFKENPQN

SEQ ID NO: 2516793 - protein, 23 aa, Entamoeba dispar
TVIRDELHFIPARALKKDGERYY

SEQ ID NO: 2516794 - protein, 22 aa, Entamoeba dispar
TVIRDELHFVPARVLKKDGERY

SEQ ID NO: 2516795 - protein, 19 aa, Entamoeba dispar
TVKCLKRVIPMLNETDFRG

SEQ ID NO: 2516796 - protein, 24 aa, Entamoeba dispar
TVKYPRWFEFYDMIQVIETLHKKV

SEQ ID NO: 2516797 - protein, 18 aa, Entamoeba dispar
TVPLDFPSCFDFLQFTNY

SEQ ID NO: 2516798 - protein, 24 aa, Entamoeba dispar
TVSELGWKCFKWCSLKSINIPTTI

SEQ ID NO: 2516799 - protein, 20 aa, Entamoeba dispar
TVSLFTHWLPRFGIEVDLVD

SEQ ID NO: 2516800 - protein, 21 aa, Entamoeba dispar
TWDVLRLITAFAQSAADGNID

SEQ ID NO: 2516801 - protein, 20 aa, Entamoeba dispar
TWMHEIDGIFSLQQQKLISR

SEQ ID NO: 2516802 - protein, 17 aa, Entamoeba dispar
TYATLSFICVFDDNENE

SEQ ID NO: 2516803 - protein, 17 aa, Entamoeba dispar
TYLESWKAVELSNALFG

SEQ ID NO: 2516804 - protein, 18 aa, Entamoeba dispar
TYQLIKFILQICYISDIS

SEQ ID NO: 2516805 - protein, 20 aa, Entamoeba dispar
VAEGACKFCYSKETKADGSI

SEQ ID NO: 2516806 - protein, 17 aa, Entamoeba dispar
VAIAWGTEFGRLKKKVF

SEQ ID NO: 2516807 - protein, 19 aa, Entamoeba dispar
VAIDISEIIIRCMKKKEDV

SEQ ID NO: 2516808 - protein, 17 aa, Entamoeba dispar
VAKGRFHLFTAKGELKD

SEQ ID NO: 2516809 - protein, 19 aa, Entamoeba dispar
VALECYNRLKIAYEKRKLE

SEQ ID NO: 2516810 - protein, 18 aa, Entamoeba dispar
VALNPKWCRCLLSTKDSG

SEQ ID NO: 2516811 - protein, 23 aa, Entamoeba dispar
VALQLKLALAIDELERSAQVIDN

SEQ ID NO: 2516812 - protein, 26 aa, Entamoeba dispar
VAPAIHCGRLYFKPSGDCAFNITINY

SEQ ID NO: 2516813 - protein, 22 aa, Entamoeba dispar
VAPKKIMYCLSIFIESTKHLTS

SEQ ID NO: 2516814 - protein, 20 aa, Entamoeba dispar
VARYWPMFPRTFGLFKKLFE

SEQ ID NO: 2516815 - protein, 17 aa, Entamoeba dispar
VAVPKWIELQLMSPTDS

SEQ ID NO: 2516816 - protein, 17 aa, Entamoeba dispar
VAWTIICKYILKALANI

SEQ ID NO: 2516817 - protein, 19 aa, Entamoeba dispar
VCADLRGWVVGYVVTKFLY

SEQ ID NO: 2516818 - protein, 17 aa, Entamoeba dispar
VCDPSFFTSFRDACMAC

SEQ ID NO: 2516819 - protein, 20 aa, Entamoeba dispar
VCFNCGKPGHMSRECPEPRK

SEQ ID NO: 2516820 - protein, 18 aa, Entamoeba dispar
VCIFRPYRVDVIGYNSTF

SEQ ID NO: 2516821 - protein, 20 aa, Entamoeba dispar
VCLIWDIGMLMCLHVIEVGE

SEQ ID NO: 2516822 - protein, 17 aa, Entamoeba dispar
VCLVMYKQHQLAIELLL

SEQ ID NO: 2516823 - protein, 18 aa, Entamoeba dispar
VCNCVICTINENLDIFSF

SEQ ID NO: 2516824 - protein, 19 aa, Entamoeba dispar
VCNSVCFKLNLNGIDTFEA

SEQ ID NO: 2516825 - protein, 19 aa, Entamoeba dispar
VCSMVRPHISSVININDSK

SEQ ID NO: 2516826 - protein, 22 aa, Entamoeba dispar
VCSVCKAPFPRGQFYNLDGKPV

SEQ ID NO: 2516827 - protein, 19 aa, Entamoeba dispar
VCVGVCALFNLAIIPSIRT

SEQ ID NO: 2516828 - protein, 23 aa, Entamoeba dispar
VCWYSRITRSIGFIINGVQLGPA

SEQ ID NO: 2516829 - protein, 17 aa, Entamoeba dispar
VDCAIFVTSLAEYDMKL

SEQ ID NO: 2516830 - protein, 17 aa, Entamoeba dispar
VDCPLRQLYKILQYLGT

SEQ ID NO: 2516831 - protein, 17 aa, Entamoeba dispar
VDDACGWPAEPNNHLLK

SEQ ID NO: 2516832 - protein, 22 aa, Entamoeba dispar
VDDFWKHVCIVWTNCSYNKSEN

SEQ ID NO: 2516833 - protein, 19 aa, Entamoeba dispar
VDFILKCIKIIGNIPGIKL

SEQ ID NO: 2516834 - protein, 22 aa, Entamoeba dispar
VDGFRISVDFARREEARDKTPG

SEQ ID NO: 2516835 - protein, 17 aa, Entamoeba dispar
VDIIKSRMNKLMINEQQ

SEQ ID NO: 2516836 - protein, 17 aa, Entamoeba dispar
VDIPIHHYFTGYQEEIE

SEQ ID NO: 2516837 - protein, 17 aa, Entamoeba dispar
VDIWSLGIMCMEMADGN

SEQ ID NO: 2516838 - protein, 18 aa, Entamoeba dispar
VDLASLCYFFIFLQPKYV

SEQ ID NO: 2516839 - protein, 22 aa, Entamoeba dispar
VDLGTACGRYFSVSVLSIIDGG

SEQ ID NO: 2516840 - protein, 22 aa, Entamoeba dispar
VDLGTACGRYFTVSVLSIIDGG

SEQ ID NO: 2516841 - protein, 19 aa, Entamoeba dispar
VDLKCSGLGRFKIVHKGLL

SEQ ID NO: 2516842 - protein, 17 aa, Entamoeba dispar
VDLLKCSILKRPWVNPF

SEQ ID NO: 2516843 - protein, 24 aa, Entamoeba dispar
VDLMKYNGGYSWWKRNSLTVFIDK

SEQ ID NO: 2516844 - protein, 17 aa, Entamoeba dispar
VDLPFRIVIIGAGGCTL

SEQ ID NO: 2516845 - protein, 18 aa, Entamoeba dispar
VDLPICFVIGVAKHPRTH

SEQ ID NO: 2516846 - protein, 17 aa, Entamoeba dispar
VDPEIIKTALIDCNYDK

SEQ ID NO: 2516847 - protein, 18 aa, Entamoeba dispar
VDRIKIFLTKTLNGKANL

SEQ ID NO: 2516848 - protein, 17 aa, Entamoeba dispar
VDSGFCYLSCPDCKKKI

SEQ ID NO: 2516849 - protein, 25 aa, Entamoeba dispar
VDSWGVAGVLCYLFGTPITKKSMVA

SEQ ID NO: 2516850 - protein, 18 aa, Entamoeba dispar
VDYILPRQKWEFFRDFSD

SEQ ID NO: 2516851 - protein, 17 aa, Entamoeba dispar
VEAFNHFLWCQSSESVS

SEQ ID NO: 2516852 - protein, 17 aa, Entamoeba dispar
VEARWNPNCYGFIASVA

SEQ ID NO: 2516853 - protein, 27 aa, Entamoeba dispar
VEENNRYLLLNGICVALKMGNPDYERT

SEQ ID NO: 2516854 - protein, 17 aa, Entamoeba dispar
VEFWKIMTFITMQYIQI

SEQ ID NO: 2516855 - protein, 18 aa, Entamoeba dispar
VEGIKFLPFELVTKNEEM

SEQ ID NO: 2516856 - protein, 29 aa, Entamoeba dispar
VEGKMIRKIMKWMLKCLICQEQIFDMTKM

SEQ ID NO: 2516857 - protein, 18 aa, Entamoeba dispar
VEIIKCINILSSIALNDK

SEQ ID NO: 2516858 - protein, 17 aa, Entamoeba dispar
VEITWKYQVQQENLIIR

SEQ ID NO: 2516859 - protein, 23 aa, Entamoeba dispar
VEKRVGVDILRLFSEYDFFRNDQ

SEQ ID NO: 2516860 - protein, 20 aa, Entamoeba dispar
VELEYCIKYPLKILQIDQQH

SEQ ID NO: 2516861 - protein, 19 aa, Entamoeba dispar
VELIREIIEEVKIRGKSTR

SEQ ID NO: 2516862 - protein, 17 aa, Entamoeba dispar
VELPFPLKKTHHLLFTI

SEQ ID NO: 2516863 - protein, 23 aa, Entamoeba dispar
VELVIPFERFTVVDWVDIEGSPA

SEQ ID NO: 2516864 - protein, 17 aa, Entamoeba dispar
VEMKFKYGIIQKELTDE

SEQ ID NO: 2516865 - protein, 18 aa, Entamoeba dispar
VEMTDWFPLIGNGTDSLG

SEQ ID NO: 2516866 - protein, 18 aa, Entamoeba dispar
VEQCCKYNGKHIIFLAGN

SEQ ID NO: 2516867 - protein, 21 aa, Entamoeba dispar
VERKSRILFVRNISFNANEES

SEQ ID NO: 2516868 - protein, 18 aa, Entamoeba dispar
VESIRFILERLIPFNQQL

SEQ ID NO: 2516869 - protein, 17 aa, Entamoeba dispar
VETYSFMRWSISDGTHN

SEQ ID NO: 2516870 - protein, 17 aa, Entamoeba dispar
VEVFPGKGLNVIIGPNG

SEQ ID NO: 2516871 - protein, 18 aa, Entamoeba dispar
VEYFCFKYNKSLLNDFKY

SEQ ID NO: 2516872 - protein, 18 aa, Entamoeba dispar
VFDCIYCGGLIYPDENEW

SEQ ID NO: 2516873 - protein, 17 aa, Entamoeba dispar
VFDIFAFEGTDYITTVS

SEQ ID NO: 2516874 - protein, 18 aa, Entamoeba dispar
VFECWDWDRMNSDDLLGT

SEQ ID NO: 2516875 - protein, 23 aa, Entamoeba dispar
VFEFAVKGLEIFGMKEHLDFDVI

SEQ ID NO: 2516876 - protein, 22 aa, Entamoeba dispar
VFFEFCKAKEAILITTDIAARG

SEQ ID NO: 2516877 - protein, 22 aa, Entamoeba dispar
VFKKRIMQLYSRLIRRYPRMLS

SEQ ID NO: 2516878 - protein, 24 aa, Entamoeba dispar
VFKRWKKRYCVLASNVIALFENAK

SEQ ID NO: 2516879 - protein, 17 aa, Entamoeba dispar
VFLKGWIPVKINKFYNP

SEQ ID NO: 2516880 - protein, 18 aa, Entamoeba dispar
VFLQTLLNAFGFVPSEKG

SEQ ID NO: 2516881 - protein, 17 aa, Entamoeba dispar
VFMLYFIRKFMEYTPSD

SEQ ID NO: 2516882 - protein, 17 aa, Entamoeba dispar
VFRELFYNYTLSPLITN

SEQ ID NO: 2516883 - protein, 20 aa, Entamoeba dispar
VFSKEIPLNFLLEVHDKIVA

SEQ ID NO: 2516884 - protein, 17 aa, Entamoeba dispar
VFVVKCVIFNVSIPLTK

SEQ ID NO: 2516885 - protein, 19 aa, Entamoeba dispar
VFWFFKDLMEIMGDWFKGG

SEQ ID NO: 2516886 - protein, 17 aa, Entamoeba dispar
VGCDLAHIFCHQDAAMA

SEQ ID NO: 2516887 - protein, 25 aa, Entamoeba dispar
VGKAKEIPKIFGICKDYVLLADEDG

SEQ ID NO: 2516888 - protein, 17 aa, Entamoeba dispar
VGKTAIETINFRKLEEK

SEQ ID NO: 2516889 - protein, 25 aa, Entamoeba dispar
VGMLHFLTYYYGMDWHKVANAPQGD

SEQ ID NO: 2516890 - protein, 19 aa, Entamoeba dispar
VHGCKRILFKFNKFDETVE

SEQ ID NO: 2516891 - protein, 17 aa, Entamoeba dispar
VHICEYGTISLRTLNII

SEQ ID NO: 2516892 - protein, 17 aa, Entamoeba dispar
VHLPRKSSTILIEKGKT

SEQ ID NO: 2516893 - protein, 19 aa, Entamoeba dispar
VIDFGSACFDNYTLYTYVQ

SEQ ID NO: 2516894 - protein, 21 aa, Entamoeba dispar
VIDGYNCTFFAYGQTGTGKTY

SEQ ID NO: 2516895 - protein, 18 aa, Entamoeba dispar
VIDWKIQMDLMINKQLSK

SEQ ID NO: 2516896 - protein, 19 aa, Entamoeba dispar
VIEGCKWYQFLHSILVGAV

SEQ ID NO: 2516897 - protein, 20 aa, Entamoeba dispar
VIFKIICFICSFITEKEEIQ

SEQ ID NO: 2516898 - protein, 20 aa, Entamoeba dispar
VIGCDCCFYIRSNCPCHVPS

SEQ ID NO: 2516899 - protein, 20 aa, Entamoeba dispar
VIKQKRNWGMLVFQLHQQHR

SEQ ID NO: 2516900 - protein, 19 aa, Entamoeba dispar
VILPIKFPQLFTDKRKPWT

SEQ ID NO: 2516901 - protein, 19 aa, Entamoeba dispar
VIPEIIIKVVMLYDENLDN

SEQ ID NO: 2516902 - protein, 19 aa, Entamoeba dispar
VIPKYCFKGCTSLQRIQLP

SEQ ID NO: 2516903 - protein, 17 aa, Entamoeba dispar
VIQCLSCVISLLKAEPT

SEQ ID NO: 2516904 - protein, 24 aa, Entamoeba dispar
VIRCSSCKEILEGVCDCILQLISP

SEQ ID NO: 2516905 - protein, 26 aa, Entamoeba dispar
VIREILYRNGLKIALSRRDENTLEPL

SEQ ID NO: 2516906 - protein, 17 aa, Entamoeba dispar
VISALKINPWFTSERDI

SEQ ID NO: 2516907 - protein, 32 aa, Entamoeba dispar
VITESLCAISFIALKMKLDFAQYYPEVLQVLK

SEQ ID NO: 2516908 - protein, 17 aa, Entamoeba dispar
VIVLYCYNSAPLLNKEM

SEQ ID NO: 2516909 - protein, 19 aa, Entamoeba dispar
VIVPFIFCENLEIVAKSQI

SEQ ID NO: 2516910 - protein, 24 aa, Entamoeba dispar
VIWPMLRPDIFTGLRAPPKGLLLF

SEQ ID NO: 2516911 - protein, 21 aa, Entamoeba dispar
VKAPMILKCFLTFAERLNIDD

SEQ ID NO: 2516912 - protein, 24 aa, Entamoeba dispar
VKEDFKVMIPFLMKFKTTKTEVIK

SEQ ID NO: 2516913 - protein, 18 aa, Entamoeba dispar
VKFIQSIIPFKAIERKER

SEQ ID NO: 2516914 - protein, 18 aa, Entamoeba dispar
VKGKESWAIKSIFLGKKC

SEQ ID NO: 2516915 - protein, 17 aa, Entamoeba dispar
VKGKPSWSIKSIFLGKK

SEQ ID NO: 2516916 - protein, 17 aa, Entamoeba dispar
VKGLKNVLCIKVTQIGS

SEQ ID NO: 2516917 - protein, 18 aa, Entamoeba dispar
VKIHFYQRIQIIIISSIV

SEQ ID NO: 2516918 - protein, 22 aa, Entamoeba dispar
VKKKKIIICWKLTKEVKERNEY

SEQ ID NO: 2516919 - protein, 25 aa, Entamoeba dispar
VKKSGWRFPLPIYRCLEYLEKNDGL

SEQ ID NO: 2516920 - protein, 20 aa, Entamoeba dispar
VKLLGNLGCGFDCASLNEIK

SEQ ID NO: 2516921 - protein, 20 aa, Entamoeba dispar
VKMCKDFKAILTLLDGIFTF

SEQ ID NO: 2516922 - protein, 20 aa, Entamoeba dispar
VKMKCFYCVVNSFIRYKNNE

SEQ ID NO: 2516923 - protein, 23 aa, Entamoeba dispar
VKMSLPLAMFLSGISFDVYAENE

SEQ ID NO: 2516924 - protein, 17 aa, Entamoeba dispar
VKPTVLVLFPFKTPAII

SEQ ID NO: 2516925 - protein, 20 aa, Entamoeba dispar
VKRKRISTFNGIRQEEIYEI

SEQ ID NO: 2516926 - protein, 19 aa, Entamoeba dispar
VKSKCPINKLIIVESKEVN

SEQ ID NO: 2516927 - protein, 20 aa, Entamoeba dispar
VKSLGYKCFKECSSLQSINI

SEQ ID NO: 2516928 - protein, 20 aa, Entamoeba dispar
VKVEGFWPIVMAKALANADI

SEQ ID NO: 2516929 - protein, 24 aa, Entamoeba dispar
VKWLWEILHSYSIELKKKFLFFST

SEQ ID NO: 2516930 - protein, 21 aa, Entamoeba dispar
VKWYFPIGIIFDALHNGSLPM

SEQ ID NO: 2516931 - protein, 19 aa, Entamoeba dispar
VKYKLVLQIVQQFYKEGKS

SEQ ID NO: 2516932 - protein, 20 aa, Entamoeba dispar
VKYSLLFEYNMYLAYYCWIK

SEQ ID NO: 2516933 - protein, 18 aa, Entamoeba dispar
VKYSYLFCIIHHYQDALT

SEQ ID NO: 2516934 - protein, 24 aa, Entamoeba dispar
VKYYLKCRFPLLFGVSLIDGERLI

SEQ ID NO: 2516935 - protein, 18 aa, Entamoeba dispar
VLAICYFDGLNVQLNMDS

SEQ ID NO: 2516936 - protein, 23 aa, Entamoeba dispar
VLALLKRRGYTFCEKKTRPCHIT

SEQ ID NO: 2516937 - protein, 19 aa, Entamoeba dispar
VLCGGDWFIGLFVRQLSCV

SEQ ID NO: 2516938 - protein, 17 aa, Entamoeba dispar
VLDLIEFWLSQCPNGFC

SEQ ID NO: 2516939 - protein, 17 aa, Entamoeba dispar
VLEGIRITRMGYPNRMI

SEQ ID NO: 2516940 - protein, 18 aa, Entamoeba dispar
VLEYPNDLLIALKALFNS

SEQ ID NO: 2516941 - protein, 18 aa, Entamoeba dispar
VLFDHVRMSYNIFRKTER

SEQ ID NO: 2516942 - protein, 22 aa, Entamoeba dispar
VLFKIICFICSFITENEQIQKM

SEQ ID NO: 2516943 - protein, 17 aa, Entamoeba dispar
VLFNFAFESLTSDEEER

SEQ ID NO: 2516944 - protein, 18 aa, Entamoeba dispar
VLGTIGIDIFKQGYAKVL

SEQ ID NO: 2516945 - protein, 18 aa, Entamoeba dispar
VLHPELFKQYGQPPSRGV

SEQ ID NO: 2516946 - protein, 17 aa, Entamoeba dispar
VLKTCSITKSFKLYYDI

SEQ ID NO: 2516947 - protein, 18 aa, Entamoeba dispar
VLLELGCKYIAEMIKGKS

SEQ ID NO: 2516948 - protein, 18 aa, Entamoeba dispar
VLLIVFKTKIEFIDIASL

SEQ ID NO: 2516949 - protein, 18 aa, Entamoeba dispar
VLLNFVVCNMLFNWNLPS

SEQ ID NO: 2516950 - protein, 19 aa, Entamoeba dispar
VLNLEQWKGIILKYENEKW

SEQ ID NO: 2516951 - protein, 25 aa, Entamoeba dispar
VLNVKRILSLMAMLVTLMRELNGIY

SEQ ID NO: 2516952 - protein, 17 aa, Entamoeba dispar
VLQPKFVKLLLAISLVR

SEQ ID NO: 2516953 - protein, 24 aa, Entamoeba dispar
VLQVCVRKSLKMRGQAFVIYDTKE

SEQ ID NO: 2516954 - protein, 19 aa, Entamoeba dispar
VLRINCQLIEIADGCERCR

SEQ ID NO: 2516955 - protein, 18 aa, Entamoeba dispar
VLRKEYLKADGFEKNFIA

SEQ ID NO: 2516956 - protein, 17 aa, Entamoeba dispar
VLSCIEILIECFKSINE

SEQ ID NO: 2516957 - protein, 18 aa, Entamoeba dispar
VLVLFPFKTPAIIFIKTL

SEQ ID NO: 2516958 - protein, 17 aa, Entamoeba dispar
VLWPCVHFLLSVFQDKT

SEQ ID NO: 2516959 - protein, 17 aa, Entamoeba dispar
VLYCYYSTYPLSCSASV

SEQ ID NO: 2516960 - protein, 17 aa, Entamoeba dispar
VLYSQGCLFRFIEKNDL

SEQ ID NO: 2516961 - protein, 17 aa, Entamoeba dispar
VLYWKNKIFHLIFNLEK

SEQ ID NO: 2516962 - protein, 17 aa, Entamoeba dispar
VMAQFLIDNNFNILFTL

SEQ ID NO: 2516963 - protein, 18 aa, Entamoeba dispar
VMEEIRLLKKLKHKHIVR

SEQ ID NO: 2516964 - protein, 21 aa, Entamoeba dispar
VMGFIRSWVNWRFSDFDDIDM

SEQ ID NO: 2516965 - protein, 18 aa, Entamoeba dispar
VMIESCIQSKFGVIGASI

SEQ ID NO: 2516966 - protein, 24 aa, Entamoeba dispar
VMKLCGWIIGRACLVLPSLYLGLM

SEQ ID NO: 2516967 - protein, 20 aa, Entamoeba dispar
VMNCKSQVIGLILFTDTRKN

SEQ ID NO: 2516968 - protein, 19 aa, Entamoeba dispar
VMVGGKPIIQWQIEVLEKL

SEQ ID NO: 2516969 - protein, 17 aa, Entamoeba dispar
VMVSRLFQDLSIKVGPR

SEQ ID NO: 2516970 - protein, 17 aa, Entamoeba dispar
VNCFDFFETVQLIYSSV

SEQ ID NO: 2516971 - protein, 17 aa, Entamoeba dispar
VNCGKKAAFSLRISTEE

SEQ ID NO: 2516972 - protein, 23 aa, Entamoeba dispar
VNEICMLCLPLIESVQGKLQLID

SEQ ID NO: 2516973 - protein, 18 aa, Entamoeba dispar
VNFAKRLPIGNVKKYPPG

SEQ ID NO: 2516974 - protein, 19 aa, Entamoeba dispar
VNGKESWAIKSIFLGKKSY

SEQ ID NO: 2516975 - protein, 19 aa, Entamoeba dispar
VNIDCEFNETIILNCQIVQ

SEQ ID NO: 2516976 - protein, 18 aa, Entamoeba dispar
VNKRWGWKEIETSPFMYE

SEQ ID NO: 2516977 - protein, 18 aa, Entamoeba dispar
VNLMKRCLVNTGINKQDI

SEQ ID NO: 2516978 - protein, 17 aa, Entamoeba dispar
VNLVWQLTVAMQKYCEL

SEQ ID NO: 2516979 - protein, 22 aa, Entamoeba dispar
VNNFPGAMPVNFGRTSFDIIQK

SEQ ID NO: 2516980 - protein, 25 aa, Entamoeba dispar
VNTECPRCKQSICAECFSSSVKEHS

SEQ ID NO: 2516981 - protein, 17 aa, Entamoeba dispar
VNTPIDEKWGFAKPFFS

SEQ ID NO: 2516982 - protein, 19 aa, Entamoeba dispar
VNYKGCLVIGYPDTETSEL

SEQ ID NO: 2516983 - protein, 23 aa, Entamoeba dispar
VNYLFCYRWIVLLFKRDFNSRDC

SEQ ID NO: 2516984 - protein, 21 aa, Entamoeba dispar
VPDIIGALILSMSKRIMNELI

SEQ ID NO: 2516985 - protein, 20 aa, Entamoeba dispar
VPFSRLLSFFSFIRLKQPII

SEQ ID NO: 2516986 - protein, 18 aa, Entamoeba dispar
VPHWSSDMIYQFKENINK

SEQ ID NO: 2516987 - protein, 21 aa, Entamoeba dispar
VPICLKELFKYSDYITHHLNY

SEQ ID NO: 2516988 - protein, 21 aa, Entamoeba dispar
VPILYCVKDVFDIKKPEEVCS

SEQ ID NO: 2516989 - protein, 22 aa, Entamoeba dispar
VPIPCASHLILLHLLEGKKEEM

SEQ ID NO: 2516990 - protein, 19 aa, Entamoeba dispar
VPKAIKIVIHFDISYFQLL

SEQ ID NO: 2516991 - protein, 17 aa, Entamoeba dispar
VPKECYFYLTGHFQFEV

SEQ ID NO: 2516992 - protein, 18 aa, Entamoeba dispar
VPKVYGWVDVELIHKKNI

SEQ ID NO: 2516993 - protein, 22 aa, Entamoeba dispar
VPLKLRCGMYLPMEEMKKYGNK

SEQ ID NO: 2516994 - protein, 19 aa, Entamoeba dispar
VPLVFGIGIMFVVEKEDKE

SEQ ID NO: 2516995 - protein, 23 aa, Entamoeba dispar
VPNLSRRAIEHFDIDLTRNNPNG

SEQ ID NO: 2516996 - protein, 36 aa, Entamoeba dispar
VPRTNSCLIRAFFYWSGCYFLRLNLMKKAEFMFRNC

SEQ ID NO: 2516997 - protein, 22 aa, Entamoeba dispar
VPVYINHLWRKCYGDESCKNYL

SEQ ID NO: 2516998 - protein, 18 aa, Entamoeba dispar
VPWCIDCWQRVYKETSEE

SEQ ID NO: 2516999 - protein, 21 aa, Entamoeba dispar
VQELGIFLGRYISQYLYKTYG

SEQ ID NO: 2517000 - protein, 17 aa, Entamoeba dispar
VQGFGFDGFVFVDGRSH

SEQ ID NO: 2517001 - protein, 17 aa, Entamoeba dispar
VQHSTIFLGGPLVKLHD

SEQ ID NO: 2517002 - protein, 18 aa, Entamoeba dispar
VQINEHFKKLIKYLPQFT

SEQ ID NO: 2517003 - protein, 24 aa, Entamoeba dispar
VQLKLLCHPLRIEFIEEFNKIFSK

SEQ ID NO: 2517004 - protein, 24 aa, Entamoeba dispar
VQRLPRYKLLLTDLIKHTDDGFVD

SEQ ID NO: 2517005 - protein, 18 aa, Entamoeba dispar
VQRLPRYVLLLESLLKAT

SEQ ID NO: 2517006 - protein, 25 aa, Entamoeba dispar
VQVACPRLSIDWGEDFRQVLITPYE

SEQ ID NO: 2517007 - protein, 18 aa, Entamoeba dispar
VRCAKYLYTYICADKAKA

SEQ ID NO: 2517008 - protein, 20 aa, Entamoeba dispar
VRIPSHFKRNGAFYIGTIQI

SEQ ID NO: 2517009 - protein, 22 aa, Entamoeba dispar
VRKTAVLCVLKLYCMEPNNIKE

SEQ ID NO: 2517010 - protein, 22 aa, Entamoeba dispar
VRLKKELAICNFYRNFLFMSRK

SEQ ID NO: 2517011 - protein, 21 aa, Entamoeba dispar
VRPECFISLILFEVLLDNEAV

SEQ ID NO: 2517012 - protein, 24 aa, Entamoeba dispar
VRRCHLTMPLCCSGGMLTKIANEY

SEQ ID NO: 2517013 - protein, 17 aa, Entamoeba dispar
VRSDFRTEFIFDCPELT

SEQ ID NO: 2517014 - protein, 18 aa, Entamoeba dispar
VRSKECIDINKSIHTSSV

SEQ ID NO: 2517015 - protein, 17 aa, Entamoeba dispar
VRVLLFYQLCSFCLKCF

SEQ ID NO: 2517016 - protein, 20 aa, Entamoeba dispar
VRVRPCFKTEVAERCCSVDE

SEQ ID NO: 2517017 - protein, 18 aa, Entamoeba dispar
VSALCLWNLVPSSNSWMN

SEQ ID NO: 2517018 - protein, 23 aa, Entamoeba dispar
VSAPHCWSFMLGSLTWLKDAGDV

SEQ ID NO: 2517019 - protein, 17 aa, Entamoeba dispar
VSCLLSFDSIEKCKEWS

SEQ ID NO: 2517020 - protein, 17 aa, Entamoeba dispar
VSDDGFLRCIIGNKADM

SEQ ID NO: 2517021 - protein, 25 aa, Entamoeba dispar
VSEEVGLKCGICWDTSSDVVSTACG

SEQ ID NO: 2517022 - protein, 22 aa, Entamoeba dispar
VSELGWKCFKWCSLKSINIPTT

SEQ ID NO: 2517023 - protein, 23 aa, Entamoeba dispar
VSELYLRWTPLFWNFLRNPNISF

SEQ ID NO: 2517024 - protein, 25 aa, Entamoeba dispar
VSICFKLIIKECLLIRQMLRTQLTK

SEQ ID NO: 2517025 - protein, 22 aa, Entamoeba dispar
VSIPLPSEWKSPILVNECSIDM

SEQ ID NO: 2517026 - protein, 24 aa, Entamoeba dispar
VSIREAICAWDWKMREQAGSDKYG

SEQ ID NO: 2517027 - protein, 24 aa, Entamoeba dispar
VSKSGWRYPIPIYRGIEYLQKNKG

SEQ ID NO: 2517028 - protein, 19 aa, Entamoeba dispar
VSLFTHWLPRFGIEVDLVD

SEQ ID NO: 2517029 - protein, 23 aa, Entamoeba dispar
VSLPFCGQFAMKLMACVRMIKEI

SEQ ID NO: 2517030 - protein, 17 aa, Entamoeba dispar
VSLRGLRKSTLDVIPIP

SEQ ID NO: 2517031 - protein, 17 aa, Entamoeba dispar
VSNALRIYSYCVASDSS

SEQ ID NO: 2517032 - protein, 18 aa, Entamoeba dispar
VSNALRIYSYCVASDSSD

SEQ ID NO: 2517033 - protein, 19 aa, Entamoeba dispar
VSRERLLSFMFKRKTNEKT

SEQ ID NO: 2517034 - protein, 17 aa, Entamoeba dispar
VSVAFNIIQYVFYSPET

SEQ ID NO: 2517035 - protein, 23 aa, Entamoeba dispar
VTCDICMRKCCVGCSIHTTIAPT

SEQ ID NO: 2517036 - protein, 17 aa, Entamoeba dispar
VTCPMCKKLFVVPTTLS

SEQ ID NO: 2517037 - protein, 22 aa, Entamoeba dispar
VTIWRPPQVLIFQLKRFEFTEK

SEQ ID NO: 2517038 - protein, 18 aa, Entamoeba dispar
VTKYGNVFGIFFHSVKIL

SEQ ID NO: 2517039 - protein, 17 aa, Entamoeba dispar
VTLKHLVDWKVFDKIKS

SEQ ID NO: 2517040 - protein, 17 aa, Entamoeba dispar
VTLKIKQIRAFKKHIRK

SEQ ID NO: 2517041 - protein, 22 aa, Entamoeba dispar
VTLPCELCIGSKLKTYIFIDNE

SEQ ID NO: 2517042 - protein, 20 aa, Entamoeba dispar
VTMYECFKWGEAYDREKFVY

SEQ ID NO: 2517043 - protein, 18 aa, Entamoeba dispar
VTPFKLKLFFYSKQTQEA

SEQ ID NO: 2517044 - protein, 17 aa, Entamoeba dispar
VTPPAFVFGDFGTNEKT

SEQ ID NO: 2517045 - protein, 17 aa, Entamoeba dispar
VTVEIFGKMAFKQITEQ

SEQ ID NO: 2517046 - protein, 19 aa, Entamoeba dispar
VVDPGCLKAGFEVVSMIYK

SEQ ID NO: 2517047 - protein, 17 aa, Entamoeba dispar
VVEQLLLYQAMLHKNNL

SEQ ID NO: 2517048 - protein, 18 aa, Entamoeba dispar
VVFETCIPKLITNEFDKI

SEQ ID NO: 2517049 - protein, 18 aa, Entamoeba dispar
VVKIKVLFMRDGVQAEEN

SEQ ID NO: 2517050 - protein, 19 aa, Entamoeba dispar
VVNCLQPFYDNGKIQDRDR

SEQ ID NO: 2517051 - protein, 18 aa, Entamoeba dispar
VVPVAGLFYAIGHSPNSK

SEQ ID NO: 2517052 - protein, 19 aa, Entamoeba dispar
VVQSGCLPLLFGLFDNTDD

SEQ ID NO: 2517053 - protein, 18 aa, Entamoeba dispar
VVQTEVFQSYGIQEGIIL

SEQ ID NO: 2517054 - protein, 21 aa, Entamoeba dispar
VVVKFYVPWCNICKSIQSKYE

SEQ ID NO: 2517055 - protein, 17 aa, Entamoeba dispar
VVVLRTGTSFACMYCNI

SEQ ID NO: 2517056 - protein, 22 aa, Entamoeba dispar
VWITCFRYLMNIIKHLYIDNKP

SEQ ID NO: 2517057 - protein, 22 aa, Entamoeba dispar
VWKVRHKSMRFISAAKIIKLNK

SEQ ID NO: 2517058 - protein, 17 aa, Entamoeba dispar
VWSCGVLMYTLAVGRNP

SEQ ID NO: 2517059 - protein, 19 aa, Entamoeba dispar
VYDCIGGICARIHSILDPY

SEQ ID NO: 2517060 - protein, 23 aa, Entamoeba dispar
VYFDRWKPIISICNKVGGNLKID

SEQ ID NO: 2517061 - protein, 23 aa, Entamoeba dispar
VYFERWKPIISICNKVGGNLKID

SEQ ID NO: 2517062 - protein, 19 aa, Entamoeba dispar
VYGHMRWYDDTNMLGIDII

SEQ ID NO: 2517063 - protein, 18 aa, Entamoeba dispar
VYKFLCSYLLKTNTHQSK

SEQ ID NO: 2517064 - protein, 19 aa, Entamoeba dispar
VYKSLYFCEILHFIKTNKD

SEQ ID NO: 2517065 - protein, 18 aa, Entamoeba dispar
VYPCLSRPELIPIYLSLI

SEQ ID NO: 2517066 - protein, 20 aa, Entamoeba dispar
VYRMDLKFRDFLMQKMINGE

SEQ ID NO: 2517067 - protein, 18 aa, Entamoeba dispar
VYSEPFAVYGINLPNQAG

SEQ ID NO: 2517068 - protein, 17 aa, Entamoeba dispar
VYSEPFIVYGVNLPNQS

SEQ ID NO: 2517069 - protein, 18 aa, Entamoeba dispar
WAALCWVSILAAESERAQ

SEQ ID NO: 2517070 - protein, 20 aa, Entamoeba dispar
WAEELGASCFAHWFQPLSQT

SEQ ID NO: 2517071 - protein, 19 aa, Entamoeba dispar
WAEELGAVCFAHWFQPLTS

SEQ ID NO: 2517072 - protein, 22 aa, Entamoeba dispar
WAEFEYCILFPFNVLKMKSIKI

SEQ ID NO: 2517073 - protein, 23 aa, Entamoeba dispar
WATKRSKLILCPYNFVTSVSIRH

SEQ ID NO: 2517074 - protein, 19 aa, Entamoeba dispar
WCFSGCKLLTSIELPTTIS

SEQ ID NO: 2517075 - protein, 17 aa, Entamoeba dispar
WCGENILGFTLMSIRDY

SEQ ID NO: 2517076 - protein, 23 aa, Entamoeba dispar
WDDDFPLKCCQLKFELPKFTPPN

SEQ ID NO: 2517077 - protein, 17 aa, Entamoeba dispar
WDIAGCVLRVYELLSQV

SEQ ID NO: 2517078 - protein, 19 aa, Entamoeba dispar
WDRRFTKGIKFFDLKAKYV

SEQ ID NO: 2517079 - protein, 20 aa, Entamoeba dispar
WDRRFTKGIKFFDLKANSLK

SEQ ID NO: 2517080 - protein, 17 aa, Entamoeba dispar
WDSEAKYYFQFCPCEKH

SEQ ID NO: 2517081 - protein, 18 aa, Entamoeba dispar
WDYLRQRMQAIAPNLSTL

SEQ ID NO: 2517082 - protein, 17 aa, Entamoeba dispar
WEICDSFSLRVLGPLIK

SEQ ID NO: 2517083 - protein, 20 aa, Entamoeba dispar
WEKLRAIAIYNVFEQYDVIN

SEQ ID NO: 2517084 - protein, 17 aa, Entamoeba dispar
WERHPYEALSIFCKNDQ

SEQ ID NO: 2517085 - protein, 18 aa, Entamoeba dispar
WFGCYDCWIQATPNGTST

SEQ ID NO: 2517086 - protein, 17 aa, Entamoeba dispar
WFREIVIKEINKKKNTN

SEQ ID NO: 2517087 - protein, 20 aa, Entamoeba dispar
WGNLKGEFRAVPGYDVSTPK

SEQ ID NO: 2517088 - protein, 22 aa, Entamoeba dispar
WGNLPRRRIDLMDENTLLTEVK

SEQ ID NO: 2517089 - protein, 17 aa, Entamoeba dispar
WHFKNFDGFALFQNGEK

SEQ ID NO: 2517090 - protein, 17 aa, Entamoeba dispar
WICSDCAIGCKKCPVCN

SEQ ID NO: 2517091 - protein, 26 aa, Entamoeba dispar
WIDCVWLIKIMETFKVIKFGYEEENN

SEQ ID NO: 2517092 - protein, 19 aa, Entamoeba dispar
WIIRPCHGFEEIYTCLNNM

SEQ ID NO: 2517093 - protein, 19 aa, Entamoeba dispar
WIKKIFIPHIHQIRKQKNY

SEQ ID NO: 2517094 - protein, 18 aa, Entamoeba dispar
WIYMHGIEVEGIFRISGN

SEQ ID NO: 2517095 - protein, 18 aa, Entamoeba dispar
WKAAISYFKAAFISEVKE

SEQ ID NO: 2517096 - protein, 20 aa, Entamoeba dispar
WKALIPRVDILYEFYEFSNQ

SEQ ID NO: 2517097 - protein, 17 aa, Entamoeba dispar
WKCELESPLKLTIEFTH

SEQ ID NO: 2517098 - protein, 18 aa, Entamoeba dispar
WKCVCIHQSIVFLMKLTE

SEQ ID NO: 2517099 - protein, 19 aa, Entamoeba dispar
WKDRVEVCVHSFSRLKPTS

SEQ ID NO: 2517100 - protein, 20 aa, Entamoeba dispar
WKEFSEAIVSLLMKGKCLSS

SEQ ID NO: 2517101 - protein, 20 aa, Entamoeba dispar
WKEFTEAIVSLLMKGKCLSS

SEQ ID NO: 2517102 - protein, 17 aa, Entamoeba dispar
WKELVFKPNIFEIINEC

SEQ ID NO: 2517103 - protein, 17 aa, Entamoeba dispar
WKGTPYYLAKEVVLENK

SEQ ID NO: 2517104 - protein, 23 aa, Entamoeba dispar
WKIKEVYALCDWKVLEIVNEKIQ

SEQ ID NO: 2517105 - protein, 24 aa, Entamoeba dispar
WKINLAICYDLRFPNWLRNSKEDP

SEQ ID NO: 2517106 - protein, 23 aa, Entamoeba dispar
WKIPYQLIDSFGFDGNNIVVALK

SEQ ID NO: 2517107 - protein, 23 aa, Entamoeba dispar
WKIPYQLIDSFGFEGNNIDIRLK

SEQ ID NO: 2517108 - protein, 22 aa, Entamoeba dispar
WKKDCFYTVLSISVARCIKAFE

SEQ ID NO: 2517109 - protein, 17 aa, Entamoeba dispar
WKKGDVISICVDFNQRT

SEQ ID NO: 2517110 - protein, 17 aa, Entamoeba dispar
WKKQLFQSLSFEDLNNF

SEQ ID NO: 2517111 - protein, 19 aa, Entamoeba dispar
WKKRWCVLTPTGMIFYFKD

SEQ ID NO: 2517112 - protein, 17 aa, Entamoeba dispar
WKKSFGVIKKTKKIVTP

SEQ ID NO: 2517113 - protein, 17 aa, Entamoeba dispar
WKLEILLILKVKNDTFD

SEQ ID NO: 2517114 - protein, 17 aa, Entamoeba dispar
WKLIFSVVGQCIEEEYQ

SEQ ID NO: 2517115 - protein, 17 aa, Entamoeba dispar
WKLLLKIICEKEKENNK

SEQ ID NO: 2517116 - protein, 17 aa, Entamoeba dispar
WKLLLNYSRSMFRVLNK

SEQ ID NO: 2517117 - protein, 17 aa, Entamoeba dispar
WKNGMVCQYRWGGENAF

SEQ ID NO: 2517118 - protein, 17 aa, Entamoeba dispar
WKNGTVCQYRWGGENAF

SEQ ID NO: 2517119 - protein, 17 aa, Entamoeba dispar
WKNLFRHALFFWLGKNA

SEQ ID NO: 2517120 - protein, 17 aa, Entamoeba dispar
WKRKTICTMERREKEKR

SEQ ID NO: 2517121 - protein, 22 aa, Entamoeba dispar
WKRRYCTKCWMPLTYSSFKTQR

SEQ ID NO: 2517122 - protein, 18 aa, Entamoeba dispar
WKSFYGLHCAKDFIEYIS

SEQ ID NO: 2517123 - protein, 20 aa, Entamoeba dispar
WKSKMCNIIEMFSKKKLDYK

SEQ ID NO: 2517124 - protein, 21 aa, Entamoeba dispar
WKSTYSINFSKFIQINNNQKS

SEQ ID NO: 2517125 - protein, 20 aa, Entamoeba dispar
WKVGEALVLEFVSSTKVAFS

SEQ ID NO: 2517126 - protein, 17 aa, Entamoeba dispar
WKWRYDRYDLIFYISQV

SEQ ID NO: 2517127 - protein, 19 aa, Entamoeba dispar
WKYMTHWTIDYGITTSENG

SEQ ID NO: 2517128 - protein, 18 aa, Entamoeba dispar
WLCKTVPNLSRRAIEHFD

SEQ ID NO: 2517129 - protein, 17 aa, Entamoeba dispar
WLIDKFGPDIKWKFDSM

SEQ ID NO: 2517130 - protein, 19 aa, Entamoeba dispar
WLIEFLIGSSLRKGSQEHA

SEQ ID NO: 2517131 - protein, 17 aa, Entamoeba dispar
WLIPYCVYRALIKSVDT

SEQ ID NO: 2517132 - protein, 20 aa, Entamoeba dispar
WLKQRFPKIIDDCQPSSQEK

SEQ ID NO: 2517133 - protein, 20 aa, Entamoeba dispar
WLRMKSRILFSFMSLGYFQE

SEQ ID NO: 2517134 - protein, 18 aa, Entamoeba dispar
WLVFNWCRGKGCILADEM

SEQ ID NO: 2517135 - protein, 19 aa, Entamoeba dispar
WLVYDGKEPFVFTNYFHGW

SEQ ID NO: 2517136 - protein, 23 aa, Entamoeba dispar
WMERTSGCTFGFGGKMGIFKGKE

SEQ ID NO: 2517137 - protein, 18 aa, Entamoeba dispar
WMIPLKSIHSFSVIANKI

SEQ ID NO: 2517138 - protein, 24 aa, Entamoeba dispar
WMSCYKCHCFFCWVCMQVTNNHQH

SEQ ID NO: 2517139 - protein, 19 aa, Entamoeba dispar
WMSSFPHDFMDGGKEALLP

SEQ ID NO: 2517140 - protein, 17 aa, Entamoeba dispar
WNCKSTCAIQLIQTVSP

SEQ ID NO: 2517141 - protein, 24 aa, Entamoeba dispar
WNDQKWRKLGMSDLCDFEGVQKWY

SEQ ID NO: 2517142 - protein, 17 aa, Entamoeba dispar
WNGKRIVIEFSEAQTSK

SEQ ID NO: 2517143 - protein, 27 aa, Entamoeba dispar
WNILLAVCYDLRFPVWLRNTLENHYDI

SEQ ID NO: 2517144 - protein, 19 aa, Entamoeba dispar
WNSLMNFEWNVYKLNLLRR

SEQ ID NO: 2517145 - protein, 17 aa, Entamoeba dispar
WNVEESIPWIIDNIRTF

SEQ ID NO: 2517146 - protein, 21 aa, Entamoeba dispar
WPACPTIKCISLPKEIEKGEE

SEQ ID NO: 2517147 - protein, 17 aa, Entamoeba dispar
WPKEWRGMYGYELKNII

SEQ ID NO: 2517148 - protein, 17 aa, Entamoeba dispar
WQDLMVISLLLLKMEQR

SEQ ID NO: 2517149 - protein, 20 aa, Entamoeba dispar
WQEIKILLNITMKYFPQILS

SEQ ID NO: 2517150 - protein, 20 aa, Entamoeba dispar
WQLGCVYIQMILRAPPFKGH

SEQ ID NO: 2517151 - protein, 19 aa, Entamoeba dispar
WQRVHVAKFNKCIVALEKQ

SEQ ID NO: 2517152 - protein, 17 aa, Entamoeba dispar
WQYIKYLFKMSYNALHY

SEQ ID NO: 2517153 - protein, 17 aa, Entamoeba dispar
WRLIPAFVKARGLVRQH

SEQ ID NO: 2517154 - protein, 17 aa, Entamoeba dispar
WRNCKSYLFDDFKDILS

SEQ ID NO: 2517155 - protein, 18 aa, Entamoeba dispar
WRQGLVLTNESFSLRNII

SEQ ID NO: 2517156 - protein, 18 aa, Entamoeba dispar
WRTLLAVIRMHLPPIEYF

SEQ ID NO: 2517157 - protein, 17 aa, Entamoeba dispar
WRVIGALFNDSFEVGID

SEQ ID NO: 2517158 - protein, 17 aa, Entamoeba dispar
WRVMFGYGVDVGRVKGK

SEQ ID NO: 2517159 - protein, 18 aa, Entamoeba dispar
WRVPLPIFRAMQYLEEHK

SEQ ID NO: 2517160 - protein, 17 aa, Entamoeba dispar
WSDDFDLFFQNKEGLLS

SEQ ID NO: 2517161 - protein, 20 aa, Entamoeba dispar
WSECPYCVNSSIPKDLSLGK

SEQ ID NO: 2517162 - protein, 22 aa, Entamoeba dispar
WSKCMGCGICATKCTFGVLVKQ

SEQ ID NO: 2517163 - protein, 22 aa, Entamoeba dispar
WSKCMGCGMCAMRCNYGVLHKS

SEQ ID NO: 2517164 - protein, 18 aa, Entamoeba dispar
WSKRMTLCAGICYGKNSG

SEQ ID NO: 2517165 - protein, 20 aa, Entamoeba dispar
WSLTCELSFLQSLYQYGNNM

SEQ ID NO: 2517166 - protein, 17 aa, Entamoeba dispar
WSPIISICNKVGGNLKI

SEQ ID NO: 2517167 - protein, 17 aa, Entamoeba dispar
WSYGCILAEMFLGKPLF

SEQ ID NO: 2517168 - protein, 18 aa, Entamoeba dispar
WSYSLLCGEIVLRREELK

SEQ ID NO: 2517169 - protein, 17 aa, Entamoeba dispar
WTLLNFINPENFPSLEN

SEQ ID NO: 2517170 - protein, 18 aa, Entamoeba dispar
WVFWDVCGQAKFRSLWKS

SEQ ID NO: 2517171 - protein, 17 aa, Entamoeba dispar
WVGGRYSLWSAIGLTIM

SEQ ID NO: 2517172 - protein, 23 aa, Entamoeba dispar
WVSDFYCSLGFVLTTYIDKIDSN

SEQ ID NO: 2517173 - protein, 17 aa, Entamoeba dispar
WVTFRNWAWWKLYVKAR

SEQ ID NO: 2517174 - protein, 19 aa, Entamoeba dispar
WWAGRLFFNEFEMLMKVLK

SEQ ID NO: 2517175 - protein, 21 aa, Entamoeba dispar
WWIVDHWYCFGSLQQFKTSPS

SEQ ID NO: 2517176 - protein, 17 aa, Entamoeba dispar
WYCIEWIIRDNLIQQLN

SEQ ID NO: 2517177 - protein, 17 aa, Entamoeba dispar
WYCKGRSVIEMNKDALC

SEQ ID NO: 2517178 - protein, 17 aa, Entamoeba dispar
WYCNIVIHILELNKVEP

SEQ ID NO: 2517179 - protein, 18 aa, Entamoeba dispar
WYDPRFPTIQGLIRRGLT

SEQ ID NO: 2517180 - protein, 17 aa, Entamoeba dispar
WYFKGCTSLTRIDIPTT

SEQ ID NO: 2517181 - protein, 17 aa, Entamoeba dispar
WYLEYICSFLIKIILEE

SEQ ID NO: 2517182 - protein, 24 aa, Entamoeba dispar
WYLSKDYDFCFSLRSLFSKEPLML

SEQ ID NO: 2517183 - protein, 17 aa, Entamoeba dispar
WYLSYLKRNCCENDVSL

SEQ ID NO: 2517184 - protein, 19 aa, Entamoeba dispar
WYVPLPLYRLIPFLEESNY

SEQ ID NO: 2517185 - protein, 17 aa, Entamoeba dispar
WYYPKLKGGTMMIITLY

SEQ ID NO: 2517186 - protein, 23 aa, Entamoeba dispar
YAIELKFIIKMICTAFVNDEIGI

SEQ ID NO: 2517187 - protein, 17 aa, Entamoeba dispar
YAKELFPDLGMKFIESR

SEQ ID NO: 2517188 - protein, 17 aa, Entamoeba dispar
YAPEFPGDYTVDIKLNG

SEQ ID NO: 2517189 - protein, 23 aa, Entamoeba dispar
YAWWKGRLSQMSQYFNAYRIDHI

SEQ ID NO: 2517190 - protein, 24 aa, Entamoeba dispar
YAYNFWICCLHFIGTPLISNNASV

SEQ ID NO: 2517191 - protein, 25 aa, Entamoeba dispar
YCFPLLIEIAMNWKLNIYDSIFQII

SEQ ID NO: 2517192 - protein, 27 aa, Entamoeba dispar
YCIDLSLPIQFCLPKVFKLTNMITDTI

SEQ ID NO: 2517193 - protein, 19 aa, Entamoeba dispar
YCIYDMKLAVLQFIPFYHT

SEQ ID NO: 2517194 - protein, 21 aa, Entamoeba dispar
YCKIFRIIFRFISKVITERID

SEQ ID NO: 2517195 - protein, 17 aa, Entamoeba dispar
YCKLPLYFERPFTDWTL

SEQ ID NO: 2517196 - protein, 18 aa, Entamoeba dispar
YCLVKWGGGLSYLEATWE

SEQ ID NO: 2517197 - protein, 17 aa, Entamoeba dispar
YCLYFYLTFFIMKENVF

SEQ ID NO: 2517198 - protein, 17 aa, Entamoeba dispar
YCNGRFGTFSQLYEIPE

SEQ ID NO: 2517199 - protein, 18 aa, Entamoeba dispar
YCNNCTFVPADIISSCQY

SEQ ID NO: 2517200 - protein, 19 aa, Entamoeba dispar
YCNNFIYMYQWFKSFVNES

SEQ ID NO: 2517201 - protein, 18 aa, Entamoeba dispar
YCNVPLFKEMLLPALKYG

SEQ ID NO: 2517202 - protein, 17 aa, Entamoeba dispar
YCQLESLKIQNIGGCVD

SEQ ID NO: 2517203 - protein, 18 aa, Entamoeba dispar
YCVARFSFRIGERYYSQS

SEQ ID NO: 2517204 - protein, 17 aa, Entamoeba dispar
YCYLIKNADTIRLMDQN

SEQ ID NO: 2517205 - protein, 22 aa, Entamoeba dispar
YDDLKYIYVWVGKKCNDFKKAK

SEQ ID NO: 2517206 - protein, 23 aa, Entamoeba dispar
YDDRNCLSLGFGFIDFYSVNDAL

SEQ ID NO: 2517207 - protein, 17 aa, Entamoeba dispar
YDFFLRLPLSISSFHFY

SEQ ID NO: 2517208 - protein, 19 aa, Entamoeba dispar
YDGVGIIPLDCPWYICYFM

SEQ ID NO: 2517209 - protein, 18 aa, Entamoeba dispar
YDILRFWGIYSLYSSIDP

SEQ ID NO: 2517210 - protein, 20 aa, Entamoeba dispar
YDIRDVWNFPRLTQIKSETP

SEQ ID NO: 2517211 - protein, 17 aa, Entamoeba dispar
YDLKDVILVGGSTFIPF

SEQ ID NO: 2517212 - protein, 24 aa, Entamoeba dispar
YDLLIEVGRCFKIFNNKCLNETHS

SEQ ID NO: 2517213 - protein, 21 aa, Entamoeba dispar
YDLPRMIGIGLFTDVSTSQAM

SEQ ID NO: 2517214 - protein, 17 aa, Entamoeba dispar
YDLSPAVMTTTLYQEII

SEQ ID NO: 2517215 - protein, 20 aa, Entamoeba dispar
YDLTVPFARYLATNGVKKIK

SEQ ID NO: 2517216 - protein, 19 aa, Entamoeba dispar
YDNCPILLKRVNEFITNSL

SEQ ID NO: 2517217 - protein, 22 aa, Entamoeba dispar
YDRLRYSIVMRLLDICSNFSIK

SEQ ID NO: 2517218 - protein, 17 aa, Entamoeba dispar
YDSICLFSGSSIPIEHT

SEQ ID NO: 2517219 - protein, 18 aa, Entamoeba dispar
YECFARMYGLLTIIIPTM

SEQ ID NO: 2517220 - protein, 19 aa, Entamoeba dispar
YEFKAMHGFVTINLRAETP

SEQ ID NO: 2517221 - protein, 18 aa, Entamoeba dispar
YEFKAMHGFVTMNFTPAQ

SEQ ID NO: 2517222 - protein, 20 aa, Entamoeba dispar
YEILDFLGVGGFGVVRKVKR

SEQ ID NO: 2517223 - protein, 24 aa, Entamoeba dispar
YEILRREFLSALAFVEPTFDLSSA

SEQ ID NO: 2517224 - protein, 20 aa, Entamoeba dispar
YEIPSGKFNNEWAVTLYNAT

SEQ ID NO: 2517225 - protein, 20 aa, Entamoeba dispar
YEISLFLGMLSKWCNITIER

SEQ ID NO: 2517226 - protein, 22 aa, Entamoeba dispar
YEITETFLSSGFYTGCEVPSVS

SEQ ID NO: 2517227 - protein, 18 aa, Entamoeba dispar
YEKFPRVVKQFARNRPLE

SEQ ID NO: 2517228 - protein, 19 aa, Entamoeba dispar
YEKGIAFPCCISLNNCCGY

SEQ ID NO: 2517229 - protein, 31 aa, Entamoeba dispar
YEKYILKPCRFLRQREKECVEFPCIPPRIKT

SEQ ID NO: 2517230 - protein, 28 aa, Entamoeba dispar
YELKKLICFISRSVMWRTEFVESTQKIR

SEQ ID NO: 2517231 - protein, 26 aa, Entamoeba dispar
YEMDQTKKFLCVCWCGQAAPDNLKTK

SEQ ID NO: 2517232 - protein, 17 aa, Entamoeba dispar
YENCYKAIMWILYLCED

SEQ ID NO: 2517233 - protein, 18 aa, Entamoeba dispar
YENCYKAIMWILYLCEDM

SEQ ID NO: 2517234 - protein, 18 aa, Entamoeba dispar
YERIRFLFLTSALLKAVD

SEQ ID NO: 2517235 - protein, 22 aa, Entamoeba dispar
YETLKLLIHYLRLIADASSINK

SEQ ID NO: 2517236 - protein, 22 aa, Entamoeba dispar
YEVHCYWRNGAIVVIEDTDGSG

SEQ ID NO: 2517237 - protein, 17 aa, Entamoeba dispar
YEWYELRKLKAIDYRVL

SEQ ID NO: 2517238 - protein, 17 aa, Entamoeba dispar
YFCNFRFNCWNEFNSFG

SEQ ID NO: 2517239 - protein, 17 aa, Entamoeba dispar
YFDRWSPIISICNKVGG

SEQ ID NO: 2517240 - protein, 18 aa, Entamoeba dispar
YFFDICGLVSQTNFEDIE

SEQ ID NO: 2517241 - protein, 24 aa, Entamoeba dispar
YFGLNWKGLNSFKRPIIISESDIF

SEQ ID NO: 2517242 - protein, 18 aa, Entamoeba dispar
YFINFLKKRFNDVQNDVF

SEQ ID NO: 2517243 - protein, 22 aa, Entamoeba dispar
YFKEFHPLKALIIYDKESKISK

SEQ ID NO: 2517244 - protein, 20 aa, Entamoeba dispar
YFPYRKVHKRVRGWVNNAPR

SEQ ID NO: 2517245 - protein, 18 aa, Entamoeba dispar
YFQDCIDFILKLLPKDKL

SEQ ID NO: 2517246 - protein, 26 aa, Entamoeba dispar
YFTKDCSFDAWKILRRGTIVLYKMPA

SEQ ID NO: 2517247 - protein, 18 aa, Entamoeba dispar
YFTVWRYYGIFLIPMRCY

SEQ ID NO: 2517248 - protein, 18 aa, Entamoeba dispar
YFVLKDRRIWYFSSCKDK

SEQ ID NO: 2517249 - protein, 17 aa, Entamoeba dispar
YGAVCVIGIGYPLPISK

SEQ ID NO: 2517250 - protein, 20 aa, Entamoeba dispar
YGCILAEMFLGKPLFPGSST

SEQ ID NO: 2517251 - protein, 17 aa, Entamoeba dispar
YGFAVDWWSYGTLIYEM

SEQ ID NO: 2517252 - protein, 17 aa, Entamoeba dispar
YGIKVTDDFRYIIINEG

SEQ ID NO: 2517253 - protein, 21 aa, Entamoeba dispar
YGLDIFKVRIRKVGKAKEIPK

SEQ ID NO: 2517254 - protein, 19 aa, Entamoeba dispar
YGLDLPSRWDLFNKQQQDI

SEQ ID NO: 2517255 - protein, 24 aa, Entamoeba dispar
YGLKFWLRILHCCGNPTSISDNKV

SEQ ID NO: 2517256 - protein, 22 aa, Entamoeba dispar
YGPTRVEGFWTYDENNIYWNPY

SEQ ID NO: 2517257 - protein, 20 aa, Entamoeba dispar
YGPTRVEGFWTYDENYPFWN

SEQ ID NO: 2517258 - protein, 26 aa, Entamoeba dispar
YGQLFECFRKLFICKTDTDSKSQLII

SEQ ID NO: 2517259 - protein, 20 aa, Entamoeba dispar
YGQLRAFPWNSLALMTTTGA

SEQ ID NO: 2517260 - protein, 17 aa, Entamoeba dispar
YGRRLKRIFVYRCGISD

SEQ ID NO: 2517261 - protein, 17 aa, Entamoeba dispar
YHIFPIFYSLGINDRYE

SEQ ID NO: 2517262 - protein, 18 aa, Entamoeba dispar
YHILRNSYQIIYEVIQST

SEQ ID NO: 2517263 - protein, 19 aa, Entamoeba dispar
YHLKLCLCPLCKHGMEVFG

SEQ ID NO: 2517264 - protein, 24 aa, Entamoeba dispar
YHLKYCFFNKLGFLIEIPLFYNSF

SEQ ID NO: 2517265 - protein, 19 aa, Entamoeba dispar
YHPYRVILCRVVLGREGRD

SEQ ID NO: 2517266 - protein, 21 aa, Entamoeba dispar
YHRVLEFLLIFLLNLNDSIIP

SEQ ID NO: 2517267 - protein, 18 aa, Entamoeba dispar
YHTLRMYDHFVFYNHVCI

SEQ ID NO: 2517268 - protein, 25 aa, Entamoeba dispar
YHYQECREIMDFLYKRLSEDGKNWR

SEQ ID NO: 2517269 - protein, 23 aa, Entamoeba dispar
YICSCTEKILFICDSCNERMSMD

SEQ ID NO: 2517270 - protein, 18 aa, Entamoeba dispar
YIEEWRKVFNMDNKTWEE

SEQ ID NO: 2517271 - protein, 18 aa, Entamoeba dispar
YIFFPGGSGNCYSSMSPI

SEQ ID NO: 2517272 - protein, 24 aa, Entamoeba dispar
YIFILRFLWILIVHRRARGITTND

SEQ ID NO: 2517273 - protein, 17 aa, Entamoeba dispar
YIIDGVFPFLIDKEEEE

SEQ ID NO: 2517274 - protein, 20 aa, Entamoeba dispar
YIKGDGFVLVYSIDNKNSFH

SEQ ID NO: 2517275 - protein, 23 aa, Entamoeba dispar
YIKGELKSVIILGLIHSEGIIIP

SEQ ID NO: 2517276 - protein, 23 aa, Entamoeba dispar
YIKHCICIPLDLPPMPLYPDQMK

SEQ ID NO: 2517277 - protein, 19 aa, Entamoeba dispar
YIKSCYEINCSEAQVKEII

SEQ ID NO: 2517278 - protein, 17 aa, Entamoeba dispar
YILINAFQFDSGENDPN

SEQ ID NO: 2517279 - protein, 18 aa, Entamoeba dispar
YIMRNCDMLRFLDSNNTP

SEQ ID NO: 2517280 - protein, 20 aa, Entamoeba dispar
YIMRNCNMLRFLDSNNTALF

SEQ ID NO: 2517281 - protein, 25 aa, Entamoeba dispar
YINGFGFRNICEWIKKIKTPYYLYA

SEQ ID NO: 2517282 - protein, 21 aa, Entamoeba dispar
YISFKGSIPFLRKTSPMHLTH

SEQ ID NO: 2517283 - protein, 19 aa, Entamoeba dispar
YIVPRSRFLPVKACNDLFI

SEQ ID NO: 2517284 - protein, 22 aa, Entamoeba dispar
YKCDLWSLGGLLYFLRTHTYPL

SEQ ID NO: 2517285 - protein, 21 aa, Entamoeba dispar
YKCECCKAILCGECIKKRKYQ

SEQ ID NO: 2517286 - protein, 23 aa, Entamoeba dispar
YKCFKLGDFNMAFIIYSCIVRAS

SEQ ID NO: 2517287 - protein, 17 aa, Entamoeba dispar
YKCKELISSIYLQNNPN

SEQ ID NO: 2517288 - protein, 18 aa, Entamoeba dispar
YKDLKVHVLISVYSHQMY

SEQ ID NO: 2517289 - protein, 17 aa, Entamoeba dispar
YKDQLVIVQWIARDQKI

SEQ ID NO: 2517290 - protein, 18 aa, Entamoeba dispar
YKDQLVIVQWIARDQKIG

SEQ ID NO: 2517291 - protein, 19 aa, Entamoeba dispar
YKEAIKIYQECAAELHNLI

SEQ ID NO: 2517292 - protein, 19 aa, Entamoeba dispar
YKFEVLISMMSEQWFWDEV

SEQ ID NO: 2517293 - protein, 24 aa, Entamoeba dispar
YKHLLRLYGRMNLLLSQIDKKQQL

SEQ ID NO: 2517294 - protein, 25 aa, Entamoeba dispar
YKHLLRLYGRMNLLLSQIDKKQQLK

SEQ ID NO: 2517295 - protein, 18 aa, Entamoeba dispar
YKHSLIRYIPGYKCIKLL

SEQ ID NO: 2517296 - protein, 23 aa, Entamoeba dispar
YKILKLCVEDGVLVNKSSPSVVA

SEQ ID NO: 2517297 - protein, 21 aa, Entamoeba dispar
YKIVFVVKCVIFNVSIPLTKI

SEQ ID NO: 2517298 - protein, 18 aa, Entamoeba dispar
YKKIYIVEWARSPIHRAS

SEQ ID NO: 2517299 - protein, 20 aa, Entamoeba dispar
YKKMWSYKEAVIFIKKKRPI

SEQ ID NO: 2517300 - protein, 18 aa, Entamoeba dispar
YKKVCEILSLMVRNKWYE

SEQ ID NO: 2517301 - protein, 18 aa, Entamoeba dispar
YKLCSIPFQFKFITPNCF

SEQ ID NO: 2517302 - protein, 21 aa, Entamoeba dispar
YKLIDWKSYFIITINELQSEA

SEQ ID NO: 2517303 - protein, 21 aa, Entamoeba dispar
YKLKLCFCPLCSSGITALGNT

SEQ ID NO: 2517304 - protein, 17 aa, Entamoeba dispar
YKLKLPRMTKILFTSSD

SEQ ID NO: 2517305 - protein, 17 aa, Entamoeba dispar
YKLLTVILLRSEIQPHH

SEQ ID NO: 2517306 - protein, 19 aa, Entamoeba dispar
YKLLVKECMRELTNDLTSV

SEQ ID NO: 2517307 - protein, 20 aa, Entamoeba dispar
YKLVDEFGFIQSLLDIFYDE

SEQ ID NO: 2517308 - protein, 17 aa, Entamoeba dispar
YKMIAKLCGGYNLEGIN

SEQ ID NO: 2517309 - protein, 17 aa, Entamoeba dispar
YKNLKWLLENSVEGLEM

SEQ ID NO: 2517310 - protein, 22 aa, Entamoeba dispar
YKQYRIPVVFGKSINKEIVDEK

SEQ ID NO: 2517311 - protein, 17 aa, Entamoeba dispar
YKRTILVSIDYHRRVND

SEQ ID NO: 2517312 - protein, 17 aa, Entamoeba dispar
YKSCVFDMNSIVHQLDA

SEQ ID NO: 2517313 - protein, 20 aa, Entamoeba dispar
YKVDFCFRDCIGIKYKQTRK

SEQ ID NO: 2517314 - protein, 20 aa, Entamoeba dispar
YKYFRMGITFIEESDKFKQM

SEQ ID NO: 2517315 - protein, 22 aa, Entamoeba dispar
YLATCGKLVFFAIKPSTPNKCP

SEQ ID NO: 2517316 - protein, 17 aa, Entamoeba dispar
YLAVVICGFVFIDQECS

SEQ ID NO: 2517317 - protein, 17 aa, Entamoeba dispar
YLDELIIYCHSRDEIVE

SEQ ID NO: 2517318 - protein, 17 aa, Entamoeba dispar
YLEICYALFNAYNGSGS

SEQ ID NO: 2517319 - protein, 25 aa, Entamoeba dispar
YLERRKEVWIAPLYFEFPGYEQAMF

SEQ ID NO: 2517320 - protein, 18 aa, Entamoeba dispar
YLFFKDINSLIPIIKNKS

SEQ ID NO: 2517321 - protein, 18 aa, Entamoeba dispar
YLIKCSFPTLSLILNVIS

SEQ ID NO: 2517322 - protein, 18 aa, Entamoeba dispar
YLIVLECNGIIKIYNNQF

SEQ ID NO: 2517323 - protein, 18 aa, Entamoeba dispar
YLKMVIVHFIKRPIFFNY

SEQ ID NO: 2517324 - protein, 24 aa, Entamoeba dispar
YLLKKVCAIPAFIVTFTVCIDEVV

SEQ ID NO: 2517325 - protein, 25 aa, Entamoeba dispar
YLPKRIFKSTCKHIVEVSGTSFNLK

SEQ ID NO: 2517326 - protein, 17 aa, Entamoeba dispar
YLPPGIYEICAYNDQSL

SEQ ID NO: 2517327 - protein, 18 aa, Entamoeba dispar
YLPTASALPFFISLFSEI

SEQ ID NO: 2517328 - protein, 17 aa, Entamoeba dispar
YLQIKLLRLLRVMNPST

SEQ ID NO: 2517329 - protein, 21 aa, Entamoeba dispar
YLRKLLIERGIIFSTECEKIE

SEQ ID NO: 2517330 - protein, 21 aa, Entamoeba dispar
YLTCLKMVLVLGGDNTLGEDR

SEQ ID NO: 2517331 - protein, 18 aa, Entamoeba dispar
YLYCGNVVKEFITTENTY

SEQ ID NO: 2517332 - protein, 21 aa, Entamoeba dispar
YLYEPMLAYHCYEFGSQSKMQ

SEQ ID NO: 2517333 - protein, 23 aa, Entamoeba dispar
YMCPRDGYKYSYIDAMDYYDTTT

SEQ ID NO: 2517334 - protein, 17 aa, Entamoeba dispar
YMDCCSITSNLFSLCFK

SEQ ID NO: 2517335 - protein, 17 aa, Entamoeba dispar
YMKEYKDQLVIVQWIAR

SEQ ID NO: 2517336 - protein, 18 aa, Entamoeba dispar
YNCKMIDFAHNWILSEEE

SEQ ID NO: 2517337 - protein, 18 aa, Entamoeba dispar
YNDYFYKRHEGLWEATAR

SEQ ID NO: 2517338 - protein, 17 aa, Entamoeba dispar
YNIIKYSFVFEFFIKEY

SEQ ID NO: 2517339 - protein, 18 aa, Entamoeba dispar
YNIPEVLITLSLDKVKID

SEQ ID NO: 2517340 - protein, 17 aa, Entamoeba dispar
YNKGCTTHGIFRETTNA

SEQ ID NO: 2517341 - protein, 19 aa, Entamoeba dispar
YNKLFRYLWPPSISQLENI

SEQ ID NO: 2517342 - protein, 17 aa, Entamoeba dispar
YNKWWSYPICKLSFEEI

SEQ ID NO: 2517343 - protein, 22 aa, Entamoeba dispar
YNQLHQWTGLTAPRVIYSCSNF

SEQ ID NO: 2517344 - protein, 20 aa, Entamoeba dispar
YNSCCVYKSLYFCEILHFIK

SEQ ID NO: 2517345 - protein, 21 aa, Entamoeba dispar
YNYKCDIWSLGAMYYYLRTGM

SEQ ID NO: 2517346 - protein, 21 aa, Entamoeba dispar
YPFTEWFWMIEFQDKYFGFQT

SEQ ID NO: 2517347 - protein, 25 aa, Entamoeba dispar
YPGCIRLSPQTALRFMRIFDTSRTG

SEQ ID NO: 2517348 - protein, 23 aa, Entamoeba dispar
YPIAPHFCDYVWRDLLGNKTFLW

SEQ ID NO: 2517349 - protein, 19 aa, Entamoeba dispar
YPIIPFKWIADETVTSPMM

SEQ ID NO: 2517350 - protein, 17 aa, Entamoeba dispar
YPILPVIRKQFSDGELY

SEQ ID NO: 2517351 - protein, 19 aa, Entamoeba dispar
YPKFDEFFTQLHLYCLKNP

SEQ ID NO: 2517352 - protein, 23 aa, Entamoeba dispar
YPKGENWQHVFTLGGIESDFLYK

SEQ ID NO: 2517353 - protein, 17 aa, Entamoeba dispar
YPLLRKINCRLSCLPTK

SEQ ID NO: 2517354 - protein, 20 aa, Entamoeba dispar
YPQCLCDLTSIVDLDVSNNL

SEQ ID NO: 2517355 - protein, 22 aa, Entamoeba dispar
YPQLLGGLAIKVASYITKQLPY

SEQ ID NO: 2517356 - protein, 24 aa, Entamoeba dispar
YPSAMKRLLIPTGYPKMITQPIQF

SEQ ID NO: 2517357 - protein, 17 aa, Entamoeba dispar
YQCKLCLTTHLTEANYL

SEQ ID NO: 2517358 - protein, 22 aa, Entamoeba dispar
YQFCPCKHVFCLDCLAPNLNES

SEQ ID NO: 2517359 - protein, 17 aa, Entamoeba dispar
YQIAWFFTNLAVSLDSE

SEQ ID NO: 2517360 - protein, 19 aa, Entamoeba dispar
YRCGCNFLATILSSESSED

SEQ ID NO: 2517361 - protein, 18 aa, Entamoeba dispar
YRCISKVYNRVCANSSTQ

SEQ ID NO: 2517362 - protein, 17 aa, Entamoeba dispar
YRDVVVIGTDLLFDTTT

SEQ ID NO: 2517363 - protein, 18 aa, Entamoeba dispar
YRDWRLVSELVIKTMSYF

SEQ ID NO: 2517364 - protein, 17 aa, Entamoeba dispar
YRGLVEMLINKGANVNC

SEQ ID NO: 2517365 - protein, 18 aa, Entamoeba dispar
YRILEMIKKFICLFPNDF

SEQ ID NO: 2517366 - protein, 32 aa, Entamoeba dispar
YRKRAHLYNEKWRKTDVNGHWSGKRFDTNRDN

SEQ ID NO: 2517367 - protein, 17 aa, Entamoeba dispar
YRLAKLVFFGLYFGVFT

SEQ ID NO: 2517368 - protein, 18 aa, Entamoeba dispar
YRLKEMFQDFNFIKKCWV

SEQ ID NO: 2517369 - protein, 20 aa, Entamoeba dispar
YRLRLSYGMVDGVCILSNEN

SEQ ID NO: 2517370 - protein, 20 aa, Entamoeba dispar
YRNIFKWAPLLALVNSLTNL

SEQ ID NO: 2517371 - protein, 18 aa, Entamoeba dispar
YRNKWCFINLFTNQISYV

SEQ ID NO: 2517372 - protein, 20 aa, Entamoeba dispar
YRNWTALMFAQFLMYNKINK

SEQ ID NO: 2517373 - protein, 23 aa, Entamoeba dispar
YRPPEVMIGYPFDGSFDNWSSGV

SEQ ID NO: 2517374 - protein, 19 aa, Entamoeba dispar
YRQFPLLAFTDFMSLFVKH

SEQ ID NO: 2517375 - protein, 17 aa, Entamoeba dispar
YRSCEFCVSFADCSGMD

SEQ ID NO: 2517376 - protein, 17 aa, Entamoeba dispar
YRSSLRSGEFVEFMKNS

SEQ ID NO: 2517377 - protein, 17 aa, Entamoeba dispar
YRVEICKNLPPFMFEED

SEQ ID NO: 2517378 - protein, 17 aa, Entamoeba dispar
YRYKYKVIQQIRMCKDL

SEQ ID NO: 2517379 - protein, 19 aa, Entamoeba dispar
YRYNCLPIQFCMMLYSLLS

SEQ ID NO: 2517380 - protein, 24 aa, Entamoeba dispar
YSACIIGARLLRKWNNTIIASEAY

SEQ ID NO: 2517381 - protein, 23 aa, Entamoeba dispar
YSFFRTAKRLILFDFVTKTIENK

SEQ ID NO: 2517382 - protein, 17 aa, Entamoeba dispar
YSFWLYDFCDVYLEASK

SEQ ID NO: 2517383 - protein, 20 aa, Entamoeba dispar
YSIELKKKFLFFSTGSDRCP

SEQ ID NO: 2517384 - protein, 21 aa, Entamoeba dispar
YSIVIDEGWRKYAVDSLHKLI

SEQ ID NO: 2517385 - protein, 22 aa, Entamoeba dispar
YSKEVFDWLDFLLIDIESNLID

SEQ ID NO: 2517386 - protein, 17 aa, Entamoeba dispar
YSLWSAIGLTIMISIGE

SEQ ID NO: 2517387 - protein, 22 aa, Entamoeba dispar
YSPMAFAIVRRFFGLTPESMIE

SEQ ID NO: 2517388 - protein, 21 aa, Entamoeba dispar
YSQGCLFRFIEKNDLSDLLIL

SEQ ID NO: 2517389 - protein, 21 aa, Entamoeba dispar
YSTNILPRFLEQVLLSRDKVT

SEQ ID NO: 2517390 - protein, 22 aa, Entamoeba dispar
YTAPEMLKFITAKTYKGKKRIE

SEQ ID NO: 2517391 - protein, 20 aa, Entamoeba dispar
YTEFKRLALLLTNLPTKRLR

SEQ ID NO: 2517392 - protein, 18 aa, Entamoeba dispar
YTFAIGLCPLRYKKDKFI

SEQ ID NO: 2517393 - protein, 23 aa, Entamoeba dispar
YTLKRLECPNVIPPYGVEQIVSG

SEQ ID NO: 2517394 - protein, 17 aa, Entamoeba dispar
YTLWYLCDFLVDVLNHQ

SEQ ID NO: 2517395 - protein, 23 aa, Entamoeba dispar
YTPKGVFCLMTFYGPACPSNSGI

SEQ ID NO: 2517396 - protein, 27 aa, Entamoeba dispar
YTQDFKKRFSLLLGFEFKSMSAVDAFK

SEQ ID NO: 2517397 - protein, 18 aa, Entamoeba dispar
YTYVIGLKICSKFFEEPL

SEQ ID NO: 2517398 - protein, 22 aa, Entamoeba dispar
YVLKLKLYIPFILIKDKTLLVL

SEQ ID NO: 2517399 - protein, 17 aa, Entamoeba dispar
YVMDEIDAALDFRNVSI

SEQ ID NO: 2517400 - protein, 17 aa, Entamoeba dispar
YVNRIGILYGIFKEDRV

SEQ ID NO: 2517401 - protein, 18 aa, Entamoeba dispar
YVNSCIQLLFSMKSFVSY

SEQ ID NO: 2517402 - protein, 19 aa, Entamoeba dispar
YVRCIAALIIRYSIQFNLL

SEQ ID NO: 2517403 - protein, 19 aa, Entamoeba dispar
YVYHLRLLISTMHQALNSY

SEQ ID NO: 2517404 - protein, 17 aa, Entamoeba dispar
YWHRWALINFEVVNYYE

SEQ ID NO: 2517405 - protein, 22 aa, Entamoeba dispar
YWKRDITTIMSLLFQPSFNNKQ

SEQ ID NO: 2517406 - protein, 20 aa, Entamoeba dispar
YWNCPEEGRILGYMERNEYL

SEQ ID NO: 2517407 - protein, 17 aa, Entamoeba dispar
YWRFEIIYMSHNNSFHF

SEQ ID NO: 2517408 - protein, 20 aa, Entamoeba dispar
YWSFKEVWKELGMNKELLLE

SEQ ID NO: 2517409 - protein, 25 aa, Entamoeba dispar
YWYWYPFTLCLSLSFIPTTIIGVTE

SEQ ID NO: 2517410 - protein, 19 aa, Entamoeba dispar
YYDIRICTYSGLTRLAVYT

SEQ ID NO: 2517411 - protein, 24 aa, Entamoeba dispar
YYDPNVACIWGWWGTLMSNHELKR

SEQ ID NO: 2517412 - protein, 17 aa, Entamoeba dispar
YYFCESWNNPVFEGYLS

SEQ ID NO: 2517413 - protein, 23 aa, Entamoeba dispar
YYLERLFCFYIPIITRCSISIID

SEQ ID NO: 2517414 - protein, 20 aa, Entamoeba dispar
YYLKEEWECIASIFEKYQIY

SEQ ID NO: 2517415 - protein, 22 aa, Entamoeba dispar
YYLKGDGFVLVYSIENKSSFMA

SEQ ID NO: 2517416 - protein, 18 aa, Entamoeba dispar
YYLRHVPKNIAKLCSIGM

SEQ ID NO: 2517417 - protein, 17 aa, Entamoeba dispar
YYLRITHCPTLTTCTIP

SEQ ID NO: 2517418 - protein, 17 aa, Entamoeba dispar
YYLSFLIGGGLKLLLDY

SEQ ID NO: 2517419 - protein, 18 aa, Entamoeba dispar
YYQSFTFDVFKLCRSHNC

SEQ ID NO: 2517420 - protein, 18 aa, Entamoeba dispar
YYYCKELFLRTMFSFFYE

SEQ ID NO: 2517421 - protein, 26 aa, Entamoeba dispar
TEAIRRKPYSVILFDEIEKAHPQVFN

SEQ ID NO: 2517422 - protein, 19 aa, Entamoeba dispar
AGAQYRGQFEERLKAVIKE

SEQ ID NO: 2517423 - protein, 25 aa, Entamoeba dispar
KRYINGRFLPDKAIDLVDEACATLF

SEQ ID NO: 2517424 - protein, 28 aa, Entamoeba dispar
IGRDEEIKRVIRILSRRTKNNPVLIGEP

SEQ ID NO: 2517425 - protein, 30 aa, Entamoeba dispar
KEVKESKIPIILFIDEIHTVLGAGATGEGA

SEQ ID NO: 2517426 - protein, 20 aa, Entamoeba dispar
YRMGNLFIVGPTKTGKTEFA

SEQ ID NO: 2517427 - protein, 19 aa, Entamoeba dispar
GMNVMRIINEPTAAAIAYG

SEQ ID NO: 2517428 - protein, 18 aa, Entamoeba dispar
IAYGARPMRRYIEKTVVT

SEQ ID NO: 2517429 - protein, 23 aa, Entamoeba dispar
CGTEFFQHYAGMYDQFKIDGVSV

SEQ ID NO: 2517430 - protein, 24 aa, Entamoeba dispar
DDMEKIWHHTFYNELRVAPEEHPV

SEQ ID NO: 2517431 - protein, 26 aa, Entamoeba dispar
EKAHPQVFNVLLQLLDEGRLTDGRGR

SEQ ID NO: 2517432 - protein, 24 aa, Entamoeba dispar
MDAANILKPMLSRGELRCIGATTL

SEQ ID NO: 2517433 - protein, 31 aa, Entamoeba dispar
NEYKGKYVVLLFYPLDWTFVCPTEMIGYSEV

SEQ ID NO: 2517434 - protein, 21 aa, Entamoeba dispar
QNIIKLKNILHEAALLQVEIS

SEQ ID NO: 2517435 - protein, 21 aa, Entamoeba dispar
TFKPEFLNRLDDIIVFSPLSE

SEQ ID NO: 2517436 - protein, 22 aa, Entamoeba dispar
CKKECCCPRIKAFKKFMNTFEK

SEQ ID NO: 2517437 - protein, 24 aa, Entamoeba dispar
DYKGNIIMPLGIWDEYFILELNLH

SEQ ID NO: 2517438 - protein, 20 aa, Entamoeba dispar
IIKSGYSIAYGARPMRRYIE

SEQ ID NO: 2517439 - protein, 19 aa, Entamoeba dispar
IIQLLDGIKFQNEKIFEMQ

SEQ ID NO: 2517440 - protein, 20 aa, Entamoeba dispar
KEMIQLAPPTMKIKVIAPPE

SEQ ID NO: 2517441 - protein, 27 aa, Entamoeba dispar
KTEFAIQEIFLKYNTFMLRGDSLFDAY

SEQ ID NO: 2517442 - protein, 25 aa, Entamoeba dispar
LEVAADLKYYAIPEAEKRMKELKEQ

SEQ ID NO: 2517443 - protein, 21 aa, Entamoeba dispar
LTDYLMKILTERGYAFTTTAE

SEQ ID NO: 2517444 - protein, 25 aa, Entamoeba dispar
NIERFHFNPIPLNEYSRKLFTNIET

SEQ ID NO: 2517445 - protein, 26 aa, Entamoeba dispar
NMERFHFNPIPLNEYSRRFFPNIETF

SEQ ID NO: 2517446 - protein, 18 aa, Entamoeba dispar
PAMYVGIQAVLSLYASGR

SEQ ID NO: 2517447 - protein, 38 aa, Entamoeba dispar
TNKRRKYILSGCYYLITKGWSFLFSKEKRIAGKLDHFF

SEQ ID NO: 2517448 - protein, 25 aa, Entamoeba dispar
CNLLGKFELTGIPPAPRGVPQIEVT

SEQ ID NO: 2517449 - protein, 26 aa, Entamoeba dispar
DKSLMYIGEYYFVKFIGKEWGELENK

SEQ ID NO: 2517450 - protein, 25 aa, Entamoeba dispar
EINNKHFDYLFWEGVCLKKEEFKGK

SEQ ID NO: 2517451 - protein, 20 aa, Entamoeba dispar
ESIISLPYLDGQDSLEITIN

SEQ ID NO: 2517452 - protein, 32 aa, Entamoeba dispar
EVLTESTLYAAWNPDFLLSVLLGNQTATCQTL

SEQ ID NO: 2517453 - protein, 24 aa, Entamoeba dispar
IDFNLQWYITCSFDRYICTPTEDE

SEQ ID NO: 2517454 - protein, 18 aa, Entamoeba dispar
IICCDTIILTQYNNQIKV

SEQ ID NO: 2517455 - protein, 34 aa, Entamoeba dispar
INEYKGKYVVLLFYPLDWTFVCPTEMIGYSEVAG

SEQ ID NO: 2517456 - protein, 24 aa, Entamoeba dispar
KKIKKYLKRHPLLIEEEIPEELIE

SEQ ID NO: 2517457 - protein, 23 aa, Entamoeba dispar
KRKKLACSYLISITKKYQESKEE

SEQ ID NO: 2517458 - protein, 22 aa, Entamoeba dispar
KSTLDVIPIPNANSLGYAGTNA

SEQ ID NO: 2517459 - protein, 24 aa, Entamoeba dispar
LKEAKPVPDFIPLESVDIPNEVEN

SEQ ID NO: 2517460 - protein, 17 aa, Entamoeba dispar
LRTACERAKRTLSSASV

SEQ ID NO: 2517461 - protein, 18 aa, Entamoeba dispar
MIGRRFSEPSIQKDMKHW

SEQ ID NO: 2517462 - protein, 30 aa, Entamoeba dispar
NEYKGKYVVLLFYPLDWTFVCPTEMIGYSE

SEQ ID NO: 2517463 - protein, 26 aa, Entamoeba dispar
NMERFHFNPIPLNEYSRKLFPNIETF

SEQ ID NO: 2517464 - protein, 27 aa, Entamoeba dispar
PFTCPPTEYYLYKKIQSISSTPILQIE

SEQ ID NO: 2517465 - protein, 18 aa, Entamoeba dispar
PGGQMIEMVLDRLPKWYE

SEQ ID NO: 2517466 - protein, 18 aa, Entamoeba dispar
PTGSFMFLGPSGVGKTEL

SEQ ID NO: 2517467 - protein, 20 aa, Entamoeba dispar
QHDLIPLVEFVFGGRQRRFI

SEQ ID NO: 2517468 - protein, 20 aa, Entamoeba dispar
QMIEMVLDRLPKWYETNGKT

SEQ ID NO: 2517469 - protein, 20 aa, Entamoeba dispar
RAYYPGARWGITRRLIASSL

SEQ ID NO: 2517470 - protein, 28 aa, Entamoeba dispar
SITLSSSWPFLIMWKGSDNEAYIQLQRS

SEQ ID NO: 2517471 - protein, 24 aa, Entamoeba dispar
TKTMKTFLTKYLEFEIKYGDESKQ

SEQ ID NO: 2517472 - protein, 18 aa, Entamoeba dispar
VFRRRWGSYGSIKNNWYS

SEQ ID NO: 2517473 - protein, 28 aa, Entamoeba dispar
VISGATKGYFLSARIFTLYSNDKTLRVI

SEQ ID NO: 2517474 - protein, 19 aa, Entamoeba dispar
VPFTNFNHHFYYDDKTYNL

SEQ ID NO: 2517475 - protein, 17 aa, Entamoeba dispar
VYTYSNKNYYVAEIYYV

SEQ ID NO: 2517476 - protein, 23 aa, Entamoeba dispar
YNLKQNNLFISFGRKSIDCSAIM

SEQ ID NO: 2517477 - protein, 17 aa, Entamoeba dispar
YSIAYGARPMRRYIEKT

SEQ ID NO: 2517478 - protein, 17 aa, Entamoeba dispar
YVIIDDKGKVRYIQMND

SEQ ID NO: 2517479 - protein, 29 aa, Entamoeba dispar
DGSYIMKIMGYITVRFKQLRSSPLEIVEA

SEQ ID NO: 2517480 - protein, 20 aa, Entamoeba dispar
DQFRNIISHCNKPHFICICN

SEQ ID NO: 2517481 - protein, 22 aa, Entamoeba dispar
DTTHIFYDLFKNTNFNSFCKCF

SEQ ID NO: 2517482 - protein, 25 aa, Entamoeba dispar
EAACPHIMLNAFQALLGFSKESGVV

SEQ ID NO: 2517483 - protein, 23 aa, Entamoeba dispar
EQGAVIIPIYYQNNQKVELYYNG

SEQ ID NO: 2517484 - protein, 19 aa, Entamoeba dispar
ERFHFNPIPLNEHSRKLFP

SEQ ID NO: 2517485 - protein, 22 aa, Entamoeba dispar
ETLVNLPLDKGIKKPLLQQVNE

SEQ ID NO: 2517486 - protein, 27 aa, Entamoeba dispar
FKDGRIFKYVIWYLVNYSEYLQEKEQG

SEQ ID NO: 2517487 - protein, 35 aa, Entamoeba dispar
GAYKNQWFNITPQKNIIIFPYRLNYNDSTKRLSLT

SEQ ID NO: 2517488 - protein, 25 aa, Entamoeba dispar
GVSQAVLLQKLKINPFKYGAVIDVV

SEQ ID NO: 2517489 - protein, 27 aa, Entamoeba dispar
GVVLANKLLHSLQLFYSTPNVQTDDCP

SEQ ID NO: 2517490 - protein, 30 aa, Entamoeba dispar
HDVEPLEMVVYLPYLCKKLQVPYCIVKGKA

SEQ ID NO: 2517491 - protein, 17 aa, Entamoeba dispar
HLIRIFCIGFTSRKSNQ

SEQ ID NO: 2517492 - protein, 26 aa, Entamoeba dispar
HNESLKYDIRLFDDANLNDIIWPEFK

SEQ ID NO: 2517493 - protein, 27 aa, Entamoeba dispar
IDYLKIKIFSFPLIRNIIKMMNDKEKT

SEQ ID NO: 2517494 - protein, 25 aa, Entamoeba dispar
IEIPLHSFLNQFRMLSRRDCELEER

SEQ ID NO: 2517495 - protein, 20 aa, Entamoeba dispar
IERFHFNPIPLNEYSRKLFT

SEQ ID NO: 2517496 - protein, 29 aa, Entamoeba dispar
IGRDEEIKRVIRILSRRTKNNPVLIGEPG

SEQ ID NO: 2517497 - protein, 26 aa, Entamoeba dispar
IIISKKYFMLIVNVMKNIRKIGNKKE

SEQ ID NO: 2517498 - protein, 24 aa, Entamoeba dispar
IKNQTVVFFVGLKSSTHLFDAYRV

SEQ ID NO: 2517499 - protein, 18 aa, Entamoeba dispar
ILMDIPKSIRVYSTRVFI

SEQ ID NO: 2517500 - protein, 17 aa, Entamoeba dispar
ITAWDRNGIDKATANVV

SEQ ID NO: 2517501 - protein, 18 aa, Entamoeba dispar
IYKRYLMIIGTMKEKEIE

SEQ ID NO: 2517502 - protein, 27 aa, Entamoeba dispar
KATEDVLLLDVAPLTLGIETAGGVMTA

SEQ ID NO: 2517503 - protein, 25 aa, Entamoeba dispar
KKLGEFKLVGIPPAKKGIPKIQVTF

SEQ ID NO: 2517504 - protein, 27 aa, Entamoeba dispar
KPEIQNGRFIPTILYGARASIPGVKNN

SEQ ID NO: 2517505 - protein, 19 aa, Entamoeba dispar
KPLIDTAVDFIPGGNIIKK

SEQ ID NO: 2517506 - protein, 26 aa, Entamoeba dispar
KSIKRKRKPLLFANRLNNEEVNDNII

SEQ ID NO: 2517507 - protein, 28 aa, Entamoeba dispar
KVFSMDNVYIRKVKILKAGKIDSLKLLD

SEQ ID NO: 2517508 - protein, 18 aa, Entamoeba dispar
LSCLLQLQGIRKEGKRVI

SEQ ID NO: 2517509 - protein, 17 aa, Entamoeba dispar
NETLYSPLYFNEETIIK

SEQ ID NO: 2517510 - protein, 20 aa, Entamoeba dispar
NGMNALFFDTIGKGKVILSG

SEQ ID NO: 2517511 - protein, 22 aa, Entamoeba dispar
NNDKMIVILTMNRFKSIDIPTE

SEQ ID NO: 2517512 - protein, 34 aa, Entamoeba dispar
NQTATCQTLVFNLTWSWVVSLRGLRKSTLDVIPI

SEQ ID NO: 2517513 - protein, 27 aa, Entamoeba dispar
NRLPEHMKIPLNDLLKDLLEEQEPANF

SEQ ID NO: 2517514 - protein, 30 aa, Entamoeba dispar
PHGMKECLPLILILRNRLNYALNGREVTMI

SEQ ID NO: 2517515 - protein, 26 aa, Entamoeba dispar
QEVHHQIFFYYNSLNIILGKQGTGKT

SEQ ID NO: 2517516 - protein, 18 aa, Entamoeba dispar
QIKKIRKIMNNLITKEAA

SEQ ID NO: 2517517 - protein, 22 aa, Entamoeba dispar
QTIRKWLKCAQGNKYRMGNLFI

SEQ ID NO: 2517518 - protein, 25 aa, Entamoeba dispar
RPVDKPLRLPLQDVYKISGIGTVPC

SEQ ID NO: 2517519 - protein, 18 aa, Entamoeba dispar
TIGSLGLLNKSIIFRELC

SEQ ID NO: 2517520 - protein, 41 aa, Entamoeba dispar
TVEKEFEVIIPIDDLLPFAAMKMFPNALFGNLTLEVKMAIQ

SEQ ID NO: 2517521 - protein, 18 aa, Entamoeba dispar
VFAPNYVVAKSKFWMMLK

SEQ ID NO: 2517522 - protein, 29 aa, Entamoeba dispar
VNGKDCLMIFHGLKLTTDKLRSIVKKWCT

SEQ ID NO: 2517523 - protein, 18 aa, Entamoeba dispar
VSKILPISKTITSIIPGG

SEQ ID NO: 2517524 - protein, 25 aa, Entamoeba dispar
VTNGTIRNYTLQKFIIQCYKEQLEN

SEQ ID NO: 2517525 - protein, 26 aa, Entamoeba dispar
VVAKSKFWMMLKKQHKVKKINAELLQ

SEQ ID NO: 2517526 - protein, 25 aa, Entamoeba dispar
VVKNYQIFLRYVSAGGIHNITKQYR

SEQ ID NO: 2517527 - protein, 25 aa, Entamoeba dispar
AAEKPHLTGFLGFKAGMTHVIREVK

SEQ ID NO: 2517528 - protein, 26 aa, Entamoeba dispar
AARNIIEKYYPLLTLDFHTNKRVVDE

SEQ ID NO: 2517529 - protein, 34 aa, Entamoeba dispar
AATILLNPHFVKLVSWYDNEWGYSNRLVDLIQII

SEQ ID NO: 2517530 - protein, 31 aa, Entamoeba dispar; identical to SEQ ID NO: 2395324

SEQ ID NO: 2517531 - protein, 34 aa, Entamoeba dispar
AESIGKGFIREGWGCLLMNSRIWERVSQGLWKDE

SEQ ID NO: 2517532 - protein, 20 aa, Entamoeba dispar
AKSTLAWKGLRVTVKITVVN

SEQ ID NO: 2517533 - protein, 17 aa, Entamoeba dispar
ALIYDTLSALKKFVPKH

SEQ ID NO: 2517534 - protein, 26 aa, Entamoeba dispar
AMTNVSSLMFLFPRTTNEVTCSRNPL

SEQ ID NO: 2517535 - protein, 24 aa, Entamoeba dispar
ATRNMLPCGLYKFPVRNTTDLEMI

SEQ ID NO: 2517536 - protein, 25 aa, Entamoeba dispar
AVGHHFNPCLFERGADGWKFVKELD

SEQ ID NO: 2517537 - protein, 27 aa, Entamoeba dispar
CCKITEGVLLRMVLSDLIKQSQSKLTM

SEQ ID NO: 2517538 - protein, 21 aa, Entamoeba dispar
CPPPPPSNNLPPPGPANVPPP

SEQ ID NO: 2517539 - protein, 27 aa, Entamoeba dispar
CVLAGIRHIRPHQYGWLGKSKRTVTRA

SEQ ID NO: 2517540 - protein, 24 aa, Entamoeba dispar
DAALDPLGWTGHSGMAILAPHLTR

SEQ ID NO: 2517541 - protein, 18 aa, Entamoeba dispar
DAANILKPMLSRGELRCI

SEQ ID NO: 2517542 - protein, 17 aa, Entamoeba dispar
DALKMYLNEVMYNIGVG

SEQ ID NO: 2517543 - protein, 24 aa, Entamoeba dispar
DERTILMIRRKKGEIKECFRNLQS

SEQ ID NO: 2517544 - protein, 21 aa, Entamoeba dispar
DFNEVVRWFAERADMIVLVFD

SEQ ID NO: 2517545 - protein, 30 aa, Entamoeba dispar
DHAAAYRYAKLLNIQLPRELLTGSNDDYYH

SEQ ID NO: 2517546 - protein, 24 aa, Entamoeba dispar
DKELFICAEGLYSGQYIYCGSKAS

SEQ ID NO: 2517547 - protein, 29 aa, Entamoeba dispar
DKPAWNLEKLRKSIVPGAILIIVAGKYAG

SEQ ID NO: 2517548 - protein, 22 aa, Entamoeba dispar
DKRERILTFNGIRQEEIYEKGE

SEQ ID NO: 2517549 - protein, 39 aa, Entamoeba dispar
DLTRYVKYPLYVRIQKEKRLLMKRLKTPPAVNIFANHTL

SEQ ID NO: 2517550 - protein, 27 aa, Entamoeba dispar
DPFMDPKYMVYLLKYDTVHRQFEGTVE

SEQ ID NO: 2517551 - protein, 26 aa, Entamoeba dispar
DQLQKEIQLLYRTKLDVNEAAKWFEQ

SEQ ID NO: 2517552 - protein, 29 aa, Entamoeba dispar
DVDVNPEFIPYIPTLSKFLSYQKCHENSV

SEQ ID NO: 2517553 - protein, 26 aa, Entamoeba dispar
DVKDPDNFIIPPKQYKEIKPMDDDEE

SEQ ID NO: 2517554 - protein, 19 aa, Entamoeba dispar
DVKFFKKIAIKKAAFGKTV

SEQ ID NO: 2517555 - protein, 32 aa, Entamoeba dispar
DVLSMDNMYSAWNPQLLISIKTPQSVNAVNSC

SEQ ID NO: 2517556 - protein, 24 aa, Entamoeba dispar
DYAKDLIKPKKNKPGYKPSAVVME

SEQ ID NO: 2517557 - protein, 24 aa, Entamoeba dispar
EAKIKQVFDAMNGKNVWEVIEAGK

SEQ ID NO: 2517558 - protein, 17 aa, Entamoeba dispar
EEQVQWNKQHAINLKCI

SEQ ID NO: 2517559 - protein, 22 aa, Entamoeba dispar
EEYCFRLQKDRVYYVRLSIAEQ

SEQ ID NO: 2517560 - protein, 22 aa, Entamoeba dispar
EGKIKARWMRKNARRLDIEHYT

SEQ ID NO: 2517561 - protein, 26 aa, Entamoeba dispar
EIVESFSFLHWYISDGSSVLNEMIPL

SEQ ID NO: 2517562 - protein, 17 aa, Entamoeba dispar
EKKVLIFDLGGGTFDVS

SEQ ID NO: 2517563 - protein, 26 aa, Entamoeba dispar
EKLKCQEIHIFYYRGQELNLDKSTAK

SEQ ID NO: 2517564 - protein, 28 aa, Entamoeba dispar
EKYIDIMVNLLFYIPMRNDYLDQLIDGI

SEQ ID NO: 2517565 - protein, 21 aa, Entamoeba dispar
EMIIYGRINNNWIKARENKNI

SEQ ID NO: 2517566 - protein, 27 aa, Entamoeba dispar
ERDETTWRVFQLRKDFFPAAKLQMEDD

SEQ ID NO: 2517567 - protein, 33 aa, Entamoeba dispar
ESIGKGFIREGWGCLLMNSRIWERVSQGLWKDE

SEQ ID NO: 2517568 - protein, 24 aa, Entamoeba dispar
ETEKGYEYLIKQVELIEDAHYNII

SEQ ID NO: 2517569 - protein, 25 aa, Entamoeba dispar
ETSYSVSMACSCLSSLFSCFESTQD

SEQ ID NO: 2517570 - protein, 19 aa, Entamoeba dispar
EVGQFMLATSKSVFLWLCD

SEQ ID NO: 2517571 - protein, 17 aa, Entamoeba dispar
FDAKRMIGRRFSEPSIQ

SEQ ID NO: 2517572 - protein, 23 aa, Entamoeba dispar
FIEYGYCMILEILIEQRKKEMMK

SEQ ID NO: 2517573 - protein, 17 aa, Entamoeba dispar
FPNVITAWDRNGIDKAT

SEQ ID NO: 2517574 - protein, 27 aa, Entamoeba dispar
FVFSDYCRPTIRLAALSHYPSIFVFTH

SEQ ID NO: 2517575 - protein, 28 aa, Entamoeba dispar
FYQRSTELLLRKLPFQHLVREIAQQSKS

SEQ ID NO: 2517576 - protein, 27 aa, Entamoeba dispar
GDLPFAEIKPPENVLFICKMNPITNEE

SEQ ID NO: 2517577 - protein, 24 aa, Entamoeba dispar
GGQNLTNVPIVPGPYQVSSYSSAV

SEQ ID NO: 2517578 - protein, 38 aa, Entamoeba dispar
GKELLKTVMKLWLPAGVTLLEMIVLHLPSPVVAQKYRT

SEQ ID NO: 2517579 - protein, 20 aa, Entamoeba dispar
GQMGFFKRTEVNKKIYRLGC

SEQ ID NO: 2517580 - protein, 24 aa, Entamoeba dispar
GQTREHILLSYTLGVKQMIVGVNK

SEQ ID NO: 2517581 - protein, 24 aa, Entamoeba dispar
GSGKTASFLLPMIQHLLNVKEKNR

SEQ ID NO: 2517582 - protein, 17 aa, Entamoeba dispar
HCRDKIILPNMIGSVIG

SEQ ID NO: 2517583 - protein, 30 aa, Entamoeba dispar
HDTMTSRRWTLRGILPQYTLCHKPCTVSGG

SEQ ID NO: 2517584 - protein, 18 aa, Entamoeba dispar
HHIAGVPQIPLVVNSKSI

SEQ ID NO: 2517585 - protein, 26 aa, Entamoeba dispar
HITALPYLAQYCSCKIWVKAEAETSF

SEQ ID NO: 2517586 - protein, 24 aa, Entamoeba dispar
HKEISPVFLVTLKTKVKDNEGKVD

SEQ ID NO: 2517587 - protein, 20 aa, Entamoeba dispar
HMGRFIIWTESAFKKLNTIF

SEQ ID NO: 2517588 - protein, 28 aa, Entamoeba dispar
IDDSYLLKVMGYITVRFKQLRTTRNEIV

SEQ ID NO: 2517589 - protein, 19 aa, Entamoeba dispar
IDEADKLLEMDFANEIDYL

SEQ ID NO: 2517590 - protein, 23 aa, Entamoeba dispar
IDVKPKRIIFKSIEEYIKVPLKE

SEQ ID NO: 2517591 - protein, 24 aa, Entamoeba dispar
IERFHFNPIPLNEYSRKLFPNIET

SEQ ID NO: 2517592 - protein, 32 aa, Entamoeba dispar
IHFKTQTHVFLIYPNFLFPTTATIDILIEQIN

SEQ ID NO: 2517593 - protein, 25 aa, Entamoeba dispar
IIEIIWYCIKPIKEDLIKINKIPFY

SEQ ID NO: 2517594 - protein, 17 aa, Entamoeba dispar
IKSGYSIAYGARPMRRY

SEQ ID NO: 2517595 - protein, 28 aa, Entamoeba dispar
ILKAGVAYRMYKAKRTTWPRVRGVAMNP

SEQ ID NO: 2517596 - protein, 25 aa, Entamoeba dispar
ILNNPLNYKIPVWFLNRQKDNKDGK

SEQ ID NO: 2517597 - protein, 18 aa, Entamoeba dispar
ILTSTQYFENYMGMYDQY

SEQ ID NO: 2517598 - protein, 18 aa, Entamoeba dispar
IMHTAPPRGMPSRGGPRG

SEQ ID NO: 2517599 - protein, 28 aa, Entamoeba dispar
INDSYILKVMGYITVRFKQLRTTKNEIV

SEQ ID NO: 2517600 - protein, 24 aa, Entamoeba dispar
ITSKYLEEFILKDTQKIIDDLIHC

SEQ ID NO: 2517601 - protein, 19 aa, Entamoeba dispar
IVAAIRKRKGLPEGVPGLD

SEQ ID NO: 2517602 - protein, 28 aa, Entamoeba dispar
IVTQEITFPCIYGMAARRTIPNGFYQNV

SEQ ID NO: 2517603 - protein, 19 aa, Entamoeba dispar
IYQSKMPGAPMHLSLDIQG

SEQ ID NO: 2517604 - protein, 20 aa, Entamoeba dispar
KAHKMKRLVPTPNSYFLEIK

SEQ ID NO: 2517605 - protein, 24 aa, Entamoeba dispar
KAHPQVFNVLLQLLDEGRLTDGRG

SEQ ID NO: 2517606 - protein, 28 aa, Entamoeba dispar
KEAKRYAAILNRYKVLKAHGMKVVSFAD

SEQ ID NO: 2517607 - protein, 17 aa, Entamoeba dispar
KEFVALEFVWEITRKHE

SEQ ID NO: 2517608 - protein, 29 aa, Entamoeba dispar
KEVKESKIPIILFIDEIHTVLGAGATGEG

SEQ ID NO: 2517609 - protein, 18 aa, Entamoeba dispar
KIIADGCYFKLATTKGPL

SEQ ID NO: 2517610 - protein, 21 aa, Entamoeba dispar
KINGVPLMRINQRYVIATSQK

SEQ ID NO: 2517611 - protein, 18 aa, Entamoeba dispar
KITCSLAKILLKDLEKKE

SEQ ID NO: 2517612 - protein, 20 aa, Entamoeba dispar
KLVVFGASRIGKTSTILQFI

SEQ ID NO: 2517613 - protein, 21 aa, Entamoeba dispar
KMMTIPTIMSGKLYEFKPELQ

SEQ ID NO: 2517614 - protein, 21 aa, Entamoeba dispar
KMTLNELVGILYEDFIQHGDT

SEQ ID NO: 2517615 - protein, 21 aa, Entamoeba dispar
KTGKFKLHITALPYLAQYCSC

SEQ ID NO: 2517616 - protein, 20 aa, Entamoeba dispar
KTLYYGSRWGVIRQLDAASM

SEQ ID NO: 2517617 - protein, 24 aa, Entamoeba dispar
KTMNIGVKYFASCGLYCLVQPNTP

SEQ ID NO: 2517618 - protein, 18 aa, Entamoeba dispar
LIKYFNYTDGILEANSGV

SEQ ID NO: 2517619 - protein, 23 aa, Entamoeba dispar
LLAINSKLKYQVFLPHTAGRYQI

SEQ ID NO: 2517620 - protein, 20 aa, Entamoeba dispar
LLNKSIIFRELCDCFDQFKI

SEQ ID NO: 2517621 - protein, 23 aa, Entamoeba dispar
LNAPHHWMLSKLGGTFAPKPSHG

SEQ ID NO: 2517622 - protein, 20 aa, Entamoeba dispar
LNEISILRRVNHPCILGCLN

SEQ ID NO: 2517623 - protein, 17 aa, Entamoeba dispar
LTMYKTLQMISNEQLNQ

SEQ ID NO: 2517624 - protein, 35 aa, Entamoeba dispar
LVKGAIIEIDPAPFRLWFLKFYGKDIASTEYYKSL

SEQ ID NO: 2517625 - protein, 20 aa, Entamoeba dispar
LVQPNTPYEIIYEYGRIMMN

SEQ ID NO: 2517626 - protein, 24 aa, Entamoeba dispar
MDAANILKPMLSRGELRCIGATTI

SEQ ID NO: 2517627 - protein, 24 aa, Entamoeba dispar
MGVRSDKLYDCVCLVFLEGAKNDI

SEQ ID NO: 2517628 - protein, 25 aa, Entamoeba dispar
MIEPSTNMPWYKGPTLIGALDSVTP

SEQ ID NO: 2517629 - protein, 18 aa, Entamoeba dispar
MKEIDIIISKKYFMLIVN

SEQ ID NO: 2517630 - protein, 17 aa, Entamoeba dispar
MLATSKSVFLWLCDLND

SEQ ID NO: 2517631 - protein, 25 aa, Entamoeba dispar
NEIDPNIIITPLFSNFKVYCSESNY

SEQ ID NO: 2517632 - protein, 32 aa, Entamoeba dispar
NEYKGKYVVLLFYPLDWTFVCPTEMIGYSEVA

SEQ ID NO: 2517633 - protein, 21 aa, Entamoeba dispar
NITNVPIVPGPYQVSSYSSAV

SEQ ID NO: 2517634 - protein, 19 aa, Entamoeba dispar
NKFCRIFNPPTCNCNLLNV

SEQ ID NO: 2517635 - protein, 26 aa, Entamoeba dispar
NKFYDDPFVMLNYNDLPLLQNGLIPP

SEQ ID NO: 2517636 - protein, 18 aa, Entamoeba dispar
NLKQNNLFISFGRKSIDC

SEQ ID NO: 2517637 - protein, 26 aa, Entamoeba dispar
NMTRKGHMFSPLKNFRKWQRKTPKQM

SEQ ID NO: 2517638 - protein, 22 aa, Entamoeba dispar
NRAFYCIIIEPTRELAAQVVEV

SEQ ID NO: 2517639 - protein, 25 aa, Entamoeba dispar
NRLVNYFIEEFKRKYKKDISGNARA

SEQ ID NO: 2517640 - protein, 23 aa, Entamoeba dispar
NSGKIIPQYLYDDQLSLAAQEKA

SEQ ID NO: 2517641 - protein, 24 aa, Entamoeba dispar
PENLTYVHNIALIKPTSTGIIKIN

SEQ ID NO: 2517642 - protein, 17 aa, Entamoeba dispar
PGCHMGRFIIWTESAFK

SEQ ID NO: 2517643 - protein, 17 aa, Entamoeba dispar
PIEHLLSYRSMPNCVVI

SEQ ID NO: 2517644 - protein, 22 aa, Entamoeba dispar
PSAAALILKALKEPPKDRKKNK

SEQ ID NO: 2517645 - protein, 17 aa, Entamoeba dispar
QAKRPFEEKLTSTFFNP

SEQ ID NO: 2517646 - protein, 19 aa, Entamoeba dispar
QAVYLLKKINAYSDVLKVI

SEQ ID NO: 2517647 - protein, 21 aa, Entamoeba dispar
QEIFMKYNTFMLRGDSLFDTY

SEQ ID NO: 2517648 - protein, 24 aa, Entamoeba dispar
QEMKKSVIIINMARGPIVVNDDIA

SEQ ID NO: 2517649 - protein, 19 aa, Entamoeba dispar
QIKPFRKIQCPIVERLVCC

SEQ ID NO: 2517650 - protein, 24 aa, Entamoeba dispar
QLAKRPHVIVGTPGRIVYHIKNTK

SEQ ID NO: 2517651 - protein, 25 aa, Entamoeba dispar
QNIEERIDILKGLIDKYPAFENQLK

SEQ ID NO: 2517652 - protein, 24 aa, Entamoeba dispar
QQEGRIKARWMRKNARRIDMEQYT

SEQ ID NO: 2517653 - protein, 17 aa, Entamoeba dispar
QQVLRRAIEKQKIMGDS

SEQ ID NO: 2517654 - protein, 18 aa, Entamoeba dispar
RAYLPVCESFGFTADLRS

SEQ ID NO: 2517655 - protein, 25 aa, Entamoeba dispar
RCQASVNVIVLILAKLLQGREDIEE

SEQ ID NO: 2517656 - protein, 27 aa, Entamoeba dispar
REINDFIVYWIAKLNKNYYKVTICDSS

SEQ ID NO: 2517657 - protein, 21 aa, Entamoeba dispar
RFLHNLPPKAMGQNLKVFLYP

SEQ ID NO: 2517658 - protein, 25 aa, Entamoeba dispar
RIAGKLDHFFPIQKIWNQNGVIMFD

SEQ ID NO: 2517659 - protein, 22 aa, Entamoeba dispar
RKDFELVAINDPFMDPKYMVYL

SEQ ID NO: 2517660 - protein, 25 aa, Entamoeba dispar
RKFSFHSFFILGMTKNQIIQQTLFN

SEQ ID NO: 2517661 - protein, 34 aa, Entamoeba dispar
RKKEAFIRKLTSKSYYIMPCCTTRFVLDAKYSDF

SEQ ID NO: 2517662 - protein, 19 aa, Entamoeba dispar
RLMYNTKRRFCLVPLTAEQ

SEQ ID NO: 2517663 - protein, 22 aa, Entamoeba dispar
RVVFRNPRQYGLDKELFICAEG

SEQ ID NO: 2517664 - protein, 23 aa, Entamoeba dispar
SALNKYKLPKTYMKLEYCVSCGI

SEQ ID NO: 2517665 - protein, 34 aa, Entamoeba dispar
SEIVPFFLNIFGSLLLKFNIYGGWTFIYQILYSV

SEQ ID NO: 2517666 - protein, 19 aa, Entamoeba dispar
SGKIVVNLNGRLNKCAVIS

SEQ ID NO: 2517667 - protein, 17 aa, Entamoeba dispar
SLIRAMFDKGIKVGGSL

SEQ ID NO: 2517668 - protein, 18 aa, Entamoeba dispar
SNCRAMVGIIAGGGRTEK

SEQ ID NO: 2517669 - protein, 26 aa, Entamoeba dispar
SPNAFNLHSFILLNISLNDLKNYRFF

SEQ ID NO: 2517670 - protein, 18 aa, Entamoeba dispar
SQLIKQHDLIPLVEFVFG

SEQ ID NO: 2517671 - protein, 25 aa, Entamoeba dispar
SSYSSFIYQSKLPGASLHLSLDVAG

SEQ ID NO: 2517672 - protein, 24 aa, Entamoeba dispar
TCDMDKVIELALKYKDERTILMIR

SEQ ID NO: 2517673 - protein, 20 aa, Entamoeba dispar
TIDISLWKFETSKYYFTIID

SEQ ID NO: 2517674 - protein, 29 aa, Entamoeba dispar
TKGYQYKMRVVYAHFPVTLVIADDGKSIQ

SEQ ID NO: 2517675 - protein, 22 aa, Entamoeba dispar
TKSFFEKLAKYIGRNIRFLIDN

SEQ ID NO: 2517676 - protein, 18 aa, Entamoeba dispar
TLLNSFVNALYGIKITDD

SEQ ID NO: 2517677 - protein, 33 aa, Entamoeba dispar
TLRQEYCFIPFKYRDGYLLSILKETEGKSIIIF

SEQ ID NO: 2517678 - protein, 22 aa, Entamoeba dispar
TNPLKNWAAMVKLNPYAKIASH

SEQ ID NO: 2517679 - protein, 21 aa, Entamoeba dispar
TPIYGMNYEKFMPALIQYYKQ

SEQ ID NO: 2517680 - protein, 24 aa, Entamoeba dispar
TPMGGFPHYGVVKNDFLMIKGTVA

SEQ ID NO: 2517681 - protein, 36 aa, Entamoeba dispar
TPSDESYRFYQLLLFNFSQFIADEDFNRYWDVFTGE

SEQ ID NO: 2517682 - protein, 26 aa, Entamoeba dispar
TTIIVNLHIWKALNPSFKTQIATIII

SEQ ID NO: 2517683 - protein, 32 aa, Entamoeba dispar
TTTLTKIIGVSWKLDFFVRPEHKEISPVFLVT

SEQ ID NO: 2517684 - protein, 20 aa, Entamoeba dispar
VDVSPLRRINQALYLMTMGC

SEQ ID NO: 2517685 - protein, 18 aa, Entamoeba dispar
VFETSQLPESIKYISFSL

SEQ ID NO: 2517686 - protein, 29 aa, Entamoeba dispar
VNSCTLTIHWQFDVTLRGLRKVLVSEDNS

SEQ ID NO: 2517687 - protein, 30 aa, Entamoeba dispar
VPLDLINPPVLRIKVFEPLFIVGKENYAKL

SEQ ID NO: 2517688 - protein, 26 aa, Entamoeba dispar
VPVKVDNHIWIYTRSAKHATAAPTEA

SEQ ID NO: 2517689 - protein, 28 aa, Entamoeba dispar
VRASLEMTFIGNGLLNSATFPSICTAWD

SEQ ID NO: 2517690 - protein, 19 aa, Entamoeba dispar
VSARGHHIAGVPQIPLVVN

SEQ ID NO: 2517691 - protein, 27 aa, Entamoeba dispar
VSEDNSFKPYIGFIGYARNNNGLVVPN

SEQ ID NO: 2517692 - protein, 18 aa, Entamoeba dispar
VSLFIKNIALFPTKERDS

SEQ ID NO: 2517693 - protein, 18 aa, Entamoeba dispar
VVKARFLHNLPPKAMGQN

SEQ ID NO: 2517694 - protein, 26 aa, Entamoeba dispar
VVNRVATYEVIPSAAALILKALKEPP

SEQ ID NO: 2517695 - protein, 24 aa, Entamoeba dispar
WEANLLPSRHFGALVLTTSYGILD

SEQ ID NO: 2517696 - protein, 23 aa, Entamoeba dispar
YCKKECCCPRIKAFKKFMNTFEK

SEQ ID NO: 2517697 - protein, 24 aa, Entamoeba dispar
YEPQKLIEYPYKQPQIEYKEKKPK

SEQ ID NO: 2517698 - protein, 25 aa, Entamoeba dispar
AAPTPKKFLILAGIEDVFTQTTGHT

SEQ ID NO: 2517699 - protein, 38 aa, Entamoeba dispar
AEKNRLLHQLKKLGKFNEIFLLNSWFSSNPNASSLQIK

SEQ ID NO: 2517700 - protein, 36 aa, Entamoeba dispar
AESIGKGFIREGWGCLLMNSRIWERVSQGLWKDEEK

SEQ ID NO: 2517701 - protein, 29 aa, Entamoeba dispar
AESISFLVPFDLRRFLPFESDCIGLLSET

SEQ ID NO: 2517702 - protein, 20 aa, Entamoeba dispar
AFEDLGMEAVWKIKVEDLLA

SEQ ID NO: 2517703 - protein, 22 aa, Entamoeba dispar
AFFRCKSLISITLSTSIKILPK

SEQ ID NO: 2517704 - protein, 20 aa, Entamoeba dispar
AGAQYRGQFEERLKAVIKEV

SEQ ID NO: 2517705 - protein, 21 aa, Entamoeba dispar
AGKIPFIIRRRLPNGSFEDWK

SEQ ID NO: 2517706 - protein, 23 aa, Entamoeba dispar
AGKISGVHWWYNDQSHAAEMTAG

SEQ ID NO: 2517707 - protein, 17 aa, Entamoeba dispar
AGLAPKIPEDLYFLMKR

SEQ ID NO: 2517708 - protein, 27 aa, Entamoeba dispar
AGPMEKIFFIPERTKVGIVTCGGLCPG

SEQ ID NO: 2517709 - protein, 22 aa, Entamoeba dispar
AGQTYFDIISEKTTYRLENFPP

SEQ ID NO: 2517710 - protein, 26 aa, Entamoeba dispar
AIAQITQNFSWVRVGCICMVVANRRL

SEQ ID NO: 2517711 - protein, 26 aa, Entamoeba dispar
AIEIKQVIQLLLNGVIYPMLMKNYRH

SEQ ID NO: 2517712 - protein, 17 aa, Entamoeba dispar
AIEKWFKSIGMKTKLSE

SEQ ID NO: 2517713 - protein, 25 aa, Entamoeba dispar
AIPPNKRWGALLPVGLIPPEITTPV

SEQ ID NO: 2517714 - protein, 24 aa, Entamoeba dispar
AIQFISNLLVLEPSLRLTAEEALQ

SEQ ID NO: 2517715 - protein, 17 aa, Entamoeba dispar
AKKLHKLAMLKEAKRYA

SEQ ID NO: 2517716 - protein, 26 aa, Entamoeba dispar
AKLYYERQFHHSIPAILSVIQQSHLP

SEQ ID NO: 2517717 - protein, 21 aa, Entamoeba dispar
ALFLKTLLDKKYSLPYAALDA

SEQ ID NO: 2517718 - protein, 24 aa, Entamoeba dispar
ALGTQIPLLLKKFPMEDDLSTHTN

SEQ ID NO: 2517719 - protein, 23 aa, Entamoeba dispar
ALKRYGYENLPVDTFMTIGSLAE

SEQ ID NO: 2517720 - protein, 18 aa, Entamoeba dispar
ALLLIRKNVLHQNHPNLN

SEQ ID NO: 2517721 - protein, 18 aa, Entamoeba dispar
ALRVLNSYFIGQDSTYRF

SEQ ID NO: 2517722 - protein, 20 aa, Entamoeba dispar
AMRAGAKRRFDAKFGAIASN

SEQ ID NO: 2517723 - protein, 19 aa, Entamoeba dispar
AQEKALIIPLQAISTANLN

SEQ ID NO: 2517724 - protein, 25 aa, Entamoeba dispar
AQPKGVLLYGPPGTGKTLLARAVAH

SEQ ID NO: 2517725 - protein, 23 aa, Entamoeba dispar
ARDALMTMVIIQKGDVWNEIERW

SEQ ID NO: 2517726 - protein, 29 aa, Entamoeba dispar
ARGNNAYMKLLVRLYGFLARRTQSKFAKT

SEQ ID NO: 2517727 - protein, 17 aa, Entamoeba dispar
ARRLDIEHYTRTDLFPW

SEQ ID NO: 2517728 - protein, 25 aa, Entamoeba dispar
ARSLKWLCQCIYYNELIIPDEEGKP

SEQ ID NO: 2517729 - protein, 19 aa, Entamoeba dispar
ASADRTIKIWKVKQNYSLV

SEQ ID NO: 2517730 - protein, 24 aa, Entamoeba dispar
ASVVAKHLLLGQKIVLVRCEDLQV

SEQ ID NO: 2517731 - protein, 21 aa, Entamoeba dispar
ATENIFTKKFFKSLSSVTTAL

SEQ ID NO: 2517732 - protein, 27 aa, Entamoeba dispar
ATFVPPAQIMFKWFNTIYKVGGDGCVM

SEQ ID NO: 2517733 - protein, 29 aa, Entamoeba dispar
ATPIELIPEFFFLPQFLINFNTIDFGKRR

SEQ ID NO: 2517734 - protein, 24 aa, Entamoeba dispar
AVAFDMPIPGYKTLNTLNLRLWSS

SEQ ID NO: 2517735 - protein, 25 aa, Entamoeba dispar
AVGKSCLLLQFQDKRFQPIHDLTIG

SEQ ID NO: 2517736 - protein, 18 aa, Entamoeba dispar
AVLNLMKFNGGYSWWRRN

SEQ ID NO: 2517737 - protein, 28 aa, Entamoeba dispar
AVRASMEMTFIGNQLLNSATFPSICTAW

SEQ ID NO: 2517738 - protein, 29 aa, Entamoeba dispar
AYDDEQNYRFILFDDINYDKNLLRLIKAI

SEQ ID NO: 2517739 - protein, 25 aa, Entamoeba dispar
AYDSYRRFVSLFGKIALNVDDEVYD

SEQ ID NO: 2517740 - protein, 28 aa, Entamoeba dispar
AYERHMMDLLRRGLDKKALKYAKKHLGT

SEQ ID NO: 2517741 - protein, 17 aa, Entamoeba dispar
AYGARPMRRYIEKTVVT

SEQ ID NO: 2517742 - protein, 18 aa, Entamoeba dispar
CDMDKVIELALKYKDERT

SEQ ID NO: 2517743 - protein, 27 aa, Entamoeba dispar
CEADKLLVYLIFYIQSLLLQFNGHTKV

SEQ ID NO: 2517744 - protein, 20 aa, Entamoeba dispar
CETILKRTYKITKYIRCKKV

SEQ ID NO: 2517745 - protein, 26 aa, Entamoeba dispar
CFCRCYSLSNIIIPSSISKLGNGCFY

SEQ ID NO: 2517746 - protein, 18 aa, Entamoeba dispar
CFSWCLSLTSINIPSSVS

SEQ ID NO: 2517747 - protein, 20 aa, Entamoeba dispar
CFYKCSSLEYINIPTTINKI

SEQ ID NO: 2517748 - protein, 22 aa, Entamoeba dispar
CGDIHGQFYDLLRLFEIGGNIP

SEQ ID NO: 2517749 - protein, 18 aa, Entamoeba dispar
CIDKQYLSFIFKFLDGLF

SEQ ID NO: 2517750 - protein, 19 aa, Entamoeba dispar
CIGVLPKPIKCKCGDHMID

SEQ ID NO: 2517751 - protein, 18 aa, Entamoeba dispar
CKDFILGLLTVKASSRLS

SEQ ID NO: 2517752 - protein, 17 aa, Entamoeba dispar
CKYGIYPHELLIGKHYG

SEQ ID NO: 2517753 - protein, 42 aa, Entamoeba dispar
CLSLMGTDFHLFLKEGFRILKPNGLMIIAEPISRLKSIKGFI

SEQ ID NO: 2517754 - protein, 18 aa, Entamoeba dispar
CNGEETSILIDKSTFRDC

SEQ ID NO: 2517755 - protein, 26 aa, Entamoeba dispar
CNLLGKFELTGIPPAPRGVPQIEVTF

SEQ ID NO: 2517756 - protein, 27 aa, Entamoeba dispar
CNMNLELPFVPFLSKADLLGGYGFNVR

SEQ ID NO: 2517757 - protein, 24 aa, Entamoeba dispar
CNSSIQHGLPYKAFHGKTGRVWNV

SEQ ID NO: 2517758 - protein, 23 aa, Entamoeba dispar
CSHNTFIRYLQNSISTFYKNAFL

SEQ ID NO: 2517759 - protein, 26 aa, Entamoeba dispar
CVQKKILRAFLINEHNLIKLAAAKTN

SEQ ID NO: 2517760 - protein, 27 aa, Entamoeba dispar
CVTKYGNVFGIFFHSVKILRNQTFVCN

SEQ ID NO: 2517761 - protein, 28 aa, Entamoeba dispar
DALLCYCESLLCYGQLILRKEMTRLNIG

SEQ ID NO: 2517762 - protein, 17 aa, Entamoeba dispar
DASLIRAMFDKGIKVGG

SEQ ID NO: 2517763 - protein, 25 aa, Entamoeba dispar
DAYKHYFDCIFGPFKNYVIKGINMI

SEQ ID NO: 2517764 - protein, 20 aa, Entamoeba dispar
DCIGLLSETIYPTLPISIIN

SEQ ID NO: 2517765 - protein, 27 aa, Entamoeba dispar
DCWSCGVVIYSLLYGTFPFAGEDQELV

SEQ ID NO: 2517766 - protein, 26 aa, Entamoeba dispar
DDEQQYKFIIFDDINYDKNLLRLIKA

SEQ ID NO: 2517767 - protein, 18 aa, Entamoeba dispar
DECENCQFIINKNQIKEM

SEQ ID NO: 2517768 - protein, 21 aa, Entamoeba dispar
DECFYLCYSLQSINIPSTISK

SEQ ID NO: 2517769 - protein, 23 aa, Entamoeba dispar
DECLRKLFECLPGESMKGTGIIV

SEQ ID NO: 2517770 - protein, 25 aa, Entamoeba dispar
DEGILQVNLPRKQQTRRSMYPRFGM

SEQ ID NO: 2517771 - protein, 19 aa, Entamoeba dispar
DELEVIRRACDVLGSGIEE

SEQ ID NO: 2517772 - protein, 24 aa, Entamoeba dispar
DENIIKIFCYCNNGFFSPLDTAFG

SEQ ID NO: 2517773 - protein, 25 aa, Entamoeba dispar
DENNVFVMLVFRKNAKNYVLNQNQM

SEQ ID NO: 2517774 - protein, 26 aa, Entamoeba dispar
DGAVGKTCLLLAFSKGEIPTAYVPTV

SEQ ID NO: 2517775 - protein, 23 aa, Entamoeba dispar
DGEFELMNYRLTSNIRQLIWVES

SEQ ID NO: 2517776 - protein, 25 aa, Entamoeba dispar
DGRINKYVIWYQVEYSRCLKEKEQG

SEQ ID NO: 2517777 - protein, 26 aa, Entamoeba dispar
DHAKKFIDFLQTLVPLRYQQTKKLVS

SEQ ID NO: 2517778 - protein, 26 aa, Entamoeba dispar
DHLLRYKFLLAFEREMLHLEDQYPWL

SEQ ID NO: 2517779 - protein, 21 aa, Entamoeba dispar
DIAKIAMKYCNGRFGTFSQLY

SEQ ID NO: 2517780 - protein, 21 aa, Entamoeba dispar
DIDLKLMRMGFETITEKSKIS

SEQ ID NO: 2517781 - protein, 23 aa, Entamoeba dispar
DIEIDGRRLILQKAIKKEQAKET

SEQ ID NO: 2517782 - protein, 18 aa, Entamoeba dispar
DIIPKFIMSSGEMVNLLL

SEQ ID NO: 2517783 - protein, 21 aa, Entamoeba dispar
DIKESFTAFKTEMDKMADIEE

SEQ ID NO: 2517784 - protein, 17 aa, Entamoeba dispar
DILKIHSKKMNLVRGID

SEQ ID NO: 2517785 - protein, 25 aa, Entamoeba dispar
DKELKIIKCINILSSIALNGKITSS

SEQ ID NO: 2517786 - protein, 22 aa, Entamoeba dispar
DKFKKLWDYCSMYLSKDVETIK

SEQ ID NO: 2517787 - protein, 25 aa, Entamoeba dispar
DKFRSEYIIHFYGAVFIPNKICMIT

SEQ ID NO: 2517788 - protein, 23 aa, Entamoeba dispar
DKIRPLWRHYYQNTQAIIFVVDS

SEQ ID NO: 2517789 - protein, 26 aa, Entamoeba dispar
DKIRSEYIIHFYGAVFIPNKICMITE

SEQ ID NO: 2517790 - protein, 20 aa, Entamoeba dispar
DKIYKLSPVWLATISSNSIT

SEQ ID NO: 2517791 - protein, 25 aa, Entamoeba dispar
DKKKTFMDIIDYIDFNQAIVFAENS

SEQ ID NO: 2517792 - protein, 22 aa, Entamoeba dispar
DKKYLKILEKEAWLVEDIALTA

SEQ ID NO: 2517793 - protein, 26 aa, Entamoeba dispar
DKLDEATYLALLAQKLQEPDSVEEIQ

SEQ ID NO: 2517794 - protein, 20 aa, Entamoeba dispar
DLIKIFDKFGYPTKQHVYIL

SEQ ID NO: 2517795 - protein, 20 aa, Entamoeba dispar
DNAKWTTYLNDIVSGATLNI

SEQ ID NO: 2517796 - protein, 26 aa, Entamoeba dispar
DNEQQFYQFGGRPYNPPIPDESLQNI

SEQ ID NO: 2517797 - protein, 25 aa, Entamoeba dispar
DNQTTIEFNIYKGFGKYVNSYEMEY

SEQ ID NO: 2517798 - protein, 26 aa, Entamoeba dispar
DNRLVNYFIEEFKRKYKKDISGNARA

SEQ ID NO: 2517799 - protein, 26 aa, Entamoeba dispar
DNRPASALPFKISAAKLDALSGQLLN

SEQ ID NO: 2517800 - protein, 34 aa, Entamoeba dispar
DPKVMAQFLIDNNFNILFTLGGDGTLRGANRINK

SEQ ID NO: 2517801 - protein, 20 aa, Entamoeba dispar
DPLINQQLLDKFPFCRGSSA

SEQ ID NO: 2517802 - protein, 30 aa, Entamoeba dispar
DPQVGIYGMDFFVVLARPGFRVSRRKRMQD

SEQ ID NO: 2517803 - protein, 21 aa, Entamoeba dispar
DPSLVAYLKSLGIDPDYVPPK

SEQ ID NO: 2517804 - protein, 28 aa, Entamoeba dispar
DQILEEYLRIFEKLPPIIKDFIENLTKL

SEQ ID NO: 2517805 - protein, 26 aa, Entamoeba dispar
DQQLHPIQPLLNKKIVITAGPTIEPI

SEQ ID NO: 2517806 - protein, 17 aa, Entamoeba dispar
DREGLGRVLSFPPHKQE

SEQ ID NO: 2517807 - protein, 24 aa, Entamoeba dispar
DRKALIWDLYPIETLNDPVAIQYE

SEQ ID NO: 2517808 - protein, 26 aa, Entamoeba dispar
DSAVDWWSFGILTYEMMVGIPPFYSE

SEQ ID NO: 2517809 - protein, 19 aa, Entamoeba dispar
DSHIPYRNSKLTELLQNCL

SEQ ID NO: 2517810 - protein, 24 aa, Entamoeba dispar
DSPYQGGLFFLDVHFPVDYPFKAP

SEQ ID NO: 2517811 - protein, 18 aa, Entamoeba dispar
DTIKFILKGYQKIGRDIK

SEQ ID NO: 2517812 - protein, 19 aa, Entamoeba dispar
DTLIDLYQVISVNQSVIFC

SEQ ID NO: 2517813 - protein, 17 aa, Entamoeba dispar
DTLYILRGIREKYENHY

SEQ ID NO: 2517814 - protein, 22 aa, Entamoeba dispar
DVECAILVAGMPRKVGMERKEL

SEQ ID NO: 2517815 - protein, 31 aa, Entamoeba dispar
DVHKEILMLLFNLIVMENGVLDPLYTDQFPD

SEQ ID NO: 2517816 - protein, 24 aa, Entamoeba dispar
DVIKPLNIQPLLSHKLKTLSGGEL

SEQ ID NO: 2517817 - protein, 21 aa, Entamoeba dispar
DVLYTIKIVFVGDPCTLDDRK

SEQ ID NO: 2517818 - protein, 25 aa, Entamoeba dispar
DVQYCPLEYYMLSSSYDRTARLWTS

SEQ ID NO: 2517819 - protein, 31 aa, Entamoeba dispar
DVVLSPELLLQYYLHTILPIKKLDSSTIICG

SEQ ID NO: 2517820 - protein, 17 aa, Entamoeba dispar
DVVPIPNANSLGYAGTN

SEQ ID NO: 2517821 - protein, 19 aa, Entamoeba dispar
DWFDYQKELKLLRAKEYQE

SEQ ID NO: 2517822 - protein, 18 aa, Entamoeba dispar
DWTFYCHKCDGMASLRTC

SEQ ID NO: 2517823 - protein, 34 aa, Entamoeba dispar
DWVNRRSWWHNPEMTEFIIFNFSHKHPLVPEKSG

SEQ ID NO: 2517824 - protein, 37 aa, Entamoeba dispar
DYGITDKSIIYLVLRQRGGKPVILLYDDKKKINEAVS

SEQ ID NO: 2517825 - protein, 21 aa, Entamoeba dispar
DYKLCPFTRHVFLSGGVAVGK

SEQ ID NO: 2517826 - protein, 18 aa, Entamoeba dispar
DYRILTTSVYIPLDFTTI

SEQ ID NO: 2517827 - protein, 19 aa, Entamoeba dispar
DYVSALVICHTRELALQAQ

SEQ ID NO: 2517828 - protein, 28 aa, Entamoeba dispar
EADVEPLVLQLKAFLEKHDLDVSVKFKP

SEQ ID NO: 2517829 - protein, 18 aa, Entamoeba dispar
EAEILALSTLKQVMEEKL

SEQ ID NO: 2517830 - protein, 20 aa, Entamoeba dispar
EAVIIKYVKAFVTVQIKEYT

SEQ ID NO: 2517831 - protein, 27 aa, Entamoeba dispar
ECLRVYVSSFWDQPFKESLFTGLFEKE

SEQ ID NO: 2517832 - protein, 20 aa, Entamoeba dispar
EDDRDYGSIPLPTVIRDELH

SEQ ID NO: 2517833 - protein, 24 aa, Entamoeba dispar
EDFNRYWDVFTGEKGFETLAPEDK

SEQ ID NO: 2517834 - protein, 26 aa, Entamoeba dispar
EDKKRIMLEILLETKVFRLAFDSEIT

SEQ ID NO: 2517835 - protein, 34 aa, Entamoeba dispar
EDYDRLRPLSYPQTDVFLICFSVVSPPSFDNVSS

SEQ ID NO: 2517836 - protein, 35 aa, Entamoeba dispar
EDYEQLRPLSYPNTDLFLLCFSVISRTSFNNISSK

SEQ ID NO: 2517837 - protein, 23 aa, Entamoeba dispar
EEEKIIRIIFKKVKGSCKVYKKY

SEQ ID NO: 2517838 - protein, 17 aa, Entamoeba dispar
EEFCCHLELNDAIDIGA

SEQ ID NO: 2517839 - protein, 25 aa, Entamoeba dispar
EEKGMSEIIMFGYESIMTSIMRKEN

SEQ ID NO: 2517840 - protein, 23 aa, Entamoeba dispar
EEKKDIEFIKTHKPTIVIGTPGR

SEQ ID NO: 2517841 - protein, 34 aa, Entamoeba dispar
EEKKKLLIMFINHYIYFFPLLDQITPDKITQIIN

SEQ ID NO: 2517842 - protein, 31 aa, Entamoeba dispar
EESKKLQIKYNGPLVILPEANVIEVFEAEEV

SEQ ID NO: 2517843 - protein, 18 aa, Entamoeba dispar
EFGIFKLDNQNKPSFKVM

SEQ ID NO: 2517844 - protein, 18 aa, Entamoeba dispar
EFKPELQNGRFIPCILYG

SEQ ID NO: 2517845 - protein, 25 aa, Entamoeba dispar
EFVGHTIALYREDSYLTRPAIETVK

SEQ ID NO: 2517846 - protein, 35 aa, Entamoeba dispar
EGGRSKEIYFFSDPKKRLLHDLPNLDREIVGKWKE

SEQ ID NO: 2517847 - protein, 20 aa, Entamoeba dispar
EGKFYTLVSYVPVASFKGLV

SEQ ID NO: 2517848 - protein, 24 aa, Entamoeba dispar
EGKTFVHPFNDPWVMAGQGTIALE

SEQ ID NO: 2517849 - protein, 24 aa, Entamoeba dispar
EIIITLFCMKINNPKKIIILRGNH

SEQ ID NO: 2517850 - protein, 26 aa, Entamoeba dispar
EIIPKKYYIEIPLSLQQFIDKCKLLY

SEQ ID NO: 2517851 - protein, 19 aa, Entamoeba dispar
EIKELLYNGIYYCTKQSIN

SEQ ID NO: 2517852 - protein, 27 aa, Entamoeba dispar
EIKKPIRGINISGRPWKEAYKKKSIKD

SEQ ID NO: 2517853 - protein, 28 aa, Entamoeba dispar
EINLCPVILIQDITYMYVRHNGLYFMAF

SEQ ID NO: 2517854 - protein, 30 aa, Entamoeba dispar
EIPEDRQIDLWPNFQFFLNEQAKEKYGDAI

SEQ ID NO: 2517855 - protein, 23 aa, Entamoeba dispar
EIPLHSFLNQFRMLSRRDCELEE

SEQ ID NO: 2517856 - protein, 18 aa, Entamoeba dispar
EIRPRNDIDDIKESFTAF

SEQ ID NO: 2517857 - protein, 25 aa, Entamoeba dispar
EISKKYQKYPRLYYTWIDKVVQTQE

SEQ ID NO: 2517858 - protein, 24 aa, Entamoeba dispar
EIVETYSFLRWSISDGTTNYSEQI

SEQ ID NO: 2517859 - protein, 21 aa, Entamoeba dispar
EKDALSTSQLIYPCMQCADIF

SEQ ID NO: 2517860 - protein, 24 aa, Entamoeba dispar
EKEVDIYIMSAAVADYRPMKIANQ

SEQ ID NO: 2517861 - protein, 22 aa, Entamoeba dispar
EKMMTIPTILSGKLYEFKPEIQ

SEQ ID NO: 2517862 - protein, 29 aa, Entamoeba dispar
EKYIDIMVNLLFYIPMRNEYLDQLINGID

SEQ ID NO: 2517863 - protein, 22 aa, Entamoeba dispar
ELINIIHDSKFKSVPRSTLDDA

SEQ ID NO: 2517864 - protein, 22 aa, Entamoeba dispar
ELIVFETSQLPESIKYISFSLS

SEQ ID NO: 2517865 - protein, 26 aa, Entamoeba dispar
ELMTQAEGLLRMGLHPTIIADGYRTG

SEQ ID NO: 2517866 - protein, 21 aa, Entamoeba dispar
ELPLGFDNYVLWVKGEDADLK

SEQ ID NO: 2517867 - protein, 27 aa, Entamoeba dispar
ELQNGRFIPCILYGAKAQLPGMTGDEN

SEQ ID NO: 2517868 - protein, 23 aa, Entamoeba dispar
EMNQFFSELSPKKLLRMYDTVAS

SEQ ID NO: 2517869 - protein, 23 aa, Entamoeba dispar
EMRSFYDIFDYLSSSQLQTTKEM

SEQ ID NO: 2517870 - protein, 17 aa, Entamoeba dispar
EMTGIEKGTILTTDNKN

SEQ ID NO: 2517871 - protein, 26 aa, Entamoeba dispar
ENGGYSWWRRNSLTVFLDKKIYKDPQ

SEQ ID NO: 2517872 - protein, 17 aa, Entamoeba dispar
EPAFAHRGFQMGVRKPH

SEQ ID NO: 2517873 - protein, 29 aa, Entamoeba dispar
EPGINGFLKKFYYTMKEPSYIDWKLNSSD

SEQ ID NO: 2517874 - protein, 23 aa, Entamoeba dispar
EPIVIDKSVIIIGLVEEGGSNVV

SEQ ID NO: 2517875 - protein, 29 aa, Entamoeba dispar
EPNVNSFLKKFYYTMKEPSYIDWKINNSD

SEQ ID NO: 2517876 - protein, 24 aa, Entamoeba dispar
EPVDWWGFGILIYEMIHGHAPFTS

SEQ ID NO: 2517877 - protein, 21 aa, Entamoeba dispar
EQHLPAMIKSFRLACYKFAGR

SEQ ID NO: 2517878 - protein, 18 aa, Entamoeba dispar
EQLYDPLINQQLLDKFPF

SEQ ID NO: 2517879 - protein, 25 aa, Entamoeba dispar
EQMEQLILQAQNELKKRIYQENEIV

SEQ ID NO: 2517880 - protein, 24 aa, Entamoeba dispar
EQSLKLSSILYDNTINIIAEEVLK

SEQ ID NO: 2517881 - protein, 24 aa, Entamoeba dispar
ERDKTLIKWMIKDILQRKKHSNLH

SEQ ID NO: 2517882 - protein, 29 aa, Entamoeba dispar
ERENKEFGWLFIKVLSLSDHFPYNYYYTL

SEQ ID NO: 2517883 - protein, 28 aa, Entamoeba dispar
ERERNDFIVYWITKLGKRKYHLVTICDS

SEQ ID NO: 2517884 - protein, 18 aa, Entamoeba dispar
ERIGSRQYNFMKEKKIRA

SEQ ID NO: 2517885 - protein, 17 aa, Entamoeba dispar
ERIHSEEYNIETPILII

SEQ ID NO: 2517886 - protein, 25 aa, Entamoeba dispar
ERSISFLVSLLKKGWQNIKCLYIKS

SEQ ID NO: 2517887 - protein, 28 aa, Entamoeba dispar
ESGILYDEYIMMQIPSVLPIQKGVEITE

SEQ ID NO: 2517888 - protein, 29 aa, Entamoeba dispar
ESRELMTYLIKRIKGLNKLKLINASYIWT

SEQ ID NO: 2517889 - protein, 22 aa, Entamoeba dispar
ESYGLLSIIGVSNRATIIIDDK

SEQ ID NO: 2517890 - protein, 24 aa, Entamoeba dispar
ETGVECMLYCEVPYDAIQVVSQLF

SEQ ID NO: 2517891 - protein, 23 aa, Entamoeba dispar
ETIKIFGMIRGEQRLTLTGHIGA

SEQ ID NO: 2517892 - protein, 20 aa, Entamoeba dispar
ETITLKDIPSLLVINKIKLT

SEQ ID NO: 2517893 - protein, 18 aa, Entamoeba dispar
ETIYPTLPISIINQSIEQ

SEQ ID NO: 2517894 - protein, 23 aa, Entamoeba dispar
ETKAVFSLFTPQLGLRIRYGNVS

SEQ ID NO: 2517895 - protein, 17 aa, Entamoeba dispar
ETSFPYSTTFDWGNIVE

SEQ ID NO: 2517896 - protein, 26 aa, Entamoeba dispar
ETYKTNFAGLLWRPQPTNIIKPEMAK

SEQ ID NO: 2517897 - protein, 17 aa, Entamoeba dispar
EVGQFMLATSKSVFLWL

SEQ ID NO: 2517898 - protein, 19 aa, Entamoeba dispar
EVLKVVEYLGYKKPTKIQE

SEQ ID NO: 2517899 - protein, 31 aa, Entamoeba dispar
EVLTESTLYAAWNPDFLLSVLLGNQTATCQT

SEQ ID NO: 2517900 - protein, 22 aa, Entamoeba dispar
EVSPVITFLKAINQKIIASSTM

SEQ ID NO: 2517901 - protein, 23 aa, Entamoeba dispar
EVTFPCIYGMAAKRTIPSGFYQN

SEQ ID NO: 2517902 - protein, 25 aa, Entamoeba dispar
EYDRLRPLSYADSDVVLLCFAVNNR

SEQ ID NO: 2517903 - protein, 23 aa, Entamoeba dispar
EYGNVFGIFFHSVKILRNQTFVC

SEQ ID NO: 2517904 - protein, 23 aa, Entamoeba dispar
FAIKSLQLFSINEIYFNSIAMKF

SEQ ID NO: 2517905 - protein, 44 aa, Entamoeba dispar
FAQHIKTMIKIIRNVFPITDFWRHVCIVWTKCYCYIPKEVIEEK

SEQ ID NO: 2517906 - protein, 20 aa, Entamoeba dispar
FCALIHRHRPDLLDWETVGE

SEQ ID NO: 2517907 - protein, 26 aa, Entamoeba dispar
FDDFIEKLIKLPRKSLEKSREVLKSR

SEQ ID NO: 2517908 - protein, 27 aa, Entamoeba dispar
FDDGRIFKTIIWYTVDYSTYLFEKEQG

SEQ ID NO: 2517909 - protein, 31 aa, Entamoeba dispar
FDKKNDLPSLLLLPIKFLPQFYSLIKEYHKS

SEQ ID NO: 2517910 - protein, 17 aa, Entamoeba dispar
FDPNYSTLFITGGGIDG

SEQ ID NO: 2517911 - protein, 17 aa, Entamoeba dispar
FDTKWFCSKIRKLRMEG

SEQ ID NO: 2517912 - protein, 18 aa, Entamoeba dispar
FDWNLIIETLKKIKAKKS

SEQ ID NO: 2517913 - protein, 18 aa, Entamoeba dispar
FEIQRFIEFSALKNSLNE

SEQ ID NO: 2517914 - protein, 20 aa, Entamoeba dispar
FESLKIPYRVVNIVSGALNN

SEQ ID NO: 2517915 - protein, 20 aa, Entamoeba dispar
FETFPIAGDLPRLLKHLSIV

SEQ ID NO: 2517916 - protein, 18 aa, Entamoeba dispar
FGPMNGTTILILDRSFDP

SEQ ID NO: 2517917 - protein, 31 aa, Entamoeba dispar
FIDDGEKLFLHGLHLYFKKLGDNDKKKTFMD

SEQ ID NO: 2517918 - protein, 17 aa, Entamoeba dispar
FIHVKQLNKDRLKRLVF

SEQ ID NO: 2517919 - protein, 30 aa, Entamoeba dispar
FIPENQNGRFYPFIMYGAKATLPTGEGDIT

SEQ ID NO: 2517920 - protein, 19 aa, Entamoeba dispar
FISEKRIFMNEPVLVSIKI

SEQ ID NO: 2517921 - protein, 19 aa, Entamoeba dispar
FKEGLKKLAAALAVGAKLG

SEQ ID NO: 2517922 - protein, 19 aa, Entamoeba dispar
FLEEATVVSLPKKSVYRLG

SEQ ID NO: 2517923 - protein, 17 aa, Entamoeba dispar
FLFPRTTNEVTCSRNPL

SEQ ID NO: 2517924 - protein, 23 aa, Entamoeba dispar
FLNEQFISFIKLNSQDNLKTVRE

SEQ ID NO: 2517925 - protein, 22 aa, Entamoeba dispar
FMPALMQYYKQPQEKHLLIILE

SEQ ID NO: 2517926 - protein, 28 aa, Entamoeba dispar
FMRERHIQIWSPILRNNIAILIIDPHAN

SEQ ID NO: 2517927 - protein, 18 aa, Entamoeba dispar
FNAVFNKEYAYRVSTDSG

SEQ ID NO: 2517928 - protein, 28 aa, Entamoeba dispar
FNDGKIFKKVIWYAISYSLYLKEKEAWN

SEQ ID NO: 2517929 - protein, 28 aa, Entamoeba dispar
FNDGKIFKYVIWYLVEYSKYLQEKEKRN

SEQ ID NO: 2517930 - protein, 25 aa, Entamoeba dispar
FNIPSSFLSFINLPTSSDLILSTPQ

SEQ ID NO: 2517931 - protein, 25 aa, Entamoeba dispar
FNSFITQHYPCIEKFLIGMRHVNFI

SEQ ID NO: 2517932 - protein, 19 aa, Entamoeba dispar
FNVVFNKEYAYRVSTDSGT

SEQ ID NO: 2517933 - protein, 18 aa, Entamoeba dispar
FQCPFPGCTLRFKRKSDA

SEQ ID NO: 2517934 - protein, 24 aa, Entamoeba dispar
FQKVNQNFDLMFGKRAFVHHYVGE

SEQ ID NO: 2517935 - protein, 27 aa, Entamoeba dispar
FQQILNDEVFFIEITKLKLTSSTTLNN

SEQ ID NO: 2517936 - protein, 25 aa, Entamoeba dispar
FQTDPSGMFIEFYAKATGAGTEAAQ

SEQ ID NO: 2517937 - protein, 26 aa, Entamoeba dispar
FQVEYRLLCEVFTDSILRNSNVVLLK

SEQ ID NO: 2517938 - protein, 21 aa, Entamoeba dispar
FRMGNLFIVGPTKTGKTEFAI

SEQ ID NO: 2517939 - protein, 27 aa, Entamoeba dispar
FRNIKNKWIIELRKYAPTVPVIVVGTQ

SEQ ID NO: 2517940 - protein, 31 aa, Entamoeba dispar
FRSVSRVFFTDIKGIFIVFSLDNMESLNHCK

SEQ ID NO: 2517941 - protein, 25 aa, Entamoeba dispar
FRTRTKMLSYWRRNLEDILSGEQLF

SEQ ID NO: 2517942 - protein, 26 aa, Entamoeba dispar
FSDTLRSYNIIFPHIEYCKILNSSMN

SEQ ID NO: 2517943 - protein, 38 aa, Entamoeba dispar
FSEVYPHLIFDNLTTPLGKRFEMILKYLFPVPKSDSKR

SEQ ID NO: 2517944 - protein, 29 aa, Entamoeba dispar
FTLQQTLCICLLSKWCRITIKKPTRRSCV

SEQ ID NO: 2517945 - protein, 22 aa, Entamoeba dispar
FTSDYKLTMLNDTKLAEIVQQI

SEQ ID NO: 2517946 - protein, 18 aa, Entamoeba dispar
FVDYPTYYVQTTYTNDKN

SEQ ID NO: 2517947 - protein, 24 aa, Entamoeba dispar
FVHINQFFVKSLLPPPQVLINAQK

SEQ ID NO: 2517948 - protein, 24 aa, Entamoeba dispar
FVNALYGIKITDDFRYIIINEDNL

SEQ ID NO: 2517949 - protein, 19 aa, Entamoeba dispar
FYGCSLLKSINIPSTISKI

SEQ ID NO: 2517950 - protein, 20 aa, Entamoeba dispar
FYKNAFLFREITSQTGVVIV

SEQ ID NO: 2517951 - protein, 29 aa, Entamoeba dispar
FYSSAVRCVLLRMGIIGIKVTIMLDTDPS

SEQ ID NO: 2517952 - protein, 18 aa, Entamoeba dispar
FYVPNIIGVLILSMSKRI

SEQ ID NO: 2517953 - protein, 24 aa, Entamoeba dispar
GAVGKTTFLLSYTSQSFLTEYTPT

SEQ ID NO: 2517954 - protein, 22 aa, Entamoeba dispar
GCQCFDWCIALTRIDIPSRTKE

SEQ ID NO: 2517955 - protein, 21 aa, Entamoeba dispar
GDGYVIVYSITSTTSFLEANG

SEQ ID NO: 2517956 - protein, 24 aa, Entamoeba dispar
GDLTPTLMRFFKAIPQIKTVCMVG

SEQ ID NO: 2517957 - protein, 17 aa, Entamoeba dispar
GDNYWDAKAKKWKKNGK

SEQ ID NO: 2517958 - protein, 18 aa, Entamoeba dispar
GEKKVLIFDLGGGTFDVS

SEQ ID NO: 2517959 - protein, 25 aa, Entamoeba dispar
GENKNGLFLILNISKCYQKETDKIP

SEQ ID NO: 2517960 - protein, 23 aa, Entamoeba dispar
GETRYPSYPLSRWSYCGVGEFQC

SEQ ID NO: 2517961 - protein, 28 aa, Entamoeba dispar
GFHVRIRIHPFHVLRINKMLSCAGADRL

SEQ ID NO: 2517962 - protein, 19 aa, Entamoeba dispar
GFKYGCDFVVYKKHPQCCH

SEQ ID NO: 2517963 - protein, 17 aa, Entamoeba dispar
GFQTKDLWKTGGIKQSP

SEQ ID NO: 2517964 - protein, 31 aa, Entamoeba dispar
GGEELIGIRRWLLVDSLLRAKSRIQEEVHYV

SEQ ID NO: 2517965 - protein, 26 aa, Entamoeba dispar
GGFGICWSNLLLGTFTVCEEGNLHIF

SEQ ID NO: 2517966 - protein, 33 aa, Entamoeba dispar
GGKFALDVFLPENYPYSPPIIKFATKVYHPNIS

SEQ ID NO: 2517967 - protein, 25 aa, Entamoeba dispar
GGLVFFHLFRSFMKHTRLTLQPSTQ

SEQ ID NO: 2517968 - protein, 23 aa, Entamoeba dispar
GGTFDICILNINKGIFQVKATNG

SEQ ID NO: 2517969 - protein, 28 aa, Entamoeba dispar
GHNESLKYDIRLFDDANLNDIIWPEFKS

SEQ ID NO: 2517970 - protein, 27 aa, Entamoeba dispar
GIEIHFPYQFIYPEQYQFIKTVTSGVT

SEQ ID NO: 2517971 - protein, 27 aa, Entamoeba dispar
GIELNQLWETLPFYLDEDKPLHGTNVP

SEQ ID NO: 2517972 - protein, 23 aa, Entamoeba dispar
GIIGWVISYFLPCKETLYNIYSQ

SEQ ID NO: 2517973 - protein, 17 aa, Entamoeba dispar
GIISGGGVFYNLTTQIL

SEQ ID NO: 2517974 - protein, 38 aa, Entamoeba dispar
GINALRNMLQLFLRQLPLKSKFEIISFGSKYDFMFKEM

SEQ ID NO: 2517975 - protein, 18 aa, Entamoeba dispar
GIPNLQVFMLMKGLATKK

SEQ ID NO: 2517976 - protein, 17 aa, Entamoeba dispar
GISEYLAIDIGCYCVFA

SEQ ID NO: 2517977 - protein, 17 aa, Entamoeba dispar
GITHYPLHTITFKSNYC

SEQ ID NO: 2517978 - protein, 27 aa, Entamoeba dispar
GIYISNKIIPFDNLIMDLIEINHNLLS

SEQ ID NO: 2517979 - protein, 20 aa, Entamoeba dispar
GKESWAIKSIFLGKKSYLDV

SEQ ID NO: 2517980 - protein, 23 aa, Entamoeba dispar
GKGYLTEYIVLNSNLRVVGIEGN

SEQ ID NO: 2517981 - protein, 28 aa, Entamoeba dispar
GKRYFKQCEFKLWRKQPQPIKTSPNAPI

SEQ ID NO: 2517982 - protein, 24 aa, Entamoeba dispar
GKTAVFVISILNQGLCLGDYVSAL

SEQ ID NO: 2517983 - protein, 20 aa, Entamoeba dispar
GLAMLGIGKIGWIEKKIPEC

SEQ ID NO: 2517984 - protein, 23 aa, Entamoeba dispar
GLHGWAFTLEKFAKMWSAKFGID

SEQ ID NO: 2517985 - protein, 23 aa, Entamoeba dispar
GLNLCLFETIFNWRQVNGLKHDD

SEQ ID NO: 2517986 - protein, 32 aa, Entamoeba dispar
GLRPYGVSFLYAGWDRYFGYQLYMCDPSGNYG

SEQ ID NO: 2517987 - protein, 19 aa, Entamoeba dispar
GMDALNSGALRFGAKEHFV

SEQ ID NO: 2517988 - protein, 19 aa, Entamoeba dispar
GMEAVWKIKVEDLLAFVLV

SEQ ID NO: 2517989 - protein, 18 aa, Entamoeba dispar
GMKQRFIKEITILSPPTI

SEQ ID NO: 2517990 - protein, 19 aa, Entamoeba dispar
GMNKIYVGPKRKRQHIAEA

SEQ ID NO: 2517991 - protein, 29 aa, Entamoeba dispar
GNATQAIYSFWLYDFCDVYLEASKVIFKG

SEQ ID NO: 2517992 - protein, 35 aa, Entamoeba dispar
GNQTATCQTLVFNLTWSWVVSLRGLRKSTLDVIPI

SEQ ID NO: 2517993 - protein, 35 aa, Entamoeba dispar
GNQTATCQTLVFNLTWSWVVSLRGLRKSTLDVVPI

SEQ ID NO: 2517994 - protein, 27 aa, Entamoeba dispar
GQATEKVFLQILPLTVVAGTEYLKSYE

SEQ ID NO: 2517995 - protein, 24 aa, Entamoeba dispar
GQHHRKTWFTTFHPDYFGKHGMRV

SEQ ID NO: 2517996 - protein, 22 aa, Entamoeba dispar
GRGCIIDCTISLNKKPGILTHS

SEQ ID NO: 2517997 - protein, 19 aa, Entamoeba dispar
GRIPHDIALSVLRSVNFDM

SEQ ID NO: 2517998 - protein, 18 aa, Entamoeba dispar
GRRGTLRRQAFGNFASAM

SEQ ID NO: 2517999 - protein, 18 aa, Entamoeba dispar
GRRVGTCFVKIVLQLSLP

SEQ ID NO: 2518000 - protein, 26 aa, Entamoeba dispar
GSITNNLVYIILSLVLSGFQQVYDTI

SEQ ID NO: 2518001 - protein, 25 aa, Entamoeba dispar
GSYRNYIVYFYYFIHVPTQIENNKD

SEQ ID NO: 2518002 - protein, 18 aa, Entamoeba dispar
GTPQVILMASGTEVDIAI

SEQ ID NO: 2518003 - protein, 19 aa, Entamoeba dispar
GTTILILDRSFDPITPLLT

SEQ ID NO: 2518004 - protein, 25 aa, Entamoeba dispar
GVEGIVKMWKINIPSSFKSSETLSL

SEQ ID NO: 2518005 - protein, 18 aa, Entamoeba dispar
GVFVYENGKGLFASCTMK

SEQ ID NO: 2518006 - protein, 17 aa, Entamoeba dispar
GWIDIRINLSNKIKKYY

SEQ ID NO: 2518007 - protein, 31 aa, Entamoeba dispar
GYRGNADVILPKGLIPWIDIPKCPKCGGLIK

SEQ ID NO: 2518008 - protein, 29 aa, Entamoeba dispar
HAAAYRYAKLLNIQLPRELLTGSNDDYYH

SEQ ID NO: 2518009 - protein, 24 aa, Entamoeba dispar
HDSELFKQFIRIPQNLLPEELQGD

SEQ ID NO: 2518010 - protein, 25 aa, Entamoeba dispar
HFGRNDPDFKWEFPKELEIPAELKP

SEQ ID NO: 2518011 - protein, 41 aa, Entamoeba dispar
HIKEILYCQVIEPMKIFIEQWNVYYKRISILKNRKIDMDRH

SEQ ID NO: 2518012 - protein, 26 aa, Entamoeba dispar
HIYYSDEKYFYFFNENEFKYDLKEDS

SEQ ID NO: 2518013 - protein, 27 aa, Entamoeba dispar
HKEDQIYRTIFIQNLSFRTTEEELKEK

SEQ ID NO: 2518014 - protein, 24 aa, Entamoeba dispar
HKHPLDYFFVVSKTCPLLKSEKHL

SEQ ID NO: 2518015 - protein, 27 aa, Entamoeba dispar
HLISPQCVIVSPQWLFLSINSKTIQPL

SEQ ID NO: 2518016 - protein, 35 aa, Entamoeba dispar
HLKEKEIIQLIGKLLNYNLYYSKIILLNNIEYNMM

SEQ ID NO: 2518017 - protein, 33 aa, Entamoeba dispar
HMLDHQKPLHFTSRYAYLTLWGDEVQNKIQFKE

SEQ ID NO: 2518018 - protein, 18 aa, Entamoeba dispar
HMYALALTPSLYTTVLQH

SEQ ID NO: 2518019 - protein, 20 aa, Entamoeba dispar
HPLALISITQSATHKTINCG

SEQ ID NO: 2518020 - protein, 43 aa, Entamoeba dispar
HPNTQLSRVILIRDQIFKLACNHYILPYIKIKEFPNNQRAVMY

SEQ ID NO: 2518021 - protein, 17 aa, Entamoeba dispar
HPRKRVHKVRATVSAFP

SEQ ID NO: 2518022 - protein, 26 aa, Entamoeba dispar
HTIGSLGLLSKSLVFRELCDCFDQFK

SEQ ID NO: 2518023 - protein, 19 aa, Entamoeba dispar
HTLRLWDLTKMESVRRFVG

SEQ ID NO: 2518024 - protein, 27 aa, Entamoeba dispar
HVGKLPRVFKLLPSFEEWIPLLQMTNP

SEQ ID NO: 2518025 - protein, 25 aa, Entamoeba dispar
HVNEADANLALLPRDIKAEDAVMLS

SEQ ID NO: 2518026 - protein, 23 aa, Entamoeba dispar
IADDFLTTTFLAASCPKLIAPAM

SEQ ID NO: 2518027 - protein, 19 aa, Entamoeba dispar
IAINSLKVNPWFTSERDIN

SEQ ID NO: 2518028 - protein, 28 aa, Entamoeba dispar
IDCVIEHLWDILSPRGIGYIVIIQDNDP

SEQ ID NO: 2518029 - protein, 25 aa, Entamoeba dispar
IDIKPKRIIFKLIEEYIKVSLKEAE

SEQ ID NO: 2518030 - protein, 25 aa, Entamoeba dispar
IDKDELYKYVYSISDPAERTKVIRT

SEQ ID NO: 2518031 - protein, 23 aa, Entamoeba dispar
IDKTIIFEKLIERIAYEGGDADT

SEQ ID NO: 2518032 - protein, 24 aa, Entamoeba dispar
IDNRLRRKFKGTNLLPKIGYGSAK

SEQ ID NO: 2518033 - protein, 26 aa, Entamoeba dispar
IDRKRMLEKLWGDNYWDAKAKKWKKN

SEQ ID NO: 2518034 - protein, 17 aa, Entamoeba dispar
IDRVCSCSIDTTCSVWS

SEQ ID NO: 2518035 - protein, 25 aa, Entamoeba dispar
IDSKIKEILPTGAIVYEKCPNCGNE

SEQ ID NO: 2518036 - protein, 26 aa, Entamoeba dispar
IEGKIQYVILGYAKAFEGIPRQLADN

SEQ ID NO: 2518037 - protein, 24 aa, Entamoeba dispar
IEIPLHSFLNQFRMLSRRDCELEE

SEQ ID NO: 2518038 - protein, 25 aa, Entamoeba dispar
IEQQSWLMMYVYKGLGASENKEATF

SEQ ID NO: 2518039 - protein, 26 aa, Entamoeba dispar
IERFHFNPIPLDYYSRKLFTNIETFH

SEQ ID NO: 2518040 - protein, 23 aa, Entamoeba dispar
IERFHFNPIPLNEYSRKLFPNIE

SEQ ID NO: 2518041 - protein, 25 aa, Entamoeba dispar
IERFHFNPIPLNKYSRKLFTNIETF

SEQ ID NO: 2518042 - protein, 19 aa, Entamoeba dispar
IFCNSKNRVEWIQRRLQAH

SEQ ID NO: 2518043 - protein, 17 aa, Entamoeba dispar
IFCVTKYGNVFGIFFHS

SEQ ID NO: 2518044 - protein, 19 aa, Entamoeba dispar
IFNEIKRLLKKKYVTTISS

SEQ ID NO: 2518045 - protein, 31 aa, Entamoeba dispar
IFRLLPGMCQSLLLRIIFLKERITIHELYNQ

SEQ ID NO: 2518046 - protein, 30 aa, Entamoeba dispar
IGCNCFYKCSLLTLINIPPSITAFGTACFY

SEQ ID NO: 2518047 - protein, 23 aa, Entamoeba dispar
IGDKCFLYCISLTSISLPQHNRM

SEQ ID NO: 2518048 - protein, 22 aa, Entamoeba dispar
IGDNCFYLCYSLTSITIPSSIS

SEQ ID NO: 2518049 - protein, 33 aa, Entamoeba dispar
IHEDLAYHSLNLWLEYLLLCRNSNDFKLSQKIK

SEQ ID NO: 2518050 - protein, 24 aa, Entamoeba dispar
IHELTNLLIARFGFPKDKIELYVE

SEQ ID NO: 2518051 - protein, 18 aa, Entamoeba dispar
IIATQVLSFPTVYGLASR

SEQ ID NO: 2518052 - protein, 25 aa, Entamoeba dispar
IIDEKYKQIFGRLVFNLVNKKQEEK

SEQ ID NO: 2518053 - protein, 23 aa, Entamoeba dispar
IIKHSQVPFYLLTDNVYALGNTM

SEQ ID NO: 2518054 - protein, 17 aa, Entamoeba dispar
IIKIKKARHPLIENNSI

SEQ ID NO: 2518055 - protein, 17 aa, Entamoeba dispar
IIKLYDVFDGNDGKLYI

SEQ ID NO: 2518056 - protein, 22 aa, Entamoeba dispar
IIKSLPNIFSSFTIYFGRDIDQ

SEQ ID NO: 2518057 - protein, 19 aa, Entamoeba dispar
IILEEKTMYPFSFSGIDKK

SEQ ID NO: 2518058 - protein, 17 aa, Entamoeba dispar
IILIDLRANTPIKTVYG

SEQ ID NO: 2518059 - protein, 17 aa, Entamoeba dispar
IILLKEGTDTSQGKGQI

SEQ ID NO: 2518060 - protein, 18 aa, Entamoeba dispar
IIPAMITTTAVVSGLQCI

SEQ ID NO: 2518061 - protein, 23 aa, Entamoeba dispar
IIRKHDELFKWWREMKREQRMTR

SEQ ID NO: 2518062 - protein, 18 aa, Entamoeba dispar
IKECFRNLQSRSITCLNE

SEQ ID NO: 2518063 - protein, 19 aa, Entamoeba dispar
IKEWIRQPLIDKDKINKRL

SEQ ID NO: 2518064 - protein, 21 aa, Entamoeba dispar
IKKILKLLRLRQINNAVFIKA

SEQ ID NO: 2518065 - protein, 21 aa, Entamoeba dispar
IKKMIPCIVNIFIVGDNLQKE

SEQ ID NO: 2518066 - protein, 25 aa, Entamoeba dispar
IKPADFLKTKLIAGKIIPAMITTTA

SEQ ID NO: 2518067 - protein, 17 aa, Entamoeba dispar
IKPIIEFGGIEPNPSHE

SEQ ID NO: 2518068 - protein, 28 aa, Entamoeba dispar
IKRVHRQIFFYYNSFNIIIGKQGAGKTT

SEQ ID NO: 2518069 - protein, 31 aa, Entamoeba dispar
IKSTDGIYPKKEIEWLMGISWNKGNKSRYKQ

SEQ ID NO: 2518070 - protein, 31 aa, Entamoeba dispar
IKTCDFLANELYKYLQKNCYLSFFDDNMDVK

SEQ ID NO: 2518071 - protein, 17 aa, Entamoeba dispar
ILHEKYNKSMTLREAEI

SEQ ID NO: 2518072 - protein, 17 aa, Entamoeba dispar
ILKYLFPVPKSDSKRVM

SEQ ID NO: 2518073 - protein, 25 aa, Entamoeba dispar
ILQRGFVQFCFDPITKLFNAIMEGR

SEQ ID NO: 2518074 - protein, 23 aa, Entamoeba dispar
ILSRSIMNWDLKGMFYLINNNDY

SEQ ID NO: 2518075 - protein, 30 aa, Entamoeba dispar
ILTNLPPVYTYFYLCVIVSSEGFVKISVLV

SEQ ID NO: 2518076 - protein, 23 aa, Entamoeba dispar
ILVDKTWIRMKQLGLKANEVTRT

SEQ ID NO: 2518077 - protein, 19 aa, Entamoeba dispar
IMLMGNVNTLPKKEDSKTI

SEQ ID NO: 2518078 - protein, 31 aa, Entamoeba dispar
IMQHNTIYILSEFWMCGLIQYETPILCFWNN

SEQ ID NO: 2518079 - protein, 24 aa, Entamoeba dispar
INAAIRGLLRLGNSKQIHTFTKHP

SEQ ID NO: 2518080 - protein, 18 aa, Entamoeba dispar
INEYLRKLLIERGIIFST

SEQ ID NO: 2518081 - protein, 18 aa, Entamoeba dispar
INIPTYITSLGYKCFYRC

SEQ ID NO: 2518082 - protein, 17 aa, Entamoeba dispar
INTLKGIISGGGVFYNL

SEQ ID NO: 2518083 - protein, 27 aa, Entamoeba dispar
INTSEPYLYFYNTDRMKLYKKVPIENM

SEQ ID NO: 2518084 - protein, 19 aa, Entamoeba dispar
INYGMCTHQRIGSGRRWFE

SEQ ID NO: 2518085 - protein, 18 aa, Entamoeba dispar
INYPIQLIDDRTQGNLER

SEQ ID NO: 2518086 - protein, 22 aa, Entamoeba dispar
IPCARRCCFACVLTGAPSLLEP

SEQ ID NO: 2518087 - protein, 20 aa, Entamoeba dispar
IPEDLYFLMKRAVSVRKHLE

SEQ ID NO: 2518088 - protein, 22 aa, Entamoeba dispar
IPIIIQLIRNRMSNIGKQMIRI

SEQ ID NO: 2518089 - protein, 29 aa, Entamoeba dispar
IPLTVHKIFTTIEELKTLGWQFKINVKYV

SEQ ID NO: 2518090 - protein, 24 aa, Entamoeba dispar
IQAKLAMVPVRRGYWGATIGEVHT

SEQ ID NO: 2518091 - protein, 19 aa, Entamoeba dispar
IQEIVPYQQMIIKPEQKKK

SEQ ID NO: 2518092 - protein, 17 aa, Entamoeba dispar
IQIINNINKIYPIIKGI

SEQ ID NO: 2518093 - protein, 19 aa, Entamoeba dispar
IQTILFGNVSAMHLHFKEY

SEQ ID NO: 2518094 - protein, 21 aa, Entamoeba dispar
IRNYLKLFMKDSTNLYNAPKY

SEQ ID NO: 2518095 - protein, 18 aa, Entamoeba dispar
ISAELPLGFDNYVLWVKG

SEQ ID NO: 2518096 - protein, 18 aa, Entamoeba dispar
ISNTLRYLKKFPEYQNLC

SEQ ID NO: 2518097 - protein, 21 aa, Entamoeba dispar
ISPFQPYYKLAFAAPELLWDL

SEQ ID NO: 2518098 - protein, 18 aa, Entamoeba dispar
ISRRGYVIIDDKGKVRYI

SEQ ID NO: 2518099 - protein, 19 aa, Entamoeba dispar
ISSSWDHTLRLWDLTKMES

SEQ ID NO: 2518100 - protein, 20 aa, Entamoeba dispar
ISWDELFVHPFITQKLQCVF

SEQ ID NO: 2518101 - protein, 25 aa, Entamoeba dispar
ITFKSNYCIPLILAKCFKIIDEYQY

SEQ ID NO: 2518102 - protein, 19 aa, Entamoeba dispar
ITHHTGFINTVAFSPDGSI

SEQ ID NO: 2518103 - protein, 24 aa, Entamoeba dispar
ITNKKKLRHMSGKQFRQLRTFHFD

SEQ ID NO: 2518104 - protein, 19 aa, Entamoeba dispar
ITNVPIVPGPYQVSSYSSA

SEQ ID NO: 2518105 - protein, 18 aa, Entamoeba dispar
ITTTNKRRYWKEIQENIY

SEQ ID NO: 2518106 - protein, 19 aa, Entamoeba dispar
IVFLGDSSVGKTCIIGRFM

SEQ ID NO: 2518107 - protein, 26 aa, Entamoeba dispar
IVGNMNKIFYLTYKYHSTNIKYLEEC

SEQ ID NO: 2518108 - protein, 24 aa, Entamoeba dispar
IVGSHWCSIALYLNNRTARSIRNR

SEQ ID NO: 2518109 - protein, 44 aa, Entamoeba dispar
IVHSYFEGMNWVLGYYYKGCQSWDWYYPYLYAPFAEDMGEYVDY

SEQ ID NO: 2518110 - protein, 18 aa, Entamoeba dispar
IVIDMWYGNRRDSAVVRT

SEQ ID NO: 2518111 - protein, 19 aa, Entamoeba dispar
IWSLGMILYFIITGDHVFR

SEQ ID NO: 2518112 - protein, 20 aa, Entamoeba dispar
IYDNRKGLFGQCNELIVFET

SEQ ID NO: 2518113 - protein, 27 aa, Entamoeba dispar
IYGGWTFIYQILYSVLKYNSSSILPLN

SEQ ID NO: 2518114 - protein, 29 aa, Entamoeba dispar
IYSIETITFLLLHKVKYPDRIHLLRGNHE

SEQ ID NO: 2518115 - protein, 21 aa, Entamoeba dispar
KAAFYGAPADHLIIPYTAECK

SEQ ID NO: 2518116 - protein, 26 aa, Entamoeba dispar
KAGKRAGNFLDFLRATEGMVHDYEQR

SEQ ID NO: 2518117 - protein, 23 aa, Entamoeba dispar
KAIGYCFLTFTEAEDAYQFVEKV

SEQ ID NO: 2518118 - protein, 22 aa, Entamoeba dispar
KAIRKLIKDRLIIKKPAAMHSR

SEQ ID NO: 2518119 - protein, 17 aa, Entamoeba dispar
KASFKINRLLRMNDLAQ

SEQ ID NO: 2518120 - protein, 28 aa, Entamoeba dispar
KATEDVLLLDVAPLTLGIETAGGIMTAL

SEQ ID NO: 2518121 - protein, 19 aa, Entamoeba dispar
KCENFLIEPLPGVSLETVN

SEQ ID NO: 2518122 - protein, 18 aa, Entamoeba dispar
KEGDIITVLKKEGDWWLG

SEQ ID NO: 2518123 - protein, 24 aa, Entamoeba dispar
KEGKELLPLPAKRLPKQPRPAELI

SEQ ID NO: 2518124 - protein, 24 aa, Entamoeba dispar
KENNIYAQFYIRDEYFVERKIDLT

SEQ ID NO: 2518125 - protein, 26 aa, Entamoeba dispar
KERELHGIIIVFNYNQDRFPKGSKEM

SEQ ID NO: 2518126 - protein, 21 aa, Entamoeba dispar
KETITLKDIPSLLVINKIKLT

SEQ ID NO: 2518127 - protein, 23 aa, Entamoeba dispar
KEVGQFMLATSKSVFLWLCDLND

SEQ ID NO: 2518128 - protein, 17 aa, Entamoeba dispar
KFDMGLNQFIWSQGIRS

SEQ ID NO: 2518129 - protein, 24 aa, Entamoeba dispar
KFKTQTIPPPIKELIQYLYVNGSN

SEQ ID NO: 2518130 - protein, 19 aa, Entamoeba dispar
KFLAGTTWFYCEPESRELM

SEQ ID NO: 2518131 - protein, 25 aa, Entamoeba dispar
KFNQQTFVETLKLIRRFNKEVSSVT

SEQ ID NO: 2518132 - protein, 25 aa, Entamoeba dispar
KGESMPIRVFLANLDLTPSYHNVNN

SEQ ID NO: 2518133 - protein, 25 aa, Entamoeba dispar
KGKYHVIAFYCRDFSRICPKEIKEI

SEQ ID NO: 2518134 - protein, 27 aa, Entamoeba dispar
KGLNCAFGRWPVKSAQFILKLLKNAVD

SEQ ID NO: 2518135 - protein, 17 aa, Entamoeba dispar
KGQLLKIFITFPDPHFK

SEQ ID NO: 2518136 - protein, 21 aa, Entamoeba dispar
KGYMPAALLLGFTMQKHYLSE

SEQ ID NO: 2518137 - protein, 20 aa, Entamoeba dispar
KHIHLLPIATPLASDKLEKK

SEQ ID NO: 2518138 - protein, 19 aa, Entamoeba dispar
KHLYLIFEYCNTDLHKFLK

SEQ ID NO: 2518139 - protein, 28 aa, Entamoeba dispar
KIECPKIAFLRMLKAAFYGAPADHLIIP

SEQ ID NO: 2518140 - protein, 28 aa, Entamoeba dispar
KIEDICECIMAFISMTLLSPVAVSQLSD

SEQ ID NO: 2518141 - protein, 32 aa, Entamoeba dispar
KIIDDLIHCNSFRLTPMWTYLTQIQIKEQFEQ

SEQ ID NO: 2518142 - protein, 19 aa, Entamoeba dispar
KIIIMGFSGVGKSSVALNY

SEQ ID NO: 2518143 - protein, 23 aa, Entamoeba dispar
KIKEGYLNLVKKLNGLVIEYNKK

SEQ ID NO: 2518144 - protein, 23 aa, Entamoeba dispar
KIKKILKLLRLRQINNAVFIKAN

SEQ ID NO: 2518145 - protein, 26 aa, Entamoeba dispar
KIKTTKLCVLILRSLKMLHPEMECYS

SEQ ID NO: 2518146 - protein, 19 aa, Entamoeba dispar
KIPECGPLDALVRPLALAP

SEQ ID NO: 2518147 - protein, 25 aa, Entamoeba dispar
KIQAFHEILLLRSQLCNILGKQNKI

SEQ ID NO: 2518148 - protein, 20 aa, Entamoeba dispar
KIRLMKLEEELHKRVIGQNE

SEQ ID NO: 2518149 - protein, 17 aa, Entamoeba dispar
KITLFKTGCSHIFINGE

SEQ ID NO: 2518150 - protein, 26 aa, Entamoeba dispar
KKADNLEVILLRRFVSFLQQRAENFV

SEQ ID NO: 2518151 - protein, 18 aa, Entamoeba dispar
KKAYRKLAIKYHPDKNPG

SEQ ID NO: 2518152 - protein, 20 aa, Entamoeba dispar
KKECCCPRIKAFKKFMNTFE

SEQ ID NO: 2518153 - protein, 20 aa, Entamoeba dispar
KKIVLYFESLSRFQKSPYIY

SEQ ID NO: 2518154 - protein, 26 aa, Entamoeba dispar
KKKRVNTDIVFPKLENFKCPVEYNEK

SEQ ID NO: 2518155 - protein, 24 aa, Entamoeba dispar
KKLHFQEYLALKKAVYRPQAFFKG

SEQ ID NO: 2518156 - protein, 28 aa, Entamoeba dispar
KKRAPKAIKIIRFLAIKTMKTHVVKFDM

SEQ ID NO: 2518157 - protein, 24 aa, Entamoeba dispar
KKRNRIEILIKAKSFFREAINANN

SEQ ID NO: 2518158 - protein, 29 aa, Entamoeba dispar
KKTFTVNCELFIFEIKMSGITTLEQLKNK

SEQ ID NO: 2518159 - protein, 27 aa, Entamoeba dispar
KKVDTPLLWHQGLLVFVQRYSKDFKPQ

SEQ ID NO: 2518160 - protein, 30 aa, Entamoeba dispar
KKVYKILDDLYVNSILFTPPNQQTTRNSTN

SEQ ID NO: 2518161 - protein, 26 aa, Entamoeba dispar
KKYLNELMPLQKQDFIGLLKTMNGLP

SEQ ID NO: 2518162 - protein, 20 aa, Entamoeba dispar
KLIEDGIHPQVIIKGYRMAS

SEQ ID NO: 2518163 - protein, 26 aa, Entamoeba dispar
KLLTITPYHQFFINALNLNVQQPSTS

SEQ ID NO: 2518164 - protein, 18 aa, Entamoeba dispar
KMDPIIGRDEEIKRVIRI

SEQ ID NO: 2518165 - protein, 26 aa, Entamoeba dispar
KMRVTFRVQHQPVLGLRILNTVSKLG

SEQ ID NO: 2518166 - protein, 20 aa, Entamoeba dispar
KMVINSLFKSFDNIFLEDDQ

SEQ ID NO: 2518167 - protein, 22 aa, Entamoeba dispar
KNEFNSFALWCRSRHLSIQATL

SEQ ID NO: 2518168 - protein, 20 aa, Entamoeba dispar
KNIPVVLVGNKLDLITDENN

SEQ ID NO: 2518169 - protein, 18 aa, Entamoeba dispar
KNIRKWIKCASGNKFRMG

SEQ ID NO: 2518170 - protein, 20 aa, Entamoeba dispar
KNRVEWIQRRLQAHNYPVSI

SEQ ID NO: 2518171 - protein, 22 aa, Entamoeba dispar
KNRYDLVLHLRTTAIGALKYYD

SEQ ID NO: 2518172 - protein, 23 aa, Entamoeba dispar
KNWKKRWFVFHNNGMLDYFTDKK

SEQ ID NO: 2518173 - protein, 18 aa, Entamoeba dispar
KNWKPLRQQIPKAVPDFF

SEQ ID NO: 2518174 - protein, 32 aa, Entamoeba dispar
KQIFSTLMFLRYLFVPFLKHPYILKSLQKCVS

SEQ ID NO: 2518175 - protein, 22 aa, Entamoeba dispar
KQSDVLRFLRRIRCWELRHLPR

SEQ ID NO: 2518176 - protein, 27 aa, Entamoeba dispar
KRIAGKLDHFFPIQKIWNQNGVIMFDE

SEQ ID NO: 2518177 - protein, 27 aa, Entamoeba dispar
KRIAGKLDHFFPIQKIWNQSGVIMFDE

SEQ ID NO: 2518178 - protein, 25 aa, Entamoeba dispar
KRQNTVPFVGWCPCSFKCGINSQPA

SEQ ID NO: 2518179 - protein, 20 aa, Entamoeba dispar
KSALLMYSYVVFNGQEYTVF

SEQ ID NO: 2518180 - protein, 24 aa, Entamoeba dispar
KSEEEIKKLIKWARGLPSIDKEEI

SEQ ID NO: 2518181 - protein, 27 aa, Entamoeba dispar
KSGKFSLGHFFIAINVEAFRDLNDFKK

SEQ ID NO: 2518182 - protein, 23 aa, Entamoeba dispar
KSIDQIFEFGIKIKEYQIVDHLL

SEQ ID NO: 2518183 - protein, 23 aa, Entamoeba dispar
KSPLCYFHNLGYDGRFFAKYGIN

SEQ ID NO: 2518184 - protein, 28 aa, Entamoeba dispar
KSQDPNIPFILQLKKYVDIYKKILDIDK

SEQ ID NO: 2518185 - protein, 32 aa, Entamoeba dispar
KSVVNEYIRFAFKLFIKIYYKDTWTDDDIRVL

SEQ ID NO: 2518186 - protein, 24 aa, Entamoeba dispar
KTDFKSVVLLAQSFLNLFNNEKDK

SEQ ID NO: 2518187 - protein, 27 aa, Entamoeba dispar
KTEFAIQEIFMKYNTFMLRGDSLFDTY

SEQ ID NO: 2518188 - protein, 23 aa, Entamoeba dispar
KTMNIGVKYFASCGLYCLVQPNT

SEQ ID NO: 2518189 - protein, 25 aa, Entamoeba dispar
KTSENYISLIRLIRENTKYKEETKH

SEQ ID NO: 2518190 - protein, 23 aa, Entamoeba dispar
KTTDVIQWKLKRVICSHKGWVSS

SEQ ID NO: 2518191 - protein, 23 aa, Entamoeba dispar
KVIEIINFIYFNLNGQLDVGISC

SEQ ID NO: 2518192 - protein, 24 aa, Entamoeba dispar
KVKSPISIIWCDTIILTQYNNQIK

SEQ ID NO: 2518193 - protein, 20 aa, Entamoeba dispar
KVMSRPFGVALLIAGVDETG

SEQ ID NO: 2518194 - protein, 24 aa, Entamoeba dispar
KVSPRHPYLFSAGDDKTIKCWDLE

SEQ ID NO: 2518195 - protein, 26 aa, Entamoeba dispar
KVTALSFFTYFFSVNSPIIRRKSVVN

SEQ ID NO: 2518196 - protein, 18 aa, Entamoeba dispar
KVVPKQLISIEPYGVMYY

SEQ ID NO: 2518197 - protein, 18 aa, Entamoeba dispar
KWFKSIGMKTKLSEWGKG

SEQ ID NO: 2518198 - protein, 27 aa, Entamoeba dispar
KWMKCQYDPLFGYPNLVRFGWETSKRI

SEQ ID NO: 2518199 - protein, 27 aa, Entamoeba dispar
KYENEELIKYALPNDLWFHVDSESSAH

SEQ ID NO: 2518200 - protein, 26 aa, Entamoeba dispar
KYKNEEFILHLWDTAGQEEYDRLRPL

SEQ ID NO: 2518201 - protein, 23 aa, Entamoeba dispar
KYLNEYLYCSINFVGESHEVLIP

SEQ ID NO: 2518202 - protein, 26 aa, Entamoeba dispar
KYNGGYNWWKRNSLTVFIDKKLYKDP

SEQ ID NO: 2518203 - protein, 23 aa, Entamoeba dispar
LANIFICLGPALRGCPFCYNYAT

SEQ ID NO: 2518204 - protein, 18 aa, Entamoeba dispar
LANKLLHSLQLFYSTPNV

SEQ ID NO: 2518205 - protein, 31 aa, Entamoeba dispar
LAQSEVHLFEQASAIFLTASNNIKLKKESGI

SEQ ID NO: 2518206 - protein, 17 aa, Entamoeba dispar
LCCILENYQCEDGIIVP

SEQ ID NO: 2518207 - protein, 19 aa, Entamoeba dispar
LDKEIYLSNVFIIIRIEEK

SEQ ID NO: 2518208 - protein, 23 aa, Entamoeba dispar
LDSVLFQYKKFVKPAYDKWVYPQ

SEQ ID NO: 2518209 - protein, 25 aa, Entamoeba dispar
LEANHFSEYLLLKEVKIPTTVTSIG

SEQ ID NO: 2518210 - protein, 18 aa, Entamoeba dispar
LEDLIRRRIKEQSWDDVV

SEQ ID NO: 2518211 - protein, 25 aa, Entamoeba dispar
LEKAQPIIISLLRKKDLSIDVIQLV

SEQ ID NO: 2518212 - protein, 23 aa, Entamoeba dispar
LEPKMYHNHLEGLKKQRVKEVFN

SEQ ID NO: 2518213 - protein, 27 aa, Entamoeba dispar
LEQQYYLSIISILQQQKLFIKSLLSKQ

SEQ ID NO: 2518214 - protein, 24 aa, Entamoeba dispar
LETPYIPFIGILSKDLMLIDEGNP

SEQ ID NO: 2518215 - protein, 19 aa, Entamoeba dispar
LFCSSLSECKLPISLSSIQ

SEQ ID NO: 2518216 - protein, 19 aa, Entamoeba dispar
LFLGTLRDYCIISPDIEYC

SEQ ID NO: 2518217 - protein, 27 aa, Entamoeba dispar
LGARCLCYSIIGYYKLLLNDNNGARDE

SEQ ID NO: 2518218 - protein, 26 aa, Entamoeba dispar
LGPGCFKNCLSLRTITLPSSISQIGE

SEQ ID NO: 2518219 - protein, 19 aa, Entamoeba dispar
LHLPRKSAFLLGKYEDIIF

SEQ ID NO: 2518220 - protein, 24 aa, Entamoeba dispar
LHVETILTLWVFLQESKKNPRVTA

SEQ ID NO: 2518221 - protein, 26 aa, Entamoeba dispar
LIEIEGHIYSLYAIFDGHRGRTAAQH

SEQ ID NO: 2518222 - protein, 20 aa, Entamoeba dispar
LIGYCQFLNQSFDYLTILEL

SEQ ID NO: 2518223 - protein, 21 aa, Entamoeba dispar
LILDRSFDPITPLLTQWTYQA

SEQ ID NO: 2518224 - protein, 25 aa, Entamoeba dispar
LINNELIGLCRLLHNVKKHLLLCNY

SEQ ID NO: 2518225 - protein, 25 aa, Entamoeba dispar
LIQYETPILCFWNNDKTLAIHLFSS

SEQ ID NO: 2518226 - protein, 17 aa, Entamoeba dispar
LISITLSTSIKILPKRC

SEQ ID NO: 2518227 - protein, 24 aa, Entamoeba dispar
LKEFLIGCIQLKQKVNATKEVVNQ

SEQ ID NO: 2518228 - protein, 28 aa, Entamoeba dispar
LKKNFESYALYISRVLKSVFQDIGITLP

SEQ ID NO: 2518229 - protein, 24 aa, Entamoeba dispar
LKNVLLYLPTLKDVGRFAQVCKSC

SEQ ID NO: 2518230 - protein, 17 aa, Entamoeba dispar
LKRYGYENLPVDTFMTL

SEQ ID NO: 2518231 - protein, 25 aa, Entamoeba dispar
LKTKQGFSTLIKRFTRLPTKHIQEF

SEQ ID NO: 2518232 - protein, 18 aa, Entamoeba dispar
LLEMDFANEIDYLIEKLP

SEQ ID NO: 2518233 - protein, 17 aa, Entamoeba dispar
LLILARQNSKIIDRTIF

SEQ ID NO: 2518234 - protein, 17 aa, Entamoeba dispar
LLKQDILCQAKSGMGKT

SEQ ID NO: 2518235 - protein, 18 aa, Entamoeba dispar
LLLHCNVHNYLQFRAIHG

SEQ ID NO: 2518236 - protein, 18 aa, Entamoeba dispar
LMATNRIDILDPALLRPG

SEQ ID NO: 2518237 - protein, 27 aa, Entamoeba dispar
LNEDSYINFSPFWKKKDGTKIPEGTKA

SEQ ID NO: 2518238 - protein, 23 aa, Entamoeba dispar
LNEVFDALWNPEIPYVIGTSGDG

SEQ ID NO: 2518239 - protein, 25 aa, Entamoeba dispar
LNGHNGWVWDITFSNNSEYLISAST

SEQ ID NO: 2518240 - protein, 18 aa, Entamoeba dispar
LNGPVFIIGKRVVAHTKK

SEQ ID NO: 2518241 - protein, 19 aa, Entamoeba dispar
LNIFKMSGKIPFTNYLFLG

SEQ ID NO: 2518242 - protein, 30 aa, Entamoeba dispar
LNNPKYGKYYLFFTNFLDSTQISLLSQSDV

SEQ ID NO: 2518243 - protein, 17 aa, Entamoeba dispar
LNTFTELILFEAPFLSN

SEQ ID NO: 2518244 - protein, 31 aa, Entamoeba dispar
LNVPEPYYLFNRFVLFNRELIGIKLPTSLKE

SEQ ID NO: 2518245 - protein, 18 aa, Entamoeba dispar
LPIVIKDGAWIGAGATIL

SEQ ID NO: 2518246 - protein, 30 aa, Entamoeba dispar
LPNDGLPEHNFYQFGGRPYNPPIPDESLQN

SEQ ID NO: 2518247 - protein, 18 aa, Entamoeba dispar
LPSQINIPSLKTLDLSSN

SEQ ID NO: 2518248 - protein, 22 aa, Entamoeba dispar
LRGYQGLYHGLMIFMDKYGMSP

SEQ ID NO: 2518249 - protein, 23 aa, Entamoeba dispar
LTEIRLSLIHFIEGMLNYDPMKR

SEQ ID NO: 2518250 - protein, 21 aa, Entamoeba dispar
LTKIPPKCDLVIQYSYHYEIN

SEQ ID NO: 2518251 - protein, 17 aa, Entamoeba dispar
LTSFPTPLLELSSLIVL

SEQ ID NO: 2518252 - protein, 21 aa, Entamoeba dispar
LTYNELVIMNILNEYYNKYED

SEQ ID NO: 2518253 - protein, 27 aa, Entamoeba dispar
LVDSKVIIKIICFICSFITEKEEIQEI

SEQ ID NO: 2518254 - protein, 18 aa, Entamoeba dispar
LVEDIALTAINFLKTHKK

SEQ ID NO: 2518255 - protein, 24 aa, Entamoeba dispar
LVEKILVNYPNLLNLRLRMPISDD

SEQ ID NO: 2518256 - protein, 28 aa, Entamoeba dispar
LVNDCNHLVFRNGLLLMSSSKGDKQIRI

SEQ ID NO: 2518257 - protein, 20 aa, Entamoeba dispar
LVPVLYKLEFVALVIQNLYT

SEQ ID NO: 2518258 - protein, 18 aa, Entamoeba dispar
LVSQRWPPIQNKDSLWIC

SEQ ID NO: 2518259 - protein, 25 aa, Entamoeba dispar
LYCELKKKGFFIKDGFKYGCDFVVY

SEQ ID NO: 2518260 - protein, 19 aa, Entamoeba dispar
LYGLVYWFRIWDHEYNLRP

SEQ ID NO: 2518261 - protein, 35 aa, Entamoeba dispar
LYKHIAQPPPDFSKVPPLFRSTPLMRHHNASKPRL

SEQ ID NO: 2518262 - protein, 25 aa, Entamoeba dispar
LYNDYDIIVLCYLLSEKQSIQINEL

SEQ ID NO: 2518263 - protein, 26 aa, Entamoeba dispar
MALFKDLERIIKLGKYTLIGGSGEYS

SEQ ID NO: 2518264 - protein, 18 aa, Entamoeba dispar
MAPELYRRLPYGNKIDCW

SEQ ID NO: 2518265 - protein, 17 aa, Entamoeba dispar
MELADCCFPLVKGVIAS

SEQ ID NO: 2518266 - protein, 27 aa, Entamoeba dispar
MELKGNVRVFCRVRPPLKNEGISVDVT

SEQ ID NO: 2518267 - protein, 24 aa, Entamoeba dispar
MERFHFNPIPLDEYSRKLFPNIET

SEQ ID NO: 2518268 - protein, 24 aa, Entamoeba dispar
MERFHFNPIPLNEYSRKLFPNIET

SEQ ID NO: 2518269 - protein, 22 aa, Entamoeba dispar
MERFHFNPIPLNEYSRKLFTNI

SEQ ID NO: 2518270 - protein, 25 aa, Entamoeba dispar
MERFHFNPIPLNHYSRKLFPNIETF

SEQ ID NO: 2518271 - protein, 24 aa, Entamoeba dispar
MIEKAKPLISIASDFIPGGEIIKK

SEQ ID NO: 2518272 - protein, 19 aa, Entamoeba dispar
MIISHFPYGPTAYFGLYNV

SEQ ID NO: 2518273 - protein, 27 aa, Entamoeba dispar
MKFNGGYSWWRRNSMTIFLDQKIYKDP

SEQ ID NO: 2518274 - protein, 24 aa, Entamoeba dispar
MKILYLNHCWAGSQYLLGVVDSEG

SEQ ID NO: 2518275 - protein, 30 aa, Entamoeba dispar
MKLRPLSVFAPLHYFELPELLMECITSMTG

SEQ ID NO: 2518276 - protein, 29 aa, Entamoeba dispar
MNACTLTIHWQFDVTLRGLRKVLTPNAEI

SEQ ID NO: 2518277 - protein, 20 aa, Entamoeba dispar
MPALIQYYKQPQEKHLLIIL

SEQ ID NO: 2518278 - protein, 21 aa, Entamoeba dispar
MPALMQYYKQPQEKHLLIILE

SEQ ID NO: 2518279 - protein, 20 aa, Entamoeba dispar
MRNAILLVFANKHDLPQAMS

SEQ ID NO: 2518280 - protein, 18 aa, Entamoeba dispar
MRVFHLKANKYYCPSINV

SEQ ID NO: 2518281 - protein, 19 aa, Entamoeba dispar
MSGKIPFTNYLFLGDYVNF

SEQ ID NO: 2518282 - protein, 17 aa, Entamoeba dispar
MVMRKLLELTLKVKSLS

SEQ ID NO: 2518283 - protein, 18 aa, Entamoeba dispar
MVSQYIEQFFIQGPYKKI

SEQ ID NO: 2518284 - protein, 26 aa, Entamoeba dispar
MYNRNYLGYLIHRILSYDPTLEEAEQ

SEQ ID NO: 2518285 - protein, 24 aa, Entamoeba dispar
NAEHSGVYPCQCSALRKGGYVVIK

SEQ ID NO: 2518286 - protein, 17 aa, Entamoeba dispar
NAGVFVYENGKGLFASC

SEQ ID NO: 2518287 - protein, 19 aa, Entamoeba dispar
NCLKLRLLDGGNLLTKMVE

SEQ ID NO: 2518288 - protein, 17 aa, Entamoeba dispar
NCQPWWIIRTYSNNNEG

SEQ ID NO: 2518289 - protein, 18 aa, Entamoeba dispar
NDCALWFIKVFPGNREFM

SEQ ID NO: 2518290 - protein, 23 aa, Entamoeba dispar
NDKGRFYAFGRVFSGTIRTGGKA

SEQ ID NO: 2518291 - protein, 27 aa, Entamoeba dispar
NDLNEFFLDMFMLRDLCDDFVEMFKKE

SEQ ID NO: 2518292 - protein, 23 aa, Entamoeba dispar
NDNDFFVYSIMKDGYQNYGCYQK

SEQ ID NO: 2518293 - protein, 24 aa, Entamoeba dispar
NEAAKWFEQTWSDTYRRNDVNILL

SEQ ID NO: 2518294 - protein, 18 aa, Entamoeba dispar
NEEIYCENGKYINNNKCI

SEQ ID NO: 2518295 - protein, 20 aa, Entamoeba dispar
NEFELFPESLGELLPDDLEE

SEQ ID NO: 2518296 - protein, 21 aa, Entamoeba dispar
NEFELFPESLGELLPDDLQEY

SEQ ID NO: 2518297 - protein, 28 aa, Entamoeba dispar
NESLLEGTIIYFLSNYYSIIVTRPSKKS

SEQ ID NO: 2518298 - protein, 18 aa, Entamoeba dispar
NETLYSPLYFNEETIIKM

SEQ ID NO: 2518299 - protein, 29 aa, Entamoeba dispar
NEYKGKYVVLLFYPLDWTFVCPTEMIGYS

SEQ ID NO: 2518300 - protein, 20 aa, Entamoeba dispar
NFIDIFRKLTNFNDNVDVCL

SEQ ID NO: 2518301 - protein, 26 aa, Entamoeba dispar
NGCGKTTFLKLLIDALTPVEGTVQRN

SEQ ID NO: 2518302 - protein, 25 aa, Entamoeba dispar
NGCTACVVLLVGKRLYTANLGDAEA

SEQ ID NO: 2518303 - protein, 22 aa, Entamoeba dispar
NGKEWCGNLIVVEFSETIESKR

SEQ ID NO: 2518304 - protein, 30 aa, Entamoeba dispar
NGLEVYIILMCYKVLYPTKIIMLRGQNELK

SEQ ID NO: 2518305 - protein, 17 aa, Entamoeba dispar
NIAVLLTHGKCFIYSTN

SEQ ID NO: 2518306 - protein, 27 aa, Entamoeba dispar
NIERFHFNPIPLNKYSRKLFPNIETFH

SEQ ID NO: 2518307 - protein, 20 aa, Entamoeba dispar
NILKPMLSRGELRCIGATTL

SEQ ID NO: 2518308 - protein, 27 aa, Entamoeba dispar
NINPEPYIIGIGFFINMISLVLEQDDI

SEQ ID NO: 2518309 - protein, 19 aa, Entamoeba dispar
NIPKEFVFENQKGFKILTD

SEQ ID NO: 2518310 - protein, 25 aa, Entamoeba dispar
NIVSFHDITFGYEPNKILFKNLNFA

SEQ ID NO: 2518311 - protein, 27 aa, Entamoeba dispar
NKDSDLISLILLIDTFRIAEAKKSITE

SEQ ID NO: 2518312 - protein, 19 aa, Entamoeba dispar
NKIKKICPCAFFETSAIKN

SEQ ID NO: 2518313 - protein, 33 aa, Entamoeba dispar
NKLMEYSLQKMMPYPYHLIGIGFFNSINHSDKL

SEQ ID NO: 2518314 - protein, 25 aa, Entamoeba dispar
NKMKEACCIGFKWAMSSGPLCEEEM

SEQ ID NO: 2518315 - protein, 26 aa, Entamoeba dispar
NKRGEAMRLIIMSATLRVSEFTENQR

SEQ ID NO: 2518316 - protein, 23 aa, Entamoeba dispar
NLEEIKFNKSLKTFQCMRCMKLT

SEQ ID NO: 2518317 - protein, 19 aa, Entamoeba dispar
NLFIKDAQPMVWEIAVILD

SEQ ID NO: 2518318 - protein, 19 aa, Entamoeba dispar
NLLTYLNTNYSYGKAINKP

SEQ ID NO: 2518319 - protein, 17 aa, Entamoeba dispar
NLQVFMLMKGLATKKCV

SEQ ID NO: 2518320 - protein, 28 aa, Entamoeba dispar
NLTDVVLGQVYFKVVRLPLASMELQIQR

SEQ ID NO: 2518321 - protein, 25 aa, Entamoeba dispar
NMERFHFNPIPLNEYSRKLFTNIET

SEQ ID NO: 2518322 - protein, 26 aa, Entamoeba dispar
NMERFHFNPIPLNNYSRKLFPNIETF

SEQ ID NO: 2518323 - protein, 25 aa, Entamoeba dispar
NNCNFDVFLLCFSVTQRSSFRNIKN

SEQ ID NO: 2518324 - protein, 23 aa, Entamoeba dispar
NNPLGILCDNLILSIQRSIIVKN

SEQ ID NO: 2518325 - protein, 18 aa, Entamoeba dispar
NNYLLGMICCGYSGFVSS

SEQ ID NO: 2518326 - protein, 23 aa, Entamoeba dispar
NNYPINFGYIYPINENVALDYVS

SEQ ID NO: 2518327 - protein, 20 aa, Entamoeba dispar
NPLIFTFVRFEGFNRKYARC

SEQ ID NO: 2518328 - protein, 20 aa, Entamoeba dispar
NQELYVLALYSSLEPKEQEK

SEQ ID NO: 2518329 - protein, 23 aa, Entamoeba dispar
NQKPYFIFQCIHPNKFYDDPFVM

SEQ ID NO: 2518330 - protein, 21 aa, Entamoeba dispar
NQLIEMIRGKIWRISMNKNGS

SEQ ID NO: 2518331 - protein, 17 aa, Entamoeba dispar
NQPINFTRTLLIINHKI

SEQ ID NO: 2518332 - protein, 23 aa, Entamoeba dispar
NQRQIIMENLPKNVLRYDCSHLK

SEQ ID NO: 2518333 - protein, 34 aa, Entamoeba dispar
NRDAAQQSFLIGLLATFGYELKINKLYKKGKTTS

SEQ ID NO: 2518334 - protein, 24 aa, Entamoeba dispar
NSDYHKPFCIIVMDVNGIWKKFYG

SEQ ID NO: 2518335 - protein, 30 aa, Entamoeba dispar
NSETEQFFKVFLYPIIRHSIHQNKKLHFQE

SEQ ID NO: 2518336 - protein, 25 aa, Entamoeba dispar
NSFNQLLSFGYLFDQPEISYKLFFH

SEQ ID NO: 2518337 - protein, 25 aa, Entamoeba dispar
NSTQQIYFYILEMPISLLMKEQSQL

SEQ ID NO: 2518338 - protein, 19 aa, Entamoeba dispar
NSYEMEYITTLRIDGIPNG

SEQ ID NO: 2518339 - protein, 24 aa, Entamoeba dispar
NSYYNQIHFISITLSPNCPIINQF

SEQ ID NO: 2518340 - protein, 25 aa, Entamoeba dispar
NTEKLSWRVFGPQGALIQNMVDFFW

SEQ ID NO: 2518341 - protein, 19 aa, Entamoeba dispar
NTFILKSFISFHTLSPYYK

SEQ ID NO: 2518342 - protein, 24 aa, Entamoeba dispar
NTIQLFHHFFPCANVFKISSSEIK

SEQ ID NO: 2518343 - protein, 36 aa, Entamoeba dispar
NTITDEGIPFWHAPKRFPHIYPFNIDNQYAKEFIIS

SEQ ID NO: 2518344 - protein, 17 aa, Entamoeba dispar
NTLYILRGIREKYENHY

SEQ ID NO: 2518345 - protein, 22 aa, Entamoeba dispar
NVKKFIFNRLKKMSQSIQFVMR

SEQ ID NO: 2518346 - protein, 19 aa, Entamoeba dispar
NVKMVYAVNRGPFTMIFND

SEQ ID NO: 2518347 - protein, 30 aa, Entamoeba dispar
NVNVLQYFIDKLNCYYLNVSHIQNLRELST

SEQ ID NO: 2518348 - protein, 20 aa, Entamoeba dispar
NVPNAQPPYILVGAIDNGSA

SEQ ID NO: 2518349 - protein, 29 aa, Entamoeba dispar
PADPRLPKPLFAWNLPKGYETVLKKAFKT

SEQ ID NO: 2518350 - protein, 19 aa, Entamoeba dispar
PALIQYYKQPQEKHLLIIL

SEQ ID NO: 2518351 - protein, 19 aa, Entamoeba dispar
PALMQYYKQPQEKHLLIIL

SEQ ID NO: 2518352 - protein, 22 aa, Entamoeba dispar
PALQMTPIGKHNPFLILTCDGL

SEQ ID NO: 2518353 - protein, 22 aa, Entamoeba dispar
PALVRPGRLDRKIEFGLPDIEG

SEQ ID NO: 2518354 - protein, 25 aa, Entamoeba dispar
PDQVRLIFMHWKGPAVKRMVMVKAN

SEQ ID NO: 2518355 - protein, 27 aa, Entamoeba dispar
PDVTVMIEIFYRGFGVSFVEREVMKKY

SEQ ID NO: 2518356 - protein, 25 aa, Entamoeba dispar
PEAEADIYFKPIIELKEIEQEKMEE

SEQ ID NO: 2518357 - protein, 28 aa, Entamoeba dispar
PEALETWPVDLFGQLLPRHLQLAYQINQ

SEQ ID NO: 2518358 - protein, 18 aa, Entamoeba dispar
PEILLGEKYDSAVDWWSF

SEQ ID NO: 2518359 - protein, 18 aa, Entamoeba dispar
PEPIDKIERKDFKDPFFF

SEQ ID NO: 2518360 - protein, 21 aa, Entamoeba dispar
PESIKYISFSLSDSKLIMNNK

SEQ ID NO: 2518361 - protein, 22 aa, Entamoeba dispar
PETRKCFQKLESASRKSKVLPE

SEQ ID NO: 2518362 - protein, 30 aa, Entamoeba dispar
PFEEKLTSTFFNPPRINNLPPQQPIQEIVP

SEQ ID NO: 2518363 - protein, 28 aa, Entamoeba dispar
PFEEKLTSTFFNPPRNNNLPPQQPIQEI

SEQ ID NO: 2518364 - protein, 19 aa, Entamoeba dispar
PFGISTLIGGFDPDGTPRL

SEQ ID NO: 2518365 - protein, 26 aa, Entamoeba dispar
PFTCPPTEYYLYKKIQSISSTPILQI

SEQ ID NO: 2518366 - protein, 19 aa, Entamoeba dispar
PFTIFPKKHRSFMKRWSKT

SEQ ID NO: 2518367 - protein, 17 aa, Entamoeba dispar
PFVVFHSSPLIPFNSEI

SEQ ID NO: 2518368 - protein, 26 aa, Entamoeba dispar
PHLNSSFKHFILFATEFNLLDKKEVT

SEQ ID NO: 2518369 - protein, 19 aa, Entamoeba dispar
PIIEHEECDPIQTPCLLIP

SEQ ID NO: 2518370 - protein, 25 aa, Entamoeba dispar
PIKSTVSDLLLLQPPSYITNNTKTL

SEQ ID NO: 2518371 - protein, 18 aa, Entamoeba dispar
PITPLLTQWTYQAMIHEF

SEQ ID NO: 2518372 - protein, 20 aa, Entamoeba dispar
PKENVIVIDMWYGNRRDSAV

SEQ ID NO: 2518373 - protein, 20 aa, Entamoeba dispar
PKKTFIFTDYTYMERMYPVV

SEQ ID NO: 2518374 - protein, 27 aa, Entamoeba dispar
PKMKTTRLVLLILKSLKVLKPQIEYYS

SEQ ID NO: 2518375 - protein, 27 aa, Entamoeba dispar
PKPHQHLLIVTKRPRSFKARPIINHSD

SEQ ID NO: 2518376 - protein, 17 aa, Entamoeba dispar
PLDALVRPLALAPCTSD

SEQ ID NO: 2518377 - protein, 21 aa, Entamoeba dispar
PLEAYHCSFLNLAIGYMDATE

SEQ ID NO: 2518378 - protein, 18 aa, Entamoeba dispar
PLKKQIIPDIKIINEYKL

SEQ ID NO: 2518379 - protein, 19 aa, Entamoeba dispar
PLKTIIFKYNDKEIRINEV

SEQ ID NO: 2518380 - protein, 26 aa, Entamoeba dispar
PMHSGGMLGGWKFSNFKDGVFSEIFH

SEQ ID NO: 2518381 - protein, 24 aa, Entamoeba dispar
PNKKYFRFKTLKELIMRIPLKLGG

SEQ ID NO: 2518382 - protein, 24 aa, Entamoeba dispar
PNNPISLFNQLLWSDPELADGFKK

SEQ ID NO: 2518383 - protein, 29 aa, Entamoeba dispar
PNRCSSMFDTLNRWLYSSSGLTKGPDSIL

SEQ ID NO: 2518384 - protein, 18 aa, Entamoeba dispar
PNSYIFVESGKYEESEPI

SEQ ID NO: 2518385 - protein, 20 aa, Entamoeba dispar
PPNGFLFRFLRDETVLFGVD

SEQ ID NO: 2518386 - protein, 18 aa, Entamoeba dispar
PQILKIDYIQDSSTSYVI

SEQ ID NO: 2518387 - protein, 23 aa, Entamoeba dispar
PRGAPPRGMPPRGGPRGAPRGRG

SEQ ID NO: 2518388 - protein, 18 aa, Entamoeba dispar
PRRVVISEFAVLFKEHDP

SEQ ID NO: 2518389 - protein, 18 aa, Entamoeba dispar
PRTCSTFRDISFGSPCNC

SEQ ID NO: 2518390 - protein, 24 aa, Entamoeba dispar
PSHPIAYEFIKQCKTPIAAPSANL

SEQ ID NO: 2518391 - protein, 24 aa, Entamoeba dispar
PSQIQIINLRALQGFFPIIESVIM

SEQ ID NO: 2518392 - protein, 18 aa, Entamoeba dispar
PSSFDWNLIIETLKKIKA

SEQ ID NO: 2518393 - protein, 32 aa, Entamoeba dispar
PTAQPKFYLTGVFYFTLMYSGSNLKEISRLLY

SEQ ID NO: 2518394 - protein, 20 aa, Entamoeba dispar
PTFAFLHKNHPNYPYFAQLC

SEQ ID NO: 2518395 - protein, 30 aa, Entamoeba dispar
PTNLVPFPRDHFAMMSYAPIVTPEKAIRQT

SEQ ID NO: 2518396 - protein, 19 aa, Entamoeba dispar
PTVIRDELHFVPARVLKKD

SEQ ID NO: 2518397 - protein, 20 aa, Entamoeba dispar
PTYITSLGYKCFYRCKSLTS

SEQ ID NO: 2518398 - protein, 24 aa, Entamoeba dispar
QCYKNYYHCLSLFNQNKLKESYTQ

SEQ ID NO: 2518399 - protein, 17 aa, Entamoeba dispar
QDILCQAKSGMGKTAVF

SEQ ID NO: 2518400 - protein, 26 aa, Entamoeba dispar
QDSTYRFFEVILVDPFNAAIRNDPKM

SEQ ID NO: 2518401 - protein, 18 aa, Entamoeba dispar
QECPLCHRLIPLSEMDKH

SEQ ID NO: 2518402 - protein, 25 aa, Entamoeba dispar
QEDCRLLWKYRYLVEKTKPGSLARL

SEQ ID NO: 2518403 - protein, 24 aa, Entamoeba dispar
QELLRLLSQQFFDMSKYSIIKVIG

SEQ ID NO: 2518404 - protein, 26 aa, Entamoeba dispar
QERNYGKVIYLYKKLIESGIKEDLHT

SEQ ID NO: 2518405 - protein, 22 aa, Entamoeba dispar
QESLPPPIVLDQPIIEETPSKR

SEQ ID NO: 2518406 - protein, 31 aa, Entamoeba dispar
QFEPEKSYFYIMRNCNMLRFLDSNNTAMFAS

SEQ ID NO: 2518407 - protein, 28 aa, Entamoeba dispar
QGKELEGRPIILKWDRGLQSKVSDKNYK

SEQ ID NO: 2518408 - protein, 23 aa, Entamoeba dispar
QHHRKTWFTTFHPDYFGKHGMRV

SEQ ID NO: 2518409 - protein, 29 aa, Entamoeba dispar
QKSGVDCFQFTILAKSKRGGPVKPGNAKF

SEQ ID NO: 2518410 - protein, 26 aa, Entamoeba dispar
QLCWYDNTLYILSIIQGMIIIVNGHM

SEQ ID NO: 2518411 - protein, 29 aa, Entamoeba dispar
QLQNNVNKLWKILTIIYTNGIENINGVEF

SEQ ID NO: 2518412 - protein, 25 aa, Entamoeba dispar
QMTENLDKALRFIQSRDVKLTGIGP

SEQ ID NO: 2518413 - protein, 19 aa, Entamoeba dispar
QMVMDIVNALQGIVLECCK

SEQ ID NO: 2518414 - protein, 30 aa, Entamoeba dispar
QNEKGEWVPVLVLLRIDFAATDIKWSPNET

SEQ ID NO: 2518415 - protein, 18 aa, Entamoeba dispar
QNRLFMRAFPFAEGLAED

SEQ ID NO: 2518416 - protein, 18 aa, Entamoeba dispar
QPPYILVGAIDNGSAPSI

SEQ ID NO: 2518417 - protein, 29 aa, Entamoeba dispar
QPPYPKMPSSLPYPYHIPVNVPTGVDLLE

SEQ ID NO: 2518418 - protein, 30 aa, Entamoeba dispar
QQKIRDALKFILQYYGINGIIIDNFTDEQI

SEQ ID NO: 2518419 - protein, 27 aa, Entamoeba dispar
QQSTPFNQFPQQQNQFSQFSKLANGST

SEQ ID NO: 2518420 - protein, 24 aa, Entamoeba dispar
QRAENFVILRRKPIKGYDISFLIT

SEQ ID NO: 2518421 - protein, 23 aa, Entamoeba dispar
QSSLDGYQTCIFAYGQTGSGKTY

SEQ ID NO: 2518422 - protein, 23 aa, Entamoeba dispar
QTKTLLSCDFRGTRPFRLITTGE

SEQ ID NO: 2518423 - protein, 30 aa, Entamoeba dispar
QVCPEQSFFIYFFPTSQFTLTKIPPKCDLV

SEQ ID NO: 2518424 - protein, 33 aa, Entamoeba dispar
QVLSQDNMYSAWNPQLLISLKAPQAVVAMNACT

SEQ ID NO: 2518425 - protein, 25 aa, Entamoeba dispar
QVYFRFGDWDTIRILRVIIKVQPIT

SEQ ID NO: 2518426 - protein, 20 aa, Entamoeba dispar
QWARDRFEGFFKTEIEPIKN

SEQ ID NO: 2518427 - protein, 28 aa, Entamoeba dispar
QWEKVQIKTFTKWVNMHLAKKGRKINDV

SEQ ID NO: 2518428 - protein, 18 aa, Entamoeba dispar
QYDFIHKHNKWIKVKEND

SEQ ID NO: 2518429 - protein, 20 aa, Entamoeba dispar
QYIKQGDGFVLIYSITSKES

SEQ ID NO: 2518430 - protein, 21 aa, Entamoeba dispar
RDALMTMVIIQKGDVWNEIER

SEQ ID NO: 2518431 - protein, 19 aa, Entamoeba dispar
RDMHGILLRPIPRAKRILS

SEQ ID NO: 2518432 - protein, 25 aa, Entamoeba dispar
REMLHLEDQYPWLNKPNAYISKHNE

SEQ ID NO: 2518433 - protein, 28 aa, Entamoeba dispar
RETDSNIIITPLFTNFKVYCSESNYDKE

SEQ ID NO: 2518434 - protein, 33 aa, Entamoeba dispar
REYETWKSNAIYLYSFLTTYETSFPYSTTFDWG

SEQ ID NO: 2518435 - protein, 26 aa, Entamoeba dispar
RFDSRIINFFPDYTNPIMFINCDGRE

SEQ ID NO: 2518436 - protein, 18 aa, Entamoeba dispar
RFQLYKHVILLKANPQTQ

SEQ ID NO: 2518437 - protein, 25 aa, Entamoeba dispar
RHDLFVLLYCGDLKEQFRRVLQRGR

SEQ ID NO: 2518438 - protein, 23 aa, Entamoeba dispar
RHNGLYFMAFTDQNINSLLVVSF

SEQ ID NO: 2518439 - protein, 20 aa, Entamoeba dispar
RIFINEPVLISIKIPENLEI

SEQ ID NO: 2518440 - protein, 27 aa, Entamoeba dispar
RIQIKITLVFRHYATMGLTGQVQFSLK

SEQ ID NO: 2518441 - protein, 22 aa, Entamoeba dispar
RKFPSLQFIHPINNGFLCFEIS

SEQ ID NO: 2518442 - protein, 30 aa, Entamoeba dispar
RKLQKRALRCYLRALDYLDNDYRIPEDQKE

SEQ ID NO: 2518443 - protein, 24 aa, Entamoeba dispar
RKYGAWIGGKLFASLSSFEERYIK

SEQ ID NO: 2518444 - protein, 28 aa, Entamoeba dispar
RKYLKDTDFVIFFLKSSFNSSLIQRLQF

SEQ ID NO: 2518445 - protein, 21 aa, Entamoeba dispar
RLLKHLSIVRKTNENEISCLF

SEQ ID NO: 2518446 - protein, 24 aa, Entamoeba dispar
RLTSIRGIQPSQPKIQFAPNIRAA

SEQ ID NO: 2518447 - protein, 24 aa, Entamoeba dispar
RNFEGYCYRLYSSSIYENIFEEFE

SEQ ID NO: 2518448 - protein, 19 aa, Entamoeba dispar
RNLPHIVQLLLTASPTIID

SEQ ID NO: 2518449 - protein, 19 aa, Entamoeba dispar
RNMLLKTFPEIAESIGKGF

SEQ ID NO: 2518450 - protein, 23 aa, Entamoeba dispar
RNSLVEYGLPIVIKDGAWIGAGA

SEQ ID NO: 2518451 - protein, 26 aa, Entamoeba dispar
RNVISWQYICRVIFYCLSVIHKKNGY

SEQ ID NO: 2518452 - protein, 25 aa, Entamoeba dispar
RPGMIIKELGLTKPIFQKTAVGGHF

SEQ ID NO: 2518453 - protein, 23 aa, Entamoeba dispar
RPQAFFKGLIFPLCQEKDVTLKE

SEQ ID NO: 2518454 - protein, 20 aa, Entamoeba dispar
RPTGSFMFLGPSGVGKTELA

SEQ ID NO: 2518455 - protein, 34 aa, Entamoeba dispar
RRKYILSGCYYLITKGWSFLFSKEKRIAGKLDHF

SEQ ID NO: 2518456 - protein, 21 aa, Entamoeba dispar
RRTRKLFKRPFRGHGISNTST

SEQ ID NO: 2518457 - protein, 17 aa, Entamoeba dispar
RSFITKILHYAKVVNIP

SEQ ID NO: 2518458 - protein, 35 aa, Entamoeba dispar
RSKYTTRPFYIKPPNSMGYLTLKFSNSGKIIPQYL

SEQ ID NO: 2518459 - protein, 24 aa, Entamoeba dispar
RSLHDAIMIVRRALKHKQMVTGGG

SEQ ID NO: 2518460 - protein, 31 aa, Entamoeba dispar
RTKKAVLMAGFSLIRLLAEPSAAAYAYGLES

SEQ ID NO: 2518461 - protein, 32 aa, Entamoeba dispar
RTPQKTLWIIRMRVLRRLLLKYRTTGKIDKHM

SEQ ID NO: 2518462 - protein, 17 aa, Entamoeba dispar
RTVTSSYYRSCHGVFLV

SEQ ID NO: 2518463 - protein, 19 aa, Entamoeba dispar
RVVIILSGRFAGKKAVVSS

SEQ ID NO: 2518464 - protein, 25 aa, Entamoeba dispar
RWDKPPILMDFVIPALTATGLQIRY

SEQ ID NO: 2518465 - protein, 25 aa, Entamoeba dispar
RYCPEQIICFDYLQSQGWSMLMEAD

SEQ ID NO: 2518466 - protein, 30 aa, Entamoeba dispar
RYFDFRVVYNHKLKNFYLLHGLYCQLLETA

SEQ ID NO: 2518467 - protein, 27 aa, Entamoeba dispar
RYGPNSFKLHRLPMPRPGQILGLVGTN

SEQ ID NO: 2518468 - protein, 23 aa, Entamoeba dispar
RYRSLIPSYIRDSSAAVIVYDIN

SEQ ID NO: 2518469 - protein, 29 aa, Entamoeba dispar
SAFFFARDFCHFVNLWDMRYQRCLMMKKE

SEQ ID NO: 2518470 - protein, 25 aa, Entamoeba dispar
SAKYHPEHAAILWRISRFNGKTQQT

SEQ ID NO: 2518471 - protein, 17 aa, Entamoeba dispar
SAVYKNITGEKVKFAFP

SEQ ID NO: 2518472 - protein, 38 aa, Entamoeba dispar
SCDIWALGCLLYELYTSKMLFAIADVGEFYFRVLKSEE

SEQ ID NO: 2518473 - protein, 27 aa, Entamoeba dispar
SCHMKRTIIVRRDYFHYVSKYQRYEKR

SEQ ID NO: 2518474 - protein, 26 aa, Entamoeba dispar
SCKSCGFIMFAIPKKGLEKKFSTNGK

SEQ ID NO: 2518475 - protein, 29 aa, Entamoeba dispar
SDALHLGHLIPFIFTKYLQDAFDCQLVVQ

SEQ ID NO: 2518476 - protein, 20 aa, Entamoeba dispar
SDGFPIKGVWKHVCIVWTKC

SEQ ID NO: 2518477 - protein, 18 aa, Entamoeba dispar
SDTRLLSVLQYFDDSQLE

SEQ ID NO: 2518478 - protein, 20 aa, Entamoeba dispar
SDVVLLCFAVNNRTSFDNIS

SEQ ID NO: 2518479 - protein, 19 aa, Entamoeba dispar
SECIRRWLSVKEMCPICKR

SEQ ID NO: 2518480 - protein, 33 aa, Entamoeba dispar
SEDAHKLIKRFWPGALTIIFPRNETVPNEVTAG

SEQ ID NO: 2518481 - protein, 24 aa, Entamoeba dispar
SEFNQLFKIIDMLGLPPKNILEQG

SEQ ID NO: 2518482 - protein, 28 aa, Entamoeba dispar
SEVLELHRLLNKWPLLKPTQALELLDFR

SEQ ID NO: 2518483 - protein, 25 aa, Entamoeba dispar
SEVSSNFRICALDPAPIITPGESSM

SEQ ID NO: 2518484 - protein, 31 aa, Entamoeba dispar
SFEALQQGMLFALLSNYGYGFRLKRPERMAK

SEQ ID NO: 2518485 - protein, 21 aa, Entamoeba dispar
SFVFNGGKFLGICAGAYFSSS

SEQ ID NO: 2518486 - protein, 25 aa, Entamoeba dispar
SFVNALYGIKITDDFRYIIINEDNL

SEQ ID NO: 2518487 - protein, 17 aa, Entamoeba dispar
SGIKRQNTVPFVGWCPC

SEQ ID NO: 2518488 - protein, 26 aa, Entamoeba dispar
SHLLSVLCILLASLNYKVLICASTNV

SEQ ID NO: 2518489 - protein, 24 aa, Entamoeba dispar
SIAQAMLLMLERCKIVSEGSGATP

SEQ ID NO: 2518490 - protein, 21 aa, Entamoeba dispar
SIAQYLIYNKHRFYNRNRAER

SEQ ID NO: 2518491 - protein, 17 aa, Entamoeba dispar
SIDIPYSVSELGRNCFC

SEQ ID NO: 2518492 - protein, 20 aa, Entamoeba dispar
SIFPTWSIVDPCFTMSLPDN

SEQ ID NO: 2518493 - protein, 19 aa, Entamoeba dispar
SILLIPKVNYVLPNGYTII

SEQ ID NO: 2518494 - protein, 28 aa, Entamoeba dispar
SILSRSIMNWDLKGMFYLINNNDYEYIN

SEQ ID NO: 2518495 - protein, 31 aa, Entamoeba dispar
SITKNIKKLIKLLRIIIKEITDLSKYTPAFK

SEQ ID NO: 2518496 - protein, 35 aa, Entamoeba dispar
SITPKYLFSNLIEYLIFHKFTPLKKQIIPDIKIIN

SEQ ID NO: 2518497 - protein, 17 aa, Entamoeba dispar
SITVRFVQGIFLVKYDP

SEQ ID NO: 2518498 - protein, 25 aa, Entamoeba dispar
SKDEKIKWMQLFTDIDGIVVTESQS

SEQ ID NO: 2518499 - protein, 17 aa, Entamoeba dispar
SKFKTIKTIIFKPQCIN

SEQ ID NO: 2518500 - protein, 20 aa, Entamoeba dispar
SKQVFKYFNNILFGGEMNDE

SEQ ID NO: 2518501 - protein, 26 aa, Entamoeba dispar
SKVIKRFILHSKKTAFIVEHDFIMAT

SEQ ID NO: 2518502 - protein, 20 aa, Entamoeba dispar
SLHALRFMDLSINRIQSVPK

SEQ ID NO: 2518503 - protein, 29 aa, Entamoeba dispar
SLLSGMMKCLYYNKAYPMPIRMFEVGDTV

SEQ ID NO: 2518504 - protein, 25 aa, Entamoeba dispar
SLQNKYYQLLLSNPFLKQLEQISLK

SEQ ID NO: 2518505 - protein, 22 aa, Entamoeba dispar
SMSHLSLLEIVSLCNFKPTSID

SEQ ID NO: 2518506 - protein, 18 aa, Entamoeba dispar
SNIVQIPDYYHNVSSVNV

SEQ ID NO: 2518507 - protein, 24 aa, Entamoeba dispar
SQKSIIYINKLFADAAQERNYGKV

SEQ ID NO: 2518508 - protein, 26 aa, Entamoeba dispar
SQLFGKDYFYLCLLNEIPNKDIISGT

SEQ ID NO: 2518509 - protein, 18 aa, Entamoeba dispar
SQPKIQFAPNIRAAGFKP

SEQ ID NO: 2518510 - protein, 23 aa, Entamoeba dispar
SQTRVIIGMFNKCVLALEEIRKS

SEQ ID NO: 2518511 - protein, 25 aa, Entamoeba dispar
SQTSFRLLFKMIKIVEYIHSKQIIH

SEQ ID NO: 2518512 - protein, 26 aa, Entamoeba dispar
SQYVLIYELLDEILDFGYPQFCTKDE

SEQ ID NO: 2518513 - protein, 24 aa, Entamoeba dispar
SRMRQILDAIYFSKSKEITNNCRC

SEQ ID NO: 2518514 - protein, 17 aa, Entamoeba dispar
SRRGYVIIDDKGKVRYI

SEQ ID NO: 2518515 - protein, 28 aa, Entamoeba dispar
SSFQYSTFFIPFYNQFVRYYFKNYLLDT

SEQ ID NO: 2518516 - protein, 19 aa, Entamoeba dispar
STIFTMYRSLGKKTIEAFR

SEQ ID NO: 2518517 - protein, 25 aa, Entamoeba dispar
STINLPYLPSLPYEQKFLMGFDKSG

SEQ ID NO: 2518518 - protein, 23 aa, Entamoeba dispar
STNKIIYAIWYALSNHLTLNFVH

SEQ ID NO: 2518519 - protein, 27 aa, Entamoeba dispar
STPPPISFIRYTLIQLLNGLEYIRTTC

SEQ ID NO: 2518520 - protein, 23 aa, Entamoeba dispar
STVKALMNEAILTGFANLLNRTN

SEQ ID NO: 2518521 - protein, 28 aa, Entamoeba dispar
SVCKKYYGIVDLYHFNPFPLLSQNDRTM

SEQ ID NO: 2518522 - protein, 25 aa, Entamoeba dispar
SVELSILKPLIPPSLITVLDRSSEE

SEQ ID NO: 2518523 - protein, 31 aa, Entamoeba dispar
SVKTWKKRWFVLKENRLWYFASKTAEEAKGF

SEQ ID NO: 2518524 - protein, 25 aa, Entamoeba dispar
SVMRTSVLAIPYFWDEEKVKENSKK

SEQ ID NO: 2518525 - protein, 18 aa, Entamoeba dispar
SVMTYVAALYKVFSSNDQ

SEQ ID NO: 2518526 - protein, 23 aa, Entamoeba dispar
SYNYLFKVLLVGDPNVGKSSLLS

SEQ ID NO: 2518527 - protein, 21 aa, Entamoeba dispar
SYYRSCHGVFLVYAQDDKTSF

SEQ ID NO: 2518528 - protein, 24 aa, Entamoeba dispar
TAGMLMNRLSCGKLLAGCRILGCN

SEQ ID NO: 2518529 - protein, 31 aa, Entamoeba dispar
TAGNILRVMLLRNPHVLFAGYRQPHPLNYII

SEQ ID NO: 2518530 - protein, 24 aa, Entamoeba dispar
TAMRDLYMKTGQGFVLVYSIIAQS

SEQ ID NO: 2518531 - protein, 31 aa, Entamoeba dispar
TCFVKIVLQLSLPLTIIIISLNNVFGKQLVT

SEQ ID NO: 2518532 - protein, 30 aa, Entamoeba dispar
TCGKIKVFISLRPLSNIGLIYSLLPSIQSS

SEQ ID NO: 2518533 - protein, 17 aa, Entamoeba dispar
TCTVVEINLYKAIGGLH

SEQ ID NO: 2518534 - protein, 27 aa, Entamoeba dispar
TDEDDVHTFFIGGSPYFVEENKVLLQS

SEQ ID NO: 2518535 - protein, 21 aa, Entamoeba dispar
TDLKIHMLYHSDEKPFQCPFP

SEQ ID NO: 2518536 - protein, 37 aa, Entamoeba dispar
TDLSKYTPAFKYFIHELVKITFYDYPLQHCRAFEVFM

SEQ ID NO: 2518537 - protein, 19 aa, Entamoeba dispar
TEFAVQEIFMKYNTFMLRG

SEQ ID NO: 2518538 - protein, 22 aa, Entamoeba dispar
TEIRNVFMFKAISGGGDGPIDG

SEQ ID NO: 2518539 - protein, 24 aa, Entamoeba dispar
TENKLYFVMDFINGGELFYHLQNE

SEQ ID NO: 2518540 - protein, 26 aa, Entamoeba dispar
TERILIPTINKCQIEWNIKGEIIPKE

SEQ ID NO: 2518541 - protein, 28 aa, Entamoeba dispar
TFIKGMYTFLKLMGREPIIINLDPANEP

SEQ ID NO: 2518542 - protein, 18 aa, Entamoeba dispar
TFPNVITAWDRNGIDKAT

SEQ ID NO: 2518543 - protein, 19 aa, Entamoeba dispar
TFTELILFEAPFLSNALEL

SEQ ID NO: 2518544 - protein, 27 aa, Entamoeba dispar
TFVCNKSALFIIRRNGMKEYIPIVSKR

SEQ ID NO: 2518545 - protein, 25 aa, Entamoeba dispar
TGEDNYPCWFEGPPFKFKKSMKDIH

SEQ ID NO: 2518546 - protein, 23 aa, Entamoeba dispar
TGSTEIIINEILALKCIDVETRT

SEQ ID NO: 2518547 - protein, 21 aa, Entamoeba dispar
TGTDPVPHYKANQPFKCVPVK

SEQ ID NO: 2518548 - protein, 24 aa, Entamoeba dispar
TIEPMSLIPILRFNPKCIVCVGDP

SEQ ID NO: 2518549 - protein, 18 aa, Entamoeba dispar
TIFTMYRSLGKKTIEAFR

SEQ ID NO: 2518550 - protein, 27 aa, Entamoeba dispar
TIGSLYAMYQEEDGYLYFIVYRESVFG

SEQ ID NO: 2518551 - protein, 20 aa, Entamoeba dispar
TIHCNRFIQCFGSFGWSGEG

SEQ ID NO: 2518552 - protein, 27 aa, Entamoeba dispar
TIHHSFDEIIPLFPNLQTFYVRRCPER

SEQ ID NO: 2518553 - protein, 28 aa, Entamoeba dispar
TIHHSFDEIIPLFPNLQTFYVRRCPERL

SEQ ID NO: 2518554 - protein, 35 aa, Entamoeba dispar
TIKNFSEKIFYIKALRMFTIFQVKSLLEPISGVSS

SEQ ID NO: 2518555 - protein, 25 aa, Entamoeba dispar
TIPTTISIIGYRFFCKCISLKSVNM

SEQ ID NO: 2518556 - protein, 22 aa, Entamoeba dispar
TIQKKCILFGGVTGYIGGICEI

SEQ ID NO: 2518557 - protein, 18 aa, Entamoeba dispar
TIQMIKIKEIGIGEEWKM

SEQ ID NO: 2518558 - protein, 18 aa, Entamoeba dispar
TIYSSNILLVKPNNETNI

SEQ ID NO: 2518559 - protein, 22 aa, Entamoeba dispar
TKIYIKGRFPYSGRKYQVTFGN

SEQ ID NO: 2518560 - protein, 27 aa, Entamoeba dispar
TKKPAPMKPIPRYPAPYPFGYDKDNRD

SEQ ID NO: 2518561 - protein, 24 aa, Entamoeba dispar
TKSWVSLYMRPVVVPGVKGVKGFE

SEQ ID NO: 2518562 - protein, 18 aa, Entamoeba dispar
TLLLNPELDFDPCNPNHP

SEQ ID NO: 2518563 - protein, 20 aa, Entamoeba dispar
TLMNFRVCFIKSISLQVSTD

SEQ ID NO: 2518564 - protein, 27 aa, Entamoeba dispar
TNENVTIPFYPWYIIAVETTNKTNEGE

SEQ ID NO: 2518565 - protein, 25 aa, Entamoeba dispar
TNEVYLSIIFLLLKQAIENGCNTDY

SEQ ID NO: 2518566 - protein, 20 aa, Entamoeba dispar
TNILNLLRKKHAEGGLWYGV

SEQ ID NO: 2518567 - protein, 27 aa, Entamoeba dispar
TNRIDILDPALLRPGRIDRKIEFPNPK

SEQ ID NO: 2518568 - protein, 19 aa, Entamoeba dispar
TNYLFLGDYVNFGMNGLEV

SEQ ID NO: 2518569 - protein, 27 aa, Entamoeba dispar
TPFMRPQLVDWLFKTSEYLHLSKKVIF

SEQ ID NO: 2518570 - protein, 30 aa, Entamoeba dispar
TPIQPLSYLPQLPVLVKISCSTLCHLNKWG

SEQ ID NO: 2518571 - protein, 20 aa, Entamoeba dispar
TPIYGMNYEKFMPALMQYYK

SEQ ID NO: 2518572 - protein, 19 aa, Entamoeba dispar
TPLLGFFEKNRFKNFLTYL

SEQ ID NO: 2518573 - protein, 19 aa, Entamoeba dispar
TPLTQQKTIVWGNSVQPQT

SEQ ID NO: 2518574 - protein, 21 aa, Entamoeba dispar
TQYLTNVNPLLLKDNSDKLKL

SEQ ID NO: 2518575 - protein, 37 aa, Entamoeba dispar
TRARNNLFFIIHKSILYHPFIQNILLNSKVSYIDCDL

SEQ ID NO: 2518576 - protein, 23 aa, Entamoeba dispar
TRTDLFPWREEMPEVQTIRKWLK

SEQ ID NO: 2518577 - protein, 28 aa, Entamoeba dispar
TRTTKMEYIYYRILLIIDDRLTVKDLVS

SEQ ID NO: 2518578 - protein, 29 aa, Entamoeba dispar
TSEYQNGIPCFWLHVLKNSGIFDGLSGNE

SEQ ID NO: 2518579 - protein, 30 aa, Entamoeba dispar
TSKNSEEYFRFLWELRLVFNKEMTQLQELK

SEQ ID NO: 2518580 - protein, 19 aa, Entamoeba dispar
TSLEELDHPLSHQNRFIAF

SEQ ID NO: 2518581 - protein, 22 aa, Entamoeba dispar
TSPCFLKPLELGADVALHSISK

SEQ ID NO: 2518582 - protein, 28 aa, Entamoeba dispar
TSTDHKMYIFQFMFIPNTDSYSTKKTKI

SEQ ID NO: 2518583 - protein, 23 aa, Entamoeba dispar
TTIMKHHPFFQGLDFDRLMKKEV

SEQ ID NO: 2518584 - protein, 18 aa, Entamoeba dispar
TTLIQRRKYLKDTDFVIF

SEQ ID NO: 2518585 - protein, 17 aa, Entamoeba dispar
TTQLSCVMIAFGTAMTM

SEQ ID NO: 2518586 - protein, 25 aa, Entamoeba dispar
TTREEMLLIEGIKRYGINNWEEVAS

SEQ ID NO: 2518587 - protein, 19 aa, Entamoeba dispar
TVKAAKKAQHFPARKFFVL

SEQ ID NO: 2518588 - protein, 24 aa, Entamoeba dispar
TVVQTFFVVQLLKEKFVENKIEWK

SEQ ID NO: 2518589 - protein, 19 aa, Entamoeba dispar
TYELYSCSYDRSVKVWNIE

SEQ ID NO: 2518590 - protein, 22 aa, Entamoeba dispar
TYMTFKAIQLFRKISDEEPLYT

SEQ ID NO: 2518591 - protein, 20 aa, Entamoeba dispar
TYMYVRHNGLYFMAFTDQNI

SEQ ID NO: 2518592 - protein, 25 aa, Entamoeba dispar
TYNRIYYVIRNVTPGRFKITRDGFE

SEQ ID NO: 2518593 - protein, 26 aa, Entamoeba dispar
TYTKGKKPIIYLLSNKKDCEKIVSTE

SEQ ID NO: 2518594 - protein, 34 aa, Entamoeba dispar
VDGNVKLTLGLVWTLILRFAISELSAEGLSAKQG

SEQ ID NO: 2518595 - protein, 18 aa, Entamoeba dispar
VDTSVFVYDFRNLNLRQT

SEQ ID NO: 2518596 - protein, 23 aa, Entamoeba dispar
VEDALMLMKNKPADLIKPVVRIH

SEQ ID NO: 2518597 - protein, 22 aa, Entamoeba dispar
VELCALLEIIGETTIKCVTNPK

SEQ ID NO: 2518598 - protein, 23 aa, Entamoeba dispar
VESKPLHVLVTGAAGQIGYNLLF

SEQ ID NO: 2518599 - protein, 29 aa, Entamoeba dispar
VFAELQRLRKIFFPDFFMKHQNISESHLA

SEQ ID NO: 2518600 - protein, 18 aa, Entamoeba dispar
VFDAKRMIGRRFSEPSIQ

SEQ ID NO: 2518601 - protein, 17 aa, Entamoeba dispar
VFGDKFIKNLQFLKMAS

SEQ ID NO: 2518602 - protein, 21 aa, Entamoeba dispar
VFLKNVLFYLETLDDVCNFNQ

SEQ ID NO: 2518603 - protein, 29 aa, Entamoeba dispar
VFNDGRIIKLLIWYTVNYSTYLKEKKKGN

SEQ ID NO: 2518604 - protein, 24 aa, Entamoeba dispar
VFSPNGHLFQVEYALEAVSKGLVS

SEQ ID NO: 2518605 - protein, 24 aa, Entamoeba dispar
VGCRGPLFLVQTRHKELWLVVMNQ

SEQ ID NO: 2518606 - protein, 38 aa, Entamoeba dispar
VGCYNFIKLCKIEYYLHCIIYRVIKDYAIQFGDITMGK

SEQ ID NO: 2518607 - protein, 20 aa, Entamoeba dispar
VGRVVLMKTGPFASKLAVIV

SEQ ID NO: 2518608 - protein, 26 aa, Entamoeba dispar
VIIRQRRTWRRKDGVTLYFEDNAAVI

SEQ ID NO: 2518609 - protein, 21 aa, Entamoeba dispar
VKILEVIIKKEPFKRNKEREN

SEQ ID NO: 2518610 - protein, 22 aa, Entamoeba dispar
VKKNFIAMLTFCDGKTPQVINA

SEQ ID NO: 2518611 - protein, 24 aa, Entamoeba dispar
VLNLRKLSFLLQKLPKDDAFRMVL

SEQ ID NO: 2518612 - protein, 21 aa, Entamoeba dispar
VLRILKLAGLAPKIPEDLYFL

SEQ ID NO: 2518613 - protein, 21 aa, Entamoeba dispar
VLYHETISPVLSYFDITPNSI

SEQ ID NO: 2518614 - protein, 19 aa, Entamoeba dispar
VLYNVIEIGLRVLHPFMPF

SEQ ID NO: 2518615 - protein, 21 aa, Entamoeba dispar
VMINKFENNYFKIGKIKKSLE

SEQ ID NO: 2518616 - protein, 17 aa, Entamoeba dispar
VNPWFTSERDINKFCNI

SEQ ID NO: 2518617 - protein, 17 aa, Entamoeba dispar
VNQSVIFCNSKNRVEWI

SEQ ID NO: 2518618 - protein, 25 aa, Entamoeba dispar
VNRKAPIVLSHHMLMGLKGPKAGKM

SEQ ID NO: 2518619 - protein, 26 aa, Entamoeba dispar
VPISRQDLVFLPKVNVNQLGGVGPLM

SEQ ID NO: 2518620 - protein, 21 aa, Entamoeba dispar
VPYQYLRFFLNDDQQLEKIKN

SEQ ID NO: 2518621 - protein, 30 aa, Entamoeba dispar
VQKQTKIIVLIPPPLQYCTFESWKSTVNPV

SEQ ID NO: 2518622 - protein, 19 aa, Entamoeba dispar
VQKTFLMRVLKSVYVDEGS

SEQ ID NO: 2518623 - protein, 24 aa, Entamoeba dispar
VRVNFEIPYYTVSGLQVRYLKVVE

SEQ ID NO: 2518624 - protein, 20 aa, Entamoeba dispar
VSIYNIKRTKKAPPIKIIDT

SEQ ID NO: 2518625 - protein, 18 aa, Entamoeba dispar
VSKERIFINEPVLISIKI

SEQ ID NO: 2518626 - protein, 17 aa, Entamoeba dispar
VSKERIFMNEPVLVSIE

SEQ ID NO: 2518627 - protein, 19 aa, Entamoeba dispar
VSLPSWELFNQQPVEYRES

SEQ ID NO: 2518628 - protein, 28 aa, Entamoeba dispar
VSNILAQLYFSLFSYDHASALQFLQDKV

SEQ ID NO: 2518629 - protein, 28 aa, Entamoeba dispar
VSSKDKVPYLFLANSYKISYWKTDIENY

SEQ ID NO: 2518630 - protein, 19 aa, Entamoeba dispar
VSTPIQQKIRDALKFILQY

SEQ ID NO: 2518631 - protein, 25 aa, Entamoeba dispar
VTENALPGMAIRTGANPLVYDCNLV

SEQ ID NO: 2518632 - protein, 22 aa, Entamoeba dispar
VTFPCIYGMAAKRTIPSGFYQN

SEQ ID NO: 2518633 - protein, 17 aa, Entamoeba dispar
VTGPFKINGVPLMRINQ

SEQ ID NO: 2518634 - protein, 24 aa, Entamoeba dispar
VVEGKIYMTVYYIKATSTSIESHE

SEQ ID NO: 2518635 - protein, 18 aa, Entamoeba dispar
VVQMIFKRLFRVYAHIYL

SEQ ID NO: 2518636 - protein, 18 aa, Entamoeba dispar
VWATLYPEWVCASVGNQI

SEQ ID NO: 2518637 - protein, 18 aa, Entamoeba dispar
VYQIIEKEFNPIWDVLQI

SEQ ID NO: 2518638 - protein, 17 aa, Entamoeba dispar
WCRITIKKPTRRSCVTE

SEQ ID NO: 2518639 - protein, 17 aa, Entamoeba dispar
WEHELNNLSIWVESIPR

SEQ ID NO: 2518640 - protein, 19 aa, Entamoeba dispar
WFAERADMIVLVFDAHKLD

SEQ ID NO: 2518641 - protein, 31 aa, Entamoeba dispar
WIEDVRSKEKGEIFLFLVGNKLDLGHREVTQ

SEQ ID NO: 2518642 - protein, 17 aa, Entamoeba dispar
WIKCASGNKFRMGNLFI

SEQ ID NO: 2518643 - protein, 17 aa, Entamoeba dispar
WNKQHAINLKCILDKIN

SEQ ID NO: 2518644 - protein, 23 aa, Entamoeba dispar
WNPQQVYMFTACSDDWNLYTYDI

SEQ ID NO: 2518645 - protein, 18 aa, Entamoeba dispar
WTIFMDVFDYFNVAAVID

SEQ ID NO: 2518646 - protein, 19 aa, Entamoeba dispar
WTLHMPDLQIESRKSFIEF

SEQ ID NO: 2518647 - protein, 18 aa, Entamoeba dispar
WYCYHLMKERKNMSLKYL

SEQ ID NO: 2518648 - protein, 20 aa, Entamoeba dispar
YACEFEIFITIKCTTKIKEQ

SEQ ID NO: 2518649 - protein, 24 aa, Entamoeba dispar
YCNGRFGTFSQLYEIPEDIDIKNI

SEQ ID NO: 2518650 - protein, 27 aa, Entamoeba dispar
YDDEQNYKFILFDDINYDKNLIRLIKA

SEQ ID NO: 2518651 - protein, 18 aa, Entamoeba dispar
YDDRYLFCGCSSGELMLF

SEQ ID NO: 2518652 - protein, 30 aa, Entamoeba dispar
YDKCLNSYHFILISYFDLRDAKTVYRLLQN

SEQ ID NO: 2518653 - protein, 17 aa, Entamoeba dispar
YFDMFDLKIFIESDNDT

SEQ ID NO: 2518654 - protein, 29 aa, Entamoeba dispar
YGERTINLFLIRWKNNFHYVIDEKVPITS

SEQ ID NO: 2518655 - protein, 18 aa, Entamoeba dispar
YGNYKFVNKKPYTYQRVY

SEQ ID NO: 2518656 - protein, 19 aa, Entamoeba dispar
YGNYKFVNKKPYTYQRVYD

SEQ ID NO: 2518657 - protein, 17 aa, Entamoeba dispar
YIDIREFYERDGELKPG

SEQ ID NO: 2518658 - protein, 24 aa, Entamoeba dispar
YKKFKNILEVIKKLAPTIHATNLM

SEQ ID NO: 2518659 - protein, 20 aa, Entamoeba dispar
YKLPFKCFNNCKSLIKINIE

SEQ ID NO: 2518660 - protein, 21 aa, Entamoeba dispar
YKLPFKCFNNCKSLIKINIEY

SEQ ID NO: 2518661 - protein, 27 aa, Entamoeba dispar
YKYNGYEIILFFLKQILIRNDVININK

SEQ ID NO: 2518662 - protein, 22 aa, Entamoeba dispar
YLAIDIGCYCVFATHFHEITGL

SEQ ID NO: 2518663 - protein, 28 aa, Entamoeba dispar
YLCYFKIELNYIHKLKQSIKIRFKDLNK

SEQ ID NO: 2518664 - protein, 27 aa, Entamoeba dispar
YMDTFPFPHYIILHDLNTLPNVLAEAL

SEQ ID NO: 2518665 - protein, 25 aa, Entamoeba dispar
YNGGYNWWKRNSLTVFIDKKLYKDP

SEQ ID NO: 2518666 - protein, 18 aa, Entamoeba dispar
YNPVRLIYGKGSLDEIEK

SEQ ID NO: 2518667 - protein, 18 aa, Entamoeba dispar
YPHKPPTLVVMTKVYSPI

SEQ ID NO: 2518668 - protein, 17 aa, Entamoeba dispar
YPYFAQLCESYNQCLHP

SEQ ID NO: 2518669 - protein, 18 aa, Entamoeba dispar
YQMIVETFKYLPIAAVVQ

SEQ ID NO: 2518670 - protein, 25 aa, Entamoeba dispar
YQNLCASTLYYWIRADERESSSISQ

SEQ ID NO: 2518671 - protein, 32 aa, Entamoeba dispar
YQSEYGRFFQEWYFDLLLSHTDKVLSAARNVF

SEQ ID NO: 2518672 - protein, 19 aa, Entamoeba dispar
YRSPFSNKYFPAFPEGGLP

SEQ ID NO: 2518673 - protein, 30 aa, Entamoeba dispar
YSHARVTSIPTILVLNPGSWKALQQTAKEY

SEQ ID NO: 2518674 - protein, 24 aa, Entamoeba dispar
YSITMLEIITWQNPFPKEIYNFPW

SEQ ID NO: 2518675 - protein, 21 aa, Entamoeba dispar
YSVAMPFIISNRDWVNRRSWW

SEQ ID NO: 2518676 - protein, 26 aa, Entamoeba dispar
YTFQNLELLRLDYCSNLNISLISNKL

SEQ ID NO: 2518677 - protein, 26 aa, Entamoeba dispar
YTFQNLELLRLNYCSNLNISLISNKL

SEQ ID NO: 2518678 - protein, 18 aa, Entamoeba dispar
YVIGIFPNEESINQIPKE

SEQ ID NO: 2518679 - protein, 25 aa, Entamoeba dispar
YVKRNRSFFYLTKDEWYSLYYERNF

SEQ ID NO: 2518680 - protein, 18 aa, Entamoeba dispar
YVSRAFCIKTKGSFVLPG

SEQ ID NO: 2518681 - protein, 27 aa, Entamoeba dispar
YYKRISHQFLLPPPIFCIGTKSDLPST

SEQ ID NO: 2518682 - protein, 26 aa, Entamoeba dispar
AAADILSFILIFLNYITKFSDKNKMN

SEQ ID NO: 2518683 - protein, 17 aa, Entamoeba dispar
AAARYIYTRLSSISRYL

SEQ ID NO: 2518684 - protein, 25 aa, Entamoeba dispar
AAAVEYLLPLRLKHQYHDGYTGWKI

SEQ ID NO: 2518685 - protein, 18 aa, Entamoeba dispar
AAAYFLRLKGHKVVVYEQ

SEQ ID NO: 2518686 - protein, 24 aa, Entamoeba dispar
AAEKGIPLYKYLAELTGHKEMTMP

SEQ ID NO: 2518687 - protein, 17 aa, Entamoeba dispar
AAEKLIQIDYRPGESYW

SEQ ID NO: 2518688 - protein, 18 aa, Entamoeba dispar
AAELFVGIPIFPGNSEYN

SEQ ID NO: 2518689 - protein, 28 aa, Entamoeba dispar
AAGQIGYNLLFLIAHGLMFGPNQTVYLH

SEQ ID NO: 2518690 - protein, 29 aa, Entamoeba dispar
AAGQIGYNLLFLIAHGLMFGPNQTVYLHL

SEQ ID NO: 2518691 - protein, 17 aa, Entamoeba dispar
AAHLIRSLITPENYVIV

SEQ ID NO: 2518692 - protein, 19 aa, Entamoeba dispar
AAIAFILLDPSKNLKVKRS

SEQ ID NO: 2518693 - protein, 25 aa, Entamoeba dispar
AAIDTLIHDTIFFYGEREYSKSRCR

SEQ ID NO: 2518694 - protein, 22 aa, Entamoeba dispar
AAIFIAHTPLNWGEAIQIICDV

SEQ ID NO: 2518695 - protein, 17 aa, Entamoeba dispar
AAIHRIFSGKAGTDNLK

SEQ ID NO: 2518696 - protein, 42 aa, Entamoeba dispar
AAILKDYLRQLPEPLIPYEYYKQFIELPLKTTDPKLFMESLP

SEQ ID NO: 2518697 - protein, 19 aa, Entamoeba dispar
AAIQLLNGLNERALLQKDE

SEQ ID NO: 2518698 - protein, 25 aa, Entamoeba dispar
AAISEFYVYFIDYIIVHAEQIIKFW

SEQ ID NO: 2518699 - protein, 25 aa, Entamoeba dispar
AAITILRIDDLIKLNPTPQPKQGQD

SEQ ID NO: 2518700 - protein, 28 aa, Entamoeba dispar
AAIYLGRSSLKPVMYEGFMAGGVAAGGQ

SEQ ID NO: 2518701 - protein, 26 aa, Entamoeba dispar
AAKALVTLLQFPFTKYNVLKVIQLRV

SEQ ID NO: 2518702 - protein, 33 aa, Entamoeba dispar
AAKGTVLILGKEKHFLLKKLTFNLIKDISEHSI

SEQ ID NO: 2518703 - protein, 29 aa, Entamoeba dispar
AAKKALTGRYYAKKILAPNFCRVTEFKEA

SEQ ID NO: 2518704 - protein, 17 aa, Entamoeba dispar
AAKKLMEHLKICTLAVS

SEQ ID NO: 2518705 - protein, 25 aa, Entamoeba dispar
AAKQLNLPQYWRQLAQKAISTGHFK

SEQ ID NO: 2518706 - protein, 25 aa, Entamoeba dispar
AALAKEWHMLFYEVSAKTNQNITEM

SEQ ID NO: 2518707 - protein, 21 aa, Entamoeba dispar
AALCIFAEMTFVPGEMLQAED

SEQ ID NO: 2518708 - protein, 18 aa, Entamoeba dispar
AALDFRNVSIIAHYIKER

SEQ ID NO: 2518709 - protein, 26 aa, Entamoeba dispar
AALKKFIRKLRQWKLYGRLILANKRL

SEQ ID NO: 2518710 - protein, 19 aa, Entamoeba dispar
AALSLAEMIAAKQGKLKAT

SEQ ID NO: 2518711 - protein, 23 aa, Entamoeba dispar
AALSQIIFTILISVGDTSDIDVR

SEQ ID NO: 2518712 - protein, 23 aa, Entamoeba dispar
AAMATIIQPFIDIGFKNLAENLL

SEQ ID NO: 2518713 - protein, 22 aa, Entamoeba dispar
AAMCALLFSGVDMKGIVVGMCV

SEQ ID NO: 2518714 - protein, 17 aa, Entamoeba dispar
AAMLLDCYDICYLWIGK

SEQ ID NO: 2518715 - protein, 29 aa, Entamoeba dispar
AAPGLALIVRCYPGFQATMIYRVAHVLYE

SEQ ID NO: 2518716 - protein, 25 aa, Entamoeba dispar
AAPGLSLIIRCYPGFQAVIVYRIAH

SEQ ID NO: 2518717 - protein, 22 aa, Entamoeba dispar
AAPICTLALRSLRYLSSLELSA

SEQ ID NO: 2518718 - protein, 24 aa, Entamoeba dispar
AAPLTYEITPFSQNFVRIGMNWKQ

SEQ ID NO: 2518719 - protein, 26 aa, Entamoeba dispar
AAPPPPPPSKISIAAPPPPPVTNYSK

SEQ ID NO: 2518720 - protein, 24 aa, Entamoeba dispar
AAQAWNHAFYWKCMCGCGVKPSEQ

SEQ ID NO: 2518721 - protein, 22 aa, Entamoeba dispar
AAQEGIVFAFAYGIEQMRNMGM

SEQ ID NO: 2518722 - protein, 27 aa, Entamoeba dispar
AAQKYSTVFIFYTPVLRSKFMNIIRKD

SEQ ID NO: 2518723 - protein, 30 aa, Entamoeba dispar
AAQQSFLIGLLVNNGFFIKLKKLYKRGKTT

SEQ ID NO: 2518724 - protein, 20 aa, Entamoeba dispar
AARLLEYFDIKMAVFEIRVL

SEQ ID NO: 2518725 - protein, 25 aa, Entamoeba dispar
AARTAMGIVLRMVQSRQISGRAILL

SEQ ID NO: 2518726 - protein, 27 aa, Entamoeba dispar
AASEGLQMILIINKIDRLVFEKNFSIE

SEQ ID NO: 2518727 - protein, 35 aa, Entamoeba dispar
AASGKYTPYCQYMFYDCLEILPDKYLELPKEEFID

SEQ ID NO: 2518728 - protein, 23 aa, Entamoeba dispar
AASKRIKGYAYYTALEYSNTISK

SEQ ID NO: 2518729 - protein, 25 aa, Entamoeba dispar
AASNRQMQILSRQFDINSIEDVQDS

SEQ ID NO: 2518730 - protein, 24 aa, Entamoeba dispar
AAVYWLGRMIFSGENPKYVARRMI

SEQ ID NO: 2518731 - protein, 21 aa, Entamoeba dispar
AAYLKMLFREALHKGFYELTL

SEQ ID NO: 2518732 - protein, 33 aa, Entamoeba dispar
ACAKYKLYNDTRLLNILLYLYNNGYVIKSAMKE

SEQ ID NO: 2518733 - protein, 22 aa, Entamoeba dispar
ACDTILKLFVNFAPRTTFKTEY

SEQ ID NO: 2518734 - protein, 17 aa, Entamoeba dispar
ACEVVNIPTGSFFSKSR

SEQ ID NO: 2518735 - protein, 18 aa, Entamoeba dispar
ACEVVNIPTGSFFSKSRN

SEQ ID NO: 2518736 - protein, 18 aa, Entamoeba dispar
ACGRKWHADHFRCAECHN

SEQ ID NO: 2518737 - protein, 37 aa, Entamoeba dispar
ACHHQSYYLERIFSLYLPMLFGYQIYISSKSVYQQTL

SEQ ID NO: 2518738 - protein, 17 aa, Entamoeba dispar
ACHNFFRSVAYITSITT

SEQ ID NO: 2518739 - protein, 31 aa, Entamoeba dispar
ACIRKQGSLFIYLFRLMLATGIPELQHEKDI

SEQ ID NO: 2518740 - protein, 24 aa, Entamoeba dispar
ACMPIVEVLVKEGICGYLVLCNKK

SEQ ID NO: 2518741 - protein, 26 aa, Entamoeba dispar
ACNTQQPIPQFPNNGQYYGQVDTFNT

SEQ ID NO: 2518742 - protein, 20 aa, Entamoeba dispar
ACPAICRPCTGRPASPSAAP

SEQ ID NO: 2518743 - protein, 17 aa, Entamoeba dispar
ACRCIVNLTYYNEPARN

SEQ ID NO: 2518744 - protein, 19 aa, Entamoeba dispar
ACRLYQFQQTFLGPTGDNE

SEQ ID NO: 2518745 - protein, 28 aa, Entamoeba dispar
ACSLYPSAIVRLYLPMGAPNQMFHPIEW

SEQ ID NO: 2518746 - protein, 21 aa, Entamoeba dispar
ACSTFGFPPISNTLEEIICNL

SEQ ID NO: 2518747 - protein, 25 aa, Entamoeba dispar
ACTYIFGTSMPRWEQYRKSCFERDF

SEQ ID NO: 2518748 - protein, 28 aa, Entamoeba dispar
ACVCCNILDLLKKIYTKKYIFVIEDVLA

SEQ ID NO: 2518749 - protein, 24 aa, Entamoeba dispar
ADAYLDQYLWYEGDKRHLFPNWIK

SEQ ID NO: 2518750 - protein, 27 aa, Entamoeba dispar
ADCFYECSLLPFINIPTSIGEFKINCF

SEQ ID NO: 2518751 - protein, 23 aa, Entamoeba dispar
ADDPEMIKLYLTTILKIFIAGDE

SEQ ID NO: 2518752 - protein, 26 aa, Entamoeba dispar
ADETVVNYLINMKKIMIAGKTCYISD

SEQ ID NO: 2518753 - protein, 20 aa, Entamoeba dispar
ADEYKFIDTLRDIKVIQQEK

SEQ ID NO: 2518754 - protein, 17 aa, Entamoeba dispar
ADFAALLCSCQEGFSYV

SEQ ID NO: 2518755 - protein, 22 aa, Entamoeba dispar
ADFGILPSRRFICCGPMYLTNN

SEQ ID NO: 2518756 - protein, 26 aa, Entamoeba dispar
ADFQGFVIQFKFNNGLYIPACEYALK

SEQ ID NO: 2518757 - protein, 27 aa, Entamoeba dispar
ADGLDELKLIKTIWAIIGISGKVVYKT

SEQ ID NO: 2518758 - protein, 33 aa, Entamoeba dispar
ADGNPPYMDYPPMRALFLITTKGIPPLKDKEKW

SEQ ID NO: 2518759 - protein, 17 aa, Entamoeba dispar
ADGTFWPIPITMSVSEE

SEQ ID NO: 2518760 - protein, 30 aa, Entamoeba dispar
ADGTPPYMDFPPMKALFQITTKGIPPLEGT

SEQ ID NO: 2518761 - protein, 19 aa, Entamoeba dispar
ADIFGFIFEIAKEGNIHLK

SEQ ID NO: 2518762 - protein, 22 aa, Entamoeba dispar
ADIHRAIRCGFILSGGPAAGGH

SEQ ID NO: 2518763 - protein, 23 aa, Entamoeba dispar
ADIIKIYLRNLPEPLLPYDSIPE

SEQ ID NO: 2518764 - protein, 22 aa, Entamoeba dispar
ADIKAICTEAGLLALRERRMKV

SEQ ID NO: 2518765 - protein, 40 aa, Entamoeba dispar
ADIKLIQQHPFFKGFNWDTIFEQTPPYLPKLKSPFDTSNF

SEQ ID NO: 2518766 - protein, 31 aa, Entamoeba dispar
ADILLLELTIAFYKINFYSSALANILLELKI

SEQ ID NO: 2518767 - protein, 26 aa, Entamoeba dispar
ADKGHKIFFKLPLIKKVELKGELIQR

SEQ ID NO: 2518768 - protein, 27 aa, Entamoeba dispar
ADKHPDLAIPLWYSYGTVVILLEEIVS

SEQ ID NO: 2518769 - protein, 23 aa, Entamoeba dispar
ADKLLTLQNYQALAGFYVGLEAY

SEQ ID NO: 2518770 - protein, 18 aa, Entamoeba dispar
ADKRDHRLIGRQQDLFFF

SEQ ID NO: 2518771 - protein, 25 aa, Entamoeba dispar
ADMKQIGIIEPFRVKKHILTAATEA

SEQ ID NO: 2518772 - protein, 29 aa, Entamoeba dispar
ADNKYIHHDILMPNIPLTTSYLDMGSCPI

SEQ ID NO: 2518773 - protein, 27 aa, Entamoeba dispar
ADNSFYNYLLPLYLENKFHVQFVIDQQ

SEQ ID NO: 2518774 - protein, 25 aa, Entamoeba dispar
ADQQKKLERIRKVAAAEIEEKEKEL

SEQ ID NO: 2518775 - protein, 27 aa, Entamoeba dispar
ADRRNNLQWFRVPPKIFFEPHSIRYLA

SEQ ID NO: 2518776 - protein, 23 aa, Entamoeba dispar
ADSINFIQKSFYKGCLMGGVHGG

SEQ ID NO: 2518777 - protein, 24 aa, Entamoeba dispar
ADSLKFIQFTNCSIGIIADGCGWG

SEQ ID NO: 2518778 - protein, 21 aa, Entamoeba dispar
ADTAIFERYIVNKYVKVVNGQ

SEQ ID NO: 2518779 - protein, 36 aa, Entamoeba dispar
ADTFRPLFQYNVDSPQLIIDFFKGLLASHKKIVQLG

SEQ ID NO: 2518780 - protein, 25 aa, Entamoeba dispar
ADVIDALDRLGFEDYCPSLQKHLNH

SEQ ID NO: 2518781 - protein, 18 aa, Entamoeba dispar
ADVITCDPNPFNESIKII

SEQ ID NO: 2518782 - protein, 27 aa, Entamoeba dispar
ADVNPEFIPYIPTLSKFLSYQKCHENS

SEQ ID NO: 2518783 - protein, 26 aa, Entamoeba dispar
ADVTIEQFMINWVNKALEEEGVDKRI

SEQ ID NO: 2518784 - protein, 35 aa, Entamoeba dispar
ADVWAAGCLLYKLEFFVTPFDGSPMKIIRGSYELP

SEQ ID NO: 2518785 - protein, 23 aa, Entamoeba dispar
ADYQLATLHLLLHSLGGVVANVG

SEQ ID NO: 2518786 - protein, 21 aa, Entamoeba dispar
AEAFQMVPRVLAENAGLDATE

SEQ ID NO: 2518787 - protein, 29 aa, Entamoeba dispar
AEANAAYVRFLMKLFRILGRSEVMGVFEY

SEQ ID NO: 2518788 - protein, 24 aa, Entamoeba dispar
AEAPTEMMMYFPQLKALCTAEEIN

SEQ ID NO: 2518789 - protein, 31 aa, Entamoeba dispar
AEASSRRYKKWLPFILAVLDAEKKTFVIVGY

SEQ ID NO: 2518790 - protein, 17 aa, Entamoeba dispar
AEAYLVGLFEDTNLCSL

SEQ ID NO: 2518791 - protein, 20 aa, Entamoeba dispar
AECCICFTGNFMSPDEHIYT

SEQ ID NO: 2518792 - protein, 31 aa, Entamoeba dispar
AEDFDTFVFSLRSPKLLKPTKFGKLRSFGDL

SEQ ID NO: 2518793 - protein, 26 aa, Entamoeba dispar
AEDHFRILIIDSVTSLFRVDFSGRGE

SEQ ID NO: 2518794 - protein, 18 aa, Entamoeba dispar
AEDTFLTTSYFRKVIYGK

SEQ ID NO: 2518795 - protein, 26 aa, Entamoeba dispar
AEEFSLPITFTCWPAEAQNGLTLSMS

SEQ ID NO: 2518796 - protein, 35 aa, Entamoeba dispar
AEERNYYIPCWIKIRYYQSFTFDVFKLCRSHNCHN

SEQ ID NO: 2518797 - protein, 23 aa, Entamoeba dispar
AEEYIIKMIPTPLTYYSAYITKY

SEQ ID NO: 2518798 - protein, 19 aa, Entamoeba dispar
AEFFVNELGFNDFKIIYDS

SEQ ID NO: 2518799 - protein, 24 aa, Entamoeba dispar
AEFKRLTLLMTNLPNKRLRDVSLR

SEQ ID NO: 2518800 - protein, 25 aa, Entamoeba dispar
AEFKRLTLLMTNLPNKRLRDVSLRV

SEQ ID NO: 2518801 - protein, 18 aa, Entamoeba dispar
AEFPLTLEPKIEKLTFGS

SEQ ID NO: 2518802 - protein, 24 aa, Entamoeba dispar
AEGDTAYDPLIGLYANRKKEQRIR

SEQ ID NO: 2518803 - protein, 22 aa, Entamoeba dispar
AEGIGMKIKIYDPFITTENQVK

SEQ ID NO: 2518804 - protein, 23 aa, Entamoeba dispar
AEGITPLMYAIELGFDDIALDIL

SEQ ID NO: 2518805 - protein, 23 aa, Entamoeba dispar
AEGRFHRLLGKLKETPFLSTSID

SEQ ID NO: 2518806 - protein, 19 aa, Entamoeba dispar
AEHLMIFGKIKVISMYNTD

SEQ ID NO: 2518807 - protein, 25 aa, Entamoeba dispar
AEIEKLKHDVTFTKQVTGDDANDLE

SEQ ID NO: 2518808 - protein, 26 aa, Entamoeba dispar
AEIGMPLYNFVQLIKPILKNADSQPI

SEQ ID NO: 2518809 - protein, 19 aa, Entamoeba dispar
AEIIINEILALKCIDVKTR

SEQ ID NO: 2518810 - protein, 23 aa, Entamoeba dispar
AEIKKFLEWVRSIPPMNVKNIKS

SEQ ID NO: 2518811 - protein, 20 aa, Entamoeba dispar
AEILAPEMFVLQASVVSVQA

SEQ ID NO: 2518812 - protein, 25 aa, Entamoeba dispar
AEILQERFAPFLPTVLQIVLSRAQM

SEQ ID NO: 2518813 - protein, 20 aa, Entamoeba dispar
AEINPFFIGSWIDMSQQGGM

SEQ ID NO: 2518814 - protein, 20 aa, Entamoeba dispar
AEITINLPPIPIGSVIEIRL

SEQ ID NO: 2518815 - protein, 24 aa, Entamoeba dispar
AEKKEIAILKTARALLKQMRRKGK

SEQ ID NO: 2518816 - protein, 17 aa, Entamoeba dispar
AEKKPFVKPKEGVIFIV

SEQ ID NO: 2518817 - protein, 18 aa, Entamoeba dispar
AEKLYNSGLISYPRTETN

SEQ ID NO: 2518818 - protein, 21 aa, Entamoeba dispar
AELCIGMMIFGFRKGFKEGKG

SEQ ID NO: 2518819 - protein, 29 aa, Entamoeba dispar
AELGTKRRIFVIPYLMYSTMERAVHPGEV

SEQ ID NO: 2518820 - protein, 19 aa, Entamoeba dispar
AELITKPRPFGVDKSILET

SEQ ID NO: 2518821 - protein, 29 aa, Entamoeba dispar
AEMCIKIKPDFIKGYNRKAFSHFCMKEYN

SEQ ID NO: 2518822 - protein, 22 aa, Entamoeba dispar
AEMIVSYLLRFGNDINTWNSGN

SEQ ID NO: 2518823 - protein, 20 aa, Entamoeba dispar
AEMPADSGYPAYLAARLASF

SEQ ID NO: 2518824 - protein, 33 aa, Entamoeba dispar
AEMYPPYFEMYPMRVLMLIAQNPPPKLKNESEH

SEQ ID NO: 2518825 - protein, 23 aa, Entamoeba dispar
AEPKEEIIFHIFGHDLVTKDGCL

SEQ ID NO: 2518826 - protein, 28 aa, Entamoeba dispar
AEQECALICLLIYEGFNMQFSVPRKSSE

SEQ ID NO: 2518827 - protein, 22 aa, Entamoeba dispar
AEQIDFFDLFLGDELNPQGMIS

SEQ ID NO: 2518828 - protein, 19 aa, Entamoeba dispar
AEQLFAFVRKILSKYCNYI

SEQ ID NO: 2518829 - protein, 22 aa, Entamoeba dispar
AEREMAFWDPRNLATPLCRHTV

SEQ ID NO: 2518830 - protein, 17 aa, Entamoeba dispar
AERMKRAIAERREQLRI

SEQ ID NO: 2518831 - protein, 29 aa, Entamoeba dispar
AERTYAIPQPYQSQYLKFGFHGLSYEYVI

SEQ ID NO: 2518832 - protein, 17 aa, Entamoeba dispar
AESIANFLSLGPVKTRK

SEQ ID NO: 2518833 - protein, 32 aa, Entamoeba dispar
AESIGKGFIREGWGCLLMNSGIWERVSQGLWK

SEQ ID NO: 2518834 - protein, 17 aa, Entamoeba dispar
AESLVPPIDFFIPQEAV

SEQ ID NO: 2518835 - protein, 30 aa, Entamoeba dispar
AEVEDTLLLNSRNHFLFAFDNTEDLSGHPH

SEQ ID NO: 2518836 - protein, 26 aa, Entamoeba dispar
AEVGDIFYVEKIIGSWAIVIVDQERF

SEQ ID NO: 2518837 - protein, 18 aa, Entamoeba dispar
AEYFAYTCDMHVLVILTD

SEQ ID NO: 2518838 - protein, 19 aa, Entamoeba dispar
AEYLHLEAELPFISFEDLL

SEQ ID NO: 2518839 - protein, 20 aa, Entamoeba dispar
AEYLLIMINKIQNYQKVIEI

SEQ ID NO: 2518840 - protein, 18 aa, Entamoeba dispar
AFDFGMDIFIDKLPLTND

SEQ ID NO: 2518841 - protein, 23 aa, Entamoeba dispar
AFDNPHEFLLRIKRQLLTQRTFK

SEQ ID NO: 2518842 - protein, 17 aa, Entamoeba dispar
AFEIAYDKLYQFICPNY

SEQ ID NO: 2518843 - protein, 28 aa, Entamoeba dispar
AFETENFEYILLFYKVFNKCSNSNELLI

SEQ ID NO: 2518844 - protein, 23 aa, Entamoeba dispar
AFEVPIINFSFKAPTIGIDIIDQ

SEQ ID NO: 2518845 - protein, 33 aa, Entamoeba dispar
AFEYNGDLLIFLLDSLYNCQFANYLEYPNTCSC

SEQ ID NO: 2518846 - protein, 26 aa, Entamoeba dispar
AFFEHLRSFQKLPGPFLVVTPLSTLE

SEQ ID NO: 2518847 - protein, 21 aa, Entamoeba dispar
AFFQTVYLPALLDNKQYQIMK

SEQ ID NO: 2518848 - protein, 26 aa, Entamoeba dispar
AFGERIYGMYFALYAELHVIIAQPTD

SEQ ID NO: 2518849 - protein, 26 aa, Entamoeba dispar
AFGLKPYMESLFTFFKENIQYFKNCR

SEQ ID NO: 2518850 - protein, 19 aa, Entamoeba dispar
AFGNQRPMINPMANFFIGV

SEQ ID NO: 2518851 - protein, 17 aa, Entamoeba dispar
AFHILFDNNLSFLPFDL

SEQ ID NO: 2518852 - protein, 20 aa, Entamoeba dispar
AFILFEKLMTILGVFYEQKR

SEQ ID NO: 2518853 - protein, 18 aa, Entamoeba dispar
AFKDACLAAFQLGRQRIK

SEQ ID NO: 2518854 - protein, 18 aa, Entamoeba dispar
AFKQLQMNKPLLLTFDDS

SEQ ID NO: 2518855 - protein, 26 aa, Entamoeba dispar
AFKSKHLPFITVFQDPTFGGTTASYA

SEQ ID NO: 2518856 - protein, 18 aa, Entamoeba dispar
AFKVLTHFRMMANKVSTL

SEQ ID NO: 2518857 - protein, 17 aa, Entamoeba dispar
AFLDNLTYKPGFEQLKQ

SEQ ID NO: 2518858 - protein, 24 aa, Entamoeba dispar
AFNELKIIIKFLTRMLLCCIIENG

SEQ ID NO: 2518859 - protein, 18 aa, Entamoeba dispar
AFNHFLWCQSSESVSDLV

SEQ ID NO: 2518860 - protein, 23 aa, Entamoeba dispar
AFNITLFGFDIIRENGTGKPYII

SEQ ID NO: 2518861 - protein, 23 aa, Entamoeba dispar
AFNKFDIIIGLFNDLKQIHWKNI

SEQ ID NO: 2518862 - protein, 18 aa, Entamoeba dispar
AFNQPLCEYLTCAVITGS

SEQ ID NO: 2518863 - protein, 18 aa, Entamoeba dispar
AFQLNKLRLIKSPSTLNL

SEQ ID NO: 2518864 - protein, 19 aa, Entamoeba dispar
AFQQSVLMGILVKEGYTFN

SEQ ID NO: 2518865 - protein, 25 aa, Entamoeba dispar
AFRLNAPNLKLDFPRAFLIMELCDG

SEQ ID NO: 2518866 - protein, 24 aa, Entamoeba dispar
AFRSPLSMFIPSNPKIFSILNSFR

SEQ ID NO: 2518867 - protein, 22 aa, Entamoeba dispar
AFSNTFADFKIPSQGDFNGLSS

SEQ ID NO: 2518868 - protein, 23 aa, Entamoeba dispar
AFSQLLRSIINLKPIFVDPGEEE

SEQ ID NO: 2518869 - protein, 30 aa, Entamoeba dispar
AFTGRLYTKFINVISFLLAIRNTETFITAF

SEQ ID NO: 2518870 - protein, 17 aa, Entamoeba dispar
AFTLEKFAKMWSAKFGI

SEQ ID NO: 2518871 - protein, 29 aa, Entamoeba dispar
AFVIDMNLLLRYIFGLIGYVPTVSFGNYS

SEQ ID NO: 2518872 - protein, 20 aa, Entamoeba dispar
AFVILLKQMIELRIHHLKIL

SEQ ID NO: 2518873 - protein, 30 aa, Entamoeba dispar
AGDFSKLQIYYIPSLGIAPSWCSFLENLTE

SEQ ID NO: 2518874 - protein, 22 aa, Entamoeba dispar
AGDPLRVKLLADTYLTDVVQYN

SEQ ID NO: 2518875 - protein, 35 aa, Entamoeba dispar
AGEDKLILVYGISLSAFLCIFETKAVIATTTKMLL

SEQ ID NO: 2518876 - protein, 23 aa, Entamoeba dispar
AGEGFLQSIYRLLSTRMGYETFV

SEQ ID NO: 2518877 - protein, 26 aa, Entamoeba dispar
AGETRKLIFNNYFSIGLDAGIALNFH

SEQ ID NO: 2518878 - protein, 27 aa, Entamoeba dispar
AGFEQQPKLFYKPKILCLNIELELKKE

SEQ ID NO: 2518879 - protein, 26 aa, Entamoeba dispar
AGHRGYYLKGWGFKLNQALINYSTNF

SEQ ID NO: 2518880 - protein, 27 aa, Entamoeba dispar
AGIVVWPCIAEILPQYVFNDRNPIICG

SEQ ID NO: 2518881 - protein, 17 aa, Entamoeba dispar
AGIYCFQPYCVTGQLEP

SEQ ID NO: 2518882 - protein, 22 aa, Entamoeba dispar
AGKGMGGAIIGLQGGVWAASAN

SEQ ID NO: 2518883 - protein, 23 aa, Entamoeba dispar
AGKISGVHWWYNDQSYAAEMTAG

SEQ ID NO: 2518884 - protein, 18 aa, Entamoeba dispar
AGKLYKFIPENQNGRFYP

SEQ ID NO: 2518885 - protein, 21 aa, Entamoeba dispar
AGLCEVHMICFIASFLEGGEA

SEQ ID NO: 2518886 - protein, 26 aa, Entamoeba dispar
AGNVLRPHVFAAFRALYESNKKKGLK

SEQ ID NO: 2518887 - protein, 23 aa, Entamoeba dispar
AGNYVLIMGEGVQSPLAIGLMKA

SEQ ID NO: 2518888 - protein, 28 aa, Entamoeba dispar
AGQERFRTIVASYYRGVLGIAMIYDVTS

SEQ ID NO: 2518889 - protein, 36 aa, Entamoeba dispar
AGQERYRAITNAYYRGALGAILVYDVTKKSSFESLD

SEQ ID NO: 2518890 - protein, 29 aa, Entamoeba dispar
AGQERYRAITNAYYRGALGALVVYDITKK

SEQ ID NO: 2518891 - protein, 39 aa, Entamoeba dispar
AGQIGYNLCFLIGRGFLFDCDVILHLYDLNDMALKGLSM

SEQ ID NO: 2518892 - protein, 26 aa, Entamoeba dispar
AGQRPLFSLRTLCLALQYITDVTPFF

SEQ ID NO: 2518893 - protein, 25 aa, Entamoeba dispar
AGRKTINILFPIEIGYDIKGPQLMT

SEQ ID NO: 2518894 - protein, 23 aa, Entamoeba dispar
AGSERFRSMVSMYYRGVSSCMIV

SEQ ID NO: 2518895 - protein, 23 aa, Entamoeba dispar
AGTTLAIVMIYDNTIYTANVGDS

SEQ ID NO: 2518896 - protein, 22 aa, Entamoeba dispar
AGTYMRTLCVHLGYLMGCGAHM

SEQ ID NO: 2518897 - protein, 25 aa, Entamoeba dispar
AGVDHYFCFGISSLIKLLQSVHNYY

SEQ ID NO: 2518898 - protein, 17 aa, Entamoeba dispar
AGYFCPNSRPTQGIHRT

SEQ ID NO: 2518899 - protein, 21 aa, Entamoeba dispar
AGYVPKYLSDILNKLESMGIK

SEQ ID NO: 2518900 - protein, 26 aa, Entamoeba dispar
AGYYDIRICTYSGLTRLAVYTRVFEV

SEQ ID NO: 2518901 - protein, 20 aa, Entamoeba dispar
AHAIKNYDLLYSLTGSLGDA

SEQ ID NO: 2518902 - protein, 24 aa, Entamoeba dispar
AHAYHAIELFRKAKMTWFGVEVCL

SEQ ID NO: 2518903 - protein, 24 aa, Entamoeba dispar
AHEDYIRDIIIHPTLPYILTCSDD

SEQ ID NO: 2518904 - protein, 31 aa, Entamoeba dispar
AHFEQYTIPFPYYLFIPKCYKMIAKLCGGYN

SEQ ID NO: 2518905 - protein, 19 aa, Entamoeba dispar
AHFIIIYDSPINCQLIGNS

SEQ ID NO: 2518906 - protein, 18 aa, Entamoeba dispar
AHGRFMELITWAIDIDFL

SEQ ID NO: 2518907 - protein, 19 aa, Entamoeba dispar
AHGRFMELITWAIDIDFLS

SEQ ID NO: 2518908 - protein, 28 aa, Entamoeba dispar
AHGSLQPFGGLIAWLRMYATDEFLNVKK

SEQ ID NO: 2518909 - protein, 27 aa, Entamoeba dispar
AHKEASVILLRYFNPIGAHKSGLLGEN

SEQ ID NO: 2518910 - protein, 30 aa, Entamoeba dispar
AHKKQSLVTVPFFRILTLDGPVDSIQFKEL

SEQ ID NO: 2518911 - protein, 17 aa, Entamoeba dispar
AHLPINISIVNESQIHT

SEQ ID NO: 2518912 - protein, 25 aa, Entamoeba dispar
AHLSKVFILFLNVPNTVLPWVYISS

SEQ ID NO: 2518913 - protein, 25 aa, Entamoeba dispar
AHMLYKKRFQPYYMSPIIAGIDDNG

SEQ ID NO: 2518914 - protein, 29 aa, Entamoeba dispar
AHNKALHFTSRYMYLTLWGDEISNQTQFK

SEQ ID NO: 2518915 - protein, 20 aa, Entamoeba dispar
AHPTYPLLLVGCIDGRILII

SEQ ID NO: 2518916 - protein, 21 aa, Entamoeba dispar
AHSASLFLIAPATADIIAKLA

SEQ ID NO: 2518917 - protein, 29 aa, Entamoeba dispar
AHTVDFRVFCFYFEFLMNAFKNKSSVIQI

SEQ ID NO: 2518918 - protein, 35 aa, Entamoeba dispar
AHWNSYFNIPLLSPEYFLLQCFVYLNAQEFLEHIY

SEQ ID NO: 2518919 - protein, 24 aa, Entamoeba dispar
AIAYDMPIPGYKTLNTLNLRLWSS

SEQ ID NO: 2518920 - protein, 24 aa, Entamoeba dispar
AICDTIRALKFPAVVRPMFENLSL

SEQ ID NO: 2518921 - protein, 29 aa, Entamoeba dispar
AICGYDDIKEAVLCLMLGGSGKALPDGTH

SEQ ID NO: 2518922 - protein, 20 aa, Entamoeba dispar
AICQHIKDWIYGTKPGIMVS

SEQ ID NO: 2518923 - protein, 23 aa, Entamoeba dispar
AIDGYALLHRIATRNPRQVVVNN

SEQ ID NO: 2518924 - protein, 29 aa, Entamoeba dispar
AIDIDDCIYLFKTAGYLVTKKFLKGYFEK

SEQ ID NO: 2518925 - protein, 23 aa, Entamoeba dispar
AIDIPHIIPLSPKFIKQVNIIFK

SEQ ID NO: 2518926 - protein, 26 aa, Entamoeba dispar
AIDPTGNHLLLYTLNGELYYTSKDLI

SEQ ID NO: 2518927 - protein, 23 aa, Entamoeba dispar
AIDTLIHDTIFFYGEREYSKSRC

SEQ ID NO: 2518928 - protein, 25 aa, Entamoeba dispar
AIDVDGLVIIRGKLVWKITVCVHII

SEQ ID NO: 2518929 - protein, 32 aa, Entamoeba dispar
AIDVHTLNYAFRWFNCFLLREFSPEQGIRLFD

SEQ ID NO: 2518930 - protein, 18 aa, Entamoeba dispar
AIDVIVMSLMEEKEISTI

SEQ ID NO: 2518931 - protein, 19 aa, Entamoeba dispar
AIDVIVMSLMEEKEISTIV

SEQ ID NO: 2518932 - protein, 22 aa, Entamoeba dispar
AIEILTGCFILIQGKTVSVIGS

SEQ ID NO: 2518933 - protein, 17 aa, Entamoeba dispar
AIELCKYLPNAIGEFRK

SEQ ID NO: 2518934 - protein, 26 aa, Entamoeba dispar
AIEYKTKILFVFETKSGVIGFYQEDI

SEQ ID NO: 2518935 - protein, 19 aa, Entamoeba dispar
AIFELLMDGFGVNKILGIS

SEQ ID NO: 2518936 - protein, 36 aa, Entamoeba dispar
AIFQLKSLGLLLPKRKDIWYYFNKVIVLSKRQTNPT

SEQ ID NO: 2518937 - protein, 26 aa, Entamoeba dispar
AIGDGIKRAFRLFGNNLGNNLERKRN

SEQ ID NO: 2518938 - protein, 43 aa, Entamoeba dispar
AIGFELNYFITWFADLFIDVFPVRLVIRIWDYYLYEGKDVLYI

SEQ ID NO: 2518939 - protein, 25 aa, Entamoeba dispar
AIGSTPSLLIKWSYTSTDNESLPIS

SEQ ID NO: 2518940 - protein, 23 aa, Entamoeba dispar
AIGTLKFIHPLQIPVCCTHQKII

SEQ ID NO: 2518941 - protein, 18 aa, Entamoeba dispar
AIHFNVGPIYLFNLNNPH

SEQ ID NO: 2518942 - protein, 34 aa, Entamoeba dispar
AIHSQILKDSLFNHFYVLWPHKFINVTNGVTPRR

SEQ ID NO: 2518943 - protein, 25 aa, Entamoeba dispar
AIHYRDINLVFFLLSHTSLIDSESL

SEQ ID NO: 2518944 - protein, 28 aa, Entamoeba dispar
AIKDSLRPLLFIFREIDPLCTLQLESYT

SEQ ID NO: 2518945 - protein, 19 aa, Entamoeba dispar
AIKHLFDEFSLNNIAVLNE

SEQ ID NO: 2518946 - protein, 17 aa, Entamoeba dispar
AIKIFYKSRGINLEHLE

SEQ ID NO: 2518947 - protein, 22 aa, Entamoeba dispar
AIKSFPLPEDILNYLYQNIKGY

SEQ ID NO: 2518948 - protein, 24 aa, Entamoeba dispar
AIKYNCVLLLPPASLIKDLAITPN

SEQ ID NO: 2518949 - protein, 24 aa, Entamoeba dispar
AILIGVLNLYYNITVQFGSIRTPK

SEQ ID NO: 2518950 - protein, 17 aa, Entamoeba dispar
AILNHPMKYQPKSKEFT

SEQ ID NO: 2518951 - protein, 19 aa, Entamoeba dispar
AILRGKVEFPLSLPSLFIK

SEQ ID NO: 2518952 - protein, 20 aa, Entamoeba dispar
AINAFKYIIQIPNIDDRKVK

SEQ ID NO: 2518953 - protein, 23 aa, Entamoeba dispar
AINDLFHVILINKKFVNLNELFH

SEQ ID NO: 2518954 - protein, 17 aa, Entamoeba dispar
AINFMNAYDSATEHDNV

SEQ ID NO: 2518955 - protein, 29 aa, Entamoeba dispar
AINHLLSPIFHFLLPFLTSTTKEPEMKFN

SEQ ID NO: 2518956 - protein, 19 aa, Entamoeba dispar
AINIINKMLTWQPSEEEKK

SEQ ID NO: 2518957 - protein, 22 aa, Entamoeba dispar
AINKYPYGLRYLCKVINENSME

SEQ ID NO: 2518958 - protein, 17 aa, Entamoeba dispar
AINSLKISPWFTSEKDV

SEQ ID NO: 2518959 - protein, 17 aa, Entamoeba dispar
AINSLKVNPWFTSERDI

SEQ ID NO: 2518960 - protein, 17 aa, Entamoeba dispar
AINSLKVNPWFTSERDV

SEQ ID NO: 2518961 - protein, 26 aa, Entamoeba dispar
AIPDSHRPFLLPIVKSKPVRTASGIV

SEQ ID NO: 2518962 - protein, 18 aa, Entamoeba dispar
AIPLPPLLDFPSSPSFHL

SEQ ID NO: 2518963 - protein, 29 aa, Entamoeba dispar
AIPRPLNIPIIPLYWNILRNITYSTSHSF

SEQ ID NO: 2518964 - protein, 17 aa, Entamoeba dispar
AIQFRHPSTNDLHFCLT

SEQ ID NO: 2518965 - protein, 36 aa, Entamoeba dispar
AIQLAFTRFMSTGNVMLPIIPRVVTVSPKYLEISTS

SEQ ID NO: 2518966 - protein, 17 aa, Entamoeba dispar
AIQLRQKKPNYVPLVVE

SEQ ID NO: 2518967 - protein, 21 aa, Entamoeba dispar
AIQMILPHLISLTHFLAQCKN

SEQ ID NO: 2518968 - protein, 23 aa, Entamoeba dispar
AIQQGVIIGLLIINGYSIEINAP

SEQ ID NO: 2518969 - protein, 18 aa, Entamoeba dispar
AIQTFIPPIQLNALSRLS

SEQ ID NO: 2518970 - protein, 25 aa, Entamoeba dispar
AIRPSNVIITKLFLNKDREAYLAKK

SEQ ID NO: 2518971 - protein, 17 aa, Entamoeba dispar
AIRRKPYSVILFDEMKK

SEQ ID NO: 2518972 - protein, 26 aa, Entamoeba dispar
AIRSIAIIIFHRLITPALVSPANYNS

SEQ ID NO: 2518973 - protein, 20 aa, Entamoeba dispar
AISHILLSVSLFKIQIQPAI

SEQ ID NO: 2518974 - protein, 20 aa, Entamoeba dispar
AISLLTKWAEECGVVLRKGS

SEQ ID NO: 2518975 - protein, 27 aa, Entamoeba dispar
AISTSTQVLIYLLGQNLQIIKIIECQN

SEQ ID NO: 2518976 - protein, 42 aa, Entamoeba dispar
AITAKVFLSKGFKTYLFSTLCPTPWTAFAVGYLKTACGVMVT

SEQ ID NO: 2518977 - protein, 17 aa, Entamoeba dispar
AITLLIDKNILIPISKE

SEQ ID NO: 2518978 - protein, 25 aa, Entamoeba dispar
AITMGYPNPFLRKLTRDIWSTNPDF

SEQ ID NO: 2518979 - protein, 24 aa, Entamoeba dispar
AITNNYLIELLNKNGVKVEERKTR

SEQ ID NO: 2518980 - protein, 27 aa, Entamoeba dispar
AITSTLKGLFRRLPIPLIPSNINSKIE

SEQ ID NO: 2518981 - protein, 26 aa, Entamoeba dispar
AIVDPMFTMSLPKRAIADTGLDVLVH

SEQ ID NO: 2518982 - protein, 19 aa, Entamoeba dispar
AIVLWELSTNKTPFSEFKF

SEQ ID NO: 2518983 - protein, 29 aa, Entamoeba dispar
AIVNCDWENTSARDLFALLSVCVPNGGKL

SEQ ID NO: 2518984 - protein, 21 aa, Entamoeba dispar
AIVREIIQKFIYFFDKGNKEE

SEQ ID NO: 2518985 - protein, 18 aa, Entamoeba dispar
AIWSGNYRFVTSLAIKDI

SEQ ID NO: 2518986 - protein, 24 aa, Entamoeba dispar
AIYLKSLQTLQLPDSLYSLKLNNS

SEQ ID NO: 2518987 - protein, 24 aa, Entamoeba dispar
AIYMHPDLLLLDEPSNHLDFHALI

SEQ ID NO: 2518988 - protein, 36 aa, Entamoeba dispar
AIYRNRLKIIPPTEPRIVVFSLWMKDMISLQEINVH

SEQ ID NO: 2518989 - protein, 18 aa, Entamoeba dispar
AIYSLLITKLTTTIPHVL

SEQ ID NO: 2518990 - protein, 31 aa, Entamoeba dispar
AKDLISLKKLWIILGWYYFYENIKESELEKS

SEQ ID NO: 2518991 - protein, 19 aa, Entamoeba dispar
AKDMWRVMFGYGVDVGRVK

SEQ ID NO: 2518992 - protein, 22 aa, Entamoeba dispar
AKDVFVIRQIYSAILNLSKEEM

SEQ ID NO: 2518993 - protein, 29 aa, Entamoeba dispar
AKEDLHSFIPIFDSKRIQLIPTLNGCLLL

SEQ ID NO: 2518994 - protein, 30 aa, Entamoeba dispar
AKEDNLLLIKKIVILTGIIRQISLQVTKNN

SEQ ID NO: 2518995 - protein, 23 aa, Entamoeba dispar
AKEFQYYELPWKQINEFISCSYT

SEQ ID NO: 2518996 - protein, 22 aa, Entamoeba dispar
AKEFTRFFSYSKKKPNFNVIYS

SEQ ID NO: 2518997 - protein, 31 aa, Entamoeba dispar
AKEGDYQFGKTKIFFRVGILAEIEEVREAKI

SEQ ID NO: 2518998 - protein, 22 aa, Entamoeba dispar
AKEIPKIFGICKDYVLLADEDG

SEQ ID NO: 2518999 - protein, 24 aa, Entamoeba dispar
AKEMNWKGLRDIETLRFVRITLEE

SEQ ID NO: 2519000 - protein, 18 aa, Entamoeba dispar
AKERSIYAHQLSLAPRGS

SEQ ID NO: 2519001 - protein, 24 aa, Entamoeba dispar
AKETLTCLTLEWIDELTDRKGEFM

SEQ ID NO: 2519002 - protein, 28 aa, Entamoeba dispar
AKEYSPMAFAIVRRFFGLTPESMIESIC

SEQ ID NO: 2519003 - protein, 19 aa, Entamoeba dispar
AKFIYLSNGSFMQKSGKTE

SEQ ID NO: 2519004 - protein, 26 aa, Entamoeba dispar
AKFSTGKYFYPTFYGYNPKTKTELFG

SEQ ID NO: 2519005 - protein, 21 aa, Entamoeba dispar
AKGIILREKLIKEPTIEMCDE

SEQ ID NO: 2519006 - protein, 23 aa, Entamoeba dispar
AKGIVFYGFKEAPIHFIPTFKII

SEQ ID NO: 2519007 - protein, 20 aa, Entamoeba dispar
AKHFPGIPTPLKKCEIDILV

SEQ ID NO: 2519008 - protein, 35 aa, Entamoeba dispar
AKHHKINPPLIKSPLLFVTLRKWIINVPTEYVDSK

SEQ ID NO: 2519009 - protein, 20 aa, Entamoeba dispar
AKHIYVFKYYQNCFTRIDKN

SEQ ID NO: 2519010 - protein, 18 aa, Entamoeba dispar
AKIAMKYCNGRFGTFSQL

SEQ ID NO: 2519011 - protein, 20 aa, Entamoeba dispar
AKIAWILQRKGLGDFVIYVT

SEQ ID NO: 2519012 - protein, 17 aa, Entamoeba dispar
AKIFLGMSSNIVSSGLR

SEQ ID NO: 2519013 - protein, 22 aa, Entamoeba dispar
AKITRLIFKQFSDLVNPKPDAN

SEQ ID NO: 2519014 - protein, 27 aa, Entamoeba dispar
AKKINFDIQIYVYNIKFGNQKYDIKKQ

SEQ ID NO: 2519015 - protein, 18 aa, Entamoeba dispar
AKKKCICRYFMGASLVCY

SEQ ID NO: 2519016 - protein, 19 aa, Entamoeba dispar
AKKKIVMCTSALSSTKSPL

SEQ ID NO: 2519017 - protein, 20 aa, Entamoeba dispar
AKKYGAVCVIGIGYPLPISK

SEQ ID NO: 2519018 - protein, 29 aa, Entamoeba dispar
AKLEPTNLYWENILYLFSIIPQEQAIHDR

SEQ ID NO: 2519019 - protein, 20 aa, Entamoeba dispar
AKLGEVWRAMSKEEKQPFFD

SEQ ID NO: 2519020 - protein, 18 aa, Entamoeba dispar
AKLIEDLGINDIGSIKAL

SEQ ID NO: 2519021 - protein, 18 aa, Entamoeba dispar
AKLKLLVKHPELVEFHDS

SEQ ID NO: 2519022 - protein, 27 aa, Entamoeba dispar
AKMISQFYITYWMMLNWVCFGGDDLTQ

SEQ ID NO: 2519023 - protein, 25 aa, Entamoeba dispar
AKMVFSSDVLKQKLGERALPGDISC

SEQ ID NO: 2519024 - protein, 25 aa, Entamoeba dispar
AKNELGKWFKIKILTFKDGGNISLD

SEQ ID NO: 2519025 - protein, 25 aa, Entamoeba dispar
AKNQELLVLNRDNGQWLERHGRIER

SEQ ID NO: 2519026 - protein, 27 aa, Entamoeba dispar
AKPNKLPFMPMILNISPDIVTIPQEIQ

SEQ ID NO: 2519027 - protein, 23 aa, Entamoeba dispar
AKQPIKGIVICCYGTTIDIPKEI

SEQ ID NO: 2519028 - protein, 27 aa, Entamoeba dispar
AKQQSLLILKLLKKHPEIPIERMPMVI

SEQ ID NO: 2519029 - protein, 24 aa, Entamoeba dispar
AKQVKFLIDYFFAVKEKLDIETLM

SEQ ID NO: 2519030 - protein, 25 aa, Entamoeba dispar
AKRIKQLRRDGVPKKAIEAMLRKEA

SEQ ID NO: 2519031 - protein, 17 aa, Entamoeba dispar
AKRILLLAFAEGKAKII

SEQ ID NO: 2519032 - protein, 17 aa, Entamoeba dispar
AKRRNMERLTLACGGVA

SEQ ID NO: 2519033 - protein, 26 aa, Entamoeba dispar
AKRSKYILNIPLNSSPILLRVNYKGC

SEQ ID NO: 2519034 - protein, 30 aa, Entamoeba dispar
AKRWGVPVLNHQWLFDCIIERRFVSINNYI

SEQ ID NO: 2519035 - protein, 24 aa, Entamoeba dispar
AKSIRNMMLIRLRRIYDEACNSSE

SEQ ID NO: 2519036 - protein, 30 aa, Entamoeba dispar
AKSNYNFERPFLWIARKLTGNPNLVFVADP

SEQ ID NO: 2519037 - protein, 28 aa, Entamoeba dispar
AKSSKLLAQWIVLCPSSVIPVFSEAATQ

SEQ ID NO: 2519038 - protein, 22 aa, Entamoeba dispar
AKTIFSIMTFPPQMYHIFNEFD

SEQ ID NO: 2519039 - protein, 23 aa, Entamoeba dispar
AKTKTFLYSPEPSFWVSYTVSSD

SEQ ID NO: 2519040 - protein, 26 aa, Entamoeba dispar
AKTLPTTLPLIFRGIDSRFFQQFLFS

SEQ ID NO: 2519041 - protein, 20 aa, Entamoeba dispar
AKTWLKQSWSHNISSSFLAM

SEQ ID NO: 2519042 - protein, 20 aa, Entamoeba dispar
AKVIERYYHLNSLIGCIVQP

SEQ ID NO: 2519043 - protein, 20 aa, Entamoeba dispar
AKVLFFTPNDELKEVNCAII

SEQ ID NO: 2519044 - protein, 22 aa, Entamoeba dispar
AKVYFDWSYFNNDDTLIITTTK

SEQ ID NO: 2519045 - protein, 25 aa, Entamoeba dispar
ALAQKYIIQIWSEAVGWIVHSHQYN

SEQ ID NO: 2519046 - protein, 19 aa, Entamoeba dispar
ALCCVLNYALMLRDRHGDN

SEQ ID NO: 2519047 - protein, 27 aa, Entamoeba dispar
ALCDFNFNVWPPINPQTFVPEPLIVPF

SEQ ID NO: 2519048 - protein, 25 aa, Entamoeba dispar
ALCKNEFIVPLFDSAVYSEPEKKVV

SEQ ID NO: 2519049 - protein, 27 aa, Entamoeba dispar
ALCLEEMLLQAVLFNDIRLLEAVNDDN

SEQ ID NO: 2519050 - protein, 17 aa, Entamoeba dispar
ALCLKTMHSVEKKNVLI

SEQ ID NO: 2519051 - protein, 19 aa, Entamoeba dispar
ALCVLRRVLESNTVIVGGG

SEQ ID NO: 2519052 - protein, 26 aa, Entamoeba dispar
ALDDSYLYFINLLTNDLEIARIFGEC

SEQ ID NO: 2519053 - protein, 24 aa, Entamoeba dispar
ALDETHFFYHTKLDWVEAGLQVIR

SEQ ID NO: 2519054 - protein, 23 aa, Entamoeba dispar
ALDHPFITQAPFTKNWQPKPRKV

SEQ ID NO: 2519055 - protein, 28 aa, Entamoeba dispar
ALDTIIKPFQFLHCHILRGYLQITLKVE

SEQ ID NO: 2519056 - protein, 23 aa, Entamoeba dispar
ALDYFEKCINYLEQKRIAKGLSR

SEQ ID NO: 2519057 - protein, 22 aa, Entamoeba dispar
ALELLDFRFPDEQVRLFALKCL

SEQ ID NO: 2519058 - protein, 27 aa, Entamoeba dispar
ALERHRPSLLFSTPRVFEKLNKIVKQK

SEQ ID NO: 2519059 - protein, 29 aa, Entamoeba dispar
ALESVKPIIIFWGLRICGLMLYSTAEENT

SEQ ID NO: 2519060 - protein, 24 aa, Entamoeba dispar
ALETIHRYVVILDKYFGSVSEIDI

SEQ ID NO: 2519061 - protein, 17 aa, Entamoeba dispar
ALEVKIFGLEYLSEFSS

SEQ ID NO: 2519062 - protein, 18 aa, Entamoeba dispar
ALFNLAIIPSIRTLINTP

SEQ ID NO: 2519063 - protein, 28 aa, Entamoeba dispar
ALGIYGIVKIHIPKTQNATLRKSLCSKT

SEQ ID NO: 2519064 - protein, 23 aa, Entamoeba dispar
ALHCMIHLWDTIAADIVYLLPET

SEQ ID NO: 2519065 - protein, 27 aa, Entamoeba dispar
ALHDYDYRLLMLESEVIIIQQPPSTKR

SEQ ID NO: 2519066 - protein, 28 aa, Entamoeba dispar
ALHDYDYRLLMLESEVIIIQQPPSTKRK

SEQ ID NO: 2519067 - protein, 27 aa, Entamoeba dispar
ALHDYDYRLLMLESEVIIVQQPPSTKR

SEQ ID NO: 2519068 - protein, 26 aa, Entamoeba dispar
ALHDYNYRLLMLESEVIIIQQPPSTK

SEQ ID NO: 2519069 - protein, 26 aa, Entamoeba dispar
ALHDYNYRLLMLESEVIIVQQPPSTK

SEQ ID NO: 2519070 - protein, 25 aa, Entamoeba dispar
ALIDCNYDKNACAELLFMAQENGSN

SEQ ID NO: 2519071 - protein, 18 aa, Entamoeba dispar
ALIDQRYFCVHGGLSPSL

SEQ ID NO: 2519072 - protein, 20 aa, Entamoeba dispar
ALIEGKWVVSKNWIINGMKK

SEQ ID NO: 2519073 - protein, 28 aa, Entamoeba dispar
ALIIRYSIQFNLLLSYLKPFVDDRAVVN

SEQ ID NO: 2519074 - protein, 22 aa, Entamoeba dispar
ALIIVLQGVIRLYLNDRLHISE

SEQ ID NO: 2519075 - protein, 21 aa, Entamoeba dispar
ALILEEFPLLDDLHPFYGDLL

SEQ ID NO: 2519076 - protein, 18 aa, Entamoeba dispar
ALIPRVDILYEFYEFSNQ

SEQ ID NO: 2519077 - protein, 23 aa, Entamoeba dispar
ALIQKMVDFFWNVGAPEVEIDRL

SEQ ID NO: 2519078 - protein, 26 aa, Entamoeba dispar
ALIRFKNRLHEWPTYCYLLKEIKSIE

SEQ ID NO: 2519079 - protein, 29 aa, Entamoeba dispar
ALIVTGPFKINGVPLMRINQRYVIATSQK

SEQ ID NO: 2519080 - protein, 18 aa, Entamoeba dispar
ALKELYLHKVSDKVLNSA

SEQ ID NO: 2519081 - protein, 37 aa, Entamoeba dispar
ALKIIHVKIIIKPGCQKIFHFSFFDVVLEVEPLPSWS

SEQ ID NO: 2519082 - protein, 19 aa, Entamoeba dispar
ALKILSKYIKESDILDMIG

SEQ ID NO: 2519083 - protein, 17 aa, Entamoeba dispar
ALKLYIKLLPEQVIPKF

SEQ ID NO: 2519084 - protein, 17 aa, Entamoeba dispar
ALKNRGDMGQLFYWLLV

SEQ ID NO: 2519085 - protein, 19 aa, Entamoeba dispar
ALKQIFPYSKLFFCRNHIE

SEQ ID NO: 2519086 - protein, 33 aa, Entamoeba dispar
ALKTNKPLHFTSRYLYLTLWGDEIKNNIQFKEV

SEQ ID NO: 2519087 - protein, 26 aa, Entamoeba dispar
ALKVLRNRPAYFRQGMLEIAVLQLLN

SEQ ID NO: 2519088 - protein, 27 aa, Entamoeba dispar
ALKVLRNRPAYFRQGMLEIAVLQLLNE

SEQ ID NO: 2519089 - protein, 23 aa, Entamoeba dispar
ALKWVVDLIIHSRSLLRVNKHQY

SEQ ID NO: 2519090 - protein, 20 aa, Entamoeba dispar
ALLCFRIISNKNYILKFDNC

SEQ ID NO: 2519091 - protein, 17 aa, Entamoeba dispar
ALLCKRTGKSCNIISVP

SEQ ID NO: 2519092 - protein, 24 aa, Entamoeba dispar
ALLNRLDVLDKEKLAWWLCERQTA

SEQ ID NO: 2519093 - protein, 17 aa, Entamoeba dispar
ALLSKVLQTLIIGNGYQ

SEQ ID NO: 2519094 - protein, 22 aa, Entamoeba dispar
ALLYSSPNIYLATKLELFVYSI

SEQ ID NO: 2519095 - protein, 19 aa, Entamoeba dispar
ALLYYSSQPYISHYKRLFK

SEQ ID NO: 2519096 - protein, 19 aa, Entamoeba dispar
ALMNGRWFDKHQLSCDYYD

SEQ ID NO: 2519097 - protein, 24 aa, Entamoeba dispar
ALNAYIFIGPVYYQKLKHMVLDKM

SEQ ID NO: 2519098 - protein, 21 aa, Entamoeba dispar
ALNDPLLFRLIEKIGRYSIKP

SEQ ID NO: 2519099 - protein, 24 aa, Entamoeba dispar
ALNLITELIIIKQDLHIYAMSKES

SEQ ID NO: 2519100 - protein, 26 aa, Entamoeba dispar
ALNPFSTLLHKWYGIDFDDYEILFPK

SEQ ID NO: 2519101 - protein, 18 aa, Entamoeba dispar
ALNQQLVADIDWINANIK

SEQ ID NO: 2519102 - protein, 22 aa, Entamoeba dispar
ALNSELIEPLPRFAIGIAQTRG

SEQ ID NO: 2519103 - protein, 26 aa, Entamoeba dispar
ALNSVPLNWVNPIYTTTGVIQIKYQQ

SEQ ID NO: 2519104 - protein, 17 aa, Entamoeba dispar
ALNYELVKKLQISCPYG

SEQ ID NO: 2519105 - protein, 17 aa, Entamoeba dispar
ALQKKIETAGLVAKNAA

SEQ ID NO: 2519106 - protein, 28 aa, Entamoeba dispar
ALQNRKYLAWTGAALLAGMSTLLDEEKC

SEQ ID NO: 2519107 - protein, 20 aa, Entamoeba dispar
ALQSKTLLPYPNPLTPLVRL

SEQ ID NO: 2519108 - protein, 17 aa, Entamoeba dispar
ALRALMYVDLSAAVHYV

SEQ ID NO: 2519109 - protein, 24 aa, Entamoeba dispar
ALRDPSLWRCIDAPHYRTGTQFKC

SEQ ID NO: 2519110 - protein, 30 aa, Entamoeba dispar
ALRNKNIIGHQFFWFLKAEMHDNRVTERYG

SEQ ID NO: 2519111 - protein, 22 aa, Entamoeba dispar
ALRRFGRFDREIDLGIPDTEGR

SEQ ID NO: 2519112 - protein, 22 aa, Entamoeba dispar
ALSDLIPYIMKIATKKLCLEEK

SEQ ID NO: 2519113 - protein, 24 aa, Entamoeba dispar
ALSKKGITVAYEFKRFIGKSFDDK

SEQ ID NO: 2519114 - protein, 22 aa, Entamoeba dispar
ALSKPAFLSSPMFAGKQSSPYN

SEQ ID NO: 2519115 - protein, 29 aa, Entamoeba dispar
ALSRLINHLLQLPKVVPFDFIVGGEFLRT

SEQ ID NO: 2519116 - protein, 20 aa, Entamoeba dispar
ALSTKPVLPPNWKQTPKGNN

SEQ ID NO: 2519117 - protein, 24 aa, Entamoeba dispar
ALTDVNPLVLKDKTDKLLLKDKQT

SEQ ID NO: 2519118 - protein, 18 aa, Entamoeba dispar
ALTFLLDGNNRFVEGKTI

SEQ ID NO: 2519119 - protein, 18 aa, Entamoeba dispar
ALTFNWLVEYAEQNGYTI

SEQ ID NO: 2519120 - protein, 28 aa, Entamoeba dispar
ALTFNYLIKILESLGYFVSTRPTKSSKK

SEQ ID NO: 2519121 - protein, 32 aa, Entamoeba dispar
ALTHNKALHFTSRFMYLTLWGDEISNQTQFKE

SEQ ID NO: 2519122 - protein, 32 aa, Entamoeba dispar
ALTLDPIDLLPYFLPLLNSLITSNPIFVKTVL

SEQ ID NO: 2519123 - protein, 23 aa, Entamoeba dispar
ALTLKFMGMLLNNDKTLPDYTIG

SEQ ID NO: 2519124 - protein, 33 aa, Entamoeba dispar
ALTNKRIFIMDYFHLHFIDEIELRYIKDVSTGI

SEQ ID NO: 2519125 - protein, 33 aa, Entamoeba dispar
ALTNSFLDILISDFHFEMKYSRTKGATKTVKMI

SEQ ID NO: 2519126 - protein, 19 aa, Entamoeba dispar
ALVKIRVATLEAIDLRKNV

SEQ ID NO: 2519127 - protein, 24 aa, Entamoeba dispar
ALVNTFIHPLLLGLSDGSIYVFLF

SEQ ID NO: 2519128 - protein, 26 aa, Entamoeba dispar
ALVRKECFLFIFYSVQQHYIPLLDHL

SEQ ID NO: 2519129 - protein, 19 aa, Entamoeba dispar
ALWLKWDKTPETRKEIEDL

SEQ ID NO: 2519130 - protein, 23 aa, Entamoeba dispar
ALYFGMPYSLWRTGVIFKKQICN

SEQ ID NO: 2519131 - protein, 20 aa, Entamoeba dispar
ALYNAFLKTDQEVLKRSEAE

SEQ ID NO: 2519132 - protein, 26 aa, Entamoeba dispar
AMAISQHIPYIIPPLNIIQNFLNSQM

SEQ ID NO: 2519133 - protein, 20 aa, Entamoeba dispar
AMAPVPYIIEGQSLGEFVLQ

SEQ ID NO: 2519134 - protein, 23 aa, Entamoeba dispar
AMETGNWRYIFITENISAMMKPL

SEQ ID NO: 2519135 - protein, 24 aa, Entamoeba dispar
AMETGNWRYIFITENISAMMKPLR

SEQ ID NO: 2519136 - protein, 29 aa, Entamoeba dispar
AMISINTLFFLRYLFIPFKETPSLFKIIQ

SEQ ID NO: 2519137 - protein, 17 aa, Entamoeba dispar
AMKRRGEFMYGSRLRNS

SEQ ID NO: 2519138 - protein, 18 aa, Entamoeba dispar
AMLAGLYIHLFKEDELDS

SEQ ID NO: 2519139 - protein, 20 aa, Entamoeba dispar
AMLNIKEFLNPPLILQRCMT

SEQ ID NO: 2519140 - protein, 26 aa, Entamoeba dispar
AMLQGLSYFLMALPDSLIPSSRFYDV

SEQ ID NO: 2519141 - protein, 20 aa, Entamoeba dispar
AMLTGRYVCYVNPTLPTYRF

SEQ ID NO: 2519142 - protein, 25 aa, Entamoeba dispar
AMNEGRTPPIVILPDEIDRNRNQRR

SEQ ID NO: 2519143 - protein, 17 aa, Entamoeba dispar
AMPIVETMLKHQMISNI

SEQ ID NO: 2519144 - protein, 18 aa, Entamoeba dispar
AMPLYNLRKNPPSRKPVT

SEQ ID NO: 2519145 - protein, 26 aa, Entamoeba dispar
AMQFNIKMQFIGFRQQSLDDIYDDDG

SEQ ID NO: 2519146 - protein, 26 aa, Entamoeba dispar
AMQKYIMKIYLKIPHDKAWIIRREFV

SEQ ID NO: 2519147 - protein, 27 aa, Entamoeba dispar
AMQKYIMKIYLKIPHDKAWIIRREFVR

SEQ ID NO: 2519148 - protein, 29 aa, Entamoeba dispar
AMQNKNISLFILTEQVCVATFSKQKSKID

SEQ ID NO: 2519149 - protein, 18 aa, Entamoeba dispar
AMRAGAKRRFDAKFGAIA

SEQ ID NO: 2519150 - protein, 19 aa, Entamoeba dispar
AMRDIKQLEYDKVELNGEI

SEQ ID NO: 2519151 - protein, 26 aa, Entamoeba dispar
AMTNVSSLMFLFPRTSNEVTCSRNPL

SEQ ID NO: 2519152 - protein, 21 aa, Entamoeba dispar
AMTQRLMLEKLTPTDSLQATI

SEQ ID NO: 2519153 - protein, 27 aa, Entamoeba dispar
AMVKAKPHLLFFYELIGSCFSLPLSHS

SEQ ID NO: 2519154 - protein, 26 aa, Entamoeba dispar
ANAFSNLLYNLWKPSNKPVIVSIKEF

SEQ ID NO: 2519155 - protein, 25 aa, Entamoeba dispar
ANDLKSIFYPFAQPCLEVVLKLVQD

SEQ ID NO: 2519156 - protein, 23 aa, Entamoeba dispar
ANEIIVIGLWDGSILIFDINGVL

SEQ ID NO: 2519157 - protein, 24 aa, Entamoeba dispar
ANETGVFLILINGPEIMSKMAGES

SEQ ID NO: 2519158 - protein, 21 aa, Entamoeba dispar
ANEYFISGVKYLKFVDQSIME

SEQ ID NO: 2519159 - protein, 22 aa, Entamoeba dispar
ANEYFISGVKYLKFVDQSIMEL

SEQ ID NO: 2519160 - protein, 18 aa, Entamoeba dispar
ANFTVIRGQTGWIVIDCM

SEQ ID NO: 2519161 - protein, 27 aa, Entamoeba dispar
ANGEIQQFLSLIFFIGQKSGTRIQKRR

SEQ ID NO: 2519162 - protein, 23 aa, Entamoeba dispar
ANGKTFLYYACEKSYRGLVEMLI

SEQ ID NO: 2519163 - protein, 24 aa, Entamoeba dispar
ANGLNPDPYYWYTQQRKYGSCPHG

SEQ ID NO: 2519164 - protein, 18 aa, Entamoeba dispar
ANHFGVGIAFIRKSRSFE

SEQ ID NO: 2519165 - protein, 27 aa, Entamoeba dispar
ANHFSEHLLLKEVILPTTITSIGNSCF

SEQ ID NO: 2519166 - protein, 18 aa, Entamoeba dispar
ANHLGAGRIFAVGSRKHC

SEQ ID NO: 2519167 - protein, 18 aa, Entamoeba dispar
ANIFIHNMNVKIGDFGLA

SEQ ID NO: 2519168 - protein, 18 aa, Entamoeba dispar
ANIILYIDSIETCYKFSM

SEQ ID NO: 2519169 - protein, 18 aa, Entamoeba dispar
ANILSCYSSCCGDSIRSV

SEQ ID NO: 2519170 - protein, 17 aa, Entamoeba dispar
ANILYQYRNYNLSVGSM

SEQ ID NO: 2519171 - protein, 19 aa, Entamoeba dispar
ANKAALNKALCLSKGAHPE

SEQ ID NO: 2519172 - protein, 30 aa, Entamoeba dispar
ANKAKILHYILLLFFPTALNFCEQMSVGLG

SEQ ID NO: 2519173 - protein, 26 aa, Entamoeba dispar
ANKESPYYRPLLPEAAFDPIFQKEIQ

SEQ ID NO: 2519174 - protein, 17 aa, Entamoeba dispar
ANKITLFKTGCSHIFIN

SEQ ID NO: 2519175 - protein, 23 aa, Entamoeba dispar
ANLADIVLILKAIGINNVIDFDY

SEQ ID NO: 2519176 - protein, 27 aa, Entamoeba dispar
ANLEEKLIIDWFSRFGIEVGDFKTSFN

SEQ ID NO: 2519177 - protein, 18 aa, Entamoeba dispar
ANLLLQSTLGPLPRVKIA

SEQ ID NO: 2519178 - protein, 28 aa, Entamoeba dispar
ANNEFVTISLFKILSSMIIKLNRQMMEN

SEQ ID NO: 2519179 - protein, 29 aa, Entamoeba dispar
ANNEFVTISLFKILSSMIIKLNRQMMENE

SEQ ID NO: 2519180 - protein, 28 aa, Entamoeba dispar
ANNQLLGCFVPHHLCIDNAIHTFAGPQL

SEQ ID NO: 2519181 - protein, 17 aa, Entamoeba dispar
ANQIRSIRGIVLENGTM

SEQ ID NO: 2519182 - protein, 26 aa, Entamoeba dispar
ANQNKKYLTQLLKEFGDDVNELRMKA

SEQ ID NO: 2519183 - protein, 31 aa, Entamoeba dispar
ANQRYDMLDPIILLYMKLVVNLTGEKAVSFK

SEQ ID NO: 2519184 - protein, 28 aa, Entamoeba dispar
ANRDWVNMRSWWFNEDKSLYIIMNHSVE

SEQ ID NO: 2519185 - protein, 17 aa, Entamoeba dispar
ANRISMFIANPSPMMAH

SEQ ID NO: 2519186 - protein, 23 aa, Entamoeba dispar
ANRNYQIVLLLSSLISVNENYPS

SEQ ID NO: 2519187 - protein, 25 aa, Entamoeba dispar
ANRWTDGIFMIQKYAKDKVSVPIEE

SEQ ID NO: 2519188 - protein, 29 aa, Entamoeba dispar
ANSKFAIVLTLIQKLYPRVYPQIMLDSKS

SEQ ID NO: 2519189 - protein, 30 aa, Entamoeba dispar
ANSWRWCTEVFDYLNIAALIDGKIFCVHGG

SEQ ID NO: 2519190 - protein, 30 aa, Entamoeba dispar
ANSYRWCMEVFDYLNIAALIDGKIFCVHGG

SEQ ID NO: 2519191 - protein, 18 aa, Entamoeba dispar
ANTKYACFLIAYFKIEKE

SEQ ID NO: 2519192 - protein, 23 aa, Entamoeba dispar
ANTPRNMLYFLTNKKITDEDVKL

SEQ ID NO: 2519193 - protein, 17 aa, Entamoeba dispar
ANVEIILQKPLCVDTRV

SEQ ID NO: 2519194 - protein, 25 aa, Entamoeba dispar
ANVKVEGFWPIVMAKALANADIEDL

SEQ ID NO: 2519195 - protein, 20 aa, Entamoeba dispar
ANVVIPLHLQFDKNGVCNIS

SEQ ID NO: 2519196 - protein, 24 aa, Entamoeba dispar
ANVYGYFTMFKVDSGFCYLSCPDC

SEQ ID NO: 2519197 - protein, 23 aa, Entamoeba dispar
ANYRIKLYYEYLKNHKFNRVIHC

SEQ ID NO: 2519198 - protein, 17 aa, Entamoeba dispar
ANYVIQKALEFIPESRH

SEQ ID NO: 2519199 - protein, 30 aa, Entamoeba dispar
APAIALEVFIRFFPIIPLKNTKTQRDWINN

SEQ ID NO: 2519200 - protein, 20 aa, Entamoeba dispar
APCYTSLLKEYYLNCYVPSI

SEQ ID NO: 2519201 - protein, 18 aa, Entamoeba dispar
APDIYLKASKKLGVDIFH

SEQ ID NO: 2519202 - protein, 19 aa, Entamoeba dispar
APDNTRYIRVCTIAIPVVS

SEQ ID NO: 2519203 - protein, 22 aa, Entamoeba dispar
APEEFFKPLASFIESWKNARKD

SEQ ID NO: 2519204 - protein, 27 aa, Entamoeba dispar
APEGYCGALYAAIQILGEDKKEACISK

SEQ ID NO: 2519205 - protein, 17 aa, Entamoeba dispar
APEPIKLMIDPTRYVII

SEQ ID NO: 2519206 - protein, 26 aa, Entamoeba dispar
APGSYSYPFVMQLPKGIPSSCFFNDR

SEQ ID NO: 2519207 - protein, 27 aa, Entamoeba dispar
APIKYNVLIFNLFYKQIPPYISTEHDQ

SEQ ID NO: 2519208 - protein, 31 aa, Entamoeba dispar
APKAFMPTLTKIFKRLFRVYAHMFYSHANHL

SEQ ID NO: 2519209 - protein, 19 aa, Entamoeba dispar
APKAVAPPPPKPKLPQVKA

SEQ ID NO: 2519210 - protein, 25 aa, Entamoeba dispar
APKSYDLIVEVLETLPLIEDNSSRS

SEQ ID NO: 2519211 - protein, 36 aa, Entamoeba dispar
APLGPEFYYNLYLFPYLVFIGFTHCHLPISGVSAQT

SEQ ID NO: 2519212 - protein, 20 aa, Entamoeba dispar
APLNFFPSPDFITAKYLVGW

SEQ ID NO: 2519213 - protein, 33 aa, Entamoeba dispar
APMDAFLCARGMKTLPMRMKIHMENGLKVAKFL

SEQ ID NO: 2519214 - protein, 24 aa, Entamoeba dispar
APNENFLCFLNSLKTVIMTEINTL

SEQ ID NO: 2519215 - protein, 19 aa, Entamoeba dispar
APNLIPGDVIFVVQTKEHR

SEQ ID NO: 2519216 - protein, 23 aa, Entamoeba dispar
APNVSFTDLIFAQSNNLKPTEIE

SEQ ID NO: 2519217 - protein, 31 aa, Entamoeba dispar
APPKLRYNTSLNNAILPFGSPRNTVISYTSP

SEQ ID NO: 2519218 - protein, 20 aa, Entamoeba dispar
APPKVKLKLSNMAKLYPEEI

SEQ ID NO: 2519219 - protein, 19 aa, Entamoeba dispar
APQGKCYCLFEYQNPEYKE

SEQ ID NO: 2519220 - protein, 17 aa, Entamoeba dispar
APQLPKAYGFHVCVTKW

SEQ ID NO: 2519221 - protein, 29 aa, Entamoeba dispar
APRSKYKPKPIYYRKYKRIVKQVKPVQHD

SEQ ID NO: 2519222 - protein, 18 aa, Entamoeba dispar
APSIYGYSDIKKAILLML

SEQ ID NO: 2519223 - protein, 30 aa, Entamoeba dispar
APSLIVTNLLPMPFSLKTPTSVFPVQSLSS

SEQ ID NO: 2519224 - protein, 22 aa, Entamoeba dispar
APTLIMGIQDPMAEYIKVVICK

SEQ ID NO: 2519225 - protein, 39 aa, Entamoeba dispar
APTQQMFDMSLFPQSFIQFLAWQRLMQIYSKLDASNIEM

SEQ ID NO: 2519226 - protein, 19 aa, Entamoeba dispar
APVDLFGIVKEQIEIAKTS

SEQ ID NO: 2519227 - protein, 20 aa, Entamoeba dispar
APYCLPLIPKTVEWLNSELP

SEQ ID NO: 2519228 - protein, 17 aa, Entamoeba dispar
AQAFIGKNRLASQAFND

SEQ ID NO: 2519229 - protein, 22 aa, Entamoeba dispar
AQDILKLRMSFQDTPLGMINTA

SEQ ID NO: 2519230 - protein, 37 aa, Entamoeba dispar
AQEDEKKILRLFLFGLYKMKALSPPVLRIVKQMYFEP

SEQ ID NO: 2519231 - protein, 26 aa, Entamoeba dispar
AQEHLPIIIVITKIDRLIIDLKLPPE

SEQ ID NO: 2519232 - protein, 26 aa, Entamoeba dispar
AQEIVDIINTSLLRFVHSPEQQVYVL

SEQ ID NO: 2519233 - protein, 26 aa, Entamoeba dispar
AQELERLLMIQKNALNRLQKKKIFNR

SEQ ID NO: 2519234 - protein, 18 aa, Entamoeba dispar
AQFTLVKSKIILGSLNEL

SEQ ID NO: 2519235 - protein, 23 aa, Entamoeba dispar
AQGYQLLLPLTLQCLQMIVPFKQ

SEQ ID NO: 2519236 - protein, 21 aa, Entamoeba dispar
AQHIVYFWQGRDASIMDMGTL

SEQ ID NO: 2519237 - protein, 23 aa, Entamoeba dispar
AQHYLQKAGISALRRARKNDNLR

SEQ ID NO: 2519238 - protein, 20 aa, Entamoeba dispar
AQIFDHKVLVLPASQRDPFC

SEQ ID NO: 2519239 - protein, 20 aa, Entamoeba dispar
AQIIIVIGKLTIPIGKWPAL

SEQ ID NO: 2519240 - protein, 23 aa, Entamoeba dispar
AQINLALCYLWGCGVKKSIDDAK

SEQ ID NO: 2519241 - protein, 24 aa, Entamoeba dispar
AQISSLCRLILSKEYRTTKGFCDL

SEQ ID NO: 2519242 - protein, 25 aa, Entamoeba dispar
AQIVLYGLVYWFRIWDHEYNLKPSK

SEQ ID NO: 2519243 - protein, 20 aa, Entamoeba dispar
AQKFFKKKGITLKMAGERTN

SEQ ID NO: 2519244 - protein, 17 aa, Entamoeba dispar
AQKFLLEIMTNSSLTQL

SEQ ID NO: 2519245 - protein, 23 aa, Entamoeba dispar
AQKQNLVIIIPPNLKSLKVFNCQ

SEQ ID NO: 2519246 - protein, 24 aa, Entamoeba dispar
AQKYLDIPLGLVYQPLHGNISTNN

SEQ ID NO: 2519247 - protein, 20 aa, Entamoeba dispar
AQLAVEFKNDHVVGFDLAGP

SEQ ID NO: 2519248 - protein, 17 aa, Entamoeba dispar
AQLIDKCAIQYLCLERA

SEQ ID NO: 2519249 - protein, 18 aa, Entamoeba dispar
AQLIGQYEQLEAKKQEDL

SEQ ID NO: 2519250 - protein, 25 aa, Entamoeba dispar
AQLNLNINYLVVSKLNLLELYEINS

SEQ ID NO: 2519251 - protein, 34 aa, Entamoeba dispar
AQLSKRKYDKLIAYIYLLLSFFPSNNETTINTSQ

SEQ ID NO: 2519252 - protein, 24 aa, Entamoeba dispar
AQLVHCLRLIGFDYVFDVDAGADK

SEQ ID NO: 2519253 - protein, 23 aa, Entamoeba dispar
AQLYSIYSYFDITLGKGVQLVGI

SEQ ID NO: 2519254 - protein, 23 aa, Entamoeba dispar
AQMASLYYLLSLNINIHPLLNDI

SEQ ID NO: 2519255 - protein, 21 aa, Entamoeba dispar
AQMELIRIALKLYQQNITKDE

SEQ ID NO: 2519256 - protein, 28 aa, Entamoeba dispar
AQNNNHIYLPYFINTSLIAFDRFIISGG

SEQ ID NO: 2519257 - protein, 25 aa, Entamoeba dispar
AQQCLCHEFFISRKLLKICTNTNEL

SEQ ID NO: 2519258 - protein, 26 aa, Entamoeba dispar
AQQDTPFGMLALPAAPGMMPIQQPMG

SEQ ID NO: 2519259 - protein, 20 aa, Entamoeba dispar
AQQLRVMLMLSKKLKQKRID

SEQ ID NO: 2519260 - protein, 32 aa, Entamoeba dispar
AQYHRGSIIRIKMERFLTYDSVEVFPGKGLNV

SEQ ID NO: 2519261 - protein, 26 aa, Entamoeba dispar
AQYKKVLNQWLSKGGYFIITSCNWTE

SEQ ID NO: 2519262 - protein, 20 aa, Entamoeba dispar
ARAELRYYDTLFTDPKPESP

SEQ ID NO: 2519263 - protein, 23 aa, Entamoeba dispar
ARAKMIKWNLGKLPNQLTDNDFK

SEQ ID NO: 2519264 - protein, 20 aa, Entamoeba dispar
ARAVLIIGAPYLQSEILTIK

SEQ ID NO: 2519265 - protein, 22 aa, Entamoeba dispar
ARAYFISNGILDVFSIPIQISL

SEQ ID NO: 2519266 - protein, 17 aa, Entamoeba dispar
ARDIYLEFCSIKGISYV

SEQ ID NO: 2519267 - protein, 27 aa, Entamoeba dispar
AREDRNYHIFYQLLAGATAQQKSEMHL

SEQ ID NO: 2519268 - protein, 23 aa, Entamoeba dispar
AREYANATLLRNLAKGAVEYSKE

SEQ ID NO: 2519269 - protein, 23 aa, Entamoeba dispar
AREYWENIVYPYIKYPSKEDVVL

SEQ ID NO: 2519270 - protein, 26 aa, Entamoeba dispar
ARFFSRQRELVISKPNALFVDAKQKI

SEQ ID NO: 2519271 - protein, 17 aa, Entamoeba dispar
ARFLQTYKKLSPKTWGT

SEQ ID NO: 2519272 - protein, 17 aa, Entamoeba dispar
ARHCKRVTILEKDMLLA

SEQ ID NO: 2519273 - protein, 20 aa, Entamoeba dispar
ARIHGVLLEKMVGFKYECII

SEQ ID NO: 2519274 - protein, 18 aa, Entamoeba dispar
ARKIWCFGPDNCGPNLFV

SEQ ID NO: 2519275 - protein, 21 aa, Entamoeba dispar
ARKIWCFGPDNCGPNLFVDVT

SEQ ID NO: 2519276 - protein, 35 aa, Entamoeba dispar
ARKMFLTSCKLSDYKYIRALRSAVFVLGLSKESKT

SEQ ID NO: 2519277 - protein, 29 aa, Entamoeba dispar
ARKMTMRTLHFFVWKKYILPNGKIITSEM

SEQ ID NO: 2519278 - protein, 17 aa, Entamoeba dispar
ARLFLPSGVPRVMNKPI

SEQ ID NO: 2519279 - protein, 18 aa, Entamoeba dispar
ARLWGISFIETSAKKKSN

SEQ ID NO: 2519280 - protein, 17 aa, Entamoeba dispar
ARMYGLLTIIIPTMIKR

SEQ ID NO: 2519281 - protein, 27 aa, Entamoeba dispar
ARNEQQWLFPKILHEIFDQCEKDAPEQ

SEQ ID NO: 2519282 - protein, 23 aa, Entamoeba dispar
ARPLFNHKDGTQQKFWYSCVNSY

SEQ ID NO: 2519283 - protein, 25 aa, Entamoeba dispar
ARQMTLIIHTAFSKIKLYEFFKWTN

SEQ ID NO: 2519284 - protein, 25 aa, Entamoeba dispar
ARQTVQFLSYLHSRGIIHCDIKPEN

SEQ ID NO: 2519285 - protein, 26 aa, Entamoeba dispar
ARTLSLFIKFLLFQNSLNEPYHGGLG

SEQ ID NO: 2519286 - protein, 25 aa, Entamoeba dispar
ARTQDYELAILLLKLGASKTKQNKN

SEQ ID NO: 2519287 - protein, 27 aa, Entamoeba dispar
ARVDGKSWHPHCFICSICNKPIEGDFI

SEQ ID NO: 2519288 - protein, 26 aa, Entamoeba dispar
ARVIRGANILFIGKYLRIEKDGEILN

SEQ ID NO: 2519289 - protein, 17 aa, Entamoeba dispar
ARVVIIVGIPYPSLGDI

SEQ ID NO: 2519290 - protein, 18 aa, Entamoeba dispar
ARWNPNCYGFIASVAEEY

SEQ ID NO: 2519291 - protein, 17 aa, Entamoeba dispar
ARWYYHCDTIGIIVWQD

SEQ ID NO: 2519292 - protein, 22 aa, Entamoeba dispar
ARYLVDVAIKRKTLDNVTVSIC

SEQ ID NO: 2519293 - protein, 19 aa, Entamoeba dispar
ASASLFPHEARLRSLTYAC

SEQ ID NO: 2519294 - protein, 31 aa, Entamoeba dispar
ASDDGTLYMWMPLQSQKPIHRLVGHSSQVMS

SEQ ID NO: 2519295 - protein, 33 aa, Entamoeba dispar
ASDDGTLYMWMPLQSQKPIHRLVGHSSQVMSCK

SEQ ID NO: 2519296 - protein, 35 aa, Entamoeba dispar
ASDIWSCGVMLYNMLFLFPFKKPKNMYELQLTDDT

SEQ ID NO: 2519297 - protein, 24 aa, Entamoeba dispar
ASDSARNILPYVSIFLVDDHKDVR

SEQ ID NO: 2519298 - protein, 25 aa, Entamoeba dispar
ASDVIMIMFKLFGQSMSDYFVQIFQ

SEQ ID NO: 2519299 - protein, 19 aa, Entamoeba dispar
ASEFISIFENVLSVQVLSM

SEQ ID NO: 2519300 - protein, 42 aa, Entamoeba dispar
ASERLRGIVPKKIIIEPITNKELYPKLWEKALNQAREEIMII

SEQ ID NO: 2519301 - protein, 25 aa, Entamoeba dispar
ASFAPYCLPLIPKTVEWLNSELPPN

SEQ ID NO: 2519302 - protein, 20 aa, Entamoeba dispar
ASFLCKVHYSYFSGSKDASL

SEQ ID NO: 2519303 - protein, 18 aa, Entamoeba dispar
ASFLLPMIQHLLNVKEKN

SEQ ID NO: 2519304 - protein, 22 aa, Entamoeba dispar
ASFVTTYLPIDGNNVKIVIWDT

SEQ ID NO: 2519305 - protein, 34 aa, Entamoeba dispar
ASGKYTPYCQYMFYDCLEILPDKYLELPKEEFID

SEQ ID NO: 2519306 - protein, 24 aa, Entamoeba dispar
ASGTRPCLYVPQSAFENLISKQVR

SEQ ID NO: 2519307 - protein, 24 aa, Entamoeba dispar
ASGYPPQPSLYRPSQQYLPSQYTS

SEQ ID NO: 2519308 - protein, 20 aa, Entamoeba dispar
ASHGKVVFLFIKLGEKEISS

SEQ ID NO: 2519309 - protein, 26 aa, Entamoeba dispar
ASIAPVKVGLFPLLTKPEFNNKVAEI

SEQ ID NO: 2519310 - protein, 22 aa, Entamoeba dispar
ASIFGVPRFYFISKEAIQLSYD

SEQ ID NO: 2519311 - protein, 31 aa, Entamoeba dispar
ASIPNSHYNLFIYLLSFIKEILRQNPSLHPE

SEQ ID NO: 2519312 - protein, 28 aa, Entamoeba dispar
ASIRQISPFVFTKTNFPVLKKLDLQHNC

SEQ ID NO: 2519313 - protein, 18 aa, Entamoeba dispar
ASKGTWAATTDSGITAPC

SEQ ID NO: 2519314 - protein, 26 aa, Entamoeba dispar
ASKNYKDHVWFKGKYKPFKTREDERD

SEQ ID NO: 2519315 - protein, 28 aa, Entamoeba dispar
ASKPCILPMIFRLFLRKDYTYEVFGLIC

SEQ ID NO: 2519316 - protein, 17 aa, Entamoeba dispar
ASKYFIETLRYITKSNL

SEQ ID NO: 2519317 - protein, 22 aa, Entamoeba dispar
ASKYFPILMKSFELNGISIKTK

SEQ ID NO: 2519318 - protein, 24 aa, Entamoeba dispar
ASLHAITILIQIIDAVLRNETQIK

SEQ ID NO: 2519319 - protein, 21 aa, Entamoeba dispar
ASLILQYYYAHGKVLELLLWM

SEQ ID NO: 2519320 - protein, 25 aa, Entamoeba dispar
ASLIPPFMIDLLRKNTSTAALELTR

SEQ ID NO: 2519321 - protein, 18 aa, Entamoeba dispar
ASLKLFQLALKRYPNSLP

SEQ ID NO: 2519322 - protein, 17 aa, Entamoeba dispar
ASLNAYIQRQEQYKQDE

SEQ ID NO: 2519323 - protein, 21 aa, Entamoeba dispar
ASLPSLFPFQLTRIDISQNLI

SEQ ID NO: 2519324 - protein, 30 aa, Entamoeba dispar
ASMALSLLNNPATRPMVSLIAQMIGMPVED

SEQ ID NO: 2519325 - protein, 17 aa, Entamoeba dispar
ASNANIFSISWKTPISL

SEQ ID NO: 2519326 - protein, 37 aa, Entamoeba dispar
ASNDILVELIYFLNKLFLFEQYLPSYLKLLKENADAL

SEQ ID NO: 2519327 - protein, 29 aa, Entamoeba dispar
ASNTPYSPFPSFSPYIPQSVQFPQQAPPQ

SEQ ID NO: 2519328 - protein, 23 aa, Entamoeba dispar
ASNVLFIIMELKDDIFKLKGNEL

SEQ ID NO: 2519329 - protein, 27 aa, Entamoeba dispar
ASPHSVYDFFLRLPLSISSFHFYDSSG

SEQ ID NO: 2519330 - protein, 28 aa, Entamoeba dispar
ASQMLELELGLLILKIGLNGTKTLILIG

SEQ ID NO: 2519331 - protein, 23 aa, Entamoeba dispar
ASRKIIRFGIITIYEPEAKPKYR

SEQ ID NO: 2519332 - protein, 27 aa, Entamoeba dispar
ASRNDGYISYWRLFRNGRWKPVKEVKC

SEQ ID NO: 2519333 - protein, 26 aa, Entamoeba dispar
ASSEKVWIYPYIKDADFVYSTFLTTE

SEQ ID NO: 2519334 - protein, 27 aa, Entamoeba dispar
ASSRELLKHKWFITNGIKVVEEVKKTN

SEQ ID NO: 2519335 - protein, 27 aa, Entamoeba dispar
ASTIYISILSAVRKLLTKYPKYKVLCT

SEQ ID NO: 2519336 - protein, 32 aa, Entamoeba dispar
ASVIKDYLRLLPNPLIPYNLYEEFIELRNNHL

SEQ ID NO: 2519337 - protein, 26 aa, Entamoeba dispar
ASVNGYLPVITPQGPMLMPVTQPPSL

SEQ ID NO: 2519338 - protein, 24 aa, Entamoeba dispar
ASVQTMFRFVFNNTLIESNFIEHF

SEQ ID NO: 2519339 - protein, 24 aa, Entamoeba dispar
ASVVAKNLLLGKKIVLIRCEDLQV

SEQ ID NO: 2519340 - protein, 25 aa, Entamoeba dispar
ASVYWLERMILSGEKLSYITRRMLR

SEQ ID NO: 2519341 - protein, 17 aa, Entamoeba dispar
ATAFKHITALKLNAMVV

SEQ ID NO: 2519342 - protein, 20 aa, Entamoeba dispar
ATAFMFPEIPKEVLDSCLGS

SEQ ID NO: 2519343 - protein, 23 aa, Entamoeba dispar
ATAFMKTMILLHNLRTINLKKYA

SEQ ID NO: 2519344 - protein, 27 aa, Entamoeba dispar
ATAKNYIALRLLFEMKVQRNFINNFSP

SEQ ID NO: 2519345 - protein, 24 aa, Entamoeba dispar
ATAMNHLFALIRKCNEYLSSTSST

SEQ ID NO: 2519346 - protein, 27 aa, Entamoeba dispar
ATASLDCKVILWDIITGKQIGVLDHSL

SEQ ID NO: 2519347 - protein, 35 aa, Entamoeba dispar
ATDIHSLFDFPKPRQIDFLPYHFLLSVNCVESKPK

SEQ ID NO: 2519348 - protein, 38 aa, Entamoeba dispar
ATDKIKSMMFNDLNVPFLKIVNPALMALYAEGKETGLV

SEQ ID NO: 2519349 - protein, 17 aa, Entamoeba dispar
ATEAAITILRIDDLIKL

SEQ ID NO: 2519350 - protein, 30 aa, Entamoeba dispar
ATEDLCMTAAPYIDFLKLGFGTSVFTGGLR

SEQ ID NO: 2519351 - protein, 26 aa, Entamoeba dispar
ATEDVLLLDVAPLTLGIETAGGVMTA

SEQ ID NO: 2519352 - protein, 23 aa, Entamoeba dispar
ATENFFLSIGAKVRLSQWEKSKE

SEQ ID NO: 2519353 - protein, 18 aa, Entamoeba dispar
ATFVVSNFNIFVCPTCSG

SEQ ID NO: 2519354 - protein, 24 aa, Entamoeba dispar
ATGDDWMDKSLLPKILQTKDWGKK

SEQ ID NO: 2519355 - protein, 27 aa, Entamoeba dispar
ATGMLRVKKFLLFLRELIEEKQNNIER

SEQ ID NO: 2519356 - protein, 28 aa, Entamoeba dispar
ATHNTPLYIPETFYESLFDESIFAGSAM

SEQ ID NO: 2519357 - protein, 28 aa, Entamoeba dispar
ATHPEYRLKITTLLPAFDFGMDIFIDKL

SEQ ID NO: 2519358 - protein, 20 aa, Entamoeba dispar
ATIEAIYYFYREWYDAMKWD

SEQ ID NO: 2519359 - protein, 26 aa, Entamoeba dispar
ATIGGLRIIGRLAVGNRKGLLLPNTC

SEQ ID NO: 2519360 - protein, 25 aa, Entamoeba dispar
ATIHFIQIGDYLMKLNNFQSLYGIV

SEQ ID NO: 2519361 - protein, 22 aa, Entamoeba dispar
ATITYFGGLNEMDDKELDSFVK

SEQ ID NO: 2519362 - protein, 17 aa, Entamoeba dispar
ATKIVCLRVFNDLFETF

SEQ ID NO: 2519363 - protein, 20 aa, Entamoeba dispar
ATKLFILSNPLHADNCPSVR

SEQ ID NO: 2519364 - protein, 27 aa, Entamoeba dispar
ATKNILITLQKWLMEDPFQFTRVEGTL

SEQ ID NO: 2519365 - protein, 23 aa, Entamoeba dispar
ATKVHLHYLYFTSLVMSDNFESR

SEQ ID NO: 2519366 - protein, 17 aa, Entamoeba dispar
ATLAWGVNLPAHLVIIK

SEQ ID NO: 2519367 - protein, 32 aa, Entamoeba dispar
ATLIGLTIRTKLMRILPPRIKLDIYLTKGTHQ

SEQ ID NO: 2519368 - protein, 25 aa, Entamoeba dispar
ATLKKFMRDLPEPLFPSYAYKEIIE

SEQ ID NO: 2519369 - protein, 32 aa, Entamoeba dispar
ATLQPPILVFDILQLKFKGLLISTKKYSFEMN

SEQ ID NO: 2519370 - protein, 21 aa, Entamoeba dispar
ATLTNLIVRCYLATSQYSVCE

SEQ ID NO: 2519371 - protein, 25 aa, Entamoeba dispar
ATNFPQILYNFLKTQSIKTAFFEAF

SEQ ID NO: 2519372 - protein, 25 aa, Entamoeba dispar
ATNNSLICMLEQLGWKIVLKNTKSS

SEQ ID NO: 2519373 - protein, 27 aa, Entamoeba dispar
ATNPFLVDLICSFIKKYKHFGNTFDFI

SEQ ID NO: 2519374 - protein, 28 aa, Entamoeba dispar
ATNVCVMVSRWFGGILLGPDRFKDIITA

SEQ ID NO: 2519375 - protein, 19 aa, Entamoeba dispar
ATPPFYELLGHMNPFIYSN

SEQ ID NO: 2519376 - protein, 17 aa, Entamoeba dispar
ATQLSCVMIAFGTAMTM

SEQ ID NO: 2519377 - protein, 18 aa, Entamoeba dispar
ATQLSCVMIAFGTAMTMG

SEQ ID NO: 2519378 - protein, 18 aa, Entamoeba dispar
ATQMKYALVWGTSVKHSP

SEQ ID NO: 2519379 - protein, 17 aa, Entamoeba dispar
ATQPLPKQLATQPLPKY

SEQ ID NO: 2519380 - protein, 23 aa, Entamoeba dispar
ATSLATHLVYSKGLVWHVSIVDI

SEQ ID NO: 2519381 - protein, 17 aa, Entamoeba dispar
ATSLLTMAGLKVPIITV

SEQ ID NO: 2519382 - protein, 23 aa, Entamoeba dispar
ATSLLTYCLIKYPLKEESKNVFI

SEQ ID NO: 2519383 - protein, 35 aa, Entamoeba dispar
ATSPPQIRYCYYFYYYLSVFPREVPFKPIPSYSIN

SEQ ID NO: 2519384 - protein, 23 aa, Entamoeba dispar
ATTLIFLFRVEPYMKMHIQLFDG

SEQ ID NO: 2519385 - protein, 24 aa, Entamoeba dispar
ATVASAIPGVNAIAAPVAAAAKTI

SEQ ID NO: 2519386 - protein, 30 aa, Entamoeba dispar
ATVCACFITEDFLTFVDLKGNTFVKRVFNR

SEQ ID NO: 2519387 - protein, 19 aa, Entamoeba dispar
ATVLYLGCEIVKIAYVGDC

SEQ ID NO: 2519388 - protein, 25 aa, Entamoeba dispar
ATVQLDFQLPLRFKLDYMSEDPNQP

SEQ ID NO: 2519389 - protein, 20 aa, Entamoeba dispar
ATWYKDLVRVCEGIPIVLVG

SEQ ID NO: 2519390 - protein, 24 aa, Entamoeba dispar
AVAKGAAYLAYLRQIECVSHKVIY

SEQ ID NO: 2519391 - protein, 20 aa, Entamoeba dispar
AVAKGAAYLAYSKQSECVGH

SEQ ID NO: 2519392 - protein, 25 aa, Entamoeba dispar
AVASVILMFLRELPEPLITFESYDL

SEQ ID NO: 2519393 - protein, 26 aa, Entamoeba dispar
AVAVLLALLYLGIKNIRIGPTAPAFL

SEQ ID NO: 2519394 - protein, 20 aa, Entamoeba dispar
AVCAFYDTIVSLPFICQNQE

SEQ ID NO: 2519395 - protein, 24 aa, Entamoeba dispar
AVCVEAGMIALRREALEIKHEDFQ

SEQ ID NO: 2519396 - protein, 18 aa, Entamoeba dispar
AVDGIIMDFILTPNTEAP

SEQ ID NO: 2519397 - protein, 23 aa, Entamoeba dispar
AVDIDLLPLYSFGNLLSVSISPE

SEQ ID NO: 2519398 - protein, 24 aa, Entamoeba dispar
AVDLLQKMFIYTPEKRISAADALK

SEQ ID NO: 2519399 - protein, 25 aa, Entamoeba dispar
AVDSFNEPVALFPVTVEPTKLNTFL

SEQ ID NO: 2519400 - protein, 30 aa, Entamoeba dispar
AVDYWSYGILLFAMAFGEAPFYDTNPSTVC

SEQ ID NO: 2519401 - protein, 29 aa, Entamoeba dispar
AVEAFARALRQLPMIIADNAGYDSADLVA

SEQ ID NO: 2519402 - protein, 18 aa, Entamoeba dispar
AVEILISMIHHPLHSKAP

SEQ ID NO: 2519403 - protein, 28 aa, Entamoeba dispar
AVELYCTYIHSLLIKPTFDWINEAIQRD

SEQ ID NO: 2519404 - protein, 21 aa, Entamoeba dispar
AVEPFEPYLMKDKFPALNHSV

SEQ ID NO: 2519405 - protein, 25 aa, Entamoeba dispar
AVEPLENLYGLCPLLQNVFIYGEST

SEQ ID NO: 2519406 - protein, 29 aa, Entamoeba dispar
AVESKFIFDFYQFFKSLHFKLKENQKQLT

SEQ ID NO: 2519407 - protein, 18 aa, Entamoeba dispar
AVETPLLVALYKSYTSAL

SEQ ID NO: 2519408 - protein, 21 aa, Entamoeba dispar
AVEYKKIITQDIVGLIGSLDL

SEQ ID NO: 2519409 - protein, 27 aa, Entamoeba dispar
AVGATLPYLGMFLTDLLFTEDMTSSAV

SEQ ID NO: 2519410 - protein, 28 aa, Entamoeba dispar
AVIDEDKIFSLLLYKTGNVIITKSMIYN

SEQ ID NO: 2519411 - protein, 21 aa, Entamoeba dispar
AVIPTQKYFAGSRPTFARCVN

SEQ ID NO: 2519412 - protein, 19 aa, Entamoeba dispar
AVIRGFLIRRELSINNLLQ

SEQ ID NO: 2519413 - protein, 26 aa, Entamoeba dispar
AVITELIRFFSQIWICYQPTEIELWK

SEQ ID NO: 2519414 - protein, 23 aa, Entamoeba dispar
AVKPSLLHVLYYDGVYMGDDRSL

SEQ ID NO: 2519415 - protein, 22 aa, Entamoeba dispar
AVKRKLFHLDPIYLHDFGYKQY

SEQ ID NO: 2519416 - protein, 31 aa, Entamoeba dispar
AVLEKVIQWLLFHNEHPLMYPDFVIGDRDKN

SEQ ID NO: 2519417 - protein, 32 aa, Entamoeba dispar
AVLEKVIQWLLFHNEHPLMYPDFVIGDRDKNA

SEQ ID NO: 2519418 - protein, 29 aa, Entamoeba dispar
AVLKFYNIAVEWLRQSLFSERILPDSEKA

SEQ ID NO: 2519419 - protein, 22 aa, Entamoeba dispar
AVLQKRLHEELAQLVIQEGNCV

SEQ ID NO: 2519420 - protein, 25 aa, Entamoeba dispar
AVMLSRPLKNLSLPLFITYLSFKEC

SEQ ID NO: 2519421 - protein, 25 aa, Entamoeba dispar
AVNMNPYPRLHFFSSSIAPVSSALS

SEQ ID NO: 2519422 - protein, 29 aa, Entamoeba dispar
AVPTYFNVNFRKYFIYLIKHQEEKMNIGM

SEQ ID NO: 2519423 - protein, 25 aa, Entamoeba dispar
AVQDKHMFAFTLSNPFNVPTQKYNW

SEQ ID NO: 2519424 - protein, 26 aa, Entamoeba dispar
AVQNNQIEIIKWIRGIAPEIIKKTNN

SEQ ID NO: 2519425 - protein, 18 aa, Entamoeba dispar
AVQYFFGYAATTEKKKEI

SEQ ID NO: 2519426 - protein, 18 aa, Entamoeba dispar
AVRAITREGLEWKGSERK

SEQ ID NO: 2519427 - protein, 27 aa, Entamoeba dispar
AVRASMEMTFIGNQLLNSATFPSICTA

SEQ ID NO: 2519428 - protein, 24 aa, Entamoeba dispar
AVREPRGYIIDGVFPFLIDKEEEE

SEQ ID NO: 2519429 - protein, 25 aa, Entamoeba dispar
AVRILLQHHALLNLTFYGKDVIKIA

SEQ ID NO: 2519430 - protein, 19 aa, Entamoeba dispar
AVRQLFMRARNSAPCVIFF

SEQ ID NO: 2519431 - protein, 28 aa, Entamoeba dispar
AVRYFDYLCDLLESIFFPQQQLKKVNKQ

SEQ ID NO: 2519432 - protein, 23 aa, Entamoeba dispar
AVSEVMFPFEQIINKAENKPDEV

SEQ ID NO: 2519433 - protein, 19 aa, Entamoeba dispar
AVSKIFPTHSFISATTSLE

SEQ ID NO: 2519434 - protein, 35 aa, Entamoeba dispar
AVVIVTNQRIYFFKPKKFKIPKYHSHLFDIKSIEI

SEQ ID NO: 2519435 - protein, 26 aa, Entamoeba dispar
AVVKRAAYLAYLKQENRISPEVIYDI

SEQ ID NO: 2519436 - protein, 17 aa, Entamoeba dispar
AVYCDKLLIVSMRDYIA

SEQ ID NO: 2519437 - protein, 18 aa, Entamoeba dispar
AVYHLLVPAMKSLKERYL

SEQ ID NO: 2519438 - protein, 19 aa, Entamoeba dispar
AVYLLRCQIINSCISYMEE

SEQ ID NO: 2519439 - protein, 17 aa, Entamoeba dispar
AVYMQRVDLLSILLLYG

SEQ ID NO: 2519440 - protein, 26 aa, Entamoeba dispar
AWARRDMIIFNGLFVLYGETGRIPLT

SEQ ID NO: 2519441 - protein, 19 aa, Entamoeba dispar
AWASLLFTGKQGYIDATRG

SEQ ID NO: 2519442 - protein, 17 aa, Entamoeba dispar
AWENWPPHVVTFFKKMS

SEQ ID NO: 2519443 - protein, 29 aa, Entamoeba dispar
AWSFRSNYIPPLIYDHILALILVSNSKVI

SEQ ID NO: 2519444 - protein, 32 aa, Entamoeba dispar
AWTERSTVYVLLKYFYWKYTEPSVMSLHEMYK

SEQ ID NO: 2519445 - protein, 28 aa, Entamoeba dispar
AWTSKIVTSAWWVYSDQVSKTAPSGEYL

SEQ ID NO: 2519446 - protein, 19 aa, Entamoeba dispar
AWYYRRRILKKIEGTFDIN

SEQ ID NO: 2519447 - protein, 17 aa, Entamoeba dispar
AYARQNCHPKWSGTVGS

SEQ ID NO: 2519448 - protein, 25 aa, Entamoeba dispar
AYCALKKYLYYSNAVDLAFSALFDD

SEQ ID NO: 2519449 - protein, 27 aa, Entamoeba dispar
AYCIDQIRRFGYFKGLFGELDEITTTN

SEQ ID NO: 2519450 - protein, 28 aa, Entamoeba dispar
AYDDEQNYRFILFDDINYDRNLIRLIKA

SEQ ID NO: 2519451 - protein, 22 aa, Entamoeba dispar
AYDDWMIPLNDYTPPKQRFIPS

SEQ ID NO: 2519452 - protein, 28 aa, Entamoeba dispar
AYDEEQNYRFILFDDINYDKNLIRLIKA

SEQ ID NO: 2519453 - protein, 20 aa, Entamoeba dispar
AYDIFLRKRFGYSERILEEM

SEQ ID NO: 2519454 - protein, 17 aa, Entamoeba dispar
AYDNSFIGAIRSLDAAG

SEQ ID NO: 2519455 - protein, 25 aa, Entamoeba dispar
AYDREKFVYIWNIADFVISGKRLQQ

SEQ ID NO: 2519456 - protein, 21 aa, Entamoeba dispar
AYEDLFDTVLFLKGQNEDGQA

SEQ ID NO: 2519457 - protein, 25 aa, Entamoeba dispar
AYEEFIPQQMSLSRLKYIFGEKIKI

SEQ ID NO: 2519458 - protein, 19 aa, Entamoeba dispar
AYEKLWYVITRIGKAAETR

SEQ ID NO: 2519459 - protein, 23 aa, Entamoeba dispar
AYELLKKDAINFMNAYDSATEHD

SEQ ID NO: 2519460 - protein, 18 aa, Entamoeba dispar
AYELSFRHQEAINCFLNA

SEQ ID NO: 2519461 - protein, 27 aa, Entamoeba dispar
AYELYNHNLFLSLNQRNTKLNKQKYSI

SEQ ID NO: 2519462 - protein, 43 aa, Entamoeba dispar
AYFINIRNYKVYEQSIFLALLNQYFDITLRLPIKQAKVFEQIL

SEQ ID NO: 2519463 - protein, 17 aa, Entamoeba dispar
AYGFHVCVTKWLTLVQL

SEQ ID NO: 2519464 - protein, 19 aa, Entamoeba dispar
AYGLVMTQLKHMKKKLITA

SEQ ID NO: 2519465 - protein, 19 aa, Entamoeba dispar
AYGQAVEILPWMASAVIQS

SEQ ID NO: 2519466 - protein, 20 aa, Entamoeba dispar
AYGSTFFVFSDYCRPTIRLA

SEQ ID NO: 2519467 - protein, 21 aa, Entamoeba dispar
AYILFKYMIPEILMETKFVIS

SEQ ID NO: 2519468 - protein, 22 aa, Entamoeba dispar
AYLEQIAPKRILASILTAIKQN

SEQ ID NO: 2519469 - protein, 17 aa, Entamoeba dispar
AYNFVRCQSSWKDTQTG

SEQ ID NO: 2519470 - protein, 21 aa, Entamoeba dispar
AYNLSLIYYKSGNKNLCINLR

SEQ ID NO: 2519471 - protein, 26 aa, Entamoeba dispar
AYNRLEAFILMIYRMIDLYSNQKNYS

SEQ ID NO: 2519472 - protein, 21 aa, Entamoeba dispar
AYPFCLPASLSLPKKSYNKMF

SEQ ID NO: 2519473 - protein, 26 aa, Entamoeba dispar
AYRNPLVDVLQFFETFHKGHYKVYNF

SEQ ID NO: 2519474 - protein, 17 aa, Entamoeba dispar
AYSFKPYGLYDGNKNVI

SEQ ID NO: 2519475 - protein, 21 aa, Entamoeba dispar
AYSIGFAAMLTGRYVCYVNPT

SEQ ID NO: 2519476 - protein, 24 aa, Entamoeba dispar
AYVSWDFKFLEWRDTNYLPGLHRL

SEQ ID NO: 2519477 - protein, 17 aa, Entamoeba dispar
CAAVYKYTKKKMEFLWT

SEQ ID NO: 2519478 - protein, 19 aa, Entamoeba dispar
CACLLVYFRDCLHSYEAVD

SEQ ID NO: 2519479 - protein, 17 aa, Entamoeba dispar
CAFGRFFSKISTLSSNS

SEQ ID NO: 2519480 - protein, 19 aa, Entamoeba dispar
CAFIALGRFLIKGYDHLSE

SEQ ID NO: 2519481 - protein, 17 aa, Entamoeba dispar
CAGMLRTIIGKGEFPIP

SEQ ID NO: 2519482 - protein, 23 aa, Entamoeba dispar
CAKKFDEIFDKMKIEESMYPSEM

SEQ ID NO: 2519483 - protein, 19 aa, Entamoeba dispar
CAKKIVEWAQYISSALMNG

SEQ ID NO: 2519484 - protein, 18 aa, Entamoeba dispar
CALCMEYSRNELESFIIF

SEQ ID NO: 2519485 - protein, 24 aa, Entamoeba dispar
CALRWGVPVLNFQWLFDCLKEGRV

SEQ ID NO: 2519486 - protein, 18 aa, Entamoeba dispar
CALTFMERDMLVKNPGCS

SEQ ID NO: 2519487 - protein, 27 aa, Entamoeba dispar
CARDGNLLCLILLLQTFPSIQESSVVD

SEQ ID NO: 2519488 - protein, 17 aa, Entamoeba dispar
CARWIAKSLVHAGLCHR

SEQ ID NO: 2519489 - protein, 28 aa, Entamoeba dispar
CASVQEYLYELLKIYPEFLKSNNKATLQ

SEQ ID NO: 2519490 - protein, 24 aa, Entamoeba dispar
CAVAILMTICEMYKNKEVPVVIVF

SEQ ID NO: 2519491 - protein, 26 aa, Entamoeba dispar
CAVVARTLSIIWNIPLIGVNHCVAHI

SEQ ID NO: 2519492 - protein, 17 aa, Entamoeba dispar
CAYWERELTRQCRLFEL

SEQ ID NO: 2519493 - protein, 17 aa, Entamoeba dispar
CCFYKCSLLKSINIPSS

SEQ ID NO: 2519494 - protein, 20 aa, Entamoeba dispar
CCIIFCGWRPHLDIDLTELN

SEQ ID NO: 2519495 - protein, 24 aa, Entamoeba dispar
CCKSSVNPFPPFMTTTYYSHDEKT

SEQ ID NO: 2519496 - protein, 26 aa, Entamoeba dispar
CCKYNGKHIIFLAGNKIDLENRVVSK

SEQ ID NO: 2519497 - protein, 24 aa, Entamoeba dispar
CCMEYKLKLPRMTKILFTSSDWSC

SEQ ID NO: 2519498 - protein, 36 aa, Entamoeba dispar
CCPIYDKFLYDIIEHPFYKYFMRGMLVTLATDSPMH

SEQ ID NO: 2519499 - protein, 22 aa, Entamoeba dispar
CCTEDMFLLNPQVPSLFEQTGC

SEQ ID NO: 2519500 - protein, 29 aa, Entamoeba dispar
CCTHQKIITKLLRKALLDQQIVLSTSTTE

SEQ ID NO: 2519501 - protein, 18 aa, Entamoeba dispar
CCVLPRPTRWWYEVKQGS

SEQ ID NO: 2519502 - protein, 20 aa, Entamoeba dispar
CCWFEVIINGVVRIPKLCCD

SEQ ID NO: 2519503 - protein, 17 aa, Entamoeba dispar
CCYIPRSSYLTETYVII

SEQ ID NO: 2519504 - protein, 17 aa, Entamoeba dispar
CDAFAGVGPFAIPAALK

SEQ ID NO: 2519505 - protein, 24 aa, Entamoeba dispar
CDDKKHFMFTLKNPFNVPPTRFKQ

SEQ ID NO: 2519506 - protein, 28 aa, Entamoeba dispar
CDEILFQCIPFILLQARLSQVLEGFVWA

SEQ ID NO: 2519507 - protein, 27 aa, Entamoeba dispar
CDEKYITAYFLLYIDIEFVKPYIRNTY

SEQ ID NO: 2519508 - protein, 33 aa, Entamoeba dispar
CDETSLPYYYNQLPFLFPGVPITYIVNPSNDSQ

SEQ ID NO: 2519509 - protein, 18 aa, Entamoeba dispar
CDFVVYKKHPQCCHSYFG

SEQ ID NO: 2519510 - protein, 18 aa, Entamoeba dispar
CDFVVYKKHPQCCHSYYG

SEQ ID NO: 2519511 - protein, 18 aa, Entamoeba dispar
CDIIDLLTRIRVVYGIDA

SEQ ID NO: 2519512 - protein, 17 aa, Entamoeba dispar
CDINGIEKKYFVKLLLS

SEQ ID NO: 2519513 - protein, 23 aa, Entamoeba dispar
CDIPLDCEIILFVFIGQKSIGCA

SEQ ID NO: 2519514 - protein, 30 aa, Entamoeba dispar
CDIWSLGVITYVLLSGYLPFFGETQDELFQ

SEQ ID NO: 2519515 - protein, 20 aa, Entamoeba dispar
CDKHFISQAVYLKHCTQGPH

SEQ ID NO: 2519516 - protein, 18 aa, Entamoeba dispar
CDKIIREFDLAPGSLNEL

SEQ ID NO: 2519517 - protein, 17 aa, Entamoeba dispar
CDKLLIVSMRDYIAAFD

SEQ ID NO: 2519518 - protein, 26 aa, Entamoeba dispar
CDKNELKIIFLFTSSHPLIVLNRLPT

SEQ ID NO: 2519519 - protein, 28 aa, Entamoeba dispar
CDKNYLIEFNLLLIRSVFDFLTILKDSM

SEQ ID NO: 2519520 - protein, 34 aa, Entamoeba dispar
CDKQQMLLERQPLQWIFIARLIVYSLKHKYNKRD

SEQ ID NO: 2519521 - protein, 29 aa, Entamoeba dispar
CDLDIQYHGIKLLLYLLKHQSYSSEVELM

SEQ ID NO: 2519522 - protein, 25 aa, Entamoeba dispar
CDLETNLEIILTKSKIKEGAIKFIK

SEQ ID NO: 2519523 - protein, 24 aa, Entamoeba dispar
CDLYPLEEIAISALYDYYSDLVDL

SEQ ID NO: 2519524 - protein, 21 aa, Entamoeba dispar
CDMKQLITFLKGRSNRKLIEV

SEQ ID NO: 2519525 - protein, 29 aa, Entamoeba dispar
CDMWSIGVLAFVLLTVSFPFDGTLEEVKQ

SEQ ID NO: 2519526 - protein, 27 aa, Entamoeba dispar
CDNEKDLLLFLPLYTTVLARGSTQPIP

SEQ ID NO: 2519527 - protein, 29 aa, Entamoeba dispar
CDNNEQELFLMQYPTRLAWRPFDLSQVKE

SEQ ID NO: 2519528 - protein, 26 aa, Entamoeba dispar
CDNTLLYAIYIFLLTYHREDITSVYK

SEQ ID NO: 2519529 - protein, 23 aa, Entamoeba dispar
CDQALAVGIFPYILKLLSSTTSV

SEQ ID NO: 2519530 - protein, 24 aa, Entamoeba dispar
CDQYVRQPIMFPVKDFFTGKLGDL

SEQ ID NO: 2519531 - protein, 22 aa, Entamoeba dispar
CDRLIQMNIIPYITQTLKQICD

SEQ ID NO: 2519532 - protein, 19 aa, Entamoeba dispar
CDRYLLGHDYPMIKIATIS

SEQ ID NO: 2519533 - protein, 18 aa, Entamoeba dispar
CDSIIIYYEMFKNEFRIN

SEQ ID NO: 2519534 - protein, 31 aa, Entamoeba dispar
CDSIKEVLIQTFKIMRIILLDASETLCDNCD

SEQ ID NO: 2519535 - protein, 23 aa, Entamoeba dispar
CDSRYLCTAPIKMITFDLRHMSV

SEQ ID NO: 2519536 - protein, 28 aa, Entamoeba dispar
CDSTIKKLYTIKAVFYSTPTRKGRHYNT

SEQ ID NO: 2519537 - protein, 17 aa, Entamoeba dispar
CDVYSFGILVFHVLTQL

SEQ ID NO: 2519538 - protein, 18 aa, Entamoeba dispar
CDWIHNYAPTFAPTALQY

SEQ ID NO: 2519539 - protein, 28 aa, Entamoeba dispar
CDYWSIGCILFEMVCGFPPFLSDDAVQT

SEQ ID NO: 2519540 - protein, 22 aa, Entamoeba dispar
CDYYAFVQYNLHLQLKEASDYA

SEQ ID NO: 2519541 - protein, 24 aa, Entamoeba dispar
CEALWTVLYVPLAKEKLYIPFGQN

SEQ ID NO: 2519542 - protein, 18 aa, Entamoeba dispar
CEDTTEPYFRAPASFLPI

SEQ ID NO: 2519543 - protein, 20 aa, Entamoeba dispar
CEEDIRVILGYNKMMYQSVL

SEQ ID NO: 2519544 - protein, 27 aa, Entamoeba dispar
CEEHGLKLIGFWDFHQFYREWTKSQEY

SEQ ID NO: 2519545 - protein, 24 aa, Entamoeba dispar
CEEKKLFIEGNARIPQEKFMEKNV

SEQ ID NO: 2519546 - protein, 19 aa, Entamoeba dispar
CEESMFSYLAPLCSVEITK

SEQ ID NO: 2519547 - protein, 25 aa, Entamoeba dispar
CEEWGQIPIMTVLMHYARTQFTDPN

SEQ ID NO: 2519548 - protein, 19 aa, Entamoeba dispar
CEEYLELFNLDQLFLVCFV

SEQ ID NO: 2519549 - protein, 27 aa, Entamoeba dispar
CEFESDLNLPLWSSFPSHIELLFKSIC

SEQ ID NO: 2519550 - protein, 18 aa, Entamoeba dispar
CEFVCQLYLSAAFSNPRK

SEQ ID NO: 2519551 - protein, 19 aa, Entamoeba dispar
CEGIPYDYKSDMWSLGCIL

SEQ ID NO: 2519552 - protein, 18 aa, Entamoeba dispar
CEGKLCIYCVARFSFRIG

SEQ ID NO: 2519553 - protein, 25 aa, Entamoeba dispar
CEGNEFTYYMLLTSEFLLNGIEKIG

SEQ ID NO: 2519554 - protein, 19 aa, Entamoeba dispar
CEHQYKLSQFCDHTRLCEV

SEQ ID NO: 2519555 - protein, 22 aa, Entamoeba dispar
CEIKEYCFCGYDLKNSHLIIPT

SEQ ID NO: 2519556 - protein, 17 aa, Entamoeba dispar
CEILFNKFTGRINFSVK

SEQ ID NO: 2519557 - protein, 37 aa, Entamoeba dispar
CEKKAKVNGLYRSLQLFGISTSDFYQQYRSLLLDTQT

SEQ ID NO: 2519558 - protein, 23 aa, Entamoeba dispar
CELDLIYYFHKVYQVIDEVFLAG

SEQ ID NO: 2519559 - protein, 23 aa, Entamoeba dispar
CELRNIEVPKYIPLPVANEEYDI

SEQ ID NO: 2519560 - protein, 31 aa, Entamoeba dispar
CENKPFVCVAIAGWIFSAKIPETIAIGLKTD

SEQ ID NO: 2519561 - protein, 32 aa, Entamoeba dispar
CENKPFVCVAIAGWIFSAKIPETIAIGLKTDS

SEQ ID NO: 2519562 - protein, 17 aa, Entamoeba dispar
CENLYWVGALDNDLRVF

SEQ ID NO: 2519563 - protein, 21 aa, Entamoeba dispar
CEPFYHEYFPGTHAVPFSIII

SEQ ID NO: 2519564 - protein, 25 aa, Entamoeba dispar
CEQLTYIHLPMSLTSLSPYCFLNCS

SEQ ID NO: 2519565 - protein, 25 aa, Entamoeba dispar
CEQWRLWQELLKRDGLNLKWIRTNS

SEQ ID NO: 2519566 - protein, 29 aa, Entamoeba dispar
CESDIKLLKILFYFPMIQTIQVQYCDLTY

SEQ ID NO: 2519567 - protein, 28 aa, Entamoeba dispar
CESNPQDMFYLIDLINWGNQHHNKHINE

SEQ ID NO: 2519568 - protein, 18 aa, Entamoeba dispar
CETTPYWDETMAFYSGYS

SEQ ID NO: 2519569 - protein, 19 aa, Entamoeba dispar
CEWIKKNSVYFPDKKKRSS

SEQ ID NO: 2519570 - protein, 24 aa, Entamoeba dispar
CEYYCLRDVLVLREGFLKYRQMVQ

SEQ ID NO: 2519571 - protein, 22 aa, Entamoeba dispar
CEYYCLRDVMVLREGFLKYREM

SEQ ID NO: 2519572 - protein, 24 aa, Entamoeba dispar
CFCACTSLVYIKIPTSITSIENEC

SEQ ID NO: 2519573 - protein, 41 aa, Entamoeba dispar
CFCHKKIPYPKKSYIYSMYDKKYFTFSLRNPSCSEPIYFKQ

SEQ ID NO: 2519574 - protein, 26 aa, Entamoeba dispar
CFCRCYSLSNIIIPSSISKLGDGCFY

SEQ ID NO: 2519575 - protein, 32 aa, Entamoeba dispar
CFDLNHFVFTIRNIFNIPPTKYKRIIKEKVFC

SEQ ID NO: 2519576 - protein, 27 aa, Entamoeba dispar
CFEGCSMLTFVYIPSSVKKIGSYCFAC

SEQ ID NO: 2519577 - protein, 17 aa, Entamoeba dispar
CFELYRQKKIDGRALIL

SEQ ID NO: 2519578 - protein, 17 aa, Entamoeba dispar
CFFKCVSLKLITMSSSL

SEQ ID NO: 2519579 - protein, 29 aa, Entamoeba dispar
CFGTEVCIFLFCLKLQYPNRVHLLRGNHE

SEQ ID NO: 2519580 - protein, 19 aa, Entamoeba dispar
CFISEYDVFVYYKHRVRAL

SEQ ID NO: 2519581 - protein, 25 aa, Entamoeba dispar
CFKECSSLRYINIPTSVSKIDCGCF

SEQ ID NO: 2519582 - protein, 26 aa, Entamoeba dispar
CFKECSSLRYINIPTSVSKIGGWCFE

SEQ ID NO: 2519583 - protein, 17 aa, Entamoeba dispar
CFKECTSLRLVKINSPS

SEQ ID NO: 2519584 - protein, 18 aa, Entamoeba dispar
CFKNCFKLKKINIPTSIK

SEQ ID NO: 2519585 - protein, 17 aa, Entamoeba dispar
CFKRCTSLILVNIPTVI

SEQ ID NO: 2519586 - protein, 17 aa, Entamoeba dispar
CFLIAYFKIEKEMIKKI

SEQ ID NO: 2519587 - protein, 18 aa, Entamoeba dispar
CFLVRALIDVVKGTKSNP

SEQ ID NO: 2519588 - protein, 19 aa, Entamoeba dispar
CFMANVLLYFTKFSDVKSF

SEQ ID NO: 2519589 - protein, 23 aa, Entamoeba dispar
CFNLQMVTQKILLPSLKGYTKQG

SEQ ID NO: 2519590 - protein, 26 aa, Entamoeba dispar
CFNQNMMDFFITAYLPDFPTMVIQKR

SEQ ID NO: 2519591 - protein, 24 aa, Entamoeba dispar
CFRECTLLRNITIPTSVTKIGREC

SEQ ID NO: 2519592 - protein, 20 aa, Entamoeba dispar
CFRLVNGVMVERTASEVIPA

SEQ ID NO: 2519593 - protein, 26 aa, Entamoeba dispar
CFSECFNLRFVPFPPSVHQIERFAFS

SEQ ID NO: 2519594 - protein, 26 aa, Entamoeba dispar
CFSGCNLLRKIIIPKTITTFGNNCFE

SEQ ID NO: 2519595 - protein, 26 aa, Entamoeba dispar
CFSIGYCPFITKIPYLGYDGYFLKKN

SEQ ID NO: 2519596 - protein, 19 aa, Entamoeba dispar
CFSSCNCMMMGGMGNLVLT

SEQ ID NO: 2519597 - protein, 29 aa, Entamoeba dispar
CFSSSCSLILFYYLPNNYPFEEIPRFEAK

SEQ ID NO: 2519598 - protein, 31 aa, Entamoeba dispar
CFSTSDNRWLLVQHPVYGLGYVPLSYVQCEK

SEQ ID NO: 2519599 - protein, 18 aa, Entamoeba dispar
CFVCHQMGHISRDCPNNP

SEQ ID NO: 2519600 - protein, 18 aa, Entamoeba dispar
CFYACQRLEKIKLPSNLS

SEQ ID NO: 2519601 - protein, 17 aa, Entamoeba dispar
CFYCRQPGHCLKNCPKK

SEQ ID NO: 2519602 - protein, 25 aa, Entamoeba dispar
CFYDCKALNRIVIPTSISKIGERCF

SEQ ID NO: 2519603 - protein, 18 aa, Entamoeba dispar
CFYDQFFCLKQDNDYYKA

SEQ ID NO: 2519604 - protein, 21 aa, Entamoeba dispar
CFYDSIELLHYLYSLTTTHWT

SEQ ID NO: 2519605 - protein, 21 aa, Entamoeba dispar
CFYQCHYRLFKDYILPERCFI

SEQ ID NO: 2519606 - protein, 23 aa, Entamoeba dispar
CGAYAMKISKFPKLKKSNTIIFT

SEQ ID NO: 2519607 - protein, 18 aa, Entamoeba dispar
CGCSSLTSIIIPLSVKIL

SEQ ID NO: 2519608 - protein, 21 aa, Entamoeba dispar
CGCTRLKSIIIPSTVSKIGDE

SEQ ID NO: 2519609 - protein, 25 aa, Entamoeba dispar
CGEEYPMITFILTAFKMVQCNIERK

SEQ ID NO: 2519610 - protein, 31 aa, Entamoeba dispar
CGEFINFLHLHYKGVILGYIRELFNDQQALE

SEQ ID NO: 2519611 - protein, 23 aa, Entamoeba dispar
CGELLHVMLYGSHPCFSDGIEIN

SEQ ID NO: 2519612 - protein, 24 aa, Entamoeba dispar
CGEPLEKYFMKDKKLMCKSCACPK

SEQ ID NO: 2519613 - protein, 17 aa, Entamoeba dispar
CGFTIRRPIKASTATNS

SEQ ID NO: 2519614 - protein, 28 aa, Entamoeba dispar
CGGHSLFNWSFFPPSTFISNVSSHPSQS

SEQ ID NO: 2519615 - protein, 23 aa, Entamoeba dispar
CGGNGYVMITTRQGMYMMQSQQV

SEQ ID NO: 2519616 - protein, 32 aa, Entamoeba dispar
CGGQSGKLFVWEWDNWEYPKNSLKGHPESIES

SEQ ID NO: 2519617 - protein, 31 aa, Entamoeba dispar
CGHMAKVRMLITQIPYFKEVTIMAFSCDTCG

SEQ ID NO: 2519618 - protein, 18 aa, Entamoeba dispar
CGIILKYIPLQTREKIKL

SEQ ID NO: 2519619 - protein, 24 aa, Entamoeba dispar
CGKDIPIYHMYTFEDQFIIPNLNI

SEQ ID NO: 2519620 - protein, 23 aa, Entamoeba dispar
CGKENIMVIIVTKHGYVFGSFNS

SEQ ID NO: 2519621 - protein, 30 aa, Entamoeba dispar
CGKNKVVCLLFPWIIRPQQNIMFIHSTMIK

SEQ ID NO: 2519622 - protein, 29 aa, Entamoeba dispar
CGKSNVIDGLLFVFGRRAKQIRQQKVVDL

SEQ ID NO: 2519623 - protein, 20 aa, Entamoeba dispar
CGKTLLAKAIAGEVGVAFIE

SEQ ID NO: 2519624 - protein, 18 aa, Entamoeba dispar
CGLGILSLFAARAGAKHV

SEQ ID NO: 2519625 - protein, 24 aa, Entamoeba dispar
CGLHLTLKNFFFDQGTQAVYCKNH

SEQ ID NO: 2519626 - protein, 26 aa, Entamoeba dispar
CGNELLYEFEILPSIISLIKDIPEFG

SEQ ID NO: 2519627 - protein, 32 aa, Entamoeba dispar
CGNGKYEITFFYMGKERHIVIDDLIPCNNGQP

SEQ ID NO: 2519628 - protein, 23 aa, Entamoeba dispar
CGNGYTLSLLGKEGYQHLYGMDY

SEQ ID NO: 2519629 - protein, 18 aa, Entamoeba dispar
CGPYECISKYKYHIKLTP

SEQ ID NO: 2519630 - protein, 24 aa, Entamoeba dispar
CGQALDFRLISLYVKTRTPTQVRS

SEQ ID NO: 2519631 - protein, 24 aa, Entamoeba dispar
CGQTNIMVIIITTDCYIFGSYNSL

SEQ ID NO: 2519632 - protein, 17 aa, Entamoeba dispar
CGRIEKLFIVGFNKMSQ

SEQ ID NO: 2519633 - protein, 24 aa, Entamoeba dispar
CGSFGKVYRGIVAGLPVAIKVPNK

SEQ ID NO: 2519634 - protein, 27 aa, Entamoeba dispar
CGSFTSLGFTFSPYAEPYRPSRSVNAS

SEQ ID NO: 2519635 - protein, 19 aa, Entamoeba dispar
CGSLSREISFIRRSPYRDI

SEQ ID NO: 2519636 - protein, 19 aa, Entamoeba dispar
CGWYVRKTEWKGMTGKELL

SEQ ID NO: 2519637 - protein, 30 aa, Entamoeba dispar
CHCPETLFDSFIKFLPHNMKHRLLQFSSTS

SEQ ID NO: 2519638 - protein, 37 aa, Entamoeba dispar
CHEESTLFWMFKYVMDFLQPFYFCKGDIIMKALRKNG

SEQ ID NO: 2519639 - protein, 18 aa, Entamoeba dispar
CHFFNIQTKKYECINYLN

SEQ ID NO: 2519640 - protein, 37 aa, Entamoeba dispar
CHIVAKMVLYDFQRGRLPYFVTPPLPEKNDTIDTDYN

SEQ ID NO: 2519641 - protein, 24 aa, Entamoeba dispar
CHNINMRFDPYVFLSLAIPNKQNS

SEQ ID NO: 2519642 - protein, 18 aa, Entamoeba dispar
CHRHLQLDLCSQVNFIVG

SEQ ID NO: 2519643 - protein, 17 aa, Entamoeba dispar
CHRLFYQSFKAKDTQFI

SEQ ID NO: 2519644 - protein, 17 aa, Entamoeba dispar
CHSFILQIRIPSLFNHI

SEQ ID NO: 2519645 - protein, 28 aa, Entamoeba dispar
CHSPYIVKLFYTFQNPTSLFYVLELCPN

SEQ ID NO: 2519646 - protein, 17 aa, Entamoeba dispar
CHVLPHRFIANALREKK

SEQ ID NO: 2519647 - protein, 24 aa, Entamoeba dispar
CIANTLFKIAYYYKSNAIHNKSST

SEQ ID NO: 2519648 - protein, 27 aa, Entamoeba dispar
CIDPAMLRPGRLDRLISVDLPNSDARV

SEQ ID NO: 2519649 - protein, 24 aa, Entamoeba dispar
CIDSLIYIMLIHIYSFNQFKELIK

SEQ ID NO: 2519650 - protein, 19 aa, Entamoeba dispar
CIECGKGYYLTEDFKCSKC

SEQ ID NO: 2519651 - protein, 30 aa, Entamoeba dispar
CIEKLPSTCFLGRLRKFILPARLVMEKDDW

SEQ ID NO: 2519652 - protein, 20 aa, Entamoeba dispar
CIELLLTLLSKLLRCKPIGQ

SEQ ID NO: 2519653 - protein, 22 aa, Entamoeba dispar
CIERLRLERAIHTQFKLSTNKS

SEQ ID NO: 2519654 - protein, 18 aa, Entamoeba dispar
CIFFMQNGYCKKGGSCTF

SEQ ID NO: 2519655 - protein, 24 aa, Entamoeba dispar
CIFGSFHSIIPFNRGIWSNFDPTT

SEQ ID NO: 2519656 - protein, 17 aa, Entamoeba dispar
CIFSLIIPEIDEPWYLK

SEQ ID NO: 2519657 - protein, 18 aa, Entamoeba dispar
CIHEIIHYIQLLKKVYSF

SEQ ID NO: 2519658 - protein, 23 aa, Entamoeba dispar
CIHSIIHTIPNLHKLNLPLTKLI

SEQ ID NO: 2519659 - protein, 30 aa, Entamoeba dispar
CIIEKAISLTVYLIYIPEKNSQLIVHLQNC

SEQ ID NO: 2519660 - protein, 17 aa, Entamoeba dispar
CIIGDSGVGKTCISSRL

SEQ ID NO: 2519661 - protein, 23 aa, Entamoeba dispar
CIISCPCYCTCYYFTESIANLYP

SEQ ID NO: 2519662 - protein, 20 aa, Entamoeba dispar
CIISKYIIEPLLLNERKFEL

SEQ ID NO: 2519663 - protein, 34 aa, Entamoeba dispar
CIISNSLLITLLNKITIKFPQSDLSYCIKFFNKL

SEQ ID NO: 2519664 - protein, 19 aa, Entamoeba dispar
CIIVVVRHPTEKKCLFVRK

SEQ ID NO: 2519665 - protein, 19 aa, Entamoeba dispar
CIIYLFFPNIKENQIQPKI

SEQ ID NO: 2519666 - protein, 17 aa, Entamoeba dispar
CIKEIEIIIKKYPYDQF

SEQ ID NO: 2519667 - protein, 25 aa, Entamoeba dispar
CIKNGTIYGYLFFNCDKERVGEAQN

SEQ ID NO: 2519668 - protein, 17 aa, Entamoeba dispar
CIKPFPPFIEDKWYYHS

SEQ ID NO: 2519669 - protein, 19 aa, Entamoeba dispar
CIKPLYSMEKTIGMMEKEE

SEQ ID NO: 2519670 - protein, 17 aa, Entamoeba dispar
CIKYLPEGNVKCLIKMK

SEQ ID NO: 2519671 - protein, 23 aa, Entamoeba dispar
CINAEIIIQLIPKGNLIVVHIID

SEQ ID NO: 2519672 - protein, 18 aa, Entamoeba dispar
CINIFKSYYFCESWNNPV

SEQ ID NO: 2519673 - protein, 30 aa, Entamoeba dispar
CINLIIQKYPHLFINQLRTFYCSYDEPIYI

SEQ ID NO: 2519674 - protein, 30 aa, Entamoeba dispar
CINTLKDLLNKFGLAYTALPDAANKFVDFT

SEQ ID NO: 2519675 - protein, 19 aa, Entamoeba dispar
CIPISKKGFLYVSLHCKKG

SEQ ID NO: 2519676 - protein, 18 aa, Entamoeba dispar
CIPNFTAPDFFLFAAIDG

SEQ ID NO: 2519677 - protein, 21 aa, Entamoeba dispar
CIQEFLAPLNLFDTSNKKYLN

SEQ ID NO: 2519678 - protein, 18 aa, Entamoeba dispar
CIQFTTLERQESFETPLI

SEQ ID NO: 2519679 - protein, 18 aa, Entamoeba dispar
CIQKMKYHFFSSSLLFVY

SEQ ID NO: 2519680 - protein, 25 aa, Entamoeba dispar
CIQLPTYVPCKVTAKYDYIATYGKD

SEQ ID NO: 2519681 - protein, 30 aa, Entamoeba dispar
CISIFPTINKIFLYDLPLEELIQPLLENMI

SEQ ID NO: 2519682 - protein, 19 aa, Entamoeba dispar
CISKYKYHIKLTPGNTKAG

SEQ ID NO: 2519683 - protein, 25 aa, Entamoeba dispar
CISTKLLYELIVARPNIFLSKLESW

SEQ ID NO: 2519684 - protein, 19 aa, Entamoeba dispar
CISVKIPIGVWFHFALCCD

SEQ ID NO: 2519685 - protein, 17 aa, Entamoeba dispar
CIVEGFEIIFDKGLDKK

SEQ ID NO: 2519686 - protein, 24 aa, Entamoeba dispar
CIVPYFSQFQLLSNSVVQIANALF

SEQ ID NO: 2519687 - protein, 24 aa, Entamoeba dispar
CKAILSYHPTLFKSFKKLIPETRS

SEQ ID NO: 2519688 - protein, 23 aa, Entamoeba dispar
CKDCGFVLMDIDDVKIQDLRQKE

SEQ ID NO: 2519689 - protein, 30 aa, Entamoeba dispar
CKDEGSKVYWKWFLALDEIPRRSGAREAPS

SEQ ID NO: 2519690 - protein, 21 aa, Entamoeba dispar
CKDFQGIVLPVVRALMVNFTE

SEQ ID NO: 2519691 - protein, 24 aa, Entamoeba dispar
CKEIIQNVIFIISGKKTEYDKQMK

SEQ ID NO: 2519692 - protein, 25 aa, Entamoeba dispar
CKEKDNFLCFLISFGMTSSPPIWLY

SEQ ID NO: 2519693 - protein, 22 aa, Entamoeba dispar
CKEVYSFLSNLLLKSNQLNQMK

SEQ ID NO: 2519694 - protein, 25 aa, Entamoeba dispar
CKFENFFTYKRYKFGVLYAAVGQTK

SEQ ID NO: 2519695 - protein, 19 aa, Entamoeba dispar
CKFLYTPNDVDTLLKFIII

SEQ ID NO: 2519696 - protein, 22 aa, Entamoeba dispar
CKFYQIGQCKFGDNCKFLHIKT

SEQ ID NO: 2519697 - protein, 17 aa, Entamoeba dispar
CKGVQWLHNGMNLIHRD

SEQ ID NO: 2519698 - protein, 25 aa, Entamoeba dispar
CKGYNSIRYFWDIGTLRIDAEEWVF

SEQ ID NO: 2519699 - protein, 24 aa, Entamoeba dispar
CKICQRVFGVIRDSFWRNARSKLN

SEQ ID NO: 2519700 - protein, 25 aa, Entamoeba dispar
CKIGQLFQIFQIFGTPTEESWPGVT

SEQ ID NO: 2519701 - protein, 25 aa, Entamoeba dispar
CKITEGVLLRMVLSDLIKQSQSKLT

SEQ ID NO: 2519702 - protein, 20 aa, Entamoeba dispar
CKIVKNCELRLFQRPDDAIF

SEQ ID NO: 2519703 - protein, 20 aa, Entamoeba dispar
CKIVNNCELRLFQRPDDAVF

SEQ ID NO: 2519704 - protein, 17 aa, Entamoeba dispar
CKIYSLFAETIISTTSH

SEQ ID NO: 2519705 - protein, 22 aa, Entamoeba dispar
CKKCLYQWWDIQRMMTCPFCRG

SEQ ID NO: 2519706 - protein, 23 aa, Entamoeba dispar
CKKHGGFYLGAIGGAAALLAEKN

SEQ ID NO: 2519707 - protein, 19 aa, Entamoeba dispar
CKKLFVVPTTLSCGHTFCY

SEQ ID NO: 2519708 - protein, 30 aa, Entamoeba dispar
CKLELVKSFYRLLINWRPTVKKYPASYFKQ

SEQ ID NO: 2519709 - protein, 20 aa, Entamoeba dispar
CKNCGSINHWTYQCTVEMEE

SEQ ID NO: 2519710 - protein, 19 aa, Entamoeba dispar
CKNECCVKWRKGICPWNKG

SEQ ID NO: 2519711 - protein, 18 aa, Entamoeba dispar
CKNFTLADGTFWPIPITM

SEQ ID NO: 2519712 - protein, 33 aa, Entamoeba dispar
CKNIAFPLFPQIVLLMRELYLLIIKSASEDTQI

SEQ ID NO: 2519713 - protein, 27 aa, Entamoeba dispar
CKNIKLIIFLMFELYLRKYNELYLTVF

SEQ ID NO: 2519714 - protein, 24 aa, Entamoeba dispar
CKNKAFGVKYLLKTNKKHPTKVMI

SEQ ID NO: 2519715 - protein, 21 aa, Entamoeba dispar
CKNNTYYQTILLKCLKSLQHI

SEQ ID NO: 2519716 - protein, 26 aa, Entamoeba dispar
CKNSKPFLPLLLYTIIQSDLSQIWSN

SEQ ID NO: 2519717 - protein, 29 aa, Entamoeba dispar
CKNYLNIRYPLPECKMLPKGWGIGMDRGE

SEQ ID NO: 2519718 - protein, 27 aa, Entamoeba dispar
CKQHGLTAFTYLRITRGLLDDGNAWGQ

SEQ ID NO: 2519719 - protein, 29 aa, Entamoeba dispar
CKQLNQKLIILFILYTVYMTQPKDKSPIP

SEQ ID NO: 2519720 - protein, 30 aa, Entamoeba dispar
CKSHHSQYLLYLPLLLRHIVIQPRSEYKII

SEQ ID NO: 2519721 - protein, 26 aa, Entamoeba dispar
CKSQCKLMLIFHHSPQSPLSLQSLSS

SEQ ID NO: 2519722 - protein, 23 aa, Entamoeba dispar
CKSSFGYFILKKNVFKVNSNPNS

SEQ ID NO: 2519723 - protein, 28 aa, Entamoeba dispar
CKTDKEFNLLFWKYLMKTKPLPSREVVP

SEQ ID NO: 2519724 - protein, 25 aa, Entamoeba dispar
CKTEYLTYRTFLQQQLIKMKEAYLK

SEQ ID NO: 2519725 - protein, 24 aa, Entamoeba dispar
CKTIDFRFVRPLSIDFLRRFNKAA

SEQ ID NO: 2519726 - protein, 27 aa, Entamoeba dispar
CKTIQAAKYWRQMIIKEILQKVSEIQN

SEQ ID NO: 2519727 - protein, 23 aa, Entamoeba dispar
CKTNSFTRHIFLSGGLAVGKTTI

SEQ ID NO: 2519728 - protein, 22 aa, Entamoeba dispar
CKVCVNLAEFILRQARNGKSKN

SEQ ID NO: 2519729 - protein, 22 aa, Entamoeba dispar
CKVEFIIHLIKFIQNNTQFKIA

SEQ ID NO: 2519730 - protein, 18 aa, Entamoeba dispar
CKYLPNAIGEFRKLIPNL

SEQ ID NO: 2519731 - protein, 18 aa, Entamoeba dispar
CLCDRPTLVSIYKGKIKT

SEQ ID NO: 2519732 - protein, 26 aa, Entamoeba dispar
CLCQQLVPFLGYFELPYSLSSLNDNS

SEQ ID NO: 2519733 - protein, 29 aa, Entamoeba dispar
CLDDKELNQMLSIKRLAPYDERKITQAEK

SEQ ID NO: 2519734 - protein, 20 aa, Entamoeba dispar
CLDMKMFKKRWEIPKSGKLT

SEQ ID NO: 2519735 - protein, 28 aa, Entamoeba dispar
CLDQFGPFVTYLLLPYGTGNDLSLSLGY

SEQ ID NO: 2519736 - protein, 24 aa, Entamoeba dispar
CLDTKLWKYITPYVNIAVKQKEIS

SEQ ID NO: 2519737 - protein, 30 aa, Entamoeba dispar
CLDYLTVRICLWVLYQLLCQIKTIIEMEMI

SEQ ID NO: 2519738 - protein, 20 aa, Entamoeba dispar
CLEQLYKTHKLYLEKSIKLV

SEQ ID NO: 2519739 - protein, 19 aa, Entamoeba dispar
CLERYWGISFANWVSRRIE

SEQ ID NO: 2519740 - protein, 23 aa, Entamoeba dispar
CLFHCLEYLFYNKSRNDPYHIRQ

SEQ ID NO: 2519741 - protein, 17 aa, Entamoeba dispar
CLFNFREEINQALLKGQ

SEQ ID NO: 2519742 - protein, 17 aa, Entamoeba dispar
CLFVLNKCDILDDETKE

SEQ ID NO: 2519743 - protein, 24 aa, Entamoeba dispar
CLGCGLIDFLPIKCSYCHNPFCNK

SEQ ID NO: 2519744 - protein, 18 aa, Entamoeba dispar
CLGPKSMLKMLIDPQAGV

SEQ ID NO: 2519745 - protein, 19 aa, Entamoeba dispar
CLIDKLLSVFIQQGNYGDD

SEQ ID NO: 2519746 - protein, 17 aa, Entamoeba dispar
CLILYSTILSNCLIVEQ

SEQ ID NO: 2519747 - protein, 17 aa, Entamoeba dispar
CLINKNKFFLRIATRIL

SEQ ID NO: 2519748 - protein, 18 aa, Entamoeba dispar
CLINQLLYGYFKDNNKST

SEQ ID NO: 2519749 - protein, 25 aa, Entamoeba dispar
CLISFYCWEIFFRRIVIRSQTYWKN

SEQ ID NO: 2519750 - protein, 25 aa, Entamoeba dispar
CLKEIAINIGKYYSLLPTDISIIDL

SEQ ID NO: 2519751 - protein, 18 aa, Entamoeba dispar
CLKGLKKAQVAFAAQVAK

SEQ ID NO: 2519752 - protein, 17 aa, Entamoeba dispar
CLKIWDIEKGESLFDVI

SEQ ID NO: 2519753 - protein, 17 aa, Entamoeba dispar
CLKIYKQWLTTSNSPIL

SEQ ID NO: 2519754 - protein, 27 aa, Entamoeba dispar
CLKLVQHPIPTWINRMAWYGNQFEKFF

SEQ ID NO: 2519755 - protein, 24 aa, Entamoeba dispar
CLKTLPLHSLYIQNFHKLVSLSVP

SEQ ID NO: 2519756 - protein, 22 aa, Entamoeba dispar
CLKTVYVPLIKYLKAYYDQNTS

SEQ ID NO: 2519757 - protein, 17 aa, Entamoeba dispar
CLLIPEHGEMGISPSCY

SEQ ID NO: 2519758 - protein, 20 aa, Entamoeba dispar
CLLLKKRFVPKMKDILETED

SEQ ID NO: 2519759 - protein, 19 aa, Entamoeba dispar
CLLLLLQLTSIDPSVSALI

SEQ ID NO: 2519760 - protein, 19 aa, Entamoeba dispar
CLLNKKNIGIIYIDKKDNV

SEQ ID NO: 2519761 - protein, 34 aa, Entamoeba dispar
CLNGLPPIPTSILPLFEMIGIDGVLAVWLALLEE

SEQ ID NO: 2519762 - protein, 17 aa, Entamoeba dispar
CLNSTLLNTLLYEWYEL

SEQ ID NO: 2519763 - protein, 28 aa, Entamoeba dispar
CLNTWVGGKLYLTNYRLIWRTSNESLGS

SEQ ID NO: 2519764 - protein, 22 aa, Entamoeba dispar
CLPLCCLISTLHSRYFCVHGGI

SEQ ID NO: 2519765 - protein, 29 aa, Entamoeba dispar
CLQFIVNEIYIRYLKIFNKQLSVTFEPNS

SEQ ID NO: 2519766 - protein, 22 aa, Entamoeba dispar
CLRCNRTCHYPCYISGDVKDGC

SEQ ID NO: 2519767 - protein, 19 aa, Entamoeba dispar
CLSAFAGMISKIVKRRLLL

SEQ ID NO: 2519768 - protein, 18 aa, Entamoeba dispar
CLSFMKFNFNHTITFPLQ

SEQ ID NO: 2519769 - protein, 24 aa, Entamoeba dispar
CLSIELIHDIDLLNWLVSDIDAEI

SEQ ID NO: 2519770 - protein, 25 aa, Entamoeba dispar
CLSKELLLFVRVIMLERLSETSLKE

SEQ ID NO: 2519771 - protein, 25 aa, Entamoeba dispar
CLTEGIFSFIKKLFVKRTYNKIYVD

SEQ ID NO: 2519772 - protein, 18 aa, Entamoeba dispar
CLTLLSTFVLNKCYFNFY

SEQ ID NO: 2519773 - protein, 25 aa, Entamoeba dispar
CLTTPLRVAVLYYIQNSLLMKWDPT

SEQ ID NO: 2519774 - protein, 22 aa, Entamoeba dispar
CLVQPNTPYEIIYEYGRIMMNE

SEQ ID NO: 2519775 - protein, 21 aa, Entamoeba dispar
CLYCHKTCHYPCYIKGDIKKG

SEQ ID NO: 2519776 - protein, 18 aa, Entamoeba dispar
CLYIPAVFCSIFGLSLDA

SEQ ID NO: 2519777 - protein, 17 aa, Entamoeba dispar
CLYLTQYVVQRQSSFRA

SEQ ID NO: 2519778 - protein, 32 aa, Entamoeba dispar
CLYPRQQLHLYPFLEKIVPAKLLVPTKILMEL

SEQ ID NO: 2519779 - protein, 48 aa, Entamoeba dispar
CLYTNIWNCPFCLMKSYYYDLFIDSRLKYYLSFLPENIKKVSFVGEEI

SEQ ID NO: 2519780 - protein, 26 aa, Entamoeba dispar
CLYYQKFFPSKLFYQWITRDGKYSQT

SEQ ID NO: 2519781 - protein, 19 aa, Entamoeba dispar
CLYYSFINEFKNLLTETSK

SEQ ID NO: 2519782 - protein, 31 aa, Entamoeba dispar
CMITSSPYLHLFLQRFKPLADLYFIQNSFIN

SEQ ID NO: 2519783 - protein, 17 aa, Entamoeba dispar
CMNSIIKLLDKKKKLFG

SEQ ID NO: 2519784 - protein, 22 aa, Entamoeba dispar
CMQRGYWLMMENVNFCNPTVLD

SEQ ID NO: 2519785 - protein, 17 aa, Entamoeba dispar
CMRCGTPFTLFFRKHHC

SEQ ID NO: 2519786 - protein, 22 aa, Entamoeba dispar
CMSLISINLPSSITKLGIGCFY

SEQ ID NO: 2519787 - protein, 30 aa, Entamoeba dispar
CNAKEWTNEFIWWCYDYDFEFGYDVQFDNI

SEQ ID NO: 2519788 - protein, 26 aa, Entamoeba dispar
CNALIYSPFTICDIVIQPSIQLGDEI

SEQ ID NO: 2519789 - protein, 24 aa, Entamoeba dispar
CNDLQADFILFSSYIHLHMKNEGK

SEQ ID NO: 2519790 - protein, 26 aa, Entamoeba dispar
CNDLQADFILFSSYLHLHMKNEGKDV

SEQ ID NO: 2519791 - protein, 25 aa, Entamoeba dispar
CNDLTLIEKRQLMRFLNDIYTERKL

SEQ ID NO: 2519792 - protein, 26 aa, Entamoeba dispar
CNDMYQWLLQALFGIKIAYRCVVIGL

SEQ ID NO: 2519793 - protein, 28 aa, Entamoeba dispar
CNEILFQCIPFILLQARLSQVLEGFVWT

SEQ ID NO: 2519794 - protein, 19 aa, Entamoeba dispar
CNGKIMNAGICQLLYHMRV

SEQ ID NO: 2519795 - protein, 18 aa, Entamoeba dispar
CNGRFGTFSQLYEIPEDI

SEQ ID NO: 2519796 - protein, 18 aa, Entamoeba dispar
CNGYRYGKGLYFANCASK

SEQ ID NO: 2519797 - protein, 33 aa, Entamoeba dispar
CNHMTRKCGYKFCWLCCVKYTPEQWMDNTTGRK

SEQ ID NO: 2519798 - protein, 23 aa, Entamoeba dispar
CNKDLVIGVYKYGFSSSEYLQQD

SEQ ID NO: 2519799 - protein, 25 aa, Entamoeba dispar
CNKKEIYHNPIIQYQLEEINGIRNE

SEQ ID NO: 2519800 - protein, 29 aa, Entamoeba dispar
CNKKYKEQAIWFLNAYWLENGEAEAENVW

SEQ ID NO: 2519801 - protein, 27 aa, Entamoeba dispar
CNKWMKYVNNILKYLISFIERSQPLLD

SEQ ID NO: 2519802 - protein, 20 aa, Entamoeba dispar
CNLIYFPDPLLDQQNSMNYI

SEQ ID NO: 2519803 - protein, 21 aa, Entamoeba dispar
CNLPLLEHMTFIDSPGVLSGE

SEQ ID NO: 2519804 - protein, 27 aa, Entamoeba dispar
CNLQPSHLVLIPYNAFTAVLHALGSSL

SEQ ID NO: 2519805 - protein, 28 aa, Entamoeba dispar
CNNQSNNLYIKLNIPIHTSTNGISAKII

SEQ ID NO: 2519806 - protein, 28 aa, Entamoeba dispar
CNPLVEFPIYITKCQGLKILNLSDCHLY

SEQ ID NO: 2519807 - protein, 19 aa, Entamoeba dispar
CNPVNLFIRDYDYKGEYII

SEQ ID NO: 2519808 - protein, 20 aa, Entamoeba dispar
CNRELLLLSFICGAEVTIDK

SEQ ID NO: 2519809 - protein, 23 aa, Entamoeba dispar
CNRNEWMYLINDNIMLLYSIQDN

SEQ ID NO: 2519810 - protein, 25 aa, Entamoeba dispar
CNSSIQHGLPYKAFHGKTGRVWNVN

SEQ ID NO: 2519811 - protein, 27 aa, Entamoeba dispar
CNTDDFIYKMIRLSIKNNIGLIGPSFP

SEQ ID NO: 2519812 - protein, 34 aa, Entamoeba dispar
CNVYRLVCYIYKGLNLWYYPKLKGGTMMIITLYE

SEQ ID NO: 2519813 - protein, 32 aa, Entamoeba dispar
CPFGTILPRSNLIDVLKILPTKKVVACPAPSI

SEQ ID NO: 2519814 - protein, 17 aa, Entamoeba dispar
CPFYTRNGKLIKVIPMK

SEQ ID NO: 2519815 - protein, 28 aa, Entamoeba dispar
CPGFLFEWYMVWFCRILPCDFCYAIIDL

SEQ ID NO: 2519816 - protein, 24 aa, Entamoeba dispar
CPGGELYYRLIQEKSFCESRTQFY

SEQ ID NO: 2519817 - protein, 18 aa, Entamoeba dispar
CPITCVFDLLFVNKKIKK

SEQ ID NO: 2519818 - protein, 23 aa, Entamoeba dispar
CPKCGYHDLRRISYYVLANGLIK

SEQ ID NO: 2519819 - protein, 24 aa, Entamoeba dispar
CPKQSFFNYFFRTSQFTLTKIPPK

SEQ ID NO: 2519820 - protein, 19 aa, Entamoeba dispar
CPKRWFIKSGKEGGIKLFS

SEQ ID NO: 2519821 - protein, 22 aa, Entamoeba dispar
CPLLNIYSCYFTYCYSFMKPAE

SEQ ID NO: 2519822 - protein, 24 aa, Entamoeba dispar
CPNALLRYLELKPINHPSLTKDKE

SEQ ID NO: 2519823 - protein, 26 aa, Entamoeba dispar
CPNKRCVVTLPFLRILEIQRGLDDCV

SEQ ID NO: 2519824 - protein, 17 aa, Entamoeba dispar
CPNPFQLPPMTPDSFRN

SEQ ID NO: 2519825 - protein, 23 aa, Entamoeba dispar
CPNPGFIIQLYEFQLKLGIKDSK

SEQ ID NO: 2519826 - protein, 20 aa, Entamoeba dispar
CPNTTCQTFYHLLCLKRLGR

SEQ ID NO: 2519827 - protein, 30 aa, Entamoeba dispar
CPPIYGHYIVKTAIVLVLFGGTRKHDIAKI

SEQ ID NO: 2519828 - protein, 26 aa, Entamoeba dispar
CPTVRSLLVVLIFKIILNGYNGNKYQ

SEQ ID NO: 2519829 - protein, 17 aa, Entamoeba dispar
CQCEFVCQLYLSAAFSN

SEQ ID NO: 2519830 - protein, 17 aa, Entamoeba dispar
CQFANYLEYPNTCSCNI

SEQ ID NO: 2519831 - protein, 17 aa, Entamoeba dispar
CQFIINKNQIKEMKIIK

SEQ ID NO: 2519832 - protein, 24 aa, Entamoeba dispar
CQFTKDVLLFFKKQATMKAQSMDY

SEQ ID NO: 2519833 - protein, 19 aa, Entamoeba dispar
CQIISLHLPLTKETKGRIG

SEQ ID NO: 2519834 - protein, 25 aa, Entamoeba dispar
CQKELDLYNRILANFVEFVHMLGEE

SEQ ID NO: 2519835 - protein, 18 aa, Entamoeba dispar
CQKEYNSLIKFKPTRRFL

SEQ ID NO: 2519836 - protein, 23 aa, Entamoeba dispar
CQKFFTAIGIHVFPFCLQFDVMD

SEQ ID NO: 2519837 - protein, 24 aa, Entamoeba dispar
CQKKEMKILVKAMAKKLNKKDMKK

SEQ ID NO: 2519838 - protein, 25 aa, Entamoeba dispar
CQKVKLFFESLQSQVDTFQSLESLT

SEQ ID NO: 2519839 - protein, 25 aa, Entamoeba dispar
CQNIQDCLNLLVSSWKNTESMIINN

SEQ ID NO: 2519840 - protein, 30 aa, Entamoeba dispar
CQNKQDRDLWLSTIETIRRLCIQSTEKYIS

SEQ ID NO: 2519841 - protein, 17 aa, Entamoeba dispar
CQPDHLIAVPRVLQRIK

SEQ ID NO: 2519842 - protein, 17 aa, Entamoeba dispar
CQQYWRDTILSLIGETI

SEQ ID NO: 2519843 - protein, 23 aa, Entamoeba dispar
CQSNLLKKPLPLLLPNFTQNDTE

SEQ ID NO: 2519844 - protein, 27 aa, Entamoeba dispar
CQSRSRNIIFIWKSFSKNGISKITDNM

SEQ ID NO: 2519845 - protein, 27 aa, Entamoeba dispar
CQTDERAMMLYISLFSQVFKTKEMMEN

SEQ ID NO: 2519846 - protein, 27 aa, Entamoeba dispar
CQTHNKYFQYYFFSQPILMVRMSITEV

SEQ ID NO: 2519847 - protein, 24 aa, Entamoeba dispar
CQTQNHIFYLYNDHLECYSLIHDQ

SEQ ID NO: 2519848 - protein, 29 aa, Entamoeba dispar
CQTTESNFSVFYLPPGIYEICAYNDQSLE

SEQ ID NO: 2519849 - protein, 18 aa, Entamoeba dispar
CQVGYYVNGSKCESCSPH

SEQ ID NO: 2519850 - protein, 22 aa, Entamoeba dispar
CQYYEEIVLFVLVMEKIMGRID

SEQ ID NO: 2519851 - protein, 25 aa, Entamoeba dispar
CRAFEVFMVGIILEKIRLVPSKSTT

SEQ ID NO: 2519852 - protein, 18 aa, Entamoeba dispar
CRAFYIKMKSKQAISLCG

SEQ ID NO: 2519853 - protein, 20 aa, Entamoeba dispar
CRAHQLVNEGYKWCFDKKLV

SEQ ID NO: 2519854 - protein, 24 aa, Entamoeba dispar
CRELLPVLINAEHTILLSGTALLS

SEQ ID NO: 2519855 - protein, 18 aa, Entamoeba dispar
CRILPCDFCYAIIDLCLL

SEQ ID NO: 2519856 - protein, 29 aa, Entamoeba dispar
CRKDNKERYFYLFNDLLVYGIGDENKIKV

SEQ ID NO: 2519857 - protein, 23 aa, Entamoeba dispar
CRKQLLPTPIVKLPITLDIVMHP

SEQ ID NO: 2519858 - protein, 24 aa, Entamoeba dispar
CRKSAFQWVQLPSNCYIIDSVDNE

SEQ ID NO: 2519859 - protein, 26 aa, Entamoeba dispar
CRKTPKPRYFILFNDQLIYGTETMGI

SEQ ID NO: 2519860 - protein, 20 aa, Entamoeba dispar
CRLFKYISAIIQNILLFIPE

SEQ ID NO: 2519861 - protein, 17 aa, Entamoeba dispar
CRLPLQKQSSLLPSINS

SEQ ID NO: 2519862 - protein, 28 aa, Entamoeba dispar
CRLTSYNYMYIIPSFRKIVIQLVSQLRH

SEQ ID NO: 2519863 - protein, 18 aa, Entamoeba dispar
CRLYYPMCYKEEHQKECL

SEQ ID NO: 2519864 - protein, 25 aa, Entamoeba dispar
CRPSTGYNAIFRKCQPCRGDCDTCT

SEQ ID NO: 2519865 - protein, 32 aa, Entamoeba dispar
CRQSFFHSITIKTLLIHLALRLTVYSQKLHSK

SEQ ID NO: 2519866 - protein, 17 aa, Entamoeba dispar
CRRLPWSKYVRRPSTRA

SEQ ID NO: 2519867 - protein, 20 aa, Entamoeba dispar
CRSALLKSISVAVPIPFKPG

SEQ ID NO: 2519868 - protein, 17 aa, Entamoeba dispar
CRSFIVKSLLHDERYSN

SEQ ID NO: 2519869 - protein, 19 aa, Entamoeba dispar
CRSYLYSNSTLRTIYNYSS

SEQ ID NO: 2519870 - protein, 19 aa, Entamoeba dispar
CRTLFESPMWSADDVKLTV

SEQ ID NO: 2519871 - protein, 19 aa, Entamoeba dispar
CRVIQRILEKIPTEKSYPL

SEQ ID NO: 2519872 - protein, 19 aa, Entamoeba dispar
CRVNTDLVCTWYLNNTCCV

SEQ ID NO: 2519873 - protein, 25 aa, Entamoeba dispar
CRYPNLLEGWIKYLYGRLKDPSALV

SEQ ID NO: 2519874 - protein, 19 aa, Entamoeba dispar
CSCGKWISPAFQIATSKID

SEQ ID NO: 2519875 - protein, 24 aa, Entamoeba dispar
CSDCLNIIFDTPGVHYCPICKQKI

SEQ ID NO: 2519876 - protein, 27 aa, Entamoeba dispar
CSDDGNIIFYKLSPKKVDLINKIHVSK

SEQ ID NO: 2519877 - protein, 21 aa, Entamoeba dispar
CSEWFRVMFVKYQCVYHILDL

SEQ ID NO: 2519878 - protein, 25 aa, Entamoeba dispar
CSGGSPYYIFQFISFLRGEGEEDTI

SEQ ID NO: 2519879 - protein, 20 aa, Entamoeba dispar
CSGLQLYRFGQTVSVCFWSE

SEQ ID NO: 2519880 - protein, 22 aa, Entamoeba dispar
CSHRGVGYRKLALWLKEHPNYF

SEQ ID NO: 2519881 - protein, 23 aa, Entamoeba dispar
CSIDGIITLKYIPTLNLQTNSTE

SEQ ID NO: 2519882 - protein, 30 aa, Entamoeba dispar
CSIDMWSFGCVIAELLLGIPIFPGENEYNQ

SEQ ID NO: 2519883 - protein, 32 aa, Entamoeba dispar
CSIKKLRFTHPQLSFRFIEWCILNYSEIIHQC

SEQ ID NO: 2519884 - protein, 18 aa, Entamoeba dispar
CSINFPSIGFEIPSTAQS

SEQ ID NO: 2519885 - protein, 23 aa, Entamoeba dispar
CSINSYIIPLKRIIIGEFKDKTN

SEQ ID NO: 2519886 - protein, 21 aa, Entamoeba dispar
CSIQFFQLNDLWLSTVRLGGV

SEQ ID NO: 2519887 - protein, 32 aa, Entamoeba dispar
CSKGKMAHNILLPWKVYVYDGGNDVYLWIGTK

SEQ ID NO: 2519888 - protein, 22 aa, Entamoeba dispar
CSKICDYIFSPYFVDINAISSN

SEQ ID NO: 2519889 - protein, 23 aa, Entamoeba dispar
CSKLKLLLIPNTVVDLAYSSFFN

SEQ ID NO: 2519890 - protein, 24 aa, Entamoeba dispar
CSLGSFLLCHGGISPKLNMLDDIR

SEQ ID NO: 2519891 - protein, 18 aa, Entamoeba dispar
CSMAIRVIAQEPSLLQLK

SEQ ID NO: 2519892 - protein, 31 aa, Entamoeba dispar
CSNDYHSFLLNRHRRFKILGIEVPKSTTPNH

SEQ ID NO: 2519893 - protein, 28 aa, Entamoeba dispar
CSNLLSVELPPFIKLIKSHCFSNCSCLQ

SEQ ID NO: 2519894 - protein, 21 aa, Entamoeba dispar
CSPAFWKFMNLIGTKKQLKGW

SEQ ID NO: 2519895 - protein, 18 aa, Entamoeba dispar
CSPDFIHFDMDFVHKAPP

SEQ ID NO: 2519896 - protein, 17 aa, Entamoeba dispar
CSPIVLHKGLPPTWDRF

SEQ ID NO: 2519897 - protein, 23 aa, Entamoeba dispar
CSPLISINIPSSISKLGYCCFCY

SEQ ID NO: 2519898 - protein, 18 aa, Entamoeba dispar
CSPNTPMALCHYFDHYFV

SEQ ID NO: 2519899 - protein, 32 aa, Entamoeba dispar
CSQKVCMPQILKILIPYLPIQKESLSICRDIL

SEQ ID NO: 2519900 - protein, 21 aa, Entamoeba dispar
CSRLILFDPDWNPAKDKQAMA

SEQ ID NO: 2519901 - protein, 24 aa, Entamoeba dispar
CSRNFGLGTLIPWDKRYLIESLSD

SEQ ID NO: 2519902 - protein, 22 aa, Entamoeba dispar
CSSLFQFPKRLICLTKMVMTNS

SEQ ID NO: 2519903 - protein, 17 aa, Entamoeba dispar
CSSLIYLDLSYNSLQSF

SEQ ID NO: 2519904 - protein, 17 aa, Entamoeba dispar
CSSLLQTAYCRKEKRCF

SEQ ID NO: 2519905 - protein, 27 aa, Entamoeba dispar
CSTEQYCVMLYHQLLEKIKKGTPVTQM

SEQ ID NO: 2519906 - protein, 30 aa, Entamoeba dispar
CSTVKISMLLLRTYFIMLDPSLFNEDLCKK

SEQ ID NO: 2519907 - protein, 26 aa, Entamoeba dispar
CSVEILKRTLLCKGNLLILFEGNEGN

SEQ ID NO: 2519908 - protein, 26 aa, Entamoeba dispar
CSVGRIPPSPLLPIIANLAAQKQLSD

SEQ ID NO: 2519909 - protein, 24 aa, Entamoeba dispar
CSVYNKICITVGLGFDSFVVMRHG

SEQ ID NO: 2519910 - protein, 25 aa, Entamoeba dispar
CSYCYGFAAVRRFLIKNDLVCIVRG

SEQ ID NO: 2519911 - protein, 18 aa, Entamoeba dispar
CTCGLDGFINFYTISDYG

SEQ ID NO: 2519912 - protein, 21 aa, Entamoeba dispar
CTDNFIELLKKWWSDNDAHIE

SEQ ID NO: 2519913 - protein, 22 aa, Entamoeba dispar
CTEGMFLLNPQVPSLFEQTGCP

SEQ ID NO: 2519914 - protein, 28 aa, Entamoeba dispar
CTEPSDWILFYLFNCVDREQYAMSSWLK

SEQ ID NO: 2519915 - protein, 20 aa, Entamoeba dispar
CTFIKNEKKIKCEFTYNSIV

SEQ ID NO: 2519916 - protein, 21 aa, Entamoeba dispar
CTGLIDQFKVTMGHLSLIDKR

SEQ ID NO: 2519917 - protein, 17 aa, Entamoeba dispar
CTIENFWGFYEDFPNIT

SEQ ID NO: 2519918 - protein, 25 aa, Entamoeba dispar
CTINKLLIIYPCGVDIIQLPPKFVD

SEQ ID NO: 2519919 - protein, 17 aa, Entamoeba dispar
CTKFTIFHQDYIMREKR

SEQ ID NO: 2519920 - protein, 18 aa, Entamoeba dispar
CTKKMILQLLPTYYGKNG

SEQ ID NO: 2519921 - protein, 18 aa, Entamoeba dispar
CTKPSINPFPPFINETGI

SEQ ID NO: 2519922 - protein, 27 aa, Entamoeba dispar
CTLPNKSWSIFIPKGTIGKQISGEPYN

SEQ ID NO: 2519923 - protein, 21 aa, Entamoeba dispar
CTLTIHWQFDVTLRGLRKVLV

SEQ ID NO: 2519924 - protein, 21 aa, Entamoeba dispar
CTMTKIGLPVPQGFVITTEMC

SEQ ID NO: 2519925 - protein, 26 aa, Entamoeba dispar
CTNKTWKQYIEWLKEKDLIIEINESV

SEQ ID NO: 2519926 - protein, 32 aa, Entamoeba dispar
CTNMEQLLIFLYPLFFDLYRSPTLSSSMKQRM

SEQ ID NO: 2519927 - protein, 23 aa, Entamoeba dispar
CTPLPLCVRVNQKSKYRDLLQTL

SEQ ID NO: 2519928 - protein, 23 aa, Entamoeba dispar
CTQDVYLFKPYMDKIFENMNPLT

SEQ ID NO: 2519929 - protein, 24 aa, Entamoeba dispar
CTRILYLIICITPVQYRLHIISKL

SEQ ID NO: 2519930 - protein, 19 aa, Entamoeba dispar
CTSLQRIQLPLGIDIIEDE

SEQ ID NO: 2519931 - protein, 20 aa, Entamoeba dispar
CTSLTSVYIPTSLTALCDSA

SEQ ID NO: 2519932 - protein, 17 aa, Entamoeba dispar
CTWDYNLNCKTLTSLCI

SEQ ID NO: 2519933 - protein, 18 aa, Entamoeba dispar
CTYCLPVIKKEKIINLIV

SEQ ID NO: 2519934 - protein, 30 aa, Entamoeba dispar
CVAPRAAEIIWLLCFMNYVSKQNVSTTRDA

SEQ ID NO: 2519935 - protein, 26 aa, Entamoeba dispar
CVCIHQSIVFLMKLTELLNIAFMRNE

SEQ ID NO: 2519936 - protein, 28 aa, Entamoeba dispar
CVDSDYLIKSYLDDFKKWTGKSQYQIIY

SEQ ID NO: 2519937 - protein, 26 aa, Entamoeba dispar
CVDVTDIPLLTFARAIGDLLTSYQNL

SEQ ID NO: 2519938 - protein, 34 aa, Entamoeba dispar
CVECYKHLCLTLGTPQQFISNKARWKCFVCSCCE

SEQ ID NO: 2519939 - protein, 18 aa, Entamoeba dispar
CVEDLKFIDWKCIVGKLT

SEQ ID NO: 2519940 - protein, 24 aa, Entamoeba dispar
CVFNIFIQFNLFKQMKEIYKYAKE

SEQ ID NO: 2519941 - protein, 27 aa, Entamoeba dispar
CVFNRFETNSLFYKFDNSLANFIVSAD

SEQ ID NO: 2519942 - protein, 31 aa, Entamoeba dispar
CVFTTLTEWVFSPSFIFFKALSPEVTVDLLN

SEQ ID NO: 2519943 - protein, 17 aa, Entamoeba dispar
CVGFNVGIEEFWRRYDD

SEQ ID NO: 2519944 - protein, 24 aa, Entamoeba dispar
CVGHKIVYDIVPTPIGIEIIGGIF

SEQ ID NO: 2519945 - protein, 27 aa, Entamoeba dispar
CVIGSFYGYITYPPAPAMLFMNVDGNE

SEQ ID NO: 2519946 - protein, 20 aa, Entamoeba dispar
CVIRDYPLMIEINCPSIHNT

SEQ ID NO: 2519947 - protein, 24 aa, Entamoeba dispar
CVIVKHIDIIDLIFEKIKRFKKDN

SEQ ID NO: 2519948 - protein, 26 aa, Entamoeba dispar
CVKEDFKVMIPFLMKFKTTKTEVIKT

SEQ ID NO: 2519949 - protein, 20 aa, Entamoeba dispar
CVKLQIWDTAGQERFATLTG

SEQ ID NO: 2519950 - protein, 17 aa, Entamoeba dispar
CVLAVGGTCYIPLVRKS

SEQ ID NO: 2519951 - protein, 18 aa, Entamoeba dispar
CVLHIIRKDTKMICGGGC

SEQ ID NO: 2519952 - protein, 17 aa, Entamoeba dispar
CVLIYDTPDKRIVPFVN

SEQ ID NO: 2519953 - protein, 40 aa, Entamoeba dispar
CVLLHFSSVPTNIIPILCYNFYFQVYPIHPEYTYAHGFTS

SEQ ID NO: 2519954 - protein, 20 aa, Entamoeba dispar
CVLPQFIRQIPSALVNIINN

SEQ ID NO: 2519955 - protein, 20 aa, Entamoeba dispar
CVLYQLVSAITYLHKNNIAH

SEQ ID NO: 2519956 - protein, 17 aa, Entamoeba dispar
CVNPIRSRYCGNVGDVV

SEQ ID NO: 2519957 - protein, 27 aa, Entamoeba dispar
CVQKKILRAFLINEHNLIKLAAAKSNL

SEQ ID NO: 2519958 - protein, 17 aa, Entamoeba dispar
CVSFLPEQLIEVVIQNM

SEQ ID NO: 2519959 - protein, 23 aa, Entamoeba dispar
CVTNSPQLLIPFARDIYLALVQK

SEQ ID NO: 2519960 - protein, 27 aa, Entamoeba dispar
CVVKRIFDIAFYFKSNALRLNTTTYID

SEQ ID NO: 2519961 - protein, 17 aa, Entamoeba dispar
CVVTTFYRGSDCCVLCF

SEQ ID NO: 2519962 - protein, 19 aa, Entamoeba dispar
CVYHIKWQIPAICKHQSFV

SEQ ID NO: 2519963 - protein, 17 aa, Entamoeba dispar
CWAIGLDPKRSAEISVR

SEQ ID NO: 2519964 - protein, 19 aa, Entamoeba dispar
CWKELLIVPSEVVDPSSFG

SEQ ID NO: 2519965 - protein, 18 aa, Entamoeba dispar
CWLCEKGIESINFFSGGI

SEQ ID NO: 2519966 - protein, 18 aa, Entamoeba dispar
CWLVIQDKRYSVWAVLLF

SEQ ID NO: 2519967 - protein, 17 aa, Entamoeba dispar
CWPAKLFVQKIFTACNR

SEQ ID NO: 2519968 - protein, 19 aa, Entamoeba dispar
CWQKNFEFIGYNYIVKKPK

SEQ ID NO: 2519969 - protein, 26 aa, Entamoeba dispar
CWSVGCVLYCLITGNFYKLSYNKTIF

SEQ ID NO: 2519970 - protein, 26 aa, Entamoeba dispar
CYAHSDLITSLLFYQSGNSFISTSMD

SEQ ID NO: 2519971 - protein, 17 aa, Entamoeba dispar
CYASGYYSYKWAEILEA

SEQ ID NO: 2519972 - protein, 18 aa, Entamoeba dispar
CYCYSLTSIIIPSSVIKL

SEQ ID NO: 2519973 - protein, 20 aa, Entamoeba dispar
CYDCKITFSRFFFTSNKQKT

SEQ ID NO: 2519974 - protein, 26 aa, Entamoeba dispar
CYDEKFNVFIVITKLTVENYPSTTSF

SEQ ID NO: 2519975 - protein, 25 aa, Entamoeba dispar
CYDKQQRILECVNILSSIALNNKVT

SEQ ID NO: 2519976 - protein, 21 aa, Entamoeba dispar
CYEQIIEIKRLLPSQWKIVLD

SEQ ID NO: 2519977 - protein, 18 aa, Entamoeba dispar
CYFCNFVAAVSFITQMNE

SEQ ID NO: 2519978 - protein, 30 aa, Entamoeba dispar
CYFDCHIFNVYLMNNLYLLATKNKSTKCGQ

SEQ ID NO: 2519979 - protein, 25 aa, Entamoeba dispar
CYGAKLMVPGLLRYSKGITMNEVVV

SEQ ID NO: 2519980 - protein, 18 aa, Entamoeba dispar
CYGEFPIYYTKTSVPICI

SEQ ID NO: 2519981 - protein, 24 aa, Entamoeba dispar
CYGNELIGLLLPFLSEQLKSTEWK

SEQ ID NO: 2519982 - protein, 17 aa, Entamoeba dispar
CYILKPSAYGIWENIQH

SEQ ID NO: 2519983 - protein, 32 aa, Entamoeba dispar
CYKKYTPIMFNGFWEFLKEFKRRGGIICICSH

SEQ ID NO: 2519984 - protein, 28 aa, Entamoeba dispar
CYKTCCYPCRVPFFISNFTARGCSCISL

SEQ ID NO: 2519985 - protein, 28 aa, Entamoeba dispar
CYKTCCYPCRVPFFISNFTARGCSCISS

SEQ ID NO: 2519986 - protein, 30 aa, Entamoeba dispar
CYLINCVQIPYCYYNLNLIGGILPNDYYKG

SEQ ID NO: 2519987 - protein, 20 aa, Entamoeba dispar
CYLLKQIKPAQLTKLVLCGC

SEQ ID NO: 2519988 - protein, 19 aa, Entamoeba dispar
CYNGYQLQNKKCILYKEPC

SEQ ID NO: 2519989 - protein, 18 aa, Entamoeba dispar
CYPNTVAAWRQGVEMPLN

SEQ ID NO: 2519990 - protein, 21 aa, Entamoeba dispar
CYQDIKTSYFEKLNIEMPKEN

SEQ ID NO: 2519991 - protein, 17 aa, Entamoeba dispar
CYRLFTENTFKYELLES

SEQ ID NO: 2519992 - protein, 20 aa, Entamoeba dispar
CYVKYFRKYSISTNPLLDGF

SEQ ID NO: 2519993 - protein, 17 aa, Entamoeba dispar
CYVPNYYFKLYENPSRI

SEQ ID NO: 2519994 - protein, 31 aa, Entamoeba dispar
DACSLYPSAMKRLLIPTGYPKMITQPIQFIF

SEQ ID NO: 2519995 - protein, 26 aa, Entamoeba dispar
DADEFIRLIQWSISTCFYKLDDERSW

SEQ ID NO: 2519996 - protein, 19 aa, Entamoeba dispar
DAEGVPSMLFSTIKKCPLT

SEQ ID NO: 2519997 - protein, 27 aa, Entamoeba dispar
DAEIFKLKAEIEKLKYENSRLKDDLEQ

SEQ ID NO: 2519998 - protein, 35 aa, Entamoeba dispar
DAEKYGNKLILGLLYTLYRIYRMNPVDLVGTENGK

SEQ ID NO: 2519999 - protein, 38 aa, Entamoeba dispar
DAEPYQPRRGFFSSLYQLIFHPIKFFTPTEKKVGEVKL

SEQ ID NO: 2520000 - protein, 33 aa, Entamoeba dispar
DAFEKSEINFVWLYEAYFIHMSFHTEQDFINQY

SEQ ID NO: 2520001 - protein, 18 aa, Entamoeba dispar
DAFIVMYSVTNKDSFLHL

SEQ ID NO: 2520002 - protein, 24 aa, Entamoeba dispar
DAGQTYFDIISEKTTYRLENFPED

SEQ ID NO: 2520003 - protein, 19 aa, Entamoeba dispar
DAIAAFWWDDFCDGDLEDL

SEQ ID NO: 2520004 - protein, 26 aa, Entamoeba dispar
DAILRRFSRRILVDLPTKEDRENILK

SEQ ID NO: 2520005 - protein, 34 aa, Entamoeba dispar
DAIPQVVFNLCWWIYTYGYLVEGIFRVSGNSDFT

SEQ ID NO: 2520006 - protein, 23 aa, Entamoeba dispar
DAISSLCGLLLLEGLPKPDIHDV

SEQ ID NO: 2520007 - protein, 23 aa, Entamoeba dispar
DAKFNIYFNYWDDNFRSLVSEIK

SEQ ID NO: 2520008 - protein, 30 aa, Entamoeba dispar
DAKLPSQLVGGILFLRVLSSFIATPDTNNL

SEQ ID NO: 2520009 - protein, 36 aa, Entamoeba dispar
DAKTAFKRLVYSRYRGIPLYLEWAPEKVFDEEKLNK

SEQ ID NO: 2520010 - protein, 21 aa, Entamoeba dispar
DAKVCILSCPFEPPKTKTTTN

SEQ ID NO: 2520011 - protein, 20 aa, Entamoeba dispar
DALCVIPKVLAQNAAKDASE

SEQ ID NO: 2520012 - protein, 17 aa, Entamoeba dispar
DALCVVRSLVKCKYLCP

SEQ ID NO: 2520013 - protein, 19 aa, Entamoeba dispar
DALESVLIGGLRKVAGDEV

SEQ ID NO: 2520014 - protein, 20 aa, Entamoeba dispar
DALFAIQQKLFHNKLTIVIL

SEQ ID NO: 2520015 - protein, 22 aa, Entamoeba dispar
DALILVYNHFIKEGLIKSAETL

SEQ ID NO: 2520016 - protein, 18 aa, Entamoeba dispar
DALINLSRIYWDIRTPQT

SEQ ID NO: 2520017 - protein, 20 aa, Entamoeba dispar
DALLAVPHALAENSGLNAIE

SEQ ID NO: 2520018 - protein, 17 aa, Entamoeba dispar
DALLFRHQSEDLIKINE

SEQ ID NO: 2520019 - protein, 20 aa, Entamoeba dispar
DALQFAYYRTISGDEESRRV

SEQ ID NO: 2520020 - protein, 24 aa, Entamoeba dispar
DALSAYCRYLPPAGTLFQPLVASL

SEQ ID NO: 2520021 - protein, 21 aa, Entamoeba dispar
DALVKIKLSFRPGAVDAEKAV

SEQ ID NO: 2520022 - protein, 25 aa, Entamoeba dispar
DAMDDAELIMFLPQLIQALKFELHH

SEQ ID NO: 2520023 - protein, 21 aa, Entamoeba dispar
DAMKIEIEKWKKIAQNNAKIE

SEQ ID NO: 2520024 - protein, 19 aa, Entamoeba dispar
DAMRFALLAYMTQGHDINL

SEQ ID NO: 2520025 - protein, 26 aa, Entamoeba dispar
DANDEQLLLLLLKTTLKLCNFDYRTN

SEQ ID NO: 2520026 - protein, 18 aa, Entamoeba dispar
DANKITLFKTGCSHIFIN

SEQ ID NO: 2520027 - protein, 22 aa, Entamoeba dispar
DANLTVLMMQLIHTATVISNNI

SEQ ID NO: 2520028 - protein, 20 aa, Entamoeba dispar
DANSIYINPILQGELDIYSG

SEQ ID NO: 2520029 - protein, 28 aa, Entamoeba dispar
DANWENVYSIQFLLINYPSDLPNVNTFI

SEQ ID NO: 2520030 - protein, 29 aa, Entamoeba dispar
DAPELISKYFTKLLPCILMVIQKIIQQQQ

SEQ ID NO: 2520031 - protein, 35 aa, Entamoeba dispar
DAQIPLGLEKALKYLFLNGLNKEGLFRLSSTPDKL

SEQ ID NO: 2520032 - protein, 18 aa, Entamoeba dispar
DAQKLLKIAQRSSASMGN

SEQ ID NO: 2520033 - protein, 18 aa, Entamoeba dispar
DASFFFIGKARLMLFKDL

SEQ ID NO: 2520034 - protein, 24 aa, Entamoeba dispar
DATAILLTIMSKKVDLVAITCVVG

SEQ ID NO: 2520035 - protein, 23 aa, Entamoeba dispar
DATEFYLLLIDHLHEAIIGKGKN

SEQ ID NO: 2520036 - protein, 24 aa, Entamoeba dispar
DATIQNSLLPISLQSICFRHCCGD

SEQ ID NO: 2520037 - protein, 17 aa, Entamoeba dispar
DATLLACKLAGIKNVSL

SEQ ID NO: 2520038 - protein, 21 aa, Entamoeba dispar
DATPIYRIVVLTHSDLPDDDD

SEQ ID NO: 2520039 - protein, 26 aa, Entamoeba dispar
DATVVDFICSFGRILEILILNKEMIE

SEQ ID NO: 2520040 - protein, 25 aa, Entamoeba dispar
DAVDKFKVYKIPLPPTIEMPSQSSN

SEQ ID NO: 2520041 - protein, 33 aa, Entamoeba dispar
DAVLLKMVEWLRMKSRILFSFMSLGYFQEMDMM

SEQ ID NO: 2520042 - protein, 24 aa, Entamoeba dispar
DAYSDVFDWAMKRISAFTHNIVYH

SEQ ID NO: 2520043 - protein, 61 aa, Entamoeba dispar
DAYTQSELCIAALKFAVTFLKKGGWFISKVFRSQDYYAILFVFEKFFKSVIATKPPASRNT

SEQ ID NO: 2520044 - protein, 41 aa, Entamoeba dispar
DCADCIFYFNRIKLPTEFLPYAFNWLLQFTSVPDQDAYHAI

SEQ ID NO: 2520045 - protein, 19 aa, Entamoeba dispar
DCDTQHLEYLWSLLKGINS

SEQ ID NO: 2520046 - protein, 23 aa, Entamoeba dispar
DCEIALICFNSTNNKIFVYSSGD

SEQ ID NO: 2520047 - protein, 17 aa, Entamoeba dispar
DCENEMFLWLGNKCQVK

SEQ ID NO: 2520048 - protein, 25 aa, Entamoeba dispar
DCESLKNLIFPKNLQILKISYCTQV

SEQ ID NO: 2520049 - protein, 19 aa, Entamoeba dispar
DCFKECTSLRLVKINSPSV

SEQ ID NO: 2520050 - protein, 22 aa, Entamoeba dispar
DCFKKFFVFDDGYSSLKEVGIN

SEQ ID NO: 2520051 - protein, 17 aa, Entamoeba dispar
DCFNYSLPTLMESIVTV

SEQ ID NO: 2520052 - protein, 26 aa, Entamoeba dispar
DCHQQSFLIGLLISIGYSITIKKPHK

SEQ ID NO: 2520053 - protein, 19 aa, Entamoeba dispar
DCHTIFIDILASLMYLPDS

SEQ ID NO: 2520054 - protein, 19 aa, Entamoeba dispar
DCITPTLLLAPEFIKRLLD

SEQ ID NO: 2520055 - protein, 31 aa, Entamoeba dispar
DCKADLFTFALLITKLWTGKLPYSPKVTLRS

SEQ ID NO: 2520056 - protein, 18 aa, Entamoeba dispar
DCKEGYGLKFWLRILHCC

SEQ ID NO: 2520057 - protein, 23 aa, Entamoeba dispar
DCKLISCGLLKMKLKKRDVMERT

SEQ ID NO: 2520058 - protein, 24 aa, Entamoeba dispar
DCLDIIVGWWQQRSPMRLEKLIGH

SEQ ID NO: 2520059 - protein, 20 aa, Entamoeba dispar
DCLDILIDSELWDLRMLKLK

SEQ ID NO: 2520060 - protein, 25 aa, Entamoeba dispar
DCLNQYNPILPNPILFSVIKVMESI

SEQ ID NO: 2520061 - protein, 27 aa, Entamoeba dispar
DCNMKIKLLPYHSLPFAWNNPIKERKL

SEQ ID NO: 2520062 - protein, 21 aa, Entamoeba dispar
DCNRIRFIPSTSFIVTQQSLI

SEQ ID NO: 2520063 - protein, 23 aa, Entamoeba dispar
DCNSVFLKDKLVWMGPCDQNNGK

SEQ ID NO: 2520064 - protein, 23 aa, Entamoeba dispar
DCRELIPEWLGFIKGVVDSEDLP

SEQ ID NO: 2520065 - protein, 22 aa, Entamoeba dispar
DCRLFHYSLRECKVKKIIGTGH

SEQ ID NO: 2520066 - protein, 25 aa, Entamoeba dispar
DCSHEHDPFISLNRWSEEKIKKEKK

SEQ ID NO: 2520067 - protein, 30 aa, Entamoeba dispar
DCSVGRIPPSPLLPIIANLAAQKQLSDIKI

SEQ ID NO: 2520068 - protein, 25 aa, Entamoeba dispar
DCTGLAVRAALLNTLIPIVNVISGD

SEQ ID NO: 2520069 - protein, 17 aa, Entamoeba dispar
DCTLDPIWNEKFDVKYN

SEQ ID NO: 2520070 - protein, 26 aa, Entamoeba dispar
DCVQPFPPFLVPSHTQPILPVLAHGP

SEQ ID NO: 2520071 - protein, 24 aa, Entamoeba dispar
DCWISLWLRSIDNELLFIKKKRVM

SEQ ID NO: 2520072 - protein, 26 aa, Entamoeba dispar
DCWSCGVVIYSLLYGTFPFAGEDQEL

SEQ ID NO: 2520073 - protein, 22 aa, Entamoeba dispar
DCYEALKTIYKSSLSLLQTAAS

SEQ ID NO: 2520074 - protein, 24 aa, Entamoeba dispar
DCYRTIYQLIGHIFNDKRDELMAT

SEQ ID NO: 2520075 - protein, 23 aa, Entamoeba dispar
DDAKTDIFLCIVLKYIYDNCWPK

SEQ ID NO: 2520076 - protein, 23 aa, Entamoeba dispar
DDALDVIEIFKIASLTGLGGISN

SEQ ID NO: 2520077 - protein, 25 aa, Entamoeba dispar
DDATLQIFIQNLVSAKLEFAKTQCF

SEQ ID NO: 2520078 - protein, 21 aa, Entamoeba dispar
DDAYLFLTNLLDILNEDNKIP

SEQ ID NO: 2520079 - protein, 35 aa, Entamoeba dispar
DDDDGVGALLKKKKEERAKRDAEFAKLTGGDVDNK

SEQ ID NO: 2520080 - protein, 18 aa, Entamoeba dispar
DDDFYGYVTWINCLTNEN

SEQ ID NO: 2520081 - protein, 29 aa, Entamoeba dispar
DDDIKDGFTQMFWQLGMKSFDEFIEKLIK

SEQ ID NO: 2520082 - protein, 17 aa, Entamoeba dispar
DDDIYCCRYYDREIREI

SEQ ID NO: 2520083 - protein, 23 aa, Entamoeba dispar
DDDRLIPVFGFGDSKTQDDTVFD

SEQ ID NO: 2520084 - protein, 30 aa, Entamoeba dispar
DDEDIAAALAKKRAERAKKFAISDSDDDDD

SEQ ID NO: 2520085 - protein, 30 aa, Entamoeba dispar
DDEDIAAALAKKRAERAKKFAISDSDDDDE

SEQ ID NO: 2520086 - protein, 24 aa, Entamoeba dispar
DDEDIEFPMYFVDSVPFEGSNNSR

SEQ ID NO: 2520087 - protein, 20 aa, Entamoeba dispar
DDEKLKEKIAKRKQEVAAAR

SEQ ID NO: 2520088 - protein, 29 aa, Entamoeba dispar
DDENLTDLRFLLFPCHYETHWFTIIVCNK

SEQ ID NO: 2520089 - protein, 24 aa, Entamoeba dispar
DDFIKKLINLPRKSLDNSKEVLKR

SEQ ID NO: 2520090 - protein, 22 aa, Entamoeba dispar
DDFIKQSLLLLFRSICIDEKIE

SEQ ID NO: 2520091 - protein, 17 aa, Entamoeba dispar
DDFLLRYGKDQFDPLKQ

SEQ ID NO: 2520092 - protein, 31 aa, Entamoeba dispar
DDFLNDPTLIKLFLQNGMFKEFFEKHPEMED

SEQ ID NO: 2520093 - protein, 20 aa, Entamoeba dispar
DDFLPYLDIFIPELKKNITD

SEQ ID NO: 2520094 - protein, 23 aa, Entamoeba dispar
DDFYDKIFNQIDDLKLKLEIQRQ

SEQ ID NO: 2520095 - protein, 22 aa, Entamoeba dispar
DDGIIFKHVIWYQVDYSTYLKE

SEQ ID NO: 2520096 - protein, 31 aa, Entamoeba dispar
DDGIKWLTMTYYYICILRSPLLYGLQPNDFT

SEQ ID NO: 2520097 - protein, 27 aa, Entamoeba dispar
DDGKIFKEIIWYLIDYSTYLKEKEQGN

SEQ ID NO: 2520098 - protein, 28 aa, Entamoeba dispar
DDGKIFKKIIWYKVEYWRYLFEKKQGNI

SEQ ID NO: 2520099 - protein, 20 aa, Entamoeba dispar
DDGQYFLLGYQNGSVDLFQS

SEQ ID NO: 2520100 - protein, 24 aa, Entamoeba dispar
DDGRIFKEIIWYTVDYSTYLKEKE

SEQ ID NO: 2520101 - protein, 26 aa, Entamoeba dispar
DDGRIFKTIIWYKVDYSTYFQEKGTG

SEQ ID NO: 2520102 - protein, 18 aa, Entamoeba dispar
DDGTLPPVPPKPRSGLMN

SEQ ID NO: 2520103 - protein, 22 aa, Entamoeba dispar
DDGYLWVAMEYMDGGCLTDLLN

SEQ ID NO: 2520104 - protein, 23 aa, Entamoeba dispar
DDHLIQFLFCSYLSNRFSEFNEK

SEQ ID NO: 2520105 - protein, 17 aa, Entamoeba dispar
DDHNVHGVIPYVLNVDT

SEQ ID NO: 2520106 - protein, 21 aa, Entamoeba dispar
DDIHHPLFQTKIKTTQDIIHN

SEQ ID NO: 2520107 - protein, 20 aa, Entamoeba dispar
DDIIFDPKKDWTFDSLSTCF

SEQ ID NO: 2520108 - protein, 28 aa, Entamoeba dispar
DDIKDGFTQMFWELGMKSFDEFIEKLKK

SEQ ID NO: 2520109 - protein, 22 aa, Entamoeba dispar
DDIKPAVKKTTTKKFSISDSDD

SEQ ID NO: 2520110 - protein, 19 aa, Entamoeba dispar
DDILFVTVHPTFNNPFIIV

SEQ ID NO: 2520111 - protein, 23 aa, Entamoeba dispar
DDIMNTLLFHLQIKDSLAVHSLL

SEQ ID NO: 2520112 - protein, 24 aa, Entamoeba dispar
DDINKFLWMIRIGAGVNPSLNENN

SEQ ID NO: 2520113 - protein, 17 aa, Entamoeba dispar
DDIRGWCDEIFKAESDV

SEQ ID NO: 2520114 - protein, 28 aa, Entamoeba dispar
DDISNLIKLWFRELPRPILNVLSCDQIF

SEQ ID NO: 2520115 - protein, 23 aa, Entamoeba dispar
DDKKKLFNKLKEDIKKIGGKLKG

SEQ ID NO: 2520116 - protein, 28 aa, Entamoeba dispar
DDKNVKGIITWFSLHNCQTRFEGTRKEN

SEQ ID NO: 2520117 - protein, 25 aa, Entamoeba dispar
DDLAIQIRKLSKKSITMLGGAYTAL

SEQ ID NO: 2520118 - protein, 29 aa, Entamoeba dispar
DDLHFECVSILLLDLHKFIQKKTTIGLYN

SEQ ID NO: 2520119 - protein, 17 aa, Entamoeba dispar
DDLLVSMQPMMSAMGTM

SEQ ID NO: 2520120 - protein, 32 aa, Entamoeba dispar
DDLQRLCEILGKPEYFIFGRILIGEYRVELKE

SEQ ID NO: 2520121 - protein, 27 aa, Entamoeba dispar
DDLRLMLQIAKYGIGVYELYLNDSLLD

SEQ ID NO: 2520122 - protein, 25 aa, Entamoeba dispar
DDLYKKILFSVIPIERIQTHQSLII

SEQ ID NO: 2520123 - protein, 32 aa, Entamoeba dispar
DDMARSLQALRNLSTQLKIVCSVKAATVGKGD

SEQ ID NO: 2520124 - protein, 28 aa, Entamoeba dispar
DDMESLAYSIIYLLKGTLPWQGLHVGKG

SEQ ID NO: 2520125 - protein, 25 aa, Entamoeba dispar
DDMKWKLEILLILKVKNDTFDSNDI

SEQ ID NO: 2520126 - protein, 21 aa, Entamoeba dispar
DDMVRYWVNKMALVSKTLGVF

SEQ ID NO: 2520127 - protein, 27 aa, Entamoeba dispar
DDNGRKFATPFFLLKKAFECCVIKSQF

SEQ ID NO: 2520128 - protein, 23 aa, Entamoeba dispar
DDNIKWIFELAMKFIELEDIQNA

SEQ ID NO: 2520129 - protein, 30 aa, Entamoeba dispar
DDNKKRILMELLWPIIKYRSSNELIEAVTS

SEQ ID NO: 2520130 - protein, 19 aa, Entamoeba dispar
DDNKLILLENFFGLICTSW

SEQ ID NO: 2520131 - protein, 21 aa, Entamoeba dispar
DDNKNYHCWSHRVWVCNKFNC

SEQ ID NO: 2520132 - protein, 35 aa, Entamoeba dispar
DDNLLVIEMKKWMKLYKLDLRIIRALYDLGFINPT

SEQ ID NO: 2520133 - protein, 23 aa, Entamoeba dispar
DDNLTALTLSKYLEKMDLNAFNG

SEQ ID NO: 2520134 - protein, 24 aa, Entamoeba dispar
DDNLTKYWKYWTDNLPTKTSKPPL

SEQ ID NO: 2520135 - protein, 29 aa, Entamoeba dispar
DDNSIQSLLTLKYLKKFKLFDGAIPTLSF

SEQ ID NO: 2520136 - protein, 37 aa, Entamoeba dispar
DDPSSPIPHLLLSPLAFVLPMTIFPNMTITKTTPSIF

SEQ ID NO: 2520137 - protein, 27 aa, Entamoeba dispar
DDPTIVMMCLWIMMLKQKNIGSSNIRK

SEQ ID NO: 2520138 - protein, 23 aa, Entamoeba dispar
DDPTLPTYYFDSLLNPIEWKNDC

SEQ ID NO: 2520139 - protein, 17 aa, Entamoeba dispar
DDQHVLLNRLKIITKIN

SEQ ID NO: 2520140 - protein, 22 aa, Entamoeba dispar
DDQLVPALVYRLTHKSTYLTED

SEQ ID NO: 2520141 - protein, 17 aa, Entamoeba dispar
DDRKNMYLVFPNGTEKI

SEQ ID NO: 2520142 - protein, 19 aa, Entamoeba dispar
DDRPNVCGLILAGIADFKT

SEQ ID NO: 2520143 - protein, 29 aa, Entamoeba dispar
DDRTIRIWNWMSRQCILILPGHEHYVMSA

SEQ ID NO: 2520144 - protein, 27 aa, Entamoeba dispar
DDRTIRIWNYLSFKCIAILTGHDHYVL

SEQ ID NO: 2520145 - protein, 25 aa, Entamoeba dispar
DDSDYYITGLLKIANLLLPKVEIVP

SEQ ID NO: 2520146 - protein, 27 aa, Entamoeba dispar
DDSFKMNISTVMPIFQTGITADITLNG

SEQ ID NO: 2520147 - protein, 23 aa, Entamoeba dispar
DDSLYIIIPVFLELLGEQVSVGL

SEQ ID NO: 2520148 - protein, 25 aa, Entamoeba dispar
DDSQCLLLFRKGLSQGILDLCIASI

SEQ ID NO: 2520149 - protein, 26 aa, Entamoeba dispar
DDTEGLMTALLKYLKKTTSLKNLILE

SEQ ID NO: 2520150 - protein, 23 aa, Entamoeba dispar
DDTEYWLKEQAVISLNRLMKTHR

SEQ ID NO: 2520151 - protein, 23 aa, Entamoeba dispar
DDTKKYYNYLQKKSWNIKLHVKG

SEQ ID NO: 2520152 - protein, 25 aa, Entamoeba dispar
DDTMLKIFFSKYPSVQKVKVVVNPH

SEQ ID NO: 2520153 - protein, 20 aa, Entamoeba dispar
DDTRLWAMLQAVSGGTWTGC

SEQ ID NO: 2520154 - protein, 25 aa, Entamoeba dispar
DDTTSLYQYLLTQLMQLQKQNVETQ

SEQ ID NO: 2520155 - protein, 20 aa, Entamoeba dispar
DDVKLTVIILNKIDIQHNNN

SEQ ID NO: 2520156 - protein, 25 aa, Entamoeba dispar
DDVKRLTHFACLYSKLIGANTELFE

SEQ ID NO: 2520157 - protein, 18 aa, Entamoeba dispar
DDVKTHIQLLRVTPKKRK

SEQ ID NO: 2520158 - protein, 23 aa, Entamoeba dispar
DDVTGCVFLKFTDNYKQHRVIRT

SEQ ID NO: 2520159 - protein, 22 aa, Entamoeba dispar
DDWKKPLIDCLIANGFTTEPQK

SEQ ID NO: 2520160 - protein, 20 aa, Entamoeba dispar
DDYELFSIFVQLIELMSSIF

SEQ ID NO: 2520161 - protein, 21 aa, Entamoeba dispar
DDYIPCLLQIIATPQYKPLQQ

SEQ ID NO: 2520162 - protein, 26 aa, Entamoeba dispar
DDYIPFAEIPPKKMCLTPTAQSQVSL

SEQ ID NO: 2520163 - protein, 24 aa, Entamoeba dispar
DDYLKGVPLLIFANKHDLPRAKSV

SEQ ID NO: 2520164 - protein, 22 aa, Entamoeba dispar
DDYYDLWCDFKNYLENNQIPDI

SEQ ID NO: 2520165 - protein, 24 aa, Entamoeba dispar
DEADRMFDMGFGPQIKRIIEGIRP

SEQ ID NO: 2520166 - protein, 27 aa, Entamoeba dispar
DEARYFLADFRYILQVINILPAHVSSQ

SEQ ID NO: 2520167 - protein, 17 aa, Entamoeba dispar
DEAYLSQNKPTQLQLSN

SEQ ID NO: 2520168 - protein, 18 aa, Entamoeba dispar
DECENCQFIIDKNQIKEM

SEQ ID NO: 2520169 - protein, 35 aa, Entamoeba dispar
DECVSPRRRPVYGGSPMPCMMIAEELNKRNKREST

SEQ ID NO: 2520170 - protein, 34 aa, Entamoeba dispar
DECYNPFTKIKLFNIIWELINLFGKIDFGINQST

SEQ ID NO: 2520171 - protein, 31 aa, Entamoeba dispar
DEDDRKSLFISIALAIKLALNTKVSNDLSIT

SEQ ID NO: 2520172 - protein, 26 aa, Entamoeba dispar
DEDEHKGFCFLKYKDPRSCVLAIDNF

SEQ ID NO: 2520173 - protein, 25 aa, Entamoeba dispar
DEDFNRYWDVFTGEKGFETLAPEDK

SEQ ID NO: 2520174 - protein, 23 aa, Entamoeba dispar
DEDILFKVLTLLKTFYSINDDKR

SEQ ID NO: 2520175 - protein, 26 aa, Entamoeba dispar
DEDIPLELMRILRIVNLSIIESNQYF

SEQ ID NO: 2520176 - protein, 19 aa, Entamoeba dispar
DEDLEILDILLAIDSKESE

SEQ ID NO: 2520177 - protein, 28 aa, Entamoeba dispar
DEDQLIPNLFRYILPWETEFKDSQRVWM

SEQ ID NO: 2520178 - protein, 18 aa, Entamoeba dispar
DEDQLIVIDNWGSSIFSI

SEQ ID NO: 2520179 - protein, 24 aa, Entamoeba dispar
DEDQPKMFMPRRFTTRRQKEKIII

SEQ ID NO: 2520180 - protein, 24 aa, Entamoeba dispar
DEDSILKQYGYNLGLTVIETYRFN

SEQ ID NO: 2520181 - protein, 24 aa, Entamoeba dispar
DEDVIKLFKQLYKLMLERHSHFFK

SEQ ID NO: 2520182 - protein, 18 aa, Entamoeba dispar
DEDVNVILFCFISNIDRF

SEQ ID NO: 2520183 - protein, 35 aa, Entamoeba dispar
DEEDKKVLFNSLALGIKMVMPKEVLKIDNTMLYNE

SEQ ID NO: 2520184 - protein, 26 aa, Entamoeba dispar
DEEEFEYDWEFAGQKIKLTGTEAEIM

SEQ ID NO: 2520185 - protein, 30 aa, Entamoeba dispar
DEEEIKWFMNKWYFFYFVSIDAEDNGCPRG

SEQ ID NO: 2520186 - protein, 27 aa, Entamoeba dispar
DEEHALFLEGLSLYHRDWKRIEQHVKT

SEQ ID NO: 2520187 - protein, 23 aa, Entamoeba dispar
DEEHLVIKFLRNSQPQYLQSKLV

SEQ ID NO: 2520188 - protein, 23 aa, Entamoeba dispar
DEEIKFLQIDVISVSSPSQLSRS

SEQ ID NO: 2520189 - protein, 26 aa, Entamoeba dispar
DEEIKYIYTIIKGIRSLNGIYSQAII

SEQ ID NO: 2520190 - protein, 25 aa, Entamoeba dispar
DEEKMVFILKLLKDEWNKSLQQNGE

SEQ ID NO: 2520191 - protein, 26 aa, Entamoeba dispar
DEELKLILPPFLWSVCSSSDIGKALT

SEQ ID NO: 2520192 - protein, 24 aa, Entamoeba dispar
DEEQAELILKRRKKLSLTVVSSTP

SEQ ID NO: 2520193 - protein, 25 aa, Entamoeba dispar
DEFARHTIWITYRKNMPLIKEKTTD

SEQ ID NO: 2520194 - protein, 26 aa, Entamoeba dispar
DEFARHTIWITYRKNMPLIKEKTTDS

SEQ ID NO: 2520195 - protein, 25 aa, Entamoeba dispar
DEFCHLYFLKKREMAIMLPDLYAIY

SEQ ID NO: 2520196 - protein, 23 aa, Entamoeba dispar
DEFKSVIDLVKKWKFVVVENIDI

SEQ ID NO: 2520197 - protein, 24 aa, Entamoeba dispar
DEFPSSICKCPLLKLYMDNNNISS

SEQ ID NO: 2520198 - protein, 19 aa, Entamoeba dispar
DEFRYVIFAIKIKENRLFQ

SEQ ID NO: 2520199 - protein, 17 aa, Entamoeba dispar
DEFVSSEYTYVIGLKIC

SEQ ID NO: 2520200 - protein, 28 aa, Entamoeba dispar
DEGGVVHFLDLYYDYTKQLLGGIEASIT

SEQ ID NO: 2520201 - protein, 23 aa, Entamoeba dispar
DEGIYWIIGDISMTFVPAFGGRI

SEQ ID NO: 2520202 - protein, 22 aa, Entamoeba dispar
DEGNIRIWKAFASESTKIKDKR

SEQ ID NO: 2520203 - protein, 36 aa, Entamoeba dispar
DEGPLYRFFDWIFNKSPLMMLILISNNSQYSQILHS

SEQ ID NO: 2520204 - protein, 26 aa, Entamoeba dispar
DEHEGAFIFMQLLEGMNYLHSQHIIH

SEQ ID NO: 2520205 - protein, 18 aa, Entamoeba dispar
DEHNIGLATYKAWCKKFN

SEQ ID NO: 2520206 - protein, 32 aa, Entamoeba dispar
DEHWKPLKHILKKYQIYVLDEVATIENCFINA

SEQ ID NO: 2520207 - protein, 33 aa, Entamoeba dispar
DEHWKPLKHILKKYQIYVLDEVATIENCFINAL

SEQ ID NO: 2520208 - protein, 29 aa, Entamoeba dispar
DEIFKDGKIFKYVIWYEVNYSTYLKEKEK

SEQ ID NO: 2520209 - protein, 22 aa, Entamoeba dispar
DEIFNINYLFQNQLFINSGFNN

SEQ ID NO: 2520210 - protein, 17 aa, Entamoeba dispar
DEIFVEEKKKPIVFKAK

SEQ ID NO: 2520211 - protein, 20 aa, Entamoeba dispar
DEIIISTKEITNLKNTIKQL

SEQ ID NO: 2520212 - protein, 21 aa, Entamoeba dispar
DEIKKFFGYDPKCVQLKKKYE

SEQ ID NO: 2520213 - protein, 23 aa, Entamoeba dispar
DEIKLAFFDLITPISTVIAKDLI

SEQ ID NO: 2520214 - protein, 18 aa, Entamoeba dispar
DEIKLVSIILPDGLLSIK

SEQ ID NO: 2520215 - protein, 17 aa, Entamoeba dispar
DEILLYDTPLETFQCIN

SEQ ID NO: 2520216 - protein, 28 aa, Entamoeba dispar
DEIPKRFYELMFLIAEKIKLEGFGAYSG

SEQ ID NO: 2520217 - protein, 24 aa, Entamoeba dispar
DEITEFFINYFKNIKPKLLNKNDI

SEQ ID NO: 2520218 - protein, 18 aa, Entamoeba dispar
DEITPIEKKPRQPKKIKE

SEQ ID NO: 2520219 - protein, 27 aa, Entamoeba dispar
DEIYTLFPRLSNEIIYKLLSNFHTDDM

SEQ ID NO: 2520220 - protein, 21 aa, Entamoeba dispar
DEKAKIKPWTKLAASQAKADE

SEQ ID NO: 2520221 - protein, 19 aa, Entamoeba dispar
DEKCYLAICKFTNQLYSLS

SEQ ID NO: 2520222 - protein, 17 aa, Entamoeba dispar
DEKFCVPFNNQLKVFFK

SEQ ID NO: 2520223 - protein, 27 aa, Entamoeba dispar
DEKKDIKPILNEKKPLAKPELLTKKEN

SEQ ID NO: 2520224 - protein, 22 aa, Entamoeba dispar
DEKKFIIYSKFRNILEIHNCQE

SEQ ID NO: 2520225 - protein, 23 aa, Entamoeba dispar
DEKKKWGMIKLKKRRDLMKEIYE

SEQ ID NO: 2520226 - protein, 17 aa, Entamoeba dispar
DEKLCELAKINYKQRNK

SEQ ID NO: 2520227 - protein, 22 aa, Entamoeba dispar
DEKPELFMIDQFGTLVPETYAS

SEQ ID NO: 2520228 - protein, 23 aa, Entamoeba dispar
DEKPIPFFKNIKPPFEGIPTACV

SEQ ID NO: 2520229 - protein, 23 aa, Entamoeba dispar
DEKRYIRLLCIVYRLMDVDADGF

SEQ ID NO: 2520230 - protein, 42 aa, Entamoeba dispar
DEKVKRIFHILFPYFLKQSFRRIILLLWKGIDWRNVPLDQLQ

SEQ ID NO: 2520231 - protein, 24 aa, Entamoeba dispar
DEKYDFFTNSFWDIGVTINIYIDK

SEQ ID NO: 2520232 - protein, 32 aa, Entamoeba dispar
DELAFVPLKLFYDFLIPKILNEKSLYGESFKL

SEQ ID NO: 2520233 - protein, 17 aa, Entamoeba dispar
DELDMISIIDLFARYRY

SEQ ID NO: 2520234 - protein, 30 aa, Entamoeba dispar
DELDYCIHSDTMFLFVLDSNGRFNSPTRFE

SEQ ID NO: 2520235 - protein, 25 aa, Entamoeba dispar
DELEFPLCFTVFSASLYSLNNQSGT

SEQ ID NO: 2520236 - protein, 23 aa, Entamoeba dispar
DELGKFLSVFMSISNKIPKDEQE

SEQ ID NO: 2520237 - protein, 25 aa, Entamoeba dispar
DELIKYYNDFTFFIALRNCINETTK

SEQ ID NO: 2520238 - protein, 21 aa, Entamoeba dispar
DELLPFVQDILTIIKNKKTEK

SEQ ID NO: 2520239 - protein, 25 aa, Entamoeba dispar
DELNIPIYCFLFEDTILLISSEQKQ

SEQ ID NO: 2520240 - protein, 17 aa, Entamoeba dispar
DELNMHRVFEKLGNQKT

SEQ ID NO: 2520241 - protein, 17 aa, Entamoeba dispar
DELYLIFGKEKSVLDLD

SEQ ID NO: 2520242 - protein, 35 aa, Entamoeba dispar
DEMEYYFKGIFGGYYKIIFTLVANEIFIFKNRIDS

SEQ ID NO: 2520243 - protein, 34 aa, Entamoeba dispar
DEMGMKLINYIVDSLFTIIYTMKEIPIIRTRSSS

SEQ ID NO: 2520244 - protein, 31 aa, Entamoeba dispar
DEMIFKIRFDAGVTDLIWRNQTNFLAGSYDG

SEQ ID NO: 2520245 - protein, 23 aa, Entamoeba dispar
DEMKDVFVYAWKINNCDPELQFA

SEQ ID NO: 2520246 - protein, 19 aa, Entamoeba dispar
DEMKEFIPVIIKGSISNIE

SEQ ID NO: 2520247 - protein, 17 aa, Entamoeba dispar
DEMKLIWKLRYTVKKTK

SEQ ID NO: 2520248 - protein, 18 aa, Entamoeba dispar
DEMKMHAIQFPFKSDKEF

SEQ ID NO: 2520249 - protein, 32 aa, Entamoeba dispar
DEMKWAEFEYCILFPFNVLKMKSIKIMIKYPK

SEQ ID NO: 2520250 - protein, 19 aa, Entamoeba dispar
DENAKLIWPLDPRNDTDWD

SEQ ID NO: 2520251 - protein, 25 aa, Entamoeba dispar
DENEDPMILFVQLNFEELPELENYP

SEQ ID NO: 2520252 - protein, 34 aa, Entamoeba dispar
DENKPKKPKNAYLLFSSEKYPQYKKQFPDLKISE

SEQ ID NO: 2520253 - protein, 23 aa, Entamoeba dispar
DENLLIMFKKYIQDKFKQIIITS

SEQ ID NO: 2520254 - protein, 27 aa, Entamoeba dispar
DENTLEPLMTFLINTLPNPLHTKILVE

SEQ ID NO: 2520255 - protein, 28 aa, Entamoeba dispar
DENYICIIKQIYIKIPYIKSICLINEKT

SEQ ID NO: 2520256 - protein, 20 aa, Entamoeba dispar
DENYLERIILIPMEEERIQV

SEQ ID NO: 2520257 - protein, 26 aa, Entamoeba dispar
DEPAAFAGRIYRMVKLGLSLDDKEEE

SEQ ID NO: 2520258 - protein, 20 aa, Entamoeba dispar
DEPIYIKIEKLEIMLMLVNE

SEQ ID NO: 2520259 - protein, 17 aa, Entamoeba dispar
DEPPFVHPLNISTFNDV

SEQ ID NO: 2520260 - protein, 36 aa, Entamoeba dispar
DEPPKYDLKDKTFGDLWVEFLLRESGSLDAQKPTNQ

SEQ ID NO: 2520261 - protein, 24 aa, Entamoeba dispar
DEQKKVLMRLSSRSYYMLDEILDD

SEQ ID NO: 2520262 - protein, 23 aa, Entamoeba dispar
DEQPIRFYVIKNKQFIAKVARNC

SEQ ID NO: 2520263 - protein, 25 aa, Entamoeba dispar
DEQPITMAHCFRRNKKNPEVEMKFK

SEQ ID NO: 2520264 - protein, 31 aa, Entamoeba dispar
DEQQVIQALRRSIYAGIILSSPQLLEPIYSV

SEQ ID NO: 2520265 - protein, 18 aa, Entamoeba dispar
DEQRLSVMEKWHSKTTMM

SEQ ID NO: 2520266 - protein, 24 aa, Entamoeba dispar
DEQYNYLTYFPLYVKFATTSVQHR

SEQ ID NO: 2520267 - protein, 23 aa, Entamoeba dispar
DERELSYISSLIKEDDKSHIETI

SEQ ID NO: 2520268 - protein, 28 aa, Entamoeba dispar
DERIGQYKYNWIIRNYLRAIEYSNESGN

SEQ ID NO: 2520269 - protein, 27 aa, Entamoeba dispar
DERIKELLPHKLFPGNRPTNSIVFKKM

SEQ ID NO: 2520270 - protein, 33 aa, Entamoeba dispar
DERIRSVFVKILFAQELFLPTMTSLMSRAKGEL

SEQ ID NO: 2520271 - protein, 26 aa, Entamoeba dispar
DERKRRTVDWLGDRLVEKIDRDHYMC

SEQ ID NO: 2520272 - protein, 26 aa, Entamoeba dispar
DERKTLAFIPFFTTTGHIVLSTLILK

SEQ ID NO: 2520273 - protein, 24 aa, Entamoeba dispar
DERNQILELINRAPDIKQANKALI

SEQ ID NO: 2520274 - protein, 22 aa, Entamoeba dispar
DERVMQLFGLVNDLLASNSETS

SEQ ID NO: 2520275 - protein, 23 aa, Entamoeba dispar
DESFYRCLRLNNINIPKGISKIG

SEQ ID NO: 2520276 - protein, 26 aa, Entamoeba dispar
DESIIQLILPILFKASKEINIIKIHG

SEQ ID NO: 2520277 - protein, 25 aa, Entamoeba dispar
DESKSLWLIALRNAFVRFNIATAVS

SEQ ID NO: 2520278 - protein, 26 aa, Entamoeba dispar
DESKTFLESFLDQFPSFKKWKEEIIT

SEQ ID NO: 2520279 - protein, 23 aa, Entamoeba dispar
DESLFDLLFGYEQSLLKKEININ

SEQ ID NO: 2520280 - protein, 23 aa, Entamoeba dispar
DESLLTFDLLSLINSFKSKDNLF

SEQ ID NO: 2520281 - protein, 22 aa, Entamoeba dispar
DESYIHRIGRSARFGRKGVAID

SEQ ID NO: 2520282 - protein, 23 aa, Entamoeba dispar
DESYLAPEKIKITQLATPTSTES

SEQ ID NO: 2520283 - protein, 32 aa, Entamoeba dispar
DETFYRVNNAFYLRPYLYEKKGKTWDDFNKDY

SEQ ID NO: 2520284 - protein, 24 aa, Entamoeba dispar
DETNHWFIESFGKGVYIIICSHAN

SEQ ID NO: 2520285 - protein, 25 aa, Entamoeba dispar
DETSKNIILYLQQENNRLHQLISLN

SEQ ID NO: 2520286 - protein, 18 aa, Entamoeba dispar
DEVFIKKINNDLLELRVR

SEQ ID NO: 2520287 - protein, 25 aa, Entamoeba dispar
DEVFPSLPVSLISKTLHSFRLDSYN

SEQ ID NO: 2520288 - protein, 22 aa, Entamoeba dispar
DEVILKRKIIPLETIHLPKLPE

SEQ ID NO: 2520289 - protein, 29 aa, Entamoeba dispar
DEVKEIRASLYDFLLRCFVYNPKDRLTPD

SEQ ID NO: 2520290 - protein, 21 aa, Entamoeba dispar
DEVLIQEINVNSTSPSPEGIH

SEQ ID NO: 2520291 - protein, 28 aa, Entamoeba dispar
DEVTNQISMFFAFAAPMILCLCEALNED

SEQ ID NO: 2520292 - protein, 35 aa, Entamoeba dispar
DEVVLLPLSFDIIQWLFFGIPFTKDTIISFFNPSF

SEQ ID NO: 2520293 - protein, 20 aa, Entamoeba dispar
DEVVPLISPIIQALMRVVLG

SEQ ID NO: 2520294 - protein, 24 aa, Entamoeba dispar
DEWQNLYDFITTIHLDFSNYDTTS

SEQ ID NO: 2520295 - protein, 18 aa, Entamoeba dispar
DEWYVPEAIFIVSEQQLF

SEQ ID NO: 2520296 - protein, 24 aa, Entamoeba dispar
DEYDLRRYFSQYGELKGLAIKKTD

SEQ ID NO: 2520297 - protein, 18 aa, Entamoeba dispar
DEYLPFLSYLSDSYSMLY

SEQ ID NO: 2520298 - protein, 22 aa, Entamoeba dispar
DEYQIPSFLNKSKLIYYNSEST

SEQ ID NO: 2520299 - protein, 23 aa, Entamoeba dispar
DEYRKRAHLYNEKWRKTDVNGHW

SEQ ID NO: 2520300 - protein, 23 aa, Entamoeba dispar
DEYVRNFLLSKKEIKKDSDDFQE

SEQ ID NO: 2520301 - protein, 21 aa, Entamoeba dispar
DFCFSLRSLFSKEPLMLLRKK

SEQ ID NO: 2520302 - protein, 19 aa, Entamoeba dispar
DFCGFDKPVILIYDDTIKE

SEQ ID NO: 2520303 - protein, 29 aa, Entamoeba dispar
DFCPNGIDAVWLWVNGSDPVFRKALEENG

SEQ ID NO: 2520304 - protein, 28 aa, Entamoeba dispar
DFDHKKFDIFKFTRQVATKFFDLAVSGE

SEQ ID NO: 2520305 - protein, 25 aa, Entamoeba dispar
DFDLDLYMKNAILLKFNHLPKPKDT

SEQ ID NO: 2520306 - protein, 25 aa, Entamoeba dispar
DFDPNLGYIGLPPEWERFLNEGGIT

SEQ ID NO: 2520307 - protein, 20 aa, Entamoeba dispar
DFDPRQYLGPARQALKELYL

SEQ ID NO: 2520308 - protein, 20 aa, Entamoeba dispar
DFDVLKLLGFTELKLNKINE

SEQ ID NO: 2520309 - protein, 25 aa, Entamoeba dispar
DFDYSTIDGWLLLSIPGIHKGNDLN

SEQ ID NO: 2520310 - protein, 24 aa, Entamoeba dispar
DFEALKFRPFFVGINFDKFQKKEV

SEQ ID NO: 2520311 - protein, 19 aa, Entamoeba dispar
DFEFIFRNIGEHSLLTTKE

SEQ ID NO: 2520312 - protein, 17 aa, Entamoeba dispar
DFEIYGNKKLLEVIDSK

SEQ ID NO: 2520313 - protein, 29 aa, Entamoeba dispar
DFERDIWRRDFYFWEGKKSTPLYYSQFLK

SEQ ID NO: 2520314 - protein, 26 aa, Entamoeba dispar
DFESEFPFYKEFFYRNPNVKHYLSKE

SEQ ID NO: 2520315 - protein, 20 aa, Entamoeba dispar
DFGHLRQRKSSFKKWMISSP

SEQ ID NO: 2520316 - protein, 22 aa, Entamoeba dispar
DFGKPFPKEIYKYPWDIANTIS

SEQ ID NO: 2520317 - protein, 18 aa, Entamoeba dispar
DFGVVEDYYWEKTEKDTK

SEQ ID NO: 2520318 - protein, 35 aa, Entamoeba dispar
DFHTWKKRWFVMKDQYIWYFPKNTGSAQPKGVIEL

SEQ ID NO: 2520319 - protein, 19 aa, Entamoeba dispar
DFIEFPYYSFGININKKLT

SEQ ID NO: 2520320 - protein, 19 aa, Entamoeba dispar
DFIEKLKKLPKKSLEQSRE

SEQ ID NO: 2520321 - protein, 18 aa, Entamoeba dispar
DFIELFDVTFDMFKSWKQ

SEQ ID NO: 2520322 - protein, 18 aa, Entamoeba dispar
DFIIKKKNLILRKSVLFT

SEQ ID NO: 2520323 - protein, 17 aa, Entamoeba dispar
DFILWDRHPSEALEICC

SEQ ID NO: 2520324 - protein, 17 aa, Entamoeba dispar
DFINLEIGIKRFQGNME

SEQ ID NO: 2520325 - protein, 25 aa, Entamoeba dispar
DFINVRDIFKFLSVHWDILSHLEQM

SEQ ID NO: 2520326 - protein, 19 aa, Entamoeba dispar
DFIQKLLQLDLSTSNLPYP

SEQ ID NO: 2520327 - protein, 18 aa, Entamoeba dispar
DFIRNKENVILKYPINHY

SEQ ID NO: 2520328 - protein, 20 aa, Entamoeba dispar
DFIVDLSQPLLLRCLHSLSQ

SEQ ID NO: 2520329 - protein, 18 aa, Entamoeba dispar
DFKNGQPINLYWSHGNQN

SEQ ID NO: 2520330 - protein, 26 aa, Entamoeba dispar
DFKTKHFIMFYHPYCEWCKEMRMLLI

SEQ ID NO: 2520331 - protein, 17 aa, Entamoeba dispar
DFLCVIRDYPLMIEINC

SEQ ID NO: 2520332 - protein, 18 aa, Entamoeba dispar
DFLLKWSFSSMKGVIENL

SEQ ID NO: 2520333 - protein, 17 aa, Entamoeba dispar
DFLPPRTVKPRNNGYTM

SEQ ID NO: 2520334 - protein, 18 aa, Entamoeba dispar
DFLQHYIIYDCVMVTLDA

SEQ ID NO: 2520335 - protein, 27 aa, Entamoeba dispar
DFLRFQQFTFNFPIVQPLNGYLQQLTS

SEQ ID NO: 2520336 - protein, 26 aa, Entamoeba dispar
DFLSNIFITFPNEPIIIPVRIKRSKP

SEQ ID NO: 2520337 - protein, 25 aa, Entamoeba dispar
DFMDGGKEALLPLLDQFIKQNENDT

SEQ ID NO: 2520338 - protein, 22 aa, Entamoeba dispar
DFNGFQIPKVYDGKLERKPMEL

SEQ ID NO: 2520339 - protein, 18 aa, Entamoeba dispar
DFNIFYEDIFNELAKHGE

SEQ ID NO: 2520340 - protein, 23 aa, Entamoeba dispar
DFNLQWYITCSFDRYICTPTEDE

SEQ ID NO: 2520341 - protein, 21 aa, Entamoeba dispar
DFNNFIVRRILTVPSTPLSDN

SEQ ID NO: 2520342 - protein, 20 aa, Entamoeba dispar
DFNSFTYVIGYKPSIKLIVK

SEQ ID NO: 2520343 - protein, 23 aa, Entamoeba dispar
DFNSNKMIIWINGGFTPFEEIEL

SEQ ID NO: 2520344 - protein, 25 aa, Entamoeba dispar
DFNTNRFFLITKESTYLVACESMED

SEQ ID NO: 2520345 - protein, 19 aa, Entamoeba dispar
DFPGLFPYGLSVPPSPDCL

SEQ ID NO: 2520346 - protein, 18 aa, Entamoeba dispar
DFPLVKGKPSWSIKSIFL

SEQ ID NO: 2520347 - protein, 25 aa, Entamoeba dispar
DFRFGEFSSLLRLFQVKCEYDPKTL

SEQ ID NO: 2520348 - protein, 19 aa, Entamoeba dispar
DFRPSDLPSIIFPDTSKFI

SEQ ID NO: 2520349 - protein, 17 aa, Entamoeba dispar
DFRYIIINEGNLEQNRD

SEQ ID NO: 2520350 - protein, 32 aa, Entamoeba dispar
DFSCPFYKTCGIIRNIIHFYNEAFQALSVDYE

SEQ ID NO: 2520351 - protein, 17 aa, Entamoeba dispar
DFSKTIAEVFYSLGFDG

SEQ ID NO: 2520352 - protein, 27 aa, Entamoeba dispar
DFSTEVVFYLFALKICYPNNIKMLRGN

SEQ ID NO: 2520353 - protein, 20 aa, Entamoeba dispar
DFTCLLINEKIKKLDKRYPK

SEQ ID NO: 2520354 - protein, 24 aa, Entamoeba dispar
DFTNCVLDVLRRAGLNEKTVDLVI

SEQ ID NO: 2520355 - protein, 19 aa, Entamoeba dispar
DFVGQLTKKQIYKLRKRCE

SEQ ID NO: 2520356 - protein, 25 aa, Entamoeba dispar
DFVPKAIMHFLINQTCKDLQKALIE

SEQ ID NO: 2520357 - protein, 28 aa, Entamoeba dispar
DFVTTYLATYLLLQPIDFAIVLKDLFNF

SEQ ID NO: 2520358 - protein, 20 aa, Entamoeba dispar
DFWVHLRRSNTEPIIRVIAE

SEQ ID NO: 2520359 - protein, 20 aa, Entamoeba dispar
DGAEKAIISVLKKWKESGKG

SEQ ID NO: 2520360 - protein, 28 aa, Entamoeba dispar
DGALWSFAINSVFYFRLLSPFCVSIGNI

SEQ ID NO: 2520361 - protein, 24 aa, Entamoeba dispar
DGCDYPFVYENPYLSDKQLDSKIH

SEQ ID NO: 2520362 - protein, 22 aa, Entamoeba dispar
DGCFSWCDSLLRINIPMALREF

SEQ ID NO: 2520363 - protein, 25 aa, Entamoeba dispar
DGCGMKIFHPPISSLFFDVLQKNRI

SEQ ID NO: 2520364 - protein, 23 aa, Entamoeba dispar
DGCNFAQWKYWPYSLHCHRLMIY

SEQ ID NO: 2520365 - protein, 32 aa, Entamoeba dispar
DGDALTTLVLNKLRGLPIAAVRAPGFGETRKG

SEQ ID NO: 2520366 - protein, 17 aa, Entamoeba dispar
DGDIIYPFIVLNKTECA

SEQ ID NO: 2520367 - protein, 33 aa, Entamoeba dispar
DGEARITFSLFPKLIICRGFGMYTLNILTKEVE

SEQ ID NO: 2520368 - protein, 31 aa, Entamoeba dispar
DGELKVWDFRQFDFPYATFNWHKKAITSVEW

SEQ ID NO: 2520369 - protein, 24 aa, Entamoeba dispar
DGELWVSGWCILSFQNKATNKSYC

SEQ ID NO: 2520370 - protein, 25 aa, Entamoeba dispar
DGEPADCILYYNYRDKYTYERFFEK

SEQ ID NO: 2520371 - protein, 29 aa, Entamoeba dispar
DGERFHINMEQPILLRLPEDEAKVLREQI

SEQ ID NO: 2520372 - protein, 17 aa, Entamoeba dispar
DGEYWKDSFRKLINQVR

SEQ ID NO: 2520373 - protein, 24 aa, Entamoeba dispar
DGFGLVVGGYFRPFTSMKNQLSIE

SEQ ID NO: 2520374 - protein, 29 aa, Entamoeba dispar
DGFHVRIRIHPFHVLRINKMLSCAGADRL

SEQ ID NO: 2520375 - protein, 20 aa, Entamoeba dispar
DGFIIVYSIIEQQSFFDVST

SEQ ID NO: 2520376 - protein, 19 aa, Entamoeba dispar
DGFILVYSKQIEKSLEYVM

SEQ ID NO: 2520377 - protein, 29 aa, Entamoeba dispar
DGFNNIYEMIRLYDLKLLNSMLTSVSYIF

SEQ ID NO: 2520378 - protein, 29 aa, Entamoeba dispar
DGFNPILVEYSIWLEMNKFHIESNHLKER

SEQ ID NO: 2520379 - protein, 25 aa, Entamoeba dispar
DGFSFSLPYLLEHCVRILQDLVISI

SEQ ID NO: 2520380 - protein, 19 aa, Entamoeba dispar
DGFVIVYSIISTTSFLEVS

SEQ ID NO: 2520381 - protein, 26 aa, Entamoeba dispar
DGGNQEIWVISKIARYAVGKNVFILD

SEQ ID NO: 2520382 - protein, 20 aa, Entamoeba dispar
DGHIFLTTPVGLRASYKCGY

SEQ ID NO: 2520383 - protein, 20 aa, Entamoeba dispar
DGIILVLNYNSVEFLDNIES

SEQ ID NO: 2520384 - protein, 23 aa, Entamoeba dispar
DGILYQPRLTKIIPARDLVPEKI

SEQ ID NO: 2520385 - protein, 21 aa, Entamoeba dispar
DGIPHLHVIEIYKRATHIVCH

SEQ ID NO: 2520386 - protein, 24 aa, Entamoeba dispar
DGIYMTYENIFPKQPKHLSNEQIK

SEQ ID NO: 2520387 - protein, 24 aa, Entamoeba dispar
DGKEPFVFTNYFHGWRVNKKQVIS

SEQ ID NO: 2520388 - protein, 17 aa, Entamoeba dispar
DGKFFHIDFGHFLGNFK

SEQ ID NO: 2520389 - protein, 27 aa, Entamoeba dispar
DGKIAVIKLFLVLFKSLHKIDFNNLIN

SEQ ID NO: 2520390 - protein, 23 aa, Entamoeba dispar
DGKIFKEVIWYKVDYSTYLKEKE

SEQ ID NO: 2520391 - protein, 25 aa, Entamoeba dispar
DGKIFKQVIWYLVNYSIYFKEKEQG

SEQ ID NO: 2520392 - protein, 23 aa, Entamoeba dispar
DGKIFKQVIWYQVDYLTYLQEKK

SEQ ID NO: 2520393 - protein, 22 aa, Entamoeba dispar
DGKIFKYVIWYDISYSIYLKEK

SEQ ID NO: 2520394 - protein, 26 aa, Entamoeba dispar
DGKPYCNFHYYKLFGQVCEKCGKVVH

SEQ ID NO: 2520395 - protein, 23 aa, Entamoeba dispar
DGKQLICVKWKGLSYLHIEWISE

SEQ ID NO: 2520396 - protein, 23 aa, Entamoeba dispar
DGKSALCNFILKKSVFGESDYTK

SEQ ID NO: 2520397 - protein, 21 aa, Entamoeba dispar
DGKSLLYSLAYWAKRVMFNDE

SEQ ID NO: 2520398 - protein, 19 aa, Entamoeba dispar
DGLFDIIQNIYQVELNELD

SEQ ID NO: 2520399 - protein, 24 aa, Entamoeba dispar
DGLHGSFGCCIWFEKQKICECVTQ

SEQ ID NO: 2520400 - protein, 23 aa, Entamoeba dispar
DGLIKYRNYWNIPLVSNQQDKIN

SEQ ID NO: 2520401 - protein, 19 aa, Entamoeba dispar
DGLILLSSFVKIFTVLLQN

SEQ ID NO: 2520402 - protein, 31 aa, Entamoeba dispar
DGLKGLIILYHYIKVDPLPLLRERIIKLKNR

SEQ ID NO: 2520403 - protein, 25 aa, Entamoeba dispar
DGLNKTLLFFTNYTIFSLKKNEQRY

SEQ ID NO: 2520404 - protein, 29 aa, Entamoeba dispar
DGLRFTKIKFVLLQIIRYEKDYPFGSWRR

SEQ ID NO: 2520405 - protein, 27 aa, Entamoeba dispar
DGLSIPKSYTLLASFKSICENRVELQL

SEQ ID NO: 2520406 - protein, 26 aa, Entamoeba dispar
DGLSIPKTLKLLTTFKSIVESRIGSL

SEQ ID NO: 2520407 - protein, 20 aa, Entamoeba dispar
DGMYLKALPLLLNNIENLEN

SEQ ID NO: 2520408 - protein, 18 aa, Entamoeba dispar
DGNFTDRLFEWLAESHIN

SEQ ID NO: 2520409 - protein, 22 aa, Entamoeba dispar
DGNIAMWTLNNGTGLYEFLYDV

SEQ ID NO: 2520410 - protein, 26 aa, Entamoeba dispar
DGNIKKFYILYPVTYNAYLNEKENGN

SEQ ID NO: 2520411 - protein, 32 aa, Entamoeba dispar
DGNPNWQATKYPFLPNFLKLEEFSTIPPSFSF

SEQ ID NO: 2520412 - protein, 27 aa, Entamoeba dispar
DGNRTYILGMVWTMILKYKINANQQKG

SEQ ID NO: 2520413 - protein, 22 aa, Entamoeba dispar
DGNTIIKLFGEPLAQVVLCLDH

SEQ ID NO: 2520414 - protein, 17 aa, Entamoeba dispar
DGNWLIRRNVTLGEKDI

SEQ ID NO: 2520415 - protein, 26 aa, Entamoeba dispar
DGPILSYRHLQFSPLVQPLISMDIIQ

SEQ ID NO: 2520416 - protein, 18 aa, Entamoeba dispar
DGQYFIKNGTLMYKLSSK

SEQ ID NO: 2520417 - protein, 18 aa, Entamoeba dispar
DGRIFKEIIWYDISCSRY

SEQ ID NO: 2520418 - protein, 24 aa, Entamoeba dispar
DGRIFKKIIWYKVEYSTYLQEKES

SEQ ID NO: 2520419 - protein, 25 aa, Entamoeba dispar
DGRIFKKVIWYKVDYSIYLKDERKG

SEQ ID NO: 2520420 - protein, 17 aa, Entamoeba dispar
DGRIFKYVIWNTVDYSK

SEQ ID NO: 2520421 - protein, 24 aa, Entamoeba dispar
DGRIIELCIYLLLAAVIEKLPLPS

SEQ ID NO: 2520422 - protein, 25 aa, Entamoeba dispar
DGRIVKTIIWYTVDYSTYLKEKEAG

SEQ ID NO: 2520423 - protein, 25 aa, Entamoeba dispar
DGRIVKTIIWYTVDYSTYLKEKEQG

SEQ ID NO: 2520424 - protein, 24 aa, Entamoeba dispar
DGRPYLQKPFYTEFKKRDPPFDSP

SEQ ID NO: 2520425 - protein, 17 aa, Entamoeba dispar
DGSFDLLHAGHYELFRK

SEQ ID NO: 2520426 - protein, 21 aa, Entamoeba dispar
DGSFKAIIEYLKRQAKKHPES

SEQ ID NO: 2520427 - protein, 31 aa, Entamoeba dispar
DGSIFGTFNSLPIPNAPLKPGKGIDDCEMIT

SEQ ID NO: 2520428 - protein, 20 aa, Entamoeba dispar
DGSLMCYHRLLLKGNNETEK

SEQ ID NO: 2520429 - protein, 37 aa, Entamoeba dispar
DGSLNTQLLDLEYFFFIKAIVASTMKLNGFLESMMKD

SEQ ID NO: 2520430 - protein, 21 aa, Entamoeba dispar
DGTIRLWSVKSLSALRTLQGH

SEQ ID NO: 2520431 - protein, 29 aa, Entamoeba dispar
DGTKLSFFSWNAWNGWIPHWCVNKATKTM

SEQ ID NO: 2520432 - protein, 22 aa, Entamoeba dispar
DGTKMLYNFALIVAHNAAATVS

SEQ ID NO: 2520433 - protein, 31 aa, Entamoeba dispar
DGTNYFKVFRLVNNIFRPSLVAEFFELYKEC

SEQ ID NO: 2520434 - protein, 23 aa, Entamoeba dispar
DGTQVIYIIVNSLFQILEKDDTI

SEQ ID NO: 2520435 - protein, 26 aa, Entamoeba dispar
DGVIQIIINLLQYFLLHSCTGDDLKL

SEQ ID NO: 2520436 - protein, 23 aa, Entamoeba dispar
DGVMAILKPLKINELCRKVLYKM

SEQ ID NO: 2520437 - protein, 17 aa, Entamoeba dispar
DGWVLIKDLLNNRQMKG

SEQ ID NO: 2520438 - protein, 24 aa, Entamoeba dispar
DGYDYSQHFAERGNGIFIQSDGKI

SEQ ID NO: 2520439 - protein, 23 aa, Entamoeba dispar
DGYLKYYLYNWACPKVEPNKLAI

SEQ ID NO: 2520440 - protein, 21 aa, Entamoeba dispar
DGYSLLMKMFEYNPGKRISAR

SEQ ID NO: 2520441 - protein, 24 aa, Entamoeba dispar
DHCKDWLDLFYSSISSGFTPPVLL

SEQ ID NO: 2520442 - protein, 24 aa, Entamoeba dispar
DHDDLTWIQWFCSLSGNEYLVEVD

SEQ ID NO: 2520443 - protein, 19 aa, Entamoeba dispar
DHHPPKFNFLLQIVNEIVN

SEQ ID NO: 2520444 - protein, 21 aa, Entamoeba dispar
DHIIRFWDLASMKVAHQLNHH

SEQ ID NO: 2520445 - protein, 27 aa, Entamoeba dispar
DHILRDCPEPRTGKLAFSTCFVCHQMG

SEQ ID NO: 2520446 - protein, 19 aa, Entamoeba dispar
DHKLLSLLNNLPYFNNNLS

SEQ ID NO: 2520447 - protein, 31 aa, Entamoeba dispar
DHKTLYYDVEPFYFYILCEFNYNEQWKSDDY

SEQ ID NO: 2520448 - protein, 27 aa, Entamoeba dispar
DHLAQFIELLGYFNKKYLNIAPQTPKY

SEQ ID NO: 2520449 - protein, 22 aa, Entamoeba dispar
DHLLDEVCVTLKYLMEHIVQLE

SEQ ID NO: 2520450 - protein, 18 aa, Entamoeba dispar
DHNGYFMKGLFNVGMWER

SEQ ID NO: 2520451 - protein, 25 aa, Entamoeba dispar
DHNIFKAGFYHPMPVQKATIPIVLA

SEQ ID NO: 2520452 - protein, 17 aa, Entamoeba dispar
DHQYEDALKYYFKSITI

SEQ ID NO: 2520453 - protein, 23 aa, Entamoeba dispar
DHRLKIIELPLKDGKYPFAVTKE

SEQ ID NO: 2520454 - protein, 26 aa, Entamoeba dispar
DHSVEQFLNLFYEFTKTLLNTTEQSV

SEQ ID NO: 2520455 - protein, 21 aa, Entamoeba dispar
DHVCIVWTKCYYYTPKNRLKI

SEQ ID NO: 2520456 - protein, 17 aa, Entamoeba dispar
DHYMKEFNSFKNDEVFK

SEQ ID NO: 2520457 - protein, 26 aa, Entamoeba dispar
DHYVYSLKFIFTPVNKIPPTEILPPE

SEQ ID NO: 2520458 - protein, 27 aa, Entamoeba dispar
DIAAALAKKRAERAKKFAISDSDDDDD

SEQ ID NO: 2520459 - protein, 26 aa, Entamoeba dispar
DIADINRRYTFRLKALNVALNTTFRE

SEQ ID NO: 2520460 - protein, 26 aa, Entamoeba dispar
DIAHIINLLARYFDVSLKYPLHPNAM

SEQ ID NO: 2520461 - protein, 18 aa, Entamoeba dispar
DIAIIMSSIKHISLFDFV

SEQ ID NO: 2520462 - protein, 25 aa, Entamoeba dispar
DIANLTVLRGQSGWIIIDCMSTIAS

SEQ ID NO: 2520463 - protein, 17 aa, Entamoeba dispar
DIATLCKDAIYQPVRTL

SEQ ID NO: 2520464 - protein, 27 aa, Entamoeba dispar
DICASAIAVLPKKPSLWLEAIELERNI

SEQ ID NO: 2520465 - protein, 20 aa, Entamoeba dispar
DICKKVQIEITPEAIIDKLE

SEQ ID NO: 2520466 - protein, 19 aa, Entamoeba dispar
DICYANIPLFISKQLINQG

SEQ ID NO: 2520467 - protein, 30 aa, Entamoeba dispar
DIDTHQYLFELLNILTLKLLEIHVPPHRNS

SEQ ID NO: 2520468 - protein, 27 aa, Entamoeba dispar
DIDVSPLFISSFLQRIRIILKYCYPDG

SEQ ID NO: 2520469 - protein, 18 aa, Entamoeba dispar
DIDWNCFYSQVICVTESN

SEQ ID NO: 2520470 - protein, 19 aa, Entamoeba dispar
DIDYLIRMKGIPKDVIIGT

SEQ ID NO: 2520471 - protein, 20 aa, Entamoeba dispar
DIDYLIRMKGIPKDVIIGTA

SEQ ID NO: 2520472 - protein, 36 aa, Entamoeba dispar
DIDYYVIRTNWYWRHQIRIMRFGKEHFYRLDETYHV

SEQ ID NO: 2520473 - protein, 23 aa, Entamoeba dispar
DIEALCVFRIAQAVLLCCDGQVD

SEQ ID NO: 2520474 - protein, 28 aa, Entamoeba dispar
DIEDSEAYLYLLHHLNNSCSLEALNSSN

SEQ ID NO: 2520475 - protein, 27 aa, Entamoeba dispar
DIEELSHAVYIYWRAKEMVKTKEFDVD

SEQ ID NO: 2520476 - protein, 25 aa, Entamoeba dispar
DIEGVSLMYLLNIVAMYLVGSCVTM

SEQ ID NO: 2520477 - protein, 23 aa, Entamoeba dispar
DIEKYCLRVKKGQPPYCCFEYID

SEQ ID NO: 2520478 - protein, 18 aa, Entamoeba dispar
DIELFKKGCKKFPIGTEG

SEQ ID NO: 2520479 - protein, 25 aa, Entamoeba dispar
DIEMRRKELEFTGINDSYNQDLIGF

SEQ ID NO: 2520480 - protein, 18 aa, Entamoeba dispar
DIENIINNVLFDCPMNSK

SEQ ID NO: 2520481 - protein, 34 aa, Entamoeba dispar
DIESRLRYILVVDALNFCFWPTEGFEYDDLTKGL

SEQ ID NO: 2520482 - protein, 18 aa, Entamoeba dispar
DIEYICQMYWKGIEWCCI

SEQ ID NO: 2520483 - protein, 18 aa, Entamoeba dispar
DIEYLCGVLQMIVSFAMP

SEQ ID NO: 2520484 - protein, 21 aa, Entamoeba dispar
DIFAQFFGHPRRPSGPRKGQS

SEQ ID NO: 2520485 - protein, 23 aa, Entamoeba dispar
DIFGALHSIWSSKKKKKEVPMIE

SEQ ID NO: 2520486 - protein, 19 aa, Entamoeba dispar
DIFGFFAFEVDPLFLVAQY

SEQ ID NO: 2520487 - protein, 18 aa, Entamoeba dispar
DIFGIQLCVGNSLLAAKA

SEQ ID NO: 2520488 - protein, 21 aa, Entamoeba dispar
DIFIEFFNWKEVYDVYVRYLV

SEQ ID NO: 2520489 - protein, 18 aa, Entamoeba dispar
DIFIETLIKWIINSKDIM

SEQ ID NO: 2520490 - protein, 17 aa, Entamoeba dispar
DIFIRSKDSTWTAVLGT

SEQ ID NO: 2520491 - protein, 18 aa, Entamoeba dispar
DIFITAIIVLDSDELKRI

SEQ ID NO: 2520492 - protein, 18 aa, Entamoeba dispar
DIFLEKYLDGLSNNALYK

SEQ ID NO: 2520493 - protein, 18 aa, Entamoeba dispar
DIFLLCFAVDNDRSIKNI

SEQ ID NO: 2520494 - protein, 17 aa, Entamoeba dispar
DIFLVSVSPIEGNIKEF

SEQ ID NO: 2520495 - protein, 20 aa, Entamoeba dispar
DIFNGLINIPVTYSGTSYQN

SEQ ID NO: 2520496 - protein, 26 aa, Entamoeba dispar
DIFSLGCVLAYLFLENSLFDVSNILD

SEQ ID NO: 2520497 - protein, 17 aa, Entamoeba dispar
DIFYLTRQPYQKSFINH

SEQ ID NO: 2520498 - protein, 18 aa, Entamoeba dispar
DIGFMVVSDPMIEITKIE

SEQ ID NO: 2520499 - protein, 18 aa, Entamoeba dispar
DIGINIDPTITRKAFEEE

SEQ ID NO: 2520500 - protein, 25 aa, Entamoeba dispar
DIGKKQMIKMLYSLKIREAIKMGLI

SEQ ID NO: 2520501 - protein, 18 aa, Entamoeba dispar
DIGPRLKLHLLSINSDFM

SEQ ID NO: 2520502 - protein, 18 aa, Entamoeba dispar
DIHECRMVFIGAGSSNTT

SEQ ID NO: 2520503 - protein, 27 aa, Entamoeba dispar
DIHGQFYDLLKLFSIGGSLPENSYIFL

SEQ ID NO: 2520504 - protein, 31 aa, Entamoeba dispar
DIHGVKLILGLLYTLYRKYRLSVLVDKKKGK

SEQ ID NO: 2520505 - protein, 18 aa, Entamoeba dispar
DIHHFAIVQLIGLNFHSN

SEQ ID NO: 2520506 - protein, 22 aa, Entamoeba dispar
DIHHPAILGMAGIVLSSSTILL

SEQ ID NO: 2520507 - protein, 30 aa, Entamoeba dispar
DIHQIYLHILQEIILFYSQKTWNLSHYFTI

SEQ ID NO: 2520508 - protein, 34 aa, Entamoeba dispar
DIHSFFYCFAEDQFFWVYKFLKGVQERDVFRISY

SEQ ID NO: 2520509 - protein, 23 aa, Entamoeba dispar
DIHSQYTYDLNVLDGSIREEQKQ

SEQ ID NO: 2520510 - protein, 35 aa, Entamoeba dispar
DIIDPALMRPGRLDQLIYIPLPDLEARVGVLQANL

SEQ ID NO: 2520511 - protein, 21 aa, Entamoeba dispar
DIIIKLWKIIISISSNELFKE

SEQ ID NO: 2520512 - protein, 26 aa, Entamoeba dispar
DIIINIAPLISFDFFNEKFGEYEKVF

SEQ ID NO: 2520513 - protein, 20 aa, Entamoeba dispar
DIIKMCMIEIFKKIHSTWLG

SEQ ID NO: 2520514 - protein, 20 aa, Entamoeba dispar
DIIKSIIDYCSITGTIIVLD

SEQ ID NO: 2520515 - protein, 28 aa, Entamoeba dispar
DIIKSLVETLVPLALKILKIAFEEYKTV

SEQ ID NO: 2520516 - protein, 17 aa, Entamoeba dispar
DIIPMDDILFGIEKKTI

SEQ ID NO: 2520517 - protein, 25 aa, Entamoeba dispar
DIIQKYQDLTSLRALLQKAITQTHL

SEQ ID NO: 2520518 - protein, 24 aa, Entamoeba dispar
DIIQSFAYQFPTPFVKNLKPGDKT

SEQ ID NO: 2520519 - protein, 18 aa, Entamoeba dispar
DIISFIREQLKIEKPNIP

SEQ ID NO: 2520520 - protein, 18 aa, Entamoeba dispar
DIISFTLNICKAIQILHT

SEQ ID NO: 2520521 - protein, 22 aa, Entamoeba dispar
DIISKLPLLTFLDLSNNNIKEF

SEQ ID NO: 2520522 - protein, 28 aa, Entamoeba dispar
DIISNQIPGWPALLIPFIQQISSLKKEQ

SEQ ID NO: 2520523 - protein, 18 aa, Entamoeba dispar
DIISTMIMYCIHIDYIIE

SEQ ID NO: 2520524 - protein, 31 aa, Entamoeba dispar
DIITVLKKEGDWWLGELKGQQGYFPYNYVCP

SEQ ID NO: 2520525 - protein, 22 aa, Entamoeba dispar
DIIVLNIIITLQKRIIIREGKS

SEQ ID NO: 2520526 - protein, 35 aa, Entamoeba dispar
DIIYKLTELFITFNFSNTFLYFMSRALIELHARTP

SEQ ID NO: 2520527 - protein, 19 aa, Entamoeba dispar
DIIYPFIVLNKTECAKKST

SEQ ID NO: 2520528 - protein, 24 aa, Entamoeba dispar
DIKCRIFCTTLQKFSFVETQLPSD

SEQ ID NO: 2520529 - protein, 30 aa, Entamoeba dispar
DIKCVNWNVKVPHIIALTLSTGSIVIFDCK

SEQ ID NO: 2520530 - protein, 27 aa, Entamoeba dispar
DIKDGFTQMFWEFGMKSFDEFIKKLIK

SEQ ID NO: 2520531 - protein, 17 aa, Entamoeba dispar
DIKDVLLESLGYHIFPI

SEQ ID NO: 2520532 - protein, 20 aa, Entamoeba dispar
DIKHWSVNPPFYSPIQQENI

SEQ ID NO: 2520533 - protein, 17 aa, Entamoeba dispar
DIKILRHPKTQYSRVIL

SEQ ID NO: 2520534 - protein, 35 aa, Entamoeba dispar
DIKIWSKNEFIISIGNFYQGWIDIASIGENCSYNH

SEQ ID NO: 2520535 - protein, 31 aa, Entamoeba dispar
DIKKLSPYRKYIQPAIEVSGLLVLDHSADKF

SEQ ID NO: 2520536 - protein, 33 aa, Entamoeba dispar
DIKLENFLLVHHQPFPLLKITDFGFGRSLADEM

SEQ ID NO: 2520537 - protein, 25 aa, Entamoeba dispar
DIKNLVLLYLYCSIDLFKDEEKSFV

SEQ ID NO: 2520538 - protein, 17 aa, Entamoeba dispar
DIKPENILFVNKLDYFI

SEQ ID NO: 2520539 - protein, 17 aa, Entamoeba dispar
DIKPKRIIFKSIEEYIK

SEQ ID NO: 2520540 - protein, 20 aa, Entamoeba dispar
DIKPSPSFSLFGDTASDTKK

SEQ ID NO: 2520541 - protein, 36 aa, Entamoeba dispar
DIKQPQYAFYVGKQSDDYLFEFGVGDIRVYKENNKT

SEQ ID NO: 2520542 - protein, 22 aa, Entamoeba dispar
DIKREVLSLREKFEKVKPNDNI

SEQ ID NO: 2520543 - protein, 27 aa, Entamoeba dispar
DIKRITNILINLFLDKPSNAARLDPGE

SEQ ID NO: 2520544 - protein, 23 aa, Entamoeba dispar
DIKRLQIKYPKLKLGITLSKYSS

SEQ ID NO: 2520545 - protein, 24 aa, Entamoeba dispar
DIKSQVLSFFSSILKIYSGSVSSS

SEQ ID NO: 2520546 - protein, 18 aa, Entamoeba dispar
DIKTIMFYDYGCSMFLST

SEQ ID NO: 2520547 - protein, 25 aa, Entamoeba dispar
DIKTKDNIIIGLKTDLNNTDEKIEG

SEQ ID NO: 2520548 - protein, 24 aa, Entamoeba dispar
DIKVGVLGCPNFEGGLIVAAQKGC

SEQ ID NO: 2520549 - protein, 26 aa, Entamoeba dispar
DIKYGYEYIFPLIPIIIVNKEDYINF

SEQ ID NO: 2520550 - protein, 22 aa, Entamoeba dispar
DIKYQIAWFFTNLAVSLDSETS

SEQ ID NO: 2520551 - protein, 17 aa, Entamoeba dispar
DILDIQIIIQHLSFGGK

SEQ ID NO: 2520552 - protein, 36 aa, Entamoeba dispar
DILDPALLRPGRLDQLLFIPLPDKASRVSILRAKLR

SEQ ID NO: 2520553 - protein, 17 aa, Entamoeba dispar
DILFVNFLREFMSQTLQ

SEQ ID NO: 2520554 - protein, 17 aa, Entamoeba dispar
DILIFLTGQEEVDECAE

SEQ ID NO: 2520555 - protein, 21 aa, Entamoeba dispar
DILISTLRLIRTFPFNSIVSD

SEQ ID NO: 2520556 - protein, 25 aa, Entamoeba dispar
DILKELIYILPPPNLYRGKKIDILQ

SEQ ID NO: 2520557 - protein, 23 aa, Entamoeba dispar
DILKKYCLMGLNQILRAIKKDEV

SEQ ID NO: 2520558 - protein, 20 aa, Entamoeba dispar
DILKKYKKTTLLAPFNIIDY

SEQ ID NO: 2520559 - protein, 32 aa, Entamoeba dispar
DILKNPVIISPRPLDWIYDPNKSFFHIGLLLI

SEQ ID NO: 2520560 - protein, 23 aa, Entamoeba dispar
DILLKGYCFISLISELIKSLIES

SEQ ID NO: 2520561 - protein, 87 aa, Entamoeba dispar
DILNGEPKPIITLMFYLMYRFRLNDTPVRIIDFSKWIKCILKINNPLFDLKTEFSDGILFARILNYYKPNIIAYNTLTRDKIKTVST

SEQ ID NO: 2520562 - protein, 18 aa, Entamoeba dispar
DILQPLAMGGFNYIINQL

SEQ ID NO: 2520563 - protein, 37 aa, Entamoeba dispar
DILQPNIVIKFKSLVTKILLFKPNCKILIAFSKSDLP

SEQ ID NO: 2520564 - protein, 30 aa, Entamoeba dispar
DIMHLDLKPSNIFIFSLNPLDSVVAKLADF

SEQ ID NO: 2520565 - protein, 29 aa, Entamoeba dispar
DIMTELDAHLYFLIPISIYLNNLTQDISS

SEQ ID NO: 2520566 - protein, 19 aa, Entamoeba dispar
DINEFIIPSSISKLGNHCF

SEQ ID NO: 2520567 - protein, 21 aa, Entamoeba dispar
DINEFIIPSSITKLGDDCFYG

SEQ ID NO: 2520568 - protein, 20 aa, Entamoeba dispar
DINEFIIPSSITKLGYHCFY

SEQ ID NO: 2520569 - protein, 23 aa, Entamoeba dispar
DINEFIIPTTITKLGWNCFEGCT

SEQ ID NO: 2520570 - protein, 24 aa, Entamoeba dispar
DINEMPPTMIRPSNPLIEQAAPKK

SEQ ID NO: 2520571 - protein, 25 aa, Entamoeba dispar
DINENLYIPMFINNPKKLTPTQEFR

SEQ ID NO: 2520572 - protein, 25 aa, Entamoeba dispar
DINFESFNLNYVTKLSLLPFDEKYL

SEQ ID NO: 2520573 - protein, 20 aa, Entamoeba dispar
DINKFIIPSSITKLGYDCFK

SEQ ID NO: 2520574 - protein, 25 aa, Entamoeba dispar
DINKLIDPFFLDQYQFLASKKSDLL

SEQ ID NO: 2520575 - protein, 21 aa, Entamoeba dispar
DINKLIIRRIIRTEYKVAYPN

SEQ ID NO: 2520576 - protein, 20 aa, Entamoeba dispar
DINKLLRWLVQRQKPIEGGF

SEQ ID NO: 2520577 - protein, 23 aa, Entamoeba dispar
DINKPVILRLDVKYVLGLVLGYG

SEQ ID NO: 2520578 - protein, 21 aa, Entamoeba dispar
DINLIQPWRYFLRENKVSLNG

SEQ ID NO: 2520579 - protein, 17 aa, Entamoeba dispar
DINLKRGVLGWGRKIMK

SEQ ID NO: 2520580 - protein, 23 aa, Entamoeba dispar
DINNVHAYWSLSSLLRTPDCITP

SEQ ID NO: 2520581 - protein, 24 aa, Entamoeba dispar
DINQIYSMKNWILIPAKTTSTPHI

SEQ ID NO: 2520582 - protein, 26 aa, Entamoeba dispar
DINSEWILALLSFIPGALFPATDTLK

SEQ ID NO: 2520583 - protein, 18 aa, Entamoeba dispar
DIPFIATTFKKYIDTLYE

SEQ ID NO: 2520584 - protein, 20 aa, Entamoeba dispar
DIPIKPRRITTPLLSSNDQQ

SEQ ID NO: 2520585 - protein, 24 aa, Entamoeba dispar
DIPLKIETLLITIIKFLFNSNTQT

SEQ ID NO: 2520586 - protein, 27 aa, Entamoeba dispar
DIQFFNGIIVIAFKKEIYRISLTNFIQ

SEQ ID NO: 2520587 - protein, 24 aa, Entamoeba dispar
DIQKFPMAITKLQGLKTLTAQYIR

SEQ ID NO: 2520588 - protein, 25 aa, Entamoeba dispar
DIQKQQLLATIRKWKTLKIFENTLC

SEQ ID NO: 2520589 - protein, 24 aa, Entamoeba dispar
DIQNSWIFGVGYGFHIRGEDKSYI

SEQ ID NO: 2520590 - protein, 18 aa, Entamoeba dispar
DIQPYLNTIVPIIISRAS

SEQ ID NO: 2520591 - protein, 22 aa, Entamoeba dispar
DIQRASILLACKLSGTKNVELA

SEQ ID NO: 2520592 - protein, 17 aa, Entamoeba dispar
DIQTFSDKKFNPLNAVV

SEQ ID NO: 2520593 - protein, 20 aa, Entamoeba dispar
DIRAERPIMLLYQSQDAPDL

SEQ ID NO: 2520594 - protein, 23 aa, Entamoeba dispar
DIREALFSFIRIVIEYCSEIICE

SEQ ID NO: 2520595 - protein, 18 aa, Entamoeba dispar
DIRIEWESKRIEKTYPPK

SEQ ID NO: 2520596 - protein, 32 aa, Entamoeba dispar
DIRITFVTWISTLMNVLLKIIKIFTPNYLYIH

SEQ ID NO: 2520597 - protein, 23 aa, Entamoeba dispar
DIRKRYQFYYDRFGQYMPYYYGK

SEQ ID NO: 2520598 - protein, 33 aa, Entamoeba dispar
DIRNHILTLFNSIIPEPMNLHLLLNLVSSIHTR

SEQ ID NO: 2520599 - protein, 20 aa, Entamoeba dispar
DISFYKCVWQCIINSRLNEG

SEQ ID NO: 2520600 - protein, 30 aa, Entamoeba dispar
DISILQIIYDTLIYFLHQIQHQLFSIKNYF

SEQ ID NO: 2520601 - protein, 18 aa, Entamoeba dispar
DISILSIGAGYPAIPYIP

SEQ ID NO: 2520602 - protein, 27 aa, Entamoeba dispar
DISINQLKYFPYLHTLHFYKSITIHEV

SEQ ID NO: 2520603 - protein, 20 aa, Entamoeba dispar
DISTIQFILQQFSFAISRSK

SEQ ID NO: 2520604 - protein, 24 aa, Entamoeba dispar
DISYITAFYYNDSQGVLLMVDLSN

SEQ ID NO: 2520605 - protein, 21 aa, Entamoeba dispar
DITDFINKLKFFGKSILSKNN

SEQ ID NO: 2520606 - protein, 23 aa, Entamoeba dispar
DITEFLHLMNCLEIFESQKGQSK

SEQ ID NO: 2520607 - protein, 18 aa, Entamoeba dispar
DITELMFSIPNLSYVHEW

SEQ ID NO: 2520608 - protein, 25 aa, Entamoeba dispar
DITIIKSIYYSKIPQKLILLTSSEL

SEQ ID NO: 2520609 - protein, 20 aa, Entamoeba dispar
DITIMMLYTKNEIIEKLKEE

SEQ ID NO: 2520610 - protein, 23 aa, Entamoeba dispar
DITKFKLSISPLEGYYQGGKWSF

SEQ ID NO: 2520611 - protein, 24 aa, Entamoeba dispar
DITKINHCFIYLLDDRSFHYLIKM

SEQ ID NO: 2520612 - protein, 26 aa, Entamoeba dispar
DITLQTPLVFWKWANEHILAIVTSTT

SEQ ID NO: 2520613 - protein, 18 aa, Entamoeba dispar
DITLYLKTYAKVLIKSKF

SEQ ID NO: 2520614 - protein, 38 aa, Entamoeba dispar
DITNQQYAFYLTGPKTKRLFTFGFGGYDLTVMKKGEEG

SEQ ID NO: 2520615 - protein, 26 aa, Entamoeba dispar
DITNTVHQWMRLFLPNQEVNVENTQK

SEQ ID NO: 2520616 - protein, 23 aa, Entamoeba dispar
DIVARKFNDLVLLLADKINKSNM

SEQ ID NO: 2520617 - protein, 24 aa, Entamoeba dispar
DIVEITIFPLSKWTTSIVHFTGQL

SEQ ID NO: 2520618 - protein, 25 aa, Entamoeba dispar
DIVESIFIFVKVILLLPDEKISDEM

SEQ ID NO: 2520619 - protein, 25 aa, Entamoeba dispar
DIVIDNCQFFYFGLKQSICAYESVL

SEQ ID NO: 2520620 - protein, 25 aa, Entamoeba dispar
DIVKKIIILGDYFVGKSSLFKYLTQ

SEQ ID NO: 2520621 - protein, 17 aa, Entamoeba dispar
DIVNIINKLFQMKSSDE

SEQ ID NO: 2520622 - protein, 26 aa, Entamoeba dispar
DIVPQELSLVFIVRKYLSNIVRSLSK

SEQ ID NO: 2520623 - protein, 20 aa, Entamoeba dispar
DIVRMLVELLCRLPEDMKRL

SEQ ID NO: 2520624 - protein, 17 aa, Entamoeba dispar
DIVRYYKLRKDEDTSFF

SEQ ID NO: 2520625 - protein, 20 aa, Entamoeba dispar
DIVVLVFLEEGVKHFDPRLF

SEQ ID NO: 2520626 - protein, 31 aa, Entamoeba dispar
DIVYNQIPGYPLLIPYFIQHLKSLNSNLLSP

SEQ ID NO: 2520627 - protein, 19 aa, Entamoeba dispar
DIWNNIRRIMKQKPNKKIL

SEQ ID NO: 2520628 - protein, 23 aa, Entamoeba dispar
DIWRNFYDLYYNPQTQPKTFFTS

SEQ ID NO: 2520629 - protein, 24 aa, Entamoeba dispar
DIWSIGVITYLVLSGNLPFYDENE

SEQ ID NO: 2520630 - protein, 19 aa, Entamoeba dispar
DIWSLGAMYYYLRTGMFPL

SEQ ID NO: 2520631 - protein, 29 aa, Entamoeba dispar
DIWSLGVLIFVLFCNRFPFPPNKVFETLS

SEQ ID NO: 2520632 - protein, 18 aa, Entamoeba dispar
DIWSVGCIVAELLTGQIL

SEQ ID NO: 2520633 - protein, 27 aa, Entamoeba dispar
DIWSYGCILAEMFLGKPLFPGSSTSDQ

SEQ ID NO: 2520634 - protein, 17 aa, Entamoeba dispar
DIYIGKGQNQKSAARPV

SEQ ID NO: 2520635 - protein, 17 aa, Entamoeba dispar
DIYLCPYHIIATGPDCG

SEQ ID NO: 2520636 - protein, 24 aa, Entamoeba dispar
DIYLFDYRKLMISGNYSQAIMLPP

SEQ ID NO: 2520637 - protein, 27 aa, Entamoeba dispar
DIYPQNILQASWILSTAIPYFPDDTVF

SEQ ID NO: 2520638 - protein, 24 aa, Entamoeba dispar
DIYQLLTFLHLYCEFESDLNLPLW

SEQ ID NO: 2520639 - protein, 17 aa, Entamoeba dispar
DIYSAGIVLFELLEGYP

SEQ ID NO: 2520640 - protein, 21 aa, Entamoeba dispar
DIYYHPLIQSCTWDTLAAQVI

SEQ ID NO: 2520641 - protein, 20 aa, Entamoeba dispar
DKALIKKAVVWLSKECNKPI

SEQ ID NO: 2520642 - protein, 22 aa, Entamoeba dispar
DKALIVLLTFINSVGLMLNQEM

SEQ ID NO: 2520643 - protein, 19 aa, Entamoeba dispar
DKAMTIIAQIWLALNSLRN

SEQ ID NO: 2520644 - protein, 21 aa, Entamoeba dispar
DKAVMEWFYDSKPLIHSHNVN

SEQ ID NO: 2520645 - protein, 29 aa, Entamoeba dispar
DKAYRNMFPFFILASQINGLPLFLHHFRI

SEQ ID NO: 2520646 - protein, 25 aa, Entamoeba dispar
DKCDQLMCFPAALPAIFSFSNGNSI

SEQ ID NO: 2520647 - protein, 26 aa, Entamoeba dispar
DKCFKGCLLLKTVVIPTTIGKLGYKF

SEQ ID NO: 2520648 - protein, 25 aa, Entamoeba dispar
DKCKEFFEILIRFYETFGLIEDKLT

SEQ ID NO: 2520649 - protein, 21 aa, Entamoeba dispar
DKCLLKFFKNEALRDMFLNFT

SEQ ID NO: 2520650 - protein, 24 aa, Entamoeba dispar
DKCLSKLIPYLIAVKEHVPRLSLQ

SEQ ID NO: 2520651 - protein, 30 aa, Entamoeba dispar
DKCPLVRCSIIYLIIHIIPKIKIEEIQEIL

SEQ ID NO: 2520652 - protein, 21 aa, Entamoeba dispar
DKDEFILQKYYWKAKCLAKMG

SEQ ID NO: 2520653 - protein, 25 aa, Entamoeba dispar
DKDGTLFYCYTYLVKNKGGDEHPQK

SEQ ID NO: 2520654 - protein, 24 aa, Entamoeba dispar
DKDKKHFVFIFNTTINKGEKYQKI

SEQ ID NO: 2520655 - protein, 22 aa, Entamoeba dispar
DKDNVIIPSLFSRYINLIIRKN

SEQ ID NO: 2520656 - protein, 28 aa, Entamoeba dispar
DKDVFEEWYLKLLAKRLLNKEATNTSME

SEQ ID NO: 2520657 - protein, 23 aa, Entamoeba dispar
DKDWGRCVCNLSDLAPVLVNGVK

SEQ ID NO: 2520658 - protein, 26 aa, Entamoeba dispar
DKEIAIQNALLLLESFKGKSYDSKEF

SEQ ID NO: 2520659 - protein, 17 aa, Entamoeba dispar
DKEIYLSNVFIIIRIEE

SEQ ID NO: 2520660 - protein, 31 aa, Entamoeba dispar
DKEKKVSRERLLSFMFKRKTNEKTTISESPK

SEQ ID NO: 2520661 - protein, 27 aa, Entamoeba dispar
DKELPFKYGFIEPWYSNNFIFESCSIE

SEQ ID NO: 2520662 - protein, 17 aa, Entamoeba dispar
DKFKDFKLYDYLGNVNL

SEQ ID NO: 2520663 - protein, 22 aa, Entamoeba dispar
DKFKIKLPRLTINKMDEVLEYE

SEQ ID NO: 2520664 - protein, 18 aa, Entamoeba dispar
DKFKKPIIKEKAITALSG

SEQ ID NO: 2520665 - protein, 21 aa, Entamoeba dispar
DKFKLAIKQIDKLPLREGHKV

SEQ ID NO: 2520666 - protein, 25 aa, Entamoeba dispar
DKFKRYFRRIVNVAKNFPFVLVVEE

SEQ ID NO: 2520667 - protein, 19 aa, Entamoeba dispar
DKFMNNIIFPNYGDEKSLP

SEQ ID NO: 2520668 - protein, 20 aa, Entamoeba dispar
DKFWKIIRHQHIANASPYVV

SEQ ID NO: 2520669 - protein, 23 aa, Entamoeba dispar
DKGKSILMLLSKIYQTFVNQCDE

SEQ ID NO: 2520670 - protein, 21 aa, Entamoeba dispar
DKGRFYAFGRVFSGTIRTGGK

SEQ ID NO: 2520671 - protein, 17 aa, Entamoeba dispar
DKGVLVPFYDKLTTIPN

SEQ ID NO: 2520672 - protein, 26 aa, Entamoeba dispar
DKHPINVLFIGSKKEECISLKGICDY

SEQ ID NO: 2520673 - protein, 18 aa, Entamoeba dispar
DKIIIFCNELKPAGFYKE

SEQ ID NO: 2520674 - protein, 25 aa, Entamoeba dispar
DKIINRYYIQIPFSQLDKYKEKLLL

SEQ ID NO: 2520675 - protein, 23 aa, Entamoeba dispar
DKIITPLFLDNINQKYFSKYYGR

SEQ ID NO: 2520676 - protein, 25 aa, Entamoeba dispar
DKILKFHSFIYFPRELKLSIIGNKT

SEQ ID NO: 2520677 - protein, 25 aa, Entamoeba dispar
DKINIPHIYYIIRKSEMNVFYIVRH

SEQ ID NO: 2520678 - protein, 24 aa, Entamoeba dispar
DKIPKLLQKEFILESTNLLPTIKE

SEQ ID NO: 2520679 - protein, 24 aa, Entamoeba dispar
DKIPSNIWLFCFPDGLRLSEFPIE

SEQ ID NO: 2520680 - protein, 20 aa, Entamoeba dispar
DKIPSYVLSDKIDPWSCGII

SEQ ID NO: 2520681 - protein, 30 aa, Entamoeba dispar
DKIRSEYIIHFYGAVFIPNKICIVTEYAKY

SEQ ID NO: 2520682 - protein, 17 aa, Entamoeba dispar
DKKADGFILVYSKQIEK

SEQ ID NO: 2520683 - protein, 27 aa, Entamoeba dispar
DKKATVIFIPLRMMRICRASFEKVIEA

SEQ ID NO: 2520684 - protein, 17 aa, Entamoeba dispar
DKKDNVFGYYSPLGITK

SEQ ID NO: 2520685 - protein, 23 aa, Entamoeba dispar
DKKELMERIAQIKILDPEQSRKV

SEQ ID NO: 2520686 - protein, 21 aa, Entamoeba dispar
DKKEPYLFTKYFQGWQKTKNQ

SEQ ID NO: 2520687 - protein, 34 aa, Entamoeba dispar
DKKEQFNCMLTFTDFILFGRTKLLGKIKICKYIE

SEQ ID NO: 2520688 - protein, 17 aa, Entamoeba dispar
DKKIGTPIYMPPEQWNS

SEQ ID NO: 2520689 - protein, 22 aa, Entamoeba dispar
DKKIQFNPIFKSSPKHFSQLSS

SEQ ID NO: 2520690 - protein, 19 aa, Entamoeba dispar
DKKIYVYNFKDLRPLYQYD

SEQ ID NO: 2520691 - protein, 27 aa, Entamoeba dispar
DKKKELIHILRIILPLKKENNIKQEKM

SEQ ID NO: 2520692 - protein, 26 aa, Entamoeba dispar
DKKKIEKPIRTALARIKDKLIQALNN

SEQ ID NO: 2520693 - protein, 19 aa, Entamoeba dispar
DKKPLLNIPSQRGMIRIPP

SEQ ID NO: 2520694 - protein, 18 aa, Entamoeba dispar
DKKTAIALIFNTLSSYII

SEQ ID NO: 2520695 - protein, 31 aa, Entamoeba dispar
DKKTFIDINYIGLRIIYYLHKKEFKKELQSS

SEQ ID NO: 2520696 - protein, 26 aa, Entamoeba dispar
DKKVVILCFKEFVGALLELKNNESPT

SEQ ID NO: 2520697 - protein, 21 aa, Entamoeba dispar
DKLAAAKVMGLRRAKRRNMER

SEQ ID NO: 2520698 - protein, 18 aa, Entamoeba dispar
DKLFKFIDIILSKSTTIS

SEQ ID NO: 2520699 - protein, 26 aa, Entamoeba dispar
DKLILDYRTLFKWYDGPLIEAMKNGD

SEQ ID NO: 2520700 - protein, 27 aa, Entamoeba dispar
DKLIPPQLYEVFSIPFKTFWKNDAERQ

SEQ ID NO: 2520701 - protein, 20 aa, Entamoeba dispar
DKLIQIYPINKFQCSLQKFC

SEQ ID NO: 2520702 - protein, 38 aa, Entamoeba dispar
DKLLLKDHFKFDLYIFEYYLMIQLYSITKDDLSYNIFN

SEQ ID NO: 2520703 - protein, 21 aa, Entamoeba dispar
DKLLNYFAKLRSTAVSFSKLG

SEQ ID NO: 2520704 - protein, 17 aa, Entamoeba dispar
DKLNWRKMLQECFKVLW

SEQ ID NO: 2520705 - protein, 19 aa, Entamoeba dispar
DKLPLYNKALLNRLMKLCY

SEQ ID NO: 2520706 - protein, 24 aa, Entamoeba dispar
DKLQFISQERIFMNEPLLVSIEIP

SEQ ID NO: 2520707 - protein, 22 aa, Entamoeba dispar
DKLSLNFLILKFIVTKLCSLIQ

SEQ ID NO: 2520708 - protein, 20 aa, Entamoeba dispar
DKLTRLIKLKNPDLLNSFNG

SEQ ID NO: 2520709 - protein, 27 aa, Entamoeba dispar
DKLYEEYQRKYFPYRKVHKRVRGWVNN

SEQ ID NO: 2520710 - protein, 17 aa, Entamoeba dispar
DKMFIKYRPVDFNENML

SEQ ID NO: 2520711 - protein, 22 aa, Entamoeba dispar
DKMFKETLPYLESFIEQGQSGA

SEQ ID NO: 2520712 - protein, 20 aa, Entamoeba dispar
DKMIDDYYGMDFEDIVNGEK

SEQ ID NO: 2520713 - protein, 20 aa, Entamoeba dispar
DKMIVILTMNRFKSIDIPTE

SEQ ID NO: 2520714 - protein, 18 aa, Entamoeba dispar
DKMIYKIRTYLHLPRNTE

SEQ ID NO: 2520715 - protein, 30 aa, Entamoeba dispar
DKMKLTTDKLLRRFIFNLNVKMCKDFKAIL

SEQ ID NO: 2520716 - protein, 21 aa, Entamoeba dispar
DKMVMLRLRELGEPIMLFGEE

SEQ ID NO: 2520717 - protein, 24 aa, Entamoeba dispar
DKNIPFGCFDLLLARVHLTHTNKG

SEQ ID NO: 2520718 - protein, 24 aa, Entamoeba dispar
DKNNRGFSLFLIDGRKREMYLSGT

SEQ ID NO: 2520719 - protein, 19 aa, Entamoeba dispar
DKNSFILIIKDPLHIHIPS

SEQ ID NO: 2520720 - protein, 27 aa, Entamoeba dispar
DKNVNFYTILFTWKQKKIWKTTPKRFS

SEQ ID NO: 2520721 - protein, 22 aa, Entamoeba dispar
DKNVPYVFVGSKAALGRACGVS

SEQ ID NO: 2520722 - protein, 27 aa, Entamoeba dispar
DKNYGFAQSYKRLLQYYLPMDSVDFAG

SEQ ID NO: 2520723 - protein, 31 aa, Entamoeba dispar
DKPCNMFQAFLIRLVIPFPLSLIVNEEATLR

SEQ ID NO: 2520724 - protein, 34 aa, Entamoeba dispar
DKPFLEYDLEWFPPQWKVNFAKRLPIGNVKKYPP

SEQ ID NO: 2520725 - protein, 26 aa, Entamoeba dispar
DKPIPVELFNKLLLVKSQTNVALICQ

SEQ ID NO: 2520726 - protein, 21 aa, Entamoeba dispar
DKPIYQVLLQNEPILEHIEEK

SEQ ID NO: 2520727 - protein, 23 aa, Entamoeba dispar
DKPKKVRSIVRISKLEDTVDKTS

SEQ ID NO: 2520728 - protein, 22 aa, Entamoeba dispar
DKPSTCFFLNRETNQIGRLCEI

SEQ ID NO: 2520729 - protein, 23 aa, Entamoeba dispar
DKPSTLKMLPSYAPIPTGKEVGT

SEQ ID NO: 2520730 - protein, 18 aa, Entamoeba dispar
DKQIWTMLMTISGKYYNN

SEQ ID NO: 2520731 - protein, 22 aa, Entamoeba dispar
DKQMKNLFERYFYHERARRMVE

SEQ ID NO: 2520732 - protein, 27 aa, Entamoeba dispar
DKQNTNHPFVQSPRYSPLGLHVQGSPT

SEQ ID NO: 2520733 - protein, 18 aa, Entamoeba dispar
DKQPLSQHPYTNTLSTFL

SEQ ID NO: 2520734 - protein, 27 aa, Entamoeba dispar
DKQTQQTIGFDYKPLQIKPKPKQPRIE

SEQ ID NO: 2520735 - protein, 19 aa, Entamoeba dispar
DKRFLSWAQKNTRKCPKCN

SEQ ID NO: 2520736 - protein, 23 aa, Entamoeba dispar
DKRHLFPNWIKPSDTEPAPLLVY

SEQ ID NO: 2520737 - protein, 17 aa, Entamoeba dispar
DKRIKTFSVEKALNGIK

SEQ ID NO: 2520738 - protein, 23 aa, Entamoeba dispar
DKRKENLILLTQRLKEMIDNAHN

SEQ ID NO: 2520739 - protein, 17 aa, Entamoeba dispar
DKRKKIEIKDEYGDIIA

SEQ ID NO: 2520740 - protein, 22 aa, Entamoeba dispar
DKRYPKLIALPIYASLSTEQQK

SEQ ID NO: 2520741 - protein, 26 aa, Entamoeba dispar
DKSDIFSYGIILWEMTYRTIHQKYQR

SEQ ID NO: 2520742 - protein, 31 aa, Entamoeba dispar
DKSKGEVIITWYSMYQNILKQKLRINLKQLD

SEQ ID NO: 2520743 - protein, 26 aa, Entamoeba dispar
DKSLNRCCFIIFTGNHFDVICLSRSL

SEQ ID NO: 2520744 - protein, 22 aa, Entamoeba dispar
DKSNILVFDLGGGTFDVTLLSI

SEQ ID NO: 2520745 - protein, 26 aa, Entamoeba dispar
DKTERIKIKLFPWDENNSLVKNARAW

SEQ ID NO: 2520746 - protein, 17 aa, Entamoeba dispar
DKTIHSVWLYLESGRTA

SEQ ID NO: 2520747 - protein, 18 aa, Entamoeba dispar
DKTIIFEELIERIAYEGG

SEQ ID NO: 2520748 - protein, 22 aa, Entamoeba dispar
DKTISFWLMDKEMYTGMSCLWQ

SEQ ID NO: 2520749 - protein, 18 aa, Entamoeba dispar
DKTIWFIEQPLVGNFEKY

SEQ ID NO: 2520750 - protein, 22 aa, Entamoeba dispar
DKTKLKFKIPGLLVMDTPGHEA

SEQ ID NO: 2520751 - protein, 22 aa, Entamoeba dispar
DKTLLNPYFIDGYAVFIACSLA

SEQ ID NO: 2520752 - protein, 20 aa, Entamoeba dispar
DKTLLVLSLEIEKVEFKRGL

SEQ ID NO: 2520753 - protein, 25 aa, Entamoeba dispar
DKTVEHIILFINKQLRDTTTTYRLY

SEQ ID NO: 2520754 - protein, 29 aa, Entamoeba dispar
DKTVKDLVVLLFETALLSSGFSLDEPAAF

SEQ ID NO: 2520755 - protein, 18 aa, Entamoeba dispar
DKVDKIYVWIGKDSSRLK

SEQ ID NO: 2520756 - protein, 31 aa, Entamoeba dispar
DKVRELIAVWGTYFPCELSEYAFLYKRYCNQ

SEQ ID NO: 2520757 - protein, 18 aa, Entamoeba dispar
DKVYWKESIIFTQTGVLN

SEQ ID NO: 2520758 - protein, 24 aa, Entamoeba dispar
DKYEFLDLCGVGNFALVRKVKDIQ

SEQ ID NO: 2520759 - protein, 26 aa, Entamoeba dispar
DKYHNLVCRVLFKQPKWLNSNKQWNG

SEQ ID NO: 2520760 - protein, 19 aa, Entamoeba dispar
DKYVQIGEKRYVRLNQFKG

SEQ ID NO: 2520761 - protein, 30 aa, Entamoeba dispar
DKYVQIGEKRYVRLNQFKGTKYIDIREFYE

SEQ ID NO: 2520762 - protein, 18 aa, Entamoeba dispar
DLADNFIDDDYAYSLPRC

SEQ ID NO: 2520763 - protein, 17 aa, Entamoeba dispar
DLAGPIEDLLLLGKHEE

SEQ ID NO: 2520764 - protein, 31 aa, Entamoeba dispar
DLAPTHPIRLGLALNFSVFYYEIMNDADKAC

SEQ ID NO: 2520765 - protein, 25 aa, Entamoeba dispar
DLAYKQPHLLLLDEPSNHLDIETVE

SEQ ID NO: 2520766 - protein, 23 aa, Entamoeba dispar
DLCCNSILDIKPLTNIPSLKEID

SEQ ID NO: 2520767 - protein, 20 aa, Entamoeba dispar
DLCFHKCWSLISINIPTTIS

SEQ ID NO: 2520768 - protein, 18 aa, Entamoeba dispar
DLDALRFLFNISAPEKKL

SEQ ID NO: 2520769 - protein, 25 aa, Entamoeba dispar
DLDHPIILSYLTSSVEYFCFKYNKS

SEQ ID NO: 2520770 - protein, 24 aa, Entamoeba dispar
DLDKMIQETRLKSLSLKQVEDKIR

SEQ ID NO: 2520771 - protein, 21 aa, Entamoeba dispar
DLDLVGTNWKFFSLERVVVVH

SEQ ID NO: 2520772 - protein, 21 aa, Entamoeba dispar
DLDLYMKNAILLKFNHLPKPK

SEQ ID NO: 2520773 - protein, 27 aa, Entamoeba dispar
DLDTEFCLMLLRKFLSKTTVRLVIMSA

SEQ ID NO: 2520774 - protein, 27 aa, Entamoeba dispar
DLEALGYMFVYFMKGSLPWQGIKGKKV

SEQ ID NO: 2520775 - protein, 45 aa, Entamoeba dispar
DLECLTFIRDVWKSSSVRWQMARNFILWVPLTAIANNYSTSTSGL

SEQ ID NO: 2520776 - protein, 25 aa, Entamoeba dispar
DLEGILVPTLCCCPIEIIQQLKLLF

SEQ ID NO: 2520777 - protein, 20 aa, Entamoeba dispar
DLEGYFPGFNEYRELVSCSN

SEQ ID NO: 2520778 - protein, 24 aa, Entamoeba dispar
DLEKYKMFNIYKFMMKDNLEDCKV

SEQ ID NO: 2520779 - protein, 21 aa, Entamoeba dispar
DLEPILPIPRCTTYVGDITTG

SEQ ID NO: 2520780 - protein, 25 aa, Entamoeba dispar
DLEQPYLAPIFIPNQINPSRINGFH

SEQ ID NO: 2520781 - protein, 27 aa, Entamoeba dispar
DLESLGYLFVYLLKGTLPWQDLSSSPD

SEQ ID NO: 2520782 - protein, 27 aa, Entamoeba dispar
DLEVAADLKYYAIPEAEKRMKELKEQN

SEQ ID NO: 2520783 - protein, 21 aa, Entamoeba dispar
DLEYLLMENQIYSKFAEAGVV

SEQ ID NO: 2520784 - protein, 17 aa, Entamoeba dispar
DLFMKQLIFSQYDFITD

SEQ ID NO: 2520785 - protein, 20 aa, Entamoeba dispar
DLFNLLTFEMIKDISNNYPS

SEQ ID NO: 2520786 - protein, 24 aa, Entamoeba dispar
DLFNPLTRLPFDSKLLINAFHISK

SEQ ID NO: 2520787 - protein, 27 aa, Entamoeba dispar
DLFNRNIPEILYFFDMNQLDIPSTDES

SEQ ID NO: 2520788 - protein, 17 aa, Entamoeba dispar
DLFTIILNVSLNMSYDG

SEQ ID NO: 2520789 - protein, 23 aa, Entamoeba dispar
DLFVLLYCGNLKEQFRRVLQRGR

SEQ ID NO: 2520790 - protein, 23 aa, Entamoeba dispar
DLFVLLYCGNLKEQYRRVLQRGR

SEQ ID NO: 2520791 - protein, 26 aa, Entamoeba dispar
DLGGQSKIRPLWRHYYEGTQGLVFVI

SEQ ID NO: 2520792 - protein, 24 aa, Entamoeba dispar
DLGKQILIRKCELDGFPSIINSLE

SEQ ID NO: 2520793 - protein, 19 aa, Entamoeba dispar
DLGSMLIMPVQRTPRYVLL

SEQ ID NO: 2520794 - protein, 26 aa, Entamoeba dispar
DLGTIENFWLFISDNNYNQLFYFESF

SEQ ID NO: 2520795 - protein, 25 aa, Entamoeba dispar
DLHLISELLVFVIFAARKSNDGVSI

SEQ ID NO: 2520796 - protein, 30 aa, Entamoeba dispar
DLHLLIRHSPFPPSLLPFTKSVNPTLFSPL

SEQ ID NO: 2520797 - protein, 18 aa, Entamoeba dispar
DLHPTIITKIISSSFPLI

SEQ ID NO: 2520798 - protein, 27 aa, Entamoeba dispar
DLIELFDSLFILEQLYFHGKMWNHTMK

SEQ ID NO: 2520799 - protein, 19 aa, Entamoeba dispar
DLIGFFQYSQENAGAMAPV

SEQ ID NO: 2520800 - protein, 24 aa, Entamoeba dispar
DLIKTPIYGMNYEKFMPALMQYYK

SEQ ID NO: 2520801 - protein, 26 aa, Entamoeba dispar
DLIKTPIYGMNYEKFMPALMQYYKQP

SEQ ID NO: 2520802 - protein, 27 aa, Entamoeba dispar
DLIKTPIYGMNYKKFIPALIQYYKQPQ

SEQ ID NO: 2520803 - protein, 17 aa, Entamoeba dispar
DLISEIILKSNLAASIQ

SEQ ID NO: 2520804 - protein, 22 aa, Entamoeba dispar
DLITQMNDPFWKDRYSTSIYLG

SEQ ID NO: 2520805 - protein, 29 aa, Entamoeba dispar
DLKCQYLDLYLIHWPIALKVGTSNTPKPE

SEQ ID NO: 2520806 - protein, 22 aa, Entamoeba dispar
DLKIKIMEDIVVGLAFLHENQI

SEQ ID NO: 2520807 - protein, 19 aa, Entamoeba dispar
DLKINPYIPIPPTASEKQK

SEQ ID NO: 2520808 - protein, 20 aa, Entamoeba dispar
DLKIVFGIEDDLKCFLRKES

SEQ ID NO: 2520809 - protein, 19 aa, Entamoeba dispar
DLKMLTYLEIFFSNATYLN

SEQ ID NO: 2520810 - protein, 26 aa, Entamoeba dispar
DLKNYFNDMFTLRDLCDDFIELFKRE

SEQ ID NO: 2520811 - protein, 19 aa, Entamoeba dispar
DLKQFIELVHFYVKNQDDE

SEQ ID NO: 2520812 - protein, 24 aa, Entamoeba dispar
DLKRGYYMYTYKIPDTQVEIPLLL

SEQ ID NO: 2520813 - protein, 29 aa, Entamoeba dispar
DLKSILCVLGSLKFYHPKLVTINDKRIGE

SEQ ID NO: 2520814 - protein, 19 aa, Entamoeba dispar
DLKYYAIPEAEKRMKELKE

SEQ ID NO: 2520815 - protein, 18 aa, Entamoeba dispar
DLLELRVRMDTVEKGSIV

SEQ ID NO: 2520816 - protein, 19 aa, Entamoeba dispar
DLLGTLWRNMDSSNIPKGE

SEQ ID NO: 2520817 - protein, 18 aa, Entamoeba dispar
DLLHIGHYKLLKHAKEIG

SEQ ID NO: 2520818 - protein, 24 aa, Entamoeba dispar
DLLIGLLRLRLPTDEKFMPELKGK

SEQ ID NO: 2520819 - protein, 18 aa, Entamoeba dispar
DLLILDEPTNHLDLNAVI

SEQ ID NO: 2520820 - protein, 22 aa, Entamoeba dispar
DLLKMIQILKNGFEVYLRLIPM

SEQ ID NO: 2520821 - protein, 26 aa, Entamoeba dispar
DLLKNPVIISPRPLDWIYDPNKSFFH

SEQ ID NO: 2520822 - protein, 30 aa, Entamoeba dispar
DLLRYDFGAPMHCLLIPAPQIDDPELDHLE

SEQ ID NO: 2520823 - protein, 32 aa, Entamoeba dispar
DLLSRKIYQSFLCTPILIAAHRTLNLYLFVNK

SEQ ID NO: 2520824 - protein, 27 aa, Entamoeba dispar
DLLVFHYFQQFNEFISLTAVVKRILET

SEQ ID NO: 2520825 - protein, 26 aa, Entamoeba dispar
DLMCHDFNLIMYYMNNTLPKYITAVG

SEQ ID NO: 2520826 - protein, 19 aa, Entamoeba dispar
DLMDFPLFSSQQLKKKQKR

SEQ ID NO: 2520827 - protein, 20 aa, Entamoeba dispar
DLMGVIRKILELMYKYHHEL

SEQ ID NO: 2520828 - protein, 26 aa, Entamoeba dispar
DLNDGLILISLFEALRKQKVQFRYNK

SEQ ID NO: 2520829 - protein, 31 aa, Entamoeba dispar
DLNEIRHFYLYLLWILKNMDLRTLTNLLNKD

SEQ ID NO: 2520830 - protein, 20 aa, Entamoeba dispar
DLNFQSKTWFPDMPSHFITK

SEQ ID NO: 2520831 - protein, 26 aa, Entamoeba dispar
DLNGLVYLYLAINKTNPKCFHWPYIN

SEQ ID NO: 2520832 - protein, 21 aa, Entamoeba dispar
DLNIIMYRLLASGVNTITLDI

SEQ ID NO: 2520833 - protein, 17 aa, Entamoeba dispar
DLNIQFLRNQIGLVGQE

SEQ ID NO: 2520834 - protein, 27 aa, Entamoeba dispar
DLNKMVEHLLLPYIKTTLIPQQSYENV

SEQ ID NO: 2520835 - protein, 27 aa, Entamoeba dispar
DLNKSNKLIILYKPLIEWGKELYEYGN

SEQ ID NO: 2520836 - protein, 22 aa, Entamoeba dispar
DLNRQLLYHGSRLTNFVGILST

SEQ ID NO: 2520837 - protein, 20 aa, Entamoeba dispar
DLNSFLIMPVQRVPRYRLLL

SEQ ID NO: 2520838 - protein, 23 aa, Entamoeba dispar
DLNTIREYLLYCLDLNNDSVNEA

SEQ ID NO: 2520839 - protein, 19 aa, Entamoeba dispar
DLPFIQRIYNSYMGFCINL

SEQ ID NO: 2520840 - protein, 24 aa, Entamoeba dispar
DLPGGPFYSTPFILQARDKKEYQK

SEQ ID NO: 2520841 - protein, 25 aa, Entamoeba dispar
DLPKDINELKLLKVELICKHKKTKE

SEQ ID NO: 2520842 - protein, 20 aa, Entamoeba dispar
DLPLLQNGLIPPSYIQGNCM

SEQ ID NO: 2520843 - protein, 32 aa, Entamoeba dispar
DLPNCSPLLQTLFKMIFIRNPTQRADIFQILG

SEQ ID NO: 2520844 - protein, 19 aa, Entamoeba dispar
DLPTTFNIEYLLSKGLEQL

SEQ ID NO: 2520845 - protein, 24 aa, Entamoeba dispar
DLQFELLNQFDFVFVDSLPFSEIT

SEQ ID NO: 2520846 - protein, 24 aa, Entamoeba dispar
DLQGRTLPLLLAKVNLLTANAFIE

SEQ ID NO: 2520847 - protein, 37 aa, Entamoeba dispar
DLQNKIMNETYYVDKRIINKLLISYITKPHQRMEIVN

SEQ ID NO: 2520848 - protein, 30 aa, Entamoeba dispar
DLQPDLVAAVFKKFLRDLPIHVINKQQTNN

SEQ ID NO: 2520849 - protein, 25 aa, Entamoeba dispar
DLQSDIKRFQEISEKIKTQNESIMK

SEQ ID NO: 2520850 - protein, 22 aa, Entamoeba dispar
DLQYFPPDVIIQDWYQLSNFGN

SEQ ID NO: 2520851 - protein, 19 aa, Entamoeba dispar
DLREEPRKESSSSSNSEEE

SEQ ID NO: 2520852 - protein, 18 aa, Entamoeba dispar
DLRFVPDDTEFPYKAVDV

SEQ ID NO: 2520853 - protein, 24 aa, Entamoeba dispar
DLRGIITTLRFILCSAAQYDISSE

SEQ ID NO: 2520854 - protein, 17 aa, Entamoeba dispar
DLRKERNALRLQIDSLK

SEQ ID NO: 2520855 - protein, 22 aa, Entamoeba dispar
DLRTLKKLGVISKVWSTTDLGS

SEQ ID NO: 2520856 - protein, 17 aa, Entamoeba dispar
DLRVLSFRIVGPIQLYE

SEQ ID NO: 2520857 - protein, 17 aa, Entamoeba dispar
DLRWCGYVHWSAGKRRY

SEQ ID NO: 2520858 - protein, 24 aa, Entamoeba dispar
DLSEPLAFNLMFATDIGPAGDLKA

SEQ ID NO: 2520859 - protein, 31 aa, Entamoeba dispar
DLSGSIGFFEFLALWNFMNLCNETFKHFDAD

SEQ ID NO: 2520860 - protein, 27 aa, Entamoeba dispar
DLSLKDTSKLRYFISHSTLEINDIHPQ

SEQ ID NO: 2520861 - protein, 22 aa, Entamoeba dispar
DLSPDLFVFRQNVLEITIDRLA

SEQ ID NO: 2520862 - protein, 21 aa, Entamoeba dispar
DLSPQFIIPNINYNDGFDTEI

SEQ ID NO: 2520863 - protein, 18 aa, Entamoeba dispar
DLTIKLQLWDTAGQERFR

SEQ ID NO: 2520864 - protein, 33 aa, Entamoeba dispar
DLTLQREELQWCKAYLIGLLILCETRNSLSGLN

SEQ ID NO: 2520865 - protein, 19 aa, Entamoeba dispar
DLTLRLVEDVLFAASKRSD

SEQ ID NO: 2520866 - protein, 25 aa, Entamoeba dispar
DLTNGLHPILFFTRDDYHDKDLRSL

SEQ ID NO: 2520867 - protein, 23 aa, Entamoeba dispar
DLTTGKPLSFLMQINFEEFEALE

SEQ ID NO: 2520868 - protein, 21 aa, Entamoeba dispar
DLVAVLIAMTQRLMLEKLTPT

SEQ ID NO: 2520869 - protein, 21 aa, Entamoeba dispar
DLVCTWYLNNTCCVWSIESSR

SEQ ID NO: 2520870 - protein, 27 aa, Entamoeba dispar
DLVESIRFILERLIPFNQQLNPRRMQL

SEQ ID NO: 2520871 - protein, 24 aa, Entamoeba dispar
DLVHFYFQLLVHMGVIKDVITSRN

SEQ ID NO: 2520872 - protein, 25 aa, Entamoeba dispar
DLVIMKNVFVILTNNEYTIIKAEVI

SEQ ID NO: 2520873 - protein, 20 aa, Entamoeba dispar
DLVKPYFAIVDPCHSFTLPK

SEQ ID NO: 2520874 - protein, 20 aa, Entamoeba dispar
DLVLEGCNLIYFPDPLLDQQ

SEQ ID NO: 2520875 - protein, 22 aa, Entamoeba dispar
DLVLLPDGLTKLSSLIFLNLSE

SEQ ID NO: 2520876 - protein, 23 aa, Entamoeba dispar
DLVQGVIYIWNFINEFKKEIEIE

SEQ ID NO: 2520877 - protein, 17 aa, Entamoeba dispar
DLVRVCEGIPIVLVGNK

SEQ ID NO: 2520878 - protein, 31 aa, Entamoeba dispar
DLVSAFFIYFENILGTLPWNSLTDSPQQICE

SEQ ID NO: 2520879 - protein, 18 aa, Entamoeba dispar
DLYELWFIKQEQVPQVIL

SEQ ID NO: 2520880 - protein, 19 aa, Entamoeba dispar
DLYFYDVYEKLTLTSDIAL

SEQ ID NO: 2520881 - protein, 19 aa, Entamoeba dispar
DLYIFFEELDVYNIYAIFV

SEQ ID NO: 2520882 - protein, 28 aa, Entamoeba dispar
DLYINHFLLFYTFIGDKFIYSSPLNDLY

SEQ ID NO: 2520883 - protein, 20 aa, Entamoeba dispar
DLYSLFLQEKLFLHECTVKS

SEQ ID NO: 2520884 - protein, 19 aa, Entamoeba dispar
DLYVDSIIPRLLSEELNKL

SEQ ID NO: 2520885 - protein, 20 aa, Entamoeba dispar
DLYVMCYGGKKSGKTFSLEG

SEQ ID NO: 2520886 - protein, 20 aa, Entamoeba dispar
DLYWVGVFDKELRVFDIIMR

SEQ ID NO: 2520887 - protein, 28 aa, Entamoeba dispar
DMCSTSLALLWVFYIRQSFIGSYDHEET

SEQ ID NO: 2520888 - protein, 27 aa, Entamoeba dispar
DMDEPNRFMVFPVKTPKCPTRFVFKNG

SEQ ID NO: 2520889 - protein, 17 aa, Entamoeba dispar
DMDKVIELALKYKDERT

SEQ ID NO: 2520890 - protein, 20 aa, Entamoeba dispar
DMDLNKFSSLTFLDISFNKL

SEQ ID NO: 2520891 - protein, 26 aa, Entamoeba dispar
DMEAEGVPICEWPMWINSQIEHTETR

SEQ ID NO: 2520892 - protein, 19 aa, Entamoeba dispar
DMEHLKIVYISPLKALATE

SEQ ID NO: 2520893 - protein, 27 aa, Entamoeba dispar
DMESLAYMFIYFMKGNLPWQGIKGTTK

SEQ ID NO: 2520894 - protein, 24 aa, Entamoeba dispar
DMFANPYVFFAVKTPLHIIKYTIH

SEQ ID NO: 2520895 - protein, 24 aa, Entamoeba dispar
DMFGCYLEDKVEFDHWIYDEHHFA

SEQ ID NO: 2520896 - protein, 34 aa, Entamoeba dispar
DMILQSICPELCGLRMCKLAIMLVTTGGISRIDK

SEQ ID NO: 2520897 - protein, 29 aa, Entamoeba dispar
DMISIIDLFARYRYLKEITALILDTLDGD

SEQ ID NO: 2520898 - protein, 19 aa, Entamoeba dispar
DMKKNFIAMLTFCDAEDPQ

SEQ ID NO: 2520899 - protein, 22 aa, Entamoeba dispar
DMKKNFIAMLTFCDGKTPQVIN

SEQ ID NO: 2520900 - protein, 24 aa, Entamoeba dispar
DMKLKLEILLILKVKNDIFDSNDI

SEQ ID NO: 2520901 - protein, 17 aa, Entamoeba dispar
DMKQLEITGLYLCGEHK

SEQ ID NO: 2520902 - protein, 20 aa, Entamoeba dispar
DMKSRMYLNFTICFSSKISS

SEQ ID NO: 2520903 - protein, 18 aa, Entamoeba dispar
DMLLTTFQKLPKTPTGNI

SEQ ID NO: 2520904 - protein, 30 aa, Entamoeba dispar
DMLQELCVLKGKLCWIIYVDVVVVEDDGNV

SEQ ID NO: 2520905 - protein, 35 aa, Entamoeba dispar
DMMTPLHYACVFKNIPVALFLYNKGSSLYLQDAMG

SEQ ID NO: 2520906 - protein, 20 aa, Entamoeba dispar
DMNIITHVWEVNGTIWACKK

SEQ ID NO: 2520907 - protein, 19 aa, Entamoeba dispar
DMNKFFNPQGDFKYIQCST

SEQ ID NO: 2520908 - protein, 17 aa, Entamoeba dispar
DMNKMFSVVFMLYGSTQ

SEQ ID NO: 2520909 - protein, 26 aa, Entamoeba dispar
DMQNIFKPHIIIKTKLQSSLSGFNID

SEQ ID NO: 2520910 - protein, 20 aa, Entamoeba dispar
DMQSLKPMKTIPITYSIFLQ

SEQ ID NO: 2520911 - protein, 28 aa, Entamoeba dispar
DMQSYFNSIYQRLLYLLQNNLSDFKLNT

SEQ ID NO: 2520912 - protein, 17 aa, Entamoeba dispar
DMRNLNNPVWELVAHEK

SEQ ID NO: 2520913 - protein, 25 aa, Entamoeba dispar
DMRTTLELLIRMYETFKPKMAKFMK

SEQ ID NO: 2520914 - protein, 23 aa, Entamoeba dispar
DMSFRHVYNWLSEARRFCNKENV

SEQ ID NO: 2520915 - protein, 23 aa, Entamoeba dispar
DMSKIFEILLAYEKTNLCITQFS

SEQ ID NO: 2520916 - protein, 33 aa, Entamoeba dispar
DMSSYLIMPIQRLPRYVLLLNELKKHTWNDHPD

SEQ ID NO: 2520917 - protein, 18 aa, Entamoeba dispar
DMTVLTPYVYFGNSQTDP

SEQ ID NO: 2520918 - protein, 24 aa, Entamoeba dispar
DMVIEWLCLNIPSRLLPNSLGGTL

SEQ ID NO: 2520919 - protein, 26 aa, Entamoeba dispar
DMVLRMAVRCSKQFKLNGIGIALCCH

SEQ ID NO: 2520920 - protein, 17 aa, Entamoeba dispar
DMWSFGCIAAELILGIP

SEQ ID NO: 2520921 - protein, 26 aa, Entamoeba dispar
DMWSFGCVVAELFLGIPLFAGSSEHN

SEQ ID NO: 2520922 - protein, 31 aa, Entamoeba dispar
DMWSIGVITYVLLCGYPPFFGDTLGEILSAV

SEQ ID NO: 2520923 - protein, 30 aa, Entamoeba dispar
DMWSLGCIAAEFFLGIPIFPGNSEYNQLYK

SEQ ID NO: 2520924 - protein, 27 aa, Entamoeba dispar
DMWSVGVMLYVCLCGYLPFDGDTIAEN

SEQ ID NO: 2520925 - protein, 25 aa, Entamoeba dispar
DNAHNLLLAKRWFSLSRLVMRYNSE

SEQ ID NO: 2520926 - protein, 34 aa, Entamoeba dispar
DNAIIPLKDIMYKINILILCRSDIKEYSIISEEI

SEQ ID NO: 2520927 - protein, 20 aa, Entamoeba dispar
DNAKWTAYLNDIVANATLNI

SEQ ID NO: 2520928 - protein, 24 aa, Entamoeba dispar
DNCKYIPCIYVINKIDAMEPSEVE

SEQ ID NO: 2520929 - protein, 23 aa, Entamoeba dispar
DNCLKALRRQLPISRQKINWANW

SEQ ID NO: 2520930 - protein, 32 aa, Entamoeba dispar
DNCPPEQLPESWKIILREAGVKKKDLQNPETR

SEQ ID NO: 2520931 - protein, 17 aa, Entamoeba dispar
DNCYRYANNLLPVVIRY

SEQ ID NO: 2520932 - protein, 23 aa, Entamoeba dispar
DNDCKRWFWELVQNAKDSIVNDP

SEQ ID NO: 2520933 - protein, 20 aa, Entamoeba dispar
DNDDEFFSDSLFGDDFFEDD

SEQ ID NO: 2520934 - protein, 25 aa, Entamoeba dispar
DNDFELYRVVIFKHALDDFKNECRT

SEQ ID NO: 2520935 - protein, 24 aa, Entamoeba dispar
DNDFFYIDSFIPSYNYKINPNVSD

SEQ ID NO: 2520936 - protein, 17 aa, Entamoeba dispar
DNDFKFVLTISKSVWDV

SEQ ID NO: 2520937 - protein, 20 aa, Entamoeba dispar
DNDLMQYLQSLYSFSIEDFN

SEQ ID NO: 2520938 - protein, 25 aa, Entamoeba dispar
DNDLYHWLDLLKFPIKSIQLIHKWR

SEQ ID NO: 2520939 - protein, 25 aa, Entamoeba dispar
DNDNFKINLPFKQEIIRENEELTER

SEQ ID NO: 2520940 - protein, 25 aa, Entamoeba dispar
DNDPYVRRNAVLGLLKLLHIPNTSI

SEQ ID NO: 2520941 - protein, 24 aa, Entamoeba dispar
DNDSLRFDIFSPEKSFSIIAANEQ

SEQ ID NO: 2520942 - protein, 18 aa, Entamoeba dispar
DNDSSRIQFLTFTAIQSI

SEQ ID NO: 2520943 - protein, 27 aa, Entamoeba dispar
DNDTLFLYLGEYWYNLMNWKIPEEQIV

SEQ ID NO: 2520944 - protein, 23 aa, Entamoeba dispar
DNDYLYLMMEYLAGGDMMTLLIR

SEQ ID NO: 2520945 - protein, 22 aa, Entamoeba dispar
DNEAYILDLSPVKETPGWTVRT

SEQ ID NO: 2520946 - protein, 22 aa, Entamoeba dispar
DNEIIFTIWCVLMGLKIMNMHD

SEQ ID NO: 2520947 - protein, 26 aa, Entamoeba dispar
DNEIRLTALWLLANLLGLAPSLSVVQ

SEQ ID NO: 2520948 - protein, 28 aa, Entamoeba dispar
DNEKFNFHLRQILAGLRKNKKLVDSLCS

SEQ ID NO: 2520949 - protein, 24 aa, Entamoeba dispar
DNELKILILQTFHMVQKQIDELKI

SEQ ID NO: 2520950 - protein, 23 aa, Entamoeba dispar
DNESLLKYFNSISEFLADCNVPS

SEQ ID NO: 2520951 - protein, 27 aa, Entamoeba dispar
DNEVIQTFFVIQLLKEKFPENKVEWKL

SEQ ID NO: 2520952 - protein, 22 aa, Entamoeba dispar
DNEYVLNQFVILSALDFIEEKK

SEQ ID NO: 2520953 - protein, 19 aa, Entamoeba dispar
DNFVRVLDRLQLDLDKYLC

SEQ ID NO: 2520954 - protein, 27 aa, Entamoeba dispar
DNGYALELFKLFVKYKCFIKVTYRSEL

SEQ ID NO: 2520955 - protein, 24 aa, Entamoeba dispar
DNIHRIHIKLQPWKEENSLVKNSR

SEQ ID NO: 2520956 - protein, 21 aa, Entamoeba dispar
DNIIIDHLFVFITQKYDNKYQ

SEQ ID NO: 2520957 - protein, 18 aa, Entamoeba dispar
DNILLKTVVTVPAYFDSS

SEQ ID NO: 2520958 - protein, 18 aa, Entamoeba dispar
DNIPPPPVAPAIGNPPPP

SEQ ID NO: 2520959 - protein, 19 aa, Entamoeba dispar
DNIVDYYILLLQHYSKEHD

SEQ ID NO: 2520960 - protein, 27 aa, Entamoeba dispar
DNKCKPIQWINPFAQASLCCDLSKLLV

SEQ ID NO: 2520961 - protein, 22 aa, Entamoeba dispar
DNKDIPLPKDFDWISSPFHTIF

SEQ ID NO: 2520962 - protein, 23 aa, Entamoeba dispar
DNKDKQFIYFYTLAKECVTNKMR

SEQ ID NO: 2520963 - protein, 28 aa, Entamoeba dispar
DNKEDIIRLYYVCLLNNFPVDEINQLMA

SEQ ID NO: 2520964 - protein, 23 aa, Entamoeba dispar
DNKEWVLLKEGYFGLVKFLNEEQ

SEQ ID NO: 2520965 - protein, 17 aa, Entamoeba dispar
DNKIIELNNIINDLKEE

SEQ ID NO: 2520966 - protein, 23 aa, Entamoeba dispar
DNKRGVYLKFFNNIEGFIPTIEL

SEQ ID NO: 2520967 - protein, 17 aa, Entamoeba dispar
DNKVKEAIAKKDQKVSS

SEQ ID NO: 2520968 - protein, 25 aa, Entamoeba dispar
DNKYDLYDYFLNNYPFFKNTNFDQF

SEQ ID NO: 2520969 - protein, 20 aa, Entamoeba dispar
DNKYFKTMTDILFYSIIEEE

SEQ ID NO: 2520970 - protein, 18 aa, Entamoeba dispar
DNLFVKNRYLIWSCSVIN

SEQ ID NO: 2520971 - protein, 21 aa, Entamoeba dispar
DNLILFVDYIRLREKLKKEIN

SEQ ID NO: 2520972 - protein, 28 aa, Entamoeba dispar
DNLKSIFQISMLFPNKTIQQLTMRVHWL

SEQ ID NO: 2520973 - protein, 37 aa, Entamoeba dispar
DNLNYAFLPRFPKTKQEGWYLIIIKPDGGLAAMKRIS

SEQ ID NO: 2520974 - protein, 22 aa, Entamoeba dispar
DNLPDVWFEPKDVWEIKGADLS

SEQ ID NO: 2520975 - protein, 26 aa, Entamoeba dispar
DNLSLDSLVLLHRLMYHKQGEDSERL

SEQ ID NO: 2520976 - protein, 21 aa, Entamoeba dispar
DNMNILDAIEFLKTLQRHKID

SEQ ID NO: 2520977 - protein, 21 aa, Entamoeba dispar
DNMVEWFPIIFNKVDVKKNEI

SEQ ID NO: 2520978 - protein, 23 aa, Entamoeba dispar
DNNCSLFTLGNRIGFIHITKTNN

SEQ ID NO: 2520979 - protein, 21 aa, Entamoeba dispar
DNNEFYATDLPPLGVSHNILQ

SEQ ID NO: 2520980 - protein, 25 aa, Entamoeba dispar
DNNELPIHFQIKKLFHSTIDSVVIK

SEQ ID NO: 2520981 - protein, 25 aa, Entamoeba dispar
DNNIKFIETLLITYRQYLAPTEFFN

SEQ ID NO: 2520982 - protein, 23 aa, Entamoeba dispar
DNNQLMDINIFKKCFNLRELSCA

SEQ ID NO: 2520983 - protein, 25 aa, Entamoeba dispar
DNNRLAVYIYIKDSNSIYGGIIQGE

SEQ ID NO: 2520984 - protein, 22 aa, Entamoeba dispar
DNNTEKCHIILLTDGYVDNKIN

SEQ ID NO: 2520985 - protein, 21 aa, Entamoeba dispar
DNNYNQLFYFESFNLSEKKID

SEQ ID NO: 2520986 - protein, 22 aa, Entamoeba dispar
DNNYTVVMPKSYHLILEKMHVK

SEQ ID NO: 2520987 - protein, 27 aa, Entamoeba dispar
DNPDDEFLKKYILEKKWEEIEDGKEDV

SEQ ID NO: 2520988 - protein, 17 aa, Entamoeba dispar
DNPEFWDNFVKLVYERG

SEQ ID NO: 2520989 - protein, 23 aa, Entamoeba dispar
DNPKFIITSTHPTSLFILLVALG

SEQ ID NO: 2520990 - protein, 23 aa, Entamoeba dispar
DNPSTMHFIYYSHNAWVKCHNEL

SEQ ID NO: 2520991 - protein, 29 aa, Entamoeba dispar
DNPYNLIEPYFLHQLLFSRKSKLYLFDCR

SEQ ID NO: 2520992 - protein, 22 aa, Entamoeba dispar
DNQKEYVMVQPTYQIPSNDYIP

SEQ ID NO: 2520993 - protein, 26 aa, Entamoeba dispar
DNQKNLVYFLCKYIHEKHPDLSHWME

SEQ ID NO: 2520994 - protein, 17 aa, Entamoeba dispar
DNQLVSLDKIKPFSDIN

SEQ ID NO: 2520995 - protein, 26 aa, Entamoeba dispar
DNQTEYFFDKLLPNGIYDFHLLNMKD

SEQ ID NO: 2520996 - protein, 28 aa, Entamoeba dispar
DNQTSADFIIYRGFGRYVTSIGMETITK

SEQ ID NO: 2520997 - protein, 18 aa, Entamoeba dispar
DNRKLLPLFGIKQDTQFF

SEQ ID NO: 2520998 - protein, 23 aa, Entamoeba dispar
DNRLRRKFKGTNLLPKIGYGSAK

SEQ ID NO: 2520999 - protein, 23 aa, Entamoeba dispar
DNSDLICFGANKKPSQLKDDTIT

SEQ ID NO: 2521000 - protein, 25 aa, Entamoeba dispar
DNSETHLIFKQYKPLYPQNMPEYPD

SEQ ID NO: 2521001 - protein, 24 aa, Entamoeba dispar
DNSFNQFLSFGYLFDQSENSYKLF

SEQ ID NO: 2521002 - protein, 24 aa, Entamoeba dispar
DNSFNQLLSFRYLFDQSEISYKLF

SEQ ID NO: 2521003 - protein, 19 aa, Entamoeba dispar
DNSLYSWYNGNPIYQSVFC

SEQ ID NO: 2521004 - protein, 26 aa, Entamoeba dispar
DNSPLIQYVIMWVIQRVGANIGFILT

SEQ ID NO: 2521005 - protein, 23 aa, Entamoeba dispar
DNSVTVSFIKVTQVSGKCNSNSA

SEQ ID NO: 2521006 - protein, 28 aa, Entamoeba dispar
DNTEDEFTQMFWKLGMKSFDDFIKKLIN

SEQ ID NO: 2521007 - protein, 27 aa, Entamoeba dispar
DNTEDGFTQMFWKLGMKNFDDFIEKLI

SEQ ID NO: 2521008 - protein, 28 aa, Entamoeba dispar
DNTEDGFTQMFWQLGMKNFDDFIEKLIK

SEQ ID NO: 2521009 - protein, 28 aa, Entamoeba dispar
DNTEDLFTQMFWQLGMKNFDDFIKKLTK

SEQ ID NO: 2521010 - protein, 28 aa, Entamoeba dispar
DNTGDEFTQIFWKLGMKNFDDFIEKLKK

SEQ ID NO: 2521011 - protein, 28 aa, Entamoeba dispar
DNTGDLFTQMFLELGMKSFDKFIEKLIK

SEQ ID NO: 2521012 - protein, 24 aa, Entamoeba dispar
DNTHRIHIKLQPWKEDNSLVKNSR

SEQ ID NO: 2521013 - protein, 32 aa, Entamoeba dispar
DNTIHIPLEPNDKGLFVCRAFSNNNSAGRFLS

SEQ ID NO: 2521014 - protein, 27 aa, Entamoeba dispar
DNTLPSSWRFWEVMAQDFCATSKESFH

SEQ ID NO: 2521015 - protein, 55 aa, Entamoeba dispar
DNTNAILKVLNVKRILSLMAMLVTLMRELNGIYYMFYEIIFNTFVSLHHDQRYKD

SEQ ID NO: 2521016 - protein, 17 aa, Entamoeba dispar
DNTPLHYFCLNFSNPNC

SEQ ID NO: 2521017 - protein, 30 aa, Entamoeba dispar
DNTPNFPQKFYFFILKSLQFIYQKEFVVIY

SEQ ID NO: 2521018 - protein, 17 aa, Entamoeba dispar
DNVCFCLISLRMTYEGV

SEQ ID NO: 2521019 - protein, 26 aa, Entamoeba dispar
DNVKYLMEWVEMNKMRILYDSVIDGS

SEQ ID NO: 2521020 - protein, 28 aa, Entamoeba dispar
DNVLQTLYILDLYLKYFSNLEELFILKD

SEQ ID NO: 2521021 - protein, 25 aa, Entamoeba dispar
DNVQIVAEKWLYDSIGSMKVMDYKS

SEQ ID NO: 2521022 - protein, 25 aa, Entamoeba dispar
DNYCFEGCLLVTLISLPPSIKVIEN

SEQ ID NO: 2521023 - protein, 21 aa, Entamoeba dispar
DNYFTWSFYQINNSLNIPLIK

SEQ ID NO: 2521024 - protein, 23 aa, Entamoeba dispar
DNYKFFKELFFSKSQTQFYVFRD

SEQ ID NO: 2521025 - protein, 23 aa, Entamoeba dispar
DNYTTYLSICASLIQSPSAAISL

SEQ ID NO: 2521026 - protein, 18 aa, Entamoeba dispar
DNYVILNKDLLKEIINSK

SEQ ID NO: 2521027 - protein, 24 aa, Entamoeba dispar
DPAARAAGIQQTNPLDAFKNAGLF

SEQ ID NO: 2521028 - protein, 27 aa, Entamoeba dispar
DPAIHHQFLSPYFFAFTNLGNTGINQF

SEQ ID NO: 2521029 - protein, 30 aa, Entamoeba dispar
DPDDSISYKWKLFTIWDTIKGEIVAMKMKG

SEQ ID NO: 2521030 - protein, 32 aa, Entamoeba dispar
DPDHFIFSLLSDSIPPTKWMKVPTPQKFLNGI

SEQ ID NO: 2521031 - protein, 36 aa, Entamoeba dispar
DPDYGPIALPLHMGDRLFFVPPKVLSKNGSEYFVPS

SEQ ID NO: 2521032 - protein, 23 aa, Entamoeba dispar
DPEEFKRKYLPNVQTKRVKSEAK

SEQ ID NO: 2521033 - protein, 21 aa, Entamoeba dispar
DPEVTIYGKFWTRESNPQYLS

SEQ ID NO: 2521034 - protein, 20 aa, Entamoeba dispar
DPFSFKILLPRIVLNQKEEA

SEQ ID NO: 2521035 - protein, 25 aa, Entamoeba dispar
DPGWTYSLDLLLIRSIATKGYKKMF

SEQ ID NO: 2521036 - protein, 32 aa, Entamoeba dispar
DPIDCHPKFMIFTLIPVPPLCVRPSIVSEGAK

SEQ ID NO: 2521037 - protein, 18 aa, Entamoeba dispar
DPIFSIGIVLNTLNKRFN

SEQ ID NO: 2521038 - protein, 19 aa, Entamoeba dispar
DPIIPSKPLILILGSMPGT

SEQ ID NO: 2521039 - protein, 24 aa, Entamoeba dispar
DPIIPSKPLILILGSMPGTESLKK

SEQ ID NO: 2521040 - protein, 26 aa, Entamoeba dispar
DPITHQAQFLSSSKFTILLNRELLNN

SEQ ID NO: 2521041 - protein, 21 aa, Entamoeba dispar
DPIYKELTRSTKHPLGGTAYL

SEQ ID NO: 2521042 - protein, 21 aa, Entamoeba dispar
DPKELLCIFQQYGDVKTIHYS

SEQ ID NO: 2521043 - protein, 23 aa, Entamoeba dispar
DPKMTSFLNDDTWKKQIDMEWKR

SEQ ID NO: 2521044 - protein, 26 aa, Entamoeba dispar
DPKPNTIRAFYRLLEQHRKNAQGDPF

SEQ ID NO: 2521045 - protein, 24 aa, Entamoeba dispar
DPLCLDEYPLLLRMVEDDVIAPLK

SEQ ID NO: 2521046 - protein, 18 aa, Entamoeba dispar
DPLFCICITRRELLQFPS

SEQ ID NO: 2521047 - protein, 17 aa, Entamoeba dispar
DPLLLYPKQSIKNKSIN

SEQ ID NO: 2521048 - protein, 29 aa, Entamoeba dispar
DPLQDKLLKCISYFLPFISDKNILKEKQN

SEQ ID NO: 2521049 - protein, 26 aa, Entamoeba dispar
DPLTSSFYLGYNMVLNLMKLEAADPE

SEQ ID NO: 2521050 - protein, 26 aa, Entamoeba dispar
DPMKRDYLTILQRLLPLGATGQKMIG

SEQ ID NO: 2521051 - protein, 19 aa, Entamoeba dispar
DPMMMYQQFFLQPMGSAQQ

SEQ ID NO: 2521052 - protein, 24 aa, Entamoeba dispar
DPNDEVFLNSFIPSSLHDLNEPIR

SEQ ID NO: 2521053 - protein, 28 aa, Entamoeba dispar
DPNKSFFHIGLLLITPTKGNILQLRCIS

SEQ ID NO: 2521054 - protein, 28 aa, Entamoeba dispar
DPNKSFFHIGLLLITPTKGNLFQLRYIS

SEQ ID NO: 2521055 - protein, 24 aa, Entamoeba dispar
DPNNYFYFQKCHGCALVFDRTSQE

SEQ ID NO: 2521056 - protein, 17 aa, Entamoeba dispar
DPNPKPTSAHTYSSYHT

SEQ ID NO: 2521057 - protein, 29 aa, Entamoeba dispar
DPNVNSFLKKFYYTMKEPSYIDWKINNSE

SEQ ID NO: 2521058 - protein, 31 aa, Entamoeba dispar
DPQVNSFLKTYYFTMRDPQYLEWRLNNDTKV

SEQ ID NO: 2521059 - protein, 23 aa, Entamoeba dispar
DPREILLLPCRHITMCAGCYEEV

SEQ ID NO: 2521060 - protein, 25 aa, Entamoeba dispar
DPRFPTIQGLIRRGLTLEAMKEFCL

SEQ ID NO: 2521061 - protein, 17 aa, Entamoeba dispar
DPRSSIMPFRDGGHLIW

SEQ ID NO: 2521062 - protein, 24 aa, Entamoeba dispar
DPSLDNNAIMSMKFMKRARAKEIE

SEQ ID NO: 2521063 - protein, 25 aa, Entamoeba dispar
DPSLDNNAIMSMKFMKRARAKEIEE

SEQ ID NO: 2521064 - protein, 24 aa, Entamoeba dispar
DPSLQKIWNLFVTSYKTIHTDRKL

SEQ ID NO: 2521065 - protein, 36 aa, Entamoeba dispar
DPSLVSRFDLWLNKYYPFGQLKLKELFLTINNDIHG

SEQ ID NO: 2521066 - protein, 17 aa, Entamoeba dispar
DPSTLFIPASCLMKMTP

SEQ ID NO: 2521067 - protein, 24 aa, Entamoeba dispar
DPSTPEWFLHNKHMFVYTLAGKPV

SEQ ID NO: 2521068 - protein, 21 aa, Entamoeba dispar
DPTFYLKYLDVKVDTPCVEVD

SEQ ID NO: 2521069 - protein, 24 aa, Entamoeba dispar
DPTKMELYIKLAGIKPRKHKGTDK

SEQ ID NO: 2521070 - protein, 22 aa, Entamoeba dispar
DPTKYRNIFPKGAKVMKYSNIP

SEQ ID NO: 2521071 - protein, 25 aa, Entamoeba dispar
DPTLLLHLSQILLITFTSLSDLNLF

SEQ ID NO: 2521072 - protein, 25 aa, Entamoeba dispar
DPTSNYLIPILSLNEECHYGIFICS

SEQ ID NO: 2521073 - protein, 25 aa, Entamoeba dispar
DPTSPRLICQWIQGIKRIDLDEENG

SEQ ID NO: 2521074 - protein, 24 aa, Entamoeba dispar
DPTTFIFSLRNPMKRSPIKFPFTG

SEQ ID NO: 2521075 - protein, 17 aa, Entamoeba dispar
DPVIFPNVSYPTADCKR

SEQ ID NO: 2521076 - protein, 20 aa, Entamoeba dispar
DPVRDQWYVDTMLLATCLGG

SEQ ID NO: 2521077 - protein, 29 aa, Entamoeba dispar
DPVVNSLLKKFYYTMKEPSYIDWKINTSG

SEQ ID NO: 2521078 - protein, 23 aa, Entamoeba dispar
DPYTNKLVIYWDVERNGKSEIID

SEQ ID NO: 2521079 - protein, 26 aa, Entamoeba dispar
DQCAKGIIWALLTIKGVIQNEPDLNK

SEQ ID NO: 2521080 - protein, 23 aa, Entamoeba dispar
DQCDIVFQKPFKISKKTLQFLTL

SEQ ID NO: 2521081 - protein, 20 aa, Entamoeba dispar
DQCVPLPQQPYYIQTTPPQG

SEQ ID NO: 2521082 - protein, 18 aa, Entamoeba dispar
DQCWGAHMIGHEITAYYG

SEQ ID NO: 2521083 - protein, 23 aa, Entamoeba dispar
DQDFASVFFSLENPQFFCGSQRG

SEQ ID NO: 2521084 - protein, 36 aa, Entamoeba dispar
DQDKVLDAVLRFCYLWFNFMPLTRGTAGCGMYWMFG

SEQ ID NO: 2521085 - protein, 22 aa, Entamoeba dispar
DQDYLIRMKGIPKSAIIGTANE

SEQ ID NO: 2521086 - protein, 23 aa, Entamoeba dispar
DQDYLIRMKGIPKSAIIGTANEK

SEQ ID NO: 2521087 - protein, 20 aa, Entamoeba dispar
DQDYLIRMKGITKSAIIGTA

SEQ ID NO: 2521088 - protein, 28 aa, Entamoeba dispar
DQESPFKSIVPFALRGPLQRYQRESGKI

SEQ ID NO: 2521089 - protein, 18 aa, Entamoeba dispar
DQETFFKDTVSKMIKRVI

SEQ ID NO: 2521090 - protein, 32 aa, Entamoeba dispar
DQFIENLWQFDISNLIWRKLGNLENFKLGREH

SEQ ID NO: 2521091 - protein, 21 aa, Entamoeba dispar
DQFITFQWELFDTDLNPIDYF

SEQ ID NO: 2521092 - protein, 29 aa, Entamoeba dispar
DQFKKQILMYLVPLKLRCGMYLPMEEMKK

SEQ ID NO: 2521093 - protein, 17 aa, Entamoeba dispar
DQFWSLASITIATTIKE

SEQ ID NO: 2521094 - protein, 19 aa, Entamoeba dispar
DQHILQRPQQKKPMILPSV

SEQ ID NO: 2521095 - protein, 20 aa, Entamoeba dispar
DQHSLLRFITTKATSITSCF

SEQ ID NO: 2521096 - protein, 26 aa, Entamoeba dispar
DQHVSRIIVIFNMVYPEDLIDQQRYI

SEQ ID NO: 2521097 - protein, 17 aa, Entamoeba dispar
DQIPLIKRLWDPETGNK

SEQ ID NO: 2521098 - protein, 23 aa, Entamoeba dispar
DQIPTEHLPFYSRVTNLLESLGY

SEQ ID NO: 2521099 - protein, 23 aa, Entamoeba dispar
DQKTDTTLLWAIPKTGRMHQIRV

SEQ ID NO: 2521100 - protein, 23 aa, Entamoeba dispar
DQLHKIFDILGTPKPIDYPDLDY

SEQ ID NO: 2521101 - protein, 18 aa, Entamoeba dispar
DQLKQVLTLVLFGAEITT

SEQ ID NO: 2521102 - protein, 23 aa, Entamoeba dispar
DQLKTPVLKFLSQKQIKINHNKE

SEQ ID NO: 2521103 - protein, 19 aa, Entamoeba dispar
DQLLVRHDLLKYLKEFPTV

SEQ ID NO: 2521104 - protein, 18 aa, Entamoeba dispar
DQLSFALIRAQSLTLPDS

SEQ ID NO: 2521105 - protein, 27 aa, Entamoeba dispar
DQLVLQICILFLCPFNQNVIQISQLLK

SEQ ID NO: 2521106 - protein, 22 aa, Entamoeba dispar
DQLVPELAIRFGCSRIGFICNT

SEQ ID NO: 2521107 - protein, 29 aa, Entamoeba dispar
DQMLRVHKPLHFTSKYAYLTLWGDEISNE

SEQ ID NO: 2521108 - protein, 18 aa, Entamoeba dispar
DQMQLFELLQLRCEEITK

SEQ ID NO: 2521109 - protein, 36 aa, Entamoeba dispar
DQMTCTYLNIFIQQLYSWLQDLLHICRVRVCPSNEP

SEQ ID NO: 2521110 - protein, 23 aa, Entamoeba dispar
DQNHFIFVIQNFSTKPTLYHPVN

SEQ ID NO: 2521111 - protein, 17 aa, Entamoeba dispar
DQNNQIHIGRYIKKLMI

SEQ ID NO: 2521112 - protein, 17 aa, Entamoeba dispar
DQNQLHFFTIDSSWKEI

SEQ ID NO: 2521113 - protein, 26 aa, Entamoeba dispar
DQNYVAFMLFILPHTTLNYSELLSAH

SEQ ID NO: 2521114 - protein, 24 aa, Entamoeba dispar
DQQKNPFLPIFYHHQFVSVLEKYI

SEQ ID NO: 2521115 - protein, 27 aa, Entamoeba dispar
DQQKVLLVPQGLFVQPTLVSPMGIQKE

SEQ ID NO: 2521116 - protein, 24 aa, Entamoeba dispar
DQQPPFPYPNWRSVVLPQGYVMYY

SEQ ID NO: 2521117 - protein, 21 aa, Entamoeba dispar
DQQRIITLLLNEQFELRSSVI

SEQ ID NO: 2521118 - protein, 23 aa, Entamoeba dispar
DQQRYIELIDDIRFVCQEYGEVE

SEQ ID NO: 2521119 - protein, 24 aa, Entamoeba dispar
DQQTNSFVFVLPEGFKTNTTSSQQ

SEQ ID NO: 2521120 - protein, 17 aa, Entamoeba dispar
DQRLQLFIQLIQNTKKA

SEQ ID NO: 2521121 - protein, 22 aa, Entamoeba dispar
DQSIKWISSLLNLTQSVEIRLR

SEQ ID NO: 2521122 - protein, 24 aa, Entamoeba dispar
DQSLKRMEFLSNGLEKYLNEMVMI

SEQ ID NO: 2521123 - protein, 27 aa, Entamoeba dispar
DQSNKIPLPLALLPEYIIGILSDFIHS

SEQ ID NO: 2521124 - protein, 20 aa, Entamoeba dispar
DQTGLRFFTGCVDKTIKMYA

SEQ ID NO: 2521125 - protein, 25 aa, Entamoeba dispar
DQVEWEIFKLIRNAVTYNGPNSPIG

SEQ ID NO: 2521126 - protein, 25 aa, Entamoeba dispar
DQVGSDDVFFLLSSSFPESLSDPHS

SEQ ID NO: 2521127 - protein, 34 aa, Entamoeba dispar
DQVMTAFTILYNYFTTLLIPKTIIINGTFGEYTT

SEQ ID NO: 2521128 - protein, 24 aa, Entamoeba dispar
DQVSLLQLLIPFLQSLYLYRNTYS

SEQ ID NO: 2521129 - protein, 24 aa, Entamoeba dispar
DQVTFNKWKLISEITKLMGNRFYI

SEQ ID NO: 2521130 - protein, 24 aa, Entamoeba dispar
DQVTFSKWKLISDITKLMGNKFYI

SEQ ID NO: 2521131 - protein, 17 aa, Entamoeba dispar
DQYIIKSIIKNIIYFYI

SEQ ID NO: 2521132 - protein, 28 aa, Entamoeba dispar
DRALELWYNFYYLFEGIFNHSLNESYEH

SEQ ID NO: 2521133 - protein, 18 aa, Entamoeba dispar
DRCLSLTSIIIPTPISKI

SEQ ID NO: 2521134 - protein, 39 aa, Entamoeba dispar
DRCLTTLFEMKQFPVIILKDNPVIFLLRSHREALKKEYE

SEQ ID NO: 2521135 - protein, 24 aa, Entamoeba dispar
DRDLDWRILALQFIQFKDLEINFL

SEQ ID NO: 2521136 - protein, 17 aa, Entamoeba dispar
DRDPYLSYICYKRKNLD

SEQ ID NO: 2521137 - protein, 17 aa, Entamoeba dispar
DREIAYNLSLIYYKSGN

SEQ ID NO: 2521138 - protein, 39 aa, Entamoeba dispar
DRFKTDDFLGTCQLPLKMPINGDVWLKLSVQGRIHVKLE

SEQ ID NO: 2521139 - protein, 24 aa, Entamoeba dispar
DRFNKFIRRYFQVSAQQQVIQQQP

SEQ ID NO: 2521140 - protein, 30 aa, Entamoeba dispar
DRFPPQIGFLFYTLRLKIINGYPSSMNSFL

SEQ ID NO: 2521141 - protein, 29 aa, Entamoeba dispar
DRFVSDDGFLRCIIGNKADMEKKVEESVI

SEQ ID NO: 2521142 - protein, 17 aa, Entamoeba dispar
DRGLFRSMAFKTFSEDA

SEQ ID NO: 2521143 - protein, 24 aa, Entamoeba dispar
DRIEQNLYGIRYYLPIIQYIGELR

SEQ ID NO: 2521144 - protein, 20 aa, Entamoeba dispar
DRIKIFLTKTLNGKANLLST

SEQ ID NO: 2521145 - protein, 17 aa, Entamoeba dispar
DRIKLLINKLQREKIVG

SEQ ID NO: 2521146 - protein, 17 aa, Entamoeba dispar
DRIVTCWDLRTPCRSPI

SEQ ID NO: 2521147 - protein, 18 aa, Entamoeba dispar
DRKIRLWNLQDESSRTFV

SEQ ID NO: 2521148 - protein, 23 aa, Entamoeba dispar
DRKKDILDLINPSSTVIITNPRL

SEQ ID NO: 2521149 - protein, 22 aa, Entamoeba dispar
DRKLARHIISLYWGHEIITDAL

SEQ ID NO: 2521150 - protein, 24 aa, Entamoeba dispar
DRKLEQITELLPLLLKGVGMHHSG

SEQ ID NO: 2521151 - protein, 23 aa, Entamoeba dispar
DRKVRLWTLPNPSTKTSQVFSGP

SEQ ID NO: 2521152 - protein, 17 aa, Entamoeba dispar
DRLILFDGGFKIINEDE

SEQ ID NO: 2521153 - protein, 18 aa, Entamoeba dispar
DRLILFDGGFKIINEDEI

SEQ ID NO: 2521154 - protein, 31 aa, Entamoeba dispar
DRLKKRPSFILFIKYYFIHVLQLEVNETSSQ

SEQ ID NO: 2521155 - protein, 26 aa, Entamoeba dispar
DRLRERLYYDIYSFITRRTKDIIITI

SEQ ID NO: 2521156 - protein, 27 aa, Entamoeba dispar
DRMRDDYAKLIFILQDITVNSINEELG

SEQ ID NO: 2521157 - protein, 25 aa, Entamoeba dispar
DRNGPLIMSIIRLLPNTINSEMIGV

SEQ ID NO: 2521158 - protein, 18 aa, Entamoeba dispar
DRNKLLSIFVPLITPDLM

SEQ ID NO: 2521159 - protein, 30 aa, Entamoeba dispar
DRPAGKGTLFLWFAYTPLKNSRKEFTEMTK

SEQ ID NO: 2521160 - protein, 21 aa, Entamoeba dispar
DRPVWKFFKNVIEKMSLTGII

SEQ ID NO: 2521161 - protein, 20 aa, Entamoeba dispar
DRRLPLIDIISFTLNICKAI

SEQ ID NO: 2521162 - protein, 17 aa, Entamoeba dispar
DRRQAYELLKKDAINFM

SEQ ID NO: 2521163 - protein, 21 aa, Entamoeba dispar
DRRRKIMSISIKRNEYDFLQH

SEQ ID NO: 2521164 - protein, 21 aa, Entamoeba dispar
DRSFHYLIKMLCLEDLMSLRC

SEQ ID NO: 2521165 - protein, 25 aa, Entamoeba dispar
DRSKRRTLFFFKKKDKKELPKSLTP

SEQ ID NO: 2521166 - protein, 17 aa, Entamoeba dispar
DRTVFIANINIKVKPAQ

SEQ ID NO: 2521167 - protein, 19 aa, Entamoeba dispar
DRVFNIISVDIDPVMKMIA

SEQ ID NO: 2521168 - protein, 25 aa, Entamoeba dispar
DRVKDMVIEILKEQVIFLNEEIIRK

SEQ ID NO: 2521169 - protein, 31 aa, Entamoeba dispar
DRVRTAPFFTLQEKLFIAYQLINAVNSLHSL

SEQ ID NO: 2521170 - protein, 20 aa, Entamoeba dispar
DRWLNACEWVIRNISQSSPE

SEQ ID NO: 2521171 - protein, 26 aa, Entamoeba dispar
DSAGLYVLYCYYSTYPLSCSASVQLK

SEQ ID NO: 2521172 - protein, 36 aa, Entamoeba dispar
DSAQQSFLFRILVDNGFTIFLKKLYKKGKTTSQLFV

SEQ ID NO: 2521173 - protein, 20 aa, Entamoeba dispar
DSCQLLFDCISRDFLQCDIK

SEQ ID NO: 2521174 - protein, 23 aa, Entamoeba dispar
DSCYPLFAIVDPCHSFTLPDNQI

SEQ ID NO: 2521175 - protein, 18 aa, Entamoeba dispar
DSDPWISQILSLQQINNQ

SEQ ID NO: 2521176 - protein, 24 aa, Entamoeba dispar
DSDVLLFPVIVLYPESNQSDCLRD

SEQ ID NO: 2521177 - protein, 25 aa, Entamoeba dispar
DSEDLYKIFNKWISSGLFSSKKLLE

SEQ ID NO: 2521178 - protein, 34 aa, Entamoeba dispar
DSEETKSQLLIKKKKYVNPIEKFRPKTKKDKQEK

SEQ ID NO: 2521179 - protein, 25 aa, Entamoeba dispar
DSELWDLRMLKLKKTTDLLSGCYSR

SEQ ID NO: 2521180 - protein, 24 aa, Entamoeba dispar
DSEMPPLDDLQLLDPRVYSEEFEI

SEQ ID NO: 2521181 - protein, 28 aa, Entamoeba dispar
DSERLDDILLFSGFKDIKQREAAIRIAQ

SEQ ID NO: 2521182 - protein, 29 aa, Entamoeba dispar
DSESGYKFILGMMFSLYRKYCICRSVSDE

SEQ ID NO: 2521183 - protein, 28 aa, Entamoeba dispar
DSETIQTYILMIRTIQRNRDRTMIDSTD

SEQ ID NO: 2521184 - protein, 17 aa, Entamoeba dispar
DSEYYWESYSHPGIHDE

SEQ ID NO: 2521185 - protein, 29 aa, Entamoeba dispar
DSFAFRLNAPNLKLDFPRAFLIMELCDGG

SEQ ID NO: 2521186 - protein, 20 aa, Entamoeba dispar
DSFDYVISKLFSSLTQWLDY

SEQ ID NO: 2521187 - protein, 20 aa, Entamoeba dispar
DSFFFLLQKSLEESIEFIEE

SEQ ID NO: 2521188 - protein, 20 aa, Entamoeba dispar
DSFICSFATYDKLNYIPLNF

SEQ ID NO: 2521189 - protein, 20 aa, Entamoeba dispar
DSFPIYRLEHLFLQLNDNDK

SEQ ID NO: 2521190 - protein, 18 aa, Entamoeba dispar
DSFTLEGVAFKKCFSYAG

SEQ ID NO: 2521191 - protein, 28 aa, Entamoeba dispar
DSFYDYINRIFFYYQLLNITVNKEESTN

SEQ ID NO: 2521192 - protein, 25 aa, Entamoeba dispar
DSGVGKSCLLLRFADDTYTDTHIAT

SEQ ID NO: 2521193 - protein, 21 aa, Entamoeba dispar
DSHFPCDFVTTYLATYLLLQP

SEQ ID NO: 2521194 - protein, 18 aa, Entamoeba dispar
DSIELMIDLFGNYVIQKL

SEQ ID NO: 2521195 - protein, 23 aa, Entamoeba dispar
DSIELYKRFDLESLKMQIQQEEL

SEQ ID NO: 2521196 - protein, 20 aa, Entamoeba dispar
DSIIIAELILLVINDLRLYL

SEQ ID NO: 2521197 - protein, 18 aa, Entamoeba dispar
DSIIPRLLSEELNKLRLS

SEQ ID NO: 2521198 - protein, 31 aa, Entamoeba dispar
DSIISFLMKYKFAELALLFVRDVHAKFAIAL

SEQ ID NO: 2521199 - protein, 26 aa, Entamoeba dispar
DSIKDSLIVTPLLQIIKIDLSHSKQK

SEQ ID NO: 2521200 - protein, 28 aa, Entamoeba dispar
DSIKIPKFYFLIDLIDRLIPKKTQSKLE

SEQ ID NO: 2521201 - protein, 28 aa, Entamoeba dispar
DSILKRCWYKKRPTILKIYNKDMQSYFN

SEQ ID NO: 2521202 - protein, 17 aa, Entamoeba dispar
DSIMEHVLPVLEKRFRL

SEQ ID NO: 2521203 - protein, 22 aa, Entamoeba dispar
DSINFYAVMPKFETTVWDLLIK

SEQ ID NO: 2521204 - protein, 25 aa, Entamoeba dispar
DSINWDYFISKVKRINPSLFYLCEG

SEQ ID NO: 2521205 - protein, 22 aa, Entamoeba dispar
DSIQTGFVLCSPSDVCHFTNLF

SEQ ID NO: 2521206 - protein, 24 aa, Entamoeba dispar
DSISDALWAFYYVSSKSKFSDLID

SEQ ID NO: 2521207 - protein, 18 aa, Entamoeba dispar
DSKKNRLKFMMRNGLINN

SEQ ID NO: 2521208 - protein, 25 aa, Entamoeba dispar
DSKNEILIYFPKTFGFCISAQPNYT

SEQ ID NO: 2521209 - protein, 17 aa, Entamoeba dispar
DSKRFITASADKTCKIW

SEQ ID NO: 2521210 - protein, 24 aa, Entamoeba dispar
DSKVIIKIICFICSFITEKEEIQE

SEQ ID NO: 2521211 - protein, 21 aa, Entamoeba dispar
DSLEGFFFCHSICGGTGSGLG

SEQ ID NO: 2521212 - protein, 19 aa, Entamoeba dispar
DSLELFGTLVSWIDISFST

SEQ ID NO: 2521213 - protein, 30 aa, Entamoeba dispar
DSLHFTRRLEYWNFHYNIGGPFLTIEESMK

SEQ ID NO: 2521214 - protein, 24 aa, Entamoeba dispar
DSLHLPKRLDLCDFFFTSIEISLC

SEQ ID NO: 2521215 - protein, 26 aa, Entamoeba dispar
DSLKEYIKLYFFDGEKYRNDLLPYFI

SEQ ID NO: 2521216 - protein, 17 aa, Entamoeba dispar
DSLKLYLNQVMYNMGIS

SEQ ID NO: 2521217 - protein, 18 aa, Entamoeba dispar
DSLLFFMNNQFKTKSVGV

SEQ ID NO: 2521218 - protein, 28 aa, Entamoeba dispar
DSLLNDEMLLNTPFLILGNKIDIPGAVS

SEQ ID NO: 2521219 - protein, 25 aa, Entamoeba dispar
DSLNIGLIHIFFKQKLEISLVPQSL

SEQ ID NO: 2521220 - protein, 24 aa, Entamoeba dispar
DSLPYSLIDYVSSPMTYLMGVPSE

SEQ ID NO: 2521221 - protein, 31 aa, Entamoeba dispar
DSLREMFFSPKNTLLYCFCDSLLKQDVNVSY

SEQ ID NO: 2521222 - protein, 26 aa, Entamoeba dispar
DSLSQLYSIFMSKLSPLFSAFEYDGT

SEQ ID NO: 2521223 - protein, 19 aa, Entamoeba dispar
DSLSYIISLYKQKGDYKNA

SEQ ID NO: 2521224 - protein, 18 aa, Entamoeba dispar
DSLTSYGLKLFYLSNDII

SEQ ID NO: 2521225 - protein, 28 aa, Entamoeba dispar
DSLVTQLFEIIGYLFIYHSEYCEIYFET

SEQ ID NO: 2521226 - protein, 26 aa, Entamoeba dispar
DSMKTAKYFFAHIIAELIKIDSGSLT

SEQ ID NO: 2521227 - protein, 25 aa, Entamoeba dispar
DSMQRHQIWRIIFSSSATVYGEPEV

SEQ ID NO: 2521228 - protein, 17 aa, Entamoeba dispar
DSNAHPILLCFQSSPIF

SEQ ID NO: 2521229 - protein, 23 aa, Entamoeba dispar
DSNELIIGIKYPTSFKITYHFRS

SEQ ID NO: 2521230 - protein, 18 aa, Entamoeba dispar
DSNFVIPMYFVDSSPDEG

SEQ ID NO: 2521231 - protein, 18 aa, Entamoeba dispar
DSNGGYLLYGIKVGEISN

SEQ ID NO: 2521232 - protein, 17 aa, Entamoeba dispar
DSNKKRLIIIDKMIYKI

SEQ ID NO: 2521233 - protein, 18 aa, Entamoeba dispar
DSNKPFPEKSLPGLLIYK

SEQ ID NO: 2521234 - protein, 23 aa, Entamoeba dispar
DSNKWIPVYIQLYNSECLNHLSI

SEQ ID NO: 2521235 - protein, 23 aa, Entamoeba dispar
DSNTVVLCPSLVHYYEVSIKGKS

SEQ ID NO: 2521236 - protein, 17 aa, Entamoeba dispar
DSPINCQLIGNSKVQFY

SEQ ID NO: 2521237 - protein, 24 aa, Entamoeba dispar
DSPLKILVLTPYRRNYYFKKKAKP

SEQ ID NO: 2521238 - protein, 25 aa, Entamoeba dispar
DSPRFKWRGLMVDLARNAISKLTLV

SEQ ID NO: 2521239 - protein, 22 aa, Entamoeba dispar
DSPTCLTAHPTYPLLLVGCIDG

SEQ ID NO: 2521240 - protein, 21 aa, Entamoeba dispar
DSPVIPVMLYHTGKIKDICRI

SEQ ID NO: 2521241 - protein, 24 aa, Entamoeba dispar
DSQIAFVMKEIIMGLAYLHGNNMI

SEQ ID NO: 2521242 - protein, 31 aa, Entamoeba dispar
DSQIRTLQETFTSLYTKKLSLQEKINTLLEQ

SEQ ID NO: 2521243 - protein, 24 aa, Entamoeba dispar
DSQLSFFQYFPKKKQLPSNPMNQC

SEQ ID NO: 2521244 - protein, 50 aa, Entamoeba dispar
DSQLSIIEFFIAMACLNHYVLFKKLPIKIPIYFINFLKKRFNDVQNDVFK

SEQ ID NO: 2521245 - protein, 23 aa, Entamoeba dispar
DSQQIFIDIICITIAIIELHREF

SEQ ID NO: 2521246 - protein, 26 aa, Entamoeba dispar
DSRFKKDARFKNFSKGKKTKLDPRFK

SEQ ID NO: 2521247 - protein, 23 aa, Entamoeba dispar
DSRTIRVIWITLLSCIQQPQLPK

SEQ ID NO: 2521248 - protein, 26 aa, Entamoeba dispar
DSSDIFFSECFILVHPLVVSSCKLME

SEQ ID NO: 2521249 - protein, 24 aa, Entamoeba dispar
DSSENILLQPELSLRFIHVPTDVG

SEQ ID NO: 2521250 - protein, 28 aa, Entamoeba dispar
DSSISLLNNYLLPLLDKRDIPTLCSSII

SEQ ID NO: 2521251 - protein, 19 aa, Entamoeba dispar
DSSNVATPIILPTQQQQPK

SEQ ID NO: 2521252 - protein, 26 aa, Entamoeba dispar
DSSSLALIHYILLRGLSDPTHLIRAK

SEQ ID NO: 2521253 - protein, 24 aa, Entamoeba dispar
DSTDFVFLLSTRAGGLGINLTTAD

SEQ ID NO: 2521254 - protein, 35 aa, Entamoeba dispar
DSTFKYLCQFLTNVGILIKYTYPEGILSINFNFRL

SEQ ID NO: 2521255 - protein, 28 aa, Entamoeba dispar
DSTGDLFTQMYWKIGMKNFDKFIEKLIK

SEQ ID NO: 2521256 - protein, 20 aa, Entamoeba dispar
DSVAFIPLFSKNGSIMDSGI

SEQ ID NO: 2521257 - protein, 24 aa, Entamoeba dispar
DSVDLLFTAVFVFASSMTQQQVME

SEQ ID NO: 2521258 - protein, 23 aa, Entamoeba dispar
DSVLAMVHGYKPYFYISVEKEYT

SEQ ID NO: 2521259 - protein, 28 aa, Entamoeba dispar
DSVLEPAAKERLASIALVKPEKARQVGD

SEQ ID NO: 2521260 - protein, 22 aa, Entamoeba dispar
DSVYLLRCQIINTCISFMEEYS

SEQ ID NO: 2521261 - protein, 34 aa, Entamoeba dispar
DSWKLINKFSYWIEPIMSNFLYESPMILYSPQQQ

SEQ ID NO: 2521262 - protein, 42 aa, Entamoeba dispar
DSWQNQLISYIKAVDLPPELAPLPPLPPKVHGKRKKALPPIP

SEQ ID NO: 2521263 - protein, 26 aa, Entamoeba dispar
DSYFSKSSLSFLRYRNLCSVQHLLDQ

SEQ ID NO: 2521264 - protein, 27 aa, Entamoeba dispar
DSYKEPPFAYWIYYVHTNIHVLNNLRR

SEQ ID NO: 2521265 - protein, 18 aa, Entamoeba dispar
DSYLHWIAASPPSSLKNS

SEQ ID NO: 2521266 - protein, 31 aa, Entamoeba dispar
DSYYFQDCIDFILKLLPKDKLLALRVIESLT

SEQ ID NO: 2521267 - protein, 25 aa, Entamoeba dispar
DTANCFMKALYQKAIFINKNNVRDE

SEQ ID NO: 2521268 - protein, 18 aa, Entamoeba dispar
DTCIFFENRKHTDLYLWF

SEQ ID NO: 2521269 - protein, 18 aa, Entamoeba dispar
DTCSLLKSILLPSTISEL

SEQ ID NO: 2521270 - protein, 20 aa, Entamoeba dispar
DTDSLMVRPPKISLKDLKNF

SEQ ID NO: 2521271 - protein, 20 aa, Entamoeba dispar
DTEFQRLFIVKSADAKNVKK

SEQ ID NO: 2521272 - protein, 23 aa, Entamoeba dispar
DTEKWDALFKYIGVLKYVEMVED

SEQ ID NO: 2521273 - protein, 19 aa, Entamoeba dispar
DTENDSEMPPLDDLQLLDP

SEQ ID NO: 2521274 - protein, 24 aa, Entamoeba dispar
DTEPSIPNLFKYLSTHSFVSLTRK

SEQ ID NO: 2521275 - protein, 28 aa, Entamoeba dispar
DTFEQHYQLLLSKRLLYKGFQAEDEKIV

SEQ ID NO: 2521276 - protein, 21 aa, Entamoeba dispar
DTFEYPLDLHTFLHPSLPTTK

SEQ ID NO: 2521277 - protein, 17 aa, Entamoeba dispar
DTFLMLQKQFQDLVLQP

SEQ ID NO: 2521278 - protein, 26 aa, Entamoeba dispar
DTFTSSTFIMVIFSNPCLTFTNVAMN

SEQ ID NO: 2521279 - protein, 24 aa, Entamoeba dispar
DTFYYIVMECSAYGSLFNFISMNP

SEQ ID NO: 2521280 - protein, 19 aa, Entamoeba dispar
DTGLLVYSLKDWVFTSIDS

SEQ ID NO: 2521281 - protein, 25 aa, Entamoeba dispar
DTGSHLPFIVSWGKEYWMKKDEYDE

SEQ ID NO: 2521282 - protein, 19 aa, Entamoeba dispar
DTHIFVISHRLGWADGSSP

SEQ ID NO: 2521283 - protein, 26 aa, Entamoeba dispar
DTHSEQLLWQKVLNSKILYKVSEIRR

SEQ ID NO: 2521284 - protein, 22 aa, Entamoeba dispar
DTIEMIHMTYYLSLIANSTSKE

SEQ ID NO: 2521285 - protein, 23 aa, Entamoeba dispar
DTIFSKFNFPLSKPLSPKDHCFS

SEQ ID NO: 2521286 - protein, 29 aa, Entamoeba dispar
DTIHIENSEFPVFNLSVSCNKAILNNSTG

SEQ ID NO: 2521287 - protein, 18 aa, Entamoeba dispar
DTIIKRLLTKCKVDELKK

SEQ ID NO: 2521288 - protein, 26 aa, Entamoeba dispar
DTIMEYSMLLLSYANLRNIKREEYKE

SEQ ID NO: 2521289 - protein, 31 aa, Entamoeba dispar
DTITSIQFVILMKGIVNFFREKLREAPIHKK

SEQ ID NO: 2521290 - protein, 24 aa, Entamoeba dispar
DTITYKIIKYIRFKKIKYNGEFIC

SEQ ID NO: 2521291 - protein, 23 aa, Entamoeba dispar
DTITYKITKYRRPKKVKYNGEII

SEQ ID NO: 2521292 - protein, 22 aa, Entamoeba dispar
DTITYNCPPIRCSYKQENKLPT

SEQ ID NO: 2521293 - protein, 24 aa, Entamoeba dispar
DTKKAETFTIPFGTKQQNQINKSK

SEQ ID NO: 2521294 - protein, 24 aa, Entamoeba dispar
DTKKRIIGLLKIWTSNVSPNIIQA

SEQ ID NO: 2521295 - protein, 26 aa, Entamoeba dispar
DTKKVISFMELFKRAIRSMAMGHVVT

SEQ ID NO: 2521296 - protein, 27 aa, Entamoeba dispar
DTKLNKSYLLIFDRTKIEQWNKAIVGL

SEQ ID NO: 2521297 - protein, 31 aa, Entamoeba dispar
DTKYDIVAIPQIICFIKNYYFDDGILTDEKL

SEQ ID NO: 2521298 - protein, 31 aa, Entamoeba dispar
DTLISLLNVRPPIYAPPLQQQPIMPQYPSYY

SEQ ID NO: 2521299 - protein, 24 aa, Entamoeba dispar
DTLKEYIAYCKAYCIPRLTENASN

SEQ ID NO: 2521300 - protein, 17 aa, Entamoeba dispar
DTLLPKLIQLLRTSFGD

SEQ ID NO: 2521301 - protein, 21 aa, Entamoeba dispar
DTLPCLRYLFDPDPPKYHIPL

SEQ ID NO: 2521302 - protein, 28 aa, Entamoeba dispar
DTMEEELYVFLWRFERDGKFDVWRCFYE

SEQ ID NO: 2521303 - protein, 33 aa, Entamoeba dispar
DTMFNLEQILEKPLPSLFLTRCCVNLATALQYL

SEQ ID NO: 2521304 - protein, 19 aa, Entamoeba dispar
DTMKWFDKMTTDSGEVLLK

SEQ ID NO: 2521305 - protein, 26 aa, Entamoeba dispar
DTMTNNLMILLLKQNNIILKERKTRK

SEQ ID NO: 2521306 - protein, 18 aa, Entamoeba dispar
DTNFIGLIIGPRGDNQKR

SEQ ID NO: 2521307 - protein, 21 aa, Entamoeba dispar
DTNMLIICFAIDSKSSFVNIS

SEQ ID NO: 2521308 - protein, 28 aa, Entamoeba dispar
DTNQQQSLGWGFRFWNSSPKASDQLENM

SEQ ID NO: 2521309 - protein, 17 aa, Entamoeba dispar
DTNSIEIKLFPSLIFKS

SEQ ID NO: 2521310 - protein, 26 aa, Entamoeba dispar
DTNVGKTCLLLTYTTNSFPDSYVPTV

SEQ ID NO: 2521311 - protein, 26 aa, Entamoeba dispar
DTNVGKTCLLLTYTTNSFPDTYVPTV

SEQ ID NO: 2521312 - protein, 27 aa, Entamoeba dispar
DTPLYKSKLVPSGVLCIVFLTKDKIQS

SEQ ID NO: 2521313 - protein, 26 aa, Entamoeba dispar
DTPVVKWLWEILHSYSIELKKKFLFF

SEQ ID NO: 2521314 - protein, 32 aa, Entamoeba dispar
DTQNTYQAIRNLIPKYKIVVEKCMLFDRAEQQ

SEQ ID NO: 2521315 - protein, 24 aa, Entamoeba dispar
DTQRAPLPNPFIPEKSRYLNLPNE

SEQ ID NO: 2521316 - protein, 24 aa, Entamoeba dispar
DTRNDLLVIQAKLQNMRLMLRLPN

SEQ ID NO: 2521317 - protein, 21 aa, Entamoeba dispar
DTRNLFSKYLSLRRQELEMAM

SEQ ID NO: 2521318 - protein, 25 aa, Entamoeba dispar
DTRTVLRLFFINFVKLLKVNNRPME

SEQ ID NO: 2521319 - protein, 27 aa, Entamoeba dispar
DTRVRFSILLNLPIIHSFPIPLREKFL

SEQ ID NO: 2521320 - protein, 27 aa, Entamoeba dispar
DTSGDYLCYQYIVKYKGQLERIEECDW

SEQ ID NO: 2521321 - protein, 25 aa, Entamoeba dispar
DTSIWVCPICNSRYPLPPDSRTYSS

SEQ ID NO: 2521322 - protein, 17 aa, Entamoeba dispar
DTSVIITNFLGIGFHLL

SEQ ID NO: 2521323 - protein, 18 aa, Entamoeba dispar
DTSYQPLLSTQQRNILPA

SEQ ID NO: 2521324 - protein, 19 aa, Entamoeba dispar
DTTHIFYDLFKNTNFNSFC

SEQ ID NO: 2521325 - protein, 18 aa, Entamoeba dispar
DTTILPEQPLTTKEISEE

SEQ ID NO: 2521326 - protein, 27 aa, Entamoeba dispar
DTTLYIYCVVGYLIYLRKKILDAKDHQ

SEQ ID NO: 2521327 - protein, 22 aa, Entamoeba dispar
DTTTTYRLYFNNCLLNPDDTIA

SEQ ID NO: 2521328 - protein, 23 aa, Entamoeba dispar
DTTVYFTWRDSYPYNPNSVQALH

SEQ ID NO: 2521329 - protein, 19 aa, Entamoeba dispar
DTVDLVPVGAWMGEGKRAG

SEQ ID NO: 2521330 - protein, 25 aa, Entamoeba dispar
DTVEFEVQWLPWHNEHVLEKFIMNL

SEQ ID NO: 2521331 - protein, 26 aa, Entamoeba dispar
DTVGKKYVRGVKLFGMKFTPNDEGCL

SEQ ID NO: 2521332 - protein, 31 aa, Entamoeba dispar
DTVHPLFQFKTLPVQVLLKLQQRKLDIDTIC

SEQ ID NO: 2521333 - protein, 24 aa, Entamoeba dispar
DTVNPSFWKKSFIDKLEGVYEVIP

SEQ ID NO: 2521334 - protein, 23 aa, Entamoeba dispar
DTYEAGYRRGADAAGPMASKGTW

SEQ ID NO: 2521335 - protein, 26 aa, Entamoeba dispar
DTYIENSFKFLPQNTIFILKDLIFNI

SEQ ID NO: 2521336 - protein, 21 aa, Entamoeba dispar
DTYQELLIKLIQEGIKKVEDN

SEQ ID NO: 2521337 - protein, 17 aa, Entamoeba dispar
DVAIIPVDSEETYCIGT

SEQ ID NO: 2521338 - protein, 32 aa, Entamoeba dispar
DVAKEIPIIRRVAKPLHYCVKTLEGGSIALQH

SEQ ID NO: 2521339 - protein, 22 aa, Entamoeba dispar
DVAPKKIMYCLSIFIESTKHLT

SEQ ID NO: 2521340 - protein, 25 aa, Entamoeba dispar
DVCGYVFAFYVQKLIHHKTDILGKY

SEQ ID NO: 2521341 - protein, 17 aa, Entamoeba dispar
DVCISSTLTIWNCQITV

SEQ ID NO: 2521342 - protein, 41 aa, Entamoeba dispar
DVCYSFLHESPWERLRLLRKRIPNILFQMLLRGRNAVGYTN

SEQ ID NO: 2521343 - protein, 30 aa, Entamoeba dispar
DVDAVELVPIIYYPVSKKPTSLVFIREFRV

SEQ ID NO: 2521344 - protein, 21 aa, Entamoeba dispar
DVDIALLFPQLPSLSIGRKIR

SEQ ID NO: 2521345 - protein, 20 aa, Entamoeba dispar
DVDYLFKDKTVLSKAYGSLI

SEQ ID NO: 2521346 - protein, 33 aa, Entamoeba dispar
DVECLLLLLNKIIPYSYDYYSNTIPPLVFDQQF

SEQ ID NO: 2521347 - protein, 18 aa, Entamoeba dispar
DVEFLSIMKFCRGESIYV

SEQ ID NO: 2521348 - protein, 18 aa, Entamoeba dispar
DVEKIVGWAFVHEIEKRP

SEQ ID NO: 2521349 - protein, 25 aa, Entamoeba dispar
DVETSLLKLPIYFCSKKNEKQNYFL

SEQ ID NO: 2521350 - protein, 17 aa, Entamoeba dispar
DVFEQFIYFVINYKKRR

SEQ ID NO: 2521351 - protein, 26 aa, Entamoeba dispar
DVFFPSLVYVLIKANIPFFASNIDYI

SEQ ID NO: 2521352 - protein, 18 aa, Entamoeba dispar
DVFLNNSFNCIVERVINV

SEQ ID NO: 2521353 - protein, 22 aa, Entamoeba dispar
DVFNYFIDYGIKPSLQFKMYAQ

SEQ ID NO: 2521354 - protein, 25 aa, Entamoeba dispar
DVFPLMKYWFINKQKKSYLLPSEML

SEQ ID NO: 2521355 - protein, 18 aa, Entamoeba dispar
DVFPQNIQFSPNGRFIAI

SEQ ID NO: 2521356 - protein, 28 aa, Entamoeba dispar
DVFQPDKYYFIIQQLYDQINICVLTLVI

SEQ ID NO: 2521357 - protein, 29 aa, Entamoeba dispar
DVHDLLVETLKNFLLYYTETETSKNVVYI

SEQ ID NO: 2521358 - protein, 20 aa, Entamoeba dispar
DVHHILLAHSASLFLIAPAT

SEQ ID NO: 2521359 - protein, 17 aa, Entamoeba dispar
DVHHPYRSIPFVKNFFA

SEQ ID NO: 2521360 - protein, 25 aa, Entamoeba dispar
DVIGYTVLVLLRKINFLDERFVLHY

SEQ ID NO: 2521361 - protein, 18 aa, Entamoeba dispar
DVIIPLYQIFNEEFIGEV

SEQ ID NO: 2521362 - protein, 30 aa, Entamoeba dispar
DVIIVKFKTIVPFLKAYKQFVSYNEKAFNI

SEQ ID NO: 2521363 - protein, 20 aa, Entamoeba dispar
DVILIAPPWGGPTKCRNKRS

SEQ ID NO: 2521364 - protein, 18 aa, Entamoeba dispar
DVILLRLDMFPDEKDTVI

SEQ ID NO: 2521365 - protein, 28 aa, Entamoeba dispar
DVILVGGPTKLCCFKKMIKEFFGKQPLT

SEQ ID NO: 2521366 - protein, 19 aa, Entamoeba dispar
DVIQWCDPYILMKYTEEGS

SEQ ID NO: 2521367 - protein, 18 aa, Entamoeba dispar
DVISLKYISSTLYDVMDK

SEQ ID NO: 2521368 - protein, 31 aa, Entamoeba dispar
DVITTLRKLIIILFLLIHTKSTKINKNNIKI

SEQ ID NO: 2521369 - protein, 28 aa, Entamoeba dispar
DVITTLRKLILILFLPIHTKSTKINKNN

SEQ ID NO: 2521370 - protein, 23 aa, Entamoeba dispar
DVKDKEEIISKLEKDRSTLKERI

SEQ ID NO: 2521371 - protein, 25 aa, Entamoeba dispar
DVKDPDNFIIPPKQYKAIKPMDDDE

SEQ ID NO: 2521372 - protein, 26 aa, Entamoeba dispar
DVKDPDNFIIPPKQYKAIKPMDDDEE

SEQ ID NO: 2521373 - protein, 20 aa, Entamoeba dispar
DVKFFKKIAIKKAAFGKTVE

SEQ ID NO: 2521374 - protein, 18 aa, Entamoeba dispar
DVKIALNKRKAINDRFNE

SEQ ID NO: 2521375 - protein, 26 aa, Entamoeba dispar
DVKKELVLPYQVLKDIDDGFKPDSYG

SEQ ID NO: 2521376 - protein, 18 aa, Entamoeba dispar
DVKKGLLCQLFGGSAKTL

SEQ ID NO: 2521377 - protein, 17 aa, Entamoeba dispar
DVKKLIQQALDDKIPII

SEQ ID NO: 2521378 - protein, 24 aa, Entamoeba dispar
DVKKNFIAILTFCDGQTPKILSSL

SEQ ID NO: 2521379 - protein, 23 aa, Entamoeba dispar
DVKKNFIAMLTFCDAEDPQVINA

SEQ ID NO: 2521380 - protein, 20 aa, Entamoeba dispar
DVKKNFIAMLTFCDGEDPQI

SEQ ID NO: 2521381 - protein, 23 aa, Entamoeba dispar
DVKKNFIAMLTFCDGEDPQIINS

SEQ ID NO: 2521382 - protein, 21 aa, Entamoeba dispar
DVKKNFIAMLTFCDGKKPQAI

SEQ ID NO: 2521383 - protein, 24 aa, Entamoeba dispar
DVKKNFIAMLTFSDGETPKILCSL

SEQ ID NO: 2521384 - protein, 23 aa, Entamoeba dispar
DVKKNFIVMLTFCDGEDPQITNT

SEQ ID NO: 2521385 - protein, 18 aa, Entamoeba dispar
DVKLERPSFVNDPTIMKR

SEQ ID NO: 2521386 - protein, 23 aa, Entamoeba dispar
DVKNNFIAMLTFCDGKSPQVIGA

SEQ ID NO: 2521387 - protein, 24 aa, Entamoeba dispar
DVKPQNILLFNWTDIVKINAKLTD

SEQ ID NO: 2521388 - protein, 18 aa, Entamoeba dispar
DVKYIQCLFVLNKCDILD

SEQ ID NO: 2521389 - protein, 22 aa, Entamoeba dispar
DVLDDVLLLSYSDYIANESNDS

SEQ ID NO: 2521390 - protein, 20 aa, Entamoeba dispar
DVLIDFLKKIFVYDPNERMT

SEQ ID NO: 2521391 - protein, 20 aa, Entamoeba dispar
DVLIRIIDTLSSYINAVATA

SEQ ID NO: 2521392 - protein, 22 aa, Entamoeba dispar
DVLIYNKYFTTFPAPMNCYFEK

SEQ ID NO: 2521393 - protein, 23 aa, Entamoeba dispar
DVLKTLCEFINKTQQRKLIEEVY

SEQ ID NO: 2521394 - protein, 38 aa, Entamoeba dispar
DVLKYMCLILSIQPIYSKFIRLGGFVRLFNSLRSVRRV

SEQ ID NO: 2521395 - protein, 36 aa, Entamoeba dispar
DVLLLWDEFILNSNKYLFYYAVVAYLIQIKDDIMKE

SEQ ID NO: 2521396 - protein, 26 aa, Entamoeba dispar
DVLLNKLKKLIEEKYMIPQSKKPEEE

SEQ ID NO: 2521397 - protein, 18 aa, Entamoeba dispar
DVLNLWKKKYETLQLQWN

SEQ ID NO: 2521398 - protein, 22 aa, Entamoeba dispar
DVLPTRNLIGVTILYGPDSSAP

SEQ ID NO: 2521399 - protein, 18 aa, Entamoeba dispar
DVLQAFLLQRRVSIISML

SEQ ID NO: 2521400 - protein, 17 aa, Entamoeba dispar
DVLSSYSSFIYQSKLPG

SEQ ID NO: 2521401 - protein, 20 aa, Entamoeba dispar
DVMDGHFVPNLTLGAPIVKC

SEQ ID NO: 2521402 - protein, 25 aa, Entamoeba dispar
DVMEKLFTFIFDEIPKRFPDELKVI

SEQ ID NO: 2521403 - protein, 24 aa, Entamoeba dispar
DVMFRYFNCIGNILSFKICSIDDK

SEQ ID NO: 2521404 - protein, 18 aa, Entamoeba dispar
DVMNKKQFKMFSASVLFV

SEQ ID NO: 2521405 - protein, 43 aa, Entamoeba dispar
DVNDFTFFLPFFLKDDIKEYMLWFNRIYDIKSFMGSSLLTFKE

SEQ ID NO: 2521406 - protein, 17 aa, Entamoeba dispar
DVNLIFSGIELIRRLHS

SEQ ID NO: 2521407 - protein, 17 aa, Entamoeba dispar
DVNLYRLSQYKSVMRKL

SEQ ID NO: 2521408 - protein, 18 aa, Entamoeba dispar
DVNPIFIRQMVNNIKKKI

SEQ ID NO: 2521409 - protein, 25 aa, Entamoeba dispar
DVNRIYVNLFIPNITNIFIETYNSA

SEQ ID NO: 2521410 - protein, 19 aa, Entamoeba dispar
DVNVTCLRSIYWNLNTSLI

SEQ ID NO: 2521411 - protein, 19 aa, Entamoeba dispar
DVNYNLVIDVMKKIMEQGK

SEQ ID NO: 2521412 - protein, 20 aa, Entamoeba dispar
DVPHLSLFGPIGAWKLNTCP

SEQ ID NO: 2521413 - protein, 35 aa, Entamoeba dispar
DVPLLYAVQKKRLDLVLLLLKFGARIYIANNAGNS

SEQ ID NO: 2521414 - protein, 36 aa, Entamoeba dispar
DVPNCLFFIDKYSQVPWILSPVLHTSYRLLEKKFID

SEQ ID NO: 2521415 - protein, 24 aa, Entamoeba dispar
DVPNCLFFIDKYSQVPWIVAPIVK

SEQ ID NO: 2521416 - protein, 29 aa, Entamoeba dispar
DVQHKTILKILFMLSKWMSSFPHDFMDGG

SEQ ID NO: 2521417 - protein, 22 aa, Entamoeba dispar
DVQIHFACHNWPLYGNKKIVNY

SEQ ID NO: 2521418 - protein, 36 aa, Entamoeba dispar
DVQIHLASTPYLYHYTLRCMKSFIESIRPNVNVIGN

SEQ ID NO: 2521419 - protein, 18 aa, Entamoeba dispar
DVQIILKSATLNLRPTIP

SEQ ID NO: 2521420 - protein, 25 aa, Entamoeba dispar
DVQKIFYGIKPLAYSLPAILHNFVN

SEQ ID NO: 2521421 - protein, 26 aa, Entamoeba dispar
DVQNYLKDLLTFYKPRKFNIKTDRIE

SEQ ID NO: 2521422 - protein, 30 aa, Entamoeba dispar
DVRDLFIPYIPKILEYCKNKLIGCTDTSVI

SEQ ID NO: 2521423 - protein, 17 aa, Entamoeba dispar
DVRKKANRYLAGKVTLA

SEQ ID NO: 2521424 - protein, 22 aa, Entamoeba dispar
DVSALMRCSKLKRIFLHGKNEI

SEQ ID NO: 2521425 - protein, 17 aa, Entamoeba dispar
DVSLITGLLVQVGNPPS

SEQ ID NO: 2521426 - protein, 27 aa, Entamoeba dispar
DVSLLSRFDFLYTLLESPLMTIPSIYT

SEQ ID NO: 2521427 - protein, 28 aa, Entamoeba dispar
DVSNNNIKWFPLLGAIKLKYLDISNNPI

SEQ ID NO: 2521428 - protein, 34 aa, Entamoeba dispar
DVSNQIKLFDTALDIRVKMQGILGDVNSLPLSED

SEQ ID NO: 2521429 - protein, 25 aa, Entamoeba dispar
DVSSDILWKRYKFLLVKKIIERHNS

SEQ ID NO: 2521430 - protein, 25 aa, Entamoeba dispar
DVTDRFFITDELPSFRKEQFNVTWD

SEQ ID NO: 2521431 - protein, 20 aa, Entamoeba dispar
DVTEYFRYVFCENGLVTYKD

SEQ ID NO: 2521432 - protein, 20 aa, Entamoeba dispar
DVTKMLLNDLIDLSMQKFSS

SEQ ID NO: 2521433 - protein, 26 aa, Entamoeba dispar
DVTLCKYCDFIYIAITEDEKYKRHIK

SEQ ID NO: 2521434 - protein, 24 aa, Entamoeba dispar
DVTMVKMFGVEFPLKAMRKRRGTM

SEQ ID NO: 2521435 - protein, 19 aa, Entamoeba dispar
DVTPFFGFERALYEGINMS

SEQ ID NO: 2521436 - protein, 17 aa, Entamoeba dispar
DVTQYDLAIRWISSEEF

SEQ ID NO: 2521437 - protein, 19 aa, Entamoeba dispar
DVTRLFYKAAIMENTMLGD

SEQ ID NO: 2521438 - protein, 24 aa, Entamoeba dispar
DVVKMHANINNRVSMVYGLECNMA

SEQ ID NO: 2521439 - protein, 30 aa, Entamoeba dispar
DVVQCETEFYPIMKYVFGNVLIADDAETAK

SEQ ID NO: 2521440 - protein, 18 aa, Entamoeba dispar
DVVTIEGIYLPDEFFSRK

SEQ ID NO: 2521441 - protein, 26 aa, Entamoeba dispar
DVVVINSFFVIKKSRELWIPSEPFKE

SEQ ID NO: 2521442 - protein, 23 aa, Entamoeba dispar
DVWALGCVLYKICYFDTPFEESP

SEQ ID NO: 2521443 - protein, 26 aa, Entamoeba dispar
DVWSGQWKYHIYRYDKPKPNNISVCI

SEQ ID NO: 2521444 - protein, 27 aa, Entamoeba dispar
DVWSYGVVFWEILTKGIIPYSSIAKAQ

SEQ ID NO: 2521445 - protein, 18 aa, Entamoeba dispar
DVYSFFNCISLHSVYFDT

SEQ ID NO: 2521446 - protein, 25 aa, Entamoeba dispar
DWFNKLIGQFWGGNDYYLVAHDFAS

SEQ ID NO: 2521447 - protein, 25 aa, Entamoeba dispar
DWIKTTLKGFKLLRLASQTDNVGVV

SEQ ID NO: 2521448 - protein, 26 aa, Entamoeba dispar
DWKKNLTFLKTQPLLPNLEKFSSLYN

SEQ ID NO: 2521449 - protein, 30 aa, Entamoeba dispar
DWKMCILCTDILIIARPFAFGKKTAKEREV

SEQ ID NO: 2521450 - protein, 23 aa, Entamoeba dispar
DWKPLTLPSLPLLKTMKIKQCQT

SEQ ID NO: 2521451 - protein, 17 aa, Entamoeba dispar
DWNLMVMELLGPSLEDL

SEQ ID NO: 2521452 - protein, 24 aa, Entamoeba dispar
DWPKGVFQIFSTKTQRLLSSVMND

SEQ ID NO: 2521453 - protein, 25 aa, Entamoeba dispar
DWRIDPEIILIRRGTHRLKGKTLKE

SEQ ID NO: 2521454 - protein, 17 aa, Entamoeba dispar
DWSYSYCLPLLVITYGN

SEQ ID NO: 2521455 - protein, 18 aa, Entamoeba dispar
DWVDGRMIKLVLGPEDPL

SEQ ID NO: 2521456 - protein, 27 aa, Entamoeba dispar
DWVIKIGFNFISFEKLFISCPIEYITC

SEQ ID NO: 2521457 - protein, 21 aa, Entamoeba dispar
DWYYPYISRDYSKIDSYQVLD

SEQ ID NO: 2521458 - protein, 32 aa, Entamoeba dispar
DYCIDYHTFIKKQNFRIIWKRIKFTSHDHEEF

SEQ ID NO: 2521459 - protein, 23 aa, Entamoeba dispar
DYCKWTIRLVFGYNKMVSMGVDS

SEQ ID NO: 2521460 - protein, 19 aa, Entamoeba dispar
DYCYEEHPRYLLRKNIVAD

SEQ ID NO: 2521461 - protein, 35 aa, Entamoeba dispar
DYDRIRPLSYPQTDVFLLCFSVVSPSSFENISSKW

SEQ ID NO: 2521462 - protein, 22 aa, Entamoeba dispar
DYEHNPRLHLTWFNKMAAENRK

SEQ ID NO: 2521463 - protein, 28 aa, Entamoeba dispar
DYEIAAIYPYVLPLLKTVPVDDPNYNMA

SEQ ID NO: 2521464 - protein, 30 aa, Entamoeba dispar
DYENTILVLLKSRLLLKKIIEQKMYQDRIK

SEQ ID NO: 2521465 - protein, 17 aa, Entamoeba dispar
DYFFNYESQSDEMKIHC

SEQ ID NO: 2521466 - protein, 18 aa, Entamoeba dispar
DYFFPSHYKDTIGIGGNI

SEQ ID NO: 2521467 - protein, 35 aa, Entamoeba dispar
DYFIRNNVNYLFCYRWIVLLFKRDFNSRDCLNVWD

SEQ ID NO: 2521468 - protein, 20 aa, Entamoeba dispar
DYFLFSLKNPTNKAPLLWNS

SEQ ID NO: 2521469 - protein, 17 aa, Entamoeba dispar
DYFWKCHNLKNTLCTIA

SEQ ID NO: 2521470 - protein, 21 aa, Entamoeba dispar
DYHKPFCIIVMDVNGIWKKFY

SEQ ID NO: 2521471 - protein, 19 aa, Entamoeba dispar
DYIFEELFDKCKKLCIDEC

SEQ ID NO: 2521472 - protein, 17 aa, Entamoeba dispar
DYIIPKPIRKVSTNLFE

SEQ ID NO: 2521473 - protein, 24 aa, Entamoeba dispar
DYIKITEMFLGPAPKEFVYVPKHQ

SEQ ID NO: 2521474 - protein, 32 aa, Entamoeba dispar
DYIKQRTKTTPFYPYLILSINRSRLNDANETI

SEQ ID NO: 2521475 - protein, 21 aa, Entamoeba dispar
DYIRLIQIMDQLADGGFPFIT

SEQ ID NO: 2521476 - protein, 23 aa, Entamoeba dispar
DYIYEVLEFAPGGNLFQRITKKP

SEQ ID NO: 2521477 - protein, 23 aa, Entamoeba dispar
DYKDVIVCVGQNKKILSNSSLSN

SEQ ID NO: 2521478 - protein, 17 aa, Entamoeba dispar
DYLDSIGLLVKASEQYN

SEQ ID NO: 2521479 - protein, 17 aa, Entamoeba dispar
DYLFSLTGLEYICLNQN

SEQ ID NO: 2521480 - protein, 17 aa, Entamoeba dispar
DYLIYFTTKDNCKNIKL

SEQ ID NO: 2521481 - protein, 25 aa, Entamoeba dispar
DYLKIKIFSFPLIRNIIKMMNDKEK

SEQ ID NO: 2521482 - protein, 20 aa, Entamoeba dispar
DYLKPYLRRTTLIKEIIDKN

SEQ ID NO: 2521483 - protein, 24 aa, Entamoeba dispar
DYLLKVDHTFIIRNLLLSQNSDIR

SEQ ID NO: 2521484 - protein, 22 aa, Entamoeba dispar
DYLPYIKELCKVSIYGKISAAK

SEQ ID NO: 2521485 - protein, 23 aa, Entamoeba dispar
DYLQIKELVPYIPPIALTGGIKC

SEQ ID NO: 2521486 - protein, 24 aa, Entamoeba dispar
DYLSYYYFYLTFHSRKDIFDNIES

SEQ ID NO: 2521487 - protein, 26 aa, Entamoeba dispar
DYMIKKKYYDSFLFTPENINLVFDES

SEQ ID NO: 2521488 - protein, 27 aa, Entamoeba dispar
DYMIKKKYYDSFLFTPENINLVFDESK

SEQ ID NO: 2521489 - protein, 24 aa, Entamoeba dispar
DYMSDFIVMLYGSPGAYGVCTMPF

SEQ ID NO: 2521490 - protein, 18 aa, Entamoeba dispar
DYNIWYNRYSGFESKQTR

SEQ ID NO: 2521491 - protein, 17 aa, Entamoeba dispar
DYPIIHFHCGHSYHKKC

SEQ ID NO: 2521492 - protein, 23 aa, Entamoeba dispar
DYPMKPPFFFTDPSPDMVIVPQH

SEQ ID NO: 2521493 - protein, 35 aa, Entamoeba dispar
DYQGLKQTLPHLTGSTIYAILSRFKSDSLNHQSID

SEQ ID NO: 2521494 - protein, 26 aa, Entamoeba dispar
DYQKEFIKWCLKVPGYYPSWFVGIRQ

SEQ ID NO: 2521495 - protein, 26 aa, Entamoeba dispar
DYQLNDFLDIIKTILGRLMIEKRRDE

SEQ ID NO: 2521496 - protein, 18 aa, Entamoeba dispar
DYRILYWKRILGIEEISQ

SEQ ID NO: 2521497 - protein, 26 aa, Entamoeba dispar
DYRRRLPIGYTRLFSYELARALGYIH

SEQ ID NO: 2521498 - protein, 18 aa, Entamoeba dispar
DYRSMVFVFTVDPITHQA

SEQ ID NO: 2521499 - protein, 29 aa, Entamoeba dispar
DYSEFKRLTLLLTKLPRKRLRDVSARLDY

SEQ ID NO: 2521500 - protein, 19 aa, Entamoeba dispar
DYSFLKICFNGVIEFNFNP

SEQ ID NO: 2521501 - protein, 23 aa, Entamoeba dispar
DYSRLLPEKILTKMSKIEFRCYL

SEQ ID NO: 2521502 - protein, 24 aa, Entamoeba dispar
DYSYYFNKAFKYSGLAFKCNRTYL

SEQ ID NO: 2521503 - protein, 20 aa, Entamoeba dispar
DYTIHCLLNNRDIKGSPWVQ

SEQ ID NO: 2521504 - protein, 37 aa, Entamoeba dispar
DYVDRGHYGLECLLLLVALKLRFPQRISLLRGNHECS

SEQ ID NO: 2521505 - protein, 24 aa, Entamoeba dispar
DYVKDLIKPKKNKPGYKPSAVVME

SEQ ID NO: 2521506 - protein, 18 aa, Entamoeba dispar
DYVKNKIMLALVFKKWWG

SEQ ID NO: 2521507 - protein, 24 aa, Entamoeba dispar
DYYARRKMIFQDKDKFKTPKYRVV

SEQ ID NO: 2521508 - protein, 19 aa, Entamoeba dispar
DYYDILELLLKKGSKEENA

SEQ ID NO: 2521509 - protein, 20 aa, Entamoeba dispar
DYYNYLNLLIHRIDLNSNTL

SEQ ID NO: 2521510 - protein, 24 aa, Entamoeba dispar
EAACPHIMLNAFQALLGFSKESGV

SEQ ID NO: 2521511 - protein, 23 aa, Entamoeba dispar
EAAIKFAPTFKIKIGKQGIYEEN

SEQ ID NO: 2521512 - protein, 24 aa, Entamoeba dispar
EAAKSLIYYLRSEEDIKIFITQFV

SEQ ID NO: 2521513 - protein, 18 aa, Entamoeba dispar
EAAKWFEQTWSDTYRRND

SEQ ID NO: 2521514 - protein, 26 aa, Entamoeba dispar
EAALLIRANWPIINIIWETRIDEVET

SEQ ID NO: 2521515 - protein, 26 aa, Entamoeba dispar
EAATQATLLLYPDYKDIRKQINVRII

SEQ ID NO: 2521516 - protein, 31 aa, Entamoeba dispar
EACQQAVFIGLLNMFGYEIGIERVYKISKKT

SEQ ID NO: 2521517 - protein, 25 aa, Entamoeba dispar
EADVYSFGIILWEIAHRLYPYEKNK

SEQ ID NO: 2521518 - protein, 25 aa, Entamoeba dispar
EADVYWSFCWILQSIQSHYTYDQPG

SEQ ID NO: 2521519 - protein, 25 aa, Entamoeba dispar
EAEIKKFLEWVRSIPPMNVKNIKSN

SEQ ID NO: 2521520 - protein, 25 aa, Entamoeba dispar
EAEKYVKALFTLASKLSPCVIFVDE

SEQ ID NO: 2521521 - protein, 24 aa, Entamoeba dispar
EAENAFELFLSTTEIKYVYYKESH

SEQ ID NO: 2521522 - protein, 22 aa, Entamoeba dispar
EAFASYYRLPKPIGSELYIPST

SEQ ID NO: 2521523 - protein, 22 aa, Entamoeba dispar
EAFDVIGVPPFLYTKKSQKDNR

SEQ ID NO: 2521524 - protein, 21 aa, Entamoeba dispar
EAFEELQDFRKKYKCKSYCEV

SEQ ID NO: 2521525 - protein, 21 aa, Entamoeba dispar
EAFISLCQRLRKFAKPEMKVL

SEQ ID NO: 2521526 - protein, 19 aa, Entamoeba dispar
EAFQMVPRVLAENAGLDAT

SEQ ID NO: 2521527 - protein, 18 aa, Entamoeba dispar
EAFRIVSHNILKHGITPT

SEQ ID NO: 2521528 - protein, 30 aa, Entamoeba dispar
EAFRVMVRTIKLWTKKRGIYGYVYCFLNGI

SEQ ID NO: 2521529 - protein, 25 aa, Entamoeba dispar
EAGDLIPWTLTQQFLDDEFAGLMGA

SEQ ID NO: 2521530 - protein, 34 aa, Entamoeba dispar
EAGFINNVLPLTAKPMIYLVNMSENDFLRKRNKY

SEQ ID NO: 2521531 - protein, 17 aa, Entamoeba dispar
EAGGIEALFKLLEKQKN

SEQ ID NO: 2521532 - protein, 21 aa, Entamoeba dispar
EAGICEIQAVYYIYRVTKGND

SEQ ID NO: 2521533 - protein, 31 aa, Entamoeba dispar
EAHCDDIVDVAFWRGLLVSASQDNLCCVIDY

SEQ ID NO: 2521534 - protein, 28 aa, Entamoeba dispar
EAHCNGMIEILFDILQFASLVPEASQVI

SEQ ID NO: 2521535 - protein, 17 aa, Entamoeba dispar
EAIEFIPIDYNKQWKFF

SEQ ID NO: 2521536 - protein, 24 aa, Entamoeba dispar
EAIELLDFRYPDPQIRGFALRCID

SEQ ID NO: 2521537 - protein, 26 aa, Entamoeba dispar
EAIKEIEQILILFSPQVFSLKNILEG

SEQ ID NO: 2521538 - protein, 25 aa, Entamoeba dispar
EAIRRKPYSVILFDEIEKAHPQVFN

SEQ ID NO: 2521539 - protein, 25 aa, Entamoeba dispar
EAIYSRIPSLSRTLLLTTPNGTELF

SEQ ID NO: 2521540 - protein, 28 aa, Entamoeba dispar
EAKENQRESWWLAYIMDQIEEEKSKGIT

SEQ ID NO: 2521541 - protein, 19 aa, Entamoeba dispar
EAKISSRREEAIASLERKR

SEQ ID NO: 2521542 - protein, 18 aa, Entamoeba dispar
EAKKLHKLAMLKEAKRYA

SEQ ID NO: 2521543 - protein, 25 aa, Entamoeba dispar
EAKKPTFIFIQKYPQKEIALEEYVT

SEQ ID NO: 2521544 - protein, 17 aa, Entamoeba dispar
EAKQFIITAVSLAIYRD

SEQ ID NO: 2521545 - protein, 17 aa, Entamoeba dispar
EAKQFVIDLFGSDLNEA

SEQ ID NO: 2521546 - protein, 25 aa, Entamoeba dispar
EAKRYAAILNRYKVLKAHGMKVVSF

SEQ ID NO: 2521547 - protein, 23 aa, Entamoeba dispar
EALDLLVEAIAKAGYTGKIEIAM

SEQ ID NO: 2521548 - protein, 26 aa, Entamoeba dispar
EALFMKPNVVLLPFCPYNFQVSSKMT

SEQ ID NO: 2521549 - protein, 33 aa, Entamoeba dispar
EALGKYLERFSSFLLNFIKLPTPNVLPYIIQTQ

SEQ ID NO: 2521550 - protein, 28 aa, Entamoeba dispar
EALHDYNYRLLMLESEVIIVQQPPSTKR

SEQ ID NO: 2521551 - protein, 27 aa, Entamoeba dispar
EALHDYNYRLLMLESEVIIVQQPPTTK

SEQ ID NO: 2521552 - protein, 18 aa, Entamoeba dispar
EALHFLVDILSEFGYFFQ

SEQ ID NO: 2521553 - protein, 36 aa, Entamoeba dispar
EALKIVGAFVFLRLINPVLLTPLKFSSKLTKPSPSS

SEQ ID NO: 2521554 - protein, 18 aa, Entamoeba dispar
EALLLGINIIDRLPETMS

SEQ ID NO: 2521555 - protein, 18 aa, Entamoeba dispar
EALPLKETLLEITSPIPL

SEQ ID NO: 2521556 - protein, 18 aa, Entamoeba dispar
EALQKQILGLRKGNSKIV

SEQ ID NO: 2521557 - protein, 24 aa, Entamoeba dispar
EALSIFAPTIYLYIVDTARCVENP

SEQ ID NO: 2521558 - protein, 22 aa, Entamoeba dispar
EALTALTLLSFVGAAKPSLILN

SEQ ID NO: 2521559 - protein, 25 aa, Entamoeba dispar
EALVNTFIHPLLLGLSDGSIYVFLF

SEQ ID NO: 2521560 - protein, 24 aa, Entamoeba dispar
EAMERSVRWLARCKNEYLKTKEKQ

SEQ ID NO: 2521561 - protein, 23 aa, Entamoeba dispar
EAMKFLLARYYAGRMIQPSYSHV

SEQ ID NO: 2521562 - protein, 26 aa, Entamoeba dispar
EANQDTLWFILQFLKKVIHNSEKNKM

SEQ ID NO: 2521563 - protein, 18 aa, Entamoeba dispar
EANYAKRLKSQTTTPLKI

SEQ ID NO: 2521564 - protein, 17 aa, Entamoeba dispar
EAPFIPLQQMNDDTIGE

SEQ ID NO: 2521565 - protein, 24 aa, Entamoeba dispar
EAPIPLEFTNKCELDYLGVKNVLC

SEQ ID NO: 2521566 - protein, 27 aa, Entamoeba dispar
EAPSVSTLLFFNILKLSPVCLTQILGT

SEQ ID NO: 2521567 - protein, 23 aa, Entamoeba dispar
EAQERVDRLLYFQETQAQRTIVR

SEQ ID NO: 2521568 - protein, 23 aa, Entamoeba dispar
EAQKFLLEIMTNSSLTQLSQSIE

SEQ ID NO: 2521569 - protein, 21 aa, Entamoeba dispar
EAQKIPLFIAAGCESTFKIVA

SEQ ID NO: 2521570 - protein, 24 aa, Entamoeba dispar
EAQQLLLNSHILAVGYDPLMSEIL

SEQ ID NO: 2521571 - protein, 25 aa, Entamoeba dispar
EARACSRIFYHPTTALPFSLSGVSF

SEQ ID NO: 2521572 - protein, 26 aa, Entamoeba dispar
EARDAYRRFIQNYNTLKFGNIFQLSK

SEQ ID NO: 2521573 - protein, 47 aa, Entamoeba dispar
EARVSILAFQFFKQIYKLFEKCPYYEKYFFLFLRCLKSFGRLESVEE

SEQ ID NO: 2521574 - protein, 17 aa, Entamoeba dispar
EASFSNAYLFFLLSECG

SEQ ID NO: 2521575 - protein, 25 aa, Entamoeba dispar
EASIETCGFIMIPLNPAYKPEQLER

SEQ ID NO: 2521576 - protein, 18 aa, Entamoeba dispar
EASLRSDGYMRRLDKHQE

SEQ ID NO: 2521577 - protein, 22 aa, Entamoeba dispar
EASPYFEQFLKLLGEPIDMKTY

SEQ ID NO: 2521578 - protein, 25 aa, Entamoeba dispar
EASQLKLRMIKLEKKNDKIIQMLDQ

SEQ ID NO: 2521579 - protein, 17 aa, Entamoeba dispar
EASVGYLFNVSVMAMCC

SEQ ID NO: 2521580 - protein, 26 aa, Entamoeba dispar
EATIYWLQRLIEMGENPKYIVRRMIK

SEQ ID NO: 2521581 - protein, 23 aa, Entamoeba dispar
EATKLFILSNPLHADNCPSVRKM

SEQ ID NO: 2521582 - protein, 25 aa, Entamoeba dispar
EATKMNELIFTDSIYKTVLNSETKE

SEQ ID NO: 2521583 - protein, 29 aa, Entamoeba dispar
EATLADGYLYILIREFGFCAKLKQTKHAE

SEQ ID NO: 2521584 - protein, 28 aa, Entamoeba dispar
EATLEELHFWPSFYLHAVLFNKTDPSYY

SEQ ID NO: 2521585 - protein, 18 aa, Entamoeba dispar
EATPAIIDVYDALHVPVF

SEQ ID NO: 2521586 - protein, 30 aa, Entamoeba dispar
EAVKFLTFTYYFRRLLKNPNYYGYDGKEQI

SEQ ID NO: 2521587 - protein, 34 aa, Entamoeba dispar
EAVKMIRINPPKVLLYAPFLFNNIPNINTIKLDA

SEQ ID NO: 2521588 - protein, 17 aa, Entamoeba dispar
EAVLRMFYQICHAVAFM

SEQ ID NO: 2521589 - protein, 28 aa, Entamoeba dispar
EAVQQAVLIALLNYLGYSIEIKHPERLA

SEQ ID NO: 2521590 - protein, 24 aa, Entamoeba dispar
EAVTPLLIKMFLKYQLKCSSIQEA

SEQ ID NO: 2521591 - protein, 23 aa, Entamoeba dispar
EAVVAFILRNYPQIRLVDVSTEL

SEQ ID NO: 2521592 - protein, 18 aa, Entamoeba dispar
EAYLNEMLYPIEVAGQRV

SEQ ID NO: 2521593 - protein, 20 aa, Entamoeba dispar
EAYLYLLHHLNNSCSLEALN

SEQ ID NO: 2521594 - protein, 18 aa, Entamoeba dispar
EAYNFVRCQSSWKDTQTG

SEQ ID NO: 2521595 - protein, 17 aa, Entamoeba dispar
EAYNFVRCQSSWKDTRT

SEQ ID NO: 2521596 - protein, 27 aa, Entamoeba dispar
EAYQQGVMIYLLVKSGFEVRVKRLDKS

SEQ ID NO: 2521597 - protein, 35 aa, Entamoeba dispar
ECCCDISGLLNYLHDKICIGYLCIWCSGETSSFHS

SEQ ID NO: 2521598 - protein, 27 aa, Entamoeba dispar
ECDIWSIGIILYIILSGTHPFSMEDEN

SEQ ID NO: 2521599 - protein, 25 aa, Entamoeba dispar
ECDNRIKLMKTIYNRIILEGPSVRA

SEQ ID NO: 2521600 - protein, 30 aa, Entamoeba dispar
ECDYWSIGCILFEMVCGFPPFLSDDAVQTC

SEQ ID NO: 2521601 - protein, 17 aa, Entamoeba dispar
ECENCQFIINKNQIKEM

SEQ ID NO: 2521602 - protein, 19 aa, Entamoeba dispar
ECENCQFIINKNQIKEMKI

SEQ ID NO: 2521603 - protein, 26 aa, Entamoeba dispar
ECFEKTIHFILITFPSLETLSVPYKF

SEQ ID NO: 2521604 - protein, 25 aa, Entamoeba dispar
ECFKSPFFIELLDKIPNDLADSNFS

SEQ ID NO: 2521605 - protein, 20 aa, Entamoeba dispar
ECFKYCTSLTLINIPSSITL

SEQ ID NO: 2521606 - protein, 17 aa, Entamoeba dispar
ECFQFAFRWFNCFLLRE

SEQ ID NO: 2521607 - protein, 27 aa, Entamoeba dispar
ECFRECTSLVYIKFPTSITSIGNECFK

SEQ ID NO: 2521608 - protein, 28 aa, Entamoeba dispar
ECFSCCGSLTIINIPTSITSFGYGCFEY

SEQ ID NO: 2521609 - protein, 28 aa, Entamoeba dispar
ECFVCSVCKAPFPRGQFYNLDGKPVCAE

SEQ ID NO: 2521610 - protein, 31 aa, Entamoeba dispar
ECFVCTKCSKPFPTPSFFQKDGNPYCEECYK

SEQ ID NO: 2521611 - protein, 26 aa, Entamoeba dispar
ECGFDVNIWLCLPGTLTVSISIDGHM

SEQ ID NO: 2521612 - protein, 24 aa, Entamoeba dispar
ECGFNPYLVELLKTLFESFPQTKK

SEQ ID NO: 2521613 - protein, 27 aa, Entamoeba dispar
ECGKLEPEWISLNLGIVICLECCGAHR

SEQ ID NO: 2521614 - protein, 30 aa, Entamoeba dispar
ECHIAYICKRVLQGLVYLHKMGIIHRDIKS

SEQ ID NO: 2521615 - protein, 23 aa, Entamoeba dispar
ECIAFKKAIKYFGYTTARGINTL

SEQ ID NO: 2521616 - protein, 18 aa, Entamoeba dispar
ECIIITGSLFRKEIFTVL

SEQ ID NO: 2521617 - protein, 17 aa, Entamoeba dispar
ECKDIIILLSQFIGVSG

SEQ ID NO: 2521618 - protein, 17 aa, Entamoeba dispar
ECKLNVLSSQHEDHFFR

SEQ ID NO: 2521619 - protein, 24 aa, Entamoeba dispar
ECLEPILTALLQLVTRKPSDEIIN

SEQ ID NO: 2521620 - protein, 20 aa, Entamoeba dispar
ECLICPSLSLDQWYIIIVCF

SEQ ID NO: 2521621 - protein, 34 aa, Entamoeba dispar
ECLLYLKNIGHLFYIKLLPKAKQLCYCQYPEIVS

SEQ ID NO: 2521622 - protein, 23 aa, Entamoeba dispar
ECLMNFKWRQGLVLTNESFSLRN

SEQ ID NO: 2521623 - protein, 23 aa, Entamoeba dispar
ECLRVYVSSFWDQPFKDTLFTSL

SEQ ID NO: 2521624 - protein, 18 aa, Entamoeba dispar
ECLWIILEPISPLTVSDY

SEQ ID NO: 2521625 - protein, 27 aa, Entamoeba dispar
ECMKKNEEIMLLENKLKTIDKHCISTN

SEQ ID NO: 2521626 - protein, 18 aa, Entamoeba dispar
ECMNFINNLLIKEPSKRL

SEQ ID NO: 2521627 - protein, 25 aa, Entamoeba dispar
ECMTFPFFCLLKIKTTEHNGVSYTF

SEQ ID NO: 2521628 - protein, 20 aa, Entamoeba dispar
ECNEIMITSMYFNDINDFIN

SEQ ID NO: 2521629 - protein, 27 aa, Entamoeba dispar
ECNVEEWKFVLYAICIHANVALKPVLI

SEQ ID NO: 2521630 - protein, 20 aa, Entamoeba dispar
ECNWIGRYYDREIREIRIEE

SEQ ID NO: 2521631 - protein, 21 aa, Entamoeba dispar
ECNWIGRYYDREIREIRIEEH

SEQ ID NO: 2521632 - protein, 21 aa, Entamoeba dispar
ECNYLNLITIPTSVSKIGKEC

SEQ ID NO: 2521633 - protein, 23 aa, Entamoeba dispar
ECPFRINLNYRTKTKTWNITKMI

SEQ ID NO: 2521634 - protein, 18 aa, Entamoeba dispar
ECSELLRKKLVTGKEIKF

SEQ ID NO: 2521635 - protein, 41 aa, Entamoeba dispar
ECSFNPISTIIFLPLANLQSFVMQFCHLTQLPFSLEQASKL

SEQ ID NO: 2521636 - protein, 23 aa, Entamoeba dispar
ECSLTFIDHSPFCRIHTFDGIID

SEQ ID NO: 2521637 - protein, 20 aa, Entamoeba dispar
ECSSLSEVILPTSIIKLGNY

SEQ ID NO: 2521638 - protein, 36 aa, Entamoeba dispar
ECTDLYIIHMPCGPSFHFKLFNLMKPKDIKGHVTVS

SEQ ID NO: 2521639 - protein, 23 aa, Entamoeba dispar
ECVDYNLRWLTKELEIELDDITL

SEQ ID NO: 2521640 - protein, 26 aa, Entamoeba dispar
ECVEKKIHLPLISLKLEGAKMGNESI

SEQ ID NO: 2521641 - protein, 25 aa, Entamoeba dispar
ECVSSIYFRILPSFEPTRVAFSKRF

SEQ ID NO: 2521642 - protein, 17 aa, Entamoeba dispar
ECWNEHLGFGIFSKKWF

SEQ ID NO: 2521643 - protein, 29 aa, Entamoeba dispar
ECYGKILAIVIRWVMYRYGKTIETCENDV

SEQ ID NO: 2521644 - protein, 35 aa, Entamoeba dispar
ECYLILLSDFYRSVVLLLFKPYDYTVIPLGKDARN

SEQ ID NO: 2521645 - protein, 26 aa, Entamoeba dispar
ECYQIGFMIYLMVKNKREVVIQRLEK

SEQ ID NO: 2521646 - protein, 21 aa, Entamoeba dispar
ECYSLISINIPSSITSFREGC

SEQ ID NO: 2521647 - protein, 22 aa, Entamoeba dispar
EDALTYLSLVNILVHRKNMNCV

SEQ ID NO: 2521648 - protein, 23 aa, Entamoeba dispar
EDASVKIVISDALGVIFDGEPLA

SEQ ID NO: 2521649 - protein, 27 aa, Entamoeba dispar
EDAYKHYFDCIFGPYTSFVLKGINILE

SEQ ID NO: 2521650 - protein, 23 aa, Entamoeba dispar
EDCFYECYLLKSINIPTSISKIG

SEQ ID NO: 2521651 - protein, 24 aa, Entamoeba dispar
EDCILELPLFIEKLSTIQSQIEYL

SEQ ID NO: 2521652 - protein, 28 aa, Entamoeba dispar
EDCVNAHQPFLQLVARPNKSKKSTPTTP

SEQ ID NO: 2521653 - protein, 24 aa, Entamoeba dispar
EDDKFIFLRKPRFVVQSLLRPYIQ

SEQ ID NO: 2521654 - protein, 43 aa, Entamoeba dispar
EDDKFYLIISELNSIYFSSFLVRYLGALRPLLDFTPRNTLSHS

SEQ ID NO: 2521655 - protein, 23 aa, Entamoeba dispar
EDDQPLFLKGYYKACIEVNYILP

SEQ ID NO: 2521656 - protein, 22 aa, Entamoeba dispar
EDDSLMFYRLLENQSEKSEKKE

SEQ ID NO: 2521657 - protein, 25 aa, Entamoeba dispar
EDEDDLFIFYQLLELGCEVTGQTTR

SEQ ID NO: 2521658 - protein, 25 aa, Entamoeba dispar
EDEFLEIYTMLPSRLQMLVPEQIFT

SEQ ID NO: 2521659 - protein, 28 aa, Entamoeba dispar
EDEFQQFDFSGLFMLLYEVLSNLSPEQL

SEQ ID NO: 2521660 - protein, 27 aa, Entamoeba dispar
EDEIIKKQMWYFVSTYTNLTLHEVIEI

SEQ ID NO: 2521661 - protein, 24 aa, Entamoeba dispar
EDEKQYYYLKAMNGYLSIITSSSE

SEQ ID NO: 2521662 - protein, 26 aa, Entamoeba dispar
EDEMIQLIVQAMKKLHDPFEEKYITK

SEQ ID NO: 2521663 - protein, 25 aa, Entamoeba dispar
EDENDIIIFKKLISQMLGIEYNQAI

SEQ ID NO: 2521664 - protein, 29 aa, Entamoeba dispar
EDEREYWKALLRVYILNSIDNFGYQKREV

SEQ ID NO: 2521665 - protein, 24 aa, Entamoeba dispar
EDFDFLLNGVYDIIISESIEYVNQ

SEQ ID NO: 2521666 - protein, 36 aa, Entamoeba dispar
EDFEGITPILLTWDFPTPRVLPLIDSLKKAVSAGAY

SEQ ID NO: 2521667 - protein, 21 aa, Entamoeba dispar
EDFIAIGRYNGVSTIPIPGSG

SEQ ID NO: 2521668 - protein, 18 aa, Entamoeba dispar
EDFIDIPILIPIPVVKNR

SEQ ID NO: 2521669 - protein, 18 aa, Entamoeba dispar
EDFPLYYAIKKRNKDAVR

SEQ ID NO: 2521670 - protein, 24 aa, Entamoeba dispar
EDFPYYEHFFYRNNSVKHYFDKTN

SEQ ID NO: 2521671 - protein, 25 aa, Entamoeba dispar
EDGFKLHYFMQNIDLPPCITVFSAP

SEQ ID NO: 2521672 - protein, 24 aa, Entamoeba dispar
EDGKFPFEFISDRTAFKEICEYYK

SEQ ID NO: 2521673 - protein, 21 aa, Entamoeba dispar
EDGLFCDLLWSDPLQYEVYED

SEQ ID NO: 2521674 - protein, 24 aa, Entamoeba dispar
EDGNWYEPVLKRNPHLFLMGFNQP

SEQ ID NO: 2521675 - protein, 26 aa, Entamoeba dispar
EDGRIFKEIIWYKVDYSTHLKEKGTG

SEQ ID NO: 2521676 - protein, 26 aa, Entamoeba dispar
EDHDQIYYLMIKLEYSRLIIKIRTIA

SEQ ID NO: 2521677 - protein, 19 aa, Entamoeba dispar
EDHLIPFISGKWGCGVFGG

SEQ ID NO: 2521678 - protein, 22 aa, Entamoeba dispar
EDIATIKFYRKDAGSLMAPMDA

SEQ ID NO: 2521679 - protein, 23 aa, Entamoeba dispar
EDIATIKFYRKDAGSLMAPMDAF

SEQ ID NO: 2521680 - protein, 17 aa, Entamoeba dispar
EDIFESVILLDELFYFK

SEQ ID NO: 2521681 - protein, 24 aa, Entamoeba dispar
EDIIMTCGCAGACNVFLKTILDPG

SEQ ID NO: 2521682 - protein, 26 aa, Entamoeba dispar
EDIKIYLQFSYLIYTISHDKIYFTSI

SEQ ID NO: 2521683 - protein, 18 aa, Entamoeba dispar
EDILSWPEGVIDKQSLIE

SEQ ID NO: 2521684 - protein, 22 aa, Entamoeba dispar
EDIPILIELPSSLCIRLMDEND

SEQ ID NO: 2521685 - protein, 30 aa, Entamoeba dispar
EDIPSVFHLAWLSFLLYKSFKDSSEKSDES

SEQ ID NO: 2521686 - protein, 17 aa, Entamoeba dispar
EDIQLELLHLIKSVSRS

SEQ ID NO: 2521687 - protein, 24 aa, Entamoeba dispar
EDIQLLIQLFKFDQPYIVSKVQLS

SEQ ID NO: 2521688 - protein, 27 aa, Entamoeba dispar
EDISNRIFIFVTYSIPVELSIKIKGVR

SEQ ID NO: 2521689 - protein, 18 aa, Entamoeba dispar
EDITQEQNGWIRQAKEAS

SEQ ID NO: 2521690 - protein, 20 aa, Entamoeba dispar
EDITYFKIHFKEAVDYIKSI

SEQ ID NO: 2521691 - protein, 29 aa, Entamoeba dispar
EDIYCKLPLYFERPFTDWTLSLLQKSFKD

SEQ ID NO: 2521692 - protein, 31 aa, Entamoeba dispar
EDKAIGFIINGVLLKPAFIGITQTELYPIVV

SEQ ID NO: 2521693 - protein, 23 aa, Entamoeba dispar
EDKDNPFLKLQQISNSQPTKETK

SEQ ID NO: 2521694 - protein, 22 aa, Entamoeba dispar
EDKLKIEIEYLKEKVQIEQTEK

SEQ ID NO: 2521695 - protein, 20 aa, Entamoeba dispar
EDKMFLFVMAAILSMHREFI

SEQ ID NO: 2521696 - protein, 24 aa, Entamoeba dispar
EDKNPLYYHYIELLAANCLMKMNS

SEQ ID NO: 2521697 - protein, 21 aa, Entamoeba dispar
EDKNYFIWIHREPVDELKSNA

SEQ ID NO: 2521698 - protein, 24 aa, Entamoeba dispar
EDKQKPILGIPVTTPGYSYYNKLL

SEQ ID NO: 2521699 - protein, 34 aa, Entamoeba dispar
EDKQYFTVLQRLLYTRVFKYIWPPSINTVEKMNL

SEQ ID NO: 2521700 - protein, 24 aa, Entamoeba dispar
EDKRKENLILLTQRLKEMIDNAHN

SEQ ID NO: 2521701 - protein, 24 aa, Entamoeba dispar
EDLDPRKVLSIFRSLIREDIETMD

SEQ ID NO: 2521702 - protein, 28 aa, Entamoeba dispar
EDLFDFHSYIFNRFSADTYLACVRCCKD

SEQ ID NO: 2521703 - protein, 24 aa, Entamoeba dispar
EDLLFRVHVKLLLGDSVIGSIYSH

SEQ ID NO: 2521704 - protein, 25 aa, Entamoeba dispar
EDLQNFRTFMAAADKPFNIKNFYGM

SEQ ID NO: 2521705 - protein, 20 aa, Entamoeba dispar
EDLSLLIESLLILIKTEESE

SEQ ID NO: 2521706 - protein, 22 aa, Entamoeba dispar
EDLSRVMLFPNISTFGIQIKGI

SEQ ID NO: 2521707 - protein, 18 aa, Entamoeba dispar
EDLWKLLTGPTVKQVMEL

SEQ ID NO: 2521708 - protein, 29 aa, Entamoeba dispar
EDMAPRIYSILNNKPLLFELCGISAMGNE

SEQ ID NO: 2521709 - protein, 22 aa, Entamoeba dispar
EDMLFIVRIDIFNNKQLITRLF

SEQ ID NO: 2521710 - protein, 17 aa, Entamoeba dispar
EDMLFKIRAIVSNNGIV

SEQ ID NO: 2521711 - protein, 20 aa, Entamoeba dispar
EDMPLTICFLGDNKTPALSV

SEQ ID NO: 2521712 - protein, 29 aa, Entamoeba dispar
EDNLTAIDLIPIFFTLQSNNYFTKVTVEN

SEQ ID NO: 2521713 - protein, 24 aa, Entamoeba dispar
EDNNISYIFLLKKIQEIRMKENMK

SEQ ID NO: 2521714 - protein, 23 aa, Entamoeba dispar
EDNPTIPFMNVRGKILEKVIEFM

SEQ ID NO: 2521715 - protein, 23 aa, Entamoeba dispar
EDNSFKPYIGFIGYARNNNGLVV

SEQ ID NO: 2521716 - protein, 36 aa, Entamoeba dispar
EDNSKDLELALTTLQYYLPLFRMAEHLKRSHEDRTN

SEQ ID NO: 2521717 - protein, 21 aa, Entamoeba dispar
EDNVIWMLVGCKSDQQINVDE

SEQ ID NO: 2521718 - protein, 23 aa, Entamoeba dispar
EDNYLIEYTIDDPPLPLYCNSWM

SEQ ID NO: 2521719 - protein, 17 aa, Entamoeba dispar
EDPGKYRFIFERDYIYI

SEQ ID NO: 2521720 - protein, 22 aa, Entamoeba dispar
EDPILLLNKTPIQTMHYGEIQP

SEQ ID NO: 2521721 - protein, 25 aa, Entamoeba dispar
EDPQTTFLFILQSFVSLIYNNKYAQ

SEQ ID NO: 2521722 - protein, 22 aa, Entamoeba dispar
EDPYDILLIVACWRAEKRHHWI

SEQ ID NO: 2521723 - protein, 17 aa, Entamoeba dispar
EDPYLVANLVKLFIKEI

SEQ ID NO: 2521724 - protein, 17 aa, Entamoeba dispar
EDQKEILRLAFAEDDVM

SEQ ID NO: 2521725 - protein, 17 aa, Entamoeba dispar
EDQWYYDNKINFWRNVY

SEQ ID NO: 2521726 - protein, 22 aa, Entamoeba dispar
EDRILLFGYEHGCGPALQYATV

SEQ ID NO: 2521727 - protein, 18 aa, Entamoeba dispar
EDRYSFIEYCFVAMIYAM

SEQ ID NO: 2521728 - protein, 23 aa, Entamoeba dispar
EDSCFDRCYSLKYINIPSTISVL

SEQ ID NO: 2521729 - protein, 34 aa, Entamoeba dispar
EDSGYGFYINKDIDFFMFVLKGNIKIPTKITKKD

SEQ ID NO: 2521730 - protein, 18 aa, Entamoeba dispar
EDSIALRPSFDNFLKFVS

SEQ ID NO: 2521731 - protein, 29 aa, Entamoeba dispar
EDSSDIEWSLPAFLPKRIKSISKEEEEII

SEQ ID NO: 2521732 - protein, 23 aa, Entamoeba dispar
EDTCQFLLIYNGLKESRNLFFQN

SEQ ID NO: 2521733 - protein, 29 aa, Entamoeba dispar
EDTIDLHGLQIEGAIIMMKEEIEARKKDG

SEQ ID NO: 2521734 - protein, 24 aa, Entamoeba dispar
EDTIEMLTIEKQCLQKRVECLEKE

SEQ ID NO: 2521735 - protein, 20 aa, Entamoeba dispar
EDTKIMKAMPAYTCIAYKSG

SEQ ID NO: 2521736 - protein, 22 aa, Entamoeba dispar
EDTLYILRGIREKYENHYGLTI

SEQ ID NO: 2521737 - protein, 22 aa, Entamoeba dispar
EDTRAFFLELYDSLLKDEKVVQ

SEQ ID NO: 2521738 - protein, 24 aa, Entamoeba dispar
EDTTPITPLISIEPIIEELNYTMN

SEQ ID NO: 2521739 - protein, 30 aa, Entamoeba dispar
EDTTYCQNLKKPLLPLFIKGIKSGNEEVMI

SEQ ID NO: 2521740 - protein, 29 aa, Entamoeba dispar
EDVEEMAQALYIYWKSRDIVKAGECDYEE

SEQ ID NO: 2521741 - protein, 20 aa, Entamoeba dispar
EDVFRHLWLNNDVFASLCEI

SEQ ID NO: 2521742 - protein, 21 aa, Entamoeba dispar
EDVLFNVCKLCKILMTDSDSD

SEQ ID NO: 2521743 - protein, 44 aa, Entamoeba dispar
EDVLKEDWTTIKLYKFLIPLIFHYQELYWFERMGMPINKVTIPG

SEQ ID NO: 2521744 - protein, 18 aa, Entamoeba dispar
EDVLKNNSFWWKEDRDWT

SEQ ID NO: 2521745 - protein, 23 aa, Entamoeba dispar
EDVLKQLILLGSDDKILLPLSDC

SEQ ID NO: 2521746 - protein, 31 aa, Entamoeba dispar
EDVSCVHYLFEKYLFIKYKTNNPEAVICLIN

SEQ ID NO: 2521747 - protein, 37 aa, Entamoeba dispar
EDVYKFMKYFKEKYIIPGEFWLYYVINVNKHKEEYLK

SEQ ID NO: 2521748 - protein, 18 aa, Entamoeba dispar
EDWFSVCKNFTLADGTFW

SEQ ID NO: 2521749 - protein, 27 aa, Entamoeba dispar
EDYDRLRPLSYPSTDVFLVCFSVIAPA

SEQ ID NO: 2521750 - protein, 27 aa, Entamoeba dispar
EDYDTNEVLKWLDPLQALVVGPGLGRD

SEQ ID NO: 2521751 - protein, 22 aa, Entamoeba dispar
EEAAWKAIVPQVQTINSFFEYS

SEQ ID NO: 2521752 - protein, 23 aa, Entamoeba dispar
EEADILCCTLNTSGSDIFLNCVK

SEQ ID NO: 2521753 - protein, 23 aa, Entamoeba dispar
EEAHLIILLFSLLPTDKLLTYEN

SEQ ID NO: 2521754 - protein, 23 aa, Entamoeba dispar
EEAKGFIELPPGTETKDVSQNKK

SEQ ID NO: 2521755 - protein, 23 aa, Entamoeba dispar
EEALPIHDMFQALLTLINEVIPA

SEQ ID NO: 2521756 - protein, 28 aa, Entamoeba dispar
EEALVKFLDSWLCVFSSDLFIGKSFKCE

SEQ ID NO: 2521757 - protein, 30 aa, Entamoeba dispar
EEANELWKKYFFEQQIYKIKEMENVFSRIV

SEQ ID NO: 2521758 - protein, 34 aa, Entamoeba dispar
EEAQNLIFKLKDPNLFKMFLEKLQSIYDLHMQNI

SEQ ID NO: 2521759 - protein, 32 aa, Entamoeba dispar
EEATLRYQVIFKFLFDIEYHRYLLSRAFTKII

SEQ ID NO: 2521760 - protein, 25 aa, Entamoeba dispar
EECDNPLFSYIIASLPKLETINGQK

SEQ ID NO: 2521761 - protein, 17 aa, Entamoeba dispar
EECISLKGICDYLINFI

SEQ ID NO: 2521762 - protein, 22 aa, Entamoeba dispar
EECNYLNLITIPTSVSKIGKEC

SEQ ID NO: 2521763 - protein, 30 aa, Entamoeba dispar
EECQRMAFLIGLLNYRGVGLIIARRSKKAE

SEQ ID NO: 2521764 - protein, 18 aa, Entamoeba dispar
EECSSEWYVELFVDYVRN

SEQ ID NO: 2521765 - protein, 26 aa, Entamoeba dispar
EECVFQYNCYGLYFAHCMALPQYKDV

SEQ ID NO: 2521766 - protein, 19 aa, Entamoeba dispar
EECYTLKAPIKIVSEQKRK

SEQ ID NO: 2521767 - protein, 24 aa, Entamoeba dispar
EEDALLCFRIISNKNYILKFDNCE

SEQ ID NO: 2521768 - protein, 21 aa, Entamoeba dispar
EEDFILLKSLCDLAVVSLEVI

SEQ ID NO: 2521769 - protein, 27 aa, Entamoeba dispar
EEDHQNIIFKKFLLGDKKFPQNLVGRF

SEQ ID NO: 2521770 - protein, 29 aa, Entamoeba dispar
EEDIKDIWIGIYFWYWHSDGRDYQEKVRK

SEQ ID NO: 2521771 - protein, 33 aa, Entamoeba dispar
EEDLIYDSIFFIPLNRRINIVLKELWKREFGVF

SEQ ID NO: 2521772 - protein, 23 aa, Entamoeba dispar
EEDMMQWACWFHNAGTEIDLPTP

SEQ ID NO: 2521773 - protein, 19 aa, Entamoeba dispar
EEDQMLIDLQKILGNKWTE

SEQ ID NO: 2521774 - protein, 20 aa, Entamoeba dispar
EEDRDYGSIPLPTVIRDELH

SEQ ID NO: 2521775 - protein, 23 aa, Entamoeba dispar
EEDRKILIAYRKYWFEGNIEQND

SEQ ID NO: 2521776 - protein, 23 aa, Entamoeba dispar
EEDSQREIFQPKVVRRKDRVSDD

SEQ ID NO: 2521777 - protein, 37 aa, Entamoeba dispar
EEEDRFGRFCLWFSYVCDFLMIYENYIYNLPLAQKVI

SEQ ID NO: 2521778 - protein, 29 aa, Entamoeba dispar
EEEEERAFMEKALRLNPNADPEKLQQMRK

SEQ ID NO: 2521779 - protein, 29 aa, Entamoeba dispar
EEEEKSEEVIPFRLPPELVQASIQQEKPS

SEQ ID NO: 2521780 - protein, 20 aa, Entamoeba dispar
EEEEPYYEDIYYGDSYYGDD

SEQ ID NO: 2521781 - protein, 26 aa, Entamoeba dispar
EEEFKTYFVQFLEYLNIPAVSKAEKG

SEQ ID NO: 2521782 - protein, 27 aa, Entamoeba dispar
EEEIDQIFRLIYSDSIELMIDLFGNYV

SEQ ID NO: 2521783 - protein, 22 aa, Entamoeba dispar
EEEIKKLIKWARGLKPIDKEEI

SEQ ID NO: 2521784 - protein, 18 aa, Entamoeba dispar
EEEKIIRIIFKKVKGSCK

SEQ ID NO: 2521785 - protein, 26 aa, Entamoeba dispar
EEEKNPIVVIAYLELPRFDKKQNKEE

SEQ ID NO: 2521786 - protein, 23 aa, Entamoeba dispar
EEELFFMEGLAHSYIFSTSLPRW

SEQ ID NO: 2521787 - protein, 18 aa, Entamoeba dispar
EEELILEKPSIYKDPFEL

SEQ ID NO: 2521788 - protein, 30 aa, Entamoeba dispar
EEELIMKRINDMQFMLNQSLKKVEMEECSG

SEQ ID NO: 2521789 - protein, 20 aa, Entamoeba dispar
EEELLLMIAIGYGDEDYLST

SEQ ID NO: 2521790 - protein, 23 aa, Entamoeba dispar
EEEMFFTEMLGLTLVFAQALPRL

SEQ ID NO: 2521791 - protein, 29 aa, Entamoeba dispar
EEENSYELCIIFILINEGFPENIIREAIK

SEQ ID NO: 2521792 - protein, 22 aa, Entamoeba dispar
EEEPFPYSFYTDGIQITDNIPN

SEQ ID NO: 2521793 - protein, 17 aa, Entamoeba dispar
EEEVLNDRILLLEKELG

SEQ ID NO: 2521794 - protein, 24 aa, Entamoeba dispar
EEEWSYIPSFLKTKPPKPKDQIDV

SEQ ID NO: 2521795 - protein, 18 aa, Entamoeba dispar
EEEYFIEQLTKPIIGEEL

SEQ ID NO: 2521796 - protein, 23 aa, Entamoeba dispar
EEEYVTLDFLTLDRIEPTENELH

SEQ ID NO: 2521797 - protein, 37 aa, Entamoeba dispar
EEFDSLRPLSYPGTDIFLLCFAVIYEPSFQNLKEKWQ

SEQ ID NO: 2521798 - protein, 24 aa, Entamoeba dispar
EEFENYLFSFVQALRLESQEKPGK

SEQ ID NO: 2521799 - protein, 30 aa, Entamoeba dispar
EEFIKKIMFEILTALLYLHSIGVIHRDLKP

SEQ ID NO: 2521800 - protein, 26 aa, Entamoeba dispar
EEFKEMKPWFRGWTGQLRKNKDGSGY

SEQ ID NO: 2521801 - protein, 17 aa, Entamoeba dispar
EEFLKDPDKFRTFIANK

SEQ ID NO: 2521802 - protein, 27 aa, Entamoeba dispar
EEFLKFRKTSSFYLFRKCIDVLGNSAS

SEQ ID NO: 2521803 - protein, 18 aa, Entamoeba dispar
EEFLVLDAKIVLDKNMIG

SEQ ID NO: 2521804 - protein, 22 aa, Entamoeba dispar
EEFRLFNLIKKEGTPKAEVEQL

SEQ ID NO: 2521805 - protein, 18 aa, Entamoeba dispar
EEFVSLRDKIKEILQMEE

SEQ ID NO: 2521806 - protein, 25 aa, Entamoeba dispar
EEGDDRYITVQSGKKIRIADEDSTE

SEQ ID NO: 2521807 - protein, 27 aa, Entamoeba dispar
EEGFEIPIPLFYEIKKEKVLLPSIGNY

SEQ ID NO: 2521808 - protein, 23 aa, Entamoeba dispar
EEGKLKIYLYPNEEFNTIDESDA

SEQ ID NO: 2521809 - protein, 26 aa, Entamoeba dispar
EEGTVPFLEFILSTALNFSPETFQNG

SEQ ID NO: 2521810 - protein, 28 aa, Entamoeba dispar
EEGTVQYYINQLINVLLIEKQITEEVMK

SEQ ID NO: 2521811 - protein, 23 aa, Entamoeba dispar
EEGYVWVVMEFMDSGCLTEVLTE

SEQ ID NO: 2521812 - protein, 42 aa, Entamoeba dispar
EEHFLKSYSLNLKKPYRNIFKWAPLLALVNSLTNLSNFVVDA

SEQ ID NO: 2521813 - protein, 39 aa, Entamoeba dispar
EEICMNAFIIIRKHGPLFIYLFRLMLATGIPELQSAKDI

SEQ ID NO: 2521814 - protein, 34 aa, Entamoeba dispar
EEIDNIKFYFKDKIWEIIWKCIFEYNKDTIKINI

SEQ ID NO: 2521815 - protein, 22 aa, Entamoeba dispar
EEIEFQVNQLYQSEIEDLYSNE

SEQ ID NO: 2521816 - protein, 26 aa, Entamoeba dispar
EEIELPLQPQVCGALVMALNGEMTDC

SEQ ID NO: 2521817 - protein, 19 aa, Entamoeba dispar
EEIFNEKIKIKYKLCSIEK

SEQ ID NO: 2521818 - protein, 33 aa, Entamoeba dispar
EEIHFYQSILQSFGYKFIFYKNPNKKKIHYLNT

SEQ ID NO: 2521819 - protein, 21 aa, Entamoeba dispar
EEIIYIKHPFIPNSKQIITNP

SEQ ID NO: 2521820 - protein, 20 aa, Entamoeba dispar
EEIKAKYIKQKVLLGKCRVA

SEQ ID NO: 2521821 - protein, 26 aa, Entamoeba dispar
EEIKKAYRKLALKLHPDKLVDVDPEE

SEQ ID NO: 2521822 - protein, 24 aa, Entamoeba dispar
EEIKKLLTWGCYLTPINKKRDTKR

SEQ ID NO: 2521823 - protein, 23 aa, Entamoeba dispar
EEIKSFDFFLKLDEDIPLELMRI

SEQ ID NO: 2521824 - protein, 22 aa, Entamoeba dispar
EEILKLIRDFPMRLTEKERGYL

SEQ ID NO: 2521825 - protein, 24 aa, Entamoeba dispar
EEILKLYTGIMKYGADFGLIELMF

SEQ ID NO: 2521826 - protein, 20 aa, Entamoeba dispar
EEILSLLERLVYLGNAEVSV

SEQ ID NO: 2521827 - protein, 20 aa, Entamoeba dispar
EEILYITDFKLKGCPVSAIL

SEQ ID NO: 2521828 - protein, 17 aa, Entamoeba dispar
EEILYLQQEFINSKKNQ

SEQ ID NO: 2521829 - protein, 20 aa, Entamoeba dispar
EEIPETIQLFSSLKKISFAS

SEQ ID NO: 2521830 - protein, 24 aa, Entamoeba dispar
EEIRPISIKLLQKIQLIFTEQRDQ

SEQ ID NO: 2521831 - protein, 27 aa, Entamoeba dispar
EEIRQYFPEPIVFKVLFEVYKRLYGIT

SEQ ID NO: 2521832 - protein, 25 aa, Entamoeba dispar
EEISGMILKYLSFMAKSKLKNTQIS

SEQ ID NO: 2521833 - protein, 24 aa, Entamoeba dispar
EEISGMILKYLYEIAQAKLGNQPI

SEQ ID NO: 2521834 - protein, 27 aa, Entamoeba dispar
EEISGMILKYLYEIAQKKLGNRPISNV

SEQ ID NO: 2521835 - protein, 17 aa, Entamoeba dispar
EEKEDIGFFVGSDYTNF

SEQ ID NO: 2521836 - protein, 23 aa, Entamoeba dispar
EEKEDWMMAFDDILSREHNSAMS

SEQ ID NO: 2521837 - protein, 26 aa, Entamoeba dispar
EEKEFYTIFGTYFKKNAKWSINKNVP

SEQ ID NO: 2521838 - protein, 17 aa, Entamoeba dispar
EEKFLPFLLDSIQPQHY

SEQ ID NO: 2521839 - protein, 27 aa, Entamoeba dispar
EEKGVFQCIVFWQRDLFEIYGFEEKDQ

SEQ ID NO: 2521840 - protein, 20 aa, Entamoeba dispar
EEKILIKLFNKEVAEKVKCE

SEQ ID NO: 2521841 - protein, 28 aa, Entamoeba dispar
EEKIVIKNLFREGIIKTIFLTFNEIEYF

SEQ ID NO: 2521842 - protein, 25 aa, Entamoeba dispar
EEKKKPIVFKAKIHRKRKNEDVSQE

SEQ ID NO: 2521843 - protein, 17 aa, Entamoeba dispar
EEKLLAELASKKQSQRK

SEQ ID NO: 2521844 - protein, 27 aa, Entamoeba dispar
EEKLLQPRKRLIRPFDENVEINKFIKP

SEQ ID NO: 2521845 - protein, 19 aa, Entamoeba dispar
EEKLTKLTLIFVTDMLIFG

SEQ ID NO: 2521846 - protein, 29 aa, Entamoeba dispar
EEKNQVIQLFQYFGLNWKGLNSFKRPIII

SEQ ID NO: 2521847 - protein, 23 aa, Entamoeba dispar
EEKPIMPMTIPETIIQHPVATIP

SEQ ID NO: 2521848 - protein, 19 aa, Entamoeba dispar
EEKRRCVELANLSQKIIQN

SEQ ID NO: 2521849 - protein, 22 aa, Entamoeba dispar
EEKSFFLFKLNEKNYERFISKT

SEQ ID NO: 2521850 - protein, 18 aa, Entamoeba dispar
EEKYIEVYIKWRNDNKTK

SEQ ID NO: 2521851 - protein, 24 aa, Entamoeba dispar
EEKYSLQSLIVLNLYLLLKHEVDA

SEQ ID NO: 2521852 - protein, 20 aa, Entamoeba dispar
EELAYPLLDSLLKDRTEPLG

SEQ ID NO: 2521853 - protein, 25 aa, Entamoeba dispar
EELFEGIYHCTIHNIPFNILGQIIE

SEQ ID NO: 2521854 - protein, 26 aa, Entamoeba dispar
EELFFMEMLGQCFIISSAMPRFEQFR

SEQ ID NO: 2521855 - protein, 26 aa, Entamoeba dispar
EELGAVCFAHWFQPLTSKSAKKFDCF

SEQ ID NO: 2521856 - protein, 32 aa, Entamoeba dispar
EELGTLFLVELSPILFKLIWKTENEIDNLTTL

SEQ ID NO: 2521857 - protein, 23 aa, Entamoeba dispar
EELKYFKECIIKVGLSYDDIKDL

SEQ ID NO: 2521858 - protein, 29 aa, Entamoeba dispar
EELLFSVRPECFISLILFEVLLDNEAVLI

SEQ ID NO: 2521859 - protein, 35 aa, Entamoeba dispar
EELLKKFNNKPLKLKLKKMFLDLQNINSIDSLKIK

SEQ ID NO: 2521860 - protein, 26 aa, Entamoeba dispar
EELLPSICLHQIIIPLPAQGITMPKN

SEQ ID NO: 2521861 - protein, 25 aa, Entamoeba dispar
EELLRHMFEPLFDATLNPEKHPELV

SEQ ID NO: 2521862 - protein, 44 aa, Entamoeba dispar
EELMKDHFYHRLMFLHIQNKCISILNPTFIQYGYTTKVAIEQLY

SEQ ID NO: 2521863 - protein, 17 aa, Entamoeba dispar
EELSKFTLLSCVLFSLI

SEQ ID NO: 2521864 - protein, 17 aa, Entamoeba dispar
EELWKNLIIISIDIKDY

SEQ ID NO: 2521865 - protein, 23 aa, Entamoeba dispar
EELYEWLRVCSGAIILQGYGLTE

SEQ ID NO: 2521866 - protein, 17 aa, Entamoeba dispar
EELYRRCTIHYRESSVI

SEQ ID NO: 2521867 - protein, 24 aa, Entamoeba dispar
EEMADLIKIWPGISPIQVIGLLDV

SEQ ID NO: 2521868 - protein, 24 aa, Entamoeba dispar
EEMDLMLAFLIRDFGKLLVNESND

SEQ ID NO: 2521869 - protein, 26 aa, Entamoeba dispar
EEMEETLFWELLVILSEMKECGCFEE

SEQ ID NO: 2521870 - protein, 25 aa, Entamoeba dispar
EEMKLSFEIVFDKEYYFVCKDKCEY

SEQ ID NO: 2521871 - protein, 20 aa, Entamoeba dispar
EEMRENVVIGFFSSKKFVGA

SEQ ID NO: 2521872 - protein, 24 aa, Entamoeba dispar
EEMRKFLFNFPSLLLNSYCTALIK

SEQ ID NO: 2521873 - protein, 23 aa, Entamoeba dispar
EENAAVPIRKLIGLAGITEGDCK

SEQ ID NO: 2521874 - protein, 21 aa, Entamoeba dispar
EENDLLLFIILNGISKENDKE

SEQ ID NO: 2521875 - protein, 29 aa, Entamoeba dispar
EENFGQIAYYFLLLSGFLQKPHHQFRGLL

SEQ ID NO: 2521876 - protein, 28 aa, Entamoeba dispar
EENIEIFNKFLMFILNRNKREEAILING

SEQ ID NO: 2521877 - protein, 18 aa, Entamoeba dispar
EENILLNSIINAMKTTKI

SEQ ID NO: 2521878 - protein, 24 aa, Entamoeba dispar
EENIMGRIQYYIMKEEWEKSEKES

SEQ ID NO: 2521879 - protein, 18 aa, Entamoeba dispar
EENLKHFKWMCQGRYGEG

SEQ ID NO: 2521880 - protein, 30 aa, Entamoeba dispar
EENNKTLPMPLLMEIIWNCVMSNNLLNNQI

SEQ ID NO: 2521881 - protein, 21 aa, Entamoeba dispar
EENTFIFLGDYVDRGNFSTEI

SEQ ID NO: 2521882 - protein, 29 aa, Entamoeba dispar
EENVFGQWGFLIYYILSKGGSVTIRPSIK

SEQ ID NO: 2521883 - protein, 25 aa, Entamoeba dispar
EEPDYFAMRKLFWSIAKRENIKFDG

SEQ ID NO: 2521884 - protein, 23 aa, Entamoeba dispar
EEPIKLYNKFVVSRVLQDFKREY

SEQ ID NO: 2521885 - protein, 18 aa, Entamoeba dispar
EEPIVIHKEIQIPVVQER

SEQ ID NO: 2521886 - protein, 23 aa, Entamoeba dispar
EEPSFFDNPRYKMLITQYTNKVE

SEQ ID NO: 2521887 - protein, 25 aa, Entamoeba dispar
EEQENLIVLQLFKENVRCFDSNSVV

SEQ ID NO: 2521888 - protein, 24 aa, Entamoeba dispar
EEQFMKVMKTPLPTSFRLTKSSET

SEQ ID NO: 2521889 - protein, 24 aa, Entamoeba dispar
EEQHTLYFVLRHLHNIYSNNDFNE

SEQ ID NO: 2521890 - protein, 21 aa, Entamoeba dispar
EEQLIDLNPMLEAFGNAKTVK

SEQ ID NO: 2521891 - protein, 17 aa, Entamoeba dispar
EEQLLKIKKEFSEKQIK

SEQ ID NO: 2521892 - protein, 27 aa, Entamoeba dispar
EEQQIRSELMGFFNHLTKSKEMKKALN

SEQ ID NO: 2521893 - protein, 17 aa, Entamoeba dispar
EEQQLYAYTNFINYIIN

SEQ ID NO: 2521894 - protein, 20 aa, Entamoeba dispar
EERCHFFYNMNLNNGITNEE

SEQ ID NO: 2521895 - protein, 33 aa, Entamoeba dispar
EERDERLALLKLFLPEPVLSTSIIILNKSGVVL

SEQ ID NO: 2521896 - protein, 27 aa, Entamoeba dispar
EEREKIETLFRFTPDPVTENKKLKEEV

SEQ ID NO: 2521897 - protein, 18 aa, Entamoeba dispar
EERIFINGPVLNSIKTPL

SEQ ID NO: 2521898 - protein, 23 aa, Entamoeba dispar
EERIRLYNKFKKVIDMMYPNEPY

SEQ ID NO: 2521899 - protein, 20 aa, Entamoeba dispar
EERITLVKKILSLGIKAHAI

SEQ ID NO: 2521900 - protein, 29 aa, Entamoeba dispar
EERKKFKKPLKRTFKVSSPQKKVVDLNNS

SEQ ID NO: 2521901 - protein, 34 aa, Entamoeba dispar
EERKKLTPLELFWLLNEFADLLGPSPLIVEKKLG

SEQ ID NO: 2521902 - protein, 17 aa, Entamoeba dispar
EERKPIYFLIDETTMSI

SEQ ID NO: 2521903 - protein, 22 aa, Entamoeba dispar
EERKRLFQINPYSQQGLSTIPL

SEQ ID NO: 2521904 - protein, 22 aa, Entamoeba dispar
EERMFVNEPVLVSIKIPYDLEI

SEQ ID NO: 2521905 - protein, 17 aa, Entamoeba dispar
EERNRKIFNYQEFDIFG

SEQ ID NO: 2521906 - protein, 22 aa, Entamoeba dispar
EERRFQMVVSILVRIMKRLKRI

SEQ ID NO: 2521907 - protein, 27 aa, Entamoeba dispar
EESDLNWFIFSIIVSDISFIFVMDDEN

SEQ ID NO: 2521908 - protein, 23 aa, Entamoeba dispar
EESIEFPMYYVDSQPFEGKDNTR

SEQ ID NO: 2521909 - protein, 26 aa, Entamoeba dispar
EESIKALPIIILFDNITDNNFNIIFQ

SEQ ID NO: 2521910 - protein, 24 aa, Entamoeba dispar
EESKAWPDYVFLKGTSFSSSNKDK

SEQ ID NO: 2521911 - protein, 24 aa, Entamoeba dispar
EESKELLIEIGFNKYAVQKQDIAD

SEQ ID NO: 2521912 - protein, 23 aa, Entamoeba dispar
EESKNNFYLLSSSWVKLVKVNQR

SEQ ID NO: 2521913 - protein, 18 aa, Entamoeba dispar
EESLRNILWGEHFINMKT

SEQ ID NO: 2521914 - protein, 22 aa, Entamoeba dispar
EESNEYLNIVLFVIDCQKNEIK

SEQ ID NO: 2521915 - protein, 26 aa, Entamoeba dispar
EESRRVKFVFISWAGEAIKKPKLRAV

SEQ ID NO: 2521916 - protein, 30 aa, Entamoeba dispar
EETIDVLSRILALIPPWVRVHRIQRDIPIP

SEQ ID NO: 2521917 - protein, 17 aa, Entamoeba dispar
EETILKRTYKITKYIRC

SEQ ID NO: 2521918 - protein, 24 aa, Entamoeba dispar
EETISLGIPVNLMLLKKNQELIIA

SEQ ID NO: 2521919 - protein, 34 aa, Entamoeba dispar
EETKDRLLSFLRLQKIGFVFQTFNLIASMTAIEN

SEQ ID NO: 2521920 - protein, 21 aa, Entamoeba dispar
EETLIRFSGFPHGGACTVVLR

SEQ ID NO: 2521921 - protein, 17 aa, Entamoeba dispar
EETPRRYPTNSITSESM

SEQ ID NO: 2521922 - protein, 18 aa, Entamoeba dispar
EETYILFIHSLSFSRYST

SEQ ID NO: 2521923 - protein, 31 aa, Entamoeba dispar
EEVFLSNYSIFGPSWIKFNGLTVVRTSVEQK

SEQ ID NO: 2521924 - protein, 18 aa, Entamoeba dispar
EEVGINYIINCTPDVMCF

SEQ ID NO: 2521925 - protein, 25 aa, Entamoeba dispar
EEVHLIVCVAMRKILKFLNSIDKAK

SEQ ID NO: 2521926 - protein, 24 aa, Entamoeba dispar
EEVIALICQYLKEQKLQETRIALV

SEQ ID NO: 2521927 - protein, 23 aa, Entamoeba dispar
EEVINPMIQPTTFLPNEITKLLP

SEQ ID NO: 2521928 - protein, 25 aa, Entamoeba dispar
EEVKGILPWIINFNYHSSLKQYHEI

SEQ ID NO: 2521929 - protein, 19 aa, Entamoeba dispar
EEVKIIIKILEGKEIKKPK

SEQ ID NO: 2521930 - protein, 26 aa, Entamoeba dispar
EEVKNHPFFERIRWNTLLSESREDIF

SEQ ID NO: 2521931 - protein, 19 aa, Entamoeba dispar
EEVLIALLPIIDQSTTKPY

SEQ ID NO: 2521932 - protein, 23 aa, Entamoeba dispar
EEVPLPILKAMYGIYFTPRSLEG

SEQ ID NO: 2521933 - protein, 27 aa, Entamoeba dispar
EEVPPPIYQPPYIPTPQQPSFIVSQPT

SEQ ID NO: 2521934 - protein, 24 aa, Entamoeba dispar
EEVRETFRRAAVVQDIMLGNAMGK

SEQ ID NO: 2521935 - protein, 26 aa, Entamoeba dispar
EEVRKIIYIINLLPSTCYYLDKSGIN

SEQ ID NO: 2521936 - protein, 25 aa, Entamoeba dispar
EEVYQRYYHVFIKGELEQVIEKVKD

SEQ ID NO: 2521937 - protein, 24 aa, Entamoeba dispar
EEWEHIIFYCCFLMMIQNNKIMMN

SEQ ID NO: 2521938 - protein, 25 aa, Entamoeba dispar
EEWEHIIFYCCFLMMIQNNKIMMSE

SEQ ID NO: 2521939 - protein, 27 aa, Entamoeba dispar
EEWVKQCEILLYRGAWQEWEIERADLI

SEQ ID NO: 2521940 - protein, 34 aa, Entamoeba dispar
EEYDRLRPLSYPSTDVFLICYSIMSKASYENVEG

SEQ ID NO: 2521941 - protein, 35 aa, Entamoeba dispar
EEYESIRPLSYPSTDVFLLCYSVVQQSSLDNIAEK

SEQ ID NO: 2521942 - protein, 19 aa, Entamoeba dispar
EEYGEIMDVFYKRSFEREH

SEQ ID NO: 2521943 - protein, 24 aa, Entamoeba dispar
EEYIFAQWGLIVKYAILKGGKFEI

SEQ ID NO: 2521944 - protein, 23 aa, Entamoeba dispar
EEYKKFFIKYSYDDLVNKKFPKG

SEQ ID NO: 2521945 - protein, 23 aa, Entamoeba dispar
EEYKKIISIIRDYAIHKATIAFT

SEQ ID NO: 2521946 - protein, 17 aa, Entamoeba dispar
EEYKKLLILFTELVIKQ

SEQ ID NO: 2521947 - protein, 20 aa, Entamoeba dispar
EEYLIRMKGIPEGVIRGEAK

SEQ ID NO: 2521948 - protein, 18 aa, Entamoeba dispar
EEYLLIRRNLLLTIETIG

SEQ ID NO: 2521949 - protein, 17 aa, Entamoeba dispar
EEYNIETPILIIENTEI

SEQ ID NO: 2521950 - protein, 34 aa, Entamoeba dispar
EEYNSLRPLSYPQTDIFLLCFSVVYHASYINVRD

SEQ ID NO: 2521951 - protein, 36 aa, Entamoeba dispar
EEYQTMIDPYIRQTNSFLIVYSIVEEKTFETAKKYV

SEQ ID NO: 2521952 - protein, 20 aa, Entamoeba dispar
EEYTWAFPPTKASGFFVGPF

SEQ ID NO: 2521953 - protein, 26 aa, Entamoeba dispar
EFALNDNICDVFLLNKPLFNRFGPYI

SEQ ID NO: 2521954 - protein, 18 aa, Entamoeba dispar
EFARLMMYKIISTTLCSN

SEQ ID NO: 2521955 - protein, 26 aa, Entamoeba dispar
EFASNLVILLTGFFDSIETLILKDNM

SEQ ID NO: 2521956 - protein, 27 aa, Entamoeba dispar
EFCCKITEGVLLRKVLSDLIKQSQSKL

SEQ ID NO: 2521957 - protein, 26 aa, Entamoeba dispar
EFCDKYIQKWIAISAPFIGTGVVPKQ

SEQ ID NO: 2521958 - protein, 20 aa, Entamoeba dispar
EFCEQTLDLRFVPDDTEFPY

SEQ ID NO: 2521959 - protein, 28 aa, Entamoeba dispar
EFCGHYMFPYCILNKHLPFWGGYVGSHF

SEQ ID NO: 2521960 - protein, 35 aa, Entamoeba dispar
EFCPLKEIIALKKAYGFYLYIDEAHSIGALGSTGR

SEQ ID NO: 2521961 - protein, 34 aa, Entamoeba dispar
EFCPLKEIIALKKAYGFYLYVDEAHSIGALGSTG

SEQ ID NO: 2521962 - protein, 30 aa, Entamoeba dispar
EFDDGRIFKEVIWYAISYSKYLKEKGTGNI

SEQ ID NO: 2521963 - protein, 24 aa, Entamoeba dispar
EFDFKDIIVLKIVNLKIIPSKTID

SEQ ID NO: 2521964 - protein, 29 aa, Entamoeba dispar
EFDGGIIIFRLYSLIIRILFIQKSSKSIT

SEQ ID NO: 2521965 - protein, 20 aa, Entamoeba dispar
EFDILHYAGTVTYNARDWVK

SEQ ID NO: 2521966 - protein, 26 aa, Entamoeba dispar
EFDIPKLLKCKKCGGLLTQACFMRCC

SEQ ID NO: 2521967 - protein, 25 aa, Entamoeba dispar
EFDLSRYIPFIKEIVLRMANNDVPD

SEQ ID NO: 2521968 - protein, 25 aa, Entamoeba dispar
EFDRGYLELIPILLGLSNEDQINLL

SEQ ID NO: 2521969 - protein, 26 aa, Entamoeba dispar
EFDRINVIIIIHSFTKMLLDKLKEIK

SEQ ID NO: 2521970 - protein, 26 aa, Entamoeba dispar
EFDRIRPLSYKDTDIFLLCFAVDNDR

SEQ ID NO: 2521971 - protein, 24 aa, Entamoeba dispar
EFDVQIYVYSIKFGDKRYLVNQRN

SEQ ID NO: 2521972 - protein, 26 aa, Entamoeba dispar
EFDYDGIHYYFCEQFLMGCKAKLFGD

SEQ ID NO: 2521973 - protein, 25 aa, Entamoeba dispar
EFDYTIFIKNIMFIIEKLRSDELAR

SEQ ID NO: 2521974 - protein, 23 aa, Entamoeba dispar
EFEIQYRTLASDKSIVDFAVNFL

SEQ ID NO: 2521975 - protein, 28 aa, Entamoeba dispar
EFEKELSIGLLWFINNNDFITFKKSNLK

SEQ ID NO: 2521976 - protein, 20 aa, Entamoeba dispar
EFELFPESLGELLPDDLQEY

SEQ ID NO: 2521977 - protein, 20 aa, Entamoeba dispar
EFERTLKMSTYLIAFVNGEF

SEQ ID NO: 2521978 - protein, 21 aa, Entamoeba dispar
EFESIAKKLDYLQHLTKGYAS

SEQ ID NO: 2521979 - protein, 28 aa, Entamoeba dispar
EFESRIFDMILMTITIPRMLQIFQKNID

SEQ ID NO: 2521980 - protein, 17 aa, Entamoeba dispar
EFEVTEHFLFQPNTRKP

SEQ ID NO: 2521981 - protein, 28 aa, Entamoeba dispar
EFFDRDVGCIKTFFWKRFGFGTEEVITL

SEQ ID NO: 2521982 - protein, 17 aa, Entamoeba dispar
EFGAEGIGLCRTERMFN

SEQ ID NO: 2521983 - protein, 19 aa, Entamoeba dispar
EFHCLITLLLQIIQTPPVS

SEQ ID NO: 2521984 - protein, 19 aa, Entamoeba dispar
EFHFPENFKKTYNKDFFGV

SEQ ID NO: 2521985 - protein, 29 aa, Entamoeba dispar
EFHIKKLINFIQNLIQLTPIALQTDTLKE

SEQ ID NO: 2521986 - protein, 24 aa, Entamoeba dispar
EFHNLKLVYRRYVGLYFICGVDET

SEQ ID NO: 2521987 - protein, 24 aa, Entamoeba dispar
EFIDKNIYLLSIKKIIQKYGKDEK

SEQ ID NO: 2521988 - protein, 24 aa, Entamoeba dispar
EFIDNFIIYNPWKEFDLSNIIVMI

SEQ ID NO: 2521989 - protein, 18 aa, Entamoeba dispar
EFIFNYFNHLSEEELKEI

SEQ ID NO: 2521990 - protein, 18 aa, Entamoeba dispar
EFIILMTAIGKCMKNKVI

SEQ ID NO: 2521991 - protein, 17 aa, Entamoeba dispar
EFILIPKQMRNRIDQVF

SEQ ID NO: 2521992 - protein, 25 aa, Entamoeba dispar
EFINDELPTQKFEPAFYAASLSSQC

SEQ ID NO: 2521993 - protein, 23 aa, Entamoeba dispar
EFINSLPLYLFDKTVLEFDTKDR

SEQ ID NO: 2521994 - protein, 17 aa, Entamoeba dispar
EFIPEVIAFIQKIIDNG

SEQ ID NO: 2521995 - protein, 27 aa, Entamoeba dispar
EFIRNYPAVVSLLFELLDRLEKMQQSY

SEQ ID NO: 2521996 - protein, 31 aa, Entamoeba dispar
EFISGPIQLYCDALLLVLSGLHKCVIFYSFT

SEQ ID NO: 2521997 - protein, 22 aa, Entamoeba dispar
EFITTMLIASPQLRSLILDDTV

SEQ ID NO: 2521998 - protein, 20 aa, Entamoeba dispar
EFIVSHLIRRHPKSKAFMAL

SEQ ID NO: 2521999 - protein, 22 aa, Entamoeba dispar
EFKAMHGFVTMNFTPAQKVPNK

SEQ ID NO: 2522000 - protein, 18 aa, Entamoeba dispar
EFKGLLTDFYNACQTGIK

SEQ ID NO: 2522001 - protein, 29 aa, Entamoeba dispar
EFKKNAGKWLIPYCVYRALIKSVDTPLPP

SEQ ID NO: 2522002 - protein, 18 aa, Entamoeba dispar
EFKKSFFKLSKLLKKKEL

SEQ ID NO: 2522003 - protein, 31 aa, Entamoeba dispar
EFKPELQNGRFIPCILYGAKAQLPGMTGDEN

SEQ ID NO: 2522004 - protein, 23 aa, Entamoeba dispar
EFKRLTLLMTNLPNKRLRDVSLR

SEQ ID NO: 2522005 - protein, 23 aa, Entamoeba dispar
EFLAKLVVDLFGPKGAVDFMEAN

SEQ ID NO: 2522006 - protein, 21 aa, Entamoeba dispar
EFLDEIYIGIVSLPNVQQKKQ

SEQ ID NO: 2522007 - protein, 43 aa, Entamoeba dispar
EFLDNIESLIKKLYNVFPIPDFWEHVSIVWTKCFCYISEKKRE

SEQ ID NO: 2522008 - protein, 25 aa, Entamoeba dispar
EFLSLLINYPFYNLFDWNDDMNTPL

SEQ ID NO: 2522009 - protein, 17 aa, Entamoeba dispar
EFLSTYVIIMIDESNDI

SEQ ID NO: 2522010 - protein, 18 aa, Entamoeba dispar
EFMKEYEKYWINVEMDKV

SEQ ID NO: 2522011 - protein, 26 aa, Entamoeba dispar
EFNCSVRIILFKFINIMLNEYRDYIG

SEQ ID NO: 2522012 - protein, 19 aa, Entamoeba dispar
EFNEIYVKALLGTTTYKKL

SEQ ID NO: 2522013 - protein, 17 aa, Entamoeba dispar
EFNFITKAISKYSRGYH

SEQ ID NO: 2522014 - protein, 18 aa, Entamoeba dispar
EFNHLASLYFIDKKKEGY

SEQ ID NO: 2522015 - protein, 25 aa, Entamoeba dispar
EFNKNTWKLMPLQSLIINCIEELNG

SEQ ID NO: 2522016 - protein, 21 aa, Entamoeba dispar
EFNTMLFPCNKYNSMYSSDEC

SEQ ID NO: 2522017 - protein, 17 aa, Entamoeba dispar
EFNVFGWREIVDPNIIF

SEQ ID NO: 2522018 - protein, 28 aa, Entamoeba dispar
EFNVIRTNWYWKHQKRIIRFSKDKFYRF

SEQ ID NO: 2522019 - protein, 20 aa, Entamoeba dispar
EFPFTVKFKENPQNPILFIA

SEQ ID NO: 2522020 - protein, 19 aa, Entamoeba dispar
EFPIKYKGIYMTPEESRLN

SEQ ID NO: 2522021 - protein, 30 aa, Entamoeba dispar
EFPKKGPRLCFLMSDMLLITVIKKVNDIPV

SEQ ID NO: 2522022 - protein, 20 aa, Entamoeba dispar
EFPKLLPCMHMICRDCLFQV

SEQ ID NO: 2522023 - protein, 17 aa, Entamoeba dispar
EFPLSLPSLFIKMERNL

SEQ ID NO: 2522024 - protein, 17 aa, Entamoeba dispar
EFQPIAPMSWILEGKEP

SEQ ID NO: 2522025 - protein, 22 aa, Entamoeba dispar
EFRCELPFHLFNQNFKLIPKQL

SEQ ID NO: 2522026 - protein, 17 aa, Entamoeba dispar
EFRILYDTDQQPFLQEY

SEQ ID NO: 2522027 - protein, 18 aa, Entamoeba dispar
EFRKQMFDIIKQKLEDNA

SEQ ID NO: 2522028 - protein, 29 aa, Entamoeba dispar
EFRLYLTEGLPYFLLYKEVPKEILEKYID

SEQ ID NO: 2522029 - protein, 23 aa, Entamoeba dispar
EFRQKRICGQSTLYYGTVKDALE

SEQ ID NO: 2522030 - protein, 19 aa, Entamoeba dispar
EFSDPAPVFNMPRDPRRLQ

SEQ ID NO: 2522031 - protein, 32 aa, Entamoeba dispar
EFSDSFIKVVPLTNWFVYCKSSLITKVKQIIS

SEQ ID NO: 2522032 - protein, 26 aa, Entamoeba dispar
EFSGGWRMRISIAKAIYMHPDLLLLD

SEQ ID NO: 2522033 - protein, 25 aa, Entamoeba dispar
EFSHPEFALYYLFNKNTYCINMYSF

SEQ ID NO: 2522034 - protein, 24 aa, Entamoeba dispar
EFSLPITFTCWPAEAQNGLTLSMS

SEQ ID NO: 2522035 - protein, 21 aa, Entamoeba dispar
EFSNKMFYSFKLENGVDGEDR

SEQ ID NO: 2522036 - protein, 24 aa, Entamoeba dispar
EFSNYFFNILNKFGEMELRAFLVF

SEQ ID NO: 2522037 - protein, 18 aa, Entamoeba dispar
EFSSLTSYVVYSSGKIKK

SEQ ID NO: 2522038 - protein, 29 aa, Entamoeba dispar
EFSVVVLLLLEILIPFEWQHIIITHLPVS

SEQ ID NO: 2522039 - protein, 32 aa, Entamoeba dispar
EFSYNPVPITNLYPFYNITSLIRYSSTDPIIN

SEQ ID NO: 2522040 - protein, 30 aa, Entamoeba dispar
EFTDILRRAFMSRMFPPETIKKLGIKHVKG

SEQ ID NO: 2522041 - protein, 18 aa, Entamoeba dispar
EFTFWNGLQFNFACLSGA

SEQ ID NO: 2522042 - protein, 36 aa, Entamoeba dispar
EFTGLTNVMILLVGKRLNIFGWYNTKKIPSNGFIKN

SEQ ID NO: 2522043 - protein, 26 aa, Entamoeba dispar
EFTHSFYHRLEWLCGFSGFTGEIVIT

SEQ ID NO: 2522044 - protein, 19 aa, Entamoeba dispar
EFTLFFLDNYPINTLVHSK

SEQ ID NO: 2522045 - protein, 17 aa, Entamoeba dispar
EFTNPCFFLPPHAFDTM

SEQ ID NO: 2522046 - protein, 26 aa, Entamoeba dispar
EFTPTAYLGWTPFKNSTIVWEAHGNE

SEQ ID NO: 2522047 - protein, 24 aa, Entamoeba dispar
EFVDKVIFIYRFQKETLQRLDSKD

SEQ ID NO: 2522048 - protein, 34 aa, Entamoeba dispar
EFVEADLVIFAFPIYWYAMPGQLKLFIDRTVMMM

SEQ ID NO: 2522049 - protein, 27 aa, Entamoeba dispar
EFVHVNFFSYLLNLPYRNINIDNIIEF

SEQ ID NO: 2522050 - protein, 20 aa, Entamoeba dispar
EFVLPDIISFIREQLKIEKP

SEQ ID NO: 2522051 - protein, 23 aa, Entamoeba dispar
EFVLSGHRLPPTDKIPIAIIGII

SEQ ID NO: 2522052 - protein, 18 aa, Entamoeba dispar
EFVVQKKSILFPNTKYEL

SEQ ID NO: 2522053 - protein, 18 aa, Entamoeba dispar
EFYERRNYQLWKQQGKRV

SEQ ID NO: 2522054 - protein, 23 aa, Entamoeba dispar
EFYFCDLNLIQDTFLKGVIETSN

SEQ ID NO: 2522055 - protein, 17 aa, Entamoeba dispar
EFYIPGYWKAQATGYAS

SEQ ID NO: 2522056 - protein, 18 aa, Entamoeba dispar
EFYIPPSAKLVEVSHCDS

SEQ ID NO: 2522057 - protein, 30 aa, Entamoeba dispar
EFYKKYGGDYLLTLPTLVFLYGMNINQTIN

SEQ ID NO: 2522058 - protein, 19 aa, Entamoeba dispar
EFYKMKPWCRDKLKHSVYL

SEQ ID NO: 2522059 - protein, 19 aa, Entamoeba dispar
EFYPKLCEWVGLSNYEVLY

SEQ ID NO: 2522060 - protein, 17 aa, Entamoeba dispar
EFYYLVFKNSGILDYCS

SEQ ID NO: 2522061 - protein, 24 aa, Entamoeba dispar
EGADSFAPTWTKSGLRELRFLKMK

SEQ ID NO: 2522062 - protein, 17 aa, Entamoeba dispar
EGAFSHCISLTSINIPD

SEQ ID NO: 2522063 - protein, 34 aa, Entamoeba dispar
EGAMFNYFLTEHWAPLKNILRRYQIYLKEEITNV

SEQ ID NO: 2522064 - protein, 22 aa, Entamoeba dispar
EGATIQFFRSKISHYALKVLRG

SEQ ID NO: 2522065 - protein, 20 aa, Entamoeba dispar
EGCLSCLKKNKLFASFISAV

SEQ ID NO: 2522066 - protein, 20 aa, Entamoeba dispar
EGCPLLGKTTLPYSLTTLNV

SEQ ID NO: 2522067 - protein, 24 aa, Entamoeba dispar
EGCTKAFEYPSHLFKHCAAQHQKN

SEQ ID NO: 2522068 - protein, 18 aa, Entamoeba dispar
EGDDRYITVQSGKKIRIA

SEQ ID NO: 2522069 - protein, 23 aa, Entamoeba dispar
EGDDRYITVQSGKKIRIADEDST

SEQ ID NO: 2522070 - protein, 18 aa, Entamoeba dispar
EGDEQVLEQIFLSDVYTA

SEQ ID NO: 2522071 - protein, 24 aa, Entamoeba dispar
EGDKDLLWIQQRPGIKVICKGNHD

SEQ ID NO: 2522072 - protein, 19 aa, Entamoeba dispar
EGDWWIGELNGQTGQFPSN

SEQ ID NO: 2522073 - protein, 22 aa, Entamoeba dispar
EGEFPIKYKGIYMTPEESRLNF

SEQ ID NO: 2522074 - protein, 27 aa, Entamoeba dispar
EGEIIINYIMYLIMKIKIEIEKINQED

SEQ ID NO: 2522075 - protein, 20 aa, Entamoeba dispar
EGEILNCLVLANYVVQNSPC

SEQ ID NO: 2522076 - protein, 25 aa, Entamoeba dispar
EGELDYCRMLNGLLPIDIRCLGWCG

SEQ ID NO: 2522077 - protein, 24 aa, Entamoeba dispar
EGENKYQYFWTKYGIEGEAPKSIK

SEQ ID NO: 2522078 - protein, 23 aa, Entamoeba dispar
EGERYYSILPSNFKIISVAWNKD

SEQ ID NO: 2522079 - protein, 21 aa, Entamoeba dispar
EGEVLIIKQIVDGLLKNKVKE

SEQ ID NO: 2522080 - protein, 19 aa, Entamoeba dispar
EGFWEHVCIVWTKCYNYTS

SEQ ID NO: 2522081 - protein, 18 aa, Entamoeba dispar
EGFWTYDENYPFWNPYTN

SEQ ID NO: 2522082 - protein, 18 aa, Entamoeba dispar
EGGELFDYIISKGRLEIE

SEQ ID NO: 2522083 - protein, 27 aa, Entamoeba dispar
EGGKVSMLGFCKKYKFLEEKQKEEANE

SEQ ID NO: 2522084 - protein, 27 aa, Entamoeba dispar
EGGVFNLRMFFPDDFPSNPPKLVFKSE

SEQ ID NO: 2522085 - protein, 22 aa, Entamoeba dispar
EGHKALIFCQTRQMLNIIEQMM

SEQ ID NO: 2522086 - protein, 25 aa, Entamoeba dispar
EGHLFIKKKFGWVSNYFILKDGKLI

SEQ ID NO: 2522087 - protein, 22 aa, Entamoeba dispar
EGHLFNDRIIWFAVSKGSKIGK

SEQ ID NO: 2522088 - protein, 18 aa, Entamoeba dispar
EGHRFKGKIRPYVSVPNP

SEQ ID NO: 2522089 - protein, 22 aa, Entamoeba dispar
EGHRRMMELYASDPMKYQRDFS

SEQ ID NO: 2522090 - protein, 24 aa, Entamoeba dispar
EGIILAIHHPHLVKRLSLHHKGSY

SEQ ID NO: 2522091 - protein, 27 aa, Entamoeba dispar
EGILIVTLHHIIILDQSFNIIKEIHVF

SEQ ID NO: 2522092 - protein, 17 aa, Entamoeba dispar
EGILYNPTPTKTDSAGI

SEQ ID NO: 2522093 - protein, 26 aa, Entamoeba dispar
EGIMSQYFFTIFFNDLTIYGTREIES

SEQ ID NO: 2522094 - protein, 17 aa, Entamoeba dispar
EGITLIKRDIIFAASLY

SEQ ID NO: 2522095 - protein, 21 aa, Entamoeba dispar
EGKALLMKYLGGIDAVPICID

SEQ ID NO: 2522096 - protein, 19 aa, Entamoeba dispar
EGKFYTLVSYVPVASFKGL

SEQ ID NO: 2522097 - protein, 22 aa, Entamoeba dispar
EGKIKARWMRKNARRLDIENYT

SEQ ID NO: 2522098 - protein, 24 aa, Entamoeba dispar
EGKKELQIEINKINTQMKEIEENK

SEQ ID NO: 2522099 - protein, 28 aa, Entamoeba dispar
EGKLLFGERFLRVDPILPGQILLDNVEQ

SEQ ID NO: 2522100 - protein, 25 aa, Entamoeba dispar
EGKNLDQLIKKWKSISRDLLVDIQH

SEQ ID NO: 2522101 - protein, 25 aa, Entamoeba dispar
EGKQGWTISFLPLTSSVTNVTISGC

SEQ ID NO: 2522102 - protein, 26 aa, Entamoeba dispar
EGKSQLRFVLMPTGLFQFAANETLLN

SEQ ID NO: 2522103 - protein, 21 aa, Entamoeba dispar
EGKTILVFDIGGGTFDITLIR

SEQ ID NO: 2522104 - protein, 25 aa, Entamoeba dispar
EGKTIYNDIIRLPKTLYQEKKQYYC

SEQ ID NO: 2522105 - protein, 25 aa, Entamoeba dispar
EGKTIYNDIIRLPKTLYQEYESLCK

SEQ ID NO: 2522106 - protein, 17 aa, Entamoeba dispar
EGLDIFQFHLGSHLKHL

SEQ ID NO: 2522107 - protein, 19 aa, Entamoeba dispar
EGLGRFYDNLDLVHAYLSE

SEQ ID NO: 2522108 - protein, 36 aa, Entamoeba dispar
EGLIVEKLILLPMDRFRRFVPIIDAFIHNTPDCCVE

SEQ ID NO: 2522109 - protein, 24 aa, Entamoeba dispar
EGLKDLITIFKTKVINFIGLIQGL

SEQ ID NO: 2522110 - protein, 39 aa, Entamoeba dispar
EGLNWVFSYYYEGCQSWDWYYPYYYAPFAKDIGKLLDPE

SEQ ID NO: 2522111 - protein, 23 aa, Entamoeba dispar
EGLQFKTYPIVLYPQLSVNEQTK

SEQ ID NO: 2522112 - protein, 29 aa, Entamoeba dispar
EGLSKALRPLAWKIFLKVIKPQASEEWIE

SEQ ID NO: 2522113 - protein, 17 aa, Entamoeba dispar
EGLVRIFHKNILLMETN

SEQ ID NO: 2522114 - protein, 25 aa, Entamoeba dispar
EGMYSTIFPSRWKVGEALVLEFVSS

SEQ ID NO: 2522115 - protein, 26 aa, Entamoeba dispar
EGNAHMSYFIRTLIEMGYKAEGMKLM

SEQ ID NO: 2522116 - protein, 22 aa, Entamoeba dispar
EGNAIVFKTIDFGKCYYTGSVT

SEQ ID NO: 2522117 - protein, 22 aa, Entamoeba dispar
EGNIFLIFEYMPHDLQSLLYST

SEQ ID NO: 2522118 - protein, 21 aa, Entamoeba dispar
EGNIRIWKAFASESTKIKDKR

SEQ ID NO: 2522119 - protein, 18 aa, Entamoeba dispar
EGNKILSDALRYYKDYDI

SEQ ID NO: 2522120 - protein, 21 aa, Entamoeba dispar
EGNLLIHKMLRYNPNKRISCE

SEQ ID NO: 2522121 - protein, 22 aa, Entamoeba dispar
EGNNIILLCSFKDTLNNKNFII

SEQ ID NO: 2522122 - protein, 17 aa, Entamoeba dispar
EGPGRVQFLKKLNEKRI

SEQ ID NO: 2522123 - protein, 22 aa, Entamoeba dispar
EGQTLMVLPFKNMIVATETKMN

SEQ ID NO: 2522124 - protein, 19 aa, Entamoeba dispar
EGQYGIPKGIFFSMPVVCY

SEQ ID NO: 2522125 - protein, 28 aa, Entamoeba dispar
EGREEQTLSLLFSMLGHNFNANQLSHVS

SEQ ID NO: 2522126 - protein, 17 aa, Entamoeba dispar
EGRGVCLRFPRYIRTRD

SEQ ID NO: 2522127 - protein, 23 aa, Entamoeba dispar
EGRNLPIPQKPSSKTWSQIARST

SEQ ID NO: 2522128 - protein, 19 aa, Entamoeba dispar
EGRWKYLRILSNDGNFDTI

SEQ ID NO: 2522129 - protein, 31 aa, Entamoeba dispar
EGRYYYQLPRIIENILVYLYNKGCTTHGIFR

SEQ ID NO: 2522130 - protein, 24 aa, Entamoeba dispar
EGSGKYTRALLYLKNIYGDGVMKI

SEQ ID NO: 2522131 - protein, 43 aa, Entamoeba dispar
EGSLSFLQMFVHLFQFLNIKKNKFPSVVYVLLVSSVDLELNEE

SEQ ID NO: 2522132 - protein, 29 aa, Entamoeba dispar
EGSPPYRELGMFKGLFKTATVGAPGLRNP

SEQ ID NO: 2522133 - protein, 31 aa, Entamoeba dispar
EGSSYKSINFMSQFKNKSLIEIRTEDYKANN

SEQ ID NO: 2522134 - protein, 18 aa, Entamoeba dispar
EGSYPTCERIRPVDLAIS

SEQ ID NO: 2522135 - protein, 24 aa, Entamoeba dispar
EGTKAVIIVLNFNTEILSENIKRM

SEQ ID NO: 2522136 - protein, 18 aa, Entamoeba dispar
EGTLAKDLILDSTKPFIN

SEQ ID NO: 2522137 - protein, 24 aa, Entamoeba dispar
EGTRLEGTWLLIEKVELGSMFSIK

SEQ ID NO: 2522138 - protein, 20 aa, Entamoeba dispar
EGVDLVQFWNNTVKPLFISS

SEQ ID NO: 2522139 - protein, 30 aa, Entamoeba dispar
EGVEQVPKRWWKFAFDSLLIEVKKKNYKES

SEQ ID NO: 2522140 - protein, 19 aa, Entamoeba dispar
EGVFKEDQKEILRLAFAED

SEQ ID NO: 2522141 - protein, 17 aa, Entamoeba dispar
EGVGLILEILPQNNRLL

SEQ ID NO: 2522142 - protein, 21 aa, Entamoeba dispar
EGVLKLFNGIYELSLQNKKKK

SEQ ID NO: 2522143 - protein, 23 aa, Entamoeba dispar
EGVLQINLPKYIDYKEVYDPFDF

SEQ ID NO: 2522144 - protein, 24 aa, Entamoeba dispar
EGVNIKIIIYSSPIFMDIVKGEEK

SEQ ID NO: 2522145 - protein, 26 aa, Entamoeba dispar
EGVPPYIDDPPLRALFKISTKGIPPV

SEQ ID NO: 2522146 - protein, 18 aa, Entamoeba dispar
EGVQQFGIGHWKLILNNF

SEQ ID NO: 2522147 - protein, 28 aa, Entamoeba dispar
EGVRYLHMNFLLHRDLKPANILISEDDV

SEQ ID NO: 2522148 - protein, 27 aa, Entamoeba dispar
EGVSDLALHFLAKLKIMVVKDIERDDI

SEQ ID NO: 2522149 - protein, 30 aa, Entamoeba dispar
EGVSQQILSALFFHKIITPAIVTPSKFCSA

SEQ ID NO: 2522150 - protein, 40 aa, Entamoeba dispar
EGVSSFKVFMVYDFFVTDGLFYKILKKTKASGGLLGVHAE

SEQ ID NO: 2522151 - protein, 31 aa, Entamoeba dispar
EGYEYSNYFILFLLCINFLYRQNNYAFEFDE

SEQ ID NO: 2522152 - protein, 22 aa, Entamoeba dispar
EGYPFRIAAVFQSPKQLLSSAL

SEQ ID NO: 2522153 - protein, 33 aa, Entamoeba dispar
EGYQSKYYYYHFLSWPYLMYVAETINKKIVGYT

SEQ ID NO: 2522154 - protein, 32 aa, Entamoeba dispar
EGYSKFYHFENLFLPSFFKKFGMDYSISAFDA

SEQ ID NO: 2522155 - protein, 17 aa, Entamoeba dispar
EGYYLKGQTLKSQNCFP

SEQ ID NO: 2522156 - protein, 24 aa, Entamoeba dispar
EHAKFVEGLALFHKDWKKIKELIG

SEQ ID NO: 2522157 - protein, 20 aa, Entamoeba dispar
EHATFYIKEIFKRYYQGIIQ

SEQ ID NO: 2522158 - protein, 21 aa, Entamoeba dispar
EHDIIFWMGDLNYRIDEEDSI

SEQ ID NO: 2522159 - protein, 24 aa, Entamoeba dispar
EHDYITAASYFYEAFENYHSLSLK

SEQ ID NO: 2522160 - protein, 27 aa, Entamoeba dispar
EHEKEGHLLYLLLDLIGDKEQTVVFCA

SEQ ID NO: 2522161 - protein, 21 aa, Entamoeba dispar
EHELRRKVEIMVLEWAEKNCK

SEQ ID NO: 2522162 - protein, 33 aa, Entamoeba dispar
EHEYLRKIIYSSGNIFVICFSLIHPQTFSNIVQ

SEQ ID NO: 2522163 - protein, 18 aa, Entamoeba dispar
EHFAILCEILRAVTKKRS

SEQ ID NO: 2522164 - protein, 22 aa, Entamoeba dispar
EHFFPKLPKKIKINKEYTLAMI

SEQ ID NO: 2522165 - protein, 21 aa, Entamoeba dispar
EHFKKLIKYLPQFTSSVIVGG

SEQ ID NO: 2522166 - protein, 23 aa, Entamoeba dispar
EHFKQIFQFMKTYFHYHDTDVQQ

SEQ ID NO: 2522167 - protein, 19 aa, Entamoeba dispar
EHFSMKFKYGWYSSHIKNI

SEQ ID NO: 2522168 - protein, 23 aa, Entamoeba dispar
EHHIPFCVVVIDKKGIWNTFYGL

SEQ ID NO: 2522169 - protein, 25 aa, Entamoeba dispar
EHHRQLPIQKFQKLRVPINCRYYCD

SEQ ID NO: 2522170 - protein, 17 aa, Entamoeba dispar
EHICAHKDIYLALPNEP

SEQ ID NO: 2522171 - protein, 21 aa, Entamoeba dispar
EHIFLETYYQASGCSSKISEH

SEQ ID NO: 2522172 - protein, 18 aa, Entamoeba dispar
EHIIKKRKYLRHIRGCPN

SEQ ID NO: 2522173 - protein, 18 aa, Entamoeba dispar
EHILIIEASLQRNKDQKK

SEQ ID NO: 2522174 - protein, 22 aa, Entamoeba dispar
EHIPIKLGPFDIACFQFSLYKP

SEQ ID NO: 2522175 - protein, 30 aa, Entamoeba dispar
EHIQNQLMRIIMIVRPRNLLYIAIDGVCPI

SEQ ID NO: 2522176 - protein, 17 aa, Entamoeba dispar
EHKAGVYSVTWGNDSKR

SEQ ID NO: 2522177 - protein, 23 aa, Entamoeba dispar
EHKDDIVALLIGPVADDLVDDDN

SEQ ID NO: 2522178 - protein, 27 aa, Entamoeba dispar
EHKGKGFFPKLLNFICNPNGVIVMVFE

SEQ ID NO: 2522179 - protein, 18 aa, Entamoeba dispar
EHLKRLFEITRYTIGIYG

SEQ ID NO: 2522180 - protein, 17 aa, Entamoeba dispar
EHLLSYRSMPNCVVIRP

SEQ ID NO: 2522181 - protein, 41 aa, Entamoeba dispar
EHLQRFDLLSLLITPIQRLPRYRLLLKDLLKHLRPSDIDYE

SEQ ID NO: 2522182 - protein, 25 aa, Entamoeba dispar
EHNFNRITYHLSPFGEFYTHEQQRN

SEQ ID NO: 2522183 - protein, 20 aa, Entamoeba dispar
EHPIKVCKILKDAGINDIEI

SEQ ID NO: 2522184 - protein, 24 aa, Entamoeba dispar
EHPKGMFVLPFETPKSIFQMTSER

SEQ ID NO: 2522185 - protein, 19 aa, Entamoeba dispar
EHQIQLIDLPYFSPSSYWD

SEQ ID NO: 2522186 - protein, 23 aa, Entamoeba dispar
EHRELFLYVCSKIHILRKNHLEQ

SEQ ID NO: 2522187 - protein, 18 aa, Entamoeba dispar
EHRERKASFLTRPKKGVN

SEQ ID NO: 2522188 - protein, 27 aa, Entamoeba dispar
EHRIIKKYVVLYELDLGLNHVIRKVAE

SEQ ID NO: 2522189 - protein, 19 aa, Entamoeba dispar
EHRILPFNSYYDIINSLLI

SEQ ID NO: 2522190 - protein, 25 aa, Entamoeba dispar
EHSEEFVPIMFWTIIQKIPKGTIND

SEQ ID NO: 2522191 - protein, 21 aa, Entamoeba dispar
EHSHTIPPLLSIKEKQNGVEE

SEQ ID NO: 2522192 - protein, 24 aa, Entamoeba dispar
EHSLQLYKMQLPQSLNKSGLIMCI

SEQ ID NO: 2522193 - protein, 22 aa, Entamoeba dispar
EHSYYGFVCLLQISTRSSDYII

SEQ ID NO: 2522194 - protein, 32 aa, Entamoeba dispar
EHTKFIKAITWLGCTSTRRLPVKLISKFVGTR

SEQ ID NO: 2522195 - protein, 24 aa, Entamoeba dispar
EHTLGKYLILIATLDQTMIQYLPS

SEQ ID NO: 2522196 - protein, 33 aa, Entamoeba dispar
EHWEKRKEVFYSSFLSLFLNDSLEELCFNLYNF

SEQ ID NO: 2522197 - protein, 23 aa, Entamoeba dispar
EHWGIIWASLRMLLEMTPGTLGN

SEQ ID NO: 2522198 - protein, 25 aa, Entamoeba dispar
EHYVPVKDFLLSNPNFKYLISCQEK

SEQ ID NO: 2522199 - protein, 23 aa, Entamoeba dispar
EHYYQTLKSWTGLEKYKIIFNEK

SEQ ID NO: 2522200 - protein, 22 aa, Entamoeba dispar
EIAITRKIQFYLVGNKIDLSSQ

SEQ ID NO: 2522201 - protein, 23 aa, Entamoeba dispar
EIAKSIKIVFKPAEAYISVKLDF

SEQ ID NO: 2522202 - protein, 25 aa, Entamoeba dispar
EIANKIKQFPFQGKTRRYFVGYCIL

SEQ ID NO: 2522203 - protein, 17 aa, Entamoeba dispar
EIAPFQMKKYVISERSK

SEQ ID NO: 2522204 - protein, 26 aa, Entamoeba dispar
EIAQEIYIRWKVRKLLREQSYDVERA

SEQ ID NO: 2522205 - protein, 21 aa, Entamoeba dispar
EIAQKRVPLMTIKQVEEKEKE

SEQ ID NO: 2522206 - protein, 26 aa, Entamoeba dispar
EIAQLREKVLFLNDEKEKLYAENSTL

SEQ ID NO: 2522207 - protein, 18 aa, Entamoeba dispar
EIARVCYKAPWPVTAREF

SEQ ID NO: 2522208 - protein, 18 aa, Entamoeba dispar
EIAYFSQFLLSDLGYIPL

SEQ ID NO: 2522209 - protein, 19 aa, Entamoeba dispar
EIDDIFNIETPTKPSDNEK

SEQ ID NO: 2522210 - protein, 23 aa, Entamoeba dispar
EIDDIHHPLFQTKIKTTQDIIHN

SEQ ID NO: 2522211 - protein, 23 aa, Entamoeba dispar
EIDELYSLPTLYSDFLIFMNKEN

SEQ ID NO: 2522212 - protein, 23 aa, Entamoeba dispar
EIDFDHFPLLYKACLDFDGVSFD

SEQ ID NO: 2522213 - protein, 29 aa, Entamoeba dispar
EIDGNMKAIFYFFVVNGKVLELMEWVAIK

SEQ ID NO: 2522214 - protein, 26 aa, Entamoeba dispar
EIDIKPKRIIFKLIEEYIKVPLKEAE

SEQ ID NO: 2522215 - protein, 28 aa, Entamoeba dispar
EIDIKPKRIIFKLIKEYIKVPLKEAEEI

SEQ ID NO: 2522216 - protein, 25 aa, Entamoeba dispar
EIDIKPKRIIFKSIEEYIKVSLKEA

SEQ ID NO: 2522217 - protein, 32 aa, Entamoeba dispar
EIDIRQFARLIAILNRGFGKDIKSVFTAVFRL

SEQ ID NO: 2522218 - protein, 31 aa, Entamoeba dispar
EIDKCNQMKLSLYLNLALCYLKVDKLNKALD

SEQ ID NO: 2522219 - protein, 24 aa, Entamoeba dispar
EIDKLLIQITTYKNPFNVIGVLPE

SEQ ID NO: 2522220 - protein, 19 aa, Entamoeba dispar
EIDKPWYLKFNNAAIYDDD

SEQ ID NO: 2522221 - protein, 24 aa, Entamoeba dispar
EIDPNIIITPLFSNFKVYCSESNY

SEQ ID NO: 2522222 - protein, 28 aa, Entamoeba dispar
EIDSKPKRIIFKLIKEYIKVPLKEAEEI

SEQ ID NO: 2522223 - protein, 26 aa, Entamoeba dispar
EIDTDYYFLLYCSNIDIQFKRLLNRN

SEQ ID NO: 2522224 - protein, 25 aa, Entamoeba dispar
EIEEKLPTLPPPRRKTNYFKENTGE

SEQ ID NO: 2522225 - protein, 21 aa, Entamoeba dispar
EIEFNFLNIPAIVFAKQVTLI

SEQ ID NO: 2522226 - protein, 20 aa, Entamoeba dispar
EIEFWGFIGGVKIFNEKNKR

SEQ ID NO: 2522227 - protein, 25 aa, Entamoeba dispar
EIEGGIPFLALSDLTGMPVKRISTR

SEQ ID NO: 2522228 - protein, 27 aa, Entamoeba dispar
EIEIDAIFEKLLLLRKKRYAATMILDG

SEQ ID NO: 2522229 - protein, 26 aa, Entamoeba dispar
EIEINGQIFTVPITVGLSDGAEFNYK

SEQ ID NO: 2522230 - protein, 27 aa, Entamoeba dispar
EIEKEGIFFTPRYYGKFKAADALSKIS

SEQ ID NO: 2522231 - protein, 25 aa, Entamoeba dispar
EIEKKCIFSFNLMLSIKSADIQKWC

SEQ ID NO: 2522232 - protein, 37 aa, Entamoeba dispar
EIEKLEYFGTVRLIGKLYIQGAVVCRLPLICCNELLQ

SEQ ID NO: 2522233 - protein, 17 aa, Entamoeba dispar
EIELAVKIFKTSILIFK

SEQ ID NO: 2522234 - protein, 17 aa, Entamoeba dispar
EIELQGIFITFQSLRSS

SEQ ID NO: 2522235 - protein, 28 aa, Entamoeba dispar
EIEQTIMNLIFFWYVNYNEDFHTPYCDT

SEQ ID NO: 2522236 - protein, 27 aa, Entamoeba dispar
EIERGWIWNSYIKRWYEMNEKYLMIFN

SEQ ID NO: 2522237 - protein, 25 aa, Entamoeba dispar
EIERIEIETIFKNELAPVPQIFLIA

SEQ ID NO: 2522238 - protein, 17 aa, Entamoeba dispar
EIESWKDLVDGIIVCWI

SEQ ID NO: 2522239 - protein, 27 aa, Entamoeba dispar
EIETLKNFIPHEDEIIISTKEITNLKN

SEQ ID NO: 2522240 - protein, 18 aa, Entamoeba dispar
EIFDKEKNGYISASELKH

SEQ ID NO: 2522241 - protein, 19 aa, Entamoeba dispar
EIFDPAYFIVVIDSLKTIS

SEQ ID NO: 2522242 - protein, 17 aa, Entamoeba dispar
EIFHVNEADANLALLPR

SEQ ID NO: 2522243 - protein, 18 aa, Entamoeba dispar
EIFILKYIIGKIPENDLL

SEQ ID NO: 2522244 - protein, 29 aa, Entamoeba dispar
EIFKDGKIFKKVIWYLVDYSTYLKEKEQG

SEQ ID NO: 2522245 - protein, 18 aa, Entamoeba dispar
EIFLLSTSIPRLVKSFTD

SEQ ID NO: 2522246 - protein, 17 aa, Entamoeba dispar
EIFMKNGQLNEEFISCV

SEQ ID NO: 2522247 - protein, 19 aa, Entamoeba dispar
EIFMKYNTFLLRGDSLFDA

SEQ ID NO: 2522248 - protein, 18 aa, Entamoeba dispar
EIFPLIREGHSITLLCTE

SEQ ID NO: 2522249 - protein, 21 aa, Entamoeba dispar
EIFRIINTIVTQIIIPPLTCS

SEQ ID NO: 2522250 - protein, 21 aa, Entamoeba dispar
EIFYTSLVVIVYYLSPNSKEM

SEQ ID NO: 2522251 - protein, 28 aa, Entamoeba dispar
EIGMLFIDNFTLARFPLPYDSKQSTRYS

SEQ ID NO: 2522252 - protein, 23 aa, Entamoeba dispar
EIGNKWTIIASYLKGRSPNDVKN

SEQ ID NO: 2522253 - protein, 25 aa, Entamoeba dispar
EIGNSCFLRCLSLTRINIPSTISKI

SEQ ID NO: 2522254 - protein, 17 aa, Entamoeba dispar
EIGRFILPLTFIITNQY

SEQ ID NO: 2522255 - protein, 21 aa, Entamoeba dispar
EIGVIINKWDIFEQKRRVIIN

SEQ ID NO: 2522256 - protein, 26 aa, Entamoeba dispar
EIHITQPIIIVGLPRSGSTTLFNIMC

SEQ ID NO: 2522257 - protein, 19 aa, Entamoeba dispar
EIHRELKMKIAIKPEDFNK

SEQ ID NO: 2522258 - protein, 23 aa, Entamoeba dispar
EIIEKFEIPKYLGKIILRITGIA

SEQ ID NO: 2522259 - protein, 21 aa, Entamoeba dispar
EIIHLLIKKHLTFSSAESCSA

SEQ ID NO: 2522260 - protein, 19 aa, Entamoeba dispar
EIIIKKYPYDQFIQTALCA

SEQ ID NO: 2522261 - protein, 28 aa, Entamoeba dispar
EIIISQLKLIPLQSIPFYPLSSPISTVG

SEQ ID NO: 2522262 - protein, 24 aa, Entamoeba dispar
EIIKEIILFIKFVCQKHNIIKEEK

SEQ ID NO: 2522263 - protein, 17 aa, Entamoeba dispar
EIILGLPYSCAIDMWSF

SEQ ID NO: 2522264 - protein, 18 aa, Entamoeba dispar
EIINFFILAIQTAAIDLI

SEQ ID NO: 2522265 - protein, 18 aa, Entamoeba dispar
EIIPLIHGQGYKGVIWTH

SEQ ID NO: 2522266 - protein, 28 aa, Entamoeba dispar
EIIPSSDFFPLFWQIASQFINNPLPGVS

SEQ ID NO: 2522267 - protein, 26 aa, Entamoeba dispar
EIIQGISITIYPPQKIYFIVHEQYKK

SEQ ID NO: 2522268 - protein, 25 aa, Entamoeba dispar
EIIRQIVFRILKIPLIEERTGTYVG

SEQ ID NO: 2522269 - protein, 21 aa, Entamoeba dispar
EIISFSPYEYSFPISLKSLII

SEQ ID NO: 2522270 - protein, 27 aa, Entamoeba dispar
EIISGTKFILYCWSRPDLRGYLNSQGV

SEQ ID NO: 2522271 - protein, 18 aa, Entamoeba dispar
EIISLHFFNSFNYLPIAC

SEQ ID NO: 2522272 - protein, 25 aa, Entamoeba dispar
EIKDIKYILLKIIRKITKKVINRKE

SEQ ID NO: 2522273 - protein, 33 aa, Entamoeba dispar
EIKDYPKFLIPTYFTAFIKKIYNFIVQGTFEGQ

SEQ ID NO: 2522274 - protein, 17 aa, Entamoeba dispar
EIKEAKQQLEEEKIKSI

SEQ ID NO: 2522275 - protein, 24 aa, Entamoeba dispar
EIKELFKSIPIAPLLVSNKKEKIN

SEQ ID NO: 2522276 - protein, 30 aa, Entamoeba dispar
EIKEYLADKLVPFSIPTYIFQLQDMPRTSF

SEQ ID NO: 2522277 - protein, 24 aa, Entamoeba dispar
EIKGVQYRAIITKAVPTANVVKCI

SEQ ID NO: 2522278 - protein, 25 aa, Entamoeba dispar
EIKGYNTCYLIYSTLTTISIKHPDV

SEQ ID NO: 2522279 - protein, 25 aa, Entamoeba dispar
EIKHPERLAAKTVQFLIVTELFYEG

SEQ ID NO: 2522280 - protein, 18 aa, Entamoeba dispar
EIKIMKMQSRKNVLKPKG

SEQ ID NO: 2522281 - protein, 24 aa, Entamoeba dispar
EIKKLKEEIGILKSLKSSDNNNEE

SEQ ID NO: 2522282 - protein, 17 aa, Entamoeba dispar
EIKKMYAECYLLCDQRK

SEQ ID NO: 2522283 - protein, 26 aa, Entamoeba dispar
EIKKNEPIICLGLGKPIEQQLFSNNG

SEQ ID NO: 2522284 - protein, 23 aa, Entamoeba dispar
EIKKPIYIVALPRSGSTFTHTML

SEQ ID NO: 2522285 - protein, 26 aa, Entamoeba dispar
EIKKQLLLIHSNMALCWLKLENWNET

SEQ ID NO: 2522286 - protein, 17 aa, Entamoeba dispar
EIKKWNAVALWSWDLQV

SEQ ID NO: 2522287 - protein, 28 aa, Entamoeba dispar
EIKNEDILFTVWWVLQSIVQNNPIGQRA

SEQ ID NO: 2522288 - protein, 18 aa, Entamoeba dispar
EIKNRILYKIIKLNNIKT

SEQ ID NO: 2522289 - protein, 26 aa, Entamoeba dispar
EIKNTFLHWMIKVLRIVLIIGEKYKS

SEQ ID NO: 2522290 - protein, 19 aa, Entamoeba dispar
EIKPIITPKQMEIKPIITP

SEQ ID NO: 2522291 - protein, 30 aa, Entamoeba dispar
EIKPNFPELFLPYTLPKSSAALFTFCEFSH

SEQ ID NO: 2522292 - protein, 27 aa, Entamoeba dispar
EIKQIVQVFPLILPLFTELNCTDKMIL

SEQ ID NO: 2522293 - protein, 18 aa, Entamoeba dispar
EIKQVLPSLLQLLLPHTV

SEQ ID NO: 2522294 - protein, 25 aa, Entamoeba dispar
EIKRVYPFASIIVLGNKLDLAYEYG

SEQ ID NO: 2522295 - protein, 17 aa, Entamoeba dispar
EIKTICHKERIVMSKEI

SEQ ID NO: 2522296 - protein, 19 aa, Entamoeba dispar
EIKVDNLFEDIGIQSNSQP

SEQ ID NO: 2522297 - protein, 19 aa, Entamoeba dispar
EILDHFNIPIDNPCILLMQ

SEQ ID NO: 2522298 - protein, 20 aa, Entamoeba dispar
EILESILSFVINQATWRDST

SEQ ID NO: 2522299 - protein, 23 aa, Entamoeba dispar
EILHFLAEIASGLWYLHFCKHII

SEQ ID NO: 2522300 - protein, 20 aa, Entamoeba dispar
EILHLLLDFLTEFGYFFEVN

SEQ ID NO: 2522301 - protein, 18 aa, Entamoeba dispar
EILIIGDRIYKIISELMN

SEQ ID NO: 2522302 - protein, 29 aa, Entamoeba dispar
EILIKEMAIIVIKLSYYIKTFLIDCKSIK

SEQ ID NO: 2522303 - protein, 18 aa, Entamoeba dispar
EILIQYYPEHIKINGFSK

SEQ ID NO: 2522304 - protein, 23 aa, Entamoeba dispar
EILKDQWLKGIKDYRPKSTVFEI

SEQ ID NO: 2522305 - protein, 18 aa, Entamoeba dispar
EILKPLPSLIGLTGMITL

SEQ ID NO: 2522306 - protein, 17 aa, Entamoeba dispar
EILKQLTVLPVESPVLL

SEQ ID NO: 2522307 - protein, 17 aa, Entamoeba dispar
EILKWFDDVDESFKQIG

SEQ ID NO: 2522308 - protein, 18 aa, Entamoeba dispar
EILLKCDELYFNEKLDSI

SEQ ID NO: 2522309 - protein, 24 aa, Entamoeba dispar
EILLKNYAILPQVVSFITGFSSTT

SEQ ID NO: 2522310 - protein, 20 aa, Entamoeba dispar
EILMDIPKSIRVYSTRVFIP

SEQ ID NO: 2522311 - protein, 20 aa, Entamoeba dispar
EILNVKFASIKPLYKKDDKA

SEQ ID NO: 2522312 - protein, 33 aa, Entamoeba dispar
EILQPGQWLDDSKLFLFSYTPGQNKPLFYSNIM

SEQ ID NO: 2522313 - protein, 26 aa, Entamoeba dispar
EILQRIRLLFVDLISTTLQSINTFYF

SEQ ID NO: 2522314 - protein, 25 aa, Entamoeba dispar
EILSFTIYELLNFDPEIVFKKFFDE

SEQ ID NO: 2522315 - protein, 24 aa, Entamoeba dispar
EILSPYKYAGYSLLIPALQDTQLR

SEQ ID NO: 2522316 - protein, 19 aa, Entamoeba dispar
EILWRWYVKKGMYEEAIKC

SEQ ID NO: 2522317 - protein, 25 aa, Entamoeba dispar
EILYQKYHWDIFASKSLLCIGPEEK

SEQ ID NO: 2522318 - protein, 26 aa, Entamoeba dispar
EIMERVLFLWALRHPASGYVQGINDL

SEQ ID NO: 2522319 - protein, 28 aa, Entamoeba dispar
EIMKYYPDNLIQNFFSPLAQKLKLCEQL

SEQ ID NO: 2522320 - protein, 26 aa, Entamoeba dispar
EIMMYYFHHGRMNSLFTWAFEKELCN

SEQ ID NO: 2522321 - protein, 25 aa, Entamoeba dispar
EIMNEGLEWLVKKDLAWKEDLVYCE

SEQ ID NO: 2522322 - protein, 22 aa, Entamoeba dispar
EINDFEILINQIINRLEQGKSR

SEQ ID NO: 2522323 - protein, 24 aa, Entamoeba dispar
EINEGMFQVLINQGEKLPTHEITK

SEQ ID NO: 2522324 - protein, 21 aa, Entamoeba dispar
EINERFKRNFLSDPKKKALPN

SEQ ID NO: 2522325 - protein, 27 aa, Entamoeba dispar
EINFAMFLTAIQRWLHLTMKSPILISL

SEQ ID NO: 2522326 - protein, 24 aa, Entamoeba dispar
EINGKNYLYLFYNNDRLDSSIHFE

SEQ ID NO: 2522327 - protein, 22 aa, Entamoeba dispar
EINGMKYIMCLCDRPTLVSIYK

SEQ ID NO: 2522328 - protein, 20 aa, Entamoeba dispar
EINGQIFTVPITVGLSDGAE

SEQ ID NO: 2522329 - protein, 30 aa, Entamoeba dispar
EINIDKLITNFFYFYVPNGSNLMNKETLEK

SEQ ID NO: 2522330 - protein, 26 aa, Entamoeba dispar
EINIKPIFVHEPTAAALYYLDTTKDK

SEQ ID NO: 2522331 - protein, 27 aa, Entamoeba dispar
EINIQKYIILCVLLRSIHPIYIEMTNE

SEQ ID NO: 2522332 - protein, 20 aa, Entamoeba dispar
EINKRCIGIIYLAIGYNENK

SEQ ID NO: 2522333 - protein, 19 aa, Entamoeba dispar
EINLKKFDFLRSLSFDKCK

SEQ ID NO: 2522334 - protein, 27 aa, Entamoeba dispar
EINLLISQMPFSFPSILGLKDIIVNDI

SEQ ID NO: 2522335 - protein, 24 aa, Entamoeba dispar
EINLWLNNQLKYYNSIKLQRGDKC

SEQ ID NO: 2522336 - protein, 23 aa, Entamoeba dispar
EINPLIIEILINQFKNIKLQEKL

SEQ ID NO: 2522337 - protein, 21 aa, Entamoeba dispar
EINQIHQIDWYFSSSYSNKNI

SEQ ID NO: 2522338 - protein, 23 aa, Entamoeba dispar
EINQLLPLFIDKFFNQFNEGTIL

SEQ ID NO: 2522339 - protein, 25 aa, Entamoeba dispar
EINSFRRIIIIYATKSLSLLNLMSR

SEQ ID NO: 2522340 - protein, 31 aa, Entamoeba dispar
EINSIDQIYRNLICKILIRNVGKSELPNEYT

SEQ ID NO: 2522341 - protein, 18 aa, Entamoeba dispar
EINSNEEINIGLQALIEV

SEQ ID NO: 2522342 - protein, 26 aa, Entamoeba dispar
EINSSYIKVFYIPYGILDNSDPINSL

SEQ ID NO: 2522343 - protein, 34 aa, Entamoeba dispar
EINTLSPQYFLFNILIQILLMIVGREQNIISQAL

SEQ ID NO: 2522344 - protein, 23 aa, Entamoeba dispar
EINTPLQIETFLPILSDETFKSG

SEQ ID NO: 2522345 - protein, 18 aa, Entamoeba dispar
EINVIPFSQPLTETTTID

SEQ ID NO: 2522346 - protein, 22 aa, Entamoeba dispar
EINYCILFDSHLLLSRIKGSKI

SEQ ID NO: 2522347 - protein, 39 aa, Entamoeba dispar
EIPCDVVASVFKKFLRNLPIHIFDRITTKKIFQRWIEII

SEQ ID NO: 2522348 - protein, 28 aa, Entamoeba dispar
EIPDGHCELLYFGFLKPVDVEKFKVHDD

SEQ ID NO: 2522349 - protein, 26 aa, Entamoeba dispar
EIPERGLLFDILWSDPFIPQTKNTDN

SEQ ID NO: 2522350 - protein, 25 aa, Entamoeba dispar
EIPIQPCLTFVLRKYNSFIEREMRR

SEQ ID NO: 2522351 - protein, 25 aa, Entamoeba dispar
EIPKGFMKYCGQIQRIELPQSITKI

SEQ ID NO: 2522352 - protein, 23 aa, Entamoeba dispar
EIPKKWMELIQKCKKTEKQIRVT

SEQ ID NO: 2522353 - protein, 21 aa, Entamoeba dispar
EIPLHSFLNQFRMLSRRDCEL

SEQ ID NO: 2522354 - protein, 21 aa, Entamoeba dispar
EIPNKIRIKFMLDGAKGISYL

SEQ ID NO: 2522355 - protein, 25 aa, Entamoeba dispar
EIPQQTWIQPITSSQYRDAFDSFDF

SEQ ID NO: 2522356 - protein, 18 aa, Entamoeba dispar
EIPSPKIPGKYFIKYMRN

SEQ ID NO: 2522357 - protein, 18 aa, Entamoeba dispar
EIPYLAIHFNVGPIYLFN

SEQ ID NO: 2522358 - protein, 26 aa, Entamoeba dispar
EIPYRSLYNCFYLQSILLPQELIFIG

SEQ ID NO: 2522359 - protein, 24 aa, Entamoeba dispar
EIQDKIHPPPVQEKKMFARPKPKF

SEQ ID NO: 2522360 - protein, 17 aa, Entamoeba dispar
EIQENISTFPNLEELQL

SEQ ID NO: 2522361 - protein, 17 aa, Entamoeba dispar
EIQIDIIVSQMFCTLNK

SEQ ID NO: 2522362 - protein, 17 aa, Entamoeba dispar
EIQKRFFDLTKNVITEE

SEQ ID NO: 2522363 - protein, 25 aa, Entamoeba dispar
EIQNKSILLILDKQLHCLPWESMPN

SEQ ID NO: 2522364 - protein, 27 aa, Entamoeba dispar
EIQRQCIDKLRMYTTALESEMSEIPSS

SEQ ID NO: 2522365 - protein, 23 aa, Entamoeba dispar
EIQRTMLELLNQLDGFDTRGEVK

SEQ ID NO: 2522366 - protein, 22 aa, Entamoeba dispar
EIQRTMLELLNQLDGFSKTDDV

SEQ ID NO: 2522367 - protein, 19 aa, Entamoeba dispar
EIQSRWFNGFRALITVNLP

SEQ ID NO: 2522368 - protein, 17 aa, Entamoeba dispar
EIQYLRRNKRITYTGEV

SEQ ID NO: 2522369 - protein, 24 aa, Entamoeba dispar
EIRELYELLFSLLTRNDVDFIQRI

SEQ ID NO: 2522370 - protein, 21 aa, Entamoeba dispar
EIREWYRVYKVAEGKKLNKYA

SEQ ID NO: 2522371 - protein, 23 aa, Entamoeba dispar
EIRGYLIGVVLKLVEMRKYDSLI

SEQ ID NO: 2522372 - protein, 17 aa, Entamoeba dispar
EIRHDGKISRRTVSGPK

SEQ ID NO: 2522373 - protein, 24 aa, Entamoeba dispar
EIRKKYALIVPRRPAWTPDMTAEE

SEQ ID NO: 2522374 - protein, 25 aa, Entamoeba dispar
EIRKNPDLLIWAVYNLVRSVDYLHT

SEQ ID NO: 2522375 - protein, 20 aa, Entamoeba dispar
EIRLIGYTYMKVDPSLFNGS

SEQ ID NO: 2522376 - protein, 19 aa, Entamoeba dispar
EIRQFLGRFGLKGDTPKQQ

SEQ ID NO: 2522377 - protein, 24 aa, Entamoeba dispar
EIRVRLYEIAAPFLIHRVNSNVQV

SEQ ID NO: 2522378 - protein, 26 aa, Entamoeba dispar
EISALRGLFFIRLLGNYFVTNLESKS

SEQ ID NO: 2522379 - protein, 23 aa, Entamoeba dispar
EISEPFLFLGIGMKDGYCYGYKI

SEQ ID NO: 2522380 - protein, 17 aa, Entamoeba dispar
EISFIRRSPYRDISPQP

SEQ ID NO: 2522381 - protein, 23 aa, Entamoeba dispar
EISGMILKYLSFMAKSKLKNTQI

SEQ ID NO: 2522382 - protein, 23 aa, Entamoeba dispar
EISGMILKYLYEIAQEKLGNHPI

SEQ ID NO: 2522383 - protein, 18 aa, Entamoeba dispar
EISGMILKYLYETAQEKL

SEQ ID NO: 2522384 - protein, 23 aa, Entamoeba dispar
EISGMILRYLYENAQAKLGNHPI

SEQ ID NO: 2522385 - protein, 18 aa, Entamoeba dispar
EISKKEIFWGEYLEILNK

SEQ ID NO: 2522386 - protein, 24 aa, Entamoeba dispar
EISKKYQKYPRLYYTWIDKVVQTQ

SEQ ID NO: 2522387 - protein, 24 aa, Entamoeba dispar
EISKRLSYLLRHGAIKERIPITKD

SEQ ID NO: 2522388 - protein, 25 aa, Entamoeba dispar
EISNKKWCIVGLGSIGKNVAKIGKG

SEQ ID NO: 2522389 - protein, 24 aa, Entamoeba dispar
EISPKKFLIINITPEFIISMNNLF

SEQ ID NO: 2522390 - protein, 23 aa, Entamoeba dispar
EISRYTQQIIKKLKARYVFSDTN

SEQ ID NO: 2522391 - protein, 17 aa, Entamoeba dispar
EISSEAATMIQNLKIII

SEQ ID NO: 2522392 - protein, 24 aa, Entamoeba dispar
EISYKLFFHQLYNILNYGHEIIVC

SEQ ID NO: 2522393 - protein, 25 aa, Entamoeba dispar
EISYKLFFHQLYNILNYGHEIIVCD

SEQ ID NO: 2522394 - protein, 25 aa, Entamoeba dispar
EISYKLFFHQLYNILNYGPEIIVCD

SEQ ID NO: 2522395 - protein, 25 aa, Entamoeba dispar
EISYTFFISFFLIPDNEIYKKYLYF

SEQ ID NO: 2522396 - protein, 32 aa, Entamoeba dispar
EITEESLIILHILNYLLLWNKINNEINNSFGY

SEQ ID NO: 2522397 - protein, 37 aa, Entamoeba dispar
EITEEVHTIPLPPSNVPSFVPPPPPLSEDAYTTETKS

SEQ ID NO: 2522398 - protein, 19 aa, Entamoeba dispar
EITELNLELDKQKQLVTKL

SEQ ID NO: 2522399 - protein, 18 aa, Entamoeba dispar
EITELPIQIWTDTYKQHL

SEQ ID NO: 2522400 - protein, 25 aa, Entamoeba dispar
EITEVKFIQSIIPFKAIERKEREEI

SEQ ID NO: 2522401 - protein, 21 aa, Entamoeba dispar
EITIIQLIKKYSVPINLIIDL

SEQ ID NO: 2522402 - protein, 18 aa, Entamoeba dispar
EITILYPNFHGRVNYRIE

SEQ ID NO: 2522403 - protein, 28 aa, Entamoeba dispar
EITKHQRLILIFQCVIRRVYLRFETEEE

SEQ ID NO: 2522404 - protein, 23 aa, Entamoeba dispar
EITKKYFDWFWKEENQEIIEQIV

SEQ ID NO: 2522405 - protein, 24 aa, Entamoeba dispar
EITKQKLDCYFIMKGTVICEKKKD

SEQ ID NO: 2522406 - protein, 24 aa, Entamoeba dispar
EITNITLQWRISAVYSIKNKVICG

SEQ ID NO: 2522407 - protein, 22 aa, Entamoeba dispar
EITNYEYLIYLNFIAGRSYNDL

SEQ ID NO: 2522408 - protein, 23 aa, Entamoeba dispar
EITPLIEHGLSSDPIKFFKKLLE

SEQ ID NO: 2522409 - protein, 17 aa, Entamoeba dispar
EITPQCIAAWKKESLLS

SEQ ID NO: 2522410 - protein, 31 aa, Entamoeba dispar
EITRKLIMTLFPCIVSYPLSIKYHIMIIKRY

SEQ ID NO: 2522411 - protein, 37 aa, Entamoeba dispar
EITTSYEYFGFLPSILPFIQCVIPLINQSPACCLGYA

SEQ ID NO: 2522412 - protein, 19 aa, Entamoeba dispar
EITVIKPWKGGDMIGLVSG

SEQ ID NO: 2522413 - protein, 18 aa, Entamoeba dispar
EIVDNIIYNLLKYGSMTK

SEQ ID NO: 2522414 - protein, 24 aa, Entamoeba dispar
EIVETYSFLRWSISDGTTNYNEQI

SEQ ID NO: 2522415 - protein, 30 aa, Entamoeba dispar
EIVGIFIARIIDTINLWPESYRYLCYSLYS

SEQ ID NO: 2522416 - protein, 18 aa, Entamoeba dispar
EIVIYFFESFNPRHEFDR

SEQ ID NO: 2522417 - protein, 19 aa, Entamoeba dispar
EIVLDIILGIYSLTINTIN

SEQ ID NO: 2522418 - protein, 19 aa, Entamoeba dispar
EIVNILLRPCCFKFLHIPI

SEQ ID NO: 2522419 - protein, 31 aa, Entamoeba dispar
EIVQKLWDIVKFYLFRESDTNTRFVYFDKLK

SEQ ID NO: 2522420 - protein, 21 aa, Entamoeba dispar
EIVRLILKEYKILNADVYCDT

SEQ ID NO: 2522421 - protein, 19 aa, Entamoeba dispar
EIVVLIPSSWFSKWTMMLN

SEQ ID NO: 2522422 - protein, 20 aa, Entamoeba dispar
EIVVLLIHQWIENGGTGNVD

SEQ ID NO: 2522423 - protein, 22 aa, Entamoeba dispar
EIVYHIAPYLPFMETNDPQLDK

SEQ ID NO: 2522424 - protein, 18 aa, Entamoeba dispar
EIYALDRIVPIALGSPNI

SEQ ID NO: 2522425 - protein, 20 aa, Entamoeba dispar
EIYDDIVGVFWKRNLNEKED

SEQ ID NO: 2522426 - protein, 17 aa, Entamoeba dispar
EIYGGIAGLYDMGPLGC

SEQ ID NO: 2522427 - protein, 18 aa, Entamoeba dispar
EIYGWQSFVSKKEYDEVW

SEQ ID NO: 2522428 - protein, 20 aa, Entamoeba dispar
EIYKYPLIGTEWGYAFDIAL

SEQ ID NO: 2522429 - protein, 19 aa, Entamoeba dispar
EIYLRMSYINIAIANQYYD

SEQ ID NO: 2522430 - protein, 23 aa, Entamoeba dispar
EIYQYSFPILVDFPSDYPKLLPI

SEQ ID NO: 2522431 - protein, 25 aa, Entamoeba dispar
EIYVNIHYKFIFKQNQFISNLIFEF

SEQ ID NO: 2522432 - protein, 23 aa, Entamoeba dispar
EKAEEWFKLERSYITDCLMLKEQ

SEQ ID NO: 2522433 - protein, 40 aa, Entamoeba dispar
EKAEEWFRKVIFIDPSYGDAWIWIYKILYEQKGKIIDFEE

SEQ ID NO: 2522434 - protein, 27 aa, Entamoeba dispar
EKAHPQVFNVLLQLLDEGRLTDGRGRT

SEQ ID NO: 2522435 - protein, 23 aa, Entamoeba dispar
EKAKPLIDTAVDFIPGGNIIKKG

SEQ ID NO: 2522436 - protein, 27 aa, Entamoeba dispar
EKASRSYLFIYENGKLKNPIKTQTQSK

SEQ ID NO: 2522437 - protein, 24 aa, Entamoeba dispar
EKAYSTFDFAILEEIPLTKEYLNT

SEQ ID NO: 2522438 - protein, 29 aa, Entamoeba dispar
EKCKEFAYQWRLYPEMELFAHWSKDHLPI

SEQ ID NO: 2522439 - protein, 26 aa, Entamoeba dispar
EKCLDLIPEQLAIIEFMFLSRINPYD

SEQ ID NO: 2522440 - protein, 26 aa, Entamoeba dispar
EKCPNPLILFEDYLVPIAKYQSSLCH

SEQ ID NO: 2522441 - protein, 20 aa, Entamoeba dispar
EKDILYILAQSKSLWERRIA

SEQ ID NO: 2522442 - protein, 18 aa, Entamoeba dispar
EKDIVLEQQTGICSTFHP

SEQ ID NO: 2522443 - protein, 23 aa, Entamoeba dispar
EKDKIIIRIINIIRINNTTEENK

SEQ ID NO: 2522444 - protein, 23 aa, Entamoeba dispar
EKDKIRFEYLYASALNDFKRGNL

SEQ ID NO: 2522445 - protein, 32 aa, Entamoeba dispar
EKDLLLFSRTHDTPYNALYFISHGKVNQMIAA

SEQ ID NO: 2522446 - protein, 29 aa, Entamoeba dispar
EKDLRDEIKDLRLDIVDLKGELESKEQEV

SEQ ID NO: 2522447 - protein, 17 aa, Entamoeba dispar
EKDMLFEMLKAATFMNI

SEQ ID NO: 2522448 - protein, 24 aa, Entamoeba dispar
EKDNEFIIHQKKFAQLNLRELLQI

SEQ ID NO: 2522449 - protein, 26 aa, Entamoeba dispar
EKDNFRIELISYLPELNREIEFILNE

SEQ ID NO: 2522450 - protein, 33 aa, Entamoeba dispar
EKDSQVTFIQLEKIKYIYQPVDDIYVVLITSIN

SEQ ID NO: 2522451 - protein, 30 aa, Entamoeba dispar
EKDSRNFHCWGYYLWILEQGKISQEDDLKF

SEQ ID NO: 2522452 - protein, 21 aa, Entamoeba dispar
EKDTIFMILDLAEGSLDKLMS

SEQ ID NO: 2522453 - protein, 24 aa, Entamoeba dispar
EKEAYLIEDIALTAINFLNTHKKV

SEQ ID NO: 2522454 - protein, 17 aa, Entamoeba dispar
EKEEFCCHLELNDAIDI

SEQ ID NO: 2522455 - protein, 19 aa, Entamoeba dispar
EKEEFCCHLELNDAIDIGA

SEQ ID NO: 2522456 - protein, 26 aa, Entamoeba dispar
EKEEFINCFPLRVKALQLINSVMGKN

SEQ ID NO: 2522457 - protein, 28 aa, Entamoeba dispar
EKEEQKALYYTLYQKPFLNKEKEINLKS

SEQ ID NO: 2522458 - protein, 19 aa, Entamoeba dispar
EKEFKKCLNLIFLNSFSVE

SEQ ID NO: 2522459 - protein, 22 aa, Entamoeba dispar
EKEFVYCIFGRKPDRSIKSMKA

SEQ ID NO: 2522460 - protein, 25 aa, Entamoeba dispar
EKEIPKSILLLYSTTLRLFAILRHD

SEQ ID NO: 2522461 - protein, 20 aa, Entamoeba dispar
EKEIRYYEAFDRLSLFINNP

SEQ ID NO: 2522462 - protein, 25 aa, Entamoeba dispar
EKEKKYNEQIAALKKGKKTSFFGKK

SEQ ID NO: 2522463 - protein, 26 aa, Entamoeba dispar
EKEKNDLIIKFEEDKKIFESEKTKQI

SEQ ID NO: 2522464 - protein, 32 aa, Entamoeba dispar
EKEKYKYLTNALKKVLLVIKELQTINSTETQF

SEQ ID NO: 2522465 - protein, 25 aa, Entamoeba dispar
EKELKIKEIELLNSQLFELQKESRR

SEQ ID NO: 2522466 - protein, 19 aa, Entamoeba dispar
EKELRLNRFALNTSLIFLS

SEQ ID NO: 2522467 - protein, 27 aa, Entamoeba dispar
EKENIVRIGILLNEKPIIKKQLNKNSY

SEQ ID NO: 2522468 - protein, 30 aa, Entamoeba dispar
EKENIVRIGILLNEKPLIKKQLNKNSYLSD

SEQ ID NO: 2522469 - protein, 24 aa, Entamoeba dispar
EKENKWILAYVFKENDLECLTFIR

SEQ ID NO: 2522470 - protein, 26 aa, Entamoeba dispar
EKEPTEHIIIVMKYIVKYLQSKGKIV

SEQ ID NO: 2522471 - protein, 21 aa, Entamoeba dispar
EKERIERIIKIKKSERIRENI

SEQ ID NO: 2522472 - protein, 28 aa, Entamoeba dispar
EKEVYRCILYYYELFQQSLNELYLYILD

SEQ ID NO: 2522473 - protein, 22 aa, Entamoeba dispar
EKFHFNPIPITIKTRRYFPNIE

SEQ ID NO: 2522474 - protein, 20 aa, Entamoeba dispar
EKFHNQLLISMLLILSETKI

SEQ ID NO: 2522475 - protein, 30 aa, Entamoeba dispar
EKFKRDVIALYEYLYAGNPIPLIYQSMVLT

SEQ ID NO: 2522476 - protein, 24 aa, Entamoeba dispar
EKFRKNVYWTIDPAQPFIDKLVEC

SEQ ID NO: 2522477 - protein, 23 aa, Entamoeba dispar
EKFRYNPISISSLRLFPKIQTQC

SEQ ID NO: 2522478 - protein, 30 aa, Entamoeba dispar
EKGEFQWAITLLNHLIFANPKNVKARELAA

SEQ ID NO: 2522479 - protein, 24 aa, Entamoeba dispar
EKGEKLLCIDFEPPKPINTSTYLC

SEQ ID NO: 2522480 - protein, 18 aa, Entamoeba dispar
EKGKLKIYLYPNEEFNQV

SEQ ID NO: 2522481 - protein, 18 aa, Entamoeba dispar
EKGLRYLCGYYGEITEVT

SEQ ID NO: 2522482 - protein, 25 aa, Entamoeba dispar
EKGRLIPRFFSYCTSVAISRGINEE

SEQ ID NO: 2522483 - protein, 23 aa, Entamoeba dispar
EKGWDFPIIQTATLPKMIQVITS

SEQ ID NO: 2522484 - protein, 19 aa, Entamoeba dispar
EKGYKYLFNNHLLSLFSCS

SEQ ID NO: 2522485 - protein, 24 aa, Entamoeba dispar
EKGYLSLSPKDLGLAAPLTYEITP

SEQ ID NO: 2522486 - protein, 17 aa, Entamoeba dispar
EKGYTRWQLKNGVLYAY

SEQ ID NO: 2522487 - protein, 22 aa, Entamoeba dispar
EKHHLLIELTSLRVQVKHQEEL

SEQ ID NO: 2522488 - protein, 26 aa, Entamoeba dispar
EKHIKTTSLLYSPLRSFTISHFPSSG

SEQ ID NO: 2522489 - protein, 20 aa, Entamoeba dispar
EKHLPSFFFPKDSEFNVYFF

SEQ ID NO: 2522490 - protein, 25 aa, Entamoeba dispar
EKHLRLLWITLIPCLNVSSLTPIDL

SEQ ID NO: 2522491 - protein, 17 aa, Entamoeba dispar
EKHPQFLKNIDLVCGCS

SEQ ID NO: 2522492 - protein, 24 aa, Entamoeba dispar
EKIALTLFHKEKTLYYLKALKKRS

SEQ ID NO: 2522493 - protein, 31 aa, Entamoeba dispar
EKIAMYMQNYTLYGSLRPFGCSLLIGGVDQH

SEQ ID NO: 2522494 - protein, 26 aa, Entamoeba dispar
EKIEELILLLELLSKPISIPINISFL

SEQ ID NO: 2522495 - protein, 28 aa, Entamoeba dispar
EKIGTPVYNFLCSYLLKTNTPQLKGLFK

SEQ ID NO: 2522496 - protein, 26 aa, Entamoeba dispar
EKIHPQVIIEGWRIALKAAQEKLETM

SEQ ID NO: 2522497 - protein, 24 aa, Entamoeba dispar
EKIKDACVPFILPTIKDIHGVYEK

SEQ ID NO: 2522498 - protein, 24 aa, Entamoeba dispar
EKIKNDIKIIPTTEFKELIQSNNI

SEQ ID NO: 2522499 - protein, 20 aa, Entamoeba dispar
EKILAAKTIMWNGPCGVFEI

SEQ ID NO: 2522500 - protein, 20 aa, Entamoeba dispar
EKILRLLQQKVKDNEAKIEQ

SEQ ID NO: 2522501 - protein, 25 aa, Entamoeba dispar
EKIRAKICFDIVKALFYMHENGGIH

SEQ ID NO: 2522502 - protein, 20 aa, Entamoeba dispar
EKIREYNTILLKSNKVNEDH

SEQ ID NO: 2522503 - protein, 25 aa, Entamoeba dispar
EKITKHVIWYYVDYSTYLKEKEEWT

SEQ ID NO: 2522504 - protein, 54 aa, Entamoeba dispar
EKKARKALEKVGLVEVPNVVEFSLKRAGSKFVINQPAVYKLPSSEHYVVYGEPR

SEQ ID NO: 2522505 - protein, 26 aa, Entamoeba dispar
EKKCLFVRKSIMPEKRYTCVAGFLEV

SEQ ID NO: 2522506 - protein, 28 aa, Entamoeba dispar
EKKCLKKRMTFIPLNKIAPQMPNLNQIK

SEQ ID NO: 2522507 - protein, 25 aa, Entamoeba dispar
EKKDLILHNILSNELPFPLIAHAIL

SEQ ID NO: 2522508 - protein, 25 aa, Entamoeba dispar
EKKDVAEMILYLTKNRVSKNLIRIY

SEQ ID NO: 2522509 - protein, 28 aa, Entamoeba dispar
EKKIPITLDSLLIKPFHVYMEYLLGRSV

SEQ ID NO: 2522510 - protein, 34 aa, Entamoeba dispar
EKKKDLTVHFVFVSLNILCFRTCYKIIKKGENDI

SEQ ID NO: 2522511 - protein, 24 aa, Entamoeba dispar
EKKKLEMQIKIYKKTYRQKQEKRI

SEQ ID NO: 2522512 - protein, 27 aa, Entamoeba dispar
EKKKNKSLKKLSFINQKLLSINDEIQS

SEQ ID NO: 2522513 - protein, 24 aa, Entamoeba dispar
EKKKPLHTFNLFETKVLIQCNELG

SEQ ID NO: 2522514 - protein, 18 aa, Entamoeba dispar
EKKKVEEARKIIKRMRVN

SEQ ID NO: 2522515 - protein, 21 aa, Entamoeba dispar
EKKKWLLESWNRVVNFYNELN

SEQ ID NO: 2522516 - protein, 24 aa, Entamoeba dispar
EKKLFKKIYAKFWKMNEREKIVAP

SEQ ID NO: 2522517 - protein, 19 aa, Entamoeba dispar
EKKLGWFEGFKIKGEVLEK

SEQ ID NO: 2522518 - protein, 21 aa, Entamoeba dispar
EKKNVLMICYCQLTDEILMDI

SEQ ID NO: 2522519 - protein, 27 aa, Entamoeba dispar
EKKQFILYLDDLWYDTSLKVGDFIHLI

SEQ ID NO: 2522520 - protein, 23 aa, Entamoeba dispar
EKKREAFMCPALYLISPTKESVD

SEQ ID NO: 2522521 - protein, 25 aa, Entamoeba dispar
EKKREAFMCPALYLISPTKESVDRI

SEQ ID NO: 2522522 - protein, 25 aa, Entamoeba dispar
EKKRQMEKALKQGAATGGVKKVKKV

SEQ ID NO: 2522523 - protein, 22 aa, Entamoeba dispar
EKKSMEGYYREKIELRSTEEVE

SEQ ID NO: 2522524 - protein, 26 aa, Entamoeba dispar
EKKSNQLIYLCDSLNLNQFIESIEKS

SEQ ID NO: 2522525 - protein, 22 aa, Entamoeba dispar
EKKSWLDIESRMSWIICGITGN

SEQ ID NO: 2522526 - protein, 24 aa, Entamoeba dispar
EKKVQMMLNIVNSKPLPRSDNGET

SEQ ID NO: 2522527 - protein, 28 aa, Entamoeba dispar
EKKVSRERLLSFMFKRKTNEKTTISESP

SEQ ID NO: 2522528 - protein, 24 aa, Entamoeba dispar
EKKVTLVLPSFDGSTRPGLAKLEP

SEQ ID NO: 2522529 - protein, 23 aa, Entamoeba dispar
EKKYLSFMKFQDYCKYLDQSPAD

SEQ ID NO: 2522530 - protein, 26 aa, Entamoeba dispar
EKLASQILENKLLMESLPETTETNLD

SEQ ID NO: 2522531 - protein, 17 aa, Entamoeba dispar
EKLAWWLCERQTATGGL

SEQ ID NO: 2522532 - protein, 21 aa, Entamoeba dispar
EKLCELLMQLIIRAPGVVQIQ

SEQ ID NO: 2522533 - protein, 44 aa, Entamoeba dispar
EKLDNQLYLHLKYEGIHLVIFGTRWLRLLFDREFHVMDVLNVWD

SEQ ID NO: 2522534 - protein, 18 aa, Entamoeba dispar
EKLENEYLIDVAAEEFKL

SEQ ID NO: 2522535 - protein, 27 aa, Entamoeba dispar
EKLHVQYLPISLQLIKMRLYLTINYNT

SEQ ID NO: 2522536 - protein, 29 aa, Entamoeba dispar
EKLIAINVDIFCRCIRLIETIQKASCRLC

SEQ ID NO: 2522537 - protein, 21 aa, Entamoeba dispar
EKLIILACDGIWDVLTNEQCV

SEQ ID NO: 2522538 - protein, 20 aa, Entamoeba dispar
EKLKQDIQTLKDTIAKNYEE

SEQ ID NO: 2522539 - protein, 17 aa, Entamoeba dispar
EKLLLLVRDFVEVLKQL

SEQ ID NO: 2522540 - protein, 21 aa, Entamoeba dispar
EKLPLRIYGRINESGLGLTTW

SEQ ID NO: 2522541 - protein, 23 aa, Entamoeba dispar
EKLQQYHVFITKEAQRIVQESDE

SEQ ID NO: 2522542 - protein, 23 aa, Entamoeba dispar
EKLTLSYDLLFTTFPTLNQGKVP

SEQ ID NO: 2522543 - protein, 17 aa, Entamoeba dispar
EKLVGFIKRQMKDDPMI

SEQ ID NO: 2522544 - protein, 19 aa, Entamoeba dispar
EKMEIVNLMYFLKGQIKGS

SEQ ID NO: 2522545 - protein, 20 aa, Entamoeba dispar
EKMISPYDDTNYIRSVRISD

SEQ ID NO: 2522546 - protein, 18 aa, Entamoeba dispar
EKMKDYCFAKLKGSTFTP

SEQ ID NO: 2522547 - protein, 22 aa, Entamoeba dispar
EKMMTIPTILSGRLYEFKPEIQ

SEQ ID NO: 2522548 - protein, 25 aa, Entamoeba dispar
EKMRLWEIRQALRREGLKTQGTIEV

SEQ ID NO: 2522549 - protein, 24 aa, Entamoeba dispar
EKNDQFAFHLFLFATQMGNQKAQI

SEQ ID NO: 2522550 - protein, 33 aa, Entamoeba dispar
EKNEIFFMDNFMMPIYLHDSLLRAQNFSALSKS

SEQ ID NO: 2522551 - protein, 37 aa, Entamoeba dispar
EKNEQENYKWVLLEDSFAQKDYIKTLLQMYENMYGIK

SEQ ID NO: 2522552 - protein, 29 aa, Entamoeba dispar
EKNEQENYKWVLLEDSYAQKDYIKTLLQM

SEQ ID NO: 2522553 - protein, 24 aa, Entamoeba dispar
EKNIIIDKMTILEAFYSCVLNNQT

SEQ ID NO: 2522554 - protein, 39 aa, Entamoeba dispar
EKNKDQYPLIWYPDIFVLNGGYRYFYQLFPECCGGYIRM

SEQ ID NO: 2522555 - protein, 22 aa, Entamoeba dispar
EKNKFTYIITQTESFISASISY

SEQ ID NO: 2522556 - protein, 35 aa, Entamoeba dispar
EKNKITKITPLIGALPLFKLNFGNNLISIVPDTIG

SEQ ID NO: 2522557 - protein, 30 aa, Entamoeba dispar
EKNKRIFIHNLLIDILIEKGYFFDSKMSKR

SEQ ID NO: 2522558 - protein, 37 aa, Entamoeba dispar
EKNKRIFTQNFLFDLCLEYGFWFESKPSRKSKKSHQM

SEQ ID NO: 2522559 - protein, 23 aa, Entamoeba dispar
EKNQIESKYVYLKEYSKYIDGCG

SEQ ID NO: 2522560 - protein, 22 aa, Entamoeba dispar
EKNQIVCPLSHRFKLCVITKQP

SEQ ID NO: 2522561 - protein, 25 aa, Entamoeba dispar
EKNTIWLFETIRLSTDMKISCFDQN

SEQ ID NO: 2522562 - protein, 26 aa, Entamoeba dispar
EKPNRDIKLLIRKYNFFNYNIKLKEQ

SEQ ID NO: 2522563 - protein, 25 aa, Entamoeba dispar
EKPTKLLVFDFGGGTLDITCIEMKL

SEQ ID NO: 2522564 - protein, 24 aa, Entamoeba dispar
EKQDNYFLLKKGPSKYYDATPDTI

SEQ ID NO: 2522565 - protein, 20 aa, Entamoeba dispar
EKQFLLQQPVVKPLSCNSRD

SEQ ID NO: 2522566 - protein, 25 aa, Entamoeba dispar
EKQIQFIPTTLFISNSFKGIYDEKI

SEQ ID NO: 2522567 - protein, 26 aa, Entamoeba dispar
EKQKELRSMIYLLFSVANELMKFNEN

SEQ ID NO: 2522568 - protein, 23 aa, Entamoeba dispar
EKQKPRHQILQLLSMEQKKSKQK

SEQ ID NO: 2522569 - protein, 25 aa, Entamoeba dispar
EKQLHIILFCNNQIVILFFDFFTNL

SEQ ID NO: 2522570 - protein, 21 aa, Entamoeba dispar
EKQLIIPPKNRIHFAAFGGSI

SEQ ID NO: 2522571 - protein, 23 aa, Entamoeba dispar
EKQNYFLMQKLHFVRGNSIQDIY

SEQ ID NO: 2522572 - protein, 26 aa, Entamoeba dispar
EKQQGVSFVMPKFHDITIAQIVEGIK

SEQ ID NO: 2522573 - protein, 17 aa, Entamoeba dispar
EKQQTYVELLEFQLKKY

SEQ ID NO: 2522574 - protein, 17 aa, Entamoeba dispar
EKRFIEMKLIGTGSYWN

SEQ ID NO: 2522575 - protein, 30 aa, Entamoeba dispar
EKRKKIYTIINKFYANYIMVIDSHQLLMTK

SEQ ID NO: 2522576 - protein, 18 aa, Entamoeba dispar
EKRSDLIKYMREHYLWKR

SEQ ID NO: 2522577 - protein, 31 aa, Entamoeba dispar
EKRTVFSPVMFPMAPSFPPVVFPSHEEKEKT

SEQ ID NO: 2522578 - protein, 20 aa, Entamoeba dispar
EKRVYWKEFSEAIVSLLMKG

SEQ ID NO: 2522579 - protein, 21 aa, Entamoeba dispar
EKRVYWKEFTEAIVSLLMKGK

SEQ ID NO: 2522580 - protein, 17 aa, Entamoeba dispar
EKRWSLYRLMYNEETDL

SEQ ID NO: 2522581 - protein, 22 aa, Entamoeba dispar
EKRYHHMMINFIKKGYAVNLYE

SEQ ID NO: 2522582 - protein, 18 aa, Entamoeba dispar
EKSIFPLINQIKKTMIDF

SEQ ID NO: 2522583 - protein, 32 aa, Entamoeba dispar
EKSKENYHQIRLFKFTFWITSVDIEEIEQPNQ

SEQ ID NO: 2522584 - protein, 20 aa, Entamoeba dispar
EKSLLKKQKFVYLILDEAHS

SEQ ID NO: 2522585 - protein, 24 aa, Entamoeba dispar
EKSNIPLFPYELIKETSPTFRLEN

SEQ ID NO: 2522586 - protein, 24 aa, Entamoeba dispar
EKSYPLLEEILPNTLDLSKDQYGN

SEQ ID NO: 2522587 - protein, 23 aa, Entamoeba dispar
EKTAKELFSIYFQTLESDREMTK

SEQ ID NO: 2522588 - protein, 22 aa, Entamoeba dispar
EKTCIILPEYCIQHLIHFLGYG

SEQ ID NO: 2522589 - protein, 22 aa, Entamoeba dispar
EKTDTIADCFAFLETKGYKKRE

SEQ ID NO: 2522590 - protein, 25 aa, Entamoeba dispar
EKTGKVVKLWQPSLSDFKEKLKEDK

SEQ ID NO: 2522591 - protein, 23 aa, Entamoeba dispar
EKTIIIDHKIGFLGGIDLAEGRW

SEQ ID NO: 2522592 - protein, 21 aa, Entamoeba dispar
EKTIVDLIRQTPLKLHLFIQE

SEQ ID NO: 2522593 - protein, 23 aa, Entamoeba dispar
EKTKRILEQLQANMKEQQANNEE

SEQ ID NO: 2522594 - protein, 23 aa, Entamoeba dispar
EKTKYKVIPYPIKNGRYKIKSNE

SEQ ID NO: 2522595 - protein, 18 aa, Entamoeba dispar
EKTLTMMLQIIYNCMKQF

SEQ ID NO: 2522596 - protein, 21 aa, Entamoeba dispar
EKTTIFFESFIKLLNEQKEII

SEQ ID NO: 2522597 - protein, 25 aa, Entamoeba dispar
EKVDEQLLYELMIQAGPVVNVSIPR

SEQ ID NO: 2522598 - protein, 19 aa, Entamoeba dispar
EKVFDHLLTPFPSVPLNQI

SEQ ID NO: 2522599 - protein, 35 aa, Entamoeba dispar
EKVKEWIRIGKAEILPGVLFIDEVHMLDLECFSFL

SEQ ID NO: 2522600 - protein, 18 aa, Entamoeba dispar
EKVKFLIETFSLVLKQDG

SEQ ID NO: 2522601 - protein, 24 aa, Entamoeba dispar
EKVKMVNSFITSIAFTISSPKIII

SEQ ID NO: 2522602 - protein, 17 aa, Entamoeba dispar
EKVLPELKKLIKETTRD

SEQ ID NO: 2522603 - protein, 27 aa, Entamoeba dispar
EKVNGKQKIYWYNQSKLTNITPEVIRE

SEQ ID NO: 2522604 - protein, 35 aa, Entamoeba dispar
EKVQIKQIILYPPIIIKKLKYIVKLNYLRDVVVAR

SEQ ID NO: 2522605 - protein, 25 aa, Entamoeba dispar
EKVQMLLPYILSSIKQKKFDKIMAD

SEQ ID NO: 2522606 - protein, 26 aa, Entamoeba dispar
EKWLKIHLQHVIWKQSGYYFHNRNIE

SEQ ID NO: 2522607 - protein, 34 aa, Entamoeba dispar
EKYDGVGIIPLDCPWYICYFMGRPQAHFVCTTQN

SEQ ID NO: 2522608 - protein, 26 aa, Entamoeba dispar
EKYFPRDRSFVDWLLCKTINGERASL

SEQ ID NO: 2522609 - protein, 32 aa, Entamoeba dispar
EKYGNKLILGLLYTLYRIYRMNPVDLVGTENG

SEQ ID NO: 2522610 - protein, 28 aa, Entamoeba dispar
EKYHSLVRLYFKDIKGVLLVFQIDRQES

SEQ ID NO: 2522611 - protein, 28 aa, Entamoeba dispar
EKYIDIMVNLLFYIPMRNDYLDQLINGI

SEQ ID NO: 2522612 - protein, 17 aa, Entamoeba dispar
EKYIKMKRARMGEACKL

SEQ ID NO: 2522613 - protein, 31 aa, Entamoeba dispar
EKYKDILLRIRTLVKTIYPIANLESVNRLSN

SEQ ID NO: 2522614 - protein, 21 aa, Entamoeba dispar
EKYLNEMVMIAQTPKPTISTE

SEQ ID NO: 2522615 - protein, 21 aa, Entamoeba dispar
EKYLRLLEREAYLVEDIALTA

SEQ ID NO: 2522616 - protein, 23 aa, Entamoeba dispar
EKYPRNLKIIELLISLSKENTSD

SEQ ID NO: 2522617 - protein, 28 aa, Entamoeba dispar
EKYQLAFITTRSLHLFHPIPISKVIHPS

SEQ ID NO: 2522618 - protein, 25 aa, Entamoeba dispar
EKYRSMVGMYYRGASGAIIVYDITS

SEQ ID NO: 2522619 - protein, 21 aa, Entamoeba dispar
EKYSMLSNFPFVYIVDVFADF

SEQ ID NO: 2522620 - protein, 27 aa, Entamoeba dispar
EKYVYVSRMLLYHRNIPLNECFVSTTL

SEQ ID NO: 2522621 - protein, 22 aa, Entamoeba dispar
EKYYFCLNHQPYYFDRLSEPFF

SEQ ID NO: 2522622 - protein, 17 aa, Entamoeba dispar
ELAAYYFSKANTSFSHV

SEQ ID NO: 2522623 - protein, 18 aa, Entamoeba dispar
ELADIKIKLDTTQQELVA

SEQ ID NO: 2522624 - protein, 27 aa, Entamoeba dispar
ELAIYEFIHFLVQIYDLLFDNACEVDI

SEQ ID NO: 2522625 - protein, 32 aa, Entamoeba dispar
ELAKKVEVIVGVPFIYIPKVQQILAGEANGAN

SEQ ID NO: 2522626 - protein, 21 aa, Entamoeba dispar
ELAPTHPIRLGLALNFSVFYF

SEQ ID NO: 2522627 - protein, 23 aa, Entamoeba dispar
ELARKLFPEKLDQFNPAFVIVDE

SEQ ID NO: 2522628 - protein, 17 aa, Entamoeba dispar
ELASRLCLNALIKKNSK

SEQ ID NO: 2522629 - protein, 29 aa, Entamoeba dispar
ELASRQMHLAKFLRALQRIADEFSVAVVL

SEQ ID NO: 2522630 - protein, 26 aa, Entamoeba dispar
ELATVWGMYGIPLKSAIKKSQWRVPL

SEQ ID NO: 2522631 - protein, 21 aa, Entamoeba dispar
ELAVKIFKTSILIFKDRERYV

SEQ ID NO: 2522632 - protein, 24 aa, Entamoeba dispar
ELCDLLIYLLVRSSPIFPEIYNNN

SEQ ID NO: 2522633 - protein, 20 aa, Entamoeba dispar
ELCIGSKLKTYIFIDNEVVS

SEQ ID NO: 2522634 - protein, 32 aa, Entamoeba dispar
ELCINKILLMNLYQFFMLPEQISLSQVKYFLE

SEQ ID NO: 2522635 - protein, 20 aa, Entamoeba dispar
ELCLKAISILRAIGTRYKPG

SEQ ID NO: 2522636 - protein, 25 aa, Entamoeba dispar
ELCQYKYCSIVPLLERRFISLFMRK

SEQ ID NO: 2522637 - protein, 17 aa, Entamoeba dispar
ELDEFIENLPPPNPSKI

SEQ ID NO: 2522638 - protein, 18 aa, Entamoeba dispar
ELDEFIFLLSSKAGGCGL

SEQ ID NO: 2522639 - protein, 32 aa, Entamoeba dispar
ELDIKLPTNQRLYILLWRIFGLTEYCLDSNGI

SEQ ID NO: 2522640 - protein, 26 aa, Entamoeba dispar
ELDLFVELFRSLCNVPIISSGHKFKT

SEQ ID NO: 2522641 - protein, 26 aa, Entamoeba dispar
ELDMNKLLKFMLVNKIVRATTTSKEW

SEQ ID NO: 2522642 - protein, 22 aa, Entamoeba dispar
ELDQMFLKGKALQYFNPDKLHD

SEQ ID NO: 2522643 - protein, 27 aa, Entamoeba dispar
ELDRNEFLLALALLKNQKAGFPVPKTI

SEQ ID NO: 2522644 - protein, 22 aa, Entamoeba dispar
ELDSSIVTCLILKGLFSKKAQC

SEQ ID NO: 2522645 - protein, 24 aa, Entamoeba dispar
ELDYQCISAILLISSLCIHHNLIQ

SEQ ID NO: 2522646 - protein, 23 aa, Entamoeba dispar
ELEAPIPRIYILQKLVISAEANI

SEQ ID NO: 2522647 - protein, 25 aa, Entamoeba dispar
ELECSLLTLPMVWNENRFKKTIEMY

SEQ ID NO: 2522648 - protein, 25 aa, Entamoeba dispar
ELEDFKKICLPLFTQAVDELKRVID

SEQ ID NO: 2522649 - protein, 20 aa, Entamoeba dispar
ELEESIIINIRELLKKKYGQ

SEQ ID NO: 2522650 - protein, 29 aa, Entamoeba dispar
ELEESKIKDIFLLMKRMLINLDMDQIEFK

SEQ ID NO: 2522651 - protein, 26 aa, Entamoeba dispar
ELEGRRNIFLALQYKRLFTQEEFLKY

SEQ ID NO: 2522652 - protein, 24 aa, Entamoeba dispar
ELEKLCPTVLYVPGNHDPTTLFHN

SEQ ID NO: 2522653 - protein, 18 aa, Entamoeba dispar
ELELTYCPLLKKIHIPSS

SEQ ID NO: 2522654 - protein, 18 aa, Entamoeba dispar
ELENFHKSMQTLLEDLKG

SEQ ID NO: 2522655 - protein, 25 aa, Entamoeba dispar
ELENKVMGLLRFELSKAKSAVCEMV

SEQ ID NO: 2522656 - protein, 24 aa, Entamoeba dispar
ELENSIFCLFYLKNANHFVKSKFN

SEQ ID NO: 2522657 - protein, 25 aa, Entamoeba dispar
ELESEVFWFFKDLMEIMGDWFKGGD

SEQ ID NO: 2522658 - protein, 28 aa, Entamoeba dispar
ELETPFNEYLFIKILTAIHNQWSSYTSN

SEQ ID NO: 2522659 - protein, 21 aa, Entamoeba dispar
ELFDYIISKGRLEIEEVLVYF

SEQ ID NO: 2522660 - protein, 18 aa, Entamoeba dispar
ELFDYTILIDKRIGYICY

SEQ ID NO: 2522661 - protein, 24 aa, Entamoeba dispar
ELFIVRLIYQRIIEGMPLLDCVKG

SEQ ID NO: 2522662 - protein, 19 aa, Entamoeba dispar
ELFKMLYREMTMGVTGPFI

SEQ ID NO: 2522663 - protein, 23 aa, Entamoeba dispar
ELFKNTYHMIPSTALQNGVHQIP

SEQ ID NO: 2522664 - protein, 18 aa, Entamoeba dispar
ELFKYVKKYQKIASINIL

SEQ ID NO: 2522665 - protein, 44 aa, Entamoeba dispar
ELFPPCMYSIYRKFLHDKHLKHFGLLQLIMFLKGVGLSMEDCKK

SEQ ID NO: 2522666 - protein, 21 aa, Entamoeba dispar
ELFTILQRICEIIGASLDTLK

SEQ ID NO: 2522667 - protein, 17 aa, Entamoeba dispar
ELFTLQYNYENQKFIST

SEQ ID NO: 2522668 - protein, 24 aa, Entamoeba dispar
ELGASCFAHWFQPLSQTTARKYDS

SEQ ID NO: 2522669 - protein, 24 aa, Entamoeba dispar
ELGDLPLSVFLMEKPEDIKKVEEI

SEQ ID NO: 2522670 - protein, 17 aa, Entamoeba dispar
ELGDVKWFKLKKEQLEE

SEQ ID NO: 2522671 - protein, 23 aa, Entamoeba dispar
ELGIEKIIQLDLKLSKNSYALND

SEQ ID NO: 2522672 - protein, 24 aa, Entamoeba dispar
ELGKWCFYGCMLLTSINIPSSISK

SEQ ID NO: 2522673 - protein, 17 aa, Entamoeba dispar
ELGLIFVTSLFSCSKFE

SEQ ID NO: 2522674 - protein, 18 aa, Entamoeba dispar
ELGPFHESFTAIVGANGC

SEQ ID NO: 2522675 - protein, 17 aa, Entamoeba dispar
ELGYKRTILVSIDYHRR

SEQ ID NO: 2522676 - protein, 27 aa, Entamoeba dispar
ELHHQSNLAYFLLRRALRNKNIIGHQF

SEQ ID NO: 2522677 - protein, 17 aa, Entamoeba dispar
ELHPIFIKSCTLNKVKS

SEQ ID NO: 2522678 - protein, 19 aa, Entamoeba dispar
ELHYFKNSLIGFYSLINST

SEQ ID NO: 2522679 - protein, 22 aa, Entamoeba dispar
ELIDPALLRPGRFDCLIEVPKP

SEQ ID NO: 2522680 - protein, 20 aa, Entamoeba dispar
ELIEDVFGFLPEEIADTLTE

SEQ ID NO: 2522681 - protein, 33 aa, Entamoeba dispar
ELIELPIQHFGRLGALLFYLMSKTSEPSQIIKQ

SEQ ID NO: 2522682 - protein, 18 aa, Entamoeba dispar
ELIEMKAIYLKYTENIKI

SEQ ID NO: 2522683 - protein, 19 aa, Entamoeba dispar
ELIIKIPNLIESKEKYQIP

SEQ ID NO: 2522684 - protein, 29 aa, Entamoeba dispar
ELIINGISYLEIIKIYSSFNISTVPVIDV

SEQ ID NO: 2522685 - protein, 19 aa, Entamoeba dispar
ELIIYLLKGNVQTYSILLV

SEQ ID NO: 2522686 - protein, 23 aa, Entamoeba dispar
ELIKEYFPQLSQYSRLNLTAIYI

SEQ ID NO: 2522687 - protein, 18 aa, Entamoeba dispar
ELIKKMRLMLRKTEKEWN

SEQ ID NO: 2522688 - protein, 19 aa, Entamoeba dispar
ELIKNYLLEWTNSYDYEKL

SEQ ID NO: 2522689 - protein, 26 aa, Entamoeba dispar
ELIKRAYTVSFLSWSLLSCGCEVQLQ

SEQ ID NO: 2522690 - protein, 21 aa, Entamoeba dispar
ELIKSMIIVDPLKRASIASML

SEQ ID NO: 2522691 - protein, 23 aa, Entamoeba dispar
ELINNYMIPLQKNGLITEKQYKT

SEQ ID NO: 2522692 - protein, 17 aa, Entamoeba dispar
ELINYFLTFGEIDSLKL

SEQ ID NO: 2522693 - protein, 28 aa, Entamoeba dispar
ELIQLYFNEYGPNLLFFIVEGPIISGHG

SEQ ID NO: 2522694 - protein, 31 aa, Entamoeba dispar
ELIQLYINKYSNLPLIINTAGWKSGFGLELL

SEQ ID NO: 2522695 - protein, 23 aa, Entamoeba dispar
ELKDAFDMFDSSKKGYLDKDDVK

SEQ ID NO: 2522696 - protein, 18 aa, Entamoeba dispar
ELKDKLHLILPYKENELI

SEQ ID NO: 2522697 - protein, 21 aa, Entamoeba dispar
ELKEKLHPLGLFKNIESLSIT

SEQ ID NO: 2522698 - protein, 17 aa, Entamoeba dispar
ELKFNIETQIKKLTQKR

SEQ ID NO: 2522699 - protein, 17 aa, Entamoeba dispar
ELKGMINAKQGIDIQNI

SEQ ID NO: 2522700 - protein, 19 aa, Entamoeba dispar
ELKHDRIKLLINKLQREKI

SEQ ID NO: 2522701 - protein, 19 aa, Entamoeba dispar
ELKHFIAESLVPPIDFFIP

SEQ ID NO: 2522702 - protein, 26 aa, Entamoeba dispar
ELKHYMNYLFFDEYCNWIQSADDQIR

SEQ ID NO: 2522703 - protein, 17 aa, Entamoeba dispar
ELKIIKCINILSSIALN

SEQ ID NO: 2522704 - protein, 17 aa, Entamoeba dispar
ELKIKRMKKQSALTGFA

SEQ ID NO: 2522705 - protein, 17 aa, Entamoeba dispar
ELKIQINKLNNSIIKNT

SEQ ID NO: 2522706 - protein, 26 aa, Entamoeba dispar
ELKIRLCGSETNWDLFKMWTGKACCH

SEQ ID NO: 2522707 - protein, 20 aa, Entamoeba dispar
ELKKAYKKLALKWHPDRNIN

SEQ ID NO: 2522708 - protein, 23 aa, Entamoeba dispar
ELKKEEVIPIKKGDIWKVCHVKK

SEQ ID NO: 2522709 - protein, 22 aa, Entamoeba dispar
ELKKIILISKKFQQAVLARTVN

SEQ ID NO: 2522710 - protein, 26 aa, Entamoeba dispar
ELKKKKILFTTYKKGSPFTSSIPLVL

SEQ ID NO: 2522711 - protein, 18 aa, Entamoeba dispar
ELKKSFYNIISLTSIKLN

SEQ ID NO: 2522712 - protein, 25 aa, Entamoeba dispar
ELKKSQNLLFNIPTKLKSISNNQKD

SEQ ID NO: 2522713 - protein, 20 aa, Entamoeba dispar
ELKLLDAPSWALQLKHDDSL

SEQ ID NO: 2522714 - protein, 22 aa, Entamoeba dispar
ELKNINNFLDRLNLRIDQSNER

SEQ ID NO: 2522715 - protein, 26 aa, Entamoeba dispar
ELKNKLLELPLMGNLVSIIHCIFDDI

SEQ ID NO: 2522716 - protein, 17 aa, Entamoeba dispar
ELKNYLEVSKGERIEVE

SEQ ID NO: 2522717 - protein, 25 aa, Entamoeba dispar
ELKPVSFINQPPIKYKALQASEHSL

SEQ ID NO: 2522718 - protein, 36 aa, Entamoeba dispar
ELKQEIDYLKTPIEPEIVFCDFPISDYFNGKEEVIE

SEQ ID NO: 2522719 - protein, 20 aa, Entamoeba dispar
ELKQFVFEKYMDNRTVADKY

SEQ ID NO: 2522720 - protein, 24 aa, Entamoeba dispar
ELKQMYLFMTITQPSYRVTVDQLL

SEQ ID NO: 2522721 - protein, 30 aa, Entamoeba dispar
ELKREKIPSELLFFFDYYIDKHVEKGIAEK

SEQ ID NO: 2522722 - protein, 25 aa, Entamoeba dispar
ELKRVMNLLTKLNKLWDLEDYHSVK

SEQ ID NO: 2522723 - protein, 26 aa, Entamoeba dispar
ELKSINNLKQLKLYGVNKLKINEIKE

SEQ ID NO: 2522724 - protein, 24 aa, Entamoeba dispar
ELKTFFVALIDNYYELFPDFSDRK

SEQ ID NO: 2522725 - protein, 29 aa, Entamoeba dispar
ELKTSPIRLALFKQPDFLNNPKIIIHLSG

SEQ ID NO: 2522726 - protein, 22 aa, Entamoeba dispar
ELKYLLTTVMIRRLKNDVLKEL

SEQ ID NO: 2522727 - protein, 17 aa, Entamoeba dispar
ELLFFIQELQKNGFDRE

SEQ ID NO: 2522728 - protein, 18 aa, Entamoeba dispar
ELLFQLYSCYFCNFRFNC

SEQ ID NO: 2522729 - protein, 23 aa, Entamoeba dispar
ELLGTFYRIGYDKNLYPYIPVHI

SEQ ID NO: 2522730 - protein, 22 aa, Entamoeba dispar
ELLHFFLHHFNINCLILIKQET

SEQ ID NO: 2522731 - protein, 27 aa, Entamoeba dispar
ELLHSLHLSVVLLPLLFTNDELNQNIN

SEQ ID NO: 2522732 - protein, 19 aa, Entamoeba dispar
ELLIEFMNNRNLNSFISCR

SEQ ID NO: 2522733 - protein, 18 aa, Entamoeba dispar
ELLKDIMDVLMNENIKKY

SEQ ID NO: 2522734 - protein, 20 aa, Entamoeba dispar
ELLKMVDSCTSASLASYSLI

SEQ ID NO: 2522735 - protein, 22 aa, Entamoeba dispar
ELLKSFIPLGNVAFQPIYTSAP

SEQ ID NO: 2522736 - protein, 20 aa, Entamoeba dispar
ELLKVSPNSPLKSSFREIAP

SEQ ID NO: 2522737 - protein, 19 aa, Entamoeba dispar
ELLKWATVCYKAALEFVGN

SEQ ID NO: 2522738 - protein, 24 aa, Entamoeba dispar
ELLLDNNKLLSPPLLSTLSNLRSL

SEQ ID NO: 2522739 - protein, 20 aa, Entamoeba dispar
ELLLNAFYIEPNDQSGWIYY

SEQ ID NO: 2522740 - protein, 23 aa, Entamoeba dispar
ELLPPGLTFGYYKNQRYIVDFCN

SEQ ID NO: 2522741 - protein, 23 aa, Entamoeba dispar
ELLQLPVAFPKKDDKIRIGLKSE

SEQ ID NO: 2522742 - protein, 25 aa, Entamoeba dispar
ELLSNSLYIPYFKPEKLIEIEDGIY

SEQ ID NO: 2522743 - protein, 17 aa, Entamoeba dispar
ELLTDKFITLSCHKNGF

SEQ ID NO: 2522744 - protein, 18 aa, Entamoeba dispar
ELLTITNKNIRILISTFQ

SEQ ID NO: 2522745 - protein, 28 aa, Entamoeba dispar
ELMERKDFFDLFKQSPYFKDLTHRLTAL

SEQ ID NO: 2522746 - protein, 17 aa, Entamoeba dispar
ELMFTDLLAESYNYIPL

SEQ ID NO: 2522747 - protein, 21 aa, Entamoeba dispar
ELMIFIRYCLKSQQINIVIST

SEQ ID NO: 2522748 - protein, 21 aa, Entamoeba dispar
ELMKEYVLFVNSLIAYQKNGT

SEQ ID NO: 2522749 - protein, 25 aa, Entamoeba dispar
ELMKRLLLIYAIKHPASGYVQGMSD

SEQ ID NO: 2522750 - protein, 25 aa, Entamoeba dispar
ELMTETLPLILVTKLTQLKQFIAQQ

SEQ ID NO: 2522751 - protein, 17 aa, Entamoeba dispar
ELMVTHGYPFNTITFYD

SEQ ID NO: 2522752 - protein, 33 aa, Entamoeba dispar
ELMYKYHHELMYIYTYDRDWYYPYISRDYSKID

SEQ ID NO: 2522753 - protein, 39 aa, Entamoeba dispar
ELNDNKISNILPLSNFYGLERLWLANNQIKYFTDFEKVF

SEQ ID NO: 2522754 - protein, 23 aa, Entamoeba dispar
ELNEQMMNIIYFTRIVVGSSSVT

SEQ ID NO: 2522755 - protein, 31 aa, Entamoeba dispar
ELNIIPIDIFNIINPLPFVLSSIHLFNESST

SEQ ID NO: 2522756 - protein, 29 aa, Entamoeba dispar
ELNIPFKNLLPFYYNLKHPLIPIYLTEII

SEQ ID NO: 2522757 - protein, 25 aa, Entamoeba dispar
ELNKNYAPALIGLALCELKDHKDGV

SEQ ID NO: 2522758 - protein, 26 aa, Entamoeba dispar
ELNKYKTLLLYPNLPTNFQEIISNNT

SEQ ID NO: 2522759 - protein, 24 aa, Entamoeba dispar
ELNLANSVLFCILDLNNDGKVPTD

SEQ ID NO: 2522760 - protein, 23 aa, Entamoeba dispar
ELNLNDNYIFYITPRISQLSNLT

SEQ ID NO: 2522761 - protein, 20 aa, Entamoeba dispar
ELNMQNILFISKDKIFVNEY

SEQ ID NO: 2522762 - protein, 18 aa, Entamoeba dispar
ELNMYCSASLLTYYSKDL

SEQ ID NO: 2522763 - protein, 23 aa, Entamoeba dispar
ELNNVFLIIAIYNSYIFDKPFKD

SEQ ID NO: 2522764 - protein, 26 aa, Entamoeba dispar
ELNQIQTFYLNPLFIHLAHSDYRKRT

SEQ ID NO: 2522765 - protein, 25 aa, Entamoeba dispar
ELNQLCCSVILSYYNGIKGCKLEIS

SEQ ID NO: 2522766 - protein, 18 aa, Entamoeba dispar
ELNQSYRIQCQCGCYINP

SEQ ID NO: 2522767 - protein, 23 aa, Entamoeba dispar
ELNSKFNVLFVKYINTATNTEEI

SEQ ID NO: 2522768 - protein, 25 aa, Entamoeba dispar
ELNSPTFNLYFYQTIIEWSIKEKNI

SEQ ID NO: 2522769 - protein, 35 aa, Entamoeba dispar
ELNVLPMIMDDYKQCVWLLIGIKDLGGKIRKSGTK

SEQ ID NO: 2522770 - protein, 24 aa, Entamoeba dispar
ELPDLKLISDDFLLRYGKDQFDPL

SEQ ID NO: 2522771 - protein, 18 aa, Entamoeba dispar
ELPEIPNIARLLVAFDSE

SEQ ID NO: 2522772 - protein, 25 aa, Entamoeba dispar
ELPELENYPKEGILQIFICGTDDTM

SEQ ID NO: 2522773 - protein, 24 aa, Entamoeba dispar
ELPETLVFHLKRFVYNDQYEIVKY

SEQ ID NO: 2522774 - protein, 20 aa, Entamoeba dispar
ELPIAAVFPGDSSSFIAAFP

SEQ ID NO: 2522775 - protein, 17 aa, Entamoeba dispar
ELPLRNSTRSKHLTSTI

SEQ ID NO: 2522776 - protein, 24 aa, Entamoeba dispar
ELPLVHFSVLKSLIGFLVQITEKS

SEQ ID NO: 2522777 - protein, 23 aa, Entamoeba dispar
ELPPNLIHFSLKDIDFRSFVPVF

SEQ ID NO: 2522778 - protein, 30 aa, Entamoeba dispar
ELPSQIVGGFLFLRLFCPAIASPENFGLLG

SEQ ID NO: 2522779 - protein, 29 aa, Entamoeba dispar
ELPSVLMRLLDCPPLVLSVLQSLKIVLFS

SEQ ID NO: 2522780 - protein, 32 aa, Entamoeba dispar
ELPTNPVLTKQIKLLISLFDKKKKQEAQMEVE

SEQ ID NO: 2522781 - protein, 21 aa, Entamoeba dispar
ELPYWLYEMTQLKDLNLSTNL

SEQ ID NO: 2522782 - protein, 25 aa, Entamoeba dispar
ELQKDHLVYKITPKILKDQNIPKQT

SEQ ID NO: 2522783 - protein, 20 aa, Entamoeba dispar
ELQKVKFIFWDDLNEKYCEK

SEQ ID NO: 2522784 - protein, 20 aa, Entamoeba dispar
ELQMAWYKDDYTRCYKQTAT

SEQ ID NO: 2522785 - protein, 24 aa, Entamoeba dispar
ELQQLFPFVDPEIIKTALIDCNYD

SEQ ID NO: 2522786 - protein, 24 aa, Entamoeba dispar
ELQTSKVIFLPEIHSIPKPTTEEE

SEQ ID NO: 2522787 - protein, 35 aa, Entamoeba dispar
ELRAILCTLTPENPQYFAEIIVAGPSADFELIGDD

SEQ ID NO: 2522788 - protein, 22 aa, Entamoeba dispar
ELREYDYLITVPKIEEGMVLDD

SEQ ID NO: 2522789 - protein, 24 aa, Entamoeba dispar
ELREYNVLYLKYVNEGIITISSHK

SEQ ID NO: 2522790 - protein, 24 aa, Entamoeba dispar
ELRGCIGCFSPSQPLYELVQQYAI

SEQ ID NO: 2522791 - protein, 18 aa, Entamoeba dispar
ELRIEIMPTYTLENKLPY

SEQ ID NO: 2522792 - protein, 21 aa, Entamoeba dispar
ELRLKQQFFFTSASLQDIVRR

SEQ ID NO: 2522793 - protein, 22 aa, Entamoeba dispar
ELRPELILAINGLLQDLNHPNE

SEQ ID NO: 2522794 - protein, 21 aa, Entamoeba dispar
ELRYLNDEILLPVNPKAQSLI

SEQ ID NO: 2522795 - protein, 23 aa, Entamoeba dispar
ELSAKYLPRFFKHNNFSSFVRQL

SEQ ID NO: 2522796 - protein, 24 aa, Entamoeba dispar
ELSAYYRRVYLGEGYPPVICQAPQ

SEQ ID NO: 2522797 - protein, 20 aa, Entamoeba dispar
ELSDGPVKAIKPKKKAKKQI

SEQ ID NO: 2522798 - protein, 22 aa, Entamoeba dispar
ELSDIFRMYKALNIQKFHSKKK

SEQ ID NO: 2522799 - protein, 24 aa, Entamoeba dispar
ELSEGILFAKLINYLQNDLINLTS

SEQ ID NO: 2522800 - protein, 25 aa, Entamoeba dispar
ELSEGVLLAKLLNYLQKDIIDLKSL

SEQ ID NO: 2522801 - protein, 23 aa, Entamoeba dispar
ELSFPLQFILLEIISINQYQYLE

SEQ ID NO: 2522802 - protein, 30 aa, Entamoeba dispar
ELSLPFKNYSTNSLFFSLPLVSLNKIIGNQ

SEQ ID NO: 2522803 - protein, 21 aa, Entamoeba dispar
ELSTILLNNGYFSLDIITLMG

SEQ ID NO: 2522804 - protein, 17 aa, Entamoeba dispar
ELSVMAYVSYFRHYEAE

SEQ ID NO: 2522805 - protein, 24 aa, Entamoeba dispar
ELSYLETFTITGLPELPAGAVRFE

SEQ ID NO: 2522806 - protein, 28 aa, Entamoeba dispar
ELTDQQIFSLLILRVLFSTIGFCTEINI

SEQ ID NO: 2522807 - protein, 19 aa, Entamoeba dispar
ELTIHRIIHQFNLTVKREE

SEQ ID NO: 2522808 - protein, 31 aa, Entamoeba dispar
ELTISYTFPSILPHRLKYFKENYGFICDCPL

SEQ ID NO: 2522809 - protein, 24 aa, Entamoeba dispar
ELTLFNVQVLLNNLFGVKLEQVIQ

SEQ ID NO: 2522810 - protein, 22 aa, Entamoeba dispar
ELTPTLLLCHFNVEIKAIYPIP

SEQ ID NO: 2522811 - protein, 25 aa, Entamoeba dispar
ELTQLLICLYQRIKIILPTILECHK

SEQ ID NO: 2522812 - protein, 26 aa, Entamoeba dispar
ELTQRQLAERTIILKNQVKLQKDDNA

SEQ ID NO: 2522813 - protein, 25 aa, Entamoeba dispar
ELTTALFCEKYIDTLFKLKRINEFG

SEQ ID NO: 2522814 - protein, 20 aa, Entamoeba dispar
ELTTLPIYGMNYEKFMPALM

SEQ ID NO: 2522815 - protein, 25 aa, Entamoeba dispar
ELTYSFCDSLCIIYLFFPNIKENQI

SEQ ID NO: 2522816 - protein, 24 aa, Entamoeba dispar
ELVEDILFAFTLDGQLHIYNTTQN

SEQ ID NO: 2522817 - protein, 24 aa, Entamoeba dispar
ELVEQIWCKLLCYCIGEIFSQHQF

SEQ ID NO: 2522818 - protein, 20 aa, Entamoeba dispar
ELVIAPGFLPQKQEKKKKER

SEQ ID NO: 2522819 - protein, 17 aa, Entamoeba dispar
ELVIPNEPIIKHLKMKE

SEQ ID NO: 2522820 - protein, 17 aa, Entamoeba dispar
ELVIVPRTKGGFSYGYV

SEQ ID NO: 2522821 - protein, 20 aa, Entamoeba dispar
ELVMNNLVQLAGCSQGAMVM

SEQ ID NO: 2522822 - protein, 20 aa, Entamoeba dispar
ELVNYLFDALLSENEKRMSA

SEQ ID NO: 2522823 - protein, 23 aa, Entamoeba dispar
ELVPILSRLYVDIALNVKPICIT

SEQ ID NO: 2522824 - protein, 17 aa, Entamoeba dispar
ELVQASIQQEKPSRTLP

SEQ ID NO: 2522825 - protein, 29 aa, Entamoeba dispar
ELVRPISCKFNVSLLPPPSSPKLHSILHY

SEQ ID NO: 2522826 - protein, 21 aa, Entamoeba dispar
ELVYMYRSAYHYSLDNFYNTF

SEQ ID NO: 2522827 - protein, 22 aa, Entamoeba dispar
ELYEQHTGIKEWNRYVKTMFDS

SEQ ID NO: 2522828 - protein, 23 aa, Entamoeba dispar
ELYEQHTGIKEWNRYVKTMFDSI

SEQ ID NO: 2522829 - protein, 17 aa, Entamoeba dispar
ELYFLELKQKKNDAKKL

SEQ ID NO: 2522830 - protein, 19 aa, Entamoeba dispar
ELYHQYYLGVFKSNSEMYT

SEQ ID NO: 2522831 - protein, 23 aa, Entamoeba dispar
ELYNILSVLIKDIGTKESFGKRY

SEQ ID NO: 2522832 - protein, 21 aa, Entamoeba dispar
ELYQKDILPIIPLKTKRSICN

SEQ ID NO: 2522833 - protein, 22 aa, Entamoeba dispar
EMAIMLPDLYAIYNRARGTLVS

SEQ ID NO: 2522834 - protein, 17 aa, Entamoeba dispar
EMALTLKNFPPQDIIFT

SEQ ID NO: 2522835 - protein, 29 aa, Entamoeba dispar
EMCNNPIRMIIIDFILSIDGSGNIPIEID

SEQ ID NO: 2522836 - protein, 17 aa, Entamoeba dispar
EMDIRLIAFKEFLSYER

SEQ ID NO: 2522837 - protein, 33 aa, Entamoeba dispar
EMELVDLASLCYFFIFLQPKYVIHSLPFQELLS

SEQ ID NO: 2522838 - protein, 24 aa, Entamoeba dispar
EMENKSIITHFKFGVIYVKPNQND

SEQ ID NO: 2522839 - protein, 34 aa, Entamoeba dispar
EMFNKGFMEIIYDIIKYLPIKRQIVLCSATLTGD

SEQ ID NO: 2522840 - protein, 28 aa, Entamoeba dispar
EMGKDWLKIFELLLEKMPIIRLNEVFKQ

SEQ ID NO: 2522841 - protein, 22 aa, Entamoeba dispar
EMGYPLFEYGINSLYQTMGFED

SEQ ID NO: 2522842 - protein, 25 aa, Entamoeba dispar
EMHLDRPESYKLIYQNKKSPQELNV

SEQ ID NO: 2522843 - protein, 32 aa, Entamoeba dispar
EMHSKDFLMVFSKFLHLLSASYLHPNVFSKFV

SEQ ID NO: 2522844 - protein, 25 aa, Entamoeba dispar
EMIELLKKTLIPNAPYLFLGDYIDR

SEQ ID NO: 2522845 - protein, 18 aa, Entamoeba dispar
EMIIHGDGDGRWIKNAKK

SEQ ID NO: 2522846 - protein, 17 aa, Entamoeba dispar
EMIKLIFIAMRGNDYYE

SEQ ID NO: 2522847 - protein, 17 aa, Entamoeba dispar
EMILLYENQPISRKSDI

SEQ ID NO: 2522848 - protein, 19 aa, Entamoeba dispar
EMIQLAPPTMKIKVIAPPE

SEQ ID NO: 2522849 - protein, 43 aa, Entamoeba dispar
EMITKDPKHFIFSLLNPSGIQPRAFYLQDNESKTLCIYSSKSK

SEQ ID NO: 2522850 - protein, 18 aa, Entamoeba dispar
EMIVKYNVILLKDLDDMS

SEQ ID NO: 2522851 - protein, 28 aa, Entamoeba dispar
EMKAFLSWKFVRLERLVLSWLDIMATMI

SEQ ID NO: 2522852 - protein, 17 aa, Entamoeba dispar
EMKELITAPFNYITDFL

SEQ ID NO: 2522853 - protein, 19 aa, Entamoeba dispar
EMKHLYFTGSVNFAIGRMI

SEQ ID NO: 2522854 - protein, 24 aa, Entamoeba dispar
EMKISEPMGIVLSSFKGESPNELS

SEQ ID NO: 2522855 - protein, 22 aa, Entamoeba dispar
EMKKTMFIGESIQKAISFGVKA

SEQ ID NO: 2522856 - protein, 17 aa, Entamoeba dispar
EMKLIGTGSYWNVYKCY

SEQ ID NO: 2522857 - protein, 17 aa, Entamoeba dispar
EMKLYRLSETVMPSLNY

SEQ ID NO: 2522858 - protein, 26 aa, Entamoeba dispar
EMKQKLFEMLGHVFNYCFINYENTFD

SEQ ID NO: 2522859 - protein, 21 aa, Entamoeba dispar
EMKQLETVYLMKVVLHVKDMN

SEQ ID NO: 2522860 - protein, 30 aa, Entamoeba dispar
EMKWAEFEYCILFPFNVLKMKSIKIMIKYP

SEQ ID NO: 2522861 - protein, 17 aa, Entamoeba dispar
EMKWIAQMLLNGVIYPM

SEQ ID NO: 2522862 - protein, 26 aa, Entamoeba dispar
EMKYVPFTIVPFLPIKFENITADYLI

SEQ ID NO: 2522863 - protein, 30 aa, Entamoeba dispar
EMLLCQMIQKYLYFISQYGWNIEMIKEWND

SEQ ID NO: 2522864 - protein, 25 aa, Entamoeba dispar
EMLNSFFDIFLYLGQSDKFIQAIYE

SEQ ID NO: 2522865 - protein, 25 aa, Entamoeba dispar
EMLPQDYLQRLVSLSPRDVDLCLKA

SEQ ID NO: 2522866 - protein, 27 aa, Entamoeba dispar
EMLSSNFIFFVNLFQRSTLDMAKEFSS

SEQ ID NO: 2522867 - protein, 33 aa, Entamoeba dispar
EMNNDGYLAFIERLFRLLHLIEMKKEINLMGSD

SEQ ID NO: 2522868 - protein, 25 aa, Entamoeba dispar
EMNNQTIFGWFLTTTIPLMESKDTL

SEQ ID NO: 2522869 - protein, 17 aa, Entamoeba dispar
EMNPWYTIAFKGVPDSI

SEQ ID NO: 2522870 - protein, 24 aa, Entamoeba dispar
EMNRPVCVVGMMKLFSLSPFNTLM

SEQ ID NO: 2522871 - protein, 18 aa, Entamoeba dispar
EMNTRLLYKFRSIEQLQN

SEQ ID NO: 2522872 - protein, 31 aa, Entamoeba dispar
EMNVQTIHPMLLLVGKYSLPYIMLHHTGVLE

SEQ ID NO: 2522873 - protein, 17 aa, Entamoeba dispar
EMQCIIPKISKLVIESL

SEQ ID NO: 2522874 - protein, 20 aa, Entamoeba dispar
EMQDSIICIPNFTAPDFFLF

SEQ ID NO: 2522875 - protein, 30 aa, Entamoeba dispar
EMRESIKYIYELILSPPLSDRFTTFMELVD

SEQ ID NO: 2522876 - protein, 25 aa, Entamoeba dispar
EMRESYLEDGFLLEKKFGTAQKHKV

SEQ ID NO: 2522877 - protein, 18 aa, Entamoeba dispar
EMRGIFNKMYSLTNLHFE

SEQ ID NO: 2522878 - protein, 42 aa, Entamoeba dispar
EMRNHLRKVGVTSFKKISMINFLIFIYGYDLHEVVNAPQGAN

SEQ ID NO: 2522879 - protein, 22 aa, Entamoeba dispar
EMSIQFNNLYSFLRNEPKTPRL

SEQ ID NO: 2522880 - protein, 34 aa, Entamoeba dispar
EMSKQLCFKLYSIVQQLVMMYWKSDEERKKKLKT

SEQ ID NO: 2522881 - protein, 25 aa, Entamoeba dispar
EMTGIIFPSQRMRGGPLKKGQSLNF

SEQ ID NO: 2522882 - protein, 22 aa, Entamoeba dispar
EMVALLKLYIKTSCTPFFIMVN

SEQ ID NO: 2522883 - protein, 18 aa, Entamoeba dispar
EMVEFFNKFIKTCLKYIG

SEQ ID NO: 2522884 - protein, 24 aa, Entamoeba dispar
EMVIQLSFISEIHPYIFPKGEFAS

SEQ ID NO: 2522885 - protein, 17 aa, Entamoeba dispar
EMVIVGCYFHSKNDFIK

SEQ ID NO: 2522886 - protein, 25 aa, Entamoeba dispar
EMYEFNSVRGCSYCYGFAAVRRFLI

SEQ ID NO: 2522887 - protein, 19 aa, Entamoeba dispar
EMYNVLVLTDFVAQKSPQF

SEQ ID NO: 2522888 - protein, 25 aa, Entamoeba dispar
EMYYTFCLIDYVLCNSPSFRRQVTD

SEQ ID NO: 2522889 - protein, 25 aa, Entamoeba dispar
ENAKKILVILTKIYQSFIPQGETPL

SEQ ID NO: 2522890 - protein, 28 aa, Entamoeba dispar
ENAQEFVQLFYDNIPRRSPTHLSASVNP

SEQ ID NO: 2522891 - protein, 21 aa, Entamoeba dispar
ENAQSFLQFLKSKSAKKENKK

SEQ ID NO: 2522892 - protein, 25 aa, Entamoeba dispar
ENATKKFFTLLFNGKSNLTKKIMKL

SEQ ID NO: 2522893 - protein, 17 aa, Entamoeba dispar
ENAYFFECAVRTLWKKA

SEQ ID NO: 2522894 - protein, 18 aa, Entamoeba dispar
ENCAGLIKIVIPSSVIYL

SEQ ID NO: 2522895 - protein, 17 aa, Entamoeba dispar
ENCFCSCELLTSVVLCG

SEQ ID NO: 2522896 - protein, 30 aa, Entamoeba dispar
ENCHKVYVVYFFQLLRQSFPTKEIVILFQS

SEQ ID NO: 2522897 - protein, 25 aa, Entamoeba dispar
ENCKSLRHVVLPLLIKVIPDNCFKE

SEQ ID NO: 2522898 - protein, 20 aa, Entamoeba dispar
ENCRMMLMIYDTLKSLSSEL

SEQ ID NO: 2522899 - protein, 24 aa, Entamoeba dispar
ENCSKLLAITIPKASKLSSKCFKN

SEQ ID NO: 2522900 - protein, 18 aa, Entamoeba dispar
ENDEEIDFSLGQDSEEKE

SEQ ID NO: 2522901 - protein, 26 aa, Entamoeba dispar
ENDELFQYCMLIKGTQLKNILIEKKK

SEQ ID NO: 2522902 - protein, 30 aa, Entamoeba dispar
ENDENEMTLLFTKFGLLYKANRLKDNPSTM

SEQ ID NO: 2522903 - protein, 28 aa, Entamoeba dispar
ENDENLFFQIIDILFVRKGENGLGQLQI

SEQ ID NO: 2522904 - protein, 17 aa, Entamoeba dispar
ENDKFWKIIRHQHIANA

SEQ ID NO: 2522905 - protein, 20 aa, Entamoeba dispar
ENDPVLCRICFQLQGKKEIG

SEQ ID NO: 2522906 - protein, 26 aa, Entamoeba dispar
ENDRKKVYMVLYNNNIYQIQPVCAPT

SEQ ID NO: 2522907 - protein, 25 aa, Entamoeba dispar
ENDTLLYVCPTPRTNMISQILPEFA

SEQ ID NO: 2522908 - protein, 30 aa, Entamoeba dispar
ENDVTTLDEFARRLTVRKVDTDAKEEKKPK

SEQ ID NO: 2522909 - protein, 20 aa, Entamoeba dispar
ENEEFLYPSSVPLTTQEVLT

SEQ ID NO: 2522910 - protein, 23 aa, Entamoeba dispar
ENEHILFVQYLKQELEEEGINVF

SEQ ID NO: 2522911 - protein, 36 aa, Entamoeba dispar
ENEIITFVHYIPSFWHFHIHFCTIHSPLFQSLNSVI

SEQ ID NO: 2522912 - protein, 27 aa, Entamoeba dispar
ENEIKNLLNWAYYLTPLDKKRSEKNTP

SEQ ID NO: 2522913 - protein, 32 aa, Entamoeba dispar
ENEILAQRYCYYPYFYSILIEDELVNKEVFNE

SEQ ID NO: 2522914 - protein, 24 aa, Entamoeba dispar
ENEIPFKIIPIRNVPRMYMNKNEV

SEQ ID NO: 2522915 - protein, 26 aa, Entamoeba dispar
ENEITKDWFYINFQKRLNSLNSDTKK

SEQ ID NO: 2522916 - protein, 17 aa, Entamoeba dispar
ENEKYFYYVGMNVKRDC

SEQ ID NO: 2522917 - protein, 25 aa, Entamoeba dispar
ENELPFVQRALPGVKVVMVLIGTHK

SEQ ID NO: 2522918 - protein, 19 aa, Entamoeba dispar
ENEMGSIQLNIRLSNYRNS

SEQ ID NO: 2522919 - protein, 24 aa, Entamoeba dispar
ENENLHLFTLQNLLLEKKKFLENK

SEQ ID NO: 2522920 - protein, 24 aa, Entamoeba dispar
ENEPPLIPVPVQIPVQPIDYSEEV

SEQ ID NO: 2522921 - protein, 29 aa, Entamoeba dispar
ENEQKLIISGIVIALKIANPKYEDTKYTV

SEQ ID NO: 2522922 - protein, 31 aa, Entamoeba dispar
ENEQRSREIAIQNIELWKQNDELKKAALEAL

SEQ ID NO: 2522923 - protein, 25 aa, Entamoeba dispar
ENETNFPFNLTLNAPFDSYLSNNVQ

SEQ ID NO: 2522924 - protein, 32 aa, Entamoeba dispar
ENEVLLITRFTPPIFRCYDPTKLLPFTHFLEY

SEQ ID NO: 2522925 - protein, 18 aa, Entamoeba dispar
ENFKKTYNKDFFGVKTSI

SEQ ID NO: 2522926 - protein, 23 aa, Entamoeba dispar
ENGICKIPLKHIPPTVHVKSDGS

SEQ ID NO: 2522927 - protein, 22 aa, Entamoeba dispar
ENGILRLALLNNPNKKNKKKGE

SEQ ID NO: 2522928 - protein, 36 aa, Entamoeba dispar
ENGMTVYHFNKTLFYDGFIFKTYKMSQLVFNDIVPT

SEQ ID NO: 2522929 - protein, 23 aa, Entamoeba dispar
ENGNLLINIISMIKERILNEELV

SEQ ID NO: 2522930 - protein, 24 aa, Entamoeba dispar
ENGNTFTMLSWVKEGLEKEGINAE

SEQ ID NO: 2522931 - protein, 18 aa, Entamoeba dispar
ENGSLMTFLLTDLQQKDI

SEQ ID NO: 2522932 - protein, 32 aa, Entamoeba dispar
ENHGFCLYNKQLFIDYILPKHFPNVKQESFIR

SEQ ID NO: 2522933 - protein, 25 aa, Entamoeba dispar
ENHHLLLDMLRMYGITFNTTFSSGK

SEQ ID NO: 2522934 - protein, 26 aa, Entamoeba dispar
ENIATWFELYSWWKDNEDAQTFTNIV

SEQ ID NO: 2522935 - protein, 21 aa, Entamoeba dispar
ENICNGCQVGYYVNGSKCESC

SEQ ID NO: 2522936 - protein, 24 aa, Entamoeba dispar
ENIDIIELYKIKYQYHPSGKYNTS

SEQ ID NO: 2522937 - protein, 18 aa, Entamoeba dispar
ENIFACVGSNKILLQPLG

SEQ ID NO: 2522938 - protein, 20 aa, Entamoeba dispar
ENIFSICKLLNMKITLVDET

SEQ ID NO: 2522939 - protein, 20 aa, Entamoeba dispar
ENIHLKIFKVEREDVIKPDE

SEQ ID NO: 2522940 - protein, 19 aa, Entamoeba dispar
ENIHQIYLNGFFNNLHKNN

SEQ ID NO: 2522941 - protein, 24 aa, Entamoeba dispar
ENIHTIASLFKLYFRELPDSLVTE

SEQ ID NO: 2522942 - protein, 33 aa, Entamoeba dispar
ENIIAVKREYLIYSWIFINTLDEKPFEISSEST

SEQ ID NO: 2522943 - protein, 32 aa, Entamoeba dispar
ENIIKIMKSIIIKFIKFYLSSPELIERLLKEL

SEQ ID NO: 2522944 - protein, 17 aa, Entamoeba dispar
ENIITVGICLNGKPLIN

SEQ ID NO: 2522945 - protein, 26 aa, Entamoeba dispar
ENIKKLEEKWKYRKIPLPTEDKMVML

SEQ ID NO: 2522946 - protein, 17 aa, Entamoeba dispar
ENILLKENKPYPTIKIG

SEQ ID NO: 2522947 - protein, 22 aa, Entamoeba dispar
ENIMFLIIDLFQNKFRFVEDKY

SEQ ID NO: 2522948 - protein, 23 aa, Entamoeba dispar
ENINNIICLLEKTIKRKDKQNFS

SEQ ID NO: 2522949 - protein, 20 aa, Entamoeba dispar
ENINQIFEIITRNILEQKYQ

SEQ ID NO: 2522950 - protein, 21 aa, Entamoeba dispar
ENINQIFEIITRNILEQKYQR

SEQ ID NO: 2522951 - protein, 29 aa, Entamoeba dispar
ENIQFEGDVFERLIIKRNIPREFYDSVSY

SEQ ID NO: 2522952 - protein, 30 aa, Entamoeba dispar
ENIRQDICYACLPLEFLKKEEYLTLAMTKQ

SEQ ID NO: 2522953 - protein, 24 aa, Entamoeba dispar
ENIRYIPTYIFVIDITCTELELEE

SEQ ID NO: 2522954 - protein, 18 aa, Entamoeba dispar
ENISEDIFLVSVSPIEGN

SEQ ID NO: 2522955 - protein, 18 aa, Entamoeba dispar
ENIVRFYGVIVKKQFSMV

SEQ ID NO: 2522956 - protein, 20 aa, Entamoeba dispar
ENIYPSYPYNFLQLSIKEMA

SEQ ID NO: 2522957 - protein, 17 aa, Entamoeba dispar
ENKDMHKLIIPKHIKRL

SEQ ID NO: 2522958 - protein, 24 aa, Entamoeba dispar
ENKEIEFGVIPRSFIDPYIYQIQE

SEQ ID NO: 2522959 - protein, 31 aa, Entamoeba dispar
ENKEKIIVKNKFIPVIPLQTNYIKMIMENGI

SEQ ID NO: 2522960 - protein, 24 aa, Entamoeba dispar
ENKENILLPLCKRLIYNEISMKSK

SEQ ID NO: 2522961 - protein, 25 aa, Entamoeba dispar
ENKFCKLYVRFIQTLRQQNGLTQNV

SEQ ID NO: 2522962 - protein, 18 aa, Entamoeba dispar
ENKFLWDYMVEYGISNAK

SEQ ID NO: 2522963 - protein, 31 aa, Entamoeba dispar
ENKITSINKLLLKPSLFLNLTNNQITSIGDI

SEQ ID NO: 2522964 - protein, 23 aa, Entamoeba dispar
ENKKGNFYSIKLQEKDAKKEKRN

SEQ ID NO: 2522965 - protein, 26 aa, Entamoeba dispar
ENKKNIKRWLVICRTELIFKKNMEDF

SEQ ID NO: 2522966 - protein, 25 aa, Entamoeba dispar
ENKKSLTVFFNLYSTVYPSSPIAHD

SEQ ID NO: 2522967 - protein, 35 aa, Entamoeba dispar
ENKNVIIYSCLMGRIGVLIPFNFREDVEFFSKLEM

SEQ ID NO: 2522968 - protein, 27 aa, Entamoeba dispar
ENKQNNAMIYLVIKEGYKVTIRRNKKE

SEQ ID NO: 2522969 - protein, 23 aa, Entamoeba dispar
ENKRPQELFYYNSKNTSRNETKD

SEQ ID NO: 2522970 - protein, 24 aa, Entamoeba dispar
ENKVEWKLIVKKSENWLASKPAIS

SEQ ID NO: 2522971 - protein, 24 aa, Entamoeba dispar
ENKVINEFIIPSSISKLGYGCFYK

SEQ ID NO: 2522972 - protein, 27 aa, Entamoeba dispar
ENKVLGWLKIIFYPRNYFRTKYNDNLL

SEQ ID NO: 2522973 - protein, 18 aa, Entamoeba dispar
ENKYRIEPSFVLAILCGI

SEQ ID NO: 2522974 - protein, 27 aa, Entamoeba dispar
ENKYYSISILLQAWKKRYLLKQSFPEI

SEQ ID NO: 2522975 - protein, 24 aa, Entamoeba dispar
ENLCKKFPFAQEDTLYLLQYLVDE

SEQ ID NO: 2522976 - protein, 25 aa, Entamoeba dispar
ENLDKAGEAVFWNNPKDFVASTNEN

SEQ ID NO: 2522977 - protein, 24 aa, Entamoeba dispar
ENLELIKHIGTQLICICIEKIERS

SEQ ID NO: 2522978 - protein, 24 aa, Entamoeba dispar
ENLEMEISILSLISSGLKWVRFGA

SEQ ID NO: 2522979 - protein, 18 aa, Entamoeba dispar
ENLIINHKILAKCSSIAI

SEQ ID NO: 2522980 - protein, 20 aa, Entamoeba dispar
ENLKALLRRGKAYLEKGQIE

SEQ ID NO: 2522981 - protein, 21 aa, Entamoeba dispar
ENLKALLRRGKAYLEKGQIEK

SEQ ID NO: 2522982 - protein, 25 aa, Entamoeba dispar
ENLKNYDIVLREIYLFNDKFKKKDI

SEQ ID NO: 2522983 - protein, 28 aa, Entamoeba dispar
ENLKRKIANGLIFIKWGYSDIVDVMQEI

SEQ ID NO: 2522984 - protein, 22 aa, Entamoeba dispar
ENLKYIIKYITIWNKSHTKTIE

SEQ ID NO: 2522985 - protein, 17 aa, Entamoeba dispar
ENLLFLQNDWNTKINQI

SEQ ID NO: 2522986 - protein, 25 aa, Entamoeba dispar
ENLQEVFLQLIIKEVPLSSWKEYLI

SEQ ID NO: 2522987 - protein, 22 aa, Entamoeba dispar
ENLRLQIELLKRENNDLKNKTI

SEQ ID NO: 2522988 - protein, 19 aa, Entamoeba dispar
ENMILFNKYPIDVELYSEQ

SEQ ID NO: 2522989 - protein, 53 aa, Entamoeba dispar
ENMIYHFEGKQYVLTFPRKVIKIYPLNVPFSLEYVVMIFWNGISINHLNLKEG

SEQ ID NO: 2522990 - protein, 24 aa, Entamoeba dispar
ENMNQNDLLFFWKELIQIACNGIA

SEQ ID NO: 2522991 - protein, 21 aa, Entamoeba dispar
ENMRDFFTIVIKLLDSDGDNE

SEQ ID NO: 2522992 - protein, 26 aa, Entamoeba dispar
ENMSYICWDPMGLFLGAVRSYVYSPH

SEQ ID NO: 2522993 - protein, 29 aa, Entamoeba dispar
ENNELSETLLFIRNLSYSINDKKLKELFA

SEQ ID NO: 2522994 - protein, 27 aa, Entamoeba dispar
ENNHLECTLFLLTCGINNLIAAQTRIE

SEQ ID NO: 2522995 - protein, 30 aa, Entamoeba dispar
ENNKISYFSIYLFYLQTKKIKMDEGKLIKV

SEQ ID NO: 2522996 - protein, 23 aa, Entamoeba dispar
ENNPFIIAGFKYLDKVFTDAQIF

SEQ ID NO: 2522997 - protein, 17 aa, Entamoeba dispar
ENNQLIEMIRGKIWRIS

SEQ ID NO: 2522998 - protein, 25 aa, Entamoeba dispar
ENNQTILYYIKSIDILQPLAMGGFN

SEQ ID NO: 2522999 - protein, 19 aa, Entamoeba dispar
ENNRYLLLNGICVALKMGN

SEQ ID NO: 2523000 - protein, 26 aa, Entamoeba dispar
ENNVDYFIYDKITPNPLYTSVKECVD

SEQ ID NO: 2523001 - protein, 17 aa, Entamoeba dispar
ENNVKMFPAIQTQYIYG

SEQ ID NO: 2523002 - protein, 17 aa, Entamoeba dispar
ENPEFFLKILKSGGMLG

SEQ ID NO: 2523003 - protein, 28 aa, Entamoeba dispar
ENPEKHLSNYLLFFGSGSEIKSLVTGYY

SEQ ID NO: 2523004 - protein, 27 aa, Entamoeba dispar
ENPELIKQICFFLIPSVSLGYKDCFKE

SEQ ID NO: 2523005 - protein, 17 aa, Entamoeba dispar
ENPFLLLKPELKYDSFE

SEQ ID NO: 2523006 - protein, 23 aa, Entamoeba dispar
ENPIPVIEVKPIPSTTYNVIAEQ

SEQ ID NO: 2523007 - protein, 22 aa, Entamoeba dispar
ENQIYCGITAIIPTMMYAQSIG

SEQ ID NO: 2523008 - protein, 26 aa, Entamoeba dispar
ENQKSIQLDLYRDTKIPLPSNFIGTL

SEQ ID NO: 2523009 - protein, 20 aa, Entamoeba dispar
ENQMFQFIKCKEPGHTCCVL

SEQ ID NO: 2523010 - protein, 26 aa, Entamoeba dispar
ENQNTLWYIFSFLRRVLEQQNINKMN

SEQ ID NO: 2523011 - protein, 23 aa, Entamoeba dispar
ENQPTLPALLLKKISEADSDLLK

SEQ ID NO: 2523012 - protein, 25 aa, Entamoeba dispar
ENQTSSFLPMIGINSLKLVIKSAKN

SEQ ID NO: 2523013 - protein, 25 aa, Entamoeba dispar
ENQVAQYIRSIPDPAMRAGAKRRFD

SEQ ID NO: 2523014 - protein, 25 aa, Entamoeba dispar
ENRKEYLLEVIQKITLPLLTESDEI

SEQ ID NO: 2523015 - protein, 17 aa, Entamoeba dispar
ENRKHTDLYLWFCCAPH

SEQ ID NO: 2523016 - protein, 29 aa, Entamoeba dispar
ENRKMGMVSPPYPAVTPTAAVSDAIVAEQ

SEQ ID NO: 2523017 - protein, 27 aa, Entamoeba dispar
ENRQMLHRILFLFAIKHPELNYTQGMN

SEQ ID NO: 2523018 - protein, 40 aa, Entamoeba dispar
ENRYDEVIIFPYIHYYNLNDFLLIKLFKKSKKENKQIGGC

SEQ ID NO: 2523019 - protein, 28 aa, Entamoeba dispar
ENSAPMATLFFARLGPMMKEEILKKVCN

SEQ ID NO: 2523020 - protein, 24 aa, Entamoeba dispar
ENSEFPIFNLRVSCNKVILNNSTR

SEQ ID NO: 2523021 - protein, 20 aa, Entamoeba dispar
ENSEFPVFNLSVSCNKAILN

SEQ ID NO: 2523022 - protein, 26 aa, Entamoeba dispar
ENSELYHFTLHLPSNKANIINSTGVG

SEQ ID NO: 2523023 - protein, 22 aa, Entamoeba dispar
ENSFIITKIQRNIKYMKHIELI

SEQ ID NO: 2523024 - protein, 33 aa, Entamoeba dispar
ENSFISLGKVFIELLRIIKWSSIQKHIILVLNK

SEQ ID NO: 2523025 - protein, 17 aa, Entamoeba dispar
ENSWRIKKLAQVCNRQL

SEQ ID NO: 2523026 - protein, 25 aa, Entamoeba dispar
ENTDIQIFVIALNSIDSYEFVEGAP

SEQ ID NO: 2523027 - protein, 17 aa, Entamoeba dispar
ENTIGAAFLTKTLIVDG

SEQ ID NO: 2523028 - protein, 24 aa, Entamoeba dispar
ENTKRVIQFLAMTAGQSKKAGQLG

SEQ ID NO: 2523029 - protein, 27 aa, Entamoeba dispar
ENTLFTYSNFLSNLFKPLFEVSKNPQN

SEQ ID NO: 2523030 - protein, 17 aa, Entamoeba dispar
ENTLRSFKPPSQAIQIL

SEQ ID NO: 2523031 - protein, 19 aa, Entamoeba dispar
ENTLYILRGIREKYENHYG

SEQ ID NO: 2523032 - protein, 20 aa, Entamoeba dispar
ENTRLTNLLINRDEKIKLVE

SEQ ID NO: 2523033 - protein, 27 aa, Entamoeba dispar
ENTSRMTSFLFGAKSLIPFLENNNLTC

SEQ ID NO: 2523034 - protein, 19 aa, Entamoeba dispar
ENTTPTPFILKLYELVNNP

SEQ ID NO: 2523035 - protein, 31 aa, Entamoeba dispar
ENTVDDYCLYFYLTFFIMKETHFEDNEMLKK

SEQ ID NO: 2523036 - protein, 17 aa, Entamoeba dispar
ENVFVFGSEYRPVPLQQ

SEQ ID NO: 2523037 - protein, 22 aa, Entamoeba dispar
ENVFYYYAYNAFGGWVPTWVVN

SEQ ID NO: 2523038 - protein, 25 aa, Entamoeba dispar
ENVINIFFDCGLMSYLINIIKKPPS

SEQ ID NO: 2523039 - protein, 21 aa, Entamoeba dispar
ENVKAMWPRKGFYLGNFDIDY

SEQ ID NO: 2523040 - protein, 29 aa, Entamoeba dispar
ENVKNMIYRAFINLPYKTFPNYQSNLFDE

SEQ ID NO: 2523041 - protein, 25 aa, Entamoeba dispar
ENVQTRVKVLKRLVASLPDTNKYTL

SEQ ID NO: 2523042 - protein, 20 aa, Entamoeba dispar
ENVVNYFFFENGIALSIEPK

SEQ ID NO: 2523043 - protein, 36 aa, Entamoeba dispar
ENVVTYIECYLINEMLWLVMEYMNGGCLTDIIDRHK

SEQ ID NO: 2523044 - protein, 25 aa, Entamoeba dispar
ENWCGLKNHLILFDSSLPNGNSNET

SEQ ID NO: 2523045 - protein, 21 aa, Entamoeba dispar
ENWTVLKRLHCKCDICASERD

SEQ ID NO: 2523046 - protein, 18 aa, Entamoeba dispar
ENYDIVFRPIKTEINKLY

SEQ ID NO: 2523047 - protein, 29 aa, Entamoeba dispar
ENYKIHFYYRFLIILTDYKMYIYNMRKMK

SEQ ID NO: 2523048 - protein, 22 aa, Entamoeba dispar
ENYKYLRMLLLQPHNQICADCS

SEQ ID NO: 2523049 - protein, 26 aa, Entamoeba dispar
ENYPIDKNMYLVRWDNYSLLEATWIL

SEQ ID NO: 2523050 - protein, 18 aa, Entamoeba dispar
ENYSKLYFFVECLDGVDV

SEQ ID NO: 2523051 - protein, 29 aa, Entamoeba dispar
ENYTMKYYYYHLLLWPSITYLAESVDGKV

SEQ ID NO: 2523052 - protein, 28 aa, Entamoeba dispar
EPDGDIFKILLIHQDRILRNTLTTFPEE

SEQ ID NO: 2523053 - protein, 24 aa, Entamoeba dispar
EPDLMEIEICFFKGLEMRSKYQDE

SEQ ID NO: 2523054 - protein, 32 aa, Entamoeba dispar
EPDVNSFVKRLYYVMKEPSYLDWKLNVSGKIE

SEQ ID NO: 2523055 - protein, 17 aa, Entamoeba dispar
EPEVFPGLVYRMASPKV

SEQ ID NO: 2523056 - protein, 25 aa, Entamoeba dispar
EPFISTSILLYILFSIRRTRENVLE

SEQ ID NO: 2523057 - protein, 18 aa, Entamoeba dispar
EPFSKKYLIGNQKEIKNI

SEQ ID NO: 2523058 - protein, 23 aa, Entamoeba dispar
EPFSLLQLPIMKNLSFLKKVNLE

SEQ ID NO: 2523059 - protein, 19 aa, Entamoeba dispar
EPHGFLRNLATNLIPIYGQ

SEQ ID NO: 2523060 - protein, 28 aa, Entamoeba dispar
EPHYIEKMLCTIPTIVKCIILGENEKFI

SEQ ID NO: 2523061 - protein, 24 aa, Entamoeba dispar
EPIFYIIQCLYLIQNGLCQFCLDS

SEQ ID NO: 2523062 - protein, 25 aa, Entamoeba dispar
EPIPVRFMLTKINPYNFSLFVFHSS

SEQ ID NO: 2523063 - protein, 24 aa, Entamoeba dispar
EPKKLEFNGLQAVLNKVKTASPGI

SEQ ID NO: 2523064 - protein, 18 aa, Entamoeba dispar
EPKKLVTFFRQTIKVQGR

SEQ ID NO: 2523065 - protein, 17 aa, Entamoeba dispar
EPKMYHNHLEGLKKQRV

SEQ ID NO: 2523066 - protein, 23 aa, Entamoeba dispar
EPKSAIWELFKQNSSKAQISLEK

SEQ ID NO: 2523067 - protein, 29 aa, Entamoeba dispar
EPMNLKEIGIMKPLVPTLLKQICDKNIEL

SEQ ID NO: 2523068 - protein, 24 aa, Entamoeba dispar
EPNAILDIFFLHCKKWGLNPNAAT

SEQ ID NO: 2523069 - protein, 26 aa, Entamoeba dispar
EPNEDVFFYFTKYISFQANKGLKKSH

SEQ ID NO: 2523070 - protein, 17 aa, Entamoeba dispar
EPNFSNHILINPKTPNV

SEQ ID NO: 2523071 - protein, 24 aa, Entamoeba dispar
EPNRPFIDIIASFKPFVSKISKAK

SEQ ID NO: 2523072 - protein, 24 aa, Entamoeba dispar
EPNSKWVIFTMIELYQITKKIDNT

SEQ ID NO: 2523073 - protein, 22 aa, Entamoeba dispar
EPPRGILLHGPPGCGKTLLAKA

SEQ ID NO: 2523074 - protein, 17 aa, Entamoeba dispar
EPQDLIEYPYQQYQIGY

SEQ ID NO: 2523075 - protein, 23 aa, Entamoeba dispar
EPQELFCYSTADKTIKNKEVRKQ

SEQ ID NO: 2523076 - protein, 21 aa, Entamoeba dispar
EPQIGLIIYVANLHFDITEEL

SEQ ID NO: 2523077 - protein, 17 aa, Entamoeba dispar
EPQLFISSLIKNVPKSI

SEQ ID NO: 2523078 - protein, 30 aa, Entamoeba dispar
EPQVNGLLKKFFYTMKDPQYLEWKLNNDQN

SEQ ID NO: 2523079 - protein, 17 aa, Entamoeba dispar
EPREFFDTLYHRCLFET

SEQ ID NO: 2523080 - protein, 35 aa, Entamoeba dispar
EPRIKLFVEFLTKKWFFTLFTHWNYYVRQAFHHFI

SEQ ID NO: 2523081 - protein, 20 aa, Entamoeba dispar
EPSETKFISYFIVTIVITKI

SEQ ID NO: 2523082 - protein, 24 aa, Entamoeba dispar
EPSGQIEWWDKIYFTSDQITDYPN

SEQ ID NO: 2523083 - protein, 24 aa, Entamoeba dispar
EPSHQRFPIIKKLNGEPIRLMDYG

SEQ ID NO: 2523084 - protein, 39 aa, Entamoeba dispar
EPSLSYSIKFKLFKKLKKIMDLGFKGPFLIITDKENLGF

SEQ ID NO: 2523085 - protein, 24 aa, Entamoeba dispar
EPSSKPPSRPIPNNKRRTSIDPLE

SEQ ID NO: 2523086 - protein, 27 aa, Entamoeba dispar
EPSTVKRLLTTLIPIYGQYQGYRCGCN

SEQ ID NO: 2523087 - protein, 30 aa, Entamoeba dispar
EPSVNGLLKRYFYLMKEPSYIDWKLNNSDK

SEQ ID NO: 2523088 - protein, 23 aa, Entamoeba dispar
EPSWESQWGPGRPGWHIECSAMA

SEQ ID NO: 2523089 - protein, 28 aa, Entamoeba dispar
EPTEILKSILFFIFKEKKEKIINFICEE

SEQ ID NO: 2523090 - protein, 19 aa, Entamoeba dispar
EPTENELHLIRLARENNTD

SEQ ID NO: 2523091 - protein, 30 aa, Entamoeba dispar
EPTKRRDIFFLLLHGIKLKNLDYPIPNNED

SEQ ID NO: 2523092 - protein, 23 aa, Entamoeba dispar
EPTKWELFAKRKGIKKTKKSGKV

SEQ ID NO: 2523093 - protein, 27 aa, Entamoeba dispar
EPTNGILNFLLFKIGGESFQTLYDSKQ

SEQ ID NO: 2523094 - protein, 17 aa, Entamoeba dispar
EPVAALLEYKRTHNDIL

SEQ ID NO: 2523095 - protein, 28 aa, Entamoeba dispar
EPVEQLKSFIPLLIATKGRFEYDLGKDD

SEQ ID NO: 2523096 - protein, 36 aa, Entamoeba dispar
EPVKDFYSDPILLIDFKSLYPSIIMEFGVCFLNSQL

SEQ ID NO: 2523097 - protein, 17 aa, Entamoeba dispar
EPVLISCEIPHNLQIIN

SEQ ID NO: 2523098 - protein, 25 aa, Entamoeba dispar
EPVLYTNRFLYNVLFSTGETLNDVL

SEQ ID NO: 2523099 - protein, 34 aa, Entamoeba dispar
EPVVNSQLLLLLLKLHPTPFIPITFHSQIKEKYK

SEQ ID NO: 2523100 - protein, 27 aa, Entamoeba dispar
EPYSIYTYRYFLKSWPHLCFFAKDKTT

SEQ ID NO: 2523101 - protein, 18 aa, Entamoeba dispar
EQAAYFQYLIGITCIDKL

SEQ ID NO: 2523102 - protein, 26 aa, Entamoeba dispar
EQAEAMIKLLIVYFKSLYSQKEIDTR

SEQ ID NO: 2523103 - protein, 22 aa, Entamoeba dispar
EQAILVLQDLLRTNPRGNLQII

SEQ ID NO: 2523104 - protein, 29 aa, Entamoeba dispar
EQALLYNKLFDIFPLLLKQTLSLLTSNSG

SEQ ID NO: 2523105 - protein, 26 aa, Entamoeba dispar
EQAYDIKYPLPKCDWIALPDFEAGAM

SEQ ID NO: 2523106 - protein, 23 aa, Entamoeba dispar
EQAYTYGVLTKVVMLINGIGDND

SEQ ID NO: 2523107 - protein, 23 aa, Entamoeba dispar
EQCDHELLVGFLKYGFESRELIQ

SEQ ID NO: 2523108 - protein, 18 aa, Entamoeba dispar
EQCIALMNGRWFDKHQLS

SEQ ID NO: 2523109 - protein, 24 aa, Entamoeba dispar
EQDEAFIGKILYKVSLIGKKECPE

SEQ ID NO: 2523110 - protein, 30 aa, Entamoeba dispar
EQDKSNITPPLTPPIEKKVMFSVTQAPSIT

SEQ ID NO: 2523111 - protein, 23 aa, Entamoeba dispar
EQEKDNLLIPNEKAKLSAQKDSS

SEQ ID NO: 2523112 - protein, 25 aa, Entamoeba dispar
EQEKKRTLLQLTTNQMKKAVVEKLK

SEQ ID NO: 2523113 - protein, 24 aa, Entamoeba dispar
EQENLFRAFFDFDNSNPPPSFKIS

SEQ ID NO: 2523114 - protein, 23 aa, Entamoeba dispar
EQENLMVLQLFKQNLECFEKSSE

SEQ ID NO: 2523115 - protein, 24 aa, Entamoeba dispar
EQEQIDFALSLLNPIFKEVSVEEV

SEQ ID NO: 2523116 - protein, 24 aa, Entamoeba dispar
EQESLPPPIVLDQPLEEVPSKRVA

SEQ ID NO: 2523117 - protein, 18 aa, Entamoeba dispar
EQFHRSTQIPKYQKSFIP

SEQ ID NO: 2523118 - protein, 36 aa, Entamoeba dispar
EQFIDAAPPAYLLAGLYLIDSLIRYLSDENAITVEQ

SEQ ID NO: 2523119 - protein, 24 aa, Entamoeba dispar
EQFKLTLCCLPIFELYGIFLLQLF

SEQ ID NO: 2523120 - protein, 18 aa, Entamoeba dispar
EQFKYNGMQLERIGRKFN

SEQ ID NO: 2523121 - protein, 23 aa, Entamoeba dispar
EQFLKYFETFGPIKCGADGKKFY

SEQ ID NO: 2523122 - protein, 17 aa, Entamoeba dispar
EQFYKDLFNRNIPEILY

SEQ ID NO: 2523123 - protein, 23 aa, Entamoeba dispar
EQGHSFLFSDKLALWKGDITKLS

SEQ ID NO: 2523124 - protein, 26 aa, Entamoeba dispar
EQHDIICDVLLFRKTLFDCYNEYIRN

SEQ ID NO: 2523125 - protein, 19 aa, Entamoeba dispar
EQHFIFFEKVTENANYDGS

SEQ ID NO: 2523126 - protein, 25 aa, Entamoeba dispar
EQIITILIQRLLTSKPLQLGVIVTF

SEQ ID NO: 2523127 - protein, 18 aa, Entamoeba dispar
EQIIVLGATNRPFDLDDA

SEQ ID NO: 2523128 - protein, 25 aa, Entamoeba dispar
EQIKIDPFISLKKLTKSKYYQEEFK

SEQ ID NO: 2523129 - protein, 24 aa, Entamoeba dispar
EQINLFVNPIGCGDSFTAGLSASL

SEQ ID NO: 2523130 - protein, 34 aa, Entamoeba dispar
EQIRKKLENLNPLKKFFVIRDPDLGAPQGKCYCL

SEQ ID NO: 2523131 - protein, 19 aa, Entamoeba dispar
EQISSVLTPLITLSRNIVN

SEQ ID NO: 2523132 - protein, 24 aa, Entamoeba dispar
EQKKKYIDQYYASKAEYNDKLKEY

SEQ ID NO: 2523133 - protein, 29 aa, Entamoeba dispar
EQKKPTIDYFFFVHGLLALSINPKEHWAP

SEQ ID NO: 2523134 - protein, 18 aa, Entamoeba dispar
EQKLLVIKIIPLMEICDD

SEQ ID NO: 2523135 - protein, 22 aa, Entamoeba dispar
EQKNKRWIIVQQQAFTHWVNET

SEQ ID NO: 2523136 - protein, 25 aa, Entamoeba dispar
EQKPIFKISMFLFQQRDSKADKAIL

SEQ ID NO: 2523137 - protein, 22 aa, Entamoeba dispar
EQLERKRFIGNDIVVIIFKEQS

SEQ ID NO: 2523138 - protein, 23 aa, Entamoeba dispar
EQLFEQLPKFNYLHKVIIRCDSN

SEQ ID NO: 2523139 - protein, 41 aa, Entamoeba dispar
EQLGFPRVKIFLENLLQKKYKEALIPTLNKLNGFVNKSQNE

SEQ ID NO: 2523140 - protein, 21 aa, Entamoeba dispar
EQLHLLIDLLTEFGYSFVSKW

SEQ ID NO: 2523141 - protein, 17 aa, Entamoeba dispar
EQLIKEITFLSSSCSMG

SEQ ID NO: 2523142 - protein, 20 aa, Entamoeba dispar
EQLKFIQLYCPTITLRYANP

SEQ ID NO: 2523143 - protein, 23 aa, Entamoeba dispar
EQLKFPNFLQRYTTQYYVPNIDD

SEQ ID NO: 2523144 - protein, 26 aa, Entamoeba dispar
EQLKNKLLKIIIKRIHIQKPVHIETD

SEQ ID NO: 2523145 - protein, 25 aa, Entamoeba dispar
EQLKNKLLKIIIKRIHIQKQVHIKT

SEQ ID NO: 2523146 - protein, 17 aa, Entamoeba dispar
EQLMNIIPLLLNEKTFA

SEQ ID NO: 2523147 - protein, 21 aa, Entamoeba dispar
EQLPLKLGTLVMLLKNTQPEI

SEQ ID NO: 2523148 - protein, 26 aa, Entamoeba dispar
EQLQKWIEERKKRFPTKAKREKCLFE

SEQ ID NO: 2523149 - protein, 23 aa, Entamoeba dispar
EQLQSMYSPLFKILNILPQITND

SEQ ID NO: 2523150 - protein, 25 aa, Entamoeba dispar
EQLSLAFEIIYDKEYLFFCKTKEEF

SEQ ID NO: 2523151 - protein, 19 aa, Entamoeba dispar
EQLTMWKNEFLKNCTTNKN

SEQ ID NO: 2523152 - protein, 32 aa, Entamoeba dispar
EQLTVMQALVLKHRWFPKLVKSKEPIVVSVGW

SEQ ID NO: 2523153 - protein, 25 aa, Entamoeba dispar
EQMEQLILQAQNEVKKRIYQENEIV

SEQ ID NO: 2523154 - protein, 27 aa, Entamoeba dispar
EQNELFFRYFSLIQNSVYHRFALFQIE

SEQ ID NO: 2523155 - protein, 26 aa, Entamoeba dispar
EQNGFTLDKLIDYQPKRSLEPSRGKN

SEQ ID NO: 2523156 - protein, 18 aa, Entamoeba dispar
EQNGWIRQAKEASKQIDS

SEQ ID NO: 2523157 - protein, 24 aa, Entamoeba dispar
EQNKILIEELLNQQILQFNIYGQP

SEQ ID NO: 2523158 - protein, 26 aa, Entamoeba dispar
EQNLLPIKLLHLFTTPFYLTPTTYPQ

SEQ ID NO: 2523159 - protein, 22 aa, Entamoeba dispar
EQNLPSKLLIITLKSIRNVCRF

SEQ ID NO: 2523160 - protein, 23 aa, Entamoeba dispar
EQNNKMFNMLDKIKTQLIDLEHK

SEQ ID NO: 2523161 - protein, 27 aa, Entamoeba dispar
EQPFLSIENYFYLFKEQIIINDIENYV

SEQ ID NO: 2523162 - protein, 23 aa, Entamoeba dispar
EQPVEMNLMDFLGTESITEEIDE

SEQ ID NO: 2523163 - protein, 19 aa, Entamoeba dispar
EQQIFPRNDPLTTLSIQST

SEQ ID NO: 2523164 - protein, 21 aa, Entamoeba dispar
EQQLYLGMLLNSTTEVCLLNN

SEQ ID NO: 2523165 - protein, 23 aa, Entamoeba dispar
EQQSQIECPFWLAPEIFKGEQWT

SEQ ID NO: 2523166 - protein, 22 aa, Entamoeba dispar
EQQTFQRFAYNSAIISGDYCIF

SEQ ID NO: 2523167 - protein, 27 aa, Entamoeba dispar
EQRANAELLISYYNTRIEVLKTNIEMI

SEQ ID NO: 2523168 - protein, 23 aa, Entamoeba dispar
EQREMSVVFIGGGLFHAEAVAYN

SEQ ID NO: 2523169 - protein, 21 aa, Entamoeba dispar
EQRYKAISLVVNKLGDLNGKV

SEQ ID NO: 2523170 - protein, 25 aa, Entamoeba dispar
EQSEHLCNLLLYLPSELSIKEMLNP

SEQ ID NO: 2523171 - protein, 24 aa, Entamoeba dispar
EQSEKLVRYIFQLAMYDNSFDIRD

SEQ ID NO: 2523172 - protein, 25 aa, Entamoeba dispar
EQSIRQIIQLPLSKPAYNAYGHIIY

SEQ ID NO: 2523173 - protein, 24 aa, Entamoeba dispar
EQSRPIVMIMKKNPMEFPNGIQAK

SEQ ID NO: 2523174 - protein, 31 aa, Entamoeba dispar
EQSTLSLLPMNQLCNLLLTYLCTYYKINVST

SEQ ID NO: 2523175 - protein, 27 aa, Entamoeba dispar
EQTINGFIIVSLHNIWFLNSVGEIEAS

SEQ ID NO: 2523176 - protein, 23 aa, Entamoeba dispar
EQTLFIWINIGIIKRLFDLYGTD

SEQ ID NO: 2523177 - protein, 24 aa, Entamoeba dispar
EQTNVIRMLFKVPVITNREFVFDC

SEQ ID NO: 2523178 - protein, 24 aa, Entamoeba dispar
EQTVIINQQPIVSTSLISQQKILK

SEQ ID NO: 2523179 - protein, 24 aa, Entamoeba dispar
EQVETACYQLEMLKYLIHCHNEAE

SEQ ID NO: 2523180 - protein, 24 aa, Entamoeba dispar
EQVKLLGDKIGELQLEKSKYLEDI

SEQ ID NO: 2523181 - protein, 21 aa, Entamoeba dispar
EQVLEQIFLSDVYTAKHVISD

SEQ ID NO: 2523182 - protein, 28 aa, Entamoeba dispar
EQVMERFMKVLYLERVLSEMLIANSHGN

SEQ ID NO: 2523183 - protein, 24 aa, Entamoeba dispar
EQVMNIIYKFDFFDFILTELRNSF

SEQ ID NO: 2523184 - protein, 34 aa, Entamoeba dispar
EQVSDIMRMLPPTRQILLFSATLPRNLAEFLKNT

SEQ ID NO: 2523185 - protein, 18 aa, Entamoeba dispar
EQWAIIFDECARKLFNMS

SEQ ID NO: 2523186 - protein, 32 aa, Entamoeba dispar
EQWHNALQYLRLNPPFKFLNPAYEGIFLSINE

SEQ ID NO: 2523187 - protein, 30 aa, Entamoeba dispar
EQWNKAIVGLLKLFNYLSINFDRLLDIIEK

SEQ ID NO: 2523188 - protein, 26 aa, Entamoeba dispar
EQYKLNILFFHCKLLLFHISEDSYEV

SEQ ID NO: 2523189 - protein, 17 aa, Entamoeba dispar
EQYTQDFKKRFSLLLGF

SEQ ID NO: 2523190 - protein, 25 aa, Entamoeba dispar
ERAKALSLLKILVTVTYEADNDFLL

SEQ ID NO: 2523191 - protein, 21 aa, Entamoeba dispar
ERAKDRREFVFGKASEEEKKR

SEQ ID NO: 2523192 - protein, 18 aa, Entamoeba dispar
ERAMGIVIGNIKKWKFNC

SEQ ID NO: 2523193 - protein, 19 aa, Entamoeba dispar
ERCFIWCSSLSEINIPKSI

SEQ ID NO: 2523194 - protein, 22 aa, Entamoeba dispar
ERDIAKIFETPLPGPITPPQNT

SEQ ID NO: 2523195 - protein, 28 aa, Entamoeba dispar
ERDRNYEFKLYQLLHVGLTVDIFCYSLT

SEQ ID NO: 2523196 - protein, 25 aa, Entamoeba dispar
ERDSTVIWIYYHLINELEEESKKQI

SEQ ID NO: 2523197 - protein, 18 aa, Entamoeba dispar
EREAYLVEDIALTAINFI

SEQ ID NO: 2523198 - protein, 29 aa, Entamoeba dispar
EREEEKKPILPKYLIKKIERQEEIKKERA

SEQ ID NO: 2523199 - protein, 24 aa, Entamoeba dispar
EREEFFRLKLIQNKKKKAIAIKEA

SEQ ID NO: 2523200 - protein, 29 aa, Entamoeba dispar
EREELYQPWRRSLDLKPCDIHIVVNFARQ

SEQ ID NO: 2523201 - protein, 17 aa, Entamoeba dispar
EREIEGLLYCIKPTMFS

SEQ ID NO: 2523202 - protein, 24 aa, Entamoeba dispar
EREKIMMGVIAPPKVKLKLSNMAK

SEQ ID NO: 2523203 - protein, 26 aa, Entamoeba dispar
EREQAERIKRAIAERKAQLAQRLELD

SEQ ID NO: 2523204 - protein, 18 aa, Entamoeba dispar
ERERLVFEYLFQLQELKS

SEQ ID NO: 2523205 - protein, 19 aa, Entamoeba dispar
ERFHFNPIPLDEYSRKFFP

SEQ ID NO: 2523206 - protein, 21 aa, Entamoeba dispar
ERFHFNPIPLDEYSRKFFPNI

SEQ ID NO: 2523207 - protein, 19 aa, Entamoeba dispar
ERFHFNPIPLDEYSRRFFP

SEQ ID NO: 2523208 - protein, 24 aa, Entamoeba dispar
ERFHFNPIPLDKYSRKLFPNIETF

SEQ ID NO: 2523209 - protein, 25 aa, Entamoeba dispar
ERFHFNPIPLHNYSRRFFPNIETFH

SEQ ID NO: 2523210 - protein, 23 aa, Entamoeba dispar
ERFHFNPIPLNDYSRRLFPNIET

SEQ ID NO: 2523211 - protein, 17 aa, Entamoeba dispar
ERFHFNPIPLNEHSREF

SEQ ID NO: 2523212 - protein, 21 aa, Entamoeba dispar
ERFHFNPIPLNEHSRKFFPNI

SEQ ID NO: 2523213 - protein, 21 aa, Entamoeba dispar
ERFHFNPIPLNEHSRKLFPNI

SEQ ID NO: 2523214 - protein, 17 aa, Entamoeba dispar
ERFHFNPIPLNEYSRKL

SEQ ID NO: 2523215 - protein, 18 aa, Entamoeba dispar
ERFHFNPIPLNEYSRKLF

SEQ ID NO: 2523216 - protein, 22 aa, Entamoeba dispar
ERFHFNPIPLNEYSRKLFPNIE

SEQ ID NO: 2523217 - protein, 23 aa, Entamoeba dispar
ERFHFNPIPLNEYSRRLFPNIET

SEQ ID NO: 2523218 - protein, 18 aa, Entamoeba dispar
ERFHFNPIPLNHYSRKLF

SEQ ID NO: 2523219 - protein, 23 aa, Entamoeba dispar
ERFHFNPIPLNKYSRKLFTNIET

SEQ ID NO: 2523220 - protein, 23 aa, Entamoeba dispar
ERFHFNPIPLNKYSRRLFTNIET

SEQ ID NO: 2523221 - protein, 23 aa, Entamoeba dispar
ERFHFNPIPLNQYSRKLFPNIET

SEQ ID NO: 2523222 - protein, 22 aa, Entamoeba dispar
ERFHFNPIPLNQYSRKLFTNIE

SEQ ID NO: 2523223 - protein, 23 aa, Entamoeba dispar
ERFHFNPISLNKYSRKLFPNIET

SEQ ID NO: 2523224 - protein, 19 aa, Entamoeba dispar
ERFHFNPITLNEYSRKFFP

SEQ ID NO: 2523225 - protein, 28 aa, Entamoeba dispar
ERFLCPEILFRPELFINDDILAKGLDVA

SEQ ID NO: 2523226 - protein, 20 aa, Entamoeba dispar
ERFMNITAAYFRNTTAVIIV

SEQ ID NO: 2523227 - protein, 24 aa, Entamoeba dispar
ERFRSLISNFYRGSSGIIVCYDVS

SEQ ID NO: 2523228 - protein, 42 aa, Entamoeba dispar
ERFVDIFHGKPVKLFLDTLSSYKIIFPRIQYCKILNSSTNTY

SEQ ID NO: 2523229 - protein, 19 aa, Entamoeba dispar
ERGAVIIPIYYQNNQKVEL

SEQ ID NO: 2523230 - protein, 26 aa, Entamoeba dispar
ERGDLYIYFEVKFPTTTEIKNSLNAL

SEQ ID NO: 2523231 - protein, 24 aa, Entamoeba dispar
ERGERLIKLFGLLDEENFKKMMKK

SEQ ID NO: 2523232 - protein, 28 aa, Entamoeba dispar
ERGTRSLWIWRNCKSYLFDDFKDILSLP

SEQ ID NO: 2523233 - protein, 29 aa, Entamoeba dispar
ERIADALKVLFPFSFTSIMSLFEGKNGIC

SEQ ID NO: 2523234 - protein, 23 aa, Entamoeba dispar
ERICYSIFMALSHCFKDFNQEDI

SEQ ID NO: 2523235 - protein, 36 aa, Entamoeba dispar
ERIEGALFNYFLTEHWAPLKNILRRYQIYLKEEITN

SEQ ID NO: 2523236 - protein, 37 aa, Entamoeba dispar
ERIEGYITLTFNKPIFIKNILVCLSSVHYFGITPLGG

SEQ ID NO: 2523237 - protein, 23 aa, Entamoeba dispar
ERIFMNEPVLISIKIPRNLKIIN

SEQ ID NO: 2523238 - protein, 30 aa, Entamoeba dispar
ERIFMNEPVLIWIEIPRNLKIINGKNIEKK

SEQ ID NO: 2523239 - protein, 25 aa, Entamoeba dispar
ERIIKDIDLRLVEQQRFSLKQLDTV

SEQ ID NO: 2523240 - protein, 18 aa, Entamoeba dispar
ERIKECVNILSSIALNNK

SEQ ID NO: 2523241 - protein, 27 aa, Entamoeba dispar
ERIKNILRPIFHFINDLNPEAINDQNY

SEQ ID NO: 2523242 - protein, 26 aa, Entamoeba dispar
ERILNSMYELWILGALDEIGNITKLG

SEQ ID NO: 2523243 - protein, 19 aa, Entamoeba dispar
ERIMIILEEKLSKNSKLYE

SEQ ID NO: 2523244 - protein, 26 aa, Entamoeba dispar
ERINKLVCVNPIRSRYCGNVGYVVVG

SEQ ID NO: 2523245 - protein, 26 aa, Entamoeba dispar
ERIQSPPIPSILMQNSEYPTLLDDID

SEQ ID NO: 2523246 - protein, 20 aa, Entamoeba dispar
ERKASFLTRPKKGVNTNESE

SEQ ID NO: 2523247 - protein, 26 aa, Entamoeba dispar
ERKDFKDPFFFKKNKIKKSKKIDNSS

SEQ ID NO: 2523248 - protein, 21 aa, Entamoeba dispar
ERKEFSGTAIGRLCIGKDDQS

SEQ ID NO: 2523249 - protein, 27 aa, Entamoeba dispar
ERKFELRFIVLMKYDILWKSQKPDIYL

SEQ ID NO: 2523250 - protein, 22 aa, Entamoeba dispar
ERKKEIFKKQYQIAINEREKQE

SEQ ID NO: 2523251 - protein, 26 aa, Entamoeba dispar
ERKKIIYNLTIMNLAIHAFFSQPSSN

SEQ ID NO: 2523252 - protein, 36 aa, Entamoeba dispar
ERKMNILMEMGFPDYICIFALKKYKWNVEESIPWII

SEQ ID NO: 2523253 - protein, 25 aa, Entamoeba dispar
ERKPVPLAIHHIPITVSFGITDSGV

SEQ ID NO: 2523254 - protein, 27 aa, Entamoeba dispar
ERKRCGKYLFTLGMISSWNNGEIETAW

SEQ ID NO: 2523255 - protein, 26 aa, Entamoeba dispar
ERKSQGFVIVTYYDIRNAKVAIKILQ

SEQ ID NO: 2523256 - protein, 24 aa, Entamoeba dispar
ERKSRILFVRNISFNANEESIRKL

SEQ ID NO: 2523257 - protein, 29 aa, Entamoeba dispar
ERKVFGVPMLIAFTYNYPLSPPELSCFIS

SEQ ID NO: 2523258 - protein, 24 aa, Entamoeba dispar
ERKYGNYWQQLMIGFVSLKGELEK

SEQ ID NO: 2523259 - protein, 21 aa, Entamoeba dispar
ERLETAIYLQFHSNPTVRVTD

SEQ ID NO: 2523260 - protein, 35 aa, Entamoeba dispar
ERLIEIYFRFKDVKHWKYWNLMKWVVEHKLPESGS

SEQ ID NO: 2523261 - protein, 30 aa, Entamoeba dispar
ERLRQKKLEYLFSQLIRYVPQFNKEAQSAL

SEQ ID NO: 2523262 - protein, 23 aa, Entamoeba dispar
ERLSKRFQIMIYTASRKEYADQV

SEQ ID NO: 2523263 - protein, 25 aa, Entamoeba dispar
ERMIKLICNVFPTEGFWEHVCVVWT

SEQ ID NO: 2523264 - protein, 20 aa, Entamoeba dispar
ERMSLFLDEHNIGLATYKAW

SEQ ID NO: 2523265 - protein, 18 aa, Entamoeba dispar
ERMYGCLAKFALVQPIRR

SEQ ID NO: 2523266 - protein, 18 aa, Entamoeba dispar
ERNDPIIHELLVGKIPIT

SEQ ID NO: 2523267 - protein, 21 aa, Entamoeba dispar
ERNIEIIPKVLPQRLDAKGVI

SEQ ID NO: 2523268 - protein, 18 aa, Entamoeba dispar
ERNIWEKEFKKCLNLIFL

SEQ ID NO: 2523269 - protein, 25 aa, Entamoeba dispar
ERNNVFFKWSCFEYNYNHQPISRNG

SEQ ID NO: 2523270 - protein, 26 aa, Entamoeba dispar
ERNYCYRQELCSMFPPLVIESLINKY

SEQ ID NO: 2523271 - protein, 20 aa, Entamoeba dispar
ERPERMVKGPYLGSVVFGTK

SEQ ID NO: 2523272 - protein, 20 aa, Entamoeba dispar
ERPRKFSLTLQRGKGPIQFN

SEQ ID NO: 2523273 - protein, 21 aa, Entamoeba dispar
ERQKRIFDESFFDIIPDSEEY

SEQ ID NO: 2523274 - protein, 33 aa, Entamoeba dispar
ERRIRLLNPVQTDMLLFLKLVDYFQDDNDKELK

SEQ ID NO: 2523275 - protein, 19 aa, Entamoeba dispar
ERRKDFIKRAHIRKLQEET

SEQ ID NO: 2523276 - protein, 22 aa, Entamoeba dispar
ERRPFKCILDVGLARTTTGSKV

SEQ ID NO: 2523277 - protein, 28 aa, Entamoeba dispar
ERRSQKTLQLFLIESLTLPSGEIIEYEN

SEQ ID NO: 2523278 - protein, 20 aa, Entamoeba dispar
ERRVVAQLLTLMDGMKSRSN

SEQ ID NO: 2523279 - protein, 26 aa, Entamoeba dispar
ERSDHLLIDFADVLHVSVRRLGRTFI

SEQ ID NO: 2523280 - protein, 19 aa, Entamoeba dispar
ERSFGIVYIGEFRGNQVAI

SEQ ID NO: 2523281 - protein, 25 aa, Entamoeba dispar
ERSKQITSFLIPPIDFFIPDEHISP

SEQ ID NO: 2523282 - protein, 25 aa, Entamoeba dispar
ERSKQIVELLTDNDYLKQARITAKN

SEQ ID NO: 2523283 - protein, 25 aa, Entamoeba dispar
ERSLNELILLLKDNLFTLSSDYSGD

SEQ ID NO: 2523284 - protein, 23 aa, Entamoeba dispar
ERSQILLQQLESKIARDLSREKK

SEQ ID NO: 2523285 - protein, 31 aa, Entamoeba dispar
ERTGNGYTIKFYYSGMFMEGLMSEMIDSVVT

SEQ ID NO: 2523286 - protein, 19 aa, Entamoeba dispar
ERTILMIRRKKGEIKECFR

SEQ ID NO: 2523287 - protein, 20 aa, Entamoeba dispar
ERTILMIRRKKGEIKECFRN

SEQ ID NO: 2523288 - protein, 26 aa, Entamoeba dispar
ERTKNAQFTIISLRPEMFELADRLMG

SEQ ID NO: 2523289 - protein, 22 aa, Entamoeba dispar
ERTLKVLKTEVFNFLDKKKQIE

SEQ ID NO: 2523290 - protein, 21 aa, Entamoeba dispar
ERTRYLVKWQKLPYTECTWEN

SEQ ID NO: 2523291 - protein, 24 aa, Entamoeba dispar
ERTVFPLRHDTLSSGLNISSILPP

SEQ ID NO: 2523292 - protein, 18 aa, Entamoeba dispar
ERVEGMLKNLILSTAFDS

SEQ ID NO: 2523293 - protein, 32 aa, Entamoeba dispar
ERVEYLLLHEFIKQTTLYILPDKKFGEGSQHK

SEQ ID NO: 2523294 - protein, 18 aa, Entamoeba dispar
ERVGIIFSHARREEILTS

SEQ ID NO: 2523295 - protein, 19 aa, Entamoeba dispar
ERVILGRLTNHLRMGIVGL

SEQ ID NO: 2523296 - protein, 27 aa, Entamoeba dispar
ERVKEALSLLLIWQTRQILPVQIEATI

SEQ ID NO: 2523297 - protein, 26 aa, Entamoeba dispar
ERYEQLLNQMYFIYENKKINKEENEI

SEQ ID NO: 2523298 - protein, 40 aa, Entamoeba dispar
ERYGESDYVLMFWNPSQPLEQWMIKDLLEGIDVKARGIRV

SEQ ID NO: 2523299 - protein, 30 aa, Entamoeba dispar
ERYLLTKQMSYLDIIPKCCGYQLPSLFEQH

SEQ ID NO: 2523300 - protein, 19 aa, Entamoeba dispar
ERYMIDGNKFILNVPSKSA

SEQ ID NO: 2523301 - protein, 28 aa, Entamoeba dispar
ERYNKLINYILMEISKIDIPIKTGTFIE

SEQ ID NO: 2523302 - protein, 28 aa, Entamoeba dispar
ERYPSKYLTLLSFLSHSLTIKGVKFQTA

SEQ ID NO: 2523303 - protein, 25 aa, Entamoeba dispar
ERYREIITKFPLLGESALSSAKDML

SEQ ID NO: 2523304 - protein, 23 aa, Entamoeba dispar
ERYRKWAQPIILKNKVVIAYGSA

SEQ ID NO: 2523305 - protein, 35 aa, Entamoeba dispar
ERYRSLSQIYYRDATVALLVYDITRLETFNAVTDW

SEQ ID NO: 2523306 - protein, 19 aa, Entamoeba dispar
ERYSCVVTTFYRGSDCCVL

SEQ ID NO: 2523307 - protein, 17 aa, Entamoeba dispar
ERYYALCVKYRSSPLLH

SEQ ID NO: 2523308 - protein, 26 aa, Entamoeba dispar
ESAFSNFMAYILISRGYKLHLNTNNM

SEQ ID NO: 2523309 - protein, 34 aa, Entamoeba dispar
ESAKQIFLFVVDMIDLLNAFIPLPNEFQQVKNFI

SEQ ID NO: 2523310 - protein, 25 aa, Entamoeba dispar
ESAVILKLIDFIKLTIVDKLNNSQQ

SEQ ID NO: 2523311 - protein, 20 aa, Entamoeba dispar
ESCLWIFINITSMSDVYVFH

SEQ ID NO: 2523312 - protein, 18 aa, Entamoeba dispar
ESCRRWCFLRIDIASTVP

SEQ ID NO: 2523313 - protein, 26 aa, Entamoeba dispar
ESDEIIPFNLILPTEKLSPSFKTIEG

SEQ ID NO: 2523314 - protein, 24 aa, Entamoeba dispar
ESDMIIEMLDLGIPYHKATVALSK

SEQ ID NO: 2523315 - protein, 26 aa, Entamoeba dispar
ESDVFTLVFFHCPQLQHISIIGISQT

SEQ ID NO: 2523316 - protein, 18 aa, Entamoeba dispar
ESEDYLRVLLLSNKVNRT

SEQ ID NO: 2523317 - protein, 30 aa, Entamoeba dispar
ESEEEILQYKFLIPIIPKLQANHFINFLES

SEQ ID NO: 2523318 - protein, 29 aa, Entamoeba dispar
ESEHWSFIIMELIETGCLLDYLYKHQLTN

SEQ ID NO: 2523319 - protein, 22 aa, Entamoeba dispar
ESEIINGFVLQTTPSGSILEVQ

SEQ ID NO: 2523320 - protein, 32 aa, Entamoeba dispar
ESEIPKFVDPLHWLQYFPPLGVEDLKLMGVAV

SEQ ID NO: 2523321 - protein, 32 aa, Entamoeba dispar
ESELTNCYSYNNGYYLYVLCPGKNITQTRVLN

SEQ ID NO: 2523322 - protein, 26 aa, Entamoeba dispar
ESEQKLGILVYQFDCFVTEKGVFDLI

SEQ ID NO: 2523323 - protein, 28 aa, Entamoeba dispar
ESEYNKFKLTFFFFQCFIKSCVVADKEI

SEQ ID NO: 2523324 - protein, 22 aa, Entamoeba dispar
ESFAYKKFLGIVISLGNYLNGG

SEQ ID NO: 2523325 - protein, 24 aa, Entamoeba dispar
ESFELSWKLTRPNGIVALVAMYES

SEQ ID NO: 2523326 - protein, 19 aa, Entamoeba dispar
ESFINVQQWFKELQEIAIT

SEQ ID NO: 2523327 - protein, 18 aa, Entamoeba dispar
ESFKAVVLMLHKENIDDP

SEQ ID NO: 2523328 - protein, 28 aa, Entamoeba dispar
ESFKLYRKLFDILASPLKFTLPINCYSS

SEQ ID NO: 2523329 - protein, 35 aa, Entamoeba dispar
ESFNSYVILPIQRIPRYRLLLKELMKTVPQQHNEY

SEQ ID NO: 2523330 - protein, 27 aa, Entamoeba dispar
ESFPINVLLLDFIQINDPFIQLCIERS

SEQ ID NO: 2523331 - protein, 24 aa, Entamoeba dispar
ESFQSIIPMYFRNASCVILVFDVS

SEQ ID NO: 2523332 - protein, 21 aa, Entamoeba dispar
ESFTRFYIKKKPTQKLTMCLE

SEQ ID NO: 2523333 - protein, 28 aa, Entamoeba dispar
ESFYQKHLLYLSLPLVPRPPPYSFSTFL

SEQ ID NO: 2523334 - protein, 24 aa, Entamoeba dispar
ESGIKSIVICLDINNPRLLNSTKT

SEQ ID NO: 2523335 - protein, 26 aa, Entamoeba dispar
ESGNAFKYLILLSHLFVCDEFNNPKR

SEQ ID NO: 2523336 - protein, 26 aa, Entamoeba dispar
ESGVTPLLMKPVIKKDLRQQTQEMGV

SEQ ID NO: 2523337 - protein, 25 aa, Entamoeba dispar
ESHGFLYIIMEYMESGSLLNIVKKF

SEQ ID NO: 2523338 - protein, 22 aa, Entamoeba dispar
ESHGILLYGPPGTGKTLLAKAV

SEQ ID NO: 2523339 - protein, 21 aa, Entamoeba dispar
ESIDFEFTVKVTFAQFENNSL

SEQ ID NO: 2523340 - protein, 20 aa, Entamoeba dispar
ESIDLFIYNPPYVPTPEEEL

SEQ ID NO: 2523341 - protein, 25 aa, Entamoeba dispar
ESIFIQCLLGYFPKELSLIDFICVS

SEQ ID NO: 2523342 - protein, 17 aa, Entamoeba dispar
ESIFSFIIDFIEKKIES

SEQ ID NO: 2523343 - protein, 20 aa, Entamoeba dispar
ESIIFTRSLTFLLTLFGEQT

SEQ ID NO: 2523344 - protein, 25 aa, Entamoeba dispar
ESIIRTKYLMLSKKNLFVFELTISE

SEQ ID NO: 2523345 - protein, 21 aa, Entamoeba dispar
ESIISLPYLDGQDSLEITINR

SEQ ID NO: 2523346 - protein, 27 aa, Entamoeba dispar
ESIKKFYTLLIITKYFNYFYIGYFTDE

SEQ ID NO: 2523347 - protein, 18 aa, Entamoeba dispar
ESIKSLFSLLLKSSPNES

SEQ ID NO: 2523348 - protein, 25 aa, Entamoeba dispar
ESIKSNYLLLLIQTNTIENNNMNKF

SEQ ID NO: 2523349 - protein, 21 aa, Entamoeba dispar
ESIPFTIGYLKKEGGLDVIVI

SEQ ID NO: 2523350 - protein, 20 aa, Entamoeba dispar
ESIPLQQKYAIKVAYDYAEE

SEQ ID NO: 2523351 - protein, 20 aa, Entamoeba dispar
ESIRISWDQAIKEALECPDY

SEQ ID NO: 2523352 - protein, 25 aa, Entamoeba dispar
ESISIFHKRITFAHIIFTNKQSCAK

SEQ ID NO: 2523353 - protein, 32 aa, Entamoeba dispar
ESISPQQYFFDYLQTLLLTTPLLLTHSNTVFN

SEQ ID NO: 2523354 - protein, 26 aa, Entamoeba dispar
ESITFNIGLFEPLIISLSIYNYKTRE

SEQ ID NO: 2523355 - protein, 20 aa, Entamoeba dispar
ESIYMTMIPNIFSLRKETGM

SEQ ID NO: 2523356 - protein, 24 aa, Entamoeba dispar
ESKDRKFYGVMYFYKMAEQDIEDA

SEQ ID NO: 2523357 - protein, 28 aa, Entamoeba dispar
ESKEKIEMFAKLPFLISNVVEILDMPEE

SEQ ID NO: 2523358 - protein, 25 aa, Entamoeba dispar
ESKEMMPLTHVLSTKLILRLQECRE

SEQ ID NO: 2523359 - protein, 17 aa, Entamoeba dispar
ESKKFFGSVPYWIAQLI

SEQ ID NO: 2523360 - protein, 22 aa, Entamoeba dispar
ESKKKYFLTSSQMKPFTTIELQ

SEQ ID NO: 2523361 - protein, 24 aa, Entamoeba dispar
ESKKQLTVELIIPIGSFCVLDSIK

SEQ ID NO: 2523362 - protein, 23 aa, Entamoeba dispar
ESKKQMNGFYFDFSLKPTGEKSL

SEQ ID NO: 2523363 - protein, 23 aa, Entamoeba dispar
ESKLFSQSFFKKYTPITSCGWWE

SEQ ID NO: 2523364 - protein, 17 aa, Entamoeba dispar
ESKPFLGMAAAIERYKV

SEQ ID NO: 2523365 - protein, 30 aa, Entamoeba dispar
ESKRMKGIYIRDLYLNLSTSAVPIYRFQCL

SEQ ID NO: 2523366 - protein, 33 aa, Entamoeba dispar
ESKSFNAYFFRILLKIFRVYLKIARYQTIGLGL

SEQ ID NO: 2523367 - protein, 19 aa, Entamoeba dispar
ESKSFSLFFTDIKPFYSSF

SEQ ID NO: 2523368 - protein, 23 aa, Entamoeba dispar
ESKTFLESFLDQFPSFKKWKEEI

SEQ ID NO: 2523369 - protein, 17 aa, Entamoeba dispar
ESKWIEFANAYTSRIDG

SEQ ID NO: 2523370 - protein, 23 aa, Entamoeba dispar
ESKWWKMMVTQICSRRGFSDVLV

SEQ ID NO: 2523371 - protein, 28 aa, Entamoeba dispar
ESLDSSTPWILYWSLNPLRLFGYNVDEY

SEQ ID NO: 2523372 - protein, 18 aa, Entamoeba dispar
ESLDYWIDLTRKSGGDDI

SEQ ID NO: 2523373 - protein, 22 aa, Entamoeba dispar
ESLELHLTWYEKLIVNQEKRDN

SEQ ID NO: 2523374 - protein, 24 aa, Entamoeba dispar
ESLELYFIIWGNLCLLGGNAIKYI

SEQ ID NO: 2523375 - protein, 17 aa, Entamoeba dispar
ESLFIPSSVQNYGSYVL

SEQ ID NO: 2523376 - protein, 19 aa, Entamoeba dispar
ESLFMVIDLAEGCLLDYVQ

SEQ ID NO: 2523377 - protein, 34 aa, Entamoeba dispar
ESLKANKPLHFTSRYLYLTLWGDEIKNNIQFKEV

SEQ ID NO: 2523378 - protein, 26 aa, Entamoeba dispar
ESLKLTQNFIIRGLTQPLPDAFQNVE

SEQ ID NO: 2523379 - protein, 18 aa, Entamoeba dispar
ESLKVIHFYVWDSIITPS

SEQ ID NO: 2523380 - protein, 23 aa, Entamoeba dispar
ESLKVIIFITRQLGGITPWYLEY

SEQ ID NO: 2523381 - protein, 23 aa, Entamoeba dispar
ESLKYDIRIFDDANLNDIIWPEF

SEQ ID NO: 2523382 - protein, 25 aa, Entamoeba dispar
ESLKYYESALKLLPNHKKLPLKIKQ

SEQ ID NO: 2523383 - protein, 21 aa, Entamoeba dispar
ESLLFVIMNLLTNGFTKQKKV

SEQ ID NO: 2523384 - protein, 28 aa, Entamoeba dispar
ESLLNNDILYWIKTELIPTINHSLYQYN

SEQ ID NO: 2523385 - protein, 19 aa, Entamoeba dispar
ESLQIVWLWEVINEMENSL

SEQ ID NO: 2523386 - protein, 27 aa, Entamoeba dispar
ESLRKAIIQPKIKAGLEIIERHLSKEE

SEQ ID NO: 2523387 - protein, 23 aa, Entamoeba dispar
ESLRNLLLILKDNLNVLSAYYTD

SEQ ID NO: 2523388 - protein, 31 aa, Entamoeba dispar
ESLVSILQPYFAHWIVVFMDGFIKSIPLINS

SEQ ID NO: 2523389 - protein, 18 aa, Entamoeba dispar
ESMSPLIKSMKFIMDDTV

SEQ ID NO: 2523390 - protein, 24 aa, Entamoeba dispar
ESNEKALILYEDPLKIINDTFMTK

SEQ ID NO: 2523391 - protein, 33 aa, Entamoeba dispar
ESNFIEHFAIFSIFIIDPLLFIEYLEKITCNLG

SEQ ID NO: 2523392 - protein, 20 aa, Entamoeba dispar
ESNHPLLHAPFNALQSIPLN

SEQ ID NO: 2523393 - protein, 29 aa, Entamoeba dispar
ESNIKYIFRDILFLLISYSLKERCELGKD

SEQ ID NO: 2523394 - protein, 25 aa, Entamoeba dispar
ESNSILFLNLVNYINIYYSHINPSL

SEQ ID NO: 2523395 - protein, 19 aa, Entamoeba dispar
ESPFIVPEKVFSILHSNKS

SEQ ID NO: 2523396 - protein, 22 aa, Entamoeba dispar
ESPLHIACLCGYKNIVESLELF

SEQ ID NO: 2523397 - protein, 23 aa, Entamoeba dispar
ESPMRIQFCKYSIPNNYYSKKVT

SEQ ID NO: 2523398 - protein, 36 aa, Entamoeba dispar
ESPTEMVNTLDFINNVLLSCITLPISEGVNFVKKEE

SEQ ID NO: 2523399 - protein, 17 aa, Entamoeba dispar
ESPVDFPGLFPYGLSVP

SEQ ID NO: 2523400 - protein, 17 aa, Entamoeba dispar
ESQARNRYLIYAKTAKK

SEQ ID NO: 2523401 - protein, 17 aa, Entamoeba dispar
ESQHFSFFLQNFPKRHD

SEQ ID NO: 2523402 - protein, 21 aa, Entamoeba dispar
ESQIHTPIKIRKLSAGRVESN

SEQ ID NO: 2523403 - protein, 25 aa, Entamoeba dispar
ESQNKFIVLMPVSLQLFGKVMNSGN

SEQ ID NO: 2523404 - protein, 32 aa, Entamoeba dispar
ESQQLYAYSEIINHALHYEKPIINDILKDLQD

SEQ ID NO: 2523405 - protein, 25 aa, Entamoeba dispar
ESQVQPPQLLFTPNLMEIKTNEIMP

SEQ ID NO: 2523406 - protein, 33 aa, Entamoeba dispar
ESREVRFYIFNDTLFMTTQPKRSIFSIMAHTAL

SEQ ID NO: 2523407 - protein, 17 aa, Entamoeba dispar
ESRLIIITIDTHKIYKK

SEQ ID NO: 2523408 - protein, 25 aa, Entamoeba dispar
ESRNGLFLPKLPPKIKEINETTSNK

SEQ ID NO: 2523409 - protein, 34 aa, Entamoeba dispar
ESRVPIITYLINDSFYFFFTHWSDIVRQHFHYFI

SEQ ID NO: 2523410 - protein, 17 aa, Entamoeba dispar
ESSFWNFDSLYQPQQHP

SEQ ID NO: 2523411 - protein, 22 aa, Entamoeba dispar
ESSGFIMMPFNPTYTSDQLSRL

SEQ ID NO: 2523412 - protein, 18 aa, Entamoeba dispar
ESSLNIILQIFQYSFVKY

SEQ ID NO: 2523413 - protein, 19 aa, Entamoeba dispar
ESSMNSIIIIWKNNIKNVD

SEQ ID NO: 2523414 - protein, 26 aa, Entamoeba dispar
ESSPLALEFFNLLGQTIQLKGFTKYK

SEQ ID NO: 2523415 - protein, 22 aa, Entamoeba dispar
ESSQFTMINLLFKMTDKVISVV

SEQ ID NO: 2523416 - protein, 24 aa, Entamoeba dispar
ESSQSFFLIYPISGETINGLDFIG

SEQ ID NO: 2523417 - protein, 28 aa, Entamoeba dispar
ESSQVVPPLIDMSFFSAGLKPQRYQNNI

SEQ ID NO: 2523418 - protein, 27 aa, Entamoeba dispar
ESSSLALRFQMLGVIPIVNMKEINLIK

SEQ ID NO: 2523419 - protein, 22 aa, Entamoeba dispar
ESSSLIFIPGIYGDKNYIFLKE

SEQ ID NO: 2523420 - protein, 38 aa, Entamoeba dispar
ESSYSFPVIIKWIYELTPWEILIFPQGVHRIEEKCVSV

SEQ ID NO: 2523421 - protein, 25 aa, Entamoeba dispar
ESTESKWKLLVFDKFCSELIENHFV

SEQ ID NO: 2523422 - protein, 21 aa, Entamoeba dispar
ESTHFLVPTQIQSIGSLLLFN

SEQ ID NO: 2523423 - protein, 28 aa, Entamoeba dispar
ESTIISQWYLILCELSETLQKHKIHKNI

SEQ ID NO: 2523424 - protein, 25 aa, Entamoeba dispar
ESTLSEILLLNYLGLTNYYDRICLA

SEQ ID NO: 2523425 - protein, 31 aa, Entamoeba dispar
ESTQPIEMRKSSIPIFSKAPVMNKSGYFMVP

SEQ ID NO: 2523426 - protein, 18 aa, Entamoeba dispar
ESTRTLLFKEAPHVFHVL

SEQ ID NO: 2523427 - protein, 17 aa, Entamoeba dispar
ESTSKIRWQSFNGKIYV

SEQ ID NO: 2523428 - protein, 22 aa, Entamoeba dispar
ESTTRFKFVLYEESKELPVTTD

SEQ ID NO: 2523429 - protein, 21 aa, Entamoeba dispar
ESTVQTLLFSATMPAWVKEIS

SEQ ID NO: 2523430 - protein, 29 aa, Entamoeba dispar
ESVELIVEIFNLWKQFFLCFNGQGKAKME

SEQ ID NO: 2523431 - protein, 24 aa, Entamoeba dispar
ESVERKMQVLYNLQHERGKSDTTS

SEQ ID NO: 2523432 - protein, 33 aa, Entamoeba dispar
ESVLDRMNDLRETILASLIKFAKVEQDEGLKKV

SEQ ID NO: 2523433 - protein, 23 aa, Entamoeba dispar
ESVLGLLVKWIDIELQVFRRFDE

SEQ ID NO: 2523434 - protein, 33 aa, Entamoeba dispar
ESVQNCVVKMNFAFLAALMKWKKEQDEIERKRR

SEQ ID NO: 2523435 - protein, 18 aa, Entamoeba dispar
ESVWNYPDGTKITAKRAK

SEQ ID NO: 2523436 - protein, 18 aa, Entamoeba dispar
ESWDVWGLGVIIIEMMNG

SEQ ID NO: 2523437 - protein, 34 aa, Entamoeba dispar
ESWISGTEWLLRVLSGMLFVPLIQRVFENKEIKK

SEQ ID NO: 2523438 - protein, 17 aa, Entamoeba dispar
ESWISLSDKGGCDAGWN

SEQ ID NO: 2523439 - protein, 21 aa, Entamoeba dispar
ESYCKIIVYLRNRGENSLNHD

SEQ ID NO: 2523440 - protein, 24 aa, Entamoeba dispar
ESYELLFEHFGINKIYSSPSPVLV

SEQ ID NO: 2523441 - protein, 21 aa, Entamoeba dispar
ESYIHRIGRSARFGRKGVAID

SEQ ID NO: 2523442 - protein, 21 aa, Entamoeba dispar
ESYMYFFQIDESIDSEFLITK

SEQ ID NO: 2523443 - protein, 25 aa, Entamoeba dispar
ETAFKLRMFSPEILFLSFHCEICNS

SEQ ID NO: 2523444 - protein, 25 aa, Entamoeba dispar
ETANKMSMFFAYSSPMMKVLTEAVN

SEQ ID NO: 2523445 - protein, 24 aa, Entamoeba dispar
ETASLMVALKVRYPNRVHLLRGNH

SEQ ID NO: 2523446 - protein, 19 aa, Entamoeba dispar
ETDFLLSLLKDPSSNLLAF

SEQ ID NO: 2523447 - protein, 23 aa, Entamoeba dispar
ETDILLHYELPQPLQLIITDNHI

SEQ ID NO: 2523448 - protein, 26 aa, Entamoeba dispar
ETDKLLTIPALFPLLNMIKKQYISPQ

SEQ ID NO: 2523449 - protein, 33 aa, Entamoeba dispar
ETDKRVLFNSLALSIKMVLPTTSKFDNTMLYNE

SEQ ID NO: 2523450 - protein, 22 aa, Entamoeba dispar
ETDRWYYGGGLYMGKKMPEVCS

SEQ ID NO: 2523451 - protein, 27 aa, Entamoeba dispar
ETEELKYFGIFMSQSFLFIKESSIEIV

SEQ ID NO: 2523452 - protein, 27 aa, Entamoeba dispar
ETEHWKSMWQELQGEFKISTIAKIDLE

SEQ ID NO: 2523453 - protein, 27 aa, Entamoeba dispar
ETEIVKFIMILFESFILNKVKVQKSEG

SEQ ID NO: 2523454 - protein, 23 aa, Entamoeba dispar
ETEKFFEAIEPYLISLENKEKTQ

SEQ ID NO: 2523455 - protein, 19 aa, Entamoeba dispar
ETEKFIKPQWLGKEVSQDP

SEQ ID NO: 2523456 - protein, 26 aa, Entamoeba dispar
ETENCKYFYVSFLNKRGLTIKGFQES

SEQ ID NO: 2523457 - protein, 26 aa, Entamoeba dispar
ETFHNGKIFKYVIWYDVRKSYGNTIP

SEQ ID NO: 2523458 - protein, 17 aa, Entamoeba dispar
ETFIRPRKSQEITPIRE

SEQ ID NO: 2523459 - protein, 30 aa, Entamoeba dispar
ETFNIFNYSIYRYIFIHHKLSIKEYDLILE

SEQ ID NO: 2523460 - protein, 18 aa, Entamoeba dispar
ETFYIYNYNDEIFKDGRI

SEQ ID NO: 2523461 - protein, 31 aa, Entamoeba dispar
ETFYRVNNAFYLRPYLYEKKGKTWDDFNKDY

SEQ ID NO: 2523462 - protein, 23 aa, Entamoeba dispar
ETFYYTFPSIYFQRNPTFIIWGL

SEQ ID NO: 2523463 - protein, 29 aa, Entamoeba dispar
ETGKSRGFGYLDFVDLEAAKKFVQEHQGE

SEQ ID NO: 2523464 - protein, 33 aa, Entamoeba dispar
ETGYAIKMYPIDNRSWILGAHCCFYIGSKDNSF

SEQ ID NO: 2523465 - protein, 19 aa, Entamoeba dispar
ETHRIVLEVICRLLKNKKD

SEQ ID NO: 2523466 - protein, 18 aa, Entamoeba dispar
ETIHLLIDVLREYGYLFK

SEQ ID NO: 2523467 - protein, 29 aa, Entamoeba dispar
ETIKLNQVVAPELPPKSSNPYFPKSKIRK

SEQ ID NO: 2523468 - protein, 22 aa, Entamoeba dispar
ETIKRCHQLGIWIEITTLIIPG

SEQ ID NO: 2523469 - protein, 19 aa, Entamoeba dispar
ETIKRFIEKKSMEGYYREK

SEQ ID NO: 2523470 - protein, 18 aa, Entamoeba dispar
ETILRVYNILFQCVILPS

SEQ ID NO: 2523471 - protein, 25 aa, Entamoeba dispar
ETKIIHFMKSLILLPSRDVFESLFW

SEQ ID NO: 2523472 - protein, 25 aa, Entamoeba dispar
ETKSQILFIPIFYKTMTDFFDNKKG

SEQ ID NO: 2523473 - protein, 25 aa, Entamoeba dispar
ETKVESFFDLFYPQELVLNNDINDD

SEQ ID NO: 2523474 - protein, 25 aa, Entamoeba dispar
ETKVKKYWKGMIKPVMIRVKTCFIE

SEQ ID NO: 2523475 - protein, 26 aa, Entamoeba dispar
ETLEKVLIQFKLPSSPVLIQNLLTSS

SEQ ID NO: 2523476 - protein, 31 aa, Entamoeba dispar
ETLIEIMCNVFPFSDFWKHVCIVWTKCYCYT

SEQ ID NO: 2523477 - protein, 35 aa, Entamoeba dispar
ETLIEIMCNVFPFYPFWKHVCIVWTKCYCYTPKNI

SEQ ID NO: 2523478 - protein, 21 aa, Entamoeba dispar
ETLIFKEYFHDLAVKDDIVTS

SEQ ID NO: 2523479 - protein, 21 aa, Entamoeba dispar
ETLIFRVEQFIDAAPPAYLLA

SEQ ID NO: 2523480 - protein, 30 aa, Entamoeba dispar
ETLKEIARYCNMYQFFGYECKEDKVIVTNA

SEQ ID NO: 2523481 - protein, 24 aa, Entamoeba dispar
ETLKKIFHPNVLLIMGIIAEKGIT

SEQ ID NO: 2523482 - protein, 17 aa, Entamoeba dispar
ETLLFLLNALQSGEESA

SEQ ID NO: 2523483 - protein, 17 aa, Entamoeba dispar
ETLLLNLTNDIPTGVIK

SEQ ID NO: 2523484 - protein, 27 aa, Entamoeba dispar
ETLMQNPLWCAYLQFFQNNNVLVHGQL

SEQ ID NO: 2523485 - protein, 23 aa, Entamoeba dispar
ETLQLQWNSFFPEQKKRWKDISS

SEQ ID NO: 2523486 - protein, 25 aa, Entamoeba dispar
ETLQNNVPLLQLPGSIIREILRTLD

SEQ ID NO: 2523487 - protein, 26 aa, Entamoeba dispar
ETLQNNVPLLQLPGSIIREILRTLDA

SEQ ID NO: 2523488 - protein, 23 aa, Entamoeba dispar
ETLRELYVRSSDGALLVCSGISP

SEQ ID NO: 2523489 - protein, 19 aa, Entamoeba dispar
ETLRFLLSNVKYYAEEFGF

SEQ ID NO: 2523490 - protein, 29 aa, Entamoeba dispar
ETLSSFIVKLFPEFSLLFNGAELEKLKPN

SEQ ID NO: 2523491 - protein, 21 aa, Entamoeba dispar
ETLSVPYKFFKLFLSSHNFHK

SEQ ID NO: 2523492 - protein, 32 aa, Entamoeba dispar
ETLTSPDFSDLFFRRTFFYSFPSFAKAKEVVD

SEQ ID NO: 2523493 - protein, 26 aa, Entamoeba dispar
ETLYESITLPLLRPELFKKGSLTKRS

SEQ ID NO: 2523494 - protein, 18 aa, Entamoeba dispar
ETLYNIYSQLFKGITRAT

SEQ ID NO: 2523495 - protein, 25 aa, Entamoeba dispar
ETMTAFWLMKTIFIGLKRSKFKQEI

SEQ ID NO: 2523496 - protein, 31 aa, Entamoeba dispar
ETMYTELILKFMTFYLNLFFSRIELVDEEGW

SEQ ID NO: 2523497 - protein, 21 aa, Entamoeba dispar
ETNEIQIIFIPGRTIPVNIKP

SEQ ID NO: 2523498 - protein, 33 aa, Entamoeba dispar
ETNEPIFSLLQKQIHVWPIIQFNITETVAIHLG

SEQ ID NO: 2523499 - protein, 34 aa, Entamoeba dispar
ETNHFPYYLEASYPFWILRLVWKKQNKSFNVIRK

SEQ ID NO: 2523500 - protein, 25 aa, Entamoeba dispar
ETNPQLILPTIKRPLTFPSIPTHNN

SEQ ID NO: 2523501 - protein, 17 aa, Entamoeba dispar
ETNTICNLIWTSLQGKY

SEQ ID NO: 2523502 - protein, 26 aa, Entamoeba dispar
ETNVCYLPIINNRVGNFPIVLKLNPK

SEQ ID NO: 2523503 - protein, 35 aa, Entamoeba dispar
ETNYYFENGLRRVLPYFYIFKVNAKGRWIGRTIVD

SEQ ID NO: 2523504 - protein, 23 aa, Entamoeba dispar
ETPKRQIQFFQTPKYVDLSIVDA

SEQ ID NO: 2523505 - protein, 34 aa, Entamoeba dispar
ETPLHKAVFNKCIRLILVELLLKAGAEVDARTKN

SEQ ID NO: 2523506 - protein, 26 aa, Entamoeba dispar
ETPQIQPITVPLFTVNNKLSEIPSFG

SEQ ID NO: 2523507 - protein, 18 aa, Entamoeba dispar
ETPRDIIQVCLKICKFIA

SEQ ID NO: 2523508 - protein, 26 aa, Entamoeba dispar
ETPTFSRFYLLIVQYVAQMQSHKLFK

SEQ ID NO: 2523509 - protein, 18 aa, Entamoeba dispar
ETPYAPPIIAQPADDTLS

SEQ ID NO: 2523510 - protein, 21 aa, Entamoeba dispar
ETQLLNEEVKRLMASYQNEKQ

SEQ ID NO: 2523511 - protein, 21 aa, Entamoeba dispar
ETQLRSLLFTFFLCYSQSHFE

SEQ ID NO: 2523512 - protein, 23 aa, Entamoeba dispar
ETQNRMAEMQKSFEGSENEMISS

SEQ ID NO: 2523513 - protein, 24 aa, Entamoeba dispar
ETQRRFIGIYLSTYYKKPVEELSS

SEQ ID NO: 2523514 - protein, 30 aa, Entamoeba dispar
ETRDIFEYSIPNKIIYIKPNHNFIFCGLEG

SEQ ID NO: 2523515 - protein, 27 aa, Entamoeba dispar
ETRDYVYIIMEFINGGNLLRGVRLANE

SEQ ID NO: 2523516 - protein, 20 aa, Entamoeba dispar
ETRECIECEKGYYLNSTKEC

SEQ ID NO: 2523517 - protein, 24 aa, Entamoeba dispar
ETRKNEIFLYLPEVLSTATAFLKD

SEQ ID NO: 2523518 - protein, 27 aa, Entamoeba dispar
ETRRTLPNIIQKLIEKGLDSKEIIEKG

SEQ ID NO: 2523519 - protein, 25 aa, Entamoeba dispar
ETRWYRAPEILLGSQRYSFAIDLWS

SEQ ID NO: 2523520 - protein, 21 aa, Entamoeba dispar
ETRYEILGGLLAFIRTMDREV

SEQ ID NO: 2523521 - protein, 21 aa, Entamoeba dispar
ETRYHFAVQLYPFAEQIKDKK

SEQ ID NO: 2523522 - protein, 32 aa, Entamoeba dispar
ETRYTTFKTIFFLRFLFPALNHAEKYIPSELR

SEQ ID NO: 2523523 - protein, 23 aa, Entamoeba dispar
ETSFILLARGIYKVRFYAMVRNS

SEQ ID NO: 2523524 - protein, 22 aa, Entamoeba dispar
ETSIILLQFLPQNDYEINLFVE

SEQ ID NO: 2523525 - protein, 33 aa, Entamoeba dispar
ETSKIHLFIHCYDVIPLSPMSGLIGWVPHSITI

SEQ ID NO: 2523526 - protein, 18 aa, Entamoeba dispar
ETSRLFPISVEYLHEHTL

SEQ ID NO: 2523527 - protein, 24 aa, Entamoeba dispar
ETTFTDPRFFWNESLVSILQPYFA

SEQ ID NO: 2523528 - protein, 21 aa, Entamoeba dispar
ETTMYIVMEYVSGGSLQQLIE

SEQ ID NO: 2523529 - protein, 22 aa, Entamoeba dispar
ETTQYRFISYFIVTIEITKVNK

SEQ ID NO: 2523530 - protein, 23 aa, Entamoeba dispar
ETTRKPPHSLLMFATNYLTEKKN

SEQ ID NO: 2523531 - protein, 26 aa, Entamoeba dispar
ETTRLNFLNIPLGTWFHLAICIYPNQ

SEQ ID NO: 2523532 - protein, 23 aa, Entamoeba dispar
ETTRYLFLVMELLEGGELFDYII

SEQ ID NO: 2523533 - protein, 17 aa, Entamoeba dispar
ETTTVSEIPSFKPSLRY

SEQ ID NO: 2523534 - protein, 34 aa, Entamoeba dispar
ETTVQSLLSHLLSLRFRFPSTSDLRFVLLSENKR

SEQ ID NO: 2523535 - protein, 20 aa, Entamoeba dispar
ETVFDSLTLGLNWGKTLNTS

SEQ ID NO: 2523536 - protein, 24 aa, Entamoeba dispar
ETVGLFLTYNPIVKEILKLSEDVQ

SEQ ID NO: 2523537 - protein, 26 aa, Entamoeba dispar
ETVRKIFKRLFRVYAHMFYNHMEHLE

SEQ ID NO: 2523538 - protein, 20 aa, Entamoeba dispar
ETVSAIIEAFLLIGDPNGTK

SEQ ID NO: 2523539 - protein, 24 aa, Entamoeba dispar
ETVSKYFPQLSQLILNMTEFDPKK

SEQ ID NO: 2523540 - protein, 25 aa, Entamoeba dispar
ETVTLEANLSFYYSKTAKTGTRKDG

SEQ ID NO: 2523541 - protein, 28 aa, Entamoeba dispar
ETVYEKYILKPCRFLRQREKECVEFPCI

SEQ ID NO: 2523542 - protein, 26 aa, Entamoeba dispar
ETVYHIARYLVYWGKAKIIEAIQLDD

SEQ ID NO: 2523543 - protein, 19 aa, Entamoeba dispar
ETWRQLWRVVERSQVVLMI

SEQ ID NO: 2523544 - protein, 29 aa, Entamoeba dispar
ETYFQLNLSTLPTLFAFALSTQSYKNYLT

SEQ ID NO: 2523545 - protein, 19 aa, Entamoeba dispar
ETYILKMRTSVQIFREVNN

SEQ ID NO: 2523546 - protein, 22 aa, Entamoeba dispar
ETYNYPISIRLLKRISSTHYFN

SEQ ID NO: 2523547 - protein, 24 aa, Entamoeba dispar
ETYQKMMHILQDAINYNPKFIGKE

SEQ ID NO: 2523548 - protein, 27 aa, Entamoeba dispar
ETYRFFTTFNYLYAIDNFFDYSKEVIK

SEQ ID NO: 2523549 - protein, 28 aa, Entamoeba dispar
ETYSGISLRVIFPAFGGDAKTIQQLSGG

SEQ ID NO: 2523550 - protein, 29 aa, Entamoeba dispar
ETYVNNLIILKDFYLQKLLDFNKDELLKN

SEQ ID NO: 2523551 - protein, 24 aa, Entamoeba dispar
EVAADLKYYAIPEAEKRMKELKEQ

SEQ ID NO: 2523552 - protein, 24 aa, Entamoeba dispar
EVALAWVDVTLRLQKTFLTAVESK

SEQ ID NO: 2523553 - protein, 28 aa, Entamoeba dispar
EVAQKKFPFIPLILKYIEAMTFYSNDFN

SEQ ID NO: 2523554 - protein, 27 aa, Entamoeba dispar
EVARIHFKLAKRTAAIKTLKLKIYKEI

SEQ ID NO: 2523555 - protein, 26 aa, Entamoeba dispar
EVARQIQTSFVYEPPPGYSVFIEQTT

SEQ ID NO: 2523556 - protein, 19 aa, Entamoeba dispar
EVASISDVFLVIGSSLEVM

SEQ ID NO: 2523557 - protein, 19 aa, Entamoeba dispar
EVCPNYIMGMCRKCQDGKY

SEQ ID NO: 2523558 - protein, 18 aa, Entamoeba dispar
EVDEKLPFTVYAHKYCQL

SEQ ID NO: 2523559 - protein, 37 aa, Entamoeba dispar
EVDGYFPVVFIGKEGLPKFFYIWTEIRPRMKEGARKL

SEQ ID NO: 2523560 - protein, 27 aa, Entamoeba dispar
EVDQMIIPHIFYKFIIMLVNRSEVQPH

SEQ ID NO: 2523561 - protein, 23 aa, Entamoeba dispar
EVDSLFLIHTFPLLEIFNNKLFE

SEQ ID NO: 2523562 - protein, 28 aa, Entamoeba dispar
EVEARWVIYQVVSALYYLHSHCIAHRDI

SEQ ID NO: 2523563 - protein, 24 aa, Entamoeba dispar
EVEEKIFRIIFKKVKGSCKVYKKY

SEQ ID NO: 2523564 - protein, 20 aa, Entamoeba dispar
EVEELSKVVIALKGNNDINT

SEQ ID NO: 2523565 - protein, 26 aa, Entamoeba dispar
EVEIDPYLLTEAFPGLLVTSQERKNL

SEQ ID NO: 2523566 - protein, 17 aa, Entamoeba dispar
EVEKIVWKIMMSLPSFS

SEQ ID NO: 2523567 - protein, 25 aa, Entamoeba dispar
EVEKQPCYFVPELMRLTGMSDDMRA

SEQ ID NO: 2523568 - protein, 26 aa, Entamoeba dispar
EVEKRIPGFPIVLHGSSSVPQEWVAV

SEQ ID NO: 2523569 - protein, 27 aa, Entamoeba dispar
EVELMICHILCCSPLHFGISVSGLLVQ

SEQ ID NO: 2523570 - protein, 19 aa, Entamoeba dispar
EVEQLPFYRTGFAEAMKLK

SEQ ID NO: 2523571 - protein, 20 aa, Entamoeba dispar
EVERLKIVINKQQQLFANKM

SEQ ID NO: 2523572 - protein, 17 aa, Entamoeba dispar
EVFIIEQIIIKMLVNKV

SEQ ID NO: 2523573 - protein, 18 aa, Entamoeba dispar
EVFINNNEFKLLIDKKND

SEQ ID NO: 2523574 - protein, 28 aa, Entamoeba dispar
EVFMEPSPKMLLFYRALKLDDMNYNELC

SEQ ID NO: 2523575 - protein, 18 aa, Entamoeba dispar
EVGALDTIIKPFQFLHCH

SEQ ID NO: 2523576 - protein, 31 aa, Entamoeba dispar
EVGALDTIIKPFQFLHCHILRGYLQITLKVE

SEQ ID NO: 2523577 - protein, 26 aa, Entamoeba dispar
EVGFNPCIIFVPLRLGPESPENEFRP

SEQ ID NO: 2523578 - protein, 26 aa, Entamoeba dispar
EVGYKLIIPSYYFQQIQVSSLLIPLQ

SEQ ID NO: 2523579 - protein, 26 aa, Entamoeba dispar
EVHELHRLLSKWPLLDPQEAIELLDF

SEQ ID NO: 2523580 - protein, 25 aa, Entamoeba dispar
EVHNAFLLIQNDIKLHFIACSESNR

SEQ ID NO: 2523581 - protein, 18 aa, Entamoeba dispar
EVHNGPIITLYRNDEWVF

SEQ ID NO: 2523582 - protein, 26 aa, Entamoeba dispar
EVHNLNKLDSLINSINIMNKNLTLSY

SEQ ID NO: 2523583 - protein, 25 aa, Entamoeba dispar
EVHVGMLVDCQVPYVILGHSERRQI

SEQ ID NO: 2523584 - protein, 17 aa, Entamoeba dispar
EVICHDFIRNKENVILK

SEQ ID NO: 2523585 - protein, 26 aa, Entamoeba dispar
EVICLLLALKIIAPDTVYLLRGNHEG

SEQ ID NO: 2523586 - protein, 20 aa, Entamoeba dispar
EVIIVACLCSYREVPQLLRE

SEQ ID NO: 2523587 - protein, 18 aa, Entamoeba dispar
EVIKEKVELFRKGSWDYT

SEQ ID NO: 2523588 - protein, 25 aa, Entamoeba dispar
EVIKMYTEPLPIYPKSKLFCTQNLK

SEQ ID NO: 2523589 - protein, 24 aa, Entamoeba dispar
EVIKQYVEAITQNLIPLLNSCLFS

SEQ ID NO: 2523590 - protein, 17 aa, Entamoeba dispar
EVIKYKKNSLKLWKCQY

SEQ ID NO: 2523591 - protein, 21 aa, Entamoeba dispar
EVIQWLFSHGADPLLRNKNGF

SEQ ID NO: 2523592 - protein, 32 aa, Entamoeba dispar
EVIVRKKALLVLKQMIKFFPSLINLEPQFIKK

SEQ ID NO: 2523593 - protein, 20 aa, Entamoeba dispar
EVIVVYPTLLHKLKTCFGKP

SEQ ID NO: 2523594 - protein, 24 aa, Entamoeba dispar
EVKCLCDPIIKLYAIVEGECSSLV

SEQ ID NO: 2523595 - protein, 23 aa, Entamoeba dispar
EVKEIIFQVIWALMIGQKELSFM

SEQ ID NO: 2523596 - protein, 21 aa, Entamoeba dispar
EVKEIKKAIELQEKQLKEIEK

SEQ ID NO: 2523597 - protein, 28 aa, Entamoeba dispar
EVKESKIPIILFIDEIHTVLGAGATGEG

SEQ ID NO: 2523598 - protein, 20 aa, Entamoeba dispar
EVKIFGLEYLSEFSSLSNSP

SEQ ID NO: 2523599 - protein, 22 aa, Entamoeba dispar
EVKKPLNYNNLYDILGGINEEP

SEQ ID NO: 2523600 - protein, 25 aa, Entamoeba dispar
EVKKQPTLVLFPVSTIAQMRPQLQY

SEQ ID NO: 2523601 - protein, 18 aa, Entamoeba dispar
EVKNILDDYTRPAMLNYT

SEQ ID NO: 2523602 - protein, 24 aa, Entamoeba dispar
EVKNLFSILLREYKVIRNVEKDFP

SEQ ID NO: 2523603 - protein, 30 aa, Entamoeba dispar
EVKNLNIFSYLILPIQRVPRYELFIRGVLK

SEQ ID NO: 2523604 - protein, 19 aa, Entamoeba dispar
EVKSFWNQLSTSAQNVFKE

SEQ ID NO: 2523605 - protein, 34 aa, Entamoeba dispar
EVKSLFEKFGTLKQFLMPKSKALALVEFEIANDA

SEQ ID NO: 2523606 - protein, 22 aa, Entamoeba dispar
EVKSRTVVYLKKGKLYLKHNSL

SEQ ID NO: 2523607 - protein, 27 aa, Entamoeba dispar
EVKYKRHEPLTPYLYLDVPGVIDDFYL

SEQ ID NO: 2523608 - protein, 21 aa, Entamoeba dispar
EVLASMFLEKNSRLLYSYLKQ

SEQ ID NO: 2523609 - protein, 24 aa, Entamoeba dispar
EVLDLNAICFVAKSSNARLTLNQQ

SEQ ID NO: 2523610 - protein, 32 aa, Entamoeba dispar
EVLEKIGTPIYSFLCSYLLKTNTPQSKGLFIG

SEQ ID NO: 2523611 - protein, 20 aa, Entamoeba dispar
EVLEKIGTPVYKFLCPYLLK

SEQ ID NO: 2523612 - protein, 32 aa, Entamoeba dispar
EVLEKIGTPVYKFLCSYLLKTNTHQSKGLFVG

SEQ ID NO: 2523613 - protein, 20 aa, Entamoeba dispar
EVLEYGFEFAQKKMGIDRLL

SEQ ID NO: 2523614 - protein, 27 aa, Entamoeba dispar
EVLFFLMAHKINYPKQFFFLRGNHESK

SEQ ID NO: 2523615 - protein, 24 aa, Entamoeba dispar
EVLFYLLAHKICYPERVFMLRGNH

SEQ ID NO: 2523616 - protein, 28 aa, Entamoeba dispar
EVLKLYLRSLPFPLLHPSKEYLGSISID

SEQ ID NO: 2523617 - protein, 23 aa, Entamoeba dispar
EVLKRYNEITPSVRLSGPTNFAP

SEQ ID NO: 2523618 - protein, 26 aa, Entamoeba dispar
EVLKTQKDFLILLEPEKESDKTRIKS

SEQ ID NO: 2523619 - protein, 21 aa, Entamoeba dispar
EVLKTWAMMGLSSGKGLIHIT

SEQ ID NO: 2523620 - protein, 22 aa, Entamoeba dispar
EVLKTWAMMGLSSGKGLIHITD

SEQ ID NO: 2523621 - protein, 21 aa, Entamoeba dispar
EVLMSILQQIPYFKNTVPLKE

SEQ ID NO: 2523622 - protein, 24 aa, Entamoeba dispar
EVLQNLIFVPSIPHEQLITKLCEG

SEQ ID NO: 2523623 - protein, 17 aa, Entamoeba dispar
EVLQQLKEKPLQEEIEI

SEQ ID NO: 2523624 - protein, 17 aa, Entamoeba dispar
EVLSDLLYLILNCKSEI

SEQ ID NO: 2523625 - protein, 24 aa, Entamoeba dispar
EVLSFQTLDFYELINMIGHTKKIT

SEQ ID NO: 2523626 - protein, 32 aa, Entamoeba dispar
EVLTESTLYSAWNPDFLLSVLLGNQTATCQTL

SEQ ID NO: 2523627 - protein, 18 aa, Entamoeba dispar
EVLVKRKKLHEPEIAYWM

SEQ ID NO: 2523628 - protein, 17 aa, Entamoeba dispar
EVMAQFLIDNNFNILFT

SEQ ID NO: 2523629 - protein, 25 aa, Entamoeba dispar
EVMNCVIRTYQFIGALIATEIPVSA

SEQ ID NO: 2523630 - protein, 25 aa, Entamoeba dispar
EVMNRIINILIYFIKDNTEQAMFVE

SEQ ID NO: 2523631 - protein, 19 aa, Entamoeba dispar
EVMRAWITSKIIDILEVDD

SEQ ID NO: 2523632 - protein, 27 aa, Entamoeba dispar
EVMSCEGGWWYGRSGCSMGYFPGEYVE

SEQ ID NO: 2523633 - protein, 34 aa, Entamoeba dispar
EVMYHGICMPWLVIDLIKLIPLICIEKREIVSFQ

SEQ ID NO: 2523634 - protein, 24 aa, Entamoeba dispar
EVNELIQIQGLLDNQLKVLYDKLK

SEQ ID NO: 2523635 - protein, 17 aa, Entamoeba dispar
EVNFCGFKIAKKGTNLS

SEQ ID NO: 2523636 - protein, 33 aa, Entamoeba dispar
EVNFSGLTEKPLDAPPPFSLNGFSFSNSTEKQK

SEQ ID NO: 2523637 - protein, 25 aa, Entamoeba dispar
EVNHVMMLVLLFKEAKVSILRYDET

SEQ ID NO: 2523638 - protein, 30 aa, Entamoeba dispar
EVNPKIYRFRPFIIKLTINTSFGIQFSGEE

SEQ ID NO: 2523639 - protein, 34 aa, Entamoeba dispar
EVNSYSTWLFPDDSENILCFAGAFLISGNCGENE

SEQ ID NO: 2523640 - protein, 28 aa, Entamoeba dispar
EVPIDNIIYSYRFLQVNSLDLTLTTGNR

SEQ ID NO: 2523641 - protein, 27 aa, Entamoeba dispar
EVPQPTYQRPTVPKPTYRPPQQTIPEP

SEQ ID NO: 2523642 - protein, 19 aa, Entamoeba dispar
EVQAKLLRELLTENGIIYG

SEQ ID NO: 2523643 - protein, 28 aa, Entamoeba dispar
EVQLIPNRINCGWTITLLLDLIKEEEIF

SEQ ID NO: 2523644 - protein, 18 aa, Entamoeba dispar
EVQPIKRAQPSIPQRQQS

SEQ ID NO: 2523645 - protein, 28 aa, Entamoeba dispar
EVQQFIIDHWYFFSKLEQFRVSQEQWTN

SEQ ID NO: 2523646 - protein, 23 aa, Entamoeba dispar
EVQTYQCAVARLYLMCIVGSAAV

SEQ ID NO: 2523647 - protein, 23 aa, Entamoeba dispar
EVRKELQPLLINPGNRKAEMLDY

SEQ ID NO: 2523648 - protein, 29 aa, Entamoeba dispar
EVRKNWVGKITLRLLWDLICLSTNNQVFD

SEQ ID NO: 2523649 - protein, 25 aa, Entamoeba dispar
EVRNGLTFLDIIILQLKALSREYGV

SEQ ID NO: 2523650 - protein, 17 aa, Entamoeba dispar
EVRSNITWKCRSIGAYY

SEQ ID NO: 2523651 - protein, 30 aa, Entamoeba dispar
EVSGLLFHRAVFFTAALLRFHINTLVKPNI

SEQ ID NO: 2523652 - protein, 24 aa, Entamoeba dispar
EVSGMILKYLYGIAQNKLGNRPIS

SEQ ID NO: 2523653 - protein, 32 aa, Entamoeba dispar
EVSLCFACQFHLLRLLYYKNLSIPIENACHNF

SEQ ID NO: 2523654 - protein, 20 aa, Entamoeba dispar
EVSLLMKYFVRVYDNKRIIE

SEQ ID NO: 2523655 - protein, 25 aa, Entamoeba dispar
EVSLNCILQKLSSLAINLRKGSTTL

SEQ ID NO: 2523656 - protein, 24 aa, Entamoeba dispar
EVSNTFYLIKIYNLFCSFIIDIYF

SEQ ID NO: 2523657 - protein, 25 aa, Entamoeba dispar
EVSSFKIILQLFSQGIFVSLNKIDS

SEQ ID NO: 2523658 - protein, 21 aa, Entamoeba dispar
EVSSVPPLPPKPRQQQGETYI

SEQ ID NO: 2523659 - protein, 18 aa, Entamoeba dispar
EVSTLFCMINLLTNIRDW

SEQ ID NO: 2523660 - protein, 19 aa, Entamoeba dispar
EVTEHFLFQPNTRKPNPNG

SEQ ID NO: 2523661 - protein, 24 aa, Entamoeba dispar
EVTFLEYTPINYYIKYIDVFLHMK

SEQ ID NO: 2523662 - protein, 17 aa, Entamoeba dispar
EVTKFNRFKEEESPTLI

SEQ ID NO: 2523663 - protein, 29 aa, Entamoeba dispar
EVTQKFLNKWIGIKSCLLTSTPMVASIQY

SEQ ID NO: 2523664 - protein, 27 aa, Entamoeba dispar
EVVDGIVWWCTPYNFVKSFNIDYVVHG

SEQ ID NO: 2523665 - protein, 30 aa, Entamoeba dispar
EVVDSDIVIFAYPVYWYAIPGEIKNFVDRT

SEQ ID NO: 2523666 - protein, 18 aa, Entamoeba dispar
EVVLLNIIGLSNKISKIL

SEQ ID NO: 2523667 - protein, 18 aa, Entamoeba dispar
EVVNITCPNPFQLPPMTP

SEQ ID NO: 2523668 - protein, 20 aa, Entamoeba dispar
EVVRNIYIELTPFSEANGLL

SEQ ID NO: 2523669 - protein, 26 aa, Entamoeba dispar
EVWIAPLYFEFPGYEQAMFKERFCDF

SEQ ID NO: 2523670 - protein, 21 aa, Entamoeba dispar
EVYFFNKYLTSVVSLPFILTY

SEQ ID NO: 2523671 - protein, 36 aa, Entamoeba dispar
EVYLQYSSAPAFFRISNLFWMTYRSGYEKLPNSSLT

SEQ ID NO: 2523672 - protein, 21 aa, Entamoeba dispar
EVYLREFLKRIFDTIHAQQQL

SEQ ID NO: 2523673 - protein, 17 aa, Entamoeba dispar
EVYLVCKDFLAPSKYDP

SEQ ID NO: 2523674 - protein, 28 aa, Entamoeba dispar
EVYVYKDHFVFFDLPTKIANKLLKSKSK

SEQ ID NO: 2523675 - protein, 24 aa, Entamoeba dispar
EWEFFVITERFHFFNRFRIKGIQH

SEQ ID NO: 2523676 - protein, 18 aa, Entamoeba dispar
EWIKLMQCFIQRKEIDEA

SEQ ID NO: 2523677 - protein, 26 aa, Entamoeba dispar
EWIPKELLTNIFIKKIISLLTQEHNL

SEQ ID NO: 2523678 - protein, 33 aa, Entamoeba dispar
EWKKKFHKYKPLKVPGVCLICKQKNIRYAYHTV

SEQ ID NO: 2523679 - protein, 23 aa, Entamoeba dispar
EWKKSIELVIKNADYHYLVNEMN

SEQ ID NO: 2523680 - protein, 22 aa, Entamoeba dispar
EWKYYEILKRITETYELVIKKR

SEQ ID NO: 2523681 - protein, 20 aa, Entamoeba dispar
EWLFWDVSGAAKFRGLWKSY

SEQ ID NO: 2523682 - protein, 18 aa, Entamoeba dispar
EWLRVCTGAYIMQSYGLT

SEQ ID NO: 2523683 - protein, 19 aa, Entamoeba dispar
EWMLRLFKESRGIKMFSGS

SEQ ID NO: 2523684 - protein, 23 aa, Entamoeba dispar
EWNHSFFIPAFVGQKCIIRLMNK

SEQ ID NO: 2523685 - protein, 19 aa, Entamoeba dispar
EWNSNDIELFKKGCKKFPI

SEQ ID NO: 2523686 - protein, 22 aa, Entamoeba dispar
EWQKVLNWLTRNGYLLTDNDFR

SEQ ID NO: 2523687 - protein, 17 aa, Entamoeba dispar
EWRERRISCLLLGEMAK

SEQ ID NO: 2523688 - protein, 18 aa, Entamoeba dispar
EWRNQYFDLIKTLAKQYP

SEQ ID NO: 2523689 - protein, 17 aa, Entamoeba dispar
EWTPEDFLWQGKCVVVA

SEQ ID NO: 2523690 - protein, 20 aa, Entamoeba dispar
EYAAKLLLEDIKVNVLLDFH

SEQ ID NO: 2523691 - protein, 19 aa, Entamoeba dispar
EYAIELKFIIKMICTAFVN

SEQ ID NO: 2523692 - protein, 23 aa, Entamoeba dispar
EYAKHLIQQCSTPMRVGTLLLKK

SEQ ID NO: 2523693 - protein, 19 aa, Entamoeba dispar
EYAQKYPFVCFAKITWEDS

SEQ ID NO: 2523694 - protein, 24 aa, Entamoeba dispar
EYASMLDQYFRNGHGFLIVYSVTD

SEQ ID NO: 2523695 - protein, 17 aa, Entamoeba dispar
EYCIKYPLKILQIDQQH

SEQ ID NO: 2523696 - protein, 21 aa, Entamoeba dispar
EYCRKVPVPCFKGTKEDLWNR

SEQ ID NO: 2523697 - protein, 28 aa, Entamoeba dispar
EYCTDFFQFFMMTLFKQINAQGYQLLLP

SEQ ID NO: 2523698 - protein, 26 aa, Entamoeba dispar
EYDIDLLSFNLEPYYYCFEDGILTTK

SEQ ID NO: 2523699 - protein, 26 aa, Entamoeba dispar
EYDRLRPMSYPNTNILIICFSIDSRS

SEQ ID NO: 2523700 - protein, 19 aa, Entamoeba dispar
EYDVFVYYKHRVRALTLII

SEQ ID NO: 2523701 - protein, 21 aa, Entamoeba dispar
EYEIELLKKWSNKTQYQIIYR

SEQ ID NO: 2523702 - protein, 21 aa, Entamoeba dispar
EYEIWVLLMKQMNEHIKDQLN

SEQ ID NO: 2523703 - protein, 18 aa, Entamoeba dispar
EYELFRFSSLQNELVLGG

SEQ ID NO: 2523704 - protein, 19 aa, Entamoeba dispar
EYFIHYSFIINYYAPCELN

SEQ ID NO: 2523705 - protein, 28 aa, Entamoeba dispar
EYFRNALFKYFDKYLREITLNKGMVKMS

SEQ ID NO: 2523706 - protein, 35 aa, Entamoeba dispar
EYFSMKKIGYSFMYKWLILLFRRDFVSEKCIRLWD

SEQ ID NO: 2523707 - protein, 20 aa, Entamoeba dispar
EYFTDFKKLIKGEPSLLIQI

SEQ ID NO: 2523708 - protein, 18 aa, Entamoeba dispar
EYGYYLNLNTKTCEEFKN

SEQ ID NO: 2523709 - protein, 27 aa, Entamoeba dispar
EYICCEQLFLIYTYFLKDIDKTPQSTY

SEQ ID NO: 2523710 - protein, 20 aa, Entamoeba dispar
EYIEPPPWRPTRRMEINNNR

SEQ ID NO: 2523711 - protein, 19 aa, Entamoeba dispar
EYIIQFYGVFIHNKICMIT

SEQ ID NO: 2523712 - protein, 17 aa, Entamoeba dispar
EYIQCEKGYYLNSNKEC

SEQ ID NO: 2523713 - protein, 20 aa, Entamoeba dispar
EYIQPLIIGCWRLCNEDKCQ

SEQ ID NO: 2523714 - protein, 18 aa, Entamoeba dispar
EYISTAYILIYQKQSKLN

SEQ ID NO: 2523715 - protein, 23 aa, Entamoeba dispar
EYITHTSFCYIFIHALTEEKSTV

SEQ ID NO: 2523716 - protein, 26 aa, Entamoeba dispar
EYITNCLYCHKTCCYPCDIKGDIKDG

SEQ ID NO: 2523717 - protein, 23 aa, Entamoeba dispar
EYIYQFAKQHIFLSGGLAVGKTT

SEQ ID NO: 2523718 - protein, 18 aa, Entamoeba dispar
EYKAIIEEKYRQEDLKES

SEQ ID NO: 2523719 - protein, 24 aa, Entamoeba dispar
EYKEHLQRILIQKTIKLPHIQNIQ

SEQ ID NO: 2523720 - protein, 22 aa, Entamoeba dispar
EYKEKILTFDGINLGGNKIEVC

SEQ ID NO: 2523721 - protein, 21 aa, Entamoeba dispar
EYKIELKPEKEIFIVPVSQSE

SEQ ID NO: 2523722 - protein, 17 aa, Entamoeba dispar
EYKKLTSVIIPTNITRL

SEQ ID NO: 2523723 - protein, 18 aa, Entamoeba dispar
EYKLKNLLVLKDNLIIIK

SEQ ID NO: 2523724 - protein, 21 aa, Entamoeba dispar
EYKLNIILRYYNKSKIVINNI

SEQ ID NO: 2523725 - protein, 24 aa, Entamoeba dispar
EYKNLECLLLRKNKIEQIPAISIP

SEQ ID NO: 2523726 - protein, 25 aa, Entamoeba dispar
EYKNTKYFIIRSKIIMNIRSEQLFE

SEQ ID NO: 2523727 - protein, 24 aa, Entamoeba dispar
EYKSAFYLMLNGRQKYLGDLGLDD

SEQ ID NO: 2523728 - protein, 19 aa, Entamoeba dispar
EYKVDYIVLFDQFTHFLSK

SEQ ID NO: 2523729 - protein, 29 aa, Entamoeba dispar
EYKYDYLISPLMRQADFDAKPMVLFLGQY

SEQ ID NO: 2523730 - protein, 28 aa, Entamoeba dispar
EYLEGYNKSLFWKPQFKKSPKLSERSSR

SEQ ID NO: 2523731 - protein, 17 aa, Entamoeba dispar
EYLIPFCEFQKICEEHG

SEQ ID NO: 2523732 - protein, 18 aa, Entamoeba dispar
EYLKGNAFLYDEIDIRQD

SEQ ID NO: 2523733 - protein, 18 aa, Entamoeba dispar
EYLKTNPLPILNYKCRAE

SEQ ID NO: 2523734 - protein, 19 aa, Entamoeba dispar
EYLNNPIISYYLMYQFGVV

SEQ ID NO: 2523735 - protein, 27 aa, Entamoeba dispar
EYLRELPDPLIPFQYYNEFVIIGRLKE

SEQ ID NO: 2523736 - protein, 21 aa, Entamoeba dispar
EYLTILIHTMAKDPTRLQTYL

SEQ ID NO: 2523737 - protein, 22 aa, Entamoeba dispar
EYLVKFIFHCLPQTVSPLLDQS

SEQ ID NO: 2523738 - protein, 20 aa, Entamoeba dispar
EYLYVNMGIVIQADPFGAPY

SEQ ID NO: 2523739 - protein, 35 aa, Entamoeba dispar
EYMKIIPSNIAIKALWIAIGFFRLGKDYQNCISED

SEQ ID NO: 2523740 - protein, 26 aa, Entamoeba dispar
EYMLLANVWVAKKIYDAFPHCAMLRR

SEQ ID NO: 2523741 - protein, 22 aa, Entamoeba dispar
EYNDYLQILLNNMPFGLQRIFG

SEQ ID NO: 2523742 - protein, 17 aa, Entamoeba dispar
EYNGMKIWCFNAGHILG

SEQ ID NO: 2523743 - protein, 22 aa, Entamoeba dispar
EYNKWWSYPICKLSFEEIFIRR

SEQ ID NO: 2523744 - protein, 24 aa, Entamoeba dispar
EYNMLYKFINMLGMPPRSLLDKGS

SEQ ID NO: 2523745 - protein, 24 aa, Entamoeba dispar
EYNPRIIWLHREPIGNIKSAILLY

SEQ ID NO: 2523746 - protein, 18 aa, Entamoeba dispar
EYNQINLLTYFINQNFYF

SEQ ID NO: 2523747 - protein, 24 aa, Entamoeba dispar
EYNQLYKIISMIGPPPTELLETAT

SEQ ID NO: 2523748 - protein, 28 aa, Entamoeba dispar
EYNTRLTKVILSPYIRSIPPKCFLECIS

SEQ ID NO: 2523749 - protein, 22 aa, Entamoeba dispar
EYPHLYFQFKSVFESVTIYKPE

SEQ ID NO: 2523750 - protein, 24 aa, Entamoeba dispar
EYPLHPRLGKILYLTQKKGIEEIG

SEQ ID NO: 2523751 - protein, 20 aa, Entamoeba dispar
EYPLLLMSDGWYTIQIQIDR

SEQ ID NO: 2523752 - protein, 23 aa, Entamoeba dispar
EYQDKHLFTFNKFISFSNDIEVI

SEQ ID NO: 2523753 - protein, 21 aa, Entamoeba dispar
EYQLYIGWYDGNPAHLDQLQP

SEQ ID NO: 2523754 - protein, 25 aa, Entamoeba dispar
EYQPNPLLDRVFWKKPTNAVIVYQE

SEQ ID NO: 2523755 - protein, 18 aa, Entamoeba dispar
EYQSPEMILLYENQPISR

SEQ ID NO: 2523756 - protein, 20 aa, Entamoeba dispar
EYREELWDYLRQRMQAIAPN

SEQ ID NO: 2523757 - protein, 21 aa, Entamoeba dispar
EYRIKLCSFLVSLPQIYTEEI

SEQ ID NO: 2523758 - protein, 32 aa, Entamoeba dispar
EYRYVVMNNLFPNDNFPLQYKFDLKGSMYGRK

SEQ ID NO: 2523759 - protein, 24 aa, Entamoeba dispar
EYSELLNMPSLVKKNYFEIYNMID

SEQ ID NO: 2523760 - protein, 32 aa, Entamoeba dispar
EYSIKDFSKYVINLSYLCIMACCGNDAIGCFV

SEQ ID NO: 2523761 - protein, 19 aa, Entamoeba dispar
EYSKDITLYLKTYAKVLIK

SEQ ID NO: 2523762 - protein, 24 aa, Entamoeba dispar
EYSNEGQRLIQVKAMGGIVEDQEI

SEQ ID NO: 2523763 - protein, 18 aa, Entamoeba dispar
EYSNIIILLHTITNYHVM

SEQ ID NO: 2523764 - protein, 32 aa, Entamoeba dispar
EYSRVEYYFNLTDWYIGYLIQLYKNGDKSIEK

SEQ ID NO: 2523765 - protein, 25 aa, Entamoeba dispar
EYSTDIYDLIFFNDTYCYNLSLLSP

SEQ ID NO: 2523766 - protein, 24 aa, Entamoeba dispar
EYSTYLQYLLLNTTNEVYLSIIFL

SEQ ID NO: 2523767 - protein, 24 aa, Entamoeba dispar
EYTNFVEMCVPISVLKGFVVTNKK

SEQ ID NO: 2523768 - protein, 18 aa, Entamoeba dispar
EYTNLYIGNIPYSSTEKD

SEQ ID NO: 2523769 - protein, 20 aa, Entamoeba dispar
EYTNLYIGNIPYSSTEKDVK

SEQ ID NO: 2523770 - protein, 22 aa, Entamoeba dispar
EYVEILIMRALSLGLVKGYISQ

SEQ ID NO: 2523771 - protein, 22 aa, Entamoeba dispar
EYVIFQFVEIATKALVSFLSEM

SEQ ID NO: 2523772 - protein, 17 aa, Entamoeba dispar
EYVPTVLIPNKNGVLIS

SEQ ID NO: 2523773 - protein, 17 aa, Entamoeba dispar
EYWHDCIPISKKGFLYV

SEQ ID NO: 2523774 - protein, 31 aa, Entamoeba dispar
EYYEGLHTLAILYIGTIRPFCSIRNSSRIIV

SEQ ID NO: 2523775 - protein, 17 aa, Entamoeba dispar
EYYKMYCERVRIRNIVI

SEQ ID NO: 2523776 - protein, 18 aa, Entamoeba dispar
EYYNNLPPLPDNDALLVL

SEQ ID NO: 2523777 - protein, 23 aa, Entamoeba dispar
EYYQIAKYCTKFTIFHQDYIMRE

SEQ ID NO: 2523778 - protein, 17 aa, Entamoeba dispar
EYYWESYSHPGIHDEML

SEQ ID NO: 2523779 - protein, 39 aa, Entamoeba dispar
FAALFVPDEPIRFLPPIEKHWFPNYSGVSSYLTMFDQIE

SEQ ID NO: 2523780 - protein, 23 aa, Entamoeba dispar
FAALICKIFTNKLPYNPSLNIQQ

SEQ ID NO: 2523781 - protein, 27 aa, Entamoeba dispar
FAASPRALITLLFFPQQPEPDFPNRLA

SEQ ID NO: 2523782 - protein, 24 aa, Entamoeba dispar
FACGIFSCAYLKLSEKQEVCGKRL

SEQ ID NO: 2523783 - protein, 18 aa, Entamoeba dispar
FACNCFGNIWDVSLQRKI

SEQ ID NO: 2523784 - protein, 23 aa, Entamoeba dispar
FAEGLVRVIPNQAEILAGQQEIP

SEQ ID NO: 2523785 - protein, 20 aa, Entamoeba dispar
FAELPLFLCVALINKYSSEL

SEQ ID NO: 2523786 - protein, 18 aa, Entamoeba dispar
FAERADMIVLVFDAHKLD

SEQ ID NO: 2523787 - protein, 20 aa, Entamoeba dispar
FAFAQKFPTPRLGLIEVIKG

SEQ ID NO: 2523788 - protein, 19 aa, Entamoeba dispar
FAFCARLKEVVLQGSLYTL

SEQ ID NO: 2523789 - protein, 31 aa, Entamoeba dispar
FAFESNCWNRVIPYCYYLTTVHRQNDQKFIT

SEQ ID NO: 2523790 - protein, 17 aa, Entamoeba dispar
FAFIGNRFEFRAVGSEQ

SEQ ID NO: 2523791 - protein, 18 aa, Entamoeba dispar
FAFIGNRFEFRAVGSSQN

SEQ ID NO: 2523792 - protein, 27 aa, Entamoeba dispar
FAFKKCYFLQIIQLPIEILSLPKSCFE

SEQ ID NO: 2523793 - protein, 17 aa, Entamoeba dispar
FAFLKNDYIIKYICSYR

SEQ ID NO: 2523794 - protein, 18 aa, Entamoeba dispar
FAFNSFENVFSGNFSFDT

SEQ ID NO: 2523795 - protein, 28 aa, Entamoeba dispar
FAFPTSKFYYFLVVALIKEYADDIIDNQ

SEQ ID NO: 2523796 - protein, 21 aa, Entamoeba dispar
FAFRWFNCFLLREMSLEKGLR

SEQ ID NO: 2523797 - protein, 20 aa, Entamoeba dispar
FAGKIFFSGRLLADTFVLSK

SEQ ID NO: 2523798 - protein, 28 aa, Entamoeba dispar
FAGMISKIVKRRLLLMKNYVSNHSIDMW

SEQ ID NO: 2523799 - protein, 35 aa, Entamoeba dispar
FAIGTTLLCGLIGKIPDIPYWIWDEHLEKKEEPIK

SEQ ID NO: 2523800 - protein, 18 aa, Entamoeba dispar
FAIISYFDKDYKDCGINK

SEQ ID NO: 2523801 - protein, 25 aa, Entamoeba dispar
FAISSLSLWILFMRDKKEWDIFLQK

SEQ ID NO: 2523802 - protein, 32 aa, Entamoeba dispar
FAKALFNRFQQWPPNLYFKGYLTFDVTDIHKC

SEQ ID NO: 2523803 - protein, 19 aa, Entamoeba dispar
FAKIFPNLMELNLSNLDIK

SEQ ID NO: 2523804 - protein, 26 aa, Entamoeba dispar
FAKRCYYWIHFGFTELGDLGGLGIGK

SEQ ID NO: 2523805 - protein, 29 aa, Entamoeba dispar
FAKTNAVQLFIPFRPMLAKPKKSVTDITS

SEQ ID NO: 2523806 - protein, 26 aa, Entamoeba dispar
FAKVDIPQFVPFIPKVLQSVGAMLSR

SEQ ID NO: 2523807 - protein, 17 aa, Entamoeba dispar
FALDFFNIALQPSEDQS

SEQ ID NO: 2523808 - protein, 17 aa, Entamoeba dispar
FALGQMVAMRPIKEYLA

SEQ ID NO: 2523809 - protein, 19 aa, Entamoeba dispar
FAMKQKFIDLRKRAFKFPT

SEQ ID NO: 2523810 - protein, 24 aa, Entamoeba dispar
FAMQRQGIIIIPMYGTFGIDALDY

SEQ ID NO: 2523811 - protein, 25 aa, Entamoeba dispar
FANCYSLINLVLPTSLVLIKRLCFS

SEQ ID NO: 2523812 - protein, 23 aa, Entamoeba dispar
FANQFVNVFYNAFDTNKSNLANF

SEQ ID NO: 2523813 - protein, 26 aa, Entamoeba dispar
FANSVFQVLCSLPPFVEYLKEVIPTD

SEQ ID NO: 2523814 - protein, 18 aa, Entamoeba dispar
FANYVIQKALEFIPESRH

SEQ ID NO: 2523815 - protein, 28 aa, Entamoeba dispar
FAQETPCQMLFTFRFNTAEICKQFKEAF

SEQ ID NO: 2523816 - protein, 44 aa, Entamoeba dispar; identical to SEQ ID NO: 2396592

SEQ ID NO: 2523817 - protein, 41 aa, Entamoeba dispar
FAQYIKTMIKVIWNVFPITDFWRHVCVVWTKCYCYIPKEVI

SEQ ID NO: 2523818 - protein, 26 aa, Entamoeba dispar
FASADKLKLSYLIDLLKGIVDEDDIK

SEQ ID NO: 2523819 - protein, 31 aa, Entamoeba dispar
FASDYFALGCMLYEFVVGYPPFNASTPEAIF

SEQ ID NO: 2523820 - protein, 17 aa, Entamoeba dispar
FASGTFSFGSLGLQAEP

SEQ ID NO: 2523821 - protein, 28 aa, Entamoeba dispar
FATDDFINVIIFLILRSHVKNPFGMTSL

SEQ ID NO: 2523822 - protein, 17 aa, Entamoeba dispar
FATLINYYKEIFKEIED

SEQ ID NO: 2523823 - protein, 23 aa, Entamoeba dispar
FAWNLLHLDYYCDITLPIITARP

SEQ ID NO: 2523824 - protein, 25 aa, Entamoeba dispar
FAYHHNFIHFNKLNYLNLFINDSID

SEQ ID NO: 2523825 - protein, 17 aa, Entamoeba dispar
FCCHLELNDAIDIGATY

SEQ ID NO: 2523826 - protein, 25 aa, Entamoeba dispar
FCCKITEGVLLRKVLSDLIKQSQSK

SEQ ID NO: 2523827 - protein, 28 aa, Entamoeba dispar
FCCKITEGVLLRMVLSDLIKQSQSKLTM

SEQ ID NO: 2523828 - protein, 17 aa, Entamoeba dispar
FCCNSLTSIYLPTHLTS

SEQ ID NO: 2523829 - protein, 23 aa, Entamoeba dispar
FCCYFDCLFYGKAHLTTKPGQPT

SEQ ID NO: 2523830 - protein, 25 aa, Entamoeba dispar
FCEDTTEPYFRAPASFLPIRERREE

SEQ ID NO: 2523831 - protein, 17 aa, Entamoeba dispar
FCEFYPDYIDFGGKCLP

SEQ ID NO: 2523832 - protein, 23 aa, Entamoeba dispar
FCEKKLVLPDNLPKIVILDEADS

SEQ ID NO: 2523833 - protein, 18 aa, Entamoeba dispar
FCEYSPEYLANITTSPLL

SEQ ID NO: 2523834 - protein, 26 aa, Entamoeba dispar
FCFEQGVLLYLLNQYYDLVIKRQPKR

SEQ ID NO: 2523835 - protein, 20 aa, Entamoeba dispar
FCFLHSLIQQQPLLRKTSPF

SEQ ID NO: 2523836 - protein, 40 aa, Entamoeba dispar
FCGRYLYVQFGYQVISNLPLNYIRLKYIANITFESVLHYF

SEQ ID NO: 2523837 - protein, 17 aa, Entamoeba dispar
FCILHLVHIGLLSSLNS

SEQ ID NO: 2523838 - protein, 18 aa, Entamoeba dispar
FCLAKIFSYDSSLISHYL

SEQ ID NO: 2523839 - protein, 17 aa, Entamoeba dispar
FCLCGQRFCFKCLGEYH

SEQ ID NO: 2523840 - protein, 17 aa, Entamoeba dispar
FCMINLLTNIRDWFDST

SEQ ID NO: 2523841 - protein, 21 aa, Entamoeba dispar
FCMIRSICKIRIGSEAKDYIL

SEQ ID NO: 2523842 - protein, 17 aa, Entamoeba dispar
FCNDDLFNLLTFEMIKD

SEQ ID NO: 2523843 - protein, 26 aa, Entamoeba dispar
FCNENEWFYFHEIKPLIKQTLPIINK

SEQ ID NO: 2523844 - protein, 20 aa, Entamoeba dispar
FCNSYFCRKLESGNFDELVR

SEQ ID NO: 2523845 - protein, 18 aa, Entamoeba dispar
FCQMFNTNELYYIWDILF

SEQ ID NO: 2523846 - protein, 22 aa, Entamoeba dispar
FCQNRNGVIGIGEWYEKFKQLI

SEQ ID NO: 2523847 - protein, 19 aa, Entamoeba dispar
FCQTEIMVLVVTKVDQKEG

SEQ ID NO: 2523848 - protein, 18 aa, Entamoeba dispar
FCRQPITSFNFPSKLTKL

SEQ ID NO: 2523849 - protein, 17 aa, Entamoeba dispar
FCRVCSYRLGITKLDIP

SEQ ID NO: 2523850 - protein, 19 aa, Entamoeba dispar
FCSALKERFSDFIGEGLLL

SEQ ID NO: 2523851 - protein, 25 aa, Entamoeba dispar
FCSIFSFIEYFLPPAIPKPRSYGVF

SEQ ID NO: 2523852 - protein, 26 aa, Entamoeba dispar
FCSVSDALLSIQFKTPYKALQLAQFL

SEQ ID NO: 2523853 - protein, 20 aa, Entamoeba dispar
FCTSPLITVIIPIAYHQEIE

SEQ ID NO: 2523854 - protein, 18 aa, Entamoeba dispar
FCVICGCPLLLDEGIRSM

SEQ ID NO: 2523855 - protein, 21 aa, Entamoeba dispar
FCVLLRLFQLNPTPDDIRMMS

SEQ ID NO: 2523856 - protein, 17 aa, Entamoeba dispar
FCVVLSKGKLYSWGAYE

SEQ ID NO: 2523857 - protein, 26 aa, Entamoeba dispar
FCYCELPIQCKICNAILLLSHHFARS

SEQ ID NO: 2523858 - protein, 17 aa, Entamoeba dispar
FCYSFFDSAFKAEDSLN

SEQ ID NO: 2523859 - protein, 26 aa, Entamoeba dispar
FDAARDWMTLFSKIATHILIVKDYKE

SEQ ID NO: 2523860 - protein, 22 aa, Entamoeba dispar
FDAKILEIVQPKPGTFIGDGIT

SEQ ID NO: 2523861 - protein, 18 aa, Entamoeba dispar
FDCAIRLRKPNFINVDYV

SEQ ID NO: 2523862 - protein, 25 aa, Entamoeba dispar
FDCASAYFPILYPPKGDEALRIDLT

SEQ ID NO: 2523863 - protein, 25 aa, Entamoeba dispar
FDCDDPFFMTTYAKDIFKYLKEEEE

SEQ ID NO: 2523864 - protein, 20 aa, Entamoeba dispar
FDCLPLCALINQNVNGRILC

SEQ ID NO: 2523865 - protein, 19 aa, Entamoeba dispar
FDCLPLCGIVNSNLGSFFC

SEQ ID NO: 2523866 - protein, 17 aa, Entamoeba dispar
FDCMKYIDPVLYSHFYS

SEQ ID NO: 2523867 - protein, 21 aa, Entamoeba dispar
FDCMTRIYVWMGDESIPLQQK

SEQ ID NO: 2523868 - protein, 26 aa, Entamoeba dispar
FDDGKIFKKVIWYTVNYSTYLKEKEQ

SEQ ID NO: 2523869 - protein, 29 aa, Entamoeba dispar
FDDGKIFKYVIWFLVEYPTYLKEKEAGNI

SEQ ID NO: 2523870 - protein, 28 aa, Entamoeba dispar
FDDGKIFKYVIWYLVDYSTYLQGKEEGN

SEQ ID NO: 2523871 - protein, 28 aa, Entamoeba dispar
FDDGRIFKEIIWYLVDYSTYLKEKEAGN

SEQ ID NO: 2523872 - protein, 26 aa, Entamoeba dispar
FDDGRIFKKMIWYKVKYSTYYERNNK

SEQ ID NO: 2523873 - protein, 28 aa, Entamoeba dispar
FDDGRIFKTIIWYTVDYSTYLFEKEQGN

SEQ ID NO: 2523874 - protein, 35 aa, Entamoeba dispar
FDDLQILLPAIYSYARKYFYLSIYSNAIKGLTINS

SEQ ID NO: 2523875 - protein, 24 aa, Entamoeba dispar
FDDRRIFKQVIWYDISYSQYLKEK

SEQ ID NO: 2523876 - protein, 25 aa, Entamoeba dispar
FDDRRIFKQVIWYDISYSQYLKEKE

SEQ ID NO: 2523877 - protein, 28 aa, Entamoeba dispar
FDDRRVFKYVIWYLVSYSEYLKKKEKWS

SEQ ID NO: 2523878 - protein, 20 aa, Entamoeba dispar
FDDSLITVILDKIKSHIGDT

SEQ ID NO: 2523879 - protein, 32 aa, Entamoeba dispar
FDDYGNVIFLSTPKFIITPQRLHFITEHPKEM

SEQ ID NO: 2523880 - protein, 27 aa, Entamoeba dispar
FDDYGSLIPIPILYDIIRTAIDHKRTI

SEQ ID NO: 2523881 - protein, 19 aa, Entamoeba dispar
FDEAVKTVLMNKPQQRSKC

SEQ ID NO: 2523882 - protein, 28 aa, Entamoeba dispar
FDEDEQLWYWNYDGTKLPLYINSTIRFK

SEQ ID NO: 2523883 - protein, 23 aa, Entamoeba dispar
FDEFIEKLIKLPRKSLEKSRENE

SEQ ID NO: 2523884 - protein, 26 aa, Entamoeba dispar
FDEFIKKLIKLPRKSLDKSREVLKRR

SEQ ID NO: 2523885 - protein, 18 aa, Entamoeba dispar
FDEFIKKLIKLPRKSLDN

SEQ ID NO: 2523886 - protein, 38 aa, Entamoeba dispar
FDEFINGLTEISFKLKEMYYLLTQGGVAELELVDTLNP

SEQ ID NO: 2523887 - protein, 20 aa, Entamoeba dispar
FDENVEINKFIKPPEFTQNQ

SEQ ID NO: 2523888 - protein, 27 aa, Entamoeba dispar
FDEQKLHLKGYIPLAFGTITRSPEMKK

SEQ ID NO: 2523889 - protein, 24 aa, Entamoeba dispar
FDEQNPPLMPLLSDPVRNTKNSSK

SEQ ID NO: 2523890 - protein, 31 aa, Entamoeba dispar
FDEYKAQKKIALDKFLFLYAKELQSEPITIS

SEQ ID NO: 2523891 - protein, 31 aa, Entamoeba dispar
FDEYMEGLMAPIPLQQPIYKEPKLSDLVNLD

SEQ ID NO: 2523892 - protein, 17 aa, Entamoeba dispar
FDFDKQILTPSKSPSSS

SEQ ID NO: 2523893 - protein, 19 aa, Entamoeba dispar
FDFIFKIIISSIECKNKEA

SEQ ID NO: 2523894 - protein, 18 aa, Entamoeba dispar
FDGLLVGVPLKAVSGRIG

SEQ ID NO: 2523895 - protein, 47 aa, Entamoeba dispar
FDGSHIKGLLINYFHTFWPSLLKIDNFLVEFITPIVKVKRGKQEISF

SEQ ID NO: 2523896 - protein, 32 aa, Entamoeba dispar
FDHSIKLWSLKNWNWKLIWKYEEHSKPVVDVD

SEQ ID NO: 2523897 - protein, 18 aa, Entamoeba dispar
FDIIAKDIKIVISIYPSN

SEQ ID NO: 2523898 - protein, 25 aa, Entamoeba dispar
FDINSYCRELLFPLTIDENNIGVDN

SEQ ID NO: 2523899 - protein, 17 aa, Entamoeba dispar
FDIYSLIQQFKIKDILD

SEQ ID NO: 2523900 - protein, 18 aa, Entamoeba dispar
FDIYSLIQQFKIKDILDY

SEQ ID NO: 2523901 - protein, 33 aa, Entamoeba dispar
FDKDLGICTAILKKFLYELPTPLIPQTNIKYLK

SEQ ID NO: 2523902 - protein, 18 aa, Entamoeba dispar
FDKEPMIFFVNRKSGNLL

SEQ ID NO: 2523903 - protein, 27 aa, Entamoeba dispar
FDKHVGYLVFVLLFSNVPESTRMIINT

SEQ ID NO: 2523904 - protein, 18 aa, Entamoeba dispar
FDKLIPKVKFIDIDDDVI

SEQ ID NO: 2523905 - protein, 20 aa, Entamoeba dispar
FDKMPLIRYNKIEQVKWAVH

SEQ ID NO: 2523906 - protein, 25 aa, Entamoeba dispar
FDLEQYLYLILGEKKFQTIYDSRQD

SEQ ID NO: 2523907 - protein, 17 aa, Entamoeba dispar
FDLIKTLAKQYPEQSDI

SEQ ID NO: 2523908 - protein, 18 aa, Entamoeba dispar
FDLNIKFGLYIKEIDEEE

SEQ ID NO: 2523909 - protein, 17 aa, Entamoeba dispar
FDMFHWGHANVIRQAAA

SEQ ID NO: 2523910 - protein, 21 aa, Entamoeba dispar
FDMKVKLWDLISKSNTPLMSL

SEQ ID NO: 2523911 - protein, 21 aa, Entamoeba dispar
FDNFPVLCEILRAVTKKRCVT

SEQ ID NO: 2523912 - protein, 24 aa, Entamoeba dispar
FDNIMITRLPSIEPFLIQKLNNIN

SEQ ID NO: 2523913 - protein, 18 aa, Entamoeba dispar
FDNKFSKYTLERVPKEFA

SEQ ID NO: 2523914 - protein, 23 aa, Entamoeba dispar
FDNYYYLNYIYLLEENNIEMDFI

SEQ ID NO: 2523915 - protein, 19 aa, Entamoeba dispar
FDPKRIFILHMTMIQRKIK

SEQ ID NO: 2523916 - protein, 23 aa, Entamoeba dispar
FDQFWSLTSITIATTIKELWESC

SEQ ID NO: 2523917 - protein, 21 aa, Entamoeba dispar
FDQICLAFRSVLRRESNLIVD

SEQ ID NO: 2523918 - protein, 26 aa, Entamoeba dispar
FDQKCPPFLIGPLKKNILPIESVEMI

SEQ ID NO: 2523919 - protein, 17 aa, Entamoeba dispar
FDQLFNTIKLHPKRFLL

SEQ ID NO: 2523920 - protein, 27 aa, Entamoeba dispar
FDQNRDQIISILIRLEDSMQIPMKETE

SEQ ID NO: 2523921 - protein, 21 aa, Entamoeba dispar
FDQQIALAFMYGYGSVGFNSA

SEQ ID NO: 2523922 - protein, 20 aa, Entamoeba dispar
FDRCLSLTSIIIPTSISKIG

SEQ ID NO: 2523923 - protein, 25 aa, Entamoeba dispar
FDRIRNRAYPDTDVFLICYAVDDQN

SEQ ID NO: 2523924 - protein, 22 aa, Entamoeba dispar
FDSDVLPTIKLLLQNGTPVIKS

SEQ ID NO: 2523925 - protein, 25 aa, Entamoeba dispar
FDSGKLVLSTWLGTNSFLSRSEAHY

SEQ ID NO: 2523926 - protein, 34 aa, Entamoeba dispar
FDSGNIISNPRWYENPQFLLTLTGKLHIKVCLKQ

SEQ ID NO: 2523927 - protein, 23 aa, Entamoeba dispar
FDSHWEKILSKIPMIIQCGDDYF

SEQ ID NO: 2523928 - protein, 21 aa, Entamoeba dispar
FDSIPIALSLQFSKRGHLLCI

SEQ ID NO: 2523929 - protein, 17 aa, Entamoeba dispar
FDSNWNLIFKSNDFYYY

SEQ ID NO: 2523930 - protein, 18 aa, Entamoeba dispar
FDSSFLLLNSIPLEIDAA

SEQ ID NO: 2523931 - protein, 25 aa, Entamoeba dispar
FDTALDIRVKMQGILGDVNSLPLSE

SEQ ID NO: 2523932 - protein, 30 aa, Entamoeba dispar
FDTVFGIYLHYPLISPFKYPRDPQHFIFST

SEQ ID NO: 2523933 - protein, 20 aa, Entamoeba dispar
FDTVWNTNYAYRVSTDDGVN

SEQ ID NO: 2523934 - protein, 26 aa, Entamoeba dispar
FDTYKKLLDLLKKYNKNYFVKTTNVD

SEQ ID NO: 2523935 - protein, 29 aa, Entamoeba dispar
FDVDTWRNFCEVFRYLPVSALIEGKILCL

SEQ ID NO: 2523936 - protein, 24 aa, Entamoeba dispar
FDVKCNLLTLLNFFVKTGHFNDQM

SEQ ID NO: 2523937 - protein, 18 aa, Entamoeba dispar
FDVMRIINEPTAAAIAYG

SEQ ID NO: 2523938 - protein, 25 aa, Entamoeba dispar
FDVSLKYPLHPNAMYSLISVRGKQQ

SEQ ID NO: 2523939 - protein, 17 aa, Entamoeba dispar
FDVVSLFESLQLLAVKG

SEQ ID NO: 2523940 - protein, 21 aa, Entamoeba dispar
FDWEFEIKQIAPEATILILGN

SEQ ID NO: 2523941 - protein, 18 aa, Entamoeba dispar
FDWINDCQMVFTGVWHGT

SEQ ID NO: 2523942 - protein, 25 aa, Entamoeba dispar
FDYNQYYIFSMWTIQRVHNFHSIFN

SEQ ID NO: 2523943 - protein, 25 aa, Entamoeba dispar
FEAEQRLGIISYGRTVKDSLRKEHN

SEQ ID NO: 2523944 - protein, 28 aa, Entamoeba dispar
FEAIDRGRYYVMYTRIKGMRDEDIDVHI

SEQ ID NO: 2523945 - protein, 24 aa, Entamoeba dispar
FEAIQQAFILSLLNNEGIGFKVKK

SEQ ID NO: 2523946 - protein, 19 aa, Entamoeba dispar
FEAYLEFYKKYGGDYLLTL

SEQ ID NO: 2523947 - protein, 17 aa, Entamoeba dispar
FECINNVIRFKDTKYDI

SEQ ID NO: 2523948 - protein, 24 aa, Entamoeba dispar
FECKFCIYCNSYGYWPTFTLVKVE

SEQ ID NO: 2523949 - protein, 17 aa, Entamoeba dispar
FECVSLEYFSVPSSISK

SEQ ID NO: 2523950 - protein, 23 aa, Entamoeba dispar
FEDIVGFLLAKIYNCIGEDIFTV

SEQ ID NO: 2523951 - protein, 18 aa, Entamoeba dispar
FEDKSLVLVVLTSSADYN

SEQ ID NO: 2523952 - protein, 24 aa, Entamoeba dispar
FEDSKYVYILLNLCNQETLKEVLV

SEQ ID NO: 2523953 - protein, 23 aa, Entamoeba dispar
FEDSLLTFVQYPPQFGARMVRCS

SEQ ID NO: 2523954 - protein, 22 aa, Entamoeba dispar
FEDYVYEFIILKKVSIKDRLPI

SEQ ID NO: 2523955 - protein, 23 aa, Entamoeba dispar
FEEDEFLCSVPTIEKPRTISKPM

SEQ ID NO: 2523956 - protein, 18 aa, Entamoeba dispar
FEEFIYYSRIYSHSTTHH

SEQ ID NO: 2523957 - protein, 25 aa, Entamoeba dispar
FEEGDKKILILRFFESAIVGKTLQT

SEQ ID NO: 2523958 - protein, 25 aa, Entamoeba dispar
FEEHYNNLERFPAIKIPKTSEEVTE

SEQ ID NO: 2523959 - protein, 28 aa, Entamoeba dispar
FEEKLTSTFFNPPRINNLPPQQPIQEIL

SEQ ID NO: 2523960 - protein, 20 aa, Entamoeba dispar
FEEKLTSTFFNPPRNNNLPP

SEQ ID NO: 2523961 - protein, 21 aa, Entamoeba dispar
FEEKYIYYLTIALNRTLTSPN

SEQ ID NO: 2523962 - protein, 34 aa, Entamoeba dispar
FEELISWITPLQHQFFEVLKYLHSLHIVHRDIKP

SEQ ID NO: 2523963 - protein, 28 aa, Entamoeba dispar
FEEQEQLWIFTQPIYPISIHSYVFKQHI

SEQ ID NO: 2523964 - protein, 32 aa, Entamoeba dispar
FEERQRFARMYLLNTPILYGKINVSKLPYGFG

SEQ ID NO: 2523965 - protein, 28 aa, Entamoeba dispar
FEEYNSRRLTFLFSQLPPELRRHIENDF

SEQ ID NO: 2523966 - protein, 17 aa, Entamoeba dispar
FEFFYKRKYESRKLQWV

SEQ ID NO: 2523967 - protein, 27 aa, Entamoeba dispar
FEFNESLLHFIFYHYNSRVFKDFNQND

SEQ ID NO: 2523968 - protein, 20 aa, Entamoeba dispar
FEFNNQQQFNVFSNDFSFDK

SEQ ID NO: 2523969 - protein, 19 aa, Entamoeba dispar
FEFPIPIEIIIDCYKNNNN

SEQ ID NO: 2523970 - protein, 25 aa, Entamoeba dispar
FEGDSIVRLPCLHKFHQECLLKSLS

SEQ ID NO: 2523971 - protein, 18 aa, Entamoeba dispar
FEGLYPFVQTVVGSSLGC

SEQ ID NO: 2523972 - protein, 17 aa, Entamoeba dispar
FEGRLPYCESHILSSTH

SEQ ID NO: 2523973 - protein, 17 aa, Entamoeba dispar
FEHCISLSNITIPTSIV

SEQ ID NO: 2523974 - protein, 25 aa, Entamoeba dispar
FEHEYEYCYYLRYTTTTPKVVIIVT

SEQ ID NO: 2523975 - protein, 25 aa, Entamoeba dispar
FEHPKGMFVLPFEIPKSIFQMTSER

SEQ ID NO: 2523976 - protein, 18 aa, Entamoeba dispar
FEIIKSHHFSDCYTFDVV

SEQ ID NO: 2523977 - protein, 18 aa, Entamoeba dispar
FEIKWMNFSYRHNTWINF

SEQ ID NO: 2523978 - protein, 17 aa, Entamoeba dispar
FEILIKEGETLPTTGAT

SEQ ID NO: 2523979 - protein, 26 aa, Entamoeba dispar
FEIRNYLMCQQGVLLLLLNQHFDITI

SEQ ID NO: 2523980 - protein, 25 aa, Entamoeba dispar
FEKETFFVKITLRLPKYVPVLRHIL

SEQ ID NO: 2523981 - protein, 20 aa, Entamoeba dispar
FEKFGGITDCKVMRTPQGVS

SEQ ID NO: 2523982 - protein, 25 aa, Entamoeba dispar
FEKGKKFFVVIVLPVFSEGQLRQKS

SEQ ID NO: 2523983 - protein, 25 aa, Entamoeba dispar
FEKKAFCYAMIIFGIIVIRDDMLDN

SEQ ID NO: 2523984 - protein, 21 aa, Entamoeba dispar
FEKKLFAKLQFLDLSYNEIKV

SEQ ID NO: 2523985 - protein, 22 aa, Entamoeba dispar
FEKKMMGMDINKIGISLIETVN

SEQ ID NO: 2523986 - protein, 21 aa, Entamoeba dispar
FEKMIICWIDIMGNAIREECS

SEQ ID NO: 2523987 - protein, 30 aa, Entamoeba dispar
FEKMISGIYMGWLARLAIRELIEKKVIFER

SEQ ID NO: 2523988 - protein, 25 aa, Entamoeba dispar
FEKNEFLINTLPIKIYKPITIQRKI

SEQ ID NO: 2523989 - protein, 25 aa, Entamoeba dispar
FEKSVPFKKFYLEALDLLQPVEKVT

SEQ ID NO: 2523990 - protein, 17 aa, Entamoeba dispar
FELFKDTYKSKLNEWEP

SEQ ID NO: 2523991 - protein, 28 aa, Entamoeba dispar
FELHHQSNLAYFLLRRALRNKNIIGHQF

SEQ ID NO: 2523992 - protein, 18 aa, Entamoeba dispar
FELHWHLIVQDEYQIPSF

SEQ ID NO: 2523993 - protein, 18 aa, Entamoeba dispar
FELIFAVYATDRLREVKY

SEQ ID NO: 2523994 - protein, 18 aa, Entamoeba dispar
FEMEFKFGSMIIYSPPDE

SEQ ID NO: 2523995 - protein, 17 aa, Entamoeba dispar
FEMIEFVELYNFNPILQ

SEQ ID NO: 2523996 - protein, 19 aa, Entamoeba dispar
FEMIESLDILPQSSRYLVI

SEQ ID NO: 2523997 - protein, 24 aa, Entamoeba dispar
FEMNTFEFIGMLQAQGFPKVIGCL

SEQ ID NO: 2523998 - protein, 18 aa, Entamoeba dispar
FEMRFFDGNIKKFYILYP

SEQ ID NO: 2523999 - protein, 24 aa, Entamoeba dispar
FENCYETFNREELLWEHISSIHGM

SEQ ID NO: 2524000 - protein, 28 aa, Entamoeba dispar
FENITGCKLLYQLLIQPDERIRSVFVKI

SEQ ID NO: 2524001 - protein, 19 aa, Entamoeba dispar
FENLFKQLTFIECRFHLVC

SEQ ID NO: 2524002 - protein, 17 aa, Entamoeba dispar
FENLRGFAVMAIDNGPL

SEQ ID NO: 2524003 - protein, 22 aa, Entamoeba dispar
FENLTMLFKIYCIDKTNIISIT

SEQ ID NO: 2524004 - protein, 18 aa, Entamoeba dispar
FENSTARHKKYFKTELNL

SEQ ID NO: 2524005 - protein, 24 aa, Entamoeba dispar
FENTLQLNELFYLKEWTGQHEFRI

SEQ ID NO: 2524006 - protein, 18 aa, Entamoeba dispar
FEPAFYAASLSSQCPQGF

SEQ ID NO: 2524007 - protein, 17 aa, Entamoeba dispar
FEPSFNNNIIYPKYLQY

SEQ ID NO: 2524008 - protein, 18 aa, Entamoeba dispar
FEPTFIPHQSLLVCPSFS

SEQ ID NO: 2524009 - protein, 29 aa, Entamoeba dispar
FEQHEYQPFNFFIQPLPSVNDRLGITPEM

SEQ ID NO: 2524010 - protein, 21 aa, Entamoeba dispar
FEQIILFTFKSHLLKSVRILT

SEQ ID NO: 2524011 - protein, 17 aa, Entamoeba dispar
FEQILKRCIEGISCLSE

SEQ ID NO: 2524012 - protein, 25 aa, Entamoeba dispar
FEQMTKCFLKFVDVFKLYSSFVNNY

SEQ ID NO: 2524013 - protein, 24 aa, Entamoeba dispar
FEQQTLKYAFFVRRKKENKITSTP

SEQ ID NO: 2524014 - protein, 28 aa, Entamoeba dispar
FEQTKFESLPQPMKLIKDVLTPEAPNKK

SEQ ID NO: 2524015 - protein, 18 aa, Entamoeba dispar
FEQTLLEQLIIPNTIEKI

SEQ ID NO: 2524016 - protein, 20 aa, Entamoeba dispar
FERAYHTATYYKKKIYLVGG

SEQ ID NO: 2524017 - protein, 28 aa, Entamoeba dispar
FERCLDDFIFFCFLVGNDFLPRIPSLDI

SEQ ID NO: 2524018 - protein, 31 aa, Entamoeba dispar
FERCVDDFIFFCFLVGNDFLPHIPSLDIRDG

SEQ ID NO: 2524019 - protein, 31 aa, Entamoeba dispar
FERCVDDFIFFCFLVGNDFLPRIPSLDIRDG

SEQ ID NO: 2524020 - protein, 19 aa, Entamoeba dispar
FERGIRIINYLYHRTASTG

SEQ ID NO: 2524021 - protein, 19 aa, Entamoeba dispar
FERIVPIYYRRSDIICIFV

SEQ ID NO: 2524022 - protein, 17 aa, Entamoeba dispar
FERNWSLAFNGNLLAIG

SEQ ID NO: 2524023 - protein, 18 aa, Entamoeba dispar
FERPWNAPKYLKQKKENK

SEQ ID NO: 2524024 - protein, 24 aa, Entamoeba dispar
FERTLFHFNCLFQLSKTNSSYLLI

SEQ ID NO: 2524025 - protein, 24 aa, Entamoeba dispar
FESFDYFNHLRLIRRRDIALRFKE

SEQ ID NO: 2524026 - protein, 32 aa, Entamoeba dispar
FESKLVPSDIVFLKGWIPVKINKFYNPMTDLT

SEQ ID NO: 2524027 - protein, 17 aa, Entamoeba dispar
FESLIRISQAHAKLMMH

SEQ ID NO: 2524028 - protein, 24 aa, Entamoeba dispar
FESLKWKKVILDIQFERAYHTATY

SEQ ID NO: 2524029 - protein, 20 aa, Entamoeba dispar
FESQHFSFFLQNFPKRHDHI

SEQ ID NO: 2524030 - protein, 27 aa, Entamoeba dispar
FESSFDVFIFKLKKFFDPIMYTVSNDI

SEQ ID NO: 2524031 - protein, 18 aa, Entamoeba dispar
FESVKTLPIYQQISDFHL

SEQ ID NO: 2524032 - protein, 31 aa, Entamoeba dispar
FETDGVRFLFRLCEDVYIVLITTLSSNVIED

SEQ ID NO: 2524033 - protein, 25 aa, Entamoeba dispar
FETDSPLWYCIISQTNESCKVLRAQ

SEQ ID NO: 2524034 - protein, 18 aa, Entamoeba dispar
FETGTFPKNFPFIIGVVV

SEQ ID NO: 2524035 - protein, 18 aa, Entamoeba dispar
FETLLYYQSDLAEIKDEI

SEQ ID NO: 2524036 - protein, 25 aa, Entamoeba dispar
FETVKTLFPSLKKSGSLVVYCQYLD

SEQ ID NO: 2524037 - protein, 22 aa, Entamoeba dispar
FETVVALVYIFMVSPRHTRACF

SEQ ID NO: 2524038 - protein, 24 aa, Entamoeba dispar
FEVGVKYLKLMWKNTKNIKEKENM

SEQ ID NO: 2524039 - protein, 20 aa, Entamoeba dispar
FEVKLKYIETFIPPLVKSLS

SEQ ID NO: 2524040 - protein, 18 aa, Entamoeba dispar
FEVLKDKIYQIRGFDISN

SEQ ID NO: 2524041 - protein, 23 aa, Entamoeba dispar
FEVNPLLNAIDYYEKKNYEVTII

SEQ ID NO: 2524042 - protein, 24 aa, Entamoeba dispar
FEVNPLLNAIDYYEKKNYEVTIII

SEQ ID NO: 2524043 - protein, 18 aa, Entamoeba dispar
FEVQDLLRRLESAKIKPL

SEQ ID NO: 2524044 - protein, 24 aa, Entamoeba dispar
FEVYLRLIPMNYFTMLNGISKLLD

SEQ ID NO: 2524045 - protein, 27 aa, Entamoeba dispar
FEWFKDCGDYFFNWFNTVLKDTNKTKR

SEQ ID NO: 2524046 - protein, 24 aa, Entamoeba dispar
FEYCKSLRRIKIPSSISKLGDGCF

SEQ ID NO: 2524047 - protein, 18 aa, Entamoeba dispar
FEYIKYISLCYQTFLNNF

SEQ ID NO: 2524048 - protein, 21 aa, Entamoeba dispar
FEYLLESLGFAFALPMESSQT

SEQ ID NO: 2524049 - protein, 26 aa, Entamoeba dispar
FEYQRIGVQFGLRKKGRLLIGDEMGL

SEQ ID NO: 2524050 - protein, 18 aa, Entamoeba dispar
FEYRIWNEYYLREFDQIC

SEQ ID NO: 2524051 - protein, 18 aa, Entamoeba dispar
FFATWCGPCRSIGPYFEE

SEQ ID NO: 2524052 - protein, 20 aa, Entamoeba dispar
FFAVYSKIDAVSLLFVCKKG

SEQ ID NO: 2524053 - protein, 18 aa, Entamoeba dispar
FFCLFDNTNGPMVVYQDP

SEQ ID NO: 2524054 - protein, 17 aa, Entamoeba dispar
FFDELDALAPKRSEDSS

SEQ ID NO: 2524055 - protein, 18 aa, Entamoeba dispar
FFDEVMTIAYQLVKIMNY

SEQ ID NO: 2524056 - protein, 31 aa, Entamoeba dispar
FFDKNNPLTFFFKIIYFISIASFGEIIQLKK

SEQ ID NO: 2524057 - protein, 17 aa, Entamoeba dispar
FFDLTKNVITEEGDDRY

SEQ ID NO: 2524058 - protein, 30 aa, Entamoeba dispar
FFDVNTFYSYVYYQIFFSKGINLDKQVDAL

SEQ ID NO: 2524059 - protein, 26 aa, Entamoeba dispar
FFEPNTLDKFIFPVNLKTLMLTNCIN

SEQ ID NO: 2524060 - protein, 18 aa, Entamoeba dispar
FFETILNKFGVLEEYAEM

SEQ ID NO: 2524061 - protein, 17 aa, Entamoeba dispar
FFFGGFSNSILSYCVKS

SEQ ID NO: 2524062 - protein, 24 aa, Entamoeba dispar
FFGCAHLISFQIPLLVHQLTDYTF

SEQ ID NO: 2524063 - protein, 17 aa, Entamoeba dispar
FFHIDFGHFLGNFKSKF

SEQ ID NO: 2524064 - protein, 17 aa, Entamoeba dispar
FFHNIETFHIYNKYDEI

SEQ ID NO: 2524065 - protein, 25 aa, Entamoeba dispar
FFHNIILHQIVPVNVLFMSSFQLLE

SEQ ID NO: 2524066 - protein, 18 aa, Entamoeba dispar
FFIGSWIDMSQQGGMDGG

SEQ ID NO: 2524067 - protein, 26 aa, Entamoeba dispar
FFISVFHGLFFYNEFNGAYLIYNVLS

SEQ ID NO: 2524068 - protein, 19 aa, Entamoeba dispar
FFKRYIIQELIGRGSFGQV

SEQ ID NO: 2524069 - protein, 29 aa, Entamoeba dispar
FFKSSYPVNGFPLFPKRSISYPMRDTALC

SEQ ID NO: 2524070 - protein, 18 aa, Entamoeba dispar
FFKVFGNVSVIKYIKKTD

SEQ ID NO: 2524071 - protein, 18 aa, Entamoeba dispar
FFLKILKSGGMLGFFAMD

SEQ ID NO: 2524072 - protein, 25 aa, Entamoeba dispar
FFNIHKIIPIFVFDGATLPSKKLIE

SEQ ID NO: 2524073 - protein, 19 aa, Entamoeba dispar
FFNVLKNNDFPSGKLLLFV

SEQ ID NO: 2524074 - protein, 25 aa, Entamoeba dispar
FFPDINITFLLDRPTTVPLQKIRKE

SEQ ID NO: 2524075 - protein, 17 aa, Entamoeba dispar
FFPGMETLSLINPTEIP

SEQ ID NO: 2524076 - protein, 19 aa, Entamoeba dispar
FFQAICNLIITIPKVHFSV

SEQ ID NO: 2524077 - protein, 18 aa, Entamoeba dispar
FFQGRVIDDIIFLTAYNQ

SEQ ID NO: 2524078 - protein, 18 aa, Entamoeba dispar
FFQTLLTCKVEEGIQSIF

SEQ ID NO: 2524079 - protein, 39 aa, Entamoeba dispar
FFQTTKEVRFFFETFKKLRVGAVLYLLYGRQSQNSRNEQ

SEQ ID NO: 2524080 - protein, 26 aa, Entamoeba dispar
FFRNIETQFLYYPFEEKIPSNHLLYR

SEQ ID NO: 2524081 - protein, 18 aa, Entamoeba dispar
FFRTAKRLILFDFVTKTI

SEQ ID NO: 2524082 - protein, 17 aa, Entamoeba dispar
FFSDIHWDTLFDESRED

SEQ ID NO: 2524083 - protein, 17 aa, Entamoeba dispar
FFSSRWTPYRRAENKLL

SEQ ID NO: 2524084 - protein, 23 aa, Entamoeba dispar
FFTHLVVEACHRTLHGYEFNVDN

SEQ ID NO: 2524085 - protein, 23 aa, Entamoeba dispar
FFTLSFLILSYTIQVTPEHLNGG

SEQ ID NO: 2524086 - protein, 30 aa, Entamoeba dispar
FFTPVTSIEYIPFYELYLDQIKPLNEWMME

SEQ ID NO: 2524087 - protein, 26 aa, Entamoeba dispar
FFVCQGRFIFKELPTTISSLEEVLMS

SEQ ID NO: 2524088 - protein, 17 aa, Entamoeba dispar
FFVSINQPDKNSQVLLD

SEQ ID NO: 2524089 - protein, 25 aa, Entamoeba dispar
FFVVSKTCPLLKFEKLLIPKTNNEI

SEQ ID NO: 2524090 - protein, 18 aa, Entamoeba dispar
FFYRAEFVEVATGANVLK

SEQ ID NO: 2524091 - protein, 19 aa, Entamoeba dispar
FGAHRFFEKEGIPFSVQEM

SEQ ID NO: 2524092 - protein, 19 aa, Entamoeba dispar
FGANKIPCVGFSVGLERIM

SEQ ID NO: 2524093 - protein, 17 aa, Entamoeba dispar
FGCEVLFFLMAHKINYP

SEQ ID NO: 2524094 - protein, 25 aa, Entamoeba dispar
FGDENYGWLSIQKTTIPKSVCCSLN

SEQ ID NO: 2524095 - protein, 18 aa, Entamoeba dispar
FGDGGIVHFFIEKEKLLK

SEQ ID NO: 2524096 - protein, 30 aa, Entamoeba dispar
FGDGKIFKYVIWYTVKYLTYLKEKKKGNIC

SEQ ID NO: 2524097 - protein, 26 aa, Entamoeba dispar
FGEALDLFFYVLQQSAERVVLTKSFQ

SEQ ID NO: 2524098 - protein, 20 aa, Entamoeba dispar
FGEDIIDLPLQIRGIGSIDN

SEQ ID NO: 2524099 - protein, 25 aa, Entamoeba dispar
FGEKKTHKLFLKIKNGVLHYADSEK

SEQ ID NO: 2524100 - protein, 21 aa, Entamoeba dispar
FGEQLLLSMFQLGLQRYISSV

SEQ ID NO: 2524101 - protein, 17 aa, Entamoeba dispar
FGFNYNLVKTLFYHITA

SEQ ID NO: 2524102 - protein, 19 aa, Entamoeba dispar
FGFSFKGPVRGIFKEIFNH

SEQ ID NO: 2524103 - protein, 27 aa, Entamoeba dispar
FGGAKIFDIFENVYRPIIDKLDLIKEI

SEQ ID NO: 2524104 - protein, 29 aa, Entamoeba dispar
FGGIQVIFSGDFFQLPPVSKGKEVKFVFE

SEQ ID NO: 2524105 - protein, 22 aa, Entamoeba dispar
FGGYSVYWLAGHHQKRFKVFIA

SEQ ID NO: 2524106 - protein, 17 aa, Entamoeba dispar
FGHGIYLTYFSDYALFY

SEQ ID NO: 2524107 - protein, 17 aa, Entamoeba dispar
FGHYYSYVKFQDKWYCC

SEQ ID NO: 2524108 - protein, 21 aa, Entamoeba dispar
FGIDILCNISFIIIGIVLHTN

SEQ ID NO: 2524109 - protein, 17 aa, Entamoeba dispar
FGIFCVTKYGNVFGIFF

SEQ ID NO: 2524110 - protein, 50 aa, Entamoeba dispar
FGILDQPLPFFMFGWHYTWFINAFNFELVLRIFDVIILEGFYVLFSVADT

SEQ ID NO: 2524111 - protein, 24 aa, Entamoeba dispar
FGIMSLLKMRTKPLTIIGPRSMEK

SEQ ID NO: 2524112 - protein, 27 aa, Entamoeba dispar
FGIPRKIRGFVWYALLLRPKTTQEIRG

SEQ ID NO: 2524113 - protein, 28 aa, Entamoeba dispar
FGITPTPEAIFLDWFPYDLENYIIENQL

SEQ ID NO: 2524114 - protein, 20 aa, Entamoeba dispar
FGIVQALSDCYRIRKDKVQL

SEQ ID NO: 2524115 - protein, 23 aa, Entamoeba dispar
FGKDRILFHYNGHGVPLPTINHE

SEQ ID NO: 2524116 - protein, 18 aa, Entamoeba dispar
FGKEYIRLRCPHAQFTEA

SEQ ID NO: 2524117 - protein, 32 aa, Entamoeba dispar
FGKPIFEEFLMTWGVVLIMKGDYTLIPELTKI

SEQ ID NO: 2524118 - protein, 21 aa, Entamoeba dispar
FGKRMLRERFLLKPLMDVNKI

SEQ ID NO: 2524119 - protein, 18 aa, Entamoeba dispar
FGLKTLYKNGGPTMFFPY

SEQ ID NO: 2524120 - protein, 19 aa, Entamoeba dispar
FGLQRIFGDLTFSNVLSIV

SEQ ID NO: 2524121 - protein, 24 aa, Entamoeba dispar
FGMDSRIKLWDLRTKNCIKEMGGH

SEQ ID NO: 2524122 - protein, 18 aa, Entamoeba dispar
FGMTSSPPIWLYETSEFI

SEQ ID NO: 2524123 - protein, 17 aa, Entamoeba dispar
FGNETLFACKLRYIIEL

SEQ ID NO: 2524124 - protein, 17 aa, Entamoeba dispar
FGNNCFYGCYSLTSINI

SEQ ID NO: 2524125 - protein, 18 aa, Entamoeba dispar
FGNVPPKGTIPLNSSPKK

SEQ ID NO: 2524126 - protein, 25 aa, Entamoeba dispar
FGPSFAERIQLEKAIFSYPNRLPGL

SEQ ID NO: 2524127 - protein, 31 aa, Entamoeba dispar
FGQYDTLHFILLMRSLIITPFNKQNGYKEHL

SEQ ID NO: 2524128 - protein, 20 aa, Entamoeba dispar
FGQYIRIDWDYGFVEGRQYG

SEQ ID NO: 2524129 - protein, 25 aa, Entamoeba dispar
FGRAKVIIKTLNQLKIKWPSNESCI

SEQ ID NO: 2524130 - protein, 24 aa, Entamoeba dispar
FGRNDPDFKWEFPKELEIPAELKP

SEQ ID NO: 2524131 - protein, 23 aa, Entamoeba dispar
FGSAFIPQRLYDVKKCEIGRFIL

SEQ ID NO: 2524132 - protein, 17 aa, Entamoeba dispar
FGSEYRPVPLQQTFFGV

SEQ ID NO: 2524133 - protein, 24 aa, Entamoeba dispar
FGSKILPEFNIKKALNIYFVCTED

SEQ ID NO: 2524134 - protein, 30 aa, Entamoeba dispar
FGSKRPVSWILICRIIIYSLMEIHKGVLYF

SEQ ID NO: 2524135 - protein, 17 aa, Entamoeba dispar
FGSLLFFEIIENNKIIA

SEQ ID NO: 2524136 - protein, 24 aa, Entamoeba dispar
FGSMPPTPLPQTPALQTPGLVAST

SEQ ID NO: 2524137 - protein, 22 aa, Entamoeba dispar
FGTKLIVRLIPQHSVPFAWTDP

SEQ ID NO: 2524138 - protein, 25 aa, Entamoeba dispar
FGVEQYVWFMTKQGFVWSTLLQTLI

SEQ ID NO: 2524139 - protein, 30 aa, Entamoeba dispar
FGVKRPVSWILICRVILYSLMELHKGTVYF

SEQ ID NO: 2524140 - protein, 18 aa, Entamoeba dispar
FGVKSWILNNTQDKTRTS

SEQ ID NO: 2524141 - protein, 17 aa, Entamoeba dispar
FGYCRSLKSIIIPTSVN

SEQ ID NO: 2524142 - protein, 18 aa, Entamoeba dispar
FGYIPTNYVIFEKEIYSD

SEQ ID NO: 2524143 - protein, 20 aa, Entamoeba dispar
FHALIWLEEVLKNWDGTLLI

SEQ ID NO: 2524144 - protein, 20 aa, Entamoeba dispar
FHAQLKEMLKQINKLGLVDE

SEQ ID NO: 2524145 - protein, 28 aa, Entamoeba dispar
FHDGRIFKKIIWYKVSYSKYLQEKEQGI

SEQ ID NO: 2524146 - protein, 17 aa, Entamoeba dispar
FHDILLLKEIDLRHVKK

SEQ ID NO: 2524147 - protein, 17 aa, Entamoeba dispar
FHEPPLEGLFCDLLWAD

SEQ ID NO: 2524148 - protein, 34 aa, Entamoeba dispar
FHEYFIEIISQLYWLRHNLLATLGLSIGFSSFRL

SEQ ID NO: 2524149 - protein, 17 aa, Entamoeba dispar
FHFLNPAFEGLFRSINA

SEQ ID NO: 2524150 - protein, 18 aa, Entamoeba dispar
FHISVPIDLPPTIKNDCV

SEQ ID NO: 2524151 - protein, 24 aa, Entamoeba dispar
FHKDLFTEGLLLPNGNPLPILTNY

SEQ ID NO: 2524152 - protein, 18 aa, Entamoeba dispar
FHKMSLSLYSFYNQRLFF

SEQ ID NO: 2524153 - protein, 19 aa, Entamoeba dispar
FHKVFQVNKYCLFGGAGLF

SEQ ID NO: 2524154 - protein, 20 aa, Entamoeba dispar
FHLFNYLHIFSQMDDFLSSA

SEQ ID NO: 2524155 - protein, 20 aa, Entamoeba dispar
FHLIYHCIVSLFLQSKQSPL

SEQ ID NO: 2524156 - protein, 23 aa, Entamoeba dispar
FHPLKPMIAIATLSKIVIIDLQK

SEQ ID NO: 2524157 - protein, 21 aa, Entamoeba dispar
FHRAVLLLRGLGINPIKAKKI

SEQ ID NO: 2524158 - protein, 24 aa, Entamoeba dispar
FHSDRVHYVLNEFIQAGLILNNDT

SEQ ID NO: 2524159 - protein, 26 aa, Entamoeba dispar
FHSLFSQFLRFVSVLSSNLLVGKKNG

SEQ ID NO: 2524160 - protein, 27 aa, Entamoeba dispar
FHVNEADANLALLPRDIKAEDAVMLSD

SEQ ID NO: 2524161 - protein, 24 aa, Entamoeba dispar
FHVTNKISFIRWVGSLKLITCVEK

SEQ ID NO: 2524162 - protein, 19 aa, Entamoeba dispar
FHYNPYDISINQLKYFPYL

SEQ ID NO: 2524163 - protein, 24 aa, Entamoeba dispar
FIADVMITFYLYCGWMDQLTEKLA

SEQ ID NO: 2524164 - protein, 17 aa, Entamoeba dispar
FIAFQQPIKKAIVCNDL

SEQ ID NO: 2524165 - protein, 18 aa, Entamoeba dispar
FIAMLTFCDGEDPQIINA

SEQ ID NO: 2524166 - protein, 19 aa, Entamoeba dispar
FIATLFDCSLAAKADPIIS

SEQ ID NO: 2524167 - protein, 17 aa, Entamoeba dispar
FICIPHFAAPEHYLFAG

SEQ ID NO: 2524168 - protein, 19 aa, Entamoeba dispar
FIDCVYQFMRIFPKEFEFN

SEQ ID NO: 2524169 - protein, 19 aa, Entamoeba dispar
FIDEIGFPKIYHYGTEGDY

SEQ ID NO: 2524170 - protein, 18 aa, Entamoeba dispar
FIDFQDKLHLTIGKKRSL

SEQ ID NO: 2524171 - protein, 18 aa, Entamoeba dispar
FIDGYAVFIACSLANHSC

SEQ ID NO: 2524172 - protein, 17 aa, Entamoeba dispar
FIDIFIDLALSILKAIH

SEQ ID NO: 2524173 - protein, 18 aa, Entamoeba dispar
FIDIRGPFIFISMNNKDK

SEQ ID NO: 2524174 - protein, 24 aa, Entamoeba dispar
FIDKFLDRLLKKESYKTFLPIAEH

SEQ ID NO: 2524175 - protein, 27 aa, Entamoeba dispar
FIDKIQLYFERYPPKIWSSAILRHFFQ

SEQ ID NO: 2524176 - protein, 22 aa, Entamoeba dispar
FIDKLFVYFPNIETLQLHPKQL

SEQ ID NO: 2524177 - protein, 19 aa, Entamoeba dispar
FIDKNNPLFWGFKNHPSVE

SEQ ID NO: 2524178 - protein, 20 aa, Entamoeba dispar
FIDLCILLGCDYCDTIKGVG

SEQ ID NO: 2524179 - protein, 17 aa, Entamoeba dispar
FIDLRKRAFKFPTMGKK

SEQ ID NO: 2524180 - protein, 24 aa, Entamoeba dispar
FIDQPKLKISAMIEFLLNSNKFIS

SEQ ID NO: 2524181 - protein, 30 aa, Entamoeba dispar
FIDSFALELYSFYNSLPIIKTQTLCYYNVP

SEQ ID NO: 2524182 - protein, 24 aa, Entamoeba dispar
FIDSLFIHMVPTTTIASLLLDICT

SEQ ID NO: 2524183 - protein, 17 aa, Entamoeba dispar
FIDTLRDIKVIQQEKEK

SEQ ID NO: 2524184 - protein, 20 aa, Entamoeba dispar
FIEDFDFPLLKKEIKTNILA

SEQ ID NO: 2524185 - protein, 17 aa, Entamoeba dispar
FIEFLKNTYKRGVDRFK

SEQ ID NO: 2524186 - protein, 33 aa, Entamoeba dispar
FIEHPLGNVKYLYLELFKSYDFTERKCYYGVIF

SEQ ID NO: 2524187 - protein, 18 aa, Entamoeba dispar
FIEIYTLGLDRNLNDSWA

SEQ ID NO: 2524188 - protein, 25 aa, Entamoeba dispar
FIEKIKEYFLSFFIKQEPSFDTKTL

SEQ ID NO: 2524189 - protein, 26 aa, Entamoeba dispar
FIENYKTIFPFKVYKCLIEVLGDYKK

SEQ ID NO: 2524190 - protein, 23 aa, Entamoeba dispar
FIEPTFTSLVKYLHSLELNCAVE

SEQ ID NO: 2524191 - protein, 36 aa, Entamoeba dispar
FIETFIIPDIPITSPPVFSPCDSLLFSSRRIFDIRQ

SEQ ID NO: 2524192 - protein, 18 aa, Entamoeba dispar
FIEYCFVAMIYAMKGSKD

SEQ ID NO: 2524193 - protein, 34 aa, Entamoeba dispar
FIGDYQPPFDLFKNIFLLLNAIKSPYVLVAVHTT

SEQ ID NO: 2524194 - protein, 17 aa, Entamoeba dispar
FIGIPIIEKSFFHKFYE

SEQ ID NO: 2524195 - protein, 18 aa, Entamoeba dispar
FIGLFPVTEGFYKLVEIV

SEQ ID NO: 2524196 - protein, 18 aa, Entamoeba dispar
FIGNVKPKHLVLIHGEGK

SEQ ID NO: 2524197 - protein, 19 aa, Entamoeba dispar
FIHCSLSNLLYPFRKMNCC

SEQ ID NO: 2524198 - protein, 17 aa, Entamoeba dispar
FIHLCNCKNPYEPNKIF

SEQ ID NO: 2524199 - protein, 19 aa, Entamoeba dispar
FIIDGFPRNAENKEAWFLQ

SEQ ID NO: 2524200 - protein, 17 aa, Entamoeba dispar
FIIGATNRPDILDPALL

SEQ ID NO: 2524201 - protein, 19 aa, Entamoeba dispar
FIIICSNTRLIFIKSKDFS

SEQ ID NO: 2524202 - protein, 20 aa, Entamoeba dispar
FIILFNQDKTKKSAISHVCY

SEQ ID NO: 2524203 - protein, 23 aa, Entamoeba dispar
FIILHQKFLLKRIIQNTIKSITL

SEQ ID NO: 2524204 - protein, 23 aa, Entamoeba dispar
FIIPSSIIEIFHFCFRKCTSLTS

SEQ ID NO: 2524205 - protein, 19 aa, Entamoeba dispar
FIIQFLKENHVSIAFVGHR

SEQ ID NO: 2524206 - protein, 19 aa, Entamoeba dispar
FIISDIRIPLQEDNNGKYP

SEQ ID NO: 2524207 - protein, 21 aa, Entamoeba dispar
FIISQLFVIRQNAIELLHILK

SEQ ID NO: 2524208 - protein, 25 aa, Entamoeba dispar
FIISTIIDNIIQLTLKYMNDIVIQK

SEQ ID NO: 2524209 - protein, 18 aa, Entamoeba dispar
FIITAVSLAIYRDGSSGG

SEQ ID NO: 2524210 - protein, 19 aa, Entamoeba dispar
FIKALGDLKIIFSASKHSK

SEQ ID NO: 2524211 - protein, 26 aa, Entamoeba dispar
FIKEICIDIPFLLRKPFSKNNWVIND

SEQ ID NO: 2524212 - protein, 17 aa, Entamoeba dispar
FIKGFGKDATRQEIIDA

SEQ ID NO: 2524213 - protein, 24 aa, Entamoeba dispar
FIKKYETFVLYSVDLKLVIALTIY

SEQ ID NO: 2524214 - protein, 18 aa, Entamoeba dispar
FIKLTKWNDINYAKLQDQ

SEQ ID NO: 2524215 - protein, 20 aa, Entamoeba dispar
FIKTFKPFIKSIPTNIIEPI

SEQ ID NO: 2524216 - protein, 17 aa, Entamoeba dispar
FIKVAYKCFKLGDFNMA

SEQ ID NO: 2524217 - protein, 17 aa, Entamoeba dispar
FIKVLFESIKKLYTKLF

SEQ ID NO: 2524218 - protein, 17 aa, Entamoeba dispar
FILGGPGAGKGTQCDKL

SEQ ID NO: 2524219 - protein, 17 aa, Entamoeba dispar
FILKYMGHNIMLDCGVH

SEQ ID NO: 2524220 - protein, 17 aa, Entamoeba dispar
FILLKQQILKTIQPFIV

SEQ ID NO: 2524221 - protein, 27 aa, Entamoeba dispar
FILNGIKQIIILKYMLSIIQLDSPFEE

SEQ ID NO: 2524222 - protein, 18 aa, Entamoeba dispar
FILSQFYTSLPISKRPET

SEQ ID NO: 2524223 - protein, 18 aa, Entamoeba dispar
FIMDIRQPTKLYNQLQLE

SEQ ID NO: 2524224 - protein, 17 aa, Entamoeba dispar
FIMTRDNSVFWKMARII

SEQ ID NO: 2524225 - protein, 37 aa, Entamoeba dispar
FINALNEYVLKLKLYIPFILIKDKTLLVLSLEIEKVE

SEQ ID NO: 2524226 - protein, 25 aa, Entamoeba dispar
FINALYGIEITDDFRYIIINEDNLE

SEQ ID NO: 2524227 - protein, 23 aa, Entamoeba dispar
FINEPVLVSFSIPKNLQIINEEN

SEQ ID NO: 2524228 - protein, 17 aa, Entamoeba dispar
FINIFVEDLLREINILF

SEQ ID NO: 2524229 - protein, 17 aa, Entamoeba dispar
FINIPRLVFMPTGPLQK

SEQ ID NO: 2524230 - protein, 29 aa, Entamoeba dispar
FINNKELLNIIIIATIRYLDCPNGSHLIS

SEQ ID NO: 2524231 - protein, 17 aa, Entamoeba dispar
FINPFKLSQFYTFSQIN

SEQ ID NO: 2524232 - protein, 20 aa, Entamoeba dispar
FINQFAPLLTLMNKFYENTA

SEQ ID NO: 2524233 - protein, 17 aa, Entamoeba dispar
FINQYYPSKINIIDGDL

SEQ ID NO: 2524234 - protein, 19 aa, Entamoeba dispar
FIPDYPYKSFRSFGGTLIK

SEQ ID NO: 2524235 - protein, 18 aa, Entamoeba dispar
FIPENQNGRFYPFIMYGA

SEQ ID NO: 2524236 - protein, 19 aa, Entamoeba dispar
FIPENQNGRFYPFIMYGAK

SEQ ID NO: 2524237 - protein, 19 aa, Entamoeba dispar
FIPSDYIIPKPIRKVSTNL

SEQ ID NO: 2524238 - protein, 26 aa, Entamoeba dispar
FIPSLHPFTQIFVIVEPIQGFVPNLY

SEQ ID NO: 2524239 - protein, 25 aa, Entamoeba dispar
FIPSQKEHILIKKLAAKLRKQFITL

SEQ ID NO: 2524240 - protein, 18 aa, Entamoeba dispar
FIQFIKQINTIQSGYLSL

SEQ ID NO: 2524241 - protein, 17 aa, Entamoeba dispar
FIQITFQNVFNNLCIQP

SEQ ID NO: 2524242 - protein, 19 aa, Entamoeba dispar
FIQLIITLFDKKANINWLL

SEQ ID NO: 2524243 - protein, 18 aa, Entamoeba dispar
FIQLLYSKKQYHLQLQFI

SEQ ID NO: 2524244 - protein, 35 aa, Entamoeba dispar
FIQMKSLAYLNSTLSWICIYLTKSLRNERNEKVNQ

SEQ ID NO: 2524245 - protein, 17 aa, Entamoeba dispar
FIQSLIGNLRYPKNKIF

SEQ ID NO: 2524246 - protein, 17 aa, Entamoeba dispar
FIRELILLMVDATPEKR

SEQ ID NO: 2524247 - protein, 22 aa, Entamoeba dispar
FIRIQWIFIHLCNCKNPYEPNK

SEQ ID NO: 2524248 - protein, 18 aa, Entamoeba dispar
FIRKCKYCKLPAISFETL

SEQ ID NO: 2524249 - protein, 24 aa, Entamoeba dispar
FIRNDKEFFILKKEGEHMKRIVKR

SEQ ID NO: 2524250 - protein, 25 aa, Entamoeba dispar
FIRNDKEFFILKKEGEHMKRIVKRE

SEQ ID NO: 2524251 - protein, 24 aa, Entamoeba dispar
FISCHFKVFNTFFSAKIHSICSVN

SEQ ID NO: 2524252 - protein, 19 aa, Entamoeba dispar
FISDIQWKPEVFGDSAIFA

SEQ ID NO: 2524253 - protein, 17 aa, Entamoeba dispar
FISEDRIFMNEPVLVSI

SEQ ID NO: 2524254 - protein, 18 aa, Entamoeba dispar
FISEDRIFMNEPVLVSIE

SEQ ID NO: 2524255 - protein, 20 aa, Entamoeba dispar
FISEDRIFMNEPVLVSIKIP

SEQ ID NO: 2524256 - protein, 25 aa, Entamoeba dispar
FISEDRIFMNEPVLVSIKIPDNLQI

SEQ ID NO: 2524257 - protein, 18 aa, Entamoeba dispar
FISEDRIFMNEPVLVSVQ

SEQ ID NO: 2524258 - protein, 25 aa, Entamoeba dispar
FISEERIFMNEPVLLSIEIPKNLVR

SEQ ID NO: 2524259 - protein, 18 aa, Entamoeba dispar
FISEKRIFMNKPVLISFE

SEQ ID NO: 2524260 - protein, 18 aa, Entamoeba dispar
FISEKRIFMNKPVLMSIK

SEQ ID NO: 2524261 - protein, 17 aa, Entamoeba dispar
FISEKRILMNEPVLVSI

SEQ ID NO: 2524262 - protein, 17 aa, Entamoeba dispar
FISIQSKAQLYLIKTKN

SEQ ID NO: 2524263 - protein, 27 aa, Entamoeba dispar
FISKDRIFMIEPVLVSIKIPSSLQIIN

SEQ ID NO: 2524264 - protein, 20 aa, Entamoeba dispar
FISKERIFMNEPVLFSIKIP

SEQ ID NO: 2524265 - protein, 19 aa, Entamoeba dispar
FISKERIFMNEPVLISIKI

SEQ ID NO: 2524266 - protein, 20 aa, Entamoeba dispar
FISKERIFMNEPVLISIKIP

SEQ ID NO: 2524267 - protein, 17 aa, Entamoeba dispar
FISKIAKQLEKCQWLQC

SEQ ID NO: 2524268 - protein, 17 aa, Entamoeba dispar
FISLFRNTKPEKKESNQ

SEQ ID NO: 2524269 - protein, 27 aa, Entamoeba dispar
FISLSRNFPDLFPSFLSSSLLPDSVFK

SEQ ID NO: 2524270 - protein, 23 aa, Entamoeba dispar
FISLYHYICIITYNTTITLYQIG

SEQ ID NO: 2524271 - protein, 18 aa, Entamoeba dispar
FISNIYKNPRYCNSEIFN

SEQ ID NO: 2524272 - protein, 19 aa, Entamoeba dispar
FISNYAPKFMWKVRILQGN

SEQ ID NO: 2524273 - protein, 19 aa, Entamoeba dispar
FISRQHYKILHNIKFHDKT

SEQ ID NO: 2524274 - protein, 18 aa, Entamoeba dispar
FISVITASIYFSLEEIKQ

SEQ ID NO: 2524275 - protein, 19 aa, Entamoeba dispar
FISYEEAISLLTKWAEECG

SEQ ID NO: 2524276 - protein, 19 aa, Entamoeba dispar
FITAKYLVGWNEYIAVFNY

SEQ ID NO: 2524277 - protein, 17 aa, Entamoeba dispar
FITASADKTCKIWNAED

SEQ ID NO: 2524278 - protein, 23 aa, Entamoeba dispar
FITEEFVEYGHLFRPVICEGKKV

SEQ ID NO: 2524279 - protein, 26 aa, Entamoeba dispar
FITGSKYWIYGVIPLNNISALKQFGY

SEQ ID NO: 2524280 - protein, 26 aa, Entamoeba dispar
FITKLPNYIHLLANIKTLVLLESYHP

SEQ ID NO: 2524281 - protein, 27 aa, Entamoeba dispar
FITQFNHVFIIVSPVIIKGVPLYRVCV

SEQ ID NO: 2524282 - protein, 18 aa, Entamoeba dispar
FIVDVRYPYEFNGGHVRY

SEQ ID NO: 2524283 - protein, 20 aa, Entamoeba dispar
FIVKALELHFVYFHAIETQE

SEQ ID NO: 2524284 - protein, 17 aa, Entamoeba dispar
FIVRFFIDNFKRIDSIH

SEQ ID NO: 2524285 - protein, 26 aa, Entamoeba dispar
FIVSKLLFWYFPSYSKKFKNLEEKGL

SEQ ID NO: 2524286 - protein, 20 aa, Entamoeba dispar
FIWIHREPVEQLKSFIPLLI

SEQ ID NO: 2524287 - protein, 18 aa, Entamoeba dispar
FIWNYSPVSLVNIGKMKL

SEQ ID NO: 2524288 - protein, 19 aa, Entamoeba dispar
FIWTFTKKCGEAFVPIVIC

SEQ ID NO: 2524289 - protein, 21 aa, Entamoeba dispar
FIYCIFNPLKQPKFIDLLILR

SEQ ID NO: 2524290 - protein, 18 aa, Entamoeba dispar
FIYESELIQKLPPDVRKK

SEQ ID NO: 2524291 - protein, 20 aa, Entamoeba dispar
FIYKRQIYMENLGFEFENII

SEQ ID NO: 2524292 - protein, 24 aa, Entamoeba dispar
FIYQKEFVVIYINKINQIPYGVFE

SEQ ID NO: 2524293 - protein, 20 aa, Entamoeba dispar
FIYSENCALVYFKSLSTLSS

SEQ ID NO: 2524294 - protein, 21 aa, Entamoeba dispar
FIYSFMMMLCSGVPQLKHVED

SEQ ID NO: 2524295 - protein, 18 aa, Entamoeba dispar
FIYTDYQYFGKMYRTISL

SEQ ID NO: 2524296 - protein, 18 aa, Entamoeba dispar
FKAKTMFLSSKYPIENRP

SEQ ID NO: 2524297 - protein, 17 aa, Entamoeba dispar
FKALMPHVGDFEKVFTT

SEQ ID NO: 2524298 - protein, 19 aa, Entamoeba dispar
FKAMHGFVTMNFAPAQRVP

SEQ ID NO: 2524299 - protein, 21 aa, Entamoeba dispar
FKCIDYFPTDRMLLHEDQVLL

SEQ ID NO: 2524300 - protein, 23 aa, Entamoeba dispar
FKDAIWDVVSKEPKELIKSMIIV

SEQ ID NO: 2524301 - protein, 17 aa, Entamoeba dispar
FKDATHIIIGAGAGLSV

SEQ ID NO: 2524302 - protein, 17 aa, Entamoeba dispar
FKDFKLYDYLGNVNLKK

SEQ ID NO: 2524303 - protein, 25 aa, Entamoeba dispar
FKDGIIFKHVIWYPVSYSTYLKEKE

SEQ ID NO: 2524304 - protein, 25 aa, Entamoeba dispar
FKDGKIFKKVIWYTVNYSTYIQEKE

SEQ ID NO: 2524305 - protein, 27 aa, Entamoeba dispar
FKDGKIFKKVVWYLVDYSKYLKEKEEW

SEQ ID NO: 2524306 - protein, 19 aa, Entamoeba dispar
FKDGKVFCALIHRHRPDLL

SEQ ID NO: 2524307 - protein, 28 aa, Entamoeba dispar
FKDGRIFKYVIWYDISYSKYLFEKEQGN

SEQ ID NO: 2524308 - protein, 17 aa, Entamoeba dispar
FKDKTVLSKAYGSLIKN

SEQ ID NO: 2524309 - protein, 18 aa, Entamoeba dispar
FKDLMPQLIGLFKTIVGS

SEQ ID NO: 2524310 - protein, 23 aa, Entamoeba dispar
FKDPYSILSSPLIKFPYIIDSTK

SEQ ID NO: 2524311 - protein, 33 aa, Entamoeba dispar
FKDTIDKFRYNPIPIYDLNFFRNIETQFLYYPF

SEQ ID NO: 2524312 - protein, 27 aa, Entamoeba dispar
FKDYKGCTVYKKIKALPNEGLCQKCHD

SEQ ID NO: 2524313 - protein, 18 aa, Entamoeba dispar
FKECYSLTTFNIPSSVST

SEQ ID NO: 2524314 - protein, 20 aa, Entamoeba dispar
FKEEGTFINLRPFTDSKTVS

SEQ ID NO: 2524315 - protein, 18 aa, Entamoeba dispar
FKEGLKKLAAALAVGAKL

SEQ ID NO: 2524316 - protein, 17 aa, Entamoeba dispar
FKEGQPLVYRLIWICFV

SEQ ID NO: 2524317 - protein, 24 aa, Entamoeba dispar
FKEINIFEFPIHFFDFEFSSSKTD

SEQ ID NO: 2524318 - protein, 32 aa, Entamoeba dispar
FKEKAELFLIKNNVPYIYYENKILPLIAGDQS

SEQ ID NO: 2524319 - protein, 18 aa, Entamoeba dispar
FKENGIFNHLIATKFKTS

SEQ ID NO: 2524320 - protein, 30 aa, Entamoeba dispar
FKENPQNPILFIAPSIPYLPTTAEKHLKVL

SEQ ID NO: 2524321 - protein, 27 aa, Entamoeba dispar
FKEPLLEVDYLFNEWPLECLASVLSVV

SEQ ID NO: 2524322 - protein, 27 aa, Entamoeba dispar
FKEQQGFFICPLINCLLTHNNKLYSDA

SEQ ID NO: 2524323 - protein, 34 aa, Entamoeba dispar
FKERIELMKTLFPIIKFDSISFFFRTWEVEENGT

SEQ ID NO: 2524324 - protein, 26 aa, Entamoeba dispar
FKESEEGWFFGCWQPKDILSGKKNIY

SEQ ID NO: 2524325 - protein, 17 aa, Entamoeba dispar
FKFIKNYGSNFVAVICG

SEQ ID NO: 2524326 - protein, 29 aa, Entamoeba dispar
FKFSVTMFPVFPPEYNFLAPKLTKESLKS

SEQ ID NO: 2524327 - protein, 34 aa, Entamoeba dispar
FKFTDTYQRMVFLWMIWLIMNQHPQVFGFNYNLV

SEQ ID NO: 2524328 - protein, 29 aa, Entamoeba dispar
FKGKEWKLCLLFNDILLIAKIDVTEKYRN

SEQ ID NO: 2524329 - protein, 28 aa, Entamoeba dispar
FKGYDPIFMDLIDHLLQLNPKSRFTAEE

SEQ ID NO: 2524330 - protein, 18 aa, Entamoeba dispar
FKHDIIGLQLIHCKNAFR

SEQ ID NO: 2524331 - protein, 18 aa, Entamoeba dispar
FKIDYKIELIVSSLLEEK

SEQ ID NO: 2524332 - protein, 27 aa, Entamoeba dispar
FKIEPKFIPFQYEMFIGSSSLFQNSSK

SEQ ID NO: 2524333 - protein, 20 aa, Entamoeba dispar
FKIIINREILQQMISGFQEE

SEQ ID NO: 2524334 - protein, 17 aa, Entamoeba dispar
FKILMIGESSVGKTSLV

SEQ ID NO: 2524335 - protein, 25 aa, Entamoeba dispar
FKINCFAWCYLLTSIDIPTTISKIG

SEQ ID NO: 2524336 - protein, 34 aa, Entamoeba dispar
FKINESMYLPLQELFLPIFIEIVAQPNPLITEKS

SEQ ID NO: 2524337 - protein, 24 aa, Entamoeba dispar
FKKDGVVYGFWIYKETISCGLFKN

SEQ ID NO: 2524338 - protein, 26 aa, Entamoeba dispar
FKKEIPRTLIFSKFNIIETIPCPKTP

SEQ ID NO: 2524339 - protein, 34 aa, Entamoeba dispar
FKKKKMCLYDKCRIIKILVGWMKEATEKGESIEG

SEQ ID NO: 2524340 - protein, 27 aa, Entamoeba dispar
FKLASHSNFFLRPSWSPEGTQLVMVGA

SEQ ID NO: 2524341 - protein, 26 aa, Entamoeba dispar
FKLGDFNMAFIIYSCIVRASYKHSEE

SEQ ID NO: 2524342 - protein, 20 aa, Entamoeba dispar
FKLLLIGDSGVGKSCLLLRF

SEQ ID NO: 2524343 - protein, 26 aa, Entamoeba dispar
FKLTPLTLVPYCSCLIDYTLLTSEEK

SEQ ID NO: 2524344 - protein, 24 aa, Entamoeba dispar
FKLVCCPLFVGFFSRNICLSINTF

SEQ ID NO: 2524345 - protein, 17 aa, Entamoeba dispar
FKLYKRSIYADAVASKG

SEQ ID NO: 2524346 - protein, 18 aa, Entamoeba dispar
FKMIRNWINALGDLANIL

SEQ ID NO: 2524347 - protein, 17 aa, Entamoeba dispar
FKNCFKLKKINISTSIK

SEQ ID NO: 2524348 - protein, 27 aa, Entamoeba dispar
FKNELAPVPQIFLIAETLKDLKDNMYE

SEQ ID NO: 2524349 - protein, 18 aa, Entamoeba dispar
FKNFLKKVKPSLYTDCLL

SEQ ID NO: 2524350 - protein, 20 aa, Entamoeba dispar
FKNFLNKCLNPDAPKRASAE

SEQ ID NO: 2524351 - protein, 17 aa, Entamoeba dispar
FKNGQPINLYWSHGNQN

SEQ ID NO: 2524352 - protein, 17 aa, Entamoeba dispar
FKNQLNIIVIYLNKIHN

SEQ ID NO: 2524353 - protein, 21 aa, Entamoeba dispar
FKPESVFKFNMAFKPKMTKLS

SEQ ID NO: 2524354 - protein, 19 aa, Entamoeba dispar
FKPFPFNLKYVLQGVTYTE

SEQ ID NO: 2524355 - protein, 19 aa, Entamoeba dispar
FKQELVKILTLKTPASYWS

SEQ ID NO: 2524356 - protein, 27 aa, Entamoeba dispar
FKQEQLHIIVVIQFILFGIDNVLKAVN

SEQ ID NO: 2524357 - protein, 38 aa, Entamoeba dispar
FKQMIRSLDLPQLGKIPLISKFFRDVSLIDPQSGTKVG

SEQ ID NO: 2524358 - protein, 33 aa, Entamoeba dispar
FKQNTYLESFFTFVTHYSFFRTAKRLILFDFVT

SEQ ID NO: 2524359 - protein, 25 aa, Entamoeba dispar
FKQQLKIIMKPIKQLIARLIENPMD

SEQ ID NO: 2524360 - protein, 31 aa, Entamoeba dispar
FKQRECLDNFFRALLGLPCDNHLLLEGKTEH

SEQ ID NO: 2524361 - protein, 19 aa, Entamoeba dispar
FKQSAFELLFFIQELQKNG

SEQ ID NO: 2524362 - protein, 27 aa, Entamoeba dispar
FKRDVIALYEYLYAGNPIPLIYQSMVL

SEQ ID NO: 2524363 - protein, 35 aa, Entamoeba dispar
FKRLQWAHQSFWSRAFLVIYPQPFGEVGSLIPFCD

SEQ ID NO: 2524364 - protein, 32 aa, Entamoeba dispar
FKSHLVILGLDGGIAKLWFVSNTSVKEKESIE

SEQ ID NO: 2524365 - protein, 26 aa, Entamoeba dispar
FKSINRKVLIFLYTEKLVVERLPIQV

SEQ ID NO: 2524366 - protein, 17 aa, Entamoeba dispar
FKSLPIEQINNLKNQLI

SEQ ID NO: 2524367 - protein, 19 aa, Entamoeba dispar
FKSPIYIDGFRLSMPYLFD

SEQ ID NO: 2524368 - protein, 32 aa, Entamoeba dispar
FKTDNILTRKYSTLFFALLPESLYDVDAISNY

SEQ ID NO: 2524369 - protein, 20 aa, Entamoeba dispar
FKTFDEQFLFKELKPPEYEA

SEQ ID NO: 2524370 - protein, 19 aa, Entamoeba dispar
FKTIHLFECFNPTLQINDS

SEQ ID NO: 2524371 - protein, 34 aa, Entamoeba dispar
FKTMKKKQILLIPYFCDIIDKLFPMQGKSVLKDD

SEQ ID NO: 2524372 - protein, 28 aa, Entamoeba dispar
FKTYFIHFTGDFVIPKYSFSSSPNTSIE

SEQ ID NO: 2524373 - protein, 24 aa, Entamoeba dispar
FKVFTYLKILDYWKELIDERMTPF

SEQ ID NO: 2524374 - protein, 20 aa, Entamoeba dispar
FKVLIIGEPSVGKTAIMERY

SEQ ID NO: 2524375 - protein, 26 aa, Entamoeba dispar
FKVNTPIDEKWGFAKPFFSNDEEFND

SEQ ID NO: 2524376 - protein, 18 aa, Entamoeba dispar
FKVRGVMNKFNSLTLAEK

SEQ ID NO: 2524377 - protein, 25 aa, Entamoeba dispar
FKYCYSLTSINIPTSIIKLGYGCFY

SEQ ID NO: 2524378 - protein, 27 aa, Entamoeba dispar
FLAKVGRKYLLDIYKPFVQEIIHNNIS

SEQ ID NO: 2524379 - protein, 20 aa, Entamoeba dispar
FLANVILYLETLETLCQFQM

SEQ ID NO: 2524380 - protein, 24 aa, Entamoeba dispar
FLASIDCFWETKKTFDYGCFNTSG

SEQ ID NO: 2524381 - protein, 20 aa, Entamoeba dispar
FLCGLYYMKVIDEKLLIELL

SEQ ID NO: 2524382 - protein, 19 aa, Entamoeba dispar
FLCNSFVLLNGTFTQQFES

SEQ ID NO: 2524383 - protein, 31 aa, Entamoeba dispar
FLDIEMPETLFIFPRLFKIEIAILYDKLSAI

SEQ ID NO: 2524384 - protein, 35 aa, Entamoeba dispar
FLDPIVVTFFKIPTSLLYLYLPKPKNYYQQYKTVL

SEQ ID NO: 2524385 - protein, 42 aa, Entamoeba dispar
FLDRNELRFQRDAILALHFIAEDFLVKLFEDSNLCALHAKRV

SEQ ID NO: 2524386 - protein, 24 aa, Entamoeba dispar
FLEERYWNIVLDYWGLTVRCLAGE

SEQ ID NO: 2524387 - protein, 21 aa, Entamoeba dispar
FLEEVLKLYKLSKTKKCGSVW

SEQ ID NO: 2524388 - protein, 18 aa, Entamoeba dispar
FLELQPSLDYPTLHLIIY

SEQ ID NO: 2524389 - protein, 18 aa, Entamoeba dispar
FLEMLLFADKHGYKWSDV

SEQ ID NO: 2524390 - protein, 25 aa, Entamoeba dispar
FLENFENFTKWKFVPFIKQHEGNKN

SEQ ID NO: 2524391 - protein, 30 aa, Entamoeba dispar
FLEPEPCFNDYYRLKPKCCLKEELCIVPLR

SEQ ID NO: 2524392 - protein, 20 aa, Entamoeba dispar
FLEVSGIRDQLFRVLEKEPD

SEQ ID NO: 2524393 - protein, 18 aa, Entamoeba dispar
FLFCTICSIIPFPSIQNI

SEQ ID NO: 2524394 - protein, 17 aa, Entamoeba dispar
FLFTHTQINHRIIHGFY

SEQ ID NO: 2524395 - protein, 21 aa, Entamoeba dispar
FLGERYMRFDPILPNNLDLDC

SEQ ID NO: 2524396 - protein, 17 aa, Entamoeba dispar
FLGGPLVKLHDFSLARY

SEQ ID NO: 2524397 - protein, 18 aa, Entamoeba dispar
FLGIKQLFKQMDKLLSRI

SEQ ID NO: 2524398 - protein, 25 aa, Entamoeba dispar
FLGLNEYKDMIWRGYCRGKPVIIDY

SEQ ID NO: 2524399 - protein, 25 aa, Entamoeba dispar
FLGSTQGLIWKKLKTLKCIKCKVNV

SEQ ID NO: 2524400 - protein, 17 aa, Entamoeba dispar
FLHERITSLPPQKPKRL

SEQ ID NO: 2524401 - protein, 18 aa, Entamoeba dispar
FLHIDFAHFLGNKLKVAG

SEQ ID NO: 2524402 - protein, 17 aa, Entamoeba dispar
FLHYFNTINKDISFNIV

SEQ ID NO: 2524403 - protein, 19 aa, Entamoeba dispar
FLIDLLENEGYFFNSSYSS

SEQ ID NO: 2524404 - protein, 17 aa, Entamoeba dispar
FLIHRALNKRSTIGRIF

SEQ ID NO: 2524405 - protein, 17 aa, Entamoeba dispar
FLIVKRMAEEHKTYSLE

SEQ ID NO: 2524406 - protein, 20 aa, Entamoeba dispar
FLLIHKTLVIYPEYIPIIIQ

SEQ ID NO: 2524407 - protein, 25 aa, Entamoeba dispar
FLLLQHRVILPFELHFKLLSIKSIF

SEQ ID NO: 2524408 - protein, 18 aa, Entamoeba dispar
FLLSFDEIKGIVNDKNES

SEQ ID NO: 2524409 - protein, 33 aa, Entamoeba dispar
FLMQMHYSFQTPDKLYFILDYVNGGELFAHLQR

SEQ ID NO: 2524410 - protein, 26 aa, Entamoeba dispar
FLNGKTCIFFRWTSDMKQPHIDRIVF

SEQ ID NO: 2524411 - protein, 20 aa, Entamoeba dispar
FLNIVTVMWDWPKESIQRLN

SEQ ID NO: 2524412 - protein, 19 aa, Entamoeba dispar
FLNIYSHLKYLLILNLKDF

SEQ ID NO: 2524413 - protein, 17 aa, Entamoeba dispar
FLNLITPSRFIPNALKS

SEQ ID NO: 2524414 - protein, 19 aa, Entamoeba dispar
FLNYQVIYCTRHIKLISEF

SEQ ID NO: 2524415 - protein, 29 aa, Entamoeba dispar
FLPFLLDSIQPQHYLPLCVYLAIQREDKT

SEQ ID NO: 2524416 - protein, 25 aa, Entamoeba dispar
FLPKKEMYYCLCLADFLVKQCPEFR

SEQ ID NO: 2524417 - protein, 26 aa, Entamoeba dispar
FLPKKEMYYCLCLVDYLVLNCPQFRP

SEQ ID NO: 2524418 - protein, 19 aa, Entamoeba dispar
FLPLLRTVSFINENDLLLV

SEQ ID NO: 2524419 - protein, 18 aa, Entamoeba dispar
FLPRIPSLDIRDGGVDLL

SEQ ID NO: 2524420 - protein, 18 aa, Entamoeba dispar
FLQLSKALAIQKFHSFLY

SEQ ID NO: 2524421 - protein, 17 aa, Entamoeba dispar
FLQNMFYCAPELYLNQI

SEQ ID NO: 2524422 - protein, 17 aa, Entamoeba dispar
FLQPETIAPFILRGGLC

SEQ ID NO: 2524423 - protein, 18 aa, Entamoeba dispar
FLRDSFIESLQTLFSKGV

SEQ ID NO: 2524424 - protein, 19 aa, Entamoeba dispar
FLRRRACLMMYPMCKEYPD

SEQ ID NO: 2524425 - protein, 30 aa, Entamoeba dispar
FLSHYQNPLFIRLLSLCKPTIFTNFINLDR

SEQ ID NO: 2524426 - protein, 23 aa, Entamoeba dispar
FLSIFDSFFIQKVPKMKTLADPF

SEQ ID NO: 2524427 - protein, 29 aa, Entamoeba dispar
FLSIQVTSPEILLLVDLLDTIMTSFNLEK

SEQ ID NO: 2524428 - protein, 17 aa, Entamoeba dispar
FLSLFKRVQQPIDTEIV

SEQ ID NO: 2524429 - protein, 24 aa, Entamoeba dispar
FLSQLYILYADYVLKNPFIISEMI

SEQ ID NO: 2524430 - protein, 41 aa, Entamoeba dispar
FLSYNCVSHPFWLPKFANAFYYTLPLLIQQMNTIASRLFSA

SEQ ID NO: 2524431 - protein, 18 aa, Entamoeba dispar
FLTGVPPQEFFFHCMAGR

SEQ ID NO: 2524432 - protein, 20 aa, Entamoeba dispar
FLTINLTNYGCRLIDIITQG

SEQ ID NO: 2524433 - protein, 17 aa, Entamoeba dispar
FLTIVYNIDNYSALDDF

SEQ ID NO: 2524434 - protein, 20 aa, Entamoeba dispar
FLTKLQIIFPETINIQKAKS

SEQ ID NO: 2524435 - protein, 17 aa, Entamoeba dispar
FLTLQNERKRIHLVWFV

SEQ ID NO: 2524436 - protein, 28 aa, Entamoeba dispar
FLTSYDPYHLLYYLLNLFISSYSDNCNK

SEQ ID NO: 2524437 - protein, 28 aa, Entamoeba dispar
FLTSYDPYHLLYYLLNLFISSYSDNSNK

SEQ ID NO: 2524438 - protein, 18 aa, Entamoeba dispar
FLTYFSTRLQRISQFFLT

SEQ ID NO: 2524439 - protein, 28 aa, Entamoeba dispar
FLVKDGYTVQYFGKGFFCPHGVRGSLKV

SEQ ID NO: 2524440 - protein, 22 aa, Entamoeba dispar
FLVQCYGMVYYSATIHIIMELA

SEQ ID NO: 2524441 - protein, 17 aa, Entamoeba dispar
FMDIWMKLYDNKDFHSM

SEQ ID NO: 2524442 - protein, 24 aa, Entamoeba dispar
FMDREKFNVLYNSQQSVIQQLKQN

SEQ ID NO: 2524443 - protein, 34 aa, Entamoeba dispar
FMDSRGYAAIPMMYIRNTIMRLMSTDVKQAVAVA

SEQ ID NO: 2524444 - protein, 17 aa, Entamoeba dispar
FMEYTPSDGIKFKQIVN

SEQ ID NO: 2524445 - protein, 17 aa, Entamoeba dispar
FMFNTLINPSGVSHSIT

SEQ ID NO: 2524446 - protein, 22 aa, Entamoeba dispar
FMIFAGILIRNSPQQPPLFLQI

SEQ ID NO: 2524447 - protein, 26 aa, Entamoeba dispar
FMKGERFVFLLCTRAGGIGINLSEAD

SEQ ID NO: 2524448 - protein, 17 aa, Entamoeba dispar
FMKIFFVECKCKNTSSL

SEQ ID NO: 2524449 - protein, 25 aa, Entamoeba dispar
FMKTPVHNLCFYKNKLYGVIPSPTK

SEQ ID NO: 2524450 - protein, 20 aa, Entamoeba dispar
FMNEPILFSIEIPLNLKTIN

SEQ ID NO: 2524451 - protein, 17 aa, Entamoeba dispar
FMNEPVLISIKIPDNLE

SEQ ID NO: 2524452 - protein, 19 aa, Entamoeba dispar
FMNEPVLISIKIPKNLQII

SEQ ID NO: 2524453 - protein, 19 aa, Entamoeba dispar
FMNEPVLISIKIPSNLKII

SEQ ID NO: 2524454 - protein, 17 aa, Entamoeba dispar
FMNEPVLVSIKIPDNLE

SEQ ID NO: 2524455 - protein, 17 aa, Entamoeba dispar
FMNEPVLVSIKIPDTLE

SEQ ID NO: 2524456 - protein, 17 aa, Entamoeba dispar
FMNEPVLVSIKIPENLE

SEQ ID NO: 2524457 - protein, 17 aa, Entamoeba dispar
FMNEPVLVSIKIPENLQ

SEQ ID NO: 2524458 - protein, 17 aa, Entamoeba dispar
FMNEPVLVSIKIPGNLQ

SEQ ID NO: 2524459 - protein, 19 aa, Entamoeba dispar
FMNKPVLMSIKIPYNLQKI

SEQ ID NO: 2524460 - protein, 25 aa, Entamoeba dispar
FMQGKIPTLKISLIQIFRAHLWQKI

SEQ ID NO: 2524461 - protein, 22 aa, Entamoeba dispar
FMQHYIYFLCHKKDYVRTFASE

SEQ ID NO: 2524462 - protein, 17 aa, Entamoeba dispar
FMRKDLISITIPTRVRC

SEQ ID NO: 2524463 - protein, 28 aa, Entamoeba dispar
FMRTFGIDLFIKLGTFLELCKQKESDVF

SEQ ID NO: 2524464 - protein, 19 aa, Entamoeba dispar
FMSAYYMMRQLKFSKIDLE

SEQ ID NO: 2524465 - protein, 26 aa, Entamoeba dispar
FMSCNLLENVFLPNIQLIPISCFENC

SEQ ID NO: 2524466 - protein, 17 aa, Entamoeba dispar
FNALFPHVKDFENIMKS

SEQ ID NO: 2524467 - protein, 21 aa, Entamoeba dispar
FNAMNDVFVRLLLNAPDVSNR

SEQ ID NO: 2524468 - protein, 19 aa, Entamoeba dispar
FNCCFIMNEAIKGLIEYDK

SEQ ID NO: 2524469 - protein, 17 aa, Entamoeba dispar
FNCFYWCTSLTSINNQN

SEQ ID NO: 2524470 - protein, 19 aa, Entamoeba dispar
FNCISLTIPSIGRQRGFVP

SEQ ID NO: 2524471 - protein, 17 aa, Entamoeba dispar
FNCISLTSLSFPDNLVW

SEQ ID NO: 2524472 - protein, 17 aa, Entamoeba dispar
FNCIWNKFIFKASPHIV

SEQ ID NO: 2524473 - protein, 18 aa, Entamoeba dispar
FNCQHLKTIILSKTLKYI

SEQ ID NO: 2524474 - protein, 21 aa, Entamoeba dispar
FNDCTSLTLISLPTTISKLED

SEQ ID NO: 2524475 - protein, 25 aa, Entamoeba dispar
FNDGKAILALCHAYTRLTGENGFEY

SEQ ID NO: 2524476 - protein, 27 aa, Entamoeba dispar
FNDGKIFKKIIWYLVSYSTYLKEKEAW

SEQ ID NO: 2524477 - protein, 25 aa, Entamoeba dispar
FNDGKIFKKVIWYLVDYSTHLKEKE

SEQ ID NO: 2524478 - protein, 27 aa, Entamoeba dispar
FNDGKIFKKVIWYLVDYSTYLKEKEQG

SEQ ID NO: 2524479 - protein, 22 aa, Entamoeba dispar
FNDGKIFKKVIWYTVDYSEYLQ

SEQ ID NO: 2524480 - protein, 26 aa, Entamoeba dispar
FNDGKIFKYIIWYKVSYSTHLKEKEQ

SEQ ID NO: 2524481 - protein, 24 aa, Entamoeba dispar
FNDGKIFKYVIWYEVNYSTYLKEK

SEQ ID NO: 2524482 - protein, 27 aa, Entamoeba dispar
FNDGKIFKYVIWYKVEYLTYLEEKGQW

SEQ ID NO: 2524483 - protein, 28 aa, Entamoeba dispar
FNDGKIFKYVIWYKVRYSTYLKEKEQGN

SEQ ID NO: 2524484 - protein, 26 aa, Entamoeba dispar
FNDGKIFKYVIWYKVSYSTYLKEKEK

SEQ ID NO: 2524485 - protein, 28 aa, Entamoeba dispar
FNDGKIFKYVIWYLVNYSTYLFEKEQGN

SEQ ID NO: 2524486 - protein, 27 aa, Entamoeba dispar
FNDGKIFKYVIWYLVSYSKYLKEKEQG

SEQ ID NO: 2524487 - protein, 30 aa, Entamoeba dispar
FNDGKIFKYVIWYYVDYWEYLQEKEKGDVY

SEQ ID NO: 2524488 - protein, 28 aa, Entamoeba dispar
FNDGRIFKKVIWYFVEYSTYLKKKKKGN

SEQ ID NO: 2524489 - protein, 27 aa, Entamoeba dispar
FNDGRIFKKVIWYLVSYSKYLKEKEQG

SEQ ID NO: 2524490 - protein, 28 aa, Entamoeba dispar
FNDGRIFKKVIWYLVSYSKYLQEKEAWN

SEQ ID NO: 2524491 - protein, 27 aa, Entamoeba dispar
FNDGRIFKQAIWYLVNYSTYLKEKEAG

SEQ ID NO: 2524492 - protein, 27 aa, Entamoeba dispar
FNDGRIFKQVIWYLVNYSTYLKEKEAG

SEQ ID NO: 2524493 - protein, 26 aa, Entamoeba dispar
FNDGRIFKQVIWYLVSYSEYLQEKEQ

SEQ ID NO: 2524494 - protein, 27 aa, Entamoeba dispar
FNDGRIFKYVIWYKVDYLTYLEEKGQW

SEQ ID NO: 2524495 - protein, 27 aa, Entamoeba dispar
FNDGRIFKYVIWYTIDYSTYLFEKEQE

SEQ ID NO: 2524496 - protein, 26 aa, Entamoeba dispar
FNDGRILKKVIWYTIDYSEYLKEKEQ

SEQ ID NO: 2524497 - protein, 18 aa, Entamoeba dispar
FNDKISALVLPLARYDHN

SEQ ID NO: 2524498 - protein, 18 aa, Entamoeba dispar
FNDNNITNLLLFNSPEVT

SEQ ID NO: 2524499 - protein, 23 aa, Entamoeba dispar
FNDPFHDFFLTLKSIPSLLETTY

SEQ ID NO: 2524500 - protein, 28 aa, Entamoeba dispar
FNDRKIFKYVIWYLVSYSKYLQEKEAGN

SEQ ID NO: 2524501 - protein, 23 aa, Entamoeba dispar
FNDVVFIIECGNSVWVGLNTNQL

SEQ ID NO: 2524502 - protein, 19 aa, Entamoeba dispar
FNDYRQKFITYDTYQETLQ

SEQ ID NO: 2524503 - protein, 29 aa, Entamoeba dispar
FNEDTFSNFFYMAPFFLNSERIKKHGNTL

SEQ ID NO: 2524504 - protein, 26 aa, Entamoeba dispar
FNEHKIEWKLLIKKAENWLSNKPTLT

SEQ ID NO: 2524505 - protein, 31 aa, Entamoeba dispar
FNEIDINEFSRLMLVPLKRLSSGDEKVIEAV

SEQ ID NO: 2524506 - protein, 18 aa, Entamoeba dispar
FNEIFDKMKIEESMYPSE

SEQ ID NO: 2524507 - protein, 17 aa, Entamoeba dispar
FNELFQFGDAFNLLAKD

SEQ ID NO: 2524508 - protein, 27 aa, Entamoeba dispar
FNEPSLDYIFKYIIIGEFSVGKTCLLM

SEQ ID NO: 2524509 - protein, 23 aa, Entamoeba dispar
FNESLFTLILTNFSLFKMVIELD

SEQ ID NO: 2524510 - protein, 24 aa, Entamoeba dispar
FNETREVYLIKELEKIAPKEKGIV

SEQ ID NO: 2524511 - protein, 17 aa, Entamoeba dispar
FNEWPLVSMWISVSDLF

SEQ ID NO: 2524512 - protein, 26 aa, Entamoeba dispar
FNEYNLFIPIQLLRLTINSINPNIIF

SEQ ID NO: 2524513 - protein, 19 aa, Entamoeba dispar
FNEYPFFKMIRNWINALGD

SEQ ID NO: 2524514 - protein, 18 aa, Entamoeba dispar
FNFNFRKILPKAEVVDLA

SEQ ID NO: 2524515 - protein, 20 aa, Entamoeba dispar
FNFPDFFDCFSYSLPTMMEM

SEQ ID NO: 2524516 - protein, 19 aa, Entamoeba dispar
FNFTNYIKLIYEQNSCIKV

SEQ ID NO: 2524517 - protein, 26 aa, Entamoeba dispar
FNGGKDWYKKRMQWLSKVGPGLDEES

SEQ ID NO: 2524518 - protein, 24 aa, Entamoeba dispar
FNGKEFCATLVRLPCVVETHKSYD

SEQ ID NO: 2524519 - protein, 30 aa, Entamoeba dispar
FNGLSGLYLRTIAWRVWLGVLPTPISVSWI

SEQ ID NO: 2524520 - protein, 23 aa, Entamoeba dispar
FNGYSQFPFFLFCEDSVSITMTQ

SEQ ID NO: 2524521 - protein, 25 aa, Entamoeba dispar
FNHCPYLTSIVLPSSVKRLGYMAFG

SEQ ID NO: 2524522 - protein, 27 aa, Entamoeba dispar
FNHIQMKYEPLIKEFPIQTKVSINPIF

SEQ ID NO: 2524523 - protein, 19 aa, Entamoeba dispar
FNHKDGTQQKFWYSCVNSY

SEQ ID NO: 2524524 - protein, 27 aa, Entamoeba dispar
FNIDHLTLCLYPEFIGDTLAYMNSIIE

SEQ ID NO: 2524525 - protein, 19 aa, Entamoeba dispar
FNIIFQYTSSIQSFLASKI

SEQ ID NO: 2524526 - protein, 28 aa, Entamoeba dispar
FNIIITLDYSVFMDVLEYFDSRESSTGS

SEQ ID NO: 2524527 - protein, 23 aa, Entamoeba dispar
FNIPQTGEVLLRIQWEGDVLPVQ

SEQ ID NO: 2524528 - protein, 17 aa, Entamoeba dispar
FNIQQIISRLILNSSHR

SEQ ID NO: 2524529 - protein, 19 aa, Entamoeba dispar
FNITHIYFNALILNMKEVD

SEQ ID NO: 2524530 - protein, 20 aa, Entamoeba dispar
FNITNWMKYIEALRLKGDFE

SEQ ID NO: 2524531 - protein, 19 aa, Entamoeba dispar
FNIVMRKYNLAAGDFPPIQ

SEQ ID NO: 2524532 - protein, 20 aa, Entamoeba dispar
FNKIVLVNLEPFFIAEQIAL

SEQ ID NO: 2524533 - protein, 24 aa, Entamoeba dispar
FNKLYGLLDSFYKISKKISTKGYQ

SEQ ID NO: 2524534 - protein, 26 aa, Entamoeba dispar
FNKNIKQIVYFLFKFKNLTEELKKEY

SEQ ID NO: 2524535 - protein, 24 aa, Entamoeba dispar
FNKTFKPFLKDIPNIEIKNITTRN

SEQ ID NO: 2524536 - protein, 34 aa, Entamoeba dispar
FNKTIPPPMKLQLEKVYWPLVTVTKKRYFGMKYE

SEQ ID NO: 2524537 - protein, 28 aa, Entamoeba dispar
FNLKTAVSWLFVNIILYSEDDNIGNLLT

SEQ ID NO: 2524538 - protein, 30 aa, Entamoeba dispar
FNLPEKHFIAFEKVKWWLDDKALDGNFVLL

SEQ ID NO: 2524539 - protein, 19 aa, Entamoeba dispar
FNLQTYPAVDEYINTVLTS

SEQ ID NO: 2524540 - protein, 17 aa, Entamoeba dispar
FNNCSSLKIINIPSSVR

SEQ ID NO: 2524541 - protein, 26 aa, Entamoeba dispar
FNNGKIFKKVIWYTVSYSKYLKEKEQ

SEQ ID NO: 2524542 - protein, 29 aa, Entamoeba dispar
FNNPPKLEIPQFPEFLIIKSDIQTKKYDI

SEQ ID NO: 2524543 - protein, 19 aa, Entamoeba dispar
FNNSCCEVGYWLSPKFQHQ

SEQ ID NO: 2524544 - protein, 24 aa, Entamoeba dispar
FNNSQNILLILKSLKEIDITIEEE

SEQ ID NO: 2524545 - protein, 19 aa, Entamoeba dispar
FNPFDLFNEMFGGMGGIPK

SEQ ID NO: 2524546 - protein, 22 aa, Entamoeba dispar
FNPGIMIFHPTLPLLVVGSNKG

SEQ ID NO: 2524547 - protein, 22 aa, Entamoeba dispar
FNPIEFVSLYRIFDSVLQIIDS

SEQ ID NO: 2524548 - protein, 17 aa, Entamoeba dispar
FNPIPLDEYSRRFFPNI

SEQ ID NO: 2524549 - protein, 31 aa, Entamoeba dispar
FNPRTAGNFVDLTWVFEMLKSQHFIHPSEFS

SEQ ID NO: 2524550 - protein, 17 aa, Entamoeba dispar
FNQFLQKEFLEMLDDTE

SEQ ID NO: 2524551 - protein, 26 aa, Entamoeba dispar
FNQIQLLYGANWKYEHPLEIRCIGVN

SEQ ID NO: 2524552 - protein, 18 aa, Entamoeba dispar
FNQLNKLFINNSSKIRFI

SEQ ID NO: 2524553 - protein, 23 aa, Entamoeba dispar
FNQLVPHPQMIFKFDLYDYQKQA

SEQ ID NO: 2524554 - protein, 23 aa, Entamoeba dispar
FNRFRIKGIQHILFYEIPTPTHY

SEQ ID NO: 2524555 - protein, 20 aa, Entamoeba dispar
FNRHICIVFELLGMNLYDVL

SEQ ID NO: 2524556 - protein, 17 aa, Entamoeba dispar
FNRPVIQLDFKHISDPN

SEQ ID NO: 2524557 - protein, 25 aa, Entamoeba dispar
FNSKNIKCILTVPAQFNDEQRNQTK

SEQ ID NO: 2524558 - protein, 17 aa, Entamoeba dispar
FNSLYFPSSLSFKTIPS

SEQ ID NO: 2524559 - protein, 18 aa, Entamoeba dispar
FNSMTSFQFSPEEDEIVS

SEQ ID NO: 2524560 - protein, 25 aa, Entamoeba dispar
FNSNLIQYIIISFDTPLTFSLNSVD

SEQ ID NO: 2524561 - protein, 31 aa, Entamoeba dispar
FNSPKIIEFLSYRQFPLLAFTDFMSLFVKHF

SEQ ID NO: 2524562 - protein, 24 aa, Entamoeba dispar
FNSSELLRKVIFPSSLTSIGNYAF

SEQ ID NO: 2524563 - protein, 22 aa, Entamoeba dispar
FNSSIFIRCFYLASSNNQSIKQ

SEQ ID NO: 2524564 - protein, 36 aa, Entamoeba dispar
FNSSLIQRLQFDLSPSSSFLFIPIEDDDLLLMNCIN

SEQ ID NO: 2524565 - protein, 17 aa, Entamoeba dispar
FNTIDFTNAGLIPRSIN

SEQ ID NO: 2524566 - protein, 18 aa, Entamoeba dispar
FNTKWFCSKIRKLRMTDF

SEQ ID NO: 2524567 - protein, 19 aa, Entamoeba dispar
FNTPVDPVALQVPTYFSVI

SEQ ID NO: 2524568 - protein, 28 aa, Entamoeba dispar
FNTRNEHMFGVEDLLFRALLNGGRLEDI

SEQ ID NO: 2524569 - protein, 30 aa, Entamoeba dispar
FNTRNEHMFGVEDLLFRALLNGGRLEDILN

SEQ ID NO: 2524570 - protein, 33 aa, Entamoeba dispar
FNTTATLKAIYHRLFVFIVNKVNEVMGKAGAHS

SEQ ID NO: 2524571 - protein, 19 aa, Entamoeba dispar
FNVILPKIDPLPEGITLGC

SEQ ID NO: 2524572 - protein, 33 aa, Entamoeba dispar
FNVLHEFLSFYVVLMKFINYKLYTNAGLNYPPQ

SEQ ID NO: 2524573 - protein, 20 aa, Entamoeba dispar
FNVWYEWLVTSPVLSRLHNA

SEQ ID NO: 2524574 - protein, 17 aa, Entamoeba dispar
FNYCRITSFPLTEDPHI

SEQ ID NO: 2524575 - protein, 32 aa, Entamoeba dispar
FNYGLNERFWMNYRKKHDLLKKYLDEITGIEK

SEQ ID NO: 2524576 - protein, 28 aa, Entamoeba dispar
FNYINDPIINYTFLSHGFYPKGGINPFC

SEQ ID NO: 2524577 - protein, 17 aa, Entamoeba dispar
FNYISLLKSVEGDLFHV

SEQ ID NO: 2524578 - protein, 29 aa, Entamoeba dispar
FNYNYEHNSVFWAIKFYHTDTKTSRKIVP

SEQ ID NO: 2524579 - protein, 31 aa, Entamoeba dispar
FNYVHGLFHVKFWVILTKTCFAIQDALLYST

SEQ ID NO: 2524580 - protein, 36 aa, Entamoeba dispar
FPCFELNNKPIFIFGYLDQGYWPDGLYTAPTDEALK

SEQ ID NO: 2524581 - protein, 25 aa, Entamoeba dispar
FPCKDYLYHILEFTGNGIALHFSLS

SEQ ID NO: 2524582 - protein, 26 aa, Entamoeba dispar
FPCLELKVIKEIWKKNNYNMVRTTDD

SEQ ID NO: 2524583 - protein, 17 aa, Entamoeba dispar
FPDEFYHLPDCINVIPV

SEQ ID NO: 2524584 - protein, 29 aa, Entamoeba dispar
FPDINKNTLWLIMRFLSKVIQNTSVNQMT

SEQ ID NO: 2524585 - protein, 18 aa, Entamoeba dispar
FPDKRPMFDVVKSVIETI

SEQ ID NO: 2524586 - protein, 19 aa, Entamoeba dispar
FPEDYFVLKYTNISKYQID

SEQ ID NO: 2524587 - protein, 26 aa, Entamoeba dispar
FPELNVNSIIFFQCTFAKKIFVKAKS

SEQ ID NO: 2524588 - protein, 27 aa, Entamoeba dispar
FPELSNFKMIGKFDGKIKFFNGNFEFD

SEQ ID NO: 2524589 - protein, 21 aa, Entamoeba dispar
FPEMFYPRILENDITNFKLHC

SEQ ID NO: 2524590 - protein, 22 aa, Entamoeba dispar
FPERYEVKDPLILEANSPIDRE

SEQ ID NO: 2524591 - protein, 22 aa, Entamoeba dispar
FPESFPHLFGKQKIRCLIPCAI

SEQ ID NO: 2524592 - protein, 23 aa, Entamoeba dispar
FPESFPHLFGKQKIRCLIPCAID

SEQ ID NO: 2524593 - protein, 17 aa, Entamoeba dispar
FPFSDPNYLSYYQMGYL

SEQ ID NO: 2524594 - protein, 22 aa, Entamoeba dispar
FPGLLVTSQERKNLFKELSICI

SEQ ID NO: 2524595 - protein, 18 aa, Entamoeba dispar
FPGLVYRMASPKVTLLVF

SEQ ID NO: 2524596 - protein, 30 aa, Entamoeba dispar
FPGTHAVPFSIIIPIVPHPSLHLKGGVGVR

SEQ ID NO: 2524597 - protein, 18 aa, Entamoeba dispar
FPGVVYRLADPKMVLLIF

SEQ ID NO: 2524598 - protein, 18 aa, Entamoeba dispar
FPHEARLRSLTYACQLEV

SEQ ID NO: 2524599 - protein, 19 aa, Entamoeba dispar
FPICESKSFKPSYIVAIQW

SEQ ID NO: 2524600 - protein, 17 aa, Entamoeba dispar
FPIIVKTTEIDLSEYTQ

SEQ ID NO: 2524601 - protein, 24 aa, Entamoeba dispar
FPKGFYHPNIYPSGTVCLSILNEE

SEQ ID NO: 2524602 - protein, 23 aa, Entamoeba dispar
FPKIETLYLYNFTDTIYPNYKNY

SEQ ID NO: 2524603 - protein, 17 aa, Entamoeba dispar
FPLLLTLSTTNKGCLLL

SEQ ID NO: 2524604 - protein, 17 aa, Entamoeba dispar
FPLTYRLSDFTKLYVTI

SEQ ID NO: 2524605 - protein, 19 aa, Entamoeba dispar
FPMLDILSIKKSENNKLVS

SEQ ID NO: 2524606 - protein, 18 aa, Entamoeba dispar
FPNALFGNLTLEVKMAIQ

SEQ ID NO: 2524607 - protein, 23 aa, Entamoeba dispar
FPNEYVDLYFTIIKHSYSTFDSL

SEQ ID NO: 2524608 - protein, 26 aa, Entamoeba dispar
FPNGPIQLFCDTLLMFISGLHKCCIY

SEQ ID NO: 2524609 - protein, 18 aa, Entamoeba dispar
FPNPLILSQFSSPNVLLS

SEQ ID NO: 2524610 - protein, 18 aa, Entamoeba dispar
FPNSVTVISPFAFSNCIN

SEQ ID NO: 2524611 - protein, 17 aa, Entamoeba dispar
FPNWLRNSKEDPYDILL

SEQ ID NO: 2524612 - protein, 20 aa, Entamoeba dispar
FPPEYTLVERILFEKEINGE

SEQ ID NO: 2524613 - protein, 20 aa, Entamoeba dispar
FPPKTVGDLAWYFIKLIEIN

SEQ ID NO: 2524614 - protein, 18 aa, Entamoeba dispar
FPPVVFYTPKELGGLGML

SEQ ID NO: 2524615 - protein, 25 aa, Entamoeba dispar
FPQGIKYILATLRQAVYKKFPESAI

SEQ ID NO: 2524616 - protein, 18 aa, Entamoeba dispar
FPQLIHLKRLHLYSFSSD

SEQ ID NO: 2524617 - protein, 17 aa, Entamoeba dispar
FPQPIFYTSNRTVILYL

SEQ ID NO: 2524618 - protein, 24 aa, Entamoeba dispar
FPQYFQPFDDLFKRLQWAHQSFWS

SEQ ID NO: 2524619 - protein, 18 aa, Entamoeba dispar
FPSFQNIYVLLRIEINIA

SEQ ID NO: 2524620 - protein, 17 aa, Entamoeba dispar
FPSLLRSIGIDAFSDCS

SEQ ID NO: 2524621 - protein, 21 aa, Entamoeba dispar
FPSLQYVQLIIGYDLMINEKI

SEQ ID NO: 2524622 - protein, 17 aa, Entamoeba dispar
FPSNLRSRRIVFNSPTQ

SEQ ID NO: 2524623 - protein, 21 aa, Entamoeba dispar
FPVCALIKKPFIFNINTVYYN

SEQ ID NO: 2524624 - protein, 18 aa, Entamoeba dispar
FPYMYYNHNTFNIGVVEN

SEQ ID NO: 2524625 - protein, 23 aa, Entamoeba dispar
FQCDDLFKLLLEWCDREEESTMV

SEQ ID NO: 2524626 - protein, 18 aa, Entamoeba dispar
FQCVILPSHLKFEQGICY

SEQ ID NO: 2524627 - protein, 24 aa, Entamoeba dispar
FQDGRAFAYIISKRRPDLLDPKYL

SEQ ID NO: 2524628 - protein, 19 aa, Entamoeba dispar
FQELLSLYNPFFEILNYLQ

SEQ ID NO: 2524629 - protein, 35 aa, Entamoeba dispar
FQFHKIHEYLKVQTPLFFVDYFRVFVSHYELGKKY

SEQ ID NO: 2524630 - protein, 23 aa, Entamoeba dispar
FQFNEEFLIFIADSLYDGRFTTF

SEQ ID NO: 2524631 - protein, 25 aa, Entamoeba dispar
FQFTKQFLWKWFNEQFIKKVNQTRE

SEQ ID NO: 2524632 - protein, 21 aa, Entamoeba dispar
FQGKRFILLDEYFQEGFNNMK

SEQ ID NO: 2524633 - protein, 17 aa, Entamoeba dispar
FQGLVEFNEIYVKALLG

SEQ ID NO: 2524634 - protein, 18 aa, Entamoeba dispar
FQHKIIVIPGDGIGVEVM

SEQ ID NO: 2524635 - protein, 17 aa, Entamoeba dispar
FQILHQLILYHNNLEIV

SEQ ID NO: 2524636 - protein, 17 aa, Entamoeba dispar
FQIPKHGYLIEWAKQGV

SEQ ID NO: 2524637 - protein, 24 aa, Entamoeba dispar
FQKFREMVYGLLLRQFHRLNEEVK

SEQ ID NO: 2524638 - protein, 20 aa, Entamoeba dispar
FQKRFGYFPKIFSRGQYSHQ

SEQ ID NO: 2524639 - protein, 26 aa, Entamoeba dispar
FQLENLRRLNLFSNKIRNVPIRLCFD

SEQ ID NO: 2524640 - protein, 33 aa, Entamoeba dispar
FQLPSIITHLSYFRIPLPDILHWMNIDISSSSG

SEQ ID NO: 2524641 - protein, 24 aa, Entamoeba dispar
FQLSHRDIIMPSLPKEFSTAIDNL

SEQ ID NO: 2524642 - protein, 19 aa, Entamoeba dispar
FQLTLRFKFKKDNSIIRIE

SEQ ID NO: 2524643 - protein, 20 aa, Entamoeba dispar
FQMIQNIILINNVGPNIISI

SEQ ID NO: 2524644 - protein, 20 aa, Entamoeba dispar
FQNDYMISVIAIQGAFKINL

SEQ ID NO: 2524645 - protein, 24 aa, Entamoeba dispar
FQNESHFLFSNHSFYSEPLYSYQP

SEQ ID NO: 2524646 - protein, 17 aa, Entamoeba dispar
FQNIYVLLRIEINIASN

SEQ ID NO: 2524647 - protein, 27 aa, Entamoeba dispar
FQPKKMTGVLFMPNAIPNHVKLAPLQI

SEQ ID NO: 2524648 - protein, 22 aa, Entamoeba dispar
FQPLSQIVVKRIFPASFEFVCR

SEQ ID NO: 2524649 - protein, 26 aa, Entamoeba dispar
FQQILNDEVFFIEITKLKLTSSTTLN

SEQ ID NO: 2524650 - protein, 22 aa, Entamoeba dispar
FQQLIYYDEIKFLKEFYKNKSL

SEQ ID NO: 2524651 - protein, 20 aa, Entamoeba dispar
FQQQISFVIPMTISPSFNNQ

SEQ ID NO: 2524652 - protein, 21 aa, Entamoeba dispar
FQQVILYFPSLTQIKELMLIS

SEQ ID NO: 2524653 - protein, 18 aa, Entamoeba dispar
FQREELVIVPRTKGGFSY

SEQ ID NO: 2524654 - protein, 19 aa, Entamoeba dispar
FQREELVIVPRTKGGFSYG

SEQ ID NO: 2524655 - protein, 17 aa, Entamoeba dispar
FQRWIEIIDAQIDSKII

SEQ ID NO: 2524656 - protein, 26 aa, Entamoeba dispar
FQSASQRAPALLFIDEIDAITPKRDN

SEQ ID NO: 2524657 - protein, 19 aa, Entamoeba dispar
FQSIARSYYRNADAAFIVF

SEQ ID NO: 2524658 - protein, 25 aa, Entamoeba dispar
FQTLMGEVAPVKKAFIITKHGSKEC

SEQ ID NO: 2524659 - protein, 20 aa, Entamoeba dispar
FRCITRGYFRGSIGAIIVYD

SEQ ID NO: 2524660 - protein, 17 aa, Entamoeba dispar
FRCPEALFQPSFLGMEC

SEQ ID NO: 2524661 - protein, 19 aa, Entamoeba dispar
FREANSFLFKPINSNEQKI

SEQ ID NO: 2524662 - protein, 24 aa, Entamoeba dispar
FREDFVYGFSTWFDVSFPQSGEVL

SEQ ID NO: 2524663 - protein, 26 aa, Entamoeba dispar
FREMKMFQTLALPTPQKRILKDVFKG

SEQ ID NO: 2524664 - protein, 17 aa, Entamoeba dispar
FRFMSKEEFRVLTAIEM

SEQ ID NO: 2524665 - protein, 20 aa, Entamoeba dispar
FRGCSSIIFINIPTHVSKLG

SEQ ID NO: 2524666 - protein, 17 aa, Entamoeba dispar
FRGIRFSAKYGFKIEDN

SEQ ID NO: 2524667 - protein, 24 aa, Entamoeba dispar
FRGNTPFIKIFNNYTSKFCDELLK

SEQ ID NO: 2524668 - protein, 18 aa, Entamoeba dispar
FRGRNKMTSFWRRHLEDV

SEQ ID NO: 2524669 - protein, 26 aa, Entamoeba dispar
FRIDKVFFFSYTFPELIKIRSEFKFF

SEQ ID NO: 2524670 - protein, 30 aa, Entamoeba dispar
FRIEEYTRAVWPSYRTFVVHLIDSLCDITL

SEQ ID NO: 2524671 - protein, 20 aa, Entamoeba dispar
FRIFLDTFFEGVRSPSFIIY

SEQ ID NO: 2524672 - protein, 24 aa, Entamoeba dispar
FRIPFQGIHPHPPLNIPFANGIEE

SEQ ID NO: 2524673 - protein, 28 aa, Entamoeba dispar
FRITFHSHKKLYDLFWKVVEPLSQIQRI

SEQ ID NO: 2524674 - protein, 17 aa, Entamoeba dispar
FRKFICCGPMYFIENVN

SEQ ID NO: 2524675 - protein, 23 aa, Entamoeba dispar
FRKKYMIFSYQFADFITNFEDMD

SEQ ID NO: 2524676 - protein, 25 aa, Entamoeba dispar
FRKTKFTPITLLNFLQSTLSKNDFS

SEQ ID NO: 2524677 - protein, 18 aa, Entamoeba dispar
FRMKTGNTINYNFKRRHW

SEQ ID NO: 2524678 - protein, 25 aa, Entamoeba dispar
FRNSSQFVLLMKRIVNFFREKLHEA

SEQ ID NO: 2524679 - protein, 25 aa, Entamoeba dispar
FRNYDSLKRYDAFVLNMVIVQSTQA

SEQ ID NO: 2524680 - protein, 18 aa, Entamoeba dispar
FRQRTFVILFSDKTERNE

SEQ ID NO: 2524681 - protein, 35 aa, Entamoeba dispar
FRQTYIRTITPFTVNRLLQLFYIGQNLFKPMDHHM

SEQ ID NO: 2524682 - protein, 33 aa, Entamoeba dispar
FRRALSFIRIGMPIPFYVLKRNIAAYPRYHKVF

SEQ ID NO: 2524683 - protein, 19 aa, Entamoeba dispar
FRRCPSLKSINIPTSITSI

SEQ ID NO: 2524684 - protein, 20 aa, Entamoeba dispar
FRRHPTYMAHKLIANCLLPQ

SEQ ID NO: 2524685 - protein, 31 aa, Entamoeba dispar
FRRISTLWRICQTYDYFFVKTVVREYTDDNP

SEQ ID NO: 2524686 - protein, 18 aa, Entamoeba dispar
FRRKLLEIKPSTEPIPFL

SEQ ID NO: 2524687 - protein, 19 aa, Entamoeba dispar
FRSAFIYAKIKTANVREWV

SEQ ID NO: 2524688 - protein, 32 aa, Entamoeba dispar
FRSDQQITFKFIRIYRLFINFLGGDIVDLSTG

SEQ ID NO: 2524689 - protein, 20 aa, Entamoeba dispar
FRSLWKSYYTNVIAVAYVIN

SEQ ID NO: 2524690 - protein, 32 aa, Entamoeba dispar
FRSTTKSYLRGLHGVLFCFDITKKETFNCIDM

SEQ ID NO: 2524691 - protein, 19 aa, Entamoeba dispar
FRSVTQSYYRGTHAAIIVF

SEQ ID NO: 2524692 - protein, 19 aa, Entamoeba dispar
FRTITRNIRTLFRKDFLAL

SEQ ID NO: 2524693 - protein, 19 aa, Entamoeba dispar
FRTSEYATDPFRFFEEMFG

SEQ ID NO: 2524694 - protein, 18 aa, Entamoeba dispar
FRTYLRYLRGSVFCEKKL

SEQ ID NO: 2524695 - protein, 23 aa, Entamoeba dispar
FRVTKPFNFFRKVQIFPSQLLFK

SEQ ID NO: 2524696 - protein, 19 aa, Entamoeba dispar
FRVVEIISCDINELLIGNV

SEQ ID NO: 2524697 - protein, 18 aa, Entamoeba dispar
FRYDISHGVALKTAKRRY

SEQ ID NO: 2524698 - protein, 17 aa, Entamoeba dispar
FRYFKNCSSIANTTAPS

SEQ ID NO: 2524699 - protein, 26 aa, Entamoeba dispar
FSADVWSLGILLFKCFTSYYPFESTG

SEQ ID NO: 2524700 - protein, 30 aa, Entamoeba dispar
FSCDVYALGLIMWQTFTQKQLFPEYDDFDE

SEQ ID NO: 2524701 - protein, 32 aa, Entamoeba dispar
FSCTEMTSLYLLLQTKLFNITHIYFNALILNM

SEQ ID NO: 2524702 - protein, 26 aa, Entamoeba dispar
FSDECSRLLFFIERHAFDVCKILLEE

SEQ ID NO: 2524703 - protein, 32 aa, Entamoeba dispar
FSDGCSGLVYVFYNKMLYFAQCGSIRSYIISN

SEQ ID NO: 2524704 - protein, 27 aa, Entamoeba dispar
FSDSLFGDDFFEDDDIFGALHSIWSSK

SEQ ID NO: 2524705 - protein, 19 aa, Entamoeba dispar
FSDTTFLAFLFCLNDIANI

SEQ ID NO: 2524706 - protein, 18 aa, Entamoeba dispar
FSDVYYVYNCIDLIFVHL

SEQ ID NO: 2524707 - protein, 20 aa, Entamoeba dispar
FSDYLRTHKLMKMSFCSMGS

SEQ ID NO: 2524708 - protein, 19 aa, Entamoeba dispar
FSEFFKHFEKWFSESEWVN

SEQ ID NO: 2524709 - protein, 24 aa, Entamoeba dispar
FSEKKIIIWGNLPRRRIDLMDENT

SEQ ID NO: 2524710 - protein, 26 aa, Entamoeba dispar
FSESIGYHQILYPKTTDVTNILNFLM

SEQ ID NO: 2524711 - protein, 26 aa, Entamoeba dispar
FSESIGYHQILYPKTTDVTNILNFLT

SEQ ID NO: 2524712 - protein, 32 aa, Entamoeba dispar
FSEVPRIMVCVLYPKIIKIDAAFISPSPTGFI

SEQ ID NO: 2524713 - protein, 28 aa, Entamoeba dispar
FSFDCDSVTLELPYVRRIYGVDDLIEIK

SEQ ID NO: 2524714 - protein, 25 aa, Entamoeba dispar
FSFGMTMYHIFTNEIPYGDLSNAQI

SEQ ID NO: 2524715 - protein, 18 aa, Entamoeba dispar
FSFIVDFLKEFPTVSSMK

SEQ ID NO: 2524716 - protein, 17 aa, Entamoeba dispar
FSFLIEFGEIKNDGNIC

SEQ ID NO: 2524717 - protein, 24 aa, Entamoeba dispar
FSGAKGCIAVFDYSSPDTIQNVRN

SEQ ID NO: 2524718 - protein, 17 aa, Entamoeba dispar
FSHCISLTSINIPDSVI

SEQ ID NO: 2524719 - protein, 20 aa, Entamoeba dispar
FSHCNALFSITLPISITMID

SEQ ID NO: 2524720 - protein, 17 aa, Entamoeba dispar
FSHFLMTSYTPLRQVNQ

SEQ ID NO: 2524721 - protein, 19 aa, Entamoeba dispar
FSHVNLAYKYFSIKKICDL

SEQ ID NO: 2524722 - protein, 25 aa, Entamoeba dispar
FSIHNTIGFLPIQIANFLNIHNELF

SEQ ID NO: 2524723 - protein, 22 aa, Entamoeba dispar
FSIKIPLKDLVLFFDSIISEVR

SEQ ID NO: 2524724 - protein, 24 aa, Entamoeba dispar
FSINPPLYGIAWFNKYNFSQYLPG

SEQ ID NO: 2524725 - protein, 22 aa, Entamoeba dispar
FSIPSWVMLLNRGNGIKTYQAG

SEQ ID NO: 2524726 - protein, 21 aa, Entamoeba dispar
FSIYRRSLVMVFATAAFMTYG

SEQ ID NO: 2524727 - protein, 25 aa, Entamoeba dispar
FSKDNTVTYYFAYGGWIVQMEEKND

SEQ ID NO: 2524728 - protein, 26 aa, Entamoeba dispar
FSKDNTVTYYFAYGGWIVQMEEKNDQ

SEQ ID NO: 2524729 - protein, 19 aa, Entamoeba dispar
FSKLTLPTILDLKGANVKV

SEQ ID NO: 2524730 - protein, 19 aa, Entamoeba dispar
FSKLTQGAKGVLLFGPPGT

SEQ ID NO: 2524731 - protein, 27 aa, Entamoeba dispar
FSKQMKFLLHRLNTLSSLPFVEDPLTL

SEQ ID NO: 2524732 - protein, 18 aa, Entamoeba dispar
FSLFCREGTIIPSLTEII

SEQ ID NO: 2524733 - protein, 18 aa, Entamoeba dispar
FSLFFTDIKPFYSSFHIE

SEQ ID NO: 2524734 - protein, 20 aa, Entamoeba dispar
FSLFQLLGRIIHRLLHNRNT

SEQ ID NO: 2524735 - protein, 25 aa, Entamoeba dispar
FSLGSMIFEFICGVPPFHEETPDAI

SEQ ID NO: 2524736 - protein, 27 aa, Entamoeba dispar
FSLIQSPLPITPVILSTPAIGRTTTGL

SEQ ID NO: 2524737 - protein, 18 aa, Entamoeba dispar
FSLKKDIYLFIKNHWNIL

SEQ ID NO: 2524738 - protein, 18 aa, Entamoeba dispar
FSLNFLLNEGERINNLIC

SEQ ID NO: 2524739 - protein, 17 aa, Entamoeba dispar
FSLPKIYPTDISINNSK

SEQ ID NO: 2524740 - protein, 17 aa, Entamoeba dispar
FSLTTFSPSGKLVQIEY

SEQ ID NO: 2524741 - protein, 17 aa, Entamoeba dispar
FSMKISIKLFKLSNMFS

SEQ ID NO: 2524742 - protein, 23 aa, Entamoeba dispar
FSNAYLFFLLSECGASASLKYTK

SEQ ID NO: 2524743 - protein, 24 aa, Entamoeba dispar
FSNDIILNSLYYFKNQMEPYSDDD

SEQ ID NO: 2524744 - protein, 25 aa, Entamoeba dispar
FSNFSLLTLLRLRGNKFNKFPDPIL

SEQ ID NO: 2524745 - protein, 31 aa, Entamoeba dispar
FSNLINTLKLMFRRYLKLENPLVAFINLTQN

SEQ ID NO: 2524746 - protein, 36 aa, Entamoeba dispar
FSNPLISLTQIWIYHDSLKYIFFPGGSGNCYSSMSP

SEQ ID NO: 2524747 - protein, 25 aa, Entamoeba dispar
FSNQFQNGFIRILQTQYKRKQVNAN

SEQ ID NO: 2524748 - protein, 28 aa, Entamoeba dispar
FSNQTLAQIKLWREKLPIDCITLPKELD

SEQ ID NO: 2524749 - protein, 24 aa, Entamoeba dispar
FSPKDPHYFAFNKASPNRHFSPLC

SEQ ID NO: 2524750 - protein, 20 aa, Entamoeba dispar
FSPQLIPHSVLSSYLFTIFL

SEQ ID NO: 2524751 - protein, 25 aa, Entamoeba dispar
FSRQTFFRLGLFSLLLHEVMLEFNM

SEQ ID NO: 2524752 - protein, 26 aa, Entamoeba dispar
FSRQTFFRLGLFSLLLHEVMLEFNMS

SEQ ID NO: 2524753 - protein, 28 aa, Entamoeba dispar
FSRQYDDLNSRFRYLNTISPENLNAVRA

SEQ ID NO: 2524754 - protein, 25 aa, Entamoeba dispar
FSRRRLEWHYLFIACSYIGARICSL

SEQ ID NO: 2524755 - protein, 27 aa, Entamoeba dispar
FSSCQLPMLLIPTTCTYLNVYCSRLPF

SEQ ID NO: 2524756 - protein, 18 aa, Entamoeba dispar
FSSFLLRYNPHHIQQIMF

SEQ ID NO: 2524757 - protein, 17 aa, Entamoeba dispar
FSSFVRYARKRCKPVLT

SEQ ID NO: 2524758 - protein, 24 aa, Entamoeba dispar
FSSLNPFFDIIFKGKGISLGELNK

SEQ ID NO: 2524759 - protein, 17 aa, Entamoeba dispar
FSSSYIKFFLTSQLVIE

SEQ ID NO: 2524760 - protein, 19 aa, Entamoeba dispar
FSSSYIKFFLTSQLVIEGE

SEQ ID NO: 2524761 - protein, 24 aa, Entamoeba dispar
FSTGKTCMLIRLSQNFFDTQHNPT

SEQ ID NO: 2524762 - protein, 26 aa, Entamoeba dispar
FSTIFPTYILYLKLDSLQLGNSIQII

SEQ ID NO: 2524763 - protein, 20 aa, Entamoeba dispar
FSVDILTKKFDLCDVVLGKA

SEQ ID NO: 2524764 - protein, 18 aa, Entamoeba dispar
FSWPKEWRGMYGYELKNI

SEQ ID NO: 2524765 - protein, 21 aa, Entamoeba dispar
FSYEQFPRRRLFPSEINPQRE

SEQ ID NO: 2524766 - protein, 21 aa, Entamoeba dispar
FSYFIPEFMYMTGLSSKMKSD

SEQ ID NO: 2524767 - protein, 25 aa, Entamoeba dispar
FTAAMFLPFVMQFLENFENFTKWKF

SEQ ID NO: 2524768 - protein, 31 aa, Entamoeba dispar
FTAMRDLYMKIANGFVLVYSITERSTYNSLD

SEQ ID NO: 2524769 - protein, 17 aa, Entamoeba dispar
FTAVFRLLDIKDQGKIG

SEQ ID NO: 2524770 - protein, 25 aa, Entamoeba dispar
FTCPPTEYYLYKKIQSISSTPILQI

SEQ ID NO: 2524771 - protein, 26 aa, Entamoeba dispar
FTDKGDIQYFWKNYILQLTNIKDESL

SEQ ID NO: 2524772 - protein, 18 aa, Entamoeba dispar
FTDYCHQVIFMTGKPSFG

SEQ ID NO: 2524773 - protein, 23 aa, Entamoeba dispar
FTEEQYFLLPYPFCVIDPVNQTV

SEQ ID NO: 2524774 - protein, 18 aa, Entamoeba dispar
FTEIFNKLVPQGKGTLVM

SEQ ID NO: 2524775 - protein, 32 aa, Entamoeba dispar
FTELRKIMNIAIPPTIPFIGSTLTDLIYTSDG

SEQ ID NO: 2524776 - protein, 25 aa, Entamoeba dispar
FTEQTIQFLLLISSQIKLIQLPVIS

SEQ ID NO: 2524777 - protein, 26 aa, Entamoeba dispar
FTEQTIQFLPLIQSQIKLIRLPVISP

SEQ ID NO: 2524778 - protein, 20 aa, Entamoeba dispar
FTFDPFDDNILYIGGEDGKI

SEQ ID NO: 2524779 - protein, 17 aa, Entamoeba dispar
FTFGKIEKKYNSYYGTI

SEQ ID NO: 2524780 - protein, 18 aa, Entamoeba dispar
FTGAMKWIRGEWSNKRAE

SEQ ID NO: 2524781 - protein, 24 aa, Entamoeba dispar
FTGCLFLQTITLPNSLLSIDDFAF

SEQ ID NO: 2524782 - protein, 17 aa, Entamoeba dispar
FTGDYFFADICLPMLKE

SEQ ID NO: 2524783 - protein, 26 aa, Entamoeba dispar
FTHPENWDFIFPITVLIKSNDRIRTY

SEQ ID NO: 2524784 - protein, 18 aa, Entamoeba dispar
FTIGSRKMAIAKKEPENT

SEQ ID NO: 2524785 - protein, 26 aa, Entamoeba dispar
FTISGFYYQSPIINITYKSSSIKNKI

SEQ ID NO: 2524786 - protein, 30 aa, Entamoeba dispar
FTIVDFEADFPFYKEFFYGNDQVKHYLSKE

SEQ ID NO: 2524787 - protein, 17 aa, Entamoeba dispar
FTKFPKLDMKLIASIDD

SEQ ID NO: 2524788 - protein, 34 aa, Entamoeba dispar
FTKKDIRLPKANKFIWLFPVHIGEALRYSPERNI

SEQ ID NO: 2524789 - protein, 20 aa, Entamoeba dispar
FTLHIPFMVKSPTGYPVIIF

SEQ ID NO: 2524790 - protein, 25 aa, Entamoeba dispar
FTLHWELQTWVPLGTYLLPSDNNVI

SEQ ID NO: 2524791 - protein, 18 aa, Entamoeba dispar
FTLPDDYLLPLYQNVTQN

SEQ ID NO: 2524792 - protein, 20 aa, Entamoeba dispar
FTLPLNLIKLDILYTNNIEI

SEQ ID NO: 2524793 - protein, 24 aa, Entamoeba dispar
FTLTKIPPKCDLVIQYSYHYEIND

SEQ ID NO: 2524794 - protein, 22 aa, Entamoeba dispar
FTMGTIIKEIILIEGNTLSSKT

SEQ ID NO: 2524795 - protein, 18 aa, Entamoeba dispar
FTMLVQKVNIALQKHGIE

SEQ ID NO: 2524796 - protein, 17 aa, Entamoeba dispar
FTNIFYLEEFVPTFISI

SEQ ID NO: 2524797 - protein, 17 aa, Entamoeba dispar
FTNKFIKKYITYARNLP

SEQ ID NO: 2524798 - protein, 32 aa, Entamoeba dispar
FTNLFQAQLVVLELPRPLLTPGYEAVIHIHTS

SEQ ID NO: 2524799 - protein, 23 aa, Entamoeba dispar
FTNNLFYYLRDNFLKFHGDSEYN

SEQ ID NO: 2524800 - protein, 19 aa, Entamoeba dispar
FTNPMLYEALFRLIDNNSN

SEQ ID NO: 2524801 - protein, 24 aa, Entamoeba dispar
FTNSKLILQHDILYPKKPTSNKEE

SEQ ID NO: 2524802 - protein, 20 aa, Entamoeba dispar
FTNTLLKEIVLPPCFISLSD

SEQ ID NO: 2524803 - protein, 17 aa, Entamoeba dispar
FTNWIVSFYSFIISNIN

SEQ ID NO: 2524804 - protein, 18 aa, Entamoeba dispar
FTQALFAAAVEYLLPLRL

SEQ ID NO: 2524805 - protein, 17 aa, Entamoeba dispar
FTQCFVYSFKLITTTTK

SEQ ID NO: 2524806 - protein, 30 aa, Entamoeba dispar
FTRLYGEYCHLCLLPYLRAVTKEVIQLLIN

SEQ ID NO: 2524807 - protein, 28 aa, Entamoeba dispar
FTRTFFRKTLAYFVIVDSTIEAATHALN

SEQ ID NO: 2524808 - protein, 26 aa, Entamoeba dispar
FTSDASFIMALLQFPGINVNAKNRDE

SEQ ID NO: 2524809 - protein, 25 aa, Entamoeba dispar
FTSGNEFIFKSFKVTLIDNKNTIPE

SEQ ID NO: 2524810 - protein, 38 aa, Entamoeba dispar
FTSKEIETIYYWKYYLNLVLPQQMSVFVLLLADIKSSE

SEQ ID NO: 2524811 - protein, 27 aa, Entamoeba dispar
FTTCQSLPLNLFLFVNKKPIIDMDVIN

SEQ ID NO: 2524812 - protein, 26 aa, Entamoeba dispar
FTTEPTLFDFFNTRDRRLPLIDIISF

SEQ ID NO: 2524813 - protein, 25 aa, Entamoeba dispar
FTTPCLPFIGTYLTDYTFLDDGNPD

SEQ ID NO: 2524814 - protein, 31 aa, Entamoeba dispar
FTTTHQTLLLLSLITPYLHHYLSPNVIISGR

SEQ ID NO: 2524815 - protein, 19 aa, Entamoeba dispar
FTTYFDVLSFIQINKKCFS

SEQ ID NO: 2524816 - protein, 18 aa, Entamoeba dispar
FTVLRGKFDGHEYLFDGK

SEQ ID NO: 2524817 - protein, 30 aa, Entamoeba dispar
FTVNNVICPYFFFPLTTFNEYSIAGWFKGI

SEQ ID NO: 2524818 - protein, 20 aa, Entamoeba dispar
FTVSLICSFILKRCGLNCNN

SEQ ID NO: 2524819 - protein, 30 aa, Entamoeba dispar
FTVTSAPTFFKYFMAFIRKIVTENSDYLFV

SEQ ID NO: 2524820 - protein, 21 aa, Entamoeba dispar
FTVYMSDLYIVGFQQFKNQTQ

SEQ ID NO: 2524821 - protein, 20 aa, Entamoeba dispar
FTYYNNYIEPNTNCYFLLTT

SEQ ID NO: 2524822 - protein, 17 aa, Entamoeba dispar
FVADPRMLKPAEIDPRT

SEQ ID NO: 2524823 - protein, 20 aa, Entamoeba dispar
FVAHGNICLLFKQIAKHDID

SEQ ID NO: 2524824 - protein, 17 aa, Entamoeba dispar
FVALRNQYIKQGDGFVL

SEQ ID NO: 2524825 - protein, 18 aa, Entamoeba dispar
FVALRNQYIKQGDGFVLI

SEQ ID NO: 2524826 - protein, 26 aa, Entamoeba dispar
FVCNKSALFIIRRNGMKEYIPIVSKR

SEQ ID NO: 2524827 - protein, 18 aa, Entamoeba dispar
FVDYPLINKPNELVQNNN

SEQ ID NO: 2524828 - protein, 27 aa, Entamoeba dispar
FVEKNRKWLLPYIVYKCCGMNGVPTME

SEQ ID NO: 2524829 - protein, 18 aa, Entamoeba dispar
FVEMHASEFILLTKQEHQ

SEQ ID NO: 2524830 - protein, 32 aa, Entamoeba dispar
FVENVISPFIFTCAVLPYLKPTGKIIFVTSNC

SEQ ID NO: 2524831 - protein, 18 aa, Entamoeba dispar
FVGKEKLVSIPINNLKRI

SEQ ID NO: 2524832 - protein, 17 aa, Entamoeba dispar
FVGSILKGKDIEQAQKL

SEQ ID NO: 2524833 - protein, 19 aa, Entamoeba dispar
FVHHFNAMNDVFVRLLLNA

SEQ ID NO: 2524834 - protein, 22 aa, Entamoeba dispar
FVIKDVIMILPKFINDLCHHPI

SEQ ID NO: 2524835 - protein, 17 aa, Entamoeba dispar
FVIPMYFVDSSPDEGVD

SEQ ID NO: 2524836 - protein, 17 aa, Entamoeba dispar
FVIVKDLFEFFKDIPMG

SEQ ID NO: 2524837 - protein, 24 aa, Entamoeba dispar
FVKANLLPIKYFGFDFHKICANKK

SEQ ID NO: 2524838 - protein, 26 aa, Entamoeba dispar
FVKDDQLFTVYNFVQGFGFDGFVFVD

SEQ ID NO: 2524839 - protein, 19 aa, Entamoeba dispar
FVKGYYRQASAFAALGQLQ

SEQ ID NO: 2524840 - protein, 27 aa, Entamoeba dispar
FVKIKADLVIVLFIEIFRAIDSDMNGT

SEQ ID NO: 2524841 - protein, 23 aa, Entamoeba dispar
FVKIQKFVKPYRKEYTEGITHFK

SEQ ID NO: 2524842 - protein, 25 aa, Entamoeba dispar
FVKKGLVDGWYDPRFPTIQGLIRRG

SEQ ID NO: 2524843 - protein, 17 aa, Entamoeba dispar
FVKSPMLNPMLGRMINK

SEQ ID NO: 2524844 - protein, 33 aa, Entamoeba dispar
FVLLEKPEQFSIITYLGVMYQMFQLKGGSVADE

SEQ ID NO: 2524845 - protein, 19 aa, Entamoeba dispar
FVLLTQYIDYMIDIVRPRK

SEQ ID NO: 2524846 - protein, 17 aa, Entamoeba dispar
FVLLYCSNLEKQFERLT

SEQ ID NO: 2524847 - protein, 18 aa, Entamoeba dispar
FVLPKNLLYLSFTNCLYS

SEQ ID NO: 2524848 - protein, 25 aa, Entamoeba dispar
FVLRAREFAADKPIILLKAGKSSEG

SEQ ID NO: 2524849 - protein, 18 aa, Entamoeba dispar
FVLSFTFKQNPYLLYNTL

SEQ ID NO: 2524850 - protein, 24 aa, Entamoeba dispar
FVNAICGIKITDDFRYIIINEDNL

SEQ ID NO: 2524851 - protein, 24 aa, Entamoeba dispar
FVNKGRLQIERPNFFILPQGRCAE

SEQ ID NO: 2524852 - protein, 25 aa, Entamoeba dispar
FVNTKLLVWGLNKPKRLMLRRLVDV

SEQ ID NO: 2524853 - protein, 20 aa, Entamoeba dispar
FVPFCFELKLVIIQQLICCN

SEQ ID NO: 2524854 - protein, 27 aa, Entamoeba dispar
FVPIAKTILRCAVLHLPSPLEAQPKRI

SEQ ID NO: 2524855 - protein, 19 aa, Entamoeba dispar
FVPIVICLSFRRGVQCIEN

SEQ ID NO: 2524856 - protein, 31 aa, Entamoeba dispar
FVPNNASYPLGIRPLYLPLDTEVIIKNIQPN

SEQ ID NO: 2524857 - protein, 19 aa, Entamoeba dispar
FVPQYPLSPGSPQSTSSSP

SEQ ID NO: 2524858 - protein, 18 aa, Entamoeba dispar
FVQIEYFCLHSFNEELKK

SEQ ID NO: 2524859 - protein, 19 aa, Entamoeba dispar
FVQLYTTPQIRCGEHKEII

SEQ ID NO: 2524860 - protein, 17 aa, Entamoeba dispar
FVQSWFDHWGIVPGDPL

SEQ ID NO: 2524861 - protein, 20 aa, Entamoeba dispar
FVRDSFLRSLATQFDTFPPS

SEQ ID NO: 2524862 - protein, 18 aa, Entamoeba dispar
FVRQLNIYGFHKLEYKTG

SEQ ID NO: 2524863 - protein, 18 aa, Entamoeba dispar
FVRQLNIYGFHKVDHPQG

SEQ ID NO: 2524864 - protein, 24 aa, Entamoeba dispar
FVSKRIFYCFIYQSPKCDLEILNY

SEQ ID NO: 2524865 - protein, 19 aa, Entamoeba dispar
FVSLFVRTFIEITSKKLKG

SEQ ID NO: 2524866 - protein, 35 aa, Entamoeba dispar
FVSRTQFMENVFPFIFHILLNCQINFSSKNDKLRF

SEQ ID NO: 2524867 - protein, 22 aa, Entamoeba dispar
FVTEFGIPYKSPLQLTFDGTNF

SEQ ID NO: 2524868 - protein, 17 aa, Entamoeba dispar
FVTIIADLKKINSVVLK

SEQ ID NO: 2524869 - protein, 23 aa, Entamoeba dispar
FVTTIIDRVLIKMQVWDIAGQER

SEQ ID NO: 2524870 - protein, 17 aa, Entamoeba dispar
FVTYTLHGDLRGCIGCF

SEQ ID NO: 2524871 - protein, 18 aa, Entamoeba dispar
FVVLNDWYKISTNQVIIF

SEQ ID NO: 2524872 - protein, 23 aa, Entamoeba dispar
FVVLSNPHFLFRSGTSFDIIFID

SEQ ID NO: 2524873 - protein, 19 aa, Entamoeba dispar
FVVYSEPFAVYGINLPNQS

SEQ ID NO: 2524874 - protein, 19 aa, Entamoeba dispar
FVYDLKLIKELTIGEIILQ

SEQ ID NO: 2524875 - protein, 17 aa, Entamoeba dispar
FVYLIDGFTMTPQYLIK

SEQ ID NO: 2524876 - protein, 19 aa, Entamoeba dispar
FVYSFKLITTTTKLLQLLI

SEQ ID NO: 2524877 - protein, 19 aa, Entamoeba dispar
FVYSTFLTTEVNGLIIFSL

SEQ ID NO: 2524878 - protein, 19 aa, Entamoeba dispar
FWICSSLTSITIPQSIIRL

SEQ ID NO: 2524879 - protein, 17 aa, Entamoeba dispar
FYADRLLDLYTLSYEGN

SEQ ID NO: 2524880 - protein, 22 aa, Entamoeba dispar
FYCPHHLCFRAFSTIQPKQQIM

SEQ ID NO: 2524881 - protein, 24 aa, Entamoeba dispar
FYCQNDWCEIAYYVSPLMGKEDRT

SEQ ID NO: 2524882 - protein, 23 aa, Entamoeba dispar
FYDCPLLQHVVLPTTLTLIGDNC

SEQ ID NO: 2524883 - protein, 17 aa, Entamoeba dispar
FYECMSLTNIMLPSLVT

SEQ ID NO: 2524884 - protein, 25 aa, Entamoeba dispar
FYECSLLISINIPSSIIKIGDYCFY

SEQ ID NO: 2524885 - protein, 20 aa, Entamoeba dispar
FYEETIPKEYHRFLMFIHSQ

SEQ ID NO: 2524886 - protein, 18 aa, Entamoeba dispar
FYEFMAMYKFMELAYNLF

SEQ ID NO: 2524887 - protein, 18 aa, Entamoeba dispar
FYEKEGRKLPWRETTDKY

SEQ ID NO: 2524888 - protein, 17 aa, Entamoeba dispar
FYEKFKDNALRETEDLK

SEQ ID NO: 2524889 - protein, 19 aa, Entamoeba dispar
FYEKYLCVWDYAAASLIVK

SEQ ID NO: 2524890 - protein, 19 aa, Entamoeba dispar
FYEYLLHSHGYPSDLETIL

SEQ ID NO: 2524891 - protein, 18 aa, Entamoeba dispar
FYGKYFKHTSIFNELVDL

SEQ ID NO: 2524892 - protein, 25 aa, Entamoeba dispar
FYGNKQLFIVITRTFLNLIHRNKVI

SEQ ID NO: 2524893 - protein, 17 aa, Entamoeba dispar
FYGYVKRSMNRAPGPTD

SEQ ID NO: 2524894 - protein, 17 aa, Entamoeba dispar
FYHLISISHPTIQDIDQ

SEQ ID NO: 2524895 - protein, 28 aa, Entamoeba dispar
FYHLPDCINVIPVQRISSTLVFVKSTNQ

SEQ ID NO: 2524896 - protein, 25 aa, Entamoeba dispar
FYIDKLEGLIPQKQWPYPSYETLWN

SEQ ID NO: 2524897 - protein, 18 aa, Entamoeba dispar
FYIKCQIAAFCELLRDYS

SEQ ID NO: 2524898 - protein, 19 aa, Entamoeba dispar
FYKAYIVSSLWDDSKNYRF

SEQ ID NO: 2524899 - protein, 37 aa, Entamoeba dispar
FYKEKMALVELMSLVLNVYHVIEIFSEQTRGIVCIKQ

SEQ ID NO: 2524900 - protein, 17 aa, Entamoeba dispar
FYKNLRTLFSKLDDDKD

SEQ ID NO: 2524901 - protein, 19 aa, Entamoeba dispar
FYLQPFNDNIYYSPSGEII

SEQ ID NO: 2524902 - protein, 17 aa, Entamoeba dispar
FYLTRQPYQKSFINHFL

SEQ ID NO: 2524903 - protein, 30 aa, Entamoeba dispar
FYMTKDDGFFCFILKSPLIKQPIKVVRKDP

SEQ ID NO: 2524904 - protein, 17 aa, Entamoeba dispar
FYNCLSLTSIIIPSSVQ

SEQ ID NO: 2524905 - protein, 23 aa, Entamoeba dispar
FYNDEFILALNRNDLNMAYHILR

SEQ ID NO: 2524906 - protein, 17 aa, Entamoeba dispar
FYNESYLDYLDSIGLLV

SEQ ID NO: 2524907 - protein, 21 aa, Entamoeba dispar
FYNHANCIIALFDLSNKDSLQ

SEQ ID NO: 2524908 - protein, 17 aa, Entamoeba dispar
FYNLFDWNDDMNTPLHY

SEQ ID NO: 2524909 - protein, 19 aa, Entamoeba dispar
FYQISFSKFPLLSKTLQMF

SEQ ID NO: 2524910 - protein, 19 aa, Entamoeba dispar
FYQIVKKYCKYALHDDRFG

SEQ ID NO: 2524911 - protein, 26 aa, Entamoeba dispar
FYRKSCGIFLVFDLTDETSFKNLTNW

SEQ ID NO: 2524912 - protein, 22 aa, Entamoeba dispar
FYRYGMDIIILALRENNLYVHQ

SEQ ID NO: 2524913 - protein, 17 aa, Entamoeba dispar
FYSFTLIGDIRDFGTED

SEQ ID NO: 2524914 - protein, 24 aa, Entamoeba dispar
FYSQFQYLFISQKYPLLSLSIKQI

SEQ ID NO: 2524915 - protein, 33 aa, Entamoeba dispar
FYTGFPMQRFPQMPIIPPNRQFPPYVIPEQNYQ

SEQ ID NO: 2524916 - protein, 22 aa, Entamoeba dispar
FYTLFCHTVGPFLLYEIEKKQY

SEQ ID NO: 2524917 - protein, 21 aa, Entamoeba dispar
FYTPKPILPAPFQDLKRFTRK

SEQ ID NO: 2524918 - protein, 17 aa, Entamoeba dispar
FYTQDIGIPGTIYPLRY

SEQ ID NO: 2524919 - protein, 17 aa, Entamoeba dispar
FYVPDIIGALILSMSKR

SEQ ID NO: 2524920 - protein, 17 aa, Entamoeba dispar
FYVVYIAIYDEYYLTPN

SEQ ID NO: 2524921 - protein, 19 aa, Entamoeba dispar
FYYAFIEYDRPEDAAKALH

SEQ ID NO: 2524922 - protein, 18 aa, Entamoeba dispar
FYYGAFQILIDILDVTDG

SEQ ID NO: 2524923 - protein, 17 aa, Entamoeba dispar
FYYVGMNVKRDCPVDIS

SEQ ID NO: 2524924 - protein, 21 aa, Entamoeba dispar
GAAFKPLFNQAIQMHLKRYEE

SEQ ID NO: 2524925 - protein, 21 aa, Entamoeba dispar
GAAFLTKTLIVDGDTIKFEIW

SEQ ID NO: 2524926 - protein, 25 aa, Entamoeba dispar
GADGKKFYRFLYDEKYEKNKGFVNF

SEQ ID NO: 2524927 - protein, 34 aa, Entamoeba dispar
GADGKTYGFYPEKSYFYLIKNADTIRLMDQNNTH

SEQ ID NO: 2524928 - protein, 32 aa, Entamoeba dispar
GADGKTYRFYPEKSYCYLIKNADTIRLMDQNN

SEQ ID NO: 2524929 - protein, 24 aa, Entamoeba dispar
GAEAPSEFVFYIPSMKAFCASEEI

SEQ ID NO: 2524930 - protein, 24 aa, Entamoeba dispar
GAEHLLRLIAKLPQICYEIHFDKM

SEQ ID NO: 2524931 - protein, 26 aa, Entamoeba dispar
GAFPVQDICSYYYGTSIYGTKFHSLV

SEQ ID NO: 2524932 - protein, 28 aa, Entamoeba dispar
GAILVVDCTFTTPVFLPALELGADVVLH

SEQ ID NO: 2524933 - protein, 21 aa, Entamoeba dispar
GAITMWTPNMANAVVGLGFHK

SEQ ID NO: 2524934 - protein, 19 aa, Entamoeba dispar
GAKFQIVYKGDGTSFKIVD

SEQ ID NO: 2524935 - protein, 17 aa, Entamoeba dispar
GAKGVLLFGPPGTGKTM

SEQ ID NO: 2524936 - protein, 32 aa, Entamoeba dispar
GAKMIFATEFAYNWYVRKFFFEEGLKDAELST

SEQ ID NO: 2524937 - protein, 21 aa, Entamoeba dispar
GALFFATLKRSFFLQELSITI

SEQ ID NO: 2524938 - protein, 21 aa, Entamoeba dispar
GALIKPWIYTEIKEKRDWDIS

SEQ ID NO: 2524939 - protein, 17 aa, Entamoeba dispar
GALWEHYSKKVKDHMDN

SEQ ID NO: 2524940 - protein, 20 aa, Entamoeba dispar
GAMFNYYLDEHWKPLKHILK

SEQ ID NO: 2524941 - protein, 18 aa, Entamoeba dispar
GAMYYYLRTGMFPLGDSR

SEQ ID NO: 2524942 - protein, 27 aa, Entamoeba dispar
GANALGLTRWRDLYRGYLCCALTDTFT

SEQ ID NO: 2524943 - protein, 25 aa, Entamoeba dispar
GANLLSLNISFNPILTLPTEISSLT

SEQ ID NO: 2524944 - protein, 17 aa, Entamoeba dispar
GAQMLLMDYSQGKNFFL

SEQ ID NO: 2524945 - protein, 23 aa, Entamoeba dispar
GAQYYEQLVKILSALKGKTVQFI

SEQ ID NO: 2524946 - protein, 25 aa, Entamoeba dispar
GAREYANATLLRNLAKGAVEYSKEI

SEQ ID NO: 2524947 - protein, 34 aa, Entamoeba dispar
GARGIPGMQMGGIRMGIPVGFNPASVQLKATGGR

SEQ ID NO: 2524948 - protein, 24 aa, Entamoeba dispar
GASKDLSIKLIGKSPAIVEMSISS

SEQ ID NO: 2524949 - protein, 19 aa, Entamoeba dispar
GASPYQYYDSWDQLTIAVS

SEQ ID NO: 2524950 - protein, 23 aa, Entamoeba dispar
GATDICYIYEWFVEKKQSIPFMS

SEQ ID NO: 2524951 - protein, 17 aa, Entamoeba dispar
GATILQKRLMYSFDLFP

SEQ ID NO: 2524952 - protein, 32 aa, Entamoeba dispar
GAYAKQLIVPLQNTLIWLIQNNKFDDFDNASA

SEQ ID NO: 2524953 - protein, 25 aa, Entamoeba dispar
GAYFGMTFPHLLMLNVSGIKKADKF

SEQ ID NO: 2524954 - protein, 35 aa, Entamoeba dispar
GAYFGPWFIPNFFLEYPELLPHSSYFLKTIPQCIY

SEQ ID NO: 2524955 - protein, 33 aa, Entamoeba dispar
GAYKMLHELSLEWSCLSFDIIPDTLGALRTTAP

SEQ ID NO: 2524956 - protein, 25 aa, Entamoeba dispar
GAYQCDGLKLYPCLVIRGTRLYEMW

SEQ ID NO: 2524957 - protein, 26 aa, Entamoeba dispar
GCALKQNILQFWRKHFTTYENFFEVE

SEQ ID NO: 2524958 - protein, 32 aa, Entamoeba dispar
GCCPTPLIYSDNFPLLYPPKLRKGNNFSETTS

SEQ ID NO: 2524959 - protein, 20 aa, Entamoeba dispar
GCDIYFCYNEWFEKAKCIKS

SEQ ID NO: 2524960 - protein, 25 aa, Entamoeba dispar
GCDLFNLCCAAAMRPIRDYIAKENK

SEQ ID NO: 2524961 - protein, 23 aa, Entamoeba dispar
GCDSLVQMKLPLINNIYPSATND

SEQ ID NO: 2524962 - protein, 29 aa, Entamoeba dispar
GCENIGFRRFILKIKPTLYSFILIKNYET

SEQ ID NO: 2524963 - protein, 26 aa, Entamoeba dispar
GCFNKKQIPKAPKKGYKYIKNDKDFF

SEQ ID NO: 2524964 - protein, 26 aa, Entamoeba dispar
GCGKPIGMSFLEVFGKKWHEGCVKCV

SEQ ID NO: 2524965 - protein, 25 aa, Entamoeba dispar
GCHHVKIMIMLYEGGLRFVLSTANL

SEQ ID NO: 2524966 - protein, 18 aa, Entamoeba dispar
GCHYTRHTGSRYRFDYIT

SEQ ID NO: 2524967 - protein, 27 aa, Entamoeba dispar
GCIAAEFFLGIPLFAGTSEYNLLFKMI

SEQ ID NO: 2524968 - protein, 23 aa, Entamoeba dispar
GCIAAELILGIPIFPGSSEYNQL

SEQ ID NO: 2524969 - protein, 25 aa, Entamoeba dispar
GCILVKIHFYQRIQIIIISSIVIFK

SEQ ID NO: 2524970 - protein, 21 aa, Entamoeba dispar
GCISLPFRLILPPISLRKVLL

SEQ ID NO: 2524971 - protein, 22 aa, Entamoeba dispar
GCISLSIINIPISFTQLGDGCF

SEQ ID NO: 2524972 - protein, 23 aa, Entamoeba dispar
GCKHFSMIWDVAGGGAFAVIPYT

SEQ ID NO: 2524973 - protein, 20 aa, Entamoeba dispar
GCKHLLGTYALFQHLEQRTN

SEQ ID NO: 2524974 - protein, 37 aa, Entamoeba dispar
GCLAKFALVQPIRRIPKLIWICYQQCLKKIIIPNSLN

SEQ ID NO: 2524975 - protein, 19 aa, Entamoeba dispar
GCLGTLSSFKRVFAIPIQK

SEQ ID NO: 2524976 - protein, 26 aa, Entamoeba dispar
GCLKDTIMFVYIKVQIEGETAIVART

SEQ ID NO: 2524977 - protein, 22 aa, Entamoeba dispar
GCLKGIPLRNLCLLGNPLPEVD

SEQ ID NO: 2524978 - protein, 18 aa, Entamoeba dispar
GCLMCGCEILPPSTYYIC

SEQ ID NO: 2524979 - protein, 22 aa, Entamoeba dispar
GCMVATMFFVKEPLFKGSNNKD

SEQ ID NO: 2524980 - protein, 18 aa, Entamoeba dispar
GCNFIRCDLKKGGCGCGF

SEQ ID NO: 2524981 - protein, 20 aa, Entamoeba dispar
GCNVLLIQKSILREGVSDLA

SEQ ID NO: 2524982 - protein, 25 aa, Entamoeba dispar
GCPIFMIHFPSKMKAFYMSKVPGHP

SEQ ID NO: 2524983 - protein, 33 aa, Entamoeba dispar
GCRICGTNCIKLLQIVYGATFKKLAAEQEKMRD

SEQ ID NO: 2524984 - protein, 19 aa, Entamoeba dispar
GCRITIFQSIPILNTFKLK

SEQ ID NO: 2524985 - protein, 22 aa, Entamoeba dispar
GCRLPIIPEEITRLALTGLDVS

SEQ ID NO: 2524986 - protein, 25 aa, Entamoeba dispar
GCSQNNQFIFILSNLENLIEKLNND

SEQ ID NO: 2524987 - protein, 20 aa, Entamoeba dispar
GCTILKGVDNMTICPGAKVL

SEQ ID NO: 2524988 - protein, 24 aa, Entamoeba dispar
GCTNGDIIFYKWVRDMFGYKRNPE

SEQ ID NO: 2524989 - protein, 21 aa, Entamoeba dispar
GDALINAPISVPPKMSIGDSN

SEQ ID NO: 2524990 - protein, 27 aa, Entamoeba dispar
GDASIETFFLIGLLAQHASIKFSILHP

SEQ ID NO: 2524991 - protein, 28 aa, Entamoeba dispar
GDCFQYIEYLKLLPFNIALNSYNKSEKT

SEQ ID NO: 2524992 - protein, 18 aa, Entamoeba dispar
GDCLSMVFMFASYRVSKG

SEQ ID NO: 2524993 - protein, 22 aa, Entamoeba dispar
GDDHLIALPIKRYESYLKKHTK

SEQ ID NO: 2524994 - protein, 32 aa, Entamoeba dispar
GDDIPIISDLLRYFFHFVKSTCPYIVEYNSNL

SEQ ID NO: 2524995 - protein, 25 aa, Entamoeba dispar
GDDLHCTINITLLQALTGCEIEIPH

SEQ ID NO: 2524996 - protein, 28 aa, Entamoeba dispar
GDDLKKFIIVQLGIESWLVRSMFVFKKM

SEQ ID NO: 2524997 - protein, 28 aa, Entamoeba dispar
GDDNALYDILRFWGIYSLYSSIDPSSTD

SEQ ID NO: 2524998 - protein, 24 aa, Entamoeba dispar
GDDPARIFQMAPIVIGDETEFIGD

SEQ ID NO: 2524999 - protein, 21 aa, Entamoeba dispar
GDDSIFQECLPICLHDYNTEQ

SEQ ID NO: 2525000 - protein, 30 aa, Entamoeba dispar
GDDVSPFGMLIIFKTSFRSSFCASLSNVYE

SEQ ID NO: 2525001 - protein, 23 aa, Entamoeba dispar
GDEHYNLISAFQKSIRGSDEDAS

SEQ ID NO: 2525002 - protein, 28 aa, Entamoeba dispar
GDEKKSIFGIFDGYGGIGAARETRRTLP

SEQ ID NO: 2525003 - protein, 29 aa, Entamoeba dispar
GDEKNELTMKIKYMELQMSAPQKEIEEKL

SEQ ID NO: 2525004 - protein, 22 aa, Entamoeba dispar
GDESLDLKLFYPQKSNIKKGEV

SEQ ID NO: 2525005 - protein, 17 aa, Entamoeba dispar
GDFACRYPNLLEGWIKY

SEQ ID NO: 2525006 - protein, 21 aa, Entamoeba dispar
GDFKGVLLSVIRKNDRKLLSC

SEQ ID NO: 2525007 - protein, 22 aa, Entamoeba dispar
GDFTKIFQPTFSYTIRSSDEFA

SEQ ID NO: 2525008 - protein, 31 aa, Entamoeba dispar
GDIDERALAIYASLFHHAFKTFKELQAMKNE

SEQ ID NO: 2525009 - protein, 24 aa, Entamoeba dispar
GDIELVIAFFKKFTEDGSQMFVHF

SEQ ID NO: 2525010 - protein, 20 aa, Entamoeba dispar
GDIFILLYCSDLKEQFDRVI

SEQ ID NO: 2525011 - protein, 24 aa, Entamoeba dispar
GDIHGQFYDMLNFMDLLGSPEDNK

SEQ ID NO: 2525012 - protein, 28 aa, Entamoeba dispar
GDIILKLMRVDLFYLIIAELLTKQFSPS

SEQ ID NO: 2525013 - protein, 17 aa, Entamoeba dispar
GDIKGIVLASRDLYCIY

SEQ ID NO: 2525014 - protein, 21 aa, Entamoeba dispar
GDIVFVVKTIRHPLFTRDGDN

SEQ ID NO: 2525015 - protein, 34 aa, Entamoeba dispar
GDIVLEKYFPVYLLIRQYLLISQKPTVLSKMGIY

SEQ ID NO: 2525016 - protein, 17 aa, Entamoeba dispar
GDKFRILSLDGGGIKCI

SEQ ID NO: 2525017 - protein, 24 aa, Entamoeba dispar
GDKKIIRIIFEKMRKYKSGILEMK

SEQ ID NO: 2525018 - protein, 28 aa, Entamoeba dispar
GDKQFHPPLSCLPSIDIISLSTIKSILV

SEQ ID NO: 2525019 - protein, 23 aa, Entamoeba dispar
GDKSILLDEIYKKHYAGVDKAHD

SEQ ID NO: 2525020 - protein, 17 aa, Entamoeba dispar
GDLEIFRKSLDLSREPN

SEQ ID NO: 2525021 - protein, 27 aa, Entamoeba dispar
GDLFETYIRPYFSDVFRPVKKGDHFLC

SEQ ID NO: 2525022 - protein, 17 aa, Entamoeba dispar
GDLIKYFNYTDGILEAN

SEQ ID NO: 2525023 - protein, 20 aa, Entamoeba dispar
GDLIKYFNYTDGILEANSGV

SEQ ID NO: 2525024 - protein, 19 aa, Entamoeba dispar
GDLKILFEVICHDFIRNKE

SEQ ID NO: 2525025 - protein, 20 aa, Entamoeba dispar
GDLLTILNEEKIRFDKWAER

SEQ ID NO: 2525026 - protein, 21 aa, Entamoeba dispar
GDLSPLCNFSLSLDPSKSPLK

SEQ ID NO: 2525027 - protein, 24 aa, Entamoeba dispar
GDMTIEAAFTKLTWLLAQGMTPDE

SEQ ID NO: 2525028 - protein, 36 aa, Entamoeba dispar
GDNLHCTITINLLQSLTGFKLTIPFLDGSEVSKKIE

SEQ ID NO: 2525029 - protein, 24 aa, Entamoeba dispar
GDNQTQFIFQRMKNLFLEEIRSFS

SEQ ID NO: 2525030 - protein, 17 aa, Entamoeba dispar
GDPLRCKFVADTYLTDV

SEQ ID NO: 2525031 - protein, 21 aa, Entamoeba dispar
GDQFYLYEPMLAYHCYEFGSQ

SEQ ID NO: 2525032 - protein, 26 aa, Entamoeba dispar
GDRCFEWCLSLSKIHLPMTLKKLGIG

SEQ ID NO: 2525033 - protein, 30 aa, Entamoeba dispar
GDRKGILSFMYQILNKYRLGNCPVKMVHFA

SEQ ID NO: 2525034 - protein, 17 aa, Entamoeba dispar
GDRYRMGNLFIVGPTKT

SEQ ID NO: 2525035 - protein, 23 aa, Entamoeba dispar
GDSFYYDALYLVADFAALLCSSQ

SEQ ID NO: 2525036 - protein, 36 aa, Entamoeba dispar
GDSIKKIKLRFTVRYDLLLTIFCDKLEKREDVKILK

SEQ ID NO: 2525037 - protein, 25 aa, Entamoeba dispar
GDSVKLQYFLRIQINTKYPPRPYFE

SEQ ID NO: 2525038 - protein, 20 aa, Entamoeba dispar
GDTFTNEKLLLLVRDFVEVL

SEQ ID NO: 2525039 - protein, 25 aa, Entamoeba dispar
GDTFVPIVIYTLLKANLPHLSSTVK

SEQ ID NO: 2525040 - protein, 44 aa, Entamoeba dispar
GDTIIPVIVYLLLHSSIPNINLLICFIDLFTPPSLIKGKLSYTT

SEQ ID NO: 2525041 - protein, 27 aa, Entamoeba dispar
GDTLTYTLLSWIIKGIPLEHAVNRAIT

SEQ ID NO: 2525042 - protein, 19 aa, Entamoeba dispar
GDVINAFLTCGYVGASSLI

SEQ ID NO: 2525043 - protein, 21 aa, Entamoeba dispar
GDYCTLIYKWLNYSKKSTKVF

SEQ ID NO: 2525044 - protein, 26 aa, Entamoeba dispar
GDYGVELFLLLCSLKVVFPNQFIILR

SEQ ID NO: 2525045 - protein, 34 aa, Entamoeba dispar
GDYSLSSFRLCEDGLFLVQPFIKKRRVKLSLESF

SEQ ID NO: 2525046 - protein, 21 aa, Entamoeba dispar
GDYYYFFIPIEWNWKTKLYEK

SEQ ID NO: 2525047 - protein, 24 aa, Entamoeba dispar
GEALPQMYIILAHLNPIIHCSRYV

SEQ ID NO: 2525048 - protein, 24 aa, Entamoeba dispar
GECCFYGCYLLKSINIPSSITSFG

SEQ ID NO: 2525049 - protein, 21 aa, Entamoeba dispar
GECIEFPMYFVDSLPDEGSDN

SEQ ID NO: 2525050 - protein, 22 aa, Entamoeba dispar
GEDCFYLCPSLTSINIPSSITS

SEQ ID NO: 2525051 - protein, 24 aa, Entamoeba dispar
GEDPMVAYRRRQAERQAEREKARK

SEQ ID NO: 2525052 - protein, 24 aa, Entamoeba dispar
GEEDEIQCLIFEKGIFAVGGREGK

SEQ ID NO: 2525053 - protein, 27 aa, Entamoeba dispar
GEEFKAFDRVYTPKLRYAGLLEYDSDN

SEQ ID NO: 2525054 - protein, 27 aa, Entamoeba dispar
GEEGVNIKIIIYSSPIFMDIVKGEEKR

SEQ ID NO: 2525055 - protein, 30 aa, Entamoeba dispar
GEELMKKYFGILFIKLPQEFIEFLEERDTS

SEQ ID NO: 2525056 - protein, 25 aa, Entamoeba dispar
GEEPHAFMQLFEDKYLIHIGNYFDR

SEQ ID NO: 2525057 - protein, 23 aa, Entamoeba dispar
GEEPKIIRIVLTGGPGGGKTTSL

SEQ ID NO: 2525058 - protein, 17 aa, Entamoeba dispar
GEEYIEPPPWRPTRRME

SEQ ID NO: 2525059 - protein, 25 aa, Entamoeba dispar
GEFEKKIFELILSKQTIKSAQEIIN

SEQ ID NO: 2525060 - protein, 23 aa, Entamoeba dispar
GEFRKLIPNLLNNLKLLVHSSFI

SEQ ID NO: 2525061 - protein, 24 aa, Entamoeba dispar
GEHPSRILCVFNILSQYDPKELLC

SEQ ID NO: 2525062 - protein, 24 aa, Entamoeba dispar
GEHQCKYIFAIKKLIYNEVAKGMC

SEQ ID NO: 2525063 - protein, 34 aa, Entamoeba dispar
GEIEFENLPATWVAFFKKAGIKKKDLSDKETRDK

SEQ ID NO: 2525064 - protein, 25 aa, Entamoeba dispar
GEIHIQIIYGLTVGAPVHGCPPPMR

SEQ ID NO: 2525065 - protein, 19 aa, Entamoeba dispar
GEIIVYIQYSGKCVGCAAA

SEQ ID NO: 2525066 - protein, 24 aa, Entamoeba dispar
GEIKHKIAFWKLPVVACEYINNHL

SEQ ID NO: 2525067 - protein, 20 aa, Entamoeba dispar
GEINLGYKIKLAIYKKENEK

SEQ ID NO: 2525068 - protein, 23 aa, Entamoeba dispar
GEIPDIRFPLPSLQILDLSSNGL

SEQ ID NO: 2525069 - protein, 25 aa, Entamoeba dispar
GEIPKFPITLNPYESFTIAFPIHLK

SEQ ID NO: 2525070 - protein, 17 aa, Entamoeba dispar
GEIPLTILPFSDNVEIT

SEQ ID NO: 2525071 - protein, 23 aa, Entamoeba dispar
GEIPWPSIIKKIYDQRTVIVQVF

SEQ ID NO: 2525072 - protein, 26 aa, Entamoeba dispar
GEKESTVVCLRWLMGAEFIVESCKPL

SEQ ID NO: 2525073 - protein, 21 aa, Entamoeba dispar
GEKIKFELIFKETLGIKDTLL

SEQ ID NO: 2525074 - protein, 25 aa, Entamoeba dispar
GEKKKWLIWKEYIDTMLKLNRVDII

SEQ ID NO: 2525075 - protein, 24 aa, Entamoeba dispar
GELIQIRNNIYTRIYFTHKHFRRE

SEQ ID NO: 2525076 - protein, 25 aa, Entamoeba dispar
GELRQHMAALYFANPEEIKLSEKKY

SEQ ID NO: 2525077 - protein, 19 aa, Entamoeba dispar
GELRRVVLPLFSKGGKGII

SEQ ID NO: 2525078 - protein, 27 aa, Entamoeba dispar
GELSLIPTTGMILSPCLHMLPSMHYGL

SEQ ID NO: 2525079 - protein, 27 aa, Entamoeba dispar
GELTGELYYLGIIDILMDYTARKKLET

SEQ ID NO: 2525080 - protein, 25 aa, Entamoeba dispar
GELVETYYILIIKLMTKCTNEPIQQ

SEQ ID NO: 2525081 - protein, 29 aa, Entamoeba dispar
GEMLPQTVILCELLMILSGARYVGTDRPN

SEQ ID NO: 2525082 - protein, 21 aa, Entamoeba dispar
GEMSPFNGLDWIETPVNTIIL

SEQ ID NO: 2525083 - protein, 19 aa, Entamoeba dispar
GENDFYSNNKFFPVVDFGK

SEQ ID NO: 2525084 - protein, 26 aa, Entamoeba dispar
GENQILRKTVFDLTKYLTNLKVVSPD

SEQ ID NO: 2525085 - protein, 23 aa, Entamoeba dispar
GENSVVFPPFRCSKGRFITIGNN

SEQ ID NO: 2525086 - protein, 24 aa, Entamoeba dispar
GENWQNIPIHWYFGSQRRYTDCIP

SEQ ID NO: 2525087 - protein, 25 aa, Entamoeba dispar
GEPLHAHTFPIFQTSTYLFDDTQMG

SEQ ID NO: 2525088 - protein, 18 aa, Entamoeba dispar
GEPYRRLVITPEDYPYHN

SEQ ID NO: 2525089 - protein, 27 aa, Entamoeba dispar
GEQLKTLRIVLQQLFPPIQASVAKIKK

SEQ ID NO: 2525090 - protein, 27 aa, Entamoeba dispar
GERIVQPPWFVCVICRRQFKDKDELQK

SEQ ID NO: 2525091 - protein, 25 aa, Entamoeba dispar
GERNYHIFYQLLAGAPENYYNDFYL

SEQ ID NO: 2525092 - protein, 31 aa, Entamoeba dispar
GERSVATMLYLLSLQEQTFCPFRLVDEINQG

SEQ ID NO: 2525093 - protein, 20 aa, Entamoeba dispar
GERVLHIHSMILKTTPSREA

SEQ ID NO: 2525094 - protein, 35 aa, Entamoeba dispar
GESWVHFYDGYLTLNQIFFDKWRFYELKDLSELKR

SEQ ID NO: 2525095 - protein, 18 aa, Entamoeba dispar
GETFINGKLSKLVKKNDC

SEQ ID NO: 2525096 - protein, 25 aa, Entamoeba dispar
GETPQTLHLLAFDSLVDSAKPGDRI

SEQ ID NO: 2525097 - protein, 35 aa, Entamoeba dispar
GETTSHIIGTFYRTIKLIESGIKPVYVFDGKPPEM

SEQ ID NO: 2525098 - protein, 26 aa, Entamoeba dispar
GETVQEYWECTLKALKFGENQGPQII

SEQ ID NO: 2525099 - protein, 29 aa, Entamoeba dispar
GETVQPLRSYLILPIQRIPRYNLLLSDFL

SEQ ID NO: 2525100 - protein, 32 aa, Entamoeba dispar
GETYCGIKIYRLYFKCTRCKTLFTIKTDPKNS

SEQ ID NO: 2525101 - protein, 27 aa, Entamoeba dispar
GEVFPDLDMLPLFLTKKKILSRVQVIN

SEQ ID NO: 2525102 - protein, 19 aa, Entamoeba dispar
GEVKLIYKITVNRSGLVEV

SEQ ID NO: 2525103 - protein, 26 aa, Entamoeba dispar
GEVNKQFICKDYLHTFEILNMYKGDI

SEQ ID NO: 2525104 - protein, 26 aa, Entamoeba dispar
GEVTLFLNGHFFLGSNQIKILGNQIN

SEQ ID NO: 2525105 - protein, 26 aa, Entamoeba dispar
GEWHIQAVCAITVWLKERNYNFWMDE

SEQ ID NO: 2525106 - protein, 28 aa, Entamoeba dispar
GEYCFRDCVLLKLISILSSISKIGYGCF

SEQ ID NO: 2525107 - protein, 19 aa, Entamoeba dispar
GEYGLIHKGIYQTASTIYI

SEQ ID NO: 2525108 - protein, 34 aa, Entamoeba dispar
GEYPIINIKNYENYLLILSPLRVLLITLEGKIIE

SEQ ID NO: 2525109 - protein, 26 aa, Entamoeba dispar
GFAKQFLQFTMFLKSYTTYVNHQSQV

SEQ ID NO: 2525110 - protein, 22 aa, Entamoeba dispar
GFCAFVINTFYYNDIKPILNDL

SEQ ID NO: 2525111 - protein, 19 aa, Entamoeba dispar
GFCEYYFKAKYSDSCFPPF

SEQ ID NO: 2525112 - protein, 26 aa, Entamoeba dispar
GFDAIQNILLINKILQQLFQQQSPFP

SEQ ID NO: 2525113 - protein, 18 aa, Entamoeba dispar
GFDLLNLFIYRKPSLVTT

SEQ ID NO: 2525114 - protein, 18 aa, Entamoeba dispar
GFEDFMLKKLINAERMTM

SEQ ID NO: 2525115 - protein, 20 aa, Entamoeba dispar
GFEIIFDKGLDKKIALEFYD

SEQ ID NO: 2525116 - protein, 19 aa, Entamoeba dispar
GFEMCRVTGIPLSYLLPRG

SEQ ID NO: 2525117 - protein, 18 aa, Entamoeba dispar
GFEPIPVRFILSKENPYN

SEQ ID NO: 2525118 - protein, 19 aa, Entamoeba dispar
GFEVIEPHRILLSEETIIQ

SEQ ID NO: 2525119 - protein, 20 aa, Entamoeba dispar
GFEYHSVLEIPISPPAPIVF

SEQ ID NO: 2525120 - protein, 17 aa, Entamoeba dispar
GFEYKIELKPEKEIFIV

SEQ ID NO: 2525121 - protein, 19 aa, Entamoeba dispar
GFFDSLVDFLTLPTNLNLN

SEQ ID NO: 2525122 - protein, 18 aa, Entamoeba dispar
GFFGLSFKKKNKRKLMRS

SEQ ID NO: 2525123 - protein, 18 aa, Entamoeba dispar
GFFKIQVDIIIAVFIKLS

SEQ ID NO: 2525124 - protein, 17 aa, Entamoeba dispar
GFFLIPEKGSWNYSLST

SEQ ID NO: 2525125 - protein, 27 aa, Entamoeba dispar
GFFNFYLSDKYIIFKELLKLYQIYVKN

SEQ ID NO: 2525126 - protein, 20 aa, Entamoeba dispar
GFFTAVFIKKGETLAPPPKQ

SEQ ID NO: 2525127 - protein, 19 aa, Entamoeba dispar
GFHCVYSGMVLSYYLPIHC

SEQ ID NO: 2525128 - protein, 33 aa, Entamoeba dispar
GFHCVYSGMVLSYYLPIHCGIKKIYIEVESVNG

SEQ ID NO: 2525129 - protein, 18 aa, Entamoeba dispar
GFHFPMRTNEVVLSTQLK

SEQ ID NO: 2525130 - protein, 29 aa, Entamoeba dispar
GFHSNPVIVLDFLSMYPTTAIAYNICYST

SEQ ID NO: 2525131 - protein, 27 aa, Entamoeba dispar
GFHVCVTKWLTLVQLLMGEIPRRNVFL

SEQ ID NO: 2525132 - protein, 21 aa, Entamoeba dispar
GFIASRFLTGVPPQEFFFHCM

SEQ ID NO: 2525133 - protein, 21 aa, Entamoeba dispar
GFIHNNAFTGCLFLQTITLPN

SEQ ID NO: 2525134 - protein, 19 aa, Entamoeba dispar
GFINVFKYDVSDDRDIIFK

SEQ ID NO: 2525135 - protein, 27 aa, Entamoeba dispar
GFIPTIELFNQKIGMISIGQLLKIRII

SEQ ID NO: 2525136 - protein, 19 aa, Entamoeba dispar
GFISFFRYDCQENKISQFN

SEQ ID NO: 2525137 - protein, 25 aa, Entamoeba dispar
GFISSIGLDLLIYFAAKSSKENVKK

SEQ ID NO: 2525138 - protein, 26 aa, Entamoeba dispar
GFISSIGLDLLIYFAAKSSKENVKKF

SEQ ID NO: 2525139 - protein, 32 aa, Entamoeba dispar
GFKEGQPLVYRLIWICFVERKLRLVRHRKIKE

SEQ ID NO: 2525140 - protein, 19 aa, Entamoeba dispar
GFKLHYFLQNTDIPPCITV

SEQ ID NO: 2525141 - protein, 19 aa, Entamoeba dispar
GFKMYDISSFITRFRDLYS

SEQ ID NO: 2525142 - protein, 22 aa, Entamoeba dispar
GFKNNPLLDRLWNNVFSRQNNG

SEQ ID NO: 2525143 - protein, 31 aa, Entamoeba dispar
GFLDDEVLTMYLVYYVLKDKNIRDDEEIKFL

SEQ ID NO: 2525144 - protein, 21 aa, Entamoeba dispar
GFLGVHLIQALQKKGYHVLCL

SEQ ID NO: 2525145 - protein, 25 aa, Entamoeba dispar
GFLHQKIETLQLDNYDSRLTLMEIE

SEQ ID NO: 2525146 - protein, 19 aa, Entamoeba dispar
GFLKTKHEFLIKLFTKEVK

SEQ ID NO: 2525147 - protein, 24 aa, Entamoeba dispar
GFLKTKHEFLIKLFTKEVKLNQLI

SEQ ID NO: 2525148 - protein, 19 aa, Entamoeba dispar
GFLQCLHRLLSTRIGYESF

SEQ ID NO: 2525149 - protein, 25 aa, Entamoeba dispar
GFNKLYHCIVALGYLHIVKFLVSTF

SEQ ID NO: 2525150 - protein, 26 aa, Entamoeba dispar
GFQLERIIHIFYKNKFIMGKEDLTIR

SEQ ID NO: 2525151 - protein, 24 aa, Entamoeba dispar
GFSGIYGCCECPITPDIYTAVFFG

SEQ ID NO: 2525152 - protein, 29 aa, Entamoeba dispar
GFSIRTIRKFLFQLLRALRTLSHANIVHC

SEQ ID NO: 2525153 - protein, 26 aa, Entamoeba dispar
GFTSDFHLALFVLRLLLSKKNELKDV

SEQ ID NO: 2525154 - protein, 38 aa, Entamoeba dispar
GFVMDDSQHFIFTLKNPLSIPPTKFVKKSIFGPSVGIN

SEQ ID NO: 2525155 - protein, 26 aa, Entamoeba dispar
GFYCSNANYLYKLLNKLDPIISLVNP

SEQ ID NO: 2525156 - protein, 26 aa, Entamoeba dispar
GFYYSKTYVFTLFFDEKPQMCLIDEI

SEQ ID NO: 2525157 - protein, 18 aa, Entamoeba dispar
GGCKTCDMAEFIIHAVNP

SEQ ID NO: 2525158 - protein, 33 aa, Entamoeba dispar
GGDGRYLNLKALDIIIRVALSRGFTDIVVGKSG

SEQ ID NO: 2525159 - protein, 30 aa, Entamoeba dispar
GGEDYYMLRPLIYPNTDVFLLCYSIDNPRS

SEQ ID NO: 2525160 - protein, 31 aa, Entamoeba dispar
GGEELIGIRRWLLVDSLLRAKSRIQEEIHYV

SEQ ID NO: 2525161 - protein, 37 aa, Entamoeba dispar
GGEKLDIIIPSYHIFFVEVLPIPPSRFRQLNKFGELI

SEQ ID NO: 2525162 - protein, 40 aa, Entamoeba dispar
GGEKTIAALALLFAVQSYYPSPFFILDEIDAALDVQNILQ

SEQ ID NO: 2525163 - protein, 33 aa, Entamoeba dispar
GGEKTLSSLALIFALHHYKPTPIYVMDEIDAAL

SEQ ID NO: 2525164 - protein, 29 aa, Entamoeba dispar
GGERSFSTVCLLLSLWNVVDCPFRAMDEF

SEQ ID NO: 2525165 - protein, 30 aa, Entamoeba dispar
GGERSYSTVCLLLALWNVVDCPFRAMDEFD

SEQ ID NO: 2525166 - protein, 26 aa, Entamoeba dispar
GGESALRLWYCFYSLLSDINEHPKDD

SEQ ID NO: 2525167 - protein, 25 aa, Entamoeba dispar
GGFGWCDGLLLRAMKSGSWVLLDEL

SEQ ID NO: 2525168 - protein, 25 aa, Entamoeba dispar
GGFIDEVLIYAFRNGIKLNGKNAND

SEQ ID NO: 2525169 - protein, 25 aa, Entamoeba dispar
GGIGSIYNYIWPSFTLGCGSYGGNS

SEQ ID NO: 2525170 - protein, 17 aa, Entamoeba dispar
GGIIFDNYHIFKFKSIH

SEQ ID NO: 2525171 - protein, 23 aa, Entamoeba dispar
GGIKCIYQCAILQRILDKFPNFF

SEQ ID NO: 2525172 - protein, 23 aa, Entamoeba dispar
GGIQAIIIVLDFNNDILSHDLET

SEQ ID NO: 2525173 - protein, 19 aa, Entamoeba dispar
GGKCLIPVFSLGRAQEFEL

SEQ ID NO: 2525174 - protein, 24 aa, Entamoeba dispar
GGKHSFITLRELFKWADRHANSYE

SEQ ID NO: 2525175 - protein, 17 aa, Entamoeba dispar
GGKIEGFLPLTGTAFVA

SEQ ID NO: 2525176 - protein, 22 aa, Entamoeba dispar
GGKSLFITFKLILSQTSFAKSI

SEQ ID NO: 2525177 - protein, 35 aa, Entamoeba dispar
GGKSTYLRMIGLCVIMAQIGMFIPCSEADISICDK

SEQ ID NO: 2525178 - protein, 32 aa, Entamoeba dispar
GGKSTYLRMIGLCVIMAQIGMFIPCSEVDISI

SEQ ID NO: 2525179 - protein, 24 aa, Entamoeba dispar
GGKVFYFHGWRVEGLLGVSRSIGD

SEQ ID NO: 2525180 - protein, 17 aa, Entamoeba dispar
GGLIAYGSTFFVFSDYC

SEQ ID NO: 2525181 - protein, 19 aa, Entamoeba dispar
GGLIKLDVVLFGEELEKEK

SEQ ID NO: 2525182 - protein, 17 aa, Entamoeba dispar
GGLIYCIGVLPKPIKCK

SEQ ID NO: 2525183 - protein, 17 aa, Entamoeba dispar
GGLYFKLKEKHPEFDDE

SEQ ID NO: 2525184 - protein, 18 aa, Entamoeba dispar
GGNAVIIATLKRLIEDSN

SEQ ID NO: 2525185 - protein, 23 aa, Entamoeba dispar
GGNNMTCDDLEWALSRVGAVETT

SEQ ID NO: 2525186 - protein, 25 aa, Entamoeba dispar
GGNQTRLLMLTNKTPGKFMDSRGYA

SEQ ID NO: 2525187 - protein, 26 aa, Entamoeba dispar
GGNVIDLYEYLYYGGILSFDLSEGGP

SEQ ID NO: 2525188 - protein, 35 aa, Entamoeba dispar
GGPQCAVSQFWSYRWNFLLMASEGYIVIAPNRRGL

SEQ ID NO: 2525189 - protein, 23 aa, Entamoeba dispar
GGQKQFMDMYLGAQKSQTFKKVE

SEQ ID NO: 2525190 - protein, 28 aa, Entamoeba dispar
GGQKQRIAIARALIRKPSILLLDEATSA

SEQ ID NO: 2525191 - protein, 23 aa, Entamoeba dispar
GGRLKYSLRIFDSIEIPIETMIE

SEQ ID NO: 2525192 - protein, 25 aa, Entamoeba dispar
GGSCSIPIVRRLICGMFSKDKVVGT

SEQ ID NO: 2525193 - protein, 24 aa, Entamoeba dispar
GGSLNRFIELLTSPGLINNDFNRV

SEQ ID NO: 2525194 - protein, 23 aa, Entamoeba dispar
GGSNILLKYIISLQPQLCCFGHC

SEQ ID NO: 2525195 - protein, 28 aa, Entamoeba dispar
GGSSIEYLGKRYCLACYKKVSASICEKC

SEQ ID NO: 2525196 - protein, 28 aa, Entamoeba dispar
GGTDIAFHPFLPWIYSTGADGTIQWYSD

SEQ ID NO: 2525197 - protein, 30 aa, Entamoeba dispar
GGVKCIYQCILLKRIIKEIPDFFDKIDLIT

SEQ ID NO: 2525198 - protein, 27 aa, Entamoeba dispar
GGYYQMLKYMGIIWNLLETNKKCDIST

SEQ ID NO: 2525199 - protein, 40 aa, Entamoeba dispar
GHALNLRSYLITPVQRLPRYKLLLEDLIRNTPEGHCDLAR

SEQ ID NO: 2525200 - protein, 34 aa, Entamoeba dispar
GHEEQILHLKFDIGLLLRLILCLSRSLNYDGDKR

SEQ ID NO: 2525201 - protein, 26 aa, Entamoeba dispar
GHELKYRKMPLPSQYLRIGFERDETT

SEQ ID NO: 2525202 - protein, 17 aa, Entamoeba dispar
GHENVLFGILYSMVMRG

SEQ ID NO: 2525203 - protein, 30 aa, Entamoeba dispar
GHFELEEPLYQPLLLPELVKLLRSICMKCH

SEQ ID NO: 2525204 - protein, 18 aa, Entamoeba dispar
GHFFSKEAFLIQYTFYPE

SEQ ID NO: 2525205 - protein, 21 aa, Entamoeba dispar
GHGFLIVYSVTDRNSFESIKN

SEQ ID NO: 2525206 - protein, 22 aa, Entamoeba dispar
GHGPFSHLYERLMKTRNIHFNH

SEQ ID NO: 2525207 - protein, 25 aa, Entamoeba dispar
GHGSTLLYVINHLLGYNISMEDLKE

SEQ ID NO: 2525208 - protein, 25 aa, Entamoeba dispar
GHISKAFIVYDRLRKLQIFEQNEYK

SEQ ID NO: 2525209 - protein, 25 aa, Entamoeba dispar
GHKIPYQIFFKDVVNQRLPIFSNLT

SEQ ID NO: 2525210 - protein, 25 aa, Entamoeba dispar
GHLFCKACLAIVFTSSDKTPLCPIC

SEQ ID NO: 2525211 - protein, 21 aa, Entamoeba dispar
GHLIWCIVFEKLTNSQFRVTY

SEQ ID NO: 2525212 - protein, 34 aa, Entamoeba dispar
GHLNIYEFIAIYRYLEICYALFNAYNGSGSEIIK

SEQ ID NO: 2525213 - protein, 19 aa, Entamoeba dispar
GHNEIMITSKYFNDIKDFI

SEQ ID NO: 2525214 - protein, 25 aa, Entamoeba dispar
GHPFAKLVLEYRKISKLLSGVIEQI

SEQ ID NO: 2525215 - protein, 19 aa, Entamoeba dispar
GHPSILSNVLWSLGIIIQR

SEQ ID NO: 2525216 - protein, 24 aa, Entamoeba dispar
GHQRITVSGWFYLKNVYLENDSRF

SEQ ID NO: 2525217 - protein, 23 aa, Entamoeba dispar
GHRLTVFINKKDSFNGGDSFGDA

SEQ ID NO: 2525218 - protein, 30 aa, Entamoeba dispar
GHSLGGVYFRLAIPILFNRNIFNNPNYIPF

SEQ ID NO: 2525219 - protein, 33 aa, Entamoeba dispar
GHTNYLTRLNLPILDVFWLSQYPAVLVSTGEVL

SEQ ID NO: 2525220 - protein, 22 aa, Entamoeba dispar
GHVYLNCHYHFVFNLLNSYNCS

SEQ ID NO: 2525221 - protein, 33 aa, Entamoeba dispar
GHYDPCGRLVMWDCQLYLPFSIEDKLKPIDYFP

SEQ ID NO: 2525222 - protein, 27 aa, Entamoeba dispar
GHYENEYMYFDIYIRKLNESWNNAITN

SEQ ID NO: 2525223 - protein, 26 aa, Entamoeba dispar
GIAINSLKINPWFTSKRDINQFCKTF

SEQ ID NO: 2525224 - protein, 28 aa, Entamoeba dispar
GIALQRQMMFLTRFFKTLVDLPSNISDV

SEQ ID NO: 2525225 - protein, 23 aa, Entamoeba dispar
GICLYFDCTFLKKSYLTTKPDTN

SEQ ID NO: 2525226 - protein, 21 aa, Entamoeba dispar
GICWECWKIYFPDEKWPDLEH

SEQ ID NO: 2525227 - protein, 35 aa, Entamoeba dispar
GIDDNHFIFTYNYEIHKLVLWKMKRETETLELFKE

SEQ ID NO: 2525228 - protein, 25 aa, Entamoeba dispar
GIDDPSFFMFVTNKKDLYCFIKKSV

SEQ ID NO: 2525229 - protein, 23 aa, Entamoeba dispar
GIDDYQFLPFIFGSAQLINHPYL

SEQ ID NO: 2525230 - protein, 28 aa, Entamoeba dispar
GIDKMCRYFMYINNYLIIETSELNWMLV

SEQ ID NO: 2525231 - protein, 21 aa, Entamoeba dispar
GIDLSFCSCFYDDKILFLGDK

SEQ ID NO: 2525232 - protein, 24 aa, Entamoeba dispar
GIDNLCIVVAPTFFWKKGEIQRQN

SEQ ID NO: 2525233 - protein, 32 aa, Entamoeba dispar
GIEAALRFMNPPFTAVLMLIKVMQYTPEKRPT

SEQ ID NO: 2525234 - protein, 26 aa, Entamoeba dispar
GIEEGELYTLLPSGSLLKDSDFGLYE

SEQ ID NO: 2525235 - protein, 23 aa, Entamoeba dispar
GIEGFPTLKLYDGASLISEYEKD

SEQ ID NO: 2525236 - protein, 24 aa, Entamoeba dispar
GIEHKLCFGPYKTGIKNSGNTCYA

SEQ ID NO: 2525237 - protein, 24 aa, Entamoeba dispar
GIENLFAPFVNVLIRLIEIATSAS

SEQ ID NO: 2525238 - protein, 27 aa, Entamoeba dispar
GIEYSGCCGLLCIIEIKEKKRIIHMAN

SEQ ID NO: 2525239 - protein, 25 aa, Entamoeba dispar
GIEYSQYRFLTPDKAFHQKESQVVF

SEQ ID NO: 2525240 - protein, 25 aa, Entamoeba dispar
GIFASYPVVLSQIYQFIVSKRSKGL

SEQ ID NO: 2525241 - protein, 26 aa, Entamoeba dispar
GIFCHENVYIYLAPGKSAETFNIFCW

SEQ ID NO: 2525242 - protein, 24 aa, Entamoeba dispar
GIFENNPCVCAFPYMFGERGLGID

SEQ ID NO: 2525243 - protein, 21 aa, Entamoeba dispar
GIFKALMPHVCDFEKVFTTRK

SEQ ID NO: 2525244 - protein, 23 aa, Entamoeba dispar
GIFNIRVNFLEMANPNFYDSRGP

SEQ ID NO: 2525245 - protein, 18 aa, Entamoeba dispar
GIFNVILSYFPSLPYETL

SEQ ID NO: 2525246 - protein, 27 aa, Entamoeba dispar
GIFSGFIEIILDPYFRTFNGFIEMIHC

SEQ ID NO: 2525247 - protein, 26 aa, Entamoeba dispar
GIFTQSLSLILFYYENNKLSDLEIIG

SEQ ID NO: 2525248 - protein, 19 aa, Entamoeba dispar
GIFVFPNMPVISKKSIDIF

SEQ ID NO: 2525249 - protein, 29 aa, Entamoeba dispar
GIFVKAICMFLTTITTPDKFFLKLMERLD

SEQ ID NO: 2525250 - protein, 27 aa, Entamoeba dispar
GIGGKVYKWIGNAMYKVSPVAKPILGM

SEQ ID NO: 2525251 - protein, 24 aa, Entamoeba dispar
GIGKGFALWLTTKPIVSGNNFGGK

SEQ ID NO: 2525252 - protein, 29 aa, Entamoeba dispar
GIGKQYAYLVISKSYFYIESYDEAVNYAL

SEQ ID NO: 2525253 - protein, 26 aa, Entamoeba dispar
GIGLEQILKPRLYGRRLKRIFVYRCG

SEQ ID NO: 2525254 - protein, 18 aa, Entamoeba dispar
GIGLPRKYPLICIDREEK

SEQ ID NO: 2525255 - protein, 25 aa, Entamoeba dispar
GIGPKVSLTLTKFFPIAIINTMKMD

SEQ ID NO: 2525256 - protein, 24 aa, Entamoeba dispar
GIGSNFVYALLDKNWHSGMEFEEA

SEQ ID NO: 2525257 - protein, 19 aa, Entamoeba dispar
GIHDILIPIIRVYYDKKDN

SEQ ID NO: 2525258 - protein, 24 aa, Entamoeba dispar
GIHKIFMCPIKNLIVRYIIREYIL

SEQ ID NO: 2525259 - protein, 18 aa, Entamoeba dispar
GIHMEFGHRVKSVSLAIF

SEQ ID NO: 2525260 - protein, 25 aa, Entamoeba dispar
GIIEVLIPLLQQEKILFKIHYYQNN

SEQ ID NO: 2525261 - protein, 22 aa, Entamoeba dispar
GIINAMVLLLIEIGKKQPELLK

SEQ ID NO: 2525262 - protein, 31 aa, Entamoeba dispar
GIINSQLLAYFMGRTFKFLTELGIPTEHIRF

SEQ ID NO: 2525263 - protein, 20 aa, Entamoeba dispar
GIIRIKPFSLLTQKEVVLYA

SEQ ID NO: 2525264 - protein, 23 aa, Entamoeba dispar
GIKDELLRSIYSYGFEKPSAIQQ

SEQ ID NO: 2525265 - protein, 22 aa, Entamoeba dispar
GIKDILHFDYLDAPSPQVMVRA

SEQ ID NO: 2525266 - protein, 19 aa, Entamoeba dispar
GIKELCKKVGLKAGSVFDT

SEQ ID NO: 2525267 - protein, 32 aa, Entamoeba dispar
GIKFIQQLFITPELHHIIPNELWKWVNKIVNK

SEQ ID NO: 2525268 - protein, 17 aa, Entamoeba dispar
GIKITDDFRYIIINEDN

SEQ ID NO: 2525269 - protein, 18 aa, Entamoeba dispar
GIKITDDFRYIIINEDNL

SEQ ID NO: 2525270 - protein, 21 aa, Entamoeba dispar
GIKKLINYIKNTPISKQDYIS

SEQ ID NO: 2525271 - protein, 19 aa, Entamoeba dispar
GIKKMKINALIPARMQCVI

SEQ ID NO: 2525272 - protein, 23 aa, Entamoeba dispar
GIKNGMWLKQAYNLCPQLVVVGY

SEQ ID NO: 2525273 - protein, 24 aa, Entamoeba dispar
GIKNNIIMVLLYNGKKIISCNGKK

SEQ ID NO: 2525274 - protein, 20 aa, Entamoeba dispar
GIKRLGVLLSGYHLYHKLAM

SEQ ID NO: 2525275 - protein, 18 aa, Entamoeba dispar
GIKSIRSIFGPKTDLDFI

SEQ ID NO: 2525276 - protein, 26 aa, Entamoeba dispar
GIKSKTLLYIPSYFDYLRVKQYLNTE

SEQ ID NO: 2525277 - protein, 25 aa, Entamoeba dispar
GIKSVYTMFYSSEIMFHVATMLPHV

SEQ ID NO: 2525278 - protein, 20 aa, Entamoeba dispar
GIKVTDDFRYIIINEGNLEQ

SEQ ID NO: 2525279 - protein, 25 aa, Entamoeba dispar
GILANHFEMIIPSLIIIEKPADEDA

SEQ ID NO: 2525280 - protein, 19 aa, Entamoeba dispar
GILEMKIGGGIIRVITCQP

SEQ ID NO: 2525281 - protein, 20 aa, Entamoeba dispar
GILKEMKYSLHSFYYPIQHG

SEQ ID NO: 2525282 - protein, 20 aa, Entamoeba dispar
GILKNEVIKYKKNSLKLWKC

SEQ ID NO: 2525283 - protein, 19 aa, Entamoeba dispar
GILNKIIMNISFDGIEISL

SEQ ID NO: 2525284 - protein, 18 aa, Entamoeba dispar
GILPSCKDYIFYCKKCGE

SEQ ID NO: 2525285 - protein, 18 aa, Entamoeba dispar
GILQFYVLVDDSGEYGIN

SEQ ID NO: 2525286 - protein, 21 aa, Entamoeba dispar
GIMENCNGLILGSVLRAVTPN

SEQ ID NO: 2525287 - protein, 18 aa, Entamoeba dispar
GIMFYEMILRRSPFDGML

SEQ ID NO: 2525288 - protein, 20 aa, Entamoeba dispar
GIMIPNPQYPLYGACIQQLG

SEQ ID NO: 2525289 - protein, 24 aa, Entamoeba dispar
GINELIKFFPTKEEKLKILPIIKK

SEQ ID NO: 2525290 - protein, 28 aa, Entamoeba dispar
GINELPIEIWLHVIPQIIARIQSEIGSV

SEQ ID NO: 2525291 - protein, 25 aa, Entamoeba dispar
GINGRYGMFPLAKGTIIALNKEEED

SEQ ID NO: 2525292 - protein, 20 aa, Entamoeba dispar
GINIPIKQIIPLLSKIVSIL

SEQ ID NO: 2525293 - protein, 19 aa, Entamoeba dispar
GINKMILINSLLEIISNDE

SEQ ID NO: 2525294 - protein, 25 aa, Entamoeba dispar
GINYIYIPIILRISIEDYKKAQTKQ

SEQ ID NO: 2525295 - protein, 30 aa, Entamoeba dispar
GIPAELRAYVWYALLLRPSNPWEIKHLYSE

SEQ ID NO: 2525296 - protein, 26 aa, Entamoeba dispar
GIPIRERYINEFVIPTSIRKIGDGCF

SEQ ID NO: 2525297 - protein, 19 aa, Entamoeba dispar
GIPISLPKDNLPILPIKMT

SEQ ID NO: 2525298 - protein, 17 aa, Entamoeba dispar
GIPIVEENWVLQSHKKM

SEQ ID NO: 2525299 - protein, 21 aa, Entamoeba dispar
GIPNFWIEVFNEVGLIGNLEV

SEQ ID NO: 2525300 - protein, 24 aa, Entamoeba dispar
GIPQPRRLFTFEKLTFYCCDSMKT

SEQ ID NO: 2525301 - protein, 24 aa, Entamoeba dispar
GIQCYLWEIQIKKEYRRQGIGKEM

SEQ ID NO: 2525302 - protein, 18 aa, Entamoeba dispar
GIQLFTIVNGTKTFFASC

SEQ ID NO: 2525303 - protein, 37 aa, Entamoeba dispar
GIQLQSLDSYLILPIQRLPRYQMLLIQLIQSIQMNSS

SEQ ID NO: 2525304 - protein, 35 aa, Entamoeba dispar
GISEKSWKLVWVVIKYTFIFVFKSRDDTTLIETFM

SEQ ID NO: 2525305 - protein, 38 aa, Entamoeba dispar
GISFLDVKYSLLFEYNMYLAYYCWIKSSGSNVERHKAI

SEQ ID NO: 2525306 - protein, 21 aa, Entamoeba dispar
GISHFFVFDVFDKALCFLDKV

SEQ ID NO: 2525307 - protein, 24 aa, Entamoeba dispar
GISRIIYLDVFRTLKSPVYQAPLI

SEQ ID NO: 2525308 - protein, 22 aa, Entamoeba dispar
GISSFVLFKNLSGMQKIEDQER

SEQ ID NO: 2525309 - protein, 17 aa, Entamoeba dispar
GITDCKVMRTPQGVSRK

SEQ ID NO: 2525310 - protein, 20 aa, Entamoeba dispar
GITFLKMVLVIDPNFSKFME

SEQ ID NO: 2525311 - protein, 29 aa, Entamoeba dispar
GITIPLDTPLLWLALNLSNSDLFLHVIIR

SEQ ID NO: 2525312 - protein, 24 aa, Entamoeba dispar
GITSDMLIKYPILKGLFDNGELLD

SEQ ID NO: 2525313 - protein, 17 aa, Entamoeba dispar
GIVIFLKDIIEMSRAVQ

SEQ ID NO: 2525314 - protein, 19 aa, Entamoeba dispar
GIVKVRWISYNNEEIPELE

SEQ ID NO: 2525315 - protein, 19 aa, Entamoeba dispar
GIVVLPCGAGKTLTAIAAC

SEQ ID NO: 2525316 - protein, 32 aa, Entamoeba dispar
GIVVYVIKQGNESEWFFSTRKGKFEVSEELGY

SEQ ID NO: 2525317 - protein, 33 aa, Entamoeba dispar
GIYEQYSIRIPKPAILKPIPKWTGKQVITGILM

SEQ ID NO: 2525318 - protein, 23 aa, Entamoeba dispar
GIYISNKIIPFDNLIMDLIEVNH

SEQ ID NO: 2525319 - protein, 22 aa, Entamoeba dispar
GIYLTYFSDYALFYSNNRNSNQ

SEQ ID NO: 2525320 - protein, 26 aa, Entamoeba dispar
GIYTNNMVTLWYRPPELLLGETRYKG

SEQ ID NO: 2525321 - protein, 19 aa, Entamoeba dispar
GIYVTRFPPEPNGYLHIGH

SEQ ID NO: 2525322 - protein, 29 aa, Entamoeba dispar
GKACEIILTFKFLRECDEWYQMVLKTLNN

SEQ ID NO: 2525323 - protein, 27 aa, Entamoeba dispar
GKAKSIFYYHYFVPELNLNDVKRFSGC

SEQ ID NO: 2525324 - protein, 23 aa, Entamoeba dispar
GKALSLLCRMLFVHIVQKAVEKS

SEQ ID NO: 2525325 - protein, 24 aa, Entamoeba dispar
GKCTIKFVFVTPERITQSKSFKEA

SEQ ID NO: 2525326 - protein, 27 aa, Entamoeba dispar
GKDAENIWRLYFLVTELDVENGANGSK

SEQ ID NO: 2525327 - protein, 25 aa, Entamoeba dispar
GKDALHWGVLRPFDSSYPGIDLYGS

SEQ ID NO: 2525328 - protein, 22 aa, Entamoeba dispar
GKDIFSYGLPLTAELLKSKKDY

SEQ ID NO: 2525329 - protein, 26 aa, Entamoeba dispar
GKEFEGRSVYLEYANTKKKGYRNGDT

SEQ ID NO: 2525330 - protein, 25 aa, Entamoeba dispar
GKEFMKQLCLDGIQFSFLSSEIKQK

SEQ ID NO: 2525331 - protein, 23 aa, Entamoeba dispar
GKEGYQHLYGMDYSPASIKFTKK

SEQ ID NO: 2525332 - protein, 17 aa, Entamoeba dispar
GKEKLVSFPINNLKRIY

SEQ ID NO: 2525333 - protein, 20 aa, Entamoeba dispar
GKEKSIAFPMFFVDSQPDED

SEQ ID NO: 2525334 - protein, 29 aa, Entamoeba dispar
GKEYEQLIFLIFYHFTVINDIFILDDETI

SEQ ID NO: 2525335 - protein, 22 aa, Entamoeba dispar
GKFFDRNWYSLYFINSMREVMG

SEQ ID NO: 2525336 - protein, 20 aa, Entamoeba dispar
GKGFLVSWCGRIEKLFIVGF

SEQ ID NO: 2525337 - protein, 17 aa, Entamoeba dispar
GKGLNVIIGPNGAGKSS

SEQ ID NO: 2525338 - protein, 25 aa, Entamoeba dispar
GKGMKLMIGSIYLFKTIKGIEVIEG

SEQ ID NO: 2525339 - protein, 21 aa, Entamoeba dispar
GKGPKLLDVRMMLPMSVRCQA

SEQ ID NO: 2525340 - protein, 47 aa, Entamoeba dispar
GKGRYWVLDPIDGTLGFLRREQYAVCLAFMIDGDIKVGVLGCPNFEG

SEQ ID NO: 2525341 - protein, 25 aa, Entamoeba dispar
GKGSIYQFQLFIIDCYREQLEKAKD

SEQ ID NO: 2525342 - protein, 24 aa, Entamoeba dispar
GKGTLHYLIKKGMDLVRINELKIV

SEQ ID NO: 2525343 - protein, 29 aa, Entamoeba dispar
GKHFDEIFNILSPFIFSSEKFRNYRFNKL

SEQ ID NO: 2525344 - protein, 19 aa, Entamoeba dispar
GKHLILEDADLTLAHGRRY

SEQ ID NO: 2525345 - protein, 23 aa, Entamoeba dispar
GKIIKQVIWYKVEYSRYSKEKEQ

SEQ ID NO: 2525346 - protein, 21 aa, Entamoeba dispar
GKIKARWMRKNARRLDIENYT

SEQ ID NO: 2525347 - protein, 21 aa, Entamoeba dispar
GKIKARWMRKNARRLDIETYA

SEQ ID NO: 2525348 - protein, 20 aa, Entamoeba dispar
GKIKARWMRKNARRLDVEQY

SEQ ID NO: 2525349 - protein, 22 aa, Entamoeba dispar
GKIKDLFRKLTPSHSPRVSPRF

SEQ ID NO: 2525350 - protein, 21 aa, Entamoeba dispar
GKIKSRWMRKNARRLDIENYT

SEQ ID NO: 2525351 - protein, 26 aa, Entamoeba dispar
GKINKKVIWYKLKYSTYLEEKQKWNI

SEQ ID NO: 2525352 - protein, 24 aa, Entamoeba dispar
GKIVGCIMSSYLLEKSRVVYQARE

SEQ ID NO: 2525353 - protein, 36 aa, Entamoeba dispar
GKIVSRIVITALLPPLRELIEGGFFNFYLSDKYIIF

SEQ ID NO: 2525354 - protein, 25 aa, Entamoeba dispar
GKKDPIIYDYKWDIDGYKLKIQSMM

SEQ ID NO: 2525355 - protein, 24 aa, Entamoeba dispar
GKKEKCFSLLLYIDSNGNVIKRWY

SEQ ID NO: 2525356 - protein, 22 aa, Entamoeba dispar
GKKGILPFYVLDQLNQMVQIVN

SEQ ID NO: 2525357 - protein, 19 aa, Entamoeba dispar
GKKIIDDKIDITIKGRHVS

SEQ ID NO: 2525358 - protein, 20 aa, Entamoeba dispar
GKKILRCQCGMGHHNTVGFS

SEQ ID NO: 2525359 - protein, 27 aa, Entamoeba dispar
GKKISCAVLYCWCVSLLLEKLNNTEKV

SEQ ID NO: 2525360 - protein, 19 aa, Entamoeba dispar
GKKKLLLYVIDRLYNRDII

SEQ ID NO: 2525361 - protein, 22 aa, Entamoeba dispar
GKKLPIIFENIYSNAFDNQRSI

SEQ ID NO: 2525362 - protein, 26 aa, Entamoeba dispar
GKKTKNPMNYFFGAAQYLPEAKELQK

SEQ ID NO: 2525363 - protein, 20 aa, Entamoeba dispar
GKLASLKAWLKKSLDETARK

SEQ ID NO: 2525364 - protein, 19 aa, Entamoeba dispar
GKLCFWKMDKKPSYYNIYP

SEQ ID NO: 2525365 - protein, 23 aa, Entamoeba dispar
GKLIKVIPMKQEMNYFGIGLREY

SEQ ID NO: 2525366 - protein, 17 aa, Entamoeba dispar
GKLILYPKDSNQLFGVE

SEQ ID NO: 2525367 - protein, 25 aa, Entamoeba dispar
GKLLEKMIVFVNLGFDKDMLKKIQQ

SEQ ID NO: 2525368 - protein, 23 aa, Entamoeba dispar
GKLLNQYLIYYLNFDYSTQRIVT

SEQ ID NO: 2525369 - protein, 25 aa, Entamoeba dispar
GKLLSLNVECRENVLSGIKKVADAV

SEQ ID NO: 2525370 - protein, 29 aa, Entamoeba dispar
GKLTKLIPTLFITHFLSRSLVEFEKELLV

SEQ ID NO: 2525371 - protein, 24 aa, Entamoeba dispar
GKLVPFHVAYIKNITTREGFFRIN

SEQ ID NO: 2525372 - protein, 26 aa, Entamoeba dispar
GKMDHSTLCVLVLNDGLFTKTTLNQL

SEQ ID NO: 2525373 - protein, 27 aa, Entamoeba dispar
GKMIRKIMKWMLKCLICQEQIFDMTKM

SEQ ID NO: 2525374 - protein, 19 aa, Entamoeba dispar
GKMSLSFPWNKLDSQPVVV

SEQ ID NO: 2525375 - protein, 25 aa, Entamoeba dispar
GKNEIMVVTKRINVAGFNKRVPKNA

SEQ ID NO: 2525376 - protein, 26 aa, Entamoeba dispar
GKNIEEIFVFIAQQFVQRMKSNTVVE

SEQ ID NO: 2525377 - protein, 17 aa, Entamoeba dispar
GKNLLGSQLYLFEGCLL

SEQ ID NO: 2525378 - protein, 26 aa, Entamoeba dispar
GKNPKNLLLTTFKLSPQKDDIKRMCE

SEQ ID NO: 2525379 - protein, 28 aa, Entamoeba dispar
GKNSFERKVLFLPLSVPKYAVIESTEEI

SEQ ID NO: 2525380 - protein, 26 aa, Entamoeba dispar
GKNSYYMWSINFSQINAILLSETAKS

SEQ ID NO: 2525381 - protein, 23 aa, Entamoeba dispar
GKNVARIKGFPSILAVDVFKEYT

SEQ ID NO: 2525382 - protein, 23 aa, Entamoeba dispar
GKPFRPFEQLLSVLPPQSKHCLP

SEQ ID NO: 2525383 - protein, 24 aa, Entamoeba dispar
GKPHFKVSCYCGHEFCFGCGRERH

SEQ ID NO: 2525384 - protein, 17 aa, Entamoeba dispar
GKPLELWNIDSLEDTTP

SEQ ID NO: 2525385 - protein, 19 aa, Entamoeba dispar
GKPSWSIKSIFLGKKSYLD

SEQ ID NO: 2525386 - protein, 20 aa, Entamoeba dispar
GKPSWSIKSIFLGKKSYLDV

SEQ ID NO: 2525387 - protein, 27 aa, Entamoeba dispar
GKQTVDDLIWPLLEKKLKISGETLDGK

SEQ ID NO: 2525388 - protein, 25 aa, Entamoeba dispar
GKQVTPLLFIIEDMVPIGVGKCELP

SEQ ID NO: 2525389 - protein, 23 aa, Entamoeba dispar
GKRKKEMLMVARSLAKDMKAICD

SEQ ID NO: 2525390 - protein, 22 aa, Entamoeba dispar
GKRRIRYFGGLKFVTPGEISKD

SEQ ID NO: 2525391 - protein, 25 aa, Entamoeba dispar
GKRRVNLFLLRWKNNNHYIIDDVVE

SEQ ID NO: 2525392 - protein, 28 aa, Entamoeba dispar
GKSESRGFGYLDFFNINEAQRCIDEMTG

SEQ ID NO: 2525393 - protein, 18 aa, Entamoeba dispar
GKSFFFTGAAGCGKSYVL

SEQ ID NO: 2525394 - protein, 23 aa, Entamoeba dispar
GKSNLLLRFTRNEFEPEKKFTIG

SEQ ID NO: 2525395 - protein, 24 aa, Entamoeba dispar
GKSNTMLIPITPTDKFKTLLEGLD

SEQ ID NO: 2525396 - protein, 28 aa, Entamoeba dispar
GKSPQQCKARWYSWLDPSIKKTEWTSTE

SEQ ID NO: 2525397 - protein, 34 aa, Entamoeba dispar
GKSVIQYCLRLLNPLQVFDILNGWDLLFEFVEKY

SEQ ID NO: 2525398 - protein, 27 aa, Entamoeba dispar
GKTAFLAKLLAFLRKHKEKIVIVSNYT

SEQ ID NO: 2525399 - protein, 28 aa, Entamoeba dispar
GKTEFAIQEIFLKFNTFMLRGDSLFDAY

SEQ ID NO: 2525400 - protein, 26 aa, Entamoeba dispar
GKTKHFQTLILNDELMLCDCPGLVFP

SEQ ID NO: 2525401 - protein, 30 aa, Entamoeba dispar
GKTLKVVVMTLYKVFLLENSNIQEEIKTIK

SEQ ID NO: 2525402 - protein, 21 aa, Entamoeba dispar
GKTLSFLIPIVQRLIELDKID

SEQ ID NO: 2525403 - protein, 22 aa, Entamoeba dispar
GKTMAFLLSTLQLINREDPFCQ

SEQ ID NO: 2525404 - protein, 31 aa, Entamoeba dispar
GKTPKKFFGTDFIKSVLPPELLLGTSTEVAK

SEQ ID NO: 2525405 - protein, 24 aa, Entamoeba dispar
GKTSFYKKYLKPMGYEWINMDTLG

SEQ ID NO: 2525406 - protein, 21 aa, Entamoeba dispar
GKTSIVLRYVEGIFDPSCKST

SEQ ID NO: 2525407 - protein, 20 aa, Entamoeba dispar
GKTTLLKIWSNEEFESIYLK

SEQ ID NO: 2525408 - protein, 21 aa, Entamoeba dispar
GKTTLLNSFINALHGIKITDD

SEQ ID NO: 2525409 - protein, 27 aa, Entamoeba dispar
GKVAGMCLTLLSRLLTTYLQRIGHTCS

SEQ ID NO: 2525410 - protein, 23 aa, Entamoeba dispar
GKVGEVFGPLNDYYFSVVPAEGV

SEQ ID NO: 2525411 - protein, 17 aa, Entamoeba dispar
GKVGLLKDHIPVGRIQQ

SEQ ID NO: 2525412 - protein, 30 aa, Entamoeba dispar
GKVLPQSHILTFFRAIGLNVNNPHFLIMQG

SEQ ID NO: 2525413 - protein, 24 aa, Entamoeba dispar
GKVQPIFTKLYQQAGAAGGMPGGM

SEQ ID NO: 2525414 - protein, 18 aa, Entamoeba dispar
GKVRKLFLGTLRDYCIIS

SEQ ID NO: 2525415 - protein, 19 aa, Entamoeba dispar
GKVWKILLGIYKIDSFEYC

SEQ ID NO: 2525416 - protein, 22 aa, Entamoeba dispar
GKYCFKDCTSLRLINVPTSVSE

SEQ ID NO: 2525417 - protein, 25 aa, Entamoeba dispar
GKYGTSPFILCRYGFGDVAQGFSRS

SEQ ID NO: 2525418 - protein, 23 aa, Entamoeba dispar
GKYPICCECLIKQLIDNEQYYRC

SEQ ID NO: 2525419 - protein, 23 aa, Entamoeba dispar
GKYQRGLLLGQTYAGFIYSAMEN

SEQ ID NO: 2525420 - protein, 25 aa, Entamoeba dispar
GLAAASFFARCNFKKIVVFERSAHL

SEQ ID NO: 2525421 - protein, 22 aa, Entamoeba dispar
GLAKQILVSYIYLGINKVSKAF

SEQ ID NO: 2525422 - protein, 31 aa, Entamoeba dispar
GLASERLCVLYVLYKNLFIDQFKIQYQTIHL

SEQ ID NO: 2525423 - protein, 17 aa, Entamoeba dispar
GLASLTQLTFLRMFHYK

SEQ ID NO: 2525424 - protein, 25 aa, Entamoeba dispar
GLDKKKILSCWVFPDDYPTESFCES

SEQ ID NO: 2525425 - protein, 28 aa, Entamoeba dispar
GLDNIDKRYIWFNKKYLSYEGMYSTIFP

SEQ ID NO: 2525426 - protein, 31 aa, Entamoeba dispar
GLDYILMAAVLKRFFRSLPEKVFDRTNTNKA

SEQ ID NO: 2525427 - protein, 28 aa, Entamoeba dispar
GLEDFYSLIEFCSPGCLGTLSSFKRVFA

SEQ ID NO: 2525428 - protein, 26 aa, Entamoeba dispar
GLEILRDLPDVDAIIAPIGSGSLLCG

SEQ ID NO: 2525429 - protein, 26 aa, Entamoeba dispar
GLEMKNRVRKLFGDIPIQLIGLEGET

SEQ ID NO: 2525430 - protein, 19 aa, Entamoeba dispar
GLESPKLWLQNDILNFMIH

SEQ ID NO: 2525431 - protein, 21 aa, Entamoeba dispar
GLFCDLLWSDPIDESIYSKLT

SEQ ID NO: 2525432 - protein, 27 aa, Entamoeba dispar
GLFKKYQPTIFLWTKTTQFSILFDTNK

SEQ ID NO: 2525433 - protein, 25 aa, Entamoeba dispar
GLFKSFVRELPSPVIPLNCYDKFVD

SEQ ID NO: 2525434 - protein, 24 aa, Entamoeba dispar
GLFSGMVFYIQREVPRHPVAFVIE

SEQ ID NO: 2525435 - protein, 19 aa, Entamoeba dispar
GLFYLIDPKGGVNTIDLLI

SEQ ID NO: 2525436 - protein, 18 aa, Entamoeba dispar
GLGGLPLGIMRRTPEPWL

SEQ ID NO: 2525437 - protein, 25 aa, Entamoeba dispar
GLGGLPPVGGLPPLGMNAPQEEIVT

SEQ ID NO: 2525438 - protein, 30 aa, Entamoeba dispar
GLGKTIQAVTLIWTLLRQGPNGEPTCKKVM

SEQ ID NO: 2525439 - protein, 19 aa, Entamoeba dispar
GLGNLYLLLDLHTSGIIHY

SEQ ID NO: 2525440 - protein, 17 aa, Entamoeba dispar
GLGVIIIEMMNGTAPFA

SEQ ID NO: 2525441 - protein, 25 aa, Entamoeba dispar
GLGVKYVLRVIGIKKIAVVVLGELD

SEQ ID NO: 2525442 - protein, 17 aa, Entamoeba dispar
GLGYYITTHYGISHGFA

SEQ ID NO: 2525443 - protein, 19 aa, Entamoeba dispar
GLHGWAFTLEKFAKMWSAK

SEQ ID NO: 2525444 - protein, 24 aa, Entamoeba dispar
GLHTPRFEMAQGNSPLFDKNGHMN

SEQ ID NO: 2525445 - protein, 17 aa, Entamoeba dispar
GLHYLLRGEKIFHRDLK

SEQ ID NO: 2525446 - protein, 20 aa, Entamoeba dispar
GLIELLNTVLKYNPYQRPTG

SEQ ID NO: 2525447 - protein, 19 aa, Entamoeba dispar
GLIKIVIPSSVIYLGENCF

SEQ ID NO: 2525448 - protein, 18 aa, Entamoeba dispar
GLIKLDVVLFGEELEKEK

SEQ ID NO: 2525449 - protein, 22 aa, Entamoeba dispar
GLINIYCPSILKSLYPNSLVQR

SEQ ID NO: 2525450 - protein, 18 aa, Entamoeba dispar
GLIRLMEEHLKVVEGAVA

SEQ ID NO: 2525451 - protein, 29 aa, Entamoeba dispar
GLISDIWSCGVILYVMTFGLMPFDGETLE

SEQ ID NO: 2525452 - protein, 21 aa, Entamoeba dispar
GLKPIALSLIKMEKYQEARRV

SEQ ID NO: 2525453 - protein, 25 aa, Entamoeba dispar
GLKTKSMCFLFNDVIIWMDNIIPLV

SEQ ID NO: 2525454 - protein, 20 aa, Entamoeba dispar
GLKVMLFSGINKYSTYLIYS

SEQ ID NO: 2525455 - protein, 21 aa, Entamoeba dispar
GLKVPVLLSDWGYEVMVTCSA

SEQ ID NO: 2525456 - protein, 18 aa, Entamoeba dispar
GLLDMIICFVTYSSTNST

SEQ ID NO: 2525457 - protein, 29 aa, Entamoeba dispar
GLLLSICRNVCFFTWAYELLIYDIEDPLC

SEQ ID NO: 2525458 - protein, 23 aa, Entamoeba dispar
GLLMKVLHWINTSKVFPYDCVKV

SEQ ID NO: 2525459 - protein, 30 aa, Entamoeba dispar
GLLNSLIYVEKLYPQVFPLIKFTDTLGDFN

SEQ ID NO: 2525460 - protein, 19 aa, Entamoeba dispar
GLLSKSLVFRELCDCFDQF

SEQ ID NO: 2525461 - protein, 26 aa, Entamoeba dispar
GLLSLRPHPFDPYRVYTIPFEEQAFK

SEQ ID NO: 2525462 - protein, 20 aa, Entamoeba dispar
GLLTILLEDSPLEAFSIFIG

SEQ ID NO: 2525463 - protein, 23 aa, Entamoeba dispar
GLMFCPELFKKVDFIEKLSSGIV

SEQ ID NO: 2525464 - protein, 21 aa, Entamoeba dispar
GLMITLWDMHYLQKSMQLEQA

SEQ ID NO: 2525465 - protein, 26 aa, Entamoeba dispar
GLNCAFGRWPVKSAQFILKLLKNAVD

SEQ ID NO: 2525466 - protein, 24 aa, Entamoeba dispar
GLNEIIHCQFFPDIPRDINVGCHW

SEQ ID NO: 2525467 - protein, 19 aa, Entamoeba dispar
GLNKMSLISDWKKLCFIKD

SEQ ID NO: 2525468 - protein, 19 aa, Entamoeba dispar
GLNKQTLLGVLKKGYRVPT

SEQ ID NO: 2525469 - protein, 24 aa, Entamoeba dispar
GLNTFMITLLVYSFLEMYNTGNIT

SEQ ID NO: 2525470 - protein, 23 aa, Entamoeba dispar
GLPLGIMRRTPEPWLKGLGCSDD

SEQ ID NO: 2525471 - protein, 23 aa, Entamoeba dispar
GLPVTVRLLDPPLHEFLPTLEEL

SEQ ID NO: 2525472 - protein, 26 aa, Entamoeba dispar
GLQESIVLGIFYQIANAIAFLHSQNP

SEQ ID NO: 2525473 - protein, 24 aa, Entamoeba dispar
GLQQLTPYFIRYISNHTLANLGSL

SEQ ID NO: 2525474 - protein, 18 aa, Entamoeba dispar
GLQVVLASVNRILLSASS

SEQ ID NO: 2525475 - protein, 39 aa, Entamoeba dispar
GLRHHTLTSLLITPVQRLPRYKLLLTDLLRHYNWEHPDY

SEQ ID NO: 2525476 - protein, 26 aa, Entamoeba dispar
GLSETVIFVRNLPFSMDSFELKQLFD

SEQ ID NO: 2525477 - protein, 27 aa, Entamoeba dispar
GLSILDNFFMPFFLLCVDDPVPNVRIH

SEQ ID NO: 2525478 - protein, 30 aa, Entamoeba dispar
GLSKYETVLKQWIPSIRMKLIYDSSQQFFD

SEQ ID NO: 2525479 - protein, 17 aa, Entamoeba dispar
GLSLIKLHDFSCGIVLE

SEQ ID NO: 2525480 - protein, 35 aa, Entamoeba dispar
GLSLYELPFQIHKIFYFLYTIGYSSTGIFRLAGRA

SEQ ID NO: 2525481 - protein, 29 aa, Entamoeba dispar
GLSSFPKYIHLLILLIRTRSRITKLRINK

SEQ ID NO: 2525482 - protein, 30 aa, Entamoeba dispar
GLTGDLFDPFLRPYFANGYIPVTQGDVIQC

SEQ ID NO: 2525483 - protein, 28 aa, Entamoeba dispar
GLTKRSFEEYFQWFIAGLKNVMNKLITN

SEQ ID NO: 2525484 - protein, 18 aa, Entamoeba dispar
GLTQLVGTIWFDKMIHIC

SEQ ID NO: 2525485 - protein, 29 aa, Entamoeba dispar
GLTSIFLNYFFDTTIVHMAPLNPLGSFYY

SEQ ID NO: 2525486 - protein, 22 aa, Entamoeba dispar
GLVCGVTCLIRYINGIKVVWMR

SEQ ID NO: 2525487 - protein, 26 aa, Entamoeba dispar
GLVDNKFSIFAPKGEPLPITYEGEYF

SEQ ID NO: 2525488 - protein, 31 aa, Entamoeba dispar
GLVIKLVSSPLYVLFLTLPERQKGMEIMYAA

SEQ ID NO: 2525489 - protein, 20 aa, Entamoeba dispar
GLVKVWDLEIQQCRQTIVGH

SEQ ID NO: 2525490 - protein, 36 aa, Entamoeba dispar
GLVYSNLWRYWCPWLMWFVSPFFKIFWKTPEEACQT

SEQ ID NO: 2525491 - protein, 25 aa, Entamoeba dispar
GLYGDYNILSYWLQAINFVIQDLVQ

SEQ ID NO: 2525492 - protein, 18 aa, Entamoeba dispar
GLYKEFINKIQGVTLRKG

SEQ ID NO: 2525493 - protein, 21 aa, Entamoeba dispar
GLYYLLGEMHFHLGRRNEAIR

SEQ ID NO: 2525494 - protein, 19 aa, Entamoeba dispar
GMAEFSLLANLITKNYKMK

SEQ ID NO: 2525495 - protein, 32 aa, Entamoeba dispar
GMCKELAPLNPDWIYIRAAAIARKVYLNNGIG

SEQ ID NO: 2525496 - protein, 28 aa, Entamoeba dispar
GMDRGEMYFINWNKKYTTWMDPRSFEER

SEQ ID NO: 2525497 - protein, 24 aa, Entamoeba dispar
GMDTITIGIYLDGKIFMKKQFDKN

SEQ ID NO: 2525498 - protein, 23 aa, Entamoeba dispar
GMDTITIGIYLDGKIFMKKQFNK

SEQ ID NO: 2525499 - protein, 17 aa, Entamoeba dispar
GMEFHCLITLLLQIIQT

SEQ ID NO: 2525500 - protein, 19 aa, Entamoeba dispar
GMERVFLTCTVIKDFEAEG

SEQ ID NO: 2525501 - protein, 18 aa, Entamoeba dispar
GMFAFKWCESLTSLSIPS

SEQ ID NO: 2525502 - protein, 33 aa, Entamoeba dispar
GMFHISMVRFVDPPLYLAHVMQDFLWDNDECIA

SEQ ID NO: 2525503 - protein, 27 aa, Entamoeba dispar
GMGDRAIFVFGFHALQFLYLDPHIVQP

SEQ ID NO: 2525504 - protein, 18 aa, Entamoeba dispar
GMGFEDIKYYKNSEIIFL

SEQ ID NO: 2525505 - protein, 28 aa, Entamoeba dispar
GMIIAIPPLIAFQCLFSKSLVSHELTLS

SEQ ID NO: 2525506 - protein, 17 aa, Entamoeba dispar
GMIKMFNPRIYEKDLQK

SEQ ID NO: 2525507 - protein, 18 aa, Entamoeba dispar
GMILKYLYETAQEKLGNH

SEQ ID NO: 2525508 - protein, 25 aa, Entamoeba dispar
GMKGFQMNYFVSCIQSQVFKKYTPL

SEQ ID NO: 2525509 - protein, 24 aa, Entamoeba dispar
GMKHPCILDLKMGCRTWFEDSSPE

SEQ ID NO: 2525510 - protein, 25 aa, Entamoeba dispar
GMKITKFPVMWMNQIYALHSSYEEA

SEQ ID NO: 2525511 - protein, 31 aa, Entamoeba dispar
GMKLRPLSVFAPLHYFELPELLMECITSMTG

SEQ ID NO: 2525512 - protein, 18 aa, Entamoeba dispar
GMKRSFISLFRNTKPEKK

SEQ ID NO: 2525513 - protein, 18 aa, Entamoeba dispar
GMLLYSLPSKFHLQFLTQ

SEQ ID NO: 2525514 - protein, 24 aa, Entamoeba dispar
GMLQVKLLRLWDPSKDLIKICVQK

SEQ ID NO: 2525515 - protein, 25 aa, Entamoeba dispar
GMNKLPGIFVVCLQSIYIVQGLELR

SEQ ID NO: 2525516 - protein, 28 aa, Entamoeba dispar
GMNQLWASKILQIFKFLNGKDTFEQHYQ

SEQ ID NO: 2525517 - protein, 19 aa, Entamoeba dispar
GMNQYFRLLSLNNSIRKSK

SEQ ID NO: 2525518 - protein, 24 aa, Entamoeba dispar
GMNSFGQQLNNGMGGFGTFGQQQN

SEQ ID NO: 2525519 - protein, 28 aa, Entamoeba dispar
GMPIIQAFLQILIPFEWQGVLIPMLPIE

SEQ ID NO: 2525520 - protein, 34 aa, Entamoeba dispar
GMQQYGQMNGVPRFDQMPGYSQMGGMPSYGTQPY

SEQ ID NO: 2525521 - protein, 18 aa, Entamoeba dispar
GMTLIEAGIIICKDKTID

SEQ ID NO: 2525522 - protein, 25 aa, Entamoeba dispar
GMTQKEKIIFNKKIIRLRKESERIK

SEQ ID NO: 2525523 - protein, 24 aa, Entamoeba dispar
GMTQKETIIFNKKIIRLKKESERI

SEQ ID NO: 2525524 - protein, 24 aa, Entamoeba dispar
GMTVSKIIPCQFAVSFQGGVVMLI

SEQ ID NO: 2525525 - protein, 24 aa, Entamoeba dispar
GMTYNRVGTLYYIYADDLRVLCEG

SEQ ID NO: 2525526 - protein, 27 aa, Entamoeba dispar
GMVAVAMYHDGVNPTFYFFKDGLKENK

SEQ ID NO: 2525527 - protein, 18 aa, Entamoeba dispar
GNASLVIQKLPPGQMSNN

SEQ ID NO: 2525528 - protein, 23 aa, Entamoeba dispar
GNDDLIINELIPRIIYCEENIKI

SEQ ID NO: 2525529 - protein, 24 aa, Entamoeba dispar
GNDLIEWIKKIFIPHIHQIRKQKN

SEQ ID NO: 2525530 - protein, 22 aa, Entamoeba dispar
GNDTNVFVYLQGNIQIIEIETQ

SEQ ID NO: 2525531 - protein, 25 aa, Entamoeba dispar
GNDVINNFIAMLTFCDGEDPQIINA

SEQ ID NO: 2525532 - protein, 22 aa, Entamoeba dispar
GNDVYLWIGTKASSTLRKSAKV

SEQ ID NO: 2525533 - protein, 21 aa, Entamoeba dispar
GNECFYGCRLLKEIDIPTTVS

SEQ ID NO: 2525534 - protein, 23 aa, Entamoeba dispar
GNEIVIFDPKHILPKYIIEFKVN

SEQ ID NO: 2525535 - protein, 24 aa, Entamoeba dispar
GNELLIGFNPLITSFPMLGRFFDN

SEQ ID NO: 2525536 - protein, 25 aa, Entamoeba dispar
GNETEYQSRWRKREISPVRECRTYK

SEQ ID NO: 2525537 - protein, 23 aa, Entamoeba dispar
GNFGGILDLYKPPRLVVNKSLHL

SEQ ID NO: 2525538 - protein, 25 aa, Entamoeba dispar
GNGLTIQWIYSLLIKLISSPHQPIR

SEQ ID NO: 2525539 - protein, 37 aa, Entamoeba dispar
GNGRLKYVPEFLFKFLLWLRKWLYPRNFLGGLFVDNH

SEQ ID NO: 2525540 - protein, 23 aa, Entamoeba dispar
GNHLDLFIRDWKKYYPTKVMLYS

SEQ ID NO: 2525541 - protein, 21 aa, Entamoeba dispar
GNIAFWTLNNGTGLYEFLYDV

SEQ ID NO: 2525542 - protein, 21 aa, Entamoeba dispar
GNIAMWTLNNGTGLYEFLYDV

SEQ ID NO: 2525543 - protein, 19 aa, Entamoeba dispar
GNICFQWKEYREKIIIKLR

SEQ ID NO: 2525544 - protein, 22 aa, Entamoeba dispar
GNIEFVDFLLYNGARVEDKTFD

SEQ ID NO: 2525545 - protein, 27 aa, Entamoeba dispar
GNIERFHFNPIPLNEYSRRLFANIETF

SEQ ID NO: 2525546 - protein, 21 aa, Entamoeba dispar
GNIFIKMQSYLKGYNLYVANN

SEQ ID NO: 2525547 - protein, 19 aa, Entamoeba dispar
GNIIYPKSTLLKKGNRQKC

SEQ ID NO: 2525548 - protein, 17 aa, Entamoeba dispar
GNIKSAILLYWNVRARY

SEQ ID NO: 2525549 - protein, 23 aa, Entamoeba dispar
GNIQNYAMQLLRKLMGYNNGMDR

SEQ ID NO: 2525550 - protein, 23 aa, Entamoeba dispar
GNIRYCGLKLLGLMMTKHPKAVI

SEQ ID NO: 2525551 - protein, 27 aa, Entamoeba dispar
GNKKIYERFMYFISKDFINHKKSYVFC

SEQ ID NO: 2525552 - protein, 29 aa, Entamoeba dispar
GNKKIYGALYLFIEIIEKETIIYKLFTNG

SEQ ID NO: 2525553 - protein, 30 aa, Entamoeba dispar
GNKNQIAKFYTWINKWEKVIPDRRAVLLAG

SEQ ID NO: 2525554 - protein, 29 aa, Entamoeba dispar
GNLDDLDSFIILMKKWWCDGQPHIELNVL

SEQ ID NO: 2525555 - protein, 28 aa, Entamoeba dispar
GNLKLKNLPRHVLIPAFLIDSGIDSETR

SEQ ID NO: 2525556 - protein, 22 aa, Entamoeba dispar
GNLLLLLLSNHYLNTLLTIILE

SEQ ID NO: 2525557 - protein, 19 aa, Entamoeba dispar
GNLLVVERGTELYFKCSTC

SEQ ID NO: 2525558 - protein, 27 aa, Entamoeba dispar
GNMERFHFNPIPLNDYSRKLFPNIETF

SEQ ID NO: 2525559 - protein, 28 aa, Entamoeba dispar
GNMERFHFNPIPLSDYSRKFFPNIETFN

SEQ ID NO: 2525560 - protein, 26 aa, Entamoeba dispar
GNMNITLFSFILFKMEIHNMLCIYFD

SEQ ID NO: 2525561 - protein, 22 aa, Entamoeba dispar
GNMVFTQYKILDFVKGEFEPLK

SEQ ID NO: 2525562 - protein, 18 aa, Entamoeba dispar
GNNEYLIGFLEFVLNRDP

SEQ ID NO: 2525563 - protein, 23 aa, Entamoeba dispar
GNNEYLIGFLEFVLNRDPTKRPQ

SEQ ID NO: 2525564 - protein, 23 aa, Entamoeba dispar
GNNMPMGRFIPNNMPMGDDLAMD

SEQ ID NO: 2525565 - protein, 23 aa, Entamoeba dispar
GNNPPLIRIIDKSGYGLFGGNTN

SEQ ID NO: 2525566 - protein, 28 aa, Entamoeba dispar
GNNVSVRDWWYYPDLTYVTDVLHEQSTM

SEQ ID NO: 2525567 - protein, 18 aa, Entamoeba dispar
GNPFRRGGIIKTINYNEI

SEQ ID NO: 2525568 - protein, 17 aa, Entamoeba dispar
GNPLRKDPLFRMKIPSA

SEQ ID NO: 2525569 - protein, 30 aa, Entamoeba dispar
GNQPQFIVLIDLLRKLFVIQDSRLTWKQYL

SEQ ID NO: 2525570 - protein, 22 aa, Entamoeba dispar
GNQRFLMTILDPAVAPGQNKND

SEQ ID NO: 2525571 - protein, 31 aa, Entamoeba dispar
GNRFCLPLCIMYPYDYSFTPPLFFTDPTPEM

SEQ ID NO: 2525572 - protein, 27 aa, Entamoeba dispar
GNSWNNLTRLIFPPSLKKIGAGCFNNV

SEQ ID NO: 2525573 - protein, 27 aa, Entamoeba dispar
GNTDGCPAFYKFLDLLGTKIELQGFDK

SEQ ID NO: 2525574 - protein, 34 aa, Entamoeba dispar
GNTIFDVRLLNSFKQYVLPFVPLKTTIDELQMKQ

SEQ ID NO: 2525575 - protein, 28 aa, Entamoeba dispar
GNTINPHSIIDFLYNFFEQKMNTSCEDE

SEQ ID NO: 2525576 - protein, 24 aa, Entamoeba dispar
GNTMQYYVPVLSIVDRELLEPGVQ

SEQ ID NO: 2525577 - protein, 24 aa, Entamoeba dispar
GNTPNLLPELTGSYLKIIDVELHD

SEQ ID NO: 2525578 - protein, 26 aa, Entamoeba dispar
GNVDSFCYFSFNKEKYFLVGDHSGRI

SEQ ID NO: 2525579 - protein, 26 aa, Entamoeba dispar
GNVKKDIPALWFKCSMKSSTSIEPVT

SEQ ID NO: 2525580 - protein, 25 aa, Entamoeba dispar
GNVKMLMGFFRALMVWETSLKKSLL

SEQ ID NO: 2525581 - protein, 29 aa, Entamoeba dispar
GNVQPCEWGIPCDLLLLKEVKKYGLESPK

SEQ ID NO: 2525582 - protein, 17 aa, Entamoeba dispar
GNWMQRTLKYLFDKNKD

SEQ ID NO: 2525583 - protein, 20 aa, Entamoeba dispar
GNYHLILCYVLKSDKVKTID

SEQ ID NO: 2525584 - protein, 18 aa, Entamoeba dispar
GPAGLAAAYFLRLKGHKV

SEQ ID NO: 2525585 - protein, 19 aa, Entamoeba dispar
GPAHPTNVHACDWDYGLIA

SEQ ID NO: 2525586 - protein, 23 aa, Entamoeba dispar
GPCKMISPVFIELAQDYPLIKCI

SEQ ID NO: 2525587 - protein, 27 aa, Entamoeba dispar
GPCLDCIISLFPPQKTFPMCTIASQPR

SEQ ID NO: 2525588 - protein, 17 aa, Entamoeba dispar
GPCRFISPIFEQYSRQY

SEQ ID NO: 2525589 - protein, 22 aa, Entamoeba dispar
GPCYKCLYPVMPSTTLNATAKT

SEQ ID NO: 2525590 - protein, 24 aa, Entamoeba dispar
GPDKQLMYFVKWVGLQYSECSWEK

SEQ ID NO: 2525591 - protein, 18 aa, Entamoeba dispar
GPEEFFVFSLNNSKGFNP

SEQ ID NO: 2525592 - protein, 18 aa, Entamoeba dispar
GPFLIITDKENLGFYQEN

SEQ ID NO: 2525593 - protein, 18 aa, Entamoeba dispar
GPGPMRRQRINPMGYRPM

SEQ ID NO: 2525594 - protein, 18 aa, Entamoeba dispar
GPIGIVFAPIRELAEQIN

SEQ ID NO: 2525595 - protein, 24 aa, Entamoeba dispar
GPKFLEKLGFMNILEQVAKNINKK

SEQ ID NO: 2525596 - protein, 30 aa, Entamoeba dispar
GPKINIIPGFWYTVLHNAGLFDYYATNPTD

SEQ ID NO: 2525597 - protein, 21 aa, Entamoeba dispar
GPLAKVWIAAHWEGKLTKQQI

SEQ ID NO: 2525598 - protein, 18 aa, Entamoeba dispar
GPLKLLEYPFSDQQIREL

SEQ ID NO: 2525599 - protein, 18 aa, Entamoeba dispar
GPLQKFLTRRITLLRVHE

SEQ ID NO: 2525600 - protein, 19 aa, Entamoeba dispar
GPNDMKVAEKIFLGRRERT

SEQ ID NO: 2525601 - protein, 18 aa, Entamoeba dispar
GPNKTQCILWEFYQSISK

SEQ ID NO: 2525602 - protein, 22 aa, Entamoeba dispar
GPNNFWYITNPSDVRAYSICLF

SEQ ID NO: 2525603 - protein, 25 aa, Entamoeba dispar
GPPKAVECVLIMDGFKMGIYKQKLL

SEQ ID NO: 2525604 - protein, 23 aa, Entamoeba dispar
GPSIEYLWIVDKKATSLPAQKYC

SEQ ID NO: 2525605 - protein, 25 aa, Entamoeba dispar
GPSLKPFTCMIAGSYWANLTVISKS

SEQ ID NO: 2525606 - protein, 38 aa, Entamoeba dispar
GPSLQIGKTFLVSSYLFDLYELFFPLNDNSKKMQTYAK

SEQ ID NO: 2525607 - protein, 19 aa, Entamoeba dispar
GPSLWLANQIQLNKLKKYN

SEQ ID NO: 2525608 - protein, 17 aa, Entamoeba dispar
GPTRVEGFWTYDENYPF

SEQ ID NO: 2525609 - protein, 29 aa, Entamoeba dispar
GPTSTNPLYALRILSRFITTTTMPAYSPH

SEQ ID NO: 2525610 - protein, 25 aa, Entamoeba dispar
GPVLYKIHLIPEYSLMVALKLSRIV

SEQ ID NO: 2525611 - protein, 18 aa, Entamoeba dispar
GPVSVFIKLNQNGRFIEG

SEQ ID NO: 2525612 - protein, 18 aa, Entamoeba dispar
GPYALILAPTRELALQIQ

SEQ ID NO: 2525613 - protein, 17 aa, Entamoeba dispar
GPYPMVGPMFVPPPIYY

SEQ ID NO: 2525614 - protein, 18 aa, Entamoeba dispar
GQALEKMIIYGKAGEGFL

SEQ ID NO: 2525615 - protein, 20 aa, Entamoeba dispar
GQCDLPFRRISGGSNIFGKT

SEQ ID NO: 2525616 - protein, 23 aa, Entamoeba dispar
GQCDLPFRRISGGTNIFAKTAGV

SEQ ID NO: 2525617 - protein, 28 aa, Entamoeba dispar
GQDELRVFWNSKVIVYKHLIENGYKVRP

SEQ ID NO: 2525618 - protein, 23 aa, Entamoeba dispar
GQDLSDDKIGLKVLYKLMDADGD

SEQ ID NO: 2525619 - protein, 19 aa, Entamoeba dispar
GQEHLILKICDFGLSRFNS

SEQ ID NO: 2525620 - protein, 29 aa, Entamoeba dispar
GQEKFRTIINSYYRGVQGAVLIYDVTNKS

SEQ ID NO: 2525621 - protein, 22 aa, Entamoeba dispar
GQEPVRFRLQFKGWDQRKIVDR

SEQ ID NO: 2525622 - protein, 25 aa, Entamoeba dispar
GQERYRSLIPNYIRGASVVVIVYDI

SEQ ID NO: 2525623 - protein, 24 aa, Entamoeba dispar
GQEWKYYEVLKRITETYELVIKKR

SEQ ID NO: 2525624 - protein, 17 aa, Entamoeba dispar
GQFIVTCQHKLPKEERI

SEQ ID NO: 2525625 - protein, 24 aa, Entamoeba dispar
GQFKSIPIAIKEPLYRIATCAPHL

SEQ ID NO: 2525626 - protein, 17 aa, Entamoeba dispar
GQFMLATSKSVFLWLCD

SEQ ID NO: 2525627 - protein, 24 aa, Entamoeba dispar
GQFWDLLQLFAVAGKPPSTKYIFL

SEQ ID NO: 2525628 - protein, 26 aa, Entamoeba dispar
GQIPWRSPDIFYKKNQLFLDVIESVN

SEQ ID NO: 2525629 - protein, 17 aa, Entamoeba dispar
GQKHFYLVGFYGNTFDK

SEQ ID NO: 2525630 - protein, 23 aa, Entamoeba dispar
GQKIFEFFSQPIPVKCSILDQPL

SEQ ID NO: 2525631 - protein, 38 aa, Entamoeba dispar
GQKTVVALSLIFAIQRCDPAPFYLFDEIDSNLDTLYRE

SEQ ID NO: 2525632 - protein, 26 aa, Entamoeba dispar
GQLFTVWFNTWFVKGTTLTLTKLELD

SEQ ID NO: 2525633 - protein, 25 aa, Entamoeba dispar
GQLFVFCKFFTSKLSLVLLATKNES

SEQ ID NO: 2525634 - protein, 23 aa, Entamoeba dispar
GQLKKWEIKYYKGLGTSKDSDAK

SEQ ID NO: 2525635 - protein, 23 aa, Entamoeba dispar
GQLTSWDYSFFDLDQQKLFELII

SEQ ID NO: 2525636 - protein, 23 aa, Entamoeba dispar
GQMLYNCLVYLMSQNIETPLVNL

SEQ ID NO: 2525637 - protein, 25 aa, Entamoeba dispar
GQMPRSVIVILLDQLVDKGKPGDRV

SEQ ID NO: 2525638 - protein, 18 aa, Entamoeba dispar
GQMQDFFDKLFTAVIRMK

SEQ ID NO: 2525639 - protein, 33 aa, Entamoeba dispar
GQNQDLTLFELPRLPEYIKYLCVYSTNSNIVIN

SEQ ID NO: 2525640 - protein, 27 aa, Entamoeba dispar
GQPLVYRLIWICFVERKLRLVRHRKIK

SEQ ID NO: 2525641 - protein, 33 aa, Entamoeba dispar
GQQITPLLYVFDGIFPLNVGIVQLPPLEKVIGI

SEQ ID NO: 2525642 - protein, 21 aa, Entamoeba dispar
GQQYQFLQQELRYYKELLNEP

SEQ ID NO: 2525643 - protein, 22 aa, Entamoeba dispar
GQRTLFRVLRAWSMQDDLGYVQ

SEQ ID NO: 2525644 - protein, 28 aa, Entamoeba dispar
GQSVYQIEFKLKKLNNLLVDDLYIKMEL

SEQ ID NO: 2525645 - protein, 25 aa, Entamoeba dispar
GQTKIKLGFIVLSLLLSNYSVIYKL

SEQ ID NO: 2525646 - protein, 24 aa, Entamoeba dispar
GQVDTFVEFLIKTTLPLLRDPESM

SEQ ID NO: 2525647 - protein, 48 aa, Entamoeba dispar
GQVTMQPISYTQPIYQPPLNQYVIPPMQQVMPPTYGPGPMRRQRINPM

SEQ ID NO: 2525648 - protein, 28 aa, Entamoeba dispar
GQWQFGTTKLFIRLPESIFAIEEMLEKM

SEQ ID NO: 2525649 - protein, 21 aa, Entamoeba dispar
GQYSPIFFQFLDCVNILLHQF

SEQ ID NO: 2525650 - protein, 17 aa, Entamoeba dispar
GQYVLASFGMDSRIKLW

SEQ ID NO: 2525651 - protein, 25 aa, Entamoeba dispar
GRAMKGFMIPLLKNIINDFKTTDLV

SEQ ID NO: 2525652 - protein, 22 aa, Entamoeba dispar
GRATYYSILPSLIGKGSSVGGY

SEQ ID NO: 2525653 - protein, 17 aa, Entamoeba dispar
GRCISLICYDRLMWVIP

SEQ ID NO: 2525654 - protein, 26 aa, Entamoeba dispar
GRDEEIKRVIRILSRRTKNNPVLIGE

SEQ ID NO: 2525655 - protein, 24 aa, Entamoeba dispar
GRDIQFWRPMESLMKEDRSILKPQ

SEQ ID NO: 2525656 - protein, 25 aa, Entamoeba dispar
GRDIQFWRPMESLMKEDRSILKPQF

SEQ ID NO: 2525657 - protein, 25 aa, Entamoeba dispar
GRDQFLHLFVIKKDKCFPIGDKSLD

SEQ ID NO: 2525658 - protein, 22 aa, Entamoeba dispar
GRDTFISLRGLLLHTKRFNEAK

SEQ ID NO: 2525659 - protein, 28 aa, Entamoeba dispar
GREGNIIRMFLFRWKNGQHYINNEKIPI

SEQ ID NO: 2525660 - protein, 18 aa, Entamoeba dispar
GREHPLFSELYQLVSVSK

SEQ ID NO: 2525661 - protein, 19 aa, Entamoeba dispar
GREKFLEEVWKWKEEYGKG

SEQ ID NO: 2525662 - protein, 18 aa, Entamoeba dispar
GREKYLCKATQIPISYQL

SEQ ID NO: 2525663 - protein, 19 aa, Entamoeba dispar
GRELLVFMASAKPINCTTP

SEQ ID NO: 2525664 - protein, 25 aa, Entamoeba dispar
GRETSYFPFKGIHILCVVFDFSNDS

SEQ ID NO: 2525665 - protein, 27 aa, Entamoeba dispar
GRFEGTAYMPLLKKLKVMFLNDGNSLA

SEQ ID NO: 2525666 - protein, 19 aa, Entamoeba dispar
GRFILLNSKCDTLYKVSFN

SEQ ID NO: 2525667 - protein, 26 aa, Entamoeba dispar
GRFILTQYSFYFIPYVEESIVTKSGV

SEQ ID NO: 2525668 - protein, 19 aa, Entamoeba dispar
GRGFNRCLAILSLIEYKGN

SEQ ID NO: 2525669 - protein, 22 aa, Entamoeba dispar
GRGRIHEMFYFRGNYESPIYYD

SEQ ID NO: 2525670 - protein, 22 aa, Entamoeba dispar
GRIFKKVIWYKVDYSTYLKKKE

SEQ ID NO: 2525671 - protein, 19 aa, Entamoeba dispar
GRIITTLQLLELLLDFFAQ

SEQ ID NO: 2525672 - protein, 18 aa, Entamoeba dispar
GRILLIRQDSEGLIYIVG

SEQ ID NO: 2525673 - protein, 27 aa, Entamoeba dispar
GRITKEIIWYDISYSKYLKKKEAGNIC

SEQ ID NO: 2525674 - protein, 24 aa, Entamoeba dispar
GRITYPLVLIYSSPTGINPQFSMI

SEQ ID NO: 2525675 - protein, 23 aa, Entamoeba dispar
GRIVLVYRRPWAPNANDRTFTLK

SEQ ID NO: 2525676 - protein, 18 aa, Entamoeba dispar
GRIVSVGVGFWKVDINGK

SEQ ID NO: 2525677 - protein, 17 aa, Entamoeba dispar
GRKEHLINRLSLQPKHL

SEQ ID NO: 2525678 - protein, 28 aa, Entamoeba dispar
GRKGSPWEFNLRDILRFCKLYIEYNSNI

SEQ ID NO: 2525679 - protein, 23 aa, Entamoeba dispar
GRLAMTGSIRRYLAEHPKDFDPR

SEQ ID NO: 2525680 - protein, 25 aa, Entamoeba dispar
GRLEIEEVLVYFQQLIFAVEHFHSR

SEQ ID NO: 2525681 - protein, 26 aa, Entamoeba dispar
GRLKKGLIYNFGSNTCWHLYGIILRT

SEQ ID NO: 2525682 - protein, 25 aa, Entamoeba dispar
GRLKTDPVRVCRYLKMIIEGVRYLH

SEQ ID NO: 2525683 - protein, 25 aa, Entamoeba dispar
GRNAFKYIMPCQIVLPNSITRIESN

SEQ ID NO: 2525684 - protein, 26 aa, Entamoeba dispar
GRPAANAPMWYWFATEQGQAVDLNSL

SEQ ID NO: 2525685 - protein, 31 aa, Entamoeba dispar
GRPYYQLPRMIENILIYLYNKGCTTHGIFRE

SEQ ID NO: 2525686 - protein, 35 aa, Entamoeba dispar
GRQQDLFFFHVLSPGSCFWLPHGTRIYNKLVQLIR

SEQ ID NO: 2525687 - protein, 19 aa, Entamoeba dispar
GRQRGFVPLIIVGKQGKPI

SEQ ID NO: 2525688 - protein, 26 aa, Entamoeba dispar
GRSGTFIILLRIYEHHFYSILKGGGE

SEQ ID NO: 2525689 - protein, 26 aa, Entamoeba dispar
GRSYRTLSQYPIYPWVICSYDSKDFR

SEQ ID NO: 2525690 - protein, 25 aa, Entamoeba dispar
GRTKEIVINLLSKMYPMPTIETSKK

SEQ ID NO: 2525691 - protein, 22 aa, Entamoeba dispar
GRTTIRLFESLIRISQAHAKLM

SEQ ID NO: 2525692 - protein, 25 aa, Entamoeba dispar
GRVRDLFDRQFLKLDSIETIVLDEA

SEQ ID NO: 2525693 - protein, 26 aa, Entamoeba dispar
GRVVTAIIHSLFPKEFDYKSMTFKEP

SEQ ID NO: 2525694 - protein, 22 aa, Entamoeba dispar
GSADMKSGLASQLCVLKYLQDM

SEQ ID NO: 2525695 - protein, 30 aa, Entamoeba dispar
GSAMDAAKIMWLLYEHPEADFFAMKQKFID

SEQ ID NO: 2525696 - protein, 21 aa, Entamoeba dispar
GSAYQLSILVLFNQKNEITID

SEQ ID NO: 2525697 - protein, 25 aa, Entamoeba dispar
GSDEPTIIFIIDTLFPIEYQMKILQ

SEQ ID NO: 2525698 - protein, 17 aa, Entamoeba dispar
GSDLTIISMIKKYGICN

SEQ ID NO: 2525699 - protein, 18 aa, Entamoeba dispar
GSDLTIISMIKKYGICNK

SEQ ID NO: 2525700 - protein, 24 aa, Entamoeba dispar
GSDSNILVIFITGAISYSEMRVAY

SEQ ID NO: 2525701 - protein, 20 aa, Entamoeba dispar
GSEFIIDCDMVIQAISQGVE

SEQ ID NO: 2525702 - protein, 22 aa, Entamoeba dispar
GSEHWLLMKSAIYIVQFLSTMC

SEQ ID NO: 2525703 - protein, 23 aa, Entamoeba dispar
GSEMNLFVCTFIQNIINSSREDL

SEQ ID NO: 2525704 - protein, 40 aa, Entamoeba dispar
GSENIGITNLPRYLPYIIETCIPFLESITCFPLMEHPKQT

SEQ ID NO: 2525705 - protein, 18 aa, Entamoeba dispar
GSENVLLLMAMKVTYPQR

SEQ ID NO: 2525706 - protein, 17 aa, Entamoeba dispar
GSERIYFDPLCEDNFVV

SEQ ID NO: 2525707 - protein, 26 aa, Entamoeba dispar
GSFCNLPLLEHLTFIDSPGVLSGEKQ

SEQ ID NO: 2525708 - protein, 17 aa, Entamoeba dispar
GSFKAIIDYLKKQGDKH

SEQ ID NO: 2525709 - protein, 20 aa, Entamoeba dispar
GSFKAIIEYLKNQGAKHPNS

SEQ ID NO: 2525710 - protein, 23 aa, Entamoeba dispar
GSFKNSLDLFKLHSLPSSSFSIN

SEQ ID NO: 2525711 - protein, 19 aa, Entamoeba dispar
GSFLFKTPAFSIQAVRGRK

SEQ ID NO: 2525712 - protein, 23 aa, Entamoeba dispar
GSFRPIIEYLKKQGERHPESEAV

SEQ ID NO: 2525713 - protein, 24 aa, Entamoeba dispar
GSGCGICKNGYYRNGKGCSKCEKE

SEQ ID NO: 2525714 - protein, 23 aa, Entamoeba dispar
GSGCGICNKGYYRNGKGCSKCEK

SEQ ID NO: 2525715 - protein, 28 aa, Entamoeba dispar
GSGHELHFFCWIVLLVQLKVINEEEYPA

SEQ ID NO: 2525716 - protein, 26 aa, Entamoeba dispar
GSGKTLAFLIPIVEILNKIHFQTRNG

SEQ ID NO: 2525717 - protein, 30 aa, Entamoeba dispar; identical to SEQ ID NO: 2484158

SEQ ID NO: 2525718 - protein, 25 aa, Entamoeba dispar
GSGKTLAYLLPTITMILNKHPKLKR

SEQ ID NO: 2525719 - protein, 27 aa, Entamoeba dispar
GSGKTLAYTIPLIKHVMAQRPLSKGEG

SEQ ID NO: 2525720 - protein, 30 aa, Entamoeba dispar
GSGKTLAYTLPLLKLINPLFNHIQTVVLIP

SEQ ID NO: 2525721 - protein, 25 aa, Entamoeba dispar
GSGKTLAYVIPILNNLLVSQEEQRR

SEQ ID NO: 2525722 - protein, 24 aa, Entamoeba dispar
GSGKTLSFLIPLFEIIKREREIIE

SEQ ID NO: 2525723 - protein, 24 aa, Entamoeba dispar
GSGQLQFLSFFNNGRVRLNCKNLH

SEQ ID NO: 2525724 - protein, 17 aa, Entamoeba dispar
GSGYFGTILKWANEIKK

SEQ ID NO: 2525725 - protein, 19 aa, Entamoeba dispar
GSHFDGWFDLRGSPYGNEY

SEQ ID NO: 2525726 - protein, 46 aa, Entamoeba dispar
GSHFSSGYFLIVPSLFALTCWRRIVWHCVLPLALSERKYLTYEAGL

SEQ ID NO: 2525727 - protein, 32 aa, Entamoeba dispar
GSHRSLYQSSLSPLLFPLIQVLLDTSTTTEDT

SEQ ID NO: 2525728 - protein, 25 aa, Entamoeba dispar
GSHWTLLYIDLFSKMGYYYDSVPSH

SEQ ID NO: 2525729 - protein, 24 aa, Entamoeba dispar
GSIDQWCLGVLTFELCTGEPPFQS

SEQ ID NO: 2525730 - protein, 26 aa, Entamoeba dispar
GSIGFYEYLALMKYVKLTTAVFKKFD

SEQ ID NO: 2525731 - protein, 23 aa, Entamoeba dispar
GSIIGSFALFFKSTGSSLTSSGD

SEQ ID NO: 2525732 - protein, 20 aa, Entamoeba dispar
GSIIPKIYRIPKNLNVTLKK

SEQ ID NO: 2525733 - protein, 24 aa, Entamoeba dispar
GSISDIIFNLLDFCYEQGLSQNEI

SEQ ID NO: 2525734 - protein, 30 aa, Entamoeba dispar
GSKKFQEQAIWMLNAMWPKDQGKSAEELWN

SEQ ID NO: 2525735 - protein, 23 aa, Entamoeba dispar
GSKQLVKMFSPPINVDFLNKMFN

SEQ ID NO: 2525736 - protein, 17 aa, Entamoeba dispar
GSKTLYIKNLSFKTKED

SEQ ID NO: 2525737 - protein, 20 aa, Entamoeba dispar
GSLGLSLVRRFAFQILSALN

SEQ ID NO: 2525738 - protein, 17 aa, Entamoeba dispar
GSLLHYQHKFNTTVYCN

SEQ ID NO: 2525739 - protein, 17 aa, Entamoeba dispar
GSLLKICRKDNKERYFY

SEQ ID NO: 2525740 - protein, 23 aa, Entamoeba dispar
GSLLYALMEYLISPTVSPAIHSI

SEQ ID NO: 2525741 - protein, 26 aa, Entamoeba dispar
GSLNLLLEYDCLLTHLSQALLGAPLP

SEQ ID NO: 2525742 - protein, 20 aa, Entamoeba dispar
GSLQSILKRCGKIDIQVLKK

SEQ ID NO: 2525743 - protein, 24 aa, Entamoeba dispar
GSLSQIHIVFYDKVIIRGAQYYEQ

SEQ ID NO: 2525744 - protein, 25 aa, Entamoeba dispar
GSMDCEGDVMKWVNTTLGSKRMTNY

SEQ ID NO: 2525745 - protein, 23 aa, Entamoeba dispar
GSNAFYNCRLLSYISISTSSSLK

SEQ ID NO: 2525746 - protein, 23 aa, Entamoeba dispar
GSNLLDLIKYYDYKGIPINDCKE

SEQ ID NO: 2525747 - protein, 22 aa, Entamoeba dispar
GSNPFGNFTTTNSTTPSTTTGT

SEQ ID NO: 2525748 - protein, 30 aa, Entamoeba dispar
GSPEDLITIPFNMFLKPLSLSPTTSSQIST

SEQ ID NO: 2525749 - protein, 27 aa, Entamoeba dispar
GSPIIQLQQILFWGIPESNSAIIKIAL

SEQ ID NO: 2525750 - protein, 20 aa, Entamoeba dispar
GSPISLFYSNQQKNQLFKIK

SEQ ID NO: 2525751 - protein, 25 aa, Entamoeba dispar
GSPRQPNCPLALSTPLPLPSNTLTE

SEQ ID NO: 2525752 - protein, 17 aa, Entamoeba dispar
GSPYKPIHFNKSNHLSM

SEQ ID NO: 2525753 - protein, 30 aa, Entamoeba dispar
GSQFNKGIPVFWFQVLKNSMLFDSANGSEA

SEQ ID NO: 2525754 - protein, 25 aa, Entamoeba dispar
GSSDAVVPPPLPPSSRGLGARPAQS

SEQ ID NO: 2525755 - protein, 27 aa, Entamoeba dispar
GSSEYERIRFLFLTSALLKAVDEHYDL

SEQ ID NO: 2525756 - protein, 29 aa, Entamoeba dispar
GSSGRISLYRALIKQLGLTPLMVLDNETC

SEQ ID NO: 2525757 - protein, 17 aa, Entamoeba dispar
GSSLFGLKPFDIEITIT

SEQ ID NO: 2525758 - protein, 28 aa, Entamoeba dispar
GSSYFEHFLNLLGNKIELFGYQGFVGGL

SEQ ID NO: 2525759 - protein, 24 aa, Entamoeba dispar
GSTCLCIFICDKKFYIANTGDCKC

SEQ ID NO: 2525760 - protein, 23 aa, Entamoeba dispar
GSTFDLKRLCRVTGATPFISLTT

SEQ ID NO: 2525761 - protein, 31 aa, Entamoeba dispar
GSTHYYIRTRDGFILMYSITSRYSFDLIQDI

SEQ ID NO: 2525762 - protein, 18 aa, Entamoeba dispar
GSTLFKLQYFNEPAYLTQ

SEQ ID NO: 2525763 - protein, 32 aa, Entamoeba dispar
GSTNYKRFWIQQISVVLLPQLSQYLSFDECKL

SEQ ID NO: 2525764 - protein, 29 aa, Entamoeba dispar
GSTSILIVPSFLKELYINDYFGSIVNCHE

SEQ ID NO: 2525765 - protein, 26 aa, Entamoeba dispar
GSTVVNLFFFEDCDSFIGSFSSIASI

SEQ ID NO: 2525766 - protein, 25 aa, Entamoeba dispar
GSVDGAVYVWNLTTSKFACCVYPEV

SEQ ID NO: 2525767 - protein, 20 aa, Entamoeba dispar
GSVDNLIDLVWSNDGFFKDQ

SEQ ID NO: 2525768 - protein, 30 aa, Entamoeba dispar
GSVDWWTFGIFMYEILYGRTPFFSRNRDQV

SEQ ID NO: 2525769 - protein, 22 aa, Entamoeba dispar
GSVFDVAILASITALLTRLFNK

SEQ ID NO: 2525770 - protein, 33 aa, Entamoeba dispar
GSVKNWKKRWFVLKPTRLWYFKAKNSTSAQGYI

SEQ ID NO: 2525771 - protein, 18 aa, Entamoeba dispar
GSVLLSPISLTPPKGVIV

SEQ ID NO: 2525772 - protein, 19 aa, Entamoeba dispar
GSVRVRLVPAPRGTGIVAA

SEQ ID NO: 2525773 - protein, 20 aa, Entamoeba dispar
GSVRVRLVPAPRGTGIVAAP

SEQ ID NO: 2525774 - protein, 29 aa, Entamoeba dispar
GSVVFLKGFINSIFYRKSNPKRKYIIVTH

SEQ ID NO: 2525775 - protein, 28 aa, Entamoeba dispar
GSWKSWKRRFFVLKDRKLWYFESENSTT

SEQ ID NO: 2525776 - protein, 25 aa, Entamoeba dispar
GSYIKILLRSAISSSPYKALEIYGN

SEQ ID NO: 2525777 - protein, 28 aa, Entamoeba dispar
GSYNPIHYIHLLLFELTKNYFKEHGRNV

SEQ ID NO: 2525778 - protein, 26 aa, Entamoeba dispar
GTAFARTFIYILELIKYLENIGADPI

SEQ ID NO: 2525779 - protein, 21 aa, Entamoeba dispar
GTAIITTLLLRNKKKYALIVD

SEQ ID NO: 2525780 - protein, 25 aa, Entamoeba dispar
GTAKSQLLKYSQKLAPRAVFTTGRG

SEQ ID NO: 2525781 - protein, 42 aa, Entamoeba dispar
GTANPTWASVTYGIFLCIQCAGLHRGLGVHLTFVRSVDMDEW

SEQ ID NO: 2525782 - protein, 20 aa, Entamoeba dispar
GTCFYGCKLLKNINIKNVQF

SEQ ID NO: 2525783 - protein, 25 aa, Entamoeba dispar
GTDYSLYSLIKKACTFIKNEKKIKC

SEQ ID NO: 2525784 - protein, 46 aa, Entamoeba dispar
GTEDFAPHGIPLDLLDRLLVIVTKQYTLQELLKIINIRAGIENVEL

SEQ ID NO: 2525785 - protein, 20 aa, Entamoeba dispar
GTEIFLRCTSPLSELRTIIE

SEQ ID NO: 2525786 - protein, 17 aa, Entamoeba dispar
GTELFVSRLLKRIANEM

SEQ ID NO: 2525787 - protein, 18 aa, Entamoeba dispar
GTEQLLRNAINNNNTFFS

SEQ ID NO: 2525788 - protein, 21 aa, Entamoeba dispar
GTFAVIPFTRVGKRYDVCLVS

SEQ ID NO: 2525789 - protein, 27 aa, Entamoeba dispar
GTFCIPFEFFEDVLPLIITTLSKVEKI

SEQ ID NO: 2525790 - protein, 22 aa, Entamoeba dispar
GTFDICILNINKGIFQVKATNG

SEQ ID NO: 2525791 - protein, 25 aa, Entamoeba dispar
GTFFKKLLPIVFTENSLCLAVMKTF

SEQ ID NO: 2525792 - protein, 26 aa, Entamoeba dispar
GTFKYPLGCAVSKSGWRYPIPIYRGI

SEQ ID NO: 2525793 - protein, 17 aa, Entamoeba dispar
GTFNYYVKDTEIKDIIS

SEQ ID NO: 2525794 - protein, 17 aa, Entamoeba dispar
GTFSQLYEIPEDIDIKN

SEQ ID NO: 2525795 - protein, 17 aa, Entamoeba dispar
GTGIYVTENGRGCIIDC

SEQ ID NO: 2525796 - protein, 23 aa, Entamoeba dispar
GTGKGLTFYISGVVTGICVIHTA

SEQ ID NO: 2525797 - protein, 22 aa, Entamoeba dispar
GTGVKVCTVIGFPLGATPSDVK

SEQ ID NO: 2525798 - protein, 25 aa, Entamoeba dispar
GTHDGSFIYLNKYTDAKSISHRHAI

SEQ ID NO: 2525799 - protein, 24 aa, Entamoeba dispar
GTIIKECLLLKNQMGQMIITTKKS

SEQ ID NO: 2525800 - protein, 24 aa, Entamoeba dispar
GTIKTFISEIPKWGTKNYDCSKDL

SEQ ID NO: 2525801 - protein, 23 aa, Entamoeba dispar
GTINGFYVFDINNPSKAKFHEKI

SEQ ID NO: 2525802 - protein, 19 aa, Entamoeba dispar
GTIYYRLNPFVVKYNEIET

SEQ ID NO: 2525803 - protein, 24 aa, Entamoeba dispar
GTKDLMVFVFDNKNNIFGGFTRSC

SEQ ID NO: 2525804 - protein, 19 aa, Entamoeba dispar
GTKLVDCVHLLPSHFHQLL

SEQ ID NO: 2525805 - protein, 23 aa, Entamoeba dispar
GTKRMSEIAGYIRDMAYILGSED

SEQ ID NO: 2525806 - protein, 25 aa, Entamoeba dispar
GTKVDFILKCIKIIGNIPGIKLAVL

SEQ ID NO: 2525807 - protein, 24 aa, Entamoeba dispar
GTLHLPRKSAFLLGKYEDIIFEQS

SEQ ID NO: 2525808 - protein, 19 aa, Entamoeba dispar
GTLKTLLKNRMRPFQDADT

SEQ ID NO: 2525809 - protein, 22 aa, Entamoeba dispar
GTLLSYPFDVLLVRSIHNYSTG

SEQ ID NO: 2525810 - protein, 23 aa, Entamoeba dispar
GTMTKIVFWIPGDTDIDLPKYVE

SEQ ID NO: 2525811 - protein, 31 aa, Entamoeba dispar
GTNEPINIKLPFLLKFLSIKNPLSLQIHPDA

SEQ ID NO: 2525812 - protein, 18 aa, Entamoeba dispar
GTNHYFAMKILIKKQMEE

SEQ ID NO: 2525813 - protein, 17 aa, Entamoeba dispar
GTPFWMAPELIKSQNYD

SEQ ID NO: 2525814 - protein, 28 aa, Entamoeba dispar
GTPNTTTQPQFGTTPSFGGFNTNQTSGT

SEQ ID NO: 2525815 - protein, 24 aa, Entamoeba dispar
GTPPKFLEPLPKLSRPTLKRTIPG

SEQ ID NO: 2525816 - protein, 21 aa, Entamoeba dispar
GTPSIYIFDCNCAGRIITWCK

SEQ ID NO: 2525817 - protein, 27 aa, Entamoeba dispar
GTPVYKFLCPYLLKTNKHQPKGLFIGN

SEQ ID NO: 2525818 - protein, 50 aa, Entamoeba dispar
GTQGLFDFIRNKLVIQLMKFFERELLTIRSLYTFNTSCAIFIQKPRGMTV

SEQ ID NO: 2525819 - protein, 19 aa, Entamoeba dispar
GTQYFVFHPVVRAAIVEHP

SEQ ID NO: 2525820 - protein, 26 aa, Entamoeba dispar
GTREINIFLFRWGKGNHYIINNNIKV

SEQ ID NO: 2525821 - protein, 19 aa, Entamoeba dispar
GTRFIAEPGRYLASNVFHL

SEQ ID NO: 2525822 - protein, 17 aa, Entamoeba dispar
GTRSALFTPFKNLGVIV

SEQ ID NO: 2525823 - protein, 25 aa, Entamoeba dispar
GTSEGVIFGWIKKQKKFELIFAVYA

SEQ ID NO: 2525824 - protein, 17 aa, Entamoeba dispar
GTSLNILPIYSIGNIQL

SEQ ID NO: 2525825 - protein, 25 aa, Entamoeba dispar
GTTDKKVMVWVIKPSSQNENSLLEF

SEQ ID NO: 2525826 - protein, 36 aa, Entamoeba dispar
GTTIDFISQYFNIPRQYFYLIKNGKLKYEGHNGEVL

SEQ ID NO: 2525827 - protein, 25 aa, Entamoeba dispar
GTVAKLIMIIKLIKDIIIMADIDID

SEQ ID NO: 2525828 - protein, 27 aa, Entamoeba dispar
GTVNKLSFVFGLHRLSLDKKVPEEVSF

SEQ ID NO: 2525829 - protein, 26 aa, Entamoeba dispar
GTVNKVISKLPLITTGSFSAYSVDKS

SEQ ID NO: 2525830 - protein, 24 aa, Entamoeba dispar
GTVTLHNIGFIKDVFREMVLLPSQ

SEQ ID NO: 2525831 - protein, 21 aa, Entamoeba dispar
GTVYFHTILLNLKFGSYESIL

SEQ ID NO: 2525832 - protein, 18 aa, Entamoeba dispar
GTWFHLAICIYPNQQILC

SEQ ID NO: 2525833 - protein, 22 aa, Entamoeba dispar
GTYVLIPYMRGNLSRTSFKVMI

SEQ ID NO: 2525834 - protein, 31 aa, Entamoeba dispar
GVAFTRLQTKFLKERFPKLGDSLISFGPCQT

SEQ ID NO: 2525835 - protein, 18 aa, Entamoeba dispar
GVAPSLPGRPLGAPPRKP

SEQ ID NO: 2525836 - protein, 23 aa, Entamoeba dispar
GVDLLNSLIIPKVNIDDIKQETE

SEQ ID NO: 2525837 - protein, 19 aa, Entamoeba dispar
GVDNMTICPGAKVLYIGAA

SEQ ID NO: 2525838 - protein, 28 aa, Entamoeba dispar
GVDPMYYLNTFGLFFKNYINSYEPLLNM

SEQ ID NO: 2525839 - protein, 19 aa, Entamoeba dispar
GVDWIVQYDCPEDTAQYIH

SEQ ID NO: 2525840 - protein, 17 aa, Entamoeba dispar
GVEKIRQLYKKCEMKVP

SEQ ID NO: 2525841 - protein, 18 aa, Entamoeba dispar
GVEKYMYFFKNAFELYEN

SEQ ID NO: 2525842 - protein, 34 aa, Entamoeba dispar
GVENFKRVGMLHFLTYYYGMDWHKVANAPQGDNT

SEQ ID NO: 2525843 - protein, 17 aa, Entamoeba dispar
GVETPTFSRFYLLIVQY

SEQ ID NO: 2525844 - protein, 26 aa, Entamoeba dispar
GVEVLCLLYALKIKYPDNIHFIRGNH

SEQ ID NO: 2525845 - protein, 23 aa, Entamoeba dispar
GVFEIIPKKIYQVRAFTLDLANF

SEQ ID NO: 2525846 - protein, 17 aa, Entamoeba dispar
GVFFSSRWTPYRRAENK

SEQ ID NO: 2525847 - protein, 26 aa, Entamoeba dispar
GVFYNLTTQILKLIDQQKYGIFTDSI

SEQ ID NO: 2525848 - protein, 22 aa, Entamoeba dispar
GVGARFWPLSRESKPKQFLDIM

SEQ ID NO: 2525849 - protein, 18 aa, Entamoeba dispar
GVGIAFIRKSRSFEDTHV

SEQ ID NO: 2525850 - protein, 25 aa, Entamoeba dispar
GVIFDKSIRIINIADKSLFVEKEIK

SEQ ID NO: 2525851 - protein, 24 aa, Entamoeba dispar
GVIKAFGAFYILPSSILNSYEYSE

SEQ ID NO: 2525852 - protein, 24 aa, Entamoeba dispar
GVKNFKGIHYLGGRFIPLELKDKL

SEQ ID NO: 2525853 - protein, 19 aa, Entamoeba dispar
GVKVIFADETVVNYLINMK

SEQ ID NO: 2525854 - protein, 20 aa, Entamoeba dispar
GVKWMYELFKQHAGGIVGDE

SEQ ID NO: 2525855 - protein, 20 aa, Entamoeba dispar
GVLAVWLALLEGEKVIITST

SEQ ID NO: 2525856 - protein, 25 aa, Entamoeba dispar
GVLGNLKVIIPWSDLLHKPIEVVLS

SEQ ID NO: 2525857 - protein, 19 aa, Entamoeba dispar
GVLLFGTIDTWIIYNLTGG

SEQ ID NO: 2525858 - protein, 25 aa, Entamoeba dispar
GVLLSKMSVIIPYIYTQFKYDGMST

SEQ ID NO: 2525859 - protein, 23 aa, Entamoeba dispar
GVLQFIPYIKRLNKIRIEILLRV

SEQ ID NO: 2525860 - protein, 19 aa, Entamoeba dispar
GVLSYKYSSKFIKILANKI

SEQ ID NO: 2525861 - protein, 18 aa, Entamoeba dispar
GVLTFELCTGKVPFFSSN

SEQ ID NO: 2525862 - protein, 27 aa, Entamoeba dispar
GVMSFDHNRFLFNGNAKIIDESAMDME

SEQ ID NO: 2525863 - protein, 38 aa, Entamoeba dispar
GVNDWAKLFKPRHLFCGYYIFIEFIVTSSSLEGLTTTI

SEQ ID NO: 2525864 - protein, 20 aa, Entamoeba dispar
GVNPSVIARAFHLASAKSAE

SEQ ID NO: 2525865 - protein, 17 aa, Entamoeba dispar
GVNWITYAFSQNTNVIL

SEQ ID NO: 2525866 - protein, 20 aa, Entamoeba dispar
GVPEKGKYPLGLSFEIVNQS

SEQ ID NO: 2525867 - protein, 23 aa, Entamoeba dispar
GVPEVMLHLRSLGLLHEDVMTVT

SEQ ID NO: 2525868 - protein, 28 aa, Entamoeba dispar
GVPLEHETKWFIMAKTSFGLEVMNCVIR

SEQ ID NO: 2525869 - protein, 24 aa, Entamoeba dispar
GVPLTILSLLSLYLDLIGMEQIYI

SEQ ID NO: 2525870 - protein, 24 aa, Entamoeba dispar
GVPPKQPPYRRFFSSIPCSLNKTE

SEQ ID NO: 2525871 - protein, 23 aa, Entamoeba dispar
GVPSRVEILISKYLNKFTEDINK

SEQ ID NO: 2525872 - protein, 17 aa, Entamoeba dispar
GVQAVVIVLDFNKEVLS

SEQ ID NO: 2525873 - protein, 21 aa, Entamoeba dispar
GVQINIPCYDYFWKCHNLKNT

SEQ ID NO: 2525874 - protein, 22 aa, Entamoeba dispar
GVRSVLFLDNYLVIGGGSGSVS

SEQ ID NO: 2525875 - protein, 24 aa, Entamoeba dispar
GVRTLVQLIILKRVVENFPHFLDN

SEQ ID NO: 2525876 - protein, 28 aa, Entamoeba dispar
GVRYRLQAKLQIIPLKRKEGSEKAIALS

SEQ ID NO: 2525877 - protein, 27 aa, Entamoeba dispar
GVSTPPDALLIIIDLTQPTSFEWARNY

SEQ ID NO: 2525878 - protein, 17 aa, Entamoeba dispar
GVVFFVMATKEYPFMHK

SEQ ID NO: 2525879 - protein, 29 aa, Entamoeba dispar
GVVIGETAILGEWCRIYQSVTLGAMHFQE

SEQ ID NO: 2525880 - protein, 29 aa, Entamoeba dispar
GVVPPVYDKLSISGFYIQQKQKSIPLTKT

SEQ ID NO: 2525881 - protein, 17 aa, Entamoeba dispar
GVVQCNDGWFNDDGTCK

SEQ ID NO: 2525882 - protein, 24 aa, Entamoeba dispar
GVVQPIIYVLKNRSLFTSDDVLNC

SEQ ID NO: 2525883 - protein, 22 aa, Entamoeba dispar
GVYELYLNDSLLDYSLTMKMHF

SEQ ID NO: 2525884 - protein, 20 aa, Entamoeba dispar
GVYNFISQLLIIELKNREQF

SEQ ID NO: 2525885 - protein, 24 aa, Entamoeba dispar
GWCEDAIFFQQGTKFLLFRNGFIQ

SEQ ID NO: 2525886 - protein, 18 aa, Entamoeba dispar
GWELIDYILKFQPSLYQS

SEQ ID NO: 2525887 - protein, 18 aa, Entamoeba dispar
GWGVEVYLLTRDNLTIYN

SEQ ID NO: 2525888 - protein, 18 aa, Entamoeba dispar
GWIDIRINLSNKIKKYYY

SEQ ID NO: 2525889 - protein, 19 aa, Entamoeba dispar
GWINVKWESGKVNQYRWGE

SEQ ID NO: 2525890 - protein, 27 aa, Entamoeba dispar
GWKINLAICYDLRFPNWLRNSKEDPYD

SEQ ID NO: 2525891 - protein, 19 aa, Entamoeba dispar
GWKVIVADWGAEACGDAVR

SEQ ID NO: 2525892 - protein, 17 aa, Entamoeba dispar
GWNIKFKNDIDRLQLSI

SEQ ID NO: 2525893 - protein, 18 aa, Entamoeba dispar
GWRLPLGNSFKFLNEIIS

SEQ ID NO: 2525894 - protein, 29 aa, Entamoeba dispar
GWVRVQIKLFTLWMDEVLQQRQMGVKDLA

SEQ ID NO: 2525895 - protein, 24 aa, Entamoeba dispar
GWVSNYFILKDGKLIHYRSSDNFL

SEQ ID NO: 2525896 - protein, 20 aa, Entamoeba dispar
GYALSYILPNNLYGVFGMGE

SEQ ID NO: 2525897 - protein, 24 aa, Entamoeba dispar
GYECFDRCLSLKELTIQNIKFISK

SEQ ID NO: 2525898 - protein, 22 aa, Entamoeba dispar
GYEDILLFDSITFLGRNYQKCF

SEQ ID NO: 2525899 - protein, 18 aa, Entamoeba dispar
GYFCLYPYASGVFSFRDR

SEQ ID NO: 2525900 - protein, 32 aa, Entamoeba dispar
GYFEHTFLTIERPLPLCFTIFSAPNYCDQYNN

SEQ ID NO: 2525901 - protein, 20 aa, Entamoeba dispar
GYFGTILKWANEIKKIGVFA

SEQ ID NO: 2525902 - protein, 22 aa, Entamoeba dispar
GYFICDYIYIITTFITKGTEFI

SEQ ID NO: 2525903 - protein, 17 aa, Entamoeba dispar
GYFIKQYIDRLRLTQTR

SEQ ID NO: 2525904 - protein, 25 aa, Entamoeba dispar
GYFPDFIEVNLPLHLIRFGTESQNS

SEQ ID NO: 2525905 - protein, 24 aa, Entamoeba dispar
GYGAYPGYPQQQYPGYPPQGQQQY

SEQ ID NO: 2525906 - protein, 21 aa, Entamoeba dispar
GYGCFYYCYSLKSINIPTSVS

SEQ ID NO: 2525907 - protein, 25 aa, Entamoeba dispar
GYGIDILTFLIDEYPMIFKEELEKH

SEQ ID NO: 2525908 - protein, 25 aa, Entamoeba dispar
GYIDFNYFNYISIRFTMAGLIEEDD

SEQ ID NO: 2525909 - protein, 27 aa, Entamoeba dispar
GYIDSIRDFIKPFMLRRLKTDVQKELP

SEQ ID NO: 2525910 - protein, 19 aa, Entamoeba dispar
GYIMMPLNPLYTKPQLERL

SEQ ID NO: 2525911 - protein, 26 aa, Entamoeba dispar
GYINEECFLLWLYDEVIPFVTEQRKK

SEQ ID NO: 2525912 - protein, 22 aa, Entamoeba dispar
GYKMYHKYFIEGSLGFEIENRN

SEQ ID NO: 2525913 - protein, 28 aa, Entamoeba dispar
GYKNWKKRYFVLKDKKLWYFDSKDSVSA

SEQ ID NO: 2525914 - protein, 18 aa, Entamoeba dispar
GYKPRIDVTNACGRLGPA

SEQ ID NO: 2525915 - protein, 17 aa, Entamoeba dispar
GYLAVVICGFVFIDQEC

SEQ ID NO: 2525916 - protein, 18 aa, Entamoeba dispar
GYLFNVSVMAMCCEPYLV

SEQ ID NO: 2525917 - protein, 31 aa, Entamoeba dispar
GYLQALYSDWTFFFSESSLDSLFSCFKYTQK

SEQ ID NO: 2525918 - protein, 19 aa, Entamoeba dispar
GYMLQILQAIQFLHSNNIL

SEQ ID NO: 2525919 - protein, 18 aa, Entamoeba dispar
GYNEIMITSKYFNDIKDF

SEQ ID NO: 2525920 - protein, 19 aa, Entamoeba dispar
GYNEIMITSKYFNDIKDFI

SEQ ID NO: 2525921 - protein, 21 aa, Entamoeba dispar
GYNEIMITSKYFNDIKDFINL

SEQ ID NO: 2525922 - protein, 19 aa, Entamoeba dispar
GYNSFISEFSSCYPNILFS

SEQ ID NO: 2525923 - protein, 17 aa, Entamoeba dispar
GYPLLKKYKHLVGHFGT

SEQ ID NO: 2525924 - protein, 22 aa, Entamoeba dispar
GYQCFDWCIALTRIDIPSRTKE

SEQ ID NO: 2525925 - protein, 26 aa, Entamoeba dispar
GYQIISSSLFLFYDYDDPLSTIDFKM

SEQ ID NO: 2525926 - protein, 24 aa, Entamoeba dispar
GYQRNLLVIKDRYPHVQYVAAGRI

SEQ ID NO: 2525927 - protein, 38 aa, Entamoeba dispar
GYQVIGAVLFFIKLKKEVQVFLIKRLNLMSKSVLKSLI

SEQ ID NO: 2525928 - protein, 26 aa, Entamoeba dispar
GYSIHPLFITIEYFNGGSLYSLINQS

SEQ ID NO: 2525929 - protein, 18 aa, Entamoeba dispar
GYSLIRLLAEPSAAVYAY

SEQ ID NO: 2525930 - protein, 23 aa, Entamoeba dispar
GYTHLIPKLFRNYDSLKRYDAFV

SEQ ID NO: 2525931 - protein, 34 aa, Entamoeba dispar
GYTHLIPKLFRNYDSLKRYDAFVLNMVIVQSTQA

SEQ ID NO: 2525932 - protein, 28 aa, Entamoeba dispar
GYTQFAVDYPYALTKHSFMLKYNSQYNQ

SEQ ID NO: 2525933 - protein, 22 aa, Entamoeba dispar
GYVCINCTQVVFLNTICAPQTI

SEQ ID NO: 2525934 - protein, 18 aa, Entamoeba dispar
GYVFGSFSSIQIPPPPRL

SEQ ID NO: 2525935 - protein, 19 aa, Entamoeba dispar
GYVILLHHFGYLTITSSDD

SEQ ID NO: 2525936 - protein, 32 aa, Entamoeba dispar
GYVLVEAKDRFRLLYTFLRKNKNKKTIVFMSS

SEQ ID NO: 2525937 - protein, 21 aa, Entamoeba dispar
GYYQLLFACSIRKFSTIYLFN

SEQ ID NO: 2525938 - protein, 19 aa, Entamoeba dispar
HAALRAAGPVPQPRHRCGN

SEQ ID NO: 2525939 - protein, 24 aa, Entamoeba dispar
HAEDVKQIFLYYDEILRCNREFAS

SEQ ID NO: 2525940 - protein, 20 aa, Entamoeba dispar
HAGLCHRVLVQLSYAIGVSH

SEQ ID NO: 2525941 - protein, 25 aa, Entamoeba dispar
HAGRGLAACHRPLPPARRRGTRGAI

SEQ ID NO: 2525942 - protein, 27 aa, Entamoeba dispar
HAHGRLEELIIWAFNKQIITKDNKNIL

SEQ ID NO: 2525943 - protein, 21 aa, Entamoeba dispar
HAIDLLKRIFLIASRPDRQND

SEQ ID NO: 2525944 - protein, 24 aa, Entamoeba dispar
HAIQLMYSPHNIGLLAITCIKRYL

SEQ ID NO: 2525945 - protein, 17 aa, Entamoeba dispar
HAIYELYNGKVAGMCLT

SEQ ID NO: 2525946 - protein, 25 aa, Entamoeba dispar
HAKFINQQIYFIYGTELFKINEELK

SEQ ID NO: 2525947 - protein, 28 aa, Entamoeba dispar
HAKFSPVCPATYRLMPKITVIKQNKKMS

SEQ ID NO: 2525948 - protein, 17 aa, Entamoeba dispar
HAKKPLYKPKDPAHPNL

SEQ ID NO: 2525949 - protein, 25 aa, Entamoeba dispar
HALFVEGLSLYHKDWKRIEGHVKTK

SEQ ID NO: 2525950 - protein, 18 aa, Entamoeba dispar
HALGAVMYEILLDGKRIV

SEQ ID NO: 2525951 - protein, 19 aa, Entamoeba dispar
HALLDGSLMCYHRLLLKGN

SEQ ID NO: 2525952 - protein, 20 aa, Entamoeba dispar
HALQFLYLDPHIVQPSFKSF

SEQ ID NO: 2525953 - protein, 28 aa, Entamoeba dispar
HALRWGVPVLSHQWLFDCIAERRLLSIN

SEQ ID NO: 2525954 - protein, 26 aa, Entamoeba dispar
HAMCDIIGFGSALIKFNQRFSYCPCC

SEQ ID NO: 2525955 - protein, 28 aa, Entamoeba dispar
HAMNRQGIIPIFLYATLGAEALDYIVKK

SEQ ID NO: 2525956 - protein, 17 aa, Entamoeba dispar
HANLSIDKIRLFSNIKK

SEQ ID NO: 2525957 - protein, 22 aa, Entamoeba dispar
HAQKYFLKLNKTAPSQPVTLNS

SEQ ID NO: 2525958 - protein, 20 aa, Entamoeba dispar
HAREFLKKPIEIICGGRSQV

SEQ ID NO: 2525959 - protein, 26 aa, Entamoeba dispar
HARHVILSYFYQFSPLKATYSLDEHG

SEQ ID NO: 2525960 - protein, 28 aa, Entamoeba dispar
HARVTSLPTILVLNPGSWKALQQTAKEY

SEQ ID NO: 2525961 - protein, 24 aa, Entamoeba dispar
HASIPTLPFSFYKTEMYQQSVAKS

SEQ ID NO: 2525962 - protein, 17 aa, Entamoeba dispar
HAVIRANILEDIQIRYI

SEQ ID NO: 2525963 - protein, 26 aa, Entamoeba dispar
HAVRKNRYIILPADFEKAYKKVVRKQ

SEQ ID NO: 2525964 - protein, 35 aa, Entamoeba dispar
HCDEFFQCELEPKEWLNISLIILSNIETQCTTLKI

SEQ ID NO: 2525965 - protein, 24 aa, Entamoeba dispar
HCDELTSCVILLLTKEFMGSKIRR

SEQ ID NO: 2525966 - protein, 26 aa, Entamoeba dispar
HCDGLYLTRVPWKISINQFAPAVKIK

SEQ ID NO: 2525967 - protein, 28 aa, Entamoeba dispar
HCDLLSVAIIPFKFLSKFYELSLQYRKI

SEQ ID NO: 2525968 - protein, 31 aa, Entamoeba dispar
HCFSAICHIYRLYPDLIPNASKLIYTAVNEE

SEQ ID NO: 2525969 - protein, 25 aa, Entamoeba dispar
HCGDSTAFALKKRKLKKLTHDQNTS

SEQ ID NO: 2525970 - protein, 20 aa, Entamoeba dispar
HCIHLKRKILEILVKCFFET

SEQ ID NO: 2525971 - protein, 18 aa, Entamoeba dispar
HCIPLSLPTFQGGTLLPD

SEQ ID NO: 2525972 - protein, 17 aa, Entamoeba dispar
HCKDWLDDFYSLVDQSK

SEQ ID NO: 2525973 - protein, 18 aa, Entamoeba dispar
HCKDWLDDFYSLVDQSKN

SEQ ID NO: 2525974 - protein, 17 aa, Entamoeba dispar
HCKILPNGNYEIGVHIA

SEQ ID NO: 2525975 - protein, 17 aa, Entamoeba dispar
HCKWVMEVIGCGFTLPV

SEQ ID NO: 2525976 - protein, 27 aa, Entamoeba dispar
HCMNQRFNYKLRLGRGFTLKELRAAKI

SEQ ID NO: 2525977 - protein, 29 aa, Entamoeba dispar
HCNLLGKFELTGIPPAPRGVPQIEVTFDI

SEQ ID NO: 2525978 - protein, 22 aa, Entamoeba dispar
HCNLSISSYKLLKGTNEIYCSV

SEQ ID NO: 2525979 - protein, 18 aa, Entamoeba dispar
HCNTTCSVISLLKSKMKV

SEQ ID NO: 2525980 - protein, 27 aa, Entamoeba dispar
HCQKPMLFMLQLYAPLEMAQSYHRVFY

SEQ ID NO: 2525981 - protein, 25 aa, Entamoeba dispar
HCRAFEVFMGGIYLEKIRLVPSKST

SEQ ID NO: 2525982 - protein, 17 aa, Entamoeba dispar
HCVNMVNEIIILKKKWI

SEQ ID NO: 2525983 - protein, 17 aa, Entamoeba dispar
HCYFFKRDILKQMEDTW

SEQ ID NO: 2525984 - protein, 18 aa, Entamoeba dispar
HCYTFQYLIGLYEQCRLK

SEQ ID NO: 2525985 - protein, 17 aa, Entamoeba dispar
HDCLTCQLKVSKARYCL

SEQ ID NO: 2525986 - protein, 24 aa, Entamoeba dispar
HDDCTIDFFNTLGVRISELTLIHR

SEQ ID NO: 2525987 - protein, 24 aa, Entamoeba dispar
HDDQVSFVLLALRLELQGIPDQVR

SEQ ID NO: 2525988 - protein, 25 aa, Entamoeba dispar
HDELTFLIPEIDFSPLFDPTQISAE

SEQ ID NO: 2525989 - protein, 17 aa, Entamoeba dispar
HDEVYSLLISCLFDLHV

SEQ ID NO: 2525990 - protein, 17 aa, Entamoeba dispar
HDFLQYLIQTHAVLFLP

SEQ ID NO: 2525991 - protein, 23 aa, Entamoeba dispar
HDGAIWDLQWHPVGHLLASCAHD

SEQ ID NO: 2525992 - protein, 24 aa, Entamoeba dispar
HDGKLNFFSDALNAKSCISSLIDI

SEQ ID NO: 2525993 - protein, 19 aa, Entamoeba dispar
HDIIRLKKVVEEFSNKLPV

SEQ ID NO: 2525994 - protein, 31 aa, Entamoeba dispar
HDITVNTPCLLFILLKITKLLIEIVEEGWAN

SEQ ID NO: 2525995 - protein, 28 aa, Entamoeba dispar
HDIYLKKGVILLFYTDYYLQVSNQMVFD

SEQ ID NO: 2525996 - protein, 27 aa, Entamoeba dispar
HDKDLRSLLLTDLRFSPDGSYLNVADD

SEQ ID NO: 2525997 - protein, 25 aa, Entamoeba dispar
HDKKIIWSTIIPFKVRSIIATETHV

SEQ ID NO: 2525998 - protein, 24 aa, Entamoeba dispar
HDLFVLLYCGDLKEQFRRVQKRGR

SEQ ID NO: 2525999 - protein, 24 aa, Entamoeba dispar
HDLKPENLLLTKDLQRIKVCDFGM

SEQ ID NO: 2526000 - protein, 26 aa, Entamoeba dispar
HDNDPFKSWTLWWKEKRNTYPSLSNI

SEQ ID NO: 2526001 - protein, 39 aa, Entamoeba dispar
HDNKYQITTIFKLKDTGLLKRLKDFMLIKVIQGSVHVPQ

SEQ ID NO: 2526002 - protein, 35 aa, Entamoeba dispar
HDNVVTFYEAFFLPAKKLMWMSMEYMDGGCLTDIL

SEQ ID NO: 2526003 - protein, 17 aa, Entamoeba dispar
HDQTLRYANLGYTPNEI

SEQ ID NO: 2526004 - protein, 20 aa, Entamoeba dispar
HDRFFIHRDIKPDNFVMGMR

SEQ ID NO: 2526005 - protein, 24 aa, Entamoeba dispar
HDSKNLVILEQLKHWYTPMIISDG

SEQ ID NO: 2526006 - protein, 29 aa, Entamoeba dispar
HDTSAPWLQILLFRLLSTIDLETTTQKIF

SEQ ID NO: 2526007 - protein, 18 aa, Entamoeba dispar
HDVRKYCSFLEFVGKIAG

SEQ ID NO: 2526008 - protein, 18 aa, Entamoeba dispar
HDVSFFLRPKHLKQWADA

SEQ ID NO: 2526009 - protein, 19 aa, Entamoeba dispar
HDYIIWMGDLNYRIEMEDS

SEQ ID NO: 2526010 - protein, 22 aa, Entamoeba dispar
HDYISQLTICDNTIFAAGGDGC

SEQ ID NO: 2526011 - protein, 30 aa, Entamoeba dispar
HECFSGCTSLVYIKIPISIISIGNKCFKNC

SEQ ID NO: 2526012 - protein, 23 aa, Entamoeba dispar
HEDMLFRVKFDLYNSQREKIETL

SEQ ID NO: 2526013 - protein, 21 aa, Entamoeba dispar
HEECLYCCYLYDILSKTNKEY

SEQ ID NO: 2526014 - protein, 24 aa, Entamoeba dispar
HEEGKLKIYLYPNEPFNPKDESDA

SEQ ID NO: 2526015 - protein, 25 aa, Entamoeba dispar
HEEGKLKIYLYPNKPFNPKDENDAI

SEQ ID NO: 2526016 - protein, 29 aa, Entamoeba dispar
HEEKRKVLLPFISRYYTLTSKLYQLFDLS

SEQ ID NO: 2526017 - protein, 17 aa, Entamoeba dispar
HEEPQIGLIIYVANLHF

SEQ ID NO: 2526018 - protein, 28 aa, Entamoeba dispar
HEEQYMRNFIYFLPYVMKHRDVYATIMN

SEQ ID NO: 2526019 - protein, 22 aa, Entamoeba dispar
HEEYYFYCLVDFTICCSKQPIG

SEQ ID NO: 2526020 - protein, 26 aa, Entamoeba dispar
HEFIEQLIYLYIPLDIFEKNLEKNQA

SEQ ID NO: 2526021 - protein, 17 aa, Entamoeba dispar
HEFLIKLFTKEVKLNQL

SEQ ID NO: 2526022 - protein, 17 aa, Entamoeba dispar
HEFLIPKKKDGSLYQLC

SEQ ID NO: 2526023 - protein, 18 aa, Entamoeba dispar
HEFNDKSLICIVQVFGDQ

SEQ ID NO: 2526024 - protein, 22 aa, Entamoeba dispar
HEFTLVIPHRTLTLTPEFLLTH

SEQ ID NO: 2526025 - protein, 25 aa, Entamoeba dispar
HEFVQLYYALFQSRVDELLKMYHQQ

SEQ ID NO: 2526026 - protein, 28 aa, Entamoeba dispar
HEIENHIYIVSKYYPKINTNIGFLKAKC

SEQ ID NO: 2526027 - protein, 27 aa, Entamoeba dispar
HEIVSPWLQISLFKLLSKIKLDSSANS

SEQ ID NO: 2526028 - protein, 25 aa, Entamoeba dispar
HEKEEYFEILLPLLGTLVEDKEVNI

SEQ ID NO: 2526029 - protein, 24 aa, Entamoeba dispar
HEKGKLKIYLYPNEEFNTIDESDA

SEQ ID NO: 2526030 - protein, 17 aa, Entamoeba dispar
HEKMNYEIPKLYYKMVF

SEQ ID NO: 2526031 - protein, 24 aa, Entamoeba dispar
HEMAKFYIAELLLAIDSIHQLNYI

SEQ ID NO: 2526032 - protein, 26 aa, Entamoeba dispar
HENIKKGILLLLFGGVHKTTKEGIAL

SEQ ID NO: 2526033 - protein, 25 aa, Entamoeba dispar
HENLDIIISSPFYRATQTAKFIAEE

SEQ ID NO: 2526034 - protein, 20 aa, Entamoeba dispar
HENQIWILLIEMLNMVEHNN

SEQ ID NO: 2526035 - protein, 31 aa, Entamoeba dispar
HERDINTDFLLLLIKKLITRNKTIKIIIMSA

SEQ ID NO: 2526036 - protein, 17 aa, Entamoeba dispar
HESDDVLMLITNQLKKD

SEQ ID NO: 2526037 - protein, 24 aa, Entamoeba dispar
HESDHITLLNTYNAWIENRKDAKW

SEQ ID NO: 2526038 - protein, 17 aa, Entamoeba dispar
HESLLLINCKDNKPFGG

SEQ ID NO: 2526039 - protein, 19 aa, Entamoeba dispar
HETGKLKIYLYPNEEFNQV

SEQ ID NO: 2526040 - protein, 24 aa, Entamoeba dispar
HETKHILEAIRFNDILISSNGALS

SEQ ID NO: 2526041 - protein, 17 aa, Entamoeba dispar
HETNTYSGVLRLFGKVT

SEQ ID NO: 2526042 - protein, 18 aa, Entamoeba dispar
HEVKLKRLDKKGISQSDN

SEQ ID NO: 2526043 - protein, 26 aa, Entamoeba dispar
HEVTYIFVYGYGRVAFMCGGLGCLLN

SEQ ID NO: 2526044 - protein, 25 aa, Entamoeba dispar
HEYAKEFLMNYLLTSLKPSLEELVK

SEQ ID NO: 2526045 - protein, 26 aa, Entamoeba dispar
HEYDKIETIIFPFSSKNKYGLIVYVN

SEQ ID NO: 2526046 - protein, 17 aa, Entamoeba dispar
HEYMKCIALLNKLQTNY

SEQ ID NO: 2526047 - protein, 17 aa, Entamoeba dispar
HFARILKKHLMTENNLG

SEQ ID NO: 2526048 - protein, 33 aa, Entamoeba dispar
HFARSYHFMFPIEPFKIITMIKPQEKCFGCGKE

SEQ ID NO: 2526049 - protein, 23 aa, Entamoeba dispar
HFCDYVWRDLLGNKTFLWNERFP

SEQ ID NO: 2526050 - protein, 21 aa, Entamoeba dispar
HFDEPFIYQLLLHCITFEPNS

SEQ ID NO: 2526051 - protein, 25 aa, Entamoeba dispar
HFEGETFILTRKSYLQQFTVLMEKM

SEQ ID NO: 2526052 - protein, 24 aa, Entamoeba dispar
HFEVFKLLCKLFTEIINRKPTNKM

SEQ ID NO: 2526053 - protein, 18 aa, Entamoeba dispar
HFFSIFHYIDLSKCVPLK

SEQ ID NO: 2526054 - protein, 36 aa, Entamoeba dispar
HFHVDHVGMLPWLTKFMDVPIYLSEPTQALLSLIIK

SEQ ID NO: 2526055 - protein, 18 aa, Entamoeba dispar
HFIFKDNTSPTASVDLVK

SEQ ID NO: 2526056 - protein, 20 aa, Entamoeba dispar
HFIFRRFSSVSKSLKIVDNR

SEQ ID NO: 2526057 - protein, 17 aa, Entamoeba dispar
HFIFSLSNSKGERRKFL

SEQ ID NO: 2526058 - protein, 19 aa, Entamoeba dispar
HFITQKRTILTLPQRDFSS

SEQ ID NO: 2526059 - protein, 19 aa, Entamoeba dispar
HFKASQFIVVSLKSGMFDN

SEQ ID NO: 2526060 - protein, 21 aa, Entamoeba dispar
HFKCEKLFQLIAKYDPKYFAT

SEQ ID NO: 2526061 - protein, 18 aa, Entamoeba dispar
HFKHKIGASWKKEYFWLS

SEQ ID NO: 2526062 - protein, 23 aa, Entamoeba dispar
HFKKNCRYDYQPEICKDFYETGY

SEQ ID NO: 2526063 - protein, 26 aa, Entamoeba dispar
HFKSTDIIFIYMYKMFTIKHIGETCF

SEQ ID NO: 2526064 - protein, 26 aa, Entamoeba dispar
HFLSEICSGLWYLHFNKHLLHRDLKL

SEQ ID NO: 2526065 - protein, 23 aa, Entamoeba dispar
HFLSKLVLFLKTGVEKLVLPALH

SEQ ID NO: 2526066 - protein, 24 aa, Entamoeba dispar
HFMKKCHGYWPELFCCQDGVSLTE

SEQ ID NO: 2526067 - protein, 25 aa, Entamoeba dispar
HFQESLFLKTLKYIHDYGFSYLTQE

SEQ ID NO: 2526068 - protein, 31 aa, Entamoeba dispar
HFTPEVISLWYRAPEILLKMPSYTSAVDMWS

SEQ ID NO: 2526069 - protein, 18 aa, Entamoeba dispar
HFVPNLTLGAPIVKCLHN

SEQ ID NO: 2526070 - protein, 18 aa, Entamoeba dispar
HFVSNPQPQPVTKKSFTT

SEQ ID NO: 2526071 - protein, 17 aa, Entamoeba dispar
HFVTLPNSLLSMTSLTS

SEQ ID NO: 2526072 - protein, 20 aa, Entamoeba dispar
HGALVVYDISNRDSFEYLQD

SEQ ID NO: 2526073 - protein, 23 aa, Entamoeba dispar
HGCCTLCLAKWDYEKIRIQKQDA

SEQ ID NO: 2526074 - protein, 27 aa, Entamoeba dispar
HGCSILDQLLLLQKLIKHYPSLIDNCN

SEQ ID NO: 2526075 - protein, 28 aa, Entamoeba dispar
HGDQLLEVFGFLDPIHVIKTLAGIVPGT

SEQ ID NO: 2526076 - protein, 27 aa, Entamoeba dispar
HGEAPPPVPPPRGGAPALPPPRRGTKN

SEQ ID NO: 2526077 - protein, 34 aa, Entamoeba dispar
HGGENQLFFIDKQIGWIISVFSRKALTVKENMHD

SEQ ID NO: 2526078 - protein, 22 aa, Entamoeba dispar
HGGFAIRHACDLIRKGELKVDV

SEQ ID NO: 2526079 - protein, 23 aa, Entamoeba dispar
HGGHYFSNRLINGKWICFNDRSV

SEQ ID NO: 2526080 - protein, 38 aa, Entamoeba dispar
HGGIVIEKGRREYWRIVNNKVRIWDRSGKIEELSGNEI

SEQ ID NO: 2526081 - protein, 18 aa, Entamoeba dispar
HGIEVEGIFRISGNNEYI

SEQ ID NO: 2526082 - protein, 21 aa, Entamoeba dispar
HGILMAYYQYLILARTERGKN

SEQ ID NO: 2526083 - protein, 30 aa, Entamoeba dispar
HGIPFSIRYIIWKYLLRYIPVENKRVELVL

SEQ ID NO: 2526084 - protein, 19 aa, Entamoeba dispar
HGIQRLKTIYCDRIDCGQL

SEQ ID NO: 2526085 - protein, 23 aa, Entamoeba dispar
HGKAFILDTFNEVFVYYGTGCPK

SEQ ID NO: 2526086 - protein, 21 aa, Entamoeba dispar
HGKTFWARRSLNIYNGLIALY

SEQ ID NO: 2526087 - protein, 31 aa, Entamoeba dispar
HGLIHTYRVVLFSLIIGYYTQKRRFGLLASC

SEQ ID NO: 2526088 - protein, 29 aa, Entamoeba dispar
HGLLSLTHMILLYYFPDVTIHLDKMKLTT

SEQ ID NO: 2526089 - protein, 17 aa, Entamoeba dispar
HGLSWRLQCRVKHHISL

SEQ ID NO: 2526090 - protein, 29 aa, Entamoeba dispar
HGMKECLPLILILRNRLNYALNGREVTMI

SEQ ID NO: 2526091 - protein, 25 aa, Entamoeba dispar
HGNYLSFTTIPKQLETLPLSEFLCI

SEQ ID NO: 2526092 - protein, 30 aa, Entamoeba dispar
HGPILRGYIRERVDLWRQWAQPPSLKNKVV

SEQ ID NO: 2526093 - protein, 23 aa, Entamoeba dispar
HGQFYDLMKLFSIGGTLPENSYI

SEQ ID NO: 2526094 - protein, 17 aa, Entamoeba dispar
HGQFYDMLTIFDVRPPE

SEQ ID NO: 2526095 - protein, 29 aa, Entamoeba dispar
HGQQDITLFFYRLLGPDPSFKKGFEDHCK

SEQ ID NO: 2526096 - protein, 36 aa, Entamoeba dispar
HGQSFMLWQIRRMIGFAIVLTNFRLPIEQMNEIMKT

SEQ ID NO: 2526097 - protein, 41 aa, Entamoeba dispar
HGSCSFFLRSNFVKTWENYFYKFLPPFPRHLIQPHIKTYVI

SEQ ID NO: 2526098 - protein, 18 aa, Entamoeba dispar
HGSLPIKVQSIPLPITST

SEQ ID NO: 2526099 - protein, 25 aa, Entamoeba dispar
HGSRLTNFVGILSTGLRIAPPEAPC

SEQ ID NO: 2526100 - protein, 24 aa, Entamoeba dispar
HGSYRNYIVYFYYFIQNNKDIYVK

SEQ ID NO: 2526101 - protein, 25 aa, Entamoeba dispar
HGTKYYAVRLFLTAMGFCSSNFWKR

SEQ ID NO: 2526102 - protein, 36 aa, Entamoeba dispar
HGYLKMVGISYSFMYKWIILLFRRDFPHSACVRLWD

SEQ ID NO: 2526103 - protein, 18 aa, Entamoeba dispar
HGYPLSQAVLINNPIRVL

SEQ ID NO: 2526104 - protein, 17 aa, Entamoeba dispar
HHDYLPIDLVSNLFKQI

SEQ ID NO: 2526105 - protein, 20 aa, Entamoeba dispar
HHGRLVIVVDQLPGIPPILS

SEQ ID NO: 2526106 - protein, 28 aa, Entamoeba dispar
HHITTKPLIDIIPVFKTLNKSSTSKKNE

SEQ ID NO: 2526107 - protein, 23 aa, Entamoeba dispar
HHKTIMRMLQPAITKGLIEIKSL

SEQ ID NO: 2526108 - protein, 31 aa, Entamoeba dispar
HHLNAFVPLIDPLPFNYFVYCISDSYLKCST

SEQ ID NO: 2526109 - protein, 18 aa, Entamoeba dispar
HHLPKGLIQCASLQSLDL

SEQ ID NO: 2526110 - protein, 32 aa, Entamoeba dispar
HHNQLDIQMYMRIAPELYLKELIVGGINRVYE

SEQ ID NO: 2526111 - protein, 24 aa, Entamoeba dispar
HHNSELAMFLLRRALRNKNRIGHQ

SEQ ID NO: 2526112 - protein, 20 aa, Entamoeba dispar
HHPFFIHQTIGNICPLMAII

SEQ ID NO: 2526113 - protein, 30 aa, Entamoeba dispar
HHPYRSIPFVKNFFASPPFLNSMFSRCFSD

SEQ ID NO: 2526114 - protein, 24 aa, Entamoeba dispar
HHRCEGFALDWSPVVEGRLITGTL

SEQ ID NO: 2526115 - protein, 17 aa, Entamoeba dispar
HHRSVIFSSYNNLQLEK

SEQ ID NO: 2526116 - protein, 27 aa, Entamoeba dispar
HHSVELTPVKLPKVFRILEEYVTKNFT

SEQ ID NO: 2526117 - protein, 18 aa, Entamoeba dispar
HHTDPFIISSMRADIETL

SEQ ID NO: 2526118 - protein, 17 aa, Entamoeba dispar
HHYYPDYYLINSTLMFD

SEQ ID NO: 2526119 - protein, 18 aa, Entamoeba dispar
HIAIAIRKDDFKCKYISG

SEQ ID NO: 2526120 - protein, 17 aa, Entamoeba dispar
HIALLVYGIFNVKVSTD

SEQ ID NO: 2526121 - protein, 29 aa, Entamoeba dispar
HICLKKHVMILVFTTDGNVFGCYNSKRLP

SEQ ID NO: 2526122 - protein, 22 aa, Entamoeba dispar
HIDFDMLFWKGEILPVPETVPF

SEQ ID NO: 2526123 - protein, 18 aa, Entamoeba dispar
HIDIRWLFTDSYFQKTTL

SEQ ID NO: 2526124 - protein, 19 aa, Entamoeba dispar
HIDPHHLILLLFKSSETVE

SEQ ID NO: 2526125 - protein, 26 aa, Entamoeba dispar
HIECKGFVVMLRKIVFYNTNQYRIGE

SEQ ID NO: 2526126 - protein, 17 aa, Entamoeba dispar
HIEICYYLNELLKALDY

SEQ ID NO: 2526127 - protein, 24 aa, Entamoeba dispar
HIELNVLHIFSSKGTFTCITPNGQ

SEQ ID NO: 2526128 - protein, 20 aa, Entamoeba dispar
HIELQKYLLKYFLTLCEDFD

SEQ ID NO: 2526129 - protein, 24 aa, Entamoeba dispar
HIEQPFFERTIPEVKIRCVGIQKM

SEQ ID NO: 2526130 - protein, 24 aa, Entamoeba dispar
HIETKIILFNTYKILLSAENDVPD

SEQ ID NO: 2526131 - protein, 20 aa, Entamoeba dispar
HIFGFSRITSSQSIPLQPLV

SEQ ID NO: 2526132 - protein, 20 aa, Entamoeba dispar
HIGQIKGFELFNRKIISYSS

SEQ ID NO: 2526133 - protein, 20 aa, Entamoeba dispar
HIHHYFPKRFKVAEKLVPLI

SEQ ID NO: 2526134 - protein, 18 aa, Entamoeba dispar
HIHSIFHYKYSAIAYSLS

SEQ ID NO: 2526135 - protein, 17 aa, Entamoeba dispar
HIIINQLISIHPLQFKE

SEQ ID NO: 2526136 - protein, 21 aa, Entamoeba dispar
HIINKFYALKEEARRISLVYE

SEQ ID NO: 2526137 - protein, 17 aa, Entamoeba dispar
HIIQFKLNTSFLEPPRL

SEQ ID NO: 2526138 - protein, 17 aa, Entamoeba dispar
HIITSQTLKWVFVGGKG

SEQ ID NO: 2526139 - protein, 21 aa, Entamoeba dispar
HIKQRLFVFCLNPFRQKLPLY

SEQ ID NO: 2526140 - protein, 19 aa, Entamoeba dispar
HIKTSLFKWKPDNTSAASC

SEQ ID NO: 2526141 - protein, 19 aa, Entamoeba dispar
HILLSYTLGVKQMIVGVNK

SEQ ID NO: 2526142 - protein, 27 aa, Entamoeba dispar
HILTPPFFLQIKIPLFHPQYPLYFEDE

SEQ ID NO: 2526143 - protein, 27 aa, Entamoeba dispar
HILYGTKTIFINPFIPTNLLKESGIEY

SEQ ID NO: 2526144 - protein, 28 aa, Entamoeba dispar
HIMKINLTIPFWWKDDLFPYIVEHRPYS

SEQ ID NO: 2526145 - protein, 22 aa, Entamoeba dispar
HINEPFDRYSIHKSLNSLGVQH

SEQ ID NO: 2526146 - protein, 17 aa, Entamoeba dispar
HINPSLFIILNNDLVQS

SEQ ID NO: 2526147 - protein, 18 aa, Entamoeba dispar
HINRPYLGILGGAKVADK

SEQ ID NO: 2526148 - protein, 27 aa, Entamoeba dispar
HINSRRRILALLTLLNEELPDTPLFYA

SEQ ID NO: 2526149 - protein, 18 aa, Entamoeba dispar
HINSVTPGILLLMEIIKE

SEQ ID NO: 2526150 - protein, 17 aa, Entamoeba dispar
HIQIPLRKFRQIQREED

SEQ ID NO: 2526151 - protein, 27 aa, Entamoeba dispar
HIRCHPLCSWVYMLLGHLINNYKDDVQ

SEQ ID NO: 2526152 - protein, 25 aa, Entamoeba dispar
HIRSSHELLFSNIKPIYQQPFKGTV

SEQ ID NO: 2526153 - protein, 26 aa, Entamoeba dispar
HIRSSHELLFSNIKPIYQQPFKGTVD

SEQ ID NO: 2526154 - protein, 28 aa, Entamoeba dispar
HIRSSHELLFSNIKPRFQQPFKGTVDIK

SEQ ID NO: 2526155 - protein, 28 aa, Entamoeba dispar
HIRSSHELLFSNIKPRFQQPFKGTVDVN

SEQ ID NO: 2526156 - protein, 26 aa, Entamoeba dispar
HIRSSHELLFSNVKPRFQQSFKGTVN

SEQ ID NO: 2526157 - protein, 25 aa, Entamoeba dispar
HIRVNSLYIVALARSNNNAAVVFEV

SEQ ID NO: 2526158 - protein, 21 aa, Entamoeba dispar
HISFYSRMTTLMADLGYDEEF

SEQ ID NO: 2526159 - protein, 27 aa, Entamoeba dispar
HISKVDIPYACKLLFQELMSMAVCPRI

SEQ ID NO: 2526160 - protein, 27 aa, Entamoeba dispar
HISNNTFLWDIFLDNLNLLFFEFQLKH

SEQ ID NO: 2526161 - protein, 22 aa, Entamoeba dispar
HISPPFTKLRLFFTCFDHIIEG

SEQ ID NO: 2526162 - protein, 24 aa, Entamoeba dispar
HISSLALLKMLKHGRAGVPVEVMG

SEQ ID NO: 2526163 - protein, 27 aa, Entamoeba dispar
HISTDALIAKLYFYYERAAELCKVTII

SEQ ID NO: 2526164 - protein, 25 aa, Entamoeba dispar
HITKPLNGCIFIFNPRTGGVHLKII

SEQ ID NO: 2526165 - protein, 24 aa, Entamoeba dispar
HITPKVVWGTEYWMKSFKFEDEEG

SEQ ID NO: 2526166 - protein, 25 aa, Entamoeba dispar
HIVFYASSFMLNYSNQPLFLASNEM

SEQ ID NO: 2526167 - protein, 27 aa, Entamoeba dispar
HIVRNWLQRWFVLTNDILYYFDEQKLH

SEQ ID NO: 2526168 - protein, 18 aa, Entamoeba dispar
HIVTLDELKVVFASTAEA

SEQ ID NO: 2526169 - protein, 21 aa, Entamoeba dispar
HIYIYMLEQGYRDAAKVFKKE

SEQ ID NO: 2526170 - protein, 24 aa, Entamoeba dispar
HKDNGFFLPLRHYHDIVSQLKNMG

SEQ ID NO: 2526171 - protein, 27 aa, Entamoeba dispar
HKEDQIYRTIFIQNLSFKTTEEELKEK

SEQ ID NO: 2526172 - protein, 18 aa, Entamoeba dispar
HKELILFSYDDCERSIPS

SEQ ID NO: 2526173 - protein, 26 aa, Entamoeba dispar
HKEMKELIQLFFIIDENIGMNNEIES

SEQ ID NO: 2526174 - protein, 25 aa, Entamoeba dispar
HKEMTMPVPCFNVINGGAHAGNALA

SEQ ID NO: 2526175 - protein, 25 aa, Entamoeba dispar
HKENKYGLPLLPKENFETLFTELGK

SEQ ID NO: 2526176 - protein, 20 aa, Entamoeba dispar
HKFKFSQQRLKYFNDIGISS

SEQ ID NO: 2526177 - protein, 21 aa, Entamoeba dispar
HKFYEPLKEWTSKQTFKLIYD

SEQ ID NO: 2526178 - protein, 19 aa, Entamoeba dispar
HKFYKGKIQIMPKCTLAGF

SEQ ID NO: 2526179 - protein, 19 aa, Entamoeba dispar
HKHIWRCTGPCRNKPPFYG

SEQ ID NO: 2526180 - protein, 19 aa, Entamoeba dispar
HKIDIDNLFEEPKIISDIN

SEQ ID NO: 2526181 - protein, 19 aa, Entamoeba dispar
HKIFKKYIPTMRIEKINEW

SEQ ID NO: 2526182 - protein, 18 aa, Entamoeba dispar
HKIGERSFGIVYIGEFRG

SEQ ID NO: 2526183 - protein, 24 aa, Entamoeba dispar
HKINLMLLNIYYYYIRINQIQINS

SEQ ID NO: 2526184 - protein, 26 aa, Entamoeba dispar
HKKENIYIPELIFGHLLTSSNYKDDD

SEQ ID NO: 2526185 - protein, 29 aa, Entamoeba dispar
HKKLIEKPRQLFKIYVPESQVSLSPYNPS

SEQ ID NO: 2526186 - protein, 25 aa, Entamoeba dispar
HKKLIFIPILSYCVLKYQFNTEINY

SEQ ID NO: 2526187 - protein, 25 aa, Entamoeba dispar
HKKTTMVNFFPKTYGFIVMEKDNLG

SEQ ID NO: 2526188 - protein, 19 aa, Entamoeba dispar
HKLCKKIVRRFNHKARRVQ

SEQ ID NO: 2526189 - protein, 27 aa, Entamoeba dispar
HKLGGMMILCIPPYRLPRDKLDEDIDR

SEQ ID NO: 2526190 - protein, 25 aa, Entamoeba dispar
HKLKKGYNILLSAKLSIIPSLTTQI

SEQ ID NO: 2526191 - protein, 18 aa, Entamoeba dispar
HKLSYIHRDIKPDNILIG

SEQ ID NO: 2526192 - protein, 22 aa, Entamoeba dispar
HKMYLLTFIVRFFIDNFKRIDS

SEQ ID NO: 2526193 - protein, 23 aa, Entamoeba dispar
HKNDNFIMIPFKIGQKNIEKEEE

SEQ ID NO: 2526194 - protein, 23 aa, Entamoeba dispar
HKNHYILLSYQLPEIIYQILSKN

SEQ ID NO: 2526195 - protein, 30 aa, Entamoeba dispar
HKNNHNYRVIPSLHFPLLSSDWGADEELML

SEQ ID NO: 2526196 - protein, 20 aa, Entamoeba dispar
HKPTSRLILCGKGVGAAVSL

SEQ ID NO: 2526197 - protein, 26 aa, Entamoeba dispar
HKQEHPFELIICGIGPSLKKYIDKHP

SEQ ID NO: 2526198 - protein, 17 aa, Entamoeba dispar
HKRNWVIEWAKSSQIKE

SEQ ID NO: 2526199 - protein, 21 aa, Entamoeba dispar
HKRRLLRLAEYLKQFDFTPQE

SEQ ID NO: 2526200 - protein, 24 aa, Entamoeba dispar
HKRVRGWVNNAPRSKYKPKPIYYR

SEQ ID NO: 2526201 - protein, 28 aa, Entamoeba dispar
HKSDIPFGWFDFKCSFFYKHIRTANYYT

SEQ ID NO: 2526202 - protein, 20 aa, Entamoeba dispar
HKSFRLSKQISFSKKDKKKD

SEQ ID NO: 2526203 - protein, 23 aa, Entamoeba dispar
HKTEINKVRWNKNGKWFLTCSKD

SEQ ID NO: 2526204 - protein, 24 aa, Entamoeba dispar
HKTITIFLCIIKRIDSLNLSELEE

SEQ ID NO: 2526205 - protein, 23 aa, Entamoeba dispar
HKVAWYCYHLMKERKNMSLKYLI

SEQ ID NO: 2526206 - protein, 21 aa, Entamoeba dispar
HKVHKYHLKINAKLDKTIAVI

SEQ ID NO: 2526207 - protein, 19 aa, Entamoeba dispar
HKVIYDIVPTPIGIEVEGG

SEQ ID NO: 2526208 - protein, 21 aa, Entamoeba dispar
HKVLLDLLMIIHSFIETYYKS

SEQ ID NO: 2526209 - protein, 17 aa, Entamoeba dispar
HKVLVLPASQRDPFCGS

SEQ ID NO: 2526210 - protein, 32 aa, Entamoeba dispar
HKWDFVSLYPKYTKLIFTLFCNIGMVSCDDFF

SEQ ID NO: 2526211 - protein, 27 aa, Entamoeba dispar
HKWSVDGISFCLLKKQFIKFKSLLHQN

SEQ ID NO: 2526212 - protein, 22 aa, Entamoeba dispar
HKYSFFVIKRVPILLDDKEKIK

SEQ ID NO: 2526213 - protein, 24 aa, Entamoeba dispar
HLAGKWPFWLSPRQVMVCTVSEKY

SEQ ID NO: 2526214 - protein, 18 aa, Entamoeba dispar
HLAMQFLEKEMLVRNPGC

SEQ ID NO: 2526215 - protein, 31 aa, Entamoeba dispar
HLCEIKNLLLSLRWRLFLKCLPEDSSLWTSV

SEQ ID NO: 2526216 - protein, 17 aa, Entamoeba dispar
HLDLNAVIWLEHYLMNW

SEQ ID NO: 2526217 - protein, 19 aa, Entamoeba dispar
HLDNIILQSISLLMNIPTA

SEQ ID NO: 2526218 - protein, 20 aa, Entamoeba dispar
HLDWKGKKLIHFGAVDYEAT

SEQ ID NO: 2526219 - protein, 19 aa, Entamoeba dispar
HLEEWFDIDKIIFNDFTFK

SEQ ID NO: 2526220 - protein, 25 aa, Entamoeba dispar
HLENNMYLLGYLPKENRCFLSDLKG

SEQ ID NO: 2526221 - protein, 18 aa, Entamoeba dispar
HLEYLWSLLKGINSERTT

SEQ ID NO: 2526222 - protein, 21 aa, Entamoeba dispar
HLFKILIIGESGVGKTAIMQR

SEQ ID NO: 2526223 - protein, 18 aa, Entamoeba dispar
HLFVFVNSLIENPAFDSQ

SEQ ID NO: 2526224 - protein, 27 aa, Entamoeba dispar
HLGEAFSQFIPLLNVYKTYVGNTEAQF

SEQ ID NO: 2526225 - protein, 17 aa, Entamoeba dispar
HLHESLKANKPLHFTSR

SEQ ID NO: 2526226 - protein, 21 aa, Entamoeba dispar
HLHETLLFLLNALQSGEESAI

SEQ ID NO: 2526227 - protein, 20 aa, Entamoeba dispar
HLIAFMAIRTFFAKKQPILI

SEQ ID NO: 2526228 - protein, 18 aa, Entamoeba dispar
HLIAIDLYKYVTSQYSIL

SEQ ID NO: 2526229 - protein, 25 aa, Entamoeba dispar
HLIDSAFTMTWDPTLQPILDCAKDA

SEQ ID NO: 2526230 - protein, 20 aa, Entamoeba dispar
HLILSDILYYGITDENIMFL

SEQ ID NO: 2526231 - protein, 20 aa, Entamoeba dispar
HLIPKLFRNYDSLKRYDAFV

SEQ ID NO: 2526232 - protein, 25 aa, Entamoeba dispar
HLIRQYLSHSFLLSSPLSSIYNQLR

SEQ ID NO: 2526233 - protein, 27 aa, Entamoeba dispar
HLISESSLFSILPRVNKIILGCHSVFA

SEQ ID NO: 2526234 - protein, 22 aa, Entamoeba dispar
HLKDVCNLILVNKKWKDIISNI

SEQ ID NO: 2526235 - protein, 24 aa, Entamoeba dispar
HLKVHFIVSLGIESNFFRSIDYYC

SEQ ID NO: 2526236 - protein, 17 aa, Entamoeba dispar
HLKWRAFGNQRPMINPM

SEQ ID NO: 2526237 - protein, 18 aa, Entamoeba dispar
HLLICLINSKLESFQVDL

SEQ ID NO: 2526238 - protein, 19 aa, Entamoeba dispar
HLLLTALCYSFKNDTFFFK

SEQ ID NO: 2526239 - protein, 19 aa, Entamoeba dispar
HLLMDILSEFGYFFNTTKS

SEQ ID NO: 2526240 - protein, 21 aa, Entamoeba dispar
HLLSLLISHLHQFYSQLPLIS

SEQ ID NO: 2526241 - protein, 20 aa, Entamoeba dispar
HLLVQILRSIEEFKQWLLQR

SEQ ID NO: 2526242 - protein, 17 aa, Entamoeba dispar
HLLYTDCTFKVIEGMIP

SEQ ID NO: 2526243 - protein, 20 aa, Entamoeba dispar
HLMDCEHIFIISDIRIPLQE

SEQ ID NO: 2526244 - protein, 24 aa, Entamoeba dispar
HLNEWIDLIFGFKQTGEPAIKALN

SEQ ID NO: 2526245 - protein, 31 aa, Entamoeba dispar
HLNIYEFIAIYRYLEICYALFNAYNGSGPEI

SEQ ID NO: 2526246 - protein, 17 aa, Entamoeba dispar
HLNMIQGAVFIPGFVVS

SEQ ID NO: 2526247 - protein, 22 aa, Entamoeba dispar
HLNNEIIELIKRTIAKAGMTIE

SEQ ID NO: 2526248 - protein, 18 aa, Entamoeba dispar
HLNSPIIGIGFINKKIIS

SEQ ID NO: 2526249 - protein, 17 aa, Entamoeba dispar
HLNVNYPTILTDKQKKE

SEQ ID NO: 2526250 - protein, 37 aa, Entamoeba dispar
HLPCLNGLPPIPTSILPLFEMIGIDGVLAVWLALLEG

SEQ ID NO: 2526251 - protein, 34 aa, Entamoeba dispar
HLPKASLNELFSKMFPHTTDLVIGTLLNSSVGYS

SEQ ID NO: 2526252 - protein, 19 aa, Entamoeba dispar
HLPLPPVKLPGNSASYHPA

SEQ ID NO: 2526253 - protein, 18 aa, Entamoeba dispar
HLPNLPLLRQHLIRQGKL

SEQ ID NO: 2526254 - protein, 24 aa, Entamoeba dispar
HLQPQEIIDLIWLIENMSLNNINY

SEQ ID NO: 2526255 - protein, 27 aa, Entamoeba dispar
HLQSLHVRLIPRIIPIITKFQSLQSLT

SEQ ID NO: 2526256 - protein, 25 aa, Entamoeba dispar
HLQTLDGYYRKALFVDFVADQIKAL

SEQ ID NO: 2526257 - protein, 27 aa, Entamoeba dispar
HLSDNGVMFLQFAFRWINCCLLREFKL

SEQ ID NO: 2526258 - protein, 29 aa, Entamoeba dispar
HLSDNLLNKRLFETMPYCFSESGSIREPF

SEQ ID NO: 2526259 - protein, 25 aa, Entamoeba dispar
HLSEAWRCWKANIPWKVPGLPEPIE

SEQ ID NO: 2526260 - protein, 17 aa, Entamoeba dispar
HLSGYIVVDMTEATAAG

SEQ ID NO: 2526261 - protein, 18 aa, Entamoeba dispar
HLSKSTLDLKWLKYLIYD

SEQ ID NO: 2526262 - protein, 18 aa, Entamoeba dispar
HLSLGMLTAKYFLMSNSS

SEQ ID NO: 2526263 - protein, 25 aa, Entamoeba dispar
HLSMIYLNIEFDLNFSRTAYTSLPD

SEQ ID NO: 2526264 - protein, 36 aa, Entamoeba dispar
HLSQALLGAPLPIEFKWKIPITKKKTGLFSIIETTE

SEQ ID NO: 2526265 - protein, 36 aa, Entamoeba dispar
HLSVMTPNFFLDFYKTFKIFFSLGNTFFSDNPFISD

SEQ ID NO: 2526266 - protein, 37 aa, Entamoeba dispar
HLSVSTLYEQIKNKKIPLCQWPLYVSTSFDNEINGGN

SEQ ID NO: 2526267 - protein, 17 aa, Entamoeba dispar
HLTLIPDGALWSFAINS

SEQ ID NO: 2526268 - protein, 27 aa, Entamoeba dispar
HLVQCQAIRLLHILKKHDRVALIRCVV

SEQ ID NO: 2526269 - protein, 21 aa, Entamoeba dispar
HLYKNIIISPGYRMLSTQHVV

SEQ ID NO: 2526270 - protein, 24 aa, Entamoeba dispar
HMALLPLINTIAILHTPYQSCSEH

SEQ ID NO: 2526271 - protein, 29 aa, Entamoeba dispar
HMDIPDGSYVKLLNFAYKGNKPSSVVLKV

SEQ ID NO: 2526272 - protein, 18 aa, Entamoeba dispar
HMEQTIDILLSFTDNTPT

SEQ ID NO: 2526273 - protein, 26 aa, Entamoeba dispar
HMGGVAFLRSPPGKFFFDFFGENMLA

SEQ ID NO: 2526274 - protein, 18 aa, Entamoeba dispar
HMIKILSQYSNIFLQKTC

SEQ ID NO: 2526275 - protein, 19 aa, Entamoeba dispar
HMKTLWGKEVWMKTSVLRD

SEQ ID NO: 2526276 - protein, 26 aa, Entamoeba dispar
HMLTTGWTYWFDLGMNQVFSTSGVTA

SEQ ID NO: 2526277 - protein, 25 aa, Entamoeba dispar
HMMILDRLIHLINIDDNILSSNHLF

SEQ ID NO: 2526278 - protein, 29 aa, Entamoeba dispar
HMTCKCGYEFCWLCGVKYTPEHWSNNTTG

SEQ ID NO: 2526279 - protein, 17 aa, Entamoeba dispar
HMWLRRGLFFCHRDINP

SEQ ID NO: 2526280 - protein, 29 aa, Entamoeba dispar
HMYCWRCLLQYLVLCPAPHKCPVCNALIY

SEQ ID NO: 2526281 - protein, 24 aa, Entamoeba dispar
HNDEIINIFKRAHQIYLNIGINET

SEQ ID NO: 2526282 - protein, 19 aa, Entamoeba dispar
HNDIKIMRFIIEKVSQKKE

SEQ ID NO: 2526283 - protein, 25 aa, Entamoeba dispar
HNELVCRVVLLLLSYVIEERYDEIV

SEQ ID NO: 2526284 - protein, 27 aa, Entamoeba dispar
HNESIKYDIRLFDDANLNDITWPEFKS

SEQ ID NO: 2526285 - protein, 33 aa, Entamoeba dispar
HNGEIIYSPVQVVHIHCTLFLTKNGYDEKGLEI

SEQ ID NO: 2526286 - protein, 32 aa, Entamoeba dispar
HNGEWTLDNDKEFLEYMKGIHNTILESCNQLT

SEQ ID NO: 2526287 - protein, 20 aa, Entamoeba dispar
HNKLIDFSLLCNMTNLKVLN

SEQ ID NO: 2526288 - protein, 17 aa, Entamoeba dispar
HNKLSMLPPGIGSLKSL

SEQ ID NO: 2526289 - protein, 18 aa, Entamoeba dispar
HNKLTQPEVIIRKGMNIE

SEQ ID NO: 2526290 - protein, 19 aa, Entamoeba dispar
HNKLTQPEVIIRKGMNIEP

SEQ ID NO: 2526291 - protein, 27 aa, Entamoeba dispar
HNKMEHWYVQLILLAPQNQRLGILKRI

SEQ ID NO: 2526292 - protein, 17 aa, Entamoeba dispar
HNKNILHRDLKSLNILV

SEQ ID NO: 2526293 - protein, 24 aa, Entamoeba dispar
HNKTLFAHLIDCLKYIYSVQEQCE

SEQ ID NO: 2526294 - protein, 24 aa, Entamoeba dispar
HNLCPYYYSRWATKRSKLILCPYN

SEQ ID NO: 2526295 - protein, 21 aa, Entamoeba dispar
HNLEIIPPLRKSCASLMDFEN

SEQ ID NO: 2526296 - protein, 22 aa, Entamoeba dispar
HNNGDELWVMLLEKAYAKVVGS

SEQ ID NO: 2526297 - protein, 18 aa, Entamoeba dispar
HNNMPMRGFGGGNNIPMG

SEQ ID NO: 2526298 - protein, 24 aa, Entamoeba dispar
HNNPDFIRVLLKNQNKIIFEKKYR

SEQ ID NO: 2526299 - protein, 20 aa, Entamoeba dispar
HNNVKWFPFPDHHNPSLIVL

SEQ ID NO: 2526300 - protein, 23 aa, Entamoeba dispar
HNPKLGMDQLLITPISQACADQR

SEQ ID NO: 2526301 - protein, 27 aa, Entamoeba dispar
HNSNSFYKVLPLRQPMLMVGLGGCPPP

SEQ ID NO: 2526302 - protein, 35 aa, Entamoeba dispar
HNSTQWVFQQLFFVRFLFPLLENPLFILDGVKQDE

SEQ ID NO: 2526303 - protein, 25 aa, Entamoeba dispar
HNTIQLFHHFFPCANIFKISSSEIK

SEQ ID NO: 2526304 - protein, 19 aa, Entamoeba dispar
HNVHGVIPYVLNVDTEEDA

SEQ ID NO: 2526305 - protein, 18 aa, Entamoeba dispar
HNVTSSYFRGTHGCIIVY

SEQ ID NO: 2526306 - protein, 21 aa, Entamoeba dispar
HNYDNFPMAYPPFNAERHLRS

SEQ ID NO: 2526307 - protein, 28 aa, Entamoeba dispar
HNYLRVTRIFNSLHAFGLKPYMESLFTF

SEQ ID NO: 2526308 - protein, 19 aa, Entamoeba dispar
HNYLYKQDIIFTKIDKRKG

SEQ ID NO: 2526309 - protein, 22 aa, Entamoeba dispar
HPALVMGVLGSIIPFPDHNQSP

SEQ ID NO: 2526310 - protein, 24 aa, Entamoeba dispar
HPDLPPVIELTFTSQPLVLSFMNS

SEQ ID NO: 2526311 - protein, 19 aa, Entamoeba dispar
HPEFEVRILDLILMEGWEI

SEQ ID NO: 2526312 - protein, 21 aa, Entamoeba dispar
HPEFFTSESLSMNCPRVTQTF

SEQ ID NO: 2526313 - protein, 23 aa, Entamoeba dispar
HPERVIYHVCKWLGNKRPSIVKG

SEQ ID NO: 2526314 - protein, 18 aa, Entamoeba dispar
HPFCGFTIRRPIKASTAT

SEQ ID NO: 2526315 - protein, 35 aa, Entamoeba dispar
HPFESKGMYIFLIKKHFDELIKKYPLKNCFPEYDG

SEQ ID NO: 2526316 - protein, 25 aa, Entamoeba dispar
HPFMPFITEELWQRLPRRNNNEISI

SEQ ID NO: 2526317 - protein, 17 aa, Entamoeba dispar
HPHIQIPLRKFRQIQRE

SEQ ID NO: 2526318 - protein, 27 aa, Entamoeba dispar
HPKEPWVLAALHTGTIYILNYQTKSIV

SEQ ID NO: 2526319 - protein, 21 aa, Entamoeba dispar
HPKNAFHYIPRVYGFKLASSD

SEQ ID NO: 2526320 - protein, 17 aa, Entamoeba dispar
HPKPNIPLIVSASLDQT

SEQ ID NO: 2526321 - protein, 32 aa, Entamoeba dispar
HPKTQHFLIGIDIIYFLTPIFALTQVEREIEY

SEQ ID NO: 2526322 - protein, 24 aa, Entamoeba dispar
HPLALPVVFNAPISMREIQSHLNE

SEQ ID NO: 2526323 - protein, 17 aa, Entamoeba dispar
HPLISLKKQIKYFNDNK

SEQ ID NO: 2526324 - protein, 17 aa, Entamoeba dispar
HPLIVDNIWSLITSCCE

SEQ ID NO: 2526325 - protein, 20 aa, Entamoeba dispar
HPLTTLIKPSLLKETGMVII

SEQ ID NO: 2526326 - protein, 21 aa, Entamoeba dispar
HPLYKSFIEFLKNTYKRGVDR

SEQ ID NO: 2526327 - protein, 37 aa, Entamoeba dispar
HPNILKLYTFFEDKNRWFLVLEYCKKGELSGLLKQVG

SEQ ID NO: 2526328 - protein, 25 aa, Entamoeba dispar
HPNNDPYFVFTACSAFWILQDGTVS

SEQ ID NO: 2526329 - protein, 28 aa, Entamoeba dispar
HPQMLGVLGLKAMALILIRLITSNTQSN

SEQ ID NO: 2526330 - protein, 22 aa, Entamoeba dispar
HPQNKWMIQFPRIFHVCKGNKE

SEQ ID NO: 2526331 - protein, 17 aa, Entamoeba dispar
HPRKLLLQPNEVKELTI

SEQ ID NO: 2526332 - protein, 24 aa, Entamoeba dispar
HPSFWHFHVHFTSINFPTLARNNS

SEQ ID NO: 2526333 - protein, 24 aa, Entamoeba dispar
HPSNYLEEVIPLTQSLFSVTIGLQ

SEQ ID NO: 2526334 - protein, 30 aa, Entamoeba dispar
HPSVYTFMSMIFLAVRFSTLGWDKINDKYF

SEQ ID NO: 2526335 - protein, 17 aa, Entamoeba dispar
HPTLPYILTCSDDTTIK

SEQ ID NO: 2526336 - protein, 24 aa, Entamoeba dispar
HPTRSWVLASLHNGKIQLWDMRTR

SEQ ID NO: 2526337 - protein, 18 aa, Entamoeba dispar
HQCIDEFQLIYPTDHIVI

SEQ ID NO: 2526338 - protein, 24 aa, Entamoeba dispar
HQCYKEFQIIIKTVLLSLEHPRFN

SEQ ID NO: 2526339 - protein, 17 aa, Entamoeba dispar
HQECLLKSLSNIHLNES

SEQ ID NO: 2526340 - protein, 21 aa, Entamoeba dispar
HQFLLELLLKPNTKKKKIKIS

SEQ ID NO: 2526341 - protein, 31 aa, Entamoeba dispar
HQFNEILNNCPLYQLLPLQTFCDLLSISVNP

SEQ ID NO: 2526342 - protein, 32 aa, Entamoeba dispar
HQFNEILNNCPLYQLLPLQTFCDLLSISVNPQ

SEQ ID NO: 2526343 - protein, 20 aa, Entamoeba dispar
HQHYSYTRYLQPPILCTSNP

SEQ ID NO: 2526344 - protein, 19 aa, Entamoeba dispar
HQIASLYLLPSDDKTTKFM

SEQ ID NO: 2526345 - protein, 26 aa, Entamoeba dispar
HQIEELFISLLGYPIDQIRSTCLILL

SEQ ID NO: 2526346 - protein, 36 aa, Entamoeba dispar
HQIETRLGQIFKLFTPFFKVYFLYISHYDDSNQVLT

SEQ ID NO: 2526347 - protein, 31 aa, Entamoeba dispar
HQIRRLTYQLIKFILQICYISDISTIQALNI

SEQ ID NO: 2526348 - protein, 22 aa, Entamoeba dispar
HQLENILIKYVSQFVQCPECKS

SEQ ID NO: 2526349 - protein, 22 aa, Entamoeba dispar
HQLKIVVELWKKQGIIDGFVDL

SEQ ID NO: 2526350 - protein, 25 aa, Entamoeba dispar
HQLQIYSDQFLPITNEIVPTGEIRK

SEQ ID NO: 2526351 - protein, 22 aa, Entamoeba dispar
HQNCVALNPKWCRCLLSTKDSG

SEQ ID NO: 2526352 - protein, 25 aa, Entamoeba dispar
HQNYELDLLFEPKVKRKLLVIQSEL

SEQ ID NO: 2526353 - protein, 24 aa, Entamoeba dispar
HQQLPMKVWLRHTQILHVCLIYKK

SEQ ID NO: 2526354 - protein, 23 aa, Entamoeba dispar
HQQLRQYIIDLINTWNGSFPNEI

SEQ ID NO: 2526355 - protein, 17 aa, Entamoeba dispar
HQQMHLLICLINSKLES

SEQ ID NO: 2526356 - protein, 17 aa, Entamoeba dispar
HQRKVQIVKPFSSLFLS

SEQ ID NO: 2526357 - protein, 20 aa, Entamoeba dispar
HQSLFSFSVLLNIKEINTFS

SEQ ID NO: 2526358 - protein, 24 aa, Entamoeba dispar
HQSQKDLPLFPGADPREFWQRAEE

SEQ ID NO: 2526359 - protein, 31 aa, Entamoeba dispar
HQTTPATPMEQPPIPPKPAHLTSKEEKKKKK

SEQ ID NO: 2526360 - protein, 17 aa, Entamoeba dispar
HQVQELQVALRQANEAL

SEQ ID NO: 2526361 - protein, 18 aa, Entamoeba dispar
HQWKCQITSIFFKQLEDV

SEQ ID NO: 2526362 - protein, 26 aa, Entamoeba dispar
HQYIFAKVLVRSLLKNGGYPDDLPPV

SEQ ID NO: 2526363 - protein, 19 aa, Entamoeba dispar
HQYTNTIFTLFQQLHTEMA

SEQ ID NO: 2526364 - protein, 28 aa, Entamoeba dispar
HRCYALQTLYSVYLWIGKQTDQISRIQA

SEQ ID NO: 2526365 - protein, 19 aa, Entamoeba dispar
HRDLKPENILLKENKPYPT

SEQ ID NO: 2526366 - protein, 18 aa, Entamoeba dispar
HRDPLKELILPPLEELRP

SEQ ID NO: 2526367 - protein, 23 aa, Entamoeba dispar
HREDTYLPLFYSESSIKPIFLRK

SEQ ID NO: 2526368 - protein, 23 aa, Entamoeba dispar
HRELMAKLYFSFVQTLLGCYVDN

SEQ ID NO: 2526369 - protein, 17 aa, Entamoeba dispar
HRFDIMHLDLKPSNIFI

SEQ ID NO: 2526370 - protein, 28 aa, Entamoeba dispar
HRFGYKGPYYLYYGKYELIFIYSILNRV

SEQ ID NO: 2526371 - protein, 17 aa, Entamoeba dispar
HRGLTTMTGFTPKGLRI

SEQ ID NO: 2526372 - protein, 22 aa, Entamoeba dispar
HRIPIHLFTYIHGISYHLLEIV

SEQ ID NO: 2526373 - protein, 25 aa, Entamoeba dispar
HRISIMCHKAKILPWRTLRFNECVC

SEQ ID NO: 2526374 - protein, 28 aa, Entamoeba dispar
HRKNIFAVTYNYLLQLAIRLYDGSLQFE

SEQ ID NO: 2526375 - protein, 21 aa, Entamoeba dispar
HRLLELYLMTQDIEISCDCSN

SEQ ID NO: 2526376 - protein, 26 aa, Entamoeba dispar
HRLRAVEQMLVLLKTRRLSGNILNDC

SEQ ID NO: 2526377 - protein, 24 aa, Entamoeba dispar
HRNYPPLLKIYPIENYQIDKKEKL

SEQ ID NO: 2526378 - protein, 35 aa, Entamoeba dispar
HRQYRFHPSVKMAKRFFPHIQNMDGFFVCKLKVNV

SEQ ID NO: 2526379 - protein, 24 aa, Entamoeba dispar
HRRRPRPGQSRLPHASLHAALRAA

SEQ ID NO: 2526380 - protein, 24 aa, Entamoeba dispar
HRSCLWICKQLRSLKIPQQDYIIF

SEQ ID NO: 2526381 - protein, 24 aa, Entamoeba dispar
HRSKGRFPVLTWYNKKNGTVIVRS

SEQ ID NO: 2526382 - protein, 29 aa, Entamoeba dispar
HRVTEGINNYWSFHFQEDHSSLKDLNDFN

SEQ ID NO: 2526383 - protein, 23 aa, Entamoeba dispar
HRVTVFPVALILAPTRELGQQIY

SEQ ID NO: 2526384 - protein, 44 aa, Entamoeba dispar
HSDSSFISFKILTLLYPQPIWNLTPYQYVVLIGLNRLSQISSSP

SEQ ID NO: 2526385 - protein, 17 aa, Entamoeba dispar
HSDVISLKYISSTLYDV

SEQ ID NO: 2526386 - protein, 20 aa, Entamoeba dispar
HSEEYNIETPILIIENTEIT

SEQ ID NO: 2526387 - protein, 21 aa, Entamoeba dispar
HSEEYNIETPILIIENTEITY

SEQ ID NO: 2526388 - protein, 22 aa, Entamoeba dispar
HSETMFVLLKQLLGVTFNVISQ

SEQ ID NO: 2526389 - protein, 21 aa, Entamoeba dispar
HSEVVALRQTATDYLALQERW

SEQ ID NO: 2526390 - protein, 29 aa, Entamoeba dispar
HSHKKYFKLSGLLPICYFLEKKDYTSEEL

SEQ ID NO: 2526391 - protein, 27 aa, Entamoeba dispar
HSIDCELERLKISLELLQSTVKDKKAK

SEQ ID NO: 2526392 - protein, 21 aa, Entamoeba dispar
HSIILNHYLSHTLHINTSPQA

SEQ ID NO: 2526393 - protein, 17 aa, Entamoeba dispar
HSIKIIHHDIKAGNILL

SEQ ID NO: 2526394 - protein, 24 aa, Entamoeba dispar
HSINTTPSAFIKKLIHFSSLDQSF

SEQ ID NO: 2526395 - protein, 20 aa, Entamoeba dispar
HSIPMQIDLMFLISNLCRNE

SEQ ID NO: 2526396 - protein, 24 aa, Entamoeba dispar
HSIQDEWFIINKLIEFSKNNNVIF

SEQ ID NO: 2526397 - protein, 29 aa, Entamoeba dispar
HSITTPQLLVEIIWILSRFSCTKEEILTS

SEQ ID NO: 2526398 - protein, 17 aa, Entamoeba dispar
HSIVRTYEMLRLAIEKQ

SEQ ID NO: 2526399 - protein, 27 aa, Entamoeba dispar
HSKDLFIITTICLIPYLTESELKVIMK

SEQ ID NO: 2526400 - protein, 18 aa, Entamoeba dispar
HSKMLLKPRINPKQFFGF

SEQ ID NO: 2526401 - protein, 25 aa, Entamoeba dispar
HSLEDLLRYESRLEKICYTDLYESD

SEQ ID NO: 2526402 - protein, 21 aa, Entamoeba dispar
HSLITQITKMNNLFNSLVLLE

SEQ ID NO: 2526403 - protein, 36 aa, Entamoeba dispar
HSLKPSVEFYLSIPSAEFYPLKFSLELRSVKNLKKL

SEQ ID NO: 2526404 - protein, 18 aa, Entamoeba dispar
HSLPQSLQLLIDDIYFIS

SEQ ID NO: 2526405 - protein, 19 aa, Entamoeba dispar
HSLQIQPPPSKLMSSKQRK

SEQ ID NO: 2526406 - protein, 23 aa, Entamoeba dispar
HSLTIYITYSLIGQTYLHSFCFH

SEQ ID NO: 2526407 - protein, 28 aa, Entamoeba dispar
HSLYPSSKIYLIYLYKKNKLQHVDSNQI

SEQ ID NO: 2526408 - protein, 35 aa, Entamoeba dispar
HSMCTLEFLPRRESYFWLLDALDMYKPVVWEFNRL

SEQ ID NO: 2526409 - protein, 22 aa, Entamoeba dispar
HSMKAWRDDIYTFYINQGVKCS

SEQ ID NO: 2526410 - protein, 22 aa, Entamoeba dispar
HSMSPIHILSKESLVPLNPDDK

SEQ ID NO: 2526411 - protein, 25 aa, Entamoeba dispar
HSNFSSFVRQLNIYGFHKVDHPLGQ

SEQ ID NO: 2526412 - protein, 24 aa, Entamoeba dispar
HSNGIMHRDIKPDNFLVVTIDDNI

SEQ ID NO: 2526413 - protein, 25 aa, Entamoeba dispar
HSNIFNPIQPINWITYGIEPLRQEI

SEQ ID NO: 2526414 - protein, 26 aa, Entamoeba dispar
HSNIKVEGFWPIIMAKALANANIEDL

SEQ ID NO: 2526415 - protein, 25 aa, Entamoeba dispar
HSNNAEWLGVLKPTVSLISCGHGNL

SEQ ID NO: 2526416 - protein, 24 aa, Entamoeba dispar
HSNNTRIYLIDRMTGLRKKYDRFS

SEQ ID NO: 2526417 - protein, 27 aa, Entamoeba dispar
HSNSSLCLFIKILSFFVKEWRYRNKNK

SEQ ID NO: 2526418 - protein, 31 aa, Entamoeba dispar
HSPFADKIWNIRFIKGLSWGRIFEDKESKQI

SEQ ID NO: 2526419 - protein, 21 aa, Entamoeba dispar
HSPKLFEQLLKLIPTLQTNEY

SEQ ID NO: 2526420 - protein, 18 aa, Entamoeba dispar
HSPLFQSLNSVIGRAIPL

SEQ ID NO: 2526421 - protein, 24 aa, Entamoeba dispar
HSQNEYFALFWRCIKEYCDDNSEI

SEQ ID NO: 2526422 - protein, 22 aa, Entamoeba dispar
HSSDILCFRYNSNGTVLASASA

SEQ ID NO: 2526423 - protein, 26 aa, Entamoeba dispar
HSSIKPFAIFILSNKITLQALIISTL

SEQ ID NO: 2526424 - protein, 19 aa, Entamoeba dispar
HSSLKLSFMEGDSIKVVDR

SEQ ID NO: 2526425 - protein, 30 aa, Entamoeba dispar
HSSLLSSDLSLWGLGALSFSLYSSLINSFL

SEQ ID NO: 2526426 - protein, 25 aa, Entamoeba dispar
HSTFHEVSQRFLFARFKNIENEEDI

SEQ ID NO: 2526427 - protein, 18 aa, Entamoeba dispar
HSTIFLGGPLVKLHDFSL

SEQ ID NO: 2526428 - protein, 27 aa, Entamoeba dispar
HSTLAQILFPLLSQYIKKNSMANLNTI

SEQ ID NO: 2526429 - protein, 19 aa, Entamoeba dispar
HSVSRLIGAPPGYVGYEEG

SEQ ID NO: 2526430 - protein, 27 aa, Entamoeba dispar
HSYAEKLYKIFENYYRHCIRKLNYHLK

SEQ ID NO: 2526431 - protein, 21 aa, Entamoeba dispar
HSYHHHIPIVLNKLSQQKIPE

SEQ ID NO: 2526432 - protein, 23 aa, Entamoeba dispar
HSYIFSTSLPRWEQFRKSAFEKD

SEQ ID NO: 2526433 - protein, 22 aa, Entamoeba dispar
HSYRVMQLSLEIYDLITPLCKV

SEQ ID NO: 2526434 - protein, 27 aa, Entamoeba dispar
HTAAVWQVKWSHPRFGPVLASCGYDKQ

SEQ ID NO: 2526435 - protein, 18 aa, Entamoeba dispar
HTATYYKKKIYLVGGLQY

SEQ ID NO: 2526436 - protein, 28 aa, Entamoeba dispar
HTCIVWTKCYNFIPRKKIEKYKIEKEKF

SEQ ID NO: 2526437 - protein, 25 aa, Entamoeba dispar
HTCNTFNLILLKANIIASLLTELNS

SEQ ID NO: 2526438 - protein, 25 aa, Entamoeba dispar
HTEQEILYGYKLLEKLLPEIKTGGN

SEQ ID NO: 2526439 - protein, 26 aa, Entamoeba dispar
HTFCQFCIFHGFKIILVSRRSIEIGG

SEQ ID NO: 2526440 - protein, 26 aa, Entamoeba dispar
HTFPTCSLFYYISFVAHFIKWIKINK

SEQ ID NO: 2526441 - protein, 24 aa, Entamoeba dispar
HTHNFEIMFHVSSLIPLLQDDGQG

SEQ ID NO: 2526442 - protein, 19 aa, Entamoeba dispar
HTIGSLGLLSKSLVFRELC

SEQ ID NO: 2526443 - protein, 19 aa, Entamoeba dispar
HTKQYIKKQIRWINNKIIK

SEQ ID NO: 2526444 - protein, 17 aa, Entamoeba dispar
HTLPRLYHLEEYKTFDD

SEQ ID NO: 2526445 - protein, 18 aa, Entamoeba dispar
HTLRLWDLTKMESVRRFV

SEQ ID NO: 2526446 - protein, 26 aa, Entamoeba dispar
HTNFKIFMELINEVYPMALSFFDESM

SEQ ID NO: 2526447 - protein, 22 aa, Entamoeba dispar
HTNNQFIPGSMDPDLFKKIIGR

SEQ ID NO: 2526448 - protein, 18 aa, Entamoeba dispar
HTPVGAIPILVIDEPFRW

SEQ ID NO: 2526449 - protein, 30 aa, Entamoeba dispar
HTQIPNRNFVVTPPILIIQILRFEQQSNNT

SEQ ID NO: 2526450 - protein, 27 aa, Entamoeba dispar
HTRKKPFIIIDGILQFLKFEKITENKN

SEQ ID NO: 2526451 - protein, 24 aa, Entamoeba dispar
HTSAKIFGILKEKKVKLINCFIGR

SEQ ID NO: 2526452 - protein, 25 aa, Entamoeba dispar
HTTKEVLVLLIKNALLKTELIGGVD

SEQ ID NO: 2526453 - protein, 27 aa, Entamoeba dispar
HTTQSVFQWKEEFLKWSTIKPDAIKLC

SEQ ID NO: 2526454 - protein, 25 aa, Entamoeba dispar
HTTTTLQYQIPPPPPPASHSSTNNS

SEQ ID NO: 2526455 - protein, 17 aa, Entamoeba dispar
HVCIVWTKCYNYTPKKI

SEQ ID NO: 2526456 - protein, 20 aa, Entamoeba dispar
HVFSKLRHQAKAEYRALYRK

SEQ ID NO: 2526457 - protein, 27 aa, Entamoeba dispar
HVGANSFISRIIFIVRDSLETKNKPSV

SEQ ID NO: 2526458 - protein, 18 aa, Entamoeba dispar
HVGDSPVFLIKRNSEKKI

SEQ ID NO: 2526459 - protein, 31 aa, Entamoeba dispar
HVGETIRVFEKKYLWIKTEKQQFNKKGSIFD

SEQ ID NO: 2526460 - protein, 17 aa, Entamoeba dispar
HVIEIYKRATHIVCHNF

SEQ ID NO: 2526461 - protein, 21 aa, Entamoeba dispar
HVKGILLYGPPGCGKTLMARQ

SEQ ID NO: 2526462 - protein, 21 aa, Entamoeba dispar
HVKGTLHYLVGYNKKNNVKVI

SEQ ID NO: 2526463 - protein, 24 aa, Entamoeba dispar
HVKMIGPFYCNFGRYISIGDNCII

SEQ ID NO: 2526464 - protein, 17 aa, Entamoeba dispar
HVKQLNKDRLKRLVFRL

SEQ ID NO: 2526465 - protein, 19 aa, Entamoeba dispar
HVLLNRLGDLPQKFIDNVR

SEQ ID NO: 2526466 - protein, 18 aa, Entamoeba dispar
HVLVILTDMSSYADALRE

SEQ ID NO: 2526467 - protein, 23 aa, Entamoeba dispar
HVNALLFNGIIEATLPLLNQPEL

SEQ ID NO: 2526468 - protein, 22 aa, Entamoeba dispar
HVNTSLFLYKLTIVQNSPIEIK

SEQ ID NO: 2526469 - protein, 18 aa, Entamoeba dispar
HVQMICEVLTLFTPEQLE

SEQ ID NO: 2526470 - protein, 24 aa, Entamoeba dispar
HVQPKMIPKVPLISLIDSAPDYSN

SEQ ID NO: 2526471 - protein, 27 aa, Entamoeba dispar
HVSFQVIKNLYLLLGSVDFLGNPVGLV

SEQ ID NO: 2526472 - protein, 27 aa, Entamoeba dispar
HVSGIIALLFNWVLNDCDVYLPEGGDD

SEQ ID NO: 2526473 - protein, 26 aa, Entamoeba dispar
HVSHDGYLIFYSFEGKVKSYDCFDRE

SEQ ID NO: 2526474 - protein, 19 aa, Entamoeba dispar
HVSLITDARFSGVSTGACI

SEQ ID NO: 2526475 - protein, 24 aa, Entamoeba dispar
HVSTINITIFWHRLHLFNEEIIEG

SEQ ID NO: 2526476 - protein, 18 aa, Entamoeba dispar
HVSTLPVNICRFSPDGTI

SEQ ID NO: 2526477 - protein, 31 aa, Entamoeba dispar
HVWSTEETYQFYQALKIFGTDFEKIQKRLGD

SEQ ID NO: 2526478 - protein, 28 aa, Entamoeba dispar
HWAVKLKKQFETLWKNAFKEKKTGDTKT

SEQ ID NO: 2526479 - protein, 19 aa, Entamoeba dispar
HWIGTMILMFPDVEMRAKL

SEQ ID NO: 2526480 - protein, 18 aa, Entamoeba dispar
HWLKINFSKAFDNIIKEY

SEQ ID NO: 2526481 - protein, 31 aa, Entamoeba dispar
HWLTFHSGYDFGYLLRLLTCEKLPSSVDDFF

SEQ ID NO: 2526482 - protein, 23 aa, Entamoeba dispar
HYAPLLCHFVDYFQPIEVTTIAE

SEQ ID NO: 2526483 - protein, 35 aa, Entamoeba dispar
HYAQLREIIKTIPKFWYFTLKNSGYLDIVFANQND

SEQ ID NO: 2526484 - protein, 25 aa, Entamoeba dispar
HYASLVYRLMNDLEFTIYIGTTLPP

SEQ ID NO: 2526485 - protein, 29 aa, Entamoeba dispar
HYDEVLNINKKFFLALKKLRETHQIETRL

SEQ ID NO: 2526486 - protein, 27 aa, Entamoeba dispar
HYEFPEIVLKCLPLLPFEITDDYLKGR

SEQ ID NO: 2526487 - protein, 21 aa, Entamoeba dispar
HYESALHDFLLAKLINADRLS

SEQ ID NO: 2526488 - protein, 19 aa, Entamoeba dispar
HYFFLLRILREKENMNYYC

SEQ ID NO: 2526489 - protein, 22 aa, Entamoeba dispar
HYIAHHCYFFRKSNLKRLYNDL

SEQ ID NO: 2526490 - protein, 34 aa, Entamoeba dispar
HYINGYLMQIKFSLMIKYLLIGISLKLYSDYEYH

SEQ ID NO: 2526491 - protein, 29 aa, Entamoeba dispar
HYITYFGQELYICFNDSEYLPMSWTSGHI

SEQ ID NO: 2526492 - protein, 17 aa, Entamoeba dispar
HYKFGILYCKSGQNNED

SEQ ID NO: 2526493 - protein, 18 aa, Entamoeba dispar
HYKILHNIKFHDKTAPQY

SEQ ID NO: 2526494 - protein, 20 aa, Entamoeba dispar
HYKYLNSWSKIAKLLKGRTA

SEQ ID NO: 2526495 - protein, 21 aa, Entamoeba dispar
HYNEQKKLLPSFTSFAVSTDN

SEQ ID NO: 2526496 - protein, 27 aa, Entamoeba dispar
HYNKIKHTGYLRNLLIRKAKKTNEIMY

SEQ ID NO: 2526497 - protein, 18 aa, Entamoeba dispar
HYNLIPSVAIIDPEFTYT

SEQ ID NO: 2526498 - protein, 18 aa, Entamoeba dispar
HYNNTRGLLISHNLKRER

SEQ ID NO: 2526499 - protein, 24 aa, Entamoeba dispar
HYNRPYYEFPNLLQQPFALMNQVS

SEQ ID NO: 2526500 - protein, 26 aa, Entamoeba dispar
HYNSHEIIKLFFPNKLYYPCKGRNCK

SEQ ID NO: 2526501 - protein, 17 aa, Entamoeba dispar
HYPVLNLSHAVGIALNY

SEQ ID NO: 2526502 - protein, 26 aa, Entamoeba dispar
HYQECREIMDFLYKRLSEDGKNWREI

SEQ ID NO: 2526503 - protein, 25 aa, Entamoeba dispar
HYQNSFIVLNKFMSIKRFKECVDNI

SEQ ID NO: 2526504 - protein, 29 aa, Entamoeba dispar
HYQTYEADLLFVLRFMVDAGLVGCSWVKV

SEQ ID NO: 2526505 - protein, 28 aa, Entamoeba dispar
HYRSSDNFLIYDLVICTVRLAKNGHEIC

SEQ ID NO: 2526506 - protein, 21 aa, Entamoeba dispar
HYSAYILFYQKEKPIMDIPPV

SEQ ID NO: 2526507 - protein, 18 aa, Entamoeba dispar
HYSSLATTLIFLFRVEPY

SEQ ID NO: 2526508 - protein, 34 aa, Entamoeba dispar
HYSTIYLTVPSFFPLPIPLLRSNAGYITSTNIID

SEQ ID NO: 2526509 - protein, 34 aa, Entamoeba dispar
HYVENIETLIYYLDELRAQPKFKILGEYPYKNYY

SEQ ID NO: 2526510 - protein, 17 aa, Entamoeba dispar
HYVFVVALILTNKNHYH

SEQ ID NO: 2526511 - protein, 22 aa, Entamoeba dispar
HYVVYGEPRNEYMDEKTKRILE

SEQ ID NO: 2526512 - protein, 21 aa, Entamoeba dispar
HYYRKFGYTLDGPYMAKSLNE

SEQ ID NO: 2526513 - protein, 17 aa, Entamoeba dispar
IAADFLISGVDLDNIPD

SEQ ID NO: 2526514 - protein, 20 aa, Entamoeba dispar
IAAEITFYIKCQIAAFCELL

SEQ ID NO: 2526515 - protein, 23 aa, Entamoeba dispar
IAAKKISNAVLYSPLINCKTETV

SEQ ID NO: 2526516 - protein, 17 aa, Entamoeba dispar
IAALRILCPLNFVLLNP

SEQ ID NO: 2526517 - protein, 18 aa, Entamoeba dispar
IAAPPPPSFTKPTVSIAA

SEQ ID NO: 2526518 - protein, 23 aa, Entamoeba dispar
IACFKKCFSLTKINIPTSISELG

SEQ ID NO: 2526519 - protein, 22 aa, Entamoeba dispar
IACFKKCFSLTKINIPTTISEL

SEQ ID NO: 2526520 - protein, 17 aa, Entamoeba dispar
IACLAGCIKNAWCKDMK

SEQ ID NO: 2526521 - protein, 19 aa, Entamoeba dispar
IACQKISHVFSYLDRFFIK

SEQ ID NO: 2526522 - protein, 23 aa, Entamoeba dispar
IADRYFKLVKRTNKYRLKESFEF

SEQ ID NO: 2526523 - protein, 20 aa, Entamoeba dispar
IAEGIKWTPIKYFNNKVVCD

SEQ ID NO: 2526524 - protein, 33 aa, Entamoeba dispar
IAEGNDTWDLLYVGLLMCGYDDLAERCKEENRD

SEQ ID NO: 2526525 - protein, 28 aa, Entamoeba dispar
IAEPLLKPRTFLIWQNSSYPSSAAKIDI

SEQ ID NO: 2526526 - protein, 20 aa, Entamoeba dispar
IAEQFFVYDLKLIKELTIGE

SEQ ID NO: 2526527 - protein, 25 aa, Entamoeba dispar
IAESFSFLHWYISDGSNVLNEMIPL

SEQ ID NO: 2526528 - protein, 26 aa, Entamoeba dispar
IAEVITLLYRSRNKMVPVYCVAFGAV

SEQ ID NO: 2526529 - protein, 23 aa, Entamoeba dispar
IAFQSIHIVLLSDFLQFLQQENI

SEQ ID NO: 2526530 - protein, 40 aa, Entamoeba dispar
IAGIRSINPDKPVEIEFFKPLTLITGPNGAGKTTIIESVR

SEQ ID NO: 2526531 - protein, 18 aa, Entamoeba dispar
IAGLYDMGPLGCALKQNI

SEQ ID NO: 2526532 - protein, 17 aa, Entamoeba dispar
IAGYKRVKEYPNSLKNG

SEQ ID NO: 2526533 - protein, 17 aa, Entamoeba dispar
IAGYNKTLIPKSGELKI

SEQ ID NO: 2526534 - protein, 21 aa, Entamoeba dispar
IAIDPWKLALKRKEQKRRNEE

SEQ ID NO: 2526535 - protein, 20 aa, Entamoeba dispar
IAIISLFYNYGIKLVKNIGR

SEQ ID NO: 2526536 - protein, 17 aa, Entamoeba dispar
IAILRKMNNFKTPSQKL

SEQ ID NO: 2526537 - protein, 24 aa, Entamoeba dispar
IAINSLKVNPWFTSERDINKFCNI

SEQ ID NO: 2526538 - protein, 22 aa, Entamoeba dispar
IAIVFSPNLLFYEDNQDGLMLS

SEQ ID NO: 2526539 - protein, 32 aa, Entamoeba dispar
IAKDLISLKKLWIILGWYYFYENIKESELEKS

SEQ ID NO: 2526540 - protein, 20 aa, Entamoeba dispar
IAKIAMKYCNGRFGTFSQLY

SEQ ID NO: 2526541 - protein, 17 aa, Entamoeba dispar
IAKIHYVSEERIFMNEP

SEQ ID NO: 2526542 - protein, 21 aa, Entamoeba dispar
IALEEGNFLMWDILKEESKTV

SEQ ID NO: 2526543 - protein, 17 aa, Entamoeba dispar
IALFERLSKLRGDEEVR

SEQ ID NO: 2526544 - protein, 17 aa, Entamoeba dispar
IALIFNTLSSYIIQTNN

SEQ ID NO: 2526545 - protein, 24 aa, Entamoeba dispar
IALLNRHFEIVLRKPKSKSTTTLS

SEQ ID NO: 2526546 - protein, 18 aa, Entamoeba dispar
IALLQSDCLKKWTGKKQC

SEQ ID NO: 2526547 - protein, 19 aa, Entamoeba dispar
IALLRMDDIFVDSFEIEDV

SEQ ID NO: 2526548 - protein, 17 aa, Entamoeba dispar
IALMRKMAEKYPDKEAM

SEQ ID NO: 2526549 - protein, 21 aa, Entamoeba dispar
IALPIHLRNFPNNPFYGQFIT

SEQ ID NO: 2526550 - protein, 27 aa, Entamoeba dispar
IALQSFKHFFFFCREFNFLSKDDIAPL

SEQ ID NO: 2526551 - protein, 23 aa, Entamoeba dispar
IALYLKNLKDVYSFLLISKKCKE

SEQ ID NO: 2526552 - protein, 29 aa, Entamoeba dispar
IAMHRRALVILLCWTLNIPYSKASEIDPK

SEQ ID NO: 2526553 - protein, 25 aa, Entamoeba dispar
IANCDITNFWKVKGIIKMFTISNEG

SEQ ID NO: 2526554 - protein, 26 aa, Entamoeba dispar
IANETGAFFFLINGPEIMSKMAGESE

SEQ ID NO: 2526555 - protein, 28 aa, Entamoeba dispar
IANLTTISFPVYPLSSLINLSSLDIESI

SEQ ID NO: 2526556 - protein, 26 aa, Entamoeba dispar
IANQIKLIIPLKIETLELPQLPEYYS

SEQ ID NO: 2526557 - protein, 25 aa, Entamoeba dispar
IANVLKKFLRNLPIHIIDNEITQQI

SEQ ID NO: 2526558 - protein, 20 aa, Entamoeba dispar
IANVYRLFLYYLFINDIFVT

SEQ ID NO: 2526559 - protein, 20 aa, Entamoeba dispar
IAQLYYHYYLRTSETQFLNE

SEQ ID NO: 2526560 - protein, 18 aa, Entamoeba dispar
IAQWRSIFVLYGITCFGI

SEQ ID NO: 2526561 - protein, 24 aa, Entamoeba dispar
IARKQLVEILWKLGDSYFADVIDE

SEQ ID NO: 2526562 - protein, 26 aa, Entamoeba dispar
IARYAVGKNVFILDLGNHSTNYITLI

SEQ ID NO: 2526563 - protein, 25 aa, Entamoeba dispar
IASCIRYLFFFIGPSIVDFTQTIST

SEQ ID NO: 2526564 - protein, 23 aa, Entamoeba dispar
IASIIKALKLLFPPSFDKDQTNK

SEQ ID NO: 2526565 - protein, 23 aa, Entamoeba dispar
IASLAHFLYNLYTETGPKYDKII

SEQ ID NO: 2526566 - protein, 19 aa, Entamoeba dispar
IASPLFIKIELLRYERRVP

SEQ ID NO: 2526567 - protein, 23 aa, Entamoeba dispar
IASQFAINFPDLEKIYLRDIAVP

SEQ ID NO: 2526568 - protein, 17 aa, Entamoeba dispar
IASTLHFLQPSVLFHKM

SEQ ID NO: 2526569 - protein, 17 aa, Entamoeba dispar
IASTQMFNFISSFFVNM

SEQ ID NO: 2526570 - protein, 22 aa, Entamoeba dispar
IASTVLHYFIELAVKIANGPSL

SEQ ID NO: 2526571 - protein, 19 aa, Entamoeba dispar
IATIISPLIQLPLSNDFIK

SEQ ID NO: 2526572 - protein, 21 aa, Entamoeba dispar
IATKYMTTCECLELGLTTCLT

SEQ ID NO: 2526573 - protein, 21 aa, Entamoeba dispar
IATSFAQCSLIPGAPSIFLYS

SEQ ID NO: 2526574 - protein, 22 aa, Entamoeba dispar
IAVNVIAEFKFLLEVFQMEENG

SEQ ID NO: 2526575 - protein, 29 aa, Entamoeba dispar
IAVYCLKDTYLPIKLLEKLMSLVNGFEMC

SEQ ID NO: 2526576 - protein, 18 aa, Entamoeba dispar
IAWNYREFIIEYHSLDNE

SEQ ID NO: 2526577 - protein, 23 aa, Entamoeba dispar
IAWQLRHKAWKILLGQVPLDQDK

SEQ ID NO: 2526578 - protein, 19 aa, Entamoeba dispar
IAYQRLNIPKLIKAEFVEK

SEQ ID NO: 2526579 - protein, 18 aa, Entamoeba dispar
IAYWILENPNSLEEKYRY

SEQ ID NO: 2526580 - protein, 19 aa, Entamoeba dispar
ICALLPETTSRLLRILKDE

SEQ ID NO: 2526581 - protein, 17 aa, Entamoeba dispar
ICCCIIKYINYKELLSN

SEQ ID NO: 2526582 - protein, 18 aa, Entamoeba dispar
ICCPVIPDVKKYVQEKGG

SEQ ID NO: 2526583 - protein, 17 aa, Entamoeba dispar
ICDLAEALLLAVIEYLN

SEQ ID NO: 2526584 - protein, 27 aa, Entamoeba dispar
ICDPEFHKEWDPYLISWTVIDKKNEQT

SEQ ID NO: 2526585 - protein, 26 aa, Entamoeba dispar
ICEAPPVPAPRRGLTLGRKSVTNIPS

SEQ ID NO: 2526586 - protein, 26 aa, Entamoeba dispar
ICEAPPVPAPRRGLVLGRRSSSISSE

SEQ ID NO: 2526587 - protein, 27 aa, Entamoeba dispar
ICEKYTPDFEWYCNIVIHILELNKVEP

SEQ ID NO: 2526588 - protein, 19 aa, Entamoeba dispar
ICELYFELHPIFIKSCTLN

SEQ ID NO: 2526589 - protein, 18 aa, Entamoeba dispar
ICFMKQIIKVLFATQTFS

SEQ ID NO: 2526590 - protein, 17 aa, Entamoeba dispar
ICFVAQSSNPRLTANQK

SEQ ID NO: 2526591 - protein, 23 aa, Entamoeba dispar
ICFVYNGEIVDPLLSLNDLSLKD

SEQ ID NO: 2526592 - protein, 25 aa, Entamoeba dispar
ICIDFISFCISNYPLIFPNDIDEKL

SEQ ID NO: 2526593 - protein, 20 aa, Entamoeba dispar
ICIGYCLSILAIIPATNVKS

SEQ ID NO: 2526594 - protein, 23 aa, Entamoeba dispar
ICIHSIIQIHILNIFVTIQNING

SEQ ID NO: 2526595 - protein, 19 aa, Entamoeba dispar
ICILKRRYLLQNNAIEILT

SEQ ID NO: 2526596 - protein, 18 aa, Entamoeba dispar
ICITGYPVNVIKGFLGLL

SEQ ID NO: 2526597 - protein, 17 aa, Entamoeba dispar
ICKLPSLNLWNITINPI

SEQ ID NO: 2526598 - protein, 23 aa, Entamoeba dispar
ICKSISLIQMMFEKNLTPCFKYS

SEQ ID NO: 2526599 - protein, 27 aa, Entamoeba dispar
ICLCDQEYKILLTLRSFTFDKTGDKVA

SEQ ID NO: 2526600 - protein, 23 aa, Entamoeba dispar
ICLEEIIILINSKKIEEEKGKEI

SEQ ID NO: 2526601 - protein, 17 aa, Entamoeba dispar
ICNAMYIGFTYATPDTI

SEQ ID NO: 2526602 - protein, 17 aa, Entamoeba dispar
ICNIIGRGFNRCLAILS

SEQ ID NO: 2526603 - protein, 33 aa, Entamoeba dispar
ICPANIFDFSKFRVLLYINSSYQPLIPSFGTME

SEQ ID NO: 2526604 - protein, 25 aa, Entamoeba dispar
ICPEGIDVVWLWVNGSDPGFRKEFE

SEQ ID NO: 2526605 - protein, 17 aa, Entamoeba dispar
ICPLPLIKFTRNGVDLR

SEQ ID NO: 2526606 - protein, 18 aa, Entamoeba dispar
ICQGPDSFYFIHKGKIGK

SEQ ID NO: 2526607 - protein, 18 aa, Entamoeba dispar
ICQKKSMFLVQNPKIKTT

SEQ ID NO: 2526608 - protein, 19 aa, Entamoeba dispar
ICQQLLREVVIQLTVVPAI

SEQ ID NO: 2526609 - protein, 17 aa, Entamoeba dispar
ICRLFTSISSEGLNRMS

SEQ ID NO: 2526610 - protein, 24 aa, Entamoeba dispar
ICSAEYLCTILIALSSKSISTNER

SEQ ID NO: 2526611 - protein, 27 aa, Entamoeba dispar
ICSTHKVSFLPLFEPKMFSSKYQIVMK

SEQ ID NO: 2526612 - protein, 22 aa, Entamoeba dispar
ICVKFAFIEFIGDKSPRLQKAG

SEQ ID NO: 2526613 - protein, 20 aa, Entamoeba dispar
ICYFHNLGYDGRFLAQYGII

SEQ ID NO: 2526614 - protein, 18 aa, Entamoeba dispar
ICYPNYLSPLKATRKIRK

SEQ ID NO: 2526615 - protein, 23 aa, Entamoeba dispar
IDACGNLVDIGDYLIYEKTKEQL

SEQ ID NO: 2526616 - protein, 30 aa, Entamoeba dispar
IDAEEWVFNRSFIPLKFSLDKKNYIGGKIG

SEQ ID NO: 2526617 - protein, 23 aa, Entamoeba dispar
IDARLIKQIILMQKIPISKYQVS

SEQ ID NO: 2526618 - protein, 24 aa, Entamoeba dispar
IDCNIILLLFTYLSKGTYKIFTQF

SEQ ID NO: 2526619 - protein, 23 aa, Entamoeba dispar
IDDFYLNIIHWNTQHELLVALTD

SEQ ID NO: 2526620 - protein, 19 aa, Entamoeba dispar
IDDIYFISDLLTLPQPYPT

SEQ ID NO: 2526621 - protein, 34 aa, Entamoeba dispar
IDDKKVLLKSPTKIIIILPPLTVGLVTIRIENEF

SEQ ID NO: 2526622 - protein, 24 aa, Entamoeba dispar
IDDLDWIDFLFTKFSSVPQLNQQL

SEQ ID NO: 2526623 - protein, 28 aa, Entamoeba dispar
IDDNYLLKVMGYITVRFKQLRTTRNEVV

SEQ ID NO: 2526624 - protein, 24 aa, Entamoeba dispar
IDECKNCQFIINKNQIKEMKITKC

SEQ ID NO: 2526625 - protein, 27 aa, Entamoeba dispar
IDEFLSTHYYWIAKQYQLLASIYERNK

SEQ ID NO: 2526626 - protein, 18 aa, Entamoeba dispar
IDELIPYLDKYGQEFEEL

SEQ ID NO: 2526627 - protein, 27 aa, Entamoeba dispar
IDENKTIDYYLPNPLKPPKIDICFKEK

SEQ ID NO: 2526628 - protein, 20 aa, Entamoeba dispar
IDEPYLYGHLMDCEHIFIIS

SEQ ID NO: 2526629 - protein, 27 aa, Entamoeba dispar
IDESYIIFDLLLFKEIIEKGYGMYKSY

SEQ ID NO: 2526630 - protein, 19 aa, Entamoeba dispar
IDETLYFPINSARPNIHFF

SEQ ID NO: 2526631 - protein, 24 aa, Entamoeba dispar
IDFDEGWYVIFGCTYQPGIERKYS

SEQ ID NO: 2526632 - protein, 26 aa, Entamoeba dispar
IDFDYYIENQLKKPLTRIFKPILGEK

SEQ ID NO: 2526633 - protein, 21 aa, Entamoeba dispar
IDFGDRLYHLNLKPQEPIKDE

SEQ ID NO: 2526634 - protein, 18 aa, Entamoeba dispar
IDFPPFLKELHTSCFSQC

SEQ ID NO: 2526635 - protein, 18 aa, Entamoeba dispar
IDFRGVSYSTLKLPQSLK

SEQ ID NO: 2526636 - protein, 32 aa, Entamoeba dispar
IDFTLLSNILFVQYLLGIVPNWRVLNSTFSRM

SEQ ID NO: 2526637 - protein, 17 aa, Entamoeba dispar
IDFYTSITRARFEELNI

SEQ ID NO: 2526638 - protein, 28 aa, Entamoeba dispar
IDGKRFHLTEGFLFYPNSKYIPFTNNYF

SEQ ID NO: 2526639 - protein, 26 aa, Entamoeba dispar
IDGLQYLLIIRHHAVFYYVKEKRSKK

SEQ ID NO: 2526640 - protein, 23 aa, Entamoeba dispar
IDGQILQTFYIQQTAQMRHEGRT

SEQ ID NO: 2526641 - protein, 34 aa, Entamoeba dispar
IDHLKGFIPIFKQKWILKLKEMMLFVVDLTEIKD

SEQ ID NO: 2526642 - protein, 18 aa, Entamoeba dispar
IDHLYGNYIIDQSTYRVG

SEQ ID NO: 2526643 - protein, 18 aa, Entamoeba dispar
IDHTCGISLLVESFYNDQ

SEQ ID NO: 2526644 - protein, 24 aa, Entamoeba dispar
IDIDHIVICAPFLKDKYVSYSLKK

SEQ ID NO: 2526645 - protein, 26 aa, Entamoeba dispar
IDIDLNLLPIDRGISSWFFLREPEGS

SEQ ID NO: 2526646 - protein, 26 aa, Entamoeba dispar
IDIKNTYLLIPLLTKKERTNSLGKVT

SEQ ID NO: 2526647 - protein, 23 aa, Entamoeba dispar
IDIKPKRIIFKSIEEYIKVPLKE

SEQ ID NO: 2526648 - protein, 25 aa, Entamoeba dispar
IDIKSHFGFVTFTNAEDGKKIIDDK

SEQ ID NO: 2526649 - protein, 19 aa, Entamoeba dispar
IDILASLMYLPDSSQIHFI

SEQ ID NO: 2526650 - protein, 32 aa, Entamoeba dispar
IDILRGIDQLLLPNVFYKLLTVILLRSEIQPH

SEQ ID NO: 2526651 - protein, 19 aa, Entamoeba dispar
IDILVVEYFKILQLQQKIN

SEQ ID NO: 2526652 - protein, 25 aa, Entamoeba dispar
IDIPQPLNWIKKDAGHFIFTLINHQ

SEQ ID NO: 2526653 - protein, 26 aa, Entamoeba dispar
IDIWSLGCCIYWMATGHPIYPIDDVN

SEQ ID NO: 2526654 - protein, 26 aa, Entamoeba dispar
IDIYEVHGLLPLFTKVYQFVGKEKLF

SEQ ID NO: 2526655 - protein, 25 aa, Entamoeba dispar
IDKDELYKYVYSISDPAERSKVIRT

SEQ ID NO: 2526656 - protein, 22 aa, Entamoeba dispar
IDKDVLNFLKSYFSFTDVDVLS

SEQ ID NO: 2526657 - protein, 26 aa, Entamoeba dispar
IDKFNYQILSIFTPLSMATSLLVYED

SEQ ID NO: 2526658 - protein, 21 aa, Entamoeba dispar
IDKIDEFIQLLYSKKQYHLQL

SEQ ID NO: 2526659 - protein, 22 aa, Entamoeba dispar
IDKKHIIQLKEKYSKEFNDLTK

SEQ ID NO: 2526660 - protein, 25 aa, Entamoeba dispar
IDKLPEFINFYFSTTRIVFLSPFNS

SEQ ID NO: 2526661 - protein, 20 aa, Entamoeba dispar
IDKLSEEQIELAKQALEDGN

SEQ ID NO: 2526662 - protein, 20 aa, Entamoeba dispar
IDKYYFDQLFNTIKLHPKRF

SEQ ID NO: 2526663 - protein, 27 aa, Entamoeba dispar
IDLCKPALSLLLTFFSKKVISNDIRVI

SEQ ID NO: 2526664 - protein, 18 aa, Entamoeba dispar
IDLEQFPLLTKISLRTHC

SEQ ID NO: 2526665 - protein, 18 aa, Entamoeba dispar
IDLKKLAQDDVLGDAVVR

SEQ ID NO: 2526666 - protein, 19 aa, Entamoeba dispar
IDLLKFLCNSFVLLNGTFT

SEQ ID NO: 2526667 - protein, 22 aa, Entamoeba dispar
IDLLLLESGKPHRLFFNIYGQR

SEQ ID NO: 2526668 - protein, 21 aa, Entamoeba dispar
IDLLLRAVPWTDYKAREEMAD

SEQ ID NO: 2526669 - protein, 18 aa, Entamoeba dispar
IDLVKWYIKRIEGDDSSY

SEQ ID NO: 2526670 - protein, 18 aa, Entamoeba dispar
IDLVYQYPNSIETLIFRV

SEQ ID NO: 2526671 - protein, 29 aa, Entamoeba dispar
IDMQHLLIQLFIRCDHTLFIWSSKSFCNS

SEQ ID NO: 2526672 - protein, 19 aa, Entamoeba dispar
IDMQYFQMVSIRQTSCCLV

SEQ ID NO: 2526673 - protein, 28 aa, Entamoeba dispar
IDMWSVGCIIAELFLGVPLFPADSEFDL

SEQ ID NO: 2526674 - protein, 24 aa, Entamoeba dispar
IDNKKFIMRLLSEDNVFLNEFVFI

SEQ ID NO: 2526675 - protein, 20 aa, Entamoeba dispar
IDNMIWNWVNEKVKGYGLYV

SEQ ID NO: 2526676 - protein, 27 aa, Entamoeba dispar
IDNMYFIMMDLMKGSIWDLLHQRPMEF

SEQ ID NO: 2526677 - protein, 22 aa, Entamoeba dispar
IDNNFNILFTLGGDGTLRGANR

SEQ ID NO: 2526678 - protein, 24 aa, Entamoeba dispar
IDNRPWHINVEYRTQKWNELVSFL

SEQ ID NO: 2526679 - protein, 27 aa, Entamoeba dispar
IDPIKRRFLIFMLNLYYSIAQQQEINK

SEQ ID NO: 2526680 - protein, 23 aa, Entamoeba dispar
IDPTLSMMLSQISKLSIGDDDKP

SEQ ID NO: 2526681 - protein, 24 aa, Entamoeba dispar
IDPTRYVIIPRPITIQFHKLKSYF

SEQ ID NO: 2526682 - protein, 23 aa, Entamoeba dispar
IDQDQIIFISEYPSQITKPSRKQ

SEQ ID NO: 2526683 - protein, 23 aa, Entamoeba dispar
IDQLLKGYFGISVLNVANENGVI

SEQ ID NO: 2526684 - protein, 26 aa, Entamoeba dispar
IDQMENQMFTIIKIKTNKPIDIINKA

SEQ ID NO: 2526685 - protein, 25 aa, Entamoeba dispar
IDQSYILPILITKSVFYFDSCCWGW

SEQ ID NO: 2526686 - protein, 28 aa, Entamoeba dispar
IDQSYSDLLLILFHRALCSCLGSFISSI

SEQ ID NO: 2526687 - protein, 18 aa, Entamoeba dispar
IDREIIFMKIIRSSYIVQ

SEQ ID NO: 2526688 - protein, 23 aa, Entamoeba dispar
IDREKIQLVSWLNQQLLTDKKIT

SEQ ID NO: 2526689 - protein, 17 aa, Entamoeba dispar
IDRKRMLEKLWGDNYWD

SEQ ID NO: 2526690 - protein, 17 aa, Entamoeba dispar
IDRLGPYIFWECNNLKK

SEQ ID NO: 2526691 - protein, 22 aa, Entamoeba dispar
IDRRLREVLIYLFSQEYSEADK

SEQ ID NO: 2526692 - protein, 20 aa, Entamoeba dispar
IDSAPLPILSLIGIVVILII

SEQ ID NO: 2526693 - protein, 18 aa, Entamoeba dispar
IDSFGYQIKLIDTQTELE

SEQ ID NO: 2526694 - protein, 17 aa, Entamoeba dispar
IDSFIDAFAKRASQLYD

SEQ ID NO: 2526695 - protein, 21 aa, Entamoeba dispar
IDSIHIFIKSLDFFAELIYDR

SEQ ID NO: 2526696 - protein, 23 aa, Entamoeba dispar
IDSKNFQLLCQDLHLLIQEELNK

SEQ ID NO: 2526697 - protein, 26 aa, Entamoeba dispar
IDSLHKYFPLRFIPTLWTEDCDLLTQ

SEQ ID NO: 2526698 - protein, 23 aa, Entamoeba dispar
IDSNIMAILCYLLNNVHITEIRE

SEQ ID NO: 2526699 - protein, 31 aa, Entamoeba dispar
IDSPPTIIALGKYFHYLLSSNNFFQIEQMLP

SEQ ID NO: 2526700 - protein, 26 aa, Entamoeba dispar
IDSRYELLYHLQTFSLSLLSEFVPLL

SEQ ID NO: 2526701 - protein, 23 aa, Entamoeba dispar
IDSSYMVFISFLSIQLEELSSYY

SEQ ID NO: 2526702 - protein, 25 aa, Entamoeba dispar
IDSTFNYLMLEYIYPILLGEMEGDI

SEQ ID NO: 2526703 - protein, 17 aa, Entamoeba dispar
IDSWHVHSFMGRPKKEW

SEQ ID NO: 2526704 - protein, 22 aa, Entamoeba dispar
IDSWNYKYRKVAEPIYDVINRF

SEQ ID NO: 2526705 - protein, 28 aa, Entamoeba dispar
IDSYQVLDMLWMIWNFDEEYSIFCKEKE

SEQ ID NO: 2526706 - protein, 17 aa, Entamoeba dispar
IDTAVDFIPGGNIIKKG

SEQ ID NO: 2526707 - protein, 20 aa, Entamoeba dispar
IDTELLKRWTGMRNFRIIFE

SEQ ID NO: 2526708 - protein, 30 aa, Entamoeba dispar
IDTEVEVQIIQRICLYWLKYDESTEEVIME

SEQ ID NO: 2526709 - protein, 21 aa, Entamoeba dispar
IDTHIFVISHRLGWADGSTPE

SEQ ID NO: 2526710 - protein, 17 aa, Entamoeba dispar
IDTITLRDSITLLNDPF

SEQ ID NO: 2526711 - protein, 24 aa, Entamoeba dispar
IDTMPLLTQRFTFDQIINAFDFFQ

SEQ ID NO: 2526712 - protein, 32 aa, Entamoeba dispar
IDTPFLLNNPKYFLHFLPRIISSLPTCRFILN

SEQ ID NO: 2526713 - protein, 23 aa, Entamoeba dispar
IDTTHIFYDLFKNTNFNSFCKCF

SEQ ID NO: 2526714 - protein, 25 aa, Entamoeba dispar
IDVGIGLERIPWLINGTPTSYLEAF

SEQ ID NO: 2526715 - protein, 25 aa, Entamoeba dispar
IDVIVPWTHLYSKPIILRLGEVIVD

SEQ ID NO: 2526716 - protein, 24 aa, Entamoeba dispar
IDVKPKRIIFKSIEEYIKVPLKEA

SEQ ID NO: 2526717 - protein, 23 aa, Entamoeba dispar
IDVLAQSLIIGNIILYHKEHVEK

SEQ ID NO: 2526718 - protein, 18 aa, Entamoeba dispar
IDVLISTQFLLAGKSDKL

SEQ ID NO: 2526719 - protein, 25 aa, Entamoeba dispar
IDVMKKITYWMLVREKYFEENLPQV

SEQ ID NO: 2526720 - protein, 27 aa, Entamoeba dispar
IDVQLQELLPFLYQRYPTTFPMDCTYY

SEQ ID NO: 2526721 - protein, 20 aa, Entamoeba dispar
IDVSLFNRLPVDKKKKSDVF

SEQ ID NO: 2526722 - protein, 17 aa, Entamoeba dispar
IDVTNACGRLGPAELDK

SEQ ID NO: 2526723 - protein, 18 aa, Entamoeba dispar
IDVVLLRELCREFGIPDT

SEQ ID NO: 2526724 - protein, 18 aa, Entamoeba dispar
IDYFDYIDEGLSKRLKSI

SEQ ID NO: 2526725 - protein, 17 aa, Entamoeba dispar
IDYLIRMKGIPKDVIIG

SEQ ID NO: 2526726 - protein, 26 aa, Entamoeba dispar
IDYLKIKIFSFPLIRNIIKMMNDKEK

SEQ ID NO: 2526727 - protein, 25 aa, Entamoeba dispar
IDYLNDAMCLPLIELTNRLGTATQN

SEQ ID NO: 2526728 - protein, 17 aa, Entamoeba dispar
IDYMVPQMLFSLLEIAS

SEQ ID NO: 2526729 - protein, 18 aa, Entamoeba dispar
IDYQILYDAFFKNQKKGT

SEQ ID NO: 2526730 - protein, 25 aa, Entamoeba dispar
IDYRPGESYWLKPNGDRLTVIFSIK

SEQ ID NO: 2526731 - protein, 22 aa, Entamoeba dispar
IDYYPFNDLKVELLRDFYNDMN

SEQ ID NO: 2526732 - protein, 26 aa, Entamoeba dispar
IEAALAKKRAERAKKFAISDSDDDDD

SEQ ID NO: 2526733 - protein, 25 aa, Entamoeba dispar
IEAIEKWFKSIGMKTKLSEWGKGKE

SEQ ID NO: 2526734 - protein, 17 aa, Entamoeba dispar
IEAIVTVTHFDITLDCL

SEQ ID NO: 2526735 - protein, 20 aa, Entamoeba dispar
IEAKKKLEILENEKKDLIDK

SEQ ID NO: 2526736 - protein, 42 aa, Entamoeba dispar
IEALLHSLLQISVIRPVVLKLADVGLPLKMISILEAHSFFTE

SEQ ID NO: 2526737 - protein, 42 aa, Entamoeba dispar
IEAPKGYPIIPLKPSYLPYPPQFLIPPQKSYLPRKVRLHSLH

SEQ ID NO: 2526738 - protein, 26 aa, Entamoeba dispar
IEATLAKKRAERAKKFAISDSDDDDD

SEQ ID NO: 2526739 - protein, 23 aa, Entamoeba dispar
IECCEIYYKDLPKKFSRYRNSNY

SEQ ID NO: 2526740 - protein, 18 aa, Entamoeba dispar
IECDEEINPIKTPCLLIP

SEQ ID NO: 2526741 - protein, 19 aa, Entamoeba dispar
IECDEEINPIKTPCLLIPE

SEQ ID NO: 2526742 - protein, 24 aa, Entamoeba dispar
IECDPFNHIYYSNRSACYCYLNND

SEQ ID NO: 2526743 - protein, 18 aa, Entamoeba dispar
IECMKIIKNIIIKGFNYI

SEQ ID NO: 2526744 - protein, 23 aa, Entamoeba dispar
IECSLSVHIINILSIISSLHKDK

SEQ ID NO: 2526745 - protein, 19 aa, Entamoeba dispar
IEDCIVEFIWNYSPVSLVN

SEQ ID NO: 2526746 - protein, 17 aa, Entamoeba dispar
IEDFYDMIWEQETPIII

SEQ ID NO: 2526747 - protein, 20 aa, Entamoeba dispar
IEDKDIIELEKSTKSKDIKD

SEQ ID NO: 2526748 - protein, 18 aa, Entamoeba dispar
IEDLISKIDFALEDIEHA

SEQ ID NO: 2526749 - protein, 26 aa, Entamoeba dispar
IEDTSNIDLFIPYLGNEGYFKINSQT

SEQ ID NO: 2526750 - protein, 24 aa, Entamoeba dispar
IEDYYMFFIHPCGTSSSLLPIIES

SEQ ID NO: 2526751 - protein, 24 aa, Entamoeba dispar
IEEAELYTLLPSGSLLKHSDFGFY

SEQ ID NO: 2526752 - protein, 49 aa, Entamoeba dispar
IEECDWRKVFMPSDAKFIEKWAYPLCSQVYYYPIKSLVIELDNEPLKSE

SEQ ID NO: 2526753 - protein, 20 aa, Entamoeba dispar
IEECGTALILFKANDQSKET

SEQ ID NO: 2526754 - protein, 35 aa, Entamoeba dispar
IEEEIISLIIKQLYHFLAYYVLDTLFTQPEKICCS

SEQ ID NO: 2526755 - protein, 26 aa, Entamoeba dispar
IEEHDPFVLLRIIYLCKTANVNIDIS

SEQ ID NO: 2526756 - protein, 17 aa, Entamoeba dispar
IEEIRRSFRGNWPVPYI

SEQ ID NO: 2526757 - protein, 20 aa, Entamoeba dispar
IEEKILLSAKKKLVLDHLII

SEQ ID NO: 2526758 - protein, 17 aa, Entamoeba dispar
IEEKVFIFLKDGVKEKT

SEQ ID NO: 2526759 - protein, 24 aa, Entamoeba dispar
IEELHLLMDILTEYGYYFTAHPMK

SEQ ID NO: 2526760 - protein, 26 aa, Entamoeba dispar
IEERGNLINELLIKRLESIPKSSDLS

SEQ ID NO: 2526761 - protein, 18 aa, Entamoeba dispar
IEERKYFFEFIKKNSKNT

SEQ ID NO: 2526762 - protein, 25 aa, Entamoeba dispar
IEEYSHLIILFKFHLNKNHVYHPLV

SEQ ID NO: 2526763 - protein, 30 aa, Entamoeba dispar
IEFFIDMVGILFTLIPYWNGNYKVLSETMK

SEQ ID NO: 2526764 - protein, 17 aa, Entamoeba dispar
IEFIKKYVQFFSRDGLK

SEQ ID NO: 2526765 - protein, 20 aa, Entamoeba dispar
IEFIPIDYNKQWKFFEDSKK

SEQ ID NO: 2526766 - protein, 21 aa, Entamoeba dispar
IEFLELLFVDLLFGDKEIPFI

SEQ ID NO: 2526767 - protein, 18 aa, Entamoeba dispar
IEFPLHCNKVLLLNNSNA

SEQ ID NO: 2526768 - protein, 28 aa, Entamoeba dispar
IEFTPISYQPLKALAPFITDFSGESIAG

SEQ ID NO: 2526769 - protein, 17 aa, Entamoeba dispar
IEFYTKFGFRKIKIIPR

SEQ ID NO: 2526770 - protein, 26 aa, Entamoeba dispar
IEGDRFAKLIKKWYFHRQNKAPSSIK

SEQ ID NO: 2526771 - protein, 24 aa, Entamoeba dispar
IEGFIADRNIGLPQLIAVIKEFFT

SEQ ID NO: 2526772 - protein, 23 aa, Entamoeba dispar
IEGIIIFFDLITSSILKILNFKG

SEQ ID NO: 2526773 - protein, 18 aa, Entamoeba dispar
IEGLIKLLNNVILYQVGD

SEQ ID NO: 2526774 - protein, 19 aa, Entamoeba dispar
IEGMLKKYITFGNKSSFNQ

SEQ ID NO: 2526775 - protein, 18 aa, Entamoeba dispar
IEGRKIIVAAAYKRIEKK

SEQ ID NO: 2526776 - protein, 25 aa, Entamoeba dispar
IEGVQQFGIGHWKLILNNFKFDDRS

SEQ ID NO: 2526777 - protein, 25 aa, Entamoeba dispar
IEHFNYWFWDYRSPYWEDIKRLVLK

SEQ ID NO: 2526778 - protein, 19 aa, Entamoeba dispar
IEHILFYHQLNPAKLISIF

SEQ ID NO: 2526779 - protein, 17 aa, Entamoeba dispar
IEHLYKGIQKDRVKQEE

SEQ ID NO: 2526780 - protein, 18 aa, Entamoeba dispar
IEHQLVVPLIVGNIFLQP

SEQ ID NO: 2526781 - protein, 25 aa, Entamoeba dispar
IEHQTIFKELMKLSYKIISFSDLNS

SEQ ID NO: 2526782 - protein, 19 aa, Entamoeba dispar
IEHTTSLVNILYSVFQFTK

SEQ ID NO: 2526783 - protein, 18 aa, Entamoeba dispar
IEIERIIQMLLNGVIYPM

SEQ ID NO: 2526784 - protein, 22 aa, Entamoeba dispar
IEIIGGIFEILIKEGETLPTTG

SEQ ID NO: 2526785 - protein, 17 aa, Entamoeba dispar
IEIILPSSLSILNVLSC

SEQ ID NO: 2526786 - protein, 19 aa, Entamoeba dispar
IEIIPMKLPNTFGLIKGNE

SEQ ID NO: 2526787 - protein, 29 aa, Entamoeba dispar
IEIKDTLFYYRMMWNLDVGPSYSLPPKSA

SEQ ID NO: 2526788 - protein, 17 aa, Entamoeba dispar
IEIKYPSIFKKDGKYYL

SEQ ID NO: 2526789 - protein, 25 aa, Entamoeba dispar
IEIPKLYIEPIPYSNSQTITFETLQ

SEQ ID NO: 2526790 - protein, 17 aa, Entamoeba dispar
IEIPYNLQIINGKNIFK

SEQ ID NO: 2526791 - protein, 20 aa, Entamoeba dispar
IEIRTICNCLWENCLKYFKD

SEQ ID NO: 2526792 - protein, 26 aa, Entamoeba dispar
IEIRTLYFTSLGMLLYSLPSKFHLQF

SEQ ID NO: 2526793 - protein, 17 aa, Entamoeba dispar
IEISKKENWLIKIWSIV

SEQ ID NO: 2526794 - protein, 26 aa, Entamoeba dispar
IEISRIQYYLTLYSKTRLRKIHQMAR

SEQ ID NO: 2526795 - protein, 19 aa, Entamoeba dispar
IEITKLTINLLRKHLTVLA

SEQ ID NO: 2526796 - protein, 17 aa, Entamoeba dispar
IEIVAQEHLPIIIVITK

SEQ ID NO: 2526797 - protein, 33 aa, Entamoeba dispar
IEKAYRLIEYYPKLYKNLFIRLVKENATLEYWD

SEQ ID NO: 2526798 - protein, 24 aa, Entamoeba dispar
IEKELDLVYLIHNLSEGMIHEYKD

SEQ ID NO: 2526799 - protein, 18 aa, Entamoeba dispar
IEKEYLWNKVRVEGGAYG

SEQ ID NO: 2526800 - protein, 23 aa, Entamoeba dispar
IEKFKYIISYWIEHFSSDFTTQM

SEQ ID NO: 2526801 - protein, 26 aa, Entamoeba dispar
IEKHATYGFYWMIGAAKVSDYKDWCL

SEQ ID NO: 2526802 - protein, 25 aa, Entamoeba dispar
IEKKERTLFIISNRNYDLSQGLMHG

SEQ ID NO: 2526803 - protein, 25 aa, Entamoeba dispar
IEKKFKVFMVILDSMTDRELDGSAK

SEQ ID NO: 2526804 - protein, 23 aa, Entamoeba dispar
IEKKGINEFTLPTTITKLGDSCF

SEQ ID NO: 2526805 - protein, 24 aa, Entamoeba dispar
IEKKNINEFIIPSSINKLGSYCFN

SEQ ID NO: 2526806 - protein, 26 aa, Entamoeba dispar
IEKKNLNIRGLIQMIDEKEKNWKRTE

SEQ ID NO: 2526807 - protein, 23 aa, Entamoeba dispar
IEKKQFNFIVPQQHSPKTTTLTF

SEQ ID NO: 2526808 - protein, 19 aa, Entamoeba dispar
IEKLKKLPRKSLETSREVL

SEQ ID NO: 2526809 - protein, 18 aa, Entamoeba dispar
IEKPRYNGLPLFPYMCRS

SEQ ID NO: 2526810 - protein, 25 aa, Entamoeba dispar
IEKPSALKGFLIPVTKSGSPINEEI

SEQ ID NO: 2526811 - protein, 24 aa, Entamoeba dispar
IEKRTFIYFTILKKYQLPMENEDL

SEQ ID NO: 2526812 - protein, 17 aa, Entamoeba dispar
IEKSFFHKFYEPLKEWT

SEQ ID NO: 2526813 - protein, 19 aa, Entamoeba dispar
IEKSLFPFVVFHSSPLIPF

SEQ ID NO: 2526814 - protein, 21 aa, Entamoeba dispar
IEKSLFPFVVFHSSPLIPFNS

SEQ ID NO: 2526815 - protein, 20 aa, Entamoeba dispar
IEKTMRHKITLEGKIQQIFF

SEQ ID NO: 2526816 - protein, 19 aa, Entamoeba dispar
IEKVILFQQKECCSATHIN

SEQ ID NO: 2526817 - protein, 23 aa, Entamoeba dispar
IELAKWIIQEFPNAFIGIAGVVT

SEQ ID NO: 2526818 - protein, 30 aa, Entamoeba dispar
IELESGDEIILCSDGIWDVTTPEKAFEIME

SEQ ID NO: 2526819 - protein, 17 aa, Entamoeba dispar
IELGYCITFFETSGRNK

SEQ ID NO: 2526820 - protein, 17 aa, Entamoeba dispar
IELKSINNLKQLKLHGV

SEQ ID NO: 2526821 - protein, 32 aa, Entamoeba dispar
IELLQNKRIGFLNSFFFTKLSKNWSLSGNRID

SEQ ID NO: 2526822 - protein, 18 aa, Entamoeba dispar
IELLSRLEPFYDVDMLSV

SEQ ID NO: 2526823 - protein, 27 aa, Entamoeba dispar
IELMSFYLITPIQRIPRYELLIRDMLK

SEQ ID NO: 2526824 - protein, 26 aa, Entamoeba dispar
IELNDVWNLDIILTTGNAKPVEKETR

SEQ ID NO: 2526825 - protein, 17 aa, Entamoeba dispar
IELPIKHPELFESLGIA

SEQ ID NO: 2526826 - protein, 23 aa, Entamoeba dispar
IELRLSQCVIPLSLPFSIKSLSL

SEQ ID NO: 2526827 - protein, 19 aa, Entamoeba dispar
IELSQFRILMKFLSKNFDN

SEQ ID NO: 2526828 - protein, 36 aa, Entamoeba dispar
IELYEFFLNFETYVQYLPFIYKLNFIQKDNIFDLVV

SEQ ID NO: 2526829 - protein, 18 aa, Entamoeba dispar
IELYKILPSFKSVKKLDL

SEQ ID NO: 2526830 - protein, 19 aa, Entamoeba dispar
IELYYKWNQKITNWVAYSI

SEQ ID NO: 2526831 - protein, 17 aa, Entamoeba dispar
IEMASCSGLTLIPKELR

SEQ ID NO: 2526832 - protein, 17 aa, Entamoeba dispar
IEMIKVNQKILQKWCNC

SEQ ID NO: 2526833 - protein, 27 aa, Entamoeba dispar
IEMKYNPIIIWVDADIKLLYQRADKRV

SEQ ID NO: 2526834 - protein, 24 aa, Entamoeba dispar
IEMLIYISTLLYDIPLTVIELLSS

SEQ ID NO: 2526835 - protein, 23 aa, Entamoeba dispar
IEMNNIHIFFVTSKFGTLNEIRQ

SEQ ID NO: 2526836 - protein, 31 aa, Entamoeba dispar
IEMSILESEGDLIRTGIRPNRKTGRQAPTKN

SEQ ID NO: 2526837 - protein, 20 aa, Entamoeba dispar
IEMSMNGISLGIHSLTGVIN

SEQ ID NO: 2526838 - protein, 18 aa, Entamoeba dispar
IEMVLDRLPKWYETNGKI

SEQ ID NO: 2526839 - protein, 19 aa, Entamoeba dispar
IENELNDWKLKKYLNESSF

SEQ ID NO: 2526840 - protein, 27 aa, Entamoeba dispar
IENELSEHWFIIPDILKSNSKQIAEKG

SEQ ID NO: 2526841 - protein, 24 aa, Entamoeba dispar
IENEPVDGLFKNGNPVDMLDLNQE

SEQ ID NO: 2526842 - protein, 19 aa, Entamoeba dispar
IENIKLLIDFYSLSTPNCP

SEQ ID NO: 2526843 - protein, 32 aa, Entamoeba dispar
IENKAFFHCGLKSLILPFSITSIALDAFDSSS

SEQ ID NO: 2526844 - protein, 17 aa, Entamoeba dispar
IENKLIEHLYKGIQKDR

SEQ ID NO: 2526845 - protein, 25 aa, Entamoeba dispar
IENLQYGFEFFINEPSHQRFPIIKK

SEQ ID NO: 2526846 - protein, 25 aa, Entamoeba dispar
IENMLEWFNKMLFFVDLLKEKRDKI

SEQ ID NO: 2526847 - protein, 29 aa, Entamoeba dispar
IENNNINMGFGDKGKWILVSEKKEVHNLN

SEQ ID NO: 2526848 - protein, 25 aa, Entamoeba dispar
IENNPFKELLSLKIRTSFNNYIIKA

SEQ ID NO: 2526849 - protein, 25 aa, Entamoeba dispar
IENNRPLLFIALMESDIELSQKYID

SEQ ID NO: 2526850 - protein, 23 aa, Entamoeba dispar
IENRYLLNYTQEQPLLLAKIKLN

SEQ ID NO: 2526851 - protein, 28 aa, Entamoeba dispar
IENSELYNFGLYVSWKKAILINSTEIHK

SEQ ID NO: 2526852 - protein, 29 aa, Entamoeba dispar
IENSELYNFGLYVSWKKAILINSTEIHKI

SEQ ID NO: 2526853 - protein, 25 aa, Entamoeba dispar
IENVELPMILLGKLSAKERKERAIK

SEQ ID NO: 2526854 - protein, 28 aa, Entamoeba dispar
IENWTLMEMYWEQAIFKYLRCDPQDHYF

SEQ ID NO: 2526855 - protein, 19 aa, Entamoeba dispar
IEPDFIKTVGEKYYNMIKN

SEQ ID NO: 2526856 - protein, 28 aa, Entamoeba dispar
IEPLDLLLVQPVQRIMRYPMLIKEVIKQ

SEQ ID NO: 2526857 - protein, 18 aa, Entamoeba dispar
IEPLLLNERKFELRFIVL

SEQ ID NO: 2526858 - protein, 17 aa, Entamoeba dispar
IEPNDQSGWIYYRWLLG

SEQ ID NO: 2526859 - protein, 30 aa, Entamoeba dispar
IEPNRKITTLRLGFIPLSPIEESFSKACQE

SEQ ID NO: 2526860 - protein, 24 aa, Entamoeba dispar
IEPSTNMPWYKGPTLIGALDSVTP

SEQ ID NO: 2526861 - protein, 21 aa, Entamoeba dispar
IEPTYGNLIPKSLKINLTNYD

SEQ ID NO: 2526862 - protein, 26 aa, Entamoeba dispar
IEPVELFMIHVFLLNNNMPPSGPQFA

SEQ ID NO: 2526863 - protein, 19 aa, Entamoeba dispar
IEPVEPLEDPQFDFATSTI

SEQ ID NO: 2526864 - protein, 19 aa, Entamoeba dispar
IEPVSQIVYNYQLVASCYL

SEQ ID NO: 2526865 - protein, 23 aa, Entamoeba dispar
IEQIPPQLMFLHQGQKGIKEAHW

SEQ ID NO: 2526866 - protein, 18 aa, Entamoeba dispar
IEQIVFSVFPLEIDDSLT

SEQ ID NO: 2526867 - protein, 30 aa, Entamoeba dispar
IEQIVKWYCIEWIIRDNLIQQLNHSISKIQ

SEQ ID NO: 2526868 - protein, 23 aa, Entamoeba dispar
IEQKYICIQLLSAITKKYRTIEI

SEQ ID NO: 2526869 - protein, 30 aa, Entamoeba dispar
IEQMLNSDIFYYLLEFLTFPFEQGVDKYSI

SEQ ID NO: 2526870 - protein, 25 aa, Entamoeba dispar
IEQVRYFGYELAKRNIPVFLPPGGH

SEQ ID NO: 2526871 - protein, 18 aa, Entamoeba dispar
IEQYQKPFADAYLKLKVG

SEQ ID NO: 2526872 - protein, 31 aa, Entamoeba dispar
IERCKENFVLGNWFYWYLTVECGCTNGDIIF

SEQ ID NO: 2526873 - protein, 20 aa, Entamoeba dispar
IERFHFNPIPLDEYSRKLFT

SEQ ID NO: 2526874 - protein, 24 aa, Entamoeba dispar
IERFHFNPIPLDKYSRKLFTNIET

SEQ ID NO: 2526875 - protein, 19 aa, Entamoeba dispar
IERFHFNPIPLNEHSRKLF

SEQ ID NO: 2526876 - protein, 24 aa, Entamoeba dispar
IERFHFNPIPLNEYSRRFFTNIET

SEQ ID NO: 2526877 - protein, 24 aa, Entamoeba dispar
IERFHFNPIPLNQYSRKLFANIET

SEQ ID NO: 2526878 - protein, 24 aa, Entamoeba dispar
IERFHFNPIPLNQYSRKLFPNIET

SEQ ID NO: 2526879 - protein, 17 aa, Entamoeba dispar
IERIGIIPMNEIMYGRE

SEQ ID NO: 2526880 - protein, 18 aa, Entamoeba dispar
IERILLEEYNIETPILII

SEQ ID NO: 2526881 - protein, 28 aa, Entamoeba dispar
IERIYDEYLPKVNYFVYLSINVNKERID

SEQ ID NO: 2526882 - protein, 26 aa, Entamoeba dispar
IERKILMKIMLEQCPLCWIDSVEKDN

SEQ ID NO: 2526883 - protein, 32 aa, Entamoeba dispar
IERKKKLQSFIVWLVCILPHSLKIHQGMISFV

SEQ ID NO: 2526884 - protein, 19 aa, Entamoeba dispar
IERKKLYMLQTRNGKMNAT

SEQ ID NO: 2526885 - protein, 17 aa, Entamoeba dispar
IERKMYWHRIVRKLKEC

SEQ ID NO: 2526886 - protein, 26 aa, Entamoeba dispar
IERKNNKILLYYPIDFDAKICSLISK

SEQ ID NO: 2526887 - protein, 20 aa, Entamoeba dispar
IERLFKYLDKFIEVSIEGKN

SEQ ID NO: 2526888 - protein, 24 aa, Entamoeba dispar
IERLIPADMVICAFGFGPDASFVE

SEQ ID NO: 2526889 - protein, 25 aa, Entamoeba dispar
IERNAFVTVLYREKNGWTLVKQGDK

SEQ ID NO: 2526890 - protein, 22 aa, Entamoeba dispar
IERNKRIIPFPSKIIVVGTKLD

SEQ ID NO: 2526891 - protein, 35 aa, Entamoeba dispar
IERNTLNPIWNRPVFLEDVVFGSLLFFEIIENNKI

SEQ ID NO: 2526892 - protein, 19 aa, Entamoeba dispar
IERRKHSIILPQHLTSLTI

SEQ ID NO: 2526893 - protein, 19 aa, Entamoeba dispar
IERTWFVIDSFTSIQDIAE

SEQ ID NO: 2526894 - protein, 24 aa, Entamoeba dispar
IESFSFFELCFNTIIYSLMANIPI

SEQ ID NO: 2526895 - protein, 23 aa, Entamoeba dispar
IESIIFLHRLYLTSPFNHFSLLQ

SEQ ID NO: 2526896 - protein, 17 aa, Entamoeba dispar
IESKFKKYGKIERITVI

SEQ ID NO: 2526897 - protein, 18 aa, Entamoeba dispar
IESKFPINIYQIIDGEDK

SEQ ID NO: 2526898 - protein, 18 aa, Entamoeba dispar
IESLHILALLFQAQIELR

SEQ ID NO: 2526899 - protein, 27 aa, Entamoeba dispar
IESLSKFVFVPLLYQEVFIYSCCEEYL

SEQ ID NO: 2526900 - protein, 25 aa, Entamoeba dispar
IESMERQLMILSNKVRFIKMVIEGD

SEQ ID NO: 2526901 - protein, 27 aa, Entamoeba dispar
IESNDSKEFFYLTPSILYPTENKTQFK

SEQ ID NO: 2526902 - protein, 19 aa, Entamoeba dispar
IESNFFRSIDYYCFDEIII

SEQ ID NO: 2526903 - protein, 25 aa, Entamoeba dispar
IESNKYLLPIINGDGLLMVDAKWND

SEQ ID NO: 2526904 - protein, 44 aa, Entamoeba dispar
IESNYLPFIDFDYPPLLAPFLPPPLPTHLSILVYSLALTPNEEL

SEQ ID NO: 2526905 - protein, 18 aa, Entamoeba dispar
IESVLSVYSYPQGLIELL

SEQ ID NO: 2526906 - protein, 17 aa, Entamoeba dispar
IESVRYACTGTSPPNSN

SEQ ID NO: 2526907 - protein, 36 aa, Entamoeba dispar
IETFKKLKITPFSGGFIFMYDIRYITDLIRSSSFPL

SEQ ID NO: 2526908 - protein, 34 aa, Entamoeba dispar
IETFSRTIFVFAKDLPLIVLYDKGLTILSIGEMW

SEQ ID NO: 2526909 - protein, 19 aa, Entamoeba dispar
IETGLLCEETRFSRGFSGE

SEQ ID NO: 2526910 - protein, 26 aa, Entamoeba dispar
IETIEKLLHRLLGLIVFRIDIHISKR

SEQ ID NO: 2526911 - protein, 18 aa, Entamoeba dispar
IETINKTIPLVRSTEEIK

SEQ ID NO: 2526912 - protein, 24 aa, Entamoeba dispar
IETKTKIPKLSGKTIRPPVIETQN

SEQ ID NO: 2526913 - protein, 21 aa, Entamoeba dispar
IETLLCCNLIRKIDARETNVV

SEQ ID NO: 2526914 - protein, 24 aa, Entamoeba dispar
IETLRKMLFAPSDKDKLAALKAII

SEQ ID NO: 2526915 - protein, 25 aa, Entamoeba dispar
IETPMKGVLWWLSKIGFNGICQELA

SEQ ID NO: 2526916 - protein, 27 aa, Entamoeba dispar
IETRAKRMTLPQLPNYLKQAIKKKKTE

SEQ ID NO: 2526917 - protein, 20 aa, Entamoeba dispar
IETWKIAVSLENIILTAKGV

SEQ ID NO: 2526918 - protein, 22 aa, Entamoeba dispar
IEVFKRCKLIRNPLFEIFMKNG

SEQ ID NO: 2526919 - protein, 23 aa, Entamoeba dispar
IEVKCPPTFRLFASQNPLGEGSG

SEQ ID NO: 2526920 - protein, 26 aa, Entamoeba dispar
IEVKGGTFKILIKDGEKLPTNIITKR

SEQ ID NO: 2526921 - protein, 18 aa, Entamoeba dispar
IEVPRKQSISTDKTSIIS

SEQ ID NO: 2526922 - protein, 23 aa, Entamoeba dispar
IEVQHILIIVLNVIKIDYKKELL

SEQ ID NO: 2526923 - protein, 25 aa, Entamoeba dispar
IEVQKGSFLFLFNPEVRGVIQVCLV

SEQ ID NO: 2526924 - protein, 24 aa, Entamoeba dispar
IEVQRYLIEKIMKKKMDNNTTNEE

SEQ ID NO: 2526925 - protein, 25 aa, Entamoeba dispar
IEVSAMLLRAIYKILRQRIGNKKIG

SEQ ID NO: 2526926 - protein, 18 aa, Entamoeba dispar
IEVSRLLTMPLNVDLMKL

SEQ ID NO: 2526927 - protein, 20 aa, Entamoeba dispar
IEWDYLDYAFMRLNKYYELK

SEQ ID NO: 2526928 - protein, 25 aa, Entamoeba dispar
IEYDTFCSDVLPFIEILKSNGMVQN

SEQ ID NO: 2526929 - protein, 19 aa, Entamoeba dispar
IEYLKTNPLPILNYKCRAE

SEQ ID NO: 2526930 - protein, 26 aa, Entamoeba dispar
IEYVKYIGIIDFQLTDYILLSAIVKK

SEQ ID NO: 2526931 - protein, 36 aa, Entamoeba dispar
IFADEPPLLDIRINLIAPVIYFYYDGKEKGMNNNIA

SEQ ID NO: 2526932 - protein, 19 aa, Entamoeba dispar
IFARDYIIRFYGGKEHVPQ

SEQ ID NO: 2526933 - protein, 29 aa, Entamoeba dispar
IFCFLVKTKRIVSVPKKWSIKKSINCAIS

SEQ ID NO: 2526934 - protein, 18 aa, Entamoeba dispar
IFCNMKKKVDWLTENMMK

SEQ ID NO: 2526935 - protein, 24 aa, Entamoeba dispar
IFCSLRLLVLDVLTQILKTIPEEK

SEQ ID NO: 2526936 - protein, 19 aa, Entamoeba dispar
IFDAKRMIGRRFSEPSIQK

SEQ ID NO: 2526937 - protein, 26 aa, Entamoeba dispar
IFDDGKIFKYVIWSSVEYPTYLKEKE

SEQ ID NO: 2526938 - protein, 29 aa, Entamoeba dispar
IFDDGKIFKYVIWYLVSYSKYLQEKEQGN

SEQ ID NO: 2526939 - protein, 29 aa, Entamoeba dispar
IFDDGKIFKYVIWYPVSYSTYLFEKEQGN

SEQ ID NO: 2526940 - protein, 19 aa, Entamoeba dispar
IFDIPQCMGMIGGKPGYAH

SEQ ID NO: 2526941 - protein, 26 aa, Entamoeba dispar
IFDKGKSNYFYLLYCDPVEEQLKRIK

SEQ ID NO: 2526942 - protein, 18 aa, Entamoeba dispar
IFDREKEFQIGTLVSMIE

SEQ ID NO: 2526943 - protein, 25 aa, Entamoeba dispar
IFEENRFIITIKSNHLPMILKSNIE

SEQ ID NO: 2526944 - protein, 17 aa, Entamoeba dispar
IFEILNTPPLYDSLTIL

SEQ ID NO: 2526945 - protein, 23 aa, Entamoeba dispar
IFENNPCVCAFPYVFGDKGFKAD

SEQ ID NO: 2526946 - protein, 17 aa, Entamoeba dispar
IFEPYIIDVFNLVRPIV

SEQ ID NO: 2526947 - protein, 25 aa, Entamoeba dispar
IFEQINWMKMEMEVKFEAIDRGRYY

SEQ ID NO: 2526948 - protein, 27 aa, Entamoeba dispar
IFESVILLDELFYFKIGNRFNSSADLF

SEQ ID NO: 2526949 - protein, 19 aa, Entamoeba dispar
IFEWNIWMEGPTQTPYEGG

SEQ ID NO: 2526950 - protein, 26 aa, Entamoeba dispar
IFEYNYIFLPFHQNSHFSLIVICFDK

SEQ ID NO: 2526951 - protein, 25 aa, Entamoeba dispar
IFFGEVIIHYNIWDFPNWEVNNNLV

SEQ ID NO: 2526952 - protein, 19 aa, Entamoeba dispar
IFFSFGKIFTLNKIKRVIT

SEQ ID NO: 2526953 - protein, 19 aa, Entamoeba dispar
IFHCTLLYHFPNDILSFVL

SEQ ID NO: 2526954 - protein, 24 aa, Entamoeba dispar
IFHIESNYWPKYVEYYLFCCEKHL

SEQ ID NO: 2526955 - protein, 20 aa, Entamoeba dispar
IFIESLIALCIKIINNPTSK

SEQ ID NO: 2526956 - protein, 18 aa, Entamoeba dispar
IFILIKMQQKQTAAYLQT

SEQ ID NO: 2526957 - protein, 17 aa, Entamoeba dispar
IFIMLNILSVRLLNCPE

SEQ ID NO: 2526958 - protein, 17 aa, Entamoeba dispar
IFINWLLQHGCNATLLD

SEQ ID NO: 2526959 - protein, 30 aa, Entamoeba dispar
IFKDGKIFKKVIWYLVSYSKYLQEKEAWNE

SEQ ID NO: 2526960 - protein, 31 aa, Entamoeba dispar
IFKDRAWKKDPYYFKKCYISSVALLKMVMHA

SEQ ID NO: 2526961 - protein, 20 aa, Entamoeba dispar
IFKEIIWYDISCSRYTKEKE

SEQ ID NO: 2526962 - protein, 24 aa, Entamoeba dispar
IFKELLLEFLSYCCFIYQCCSKVL

SEQ ID NO: 2526963 - protein, 17 aa, Entamoeba dispar
IFKGCSSLRLINLGKIK

SEQ ID NO: 2526964 - protein, 21 aa, Entamoeba dispar
IFKIAYDYRCSLGMGITGYAA

SEQ ID NO: 2526965 - protein, 17 aa, Entamoeba dispar
IFKLCILTEKYLKGKEY

SEQ ID NO: 2526966 - protein, 30 aa, Entamoeba dispar
IFKNDEKMMLAFFTIVAQKYLKLKRTDMEE

SEQ ID NO: 2526967 - protein, 18 aa, Entamoeba dispar
IFKNRYILKGPLEHPIFF

SEQ ID NO: 2526968 - protein, 24 aa, Entamoeba dispar
IFLGRYISQYLYKTYGEYALVISV

SEQ ID NO: 2526969 - protein, 27 aa, Entamoeba dispar
IFLGSTQGLIWKKLKTLKCIKCKVNVI

SEQ ID NO: 2526970 - protein, 18 aa, Entamoeba dispar
IFLHQKLKKNNKVELIIF

SEQ ID NO: 2526971 - protein, 17 aa, Entamoeba dispar
IFLVGNKCDLADSRVIT

SEQ ID NO: 2526972 - protein, 18 aa, Entamoeba dispar
IFLYSIRTSKLLDVLTGH

SEQ ID NO: 2526973 - protein, 18 aa, Entamoeba dispar
IFMNEPLLVSIEIPEGLQ

SEQ ID NO: 2526974 - protein, 19 aa, Entamoeba dispar
IFMNEPVLISFEIPENLQI

SEQ ID NO: 2526975 - protein, 20 aa, Entamoeba dispar
IFMNEPVLISIKIPDNLEII

SEQ ID NO: 2526976 - protein, 18 aa, Entamoeba dispar
IFMNEPVLISIKIPENLQ

SEQ ID NO: 2526977 - protein, 19 aa, Entamoeba dispar
IFMNEPVLISIKIPENLQI

SEQ ID NO: 2526978 - protein, 20 aa, Entamoeba dispar
IFMNEPVLISIKIPENLQII

SEQ ID NO: 2526979 - protein, 19 aa, Entamoeba dispar
IFMNEPVLVSIKIPDNLEI

SEQ ID NO: 2526980 - protein, 18 aa, Entamoeba dispar
IFMNEPVLVSIKIPDNLQ

SEQ ID NO: 2526981 - protein, 20 aa, Entamoeba dispar
IFMNEPVLVSIKIPYDLEII

SEQ ID NO: 2526982 - protein, 19 aa, Entamoeba dispar
IFMNEPVLVSISIPEHLII

SEQ ID NO: 2526983 - protein, 19 aa, Entamoeba dispar
IFMNKPVLVSIKIPDNLQI

SEQ ID NO: 2526984 - protein, 21 aa, Entamoeba dispar
IFMSEPVLISIKIPDNLQIIN

SEQ ID NO: 2526985 - protein, 33 aa, Entamoeba dispar
IFNDGIIFKEVIWYPVSYLTYLKEKEAGNIYKN

SEQ ID NO: 2526986 - protein, 26 aa, Entamoeba dispar
IFNDGKIFKEIIWYAVNYSTYFQEKG

SEQ ID NO: 2526987 - protein, 28 aa, Entamoeba dispar
IFNDGKIFKKVIWYLVSYSTYLQEKEQG

SEQ ID NO: 2526988 - protein, 28 aa, Entamoeba dispar
IFNDGRIFKKVIWYLVSYSKYLKEKEQG

SEQ ID NO: 2526989 - protein, 20 aa, Entamoeba dispar
IFNEIKRLLKKKYVTTINSI

SEQ ID NO: 2526990 - protein, 19 aa, Entamoeba dispar
IFNLLNAPTKKSPSPSSQS

SEQ ID NO: 2526991 - protein, 22 aa, Entamoeba dispar
IFNLMKTWEKLSLAARVIAGIS

SEQ ID NO: 2526992 - protein, 19 aa, Entamoeba dispar
IFNSKIPFDCIIGPIVKTL

SEQ ID NO: 2526993 - protein, 19 aa, Entamoeba dispar
IFNYFLKIEDIYSSSLLYV

SEQ ID NO: 2526994 - protein, 18 aa, Entamoeba dispar
IFNYLRLDGKTSQKQRDI

SEQ ID NO: 2526995 - protein, 19 aa, Entamoeba dispar
IFPIIKCTTIKSLSLAFNK

SEQ ID NO: 2526996 - protein, 21 aa, Entamoeba dispar
IFPSQLLFKYPKETIINEKIQ

SEQ ID NO: 2526997 - protein, 18 aa, Entamoeba dispar
IFQEVLVQHLRTLDICSV

SEQ ID NO: 2526998 - protein, 23 aa, Entamoeba dispar
IFQTNTNFIFRLVNSKDLNDNPR

SEQ ID NO: 2526999 - protein, 31 aa, Entamoeba dispar
IFRNEELRNLVFFKYPKWTGGLYCSPSIPGS

SEQ ID NO: 2527000 - protein, 17 aa, Entamoeba dispar
IFSEISYGFPLLSKIDL

SEQ ID NO: 2527001 - protein, 19 aa, Entamoeba dispar
IFSGSTLIYLIKGDGKTMD

SEQ ID NO: 2527002 - protein, 17 aa, Entamoeba dispar
IFSLFKIKRFGKKPIEV

SEQ ID NO: 2527003 - protein, 29 aa, Entamoeba dispar
IFSTSHRIWLWIVNMPQIIHAMNVLAPPT

SEQ ID NO: 2527004 - protein, 27 aa, Entamoeba dispar
IFTDNGKYFGYAQLLNSDKLPDWVDRS

SEQ ID NO: 2527005 - protein, 26 aa, Entamoeba dispar
IFTPSILFHMLSLQSLPINIVIAVMK

SEQ ID NO: 2527006 - protein, 18 aa, Entamoeba dispar
IFTQFLLDILPHLDEFSL

SEQ ID NO: 2527007 - protein, 18 aa, Entamoeba dispar
IFTQLPDSLLDLSLISCK

SEQ ID NO: 2527008 - protein, 23 aa, Entamoeba dispar
IFTYFGYRKFSKGNYKGFPCFEL

SEQ ID NO: 2527009 - protein, 28 aa, Entamoeba dispar
IFVSQSLTLWWNVMQNMPLLWNTTDKEF

SEQ ID NO: 2527010 - protein, 19 aa, Entamoeba dispar
IFVTRAELNAFKDFYEPVV

SEQ ID NO: 2527011 - protein, 20 aa, Entamoeba dispar
IFYFKWRHCFIDGISLKDRL

SEQ ID NO: 2527012 - protein, 30 aa, Entamoeba dispar
IGAGIFEKKLFPKLQFLDLSYNEIKVIENL

SEQ ID NO: 2527013 - protein, 25 aa, Entamoeba dispar
IGALNYYADIIFKQPAKKSITTHQY

SEQ ID NO: 2527014 - protein, 25 aa, Entamoeba dispar
IGAPGYGLVIYKPPFARSYCYNTSM

SEQ ID NO: 2527015 - protein, 18 aa, Entamoeba dispar
IGCAIRCGISLELERKTK

SEQ ID NO: 2527016 - protein, 17 aa, Entamoeba dispar
IGCIIFECFIKRPPFQA

SEQ ID NO: 2527017 - protein, 27 aa, Entamoeba dispar
IGCTTNKIILLLKDFIETFQESYFELK

SEQ ID NO: 2527018 - protein, 18 aa, Entamoeba dispar
IGCVIRCGISLELERKTK

SEQ ID NO: 2527019 - protein, 23 aa, Entamoeba dispar
IGDAAFWGCCSIRRILFPSSVSS

SEQ ID NO: 2527020 - protein, 28 aa, Entamoeba dispar
IGDDCFYGCYLLKSINIPSSITLFRRGC

SEQ ID NO: 2527021 - protein, 24 aa, Entamoeba dispar
IGDILTSKQFTLFASMKLVLKPKK

SEQ ID NO: 2527022 - protein, 17 aa, Entamoeba dispar
IGDPRYRKVSVGFVVYK

SEQ ID NO: 2527023 - protein, 20 aa, Entamoeba dispar
IGDWCFWICSSLTSITIPQS

SEQ ID NO: 2527024 - protein, 25 aa, Entamoeba dispar
IGDWIYLTDTLPFTGRDRRLYLKVT

SEQ ID NO: 2527025 - protein, 30 aa, Entamoeba dispar
IGDYCFYGCSLLISINIPSSIIKLGDYCFY

SEQ ID NO: 2527026 - protein, 24 aa, Entamoeba dispar
IGEEYTLVCAVYFILKYCGKKGNV

SEQ ID NO: 2527027 - protein, 44 aa, Entamoeba dispar
IGEGEEYYLIWFKRELFSSKGRLFGIPFMKVAKPQMRVIINNIL

SEQ ID NO: 2527028 - protein, 26 aa, Entamoeba dispar
IGEIFNLYMRVILDEKNKMVFASIPG

SEQ ID NO: 2527029 - protein, 36 aa, Entamoeba dispar
IGEISTTFLLALYKQTKLPTLIPRLINFMLEHPTFP

SEQ ID NO: 2527030 - protein, 26 aa, Entamoeba dispar
IGEIYRKRIEMRTMIVEVIIEGIEWK

SEQ ID NO: 2527031 - protein, 24 aa, Entamoeba dispar
IGEKNIMFYFETVQGDIFGSYNEL

SEQ ID NO: 2527032 - protein, 25 aa, Entamoeba dispar
IGEKRYVRLNQFKGTKYIDIREFYE

SEQ ID NO: 2527033 - protein, 22 aa, Entamoeba dispar
IGELENKLMLQENIILQLKEEI

SEQ ID NO: 2527034 - protein, 22 aa, Entamoeba dispar
IGELPQIQLIWNCQEPIKMSIN

SEQ ID NO: 2527035 - protein, 27 aa, Entamoeba dispar
IGEMKQLDMVYLMKVALHVFDMNDIQN

SEQ ID NO: 2527036 - protein, 26 aa, Entamoeba dispar
IGESAIFVFGYQGTTLFFLDPHYVQN

SEQ ID NO: 2527037 - protein, 26 aa, Entamoeba dispar
IGESLTLMLNIFLTTSKNLKCIEEIT

SEQ ID NO: 2527038 - protein, 26 aa, Entamoeba dispar
IGETFQRFIPYLKVYYQFIGNSGVSL

SEQ ID NO: 2527039 - protein, 18 aa, Entamoeba dispar
IGEYFIIGKHQQGTEIKA

SEQ ID NO: 2527040 - protein, 17 aa, Entamoeba dispar
IGFDKTSLFSGQPVPIV

SEQ ID NO: 2527041 - protein, 29 aa, Entamoeba dispar
IGFITEDIPFIPFAPFIEQVENLCISSLT

SEQ ID NO: 2527042 - protein, 20 aa, Entamoeba dispar
IGFKEMTVIFDTLYDGWGRK

SEQ ID NO: 2527043 - protein, 23 aa, Entamoeba dispar
IGFYEYLALMKFVDLVDKTFIHF

SEQ ID NO: 2527044 - protein, 26 aa, Entamoeba dispar
IGGKVYKWIGNAMYKVSPVAKPILGM

SEQ ID NO: 2527045 - protein, 18 aa, Entamoeba dispar
IGGKYFLNPGSATGAYSP

SEQ ID NO: 2527046 - protein, 20 aa, Entamoeba dispar
IGGYFIINGIERYLRMIVYA

SEQ ID NO: 2527047 - protein, 31 aa, Entamoeba dispar
IGHLNLRGFLPSFFMITVIRELLKDCTDQSF

SEQ ID NO: 2527048 - protein, 20 aa, Entamoeba dispar
IGHQSMIPRVTFYDNFVISV

SEQ ID NO: 2527049 - protein, 26 aa, Entamoeba dispar
IGHSENILFILFDNGKIRVYRTNELD

SEQ ID NO: 2527050 - protein, 17 aa, Entamoeba dispar
IGIFNFIVDIPSSIDYL

SEQ ID NO: 2527051 - protein, 30 aa, Entamoeba dispar
IGIIMINIIKYIYNLQPFLLDNLKYNITIP

SEQ ID NO: 2527052 - protein, 18 aa, Entamoeba dispar
IGILVKYMKRHNNQLPFE

SEQ ID NO: 2527053 - protein, 17 aa, Entamoeba dispar
IGIYLDGESFMKKQFDK

SEQ ID NO: 2527054 - protein, 23 aa, Entamoeba dispar
IGKEWTSLLTHNKLTQPEVIIRK

SEQ ID NO: 2527055 - protein, 30 aa, Entamoeba dispar
IGKKINKPRFIYLFNDMLMYGIGDERKLSV

SEQ ID NO: 2527056 - protein, 17 aa, Entamoeba dispar
IGKLAWNLLISEIQLNP

SEQ ID NO: 2527057 - protein, 24 aa, Entamoeba dispar
IGKLPLIHPSIISYNIMLYRDFHH

SEQ ID NO: 2527058 - protein, 36 aa, Entamoeba dispar
IGKQHLPILAMIFSPTPILPFYNKNYTKLRSILFAH

SEQ ID NO: 2527059 - protein, 22 aa, Entamoeba dispar
IGKYYYFGDIKEKEYLSIKKKK

SEQ ID NO: 2527060 - protein, 20 aa, Entamoeba dispar
IGLAIFYYQRRKVKEQPLYD

SEQ ID NO: 2527061 - protein, 29 aa, Entamoeba dispar
IGLECPKIWIKNPFLQISMIKFGIKTEQE

SEQ ID NO: 2527062 - protein, 24 aa, Entamoeba dispar
IGLERITMLYLGIPNIRKVTLFPR

SEQ ID NO: 2527063 - protein, 20 aa, Entamoeba dispar
IGLFKKLLYDAVQDGLSIPK

SEQ ID NO: 2527064 - protein, 26 aa, Entamoeba dispar
IGLHYQRMFFIKYTGIESFIREHPDY

SEQ ID NO: 2527065 - protein, 27 aa, Entamoeba dispar
IGLNVNNPHFLIMQGKVVKVLNMKPME

SEQ ID NO: 2527066 - protein, 24 aa, Entamoeba dispar
IGLTQTQIVILKRVFKIKEEQLEY

SEQ ID NO: 2527067 - protein, 27 aa, Entamoeba dispar
IGMNTSIFGYLNFGLLSFAKVQGKKCI

SEQ ID NO: 2527068 - protein, 27 aa, Entamoeba dispar
IGNGGLVQWAPFLADLFMLARRDETVK

SEQ ID NO: 2527069 - protein, 23 aa, Entamoeba dispar
IGNIIESYLKYGWIFEIKNKYKE

SEQ ID NO: 2527070 - protein, 17 aa, Entamoeba dispar
IGNKLIDIFLVEGGYER

SEQ ID NO: 2527071 - protein, 17 aa, Entamoeba dispar
IGNKWTIIASYLEGRSP

SEQ ID NO: 2527072 - protein, 23 aa, Entamoeba dispar
IGNQVLRFYRRIVRDYLTRNYTA

SEQ ID NO: 2527073 - protein, 19 aa, Entamoeba dispar
IGNRREKGLRYLCGYYGEI

SEQ ID NO: 2527074 - protein, 18 aa, Entamoeba dispar
IGNYCFYGCSLLTTIDIP

SEQ ID NO: 2527075 - protein, 25 aa, Entamoeba dispar
IGPNTWIALNQLVLDLVYKAVDNPN

SEQ ID NO: 2527076 - protein, 22 aa, Entamoeba dispar
IGPRYCMRCIKILAGCFSGSVV

SEQ ID NO: 2527077 - protein, 21 aa, Entamoeba dispar
IGQLTIFWPEKLLLNSENSYV

SEQ ID NO: 2527078 - protein, 26 aa, Entamoeba dispar
IGQNAFNCCILLNKIYLPDSVHKIDE

SEQ ID NO: 2527079 - protein, 24 aa, Entamoeba dispar
IGQSRLCMFYLQKAHIGEIQASVW

SEQ ID NO: 2527080 - protein, 23 aa, Entamoeba dispar
IGRAPTLVAIALIELGMENTDAM

SEQ ID NO: 2527081 - protein, 17 aa, Entamoeba dispar
IGRECFSWCGSLQSITI

SEQ ID NO: 2527082 - protein, 37 aa, Entamoeba dispar
IGRELTLKEQWYKAKYDYINIPISISRIMGYKERWEN

SEQ ID NO: 2527083 - protein, 35 aa, Entamoeba dispar
IGRFCCIFQRCFLDYHFLMFFIDNNGLSLLKDSIE

SEQ ID NO: 2527084 - protein, 17 aa, Entamoeba dispar
IGRRFSEPSIQKDMKHW

SEQ ID NO: 2527085 - protein, 33 aa, Entamoeba dispar
IGSKVWSMLVHHFYLRDALFELKGHDFVRYNVE

SEQ ID NO: 2527086 - protein, 31 aa, Entamoeba dispar
IGSKVWSMLVHHFYLRDALFELKGHGFVKYK

SEQ ID NO: 2527087 - protein, 24 aa, Entamoeba dispar
IGSLRQVLEIISLRTETAPIPMQV

SEQ ID NO: 2527088 - protein, 26 aa, Entamoeba dispar
IGSWCFWGCSSLKYITIPTSVSEIGD

SEQ ID NO: 2527089 - protein, 21 aa, Entamoeba dispar
IGTFFHCISLTSLQLPKTITS

SEQ ID NO: 2527090 - protein, 28 aa, Entamoeba dispar
IGTKTQLEFAILLINLAQSIRKRLNIDT

SEQ ID NO: 2527091 - protein, 27 aa, Entamoeba dispar
IGTPVYNFLCSYLLKTYKHQSKGLFIG

SEQ ID NO: 2527092 - protein, 17 aa, Entamoeba dispar
IGTSFLSLFKRVQQPID

SEQ ID NO: 2527093 - protein, 28 aa, Entamoeba dispar
IGVFKNELILFYMFYVMVGEESQLKAAK

SEQ ID NO: 2527094 - protein, 23 aa, Entamoeba dispar
IGVPPPPPPGMPGAPPPPPPGMP

SEQ ID NO: 2527095 - protein, 28 aa, Entamoeba dispar
IGYDSLLENIYLILNNNKILLLEGEHGS

SEQ ID NO: 2527096 - protein, 24 aa, Entamoeba dispar
IGYGCFNELLLSLKIPENLKEVNG

SEQ ID NO: 2527097 - protein, 17 aa, Entamoeba dispar
IGYGCFYECLSLTTINI

SEQ ID NO: 2527098 - protein, 23 aa, Entamoeba dispar
IGYGCFYGCSTLTRIDIAKIHYV

SEQ ID NO: 2527099 - protein, 19 aa, Entamoeba dispar
IGYLQPPPQQQVPIRRQYI

SEQ ID NO: 2527100 - protein, 19 aa, Entamoeba dispar
IGYNDGIIKFWNIAQQKFG

SEQ ID NO: 2527101 - protein, 23 aa, Entamoeba dispar
IGYNEIMITSKYFNNIKDFINLE

SEQ ID NO: 2527102 - protein, 17 aa, Entamoeba dispar
IHAFFSQPSSNLLFIQN

SEQ ID NO: 2527103 - protein, 20 aa, Entamoeba dispar
IHASNIFSMFKDCPIVKKAV

SEQ ID NO: 2527104 - protein, 18 aa, Entamoeba dispar
IHAVSVIHYLLHEDYEQF

SEQ ID NO: 2527105 - protein, 25 aa, Entamoeba dispar
IHCKDIKHLYKFKNIRKLIVVELKS

SEQ ID NO: 2527106 - protein, 25 aa, Entamoeba dispar
IHEEKSFLFSMMNNFVPIAKTILRC

SEQ ID NO: 2527107 - protein, 28 aa, Entamoeba dispar
IHEIFPVYEFWEHVCVVWSKCYCYTPQN

SEQ ID NO: 2527108 - protein, 25 aa, Entamoeba dispar
IHESVDEILLGRIFSIVGHVVSCKI

SEQ ID NO: 2527109 - protein, 17 aa, Entamoeba dispar
IHFQWFTQQKQIDLFFE

SEQ ID NO: 2527110 - protein, 28 aa, Entamoeba dispar
IHGVKLILGLLYTLYRKYRLSVLVDKKK

SEQ ID NO: 2527111 - protein, 20 aa, Entamoeba dispar
IHHPAILGMAGIVLSSSTIL

SEQ ID NO: 2527112 - protein, 28 aa, Entamoeba dispar
IHIENSFIELFIKKIGGLFIEKSSGRKN

SEQ ID NO: 2527113 - protein, 26 aa, Entamoeba dispar
IHINSIWFSFVFPQINPKNYITDPFI

SEQ ID NO: 2527114 - protein, 18 aa, Entamoeba dispar
IHIQLYRPMIELCNKDRL

SEQ ID NO: 2527115 - protein, 17 aa, Entamoeba dispar
IHKKELIDFIVSSLPKR

SEQ ID NO: 2527116 - protein, 29 aa, Entamoeba dispar
IHKKTKLHYKLLIQTLLMLRHYNESQKKM

SEQ ID NO: 2527117 - protein, 19 aa, Entamoeba dispar
IHKLSYIHRDIKPDNILIG

SEQ ID NO: 2527118 - protein, 25 aa, Entamoeba dispar
IHKTQNLFEYVYRSSLRSGEFVEFM

SEQ ID NO: 2527119 - protein, 18 aa, Entamoeba dispar
IHLELVKKSRLFSCKIND

SEQ ID NO: 2527120 - protein, 19 aa, Entamoeba dispar
IHLIEYIEEFPPLLSQVGM

SEQ ID NO: 2527121 - protein, 17 aa, Entamoeba dispar
IHMENGLKVAKFLEQHE

SEQ ID NO: 2527122 - protein, 28 aa, Entamoeba dispar
IHMMTLKNFAMILGPLVIHPLPGTNAVN

SEQ ID NO: 2527123 - protein, 23 aa, Entamoeba dispar
IHNIPFNILGQIIELAEITKEKD

SEQ ID NO: 2527124 - protein, 26 aa, Entamoeba dispar
IHPKYLIDLTTFPLLTKLTLNIFSQP

SEQ ID NO: 2527125 - protein, 30 aa, Entamoeba dispar
IHPRLLVEGIELARQHLFDYLPKVVKKIDC

SEQ ID NO: 2527126 - protein, 22 aa, Entamoeba dispar
IHRDFRAYITSVNWLNKHYSLN

SEQ ID NO: 2527127 - protein, 21 aa, Entamoeba dispar
IHRHELPVPCLLPIIHEDNDV

SEQ ID NO: 2527128 - protein, 22 aa, Entamoeba dispar
IHSEEYNIETPILIIENTEITY

SEQ ID NO: 2527129 - protein, 24 aa, Entamoeba dispar
IHSFPNFHKFILNTKLNEFIHSID

SEQ ID NO: 2527130 - protein, 33 aa, Entamoeba dispar
IHSQILKDSLFNHFYVLWPHKFINVTNGVTPRR

SEQ ID NO: 2527131 - protein, 27 aa, Entamoeba dispar
IHSVGLFSILAVLEKEEFINCFPLRVK

SEQ ID NO: 2527132 - protein, 26 aa, Entamoeba dispar
IHTMEYVYRFLISSLHRIIISPNDKN

SEQ ID NO: 2527133 - protein, 23 aa, Entamoeba dispar
IHVFPFCLQFDVMDKFIRGGRKF

SEQ ID NO: 2527134 - protein, 24 aa, Entamoeba dispar
IHVTKQIIFLPKNSTLQSSNQMVR

SEQ ID NO: 2527135 - protein, 23 aa, Entamoeba dispar
IHWKNIDLYLSKLTIYVIEILIK

SEQ ID NO: 2527136 - protein, 19 aa, Entamoeba dispar
IHYQYLQIQLQKYWNKIKS

SEQ ID NO: 2527137 - protein, 20 aa, Entamoeba dispar
IIACLLKCFLQKMPTHIIDT

SEQ ID NO: 2527138 - protein, 30 aa, Entamoeba dispar
IIAIYSNSCLIFQRPYLCGLYNESTTLWIQ

SEQ ID NO: 2527139 - protein, 18 aa, Entamoeba dispar
IIAPIGSGSLLCGLALAV

SEQ ID NO: 2527140 - protein, 18 aa, Entamoeba dispar
IIASILHKVSIPSKHSAV

SEQ ID NO: 2527141 - protein, 18 aa, Entamoeba dispar
IICGGMAYTFLAASKNMK

SEQ ID NO: 2527142 - protein, 18 aa, Entamoeba dispar
IICRCGDSPIYVLTTDDE

SEQ ID NO: 2527143 - protein, 20 aa, Entamoeba dispar
IIDAFYERRLHRMEARAMKA

SEQ ID NO: 2527144 - protein, 41 aa, Entamoeba dispar
IIDALCNIILTCPITIDCISFIFDTMSRWLLCYGKNMFSIR

SEQ ID NO: 2527145 - protein, 27 aa, Entamoeba dispar
IIDEPTPLILVLKLLLSLKLTEECSDT

SEQ ID NO: 2527146 - protein, 18 aa, Entamoeba dispar
IIDGITFEFIPTPNTEAP

SEQ ID NO: 2527147 - protein, 23 aa, Entamoeba dispar
IIDIKWVGNIICCIGGLYDGKEY

SEQ ID NO: 2527148 - protein, 17 aa, Entamoeba dispar
IIDNCLWPKLFSVTPSP

SEQ ID NO: 2527149 - protein, 27 aa, Entamoeba dispar
IIDQLYLFPSIFIIQLSFTIDGSNELP

SEQ ID NO: 2527150 - protein, 18 aa, Entamoeba dispar
IIDTISFPIEFIQNPIEI

SEQ ID NO: 2527151 - protein, 34 aa, Entamoeba dispar
IIEDGIRVLQYSYVKVFFLPKEDLSPDLFVFRQN

SEQ ID NO: 2527152 - protein, 26 aa, Entamoeba dispar
IIEDNDHFVFCLYPSNDERTTTRWIP

SEQ ID NO: 2527153 - protein, 22 aa, Entamoeba dispar
IIEDTMIRLLNEKYLIMDTLNK

SEQ ID NO: 2527154 - protein, 21 aa, Entamoeba dispar
IIEEEFTCLFELVDRVKDMVI

SEQ ID NO: 2527155 - protein, 24 aa, Entamoeba dispar
IIEIIWYCIKPIKEETIKINKIPF

SEQ ID NO: 2527156 - protein, 24 aa, Entamoeba dispar
IIEIPPTISRLTSLKQLIICGNKI

SEQ ID NO: 2527157 - protein, 17 aa, Entamoeba dispar
IIEKEIYSIISIIWERG

SEQ ID NO: 2527158 - protein, 18 aa, Entamoeba dispar
IIEKEIYSIISIIWERGI

SEQ ID NO: 2527159 - protein, 25 aa, Entamoeba dispar
IIEKSYPILVFYRYVQNREKENWTV

SEQ ID NO: 2527160 - protein, 17 aa, Entamoeba dispar
IIELEKSTKSKDIKDLE

SEQ ID NO: 2527161 - protein, 23 aa, Entamoeba dispar
IIELKSINNLKQLKLHGVNKLKI

SEQ ID NO: 2527162 - protein, 30 aa, Entamoeba dispar
IIELNTYVGFFYRVSFYGQAFTNIFGQQND

SEQ ID NO: 2527163 - protein, 20 aa, Entamoeba dispar
IIELQAMVSNLKQNLAGLQQ

SEQ ID NO: 2527164 - protein, 17 aa, Entamoeba dispar
IIEPRIKDALTLSELEL

SEQ ID NO: 2527165 - protein, 19 aa, Entamoeba dispar
IIETTGFGMFNYDGLQLTE

SEQ ID NO: 2527166 - protein, 24 aa, Entamoeba dispar
IIEVPFIHSLIKLVINPLQLVLDH

SEQ ID NO: 2527167 - protein, 31 aa, Entamoeba dispar
IIEWSKTEMYVFIRTIKLYFEMFFDNTSQLC

SEQ ID NO: 2527168 - protein, 20 aa, Entamoeba dispar
IIFCNELKPAGFYKEKLKLQ

SEQ ID NO: 2527169 - protein, 21 aa, Entamoeba dispar
IIFGQLLTEKKYIRKLYSLIQ

SEQ ID NO: 2527170 - protein, 25 aa, Entamoeba dispar
IIFSSHLFFNFYNLCSLELPKSIVK

SEQ ID NO: 2527171 - protein, 18 aa, Entamoeba dispar
IIFVFIRNEEVVSMEIFY

SEQ ID NO: 2527172 - protein, 26 aa, Entamoeba dispar
IIGDKKPFFISLPCKRNIPMEQFSDY

SEQ ID NO: 2527173 - protein, 18 aa, Entamoeba dispar
IIGLFSNDTIITRKFLCC

SEQ ID NO: 2527174 - protein, 30 aa, Entamoeba dispar
IIGSDFLTRPILLQLLRKVLYTENPDQPLF

SEQ ID NO: 2527175 - protein, 24 aa, Entamoeba dispar
IIGSSDFMFSIKSPKLPGYNKFDI

SEQ ID NO: 2527176 - protein, 19 aa, Entamoeba dispar
IIHAMNVLAPPTFIDIMKY

SEQ ID NO: 2527177 - protein, 18 aa, Entamoeba dispar
IIHDRIIKQLNTLNWRRL

SEQ ID NO: 2527178 - protein, 19 aa, Entamoeba dispar
IIHIYSVLELFFNSNLPSY

SEQ ID NO: 2527179 - protein, 20 aa, Entamoeba dispar
IIHLVSRSDLFGLLTSLSIL

SEQ ID NO: 2527180 - protein, 18 aa, Entamoeba dispar
IIHNIASKPPLPINGNII

SEQ ID NO: 2527181 - protein, 27 aa, Entamoeba dispar
IIHSNIYYLNAFNELLYFKKPSQLEMI

SEQ ID NO: 2527182 - protein, 17 aa, Entamoeba dispar
IIICDWMGINLYYDSLL

SEQ ID NO: 2527183 - protein, 19 aa, Entamoeba dispar
IIIERGYCDVYPDGIQKPR

SEQ ID NO: 2527184 - protein, 17 aa, Entamoeba dispar
IIIFSPLSEKELKEIVK

SEQ ID NO: 2527185 - protein, 17 aa, Entamoeba dispar
IIIKILLEFHTGLGDDK

SEQ ID NO: 2527186 - protein, 18 aa, Entamoeba dispar
IIINEPILVSISIPEHLK

SEQ ID NO: 2527187 - protein, 19 aa, Entamoeba dispar
IIINNPLKFIFSSQFSWCK

SEQ ID NO: 2527188 - protein, 20 aa, Entamoeba dispar
IIIPATTIYYLCQQIRTVLL

SEQ ID NO: 2527189 - protein, 26 aa, Entamoeba dispar
IIIPSHDFIIEKIWDKVIENNKKFDH

SEQ ID NO: 2527190 - protein, 20 aa, Entamoeba dispar
IIIQLIRNRMSNIGKQMIRI

SEQ ID NO: 2527191 - protein, 36 aa, Entamoeba dispar
IIISFQSIIRGYLTRRVFGLKLMIKRKAALMEFLTT

SEQ ID NO: 2527192 - protein, 26 aa, Entamoeba dispar
IIISKESIVITLIRALESNNKILIER

SEQ ID NO: 2527193 - protein, 29 aa, Entamoeba dispar
IIISNTRSFICPLTKKLFVNPVKAQVCGH

SEQ ID NO: 2527194 - protein, 37 aa, Entamoeba dispar
IIISSFVELLNKPLRRYVEIKLFSGIARLIEYYNDIS

SEQ ID NO: 2527195 - protein, 19 aa, Entamoeba dispar
IIISVIREILYRNGLKIAL

SEQ ID NO: 2527196 - protein, 17 aa, Entamoeba dispar
IIITIDTHKIYKKISLP

SEQ ID NO: 2527197 - protein, 17 aa, Entamoeba dispar
IIIWGKDINQYKPKCIN

SEQ ID NO: 2527198 - protein, 25 aa, Entamoeba dispar
IIIYQRQYLPYNLADRVRTAPFFTL

SEQ ID NO: 2527199 - protein, 26 aa, Entamoeba dispar
IIKAYYRFLNLITPSRFIPNALKSYG

SEQ ID NO: 2527200 - protein, 17 aa, Entamoeba dispar
IIKDIKFINVIDASKNC

SEQ ID NO: 2527201 - protein, 21 aa, Entamoeba dispar
IIKHWIYLFDNNDAQLIVLLN

SEQ ID NO: 2527202 - protein, 18 aa, Entamoeba dispar
IIKIHRDYIINYVDHIVT

SEQ ID NO: 2527203 - protein, 18 aa, Entamoeba dispar
IIKILEGKEIKKPKAFEE

SEQ ID NO: 2527204 - protein, 26 aa, Entamoeba dispar
IIKIYNCFFCYFNGSLQFWIVMEKCT

SEQ ID NO: 2527205 - protein, 25 aa, Entamoeba dispar
IIKKIKHPFIISYYNDYSINNNKFL

SEQ ID NO: 2527206 - protein, 26 aa, Entamoeba dispar
IIKLNGVYNLIPWMCKNLLLNQFVDG

SEQ ID NO: 2527207 - protein, 18 aa, Entamoeba dispar
IIKLRKICNIKIGYENKE

SEQ ID NO: 2527208 - protein, 25 aa, Entamoeba dispar
IIKNKDFYYLITKLSRHVTAAYGSK

SEQ ID NO: 2527209 - protein, 18 aa, Entamoeba dispar
IIKQLNTLNWRRLNVHFR

SEQ ID NO: 2527210 - protein, 29 aa, Entamoeba dispar
IIKQRVIGKCWLIFNKPKYIENVKIIEGE

SEQ ID NO: 2527211 - protein, 22 aa, Entamoeba dispar
IIKSGYSIAYGARPMRRYIEKT

SEQ ID NO: 2527212 - protein, 20 aa, Entamoeba dispar
IIKSIIKNIIYFYINGKEIE

SEQ ID NO: 2527213 - protein, 27 aa, Entamoeba dispar
IIKSRMTSIIIGKIKTFLVYPIEEQLL

SEQ ID NO: 2527214 - protein, 29 aa, Entamoeba dispar
IIKSWDDMELLWNYTFKEKLHVETNGKSV

SEQ ID NO: 2527215 - protein, 17 aa, Entamoeba dispar
IIKTFELMVKNKEVIFT

SEQ ID NO: 2527216 - protein, 17 aa, Entamoeba dispar
IIKTPHIGLRKTQPRFS

SEQ ID NO: 2527217 - protein, 18 aa, Entamoeba dispar
IILIDLRANTPIKTVYGV

SEQ ID NO: 2527218 - protein, 36 aa, Entamoeba dispar
IILINSRIKKDIKILKGIKLYLPNIVLLDSNNERNV

SEQ ID NO: 2527219 - protein, 25 aa, Entamoeba dispar
IILKHFIFIIIYDEIFNDGKIFKEI

SEQ ID NO: 2527220 - protein, 21 aa, Entamoeba dispar
IILLHKKIIEILGMYLQYFNQ

SEQ ID NO: 2527221 - protein, 17 aa, Entamoeba dispar
IILLHTITNYHVMSVHF

SEQ ID NO: 2527222 - protein, 18 aa, Entamoeba dispar
IILLPDTVHYVFLSATIP

SEQ ID NO: 2527223 - protein, 29 aa, Entamoeba dispar
IILNELPIELILKLFFYCFNHSPSIYALQ

SEQ ID NO: 2527224 - protein, 18 aa, Entamoeba dispar
IILSSISELGYCCFYECS

SEQ ID NO: 2527225 - protein, 19 aa, Entamoeba dispar
IILVDHFVCIYQSGTLLRC

SEQ ID NO: 2527226 - protein, 25 aa, Entamoeba dispar
IIMDKSMTFYGFKNKLNLSSKLWRN

SEQ ID NO: 2527227 - protein, 19 aa, Entamoeba dispar
IIMFNQRLWNTVHFSEFFY

SEQ ID NO: 2527228 - protein, 25 aa, Entamoeba dispar
IIMPVQRLMRYPILLKELIKNTSSF

SEQ ID NO: 2527229 - protein, 24 aa, Entamoeba dispar
IINEFLHIFQMPPVINIKGYIKEP

SEQ ID NO: 2527230 - protein, 25 aa, Entamoeba dispar
IINEHHWIIEWAKSTQIRDSDLDKK

SEQ ID NO: 2527231 - protein, 20 aa, Entamoeba dispar
IINENAFDGLLVGVPLKAVS

SEQ ID NO: 2527232 - protein, 24 aa, Entamoeba dispar
IINEQALLHKPVEIRKLSTGRVES

SEQ ID NO: 2527233 - protein, 17 aa, Entamoeba dispar
IINGFSYLLDKENIRDF

SEQ ID NO: 2527234 - protein, 24 aa, Entamoeba dispar
IINHSNLHLYLLTDNIYAIGNTMF

SEQ ID NO: 2527235 - protein, 17 aa, Entamoeba dispar
IINIKRILYNNKINKRI

SEQ ID NO: 2527236 - protein, 20 aa, Entamoeba dispar
IINLEYQSPLLFCQIRSLEN

SEQ ID NO: 2527237 - protein, 22 aa, Entamoeba dispar
IINNFQSISLFFFVACCHPMAE

SEQ ID NO: 2527238 - protein, 27 aa, Entamoeba dispar
IINNSLGYYLLPLDYFCSRHTKLSDDL

SEQ ID NO: 2527239 - protein, 18 aa, Entamoeba dispar
IINRLWNYEMLEEYIICQ

SEQ ID NO: 2527240 - protein, 18 aa, Entamoeba dispar
IINSTFIVRKNETIMLMG

SEQ ID NO: 2527241 - protein, 20 aa, Entamoeba dispar
IIPDFLPNEIMTLPIPLSES

SEQ ID NO: 2527242 - protein, 17 aa, Entamoeba dispar
IIPDTLGALRTTAPYTL

SEQ ID NO: 2527243 - protein, 32 aa, Entamoeba dispar
IIPEIDKPWYLKFNCLYIYKDNTENPLTQNFW

SEQ ID NO: 2527244 - protein, 26 aa, Entamoeba dispar
IIPEIDKPWYLKFNNSAIYDDDIKDG

SEQ ID NO: 2527245 - protein, 20 aa, Entamoeba dispar
IIPLTYDFERFNIKLGKIEG

SEQ ID NO: 2527246 - protein, 18 aa, Entamoeba dispar
IIPPKPSQWVIRDKNHFV

SEQ ID NO: 2527247 - protein, 18 aa, Entamoeba dispar
IIPRSRIPRVGNKRRRIM

SEQ ID NO: 2527248 - protein, 19 aa, Entamoeba dispar
IIPTLKMLKLKYPSFQITI

SEQ ID NO: 2527249 - protein, 17 aa, Entamoeba dispar
IIQFNSMLLNNCMSYQR

SEQ ID NO: 2527250 - protein, 17 aa, Entamoeba dispar
IIQGYITSLFKLYSVET

SEQ ID NO: 2527251 - protein, 33 aa, Entamoeba dispar
IIQLNDVFLTQKYFYLVFELVDGGDLFKLTLNK

SEQ ID NO: 2527252 - protein, 26 aa, Entamoeba dispar
IIQNVYLLLCLLTNKIIGIWKTNNKI

SEQ ID NO: 2527253 - protein, 19 aa, Entamoeba dispar
IIQTQIFEKLLKILSETTD

SEQ ID NO: 2527254 - protein, 19 aa, Entamoeba dispar
IIQVCLKICKFIAQNDLMK

SEQ ID NO: 2527255 - protein, 26 aa, Entamoeba dispar
IIQVSSKFYGIPWKSNGEGLMYIGVM

SEQ ID NO: 2527256 - protein, 17 aa, Entamoeba dispar
IIQYFPSVLQRFPTLRT

SEQ ID NO: 2527257 - protein, 20 aa, Entamoeba dispar
IIQYYGYTQLSDSMLLFSEY

SEQ ID NO: 2527258 - protein, 18 aa, Entamoeba dispar
IIRIIFKKVKGSCKVYKK

SEQ ID NO: 2527259 - protein, 17 aa, Entamoeba dispar
IIRINTNLTFEQFNNIC

SEQ ID NO: 2527260 - protein, 23 aa, Entamoeba dispar
IIRKTVYDLTAYLTNLKVVSPDQ

SEQ ID NO: 2527261 - protein, 18 aa, Entamoeba dispar
IIRKYHIIERILSEAYNI

SEQ ID NO: 2527262 - protein, 17 aa, Entamoeba dispar
IIRLFSCSPNDKIKVCK

SEQ ID NO: 2527263 - protein, 20 aa, Entamoeba dispar
IIRRCQFIENILLPFQCQSI

SEQ ID NO: 2527264 - protein, 28 aa, Entamoeba dispar
IIRSKFLRRRFCTFVIMKLGGLCTVEDM

SEQ ID NO: 2527265 - protein, 35 aa, Entamoeba dispar
IIRSQTMIPPELTLLYKIPETYIKDLLRLGAEMLP

SEQ ID NO: 2527266 - protein, 20 aa, Entamoeba dispar
IIRVVQINPHKLLGCVGQHD

SEQ ID NO: 2527267 - protein, 30 aa, Entamoeba dispar
IISADTILKTMFWYLMESKIDPKYKLEIPS

SEQ ID NO: 2527268 - protein, 17 aa, Entamoeba dispar
IISALRILGFFVSQRTA

SEQ ID NO: 2527269 - protein, 21 aa, Entamoeba dispar
IISCGYYNYLSYTKGPLIDNH

SEQ ID NO: 2527270 - protein, 18 aa, Entamoeba dispar
IISGLKFIPSKDINNLVP

SEQ ID NO: 2527271 - protein, 26 aa, Entamoeba dispar
IISIPVSCFYQCPVLKTLKIKNKTLT

SEQ ID NO: 2527272 - protein, 19 aa, Entamoeba dispar
IISIRRPIISGDLKKEGYI

SEQ ID NO: 2527273 - protein, 17 aa, Entamoeba dispar
IISLKKLHDNCGIVYYK

SEQ ID NO: 2527274 - protein, 29 aa, Entamoeba dispar
IISLKRFYKIFFELHLVFAKAPKSEQTRV

SEQ ID NO: 2527275 - protein, 24 aa, Entamoeba dispar
IISLLQIYYCPISISLPTQMKHEL

SEQ ID NO: 2527276 - protein, 26 aa, Entamoeba dispar
IISNVFPIYDFWEHVCIVWTKCYNYT

SEQ ID NO: 2527277 - protein, 23 aa, Entamoeba dispar
IISPILISLFENKNFRIAIDAVK

SEQ ID NO: 2527278 - protein, 17 aa, Entamoeba dispar
IISPLGSFHKKTPIRIK

SEQ ID NO: 2527279 - protein, 17 aa, Entamoeba dispar
IISPTFTLSFIQNTLVR

SEQ ID NO: 2527280 - protein, 25 aa, Entamoeba dispar
IISREFFNSRFIYGFNYLSIENVEL

SEQ ID NO: 2527281 - protein, 18 aa, Entamoeba dispar
IISSLPTCRFILNTNTVD

SEQ ID NO: 2527282 - protein, 17 aa, Entamoeba dispar
IISTMIMYCIHIDYIIE

SEQ ID NO: 2527283 - protein, 32 aa, Entamoeba dispar
IISTNETFWLMYKLIELLSRYVIILLDEENPI

SEQ ID NO: 2527284 - protein, 17 aa, Entamoeba dispar
IISVLNICFEFLKIDPI

SEQ ID NO: 2527285 - protein, 20 aa, Entamoeba dispar
IITLDFLRYSFYTNISAIKT

SEQ ID NO: 2527286 - protein, 20 aa, Entamoeba dispar
IITLFTFICYDSIEPIYLKN

SEQ ID NO: 2527287 - protein, 26 aa, Entamoeba dispar
IIVACDGFWNVFKYEDAISLARNYLF

SEQ ID NO: 2527288 - protein, 21 aa, Entamoeba dispar
IIVDEKLVIELKNQGYDEEHI

SEQ ID NO: 2527289 - protein, 18 aa, Entamoeba dispar
IIVDLLTLHERIIPCIEV

SEQ ID NO: 2527290 - protein, 26 aa, Entamoeba dispar
IIVICEDYIIVYNVKSGFFERRKYSN

SEQ ID NO: 2527291 - protein, 31 aa, Entamoeba dispar
IIVNFRGFRMLLTICYDTRFPMFVRYNYDYD

SEQ ID NO: 2527292 - protein, 19 aa, Entamoeba dispar
IIVNLHIWKALNPSFKTQI

SEQ ID NO: 2527293 - protein, 18 aa, Entamoeba dispar
IIVNMHIWKGLNASFKTQ

SEQ ID NO: 2527294 - protein, 17 aa, Entamoeba dispar
IIVNMHIWKSLNASFKT

SEQ ID NO: 2527295 - protein, 18 aa, Entamoeba dispar
IIVNMHIWKSLNASFKTQ

SEQ ID NO: 2527296 - protein, 17 aa, Entamoeba dispar
IIVNMHIWKSLNPSFKT

SEQ ID NO: 2527297 - protein, 18 aa, Entamoeba dispar
IIVNMHIWKSLNPSFKTQ

SEQ ID NO: 2527298 - protein, 19 aa, Entamoeba dispar
IIVNYTEGVLQINLPKYID

SEQ ID NO: 2527299 - protein, 17 aa, Entamoeba dispar
IIVTRRPHSFKARPIIN

SEQ ID NO: 2527300 - protein, 18 aa, Entamoeba dispar
IIVYFYDINARQHSIIPF

SEQ ID NO: 2527301 - protein, 17 aa, Entamoeba dispar
IIWPDYCDLLLTALERS

SEQ ID NO: 2527302 - protein, 18 aa, Entamoeba dispar
IIYDLLGVLIRRSSTNTL

SEQ ID NO: 2527303 - protein, 18 aa, Entamoeba dispar
IIYEFHQKLISLGVTEEE

SEQ ID NO: 2527304 - protein, 18 aa, Entamoeba dispar
IIYFVYNIIDASTFRFIQ

SEQ ID NO: 2527305 - protein, 18 aa, Entamoeba dispar
IIYGRINNNWIKARENKN

SEQ ID NO: 2527306 - protein, 23 aa, Entamoeba dispar
IIYKEPQLLKYEEPILIGVLDNV

SEQ ID NO: 2527307 - protein, 19 aa, Entamoeba dispar
IIYKIRYNIIFLNEDLNEV

SEQ ID NO: 2527308 - protein, 26 aa, Entamoeba dispar
IIYLSSFNFPFLKQPFQIGSPHHSTS

SEQ ID NO: 2527309 - protein, 21 aa, Entamoeba dispar
IIYLSVVHKGLNPGIIKGIFS

SEQ ID NO: 2527310 - protein, 20 aa, Entamoeba dispar
IIYRKTYCGFALSNAFDSFE

SEQ ID NO: 2527311 - protein, 19 aa, Entamoeba dispar
IKAFKKFMYTFEKAQIGKE

SEQ ID NO: 2527312 - protein, 32 aa, Entamoeba dispar
IKAHGVTCFVSRQLIYPIPEQFFNANGIVSID

SEQ ID NO: 2527313 - protein, 18 aa, Entamoeba dispar
IKAIITCGIYLKKFKDTF

SEQ ID NO: 2527314 - protein, 32 aa, Entamoeba dispar
IKAKYNTDFYILDKFPAAIRPFYTMPDIDDPN

SEQ ID NO: 2527315 - protein, 38 aa, Entamoeba dispar
IKAQSIAIPFELWYLEANYTCIIFIGERKKRIKFVLQL

SEQ ID NO: 2527316 - protein, 19 aa, Entamoeba dispar
IKCEYCSLMFPVNQIQQHK

SEQ ID NO: 2527317 - protein, 26 aa, Entamoeba dispar
IKCGPTHQIFPLFQPNPLFNDEEFHP

SEQ ID NO: 2527318 - protein, 18 aa, Entamoeba dispar
IKCINILSSIALNDKITS

SEQ ID NO: 2527319 - protein, 19 aa, Entamoeba dispar
IKCINILSSIALNDKITSS

SEQ ID NO: 2527320 - protein, 18 aa, Entamoeba dispar
IKDFFSEFFKHFEKWFSE

SEQ ID NO: 2527321 - protein, 18 aa, Entamoeba dispar
IKDGSVFVFDFGGGTLDI

SEQ ID NO: 2527322 - protein, 23 aa, Entamoeba dispar
IKDLNMLLTDIIELADKANMLST

SEQ ID NO: 2527323 - protein, 30 aa, Entamoeba dispar
IKDTEMNVVIPRYSPLPSKESRIFVTNQDN

SEQ ID NO: 2527324 - protein, 19 aa, Entamoeba dispar
IKDTPTYCNITLDSFKKQN

SEQ ID NO: 2527325 - protein, 20 aa, Entamoeba dispar
IKDWLSVLAEIFKANIIAWE

SEQ ID NO: 2527326 - protein, 26 aa, Entamoeba dispar
IKDYDLLFNLIIRDSWQFLFSHSPID

SEQ ID NO: 2527327 - protein, 25 aa, Entamoeba dispar
IKEAKLMVFRGYSRGFAFVEYETEE

SEQ ID NO: 2527328 - protein, 20 aa, Entamoeba dispar
IKECLRKLLVGKKFEAKECY

SEQ ID NO: 2527329 - protein, 18 aa, Entamoeba dispar
IKEDIHLLSLLISHLHQF

SEQ ID NO: 2527330 - protein, 25 aa, Entamoeba dispar
IKEDQKQQPLVNEVPKEEEIHEEKS

SEQ ID NO: 2527331 - protein, 25 aa, Entamoeba dispar
IKEGRLKMNLLMKSLSSSLYNFKKY

SEQ ID NO: 2527332 - protein, 18 aa, Entamoeba dispar
IKEHLYKNIIISPGYRML

SEQ ID NO: 2527333 - protein, 19 aa, Entamoeba dispar
IKEIETIIFPFSSKNKYGL

SEQ ID NO: 2527334 - protein, 18 aa, Entamoeba dispar
IKEIFAEQIAFITDDTIA

SEQ ID NO: 2527335 - protein, 17 aa, Entamoeba dispar
IKEIGRYCFNKCTGLKR

SEQ ID NO: 2527336 - protein, 18 aa, Entamoeba dispar
IKEIGSWCFCRCYSLSNI

SEQ ID NO: 2527337 - protein, 21 aa, Entamoeba dispar
IKEILLLIPSLQPPPSQIRFI

SEQ ID NO: 2527338 - protein, 24 aa, Entamoeba dispar
IKEIPDFFDKIDLITGLSASSLVS

SEQ ID NO: 2527339 - protein, 19 aa, Entamoeba dispar
IKELFLQPNSPLLYAYCHL

SEQ ID NO: 2527340 - protein, 23 aa, Entamoeba dispar
IKELQSLIFFLNNLVLHANEQFK

SEQ ID NO: 2527341 - protein, 27 aa, Entamoeba dispar
IKELREIYYLLHPLKYTSKGIQIQTVI

SEQ ID NO: 2527342 - protein, 25 aa, Entamoeba dispar
IKELSYPIHCACTIPPPSFIDVVQS

SEQ ID NO: 2527343 - protein, 20 aa, Entamoeba dispar
IKELYLSYLIGIIHGSLNSR

SEQ ID NO: 2527344 - protein, 18 aa, Entamoeba dispar
IKEMMKFDIKQPENAFIM

SEQ ID NO: 2527345 - protein, 24 aa, Entamoeba dispar
IKEPSMYYLIKLKKNTYNIGFSRR

SEQ ID NO: 2527346 - protein, 26 aa, Entamoeba dispar
IKESIANFCLPLTRLFWNIENEIMKY

SEQ ID NO: 2527347 - protein, 19 aa, Entamoeba dispar
IKESIELINLIKVSSFCKE

SEQ ID NO: 2527348 - protein, 22 aa, Entamoeba dispar
IKESIVTKKWTKKFSVKKDQMA

SEQ ID NO: 2527349 - protein, 22 aa, Entamoeba dispar
IKESLESFVPIPLHSYEKIKRS

SEQ ID NO: 2527350 - protein, 18 aa, Entamoeba dispar
IKEYIPCPQPFWDTNGLN

SEQ ID NO: 2527351 - protein, 17 aa, Entamoeba dispar
IKEYYLLFKTKINEQIE

SEQ ID NO: 2527352 - protein, 18 aa, Entamoeba dispar
IKFAYIFTGAKGGVVPYQ

SEQ ID NO: 2527353 - protein, 21 aa, Entamoeba dispar
IKFDIIVFGLPQHEISSIVHL

SEQ ID NO: 2527354 - protein, 19 aa, Entamoeba dispar
IKFEFKPISLFNSLTKKLV

SEQ ID NO: 2527355 - protein, 17 aa, Entamoeba dispar
IKFIIADYPCCLRLIKI

SEQ ID NO: 2527356 - protein, 20 aa, Entamoeba dispar
IKFNLTLIEKKNVGMIKMFN

SEQ ID NO: 2527357 - protein, 28 aa, Entamoeba dispar
IKFQEIIQNCIFLPSLQLFTKMSSNKYN

SEQ ID NO: 2527358 - protein, 24 aa, Entamoeba dispar
IKGDLEAFLARENRFALLGRKDKE

SEQ ID NO: 2527359 - protein, 30 aa, Entamoeba dispar
IKGGNGILYCSLYITKYQMINNILPIECEI

SEQ ID NO: 2527360 - protein, 20 aa, Entamoeba dispar
IKGIGVSCFILCSSLKSINI

SEQ ID NO: 2527361 - protein, 26 aa, Entamoeba dispar
IKGKKNPLFDFRFTFEDFKRRTDICM

SEQ ID NO: 2527362 - protein, 36 aa, Entamoeba dispar
IKGNENVMIFFFLKRNIIVGIYFITPLQPDKQIKEN

SEQ ID NO: 2527363 - protein, 22 aa, Entamoeba dispar
IKGPELLTMWYGESEANVRDVF

SEQ ID NO: 2527364 - protein, 21 aa, Entamoeba dispar
IKGRFCLGVFDLIPNGMVRRK

SEQ ID NO: 2527365 - protein, 19 aa, Entamoeba dispar
IKGYFQNRKIDKEFDIGIF

SEQ ID NO: 2527366 - protein, 37 aa, Entamoeba dispar
IKHDLRSFLIMPVQRLPRYVLLLKELQKNTPKDHKDY

SEQ ID NO: 2527367 - protein, 27 aa, Entamoeba dispar
IKHEIMEVWHFIRLTGTTAFISDDFNE

SEQ ID NO: 2527368 - protein, 25 aa, Entamoeba dispar
IKHGKYGRNALLFNLCFVFDEGTTD

SEQ ID NO: 2527369 - protein, 19 aa, Entamoeba dispar
IKHLCLIIITFINEAINLN

SEQ ID NO: 2527370 - protein, 17 aa, Entamoeba dispar
IKHLDVIDLLKKEIKEL

SEQ ID NO: 2527371 - protein, 26 aa, Entamoeba dispar
IKHLEEFDWIALFERVHSTIIKSTES

SEQ ID NO: 2527372 - protein, 23 aa, Entamoeba dispar
IKHLILCNVFSQSLYLPNTLMKI

SEQ ID NO: 2527373 - protein, 19 aa, Entamoeba dispar
IKHQNKVSTILPISKDDAL

SEQ ID NO: 2527374 - protein, 29 aa, Entamoeba dispar
IKHVLDIVILTDKWSIKISLDYIDQIYKS

SEQ ID NO: 2527375 - protein, 17 aa, Entamoeba dispar
IKIALLPNMQQPIKEML

SEQ ID NO: 2527376 - protein, 18 aa, Entamoeba dispar
IKIELLRYERRVPLNDIR

SEQ ID NO: 2527377 - protein, 26 aa, Entamoeba dispar
IKIIGDIMYWEAALPYELVVLNCYNN

SEQ ID NO: 2527378 - protein, 19 aa, Entamoeba dispar
IKIILPTILECHKTIKLNG

SEQ ID NO: 2527379 - protein, 26 aa, Entamoeba dispar
IKIIPHKYFTFKKVWRAYANYARRRK

SEQ ID NO: 2527380 - protein, 25 aa, Entamoeba dispar
IKIKHIVRIILKHFYSPLLLENIDN

SEQ ID NO: 2527381 - protein, 17 aa, Entamoeba dispar
IKILKKNPKVSFTVVGK

SEQ ID NO: 2527382 - protein, 21 aa, Entamoeba dispar
IKIMKIIHYFLSNGVSNELLG

SEQ ID NO: 2527383 - protein, 18 aa, Entamoeba dispar
IKIPDILDYCSQYMMTTN

SEQ ID NO: 2527384 - protein, 28 aa, Entamoeba dispar
IKIPQNALYYFIDSLFSLFDQWKKFDQT

SEQ ID NO: 2527385 - protein, 19 aa, Entamoeba dispar
IKIPYNLQIINGKNIFKKD

SEQ ID NO: 2527386 - protein, 19 aa, Entamoeba dispar
IKIQKRLAWTTLCRLVFLS

SEQ ID NO: 2527387 - protein, 30 aa, Entamoeba dispar
IKIQNETLFYLYNNLWYKTMFQIKRDEDIK

SEQ ID NO: 2527388 - protein, 26 aa, Entamoeba dispar
IKITKLFSLHQILYYLHNELANKKIN

SEQ ID NO: 2527389 - protein, 27 aa, Entamoeba dispar
IKIVNQKHFLLPTSLTYLSLCQCEDVK

SEQ ID NO: 2527390 - protein, 31 aa, Entamoeba dispar
IKKCPLTSRRPLLNHIVLAGGSTLFPGLPER

SEQ ID NO: 2527391 - protein, 26 aa, Entamoeba dispar
IKKDLQRLMELIFNKSLMSCDELINF

SEQ ID NO: 2527392 - protein, 25 aa, Entamoeba dispar
IKKEKQVIFMIYQNMNNLEQLRDYC

SEQ ID NO: 2527393 - protein, 18 aa, Entamoeba dispar
IKKFFISPISLLKKDEIE

SEQ ID NO: 2527394 - protein, 21 aa, Entamoeba dispar
IKKFKVAVIFSYVGRGYFGLM

SEQ ID NO: 2527395 - protein, 26 aa, Entamoeba dispar
IKKFSQETYILASRLPLVVDVNHMMT

SEQ ID NO: 2527396 - protein, 26 aa, Entamoeba dispar
IKKGEMPFFQFVLNVKSFGQTVENIF

SEQ ID NO: 2527397 - protein, 17 aa, Entamoeba dispar
IKKIIDELIPYLDKYGQ

SEQ ID NO: 2527398 - protein, 18 aa, Entamoeba dispar
IKKILKTDLIAAYAGDPA

SEQ ID NO: 2527399 - protein, 23 aa, Entamoeba dispar
IKKKCYIEYIFAYSVVDMNVMAK

SEQ ID NO: 2527400 - protein, 25 aa, Entamoeba dispar
IKKKFDGYAIFRPKYRRFELYEDDD

SEQ ID NO: 2527401 - protein, 22 aa, Entamoeba dispar
IKKKFYEEIINVGRVDFTVIRE

SEQ ID NO: 2527402 - protein, 21 aa, Entamoeba dispar
IKKLIKLPRKSLDNSREVLTK

SEQ ID NO: 2527403 - protein, 25 aa, Entamoeba dispar
IKKLNKLYEKFPRVVKQFARNRPLE

SEQ ID NO: 2527404 - protein, 25 aa, Entamoeba dispar
IKKLVRGCVGIKRKPNEPVLETKRK

SEQ ID NO: 2527405 - protein, 24 aa, Entamoeba dispar
IKKLYNETLLQDLLAENPAIVNER

SEQ ID NO: 2527406 - protein, 22 aa, Entamoeba dispar
IKKMIPCIVNIFIVGDNLQKEF

SEQ ID NO: 2527407 - protein, 22 aa, Entamoeba dispar
IKKQMFLHQLPNTLVFQLKRFD

SEQ ID NO: 2527408 - protein, 22 aa, Entamoeba dispar
IKKQNLNIIFPPNLKSLTIKYC

SEQ ID NO: 2527409 - protein, 25 aa, Entamoeba dispar
IKKSLIIHDLISQKLLFKTTDLILK

SEQ ID NO: 2527410 - protein, 17 aa, Entamoeba dispar
IKKSLSKIKLTPGTIGK

SEQ ID NO: 2527411 - protein, 21 aa, Entamoeba dispar
IKKYITYARNLPTPSLTQFAS

SEQ ID NO: 2527412 - protein, 20 aa, Entamoeba dispar
IKLAFFDLITPISTVIAKDL

SEQ ID NO: 2527413 - protein, 17 aa, Entamoeba dispar
IKLKIPIGLGEFSRFVQ

SEQ ID NO: 2527414 - protein, 31 aa, Entamoeba dispar
IKLMIDPTRYVIIPRPITIQFHKLKSYFQKD

SEQ ID NO: 2527415 - protein, 24 aa, Entamoeba dispar
IKLPDSLLIIDSYAFSLCYSLISI

SEQ ID NO: 2527416 - protein, 24 aa, Entamoeba dispar
IKMDNYIVGLTNKYGWNIHQNDVI

SEQ ID NO: 2527417 - protein, 18 aa, Entamoeba dispar
IKMKLYFNYFEEGKLNKV

SEQ ID NO: 2527418 - protein, 19 aa, Entamoeba dispar
IKMKVLIDVLKGIQFLHRN

SEQ ID NO: 2527419 - protein, 17 aa, Entamoeba dispar
IKMMKQQSFKSVFEYIM

SEQ ID NO: 2527420 - protein, 34 aa, Entamoeba dispar
IKNASLQLYFLHLKFPRLVSHLFPFFNDLTHQKR

SEQ ID NO: 2527421 - protein, 26 aa, Entamoeba dispar
IKNDTIKFILRLLEKNGFLIQITKDI

SEQ ID NO: 2527422 - protein, 29 aa, Entamoeba dispar
IKNDVWAYGITLWELFTKGKLPYSALNKE

SEQ ID NO: 2527423 - protein, 19 aa, Entamoeba dispar
IKNELENRGYNIHLKQDDV

SEQ ID NO: 2527424 - protein, 24 aa, Entamoeba dispar
IKNFENYIFLTFNEYAIVISVDTP

SEQ ID NO: 2527425 - protein, 21 aa, Entamoeba dispar
IKNIIPFRHTISFLPDNISYN

SEQ ID NO: 2527426 - protein, 19 aa, Entamoeba dispar
IKNKIAFSLPLTVNAFLVQ

SEQ ID NO: 2527427 - protein, 25 aa, Entamoeba dispar
IKNKSWNYINWDTIVFYKIHQVFGG

SEQ ID NO: 2527428 - protein, 22 aa, Entamoeba dispar
IKNLQRKNRLIITKLRSEDKKD

SEQ ID NO: 2527429 - protein, 18 aa, Entamoeba dispar
IKNNIPIPNSFNVKSKEE

SEQ ID NO: 2527430 - protein, 23 aa, Entamoeba dispar
IKNNKEFYLIRNMNIDGKITQIR

SEQ ID NO: 2527431 - protein, 24 aa, Entamoeba dispar
IKNPRKIVLYFDLLKVLLDNNNQN

SEQ ID NO: 2527432 - protein, 23 aa, Entamoeba dispar
IKNQTVVFFVGLKSSTHLFDAYR

SEQ ID NO: 2527433 - protein, 28 aa, Entamoeba dispar
IKNSELLQCIYIICKKLIINNSAGIIEP

SEQ ID NO: 2527434 - protein, 19 aa, Entamoeba dispar
IKNYLFLDDYYEATTLGTI

SEQ ID NO: 2527435 - protein, 17 aa, Entamoeba dispar
IKNYLMKGYHMIGLFDG

SEQ ID NO: 2527436 - protein, 25 aa, Entamoeba dispar
IKPAEKLRPLYWNRIVIDMNNDKSI

SEQ ID NO: 2527437 - protein, 25 aa, Entamoeba dispar
IKPESYLINGIFVFGIEYAQLKKIW

SEQ ID NO: 2527438 - protein, 26 aa, Entamoeba dispar
IKPINNYSLFKYIGKPTLIGNFNINL

SEQ ID NO: 2527439 - protein, 18 aa, Entamoeba dispar
IKPLGVVVCNFLPPNNDG

SEQ ID NO: 2527440 - protein, 17 aa, Entamoeba dispar
IKPPFFGFGSLEPKFAI

SEQ ID NO: 2527441 - protein, 31 aa, Entamoeba dispar
IKPQVDKFTFPDGHSILLLAEGRLVNLGCAT

SEQ ID NO: 2527442 - protein, 18 aa, Entamoeba dispar
IKPTMEIKSKLSTQPVIK

SEQ ID NO: 2527443 - protein, 32 aa, Entamoeba dispar
IKQHDFFSNIKFALIRNMTPPIIPRLNGRRDT

SEQ ID NO: 2527444 - protein, 26 aa, Entamoeba dispar
IKQKVLLGKCRVAVEYFKTGRDQALQ

SEQ ID NO: 2527445 - protein, 27 aa, Entamoeba dispar
IKQLFLDNNFQLLKENNLWTLEKGKKY

SEQ ID NO: 2527446 - protein, 32 aa, Entamoeba dispar
IKQLPGLYVLMLLDYIFKYIERYPSLLLLLKE

SEQ ID NO: 2527447 - protein, 32 aa, Entamoeba dispar
IKQMLGDGSYKLGPFLNTLFTVQDEDFKDNRN

SEQ ID NO: 2527448 - protein, 24 aa, Entamoeba dispar
IKQRNINEFILPTTITKLTDECFS

SEQ ID NO: 2527449 - protein, 24 aa, Entamoeba dispar
IKQSAFLVVITSRTLSLENCSVDC

SEQ ID NO: 2527450 - protein, 21 aa, Entamoeba dispar
IKQTYEIFYLNRDKVNNNQNF

SEQ ID NO: 2527451 - protein, 22 aa, Entamoeba dispar
IKQVSIIKLFGLLFEHCKYEKS

SEQ ID NO: 2527452 - protein, 41 aa, Entamoeba dispar
IKRCKSHITLFKNGIKFICGMNGYIFISLNNESDYSNVGFE

SEQ ID NO: 2527453 - protein, 33 aa, Entamoeba dispar
IKRETLVNLIIEKFFFFLLETINTIKSFEYKKD

SEQ ID NO: 2527454 - protein, 25 aa, Entamoeba dispar
IKRITNILINLFLDKPSNAARLDPG

SEQ ID NO: 2527455 - protein, 24 aa, Entamoeba dispar
IKRKRKPLLFANRLNNEEVNDNII

SEQ ID NO: 2527456 - protein, 21 aa, Entamoeba dispar
IKRLVLIYLESIDKMDKGELR

SEQ ID NO: 2527457 - protein, 27 aa, Entamoeba dispar
IKRMCEDYMIKLIDKYPPTKIKRNQII

SEQ ID NO: 2527458 - protein, 26 aa, Entamoeba dispar
IKRMVKLLCNIFPVDDFWKHVCIVWT

SEQ ID NO: 2527459 - protein, 34 aa, Entamoeba dispar
IKRQCLVINTLKYIYFRIERLLTVSFAELGEEIK

SEQ ID NO: 2527460 - protein, 23 aa, Entamoeba dispar
IKRTMLKTQYRMHPAIAEFSNKM

SEQ ID NO: 2527461 - protein, 19 aa, Entamoeba dispar
IKRTMLKTQYRMHPAIVEF

SEQ ID NO: 2527462 - protein, 21 aa, Entamoeba dispar
IKRVHRQIFFYYNSFNIIIGK

SEQ ID NO: 2527463 - protein, 27 aa, Entamoeba dispar
IKRVHRQIFFYYNSFNIIIGKQGAGKT

SEQ ID NO: 2527464 - protein, 29 aa, Entamoeba dispar
IKRVHRQIFFYYNSFNIIIGKQGAGKTTF

SEQ ID NO: 2527465 - protein, 26 aa, Entamoeba dispar
IKRYCNNFIYMYQWFKSFVNESEHQG

SEQ ID NO: 2527466 - protein, 18 aa, Entamoeba dispar
IKSGYSIAYGARPMRRYI

SEQ ID NO: 2527467 - protein, 21 aa, Entamoeba dispar
IKSHKFFRSVKFQLIRNIPPP

SEQ ID NO: 2527468 - protein, 31 aa, Entamoeba dispar
IKSHPWFKGFDWEGLFQKKLSPPFVPVLKDK

SEQ ID NO: 2527469 - protein, 28 aa, Entamoeba dispar
IKSHQSFPCIPFFGVYLQDLTFIHEGNE

SEQ ID NO: 2527470 - protein, 31 aa, Entamoeba dispar
IKSHSWFKGFDWEGLFQKKLSPPFVPVLKDK

SEQ ID NO: 2527471 - protein, 22 aa, Entamoeba dispar
IKSLPVVHPLLNGIISCFMPPV

SEQ ID NO: 2527472 - protein, 24 aa, Entamoeba dispar
IKSLQKIIIYSNSFYILSLAQREF

SEQ ID NO: 2527473 - protein, 35 aa, Entamoeba dispar
IKSLQKIIIYSNSFYILSLAQRKFISIQSKAQLYL

SEQ ID NO: 2527474 - protein, 23 aa, Entamoeba dispar
IKSPIIRFQIISTPLHFNSLEDL

SEQ ID NO: 2527475 - protein, 38 aa, Entamoeba dispar
IKSPKELLKLLSIKDFYLMFMLFFDDDNTKFITQLLSC

SEQ ID NO: 2527476 - protein, 19 aa, Entamoeba dispar
IKSPLFHSLVGYEKKILNV

SEQ ID NO: 2527477 - protein, 25 aa, Entamoeba dispar
IKSQLIQHRSLLFQYFSITITENGE

SEQ ID NO: 2527478 - protein, 18 aa, Entamoeba dispar
IKSRLPKEPVLNSAIKEL

SEQ ID NO: 2527479 - protein, 17 aa, Entamoeba dispar
IKSRWMRKNSRRIDMEN

SEQ ID NO: 2527480 - protein, 25 aa, Entamoeba dispar
IKSSGKMVLLDKLLPKLNTDGHKVL

SEQ ID NO: 2527481 - protein, 32 aa, Entamoeba dispar
IKSTDGIYPKKEIEWLMGISWNKGNKSRYKQD

SEQ ID NO: 2527482 - protein, 26 aa, Entamoeba dispar
IKSTPEFTIGIKTRGLEKKQRFTRVS

SEQ ID NO: 2527483 - protein, 31 aa, Entamoeba dispar
IKTAIRLFELITKYVFIRRVGGGVYGPLYTS

SEQ ID NO: 2527484 - protein, 28 aa, Entamoeba dispar
IKTAKPICIEPYELFPQLGRFTLRDAGK

SEQ ID NO: 2527485 - protein, 18 aa, Entamoeba dispar
IKTFNKIVLVNLEPFFIA

SEQ ID NO: 2527486 - protein, 32 aa, Entamoeba dispar
IKTGNLFINYLYLLLKEYSYIMEIPCTLIIIS

SEQ ID NO: 2527487 - protein, 26 aa, Entamoeba dispar
IKTGTRIFVLSFIFRNIIQSISTNSF

SEQ ID NO: 2527488 - protein, 30 aa, Entamoeba dispar
IKTHPWWNGFDWDALYQKKIPAPFKPDMSQ

SEQ ID NO: 2527489 - protein, 23 aa, Entamoeba dispar
IKTIGYWIKIDIIYQNLGDKKTL

SEQ ID NO: 2527490 - protein, 19 aa, Entamoeba dispar
IKTIQRIIAPTFYVRSIDL

SEQ ID NO: 2527491 - protein, 26 aa, Entamoeba dispar
IKTKKGIFFYTIYSFIGNIIESYLKY

SEQ ID NO: 2527492 - protein, 33 aa, Entamoeba dispar
IKTLEQYTLLKRIKIIKSFWRNIKENEKERFIR

SEQ ID NO: 2527493 - protein, 17 aa, Entamoeba dispar
IKTLKLKIYKEIGPFNK

SEQ ID NO: 2527494 - protein, 18 aa, Entamoeba dispar
IKTLLQMYENMYGIKVNK

SEQ ID NO: 2527495 - protein, 28 aa, Entamoeba dispar
IKTPTKLLHLGFHKLPFIPKESAELFYF

SEQ ID NO: 2527496 - protein, 29 aa, Entamoeba dispar
IKTQFTQFVLYQQLIQFLLKTKYFNDSSS

SEQ ID NO: 2527497 - protein, 24 aa, Entamoeba dispar
IKTRNPIVFSFHPSALKCSIMAAK

SEQ ID NO: 2527498 - protein, 19 aa, Entamoeba dispar
IKTTRLCVLILQSLKEIKP

SEQ ID NO: 2527499 - protein, 34 aa, Entamoeba dispar
IKTVSTCLQLAKSQLNIPILLSAQAVGANQLDDN

SEQ ID NO: 2527500 - protein, 21 aa, Entamoeba dispar
IKVDYIDLFIKEMMKKFKEQY

SEQ ID NO: 2527501 - protein, 29 aa, Entamoeba dispar
IKVIMKNCGSYFVKNLGRRCSKYIRKMKE

SEQ ID NO: 2527502 - protein, 32 aa, Entamoeba dispar
IKVKPAQMKKFLKQFGKLESYRFRGGAFIQDE

SEQ ID NO: 2527503 - protein, 23 aa, Entamoeba dispar
IKVLMEVILLQRLSAEFPNMFAN

SEQ ID NO: 2527504 - protein, 19 aa, Entamoeba dispar
IKVNCTTTLFFARMGSIKK

SEQ ID NO: 2527505 - protein, 24 aa, Entamoeba dispar
IKVQMGMLRVIDIILKSDFGEIFC

SEQ ID NO: 2527506 - protein, 18 aa, Entamoeba dispar
IKVWVQVACPRLSIDWGE

SEQ ID NO: 2527507 - protein, 26 aa, Entamoeba dispar
IKYEIIMIDWGFYNKLLQTNPAISRT

SEQ ID NO: 2527508 - protein, 21 aa, Entamoeba dispar
IKYILKLLEELLIQNEFNFLF

SEQ ID NO: 2527509 - protein, 18 aa, Entamoeba dispar
IKYLFTSLLGINEKSYNR

SEQ ID NO: 2527510 - protein, 18 aa, Entamoeba dispar
IKYQGIVKEINDIQQRIK

SEQ ID NO: 2527511 - protein, 29 aa, Entamoeba dispar
IKYQTLLCEQFIPLIMNILMEPLNTQDKY

SEQ ID NO: 2527512 - protein, 24 aa, Entamoeba dispar
ILAKIIPRMTFYASRPLPIVTTEI

SEQ ID NO: 2527513 - protein, 17 aa, Entamoeba dispar
ILALLQKNNEIIGKIQL

SEQ ID NO: 2527514 - protein, 18 aa, Entamoeba dispar
ILALVSFNRLIVIRGHEQ

SEQ ID NO: 2527515 - protein, 24 aa, Entamoeba dispar
ILAPLVRSKLLYAHLMIIAGQKQM

SEQ ID NO: 2527516 - protein, 30 aa, Entamoeba dispar
ILCYQRLLTLQFIIIFNNKGIHRVLLTDDD

SEQ ID NO: 2527517 - protein, 19 aa, Entamoeba dispar
ILDCLKPVYTPLLSETMFD

SEQ ID NO: 2527518 - protein, 18 aa, Entamoeba dispar
ILDFSLFHRMEDPQTTFL

SEQ ID NO: 2527519 - protein, 17 aa, Entamoeba dispar
ILDIAGFEIFRENSFEQ

SEQ ID NO: 2527520 - protein, 17 aa, Entamoeba dispar
ILDILFVNFLREFMSQT

SEQ ID NO: 2527521 - protein, 21 aa, Entamoeba dispar
ILDKFPNFFEKIDVITGVSAS

SEQ ID NO: 2527522 - protein, 32 aa, Entamoeba dispar
ILDRLIEIVAFPRLYYKTIPLPFDYQTYFLHC

SEQ ID NO: 2527523 - protein, 28 aa, Entamoeba dispar
ILDVNFVINLELPLIYPSQSIDINTYIH

SEQ ID NO: 2527524 - protein, 23 aa, Entamoeba dispar
ILDYKENIPPFLLIDGDASVTIK

SEQ ID NO: 2527525 - protein, 18 aa, Entamoeba dispar
ILEDDGQELEWYDDHMPE

SEQ ID NO: 2527526 - protein, 27 aa, Entamoeba dispar
ILEDQSKLYHAYWQQTKTDFSDFKKES

SEQ ID NO: 2527527 - protein, 18 aa, Entamoeba dispar
ILEEYWQNHKDLWSVSIF

SEQ ID NO: 2527528 - protein, 17 aa, Entamoeba dispar
ILEIMKFDIKCGYLLAL

SEQ ID NO: 2527529 - protein, 23 aa, Entamoeba dispar
ILEKDEGWWKGELNGQEGWIPNN

SEQ ID NO: 2527530 - protein, 30 aa, Entamoeba dispar; identical to SEQ ID NO: 2486898

SEQ ID NO: 2527531 - protein, 18 aa, Entamoeba dispar
ILELIKKHPPPTFKNKEE

SEQ ID NO: 2527532 - protein, 23 aa, Entamoeba dispar
ILEMFHYNPIPILSRKLFPNIET

SEQ ID NO: 2527533 - protein, 20 aa, Entamoeba dispar
ILEQPHLLLIEGMLNKYCRK

SEQ ID NO: 2527534 - protein, 31 aa, Entamoeba dispar
ILESYHPMFRSTLFRWLEEIEYLNISGCIRL

SEQ ID NO: 2527535 - protein, 22 aa, Entamoeba dispar
ILEYINRFIYYSSFIRKNIYLD

SEQ ID NO: 2527536 - protein, 17 aa, Entamoeba dispar
ILEYYQTLVMKITGFKT

SEQ ID NO: 2527537 - protein, 30 aa, Entamoeba dispar
ILFDKKWKKRYLIWKGMVLYFYDKKGSKDI

SEQ ID NO: 2527538 - protein, 29 aa, Entamoeba dispar
ILFDNNLSFLPFDLSFSASLIPLIYQGRI

SEQ ID NO: 2527539 - protein, 18 aa, Entamoeba dispar
ILFHIKLPEAISNKPSLW

SEQ ID NO: 2527540 - protein, 19 aa, Entamoeba dispar
ILFKIKMVLDDPYVASEFI

SEQ ID NO: 2527541 - protein, 20 aa, Entamoeba dispar
ILFKNLNFALNMESRIALVG

SEQ ID NO: 2527542 - protein, 18 aa, Entamoeba dispar
ILFNLLKEQDSMKCCIKG

SEQ ID NO: 2527543 - protein, 20 aa, Entamoeba dispar
ILFPKIVFNIIIKNVEMILS

SEQ ID NO: 2527544 - protein, 19 aa, Entamoeba dispar
ILFYRLCQESFITKRTKGM

SEQ ID NO: 2527545 - protein, 22 aa, Entamoeba dispar
ILGKFIMLPTTQDKLIRLKSCQ

SEQ ID NO: 2527546 - protein, 17 aa, Entamoeba dispar
ILGLFDALSGHVSSTVE

SEQ ID NO: 2527547 - protein, 17 aa, Entamoeba dispar
ILGLPYSCAIDMWSFGC

SEQ ID NO: 2527548 - protein, 19 aa, Entamoeba dispar
ILGLPYSCSIDMWSFGCVI

SEQ ID NO: 2527549 - protein, 25 aa, Entamoeba dispar
ILGSECFKYCFEVIRVDVLRNVKKL

SEQ ID NO: 2527550 - protein, 24 aa, Entamoeba dispar
ILHAQKFLVKLYDLQQKEISEEKK

SEQ ID NO: 2527551 - protein, 19 aa, Entamoeba dispar
ILHCPIIEDLIRKIQTIDN

SEQ ID NO: 2527552 - protein, 18 aa, Entamoeba dispar
ILHVYLHQVHLKELLEIL

SEQ ID NO: 2527553 - protein, 19 aa, Entamoeba dispar
ILHYTLKIIIKILEIGEKE

SEQ ID NO: 2527554 - protein, 19 aa, Entamoeba dispar
ILIELKYLNEISGILTFGP

SEQ ID NO: 2527555 - protein, 24 aa, Entamoeba dispar
ILIFTANIIYHLFDQFNEHMKKLE

SEQ ID NO: 2527556 - protein, 20 aa, Entamoeba dispar
ILIFYAQEIFKIYPIVIVHL

SEQ ID NO: 2527557 - protein, 17 aa, Entamoeba dispar
ILIIMSYLSDNNLAPLT

SEQ ID NO: 2527558 - protein, 18 aa, Entamoeba dispar
ILIIYFTRDGHSEKIAND

SEQ ID NO: 2527559 - protein, 17 aa, Entamoeba dispar
ILILTINSIIYLSTTSF

SEQ ID NO: 2527560 - protein, 18 aa, Entamoeba dispar
ILIPKNPDAPLPSLKIEE

SEQ ID NO: 2527561 - protein, 17 aa, Entamoeba dispar
ILITFKIDNNVFGLYIN

SEQ ID NO: 2527562 - protein, 20 aa, Entamoeba dispar
ILITLLCMKVNDPTGVILLR

SEQ ID NO: 2527563 - protein, 18 aa, Entamoeba dispar
ILIVPPTPKKTLPFGLLV

SEQ ID NO: 2527564 - protein, 17 aa, Entamoeba dispar
ILKAIAPLTGRQLCSIL

SEQ ID NO: 2527565 - protein, 18 aa, Entamoeba dispar
ILKCNIALFVLRERIRKA

SEQ ID NO: 2527566 - protein, 17 aa, Entamoeba dispar
ILKCPMRLENKLLALVV

SEQ ID NO: 2527567 - protein, 25 aa, Entamoeba dispar
ILKEKMFDIIAKDIKIVISIYPSNS

SEQ ID NO: 2527568 - protein, 23 aa, Entamoeba dispar
ILKESLNALCKIASLFNQSKKET

SEQ ID NO: 2527569 - protein, 25 aa, Entamoeba dispar
ILKESLNALCKIASLFNQSKKETEE

SEQ ID NO: 2527570 - protein, 26 aa, Entamoeba dispar
ILKEYLTHFLLYIHFPWERNIENGST

SEQ ID NO: 2527571 - protein, 18 aa, Entamoeba dispar
ILKGVERKLKSLESLKKC

SEQ ID NO: 2527572 - protein, 30 aa, Entamoeba dispar
ILKIEKYHIPYLFPIPYLSDEKYSIAFYYN

SEQ ID NO: 2527573 - protein, 29 aa, Entamoeba dispar
ILKQMKLMNLLRNYSFLYKSAAFLYVYPA

SEQ ID NO: 2527574 - protein, 17 aa, Entamoeba dispar
ILLHSDYSMQCSVYSYI

SEQ ID NO: 2527575 - protein, 26 aa, Entamoeba dispar
ILLHYYASHSLLPNLLLSLASFEIKS

SEQ ID NO: 2527576 - protein, 21 aa, Entamoeba dispar
ILLKQMSMVLVALSKPTPLPL

SEQ ID NO: 2527577 - protein, 26 aa, Entamoeba dispar
ILLNEKKPLVMSTAKALRVVNEIKEK

SEQ ID NO: 2527578 - protein, 17 aa, Entamoeba dispar
ILLNKLYDVLPKEKTLK

SEQ ID NO: 2527579 - protein, 18 aa, Entamoeba dispar
ILLREEDDILSWLGNSDF

SEQ ID NO: 2527580 - protein, 28 aa, Entamoeba dispar
ILLRRMTDTIKPLKYSPLFIQKQNELLQ

SEQ ID NO: 2527581 - protein, 19 aa, Entamoeba dispar
ILLSFNLLEEKIAKDVLLK

SEQ ID NO: 2527582 - protein, 29 aa, Entamoeba dispar
ILLTKSPIYQHGCSWAWKLMDGNAPLSFN

SEQ ID NO: 2527583 - protein, 18 aa, Entamoeba dispar
ILMILNLSTFCGIPLWNV

SEQ ID NO: 2527584 - protein, 17 aa, Entamoeba dispar
ILMLAIQLGFNDIAFEI

SEQ ID NO: 2527585 - protein, 18 aa, Entamoeba dispar
ILMNVHKEILFFAKAKED

SEQ ID NO: 2527586 - protein, 20 aa, Entamoeba dispar
ILMSCRNYINFHIKCSKAFL

SEQ ID NO: 2527587 - protein, 17 aa, Entamoeba dispar
ILMTFVQGLPTINDKWV

SEQ ID NO: 2527588 - protein, 20 aa, Entamoeba dispar
ILNCIELFDSNEYPIQVILP

SEQ ID NO: 2527589 - protein, 18 aa, Entamoeba dispar
ILNGANFAKNHGVYYCKV

SEQ ID NO: 2527590 - protein, 26 aa, Entamoeba dispar
ILNHSNIVVLVFDSLGSVFGGYMNKP

SEQ ID NO: 2527591 - protein, 19 aa, Entamoeba dispar
ILNKIKEVLKTQKDFLILL

SEQ ID NO: 2527592 - protein, 31 aa, Entamoeba dispar
ILNQSLKILPKEPLIWIAAARIEEIKGHNPE

SEQ ID NO: 2527593 - protein, 24 aa, Entamoeba dispar
ILNSSYILPPQFYSNFNLSFLTPH

SEQ ID NO: 2527594 - protein, 26 aa, Entamoeba dispar
ILNTLNFQIIRPTPLDFLRRFSRAAD

SEQ ID NO: 2527595 - protein, 23 aa, Entamoeba dispar
ILNYKIVFVVLLNDSLYEDIKRK

SEQ ID NO: 2527596 - protein, 18 aa, Entamoeba dispar
ILPANPFEILDRPGVGEV

SEQ ID NO: 2527597 - protein, 18 aa, Entamoeba dispar
ILPIIPLKTKRSICNNTY

SEQ ID NO: 2527598 - protein, 24 aa, Entamoeba dispar
ILPNCIRELGKELFYGCSNLTLID

SEQ ID NO: 2527599 - protein, 21 aa, Entamoeba dispar
ILQALILARLVTKFPRLLEEV

SEQ ID NO: 2527600 - protein, 17 aa, Entamoeba dispar
ILQFLKFEKITENKNYD

SEQ ID NO: 2527601 - protein, 17 aa, Entamoeba dispar
ILQFVIEKQKFTQQELR

SEQ ID NO: 2527602 - protein, 30 aa, Entamoeba dispar
ILQGLNGFRKLLLITPPPLIEIYQSGVLSR

SEQ ID NO: 2527603 - protein, 25 aa, Entamoeba dispar
ILQHEFLVPYVAPPIYDHIKSPTFA

SEQ ID NO: 2527604 - protein, 19 aa, Entamoeba dispar
ILQIMLRNSLNKQDVLILY

SEQ ID NO: 2527605 - protein, 20 aa, Entamoeba dispar
ILQIVDGRDPLFYYSTDLVK

SEQ ID NO: 2527606 - protein, 22 aa, Entamoeba dispar
ILQKNYLIIFKTTDGSIYGTYN

SEQ ID NO: 2527607 - protein, 17 aa, Entamoeba dispar
ILQKSKNVLLCERTTIG

SEQ ID NO: 2527608 - protein, 27 aa, Entamoeba dispar
ILQKVKHPFLVNLYYSFQSATHLHYVI

SEQ ID NO: 2527609 - protein, 19 aa, Entamoeba dispar
ILQLKALSREYGVVVPLVL

SEQ ID NO: 2527610 - protein, 17 aa, Entamoeba dispar
ILQLLPTYYGKNGKYYG

SEQ ID NO: 2527611 - protein, 33 aa, Entamoeba dispar
ILQPKQDIVFCYPPPPIFIAERGQFSNYLDMLL

SEQ ID NO: 2527612 - protein, 22 aa, Entamoeba dispar
ILQPLQCVSGFLVLRVICPAIM

SEQ ID NO: 2527613 - protein, 32 aa, Entamoeba dispar
ILQQRIQMSFILYNDYLYSEAMYFIGNIMSMA

SEQ ID NO: 2527614 - protein, 19 aa, Entamoeba dispar
ILQYMILSNNKLKISPDLS

SEQ ID NO: 2527615 - protein, 18 aa, Entamoeba dispar
ILRLYQTRADYYSLIGDI

SEQ ID NO: 2527616 - protein, 21 aa, Entamoeba dispar
ILRRGYWMLSNISVSKFPETT

SEQ ID NO: 2527617 - protein, 19 aa, Entamoeba dispar
ILRSLILQNGGKYLMKYSS

SEQ ID NO: 2527618 - protein, 25 aa, Entamoeba dispar
ILSDLRMIKPFLSYYHNAAVKAIKF

SEQ ID NO: 2527619 - protein, 26 aa, Entamoeba dispar
ILSDYCFYLEELYGTADLNIAENILA

SEQ ID NO: 2527620 - protein, 24 aa, Entamoeba dispar
ILSEFDILYFFKSDIELFKWNIEQ

SEQ ID NO: 2527621 - protein, 17 aa, Entamoeba dispar
ILSIVDILIHYSDDEAL

SEQ ID NO: 2527622 - protein, 23 aa, Entamoeba dispar
ILSPNYWEVIDLITGNIIQSTKP

SEQ ID NO: 2527623 - protein, 18 aa, Entamoeba dispar
ILSSEIHFLPKSNDYQVL

SEQ ID NO: 2527624 - protein, 18 aa, Entamoeba dispar
ILSSPQLLEPIYSVEIIT

SEQ ID NO: 2527625 - protein, 18 aa, Entamoeba dispar
ILSTAIPYFPDDTVFVAV

SEQ ID NO: 2527626 - protein, 25 aa, Entamoeba dispar
ILSVGDCEAFIYKSAIGRTFSVNKK

SEQ ID NO: 2527627 - protein, 25 aa, Entamoeba dispar
ILTDNIFRYKEDINRLNPNGKLETE

SEQ ID NO: 2527628 - protein, 34 aa, Entamoeba dispar
ILTEFHWDRNRLFDRLICDLLYEDALEHINSATI

SEQ ID NO: 2527629 - protein, 19 aa, Entamoeba dispar
ILTIIKNKKTEKAVIFGLN

SEQ ID NO: 2527630 - protein, 23 aa, Entamoeba dispar
ILTIQKLLHYISQYKSLSEMEKH

SEQ ID NO: 2527631 - protein, 30 aa, Entamoeba dispar
ILTLKGMGIDKVINFPFPSQINIERLKEAN

SEQ ID NO: 2527632 - protein, 17 aa, Entamoeba dispar
ILTLMQKIINLQPSLLN

SEQ ID NO: 2527633 - protein, 24 aa, Entamoeba dispar
ILTPKFPEFFTDEMKEFIPVIIKG

SEQ ID NO: 2527634 - protein, 34 aa, Entamoeba dispar
ILTSLTRLQLFYIQGIINLPKTLQIFIVKSSNIQ

SEQ ID NO: 2527635 - protein, 30 aa, Entamoeba dispar
ILVEKRVAYRALFIHYFLQVAEEMKKLNNF

SEQ ID NO: 2527636 - protein, 18 aa, Entamoeba dispar
ILVFDSINRFIVKTIPAM

SEQ ID NO: 2527637 - protein, 19 aa, Entamoeba dispar
ILVGNNFFGDASSLFGIFD

SEQ ID NO: 2527638 - protein, 18 aa, Entamoeba dispar
ILVKLEYFNPMSSVKDRV

SEQ ID NO: 2527639 - protein, 24 aa, Entamoeba dispar
ILVLTHIFLITNDEIRTLIFNWII

SEQ ID NO: 2527640 - protein, 18 aa, Entamoeba dispar
ILVNCAIETLLSINKNND

SEQ ID NO: 2527641 - protein, 41 aa, Entamoeba dispar
ILVSGGVDTIILFRPINDMNQLIYRIFPIGVDSPKAKVCST

SEQ ID NO: 2527642 - protein, 20 aa, Entamoeba dispar
ILVWNPHHRLRPIQALHHPF

SEQ ID NO: 2527643 - protein, 18 aa, Entamoeba dispar
ILYDLQFNLFSQVRSNVL

SEQ ID NO: 2527644 - protein, 30 aa, Entamoeba dispar
ILYESQGLVPLLRLQWNKFDPNFIATFAMD

SEQ ID NO: 2527645 - protein, 17 aa, Entamoeba dispar
ILYFINDKTLMIVGLKS

SEQ ID NO: 2527646 - protein, 17 aa, Entamoeba dispar
ILYMQFIYNDSLDYNSL

SEQ ID NO: 2527647 - protein, 21 aa, Entamoeba dispar
ILYNELLTLNIPFGKTIIEKM

SEQ ID NO: 2527648 - protein, 19 aa, Entamoeba dispar
ILYNFSVVHDKFPPNPKFV

SEQ ID NO: 2527649 - protein, 20 aa, Entamoeba dispar
ILYQNPTYVIPTGPQNQRIV

SEQ ID NO: 2527650 - protein, 18 aa, Entamoeba dispar
ILYRLPHSKLIQLPEYSI

SEQ ID NO: 2527651 - protein, 17 aa, Entamoeba dispar
ILYYLNAQPIQLLSSCL

SEQ ID NO: 2527652 - protein, 20 aa, Entamoeba dispar
IMCSGTPLVYSCIKILMQRV

SEQ ID NO: 2527653 - protein, 17 aa, Entamoeba dispar
IMDFILTPNTEAPSNMM

SEQ ID NO: 2527654 - protein, 31 aa, Entamoeba dispar
IMDMFQLKKMLKFLWHKLIPHTKKHTLLLRK

SEQ ID NO: 2527655 - protein, 17 aa, Entamoeba dispar
IMDVLMNENIKKYVSNK

SEQ ID NO: 2527656 - protein, 21 aa, Entamoeba dispar
IMEHVLPVLEKRFRLKPMLID

SEQ ID NO: 2527657 - protein, 26 aa, Entamoeba dispar
IMEIPYLAIHFNVGPIYLFNLNNPHE

SEQ ID NO: 2527658 - protein, 19 aa, Entamoeba dispar
IMELWELITNMMKCIAIAL

SEQ ID NO: 2527659 - protein, 18 aa, Entamoeba dispar
IMFSSLFDIYSSFISTLC

SEQ ID NO: 2527660 - protein, 18 aa, Entamoeba dispar
IMFYDYGCSMFLSTNKIV

SEQ ID NO: 2527661 - protein, 25 aa, Entamoeba dispar
IMGEIVALNALLKKNLRSIDYKYCM

SEQ ID NO: 2527662 - protein, 17 aa, Entamoeba dispar
IMIDTINTIPIIVHIIS

SEQ ID NO: 2527663 - protein, 18 aa, Entamoeba dispar
IMIIGMKGITLDSIGYKN

SEQ ID NO: 2527664 - protein, 25 aa, Entamoeba dispar
IMKDPYIIYAILDLIHSHYQILKDE

SEQ ID NO: 2527665 - protein, 19 aa, Entamoeba dispar
IMKDTGLYSKCECTMESDV

SEQ ID NO: 2527666 - protein, 26 aa, Entamoeba dispar
IMKKYMKYILTYLPINSKRAKNINQK

SEQ ID NO: 2527667 - protein, 17 aa, Entamoeba dispar
IMKLSRITEILKSSEST

SEQ ID NO: 2527668 - protein, 22 aa, Entamoeba dispar
IMKRINDMQFMLNQSLKKVEME

SEQ ID NO: 2527669 - protein, 28 aa, Entamoeba dispar
IMKTSFTLINWRSVIPTAPAHGLFLDQC

SEQ ID NO: 2527670 - protein, 18 aa, Entamoeba dispar
IMMTFNILISTLPKETRL

SEQ ID NO: 2527671 - protein, 21 aa, Entamoeba dispar
IMNAGICQLLYHMRVNSHFSI

SEQ ID NO: 2527672 - protein, 24 aa, Entamoeba dispar
IMNKTFTFFILQDGTLKYYNSNGT

SEQ ID NO: 2527673 - protein, 28 aa, Entamoeba dispar
IMPVQRVPRYRLLLQDLLKNTPDETLGK

SEQ ID NO: 2527674 - protein, 26 aa, Entamoeba dispar
IMQRHQYLAFHLLNCNLNSFNVNNGN

SEQ ID NO: 2527675 - protein, 31 aa, Entamoeba dispar
IMSSDQVMLLIPKLLRAQKINKILFNNLNSS

SEQ ID NO: 2527676 - protein, 26 aa, Entamoeba dispar
IMSSSTMIFMYSYFSRIEFTPISYQP

SEQ ID NO: 2527677 - protein, 17 aa, Entamoeba dispar
IMTDWYACKDTVRMVLG

SEQ ID NO: 2527678 - protein, 28 aa, Entamoeba dispar
IMTLGLNEHRFQQIVDSLDLFDEYNELN

SEQ ID NO: 2527679 - protein, 17 aa, Entamoeba dispar
IMWAAAAGQFELNVMEP

SEQ ID NO: 2527680 - protein, 17 aa, Entamoeba dispar
INAFFDSPLDLTKMEQP

SEQ ID NO: 2527681 - protein, 25 aa, Entamoeba dispar
INAINLPILPRFYMKQELCGLHGEE

SEQ ID NO: 2527682 - protein, 17 aa, Entamoeba dispar
INALHGIKITDDFRYII

SEQ ID NO: 2527683 - protein, 33 aa, Entamoeba dispar
INALRNMLQLFLRQLPLKSKFEIISFGSKYDFM

SEQ ID NO: 2527684 - protein, 18 aa, Entamoeba dispar
INCILLCLRYGGSDVWSS

SEQ ID NO: 2527685 - protein, 28 aa, Entamoeba dispar
INCNSYCLFHFCHEVFYFIAVTDIDVSP

SEQ ID NO: 2527686 - protein, 25 aa, Entamoeba dispar
INDEGYHRLFYPIIDRIMEVFQPSV

SEQ ID NO: 2527687 - protein, 26 aa, Entamoeba dispar
INDEGYHRLFYPIIDRIMEVFQPSVV

SEQ ID NO: 2527688 - protein, 28 aa, Entamoeba dispar
INDELIPIFLERLVAFPLDKLTINYKLL

SEQ ID NO: 2527689 - protein, 28 aa, Entamoeba dispar
INDICAPYLQIKLLRLLRVMNPSTKYYQ

SEQ ID NO: 2527690 - protein, 30 aa, Entamoeba dispar
INDKTLLSLFHLHTLYLRLLSQEFASFTGD

SEQ ID NO: 2527691 - protein, 17 aa, Entamoeba dispar
INDLFEGLENADAEELS

SEQ ID NO: 2527692 - protein, 18 aa, Entamoeba dispar
INDLLLNDLKETEQLFIE

SEQ ID NO: 2527693 - protein, 17 aa, Entamoeba dispar
INDLYANSLTIYDNRKG

SEQ ID NO: 2527694 - protein, 18 aa, Entamoeba dispar
INDLYANSLTIYDNRKGL

SEQ ID NO: 2527695 - protein, 17 aa, Entamoeba dispar
INDLYANSLTIYDNRNG

SEQ ID NO: 2527696 - protein, 25 aa, Entamoeba dispar
INDNEFLYISLFNMQLKLVQTFSHS

SEQ ID NO: 2527697 - protein, 24 aa, Entamoeba dispar
INDPKSFVFSLYKNKRYQKLKFPF

SEQ ID NO: 2527698 - protein, 23 aa, Entamoeba dispar
INDPTLCSQLFIKEIDNALIESI

SEQ ID NO: 2527699 - protein, 29 aa, Entamoeba dispar
INDQIVMAIGKIIPPEQLTLDRLVDYLDT

SEQ ID NO: 2527700 - protein, 22 aa, Entamoeba dispar
INDRYEFPRELDLYPYCIEHIN

SEQ ID NO: 2527701 - protein, 26 aa, Entamoeba dispar
INDSKWYCFPLLIEIAMNWKLNIYDS

SEQ ID NO: 2527702 - protein, 27 aa, Entamoeba dispar
INDSYILKVMGYITVRFKQLRTTKNEI

SEQ ID NO: 2527703 - protein, 28 aa, Entamoeba dispar
INDSYILKVMGYITVRFKQLRTTKNEIA

SEQ ID NO: 2527704 - protein, 33 aa, Entamoeba dispar
INEAFFKLRNYQVYQQGILLALLNKHFEITLQI

SEQ ID NO: 2527705 - protein, 26 aa, Entamoeba dispar
INEEKYILKLLSIFGRYYRNRPYTKQ

SEQ ID NO: 2527706 - protein, 19 aa, Entamoeba dispar
INEFIIPSLIDRLGDYCFS

SEQ ID NO: 2527707 - protein, 18 aa, Entamoeba dispar
INEFIIPSSINKLGYRCF

SEQ ID NO: 2527708 - protein, 18 aa, Entamoeba dispar
INEFIIPSSISELGFSCF

SEQ ID NO: 2527709 - protein, 18 aa, Entamoeba dispar
INEFIIPSSISKLGDLCF

SEQ ID NO: 2527710 - protein, 18 aa, Entamoeba dispar
INEFIIPSSITKLGDCCF

SEQ ID NO: 2527711 - protein, 18 aa, Entamoeba dispar
INEFIIPSSITKLGDGCF

SEQ ID NO: 2527712 - protein, 18 aa, Entamoeba dispar
INEFIIPSSITKLGDHCF

SEQ ID NO: 2527713 - protein, 18 aa, Entamoeba dispar
INEFIIPSSITKLGEYCF

SEQ ID NO: 2527714 - protein, 18 aa, Entamoeba dispar
INEFIIPSSITKLGYGCF

SEQ ID NO: 2527715 - protein, 19 aa, Entamoeba dispar
INEFIIPSSITKLGYKCFY

SEQ ID NO: 2527716 - protein, 19 aa, Entamoeba dispar
INEFIIPSSITKLGYRCFS

SEQ ID NO: 2527717 - protein, 22 aa, Entamoeba dispar
INEFIIPTTITKLGWKCFEYCT

SEQ ID NO: 2527718 - protein, 25 aa, Entamoeba dispar
INEFSIILDHLITVGSFTIKCTTLE

SEQ ID NO: 2527719 - protein, 18 aa, Entamoeba dispar
INEFYQFAVLLETEFPKL

SEQ ID NO: 2527720 - protein, 17 aa, Entamoeba dispar
INEGIWRSMRRVVIYLE

SEQ ID NO: 2527721 - protein, 19 aa, Entamoeba dispar
INEGLIPEYIHIEKESLCA

SEQ ID NO: 2527722 - protein, 18 aa, Entamoeba dispar
INEIGYYCFYECCSLISI

SEQ ID NO: 2527723 - protein, 37 aa, Entamoeba dispar
INEILIKYMFSLKYGFKYLYYIIPKIISLSNSIDSTG

SEQ ID NO: 2527724 - protein, 21 aa, Entamoeba dispar
INELGKKIKLFKKKNQLILEE

SEQ ID NO: 2527725 - protein, 25 aa, Entamoeba dispar
INELKNELIIIEQKLKDIPNLDELE

SEQ ID NO: 2527726 - protein, 17 aa, Entamoeba dispar
INELNFELLRNATMLRK

SEQ ID NO: 2527727 - protein, 21 aa, Entamoeba dispar
INEMEFLGIVIPPSDFQQYNQ

SEQ ID NO: 2527728 - protein, 26 aa, Entamoeba dispar
INENKLIEFFGIIPIIHIEGRTFPVS

SEQ ID NO: 2527729 - protein, 25 aa, Entamoeba dispar
INENTKLPLFLGREGKEFKEEGTFI

SEQ ID NO: 2527730 - protein, 30 aa, Entamoeba dispar
INEPILICGDSCIDSYIISFSLAIGGYLWV

SEQ ID NO: 2527731 - protein, 31 aa, Entamoeba dispar
INEQPLFVIHVLWLRILYKISLPDDNNCFIL

SEQ ID NO: 2527732 - protein, 23 aa, Entamoeba dispar
INEQRVYYEWRDELDNSDSEEII

SEQ ID NO: 2527733 - protein, 23 aa, Entamoeba dispar
INERMNIIDKKILYIMNCMATSE

SEQ ID NO: 2527734 - protein, 24 aa, Entamoeba dispar
INFEDYYYYLSTKVPTLRWVELEY

SEQ ID NO: 2527735 - protein, 17 aa, Entamoeba dispar
INFLFVKGCNDYFDSPL

SEQ ID NO: 2527736 - protein, 22 aa, Entamoeba dispar
INFLNFFQMFNPNVIVPQHPQN

SEQ ID NO: 2527737 - protein, 22 aa, Entamoeba dispar
INFSKFPFYFEVGGNIAQEIGD

SEQ ID NO: 2527738 - protein, 30 aa, Entamoeba dispar
INGEDPFNIIRKFGKKYIGLRSPHAQFEKA

SEQ ID NO: 2527739 - protein, 40 aa, Entamoeba dispar
INGFGFRNICEWIKKIKTPYYLYAFSVIQYILAKTNHYDN

SEQ ID NO: 2527740 - protein, 19 aa, Entamoeba dispar
INGFINIFSIKTGVIVGSL

SEQ ID NO: 2527741 - protein, 22 aa, Entamoeba dispar
INGIEKKYFVKLLLSFHDVKRK

SEQ ID NO: 2527742 - protein, 24 aa, Entamoeba dispar
INGIERYLRMIVYAKANHPLAVIR

SEQ ID NO: 2527743 - protein, 30 aa, Entamoeba dispar
INGIKYLSTFFPINAIFKSALQTQSKKIAR

SEQ ID NO: 2527744 - protein, 27 aa, Entamoeba dispar
INGKVLISGGLTLPLLSSSYLVSRNGE

SEQ ID NO: 2527745 - protein, 17 aa, Entamoeba dispar
INGTITSKYNFLVQTRN

SEQ ID NO: 2527746 - protein, 28 aa, Entamoeba dispar
INGVEVFMLLIALKVKYPRRVTLLRGNH

SEQ ID NO: 2527747 - protein, 29 aa, Entamoeba dispar
INGVLLLPPLILLFHELNPHRFFMSYIIN

SEQ ID NO: 2527748 - protein, 19 aa, Entamoeba dispar
INHFWKVKRDVYKFIHDQT

SEQ ID NO: 2527749 - protein, 42 aa, Entamoeba dispar
INHIYTKEQKTKLRDLFRKHGANWKMVKYALETGIKEDYCRR

SEQ ID NO: 2527750 - protein, 20 aa, Entamoeba dispar
INHLILIKNWTEALESELVA

SEQ ID NO: 2527751 - protein, 28 aa, Entamoeba dispar
INHLVEMGFLRDDAIKALRKSQNNTAIA

SEQ ID NO: 2527752 - protein, 21 aa, Entamoeba dispar
INHRKLLDAIFVLAGVPREKF

SEQ ID NO: 2527753 - protein, 17 aa, Entamoeba dispar
INHVKPYFLISGKVLNS

SEQ ID NO: 2527754 - protein, 19 aa, Entamoeba dispar
INHYKALFVQNVFIQGKES

SEQ ID NO: 2527755 - protein, 30 aa, Entamoeba dispar
INIDISIYYNFIYSLYLLFDSDVKNTLFLV

SEQ ID NO: 2527756 - protein, 34 aa, Entamoeba dispar
INIDLTLLPFPSIIEDWFYLQPTPFTDNVTSGRI

SEQ ID NO: 2527757 - protein, 18 aa, Entamoeba dispar
INIFAAASYRNGKISEFE

SEQ ID NO: 2527758 - protein, 17 aa, Entamoeba dispar
INIIIPNVSVEPNIITI

SEQ ID NO: 2527759 - protein, 28 aa, Entamoeba dispar
INIITAFPYSNWQIPYTAFINNTTQQLP

SEQ ID NO: 2527760 - protein, 19 aa, Entamoeba dispar
INIKFFLTSQLVIEGDRYL

SEQ ID NO: 2527761 - protein, 30 aa, Entamoeba dispar
INIKYSSIILESIPTIIIFNEGQYTSFLNR

SEQ ID NO: 2527762 - protein, 24 aa, Entamoeba dispar
INILDENWIFSRKADMEKPLFSNA

SEQ ID NO: 2527763 - protein, 26 aa, Entamoeba dispar
ININKGLINLPLYLLTDNIYAIGNTM

SEQ ID NO: 2527764 - protein, 25 aa, Entamoeba dispar
ININKLTFIISKLSSISFLLTQKII

SEQ ID NO: 2527765 - protein, 18 aa, Entamoeba dispar
INIPSSIKEIGWSCFYEC

SEQ ID NO: 2527766 - protein, 19 aa, Entamoeba dispar
INIPTSISRLGWYCFKGCY

SEQ ID NO: 2527767 - protein, 18 aa, Entamoeba dispar
INIQIFSNSLVLLVNEKL

SEQ ID NO: 2527768 - protein, 24 aa, Entamoeba dispar
INISLEMMILCATKLKLGVDRYLK

SEQ ID NO: 2527769 - protein, 26 aa, Entamoeba dispar
INISPNNFLILNITPEFILTLNQLFE

SEQ ID NO: 2527770 - protein, 21 aa, Entamoeba dispar
INISYIRTSIIALFTNIQNSF

SEQ ID NO: 2527771 - protein, 20 aa, Entamoeba dispar
INIYFHSMTFITPSVLVGSE

SEQ ID NO: 2527772 - protein, 24 aa, Entamoeba dispar
INKEGYIKYFSYLIHHPVGSYTDI

SEQ ID NO: 2527773 - protein, 22 aa, Entamoeba dispar
INKENWIYQKPSLYSSPEMVIV

SEQ ID NO: 2527774 - protein, 19 aa, Entamoeba dispar
INKFIIPSSITKLGEYCFY

SEQ ID NO: 2527775 - protein, 22 aa, Entamoeba dispar
INKFLGKEFVFKVKGKMNPMKR

SEQ ID NO: 2527776 - protein, 24 aa, Entamoeba dispar
INKFYNQYNIDVKYGKSGLISKNA

SEQ ID NO: 2527777 - protein, 22 aa, Entamoeba dispar
INKKIIWDKVNYLTYLQEKEAG

SEQ ID NO: 2527778 - protein, 21 aa, Entamoeba dispar
INKKKAWEIFVKGLKNKDSTI

SEQ ID NO: 2527779 - protein, 18 aa, Entamoeba dispar
INKKMIKTYLIKDELKPS

SEQ ID NO: 2527780 - protein, 30 aa, Entamoeba dispar
INKKYTYEELLQRPIYLDKTKLETYLSDEE

SEQ ID NO: 2527781 - protein, 33 aa, Entamoeba dispar
INKNKDYKILTPVRIPILVDLKPGEYVTNCLYC

SEQ ID NO: 2527782 - protein, 28 aa, Entamoeba dispar
INKNKEYLTPFLKYPPFEESRKKITQEC

SEQ ID NO: 2527783 - protein, 34 aa, Entamoeba dispar
INKNNYSIYLATCGKLVFFAIKPSTPNKCPLKVE

SEQ ID NO: 2527784 - protein, 25 aa, Entamoeba dispar
INKQEFILKIYPYKQTEITLLVQND

SEQ ID NO: 2527785 - protein, 27 aa, Entamoeba dispar
INLEGKVKCFGIFPKGFEKAAGPSFAP

SEQ ID NO: 2527786 - protein, 28 aa, Entamoeba dispar
INLELPVFHIGFFRPIIQVLQCVCKNCN

SEQ ID NO: 2527787 - protein, 19 aa, Entamoeba dispar
INLFEFYSEFTRQLKYFNK

SEQ ID NO: 2527788 - protein, 24 aa, Entamoeba dispar
INLIIDPSIRKILLEIVRIINQLV

SEQ ID NO: 2527789 - protein, 31 aa, Entamoeba dispar
INLKKRSYRKLLTIPFLQIQRLCFSDDNVID

SEQ ID NO: 2527790 - protein, 17 aa, Entamoeba dispar
INLKYLKIISFMYEMDC

SEQ ID NO: 2527791 - protein, 18 aa, Entamoeba dispar
INLLPRGWHGLLSLTHMI

SEQ ID NO: 2527792 - protein, 21 aa, Entamoeba dispar
INLSHFYTIFQSEIAVLAICY

SEQ ID NO: 2527793 - protein, 33 aa, Entamoeba dispar
INLSIQPTLLNYITSLVFLINNFVFHHQTYTDE

SEQ ID NO: 2527794 - protein, 24 aa, Entamoeba dispar
INLVQCRLFLTKLIAVFNRGDTFT

SEQ ID NO: 2527795 - protein, 20 aa, Entamoeba dispar
INLWSVLITGFKPTITLKDS

SEQ ID NO: 2527796 - protein, 18 aa, Entamoeba dispar
INLYKWRKVYELIQQVLN

SEQ ID NO: 2527797 - protein, 20 aa, Entamoeba dispar
INMVKYLLPLGADPFIKCVT

SEQ ID NO: 2527798 - protein, 26 aa, Entamoeba dispar
INNAFEQFIFLYLRHPYDIEEIDKIF

SEQ ID NO: 2527799 - protein, 25 aa, Entamoeba dispar
INNCPNIINIPLPFTSELTVDYDGS

SEQ ID NO: 2527800 - protein, 26 aa, Entamoeba dispar
INNDPHYFIFSLINKSQYGAFSMSLV

SEQ ID NO: 2527801 - protein, 26 aa, Entamoeba dispar
INNEPYIIIIDLFNIIHILKYINNQI

SEQ ID NO: 2527802 - protein, 22 aa, Entamoeba dispar
INNFGKFSKIIGLEAFVEFKTS

SEQ ID NO: 2527803 - protein, 17 aa, Entamoeba dispar
INNFIAMLTFCDGKTPQ

SEQ ID NO: 2527804 - protein, 30 aa, Entamoeba dispar
INNHEELIFFLLFVDFTIYCSKQPIGQHGI

SEQ ID NO: 2527805 - protein, 23 aa, Entamoeba dispar
INNHPLLLAYLQSIPVDIFCQTT

SEQ ID NO: 2527806 - protein, 23 aa, Entamoeba dispar
INNIDFYCLMPSTYISYLTSNTD

SEQ ID NO: 2527807 - protein, 17 aa, Entamoeba dispar
INNIIINNPLKFIFSSQ

SEQ ID NO: 2527808 - protein, 19 aa, Entamoeba dispar
INNIKSSHFYMVRELHDQL

SEQ ID NO: 2527809 - protein, 28 aa, Entamoeba dispar
INNIKYIHVLLLIELAKVIKFYIADDKH

SEQ ID NO: 2527810 - protein, 31 aa, Entamoeba dispar
INNIPNTWYINNQLIYVPIPDSIQDFKHDSI

SEQ ID NO: 2527811 - protein, 24 aa, Entamoeba dispar
INNKFHVHFIDFTGKGPYVFASEL

SEQ ID NO: 2527812 - protein, 21 aa, Entamoeba dispar
INNLKLEFIRFFKVKHVNINE

SEQ ID NO: 2527813 - protein, 33 aa, Entamoeba dispar
INNMNRLLINKLFKYLWPPMIALKEGQCIQEIN

SEQ ID NO: 2527814 - protein, 22 aa, Entamoeba dispar
INNPRGILLNCNLAICCKMTHH

SEQ ID NO: 2527815 - protein, 22 aa, Entamoeba dispar
INNQRIILRLFDLKRNKECNEI

SEQ ID NO: 2527816 - protein, 24 aa, Entamoeba dispar
INNRFNVLWVSGKMKGIDPVNPAQ

SEQ ID NO: 2527817 - protein, 24 aa, Entamoeba dispar
INNYDWLMKQLGLSNPFEELPDRD

SEQ ID NO: 2527818 - protein, 24 aa, Entamoeba dispar
INPLFNHIQTVVLIPTLPLVLQVS

SEQ ID NO: 2527819 - protein, 17 aa, Entamoeba dispar
INPLFSIKPLIGPKDFI

SEQ ID NO: 2527820 - protein, 19 aa, Entamoeba dispar
INQCYINFYVKLITEKTSS

SEQ ID NO: 2527821 - protein, 25 aa, Entamoeba dispar
INQHYLYQLLVFYSTLTLTKAHIHG

SEQ ID NO: 2527822 - protein, 17 aa, Entamoeba dispar
INQLIRFIPMRLTERER

SEQ ID NO: 2527823 - protein, 24 aa, Entamoeba dispar
INQLSEHFSNFFKRYIIQELIGRG

SEQ ID NO: 2527824 - protein, 34 aa, Entamoeba dispar
INQNKTFILRDDIQLIFFGFDKKGSNINKTFQEM

SEQ ID NO: 2527825 - protein, 24 aa, Entamoeba dispar
INREDPFNIIRELGKKYFALKCSH

SEQ ID NO: 2527826 - protein, 25 aa, Entamoeba dispar
INRENSIEFLLKYIKNKLISQENKD

SEQ ID NO: 2527827 - protein, 22 aa, Entamoeba dispar
INRINYDFTPFKTLTSLTLTAQ

SEQ ID NO: 2527828 - protein, 19 aa, Entamoeba dispar
INRIRLEDDLKRLNIENHR

SEQ ID NO: 2527829 - protein, 22 aa, Entamoeba dispar
INRKREEMIKKLKSSIQMKVQQ

SEQ ID NO: 2527830 - protein, 23 aa, Entamoeba dispar
INRLRLVLLIEEYMITSSFVSHF

SEQ ID NO: 2527831 - protein, 24 aa, Entamoeba dispar
INRRNALTSIPKNAFMKFVKDLVL

SEQ ID NO: 2527832 - protein, 25 aa, Entamoeba dispar
INRVRRSFLKLIQQNLITLDNNGGD

SEQ ID NO: 2527833 - protein, 23 aa, Entamoeba dispar
INRWSNLIIHNLIFYGITVKEWK

SEQ ID NO: 2527834 - protein, 28 aa, Entamoeba dispar
INSARPNIHFFLYKPRLIGSKCVGFYQL

SEQ ID NO: 2527835 - protein, 28 aa, Entamoeba dispar
INSDVKKYAILLPINGKLVPFHVAYIKN

SEQ ID NO: 2527836 - protein, 26 aa, Entamoeba dispar
INSEDQLLIRLKKRFYFRDRNVNDTD

SEQ ID NO: 2527837 - protein, 17 aa, Entamoeba dispar
INSFCQNTKFLAAPALK

SEQ ID NO: 2527838 - protein, 40 aa, Entamoeba dispar
INSIAPTLLTKMLIPLLKKSTIIPYIIFVHAREGVFQCHK

SEQ ID NO: 2527839 - protein, 25 aa, Entamoeba dispar
INSIFKGELPEIPKIFFTATTFKEL

SEQ ID NO: 2527840 - protein, 25 aa, Entamoeba dispar
INSIKNEIQSLLFLCGCPSVNEAHS

SEQ ID NO: 2527841 - protein, 18 aa, Entamoeba dispar
INSISFFIFACDCRLRYT

SEQ ID NO: 2527842 - protein, 29 aa, Entamoeba dispar
INSSLIYSQLVPILARPLQLFPSVVTSKL

SEQ ID NO: 2527843 - protein, 26 aa, Entamoeba dispar
INSSYCQIIFVLNQVDKFLDKELSHK

SEQ ID NO: 2527844 - protein, 18 aa, Entamoeba dispar
INSVFKKGFAQSGIIILP

SEQ ID NO: 2527845 - protein, 17 aa, Entamoeba dispar
INSYSHYYYILVNGIII

SEQ ID NO: 2527846 - protein, 19 aa, Entamoeba dispar
INTFIIFKDYLYKYYCFRN

SEQ ID NO: 2527847 - protein, 24 aa, Entamoeba dispar
INTKTKYDFILPISLKSLTFSSDI

SEQ ID NO: 2527848 - protein, 25 aa, Entamoeba dispar
INTPVIGQFTYNPIAPHLQFQQQRQ

SEQ ID NO: 2527849 - protein, 22 aa, Entamoeba dispar
INTQITHLLFNNNVRHVTVFFE

SEQ ID NO: 2527850 - protein, 24 aa, Entamoeba dispar
INTRIFNIITYHQVPIIDEPIPDS

SEQ ID NO: 2527851 - protein, 23 aa, Entamoeba dispar
INTTHPPFIPSGRVIQMIPGKSV

SEQ ID NO: 2527852 - protein, 29 aa, Entamoeba dispar
INTTIGNIFLTFIPFLKVYNEYCSNFRHT

SEQ ID NO: 2527853 - protein, 24 aa, Entamoeba dispar
INTVEDKWRLIPAFVKARGLVRQH

SEQ ID NO: 2527854 - protein, 18 aa, Entamoeba dispar
INTVLKEFKFPISDCGKL

SEQ ID NO: 2527855 - protein, 23 aa, Entamoeba dispar
INTWPIQITTYPKDAITICIKAV

SEQ ID NO: 2527856 - protein, 18 aa, Entamoeba dispar
INTYPRDWMLCERHFIEK

SEQ ID NO: 2527857 - protein, 21 aa, Entamoeba dispar
INVCLLISVFPFYENSHERKN

SEQ ID NO: 2527858 - protein, 20 aa, Entamoeba dispar
INVEKILRRGGPEYKAIITE

SEQ ID NO: 2527859 - protein, 20 aa, Entamoeba dispar
INVLFSFIRTHTNSKMIVFF

SEQ ID NO: 2527860 - protein, 18 aa, Entamoeba dispar
INVQLFYKMLTQHQLDQI

SEQ ID NO: 2527861 - protein, 27 aa, Entamoeba dispar
INVRIIDYTTRIPIRDLRHCHINTLIR

SEQ ID NO: 2527862 - protein, 28 aa, Entamoeba dispar
INVSLPLPITLLKFFKQPTPMISSSLPE

SEQ ID NO: 2527863 - protein, 25 aa, Entamoeba dispar
INVSTVDLLLQKKKYRLAYDCLSFI

SEQ ID NO: 2527864 - protein, 25 aa, Entamoeba dispar
INVTSVLHLWLMVSIPKLDTNKSFK

SEQ ID NO: 2527865 - protein, 17 aa, Entamoeba dispar
INYDKNLLRLIKALTSA

SEQ ID NO: 2527866 - protein, 18 aa, Entamoeba dispar
INYDKNLLRLIKALTSAI

SEQ ID NO: 2527867 - protein, 18 aa, Entamoeba dispar
INYFLTFGEIDSLKLTEV

SEQ ID NO: 2527868 - protein, 21 aa, Entamoeba dispar
INYHDIIISLFSTCFCSLQFP

SEQ ID NO: 2527869 - protein, 18 aa, Entamoeba dispar
INYIETGLLCEETRFSRG

SEQ ID NO: 2527870 - protein, 19 aa, Entamoeba dispar
INYKKRRLMRKDEIQFLID

SEQ ID NO: 2527871 - protein, 18 aa, Entamoeba dispar
INYPIQLVDDRTQGNLAR

SEQ ID NO: 2527872 - protein, 18 aa, Entamoeba dispar
INYPIQLVDDRTQGNLER

SEQ ID NO: 2527873 - protein, 22 aa, Entamoeba dispar
INYSIISPLYYKIRACIGLVQH

SEQ ID NO: 2527874 - protein, 27 aa, Entamoeba dispar
INYVQIPDYYYNLNLIGGILPNDYYKG

SEQ ID NO: 2527875 - protein, 17 aa, Entamoeba dispar
IPAFRSTEIPAIGLEIV

SEQ ID NO: 2527876 - protein, 20 aa, Entamoeba dispar
IPALIQYYKQPQEKHLLIIL

SEQ ID NO: 2527877 - protein, 27 aa, Entamoeba dispar
IPALKVCKVLFKYIRILYNDIKDLPEK

SEQ ID NO: 2527878 - protein, 27 aa, Entamoeba dispar
IPCKQILNQLKLLPEANPFLTPVDPIA

SEQ ID NO: 2527879 - protein, 31 aa, Entamoeba dispar
IPDEMLCHRLGLIPILADPRKFKFPKDRHFT

SEQ ID NO: 2527880 - protein, 30 aa, Entamoeba dispar
IPDEYNHLFVYLISFLKKMICLGENEVLLI

SEQ ID NO: 2527881 - protein, 24 aa, Entamoeba dispar
IPDPNSLLKIPRAIYPIIEKEAKL

SEQ ID NO: 2527882 - protein, 43 aa, Entamoeba dispar
IPDPVEFSKQILPKFFKHSNICSFVRQLNIYGFRKLETQTGFC

SEQ ID NO: 2527883 - protein, 25 aa, Entamoeba dispar
IPDQARGIFIDWKGPKCKGIAKVRV

SEQ ID NO: 2527884 - protein, 23 aa, Entamoeba dispar
IPDTLRLEIWKLFLQPKKEIVEE

SEQ ID NO: 2527885 - protein, 26 aa, Entamoeba dispar
IPEETHIFNKLYYSNGSTISPINYPT

SEQ ID NO: 2527886 - protein, 25 aa, Entamoeba dispar
IPEIDEPWYLKFNNSAIYDDDIKDG

SEQ ID NO: 2527887 - protein, 25 aa, Entamoeba dispar
IPEIDEPWYLKFNNSAIYDDNTEDG

SEQ ID NO: 2527888 - protein, 27 aa, Entamoeba dispar
IPELISGIFLYLNKPLLDTVIVNQERL

SEQ ID NO: 2527889 - protein, 19 aa, Entamoeba dispar
IPERYDADLILKHFKRTFN

SEQ ID NO: 2527890 - protein, 30 aa, Entamoeba dispar
IPEVRQFFEIPFVVQLYYAAIPMQLPVVEN

SEQ ID NO: 2527891 - protein, 19 aa, Entamoeba dispar
IPFDCIIGPIVKTLDLELE

SEQ ID NO: 2527892 - protein, 18 aa, Entamoeba dispar
IPFDFKSNKIEDEFLMFL

SEQ ID NO: 2527893 - protein, 19 aa, Entamoeba dispar
IPFGSHIFVLDGRKGSYCV

SEQ ID NO: 2527894 - protein, 25 aa, Entamoeba dispar
IPFNRGIWSNFDPTTFIFSLRNPMK

SEQ ID NO: 2527895 - protein, 21 aa, Entamoeba dispar
IPFNSKFVFPINLALESISVR

SEQ ID NO: 2527896 - protein, 17 aa, Entamoeba dispar
IPFQLYFNPMNIKKINI

SEQ ID NO: 2527897 - protein, 24 aa, Entamoeba dispar
IPFQPQAILPQLLNFLPIISDHEE

SEQ ID NO: 2527898 - protein, 20 aa, Entamoeba dispar
IPFSIVEIIINIFKKLLLSN

SEQ ID NO: 2527899 - protein, 18 aa, Entamoeba dispar
IPGMKEYIILYPVSFHKY

SEQ ID NO: 2527900 - protein, 22 aa, Entamoeba dispar
IPHNLIIDILVKGTEYLRLTDN

SEQ ID NO: 2527901 - protein, 18 aa, Entamoeba dispar
IPHPIFGISLKDANKSNY

SEQ ID NO: 2527902 - protein, 19 aa, Entamoeba dispar
IPIDRIVGVFLIDEDWQFE

SEQ ID NO: 2527903 - protein, 21 aa, Entamoeba dispar
IPIDVFLEDTNNYRPKGNAYL

SEQ ID NO: 2527904 - protein, 23 aa, Entamoeba dispar
IPIERACYYLKRVNPEGPLLSMM

SEQ ID NO: 2527905 - protein, 21 aa, Entamoeba dispar
IPIERACYYLKRVNPEGPMLS

SEQ ID NO: 2527906 - protein, 23 aa, Entamoeba dispar
IPIGKWPALLNQVLQWTQSQNEI

SEQ ID NO: 2527907 - protein, 19 aa, Entamoeba dispar
IPIHLTITLHFIGINQTES

SEQ ID NO: 2527908 - protein, 18 aa, Entamoeba dispar
IPIHVFGTNKGSTNYKRF

SEQ ID NO: 2527909 - protein, 17 aa, Entamoeba dispar
IPIIIQLIRNRMSNIGK

SEQ ID NO: 2527910 - protein, 17 aa, Entamoeba dispar
IPIIYPNDTVMDLSIAT

SEQ ID NO: 2527911 - protein, 17 aa, Entamoeba dispar
IPILSRKLFPNIETHYL

SEQ ID NO: 2527912 - protein, 29 aa, Entamoeba dispar
IPILVIDEPFRWEGCSWGWGWDTVDSWKV

SEQ ID NO: 2527913 - protein, 19 aa, Entamoeba dispar
IPINIDYFHKSAVKALCFE

SEQ ID NO: 2527914 - protein, 17 aa, Entamoeba dispar
IPISLNLDHGANFQICK

SEQ ID NO: 2527915 - protein, 20 aa, Entamoeba dispar
IPIYNMIYDWILQGTFNDPF

SEQ ID NO: 2527916 - protein, 22 aa, Entamoeba dispar
IPKDYHLIYLMITKKVNPFIHY

SEQ ID NO: 2527917 - protein, 26 aa, Entamoeba dispar
IPKEYHRFLMFIHSQLKAMIYELNKE

SEQ ID NO: 2527918 - protein, 17 aa, Entamoeba dispar
IPKEYIDLSDFKKWVLF

SEQ ID NO: 2527919 - protein, 21 aa, Entamoeba dispar
IPKFSLPIKTLKWSVNWSVNS

SEQ ID NO: 2527920 - protein, 17 aa, Entamoeba dispar
IPKGIFFSMPVVCYGGE

SEQ ID NO: 2527921 - protein, 22 aa, Entamoeba dispar
IPKVLIIQLVRIYSKKYPTQQV

SEQ ID NO: 2527922 - protein, 34 aa, Entamoeba dispar
IPKYKTSYFTVWRYYGIFLIPMRCYISQGAKDIQ

SEQ ID NO: 2527923 - protein, 24 aa, Entamoeba dispar
IPLLPTSFDFIQLYKQIISTTTND

SEQ ID NO: 2527924 - protein, 17 aa, Entamoeba dispar
IPLNEYSRKLFPNIETF

SEQ ID NO: 2527925 - protein, 25 aa, Entamoeba dispar
IPMDLRVPYPFPKLQEFYNSIDIPN

SEQ ID NO: 2527926 - protein, 18 aa, Entamoeba dispar
IPMGLEKALKYLYSNGLD

SEQ ID NO: 2527927 - protein, 30 aa, Entamoeba dispar
IPNEIIKEKLILKVLIKGEESEKWVECGID

SEQ ID NO: 2527928 - protein, 21 aa, Entamoeba dispar
IPNEYLLKESPIEENPVYLKM

SEQ ID NO: 2527929 - protein, 22 aa, Entamoeba dispar
IPNIDLLIIKLFKAKTSKELAQ

SEQ ID NO: 2527930 - protein, 18 aa, Entamoeba dispar
IPNIECCCDISGLLNYLH

SEQ ID NO: 2527931 - protein, 17 aa, Entamoeba dispar
IPNKIRIKFMIDGAKGI

SEQ ID NO: 2527932 - protein, 20 aa, Entamoeba dispar
IPNKIRIKFMLDGAKGISYL

SEQ ID NO: 2527933 - protein, 17 aa, Entamoeba dispar
IPNPISGDFFVTMKEEN

SEQ ID NO: 2527934 - protein, 27 aa, Entamoeba dispar
IPNTWYINNQLIYVPIPDSIQDFKHDS

SEQ ID NO: 2527935 - protein, 24 aa, Entamoeba dispar
IPNYQIDKFIFFGSLTTGILNNIE

SEQ ID NO: 2527936 - protein, 35 aa, Entamoeba dispar
IPPANSPFILHLNHMPVIFDILEMLEYPISEKVRR

SEQ ID NO: 2527937 - protein, 21 aa, Entamoeba dispar
IPPHMFIDINALTAAFYFSAI

SEQ ID NO: 2527938 - protein, 17 aa, Entamoeba dispar
IPPIMNIACSLNPTIHC

SEQ ID NO: 2527939 - protein, 25 aa, Entamoeba dispar
IPPMIVELALTIKSLYREEWKGDWQ

SEQ ID NO: 2527940 - protein, 37 aa, Entamoeba dispar
IPPMNSNIYTFIRSLVLQPIVLYFSCNLQPSHLVLIP

SEQ ID NO: 2527941 - protein, 27 aa, Entamoeba dispar
IPPSKPSNLLLLINKLLFAPTIGKCVA

SEQ ID NO: 2527942 - protein, 36 aa, Entamoeba dispar
IPQLRNDIKYILDAPSLLQVYLSQWNFDECIKIHDN

SEQ ID NO: 2527943 - protein, 25 aa, Entamoeba dispar
IPQNKKPIPFPSQPTNPLLVIKSWP

SEQ ID NO: 2527944 - protein, 31 aa, Entamoeba dispar
IPQTTDIVFSLRNLFNRPPIIIKQNIQNKLV

SEQ ID NO: 2527945 - protein, 18 aa, Entamoeba dispar
IPSCLSLLTNLYQLSLFA

SEQ ID NO: 2527946 - protein, 17 aa, Entamoeba dispar
IPSFKQVIQSHPISVVV

SEQ ID NO: 2527947 - protein, 20 aa, Entamoeba dispar
IPSFMLLEINDSELTIYEYT

SEQ ID NO: 2527948 - protein, 20 aa, Entamoeba dispar
IPSHPFSLFCREGTIIPSLT

SEQ ID NO: 2527949 - protein, 24 aa, Entamoeba dispar
IPSIFGLMILFDTNGFPLCLLDGS

SEQ ID NO: 2527950 - protein, 30 aa, Entamoeba dispar
IPSIGIYAYELFNFYGVKRIIRIGSAGAIN

SEQ ID NO: 2527951 - protein, 23 aa, Entamoeba dispar
IPSIYIYTKIILSFSKTLKSLFV

SEQ ID NO: 2527952 - protein, 18 aa, Entamoeba dispar
IPSLVSLLEEAKQEIPDW

SEQ ID NO: 2527953 - protein, 33 aa, Entamoeba dispar
IPSNHLLYRIKYYVPYYCYLENKKKWIHCDNVM

SEQ ID NO: 2527954 - protein, 27 aa, Entamoeba dispar
IPSNIDCGFRPKFGKLQLVNGKIIEEL

SEQ ID NO: 2527955 - protein, 23 aa, Entamoeba dispar
IPSRLPPTTIQPPLQPSLQPSIP

SEQ ID NO: 2527956 - protein, 26 aa, Entamoeba dispar
IPSSVIKLGYRCFFYMFKIGNECFYD

SEQ ID NO: 2527957 - protein, 19 aa, Entamoeba dispar
IPSSVKSLGYHCFYGCSSL

SEQ ID NO: 2527958 - protein, 18 aa, Entamoeba dispar
IPSSVSKIGYYCFYKCYS

SEQ ID NO: 2527959 - protein, 29 aa, Entamoeba dispar
IPTDAYFARIPEWIPYHVFITSHKDGSIK

SEQ ID NO: 2527960 - protein, 24 aa, Entamoeba dispar
IPTDEYITFPWTEYFKTFDKLLSD

SEQ ID NO: 2527961 - protein, 17 aa, Entamoeba dispar
IPTFEEVFLSLEPDILS

SEQ ID NO: 2527962 - protein, 18 aa, Entamoeba dispar
IPTKPMAVPRRFAQLPAK

SEQ ID NO: 2527963 - protein, 25 aa, Entamoeba dispar
IPTSVSKLEYWCFYGCSSLKSINIP

SEQ ID NO: 2527964 - protein, 27 aa, Entamoeba dispar
IPTTGDLHWFKVPPKVFFEPFSIRYLA

SEQ ID NO: 2527965 - protein, 27 aa, Entamoeba dispar
IPTTIGKLGYKFFKGCISLTNVNIPAS

SEQ ID NO: 2527966 - protein, 26 aa, Entamoeba dispar
IPTVTDGVIIIYLHPGITSTFIEAVL

SEQ ID NO: 2527967 - protein, 22 aa, Entamoeba dispar
IPVERIKGCNFIRCDLKKGGCG

SEQ ID NO: 2527968 - protein, 26 aa, Entamoeba dispar
IPVFEQIILFTFKSHLLKSVRILTTP

SEQ ID NO: 2527969 - protein, 18 aa, Entamoeba dispar
IPVIAINVYYKNFVQPKK

SEQ ID NO: 2527970 - protein, 17 aa, Entamoeba dispar
IPVKIRVEYLKGIEQKV

SEQ ID NO: 2527971 - protein, 33 aa, Entamoeba dispar
IPVLTRPVSFTLVRQYRSFITNSKIIHIVWRKR

SEQ ID NO: 2527972 - protein, 23 aa, Entamoeba dispar
IPVQIQPIYTIKNGKIIIADISL

SEQ ID NO: 2527973 - protein, 27 aa, Entamoeba dispar
IPYGQLRAFPWNSLALMTTTGAKGSKV

SEQ ID NO: 2527974 - protein, 25 aa, Entamoeba dispar
IPYLAEAMNIPLINYQFESNSSICI

SEQ ID NO: 2527975 - protein, 24 aa, Entamoeba dispar
IPYRYTNYIQPISSALLFTKMIVE

SEQ ID NO: 2527976 - protein, 26 aa, Entamoeba dispar
IPYSQLIINTPIYSFQELGIRTNNRE

SEQ ID NO: 2527977 - protein, 19 aa, Entamoeba dispar
IPYVISHYPILKHFIENIN

SEQ ID NO: 2527978 - protein, 20 aa, Entamoeba dispar
IQAIQLCLKKDFDGALIEIK

SEQ ID NO: 2527979 - protein, 22 aa, Entamoeba dispar
IQCPNSITAYRISQTIYAEYTT

SEQ ID NO: 2527980 - protein, 26 aa, Entamoeba dispar
IQCPQSNWWLVYKQKSFGYVPAAYLN

SEQ ID NO: 2527981 - protein, 24 aa, Entamoeba dispar
IQCRSLTSIVIPTSISKLRKWCFS

SEQ ID NO: 2527982 - protein, 19 aa, Entamoeba dispar
IQDIYIFDCGHKFCIDCCY

SEQ ID NO: 2527983 - protein, 20 aa, Entamoeba dispar
IQDRTFWIARLKDLIHSALL

SEQ ID NO: 2527984 - protein, 23 aa, Entamoeba dispar
IQDTPLIINVLSQFGVIVNVIES

SEQ ID NO: 2527985 - protein, 17 aa, Entamoeba dispar
IQDYIIPDNPFSPTFDD

SEQ ID NO: 2527986 - protein, 19 aa, Entamoeba dispar
IQECIEFEKGYYLNSNKEC

SEQ ID NO: 2527987 - protein, 29 aa, Entamoeba dispar
IQEGAIDILIKIYLKFLPENGYITENGTI

SEQ ID NO: 2527988 - protein, 17 aa, Entamoeba dispar
IQEGKIIKLPIGFVSAC

SEQ ID NO: 2527989 - protein, 17 aa, Entamoeba dispar
IQEIIRTIKVGGKALIT

SEQ ID NO: 2527990 - protein, 24 aa, Entamoeba dispar
IQEMFEFRIQNFLDIYLHESSQST

SEQ ID NO: 2527991 - protein, 29 aa, Entamoeba dispar
IQENPQTLIPRFYGMFRIKPQKDEEYRYV

SEQ ID NO: 2527992 - protein, 29 aa, Entamoeba dispar
IQEVKYILSRYPLIRTIDHIKHLLYQFKE

SEQ ID NO: 2527993 - protein, 21 aa, Entamoeba dispar
IQFISEDRIFINEPVLVSIEI

SEQ ID NO: 2527994 - protein, 22 aa, Entamoeba dispar
IQFISEERIFINEPVLLSIEIP

SEQ ID NO: 2527995 - protein, 31 aa, Entamoeba dispar
IQFISEERIFMNKPVLISFKIPKNLQKINGE

SEQ ID NO: 2527996 - protein, 19 aa, Entamoeba dispar
IQFLQIMTLDPFYTSNSPS

SEQ ID NO: 2527997 - protein, 18 aa, Entamoeba dispar
IQFNVYKGFGKYVNSPEM

SEQ ID NO: 2527998 - protein, 17 aa, Entamoeba dispar
IQFYLVGNKIDLSSQES

SEQ ID NO: 2527999 - protein, 24 aa, Entamoeba dispar
IQGDMGDYLPFRPGSFDGCISISA

SEQ ID NO: 2528000 - protein, 18 aa, Entamoeba dispar
IQGMNKFDIKQPQYAFYV

SEQ ID NO: 2528001 - protein, 38 aa, Entamoeba dispar
IQHCILNIFSLTRFNLITGLLSIELFLEALDSICYLPT

SEQ ID NO: 2528002 - protein, 25 aa, Entamoeba dispar
IQIEDDILFIVPDHKLKPSELHRIE

SEQ ID NO: 2528003 - protein, 19 aa, Entamoeba dispar
IQIKMKLRSLLLKKNNQPD

SEQ ID NO: 2528004 - protein, 20 aa, Entamoeba dispar
IQILGKYFIEVFKACGIQEG

SEQ ID NO: 2528005 - protein, 20 aa, Entamoeba dispar
IQILQSFISLYSLSGDIIAE

SEQ ID NO: 2528006 - protein, 18 aa, Entamoeba dispar
IQINNEQHFIFFEKVTEN

SEQ ID NO: 2528007 - protein, 18 aa, Entamoeba dispar
IQIPQWALISYTSIPHPI

SEQ ID NO: 2528008 - protein, 19 aa, Entamoeba dispar
IQIWDYRTKILLHTYPHAH

SEQ ID NO: 2528009 - protein, 24 aa, Entamoeba dispar
IQKCIDIGYSKLRIPKLVKAENIV

SEQ ID NO: 2528010 - protein, 41 aa, Entamoeba dispar
IQKCIGGHSYILIFLKFNYGNILGIFFQKTLPRFGGKSRIN

SEQ ID NO: 2528011 - protein, 28 aa, Entamoeba dispar
IQKCLEIKPDFTKGIIRLATIYEELKQP

SEQ ID NO: 2528012 - protein, 18 aa, Entamoeba dispar
IQKDMKHWSFKKSEIFST

SEQ ID NO: 2528013 - protein, 35 aa, Entamoeba dispar
IQKEYPLFRDITIPIIFGLYLLKTGIRIELFKKIL

SEQ ID NO: 2528014 - protein, 26 aa, Entamoeba dispar
IQKGLFCLMHILLQYHDPQLCHCLDS

SEQ ID NO: 2528015 - protein, 25 aa, Entamoeba dispar
IQKIFYGIKPLAYSLPIILNGFLKK

SEQ ID NO: 2528016 - protein, 17 aa, Entamoeba dispar
IQKLLEEKSLLVDQLKQ

SEQ ID NO: 2528017 - protein, 23 aa, Entamoeba dispar
IQKNQFTTLKIKFKNHLTSFHKA

SEQ ID NO: 2528018 - protein, 20 aa, Entamoeba dispar
IQKPLFLKKEENKQPKPSIK

SEQ ID NO: 2528019 - protein, 48 aa, Entamoeba dispar
IQKQISYQNLMYQYPYFYFPYVYYPQPYNVNGIPPYFFNQFNSIEQPS

SEQ ID NO: 2528020 - protein, 34 aa, Entamoeba dispar
IQKRYSQFYFLDNYLHMKYPKIKLPSLPPKEILH

SEQ ID NO: 2528021 - protein, 34 aa, Entamoeba dispar
IQKWPKVSHIIALRLLHFSFANSFIRQYAVNCLV

SEQ ID NO: 2528022 - protein, 17 aa, Entamoeba dispar
IQKYFEKCGNINLMEFN

SEQ ID NO: 2528023 - protein, 23 aa, Entamoeba dispar
IQKYNEIFKFLWKIKCMSISIDK

SEQ ID NO: 2528024 - protein, 25 aa, Entamoeba dispar
IQLEKKGIELLFLMSDGITDGVTEK

SEQ ID NO: 2528025 - protein, 25 aa, Entamoeba dispar
IQLGDQEFLFFSLNGFYNFIKRRRF

SEQ ID NO: 2528026 - protein, 18 aa, Entamoeba dispar
IQLLHSLNTLKENRFAVG

SEQ ID NO: 2528027 - protein, 27 aa, Entamoeba dispar
IQLLRIMTGCILLYDTVVPTGAFSSKG

SEQ ID NO: 2528028 - protein, 18 aa, Entamoeba dispar
IQLPIFLLNKMNSVISYT

SEQ ID NO: 2528029 - protein, 19 aa, Entamoeba dispar
IQLPPKFVDFALTPFGCIT

SEQ ID NO: 2528030 - protein, 24 aa, Entamoeba dispar
IQLREMERGIWTAAEQLVHKAMEN

SEQ ID NO: 2528031 - protein, 22 aa, Entamoeba dispar
IQLRKVCNHPFLIPGVEEKEIA

SEQ ID NO: 2528032 - protein, 21 aa, Entamoeba dispar
IQLTFHSIFSHRFYEFNHSQI

SEQ ID NO: 2528033 - protein, 33 aa, Entamoeba dispar
IQLTLKQIQIPPLKWINPITGTGKITIKYTSLT

SEQ ID NO: 2528034 - protein, 25 aa, Entamoeba dispar
IQMVSLATKPLYTTPLILLNDVEAE

SEQ ID NO: 2528035 - protein, 23 aa, Entamoeba dispar
IQNEFNFLFTFIRELRNKFNEYP

SEQ ID NO: 2528036 - protein, 29 aa, Entamoeba dispar
IQNENDLIRLFYIYLLNSNESNLLQKVLE

SEQ ID NO: 2528037 - protein, 34 aa, Entamoeba dispar
IQNFKSDWEDGYAIKFIFADDHPFELFSQFGITQ

SEQ ID NO: 2528038 - protein, 25 aa, Entamoeba dispar
IQNITLSDILYFRGISGHLHNVKMK

SEQ ID NO: 2528039 - protein, 17 aa, Entamoeba dispar
IQNLINFGYGLNVAIRA

SEQ ID NO: 2528040 - protein, 26 aa, Entamoeba dispar
IQNNCKYVKMILGHISLLFSPEKIDV

SEQ ID NO: 2528041 - protein, 25 aa, Entamoeba dispar
IQNNQIIFLYTLLDGACPKSYGMKV

SEQ ID NO: 2528042 - protein, 25 aa, Entamoeba dispar
IQNTEFKLFYKNFTLKDTQYYLYEL

SEQ ID NO: 2528043 - protein, 19 aa, Entamoeba dispar
IQPFQWEGVVLPYIPSHLY

SEQ ID NO: 2528044 - protein, 27 aa, Entamoeba dispar
IQPPKRKVLQILPLTPVKSLKEKKRRD

SEQ ID NO: 2528045 - protein, 22 aa, Entamoeba dispar
IQQETLKLATPFGLRVCCCIGG

SEQ ID NO: 2528046 - protein, 19 aa, Entamoeba dispar
IQQFIIKYLSQTNIEQKEI

SEQ ID NO: 2528047 - protein, 22 aa, Entamoeba dispar
IQQGVIIGLLIINGYSIEINAP

SEQ ID NO: 2528048 - protein, 22 aa, Entamoeba dispar
IQQIYYIIPDLIFGINKEISKE

SEQ ID NO: 2528049 - protein, 17 aa, Entamoeba dispar
IQQLKDIHFLVALAYTL

SEQ ID NO: 2528050 - protein, 22 aa, Entamoeba dispar
IQQLKLLFPEEHYFIQNQFGIT

SEQ ID NO: 2528051 - protein, 27 aa, Entamoeba dispar
IQQNISKYFYGLDPKDLLDKMCSSLIG

SEQ ID NO: 2528052 - protein, 25 aa, Entamoeba dispar
IQQNNLPPFLLQKPSSPKPLQEPSK

SEQ ID NO: 2528053 - protein, 18 aa, Entamoeba dispar
IQQPSNSADLFWSNQQQS

SEQ ID NO: 2528054 - protein, 25 aa, Entamoeba dispar
IQQQPPQIHITENPIPVIEVKPIPS

SEQ ID NO: 2528055 - protein, 23 aa, Entamoeba dispar
IQQQRFLSYSLIPPFFKQEQIKE

SEQ ID NO: 2528056 - protein, 19 aa, Entamoeba dispar
IQQRCHEMLMLNQIGISYQ

SEQ ID NO: 2528057 - protein, 17 aa, Entamoeba dispar
IQQVDAIELMLGTKKQM

SEQ ID NO: 2528058 - protein, 28 aa, Entamoeba dispar
IQQVHHQIFFYYNSLNIILGKQGTGKTT

SEQ ID NO: 2528059 - protein, 27 aa, Entamoeba dispar
IQRAEFHSFDWPIVPPEFLKTLGNIFT

SEQ ID NO: 2528060 - protein, 26 aa, Entamoeba dispar
IQRIQYGYLFILQCLNNIDINERKKI

SEQ ID NO: 2528061 - protein, 30 aa, Entamoeba dispar
IQRNLISPYILTFVGLTEFPYAAVTELAPY

SEQ ID NO: 2528062 - protein, 26 aa, Entamoeba dispar
IQRQINEFLPKKLKFIKTETINPIAN

SEQ ID NO: 2528063 - protein, 23 aa, Entamoeba dispar
IQRQNYFMMYASKKLFIPQFIPT

SEQ ID NO: 2528064 - protein, 20 aa, Entamoeba dispar
IQRYILINAFQFDSGENDPN

SEQ ID NO: 2528065 - protein, 24 aa, Entamoeba dispar
IQSAPFLTYFIRNGGVIFSSYIKN

SEQ ID NO: 2528066 - protein, 26 aa, Entamoeba dispar
IQSIIKKYYAFKLILSKSSILQTKYN

SEQ ID NO: 2528067 - protein, 21 aa, Entamoeba dispar
IQSINPPLQSPFVICQQPFLQ

SEQ ID NO: 2528068 - protein, 28 aa, Entamoeba dispar
IQSKEYGLLVIFLLSDVLLVHRAKQEVK

SEQ ID NO: 2528069 - protein, 22 aa, Entamoeba dispar
IQSLMDFDISIILKGYCCHIKE

SEQ ID NO: 2528070 - protein, 23 aa, Entamoeba dispar
IQSQNPILLRKVNIKKNIKIEDI

SEQ ID NO: 2528071 - protein, 21 aa, Entamoeba dispar
IQSQSFIFVKGVPLNFERYSQ

SEQ ID NO: 2528072 - protein, 35 aa, Entamoeba dispar
IQSSYKKELLLFILTYVFYPNIIIPQQIIGKTSIE

SEQ ID NO: 2528073 - protein, 29 aa, Entamoeba dispar
IQSTLHSPYPIFYSHIVQSILCALKVTPP

SEQ ID NO: 2528074 - protein, 33 aa, Entamoeba dispar
IQTDCTIFKLSKPPFLLFPNKQPTSIQFNFEDK

SEQ ID NO: 2528075 - protein, 36 aa, Entamoeba dispar
IQTTKKYMFILDRFRINPIRITSFVKNLFQFLDTQI

SEQ ID NO: 2528076 - protein, 25 aa, Entamoeba dispar
IQVDNVILPPWAKGSYRKFVRTNMM

SEQ ID NO: 2528077 - protein, 21 aa, Entamoeba dispar
IQVEMCLVLMISKQKFIFSFI

SEQ ID NO: 2528078 - protein, 35 aa, Entamoeba dispar
IQVPENICCSKGFQFKFFMTYMDMLSLEDEYKIFK

SEQ ID NO: 2528079 - protein, 17 aa, Entamoeba dispar
IQYFIHPSYLQFPLMNE

SEQ ID NO: 2528080 - protein, 17 aa, Entamoeba dispar
IQYKWNLLINPYFGEGE

SEQ ID NO: 2528081 - protein, 17 aa, Entamoeba dispar
IQYMALDIAKPPPPEEF

SEQ ID NO: 2528082 - protein, 25 aa, Entamoeba dispar
IQYRQFIINYIYRTLQIDKIAIPQE

SEQ ID NO: 2528083 - protein, 21 aa, Entamoeba dispar
IQYRSPNSLVLLPVHDSTATI

SEQ ID NO: 2528084 - protein, 26 aa, Entamoeba dispar
IQYTIEQFVDYFRHCGIAKKKTPTQY

SEQ ID NO: 2528085 - protein, 17 aa, Entamoeba dispar
IRAMFDKGIKVGGSLLG

SEQ ID NO: 2528086 - protein, 21 aa, Entamoeba dispar
IRCLKIYKQWLTTSNSPILIQ

SEQ ID NO: 2528087 - protein, 17 aa, Entamoeba dispar
IRCSQECDIAVFTIGRI

SEQ ID NO: 2528088 - protein, 26 aa, Entamoeba dispar
IRDKNHFVFSLLNPYGTKPIKFTPII

SEQ ID NO: 2528089 - protein, 23 aa, Entamoeba dispar
IRDLEFMIGPMLYEASWQELAKQ

SEQ ID NO: 2528090 - protein, 24 aa, Entamoeba dispar
IRDLVKVIPLERILVETDGPFMAP

SEQ ID NO: 2528091 - protein, 17 aa, Entamoeba dispar
IRDYIPVLIISYEQVRS

SEQ ID NO: 2528092 - protein, 26 aa, Entamoeba dispar
IREDDVIFCYIGDSPIYIKSNKQVKK

SEQ ID NO: 2528093 - protein, 24 aa, Entamoeba dispar
IREDKSYFNSLIPLGVNIIEQSVF

SEQ ID NO: 2528094 - protein, 25 aa, Entamoeba dispar
IREGWKYIFTLLSRIEQVFLTEQVA

SEQ ID NO: 2528095 - protein, 26 aa, Entamoeba dispar
IREKDGIWAALCWVSILAAESERAQR

SEQ ID NO: 2528096 - protein, 27 aa, Entamoeba dispar
IREKNPDAFVPWIPNNMQLAVCDIPSK

SEQ ID NO: 2528097 - protein, 20 aa, Entamoeba dispar
IRELRKEHLCKYKSLKTINI

SEQ ID NO: 2528098 - protein, 24 aa, Entamoeba dispar
IRERDINEFIIPTSIRKIGDGCFS

SEQ ID NO: 2528099 - protein, 22 aa, Entamoeba dispar
IRFPKTYPVIYKTLRVDGELTV

SEQ ID NO: 2528100 - protein, 22 aa, Entamoeba dispar
IRFSAIIRFIGHLNLRGFLPSF

SEQ ID NO: 2528101 - protein, 18 aa, Entamoeba dispar
IRFVLGKPIYRAHLSLVA

SEQ ID NO: 2528102 - protein, 17 aa, Entamoeba dispar
IRGEICATLPVLCEGGI

SEQ ID NO: 2528103 - protein, 29 aa, Entamoeba dispar
IRGQMQRKVWINVNDVILVSLREYEDGKA

SEQ ID NO: 2528104 - protein, 26 aa, Entamoeba dispar
IRHNIVPAVFGLRWIRMLYAREFHID

SEQ ID NO: 2528105 - protein, 29 aa, Entamoeba dispar
IRHRNVAKLIYIQLLGYPTQYGQMECLAL

SEQ ID NO: 2528106 - protein, 33 aa, Entamoeba dispar
IRIAHGFHDLFIRTIKKLKITPISGGFVFMYDV

SEQ ID NO: 2528107 - protein, 18 aa, Entamoeba dispar
IRIETTSTYLYIPVSFES

SEQ ID NO: 2528108 - protein, 17 aa, Entamoeba dispar
IRIFPNLQTLYLRRCPE

SEQ ID NO: 2528109 - protein, 20 aa, Entamoeba dispar
IRILISTFQILLNPSNTKYQ

SEQ ID NO: 2528110 - protein, 22 aa, Entamoeba dispar
IRILKYITFDQKCPPFLIGPLK

SEQ ID NO: 2528111 - protein, 17 aa, Entamoeba dispar
IRILTYNMYLRPMLISA

SEQ ID NO: 2528112 - protein, 18 aa, Entamoeba dispar
IRILTYNMYLRPMLISAA

SEQ ID NO: 2528113 - protein, 20 aa, Entamoeba dispar
IRIMASLCLLELIQKFDIGV

SEQ ID NO: 2528114 - protein, 19 aa, Entamoeba dispar
IRIRLEKNLYDKLIAIKEV

SEQ ID NO: 2528115 - protein, 17 aa, Entamoeba dispar
IRIRLSEYLKRLEMEEC

SEQ ID NO: 2528116 - protein, 25 aa, Entamoeba dispar
IRISPFNFSKLKLFNPFIPDFLVDV

SEQ ID NO: 2528117 - protein, 19 aa, Entamoeba dispar
IRKDLNYPTDFYPLYAFLL

SEQ ID NO: 2528118 - protein, 31 aa, Entamoeba dispar
IRKQYPFEDLVYRPFLRLTYKEAIEMLRAAG

SEQ ID NO: 2528119 - protein, 25 aa, Entamoeba dispar
IRKYKSFNVWKYCTEAFDYLGLAAI

SEQ ID NO: 2528120 - protein, 18 aa, Entamoeba dispar
IRLKIPICVSPQKCFDLG

SEQ ID NO: 2528121 - protein, 23 aa, Entamoeba dispar
IRLKQFGFLVELLKDVSRSATYF

SEQ ID NO: 2528122 - protein, 18 aa, Entamoeba dispar
IRLLNLFNLEKENEHFKC

SEQ ID NO: 2528123 - protein, 17 aa, Entamoeba dispar
IRLLNRHYELVNQTVFT

SEQ ID NO: 2528124 - protein, 29 aa, Entamoeba dispar
IRLPVESYSFYYFLTYKEALKQIKNFNKC

SEQ ID NO: 2528125 - protein, 20 aa, Entamoeba dispar
IRLTIKGQIARFNELIQKHL

SEQ ID NO: 2528126 - protein, 27 aa, Entamoeba dispar
IRMETLTYLPILLPELEIQTVKEIIVN

SEQ ID NO: 2528127 - protein, 21 aa, Entamoeba dispar
IRNHQLTYSHFPPKQTTNTFD

SEQ ID NO: 2528128 - protein, 28 aa, Entamoeba dispar
IRNIAMLYSYLFYSNAIPWELFSIIKLT

SEQ ID NO: 2528129 - protein, 20 aa, Entamoeba dispar
IRNSGSIEWVVYHVNFKNGE

SEQ ID NO: 2528130 - protein, 19 aa, Entamoeba dispar
IRNSPQQPPLFLQIEEDFS

SEQ ID NO: 2528131 - protein, 20 aa, Entamoeba dispar
IRNTLPYGFSFSFNKENNKE

SEQ ID NO: 2528132 - protein, 26 aa, Entamoeba dispar
IRNWAYKMILFFPNIQTFRIKDLNVF

SEQ ID NO: 2528133 - protein, 23 aa, Entamoeba dispar
IRPDKQIVMFSATFPISVEQHAR

SEQ ID NO: 2528134 - protein, 19 aa, Entamoeba dispar
IRPNRKTGRQAPTKNLMEF

SEQ ID NO: 2528135 - protein, 24 aa, Entamoeba dispar
IRPSNVIITKLFLNKDREAYLAKK

SEQ ID NO: 2528136 - protein, 26 aa, Entamoeba dispar
IRQKNPIYTFDFLTSYNGGMFTSDCL

SEQ ID NO: 2528137 - protein, 19 aa, Entamoeba dispar
IRRCERISLFLDESGIGLN

SEQ ID NO: 2528138 - protein, 25 aa, Entamoeba dispar
IRRDNLLKRKYYDSFLFNSFSDELA

SEQ ID NO: 2528139 - protein, 18 aa, Entamoeba dispar
IRRKKKIHVSDDLEYLLM

SEQ ID NO: 2528140 - protein, 21 aa, Entamoeba dispar
IRSALWTLSNLVFCSTLNVAN

SEQ ID NO: 2528141 - protein, 19 aa, Entamoeba dispar
IRSHAQKYFLKLQKAQQQN

SEQ ID NO: 2528142 - protein, 36 aa, Entamoeba dispar
IRSKYTTRPFYIKPPNSMGYLTLKFSNSGKIIPQYL

SEQ ID NO: 2528143 - protein, 17 aa, Entamoeba dispar
IRSLTYIHSLGICHRDI

SEQ ID NO: 2528144 - protein, 25 aa, Entamoeba dispar
IRSPLRKFRDVLVQFQFIAIMNDYN

SEQ ID NO: 2528145 - protein, 24 aa, Entamoeba dispar
IRTAALVDNSLWIGTFAGLHICDP

SEQ ID NO: 2528146 - protein, 30 aa, Entamoeba dispar
IRTCEPLPDPLLFLRACMLRIDLNGKWLQE

SEQ ID NO: 2528147 - protein, 18 aa, Entamoeba dispar
IRTEATMLLCLISNKKKG

SEQ ID NO: 2528148 - protein, 29 aa, Entamoeba dispar
IRTIKVGGKALITVWAKEQKKFENEEGQD

SEQ ID NO: 2528149 - protein, 26 aa, Entamoeba dispar
IRTMIEIISNIFPISDFWEHVCIVWT

SEQ ID NO: 2528150 - protein, 27 aa, Entamoeba dispar
IRTVGLINLSILFIPALNESSIEIYLN

SEQ ID NO: 2528151 - protein, 26 aa, Entamoeba dispar
IRTVRPVLMLFDAIIVDGINISKKKY

SEQ ID NO: 2528152 - protein, 19 aa, Entamoeba dispar
IRVCEDIVFPTFIPFYDYF

SEQ ID NO: 2528153 - protein, 26 aa, Entamoeba dispar
IRVGEYLFSCTFFLYCSDIELQYKRI

SEQ ID NO: 2528154 - protein, 22 aa, Entamoeba dispar
IRVINFFELLSGKTLKEKYDLR

SEQ ID NO: 2528155 - protein, 17 aa, Entamoeba dispar
IRVWSGQLMICDTCYIG

SEQ ID NO: 2528156 - protein, 17 aa, Entamoeba dispar
IRYSLPSTPLSLASFFK

SEQ ID NO: 2528157 - protein, 26 aa, Entamoeba dispar
IRYYNDEIWLMKPCTGSVLFDIIFNI

SEQ ID NO: 2528158 - protein, 25 aa, Entamoeba dispar
ISADGRFFVCYLSKSFELQVYYLRD

SEQ ID NO: 2528159 - protein, 29 aa, Entamoeba dispar
ISADTILKTMFWYLMESKIDPKYKLEIPS

SEQ ID NO: 2528160 - protein, 29 aa, Entamoeba dispar
ISAFTICNNNIWLAMPMFNQIGIVSFNYQ

SEQ ID NO: 2528161 - protein, 29 aa, Entamoeba dispar
ISALSQIIFMRYFLYNSLNSCDPLYVISA

SEQ ID NO: 2528162 - protein, 31 aa, Entamoeba dispar
ISATCYPLEIDLWLAYSEYATMGLKLQVAEG

SEQ ID NO: 2528163 - protein, 18 aa, Entamoeba dispar
ISCCLYTNIWNCPFCLMK

SEQ ID NO: 2528164 - protein, 21 aa, Entamoeba dispar
ISCFINFLFTKCCKEILVIFT

SEQ ID NO: 2528165 - protein, 23 aa, Entamoeba dispar
ISCIKLNCYGCRNLNIYIKRINE

SEQ ID NO: 2528166 - protein, 20 aa, Entamoeba dispar
ISCLLPLKEKIVELRLFTYD

SEQ ID NO: 2528167 - protein, 17 aa, Entamoeba dispar
ISCTDICRYLFFNEETG

SEQ ID NO: 2528168 - protein, 24 aa, Entamoeba dispar
ISDADWCRYVHLFCIYCGKRYTSL

SEQ ID NO: 2528169 - protein, 38 aa, Entamoeba dispar
ISDHCLLMTDILHRGLKKFWWKAMDYLSFKTLNKRKKE

SEQ ID NO: 2528170 - protein, 26 aa, Entamoeba dispar
ISDISCPWCYVGRKRMLNAISTIKNK

SEQ ID NO: 2528171 - protein, 18 aa, Entamoeba dispar
ISDKLLLHTIKDHTWNIF

SEQ ID NO: 2528172 - protein, 32 aa, Entamoeba dispar
ISDLLITPVQRLPRYQLLLKDLLKHTQQNHVD

SEQ ID NO: 2528173 - protein, 17 aa, Entamoeba dispar
ISDLLTLPQPYPTMLTS

SEQ ID NO: 2528174 - protein, 27 aa, Entamoeba dispar
ISDSYLLRIWDSIFAFPTSKFYYFLVV

SEQ ID NO: 2528175 - protein, 20 aa, Entamoeba dispar
ISDVFLVIGSSLEVMPANAL

SEQ ID NO: 2528176 - protein, 22 aa, Entamoeba dispar
ISDYEIIQPIPWLQSNDINESL

SEQ ID NO: 2528177 - protein, 30 aa, Entamoeba dispar
ISDYIRTRDGFILMYSITSRYSFDLIQDIH

SEQ ID NO: 2528178 - protein, 32 aa, Entamoeba dispar
ISDYKPILIDGFKLSLQLLVKEVSNLWDDFLY

SEQ ID NO: 2528179 - protein, 26 aa, Entamoeba dispar
ISEDSKHFIFTLRNPHLVPPTMIQPR

SEQ ID NO: 2528180 - protein, 25 aa, Entamoeba dispar
ISEERIFINQLVLSSFKIPENLQII

SEQ ID NO: 2528181 - protein, 26 aa, Entamoeba dispar
ISEFSSCYPNILFSLLSGLQCLVYTT

SEQ ID NO: 2528182 - protein, 26 aa, Entamoeba dispar
ISEGGKYYVWKLGEFLKKNPGVQKYK

SEQ ID NO: 2528183 - protein, 25 aa, Entamoeba dispar
ISEHATRIRLLLNELNKQMSVYGQT

SEQ ID NO: 2528184 - protein, 24 aa, Entamoeba dispar
ISEKDLVLACLKNNKPFTTDRIII

SEQ ID NO: 2528185 - protein, 18 aa, Entamoeba dispar
ISELFFGMLLKRTLCDCG

SEQ ID NO: 2528186 - protein, 23 aa, Entamoeba dispar
ISELIKYGMSLLFSYQLDNRSIE

SEQ ID NO: 2528187 - protein, 19 aa, Entamoeba dispar
ISELPYGCFSWCSSLTSID

SEQ ID NO: 2528188 - protein, 28 aa, Entamoeba dispar
ISELSNKITPLVNNITLQQAKIALDENN

SEQ ID NO: 2528189 - protein, 23 aa, Entamoeba dispar
ISENIVPPLPFKMKAVSDFMEIS

SEQ ID NO: 2528190 - protein, 25 aa, Entamoeba dispar
ISESCFVWCRNLQYIKLPDGITSIQ

SEQ ID NO: 2528191 - protein, 20 aa, Entamoeba dispar
ISFEEFKRNITLSLDEYYKL

SEQ ID NO: 2528192 - protein, 24 aa, Entamoeba dispar
ISFEQFVAQLYKLGKNEIMCDWLR

SEQ ID NO: 2528193 - protein, 21 aa, Entamoeba dispar
ISFETIYNQTLLQLPSKLRSE

SEQ ID NO: 2528194 - protein, 20 aa, Entamoeba dispar
ISFHTLSPYYKTILNCIKLF

SEQ ID NO: 2528195 - protein, 19 aa, Entamoeba dispar
ISFKYNLGQITFKHFIILF

SEQ ID NO: 2528196 - protein, 29 aa, Entamoeba dispar
ISFMEEYSILNLFMKKLISSPSPREKDVK

SEQ ID NO: 2528197 - protein, 25 aa, Entamoeba dispar
ISFNQDFSCFALGTTKGFCVYGIEQ

SEQ ID NO: 2528198 - protein, 25 aa, Entamoeba dispar
ISFNQDFSCFALGTTKGFFVYGIEQ

SEQ ID NO: 2528199 - protein, 18 aa, Entamoeba dispar
ISFRRRTNRRQTLAEYLF

SEQ ID NO: 2528200 - protein, 24 aa, Entamoeba dispar
ISFTELLLSLLTRQFSQWTNSTTL

SEQ ID NO: 2528201 - protein, 26 aa, Entamoeba dispar
ISGATKGYFLSARIFTLYSNDKTLRV

SEQ ID NO: 2528202 - protein, 24 aa, Entamoeba dispar
ISGEPYNFEYTFSKSYDIGVSLTI

SEQ ID NO: 2528203 - protein, 23 aa, Entamoeba dispar
ISGFKLVFNSRLLTIFSPHELEL

SEQ ID NO: 2528204 - protein, 17 aa, Entamoeba dispar
ISGFYYQSPIINITYKS

SEQ ID NO: 2528205 - protein, 28 aa, Entamoeba dispar
ISGIKITRNYLFIVFENMVSIMDLSSKS

SEQ ID NO: 2528206 - protein, 17 aa, Entamoeba dispar
ISGITFFNDYQVHCLSF

SEQ ID NO: 2528207 - protein, 26 aa, Entamoeba dispar
ISGKKPFPSLLRNYLRELRSLWISLL

SEQ ID NO: 2528208 - protein, 18 aa, Entamoeba dispar
ISGLHKCCIYYNIVENLS

SEQ ID NO: 2528209 - protein, 21 aa, Entamoeba dispar
ISGMILKYLYEIAQAKLGNHP

SEQ ID NO: 2528210 - protein, 21 aa, Entamoeba dispar
ISGMILKYLYEITQARLGNHP

SEQ ID NO: 2528211 - protein, 27 aa, Entamoeba dispar
ISGTTKGYFLSARIFTLYSNDKTLRVI

SEQ ID NO: 2528212 - protein, 17 aa, Entamoeba dispar
ISHKWDFVSLYPKYTKL

SEQ ID NO: 2528213 - protein, 23 aa, Entamoeba dispar
ISHLTKQFIKIKKIVFSDQNDSI

SEQ ID NO: 2528214 - protein, 31 aa, Entamoeba dispar
ISHPLHGIMIPIPQYPLYSAAISQFGGFQIN

SEQ ID NO: 2528215 - protein, 29 aa, Entamoeba dispar
ISHSKCNYPYPKVIKIPFQSMEAANVLIN

SEQ ID NO: 2528216 - protein, 25 aa, Entamoeba dispar
ISHTLLTQFLIPKRFDCLVALNVSA

SEQ ID NO: 2528217 - protein, 19 aa, Entamoeba dispar
ISHVFSYLDRFFIKQQKAI

SEQ ID NO: 2528218 - protein, 26 aa, Entamoeba dispar
ISIDTHFPLVFSSVLTKRLNLHIQKC

SEQ ID NO: 2528219 - protein, 35 aa, Entamoeba dispar
ISIGQLLKIRIISFDKQLLLCSLNLFPEENVPEKY

SEQ ID NO: 2528220 - protein, 25 aa, Entamoeba dispar
ISIIPDYCFSYCSSLTLIDIPPSIK

SEQ ID NO: 2528221 - protein, 18 aa, Entamoeba dispar
ISIISKYFKKYTKEIYLY

SEQ ID NO: 2528222 - protein, 17 aa, Entamoeba dispar
ISIKFVHEIIGKKSLNY

SEQ ID NO: 2528223 - protein, 19 aa, Entamoeba dispar
ISIKIPYTIQIINGKNIFK

SEQ ID NO: 2528224 - protein, 27 aa, Entamoeba dispar
ISIKTKKLFPLIQTQHLYFPTDERIPT

SEQ ID NO: 2528225 - protein, 25 aa, Entamoeba dispar
ISILKALLSGYFLNTAQLTKEGIYR

SEQ ID NO: 2528226 - protein, 25 aa, Entamoeba dispar
ISIMQMIEWYYQGLLNTIAPFAKKI

SEQ ID NO: 2528227 - protein, 26 aa, Entamoeba dispar
ISINDYVNLLLLKDKTLFQESIIQQL

SEQ ID NO: 2528228 - protein, 24 aa, Entamoeba dispar
ISISELLFVVWKHCNESMKNTIFI

SEQ ID NO: 2528229 - protein, 17 aa, Entamoeba dispar
ISISKFFDSLSATPIEL

SEQ ID NO: 2528230 - protein, 22 aa, Entamoeba dispar
ISISYLSKIIKKMGLGKRANHS

SEQ ID NO: 2528231 - protein, 28 aa, Entamoeba dispar
ISITMSVAIFHKKLTWLKKFPKEQEELA

SEQ ID NO: 2528232 - protein, 17 aa, Entamoeba dispar
ISIVEVIIPIFKSMIEE

SEQ ID NO: 2528233 - protein, 22 aa, Entamoeba dispar
ISIYHQWLFGEHIPKIIQDNRQ

SEQ ID NO: 2528234 - protein, 18 aa, Entamoeba dispar
ISIYKPKTVFGHSIVSVL

SEQ ID NO: 2528235 - protein, 18 aa, Entamoeba dispar
ISIYLLFLHNPMISDVIV

SEQ ID NO: 2528236 - protein, 19 aa, Entamoeba dispar
ISIYQNLYKLIRSSSIENT

SEQ ID NO: 2528237 - protein, 26 aa, Entamoeba dispar
ISKALLPSLLLYPKIYHHLKSSLLLN

SEQ ID NO: 2528238 - protein, 27 aa, Entamoeba dispar
ISKALLPSLLLYPKIYHHLKSSLLLNY

SEQ ID NO: 2528239 - protein, 22 aa, Entamoeba dispar
ISKDFLGLRVLKGINLITPTTM

SEQ ID NO: 2528240 - protein, 32 aa, Entamoeba dispar
ISKEIPSFYNVMKALLICFRNGIEKPSVLKVM

SEQ ID NO: 2528241 - protein, 17 aa, Entamoeba dispar
ISKEQADRMFKFTPVHI

SEQ ID NO: 2528242 - protein, 19 aa, Entamoeba dispar
ISKERIFMNEPILFSIEIP

SEQ ID NO: 2528243 - protein, 24 aa, Entamoeba dispar
ISKERIFMNEPVLISFEIPNNLNE

SEQ ID NO: 2528244 - protein, 17 aa, Entamoeba dispar
ISKERIFMNEPVLVSIK

SEQ ID NO: 2528245 - protein, 19 aa, Entamoeba dispar
ISKERIFMNEPVLVSIKIP

SEQ ID NO: 2528246 - protein, 19 aa, Entamoeba dispar
ISKERIFMSEPVLISIKIP

SEQ ID NO: 2528247 - protein, 31 aa, Entamoeba dispar
ISKIGYYCFKKCFLLTKINLPTTISELGNYC

SEQ ID NO: 2528248 - protein, 29 aa, Entamoeba dispar
ISKINHMFPVHKYIRIRQWINLNNKDCLY

SEQ ID NO: 2528249 - protein, 31 aa, Entamoeba dispar
ISKKTLQFLTLKLIIFPKQDEIKFASLVKQK

SEQ ID NO: 2528250 - protein, 27 aa, Entamoeba dispar
ISKKTNLLPPLIYILNSLNTLTKEELI

SEQ ID NO: 2528251 - protein, 23 aa, Entamoeba dispar
ISKKYQKYPRLYYTWIDKVVQTQ

SEQ ID NO: 2528252 - protein, 24 aa, Entamoeba dispar
ISKKYQKYPRLYYTWIDKVVQTQE

SEQ ID NO: 2528253 - protein, 28 aa, Entamoeba dispar
ISKLIRFYPQLFNLFYSSFRDLCIQPYI

SEQ ID NO: 2528254 - protein, 32 aa, Entamoeba dispar
ISKLNIEVLKLLMIRVKRLYEFICKQYSSIVA

SEQ ID NO: 2528255 - protein, 28 aa, Entamoeba dispar
ISKMSPFIFFMLEFAHNKFYITYRLEPM

SEQ ID NO: 2528256 - protein, 24 aa, Entamoeba dispar
ISKNKVVIPIKRKSFRVEEKGNQE

SEQ ID NO: 2528257 - protein, 27 aa, Entamoeba dispar
ISKPEFWQHLCIILTNCYCYIPEKVIE

SEQ ID NO: 2528258 - protein, 24 aa, Entamoeba dispar
ISKSLSWPTILYVVGSIVKGWLQK

SEQ ID NO: 2528259 - protein, 23 aa, Entamoeba dispar
ISKTRIFYLKKYEYFEISYKSNI

SEQ ID NO: 2528260 - protein, 23 aa, Entamoeba dispar
ISKTSWICELNQPINKEFIHQLF

SEQ ID NO: 2528261 - protein, 20 aa, Entamoeba dispar
ISKYTNAVGVGKYTYKCQVI

SEQ ID NO: 2528262 - protein, 17 aa, Entamoeba dispar
ISLAMLKAKKRGAEEVD

SEQ ID NO: 2528263 - protein, 26 aa, Entamoeba dispar
ISLANEYCIIPYEIKIQTLIRILKDS

SEQ ID NO: 2528264 - protein, 17 aa, Entamoeba dispar
ISLDISCNRLTSIKFPC

SEQ ID NO: 2528265 - protein, 17 aa, Entamoeba dispar
ISLEDLKTCNFTRVGYS

SEQ ID NO: 2528266 - protein, 18 aa, Entamoeba dispar
ISLEIHIARLEYKYGSLI

SEQ ID NO: 2528267 - protein, 19 aa, Entamoeba dispar
ISLEIHIARLEYKYGSLIK

SEQ ID NO: 2528268 - protein, 17 aa, Entamoeba dispar
ISLFIDNYIHPKQTEWS

SEQ ID NO: 2528269 - protein, 39 aa, Entamoeba dispar
ISLFTVLIEIVIDPYYRTIEGFLFLFQRELLSVNFFDKN

SEQ ID NO: 2528270 - protein, 18 aa, Entamoeba dispar
ISLHPLLKCLIKYENQTL

SEQ ID NO: 2528271 - protein, 32 aa, Entamoeba dispar
ISLKLLTEDGIYIIWFSNIQFNEIISICTKLQ

SEQ ID NO: 2528272 - protein, 23 aa, Entamoeba dispar
ISLLRMMYALEFNYQLMAPEQLN

SEQ ID NO: 2528273 - protein, 18 aa, Entamoeba dispar
ISLNIPTRPFLLTENTGS

SEQ ID NO: 2528274 - protein, 22 aa, Entamoeba dispar
ISLNSFNVWNRKFSGKGNKVPI

SEQ ID NO: 2528275 - protein, 21 aa, Entamoeba dispar
ISLPIVLCGGDWFIGLFVRQL

SEQ ID NO: 2528276 - protein, 32 aa, Entamoeba dispar
ISLSNFLHTSVMPPFISFIIKLIGSHRSLYQS

SEQ ID NO: 2528277 - protein, 18 aa, Entamoeba dispar
ISLVINYDMPLNREVYIH

SEQ ID NO: 2528278 - protein, 17 aa, Entamoeba dispar
ISLYKQKGDYKNALKLI

SEQ ID NO: 2528279 - protein, 25 aa, Entamoeba dispar
ISMEELYTMFGWPLAKKYGTLHDAF

SEQ ID NO: 2528280 - protein, 19 aa, Entamoeba dispar
ISMFEKKIVYIEAQINEAS

SEQ ID NO: 2528281 - protein, 18 aa, Entamoeba dispar
ISMNFRFTEPLWKKYENK

SEQ ID NO: 2528282 - protein, 30 aa, Entamoeba dispar
ISNDKLQLYGNLFYLLQSDPVYVARLINCI

SEQ ID NO: 2528283 - protein, 33 aa, Entamoeba dispar
ISNEKQISLLRRKKLFVWIEYKNKDVIGHKANV

SEQ ID NO: 2528284 - protein, 30 aa, Entamoeba dispar
ISNFDLILNHPVILSPLYKITIVKAETKLY

SEQ ID NO: 2528285 - protein, 27 aa, Entamoeba dispar
ISNIDSYNYALELLKKFSAVSSKTKIV

SEQ ID NO: 2528286 - protein, 30 aa, Entamoeba dispar
ISNIPIVSEQWLIDTIKSTTIKDPCKYLVP

SEQ ID NO: 2528287 - protein, 27 aa, Entamoeba dispar
ISNNRSYLLCLLLQYKYKTKHQEFTTF

SEQ ID NO: 2528288 - protein, 18 aa, Entamoeba dispar
ISNQPIPNLLDLGLEPVT

SEQ ID NO: 2528289 - protein, 19 aa, Entamoeba dispar
ISNSDLMDFPLFSSQQLKK

SEQ ID NO: 2528290 - protein, 25 aa, Entamoeba dispar
ISNSMPFQFLSLHLSKSVIYIPSVG

SEQ ID NO: 2528291 - protein, 27 aa, Entamoeba dispar
ISNTCIVGYLPYFKQTQVLDIVVEKCF

SEQ ID NO: 2528292 - protein, 18 aa, Entamoeba dispar
ISNYIHVFSLHPSNIILT

SEQ ID NO: 2528293 - protein, 20 aa, Entamoeba dispar
ISNYLWEIILENVDLIKEGK

SEQ ID NO: 2528294 - protein, 19 aa, Entamoeba dispar
ISPDLKNTKALLKQTQKEL

SEQ ID NO: 2528295 - protein, 17 aa, Entamoeba dispar
ISPFRNLSTTFISQRNQ

SEQ ID NO: 2528296 - protein, 20 aa, Entamoeba dispar
ISPHAGFRYSGPTAGYDFAA

SEQ ID NO: 2528297 - protein, 18 aa, Entamoeba dispar
ISPHFIFNVDEFGFQLKT

SEQ ID NO: 2528298 - protein, 17 aa, Entamoeba dispar
ISPIQQPYIPPVPQQQS

SEQ ID NO: 2528299 - protein, 27 aa, Entamoeba dispar
ISPKYAYNFWICCLHFIGTPLISNNAS

SEQ ID NO: 2528300 - protein, 29 aa, Entamoeba dispar
ISPLRLKVMNFVRIWIKNAWRDFEGQTEL

SEQ ID NO: 2528301 - protein, 27 aa, Entamoeba dispar
ISPNAKMLLELKFNKLYGLLDSFYKIS

SEQ ID NO: 2528302 - protein, 27 aa, Entamoeba dispar
ISPNDYSLFLYYSKRRVNPFIRPKSIL

SEQ ID NO: 2528303 - protein, 37 aa, Entamoeba dispar
ISPNNQILLLNLYEQLIKVVLLPQYPKDQLTASNIKV

SEQ ID NO: 2528304 - protein, 19 aa, Entamoeba dispar
ISPVLSYFDITPNSIIVES

SEQ ID NO: 2528305 - protein, 20 aa, Entamoeba dispar
ISPVLSYFDITPNSIIVESG

SEQ ID NO: 2528306 - protein, 18 aa, Entamoeba dispar
ISQCGTGIYVTENGRGCI

SEQ ID NO: 2528307 - protein, 28 aa, Entamoeba dispar
ISQKEIIVDGLLYSLSIWDTAGHEKYQS

SEQ ID NO: 2528308 - protein, 24 aa, Entamoeba dispar
ISQLETMYINFEKISLPKGYVETN

SEQ ID NO: 2528309 - protein, 31 aa, Entamoeba dispar
ISQLIKQHDLIPLVEFVFGGRQRRFIINLEN

SEQ ID NO: 2528310 - protein, 20 aa, Entamoeba dispar
ISQLLPLYKYRLKNGYLLIP

SEQ ID NO: 2528311 - protein, 24 aa, Entamoeba dispar
ISQRWIPEIKHFCPDVPFILVATK

SEQ ID NO: 2528312 - protein, 23 aa, Entamoeba dispar
ISQYYQIVPSMKKKISADISIQP

SEQ ID NO: 2528313 - protein, 20 aa, Entamoeba dispar
ISRDQVIELLRALGKAPTQQ

SEQ ID NO: 2528314 - protein, 22 aa, Entamoeba dispar
ISRDQVIELLRALGKAPTQQQE

SEQ ID NO: 2528315 - protein, 26 aa, Entamoeba dispar
ISRKEMYFMLCLIDYMISNYEPFRKG

SEQ ID NO: 2528316 - protein, 23 aa, Entamoeba dispar
ISRLGWYCFKGCYSLMSINIPSS

SEQ ID NO: 2528317 - protein, 18 aa, Entamoeba dispar
ISRLIIKCKNIEYTISDR

SEQ ID NO: 2528318 - protein, 17 aa, Entamoeba dispar
ISRNRYEWYIAQYAMQK

SEQ ID NO: 2528319 - protein, 18 aa, Entamoeba dispar
ISRRKLELIKASRTNREK

SEQ ID NO: 2528320 - protein, 23 aa, Entamoeba dispar
ISRSYIYSIIPSICPLLVHPNIT

SEQ ID NO: 2528321 - protein, 24 aa, Entamoeba dispar
ISRTTPIPIGGYIFVTIIADLKKI

SEQ ID NO: 2528322 - protein, 27 aa, Entamoeba dispar
ISSFFPPHPLHFFSLPILPSIIHTPSL

SEQ ID NO: 2528323 - protein, 25 aa, Entamoeba dispar
ISSFHGLIALDYRRFNKNPISMILD

SEQ ID NO: 2528324 - protein, 20 aa, Entamoeba dispar
ISSFIKQFIYLTFTTDDIDD

SEQ ID NO: 2528325 - protein, 29 aa, Entamoeba dispar
ISSIDQYYKPFIYIQPLVSSSPSYSCIYS

SEQ ID NO: 2528326 - protein, 21 aa, Entamoeba dispar
ISSIFKLICFSHEIGSYIIQD

SEQ ID NO: 2528327 - protein, 17 aa, Entamoeba dispar
ISSIILASSRKKPLNQI

SEQ ID NO: 2528328 - protein, 26 aa, Entamoeba dispar
ISSKGIPIKLLYFIVSSRNDIKIFSQ

SEQ ID NO: 2528329 - protein, 27 aa, Entamoeba dispar
ISSLARLSPPLPIPLITELHISTFQMI

SEQ ID NO: 2528330 - protein, 18 aa, Entamoeba dispar
ISSLLKLLRFQIVQFQVA

SEQ ID NO: 2528331 - protein, 24 aa, Entamoeba dispar
ISSLLKLRHPFIIKLISVENKVDS

SEQ ID NO: 2528332 - protein, 24 aa, Entamoeba dispar
ISSNTFLWDVFLDNLNKLFFEFQL

SEQ ID NO: 2528333 - protein, 17 aa, Entamoeba dispar
ISSNYFESIPLLSSLIN

SEQ ID NO: 2528334 - protein, 18 aa, Entamoeba dispar
ISSSWDHTLRLWDLTKME

SEQ ID NO: 2528335 - protein, 18 aa, Entamoeba dispar
ISSWFFLREPEGSELGFS

SEQ ID NO: 2528336 - protein, 29 aa, Entamoeba dispar
ISTFRGIPDWDWFYQFNAPPEITDLIQYH

SEQ ID NO: 2528337 - protein, 22 aa, Entamoeba dispar
ISTITFSYIHTPLINELINHTN

SEQ ID NO: 2528338 - protein, 25 aa, Entamoeba dispar
ISTLHFPYYYVTPTLKKLNDLRNKI

SEQ ID NO: 2528339 - protein, 19 aa, Entamoeba dispar
ISTLSLFRLDKFSGTNALQ

SEQ ID NO: 2528340 - protein, 29 aa, Entamoeba dispar
ISTLTLTFKILINELKNKPTKRVWGKIST

SEQ ID NO: 2528341 - protein, 24 aa, Entamoeba dispar
ISVAAYYVPLLKTLGLTTILSTEL

SEQ ID NO: 2528342 - protein, 27 aa, Entamoeba dispar
ISVDEQYWIFQLVAAILHLGNVYFTEN

SEQ ID NO: 2528343 - protein, 18 aa, Entamoeba dispar
ISVDKLYRTKPCKYFFET

SEQ ID NO: 2528344 - protein, 29 aa, Entamoeba dispar
ISVDYYKISPLIPFLLKQLGSSSCEAVSN

SEQ ID NO: 2528345 - protein, 18 aa, Entamoeba dispar
ISVFPYVTDLLTCILSIN

SEQ ID NO: 2528346 - protein, 18 aa, Entamoeba dispar
ISVIPINCFCGCTSLTSI

SEQ ID NO: 2528347 - protein, 19 aa, Entamoeba dispar
ISVIPINCFCGCTSLTSIT

SEQ ID NO: 2528348 - protein, 17 aa, Entamoeba dispar
ISVLKKWKESGKGDIID

SEQ ID NO: 2528349 - protein, 17 aa, Entamoeba dispar
ISVNLYSFVPSGICPLN

SEQ ID NO: 2528350 - protein, 17 aa, Entamoeba dispar
ISVPLPGSISLLDLSFN

SEQ ID NO: 2528351 - protein, 23 aa, Entamoeba dispar
ISVPYTFGFLERKQINAAMSLIG

SEQ ID NO: 2528352 - protein, 24 aa, Entamoeba dispar
ISVSKEILLFVRNILLNSNNTTNN

SEQ ID NO: 2528353 - protein, 33 aa, Entamoeba dispar
ISYFLGEICSGLWYLHFNKRLIHRDLKPANLLL

SEQ ID NO: 2528354 - protein, 21 aa, Entamoeba dispar
ISYKLFFHQLYNILNYGHEII

SEQ ID NO: 2528355 - protein, 19 aa, Entamoeba dispar
ISYLATHLTLGYANAFPLN

SEQ ID NO: 2528356 - protein, 19 aa, Entamoeba dispar
ISYNKLIFPQTLQSLTLRL

SEQ ID NO: 2528357 - protein, 24 aa, Entamoeba dispar
ISYNRVRILFKFIVSILKVKSYDN

SEQ ID NO: 2528358 - protein, 27 aa, Entamoeba dispar
ISYQKRLDVIILLVKKLITDQSSLQYF

SEQ ID NO: 2528359 - protein, 18 aa, Entamoeba dispar
ISYSKRISKETICFVYNG

SEQ ID NO: 2528360 - protein, 18 aa, Entamoeba dispar
ITALLTLELQEMKIGLDG

SEQ ID NO: 2528361 - protein, 18 aa, Entamoeba dispar
ITALMKLLKKFNSIKDLL

SEQ ID NO: 2528362 - protein, 18 aa, Entamoeba dispar
ITALRNGYWILLDEINLA

SEQ ID NO: 2528363 - protein, 19 aa, Entamoeba dispar
ITALWMGEIIRYSQLPSFY

SEQ ID NO: 2528364 - protein, 18 aa, Entamoeba dispar
ITAMLRRILQIYSIIHVD

SEQ ID NO: 2528365 - protein, 29 aa, Entamoeba dispar
ITASEDGLIKLWNLIDGHLIATLRGHSKG

SEQ ID NO: 2528366 - protein, 18 aa, Entamoeba dispar
ITCICGTYFCYNCGEKID

SEQ ID NO: 2528367 - protein, 18 aa, Entamoeba dispar
ITCQPEIKELDRLLDQFY

SEQ ID NO: 2528368 - protein, 17 aa, Entamoeba dispar
ITCSLRFPGQLNQDLKK

SEQ ID NO: 2528369 - protein, 18 aa, Entamoeba dispar
ITCVNWSLTNNFLFCSGD

SEQ ID NO: 2528370 - protein, 22 aa, Entamoeba dispar
ITDFRSVLFNGGKSLKEGEVTE

SEQ ID NO: 2528371 - protein, 31 aa, Entamoeba dispar
ITDIHFVSTLFYYMRLCVLSYGKWVYIQGDK

SEQ ID NO: 2528372 - protein, 21 aa, Entamoeba dispar
ITDMRILLDPFALPAIQDFHS

SEQ ID NO: 2528373 - protein, 20 aa, Entamoeba dispar
ITECTFDFLKLVLQKSQRPF

SEQ ID NO: 2528374 - protein, 26 aa, Entamoeba dispar
ITEELIHKYFDPFGPIIGVDIVYKPQ

SEQ ID NO: 2528375 - protein, 18 aa, Entamoeba dispar
ITEEQICWLKLKIYNTFV

SEQ ID NO: 2528376 - protein, 23 aa, Entamoeba dispar
ITEGKVIAIRYILRAMAVASKFK

SEQ ID NO: 2528377 - protein, 26 aa, Entamoeba dispar
ITEGKYLNFIGIGGIIPLLSNNLSEP

SEQ ID NO: 2528378 - protein, 23 aa, Entamoeba dispar
ITEIFYQVFLKQLGKIKLTSPEF

SEQ ID NO: 2528379 - protein, 25 aa, Entamoeba dispar
ITEMNNKYSVLLTAARAAEERNKKE

SEQ ID NO: 2528380 - protein, 32 aa, Entamoeba dispar
ITERMTANLPLFYFSPININPPKFKKVDLPQE

SEQ ID NO: 2528381 - protein, 19 aa, Entamoeba dispar
ITEVPLNWYLQQKKLLQNK

SEQ ID NO: 2528382 - protein, 18 aa, Entamoeba dispar
ITFCYAATVALNTSLLCG

SEQ ID NO: 2528383 - protein, 20 aa, Entamoeba dispar
ITFCYAATVALNTTLLCGVQ

SEQ ID NO: 2528384 - protein, 21 aa, Entamoeba dispar
ITFCYAATVALNTTLLCGVQL

SEQ ID NO: 2528385 - protein, 25 aa, Entamoeba dispar
ITFEDWYYIFHRVYFKILESIGYYH

SEQ ID NO: 2528386 - protein, 19 aa, Entamoeba dispar
ITFFFNFEIPAEIITKLFN

SEQ ID NO: 2528387 - protein, 24 aa, Entamoeba dispar
ITFGKDCFILVLKKILKDACLSGG

SEQ ID NO: 2528388 - protein, 17 aa, Entamoeba dispar
ITFGTFDSLPLSKEYLN

SEQ ID NO: 2528389 - protein, 25 aa, Entamoeba dispar
ITFKSNYCIPLILAKCFKTIDEYQY

SEQ ID NO: 2528390 - protein, 25 aa, Entamoeba dispar
ITGFKGVLLIVFKTKIEFIDIASLN

SEQ ID NO: 2528391 - protein, 20 aa, Entamoeba dispar
ITGGLYFKLKEKHPEFDDEK

SEQ ID NO: 2528392 - protein, 27 aa, Entamoeba dispar
ITGLQNLIHILLLYHDPILSIHLDTNR

SEQ ID NO: 2528393 - protein, 18 aa, Entamoeba dispar
ITGNFYKLSYNKTIFDEI

SEQ ID NO: 2528394 - protein, 26 aa, Entamoeba dispar
ITGVERIVLPMYFVDSKPIERLDNTR

SEQ ID NO: 2528395 - protein, 26 aa, Entamoeba dispar
ITHCELLRCFIKILKRIKDINENNIQ

SEQ ID NO: 2528396 - protein, 25 aa, Entamoeba dispar
ITHDPRILLLYTKITSLPKMLFISE

SEQ ID NO: 2528397 - protein, 22 aa, Entamoeba dispar
ITHIQLFDYWCSIQHIELHEKP

SEQ ID NO: 2528398 - protein, 18 aa, Entamoeba dispar
ITHLMRLLQLSLTSFGVK

SEQ ID NO: 2528399 - protein, 30 aa, Entamoeba dispar
ITHNRIPQFTIIPFSYCFYKPLPLNKFGNI

SEQ ID NO: 2528400 - protein, 20 aa, Entamoeba dispar
ITHPLVMTLFTSPNYCDVYD

SEQ ID NO: 2528401 - protein, 21 aa, Entamoeba dispar
ITIEIPLSRKEFPGYFKDVIN

SEQ ID NO: 2528402 - protein, 19 aa, Entamoeba dispar
ITIFKANEKLPLKKTIPIT

SEQ ID NO: 2528403 - protein, 17 aa, Entamoeba dispar
ITIGIYLDGESFMKKQF

SEQ ID NO: 2528404 - protein, 18 aa, Entamoeba dispar
ITIILDKIKQYIGDTEFQ

SEQ ID NO: 2528405 - protein, 30 aa, Entamoeba dispar
ITIINLLPSLNKILPLLIKLHGTDLLPLFS

SEQ ID NO: 2528406 - protein, 25 aa, Entamoeba dispar
ITINDTLFFYVPMKNKSIEVNEIHN

SEQ ID NO: 2528407 - protein, 18 aa, Entamoeba dispar
ITIPTRIIKIGGGCCFYV

SEQ ID NO: 2528408 - protein, 29 aa, Entamoeba dispar
ITIQEIVYPSRFLLIKDTNNPYLAFPNNC

SEQ ID NO: 2528409 - protein, 18 aa, Entamoeba dispar
ITISDFVTYIGEKAFGGC

SEQ ID NO: 2528410 - protein, 29 aa, Entamoeba dispar
ITKCLLVKPSTIFDLWRQCHQPYSKMYEA

SEQ ID NO: 2528411 - protein, 25 aa, Entamoeba dispar
ITKEVIPLFLDIIQIFLKSGDDKAL

SEQ ID NO: 2528412 - protein, 27 aa, Entamoeba dispar
ITKKSKGFGFVLFVVPQDAVKACNEMD

SEQ ID NO: 2528413 - protein, 33 aa, Entamoeba dispar
ITKLGDYCFSYYPSLTLINIPSSIIELGYGCFY

SEQ ID NO: 2528414 - protein, 25 aa, Entamoeba dispar
ITKNTYLCVKRLPRSARQMVMKKIR

SEQ ID NO: 2528415 - protein, 24 aa, Entamoeba dispar
ITKRDEIIQSLKQLDGLLVSQEIA

SEQ ID NO: 2528416 - protein, 33 aa, Entamoeba dispar
ITKRETFIEQLVFYNILQWLDNFDGTVPIPAIL

SEQ ID NO: 2528417 - protein, 20 aa, Entamoeba dispar
ITKRTLISSYRRERDRFWNI

SEQ ID NO: 2528418 - protein, 43 aa, Entamoeba dispar
ITKTKALFQTLNDLLIDKITWWAGRLFFNEFEMLMKVLKESNE

SEQ ID NO: 2528419 - protein, 34 aa, Entamoeba dispar
ITKVSKIMYLGDSTIIIFLFLDGRQEEIRLRNEN

SEQ ID NO: 2528420 - protein, 24 aa, Entamoeba dispar
ITLDESEIFWLFKSVMDMMEQFYK

SEQ ID NO: 2528421 - protein, 21 aa, Entamoeba dispar
ITLFNLYKERKCIGYRWIHGQ

SEQ ID NO: 2528422 - protein, 23 aa, Entamoeba dispar
ITLIVKMLCECGLFYHPNNKNTG

SEQ ID NO: 2528423 - protein, 19 aa, Entamoeba dispar
ITLLKVKRISSEDLRIVIC

SEQ ID NO: 2528424 - protein, 31 aa, Entamoeba dispar
ITLMQNDLFRKVPYFELLGNGWMKKDKDTLT

SEQ ID NO: 2528425 - protein, 26 aa, Entamoeba dispar
ITLNKGMVKMSLPLAMFLSGISFDVY

SEQ ID NO: 2528426 - protein, 19 aa, Entamoeba dispar
ITLPLLKRKDEILSIPDFL

SEQ ID NO: 2528427 - protein, 19 aa, Entamoeba dispar
ITLPLSILSIGNRSFCNCV

SEQ ID NO: 2528428 - protein, 27 aa, Entamoeba dispar
ITLPPNISLLIQYLKKHAITIEGIFRV

SEQ ID NO: 2528429 - protein, 27 aa, Entamoeba dispar
ITLRFQNYYFFKEKVSFRVIRCLEPFV

SEQ ID NO: 2528430 - protein, 26 aa, Entamoeba dispar
ITLSSSWAFIIMWKGSDNEAYIQLQR

SEQ ID NO: 2528431 - protein, 22 aa, Entamoeba dispar
ITMHKNCFRCSVCKKILNGANF

SEQ ID NO: 2528432 - protein, 29 aa, Entamoeba dispar
ITMLHDYFDILIFTHKYSPYIQLIEKCKE

SEQ ID NO: 2528433 - protein, 32 aa, Entamoeba dispar
ITNALPNEVSEKLPKLPISQQKERIKNAKKQT

SEQ ID NO: 2528434 - protein, 24 aa, Entamoeba dispar
ITNFQTENLFKHKLIDFIIEFMQE

SEQ ID NO: 2528435 - protein, 28 aa, Entamoeba dispar
ITNITLNDLLRLCWGLMTVADFTVRRNL

SEQ ID NO: 2528436 - protein, 34 aa, Entamoeba dispar
ITNKSSLFFIFQTQSDLFGFYFGSSISAFDKYLS

SEQ ID NO: 2528437 - protein, 19 aa, Entamoeba dispar
ITNLTFLETITLPHFPILL

SEQ ID NO: 2528438 - protein, 33 aa, Entamoeba dispar
ITNPIIFSCGIIKICIILIKKSQVKFYTPIIDL

SEQ ID NO: 2528439 - protein, 25 aa, Entamoeba dispar
ITNSSNLIPLPRTPSARKVIQDFLK

SEQ ID NO: 2528440 - protein, 24 aa, Entamoeba dispar
ITNSVEFFDICRIKDALALAHKLD

SEQ ID NO: 2528441 - protein, 23 aa, Entamoeba dispar
ITPDWMALIFKTIQYPGCLHEHH

SEQ ID NO: 2528442 - protein, 19 aa, Entamoeba dispar
ITPIFVFDGARLPSKITTE

SEQ ID NO: 2528443 - protein, 27 aa, Entamoeba dispar
ITPLKEECIWFYQSNFRLLEKYGNFYD

SEQ ID NO: 2528444 - protein, 21 aa, Entamoeba dispar
ITPSILAIQLPCYHYFHSECI

SEQ ID NO: 2528445 - protein, 19 aa, Entamoeba dispar
ITPTKGNLFQLRYISKATV

SEQ ID NO: 2528446 - protein, 17 aa, Entamoeba dispar
ITQDIVGLIGSLDLNTI

SEQ ID NO: 2528447 - protein, 26 aa, Entamoeba dispar
ITQPEATYLLWMDFSKYGISSDKIDD

SEQ ID NO: 2528448 - protein, 24 aa, Entamoeba dispar
ITQTFKTLIPLIQSFHTKIENLRI

SEQ ID NO: 2528449 - protein, 23 aa, Entamoeba dispar
ITQTRDIIIIDFGLTIMSETIEN

SEQ ID NO: 2528450 - protein, 24 aa, Entamoeba dispar
ITRDDLVVCWYSRITRSIGFIING

SEQ ID NO: 2528451 - protein, 26 aa, Entamoeba dispar
ITREHFRYIIKYIFSFISKDKQHEQL

SEQ ID NO: 2528452 - protein, 22 aa, Entamoeba dispar
ITRFNLFVVIGLADGKAKFFTW

SEQ ID NO: 2528453 - protein, 34 aa, Entamoeba dispar
ITRIEEAFDILILARCWLKFSYVYSFYSSEEGKI

SEQ ID NO: 2528454 - protein, 26 aa, Entamoeba dispar
ITRIKNALIYYIQYNQPISSVFLKEH

SEQ ID NO: 2528455 - protein, 21 aa, Entamoeba dispar
ITRILQEVLGGQGFLIAIGCI

SEQ ID NO: 2528456 - protein, 24 aa, Entamoeba dispar
ITRKNEFAILLIKFLWLRINSNCI

SEQ ID NO: 2528457 - protein, 37 aa, Entamoeba dispar
ITRMGYPNRMIYSEFLKRYYFLGDKINRRASDEKATA

SEQ ID NO: 2528458 - protein, 35 aa, Entamoeba dispar
ITRQEEYYYLFQIVSYLYFAPFRQEGLSIVSKLDR

SEQ ID NO: 2528459 - protein, 27 aa, Entamoeba dispar
ITSKRSKLTLPFLKINTISFTSEDVID

SEQ ID NO: 2528460 - protein, 23 aa, Entamoeba dispar
ITSLPDIPFLKECHLEELILNNN

SEQ ID NO: 2528461 - protein, 31 aa, Entamoeba dispar
ITSLPLEHLTLFKYIMKLSYKISAYEDINLM

SEQ ID NO: 2528462 - protein, 22 aa, Entamoeba dispar
ITSLYKKWNWTIPNGVKMDCVY

SEQ ID NO: 2528463 - protein, 27 aa, Entamoeba dispar
ITSRQSVMYLLYYFCSALKERFSDFIG

SEQ ID NO: 2528464 - protein, 26 aa, Entamoeba dispar
ITSSHLKICGIYWGITTLHLLNQVTE

SEQ ID NO: 2528465 - protein, 24 aa, Entamoeba dispar
ITSSLRIIIKPHFIFQNLTNEVFN

SEQ ID NO: 2528466 - protein, 32 aa, Entamoeba dispar
ITTDHNPYFDSFIRWQFLKLKEMGKIQFGKRY

SEQ ID NO: 2528467 - protein, 26 aa, Entamoeba dispar
ITTEKPPIISLLFTTKSRLYISSHSG

SEQ ID NO: 2528468 - protein, 23 aa, Entamoeba dispar
ITTEVLMTCTFRALDKSCSASLD

SEQ ID NO: 2528469 - protein, 21 aa, Entamoeba dispar
ITTFKSFFLNLKQLTSLKKVI

SEQ ID NO: 2528470 - protein, 29 aa, Entamoeba dispar
ITTFSDWKLILYFINLLGKFGGEPNYEID

SEQ ID NO: 2528471 - protein, 32 aa, Entamoeba dispar
ITTIPSHYLYCGMLIYLLQFNKEAYFSLVLDK

SEQ ID NO: 2528472 - protein, 19 aa, Entamoeba dispar
ITTISFLPTTLTTLNMRGL

SEQ ID NO: 2528473 - protein, 18 aa, Entamoeba dispar
ITTLGRLHPLGVNDVFID

SEQ ID NO: 2528474 - protein, 36 aa, Entamoeba dispar
ITTLPDVLPGYLPTASALPFFISLFSEIKWDDEISC

SEQ ID NO: 2528475 - protein, 17 aa, Entamoeba dispar
ITTLRYFNEFILSRILE

SEQ ID NO: 2528476 - protein, 18 aa, Entamoeba dispar
ITTLYTPLMAVATDINGN

SEQ ID NO: 2528477 - protein, 23 aa, Entamoeba dispar
ITTMIPKFILRCSVEVIQELFNF

SEQ ID NO: 2528478 - protein, 19 aa, Entamoeba dispar
ITTNTPQPFPKLKKKTQCC

SEQ ID NO: 2528479 - protein, 28 aa, Entamoeba dispar
ITTQREMFFYMSLLSQQLPIESQFIGSL

SEQ ID NO: 2528480 - protein, 26 aa, Entamoeba dispar
ITTSFGKFYNPLPILPKHNPYTCLEK

SEQ ID NO: 2528481 - protein, 25 aa, Entamoeba dispar
ITVDQRSLLLLSRLEWILKDISNDN

SEQ ID NO: 2528482 - protein, 17 aa, Entamoeba dispar
ITVFVLIAQKKLVPHLK

SEQ ID NO: 2528483 - protein, 17 aa, Entamoeba dispar
ITVIAWGFGLERPTMIS

SEQ ID NO: 2528484 - protein, 18 aa, Entamoeba dispar
ITVILDKIKSHIGDTDFQ

SEQ ID NO: 2528485 - protein, 24 aa, Entamoeba dispar
ITYDVQPLAIIKRIDSDSPAEKAG

SEQ ID NO: 2528486 - protein, 17 aa, Entamoeba dispar
IVAQRKKLPKSGKNNTL

SEQ ID NO: 2528487 - protein, 20 aa, Entamoeba dispar
IVCERIILPSSIKQILMYKV

SEQ ID NO: 2528488 - protein, 28 aa, Entamoeba dispar
IVCFHIDFYVRMFVLVKSSVALSGELPL

SEQ ID NO: 2528489 - protein, 18 aa, Entamoeba dispar
IVCPLKKVEFSPGHQFVA

SEQ ID NO: 2528490 - protein, 24 aa, Entamoeba dispar
IVCPSRVLDIKFSPANDVVAVGDM

SEQ ID NO: 2528491 - protein, 25 aa, Entamoeba dispar
IVDFDACSLYPSAVARLFLPSGVPR

SEQ ID NO: 2528492 - protein, 26 aa, Entamoeba dispar
IVDFDACSLYPSAVARLFLPSGVPRV

SEQ ID NO: 2528493 - protein, 17 aa, Entamoeba dispar
IVDFVKFDIGNTAMMIG

SEQ ID NO: 2528494 - protein, 31 aa, Entamoeba dispar
IVDGNLTLILGLLWTLILKYQIAQNKMDASK

SEQ ID NO: 2528495 - protein, 22 aa, Entamoeba dispar
IVDNLSLIPIKFSGIIRDLMAK

SEQ ID NO: 2528496 - protein, 18 aa, Entamoeba dispar
IVDPCHSFTLPKNQIING

SEQ ID NO: 2528497 - protein, 33 aa, Entamoeba dispar
IVDRIRGYPKTAPLMKYLVTLHVLFGELQNWQN

SEQ ID NO: 2528498 - protein, 27 aa, Entamoeba dispar
IVDTDIFKIINKYLIVLQQWTDMENFN

SEQ ID NO: 2528499 - protein, 25 aa, Entamoeba dispar
IVEATLQEAVLVMVGSSIGVLSTAT

SEQ ID NO: 2528500 - protein, 17 aa, Entamoeba dispar
IVEAYNFVRCQSSWKDT

SEQ ID NO: 2528501 - protein, 20 aa, Entamoeba dispar
IVEFCNLIVGTWKLNERTFN

SEQ ID NO: 2528502 - protein, 17 aa, Entamoeba dispar
IVEIVFVPSKHGGYKGI

SEQ ID NO: 2528503 - protein, 17 aa, Entamoeba dispar
IVELIMNSFRAAFIEDE

SEQ ID NO: 2528504 - protein, 24 aa, Entamoeba dispar
IVEPVSFLFVDTLTFNVINSKTQL

SEQ ID NO: 2528505 - protein, 25 aa, Entamoeba dispar
IVESFSFLHWYISDGSTVLNEMIPL

SEQ ID NO: 2528506 - protein, 26 aa, Entamoeba dispar
IVEWTNMRNYRILYRSSKDGLSARSL

SEQ ID NO: 2528507 - protein, 23 aa, Entamoeba dispar
IVEYSMRLLCRIIKGDEVLITNI

SEQ ID NO: 2528508 - protein, 25 aa, Entamoeba dispar
IVEYSMRLLCRIIKGDGVLITNIVD

SEQ ID NO: 2528509 - protein, 17 aa, Entamoeba dispar
IVFGNYYHDKCVHCYKC

SEQ ID NO: 2528510 - protein, 24 aa, Entamoeba dispar
IVFHKIKEQFGGKLKFIFNGGAPL

SEQ ID NO: 2528511 - protein, 25 aa, Entamoeba dispar
IVFNEIPYFALIPSSSQLSLSPESL

SEQ ID NO: 2528512 - protein, 19 aa, Entamoeba dispar
IVFNQRFDNKFSKYTLERV

SEQ ID NO: 2528513 - protein, 26 aa, Entamoeba dispar
IVFNSPLTFVNNLPLKLLITCVKNEN

SEQ ID NO: 2528514 - protein, 26 aa, Entamoeba dispar
IVGCIEIITFILIDYPHIYPNDVDVN

SEQ ID NO: 2528515 - protein, 18 aa, Entamoeba dispar
IVGDKMFIKYRPVDFNEN

SEQ ID NO: 2528516 - protein, 25 aa, Entamoeba dispar
IVGIIKRNWKPLPGYIKQESSGNYS

SEQ ID NO: 2528517 - protein, 20 aa, Entamoeba dispar
IVGKDTPFRFITDNELQKQL

SEQ ID NO: 2528518 - protein, 20 aa, Entamoeba dispar
IVGLTYWSPIEKSFTFISPY

SEQ ID NO: 2528519 - protein, 19 aa, Entamoeba dispar
IVGTRRKPRIVCPQCSFVY

SEQ ID NO: 2528520 - protein, 17 aa, Entamoeba dispar
IVGWYHSHPGFGCWLSS

SEQ ID NO: 2528521 - protein, 28 aa, Entamoeba dispar
IVHFKPKIIFKKQPMIRYLSDDIKFTFI

SEQ ID NO: 2528522 - protein, 17 aa, Entamoeba dispar
IVHLIDSGFIQECNLEV

SEQ ID NO: 2528523 - protein, 33 aa, Entamoeba dispar
IVHLPPSLAVIFQPFKQFYLEKFPSRRINIQPE

SEQ ID NO: 2528524 - protein, 28 aa, Entamoeba dispar
IVHNNLLKFFFIEYSIKERTFTFFSQHH

SEQ ID NO: 2528525 - protein, 17 aa, Entamoeba dispar
IVHPNFRLIGTRTIYKG

SEQ ID NO: 2528526 - protein, 28 aa, Entamoeba dispar
IVIFDTMLLSPIALLRGHSDWVFGSKFI

SEQ ID NO: 2528527 - protein, 17 aa, Entamoeba dispar
IVINFYIEFLQNELQQK

SEQ ID NO: 2528528 - protein, 18 aa, Entamoeba dispar
IVINPINYTLIITSTFNP

SEQ ID NO: 2528529 - protein, 24 aa, Entamoeba dispar
IVKAIGLPVLGWGCPDPYACVWDN

SEQ ID NO: 2528530 - protein, 21 aa, Entamoeba dispar
IVKALHITIIFEQQLYKRLYH

SEQ ID NO: 2528531 - protein, 20 aa, Entamoeba dispar
IVKATFNKYLVLPEDYDASI

SEQ ID NO: 2528532 - protein, 18 aa, Entamoeba dispar
IVKDLKIVFGIEDDLKCF

SEQ ID NO: 2528533 - protein, 31 aa, Entamoeba dispar
IVKFIRGVEILMFYSQPPPIYYAYNLVENIV

SEQ ID NO: 2528534 - protein, 34 aa, Entamoeba dispar
IVKIISDVFQFKDFWKHICIVWTKCYNYTPKNKL

SEQ ID NO: 2528535 - protein, 25 aa, Entamoeba dispar
IVKKIQIPYVFRYLAAELSAMNVRL

SEQ ID NO: 2528536 - protein, 27 aa, Entamoeba dispar
IVKKLELKYLFCSPISKGIELIEKNPS

SEQ ID NO: 2528537 - protein, 27 aa, Entamoeba dispar
IVKKTSLFRIYFFTNDKGNPFIRTLET

SEQ ID NO: 2528538 - protein, 28 aa, Entamoeba dispar
IVKKTSLFRIYFFTNDKRNPFIKTLEVL

SEQ ID NO: 2528539 - protein, 24 aa, Entamoeba dispar
IVKMYDHFMYCDHLCISFELLNQN

SEQ ID NO: 2528540 - protein, 20 aa, Entamoeba dispar
IVKNGGVVMNLFGTKRVNGQ

SEQ ID NO: 2528541 - protein, 23 aa, Entamoeba dispar
IVKNIDYIILFDEQGNRNEIEGE

SEQ ID NO: 2528542 - protein, 18 aa, Entamoeba dispar
IVLFDQFTHFLSKLVLFL

SEQ ID NO: 2528543 - protein, 20 aa, Entamoeba dispar
IVLITKCKIIKTKNGDNYFG

SEQ ID NO: 2528544 - protein, 26 aa, Entamoeba dispar
IVLKFRNIHFASFRSPLRKVHDICVI

SEQ ID NO: 2528545 - protein, 18 aa, Entamoeba dispar
IVLLMLDHCPQTFNLLFD

SEQ ID NO: 2528546 - protein, 17 aa, Entamoeba dispar
IVLLYNDLNKIRGIVIE

SEQ ID NO: 2528547 - protein, 19 aa, Entamoeba dispar
IVLNILDPNPFSLPTLAVF

SEQ ID NO: 2528548 - protein, 30 aa, Entamoeba dispar
IVLNILNSNPFFLQPMTPPALIRINQQEEE

SEQ ID NO: 2528549 - protein, 24 aa, Entamoeba dispar
IVLNYLKHYSVIAKFILINKKCWD

SEQ ID NO: 2528550 - protein, 20 aa, Entamoeba dispar
IVLSMNPFYHPDLPPVIELT

SEQ ID NO: 2528551 - protein, 29 aa, Entamoeba dispar
IVLSSLSCLFINCDILIKKITKKGCEIKQ

SEQ ID NO: 2528552 - protein, 18 aa, Entamoeba dispar
IVMDSFNFIIINILNHHI

SEQ ID NO: 2528553 - protein, 23 aa, Entamoeba dispar
IVMKDLFRKYPKKYLPVIAKLCD

SEQ ID NO: 2528554 - protein, 25 aa, Entamoeba dispar
IVNDHYHHSFFDQFLIPYESLNEEE

SEQ ID NO: 2528555 - protein, 18 aa, Entamoeba dispar
IVNFLVWSEQKYGKKVSV

SEQ ID NO: 2528556 - protein, 39 aa, Entamoeba dispar
IVNGEKTRFPYINVPKDDSGLTAYDILCLDDKELNQMLS

SEQ ID NO: 2528557 - protein, 31 aa, Entamoeba dispar
IVNIIRRSLMLLSRYPLPLFKDLEPEVEEMR

SEQ ID NO: 2528558 - protein, 24 aa, Entamoeba dispar
IVNIKFISKDRIFINEPALVSIQI

SEQ ID NO: 2528559 - protein, 29 aa, Entamoeba dispar
IVNIKFISKDRIFINEPVLVSIQIPENLH

SEQ ID NO: 2528560 - protein, 27 aa, Entamoeba dispar
IVNKVKPFLRQCGFSDIYSIPISGFSG

SEQ ID NO: 2528561 - protein, 22 aa, Entamoeba dispar
IVNRRWLFLGCSSLTSINIPTS

SEQ ID NO: 2528562 - protein, 20 aa, Entamoeba dispar
IVNSFYIQALMNPEKYGLCS

SEQ ID NO: 2528563 - protein, 19 aa, Entamoeba dispar
IVNWHPIQEDFFVSGGANG

SEQ ID NO: 2528564 - protein, 20 aa, Entamoeba dispar
IVPLNIWNFCFGDGLRVSRT

SEQ ID NO: 2528565 - protein, 17 aa, Entamoeba dispar
IVPPIKTNPTHKSEPTS

SEQ ID NO: 2528566 - protein, 19 aa, Entamoeba dispar
IVPPPPITTPTIPPPKDLT

SEQ ID NO: 2528567 - protein, 17 aa, Entamoeba dispar
IVPPQTFVQPIVPSKQT

SEQ ID NO: 2528568 - protein, 28 aa, Entamoeba dispar
IVPSQRPMILFEYYETFIVKSSVYKAFV

SEQ ID NO: 2528569 - protein, 19 aa, Entamoeba dispar
IVQELLIDLLKEKTIHLIG

SEQ ID NO: 2528570 - protein, 25 aa, Entamoeba dispar
IVQYWIPEIKKYRPELPLILCGSHY

SEQ ID NO: 2528571 - protein, 27 aa, Entamoeba dispar
IVRKYIPNAPFNLLSLKFNLGDIEDYV

SEQ ID NO: 2528572 - protein, 18 aa, Entamoeba dispar
IVRNEFVTVLLNGEKWSL

SEQ ID NO: 2528573 - protein, 27 aa, Entamoeba dispar
IVRQHFHYFILYRSTLCWIKDIYNNKL

SEQ ID NO: 2528574 - protein, 27 aa, Entamoeba dispar
IVRTTPRVISIHQKLLKEKKPRISSIV

SEQ ID NO: 2528575 - protein, 17 aa, Entamoeba dispar
IVRTYEMLRLAIEKQIR

SEQ ID NO: 2528576 - protein, 19 aa, Entamoeba dispar
IVSDEYEIWVLLMKQMNEH

SEQ ID NO: 2528577 - protein, 23 aa, Entamoeba dispar
IVSKNAYVLYYIRKDIDQQISIN

SEQ ID NO: 2528578 - protein, 19 aa, Entamoeba dispar
IVSLSSVRYLIFDEADRML

SEQ ID NO: 2528579 - protein, 25 aa, Entamoeba dispar
IVSMLKMTRSLLLRDRLIELIDSLL

SEQ ID NO: 2528580 - protein, 25 aa, Entamoeba dispar
IVSNCTEYLVRYRCLINRCNEISKN

SEQ ID NO: 2528581 - protein, 23 aa, Entamoeba dispar
IVSTIKFIPLHHGLLTIDKLNYS

SEQ ID NO: 2528582 - protein, 27 aa, Entamoeba dispar
IVTEELYLHPSIFQKYLVTPANKYVAA

SEQ ID NO: 2528583 - protein, 25 aa, Entamoeba dispar
IVTKTLAYILLKENIQFIPTNICFI

SEQ ID NO: 2528584 - protein, 18 aa, Entamoeba dispar
IVTLFTPKENKYSTALEI

SEQ ID NO: 2528585 - protein, 19 aa, Entamoeba dispar
IVTLKPNFVLPLQTDGEPF

SEQ ID NO: 2528586 - protein, 21 aa, Entamoeba dispar
IVTVRIYLNGKPLIKNEFNKN

SEQ ID NO: 2528587 - protein, 20 aa, Entamoeba dispar
IVTYDLYLCDVQKPSLLGMN

SEQ ID NO: 2528588 - protein, 18 aa, Entamoeba dispar
IVVKRLISAIGYLHSMNI

SEQ ID NO: 2528589 - protein, 30 aa, Entamoeba dispar
IVVRISFIYSQILILWEVKTNLFGWNNIIK

SEQ ID NO: 2528590 - protein, 20 aa, Entamoeba dispar
IVVSVGWRRYQTIATFSMED

SEQ ID NO: 2528591 - protein, 21 aa, Entamoeba dispar
IVVTQQWLSILQSLPEPFRFY

SEQ ID NO: 2528592 - protein, 17 aa, Entamoeba dispar
IVVYVIKQGNESEWFFS

SEQ ID NO: 2528593 - protein, 27 aa, Entamoeba dispar
IVWDNLDLILIGILLRKIESTKEIEKI

SEQ ID NO: 2528594 - protein, 19 aa, Entamoeba dispar
IVWKIMMSLPSFSGVMKKV

SEQ ID NO: 2528595 - protein, 17 aa, Entamoeba dispar
IVYDVNKLETFEKLNYW

SEQ ID NO: 2528596 - protein, 22 aa, Entamoeba dispar
IVYDYVIVLLKLYLSSSKLLPG

SEQ ID NO: 2528597 - protein, 23 aa, Entamoeba dispar
IWCCGVMLFYMSTGMFPFNQEGV

SEQ ID NO: 2528598 - protein, 18 aa, Entamoeba dispar
IWCFGPDNCGPNLFVDVT

SEQ ID NO: 2528599 - protein, 17 aa, Entamoeba dispar
IWIIQCCVLPRPTRWWY

SEQ ID NO: 2528600 - protein, 17 aa, Entamoeba dispar
IWNGVPVPLEDFTTPLP

SEQ ID NO: 2528601 - protein, 29 aa, Entamoeba dispar
IWQNRFNILIQFPDSIDLLLRAVPWTDYK

SEQ ID NO: 2528602 - protein, 17 aa, Entamoeba dispar
IWRVFHSPIIGTKKVER

SEQ ID NO: 2528603 - protein, 18 aa, Entamoeba dispar
IWSCGCVLAEMIIRNYPL

SEQ ID NO: 2528604 - protein, 22 aa, Entamoeba dispar
IWSIGVILVRMLTGKYPFYSKD

SEQ ID NO: 2528605 - protein, 19 aa, Entamoeba dispar
IWVDGCFDMFHWGHANVIR

SEQ ID NO: 2528606 - protein, 18 aa, Entamoeba dispar
IWVGKKTINGPIHLEWYY

SEQ ID NO: 2528607 - protein, 17 aa, Entamoeba dispar
IWVYVYDCPENEGRSGK

SEQ ID NO: 2528608 - protein, 19 aa, Entamoeba dispar
IYAEKMKFCLWKKLKDNKL

SEQ ID NO: 2528609 - protein, 18 aa, Entamoeba dispar
IYDAFPHCAMLRRHPPPD

SEQ ID NO: 2528610 - protein, 17 aa, Entamoeba dispar
IYDEHHFAFSFAHSGEL

SEQ ID NO: 2528611 - protein, 26 aa, Entamoeba dispar
IYDIFNTISFMIKYLHSVIMEHSEIF

SEQ ID NO: 2528612 - protein, 19 aa, Entamoeba dispar
IYDKATLISVKRYEKTKKD

SEQ ID NO: 2528613 - protein, 19 aa, Entamoeba dispar
IYDYELWKYLNKLNVDVTC

SEQ ID NO: 2528614 - protein, 28 aa, Entamoeba dispar
IYEDIFPLLSILYPRIETINTTYFILSM

SEQ ID NO: 2528615 - protein, 27 aa, Entamoeba dispar
IYEDQNLLTDLLISPLPTMVAGFVEIE

SEQ ID NO: 2528616 - protein, 23 aa, Entamoeba dispar
IYEPQIISEIIIFSMSLTMLPES

SEQ ID NO: 2528617 - protein, 18 aa, Entamoeba dispar
IYERLLSIEKKQVSIPKV

SEQ ID NO: 2528618 - protein, 24 aa, Entamoeba dispar
IYESTFVRAVKLISARIEGILDYL

SEQ ID NO: 2528619 - protein, 22 aa, Entamoeba dispar
IYFFEDGFRRVIPYYKEFKVNV

SEQ ID NO: 2528620 - protein, 19 aa, Entamoeba dispar
IYFGRKISSFILFPNQIIT

SEQ ID NO: 2528621 - protein, 17 aa, Entamoeba dispar
IYFIIENLLNYYQLNIN

SEQ ID NO: 2528622 - protein, 19 aa, Entamoeba dispar
IYGCSNARFGGCGSVMTVI

SEQ ID NO: 2528623 - protein, 24 aa, Entamoeba dispar
IYGQPVNIPINCSVIFVTKKGYNE

SEQ ID NO: 2528624 - protein, 18 aa, Entamoeba dispar
IYGQYQGYRCGCNFLATI

SEQ ID NO: 2528625 - protein, 18 aa, Entamoeba dispar
IYGRNEFILIPKQMRNRI

SEQ ID NO: 2528626 - protein, 18 aa, Entamoeba dispar
IYHCCLPKLLPSTSQIYF

SEQ ID NO: 2528627 - protein, 25 aa, Entamoeba dispar
IYHELNTMAIYMYSFRNRDSFYVGI

SEQ ID NO: 2528628 - protein, 17 aa, Entamoeba dispar
IYHNDCYIFDTGKQLIV

SEQ ID NO: 2528629 - protein, 38 aa, Entamoeba dispar
IYIEDTIYPIIPINIIFNKVLELILFKNLHLTTQTIES

SEQ ID NO: 2528630 - protein, 25 aa, Entamoeba dispar
IYIEEQFFISNYGGKRIWNLISLTI

SEQ ID NO: 2528631 - protein, 18 aa, Entamoeba dispar
IYIELTPFSEANGLLTPS

SEQ ID NO: 2528632 - protein, 30 aa, Entamoeba dispar
IYIENSELYCFDLCILCNKAILINSTEIYS

SEQ ID NO: 2528633 - protein, 20 aa, Entamoeba dispar
IYIKWNYKAEEFSLPITFTC

SEQ ID NO: 2528634 - protein, 29 aa, Entamoeba dispar
IYIPSVGIMFDLIPTALTLLESYSIDLIN

SEQ ID NO: 2528635 - protein, 25 aa, Entamoeba dispar
IYKDKFRPIIPKAPFQYFGKKYESL

SEQ ID NO: 2528636 - protein, 26 aa, Entamoeba dispar
IYKKEFVDEIIPIKTQEAWKMARIVV

SEQ ID NO: 2528637 - protein, 24 aa, Entamoeba dispar
IYKKKKVFFLIFIEEMNPIGFYVD

SEQ ID NO: 2528638 - protein, 21 aa, Entamoeba dispar
IYKKNEFIIQTTKMLIALLNS

SEQ ID NO: 2528639 - protein, 23 aa, Entamoeba dispar
IYKRLNIYKPWRATNEQMEMFHS

SEQ ID NO: 2528640 - protein, 19 aa, Entamoeba dispar
IYLPNCVQFIISEASIETC

SEQ ID NO: 2528641 - protein, 17 aa, Entamoeba dispar
IYMHEYFKQFFTEYSTD

SEQ ID NO: 2528642 - protein, 27 aa, Entamoeba dispar
IYNDGRIFKYVIWYTVSYSTYLQEKEQ

SEQ ID NO: 2528643 - protein, 26 aa, Entamoeba dispar
IYNDTIGKEYFIFTGSTVVKVERVIA

SEQ ID NO: 2528644 - protein, 32 aa, Entamoeba dispar
IYNEIINLTFYINTIRYRNSLLIGIQKPSLTI

SEQ ID NO: 2528645 - protein, 23 aa, Entamoeba dispar
IYNFIDESLRLKIKYALKLSTGK

SEQ ID NO: 2528646 - protein, 17 aa, Entamoeba dispar
IYNFIVQGTFEGQLRKT

SEQ ID NO: 2528647 - protein, 23 aa, Entamoeba dispar
IYNSKMGGYPYFPKGMEYPKDEN

SEQ ID NO: 2528648 - protein, 20 aa, Entamoeba dispar
IYNVETLLKLISLQGIANDI

SEQ ID NO: 2528649 - protein, 21 aa, Entamoeba dispar
IYNVFITFKKNIKNKSKLVKK

SEQ ID NO: 2528650 - protein, 17 aa, Entamoeba dispar
IYPHFLGQDILRLQGIF

SEQ ID NO: 2528651 - protein, 18 aa, Entamoeba dispar
IYPMLMKNYRHDLFVLLY

SEQ ID NO: 2528652 - protein, 24 aa, Entamoeba dispar
IYPMLMKNYRHDLFVLLYCGDLKE

SEQ ID NO: 2528653 - protein, 19 aa, Entamoeba dispar
IYPQYFFTTFGILNQQFAD

SEQ ID NO: 2528654 - protein, 21 aa, Entamoeba dispar
IYPVLMMFRSELTLPSMSMIH

SEQ ID NO: 2528655 - protein, 22 aa, Entamoeba dispar
IYQFESIILIKKSGVFKIRIKK

SEQ ID NO: 2528656 - protein, 18 aa, Entamoeba dispar
IYQLNKSAVYYEMKQWRF

SEQ ID NO: 2528657 - protein, 22 aa, Entamoeba dispar
IYQRALKYFSRDLSLWDALSQE

SEQ ID NO: 2528658 - protein, 23 aa, Entamoeba dispar
IYQRALKYFSRDLSLWDALSQEI

SEQ ID NO: 2528659 - protein, 23 aa, Entamoeba dispar
IYSGYFFHVEFVGEALKSLSTPF

SEQ ID NO: 2528660 - protein, 17 aa, Entamoeba dispar
IYSNLNKMLITNTAIVI

SEQ ID NO: 2528661 - protein, 26 aa, Entamoeba dispar
IYSPVKSLFIHHFMLGLIAVCEKKTD

SEQ ID NO: 2528662 - protein, 27 aa, Entamoeba dispar
IYTFQNLELLRLDYCSNLNISLISNKL

SEQ ID NO: 2528663 - protein, 27 aa, Entamoeba dispar
IYTFQNLELLRLNYCSNLNVSLISNKL

SEQ ID NO: 2528664 - protein, 18 aa, Entamoeba dispar
IYVDGCYDMFHWGHANVI

SEQ ID NO: 2528665 - protein, 20 aa, Entamoeba dispar
IYVGYRYYTTFNQKCSYPFG

SEQ ID NO: 2528666 - protein, 18 aa, Entamoeba dispar
IYWDGTCCTLVRSHLQKS

SEQ ID NO: 2528667 - protein, 17 aa, Entamoeba dispar
IYYFSDLYEKCSDIWPK

SEQ ID NO: 2528668 - protein, 24 aa, Entamoeba dispar
KAAEYQLPYHIAKKKVPFINEQGV

SEQ ID NO: 2528669 - protein, 24 aa, Entamoeba dispar
KAAKRYIKRASKKILKIKRQTKKS

SEQ ID NO: 2528670 - protein, 25 aa, Entamoeba dispar
KADIKLFAKIFRFDLNEEYNELCSK

SEQ ID NO: 2528671 - protein, 24 aa, Entamoeba dispar
KADKDDWFKIFEIAYEKAVERKKV

SEQ ID NO: 2528672 - protein, 18 aa, Entamoeba dispar
KADQHVFLALSFAGKSNP

SEQ ID NO: 2528673 - protein, 24 aa, Entamoeba dispar
KADRKYVVMIFNDSIIIIKEQQEE

SEQ ID NO: 2528674 - protein, 25 aa, Entamoeba dispar
KAELKPKIFVIPLGTGNDLSHCTGW

SEQ ID NO: 2528675 - protein, 24 aa, Entamoeba dispar
KAEMVLIGLFLHFLLSGVSHPKPK

SEQ ID NO: 2528676 - protein, 30 aa, Entamoeba dispar
KAEVDVTIWRPPQVLIFQLKRFEFTEKYEQ

SEQ ID NO: 2528677 - protein, 18 aa, Entamoeba dispar
KAFKRKHDLKKHITFHVK

SEQ ID NO: 2528678 - protein, 18 aa, Entamoeba dispar
KAFLTQFVLEFQGKFDEV

SEQ ID NO: 2528679 - protein, 24 aa, Entamoeba dispar
KAFRYRIVLSTLLGQTIRITSIRE

SEQ ID NO: 2528680 - protein, 18 aa, Entamoeba dispar
KAFSRFHQCLNSHQFKNF

SEQ ID NO: 2528681 - protein, 32 aa, Entamoeba dispar
KAFVSKKRPIKNEQLLQLIFKSIDADGNGEID

SEQ ID NO: 2528682 - protein, 36 aa, Entamoeba dispar
KAGFKYRIQTEKPLFPLFLCDAGLIIISRFPIVESQ

SEQ ID NO: 2528683 - protein, 35 aa, Entamoeba dispar
KAGFKYRIQTEKPLFPLFLCDAGLVIISRFPIVEN

SEQ ID NO: 2528684 - protein, 28 aa, Entamoeba dispar
KAGFVRYNWIYPFLTKESFYKFGRDVCE

SEQ ID NO: 2528685 - protein, 21 aa, Entamoeba dispar
KAGKWDVPLPKVKPIAESEVF

SEQ ID NO: 2528686 - protein, 24 aa, Entamoeba dispar
KAGRIVMELFNDIVPKTAENFRCL

SEQ ID NO: 2528687 - protein, 19 aa, Entamoeba dispar
KAHILFNGPIPTPKTFNEI

SEQ ID NO: 2528688 - protein, 18 aa, Entamoeba dispar
KAHLSNYPIIPNFEQLYN

SEQ ID NO: 2528689 - protein, 22 aa, Entamoeba dispar
KAHPFFKGFDFNCIEKNIPPYL

SEQ ID NO: 2528690 - protein, 21 aa, Entamoeba dispar
KAHPQVFNVLLQLLDEGRLTD

SEQ ID NO: 2528691 - protein, 25 aa, Entamoeba dispar
KAHPQVFNVLLQLLDEGRLTDGRGR

SEQ ID NO: 2528692 - protein, 29 aa, Entamoeba dispar
KAHPWLHDIHWDNLFAKKILPDYIPQLSS

SEQ ID NO: 2528693 - protein, 20 aa, Entamoeba dispar
KAHYFTSWQALCPGFSTITE

SEQ ID NO: 2528694 - protein, 25 aa, Entamoeba dispar
KAIDPKMVIVWKPNLLYMTEDGVLE

SEQ ID NO: 2528695 - protein, 20 aa, Entamoeba dispar
KAINEWILKSLIKNIQKKRE

SEQ ID NO: 2528696 - protein, 20 aa, Entamoeba dispar
KAIPIRIFDSIFMPSRRHFL

SEQ ID NO: 2528697 - protein, 20 aa, Entamoeba dispar
KAIQLISLIFSLYSNKTYAT

SEQ ID NO: 2528698 - protein, 25 aa, Entamoeba dispar
KAKAFAIAVEWYRALRSICWSSIQS

SEQ ID NO: 2528699 - protein, 23 aa, Entamoeba dispar
KAKELLLLAKAMKELKMEYRSVL

SEQ ID NO: 2528700 - protein, 24 aa, Entamoeba dispar
KAKKQVLIDLKKLTPELRAVLKAA

SEQ ID NO: 2528701 - protein, 18 aa, Entamoeba dispar
KAKLFITNIHRFTKPIYC

SEQ ID NO: 2528702 - protein, 24 aa, Entamoeba dispar
KAKLPIVLTPQHHLLFVIQEVLLT

SEQ ID NO: 2528703 - protein, 25 aa, Entamoeba dispar
KAKQVPEILILQEPSYPLISCKEKI

SEQ ID NO: 2528704 - protein, 26 aa, Entamoeba dispar
KAKTCQLAFDVYIKQLAKTIGGLMVE

SEQ ID NO: 2528705 - protein, 23 aa, Entamoeba dispar
KAKTIVYGCIYGIGPFSLADQLH

SEQ ID NO: 2528706 - protein, 20 aa, Entamoeba dispar
KALCRKYLKNPFEVFIDDGE

SEQ ID NO: 2528707 - protein, 22 aa, Entamoeba dispar
KALDRTQVFGQYIRIDWDYGFV

SEQ ID NO: 2528708 - protein, 23 aa, Entamoeba dispar
KALEIIHRIMLDGPQQACTTKTF

SEQ ID NO: 2528709 - protein, 20 aa, Entamoeba dispar
KALHLINGNIRIVVSPTLIL

SEQ ID NO: 2528710 - protein, 18 aa, Entamoeba dispar
KALPHLIYIKTGNVKKDI

SEQ ID NO: 2528711 - protein, 23 aa, Entamoeba dispar
KALQRIVFTYLYPRLDINVSMKR

SEQ ID NO: 2528712 - protein, 20 aa, Entamoeba dispar
KAMELSILCDCKVSLMVFKD

SEQ ID NO: 2528713 - protein, 17 aa, Entamoeba dispar
KAMHGFVTMNFAPAQKV

SEQ ID NO: 2528714 - protein, 21 aa, Entamoeba dispar
KANIIAWEYPGYTKGSHYSDE

SEQ ID NO: 2528715 - protein, 26 aa, Entamoeba dispar
KANISYLDIIHLYSSFNKTQEPTVIE

SEQ ID NO: 2528716 - protein, 24 aa, Entamoeba dispar
KAPELLLHIHYYTPSIDIWSCGCV

SEQ ID NO: 2528717 - protein, 26 aa, Entamoeba dispar
KAPPIKLPKKFILNVPKRTDANILKN

SEQ ID NO: 2528718 - protein, 24 aa, Entamoeba dispar
KAPPNIHLFLYPELPETNFLPSYF

SEQ ID NO: 2528719 - protein, 25 aa, Entamoeba dispar
KAQGRLDSFFSVKKVPLSKSEAASG

SEQ ID NO: 2528720 - protein, 21 aa, Entamoeba dispar
KAQMILLEFINRSDTYLKVPG

SEQ ID NO: 2528721 - protein, 24 aa, Entamoeba dispar
KAQYQFYLGWYDGNPAHLNELTPI

SEQ ID NO: 2528722 - protein, 28 aa, Entamoeba dispar
KATLIKRRVVIALKYFCSDALDECNQGL

SEQ ID NO: 2528723 - protein, 20 aa, Entamoeba dispar
KATLKFLRPCEIEALKYTCE

SEQ ID NO: 2528724 - protein, 26 aa, Entamoeba dispar
KATMHHICLLRGKLVKYRKMLAPIKF

SEQ ID NO: 2528725 - protein, 26 aa, Entamoeba dispar
KATSKIFNLLINKRGVHQKPVDVKLK

SEQ ID NO: 2528726 - protein, 37 aa, Entamoeba dispar
KAVAGLVLFNQYWYWYPFTLCLSLSFIPTTIIGVTED

SEQ ID NO: 2528727 - protein, 24 aa, Entamoeba dispar
KAVLDQFVVTQIELSTIIADVSQH

SEQ ID NO: 2528728 - protein, 26 aa, Entamoeba dispar
KAVLMAGFSLIRLLDEPSAAAYAYGL

SEQ ID NO: 2528729 - protein, 24 aa, Entamoeba dispar
KAVNDLFSKLSFPKKFKPSKDIQR

SEQ ID NO: 2528730 - protein, 21 aa, Entamoeba dispar
KAYFSDLDTHKIKFAYDGASS

SEQ ID NO: 2528731 - protein, 23 aa, Entamoeba dispar
KAYLRSMVEPLIPYKYFEYYAQL

SEQ ID NO: 2528732 - protein, 19 aa, Entamoeba dispar
KAYPLFGIKNFRSTCFANS

SEQ ID NO: 2528733 - protein, 24 aa, Entamoeba dispar
KAYSDIVYLISFFDEKRQIQQGLA

SEQ ID NO: 2528734 - protein, 18 aa, Entamoeba dispar
KCCCFYVSLNHQQLPMKV

SEQ ID NO: 2528735 - protein, 20 aa, Entamoeba dispar
KCCFRYCRSLQSINIPSSIN

SEQ ID NO: 2528736 - protein, 18 aa, Entamoeba dispar
KCCIPLQGICRQTIVKYG

SEQ ID NO: 2528737 - protein, 19 aa, Entamoeba dispar
KCCIYYNIVENLSILSHSK

SEQ ID NO: 2528738 - protein, 32 aa, Entamoeba dispar
KCCLKEELCIVPLRKQLNWKALNNPQMKRVIE

SEQ ID NO: 2528739 - protein, 25 aa, Entamoeba dispar
KCDLWSLGGLLYFLRTHTYPLSANR

SEQ ID NO: 2528740 - protein, 19 aa, Entamoeba dispar
KCFGLGIGPIIWMKGELAS

SEQ ID NO: 2528741 - protein, 18 aa, Entamoeba dispar
KCFLQQLALKLLCNVVYG

SEQ ID NO: 2528742 - protein, 17 aa, Entamoeba dispar
KCGEAFVPIVICLSFRR

SEQ ID NO: 2528743 - protein, 37 aa, Entamoeba dispar
KCGIELLEFILDPLSTHFLPPSIIDPLKEKGSFTLKD

SEQ ID NO: 2528744 - protein, 17 aa, Entamoeba dispar
KCGQVGHKSIDCPENTD

SEQ ID NO: 2528745 - protein, 21 aa, Entamoeba dispar
KCGRCFKFCPYGAIIHKSIPC

SEQ ID NO: 2528746 - protein, 23 aa, Entamoeba dispar
KCGRILLKVIGDQTYLSCPNCSL

SEQ ID NO: 2528747 - protein, 26 aa, Entamoeba dispar
KCHQTCHYPCHYLSLVSKFTMKYCHC

SEQ ID NO: 2528748 - protein, 17 aa, Entamoeba dispar
KCIDLFDSNDYPIHVVF

SEQ ID NO: 2528749 - protein, 23 aa, Entamoeba dispar
KCILQAIIFSRLVEKFPTLLEEV

SEQ ID NO: 2528750 - protein, 25 aa, Entamoeba dispar
KCISDLKHFIFTVKLNQPDTIKQYY

SEQ ID NO: 2528751 - protein, 23 aa, Entamoeba dispar
KCKGCVDGYYKNEESCIKCADHC

SEQ ID NO: 2528752 - protein, 25 aa, Entamoeba dispar
KCKKTCHYPCHVPSLVSFFTIRACH

SEQ ID NO: 2528753 - protein, 25 aa, Entamoeba dispar
KCKPFPMDPIIPYSGAIVAKEIDAV

SEQ ID NO: 2528754 - protein, 17 aa, Entamoeba dispar
KCKRTCHYPCHVPSLIS

SEQ ID NO: 2528755 - protein, 17 aa, Entamoeba dispar
KCKVETLPRRPTQSIPN

SEQ ID NO: 2528756 - protein, 20 aa, Entamoeba dispar
KCKYKLQKCLKRCKHFELGN

SEQ ID NO: 2528757 - protein, 20 aa, Entamoeba dispar
KCLKAIIISNPNLIGFCVDY

SEQ ID NO: 2528758 - protein, 21 aa, Entamoeba dispar
KCLPKQYIKVRTISKYSYLKP

SEQ ID NO: 2528759 - protein, 25 aa, Entamoeba dispar
KCLQFLVHPRPVSSLMFHPTEHLLA

SEQ ID NO: 2528760 - protein, 18 aa, Entamoeba dispar
KCLQIIKQLQKYHLFHEL

SEQ ID NO: 2528761 - protein, 17 aa, Entamoeba dispar
KCLRYRFIKGMTETFYH

SEQ ID NO: 2528762 - protein, 17 aa, Entamoeba dispar
KCLTLAKAINQLIRDRN

SEQ ID NO: 2528763 - protein, 20 aa, Entamoeba dispar
KCMGELPGPYIKYFVQSIGP

SEQ ID NO: 2528764 - protein, 28 aa, Entamoeba dispar
KCNEDMILWGLFSLANAIHFLNITAKLG

SEQ ID NO: 2528765 - protein, 24 aa, Entamoeba dispar
KCNEYCIMIDNLCQFLPQDRVSAF

SEQ ID NO: 2528766 - protein, 20 aa, Entamoeba dispar
KCNRTCHYPCYIKGDMKKNC

SEQ ID NO: 2528767 - protein, 24 aa, Entamoeba dispar
KCNRYPLLPLGLYDNPGMEPVRLY

SEQ ID NO: 2528768 - protein, 26 aa, Entamoeba dispar
KCNYYPPPLYRIPPPNIPPNGYLPIP

SEQ ID NO: 2528769 - protein, 19 aa, Entamoeba dispar
KCQIELFSVDHPFIPLWVN

SEQ ID NO: 2528770 - protein, 17 aa, Entamoeba dispar
KCQPTFFIAVPRVLQKI

SEQ ID NO: 2528771 - protein, 17 aa, Entamoeba dispar
KCRLVCKIWKDYLKTLP

SEQ ID NO: 2528772 - protein, 28 aa, Entamoeba dispar
KCSMTPKYLLLFYMKFMHLIGNICNIQK

SEQ ID NO: 2528773 - protein, 23 aa, Entamoeba dispar
KCSRKEWELLKMLANKVIMKMVD

SEQ ID NO: 2528774 - protein, 18 aa, Entamoeba dispar
KCTKQILCIVLQMVYNNV

SEQ ID NO: 2528775 - protein, 24 aa, Entamoeba dispar
KCTSLQQLFFYPKSNSFAITQFNN

SEQ ID NO: 2528776 - protein, 18 aa, Entamoeba dispar
KCVFKIGFFLSEMKLRCH

SEQ ID NO: 2528777 - protein, 27 aa, Entamoeba dispar
KCVLKTYLLLIKLLPHSQEQLLKIYEN

SEQ ID NO: 2528778 - protein, 20 aa, Entamoeba dispar
KCVNAFILSHNELTIKEICT

SEQ ID NO: 2528779 - protein, 19 aa, Entamoeba dispar
KCYMLGYIPPQYKNGHIFK

SEQ ID NO: 2528780 - protein, 22 aa, Entamoeba dispar
KDAFVFLHPFNSHFIDQNIFSM

SEQ ID NO: 2528781 - protein, 23 aa, Entamoeba dispar
KDALNLLRGSYGTIFENFKKVYD

SEQ ID NO: 2528782 - protein, 33 aa, Entamoeba dispar
KDCIFSTIISYIDEPWYLKFNNSAIYDDDIKDG

SEQ ID NO: 2528783 - protein, 22 aa, Entamoeba dispar
KDCKTLTRINIPTSVSLIGNEC

SEQ ID NO: 2528784 - protein, 23 aa, Entamoeba dispar
KDCTTLTSITIPPSIRKIGNRCF

SEQ ID NO: 2528785 - protein, 33 aa, Entamoeba dispar
KDDDAPIVYGFRPYMKEFIRKIDQMENQMFTII

SEQ ID NO: 2528786 - protein, 26 aa, Entamoeba dispar
KDDEDWFRPILNHPNLYFINVDQNGS

SEQ ID NO: 2528787 - protein, 21 aa, Entamoeba dispar
KDDFFSKIIAQQQKERKEIQA

SEQ ID NO: 2528788 - protein, 23 aa, Entamoeba dispar
KDDGRIFAMKILRKDIVKERKQV

SEQ ID NO: 2528789 - protein, 25 aa, Entamoeba dispar
KDDQSHLNWLNKFISSTQLQHKQKE

SEQ ID NO: 2528790 - protein, 22 aa, Entamoeba dispar
KDDTIFISFSKYLDYLVIIHNQ

SEQ ID NO: 2528791 - protein, 25 aa, Entamoeba dispar
KDEDTSFFILNLSNPLKKGKSIYEC

SEQ ID NO: 2528792 - protein, 24 aa, Entamoeba dispar
KDEFHPFFLTEKYTISYISYLYKN

SEQ ID NO: 2528793 - protein, 27 aa, Entamoeba dispar
KDEILSIPDFLWITKQKCWIEVDDFCA

SEQ ID NO: 2528794 - protein, 28 aa, Entamoeba dispar
KDEITMKLQIALIYYKKEEIEKYRFNKL

SEQ ID NO: 2528795 - protein, 30 aa, Entamoeba dispar
KDEIYNCVFKWIHFFVMKDVKIVRRKEKEE

SEQ ID NO: 2528796 - protein, 24 aa, Entamoeba dispar
KDEKIKWMQLFTDIDGIVVTESQS

SEQ ID NO: 2528797 - protein, 25 aa, Entamoeba dispar
KDEKKLFQPLLWKPKNEKYSKKKYN

SEQ ID NO: 2528798 - protein, 25 aa, Entamoeba dispar
KDERLLDELWMFCFPNGMKASQQKR

SEQ ID NO: 2528799 - protein, 21 aa, Entamoeba dispar
KDFIRSFLVIDPNKRLKAVDC

SEQ ID NO: 2528800 - protein, 18 aa, Entamoeba dispar
KDFITIGMKWALVCRPKE

SEQ ID NO: 2528801 - protein, 27 aa, Entamoeba dispar
KDFKIILHDIRMFNKPLMIFEKHMKDV

SEQ ID NO: 2528802 - protein, 28 aa, Entamoeba dispar
KDFSYLSGLIRILADRYPSFLPKFIESS

SEQ ID NO: 2528803 - protein, 20 aa, Entamoeba dispar
KDFTIFVHKTKPKKFELKGE

SEQ ID NO: 2528804 - protein, 28 aa, Entamoeba dispar
KDGDKKIIRIIFEKMRKYKSGILEMKIG

SEQ ID NO: 2528805 - protein, 25 aa, Entamoeba dispar
KDGFILDKWLIEQRKLRGSVFGKEI

SEQ ID NO: 2528806 - protein, 26 aa, Entamoeba dispar
KDGIRVINFFELLSGKTLKEKYDLRP

SEQ ID NO: 2528807 - protein, 23 aa, Entamoeba dispar
KDGKIFKKVIWYQVYYSTYLQEK

SEQ ID NO: 2528808 - protein, 25 aa, Entamoeba dispar
KDGKIFKKVVWYLVDYSKYLKEKEE

SEQ ID NO: 2528809 - protein, 24 aa, Entamoeba dispar
KDGKLFTKIVFPSHFGLKRLVVLT

SEQ ID NO: 2528810 - protein, 18 aa, Entamoeba dispar
KDGKVFCALIHRHRPDLL

SEQ ID NO: 2528811 - protein, 26 aa, Entamoeba dispar
KDGRIFKHIIWCIVEYSTYLQEKEKG

SEQ ID NO: 2528812 - protein, 25 aa, Entamoeba dispar
KDGRIFKQVIWYKVYYSTYLKEKKQ

SEQ ID NO: 2528813 - protein, 27 aa, Entamoeba dispar
KDGRIFKQVIWYPVNYSKYLKKKEKWS

SEQ ID NO: 2528814 - protein, 25 aa, Entamoeba dispar
KDGRIFKYVIWYLVNYSEYLQEKEQ

SEQ ID NO: 2528815 - protein, 24 aa, Entamoeba dispar
KDGRIIKYVTWYTIEYSTYLQEKE

SEQ ID NO: 2528816 - protein, 24 aa, Entamoeba dispar
KDGRLFKYVIWYDISYSLYLKEKE

SEQ ID NO: 2528817 - protein, 25 aa, Entamoeba dispar
KDGTKYEYIILKKTLHPKDEQTEPL

SEQ ID NO: 2528818 - protein, 25 aa, Entamoeba dispar
KDGYHPYRVILCRVVLGREGRDYVV

SEQ ID NO: 2528819 - protein, 21 aa, Entamoeba dispar
KDHFNKKYIIGFIGFNNLGRT

SEQ ID NO: 2528820 - protein, 25 aa, Entamoeba dispar
KDHQPIVFKFFFKDDVKLGNVIIVC

SEQ ID NO: 2528821 - protein, 24 aa, Entamoeba dispar
KDHTIIFDCPFYIKNSTLLPLVVN

SEQ ID NO: 2528822 - protein, 27 aa, Entamoeba dispar
KDIEDDKLFEIALEKGLQMINGININE

SEQ ID NO: 2528823 - protein, 23 aa, Entamoeba dispar
KDIEIMEFLYPKRRKRTLLICEK

SEQ ID NO: 2528824 - protein, 24 aa, Entamoeba dispar
KDIHFLVSVVYTLPRLDLDSIKSK

SEQ ID NO: 2528825 - protein, 21 aa, Entamoeba dispar
KDIIILLSQFIGVSGKIESIG

SEQ ID NO: 2528826 - protein, 42 aa, Entamoeba dispar
KDIIIPCFSFVRDIIHAPIIKHFFIILGYPNQPYQSVYVSST

SEQ ID NO: 2528827 - protein, 18 aa, Entamoeba dispar
KDIKMFKFVYAKVGITYP

SEQ ID NO: 2528828 - protein, 20 aa, Entamoeba dispar
KDIKSVFTAVFRLLDIKDQG

SEQ ID NO: 2528829 - protein, 27 aa, Entamoeba dispar
KDIKYQPLIVLLFQLLLEDLNSTKVKQ

SEQ ID NO: 2528830 - protein, 26 aa, Entamoeba dispar
KDILPIAQLMRTLYLFQQTEKNPFKE

SEQ ID NO: 2528831 - protein, 20 aa, Entamoeba dispar
KDINEFIIPSSITKLGDHCF

SEQ ID NO: 2528832 - protein, 22 aa, Entamoeba dispar
KDINEFIIPSSITKLGYRCFNG

SEQ ID NO: 2528833 - protein, 25 aa, Entamoeba dispar
KDINKFIIPSSITKLGFCCFKECST

SEQ ID NO: 2528834 - protein, 18 aa, Entamoeba dispar
KDITGYIEYGVFWPDDNG

SEQ ID NO: 2528835 - protein, 26 aa, Entamoeba dispar
KDIYLFIKNHWNILGKIKLFQKPNWK

SEQ ID NO: 2528836 - protein, 22 aa, Entamoeba dispar
KDKDCIFLEDDPSHFIFSLSNS

SEQ ID NO: 2528837 - protein, 19 aa, Entamoeba dispar
KDKGKSLTFKQMKELYITR

SEQ ID NO: 2528838 - protein, 19 aa, Entamoeba dispar
KDKIKFILSSKTKVYEASS

SEQ ID NO: 2528839 - protein, 24 aa, Entamoeba dispar
KDKKDLLALCTKIKKAQEKFEKLG

SEQ ID NO: 2528840 - protein, 28 aa, Entamoeba dispar
KDKKKKTYLLNIWKSTYSINFSKFIQIN

SEQ ID NO: 2528841 - protein, 23 aa, Entamoeba dispar
KDKKNIMFVITSTSGNVFGSFHS

SEQ ID NO: 2528842 - protein, 33 aa, Entamoeba dispar
KDKQIHVDKEFKKWLEQQNISMYGEGWAAKFKE

SEQ ID NO: 2528843 - protein, 29 aa, Entamoeba dispar
KDKSPIPIRLPYSMAIKLFPLPTELHNEQ

SEQ ID NO: 2528844 - protein, 21 aa, Entamoeba dispar
KDKTDNFFIHTLPFQEETKSQ

SEQ ID NO: 2528845 - protein, 24 aa, Entamoeba dispar
KDKTKIMFDLLFSYVSSIDQQSIP

SEQ ID NO: 2528846 - protein, 38 aa, Entamoeba dispar
KDKYNESDWVLMFYNPSVPLEQWMVKDLLETIDVRARG

SEQ ID NO: 2528847 - protein, 22 aa, Entamoeba dispar
KDLEYIIIPINVEKHWTLLIYC

SEQ ID NO: 2528848 - protein, 18 aa, Entamoeba dispar
KDLILHLITHHEYQRLSW

SEQ ID NO: 2528849 - protein, 22 aa, Entamoeba dispar
KDLINDFWKRLTGRQIDETWFI

SEQ ID NO: 2528850 - protein, 33 aa, Entamoeba dispar
KDLIPIIKSFSIPTSFFIYLSNKLPIEKAYRLI

SEQ ID NO: 2528851 - protein, 23 aa, Entamoeba dispar
KDLKGQFECYWTYLLNALDFVLH

SEQ ID NO: 2528852 - protein, 19 aa, Entamoeba dispar
KDLLPRMQVEWRNVVQFVT

SEQ ID NO: 2528853 - protein, 24 aa, Entamoeba dispar
KDLMVVNEYLFAPKILCVELAHLD

SEQ ID NO: 2528854 - protein, 26 aa, Entamoeba dispar
KDLNDFFIDMFMLKDICDDFVELFRK

SEQ ID NO: 2528855 - protein, 25 aa, Entamoeba dispar
KDLNDNPRRWYFDLRPEHEDYVDCI

SEQ ID NO: 2528856 - protein, 20 aa, Entamoeba dispar
KDLPPVKPWQDTTVTDALVS

SEQ ID NO: 2528857 - protein, 24 aa, Entamoeba dispar
KDLQDGIILSRYLQIETGKVIPNI

SEQ ID NO: 2528858 - protein, 24 aa, Entamoeba dispar
KDLTKIDLSSFLSPPIIMGIITAS

SEQ ID NO: 2528859 - protein, 24 aa, Entamoeba dispar
KDLWSVSIFFFSSIAKKCTTYFEK

SEQ ID NO: 2528860 - protein, 17 aa, Entamoeba dispar
KDMERYELVNKFMIKCF

SEQ ID NO: 2528861 - protein, 23 aa, Entamoeba dispar
KDMFKKLVICILVTIKDGVCKQK

SEQ ID NO: 2528862 - protein, 21 aa, Entamoeba dispar
KDMHKLIIPKHIKRLGKFSFK

SEQ ID NO: 2528863 - protein, 20 aa, Entamoeba dispar
KDMHYYISLYANPLQKHIKT

SEQ ID NO: 2528864 - protein, 35 aa, Entamoeba dispar
KDMKFIEILKEKNNLLRLLVHSLCPPIYGHYIVKT

SEQ ID NO: 2528865 - protein, 20 aa, Entamoeba dispar
KDMLILYNDSMRRLVLGKEL

SEQ ID NO: 2528866 - protein, 24 aa, Entamoeba dispar
KDMYLSQWFSLMTLLSSIANASKS

SEQ ID NO: 2528867 - protein, 18 aa, Entamoeba dispar
KDNELIGCMFPQPFHTER

SEQ ID NO: 2528868 - protein, 24 aa, Entamoeba dispar
KDNFQEQLIALRLLHTIISLQIEQ

SEQ ID NO: 2528869 - protein, 22 aa, Entamoeba dispar
KDNKIIGLLPNASLLYHTLDYK

SEQ ID NO: 2528870 - protein, 17 aa, Entamoeba dispar
KDNLWLNLIDGSVYCGR

SEQ ID NO: 2528871 - protein, 24 aa, Entamoeba dispar
KDNQLIVWNVYEKTIKKLKLPNTV

SEQ ID NO: 2528872 - protein, 21 aa, Entamoeba dispar
KDNTIWMVDPFMMRVVKKYFN

SEQ ID NO: 2528873 - protein, 20 aa, Entamoeba dispar
KDNVLIMWDMQSLKPMKTIP

SEQ ID NO: 2528874 - protein, 21 aa, Entamoeba dispar
KDPKPLFFENPITPLNSCLSQ

SEQ ID NO: 2528875 - protein, 19 aa, Entamoeba dispar
KDPLILKAFGLFREVVLSN

SEQ ID NO: 2528876 - protein, 24 aa, Entamoeba dispar
KDPRQIDFSLINPGSIALTTKNGK

SEQ ID NO: 2528877 - protein, 32 aa, Entamoeba dispar
KDQEINLRLPLKDLLVFFESALIQTESRVDIY

SEQ ID NO: 2528878 - protein, 22 aa, Entamoeba dispar
KDQKKLWIQLAIKLNYEERDDI

SEQ ID NO: 2528879 - protein, 31 aa, Entamoeba dispar
KDQLQKEIQLLYRTKLDVNEAAKWFEQTWSD

SEQ ID NO: 2528880 - protein, 25 aa, Entamoeba dispar
KDRDELPLYLIWLEENANAQTLKFK

SEQ ID NO: 2528881 - protein, 23 aa, Entamoeba dispar
KDRNNIIPILTSFKQKRDTSKRD

SEQ ID NO: 2528882 - protein, 25 aa, Entamoeba dispar
KDSDGIILFFDTTIGPSFVDLEEYY

SEQ ID NO: 2528883 - protein, 27 aa, Entamoeba dispar
KDSEFNVYFFLNVIIENGFTIVPKDGQ

SEQ ID NO: 2528884 - protein, 21 aa, Entamoeba dispar
KDSFNVIAPIRMKKVAEMISK

SEQ ID NO: 2528885 - protein, 22 aa, Entamoeba dispar
KDSHNLICQLFLRVNGKFNVSN

SEQ ID NO: 2528886 - protein, 21 aa, Entamoeba dispar
KDSLLRDWSLFYLRCIHHMSV

SEQ ID NO: 2528887 - protein, 22 aa, Entamoeba dispar
KDSRFITTLLSIPGINPYAPDN

SEQ ID NO: 2528888 - protein, 24 aa, Entamoeba dispar
KDSSSLISRLFRITEGIAGSSGDD

SEQ ID NO: 2528889 - protein, 28 aa, Entamoeba dispar
KDSVFPDSLLLLFYYSLCYVFEKEVKNS

SEQ ID NO: 2528890 - protein, 26 aa, Entamoeba dispar
KDSVPIIYFQENSWIIRPCHGFEEIY

SEQ ID NO: 2528891 - protein, 28 aa, Entamoeba dispar
KDTDTYLPLPFMPKLQTLTIRFTQKVIQ

SEQ ID NO: 2528892 - protein, 25 aa, Entamoeba dispar
KDTDWDGLLAIIQNIYENELDGCDP

SEQ ID NO: 2528893 - protein, 26 aa, Entamoeba dispar
KDTGVLLWQNPYGTIPILSYQGDVKT

SEQ ID NO: 2528894 - protein, 23 aa, Entamoeba dispar
KDTKILNIFPLIIQISHSFENDI

SEQ ID NO: 2528895 - protein, 23 aa, Entamoeba dispar
KDTQFIIYQILKAVQYLQKKHII

SEQ ID NO: 2528896 - protein, 26 aa, Entamoeba dispar
KDVEQTYKRIFLLEYYKLQKCGEVEV

SEQ ID NO: 2528897 - protein, 17 aa, Entamoeba dispar
KDVFREMVLLPSQIEVT

SEQ ID NO: 2528898 - protein, 29 aa, Entamoeba dispar
KDVILVGGSTFIPFIQKLVESYCVNTKFK

SEQ ID NO: 2528899 - protein, 23 aa, Entamoeba dispar
KDVIQPINPSQLQMLKLNESDQE

SEQ ID NO: 2528900 - protein, 27 aa, Entamoeba dispar
KDVKDPDNFIIPPKQYKTIKPMDDDEE

SEQ ID NO: 2528901 - protein, 29 aa, Entamoeba dispar
KDVLLESLGYHIFPIFYSLGINDRYESII

SEQ ID NO: 2528902 - protein, 24 aa, Entamoeba dispar
KDVNLACMFWRKAKVLGSEKAVQF

SEQ ID NO: 2528903 - protein, 18 aa, Entamoeba dispar
KDYCVPLSIINYQDKIFV

SEQ ID NO: 2528904 - protein, 25 aa, Entamoeba dispar
KDYEELLFEKRWGIRCSQECDIAVF

SEQ ID NO: 2528905 - protein, 29 aa, Entamoeba dispar
KDYNHQLGILYIYHIKFNIEGFKIIKQIS

SEQ ID NO: 2528906 - protein, 20 aa, Entamoeba dispar
KDYNLKIKLPKSKIINEKSI

SEQ ID NO: 2528907 - protein, 24 aa, Entamoeba dispar
KDYSLLLIHIIKQLKINNNLIICT

SEQ ID NO: 2528908 - protein, 22 aa, Entamoeba dispar
KDYYGLLYCNLIANVDVSGKYH

SEQ ID NO: 2528909 - protein, 29 aa, Entamoeba dispar
KEAEVVILVNLPLLQSISLPKSLKNIVIN

SEQ ID NO: 2528910 - protein, 20 aa, Entamoeba dispar
KEAFLIQYTFYPEGSEKAQH

SEQ ID NO: 2528911 - protein, 21 aa, Entamoeba dispar
KEAIEMILKTNYFSGYSIVLS

SEQ ID NO: 2528912 - protein, 18 aa, Entamoeba dispar
KEAKPVPDFIPLESVDIP

SEQ ID NO: 2528913 - protein, 28 aa, Entamoeba dispar
KEALINYLKKFGFIPNSFDDQVAMKCPK

SEQ ID NO: 2528914 - protein, 45 aa, Entamoeba dispar
KEALQEAVILPIKFPQLFTDKRKPWTGILLFGPPGTGKSFLAKAV

SEQ ID NO: 2528915 - protein, 33 aa, Entamoeba dispar
KEAQLVKEIMSLKGIYIVQLISEFMYKDHYCIV

SEQ ID NO: 2528916 - protein, 18 aa, Entamoeba dispar
KEARVDYDAEASCIECIS

SEQ ID NO: 2528917 - protein, 25 aa, Entamoeba dispar
KEAVIVRTFQILAEKKSISLVDIKK

SEQ ID NO: 2528918 - protein, 23 aa, Entamoeba dispar
KEAYEEIFPPLIGGIQTHIVTKD

SEQ ID NO: 2528919 - protein, 31 aa, Entamoeba dispar
KEAYNIIKYSFVFEFFIKEYEQIYKLFNFRQ

SEQ ID NO: 2528920 - protein, 19 aa, Entamoeba dispar
KECCCPRIKAFKKFMNTFE

SEQ ID NO: 2528921 - protein, 21 aa, Entamoeba dispar
KECCCPRIKAFKKFMYTFEKA

SEQ ID NO: 2528922 - protein, 30 aa, Entamoeba dispar
KECIFSSIIPYIDEPWYLKFNNSAIFANKT

SEQ ID NO: 2528923 - protein, 24 aa, Entamoeba dispar
KECIQCEYGYYLNSNKECQIGSHC

SEQ ID NO: 2528924 - protein, 18 aa, Entamoeba dispar
KECSLLTTINIPSSITKI

SEQ ID NO: 2528925 - protein, 20 aa, Entamoeba dispar
KECTLLTTIIIPTTINELGK

SEQ ID NO: 2528926 - protein, 21 aa, Entamoeba dispar
KEDDIYIKKLLLRVSENDDFT

SEQ ID NO: 2528927 - protein, 21 aa, Entamoeba dispar
KEDEEFWKALGGKNDNIVKAE

SEQ ID NO: 2528928 - protein, 23 aa, Entamoeba dispar
KEDFKKFYEAFGKNLKLGIHEDS

SEQ ID NO: 2528929 - protein, 20 aa, Entamoeba dispar
KEDIILCNVLFGNAFKTIEE

SEQ ID NO: 2528930 - protein, 22 aa, Entamoeba dispar
KEDIILIFIEITILLMQNESNF

SEQ ID NO: 2528931 - protein, 33 aa, Entamoeba dispar
KEDKALNLYVLLKLNMIHGKVLIFVNSIQKCFY

SEQ ID NO: 2528932 - protein, 24 aa, Entamoeba dispar
KEDKLFIDGIPEFPVIKATDEVPI

SEQ ID NO: 2528933 - protein, 26 aa, Entamoeba dispar
KEDLEIDPALLLKHAQRVMVDEPEET

SEQ ID NO: 2528934 - protein, 17 aa, Entamoeba dispar
KEDLVGVEKIRQLYKKC

SEQ ID NO: 2528935 - protein, 20 aa, Entamoeba dispar
KEDQKEILRLAFAEDDVMNE

SEQ ID NO: 2528936 - protein, 18 aa, Entamoeba dispar
KEEALMNCLLKYSENALK

SEQ ID NO: 2528937 - protein, 29 aa, Entamoeba dispar
KEEDFTKYLIKYQGKPSIFQGRKGNEDIS

SEQ ID NO: 2528938 - protein, 24 aa, Entamoeba dispar
KEEDLKIAFNCLPNIYKINVKLIQ

SEQ ID NO: 2528939 - protein, 24 aa, Entamoeba dispar
KEEEKRIIKWLNNIYVIEKNKEGI

SEQ ID NO: 2528940 - protein, 24 aa, Entamoeba dispar
KEEEPIVLLIDPKKRRSLRFYEAI

SEQ ID NO: 2528941 - protein, 24 aa, Entamoeba dispar
KEEFLEYPIFDEYQFNCINDHISS

SEQ ID NO: 2528942 - protein, 32 aa, Entamoeba dispar
KEEFMDIGCTCTLIYIWEENNKIYIRSGNVGD

SEQ ID NO: 2528943 - protein, 25 aa, Entamoeba dispar
KEEGNDFFYALSDGVIVKHIINKFY

SEQ ID NO: 2528944 - protein, 26 aa, Entamoeba dispar
KEEIYNLYPLFDILLGAPEINIREKA

SEQ ID NO: 2528945 - protein, 25 aa, Entamoeba dispar
KEEKGYQYSLFYNPSLIESPLNTRW

SEQ ID NO: 2528946 - protein, 23 aa, Entamoeba dispar
KEEKYIIFIKKIEGIKKIKQGRI

SEQ ID NO: 2528947 - protein, 22 aa, Entamoeba dispar
KEELLAKAQQFKTKMNKFKKQA

SEQ ID NO: 2528948 - protein, 19 aa, Entamoeba dispar
KEELPILQPFSLINYSGMD

SEQ ID NO: 2528949 - protein, 27 aa, Entamoeba dispar
KEELSMNIYLVYLYEKRKEIEALNKEM

SEQ ID NO: 2528950 - protein, 17 aa, Entamoeba dispar
KEELVELNLLPFENEEK

SEQ ID NO: 2528951 - protein, 25 aa, Entamoeba dispar
KEENGDEAFTRRLNPRKVDDNAIEE

SEQ ID NO: 2528952 - protein, 24 aa, Entamoeba dispar
KEENIGIMQPLFIKGNDSMKFGDV

SEQ ID NO: 2528953 - protein, 28 aa, Entamoeba dispar
KEENRLYKLLCWTGKDIWACIKPTNNKS

SEQ ID NO: 2528954 - protein, 25 aa, Entamoeba dispar
KEEPKKIIPILPKEKKSAITEICEI

SEQ ID NO: 2528955 - protein, 35 aa, Entamoeba dispar
KEEQEITEWFKSQPIYEDILMYNAIDIDDCIYLFK

SEQ ID NO: 2528956 - protein, 17 aa, Entamoeba dispar
KEETRECIECEKGYYLN

SEQ ID NO: 2528957 - protein, 25 aa, Entamoeba dispar
KEETRNKILILLKNITKCNDQQLTQ

SEQ ID NO: 2528958 - protein, 25 aa, Entamoeba dispar
KEEVITPITMNWILYGYRASKNIDG

SEQ ID NO: 2528959 - protein, 30 aa, Entamoeba dispar
KEEWSDWVEKISLVFLKSNPSRILSKCEDI

SEQ ID NO: 2528960 - protein, 20 aa, Entamoeba dispar
KEEWSLFNKSIVAFGQCCCR

SEQ ID NO: 2528961 - protein, 26 aa, Entamoeba dispar
KEEYDKYGIIIKTLFRKEGSLQQLNA

SEQ ID NO: 2528962 - protein, 23 aa, Entamoeba dispar
KEEYLLDTLNLKKTFMVKKRGKT

SEQ ID NO: 2528963 - protein, 23 aa, Entamoeba dispar
KEFDRFGNIAEIHLPIDKITKKS

SEQ ID NO: 2528964 - protein, 18 aa, Entamoeba dispar
KEFDYLHLIIYDIYRVEL

SEQ ID NO: 2528965 - protein, 21 aa, Entamoeba dispar
KEFINKIQGVTLRKGYKKRTV

SEQ ID NO: 2528966 - protein, 26 aa, Entamoeba dispar
KEFISWIMFRMFHLFEKLNQFKEMVE

SEQ ID NO: 2528967 - protein, 25 aa, Entamoeba dispar
KEFKELFEPILILTKKIVEELDRAY

SEQ ID NO: 2528968 - protein, 17 aa, Entamoeba dispar
KEFKKWLGVERIPVQTG

SEQ ID NO: 2528969 - protein, 19 aa, Entamoeba dispar
KEFPTFPGAILFTTNCLMK

SEQ ID NO: 2528970 - protein, 24 aa, Entamoeba dispar
KEFRKIYYLIETRCKIGITATPIR

SEQ ID NO: 2528971 - protein, 18 aa, Entamoeba dispar
KEFVALEFVWEITRKHER

SEQ ID NO: 2528972 - protein, 27 aa, Entamoeba dispar
KEFVMNLAHFAILPDLSSLAKAKQFAA

SEQ ID NO: 2528973 - protein, 18 aa, Entamoeba dispar
KEFYRNSFTLMIVQMTCG

SEQ ID NO: 2528974 - protein, 25 aa, Entamoeba dispar
KEGDLRKVYSACTLAIHLAIQDNSP

SEQ ID NO: 2528975 - protein, 25 aa, Entamoeba dispar
KEGGFLIEIIEEIIFDPAIGKKKKR

SEQ ID NO: 2528976 - protein, 18 aa, Entamoeba dispar
KEGIIRKSSLVPDNKKPV

SEQ ID NO: 2528977 - protein, 21 aa, Entamoeba dispar
KEGKFFDSFDKAYGCCGFPIC

SEQ ID NO: 2528978 - protein, 23 aa, Entamoeba dispar
KEGKLKIYLYPNEPFNQKDESEA

SEQ ID NO: 2528979 - protein, 19 aa, Entamoeba dispar
KEGLPLPVYDSLKYFKENP

SEQ ID NO: 2528980 - protein, 24 aa, Entamoeba dispar
KEGNEGGWYFSDNKDLPFDSNEWE

SEQ ID NO: 2528981 - protein, 25 aa, Entamoeba dispar
KEGNEMIWYFMKYIRESNKINEIKE

SEQ ID NO: 2528982 - protein, 23 aa, Entamoeba dispar
KEGSLLDSLLIKASLIDKNEPEN

SEQ ID NO: 2528983 - protein, 20 aa, Entamoeba dispar
KEGSVIMIRVWSGQLMICDT

SEQ ID NO: 2528984 - protein, 38 aa, Entamoeba dispar
KEGYILKRWVTRYVLVKRNYLIYFVSDKEFSKLTLPTI

SEQ ID NO: 2528985 - protein, 17 aa, Entamoeba dispar
KEHLINRLSLQPKHLEK

SEQ ID NO: 2528986 - protein, 22 aa, Entamoeba dispar
KEHYPQIYFNFINRIKEITESL

SEQ ID NO: 2528987 - protein, 17 aa, Entamoeba dispar
KEIDIIISKKYFMLIVN

SEQ ID NO: 2528988 - protein, 25 aa, Entamoeba dispar
KEIEIKRLLPFLEDKIIEKGIDKER

SEQ ID NO: 2528989 - protein, 31 aa, Entamoeba dispar
KEIEKHIDIIRNILIIFKLIDEQEDINKELM

SEQ ID NO: 2528990 - protein, 19 aa, Entamoeba dispar
KEIFEKFVLKEYVPTVLIP

SEQ ID NO: 2528991 - protein, 28 aa, Entamoeba dispar
KEIFIEFINDHLWYYTPLERIFRNITND

SEQ ID NO: 2528992 - protein, 21 aa, Entamoeba dispar
KEIGLHFPTVSVSWFPTYIKT

SEQ ID NO: 2528993 - protein, 26 aa, Entamoeba dispar
KEIIEIDILYLLIIHFNKLTNEEINE

SEQ ID NO: 2528994 - protein, 18 aa, Entamoeba dispar
KEIINRDVFWTGIDTNEI

SEQ ID NO: 2528995 - protein, 27 aa, Entamoeba dispar
KEIISTPPFNNLNKFKIHILHSSVPLQ

SEQ ID NO: 2528996 - protein, 26 aa, Entamoeba dispar
KEIKEHPLFVFNIYINSYTPQTVKEK

SEQ ID NO: 2528997 - protein, 24 aa, Entamoeba dispar
KEIKETMLISNHFIKTLSIEEINS

SEQ ID NO: 2528998 - protein, 33 aa, Entamoeba dispar
KEINGHELFWIYYCSLPLFTSKVPVVDFWLDRI

SEQ ID NO: 2528999 - protein, 25 aa, Entamoeba dispar
KEINSYHKLLYPGKFKNVFARTQMI

SEQ ID NO: 2529000 - protein, 19 aa, Entamoeba dispar
KEIPIIDNVLKPCSEKLSI

SEQ ID NO: 2529001 - protein, 26 aa, Entamoeba dispar
KEIPLSWYHRIIMFTFSNLALTNDKY

SEQ ID NO: 2529002 - protein, 24 aa, Entamoeba dispar
KEIPNCCFFRCYSLSQINIPKHCT

SEQ ID NO: 2529003 - protein, 18 aa, Entamoeba dispar
KEIQENIYTFQNLELLRL

SEQ ID NO: 2529004 - protein, 17 aa, Entamoeba dispar
KEITELPWYNDHNLINQ

SEQ ID NO: 2529005 - protein, 17 aa, Entamoeba dispar
KEIVFQRKQQREEEMRK

SEQ ID NO: 2529006 - protein, 19 aa, Entamoeba dispar
KEIVPPPYGLYPELFVDTK

SEQ ID NO: 2529007 - protein, 22 aa, Entamoeba dispar
KEIVQWPVLHPELFKQYGQPPS

SEQ ID NO: 2529008 - protein, 19 aa, Entamoeba dispar
KEIYEFIHKNYKACGVLSE

SEQ ID NO: 2529009 - protein, 20 aa, Entamoeba dispar
KEIYRLFGELPKDITGLCAL

SEQ ID NO: 2529010 - protein, 24 aa, Entamoeba dispar
KEIYRLIDYIIQHYEPNCFIKKDP

SEQ ID NO: 2529011 - protein, 39 aa, Entamoeba dispar
KEIYSAFNVFIRYLSYYTTYMNIYFPLKTFYESDNNTIK

SEQ ID NO: 2529012 - protein, 22 aa, Entamoeba dispar
KEKEKFIKLYKEAESATAAVEK

SEQ ID NO: 2529013 - protein, 24 aa, Entamoeba dispar
KEKEPLLDAYADNIQRKLVPAIND

SEQ ID NO: 2529014 - protein, 17 aa, Entamoeba dispar
KEKETIIFPFLSKNKYG

SEQ ID NO: 2529015 - protein, 24 aa, Entamoeba dispar
KEKETIIFPFLSKNKYGLIVYVKR

SEQ ID NO: 2529016 - protein, 17 aa, Entamoeba dispar
KEKETIIFPFLSKNRYG

SEQ ID NO: 2529017 - protein, 24 aa, Entamoeba dispar
KEKGIYPIFVFDGKTQTYLKENTI

SEQ ID NO: 2529018 - protein, 24 aa, Entamoeba dispar
KEKGYTRWQLKNGVLYAYLQEEKN

SEQ ID NO: 2529019 - protein, 32 aa, Entamoeba dispar
KEKIQTILRDTLSKKIIVIPVDLPHTHDDDLI

SEQ ID NO: 2529020 - protein, 22 aa, Entamoeba dispar
KEKKLLLAQKMWNVLLDYSQLT

SEQ ID NO: 2529021 - protein, 18 aa, Entamoeba dispar
KEKKLSLILDLDGTIVFT

SEQ ID NO: 2529022 - protein, 17 aa, Entamoeba dispar
KEKLDIETLMKLFDHIK

SEQ ID NO: 2529023 - protein, 25 aa, Entamoeba dispar
KEKLKEKKILLQKTKKGQPIMNNIM

SEQ ID NO: 2529024 - protein, 25 aa, Entamoeba dispar
KEKLKKPKIFRLSLNKREQHLQKET

SEQ ID NO: 2529025 - protein, 17 aa, Entamoeba dispar
KEKLLYVETSDVLIRII

SEQ ID NO: 2529026 - protein, 28 aa, Entamoeba dispar
KEKLQKLYDTLPLILPKNAKGLGLFMKY

SEQ ID NO: 2529027 - protein, 24 aa, Entamoeba dispar
KEKMKRRFIKKYSFEPTRDEFLLF

SEQ ID NO: 2529028 - protein, 24 aa, Entamoeba dispar
KEKSSLLGPIGFVGGLVAGVTGVV

SEQ ID NO: 2529029 - protein, 20 aa, Entamoeba dispar
KEKTVFRKKLIKLKKEAERI

SEQ ID NO: 2529030 - protein, 26 aa, Entamoeba dispar
KEKWTRYIEFWVLYARYEEKLQHYEN

SEQ ID NO: 2529031 - protein, 18 aa, Entamoeba dispar
KEKYIWTDIINFEKEEQP

SEQ ID NO: 2529032 - protein, 23 aa, Entamoeba dispar
KEKYQIPYSIKIIGSSKFSFKGI

SEQ ID NO: 2529033 - protein, 24 aa, Entamoeba dispar
KEKYQIPYSIKIIGSSKFSFKGIL

SEQ ID NO: 2529034 - protein, 27 aa, Entamoeba dispar
KELDDTKVLLFIKLCGKTQIILQSKAK

SEQ ID NO: 2529035 - protein, 28 aa, Entamoeba dispar
KELDSFVKKHYPYVTSYTRDDSVKEVTI

SEQ ID NO: 2529036 - protein, 24 aa, Entamoeba dispar
KELEKLFIFLVQNIDKLLDIVVYN

SEQ ID NO: 2529037 - protein, 18 aa, Entamoeba dispar
KELELIKANISYLDIIHL

SEQ ID NO: 2529038 - protein, 17 aa, Entamoeba dispar
KELFLRTMFSFFYEGDS

SEQ ID NO: 2529039 - protein, 17 aa, Entamoeba dispar
KELFPTLGEGRNLPIPQ

SEQ ID NO: 2529040 - protein, 23 aa, Entamoeba dispar
KELFQQHLLPKRCLLNFQQQNFE

SEQ ID NO: 2529041 - protein, 22 aa, Entamoeba dispar
KELHKTYLMLVEKSNIQLQVLN

SEQ ID NO: 2529042 - protein, 24 aa, Entamoeba dispar
KELIDFIVSSLPKRGSIKFKVSNG

SEQ ID NO: 2529043 - protein, 22 aa, Entamoeba dispar
KELIFFIHCCLSHLLDRNPPCL

SEQ ID NO: 2529044 - protein, 20 aa, Entamoeba dispar
KELKFYDWIKQFADNKIKGI

SEQ ID NO: 2529045 - protein, 27 aa, Entamoeba dispar
KELKKDDLWILLPQEYPYSFNSKIYII

SEQ ID NO: 2529046 - protein, 23 aa, Entamoeba dispar
KELLKRLVLNCFYHFNSLFSSFH

SEQ ID NO: 2529047 - protein, 19 aa, Entamoeba dispar
KELLLSLPIEYFQSIVNEK

SEQ ID NO: 2529048 - protein, 20 aa, Entamoeba dispar
KELLPFDLKIKIMEDIVVGL

SEQ ID NO: 2529049 - protein, 18 aa, Entamoeba dispar
KELLPKPSSVPMKDEKCT

SEQ ID NO: 2529050 - protein, 21 aa, Entamoeba dispar
KELLQMSEKLGYKFKYRTTKP

SEQ ID NO: 2529051 - protein, 18 aa, Entamoeba dispar
KELLTLTCRKIVTVPYIS

SEQ ID NO: 2529052 - protein, 23 aa, Entamoeba dispar
KELMIKIFEEYFINEIKVNILNS

SEQ ID NO: 2529053 - protein, 21 aa, Entamoeba dispar
KELMKLGAKFIYLSNGSFMQK

SEQ ID NO: 2529054 - protein, 25 aa, Entamoeba dispar
KELSAYMEVLFNQQVQIEKEADKKK

SEQ ID NO: 2529055 - protein, 27 aa, Entamoeba dispar
KELSDFLFAPKLLKRDFKLNYIETMDE

SEQ ID NO: 2529056 - protein, 26 aa, Entamoeba dispar
KELTKMNLDPLFSDVIINQPETKREE

SEQ ID NO: 2529057 - protein, 18 aa, Entamoeba dispar
KELTPLMEKYINPIIHSC

SEQ ID NO: 2529058 - protein, 20 aa, Entamoeba dispar
KELVRYINNFKLPESIFDDI

SEQ ID NO: 2529059 - protein, 25 aa, Entamoeba dispar
KELYNGMFLKLVFIIKKCFACDEEE

SEQ ID NO: 2529060 - protein, 26 aa, Entamoeba dispar
KEMCELFRIDLFGSIVYSILIEKTRK

SEQ ID NO: 2529061 - protein, 19 aa, Entamoeba dispar
KEMERILSPPSYIEDLNRI

SEQ ID NO: 2529062 - protein, 28 aa, Entamoeba dispar
KEMKKRLEMMFGKIKIGILGLEEMKDES

SEQ ID NO: 2529063 - protein, 24 aa, Entamoeba dispar
KEMKRRIWYARHSEPYFEDENEGI

SEQ ID NO: 2529064 - protein, 24 aa, Entamoeba dispar
KEMQQIMFSILTLAKEDLKMACSQ

SEQ ID NO: 2529065 - protein, 26 aa, Entamoeba dispar
KEMRQTFPQCFWCDPTAFFTDGPLMN

SEQ ID NO: 2529066 - protein, 18 aa, Entamoeba dispar
KEMSYVPYAVENLKLQCE

SEQ ID NO: 2529067 - protein, 32 aa, Entamoeba dispar
KENAQQYFLVTPKLLSDLPFGENMTVLCVMNG

SEQ ID NO: 2529068 - protein, 23 aa, Entamoeba dispar
KENCFFINFDKKGNVFGAFMKEN

SEQ ID NO: 2529069 - protein, 21 aa, Entamoeba dispar
KENESWLNEMIKYIIGQGGIQ

SEQ ID NO: 2529070 - protein, 23 aa, Entamoeba dispar
KENEWICIYIEDKIIKKEFNQIT

SEQ ID NO: 2529071 - protein, 20 aa, Entamoeba dispar
KENFPELRLLDISHNHIKKI

SEQ ID NO: 2529072 - protein, 23 aa, Entamoeba dispar
KENGRYLCHIIKKYHLKSIEQIP

SEQ ID NO: 2529073 - protein, 24 aa, Entamoeba dispar
KENHKLGIIPPTYPAIIPISSISS

SEQ ID NO: 2529074 - protein, 25 aa, Entamoeba dispar
KENIDDPFVNFLFPHNKSAGDDDIK

SEQ ID NO: 2529075 - protein, 24 aa, Entamoeba dispar
KENKALFSLIPYASKVSIKRTSCT

SEQ ID NO: 2529076 - protein, 35 aa, Entamoeba dispar
KENKRSNFHISMKRFEFKKPNLISKPLKDRMKDST

SEQ ID NO: 2529077 - protein, 26 aa, Entamoeba dispar
KENKTIRILEYYGYDDNVWKESSSEE

SEQ ID NO: 2529078 - protein, 20 aa, Entamoeba dispar
KENLLTIHKNSIKLLTEILL

SEQ ID NO: 2529079 - protein, 23 aa, Entamoeba dispar
KENNIYAQFYIRDEYFVERKIDL

SEQ ID NO: 2529080 - protein, 26 aa, Entamoeba dispar
KENNLSLILEFIKNQNIKVTTTVQDI

SEQ ID NO: 2529081 - protein, 30 aa, Entamoeba dispar
KENNQVISYIPWWTIVEMANNIFGDDGWSN

SEQ ID NO: 2529082 - protein, 27 aa, Entamoeba dispar
KENPHQIILELFDFSNPLISLTQIWIY

SEQ ID NO: 2529083 - protein, 25 aa, Entamoeba dispar
KENPQMIALRVRKRGKISSQMMVFK

SEQ ID NO: 2529084 - protein, 28 aa, Entamoeba dispar
KENSNTFIPILPFISKTFSKKLSFSEDT

SEQ ID NO: 2529085 - protein, 24 aa, Entamoeba dispar
KENSPIFIQFLEIVVMLIKKYPNA

SEQ ID NO: 2529086 - protein, 20 aa, Entamoeba dispar
KEPFADLLRGSLQNFLNAFT

SEQ ID NO: 2529087 - protein, 24 aa, Entamoeba dispar
KEPFCGWYHSHPSYKCWLSGIDVA

SEQ ID NO: 2529088 - protein, 24 aa, Entamoeba dispar
KEPFMLPLNVILDEYLDKFKRYFR

SEQ ID NO: 2529089 - protein, 18 aa, Entamoeba dispar
KEPHMWLRRGLFFCHRDI

SEQ ID NO: 2529090 - protein, 27 aa, Entamoeba dispar
KEPIRKLYLLHTQKVIILLQRSMFMKS

SEQ ID NO: 2529091 - protein, 24 aa, Entamoeba dispar
KEPKEFLKIFKGKFIIHLGGYNEY

SEQ ID NO: 2529092 - protein, 22 aa, Entamoeba dispar
KEPKFILVTSLRNIIDSLNEDD

SEQ ID NO: 2529093 - protein, 26 aa, Entamoeba dispar
KEPKNLYIQQIIWLVVSTFGDKLPSV

SEQ ID NO: 2529094 - protein, 17 aa, Entamoeba dispar
KEQADRMFKFTPVHIRK

SEQ ID NO: 2529095 - protein, 34 aa, Entamoeba dispar
KEQAIYCIGTIIKKFISILPFDALKESFNELISL

SEQ ID NO: 2529096 - protein, 24 aa, Entamoeba dispar
KEQALPIMPLKEPLSFIPDDIKLT

SEQ ID NO: 2529097 - protein, 21 aa, Entamoeba dispar
KEQCIERVQYLKQLALQKKSI

SEQ ID NO: 2529098 - protein, 26 aa, Entamoeba dispar
KEQHIQILKIFHRSYNNYLNKAQLFH

SEQ ID NO: 2529099 - protein, 18 aa, Entamoeba dispar
KEQHLFHFTPVLSKERCR

SEQ ID NO: 2529100 - protein, 23 aa, Entamoeba dispar
KEQHLPAMIKSFRLACYKFAGRQ

SEQ ID NO: 2529101 - protein, 19 aa, Entamoeba dispar
KEQITIKLYNSLKKLFNEE

SEQ ID NO: 2529102 - protein, 18 aa, Entamoeba dispar
KEQKKILERELYFSSTSS

SEQ ID NO: 2529103 - protein, 17 aa, Entamoeba dispar
KEQLAQQKPIQKSLPVI

SEQ ID NO: 2529104 - protein, 20 aa, Entamoeba dispar
KEQLQMCFELVKENMFSLDS

SEQ ID NO: 2529105 - protein, 47 aa, Entamoeba dispar
KEQNKYDWALNFIKFLKEMVVYIKQYHTTGLTWNPKGGIASAQTTPV

SEQ ID NO: 2529106 - protein, 25 aa, Entamoeba dispar
KEQNPGYFKAYEFRLALKSQISRYN

SEQ ID NO: 2529107 - protein, 39 aa, Entamoeba dispar
KEQPPSEQLPKQNTLPPKPAAPAALPPKHHQSLNSKTNS

SEQ ID NO: 2529108 - protein, 31 aa, Entamoeba dispar
KEQYKTFSKIWPCNLFPPSLPTPNIENEEIT

SEQ ID NO: 2529109 - protein, 17 aa, Entamoeba dispar
KEQYSLALNYLKKAMTL

SEQ ID NO: 2529110 - protein, 29 aa, Entamoeba dispar
KERADQRKQRELENLRLQEQLRKQKEEEE

SEQ ID NO: 2529111 - protein, 24 aa, Entamoeba dispar
KERDKIRIRIINNIRTNNIIEENK

SEQ ID NO: 2529112 - protein, 17 aa, Entamoeba dispar
KERDMIIMGFNYLDILA

SEQ ID NO: 2529113 - protein, 23 aa, Entamoeba dispar
KERIDKYEWAEHIQSIFAKESLK

SEQ ID NO: 2529114 - protein, 21 aa, Entamoeba dispar
KERIFIKEYIDFKPSTGKKML

SEQ ID NO: 2529115 - protein, 22 aa, Entamoeba dispar
KERIFMNEPLLVSIKIPKTLQI

SEQ ID NO: 2529116 - protein, 21 aa, Entamoeba dispar
KERKCIGYRWIHGQLMNHFEW

SEQ ID NO: 2529117 - protein, 26 aa, Entamoeba dispar
KERKKQYYCLLQTISQKRFIGVVGGV

SEQ ID NO: 2529118 - protein, 19 aa, Entamoeba dispar
KERKSLGWMAPLYKEYPGG

SEQ ID NO: 2529119 - protein, 17 aa, Entamoeba dispar
KERLASIALVKPEKARQ

SEQ ID NO: 2529120 - protein, 25 aa, Entamoeba dispar
KERLKQLALERIDLSKDPYFYKTHV

SEQ ID NO: 2529121 - protein, 28 aa, Entamoeba dispar
KERMDFLLVQFRIALESEDYLRVLLLSN

SEQ ID NO: 2529122 - protein, 26 aa, Entamoeba dispar
KERNEELIKELLTMKQAAVEMQDAVD

SEQ ID NO: 2529123 - protein, 17 aa, Entamoeba dispar
KERNSMKILQNKTMYLA

SEQ ID NO: 2529124 - protein, 31 aa, Entamoeba dispar
KERVKGTLVWLLNLGILWVDDQFSLDGKTIR

SEQ ID NO: 2529125 - protein, 27 aa, Entamoeba dispar
KESERKKRMVILYERKLDSMRELLQIT

SEQ ID NO: 2529126 - protein, 28 aa, Entamoeba dispar
KESFILFNKYSEGPFNIIFKIIKENTGE

SEQ ID NO: 2529127 - protein, 24 aa, Entamoeba dispar
KESIYALFALLLHTNPVISELFET

SEQ ID NO: 2529128 - protein, 26 aa, Entamoeba dispar
KESKLSLIRPIYIYLGCCIKKDFHQQ

SEQ ID NO: 2529129 - protein, 28 aa, Entamoeba dispar
KESPESFYFLKRYTQLKSLSLIVEYQRN

SEQ ID NO: 2529130 - protein, 33 aa, Entamoeba dispar
KESPFSLIVQLFPCYIDLLIKYVQFDSNILRVI

SEQ ID NO: 2529131 - protein, 17 aa, Entamoeba dispar
KESPKKFFSLKGDMLWF

SEQ ID NO: 2529132 - protein, 24 aa, Entamoeba dispar
KESQLPRLLTSDPISKYYGFQRGD

SEQ ID NO: 2529133 - protein, 26 aa, Entamoeba dispar
KESSESSSSLTPTSESEKKEVTEEPK

SEQ ID NO: 2529134 - protein, 22 aa, Entamoeba dispar
KESTMLFHYILQKFTINEISSI

SEQ ID NO: 2529135 - protein, 26 aa, Entamoeba dispar
KESVKDIFLLIQQYISYRIDNLQSVC

SEQ ID NO: 2529136 - protein, 25 aa, Entamoeba dispar
KESWDVWGLGVIIIEMMNGTAPFAE

SEQ ID NO: 2529137 - protein, 28 aa, Entamoeba dispar
KESWKAIPAMRLMPLLETALGYEVIGID

SEQ ID NO: 2529138 - protein, 20 aa, Entamoeba dispar
KETAFLYFSETNFFAQTGGD

SEQ ID NO: 2529139 - protein, 29 aa, Entamoeba dispar
KETEQYIERLPPGTYFTPSSVINKVKSRY

SEQ ID NO: 2529140 - protein, 26 aa, Entamoeba dispar
KETESTFKRILPYALLKYLESEEQPK

SEQ ID NO: 2529141 - protein, 17 aa, Entamoeba dispar
KETGQNQFECLICLDTA

SEQ ID NO: 2529142 - protein, 22 aa, Entamoeba dispar
KETIIFPFLSKNKYGIIAYVKR

SEQ ID NO: 2529143 - protein, 25 aa, Entamoeba dispar
KETKRTFFFWNQENDINIFYKGIEL

SEQ ID NO: 2529144 - protein, 24 aa, Entamoeba dispar
KETKRTFFFWNQENDINSFYKGIE

SEQ ID NO: 2529145 - protein, 20 aa, Entamoeba dispar
KETLFLQLNELKRNLREAER

SEQ ID NO: 2529146 - protein, 20 aa, Entamoeba dispar
KETMKAIKKLLLRGIENAKV

SEQ ID NO: 2529147 - protein, 24 aa, Entamoeba dispar
KETSPICILVFLPGMAEIEEMKSR

SEQ ID NO: 2529148 - protein, 36 aa, Entamoeba dispar
KEVDVKMGFLLLKNYLLNLPVPLLSSNLLNKLDMVL

SEQ ID NO: 2529149 - protein, 21 aa, Entamoeba dispar
KEVEGYLKNKVIWIVCGTMAD

SEQ ID NO: 2529150 - protein, 34 aa, Entamoeba dispar
KEVFEKWMTFKPGEYPWLAYIKFEIRIGEIKIAK

SEQ ID NO: 2529151 - protein, 23 aa, Entamoeba dispar
KEVGRIVFDKLWHGSYESIDKIE

SEQ ID NO: 2529152 - protein, 26 aa, Entamoeba dispar
KEVIRRQHEVLLKLKKEREIMENEIK

SEQ ID NO: 2529153 - protein, 27 aa, Entamoeba dispar
KEVISVPSFFFIFSDATSYISTSFDVA

SEQ ID NO: 2529154 - protein, 17 aa, Entamoeba dispar
KEVKEIKIRPLDPYFYC

SEQ ID NO: 2529155 - protein, 24 aa, Entamoeba dispar
KEVKILFVQLLKAVNYIHSKNIMH

SEQ ID NO: 2529156 - protein, 26 aa, Entamoeba dispar
KEVPLPSDIIYFDIPKEILRQNSLAD

SEQ ID NO: 2529157 - protein, 29 aa, Entamoeba dispar
KEVVLIHLKVTKTLLLFDETFRTMKAFEG

SEQ ID NO: 2529158 - protein, 19 aa, Entamoeba dispar
KEVVLKWKRGKKDTNKGKF

SEQ ID NO: 2529159 - protein, 24 aa, Entamoeba dispar
KEVVLYAHYMKLRYFSVECTYAGT

SEQ ID NO: 2529160 - protein, 26 aa, Entamoeba dispar
KEVVQYPVEFPDKFRKFGMEPSKGVL

SEQ ID NO: 2529161 - protein, 25 aa, Entamoeba dispar
KEVVRPILDPYYPENFYINQDFYTN

SEQ ID NO: 2529162 - protein, 33 aa, Entamoeba dispar
KEWDIFLQKMIALYPIKIFYKEIRKIFLAVTQM

SEQ ID NO: 2529163 - protein, 17 aa, Entamoeba dispar
KEWFENELKIQWNPITY

SEQ ID NO: 2529164 - protein, 21 aa, Entamoeba dispar
KEWTSLLTHNKLTQPEVIIRK

SEQ ID NO: 2529165 - protein, 20 aa, Entamoeba dispar
KEYAIVLSNLTIQDTPLIIN

SEQ ID NO: 2529166 - protein, 17 aa, Entamoeba dispar
KEYEELSIMLNELNGLL

SEQ ID NO: 2529167 - protein, 26 aa, Entamoeba dispar
KEYEPYLQRTNVSLIIKKGFINGMKN

SEQ ID NO: 2529168 - protein, 18 aa, Entamoeba dispar
KEYEQIYKLFNFRQKKDI

SEQ ID NO: 2529169 - protein, 18 aa, Entamoeba dispar
KEYIDCGRITFIDLPCCW

SEQ ID NO: 2529170 - protein, 17 aa, Entamoeba dispar
KEYIDLSDFKKWVLFIA

SEQ ID NO: 2529171 - protein, 22 aa, Entamoeba dispar
KEYKPIHRMIKKEVYVPAKLRE

SEQ ID NO: 2529172 - protein, 25 aa, Entamoeba dispar
KEYPLHPRLGKILYLTQKKGIEEIG

SEQ ID NO: 2529173 - protein, 24 aa, Entamoeba dispar
KEYVKYFYPLEIKGHLYDLNLEHL

SEQ ID NO: 2529174 - protein, 31 aa, Entamoeba dispar
KFCVPFNNQLKVFFKYFAQYLRQRVASRATT

SEQ ID NO: 2529175 - protein, 18 aa, Entamoeba dispar
KFDCWEGLFYFLSQIVNT

SEQ ID NO: 2529176 - protein, 26 aa, Entamoeba dispar
KFDDCDMLLIIGTALVVYPFANLVDH

SEQ ID NO: 2529177 - protein, 17 aa, Entamoeba dispar
KFDIFLEKYLDGLSNNA

SEQ ID NO: 2529178 - protein, 26 aa, Entamoeba dispar
KFDIKDPQYAFGLYNQLDGGLFEFGG

SEQ ID NO: 2529179 - protein, 26 aa, Entamoeba dispar
KFDMDLTHTLPILVDLILGLFKNDNI

SEQ ID NO: 2529180 - protein, 17 aa, Entamoeba dispar
KFDTLIGEGLNESFYLV

SEQ ID NO: 2529181 - protein, 21 aa, Entamoeba dispar
KFEHFILIEIFTQMGAPLKIF

SEQ ID NO: 2529182 - protein, 32 aa, Entamoeba dispar
KFEKVLLRYHGLYWVTMILVDNNLIFLTKMDK

SEQ ID NO: 2529183 - protein, 21 aa, Entamoeba dispar
KFELAIRVFDVILLEGFTAMF

SEQ ID NO: 2529184 - protein, 21 aa, Entamoeba dispar
KFELQQYQKQLIYLSIQTSVT

SEQ ID NO: 2529185 - protein, 25 aa, Entamoeba dispar
KFENNMFSYFIRYVDVYLNIHQIQK

SEQ ID NO: 2529186 - protein, 31 aa, Entamoeba dispar
KFENYTEMFYYKTYLFALNKRCEQYINFISL

SEQ ID NO: 2529187 - protein, 25 aa, Entamoeba dispar
KFEVIKILIEIIKKNLSLKLMEMSG

SEQ ID NO: 2529188 - protein, 24 aa, Entamoeba dispar
KFEVQYLNFWIEPSKKEITSLVVD

SEQ ID NO: 2529189 - protein, 22 aa, Entamoeba dispar
KFFDELTVVFYKKDWDCFNSVD

SEQ ID NO: 2529190 - protein, 23 aa, Entamoeba dispar
KFFDIPMKVLSFSKLNTLKMANN

SEQ ID NO: 2529191 - protein, 25 aa, Entamoeba dispar
KFFEDLEVLFIDYSEAFPKYVEVIN

SEQ ID NO: 2529192 - protein, 20 aa, Entamoeba dispar
KFFEIQRIIPDFKPLTHLHV

SEQ ID NO: 2529193 - protein, 20 aa, Entamoeba dispar
KFFQMYPFEIIVQFDALGIF

SEQ ID NO: 2529194 - protein, 17 aa, Entamoeba dispar
KFFSKFNELIINNDDLK

SEQ ID NO: 2529195 - protein, 25 aa, Entamoeba dispar
KFFSNIKKWYYLHPVEHQRTETMGR

SEQ ID NO: 2529196 - protein, 18 aa, Entamoeba dispar
KFFSNYPICGIRNLGNTC

SEQ ID NO: 2529197 - protein, 17 aa, Entamoeba dispar
KFFSVESKYLITESGFA

SEQ ID NO: 2529198 - protein, 24 aa, Entamoeba dispar
KFGCSRELFLFSRNILEGSSLKKL

SEQ ID NO: 2529199 - protein, 28 aa, Entamoeba dispar
KFGFATTKPILYFRLIGKNSIDEITISM

SEQ ID NO: 2529200 - protein, 20 aa, Entamoeba dispar
KFGFRKIKIIPRAYPRLPHP

SEQ ID NO: 2529201 - protein, 31 aa, Entamoeba dispar
KFGIEVMCLLYLFKIQFPNQFFLLRGNHESF

SEQ ID NO: 2529202 - protein, 27 aa, Entamoeba dispar
KFGIHGYPTITFFPKDFKYGKDFMYEH

SEQ ID NO: 2529203 - protein, 18 aa, Entamoeba dispar
KFGNQKYDIKKQNYLTVL

SEQ ID NO: 2529204 - protein, 25 aa, Entamoeba dispar
KFHAKWNPTCQCVFQTLADIRINDE

SEQ ID NO: 2529205 - protein, 18 aa, Entamoeba dispar
KFHLEYTLRILPHQQNTG

SEQ ID NO: 2529206 - protein, 25 aa, Entamoeba dispar
KFHPEHFVCSFCVNPLTESSFKENG

SEQ ID NO: 2529207 - protein, 19 aa, Entamoeba dispar
KFICPIENCRRCFTTKSYL

SEQ ID NO: 2529208 - protein, 21 aa, Entamoeba dispar
KFIDDIVFNQLNSINSKFRIR

SEQ ID NO: 2529209 - protein, 20 aa, Entamoeba dispar
KFIDLLILRDEPPFLLQPLL

SEQ ID NO: 2529210 - protein, 19 aa, Entamoeba dispar
KFIDWKCIVGKLTVKQRNI

SEQ ID NO: 2529211 - protein, 18 aa, Entamoeba dispar
KFIESFGVIIFSIKIDTN

SEQ ID NO: 2529212 - protein, 17 aa, Entamoeba dispar
KFIFSSQFSWCKSELNK

SEQ ID NO: 2529213 - protein, 18 aa, Entamoeba dispar
KFIHVKQLNKDRLKRLVF

SEQ ID NO: 2529214 - protein, 17 aa, Entamoeba dispar
KFIICDISPVFAKQIRA

SEQ ID NO: 2529215 - protein, 20 aa, Entamoeba dispar
KFIKEMIITLKRLKIGIGED

SEQ ID NO: 2529216 - protein, 26 aa, Entamoeba dispar
KFIKQEPKLWFQLGCLYEKAGLFEQA

SEQ ID NO: 2529217 - protein, 17 aa, Entamoeba dispar
KFILSSKTKVYEASSLK

SEQ ID NO: 2529218 - protein, 25 aa, Entamoeba dispar
KFIPKYVELKILPANPFEILDRPGV

SEQ ID NO: 2529219 - protein, 27 aa, Entamoeba dispar
KFISDPNHFIFSLKKSTFKPMKWNPIG

SEQ ID NO: 2529220 - protein, 18 aa, Entamoeba dispar
KFISYFIVTIVITKINKK

SEQ ID NO: 2529221 - protein, 19 aa, Entamoeba dispar
KFIVIKTFSKFLKHIVHSF

SEQ ID NO: 2529222 - protein, 27 aa, Entamoeba dispar
KFIYKNQYLVVNLLTRQLESLTQPTTE

SEQ ID NO: 2529223 - protein, 17 aa, Entamoeba dispar
KFKEDLLPSLKKLRDQF

SEQ ID NO: 2529224 - protein, 20 aa, Entamoeba dispar
KFKLVENLDILRKKYKDCKT

SEQ ID NO: 2529225 - protein, 20 aa, Entamoeba dispar
KFKNQLGGVMFLCATELTVT

SEQ ID NO: 2529226 - protein, 24 aa, Entamoeba dispar
KFKRNLPHVLKQYTPFKLFAKSEK

SEQ ID NO: 2529227 - protein, 17 aa, Entamoeba dispar
KFKVVITVPATFTDQQK

SEQ ID NO: 2529228 - protein, 19 aa, Entamoeba dispar
KFKYAKGNLFSFVLQDKDG

SEQ ID NO: 2529229 - protein, 18 aa, Entamoeba dispar
KFLFYREKLGNPQHILAP

SEQ ID NO: 2529230 - protein, 25 aa, Entamoeba dispar
KFLGFYKVYCGLKEPLRILVDEQFL

SEQ ID NO: 2529231 - protein, 21 aa, Entamoeba dispar
KFLHIKTLPQEKLISTQTPHF

SEQ ID NO: 2529232 - protein, 20 aa, Entamoeba dispar
KFLNKMKAFVNLGFDEDILK

SEQ ID NO: 2529233 - protein, 28 aa, Entamoeba dispar
KFMNCMEQFIDSLLIDPVSLYTVRNCQD

SEQ ID NO: 2529234 - protein, 21 aa, Entamoeba dispar
KFMPAIGLGTWLAAPGEVGKA

SEQ ID NO: 2529235 - protein, 19 aa, Entamoeba dispar
KFMRADVKKSFLKGKSVEE

SEQ ID NO: 2529236 - protein, 19 aa, Entamoeba dispar
KFNIYKGFGKYISSIGMEF

SEQ ID NO: 2529237 - protein, 17 aa, Entamoeba dispar
KFPICNNSLPWSWKMKP

SEQ ID NO: 2529238 - protein, 20 aa, Entamoeba dispar
KFPINIYQIIDGEDKRMKIK

SEQ ID NO: 2529239 - protein, 20 aa, Entamoeba dispar
KFPMFIAKCNVISGVGISAF

SEQ ID NO: 2529240 - protein, 20 aa, Entamoeba dispar
KFRYKFLITIFGEIFKRCKC

SEQ ID NO: 2529241 - protein, 29 aa, Entamoeba dispar
KFSCDFRQSVLELLLWCNEKNLPIEQFAL

SEQ ID NO: 2529242 - protein, 21 aa, Entamoeba dispar
KFSGHYISYCKTPSGGWFRFD

SEQ ID NO: 2529243 - protein, 21 aa, Entamoeba dispar
KFSLNCDIVLKWLKNGKEDIE

SEQ ID NO: 2529244 - protein, 24 aa, Entamoeba dispar
KFSPDYPLFALGFEKKIEIWRIPV

SEQ ID NO: 2529245 - protein, 20 aa, Entamoeba dispar
KFSSLTFLDISFNKLNLIPS

SEQ ID NO: 2529246 - protein, 25 aa, Entamoeba dispar
KFSVNKQMIRFTGSKIGPNPLTNEK

SEQ ID NO: 2529247 - protein, 18 aa, Entamoeba dispar
KFTAYLKQNGIGLHCGLQ

SEQ ID NO: 2529248 - protein, 21 aa, Entamoeba dispar
KFTEIPACIFKLTNLEIFEME

SEQ ID NO: 2529249 - protein, 18 aa, Entamoeba dispar
KFTIFHQDYIMREKRFND

SEQ ID NO: 2529250 - protein, 30 aa, Entamoeba dispar
KFTKWRNYQALQEAFFIGLLNQFATITICK

SEQ ID NO: 2529251 - protein, 35 aa, Entamoeba dispar
KFTLPINCYSSWINLALLIIFKSPFPNKFQERPEP

SEQ ID NO: 2529252 - protein, 17 aa, Entamoeba dispar
KFVFELFNRIQLVDEVT

SEQ ID NO: 2529253 - protein, 30 aa, Entamoeba dispar
KFYEEFLNVLKKWTGLEHFDIVFEYAVDGY

SEQ ID NO: 2529254 - protein, 22 aa, Entamoeba dispar
KGADFPPYAFVKFTDEKSAGLA

SEQ ID NO: 2529255 - protein, 33 aa, Entamoeba dispar
KGAEGISIYKTKQAVIIGYFSDASVSAGQNSDA

SEQ ID NO: 2529256 - protein, 25 aa, Entamoeba dispar
KGASYTPYFNVLGVILCFDYQKSNT

SEQ ID NO: 2529257 - protein, 34 aa, Entamoeba dispar
KGATRAFAPLNPVIPDAYKPIGQPAIIGGSMGTC

SEQ ID NO: 2529258 - protein, 19 aa, Entamoeba dispar
KGAVLIAAPPPPSFTKPTV

SEQ ID NO: 2529259 - protein, 20 aa, Entamoeba dispar
KGCAFVSFKTPLEAQKCFSN

SEQ ID NO: 2529260 - protein, 23 aa, Entamoeba dispar
KGCEKAIGQLLYQLATKLNKGKE

SEQ ID NO: 2529261 - protein, 22 aa, Entamoeba dispar
KGCGFVKFVYRDDAVSCYNYHK

SEQ ID NO: 2529262 - protein, 23 aa, Entamoeba dispar
KGCIALKSILLPLKLQIIEKGCF

SEQ ID NO: 2529263 - protein, 26 aa, Entamoeba dispar
KGDHIYNIVIPRYTLHPTSLSVGDVV

SEQ ID NO: 2529264 - protein, 22 aa, Entamoeba dispar
KGDHPPITPLNYPNEYLNDSEK

SEQ ID NO: 2529265 - protein, 25 aa, Entamoeba dispar
KGDNGFISCSILVKGIRRVLFVEPK

SEQ ID NO: 2529266 - protein, 27 aa, Entamoeba dispar
KGDVIALYEYLYAGNPIPLIYQSMVLT

SEQ ID NO: 2529267 - protein, 28 aa, Entamoeba dispar
KGDVIALYEYLYAGNPITFDLSKYGPHF

SEQ ID NO: 2529268 - protein, 28 aa, Entamoeba dispar
KGDYDIRGWFQWYCRYYIGRRGPSDQIQ

SEQ ID NO: 2529269 - protein, 26 aa, Entamoeba dispar
KGEGIDSYFKLKANFLAVALKTRTAE

SEQ ID NO: 2529270 - protein, 17 aa, Entamoeba dispar
KGEGNIFLIFEYMPHDL

SEQ ID NO: 2529271 - protein, 23 aa, Entamoeba dispar
KGEILDFIGVKKWKTVRVVVYNK

SEQ ID NO: 2529272 - protein, 22 aa, Entamoeba dispar
KGEKIPIRIPLRGVPLTPSYNN

SEQ ID NO: 2529273 - protein, 20 aa, Entamoeba dispar
KGELEWLIEIEFIHDNEINS

SEQ ID NO: 2529274 - protein, 22 aa, Entamoeba dispar
KGEYKWAVELLNHLIFTNPNNE

SEQ ID NO: 2529275 - protein, 19 aa, Entamoeba dispar
KGEYYFKSLKEILKEKSFI

SEQ ID NO: 2529276 - protein, 20 aa, Entamoeba dispar
KGFGKYISSIGMEFITTLRV

SEQ ID NO: 2529277 - protein, 17 aa, Entamoeba dispar
KGFGQIIVHSYIEQLAK

SEQ ID NO: 2529278 - protein, 20 aa, Entamoeba dispar
KGFMKKEDWFSVCKNFTLAD

SEQ ID NO: 2529279 - protein, 25 aa, Entamoeba dispar
KGFMKKEDWFSVCKNFTLADGTFWP

SEQ ID NO: 2529280 - protein, 25 aa, Entamoeba dispar
KGFNYASMGITFNGAFKALMEIIEK

SEQ ID NO: 2529281 - protein, 20 aa, Entamoeba dispar
KGGFAVPGFNFNNLEQMQAI

SEQ ID NO: 2529282 - protein, 20 aa, Entamoeba dispar
KGGILDILFKQKAGTIMKGE

SEQ ID NO: 2529283 - protein, 31 aa, Entamoeba dispar
KGGKGSVDDDFMAAYLGMQHNRIGGEGVIDL

SEQ ID NO: 2529284 - protein, 24 aa, Entamoeba dispar
KGHKFYSELLPFCRDNSIIKTDVS

SEQ ID NO: 2529285 - protein, 20 aa, Entamoeba dispar
KGHYISWNRVLDQWYCCNDE

SEQ ID NO: 2529286 - protein, 23 aa, Entamoeba dispar
KGICDYLINFITGNKSKGPVSIS

SEQ ID NO: 2529287 - protein, 28 aa, Entamoeba dispar
KGICNTDDFIYKFIRVCVMNNIGLSGPA

SEQ ID NO: 2529288 - protein, 22 aa, Entamoeba dispar
KGIDILITLAKCYYFKYIINLY

SEQ ID NO: 2529289 - protein, 26 aa, Entamoeba dispar
KGIEGMIRIILFFQFAQFQEASIVKE

SEQ ID NO: 2529290 - protein, 24 aa, Entamoeba dispar
KGIETQLSVLILLSSKDKKTMSRE

SEQ ID NO: 2529291 - protein, 18 aa, Entamoeba dispar
KGIFLRNYILDCVKSILP

SEQ ID NO: 2529292 - protein, 25 aa, Entamoeba dispar
KGIKKRVCFLFSDQVFIYGSPGVGS

SEQ ID NO: 2529293 - protein, 21 aa, Entamoeba dispar
KGIKRVIGRYSRRGNNLFIPQ

SEQ ID NO: 2529294 - protein, 19 aa, Entamoeba dispar
KGIKSWLSIALSSAPESTP

SEQ ID NO: 2529295 - protein, 21 aa, Entamoeba dispar
KGIKYVIDSGLGKWKIYNPKI

SEQ ID NO: 2529296 - protein, 17 aa, Entamoeba dispar
KGILQFYILIDDSEEYG

SEQ ID NO: 2529297 - protein, 18 aa, Entamoeba dispar
KGILQFYILIDDSEEYGI

SEQ ID NO: 2529298 - protein, 18 aa, Entamoeba dispar
KGINKPKIKYYGTVIENI

SEQ ID NO: 2529299 - protein, 26 aa, Entamoeba dispar
KGINYTTLPFYIPKEFYRLTSYIISH

SEQ ID NO: 2529300 - protein, 21 aa, Entamoeba dispar
KGIPISLNLDHGANFQICKEC

SEQ ID NO: 2529301 - protein, 24 aa, Entamoeba dispar
KGIQKYNFGPSYIYVCGCEGTWNI

SEQ ID NO: 2529302 - protein, 30 aa, Entamoeba dispar
KGITQGMFEVLFILDEFLQWGFVEKISVSN

SEQ ID NO: 2529303 - protein, 17 aa, Entamoeba dispar
KGIYMYRTYKEAIKKNS

SEQ ID NO: 2529304 - protein, 17 aa, Entamoeba dispar
KGIYPQGGGCRYCGDVN

SEQ ID NO: 2529305 - protein, 23 aa, Entamoeba dispar
KGKEIKTIYVKFADKKLRDEKET

SEQ ID NO: 2529306 - protein, 25 aa, Entamoeba dispar
KGKENILLMVFTKKGYVFGSFHSII

SEQ ID NO: 2529307 - protein, 19 aa, Entamoeba dispar
KGKGFQKSKTKLKRTDFKG

SEQ ID NO: 2529308 - protein, 18 aa, Entamoeba dispar
KGKIRPYVSVPNPLVVEA

SEQ ID NO: 2529309 - protein, 25 aa, Entamoeba dispar
KGKITCSVLFFLKSIVLSLEKECNF

SEQ ID NO: 2529310 - protein, 22 aa, Entamoeba dispar
KGKKLACSYLISITKKYQESKE

SEQ ID NO: 2529311 - protein, 24 aa, Entamoeba dispar
KGKKNLAFIIMNESDMFGCYLEDK

SEQ ID NO: 2529312 - protein, 23 aa, Entamoeba dispar
KGKKYIKLPYVVKGMDISLTGLL

SEQ ID NO: 2529313 - protein, 20 aa, Entamoeba dispar
KGKPIPPPRPGNRDALSHHH

SEQ ID NO: 2529314 - protein, 21 aa, Entamoeba dispar
KGKPSWSIKSIFLGKKSYLDV

SEQ ID NO: 2529315 - protein, 31 aa, Entamoeba dispar
KGKQCTKALGYLKYLLTNKKGFKQLCLENQL

SEQ ID NO: 2529316 - protein, 34 aa, Entamoeba dispar
KGKTIIASPRKKLGKIYTVFYQTIQLKIEYDETG

SEQ ID NO: 2529317 - protein, 24 aa, Entamoeba dispar
KGKVTPFSLLTTFGSKLIIKGRVV

SEQ ID NO: 2529318 - protein, 25 aa, Entamoeba dispar
KGLEYLFYNHLIEVGYKLIIPSYYF

SEQ ID NO: 2529319 - protein, 30 aa, Entamoeba dispar
KGLFNITCATTSMPPLYQARALFDFESKNA

SEQ ID NO: 2529320 - protein, 18 aa, Entamoeba dispar
KGLIISDDIKKPLTSLSI

SEQ ID NO: 2529321 - protein, 22 aa, Entamoeba dispar
KGLKNVLCIKVTQIGSVFGYFH

SEQ ID NO: 2529322 - protein, 40 aa, Entamoeba dispar
KGLLNEVFHVIYIPLLRHPIIFPTMKLKILELLNFVCEKN

SEQ ID NO: 2529323 - protein, 23 aa, Entamoeba dispar
KGLQGIIIVLNFTNPRLSDNIKK

SEQ ID NO: 2529324 - protein, 22 aa, Entamoeba dispar
KGLRTMVITPEMLALKEESLNG

SEQ ID NO: 2529325 - protein, 26 aa, Entamoeba dispar
KGLSVIFERLYLFILNSSLSTPQQKQ

SEQ ID NO: 2529326 - protein, 22 aa, Entamoeba dispar
KGLTKYLIIYLCAKDNDYMIKK

SEQ ID NO: 2529327 - protein, 25 aa, Entamoeba dispar
KGLVKPSMYFVLENTIENLSQLSLY

SEQ ID NO: 2529328 - protein, 17 aa, Entamoeba dispar
KGLVLYLNYKREFYETF

SEQ ID NO: 2529329 - protein, 22 aa, Entamoeba dispar
KGMLFISSIFNTINIIKGKEDE

SEQ ID NO: 2529330 - protein, 19 aa, Entamoeba dispar
KGMPFLIYVNKTDKKQFDQ

SEQ ID NO: 2529331 - protein, 18 aa, Entamoeba dispar
KGMSTLSSMWKQLPEEDK

SEQ ID NO: 2529332 - protein, 25 aa, Entamoeba dispar
KGMTNFDRIVLYFHDKRIDDSLTFS

SEQ ID NO: 2529333 - protein, 24 aa, Entamoeba dispar
KGNALYNIVHSFPLLNISTISQPI

SEQ ID NO: 2529334 - protein, 29 aa, Entamoeba dispar
KGNEGLLMPYLCCILQRIYVISSSYLEDI

SEQ ID NO: 2529335 - protein, 26 aa, Entamoeba dispar
KGNEKRIILLLKLLSKWEFESLNEEA

SEQ ID NO: 2529336 - protein, 23 aa, Entamoeba dispar
KGNIDLFHFIISGSNPILKEYLT

SEQ ID NO: 2529337 - protein, 21 aa, Entamoeba dispar
KGNLFQLRYISKATVTIQPLE

SEQ ID NO: 2529338 - protein, 17 aa, Entamoeba dispar
KGNLIVVHIIDSILKNL

SEQ ID NO: 2529339 - protein, 17 aa, Entamoeba dispar
KGNVSGLTEYMSRLLRA

SEQ ID NO: 2529340 - protein, 19 aa, Entamoeba dispar
KGPVRGIFKEIFNHINSLK

SEQ ID NO: 2529341 - protein, 22 aa, Entamoeba dispar
KGPVRIPTKILRITTRKTPCGE

SEQ ID NO: 2529342 - protein, 27 aa, Entamoeba dispar
KGQELVRVLLFYQLCSFCLKCFYKELS

SEQ ID NO: 2529343 - protein, 26 aa, Entamoeba dispar
KGQKFNRIHSFLYSGYWGNVIARLDN

SEQ ID NO: 2529344 - protein, 25 aa, Entamoeba dispar
KGQLDNIHIRYFDSIPIALSLQFSK

SEQ ID NO: 2529345 - protein, 23 aa, Entamoeba dispar
KGQLHVLYQPDGRPRNVYPIELL

SEQ ID NO: 2529346 - protein, 23 aa, Entamoeba dispar
KGQLLNIKFYREGIENEKRIFEL

SEQ ID NO: 2529347 - protein, 32 aa, Entamoeba dispar
KGRDYKILSLQEWYRMLWDYDYFEYIRDVMKL

SEQ ID NO: 2529348 - protein, 19 aa, Entamoeba dispar
KGRELLIEKKWPIGNIKFE

SEQ ID NO: 2529349 - protein, 17 aa, Entamoeba dispar
KGRIIHEILINYSSQTS

SEQ ID NO: 2529350 - protein, 17 aa, Entamoeba dispar
KGRTTIIIAHRLSTIQN

SEQ ID NO: 2529351 - protein, 26 aa, Entamoeba dispar
KGSILPNLLISSFKRDLSLSNLMIHS

SEQ ID NO: 2529352 - protein, 18 aa, Entamoeba dispar
KGSIWDLLHQRPMEFFEI

SEQ ID NO: 2529353 - protein, 23 aa, Entamoeba dispar
KGSKSWVFGIEKGFWIHSKQNKS

SEQ ID NO: 2529354 - protein, 22 aa, Entamoeba dispar
KGSPFTPEILPGITAGNCVVSG

SEQ ID NO: 2529355 - protein, 25 aa, Entamoeba dispar
KGSQGPLPIKFTPLSPSDSLIQISP

SEQ ID NO: 2529356 - protein, 24 aa, Entamoeba dispar
KGSQQQIFPIFTLKTIIQTDSLDS

SEQ ID NO: 2529357 - protein, 32 aa, Entamoeba dispar
KGSTHYYIRTRDGFILMYSITSRYSFDLIQDI

SEQ ID NO: 2529358 - protein, 18 aa, Entamoeba dispar
KGTETLVNLPLDKGIKKP

SEQ ID NO: 2529359 - protein, 17 aa, Entamoeba dispar
KGTKDLIAMGIMLGLTT

SEQ ID NO: 2529360 - protein, 17 aa, Entamoeba dispar
KGTPHLLLTKNVLNYCQ

SEQ ID NO: 2529361 - protein, 24 aa, Entamoeba dispar
KGVKFYSPIVVLLESKKKINISYI

SEQ ID NO: 2529362 - protein, 34 aa, Entamoeba dispar
KGVNFLLCICNDIRFPAFLRNLKLEYDVILCSIN

SEQ ID NO: 2529363 - protein, 34 aa, Entamoeba dispar
KGVTTLELYIPISPLQLPTVIAPPFSLTNSVVLK

SEQ ID NO: 2529364 - protein, 33 aa, Entamoeba dispar
KGWNILLAVCYDLRFPVWLRNTLENHYDILIIV

SEQ ID NO: 2529365 - protein, 17 aa, Entamoeba dispar
KGYAYYTALEYSNTISK

SEQ ID NO: 2529366 - protein, 24 aa, Entamoeba dispar
KGYGNIYVILFDQNMNVFGCFIHS

SEQ ID NO: 2529367 - protein, 22 aa, Entamoeba dispar
KGYIPFIGVIIQDLTFIDEGNP

SEQ ID NO: 2529368 - protein, 17 aa, Entamoeba dispar
KGYKSFFQKRYFQFLLS

SEQ ID NO: 2529369 - protein, 19 aa, Entamoeba dispar
KGYWIVLDELNLAPSEVLE

SEQ ID NO: 2529370 - protein, 18 aa, Entamoeba dispar
KHAIAYGLVMTQLKHMKK

SEQ ID NO: 2529371 - protein, 21 aa, Entamoeba dispar
KHCVALFEFMATAATLDNEIF

SEQ ID NO: 2529372 - protein, 19 aa, Entamoeba dispar
KHDISWTKDTFKLFQVLIQ

SEQ ID NO: 2529373 - protein, 30 aa, Entamoeba dispar
KHEAFFIHHGLFLLVESLKLIVYRNLFDLV

SEQ ID NO: 2529374 - protein, 26 aa, Entamoeba dispar
KHEPKQYISLAPILYEIIKEPINQNN

SEQ ID NO: 2529375 - protein, 32 aa, Entamoeba dispar
KHFNIALEINPIYQRLWFALGICCLQISDISG

SEQ ID NO: 2529376 - protein, 25 aa, Entamoeba dispar
KHFNNLCLRFHFFQSILNKVIVNSD

SEQ ID NO: 2529377 - protein, 24 aa, Entamoeba dispar
KHFPYYRTAIPKILLDPPFCNNPQ

SEQ ID NO: 2529378 - protein, 33 aa, Entamoeba dispar
KHGHVPKLMCPLFYLGFCPYGKKCKFVHPTISV

SEQ ID NO: 2529379 - protein, 23 aa, Entamoeba dispar
KHGKKLEIFERYLMIIGSGHISI

SEQ ID NO: 2529380 - protein, 17 aa, Entamoeba dispar
KHGMEVFGVKRPVSWIL

SEQ ID NO: 2529381 - protein, 25 aa, Entamoeba dispar
KHGWTLLHYAAWFNKSHICSMLMRY

SEQ ID NO: 2529382 - protein, 20 aa, Entamoeba dispar
KHIIFHLHLIAQYSQFNLMD

SEQ ID NO: 2529383 - protein, 17 aa, Entamoeba dispar
KHIPHCFIQFQNMFISL

SEQ ID NO: 2529384 - protein, 25 aa, Entamoeba dispar
KHIQPNYILMNLPATAIEFLDCIPE

SEQ ID NO: 2529385 - protein, 22 aa, Entamoeba dispar
KHKKGLFDLFSRIKHTTNEEKK

SEQ ID NO: 2529386 - protein, 27 aa, Entamoeba dispar
KHLDKLFEIINKYLLHQHPRVRNMALS

SEQ ID NO: 2529387 - protein, 34 aa, Entamoeba dispar
KHMHRAILFFYNNTFPYFFRMELICRRNVGIIST

SEQ ID NO: 2529388 - protein, 35 aa, Entamoeba dispar
KHMKHKHIVLVLNKCDLVPTWATARWVKVLSKEFP

SEQ ID NO: 2529389 - protein, 25 aa, Entamoeba dispar
KHNLNKSVLLYSLYNSIHNSDIVYD

SEQ ID NO: 2529390 - protein, 24 aa, Entamoeba dispar
KHNQLRELALWNGTFREDRVYEVE

SEQ ID NO: 2529391 - protein, 17 aa, Entamoeba dispar
KHNVKMVYAVNRGPFTM

SEQ ID NO: 2529392 - protein, 33 aa, Entamoeba dispar
KHPFIVHLEWDFETPFYYIFVMTYCAGGDFWRL

SEQ ID NO: 2529393 - protein, 25 aa, Entamoeba dispar
KHPKQKVCIVRFSKDVKILGDCTKQ

SEQ ID NO: 2529394 - protein, 30 aa, Entamoeba dispar
KHPLDYFFVVSKTCPLLKFEKHLIPKTNNE

SEQ ID NO: 2529395 - protein, 26 aa, Entamoeba dispar
KHPNTPQWRLITFTDKTINQFINALH

SEQ ID NO: 2529396 - protein, 26 aa, Entamoeba dispar
KHPTRDLILPQIIITLDIAFREKGGF

SEQ ID NO: 2529397 - protein, 23 aa, Entamoeba dispar
KHQILIPIIGNFGVGKTSLLFTF

SEQ ID NO: 2529398 - protein, 26 aa, Entamoeba dispar
KHQLRALLYFIPIEQKGKYYIHCLNS

SEQ ID NO: 2529399 - protein, 17 aa, Entamoeba dispar
KHQTTINIILEVISKFV

SEQ ID NO: 2529400 - protein, 39 aa, Entamoeba dispar
KHQVLSVFGIKWLKMMFAREFLLADSVIIWDAIFAYGSS

SEQ ID NO: 2529401 - protein, 25 aa, Entamoeba dispar
KHRVRALTLIIFTDVLILCKKEKKG

SEQ ID NO: 2529402 - protein, 23 aa, Entamoeba dispar
KHSKYFAQWTERHYGYKKIFDTA

SEQ ID NO: 2529403 - protein, 17 aa, Entamoeba dispar
KHSLHWSSSLLLRYFPS

SEQ ID NO: 2529404 - protein, 25 aa, Entamoeba dispar
KHTENFFYNYALKKYAKKDKEEMEL

SEQ ID NO: 2529405 - protein, 42 aa, Entamoeba dispar
KHTNAIRKCFISYKGYFYTAVVYGIPITWMVPHQFAIEKNET

SEQ ID NO: 2529406 - protein, 22 aa, Entamoeba dispar
KHTNEIIFCNYQYIVGMDPKIY

SEQ ID NO: 2529407 - protein, 17 aa, Entamoeba dispar
KHVCIVWTKCYCYTPKN

SEQ ID NO: 2529408 - protein, 30 aa, Entamoeba dispar
KHWKEVLISKYYRSLLRLIGQFDQQQIELS

SEQ ID NO: 2529409 - protein, 22 aa, Entamoeba dispar
KHYRDSFILGLFDALSGHVSST

SEQ ID NO: 2529410 - protein, 24 aa, Entamoeba dispar
KHYTNFMVGYVPYGALFCILDQFL

SEQ ID NO: 2529411 - protein, 19 aa, Entamoeba dispar
KIAALKKALGNYPTILGTI

SEQ ID NO: 2529412 - protein, 25 aa, Entamoeba dispar
KIAKDEIILIMPLKTDPETGYFSLI

SEQ ID NO: 2529413 - protein, 25 aa, Entamoeba dispar
KIAPSDLAFVIIVPSLNGIMSDVNV

SEQ ID NO: 2529414 - protein, 20 aa, Entamoeba dispar
KIAQSMKPMLGKTSEIKAEE

SEQ ID NO: 2529415 - protein, 35 aa, Entamoeba dispar
KIASESHFVIKLLDLIFSSILLQQQHQIAIAMEFC

SEQ ID NO: 2529416 - protein, 23 aa, Entamoeba dispar
KIASIGEWSFCECPRLSIIEYNS

SEQ ID NO: 2529417 - protein, 17 aa, Entamoeba dispar
KIASLIDRYENNDRKKQ

SEQ ID NO: 2529418 - protein, 18 aa, Entamoeba dispar
KICFNGVIEFNFNPMTKI

SEQ ID NO: 2529419 - protein, 27 aa, Entamoeba dispar
KICGEKNVMFIIITKTGYAFGCFCHKK

SEQ ID NO: 2529420 - protein, 21 aa, Entamoeba dispar
KICILKGISPRLPSKGLNTLT

SEQ ID NO: 2529421 - protein, 20 aa, Entamoeba dispar
KICSYLFNCANDKKECYLPR

SEQ ID NO: 2529422 - protein, 24 aa, Entamoeba dispar
KIDETLIIKIEEIKRRLETLKKNQ

SEQ ID NO: 2529423 - protein, 24 aa, Entamoeba dispar
KIDEYKMTVYLTKILPRFVSDINN

SEQ ID NO: 2529424 - protein, 26 aa, Entamoeba dispar
KIDGEVQLIPVQKIKSKPGKRKQITK

SEQ ID NO: 2529425 - protein, 24 aa, Entamoeba dispar
KIDHSFLIPLITSIEIIARGCNVK

SEQ ID NO: 2529426 - protein, 21 aa, Entamoeba dispar
KIDIRSHYPVLNLSHAVGIAL

SEQ ID NO: 2529427 - protein, 27 aa, Entamoeba dispar
KIDKDELYKYVYSISDPAERTKVIRTL

SEQ ID NO: 2529428 - protein, 22 aa, Entamoeba dispar
KIDLKEIAFLSLYSLKKITFPT

SEQ ID NO: 2529429 - protein, 21 aa, Entamoeba dispar
KIDLKLCLAPFLDKLPNVSSE

SEQ ID NO: 2529430 - protein, 26 aa, Entamoeba dispar
KIDRDHYMCIICFKRMSRGYACCHCI

SEQ ID NO: 2529431 - protein, 25 aa, Entamoeba dispar
KIDRTYCVFAYLQRIQILNCFYTGC

SEQ ID NO: 2529432 - protein, 19 aa, Entamoeba dispar
KIECFFSLIQSKMTAQDIT

SEQ ID NO: 2529433 - protein, 23 aa, Entamoeba dispar
KIEDKLILPSTLKQYAMLITDKY

SEQ ID NO: 2529434 - protein, 23 aa, Entamoeba dispar
KIEEKRVLVLAGNKVDLSERVIT

SEQ ID NO: 2529435 - protein, 24 aa, Entamoeba dispar
KIEEMITNLWIRYSSVLKSIKADK

SEQ ID NO: 2529436 - protein, 21 aa, Entamoeba dispar
KIEFLKYITCRYLDVLSSEVY

SEQ ID NO: 2529437 - protein, 35 aa, Entamoeba dispar
KIEFNSLMTPFIPILRFRMLKDIKQLPGLYVLMLL

SEQ ID NO: 2529438 - protein, 19 aa, Entamoeba dispar
KIEGFLPLTGTAFVAWGDK

SEQ ID NO: 2529439 - protein, 26 aa, Entamoeba dispar
KIEGKKRITLLPLLSELDIWNQMDVW

SEQ ID NO: 2529440 - protein, 24 aa, Entamoeba dispar
KIEIAQAIYIRWKTKKLINERMLT

SEQ ID NO: 2529441 - protein, 17 aa, Entamoeba dispar
KIEIFTNKIPLLKDEIP

SEQ ID NO: 2529442 - protein, 24 aa, Entamoeba dispar
KIEIKNPMFIVSLPRSGSTYLHNL

SEQ ID NO: 2529443 - protein, 28 aa, Entamoeba dispar
KIEITPQVTNPLNAIKSTPPTPANEIET

SEQ ID NO: 2529444 - protein, 21 aa, Entamoeba dispar
KIEIWRIPVLTRPVSFTLVRQ

SEQ ID NO: 2529445 - protein, 29 aa, Entamoeba dispar
KIELPKYFFCFRFIKTPDLIELHWSKKHY

SEQ ID NO: 2529446 - protein, 20 aa, Entamoeba dispar
KIENITFKSLPIEQINNLKN

SEQ ID NO: 2529447 - protein, 30 aa, Entamoeba dispar
KIEQIQQTKLIYEKFKPITPTPLSNQIEIE

SEQ ID NO: 2529448 - protein, 25 aa, Entamoeba dispar
KIESFYPIEVSTLVLRTLYNIFIQK

SEQ ID NO: 2529449 - protein, 23 aa, Entamoeba dispar
KIESYNFIPFINSLIELINSPIN

SEQ ID NO: 2529450 - protein, 31 aa, Entamoeba dispar
KIETIHFLQDILLDYGYFFTLATEKGKKSTN

SEQ ID NO: 2529451 - protein, 19 aa, Entamoeba dispar
KIEVTKDGFKFDFGKNETA

SEQ ID NO: 2529452 - protein, 17 aa, Entamoeba dispar
KIFEIEPTLFVFKATSH

SEQ ID NO: 2529453 - protein, 19 aa, Entamoeba dispar
KIFEMYCLKSNMLELLRII

SEQ ID NO: 2529454 - protein, 31 aa, Entamoeba dispar
KIFHNRFIVLEDSLIFISKEKLNQFIFQLQN

SEQ ID NO: 2529455 - protein, 25 aa, Entamoeba dispar
KIFINEPVLISIKIPKNLQIINGKN

SEQ ID NO: 2529456 - protein, 18 aa, Entamoeba dispar
KIFLKSEDMWMKYPLMEF

SEQ ID NO: 2529457 - protein, 20 aa, Entamoeba dispar
KIFLNFLKKCQILYDEIAER

SEQ ID NO: 2529458 - protein, 34 aa, Entamoeba dispar
KIFNDGRIFTYVIWYPVSYLTYLKEKGTGNIYKN

SEQ ID NO: 2529459 - protein, 18 aa, Entamoeba dispar
KIFSKILTPKTISFEQHP

SEQ ID NO: 2529460 - protein, 17 aa, Entamoeba dispar
KIFSLQLEYGPYSTNFT

SEQ ID NO: 2529461 - protein, 26 aa, Entamoeba dispar
KIFVNEYNLGFIYIDNLKRINGKEVE

SEQ ID NO: 2529462 - protein, 21 aa, Entamoeba dispar
KIGASWKKEYFWLSSRRDCYI

SEQ ID NO: 2529463 - protein, 25 aa, Entamoeba dispar
KIGCGRFYEWSSLTPINIGNIKFIS

SEQ ID NO: 2529464 - protein, 23 aa, Entamoeba dispar
KIGEGCFNLCYSLTSIDIPSSVS

SEQ ID NO: 2529465 - protein, 24 aa, Entamoeba dispar
KIGEGCFNLCYSLTSIDIPSSVSE

SEQ ID NO: 2529466 - protein, 26 aa, Entamoeba dispar
KIGLTVCGWKNGFYKDCLFSPDESNF

SEQ ID NO: 2529467 - protein, 24 aa, Entamoeba dispar
KIGMYLLRGISRKKEWIKKVKKNE

SEQ ID NO: 2529468 - protein, 31 aa, Entamoeba dispar
KIGNDIYQFCRTFVLILSPNPIILNDHLHLF

SEQ ID NO: 2529469 - protein, 21 aa, Entamoeba dispar
KIGPNPLTNEKLYNSKYAIFD

SEQ ID NO: 2529470 - protein, 24 aa, Entamoeba dispar
KIGQFKIFPWIMETSNLLSFNDQI

SEQ ID NO: 2529471 - protein, 22 aa, Entamoeba dispar
KIGWLEKPIPECGPLDVICRPL

SEQ ID NO: 2529472 - protein, 30 aa, Entamoeba dispar
KIGWSCFSGCPWLNEVIIPSSVSKIGGSCF

SEQ ID NO: 2529473 - protein, 26 aa, Entamoeba dispar
KIGYDCFYYNLFKSIDLSHVLQLDVG

SEQ ID NO: 2529474 - protein, 24 aa, Entamoeba dispar
KIHECGGLYKIYIADWFAQLNHKM

SEQ ID NO: 2529475 - protein, 25 aa, Entamoeba dispar
KIHERANAFNLKWMKSNINGKWSGK

SEQ ID NO: 2529476 - protein, 23 aa, Entamoeba dispar
KIHFNVESFYYSNSSWIYVRGVC

SEQ ID NO: 2529477 - protein, 18 aa, Entamoeba dispar
KIHLLIVPKGGRSVMPII

SEQ ID NO: 2529478 - protein, 24 aa, Entamoeba dispar
KIHQHMYIDSIPLIIKFEDSNKWP

SEQ ID NO: 2529479 - protein, 26 aa, Entamoeba dispar
KIHSCDFLFPMNFPQSLQSLDLFIEN

SEQ ID NO: 2529480 - protein, 24 aa, Entamoeba dispar
KIHTDLMVALAHFGEKWPGYEFEV

SEQ ID NO: 2529481 - protein, 20 aa, Entamoeba dispar
KIHVSDDLEYLLMENQIYSK

SEQ ID NO: 2529482 - protein, 33 aa, Entamoeba dispar
KIIDDLIHCNSFRLTPMWTYLTQIQIKEQFEQN

SEQ ID NO: 2529483 - protein, 17 aa, Entamoeba dispar
KIIDSIIFAFKGRVLAF

SEQ ID NO: 2529484 - protein, 35 aa, Entamoeba dispar
KIIEDIKKGMKVGMKKGFKKGFHKEFHDKKNKKNH

SEQ ID NO: 2529485 - protein, 18 aa, Entamoeba dispar
KIIEILGMYLQYFNQNEQ

SEQ ID NO: 2529486 - protein, 19 aa, Entamoeba dispar
KIIIRNTQKLLILQNEKEN

SEQ ID NO: 2529487 - protein, 36 aa, Entamoeba dispar
KIIKEDLDRWEYAKSAILVLFKPLDYAMANGASLTI

SEQ ID NO: 2529488 - protein, 20 aa, Entamoeba dispar
KIILIYQMSYRKTKDLKKTL

SEQ ID NO: 2529489 - protein, 34 aa, Entamoeba dispar
KIILSGIRILNRLLLLSFPSQEIIYPSIIKAAER

SEQ ID NO: 2529490 - protein, 25 aa, Entamoeba dispar
KIINHSNLPLYLLTDNIYAIGNTMF

SEQ ID NO: 2529491 - protein, 17 aa, Entamoeba dispar
KIIPFDKVHNGLCDCED

SEQ ID NO: 2529492 - protein, 18 aa, Entamoeba dispar
KIIQLTKTEIPKKCFKWN

SEQ ID NO: 2529493 - protein, 20 aa, Entamoeba dispar
KIIRFECLICDILETAIKYE

SEQ ID NO: 2529494 - protein, 21 aa, Entamoeba dispar
KIITIPDIPLELKYLKSLDVS

SEQ ID NO: 2529495 - protein, 17 aa, Entamoeba dispar
KIKDFIKLTKWNDINYA

SEQ ID NO: 2529496 - protein, 27 aa, Entamoeba dispar
KIKDLDYLIGPILYQENWKDLIKEKYI

SEQ ID NO: 2529497 - protein, 17 aa, Entamoeba dispar
KIKEIYSFSKHAIRIYD

SEQ ID NO: 2529498 - protein, 18 aa, Entamoeba dispar
KIKEVFDAMNGKNVWEVI

SEQ ID NO: 2529499 - protein, 18 aa, Entamoeba dispar
KIKIIPRAYPRLPHPNGY

SEQ ID NO: 2529500 - protein, 27 aa, Entamoeba dispar
KIKKFITTYYFMIEIKPSPQFVIEGDI

SEQ ID NO: 2529501 - protein, 25 aa, Entamoeba dispar
KIKKIEPPLPSIPPPRRKSLFIQNT

SEQ ID NO: 2529502 - protein, 18 aa, Entamoeba dispar
KIKKKALPSGPIQFNEEF

SEQ ID NO: 2529503 - protein, 24 aa, Entamoeba dispar
KIKKKLFLTFVHHINQFFDNYGDA

SEQ ID NO: 2529504 - protein, 22 aa, Entamoeba dispar
KIKKPIYIVSLPRSGSTFTHAV

SEQ ID NO: 2529505 - protein, 24 aa, Entamoeba dispar
KIKKYLKRHPLLIEEEILEELIER

SEQ ID NO: 2529506 - protein, 21 aa, Entamoeba dispar
KIKKYLKRHPLLIEEEIPEEL

SEQ ID NO: 2529507 - protein, 17 aa, Entamoeba dispar
KIKLFKKKNQLILEELK

SEQ ID NO: 2529508 - protein, 20 aa, Entamoeba dispar
KIKLIIIDSIPTFYKKTICN

SEQ ID NO: 2529509 - protein, 19 aa, Entamoeba dispar
KIKNITLNPLFIRPDEEPE

SEQ ID NO: 2529510 - protein, 21 aa, Entamoeba dispar
KIKQTIIAIPYINFVLNEHYQ

SEQ ID NO: 2529511 - protein, 23 aa, Entamoeba dispar
KIKSCILMTQRGHSKGFGFVEYE

SEQ ID NO: 2529512 - protein, 23 aa, Entamoeba dispar
KIKSEACWLLANTIFKINDSMYN

SEQ ID NO: 2529513 - protein, 18 aa, Entamoeba dispar
KIKSRWMRKNSRRIDMEN

SEQ ID NO: 2529514 - protein, 35 aa, Entamoeba dispar
KIKTFLVYPIEEQLLSWLLDGFLELESDQYEKVFN

SEQ ID NO: 2529515 - protein, 23 aa, Entamoeba dispar
KIKTFVEFPFFINNMVETGSMVT

SEQ ID NO: 2529516 - protein, 25 aa, Entamoeba dispar
KIKTKKEKLLPKLKKLVKDTTRDDE

SEQ ID NO: 2529517 - protein, 35 aa, Entamoeba dispar
KIKTLDLGNYHLKFLIQPFLHWPDTMMTVIEELKV

SEQ ID NO: 2529518 - protein, 25 aa, Entamoeba dispar
KIKTTDLCILILKSLKELKPEKEFY

SEQ ID NO: 2529519 - protein, 23 aa, Entamoeba dispar
KIKTTRFVVLILTSLKVLKPGVE

SEQ ID NO: 2529520 - protein, 17 aa, Entamoeba dispar
KIKVRTVIALKGLLLDA

SEQ ID NO: 2529521 - protein, 36 aa, Entamoeba dispar
KILDFKTFLLDNLSISLIPYLFHSYTIYNILSEFDV

SEQ ID NO: 2529522 - protein, 18 aa, Entamoeba dispar
KILDGSIDLKKLAQDDVL

SEQ ID NO: 2529523 - protein, 20 aa, Entamoeba dispar
KILDLKGKLILPSLCTFGNL

SEQ ID NO: 2529524 - protein, 20 aa, Entamoeba dispar
KILDPLLIDFIFQHRDNNKK

SEQ ID NO: 2529525 - protein, 25 aa, Entamoeba dispar
KILEEFICYFIIDKSLNENEIVLND

SEQ ID NO: 2529526 - protein, 25 aa, Entamoeba dispar
KILEVLSIDLLPILPIEQWKNTSSF

SEQ ID NO: 2529527 - protein, 21 aa, Entamoeba dispar
KILIDIFQIDKVIVPSLVMLL

SEQ ID NO: 2529528 - protein, 18 aa, Entamoeba dispar
KILIFSQMTRMLDIIDDY

SEQ ID NO: 2529529 - protein, 17 aa, Entamoeba dispar
KILKEWVQLGNKIVIFN

SEQ ID NO: 2529530 - protein, 32 aa, Entamoeba dispar
KILKIEKYHIPYLFPIPYLSDEKYSIAFYYNE

SEQ ID NO: 2529531 - protein, 23 aa, Entamoeba dispar
KILKYPWNDLLSLPNLKRIIIKC

SEQ ID NO: 2529532 - protein, 17 aa, Entamoeba dispar
KILLFGCNGFVGKFILR

SEQ ID NO: 2529533 - protein, 31 aa, Entamoeba dispar
KILLTCKRYHPMFHYYYYNNNYLDNEKINKI

SEQ ID NO: 2529534 - protein, 19 aa, Entamoeba dispar
KILMTDIRKPPTRDPPLAL

SEQ ID NO: 2529535 - protein, 18 aa, Entamoeba dispar
KILPFAQTLLQISHKMIT

SEQ ID NO: 2529536 - protein, 17 aa, Entamoeba dispar
KILRHPKTQYSRVILIR

SEQ ID NO: 2529537 - protein, 18 aa, Entamoeba dispar
KILSLFIHQLGSQKDKII

SEQ ID NO: 2529538 - protein, 20 aa, Entamoeba dispar
KIMADALWGFSFIVSNPQNI

SEQ ID NO: 2529539 - protein, 22 aa, Entamoeba dispar
KIMKFNRPMVLLTDIGGQGKCQ

SEQ ID NO: 2529540 - protein, 24 aa, Entamoeba dispar
KIMKGFINVFKYDVSDDRDIIFKF

SEQ ID NO: 2529541 - protein, 22 aa, Entamoeba dispar
KIMPLELRALISGLPFCVVSTD

SEQ ID NO: 2529542 - protein, 26 aa, Entamoeba dispar
KIMTNTDEYFIEKIRETKSGYEKIKK

SEQ ID NO: 2529543 - protein, 21 aa, Entamoeba dispar
KINALIPARMQCVIDALLVPE

SEQ ID NO: 2529544 - protein, 28 aa, Entamoeba dispar
KINEDLRIKIFLWKTIQCDKSLGTVRGG

SEQ ID NO: 2529545 - protein, 21 aa, Entamoeba dispar
KINENIIVFDTPPSLLEIKQE

SEQ ID NO: 2529546 - protein, 25 aa, Entamoeba dispar
KINEPYIPLINAFLKDIEKFEDENP

SEQ ID NO: 2529547 - protein, 29 aa, Entamoeba dispar
KINEYGHHWTLISQFIPGRAPNSIKNRFY

SEQ ID NO: 2529548 - protein, 25 aa, Entamoeba dispar
KINFLDERFVLHYLHSILLSVTGCY

SEQ ID NO: 2529549 - protein, 24 aa, Entamoeba dispar
KINFYYCNRIRSFKIPTKITSLRL

SEQ ID NO: 2529550 - protein, 25 aa, Entamoeba dispar
KINKEEIIKMVKSGEYKLVPIEQYD

SEQ ID NO: 2529551 - protein, 24 aa, Entamoeba dispar
KINKKVIWYKLKYSTYLEEKQKGN

SEQ ID NO: 2529552 - protein, 22 aa, Entamoeba dispar
KINKLFYIQKINRVKEWILSKH

SEQ ID NO: 2529553 - protein, 24 aa, Entamoeba dispar
KINKQIIWYEVYYSRYLKEKEAGN

SEQ ID NO: 2529554 - protein, 19 aa, Entamoeba dispar
KINLSIKERIIGSSAIQSA

SEQ ID NO: 2529555 - protein, 17 aa, Entamoeba dispar
KINRIKLFEGILEIIDG

SEQ ID NO: 2529556 - protein, 22 aa, Entamoeba dispar
KINRLLFELFVTLIFNEREEDV

SEQ ID NO: 2529557 - protein, 32 aa, Entamoeba dispar
KINSKIDFLRFYITNYKLYFIACQKISHVFSY

SEQ ID NO: 2529558 - protein, 23 aa, Entamoeba dispar
KINSPFQHATLKPKFNFFERAEE

SEQ ID NO: 2529559 - protein, 30 aa, Entamoeba dispar
KINTSLLPPKYDLLSFIQISEIPSKCQQQT

SEQ ID NO: 2529560 - protein, 39 aa, Entamoeba dispar
KINYFYKLFKIIREYIIQQLNDLLRWLFGEMIQSECIEN

SEQ ID NO: 2529561 - protein, 29 aa, Entamoeba dispar
KINYSHCYGWLPLLYKITQEDFFASLIHL

SEQ ID NO: 2529562 - protein, 24 aa, Entamoeba dispar
KIPESLFSMTKLVELFLNCNQIPE

SEQ ID NO: 2529563 - protein, 29 aa, Entamoeba dispar
KIPGKYFIKYMRNIPIHFQWFTQQKQIDL

SEQ ID NO: 2529564 - protein, 26 aa, Entamoeba dispar
KIPINNPHLLCVFPVPIISEKDEYYV

SEQ ID NO: 2529565 - protein, 29 aa, Entamoeba dispar
KIPLVYAVQLQLPLLVRLILDIDSSDVKL

SEQ ID NO: 2529566 - protein, 19 aa, Entamoeba dispar
KIPNLFKFAGDMLGLTQFN

SEQ ID NO: 2529567 - protein, 17 aa, Entamoeba dispar
KIPPLKNNKDKLIYHYI

SEQ ID NO: 2529568 - protein, 25 aa, Entamoeba dispar
KIPQLLSWRLNGELSLWNLGQKNQI

SEQ ID NO: 2529569 - protein, 24 aa, Entamoeba dispar
KIPQLPEYIKYICVQSRMLNLIID

SEQ ID NO: 2529570 - protein, 31 aa, Entamoeba dispar
KIPSLLSHYIQLYFLPAVRSLVIEEIRRSFR

SEQ ID NO: 2529571 - protein, 24 aa, Entamoeba dispar
KIQALQEIEEIIKTGPILEREPEE

SEQ ID NO: 2529572 - protein, 25 aa, Entamoeba dispar
KIQEKLYLDFLFSRDKTDNLLLNNI

SEQ ID NO: 2529573 - protein, 19 aa, Entamoeba dispar
KIQKFVYLDGPNKTDFIID

SEQ ID NO: 2529574 - protein, 29 aa, Entamoeba dispar
KIQKKYQPIPFFIPKEIYRLIDYIIQHYE

SEQ ID NO: 2529575 - protein, 21 aa, Entamoeba dispar
KIQLLLPKLPDLLMSKDLSLR

SEQ ID NO: 2529576 - protein, 36 aa, Entamoeba dispar
KIQQLQEFYIIFIDGYQFCIGFYFSIQSVKEWEWIV

SEQ ID NO: 2529577 - protein, 25 aa, Entamoeba dispar
KIREELPIFFKKKEIIRSIKENQIN

SEQ ID NO: 2529578 - protein, 23 aa, Entamoeba dispar
KIRNPIFSFTFTIPFGYYEVKVI

SEQ ID NO: 2529579 - protein, 17 aa, Entamoeba dispar
KIRQKYAILLGEEEKGE

SEQ ID NO: 2529580 - protein, 32 aa, Entamoeba dispar
KIRRGIQILKMRYLIIYKYYSDKSVILALIRD

SEQ ID NO: 2529581 - protein, 26 aa, Entamoeba dispar
KIRSATTFMLLLLDPDWYNSESFKKL

SEQ ID NO: 2529582 - protein, 28 aa, Entamoeba dispar
KIRSTFFQMYFSTLYICGFDEMLKIIKI

SEQ ID NO: 2529583 - protein, 24 aa, Entamoeba dispar
KIRVVLWEMFLGILKFNSTEEERK

SEQ ID NO: 2529584 - protein, 18 aa, Entamoeba dispar
KIRWQRVHVAKFNKCIVA

SEQ ID NO: 2529585 - protein, 19 aa, Entamoeba dispar
KIRYQSNLVFIVITNNEQF

SEQ ID NO: 2529586 - protein, 32 aa, Entamoeba dispar
KISEAHHYLMDLLRLHGYFYNSYYSSGKNHSN

SEQ ID NO: 2529587 - protein, 18 aa, Entamoeba dispar
KISEGEMYNVLVLTDFVA

SEQ ID NO: 2529588 - protein, 20 aa, Entamoeba dispar
KISEVKRILKMNKQSIGIVG

SEQ ID NO: 2529589 - protein, 17 aa, Entamoeba dispar
KISGSFSSLLFSAPEVN

SEQ ID NO: 2529590 - protein, 21 aa, Entamoeba dispar
KISIDPYTIEKFPLPSKHPIV

SEQ ID NO: 2529591 - protein, 21 aa, Entamoeba dispar
KISIKVIKDIKILRKCLIGNS

SEQ ID NO: 2529592 - protein, 22 aa, Entamoeba dispar
KISKDFIPFAINKILNDAPNNQ

SEQ ID NO: 2529593 - protein, 35 aa, Entamoeba dispar
KISKELFSRPIYAVICMFLRIVVSEVQLQISSYNA

SEQ ID NO: 2529594 - protein, 28 aa, Entamoeba dispar
KISKQVMGCLLLFPRIQIDYQTFYNQSY

SEQ ID NO: 2529595 - protein, 24 aa, Entamoeba dispar
KISKTIICYLLRFGTKIDEENMIL

SEQ ID NO: 2529596 - protein, 26 aa, Entamoeba dispar
KISLPKHILFVIRAKKFKPIYELVKL

SEQ ID NO: 2529597 - protein, 17 aa, Entamoeba dispar
KISLQLLNGLQYLHSNK

SEQ ID NO: 2529598 - protein, 25 aa, Entamoeba dispar
KISRQSFFYIILEFIKNQTNCEIAY

SEQ ID NO: 2529599 - protein, 21 aa, Entamoeba dispar
KISSFILFPNQIITIRTESLI

SEQ ID NO: 2529600 - protein, 29 aa, Entamoeba dispar
KISSLMIGVSNILKLYFPDNTNPFDDNAP

SEQ ID NO: 2529601 - protein, 26 aa, Entamoeba dispar
KISVIPPHLFKITSLKKLILSQNNLY

SEQ ID NO: 2529602 - protein, 25 aa, Entamoeba dispar
KISYPSLIFPSYSSAALSYLKRPTS

SEQ ID NO: 2529603 - protein, 25 aa, Entamoeba dispar
KITADLFLVFLKQLKEKSQDLVIQN

SEQ ID NO: 2529604 - protein, 21 aa, Entamoeba dispar
KITEGVLLRMVLSDLIKQSQS

SEQ ID NO: 2529605 - protein, 23 aa, Entamoeba dispar
KITERVYLQRILSNVAKSFGTRI

SEQ ID NO: 2529606 - protein, 19 aa, Entamoeba dispar
KITKGIILHQLMAFNQIRK

SEQ ID NO: 2529607 - protein, 22 aa, Entamoeba dispar
KITKGIILHQLMAFNQIRKLEV

SEQ ID NO: 2529608 - protein, 22 aa, Entamoeba dispar
KITKGVILHQLMAFNQIRKLEV

SEQ ID NO: 2529609 - protein, 25 aa, Entamoeba dispar
KITNEFLNTIIIDALYQLEELELSL

SEQ ID NO: 2529610 - protein, 22 aa, Entamoeba dispar
KITQGFELSFSFDPEKLKEPYS

SEQ ID NO: 2529611 - protein, 23 aa, Entamoeba dispar
KITQPLIISKILKYMGIADELKK

SEQ ID NO: 2529612 - protein, 23 aa, Entamoeba dispar
KITQRYLLLGFERGIRIYKFVNE

SEQ ID NO: 2529613 - protein, 24 aa, Entamoeba dispar
KITRSSLFLAYLIENPFNREICLL

SEQ ID NO: 2529614 - protein, 20 aa, Entamoeba dispar
KITTKTYTPYSSSIVPKPVS

SEQ ID NO: 2529615 - protein, 20 aa, Entamoeba dispar
KIVCLRVFNDLFETFIENRD

SEQ ID NO: 2529616 - protein, 27 aa, Entamoeba dispar
KIVELFIKPNLSILKKVTYTKHILNLL

SEQ ID NO: 2529617 - protein, 28 aa, Entamoeba dispar
KIVFEPIFQYLMQTIIEKLIIYQNLDSF

SEQ ID NO: 2529618 - protein, 20 aa, Entamoeba dispar
KIVFKYLPIKEIKCVTIINH

SEQ ID NO: 2529619 - protein, 17 aa, Entamoeba dispar
KIVFYNTNQYRIGEYFI

SEQ ID NO: 2529620 - protein, 18 aa, Entamoeba dispar
KIVHGITSYLVKWKNYSS

SEQ ID NO: 2529621 - protein, 25 aa, Entamoeba dispar
KIVIHFDISYFQLLNFQKKYQRKVE

SEQ ID NO: 2529622 - protein, 17 aa, Entamoeba dispar
KIVINKQQQLFANKMVE

SEQ ID NO: 2529623 - protein, 19 aa, Entamoeba dispar
KIVKFPPISRLDVAGVDLS

SEQ ID NO: 2529624 - protein, 28 aa, Entamoeba dispar
KIVLTFVMSLIPFFFQKYISKHTLVSSF

SEQ ID NO: 2529625 - protein, 26 aa, Entamoeba dispar
KIVNLIQLNPVFLAEQLVLFDLTEFQ

SEQ ID NO: 2529626 - protein, 18 aa, Entamoeba dispar
KIVPAAVTVELLLNAIRN

SEQ ID NO: 2529627 - protein, 25 aa, Entamoeba dispar
KIVPSHITVKLLLKAIQEHPHKVFL

SEQ ID NO: 2529628 - protein, 44 aa, Entamoeba dispar
KIVQEAVIWPMLRPDIFTGLRAPPKGLLLFGPPGTGKTMIGKAI

SEQ ID NO: 2529629 - protein, 24 aa, Entamoeba dispar
KIVYKWRFNSWPEGKYSHVEITLT

SEQ ID NO: 2529630 - protein, 17 aa, Entamoeba dispar
KIWAFKPNLAHAIQVQI

SEQ ID NO: 2529631 - protein, 18 aa, Entamoeba dispar
KIWKFICQVLSTHKMKVT

SEQ ID NO: 2529632 - protein, 24 aa, Entamoeba dispar
KIYDMINLFMWNFVQKHIATQGKG

SEQ ID NO: 2529633 - protein, 19 aa, Entamoeba dispar
KIYEDTLPCLRYLFDPDPP

SEQ ID NO: 2529634 - protein, 17 aa, Entamoeba dispar
KIYFIVHEQYKKIFCNE

SEQ ID NO: 2529635 - protein, 18 aa, Entamoeba dispar
KIYMKRREKRIPYRGKVS

SEQ ID NO: 2529636 - protein, 18 aa, Entamoeba dispar
KIYNIIKEGYQRIKKGEI

SEQ ID NO: 2529637 - protein, 17 aa, Entamoeba dispar
KIYNILCAINYVLEISN

SEQ ID NO: 2529638 - protein, 17 aa, Entamoeba dispar
KIYPSYQLYLNYLFIIH

SEQ ID NO: 2529639 - protein, 20 aa, Entamoeba dispar
KKACEALMLLGMFHGNKIGQ

SEQ ID NO: 2529640 - protein, 22 aa, Entamoeba dispar
KKACGFVKFKRVEDAIRCVCDA

SEQ ID NO: 2529641 - protein, 34 aa, Entamoeba dispar
KKAENQVLKQKALCLFYERYPEAVSEVMFPFEQI

SEQ ID NO: 2529642 - protein, 34 aa, Entamoeba dispar
KKAENQVLKQKALCLFYERYPEAVSEVMFPFEQM

SEQ ID NO: 2529643 - protein, 20 aa, Entamoeba dispar
KKAFILKNALGNKTVPFNCR

SEQ ID NO: 2529644 - protein, 26 aa, Entamoeba dispar
KKAIKLVNKFFISRDYPPLAEQSNFS

SEQ ID NO: 2529645 - protein, 27 aa, Entamoeba dispar
KKAIQSFEYLLRNFKYAFSDVKKRNVA

SEQ ID NO: 2529646 - protein, 33 aa, Entamoeba dispar
KKAMELSILCDCEVSLFIFANDKLVVYSSKDVK

SEQ ID NO: 2529647 - protein, 27 aa, Entamoeba dispar
KKANINWLLEMIVYIALSPNINKETHD

SEQ ID NO: 2529648 - protein, 28 aa, Entamoeba dispar
KKASDIAHLIHRVLFGTPGSVEERKKDI

SEQ ID NO: 2529649 - protein, 26 aa, Entamoeba dispar
KKATVIFVPLRMMRICRASFEKVIEA

SEQ ID NO: 2529650 - protein, 22 aa, Entamoeba dispar
KKAVNRFLAANDLFCIVRAHQV

SEQ ID NO: 2529651 - protein, 22 aa, Entamoeba dispar
KKAYQTLPFVRVDSIYFSNEDI

SEQ ID NO: 2529652 - protein, 25 aa, Entamoeba dispar
KKCALAVATLRFNPIRKTEIFNGLQ

SEQ ID NO: 2529653 - protein, 17 aa, Entamoeba dispar
KKCFKWNNCRREEMGSI

SEQ ID NO: 2529654 - protein, 27 aa, Entamoeba dispar
KKCGDVQFLVISLKDTLYERADALVGV

SEQ ID NO: 2529655 - protein, 25 aa, Entamoeba dispar
KKCKEDIIVILGYNNMIYTNLTDLQ

SEQ ID NO: 2529656 - protein, 30 aa, Entamoeba dispar
KKCLNFKTFPKYFIMSIKLFEMGYYGCIKK

SEQ ID NO: 2529657 - protein, 30 aa, Entamoeba dispar
KKCPLTSRRPLLNHIILSGGSTLFPGLPER

SEQ ID NO: 2529658 - protein, 24 aa, Entamoeba dispar
KKDCKCLFKCEGEWPFSLETIAIV

SEQ ID NO: 2529659 - protein, 25 aa, Entamoeba dispar
KKDCYKTMMFWNQPNELDAVISAIL

SEQ ID NO: 2529660 - protein, 26 aa, Entamoeba dispar
KKDDRIRRLVLLIKSILCCYDFHQPA

SEQ ID NO: 2529661 - protein, 27 aa, Entamoeba dispar
KKDEFKYGFQKFNLFKGKKVFATELFT

SEQ ID NO: 2529662 - protein, 26 aa, Entamoeba dispar
KKDELLQETIDLWKKLRERAGITRDE

SEQ ID NO: 2529663 - protein, 18 aa, Entamoeba dispar
KKDGKKILRCQCGMGHHN

SEQ ID NO: 2529664 - protein, 27 aa, Entamoeba dispar
KKDGQYKITNWKSPKIMCTSEGGVFFV

SEQ ID NO: 2529665 - protein, 20 aa, Entamoeba dispar
KKDIKMIDLPEWVRRYSKKK

SEQ ID NO: 2529666 - protein, 37 aa, Entamoeba dispar
KKDKKIIFPIEKTCYISLSSYLFITLIKKNSTKKEEK

SEQ ID NO: 2529667 - protein, 23 aa, Entamoeba dispar
KKDKLSPVIVSNFCKMFVVHYDR

SEQ ID NO: 2529668 - protein, 22 aa, Entamoeba dispar
KKDNEMLLKLMKDPYANYVIQT

SEQ ID NO: 2529669 - protein, 32 aa, Entamoeba dispar
KKDPNRPKRPQTPYFLYLHEHRASIKEEHPDA

SEQ ID NO: 2529670 - protein, 23 aa, Entamoeba dispar
KKDRIQFLLTFNKSKKKLNKIRE

SEQ ID NO: 2529671 - protein, 32 aa, Entamoeba dispar
KKDVPLPYFEFKYSSIYYKQLLINLLKEKEKA

SEQ ID NO: 2529672 - protein, 21 aa, Entamoeba dispar
KKDYFTFIYHDDSSPIPFNFS

SEQ ID NO: 2529673 - protein, 23 aa, Entamoeba dispar
KKDYSFVGKLLPYILLSMNKHIE

SEQ ID NO: 2529674 - protein, 27 aa, Entamoeba dispar
KKEEECQIADFTVRIKEKENEIETLKN

SEQ ID NO: 2529675 - protein, 31 aa, Entamoeba dispar
KKEEKKYILTYKLIENYLQRIIYQPKNQGED

SEQ ID NO: 2529676 - protein, 25 aa, Entamoeba dispar
KKEEKLMKIRFIIELSRCSIVEPNK

SEQ ID NO: 2529677 - protein, 26 aa, Entamoeba dispar
KKEELPSKLILFKKGENNFIGKNYNE

SEQ ID NO: 2529678 - protein, 20 aa, Entamoeba dispar
KKEFIECVSSIYFRILPSFE

SEQ ID NO: 2529679 - protein, 17 aa, Entamoeba dispar
KKEFNIIITLDYSVFMD

SEQ ID NO: 2529680 - protein, 26 aa, Entamoeba dispar
KKEGLMRAVFVSCSLIKFGVSIENAL

SEQ ID NO: 2529681 - protein, 24 aa, Entamoeba dispar
KKEGLVYLLWGAFAQKKASGVDST

SEQ ID NO: 2529682 - protein, 21 aa, Entamoeba dispar
KKEHEALLERLRLAKEEEEKI

SEQ ID NO: 2529683 - protein, 20 aa, Entamoeba dispar
KKEIFVFRTPDIIVSKHFSS

SEQ ID NO: 2529684 - protein, 41 aa, Entamoeba dispar
KKEIFWGEYLEILNKYLKQLPLRYFIIPTIISKNNKATRMS

SEQ ID NO: 2529685 - protein, 33 aa, Entamoeba dispar
KKEIGIITKYIYFFFIKSPLPFISHKLFLVNEM

SEQ ID NO: 2529686 - protein, 25 aa, Entamoeba dispar
KKEIILIIKELICLLDDLKIIEDKE

SEQ ID NO: 2529687 - protein, 19 aa, Entamoeba dispar
KKEIILSPNLKIIKGKIND

SEQ ID NO: 2529688 - protein, 26 aa, Entamoeba dispar
KKEIKDFFDDLIENILLTVGDKEVVR

SEQ ID NO: 2529689 - protein, 32 aa, Entamoeba dispar
KKEIQTFNDFFYALSVILPRSTIGSFKQMIRS

SEQ ID NO: 2529690 - protein, 18 aa, Entamoeba dispar
KKEISYEDKFILFKELAI

SEQ ID NO: 2529691 - protein, 19 aa, Entamoeba dispar
KKEIYHNPIIQYQIEEING

SEQ ID NO: 2529692 - protein, 19 aa, Entamoeba dispar
KKEIYPWGTRMRYLYIALE

SEQ ID NO: 2529693 - protein, 30 aa, Entamoeba dispar
KKEKEIIIQEKLGKYFKFKKNYNNLEIVIK

SEQ ID NO: 2529694 - protein, 34 aa, Entamoeba dispar
KKEKKNIEVTVEIGFLLQTYNKTLKVPSQMKVRE

SEQ ID NO: 2529695 - protein, 34 aa, Entamoeba dispar
KKEKPLPPIPVNNRPLPSIPQPKIIPTKEDELNQ

SEQ ID NO: 2529696 - protein, 24 aa, Entamoeba dispar
KKEKSPIHLLTRKYAQYNALLHYA

SEQ ID NO: 2529697 - protein, 21 aa, Entamoeba dispar
KKEMYNIPTIPPSQTTNLSID

SEQ ID NO: 2529698 - protein, 21 aa, Entamoeba dispar
KKENWLIKIWSIVCLTHLIEE

SEQ ID NO: 2529699 - protein, 23 aa, Entamoeba dispar
KKEPAILIDPYIGKFLRPHQIEG

SEQ ID NO: 2529700 - protein, 24 aa, Entamoeba dispar
KKEPNEIKLPPNSPTRHTSNRLFI

SEQ ID NO: 2529701 - protein, 27 aa, Entamoeba dispar
KKERELHGIIIVFNFSQNKFSQISKEM

SEQ ID NO: 2529702 - protein, 23 aa, Entamoeba dispar
KKESKFFTGEIIKIFGSLNEDTI

SEQ ID NO: 2529703 - protein, 28 aa, Entamoeba dispar
KKESYREIFNDIFLLADGKGLFNSRDNK

SEQ ID NO: 2529704 - protein, 26 aa, Entamoeba dispar
KKETLEFAFKYFITPYVVEQLKIELR

SEQ ID NO: 2529705 - protein, 21 aa, Entamoeba dispar
KKEVIELRKEKLTLQGKIDEL

SEQ ID NO: 2529706 - protein, 42 aa, Entamoeba dispar
KKEWDFSFIPTIELTLRLFGNYPYSIILPKTLVKLTIEMWHE

SEQ ID NO: 2529707 - protein, 18 aa, Entamoeba dispar
KKEYFWLSSRRDCYIKGG

SEQ ID NO: 2529708 - protein, 20 aa, Entamoeba dispar
KKFDEIFDKMKIEESMYPSE

SEQ ID NO: 2529709 - protein, 21 aa, Entamoeba dispar
KKFDTIFDKMKIDESFYPSEM

SEQ ID NO: 2529710 - protein, 20 aa, Entamoeba dispar
KKFDTIFDKMKINESFYPSE

SEQ ID NO: 2529711 - protein, 21 aa, Entamoeba dispar
KKFDTIFDKMKINESFYPSEM

SEQ ID NO: 2529712 - protein, 21 aa, Entamoeba dispar
KKFFGSVPYWIAQLIEIENNI

SEQ ID NO: 2529713 - protein, 18 aa, Entamoeba dispar
KKFKEQYLPNKTIVKSIM

SEQ ID NO: 2529714 - protein, 29 aa, Entamoeba dispar
KKFKPTLVFGVPRFYEKLLFRAKEISGSS

SEQ ID NO: 2529715 - protein, 21 aa, Entamoeba dispar
KKFNTFLHDDTWKNQMQLKWK

SEQ ID NO: 2529716 - protein, 30 aa, Entamoeba dispar
KKFTRKTNGYSLWVFGSIDNLLSVNGAFVL

SEQ ID NO: 2529717 - protein, 25 aa, Entamoeba dispar
KKGDYDPLPYIKPLSGTTLTQKVME

SEQ ID NO: 2529718 - protein, 28 aa, Entamoeba dispar
KKGEPRTMFKFVLEFLKLSLQNEDTDEG

SEQ ID NO: 2529719 - protein, 25 aa, Entamoeba dispar
KKGGKFFVRYYAPWCGFCKMMSYDY

SEQ ID NO: 2529720 - protein, 25 aa, Entamoeba dispar
KKGIINSLILLLQDPNPRVRVALLN

SEQ ID NO: 2529721 - protein, 26 aa, Entamoeba dispar
KKGILSFMYQILSKYRLGNCPVKMTD

SEQ ID NO: 2529722 - protein, 25 aa, Entamoeba dispar
KKGKKYQMMFEWGRIGGTLHNTFRN

SEQ ID NO: 2529723 - protein, 20 aa, Entamoeba dispar
KKGLFDLFSRIKHTTSEEKK

SEQ ID NO: 2529724 - protein, 21 aa, Entamoeba dispar
KKGLNFGVVLIPEGLVEFIPE

SEQ ID NO: 2529725 - protein, 21 aa, Entamoeba dispar
KKGNEIIIYEKEYLNLLINQI

SEQ ID NO: 2529726 - protein, 23 aa, Entamoeba dispar
KKGSPQFMLKYKTNVDPSKPLAH

SEQ ID NO: 2529727 - protein, 18 aa, Entamoeba dispar
KKGSYFIRIFVKQPNTPL

SEQ ID NO: 2529728 - protein, 23 aa, Entamoeba dispar
KKGTIKFNVLLTSFELVIKDQDL

SEQ ID NO: 2529729 - protein, 28 aa, Entamoeba dispar
KKGVSRTIILIGYKPKRFSDKILGEVEI

SEQ ID NO: 2529730 - protein, 26 aa, Entamoeba dispar
KKGYKKGNVKLILLIGGTCKMPRIRD

SEQ ID NO: 2529731 - protein, 22 aa, Entamoeba dispar
KKHGGFYLGAIGGAAALLAEKN

SEQ ID NO: 2529732 - protein, 23 aa, Entamoeba dispar
KKHGVIIYMEPQDFLMKKPDTKS

SEQ ID NO: 2529733 - protein, 31 aa, Entamoeba dispar
KKHGVTVHFLRLPYFFNYLQIAAGEEEVWEV

SEQ ID NO: 2529734 - protein, 21 aa, Entamoeba dispar
KKHIAILFGAFSNTGKLIEES

SEQ ID NO: 2529735 - protein, 23 aa, Entamoeba dispar
KKHSEFIQYPIMLYVTKETEEEV

SEQ ID NO: 2529736 - protein, 19 aa, Entamoeba dispar
KKIAFWNTTNNIPLYIMER

SEQ ID NO: 2529737 - protein, 25 aa, Entamoeba dispar
KKIAMKGVVQLFNAIAEHQHKLKIA

SEQ ID NO: 2529738 - protein, 17 aa, Entamoeba dispar
KKIFNREKRIVFDEEGK

SEQ ID NO: 2529739 - protein, 22 aa, Entamoeba dispar
KKIFRKTVTIGYMPIMLQSKHC

SEQ ID NO: 2529740 - protein, 30 aa, Entamoeba dispar
KKIGAINCFFYPIIPFKWIADETVTSPMMN

SEQ ID NO: 2529741 - protein, 21 aa, Entamoeba dispar
KKIGELLFDLKREEEQRKILE

SEQ ID NO: 2529742 - protein, 26 aa, Entamoeba dispar
KKIGITQKEKIIFNKKIIRLKEESER

SEQ ID NO: 2529743 - protein, 21 aa, Entamoeba dispar
KKIHSTWLGVQLLLNIHDEIV

SEQ ID NO: 2529744 - protein, 17 aa, Entamoeba dispar
KKIIGEKNIMFYFETVQ

SEQ ID NO: 2529745 - protein, 21 aa, Entamoeba dispar
KKILLFDTIQFKNLGYKNNIS

SEQ ID NO: 2529746 - protein, 35 aa, Entamoeba dispar
KKIMKDFVLYYPEYLWYPFLTLIISKLEQPNFSKS

SEQ ID NO: 2529747 - protein, 17 aa, Entamoeba dispar
KKIPNEYLLKESPIEEN

SEQ ID NO: 2529748 - protein, 18 aa, Entamoeba dispar
KKITLYINGLLKSTAKLI

SEQ ID NO: 2529749 - protein, 20 aa, Entamoeba dispar
KKIVIIKDLKGINKGYAFVE

SEQ ID NO: 2529750 - protein, 20 aa, Entamoeba dispar
KKIVPSLTLSGPTSFAPLIK

SEQ ID NO: 2529751 - protein, 20 aa, Entamoeba dispar
KKIVSLIQVYPPFVTMKWEE

SEQ ID NO: 2529752 - protein, 22 aa, Entamoeba dispar
KKKAEEIIEKNLRWIDNNQNGS

SEQ ID NO: 2529753 - protein, 23 aa, Entamoeba dispar
KKKAEEIIEKNLRWIDNNQNGSK

SEQ ID NO: 2529754 - protein, 26 aa, Entamoeba dispar
KKKATKALPFLQIRSINFGNGDVFNF

SEQ ID NO: 2529755 - protein, 17 aa, Entamoeba dispar
KKKDSLFSLFRSNDEDL

SEQ ID NO: 2529756 - protein, 35 aa, Entamoeba dispar
KKKERKKWKFMQKYYHIGSFFRDGGKWDVSKGNWD

SEQ ID NO: 2529757 - protein, 22 aa, Entamoeba dispar
KKKFKVIIVVPIWSEGELKSNI

SEQ ID NO: 2529758 - protein, 24 aa, Entamoeba dispar
KKKIDIVKVFKIMWTKNSPKKQKI

SEQ ID NO: 2529759 - protein, 21 aa, Entamoeba dispar
KKKIEIFTNKIPLLNDEIPQI

SEQ ID NO: 2529760 - protein, 29 aa, Entamoeba dispar
KKKIIVLRYDLLKPKVLAPMKYHIKINDP

SEQ ID NO: 2529761 - protein, 21 aa, Entamoeba dispar
KKKIIYIFKKRTLSNQFEESL

SEQ ID NO: 2529762 - protein, 24 aa, Entamoeba dispar
KKKIKFCFNCKEIWHSGLTCSQYQ

SEQ ID NO: 2529763 - protein, 22 aa, Entamoeba dispar
KKKINYPIQLLDDRTQGNLERQ

SEQ ID NO: 2529764 - protein, 25 aa, Entamoeba dispar
KKKKILQQLILKKITNEFLNTIIID

SEQ ID NO: 2529765 - protein, 26 aa, Entamoeba dispar
KKKKKSYLYFVYKGVYRNITVAIKKD

SEQ ID NO: 2529766 - protein, 24 aa, Entamoeba dispar
KKKKTITCLWNKLFKQIGKLVIEG

SEQ ID NO: 2529767 - protein, 22 aa, Entamoeba dispar
KKKLFDITLLDINNYQKLPPKI

SEQ ID NO: 2529768 - protein, 37 aa, Entamoeba dispar
KKKNVIIIFEFSLLDNVLMDIPKWVKVYSSEIVISKS

SEQ ID NO: 2529769 - protein, 31 aa, Entamoeba dispar
KKKPKRKLKIFKIFFMAIVEKELQYIKKERF

SEQ ID NO: 2529770 - protein, 20 aa, Entamoeba dispar
KKKPLFFNKQPQIEYNKQEN

SEQ ID NO: 2529771 - protein, 22 aa, Entamoeba dispar
KKKPLFFNKQPQIEYNKQENDI

SEQ ID NO: 2529772 - protein, 25 aa, Entamoeba dispar
KKKPNNQFWKAMKAYGLAYTGQLEK

SEQ ID NO: 2529773 - protein, 29 aa, Entamoeba dispar
KKKTIRNGLLYLLFFLRQKESPRRKRDRE

SEQ ID NO: 2529774 - protein, 25 aa, Entamoeba dispar
KKKTSLWIVCELFRIIVSSNLQEFD

SEQ ID NO: 2529775 - protein, 22 aa, Entamoeba dispar
KKKVDFMALFDQAMQQPAPSQQ

SEQ ID NO: 2529776 - protein, 25 aa, Entamoeba dispar
KKKWDGIVNMTVPLDFPSCFDFLQF

SEQ ID NO: 2529777 - protein, 24 aa, Entamoeba dispar
KKKWKLRFVIVNGSTLYYYKTELD

SEQ ID NO: 2529778 - protein, 23 aa, Entamoeba dispar
KKKYEFLFVGGGFYIKCICNEND

SEQ ID NO: 2529779 - protein, 21 aa, Entamoeba dispar
KKKYQLKDDIIISFSLHDNNC

SEQ ID NO: 2529780 - protein, 34 aa, Entamoeba dispar
KKKYTELLKVTATKTMLLFNQYLEKKPGCKGKIK

SEQ ID NO: 2529781 - protein, 22 aa, Entamoeba dispar
KKLAEAKGKRKFALQTKEGIGK

SEQ ID NO: 2529782 - protein, 21 aa, Entamoeba dispar
KKLENWFVLCEMRVYLARIET

SEQ ID NO: 2529783 - protein, 26 aa, Entamoeba dispar
KKLGHDFCLKHLLNLPGNFTATKLAW

SEQ ID NO: 2529784 - protein, 17 aa, Entamoeba dispar
KKLIKLPRKSLDNSREV

SEQ ID NO: 2529785 - protein, 20 aa, Entamoeba dispar
KKLIPLINAFQATHKIFQAA

SEQ ID NO: 2529786 - protein, 20 aa, Entamoeba dispar
KKLIQQALDDKIPIITSTFV

SEQ ID NO: 2529787 - protein, 27 aa, Entamoeba dispar
KKLKQKHLPLKSLFQKSYESLNELFNE

SEQ ID NO: 2529788 - protein, 21 aa, Entamoeba dispar
KKLLEVIDSKVCISVRSFSHN

SEQ ID NO: 2529789 - protein, 18 aa, Entamoeba dispar
KKLLEWVKRLESIKFGRE

SEQ ID NO: 2529790 - protein, 20 aa, Entamoeba dispar
KKLLILFTELVIKQSGIKEV

SEQ ID NO: 2529791 - protein, 17 aa, Entamoeba dispar
KKLLKRKVFFLMDKKTY

SEQ ID NO: 2529792 - protein, 21 aa, Entamoeba dispar
KKLMGHLNVLRGFSQLLKEEA

SEQ ID NO: 2529793 - protein, 20 aa, Entamoeba dispar
KKLMKLSWHGIPFSIRYIIW

SEQ ID NO: 2529794 - protein, 23 aa, Entamoeba dispar
KKLNNLIIVWTKTTSIIAQNQIT

SEQ ID NO: 2529795 - protein, 20 aa, Entamoeba dispar
KKLNYLPMITDFKFFVETFV

SEQ ID NO: 2529796 - protein, 19 aa, Entamoeba dispar
KKLPPIFHLIRNPINNDIC

SEQ ID NO: 2529797 - protein, 19 aa, Entamoeba dispar
KKLQNEFLIHKFGMEIIPS

SEQ ID NO: 2529798 - protein, 20 aa, Entamoeba dispar
KKLSILWKQIEKDIVRTHIT

SEQ ID NO: 2529799 - protein, 21 aa, Entamoeba dispar
KKLSSSLFYYCISLKSIEIPS

SEQ ID NO: 2529800 - protein, 21 aa, Entamoeba dispar
KKLTDPNWIPTFTVVSDDKLE

SEQ ID NO: 2529801 - protein, 21 aa, Entamoeba dispar
KKLTKLPRISLKQSREVLKRR

SEQ ID NO: 2529802 - protein, 20 aa, Entamoeba dispar
KKLVSMYETCNEKQLIKIKE

SEQ ID NO: 2529803 - protein, 21 aa, Entamoeba dispar
KKLYILATTCLAPDVLRNLDV

SEQ ID NO: 2529804 - protein, 21 aa, Entamoeba dispar
KKLYTKLFEIIKKDLQRLMEL

SEQ ID NO: 2529805 - protein, 24 aa, Entamoeba dispar
KKMCIAIEFAPNGSLGHILKKIKL

SEQ ID NO: 2529806 - protein, 24 aa, Entamoeba dispar
KKMCNHLLLFALPLREEYAKSMID

SEQ ID NO: 2529807 - protein, 19 aa, Entamoeba dispar
KKMIKEFFGKQPLTTIDTM

SEQ ID NO: 2529808 - protein, 20 aa, Entamoeba dispar
KKMIPCIVNIFIVGDNLQKE

SEQ ID NO: 2529809 - protein, 27 aa, Entamoeba dispar
KKMMSNIEKQFKLLEQQKTLHKKNLAK

SEQ ID NO: 2529810 - protein, 22 aa, Entamoeba dispar
KKMNRLFEKMTILESKKKELIK

SEQ ID NO: 2529811 - protein, 23 aa, Entamoeba dispar
KKMVLDFTAPFKRISYVHALEEK

SEQ ID NO: 2529812 - protein, 24 aa, Entamoeba dispar
KKMVYMYLCTYSEKYPELSILCVN

SEQ ID NO: 2529813 - protein, 23 aa, Entamoeba dispar
KKNAMILLSFYNACNKIPELIDF

SEQ ID NO: 2529814 - protein, 21 aa, Entamoeba dispar
KKNCLMIFRNIGEGQTLMVLP

SEQ ID NO: 2529815 - protein, 23 aa, Entamoeba dispar
KKNELYKDLIKLGFDQIRDPKKA

SEQ ID NO: 2529816 - protein, 32 aa, Entamoeba dispar
KKNFKNIYCVIKLNLWYIKPKTIKYGNVEHKI

SEQ ID NO: 2529817 - protein, 24 aa, Entamoeba dispar
KKNFRKSFKLPFSRNSLGINLDLC

SEQ ID NO: 2529818 - protein, 25 aa, Entamoeba dispar
KKNIKLVFTALPFIRTFLLNETESL

SEQ ID NO: 2529819 - protein, 18 aa, Entamoeba dispar
KKNIQKPLFLKKEENKQP

SEQ ID NO: 2529820 - protein, 30 aa, Entamoeba dispar
KKNKNIAPDYWLIGSLLMVALVNSVEGRDD

SEQ ID NO: 2529821 - protein, 20 aa, Entamoeba dispar
KKNKTLKKMYYRKYYDDCIV

SEQ ID NO: 2529822 - protein, 22 aa, Entamoeba dispar
KKNQIKAFDLFKAAAFKKHPDS

SEQ ID NO: 2529823 - protein, 25 aa, Entamoeba dispar
KKNQIWDLNLAPRALVKPSFLLSKT

SEQ ID NO: 2529824 - protein, 24 aa, Entamoeba dispar
KKNVMKVFSLITYKTFADLGKEAE

SEQ ID NO: 2529825 - protein, 18 aa, Entamoeba dispar
KKPDSRFKKDARFKNFSK

SEQ ID NO: 2529826 - protein, 20 aa, Entamoeba dispar
KKPLLLILQNYDPAGDDIRV

SEQ ID NO: 2529827 - protein, 28 aa, Entamoeba dispar
KKPMKYIRSIYNRLLLESPTIRAAGITT

SEQ ID NO: 2529828 - protein, 29 aa, Entamoeba dispar
KKPNSELFYIIYFLPFTINIDNDRKVYLN

SEQ ID NO: 2529829 - protein, 27 aa, Entamoeba dispar
KKPPKKDYLALFDLEDIKPFTSQQLPL

SEQ ID NO: 2529830 - protein, 23 aa, Entamoeba dispar
KKPPKQFKFITPNVYKKKAIKQK

SEQ ID NO: 2529831 - protein, 24 aa, Entamoeba dispar
KKPTKFIVLIMKLLMLRPDKSIIY

SEQ ID NO: 2529832 - protein, 25 aa, Entamoeba dispar
KKQDDWRWSDLLQFKIIILVEGKMY

SEQ ID NO: 2529833 - protein, 33 aa, Entamoeba dispar
KKQETLPFLKYYSLIIELLFINSQLQITCFTLI

SEQ ID NO: 2529834 - protein, 19 aa, Entamoeba dispar
KKQIIATSYIIKLNNFKGN

SEQ ID NO: 2529835 - protein, 30 aa, Entamoeba dispar
KKQIPMDTFAYLPFFLTSFKDIKSLKMSQN

SEQ ID NO: 2529836 - protein, 20 aa, Entamoeba dispar
KKQKNEILSMKKDIIKKNEE

SEQ ID NO: 2529837 - protein, 18 aa, Entamoeba dispar
KKQLIIGEYLKKYVEEKG

SEQ ID NO: 2529838 - protein, 20 aa, Entamoeba dispar
KKQQVLKTNPLIKLQNENQP

SEQ ID NO: 2529839 - protein, 23 aa, Entamoeba dispar
KKQYFQVIFDGISYYEGIFSIQQ

SEQ ID NO: 2529840 - protein, 23 aa, Entamoeba dispar
KKRDFYTFFSYKDKSKSAGWRLD

SEQ ID NO: 2529841 - protein, 18 aa, Entamoeba dispar
KKREFVLDRCFYKEKMAL

SEQ ID NO: 2529842 - protein, 18 aa, Entamoeba dispar
KKREIYANYLKTVIAICP

SEQ ID NO: 2529843 - protein, 28 aa, Entamoeba dispar
KKREYTILYFQVLVRLLQVFDQKSLPNN

SEQ ID NO: 2529844 - protein, 29 aa, Entamoeba dispar
KKREYTILYFQVLVRLLQVFDQKSLPNNQ

SEQ ID NO: 2529845 - protein, 21 aa, Entamoeba dispar
KKRIYLKDYIPVLKNITGKTN

SEQ ID NO: 2529846 - protein, 20 aa, Entamoeba dispar
KKRKNKYGQLLKITSIKTMD

SEQ ID NO: 2529847 - protein, 25 aa, Entamoeba dispar
KKRKPVVGCFFELLVLKTQGVIDLQ

SEQ ID NO: 2529848 - protein, 27 aa, Entamoeba dispar
KKRLFKKWEVILFRKQDRKKKYSQKHH

SEQ ID NO: 2529849 - protein, 26 aa, Entamoeba dispar
KKRRVVLMKILLRLHRIYKLDELKHY

SEQ ID NO: 2529850 - protein, 19 aa, Entamoeba dispar
KKSAFCIFATGGMGGDCCI

SEQ ID NO: 2529851 - protein, 27 aa, Entamoeba dispar
KKSALDFLNLPISITRGVLGNLKVIIP

SEQ ID NO: 2529852 - protein, 22 aa, Entamoeba dispar
KKSCQFQILTALKKVSNHPWLI

SEQ ID NO: 2529853 - protein, 26 aa, Entamoeba dispar
KKSDVFSFGIVFWEVIHAVYCKHYNR

SEQ ID NO: 2529854 - protein, 26 aa, Entamoeba dispar
KKSEKFFKLFVPIFIQCFHDQLQDAD

SEQ ID NO: 2529855 - protein, 24 aa, Entamoeba dispar
KKSERIHYQLIQKGILKGNETIEK

SEQ ID NO: 2529856 - protein, 20 aa, Entamoeba dispar
KKSFFLMNAMKEAVKYVDQS

SEQ ID NO: 2529857 - protein, 32 aa, Entamoeba dispar
KKSIRLKLKNNLYQYIFGKGKLIISLKGITYK

SEQ ID NO: 2529858 - protein, 24 aa, Entamoeba dispar
KKSLCFEVVYDKQFVFFCKDDDMV

SEQ ID NO: 2529859 - protein, 24 aa, Entamoeba dispar
KKSQWRVPLPIFRAMQYLEEHKGD

SEQ ID NO: 2529860 - protein, 25 aa, Entamoeba dispar
KKSTPLYYSQFLKKNYPVLVEYYEK

SEQ ID NO: 2529861 - protein, 28 aa, Entamoeba dispar
KKTFTVNCELFIFEIKMSGITTLEQLKN

SEQ ID NO: 2529862 - protein, 22 aa, Entamoeba dispar
KKTIYILRRLLETETIFNNVIC

SEQ ID NO: 2529863 - protein, 28 aa, Entamoeba dispar
KKTKELCEGFIDLAKYADLNGASKDLSI

SEQ ID NO: 2529864 - protein, 29 aa, Entamoeba dispar
KKTMNIGVKYFASCGLYCLVQPNTPYEII

SEQ ID NO: 2529865 - protein, 23 aa, Entamoeba dispar
KKTNFYVFVKVIIKEPISIEHEP

SEQ ID NO: 2529866 - protein, 24 aa, Entamoeba dispar
KKTPKYGLIFHAALIGQAPAKAKG

SEQ ID NO: 2529867 - protein, 24 aa, Entamoeba dispar
KKTSEDFIDLLLEKKVEAKEKKPT

SEQ ID NO: 2529868 - protein, 32 aa, Entamoeba dispar
KKTSPISLYLTQCLSVIFEPPTSFSIINYCDD

SEQ ID NO: 2529869 - protein, 20 aa, Entamoeba dispar
KKVDILAYWVSQSLYESVQK

SEQ ID NO: 2529870 - protein, 21 aa, Entamoeba dispar
KKVFEKLLVFQQEMLKKDRTK

SEQ ID NO: 2529871 - protein, 22 aa, Entamoeba dispar
KKVFKVRPFVPPISSQIKIKNR

SEQ ID NO: 2529872 - protein, 26 aa, Entamoeba dispar
KKVIDYMVIVLQFPDSFPSKESVYVM

SEQ ID NO: 2529873 - protein, 23 aa, Entamoeba dispar
KKVIPYIASGFKKDKIWLRRTRA

SEQ ID NO: 2529874 - protein, 21 aa, Entamoeba dispar
KKVIWYAISYSLYLKEKETWN

SEQ ID NO: 2529875 - protein, 17 aa, Entamoeba dispar
KKVIWYDISYSQYLKEK

SEQ ID NO: 2529876 - protein, 37 aa, Entamoeba dispar
KKVKYCMIMKKIPLINPLSLFSLRKLYASSKYTLDSI

SEQ ID NO: 2529877 - protein, 18 aa, Entamoeba dispar
KKVLKSWTKQRAFKVLYN

SEQ ID NO: 2529878 - protein, 19 aa, Entamoeba dispar
KKVPHYKFTDFWNGYGSCI

SEQ ID NO: 2529879 - protein, 26 aa, Entamoeba dispar
KKVTHWIWYVFPVIQGLWGGRNNDLY

SEQ ID NO: 2529880 - protein, 30 aa, Entamoeba dispar
KKVTNVKLIYSKNYLLLLREGNRGFPDDFD

SEQ ID NO: 2529881 - protein, 34 aa, Entamoeba dispar
KKVVPPVPHRSLPPKPVRSSAINSPLTTPITTNA

SEQ ID NO: 2529882 - protein, 22 aa, Entamoeba dispar
KKVWSNLKILKLQKCQLTELEE

SEQ ID NO: 2529883 - protein, 31 aa, Entamoeba dispar
KKVYKILDDLYVNSILFTPPNQQTTRNSTNS

SEQ ID NO: 2529884 - protein, 26 aa, Entamoeba dispar
KKVYKILNDLYVDSILFTSPNQQTTG

SEQ ID NO: 2529885 - protein, 28 aa, Entamoeba dispar
KKWESKLKYMNRFLKLIGPDKQIPELHS

SEQ ID NO: 2529886 - protein, 25 aa, Entamoeba dispar
KKWGKKWVVMKKNCLMIFRNIGEGQ

SEQ ID NO: 2529887 - protein, 22 aa, Entamoeba dispar
KKWVLFIASYVKELYFKKNPYD

SEQ ID NO: 2529888 - protein, 17 aa, Entamoeba dispar
KKWYRQEVEIKEFTIED

SEQ ID NO: 2529889 - protein, 17 aa, Entamoeba dispar
KKYFEDVDNFKLDTVIE

SEQ ID NO: 2529890 - protein, 23 aa, Entamoeba dispar
KKYFIIRDDATVFAFAIGGKYEI

SEQ ID NO: 2529891 - protein, 18 aa, Entamoeba dispar
KKYHPDCFICDKCGIAFN

SEQ ID NO: 2529892 - protein, 22 aa, Entamoeba dispar
KKYIGEYIWLKNKEVLEMTDSL

SEQ ID NO: 2529893 - protein, 26 aa, Entamoeba dispar
KKYIKQMTIIKRNYIDILLPKIRDIK

SEQ ID NO: 2529894 - protein, 25 aa, Entamoeba dispar
KKYPFQTIIKIFPKLQTIYFNQPHV

SEQ ID NO: 2529895 - protein, 20 aa, Entamoeba dispar
KKYQLVAHQLIWNCDTYSTE

SEQ ID NO: 2529896 - protein, 21 aa, Entamoeba dispar
KKYYYLVMEYCNFGTLAQYIN

SEQ ID NO: 2529897 - protein, 21 aa, Entamoeba dispar
KLAASYFLYNQYFVNGKWPED

SEQ ID NO: 2529898 - protein, 31 aa, Entamoeba dispar
KLAIEKVRLKGLMLLFMSIGGVIEVKDVMNF

SEQ ID NO: 2529899 - protein, 18 aa, Entamoeba dispar
KLALKRKEQKRRNEEKEI

SEQ ID NO: 2529900 - protein, 28 aa, Entamoeba dispar
KLARKTYLDFLQRTLCWDPKFRLTPAQA

SEQ ID NO: 2529901 - protein, 25 aa, Entamoeba dispar
KLASAQVMALFNKAIRKVVTFLSEK

SEQ ID NO: 2529902 - protein, 25 aa, Entamoeba dispar
KLASFNRLFKYQAALILFAMASRTE

SEQ ID NO: 2529903 - protein, 26 aa, Entamoeba dispar
KLATNIATTILLVDQIVMQKPAGGPK

SEQ ID NO: 2529904 - protein, 27 aa, Entamoeba dispar
KLATNIATTILLVDQIVMQKPAGGPKI

SEQ ID NO: 2529905 - protein, 21 aa, Entamoeba dispar
KLCIYCVARFSFRIGERYYSQ

SEQ ID NO: 2529906 - protein, 23 aa, Entamoeba dispar
KLCSIPFQFKFITPNCFISLEKN

SEQ ID NO: 2529907 - protein, 20 aa, Entamoeba dispar
KLDDFCTFGFLIKNFHEIDD

SEQ ID NO: 2529908 - protein, 17 aa, Entamoeba dispar
KLDIIKPGFSSALITDC

SEQ ID NO: 2529909 - protein, 18 aa, Entamoeba dispar
KLDTLFITPTKKGKYKSF

SEQ ID NO: 2529910 - protein, 23 aa, Entamoeba dispar
KLDVDIVYFSIQILLIMSKEDDG

SEQ ID NO: 2529911 - protein, 24 aa, Entamoeba dispar
KLDVMTKLLQFPGKFDDCSRNVKT

SEQ ID NO: 2529912 - protein, 20 aa, Entamoeba dispar
KLEAIYFPRELKILQIYKCP

SEQ ID NO: 2529913 - protein, 19 aa, Entamoeba dispar
KLEASLFKSLYDAGIKVGK

SEQ ID NO: 2529914 - protein, 21 aa, Entamoeba dispar
KLEDFILMRQFIQVENIGLGF

SEQ ID NO: 2529915 - protein, 19 aa, Entamoeba dispar
KLEEKLNIWKALMQLEANH

SEQ ID NO: 2529916 - protein, 26 aa, Entamoeba dispar
KLEEPLEYLYLLYNKSIEVFSFLMKL

SEQ ID NO: 2529917 - protein, 28 aa, Entamoeba dispar
KLEFISFSDILLKYFTPSMLDLYCKYAN

SEQ ID NO: 2529918 - protein, 29 aa, Entamoeba dispar
KLEIDYKYDYLISPTMRPADFDAKPMVLF

SEQ ID NO: 2529919 - protein, 17 aa, Entamoeba dispar
KLEILENEKKDLIDKMA

SEQ ID NO: 2529920 - protein, 22 aa, Entamoeba dispar
KLEKVLLGIVYHICKIDNNGLT

SEQ ID NO: 2529921 - protein, 24 aa, Entamoeba dispar
KLELKKLVYLYLMNYSRSQPERAI

SEQ ID NO: 2529922 - protein, 25 aa, Entamoeba dispar
KLENGDIYWWLKSIGFEDSIFDFVN

SEQ ID NO: 2529923 - protein, 17 aa, Entamoeba dispar
KLENVFNSMVFSSFIHN

SEQ ID NO: 2529924 - protein, 18 aa, Entamoeba dispar
KLEQPFLNSLRDLFVKLM

SEQ ID NO: 2529925 - protein, 18 aa, Entamoeba dispar
KLERAIQTQFKLSTNKST

SEQ ID NO: 2529926 - protein, 24 aa, Entamoeba dispar
KLFDAYGLIVIGRLPAPIVSDHLA

SEQ ID NO: 2529927 - protein, 19 aa, Entamoeba dispar
KLFDIQLGKWKKMFDEICV

SEQ ID NO: 2529928 - protein, 21 aa, Entamoeba dispar
KLFDLSYVLPNLIAMAFPATG

SEQ ID NO: 2529929 - protein, 20 aa, Entamoeba dispar
KLFEMGYYGCIKKTDYLTFP

SEQ ID NO: 2529930 - protein, 19 aa, Entamoeba dispar
KLFGVHRLDRLTSGVLIIA

SEQ ID NO: 2529931 - protein, 24 aa, Entamoeba dispar
KLFIQSISSQRWLIPKTGLVIPQK

SEQ ID NO: 2529932 - protein, 20 aa, Entamoeba dispar
KLFLHQLHNILNYGPEIIVC

SEQ ID NO: 2529933 - protein, 28 aa, Entamoeba dispar
KLFPNIETHYLYFPFDKKISSIQLEAIC

SEQ ID NO: 2529934 - protein, 27 aa, Entamoeba dispar
KLFSSNRFFLFVFNGALNSTFKRKTEE

SEQ ID NO: 2529935 - protein, 19 aa, Entamoeba dispar
KLFVNLCCDTFLILRKNYH

SEQ ID NO: 2529936 - protein, 17 aa, Entamoeba dispar
KLFYPQKSNIKKGEVEM

SEQ ID NO: 2529937 - protein, 24 aa, Entamoeba dispar
KLGEFKLVGIPPAKKGIPKIQVTF

SEQ ID NO: 2529938 - protein, 32 aa, Entamoeba dispar
KLGGHDLDLTIIDWLRLQDYRIQPKKGSMVLP

SEQ ID NO: 2529939 - protein, 19 aa, Entamoeba dispar
KLGIRPSHGVLLYGPSGCA

SEQ ID NO: 2529940 - protein, 24 aa, Entamoeba dispar
KLGKECFFHCALLKEINIPKRLNL

SEQ ID NO: 2529941 - protein, 31 aa, Entamoeba dispar
KLGQYTLNFFIQPFLHWPDTMMTVIPELKVL

SEQ ID NO: 2529942 - protein, 26 aa, Entamoeba dispar
KLGTNPLVFAFPSDEGFPFCLDCATS

SEQ ID NO: 2529943 - protein, 25 aa, Entamoeba dispar
KLHEECLYCCYLYDILSKTNKEYEE

SEQ ID NO: 2529944 - protein, 27 aa, Entamoeba dispar
KLHSTLSLKINTLWRNNLKYLEMVNTN

SEQ ID NO: 2529945 - protein, 20 aa, Entamoeba dispar
KLIECYPLRVGHGIFLNKKA

SEQ ID NO: 2529946 - protein, 22 aa, Entamoeba dispar
KLIEHYIIGPYSPDLAIYVGKK

SEQ ID NO: 2529947 - protein, 20 aa, Entamoeba dispar
KLIEIMQKWKLFLENTKDYI

SEQ ID NO: 2529948 - protein, 20 aa, Entamoeba dispar
KLIELLKKAPSESLFIILQV

SEQ ID NO: 2529949 - protein, 19 aa, Entamoeba dispar
KLIFDLFNEFYQFKETAKL

SEQ ID NO: 2529950 - protein, 20 aa, Entamoeba dispar
KLIIKLFQYQLKYSIYMMAL

SEQ ID NO: 2529951 - protein, 20 aa, Entamoeba dispar
KLIIQALEKLLTIGKPGEGF

SEQ ID NO: 2529952 - protein, 17 aa, Entamoeba dispar
KLIIRRCQFIENILLPF

SEQ ID NO: 2529953 - protein, 25 aa, Entamoeba dispar
KLIISIISHPSFQHAFDSSVPILVS

SEQ ID NO: 2529954 - protein, 25 aa, Entamoeba dispar
KLIKTNVIVFCDIPVAWKTQGDVLN

SEQ ID NO: 2529955 - protein, 25 aa, Entamoeba dispar
KLINEFKICFASRGEALTQKIFSLM

SEQ ID NO: 2529956 - protein, 21 aa, Entamoeba dispar
KLINRGVNVDMIEWSKSGLVV

SEQ ID NO: 2529957 - protein, 20 aa, Entamoeba dispar
KLIPILFDIIPILCSFHPDT

SEQ ID NO: 2529958 - protein, 34 aa, Entamoeba dispar
KLIPKQYFDYFSVFILYKLVIKQLSLIVQDLQDF

SEQ ID NO: 2529959 - protein, 17 aa, Entamoeba dispar
KLISKFVGTRTPVQVRT

SEQ ID NO: 2529960 - protein, 34 aa, Entamoeba dispar
KLISLRSYLFSIPMFHYLQPYSNFISLIDFGKYL

SEQ ID NO: 2529961 - protein, 18 aa, Entamoeba dispar
KLISMNCWLSFGRVVLNN

SEQ ID NO: 2529962 - protein, 18 aa, Entamoeba dispar
KLISNLFKPYSLELIFDM

SEQ ID NO: 2529963 - protein, 21 aa, Entamoeba dispar
KLIVEFNSSPILFLDGEFPAN

SEQ ID NO: 2529964 - protein, 17 aa, Entamoeba dispar
KLIWPLDPRNDTDWDGL

SEQ ID NO: 2529965 - protein, 19 aa, Entamoeba dispar
KLKDVIPLLKIELNKYIGF

SEQ ID NO: 2529966 - protein, 29 aa, Entamoeba dispar
KLKEEVFPTVKYNLLLKILQEFKPGNSNP

SEQ ID NO: 2529967 - protein, 21 aa, Entamoeba dispar
KLKFLQSSFPCLELKVIKEIW

SEQ ID NO: 2529968 - protein, 24 aa, Entamoeba dispar
KLKGIYKIAALLPSLKTSPIVIKQ

SEQ ID NO: 2529969 - protein, 23 aa, Entamoeba dispar
KLKIKDIIPLFGIGIYSEGDNAF

SEQ ID NO: 2529970 - protein, 20 aa, Entamoeba dispar
KLKKCITASYFYNAAKLKGK

SEQ ID NO: 2529971 - protein, 18 aa, Entamoeba dispar
KLKKFQCKVCGEKQSYKH

SEQ ID NO: 2529972 - protein, 17 aa, Entamoeba dispar
KLKKRLFDLSLSSRQTV

SEQ ID NO: 2529973 - protein, 19 aa, Entamoeba dispar
KLKNAPQYLLLQLNRFSIA

SEQ ID NO: 2529974 - protein, 25 aa, Entamoeba dispar
KLKQNRLNYFFVSAKTGLNIKKAFI

SEQ ID NO: 2529975 - protein, 21 aa, Entamoeba dispar
KLKSKKLLNNLLPQLQLKKRK

SEQ ID NO: 2529976 - protein, 25 aa, Entamoeba dispar
KLKTTKLCILILRSLKKLHPMNDYF

SEQ ID NO: 2529977 - protein, 19 aa, Entamoeba dispar
KLKVIVYPRILNTTDIPLR

SEQ ID NO: 2529978 - protein, 20 aa, Entamoeba dispar
KLLALNIIQVLLPYLNNQQY

SEQ ID NO: 2529979 - protein, 19 aa, Entamoeba dispar
KLLAPLLTRKESFDEILNL

SEQ ID NO: 2529980 - protein, 19 aa, Entamoeba dispar
KLLEISLSPTIQNIGDGCF

SEQ ID NO: 2529981 - protein, 19 aa, Entamoeba dispar
KLLEMDFANEIDYLIEKLP

SEQ ID NO: 2529982 - protein, 24 aa, Entamoeba dispar
KLLIKLCEAVHLKEKIEAEFTGVK

SEQ ID NO: 2529983 - protein, 18 aa, Entamoeba dispar
KLLKYDEEYTWAFPPTKA

SEQ ID NO: 2529984 - protein, 32 aa, Entamoeba dispar
KLLMNLYNHWYYFYLSLVRYPLSLDISMMNQH

SEQ ID NO: 2529985 - protein, 31 aa, Entamoeba dispar
KLLNIGKEILTVKLLLLFGDRIFSTPKISKQ

SEQ ID NO: 2529986 - protein, 21 aa, Entamoeba dispar
KLLNKLWEELPKSWKILVVDK

SEQ ID NO: 2529987 - protein, 28 aa, Entamoeba dispar
KLLPDIHYFVFCYELPYSTAVILKEKMI

SEQ ID NO: 2529988 - protein, 24 aa, Entamoeba dispar
KLLPNYYQKWNLILCGLHANQMIF

SEQ ID NO: 2529989 - protein, 24 aa, Entamoeba dispar
KLLQFLADELFTFKYGTFAFNCEK

SEQ ID NO: 2529990 - protein, 22 aa, Entamoeba dispar
KLLSSIIKKAPSLKLKFIKNFH

SEQ ID NO: 2529991 - protein, 19 aa, Entamoeba dispar
KLLTEILLQYQNEINYLEQ

SEQ ID NO: 2529992 - protein, 19 aa, Entamoeba dispar
KLLTRLYKKKKNMEPSHVQ

SEQ ID NO: 2529993 - protein, 17 aa, Entamoeba dispar
KLLVKHPELVEFHDSNS

SEQ ID NO: 2529994 - protein, 20 aa, Entamoeba dispar
KLMEHLKICTLAVSLGCVDT

SEQ ID NO: 2529995 - protein, 24 aa, Entamoeba dispar
KLMNKAVLILYPTGLQMYIIPLHD

SEQ ID NO: 2529996 - protein, 20 aa, Entamoeba dispar
KLMQQMVPMYYLYDYGTIEF

SEQ ID NO: 2529997 - protein, 31 aa, Entamoeba dispar
KLNAELVYFNYFIPFPIPIDKNKKMYLFPRN

SEQ ID NO: 2529998 - protein, 21 aa, Entamoeba dispar
KLNDFNYLKEFGHNLVGFEEL

SEQ ID NO: 2529999 - protein, 25 aa, Entamoeba dispar
KLNDKIELFGIIWSSKEALVKLLGI

SEQ ID NO: 2530000 - protein, 18 aa, Entamoeba dispar
KLNFIDRRISFDKSISST

SEQ ID NO: 2530001 - protein, 34 aa, Entamoeba dispar
KLNFTSILQSLFLSGSHFFYHFLELYRTQCSSFS

SEQ ID NO: 2530002 - protein, 18 aa, Entamoeba dispar
KLNKEIELIIQSKKVKMI

SEQ ID NO: 2530003 - protein, 28 aa, Entamoeba dispar
KLNKTLTEIPSYHKILLTGTPIQNNIDE

SEQ ID NO: 2530004 - protein, 25 aa, Entamoeba dispar
KLNKWLGLESNYLLYRNHLSSLKDR

SEQ ID NO: 2530005 - protein, 27 aa, Entamoeba dispar
KLNSGLHFLVLYRYYLRHVPKNIAKLC

SEQ ID NO: 2530006 - protein, 26 aa, Entamoeba dispar
KLNSTWYAKLGMWHKALNKLEEESKN

SEQ ID NO: 2530007 - protein, 27 aa, Entamoeba dispar
KLPEIHHPIIMSLIDQLPVRFKETLLS

SEQ ID NO: 2530008 - protein, 40 aa, Entamoeba dispar
KLPERPQGEFILWQPTRHTLFLPSQILAAAGYDSTETLDI

SEQ ID NO: 2530009 - protein, 17 aa, Entamoeba dispar
KLPFNCLVVALVFDVEM

SEQ ID NO: 2530010 - protein, 18 aa, Entamoeba dispar
KLPGTFCPIADYELVHKA

SEQ ID NO: 2530011 - protein, 19 aa, Entamoeba dispar
KLPIYNQVIVDPTAFEEEK

SEQ ID NO: 2530012 - protein, 18 aa, Entamoeba dispar
KLPLPSTLFELISLPRSI

SEQ ID NO: 2530013 - protein, 17 aa, Entamoeba dispar
KLPPIQGKILGCISPHA

SEQ ID NO: 2530014 - protein, 26 aa, Entamoeba dispar
KLPPSSMLFWVPHPTLNEPSKGIIMT

SEQ ID NO: 2530015 - protein, 22 aa, Entamoeba dispar
KLPSLNLWNITINPIPLKIMGF

SEQ ID NO: 2530016 - protein, 18 aa, Entamoeba dispar
KLQIFYYNDDHKLQCSQP

SEQ ID NO: 2530017 - protein, 26 aa, Entamoeba dispar
KLQKNYLFVVVDKKIYVYNFKDLRPL

SEQ ID NO: 2530018 - protein, 27 aa, Entamoeba dispar
KLRDLFSLFFNVEFFERVWSKTDPKDE

SEQ ID NO: 2530019 - protein, 19 aa, Entamoeba dispar
KLRGDINILMLGDPGTSKS

SEQ ID NO: 2530020 - protein, 30 aa, Entamoeba dispar
KLRKEHSLLFILLIINYWLNLERKEYISKY

SEQ ID NO: 2530021 - protein, 18 aa, Entamoeba dispar
KLRKMFLEKEHNSACVII

SEQ ID NO: 2530022 - protein, 26 aa, Entamoeba dispar
KLRLLKEIEENFLYLSIERFINKESI

SEQ ID NO: 2530023 - protein, 24 aa, Entamoeba dispar
KLRPLWRYYYSGTNAIIFVVDSND

SEQ ID NO: 2530024 - protein, 29 aa, Entamoeba dispar
KLRSFILSDDLIWQNFYNLYFSISSFNQK

SEQ ID NO: 2530025 - protein, 23 aa, Entamoeba dispar
KLRSIFRQLPKERVLLYCSSKGP

SEQ ID NO: 2530026 - protein, 21 aa, Entamoeba dispar
KLSERFYLRQDGTRIYFFSEE

SEQ ID NO: 2530027 - protein, 29 aa, Entamoeba dispar
KLSIQQFLKLRYTIQHLLMSTLSVIVNHP

SEQ ID NO: 2530028 - protein, 23 aa, Entamoeba dispar
KLSLIKLHKRDIPFVSSIITALT

SEQ ID NO: 2530029 - protein, 23 aa, Entamoeba dispar
KLSLLQLTNILYFVSSNSLIYNT

SEQ ID NO: 2530030 - protein, 22 aa, Entamoeba dispar
KLSLMQMIIYNHSINYMSFVHT

SEQ ID NO: 2530031 - protein, 19 aa, Entamoeba dispar
KLSMKYHILCKETAFIAID

SEQ ID NO: 2530032 - protein, 17 aa, Entamoeba dispar
KLSMLPPGIGSLKSLDT

SEQ ID NO: 2530033 - protein, 17 aa, Entamoeba dispar
KLSNCIICIGIKGIKCI

SEQ ID NO: 2530034 - protein, 24 aa, Entamoeba dispar
KLSNFLSIFGSKALPRTPFYLVTI

SEQ ID NO: 2530035 - protein, 20 aa, Entamoeba dispar
KLSSFDMDLNKFSSLTFLDI

SEQ ID NO: 2530036 - protein, 24 aa, Entamoeba dispar
KLSSKWEYILTEGIFRVPGNMTDI

SEQ ID NO: 2530037 - protein, 27 aa, Entamoeba dispar
KLSVIDLIYRTMFPFNLDAQKVIEQIF

SEQ ID NO: 2530038 - protein, 24 aa, Entamoeba dispar
KLTEFPLDILKLTSLTNLYLTNNY

SEQ ID NO: 2530039 - protein, 19 aa, Entamoeba dispar
KLTKQHELLLTFIQTHEEP

SEQ ID NO: 2530040 - protein, 20 aa, Entamoeba dispar
KLTLFLKRMVLIKNGAELSE

SEQ ID NO: 2530041 - protein, 21 aa, Entamoeba dispar
KLTLFLKRMVLIKNGAELSEQ

SEQ ID NO: 2530042 - protein, 20 aa, Entamoeba dispar
KLTLLTLLNLDNCPNILELP

SEQ ID NO: 2530043 - protein, 18 aa, Entamoeba dispar
KLTMYKTLQMISNEQLNQ

SEQ ID NO: 2530044 - protein, 19 aa, Entamoeba dispar
KLTMYKTLQMISNEQLNQT

SEQ ID NO: 2530045 - protein, 22 aa, Entamoeba dispar
KLTPLHYCCVYGMVHLIDDIIA

SEQ ID NO: 2530046 - protein, 18 aa, Entamoeba dispar
KLVDIFGQIFFDSFERQN

SEQ ID NO: 2530047 - protein, 24 aa, Entamoeba dispar
KLVECYQLILDVAAWINEKKLYEE

SEQ ID NO: 2530048 - protein, 20 aa, Entamoeba dispar
KLVEGMKRLSRSDPLCLCYT

SEQ ID NO: 2530049 - protein, 26 aa, Entamoeba dispar
KLVGKLSVPQQGRLIRYLNLEHRIDI

SEQ ID NO: 2530050 - protein, 19 aa, Entamoeba dispar
KLVHPIKYFINAILKNPIS

SEQ ID NO: 2530051 - protein, 19 aa, Entamoeba dispar
KLVKLQRISFTANFLNHYQ

SEQ ID NO: 2530052 - protein, 17 aa, Entamoeba dispar
KLVKTLPINASFHGICL

SEQ ID NO: 2530053 - protein, 20 aa, Entamoeba dispar
KLVLKSTILAPPNLCGACVF

SEQ ID NO: 2530054 - protein, 22 aa, Entamoeba dispar
KLVLRHILLDRGMIGEYIQICK

SEQ ID NO: 2530055 - protein, 17 aa, Entamoeba dispar
KLVRYIGFDIIDLSPII

SEQ ID NO: 2530056 - protein, 21 aa, Entamoeba dispar
KLVSFPINNLKRIYGRPIRKR

SEQ ID NO: 2530057 - protein, 18 aa, Entamoeba dispar
KLVSKPFRVVSYPTSIYD

SEQ ID NO: 2530058 - protein, 37 aa, Entamoeba dispar
KLVSVFVKNIPYGWATNDMYQYFASSGPVKTRVITNK

SEQ ID NO: 2530059 - protein, 20 aa, Entamoeba dispar
KLVSYPEYMLKKNSSLKVPE

SEQ ID NO: 2530060 - protein, 20 aa, Entamoeba dispar
KLVVTIKRFLPNIRNFNKEV

SEQ ID NO: 2530061 - protein, 33 aa, Entamoeba dispar
KLYIDCTGYLYRMTLWEVPLLAIVSELYQKMTH

SEQ ID NO: 2530062 - protein, 17 aa, Entamoeba dispar
KLYMLQTRNGKMNATAT

SEQ ID NO: 2530063 - protein, 20 aa, Entamoeba dispar
KLYQGLFYQIVCCVIPNYQK

SEQ ID NO: 2530064 - protein, 25 aa, Entamoeba dispar
KLYQYPLENGVILFHIKLPEAISNK

SEQ ID NO: 2530065 - protein, 17 aa, Entamoeba dispar
KLYRTKPCKYFFETGVC

SEQ ID NO: 2530066 - protein, 26 aa, Entamoeba dispar
KLYSMYLSQWFSLMTLLSSIANASKS

SEQ ID NO: 2530067 - protein, 30 aa, Entamoeba dispar
KMAVNSGYWSLYRYDPRLVAQGKPGLQLDC

SEQ ID NO: 2530068 - protein, 19 aa, Entamoeba dispar
KMCDLPEWIRRYSKKIEDF

SEQ ID NO: 2530069 - protein, 29 aa, Entamoeba dispar
KMCKDFKAILTLLDGIFTFQNKNLYFYMI

SEQ ID NO: 2530070 - protein, 24 aa, Entamoeba dispar
KMCKHIFHIPSMKGCPIAWEDLNK

SEQ ID NO: 2530071 - protein, 27 aa, Entamoeba dispar
KMDCQLMLLRHWTLYDSLFHTREIASK

SEQ ID NO: 2530072 - protein, 21 aa, Entamoeba dispar
KMDELIITRIYAALPSDIQAQ

SEQ ID NO: 2530073 - protein, 17 aa, Entamoeba dispar
KMDHYMKEFNSFKNDEV

SEQ ID NO: 2530074 - protein, 28 aa, Entamoeba dispar
KMDMVSEKLGKYLLQGWTMLGSCCVQHP

SEQ ID NO: 2530075 - protein, 23 aa, Entamoeba dispar
KMDPHPTFGLSYQNIILETNRPL

SEQ ID NO: 2530076 - protein, 17 aa, Entamoeba dispar
KMDPIIGRDEEIKRVIR

SEQ ID NO: 2530077 - protein, 23 aa, Entamoeba dispar
KMDPSFLLTFKDCLLSLGATSQA

SEQ ID NO: 2530078 - protein, 19 aa, Entamoeba dispar
KMECHIMGRLIFPKVENKE

SEQ ID NO: 2530079 - protein, 18 aa, Entamoeba dispar
KMEEIVSYGLYPKQFEAY

SEQ ID NO: 2530080 - protein, 26 aa, Entamoeba dispar
KMEMRIAFLDFLKRSLQWDPEVRMRP

SEQ ID NO: 2530081 - protein, 18 aa, Entamoeba dispar
KMENGLLTQMIWKEILRN

SEQ ID NO: 2530082 - protein, 25 aa, Entamoeba dispar
KMENQHITVQLLSKFKYPQGTNPIE

SEQ ID NO: 2530083 - protein, 25 aa, Entamoeba dispar
KMEQLCGIVIFMFAKPEIVPLMKNI

SEQ ID NO: 2530084 - protein, 17 aa, Entamoeba dispar
KMFDIIAKDIKIVISIY

SEQ ID NO: 2530085 - protein, 17 aa, Entamoeba dispar
KMFKFVYAKVGITYPIW

SEQ ID NO: 2530086 - protein, 34 aa, Entamoeba dispar
KMFKKIDLTLLNRLLRLIMDPLLADYITAKNNIT

SEQ ID NO: 2530087 - protein, 21 aa, Entamoeba dispar
KMGGLDLFFTIKPKNGESALL

SEQ ID NO: 2530088 - protein, 21 aa, Entamoeba dispar
KMGIDLAFNTNFHLLCVEKYQ

SEQ ID NO: 2530089 - protein, 19 aa, Entamoeba dispar
KMHSIIAIVVFYRVSDEYV

SEQ ID NO: 2530090 - protein, 25 aa, Entamoeba dispar
KMIEKSLFIYLDAAKLLYQYDKIQN

SEQ ID NO: 2530091 - protein, 21 aa, Entamoeba dispar
KMIKEWIRQPLIDKDKINKRL

SEQ ID NO: 2530092 - protein, 17 aa, Entamoeba dispar
KMILEIAKGLKYLHELK

SEQ ID NO: 2530093 - protein, 19 aa, Entamoeba dispar
KMIPQPPGSPAKKDKDCIF

SEQ ID NO: 2530094 - protein, 18 aa, Entamoeba dispar
KMIQPRMLQSSFLSKVIR

SEQ ID NO: 2530095 - protein, 17 aa, Entamoeba dispar
KMIVFFQTTKEVRFFFE

SEQ ID NO: 2530096 - protein, 18 aa, Entamoeba dispar
KMIYIVPYVSMAQEKEEY

SEQ ID NO: 2530097 - protein, 29 aa, Entamoeba dispar
KMKELLEGIFLRLFSFKMIPDSFKSFMTY

SEQ ID NO: 2530098 - protein, 21 aa, Entamoeba dispar
KMKFCLWKKLKDNKLISQRYG

SEQ ID NO: 2530099 - protein, 20 aa, Entamoeba dispar
KMKNLFDKLIPKVKFIDIDD

SEQ ID NO: 2530100 - protein, 18 aa, Entamoeba dispar
KMKSILSELPIASTVLHY

SEQ ID NO: 2530101 - protein, 24 aa, Entamoeba dispar
KMKTIPTFNITFGQLELLLNPEQN

SEQ ID NO: 2530102 - protein, 27 aa, Entamoeba dispar
KMKTKPIIYSPVPIWFKGYLTDSGIKC

SEQ ID NO: 2530103 - protein, 17 aa, Entamoeba dispar
KMKYHFFSSSLLFVYDA

SEQ ID NO: 2530104 - protein, 36 aa, Entamoeba dispar
KMLFDHIRIHPICDGIYLLIGKLLDKYTKAFCTVLQ

SEQ ID NO: 2530105 - protein, 21 aa, Entamoeba dispar
KMLGCIVSGLMIISASKFVQD

SEQ ID NO: 2530106 - protein, 21 aa, Entamoeba dispar
KMLHLKLFYETISQNYEIIFS

SEQ ID NO: 2530107 - protein, 21 aa, Entamoeba dispar
KMMLLLIDINKQKTLNIVESL

SEQ ID NO: 2530108 - protein, 33 aa, Entamoeba dispar
KMNEIIVIFIMKEWDTIWFTFSEDIIRNGFINE

SEQ ID NO: 2530109 - protein, 23 aa, Entamoeba dispar
KMNELIFTGTYLSAGSNSTIRTN

SEQ ID NO: 2530110 - protein, 21 aa, Entamoeba dispar
KMNFDDIADKLYLQCFEQFQM

SEQ ID NO: 2530111 - protein, 21 aa, Entamoeba dispar
KMNIIEYRNNITKWKRLMNMK

SEQ ID NO: 2530112 - protein, 17 aa, Entamoeba dispar
KMNNLFNSLVLLETQRG

SEQ ID NO: 2530113 - protein, 20 aa, Entamoeba dispar
KMNQLQEVMLNRQRLLTQKN

SEQ ID NO: 2530114 - protein, 22 aa, Entamoeba dispar
KMNTDIPPQLPPKPKRMTVAKN

SEQ ID NO: 2530115 - protein, 23 aa, Entamoeba dispar
KMNWKAIINILNLAALDSSPNII

SEQ ID NO: 2530116 - protein, 20 aa, Entamoeba dispar
KMNYEIPKLYYKMVFEDELS

SEQ ID NO: 2530117 - protein, 19 aa, Entamoeba dispar
KMPESLSILVKPKTKTKET

SEQ ID NO: 2530118 - protein, 33 aa, Entamoeba dispar
KMPHDPTYLINYQNPLLWKNIMQPYTSKGYSSS

SEQ ID NO: 2530119 - protein, 26 aa, Entamoeba dispar
KMQKSQIFFQKLFNLPVHMPNNNEAL

SEQ ID NO: 2530120 - protein, 33 aa, Entamoeba dispar
KMRDSNHPSIFIIKARIKIIKTNDLTYYGCETC

SEQ ID NO: 2530121 - protein, 35 aa, Entamoeba dispar
KMREVIKVLPKREQYRLLRKMDLRHRFSLGTEMDT

SEQ ID NO: 2530122 - protein, 18 aa, Entamoeba dispar
KMRILYDSVIDGSSCEVI

SEQ ID NO: 2530123 - protein, 18 aa, Entamoeba dispar
KMRKMELPFTLIVDDPMA

SEQ ID NO: 2530124 - protein, 20 aa, Entamoeba dispar
KMRNCDIGFMVVSDPMIEIT

SEQ ID NO: 2530125 - protein, 34 aa, Entamoeba dispar
KMRQGQTLISFFYPAKNLKLLDLAVKKGINVISM

SEQ ID NO: 2530126 - protein, 20 aa, Entamoeba dispar
KMSELYWDYTKRKKWDNFYT

SEQ ID NO: 2530127 - protein, 25 aa, Entamoeba dispar
KMSISFNWILDRCLSFGYEFKKRST

SEQ ID NO: 2530128 - protein, 20 aa, Entamoeba dispar
KMTQEDYDFLYKIVLIGESG

SEQ ID NO: 2530129 - protein, 17 aa, Entamoeba dispar
KMTQIMFETFNTPAMYV

SEQ ID NO: 2530130 - protein, 18 aa, Entamoeba dispar
KMVCIGRVLLSRKAKDFI

SEQ ID NO: 2530131 - protein, 26 aa, Entamoeba dispar
KMVCRSAIDGLIRKLEHQYLTFVRSR

SEQ ID NO: 2530132 - protein, 23 aa, Entamoeba dispar
KMVKIPVFAIYGQQDRFAGGMKK

SEQ ID NO: 2530133 - protein, 28 aa, Entamoeba dispar
KMVRELYCGLIQLFCNLFEKEKNALQQI

SEQ ID NO: 2530134 - protein, 32 aa, Entamoeba dispar
KMVRVSGKFFMKWRIIELKPEYLNSGDVFIID

SEQ ID NO: 2530135 - protein, 23 aa, Entamoeba dispar
KMWDEFITFPDTTLYIYCVVGYL

SEQ ID NO: 2530136 - protein, 20 aa, Entamoeba dispar
KMYHNHLEGLKKQRVKEVFN

SEQ ID NO: 2530137 - protein, 20 aa, Entamoeba dispar
KMYVITRRSLIQYSERFELG

SEQ ID NO: 2530138 - protein, 25 aa, Entamoeba dispar
KNAEYFFVPLIKRKCIVKQDYLVPI

SEQ ID NO: 2530139 - protein, 21 aa, Entamoeba dispar
KNAKHLACRIFYQSKTQTIAD

SEQ ID NO: 2530140 - protein, 26 aa, Entamoeba dispar
KNAKPMALILFNDLLMVCEYIEKGVF

SEQ ID NO: 2530141 - protein, 34 aa, Entamoeba dispar
KNAQYLPDFVRMFFNRFFTLLREGDIEDVVIEKI

SEQ ID NO: 2530142 - protein, 26 aa, Entamoeba dispar
KNCIELLMKCWILYDLDKGYQQGMSD

SEQ ID NO: 2530143 - protein, 26 aa, Entamoeba dispar
KNCKLDSFYFIGWIGKTTLNHNISKE

SEQ ID NO: 2530144 - protein, 18 aa, Entamoeba dispar
KNCLLCHQPFTLVNRKHH

SEQ ID NO: 2530145 - protein, 32 aa, Entamoeba dispar
KNCNKTCHYPCHVPFFISALTMRGCSCIVNGR

SEQ ID NO: 2530146 - protein, 18 aa, Entamoeba dispar
KNCPKPIKTWSECGIIQL

SEQ ID NO: 2530147 - protein, 25 aa, Entamoeba dispar
KNCQFSYSMLLMKLSLQTTEAVCDG

SEQ ID NO: 2530148 - protein, 28 aa, Entamoeba dispar
KNCVDCGCYMLYYIRKIASQPKRTLKEF

SEQ ID NO: 2530149 - protein, 23 aa, Entamoeba dispar
KNCVSLTHINIPTSIKLIKNNIF

SEQ ID NO: 2530150 - protein, 20 aa, Entamoeba dispar
KNDELLLNQMQLDEYIKVND

SEQ ID NO: 2530151 - protein, 26 aa, Entamoeba dispar
KNDELLVELVSHYSFFFGGFSNSILS

SEQ ID NO: 2530152 - protein, 28 aa, Entamoeba dispar
KNDKIVLDFFVWWKCPIQTINTIKQLAS

SEQ ID NO: 2530153 - protein, 17 aa, Entamoeba dispar
KNDLYIKQILSYMEKKS

SEQ ID NO: 2530154 - protein, 36 aa, Entamoeba dispar
KNDPGHFVFTLQNPFNIAPTPFYPIKKKCKSCAIHP

SEQ ID NO: 2530155 - protein, 20 aa, Entamoeba dispar
KNDRIVLILIKHCASLNITN

SEQ ID NO: 2530156 - protein, 30 aa, Entamoeba dispar
KNDVEPEFDLQFLRSILQTNINIISEEYNK

SEQ ID NO: 2530157 - protein, 26 aa, Entamoeba dispar
KNDVGLIVCFLLRYEIFEPYHAFFIP

SEQ ID NO: 2530158 - protein, 23 aa, Entamoeba dispar
KNDVLGYLRRLEEIGLLHGGRKG

SEQ ID NO: 2530159 - protein, 24 aa, Entamoeba dispar
KNDVNMIVILIKQLNLMNSDVFNS

SEQ ID NO: 2530160 - protein, 30 aa, Entamoeba dispar
KNEEKLLPREVILWVLLPADEEAYNYPIKI

SEQ ID NO: 2530161 - protein, 21 aa, Entamoeba dispar
KNEGLYTYDELLDRIFAQCNI

SEQ ID NO: 2530162 - protein, 24 aa, Entamoeba dispar
KNEIDERMLLNLQKKKWTDSLEVE

SEQ ID NO: 2530163 - protein, 21 aa, Entamoeba dispar
KNEINKWLPSIKVALMGGTRE

SEQ ID NO: 2530164 - protein, 23 aa, Entamoeba dispar
KNEIVSSILFNGKLILTSEQINT

SEQ ID NO: 2530165 - protein, 26 aa, Entamoeba dispar
KNEKGKLKIYLYPNEPFNQKDESDAI

SEQ ID NO: 2530166 - protein, 27 aa, Entamoeba dispar
KNEKKPVFQLLLYFLVLDIDNENEESL

SEQ ID NO: 2530167 - protein, 25 aa, Entamoeba dispar
KNELARLLIKYLKNGKIQSLHKSFE

SEQ ID NO: 2530168 - protein, 27 aa, Entamoeba dispar
KNENVLIKYTIPRKIKYENIWIGIYDR

SEQ ID NO: 2530169 - protein, 23 aa, Entamoeba dispar
KNENWEFIPFDLSTTPLIGRNYF

SEQ ID NO: 2530170 - protein, 24 aa, Entamoeba dispar
KNEPYSNAIYPIEPQRNILKQERY

SEQ ID NO: 2530171 - protein, 26 aa, Entamoeba dispar
KNESILIIIVWFFHYEEKEVLYYISQ

SEQ ID NO: 2530172 - protein, 24 aa, Entamoeba dispar
KNESPDLLYIYLRNGRICVHINST

SEQ ID NO: 2530173 - protein, 21 aa, Entamoeba dispar
KNEWRIWIANTTKFGPIKLLL

SEQ ID NO: 2530174 - protein, 21 aa, Entamoeba dispar
KNFDDFIKKLTKLPRISLETS

SEQ ID NO: 2530175 - protein, 28 aa, Entamoeba dispar
KNFDEFIKKLIKLPRKSLKQSREVLKKR

SEQ ID NO: 2530176 - protein, 26 aa, Entamoeba dispar
KNFDKFIEKLIKLPRKSLKQSREVLE

SEQ ID NO: 2530177 - protein, 17 aa, Entamoeba dispar
KNFKRREKRHTIQTTLE

SEQ ID NO: 2530178 - protein, 21 aa, Entamoeba dispar
KNFLMRFIQTQHFNTWWFSQY

SEQ ID NO: 2530179 - protein, 19 aa, Entamoeba dispar
KNFPFIIGVVVKKGEEDKE

SEQ ID NO: 2530180 - protein, 18 aa, Entamoeba dispar
KNFSSILAQFSRLEKDSQ

SEQ ID NO: 2530181 - protein, 24 aa, Entamoeba dispar
KNFYKSPFIVCTYNYILDPKEENV

SEQ ID NO: 2530182 - protein, 31 aa, Entamoeba dispar
KNGFNLDLCEFIFWGMVRYCTDEELLEFMKE

SEQ ID NO: 2530183 - protein, 25 aa, Entamoeba dispar
KNGGVYFVPAFQGLGTPYWDDDVRG

SEQ ID NO: 2530184 - protein, 23 aa, Entamoeba dispar
KNGKFPFVIIGNKIDKGSVISKE

SEQ ID NO: 2530185 - protein, 26 aa, Entamoeba dispar
KNGKYYGVWWGCKLVFDCMKYIDPVL

SEQ ID NO: 2530186 - protein, 23 aa, Entamoeba dispar
KNGRLPAIEFMFGLPLETPRNKQ

SEQ ID NO: 2530187 - protein, 28 aa, Entamoeba dispar
KNGSFVIEKLFIKSSIDGKLKIIEEMNS

SEQ ID NO: 2530188 - protein, 27 aa, Entamoeba dispar
KNHEKGKLKIYLYPNEPFNQVEESDAI

SEQ ID NO: 2530189 - protein, 23 aa, Entamoeba dispar
KNHGVYYCKVHFQQMFREKGNYD

SEQ ID NO: 2530190 - protein, 22 aa, Entamoeba dispar
KNHHILIYDCSNNQLLGTLKGH

SEQ ID NO: 2530191 - protein, 24 aa, Entamoeba dispar
KNHLQPIQILPKKDKLVGMYIHST

SEQ ID NO: 2530192 - protein, 18 aa, Entamoeba dispar
KNHLVILAHAKKLGGQLK

SEQ ID NO: 2530193 - protein, 28 aa, Entamoeba dispar
KNHMELSFYLVLHFLFHEEIILSPMEKK

SEQ ID NO: 2530194 - protein, 26 aa, Entamoeba dispar
KNHSLAFRVYVYCGVMLSNPFVYEMD

SEQ ID NO: 2530195 - protein, 19 aa, Entamoeba dispar
KNHYFVKSPMLNPMLGRMI

SEQ ID NO: 2530196 - protein, 17 aa, Entamoeba dispar
KNIAQFIYNVDPCIPWH

SEQ ID NO: 2530197 - protein, 25 aa, Entamoeba dispar
KNIEDYYFILLRKVHLYAHSVGPNT

SEQ ID NO: 2530198 - protein, 27 aa, Entamoeba dispar
KNIEEYLKILTLYTFGKKKKEGKEIII

SEQ ID NO: 2530199 - protein, 28 aa, Entamoeba dispar
KNIEREFIQPQWIFDCVNENFILPCGEY

SEQ ID NO: 2530200 - protein, 28 aa, Entamoeba dispar
KNIEVTVEIGFLLQTYNKTLKVPSQMKV

SEQ ID NO: 2530201 - protein, 19 aa, Entamoeba dispar
KNIFLMDSIIFLEPNNKVS

SEQ ID NO: 2530202 - protein, 17 aa, Entamoeba dispar
KNIFLMNGIYYIVTDVI

SEQ ID NO: 2530203 - protein, 27 aa, Entamoeba dispar
KNIIKVMELLMILIKLQDTKKNGNASP

SEQ ID NO: 2530204 - protein, 19 aa, Entamoeba dispar
KNIILSSKKFQYLFEYFKS

SEQ ID NO: 2530205 - protein, 22 aa, Entamoeba dispar
KNIISTSMLFYNETMIGLIGSD

SEQ ID NO: 2530206 - protein, 31 aa, Entamoeba dispar
KNIKDALSFLPLLNYITLKHIIFHLHLIAQY

SEQ ID NO: 2530207 - protein, 23 aa, Entamoeba dispar
KNIKTIEIQYLRRNKRITYTGEV

SEQ ID NO: 2530208 - protein, 22 aa, Entamoeba dispar
KNILEKEILPNFKFSYQKYNEC

SEQ ID NO: 2530209 - protein, 23 aa, Entamoeba dispar
KNINEFIIPSSITKLGYCCFSKC

SEQ ID NO: 2530210 - protein, 38 aa, Entamoeba dispar
KNIQNILTFLPDIYYETLKLLIHYLRLIADASSINKMN

SEQ ID NO: 2530211 - protein, 23 aa, Entamoeba dispar
KNKELHIVFSSRIIPELISGIFL

SEQ ID NO: 2530212 - protein, 17 aa, Entamoeba dispar
KNKIAFSLPLTVNAFLV

SEQ ID NO: 2530213 - protein, 27 aa, Entamoeba dispar
KNKIKEGMMMLNKLKNIYQVINEIRYE

SEQ ID NO: 2530214 - protein, 17 aa, Entamoeba dispar
KNKINRIKLFEGILEII

SEQ ID NO: 2530215 - protein, 29 aa, Entamoeba dispar
KNKIPVEDILPLLPLDWELGEFKGVIKNA

SEQ ID NO: 2530216 - protein, 21 aa, Entamoeba dispar
KNKIRFEWLVNLFDTENNELK

SEQ ID NO: 2530217 - protein, 29 aa, Entamoeba dispar
KNKITELNLLLIDILNMLGYTFTTTTSEG

SEQ ID NO: 2530218 - protein, 27 aa, Entamoeba dispar
KNKKGMFKIYMRGVVLALKHIDEPTIL

SEQ ID NO: 2530219 - protein, 26 aa, Entamoeba dispar
KNKKVFVQNLLIDLLDEFGFQFHTTL

SEQ ID NO: 2530220 - protein, 24 aa, Entamoeba dispar
KNKKYCKIFRIIFRFISKVITERI

SEQ ID NO: 2530221 - protein, 17 aa, Entamoeba dispar
KNKLLKRCIPHPLNNTL

SEQ ID NO: 2530222 - protein, 19 aa, Entamoeba dispar
KNKMFKWTLAKVSPRILFQ

SEQ ID NO: 2530223 - protein, 24 aa, Entamoeba dispar
KNKNPYIIFCNTKREEVRAANPNL

SEQ ID NO: 2530224 - protein, 24 aa, Entamoeba dispar
KNKTKLVIMLLKYQCLSSEINQNI

SEQ ID NO: 2530225 - protein, 24 aa, Entamoeba dispar
KNKTPVYCMRWTPDGRRIVTGNEK

SEQ ID NO: 2530226 - protein, 19 aa, Entamoeba dispar
KNLFFQKRILDEVVNDPDE

SEQ ID NO: 2530227 - protein, 19 aa, Entamoeba dispar
KNLFYLICNIIFDCNEEDF

SEQ ID NO: 2530228 - protein, 17 aa, Entamoeba dispar
KNLIIVMEYARGGDLSR

SEQ ID NO: 2530229 - protein, 37 aa, Entamoeba dispar
KNLKRYLTVLSNPHYQFLTFLKICNYLLTSPLYSQAN

SEQ ID NO: 2530230 - protein, 26 aa, Entamoeba dispar
KNLKTVYVLFQFRFPETIIYDFHNVD

SEQ ID NO: 2530231 - protein, 20 aa, Entamoeba dispar
KNLTIRGALTLNGTCIFVCF

SEQ ID NO: 2530232 - protein, 18 aa, Entamoeba dispar
KNLTKIICWLKKTENTTN

SEQ ID NO: 2530233 - protein, 18 aa, Entamoeba dispar
KNLVGKYELILFTASTES

SEQ ID NO: 2530234 - protein, 27 aa, Entamoeba dispar
KNMLDQYFAILLNFFKSKAQQLSQVLL

SEQ ID NO: 2530235 - protein, 17 aa, Entamoeba dispar
KNNKHYYFILNITDDRS

SEQ ID NO: 2530236 - protein, 28 aa, Entamoeba dispar
KNNKIIFEPYDEFEWFLFNGNEMVVLRK

SEQ ID NO: 2530237 - protein, 24 aa, Entamoeba dispar
KNNKNIIIKLIKDLEKRINNIKSS

SEQ ID NO: 2530238 - protein, 21 aa, Entamoeba dispar
KNNLLEYWVINKNGIRICQIN

SEQ ID NO: 2530239 - protein, 32 aa, Entamoeba dispar
KNNLSKFEIPTIKLPVMFSLSESRLECLKKIS

SEQ ID NO: 2530240 - protein, 26 aa, Entamoeba dispar
KNNPNWLIEFLIGSSLRKGSQEHAIE

SEQ ID NO: 2530241 - protein, 18 aa, Entamoeba dispar
KNPICYFHNLGYDGRFLA

SEQ ID NO: 2530242 - protein, 21 aa, Entamoeba dispar
KNPSLVTLGIMRPSVSDSSAT

SEQ ID NO: 2530243 - protein, 29 aa, Entamoeba dispar
KNPYVLRSMSLIHIFDTLCIMVDPAKLVG

SEQ ID NO: 2530244 - protein, 24 aa, Entamoeba dispar
KNQIIDRMINIKEKKLREVVTNEN

SEQ ID NO: 2530245 - protein, 27 aa, Entamoeba dispar
KNQIPLSIIIIFLLKQCNYSNELSEEN

SEQ ID NO: 2530246 - protein, 19 aa, Entamoeba dispar
KNQLIDDLQKSLSRSGVNW

SEQ ID NO: 2530247 - protein, 17 aa, Entamoeba dispar
KNQLVYLRQGMLELAIL

SEQ ID NO: 2530248 - protein, 26 aa, Entamoeba dispar
KNQPLNNLFNLLIKDLTKIEINSTDL

SEQ ID NO: 2530249 - protein, 24 aa, Entamoeba dispar
KNQPQAIMFLVDQLKDIANQKILI

SEQ ID NO: 2530250 - protein, 37 aa, Entamoeba dispar
KNQQPLRSILIMPVQRIPRYVLLLKDLLKNTDVTHSQ

SEQ ID NO: 2530251 - protein, 24 aa, Entamoeba dispar
KNQTYAVYSIYRGTSSYIENDEFV

SEQ ID NO: 2530252 - protein, 29 aa, Entamoeba dispar
KNRDLIKEPLLLHIILSLHSYEVIDLCHA

SEQ ID NO: 2530253 - protein, 28 aa, Entamoeba dispar
KNRDWVNMRSWWFNEDKSLFIIINHSVE

SEQ ID NO: 2530254 - protein, 26 aa, Entamoeba dispar
KNRGDMGQLFYWLLVGENEKTKISLR

SEQ ID NO: 2530255 - protein, 30 aa, Entamoeba dispar
KNRRTFIHNFLFDILLEKSYFFNSKLSRKT

SEQ ID NO: 2530256 - protein, 41 aa, Entamoeba dispar
KNSATVLHLIYLPILRISNQSPSPFYLVCITIQLPIPHREV

SEQ ID NO: 2530257 - protein, 27 aa, Entamoeba dispar
KNSEQMKIFQLFRQLERLSYDDICSKT

SEQ ID NO: 2530258 - protein, 23 aa, Entamoeba dispar
KNSFELSKYFARPKLIEKVNNFK

SEQ ID NO: 2530259 - protein, 27 aa, Entamoeba dispar
KNSFERKVLFLPLSVPKYAVIESTEEI

SEQ ID NO: 2530260 - protein, 17 aa, Entamoeba dispar
KNSGILKKAAYMEEELK

SEQ ID NO: 2530261 - protein, 30 aa, Entamoeba dispar
KNSIEVITLLLLYKLKYPHSIFLLRGNHED

SEQ ID NO: 2530262 - protein, 26 aa, Entamoeba dispar
KNSLYYLLITFARWSHRLYECGEEKR

SEQ ID NO: 2530263 - protein, 27 aa, Entamoeba dispar
KNSMLRPLVILIRYLLHQAGFTSVMNG

SEQ ID NO: 2530264 - protein, 18 aa, Entamoeba dispar
KNSRIWLDTILNGNKKRI

SEQ ID NO: 2530265 - protein, 25 aa, Entamoeba dispar
KNSRIWLNSALSRRTKRIKTLVIVS

SEQ ID NO: 2530266 - protein, 24 aa, Entamoeba dispar
KNSVIIDIIYKYLINKVEIVNNEF

SEQ ID NO: 2530267 - protein, 24 aa, Entamoeba dispar
KNTDEQYWWYKANDDWLIQNEEEY

SEQ ID NO: 2530268 - protein, 33 aa, Entamoeba dispar
KNTEKLFGLIRNFSLLFVFPMSGFIPICVEYLQ

SEQ ID NO: 2530269 - protein, 23 aa, Entamoeba dispar
KNTEWERIIIKTKLKDVISLYYC

SEQ ID NO: 2530270 - protein, 23 aa, Entamoeba dispar
KNTFQLFIILSEFHQKQYQMKSV

SEQ ID NO: 2530271 - protein, 23 aa, Entamoeba dispar
KNTIVFNQRFDNKFSKYTLERVP

SEQ ID NO: 2530272 - protein, 25 aa, Entamoeba dispar
KNTMDVSLANYLSLIESYGVLQESP

SEQ ID NO: 2530273 - protein, 22 aa, Entamoeba dispar
KNTSCHYPCFIPGDVKDGCYCI

SEQ ID NO: 2530274 - protein, 30 aa, Entamoeba dispar
KNTVDDYCLYFYLTFFIMKENVFDDNEVME

SEQ ID NO: 2530275 - protein, 38 aa, Entamoeba dispar
KNTVLSMYFDLFMKYLQFVQPILTLKVHISKQIYSATL

SEQ ID NO: 2530276 - protein, 25 aa, Entamoeba dispar
KNTYKFFNKLLNLNPNLRPSIDTCA

SEQ ID NO: 2530277 - protein, 39 aa, Entamoeba dispar
KNVDLWNCKGAISYIDKLRLYIKTMVEYLKANSGRQIIS

SEQ ID NO: 2530278 - protein, 26 aa, Entamoeba dispar
KNVENKNVVFPLTALSFIHTESNNKK

SEQ ID NO: 2530279 - protein, 34 aa, Entamoeba dispar
KNVLMQLHHPFIVKLYYAFQTADKLYMVMDFVNG

SEQ ID NO: 2530280 - protein, 19 aa, Entamoeba dispar
KNVPYVFVGSKAALGRACG

SEQ ID NO: 2530281 - protein, 18 aa, Entamoeba dispar
KNVRLRYYLRVSVNKKYS

SEQ ID NO: 2530282 - protein, 25 aa, Entamoeba dispar
KNVSICFKLIIKECLLIRQMLRTQL

SEQ ID NO: 2530283 - protein, 19 aa, Entamoeba dispar
KNVSLIDLCRYAFLSMDNN

SEQ ID NO: 2530284 - protein, 29 aa, Entamoeba dispar
KNWINEPINSIFYWIIKTIKNDFEENIYD

SEQ ID NO: 2530285 - protein, 28 aa, Entamoeba dispar
KNWSTQTDVLLFNINQTINTLMVSSKTK

SEQ ID NO: 2530286 - protein, 21 aa, Entamoeba dispar
KNYAPALIGLALCELKDHKDG

SEQ ID NO: 2530287 - protein, 24 aa, Entamoeba dispar
KNYINSYEPLLNMLKEMNSKGLLN

SEQ ID NO: 2530288 - protein, 24 aa, Entamoeba dispar
KNYKDQAIFFLNAFWAEAGKDAEN

SEQ ID NO: 2530289 - protein, 21 aa, Entamoeba dispar
KNYKYLRRSLYIGADFFVICY

SEQ ID NO: 2530290 - protein, 30 aa, Entamoeba dispar
KNYSPGDFLGVGLVIEMIRMYGIRACELGP

SEQ ID NO: 2530291 - protein, 26 aa, Entamoeba dispar
KNYYEQHPFYAFFYSEEKEQPEEEVE

SEQ ID NO: 2530292 - protein, 24 aa, Entamoeba dispar
KPAIPYLKFFLKEMSQIFEEEEEI

SEQ ID NO: 2530293 - protein, 29 aa, Entamoeba dispar
KPAKLKKHYLINGYYYAMAKYLFQETKTD

SEQ ID NO: 2530294 - protein, 20 aa, Entamoeba dispar
KPATNNLFSFDLDEPKKENQ

SEQ ID NO: 2530295 - protein, 18 aa, Entamoeba dispar
KPCFDYLLSCLATNDGTI

SEQ ID NO: 2530296 - protein, 23 aa, Entamoeba dispar
KPDVRFVIHHSLPKSLEGYYQES

SEQ ID NO: 2530297 - protein, 26 aa, Entamoeba dispar
KPEEYFRFLWELRMVFNRDLTQLESL

SEQ ID NO: 2530298 - protein, 22 aa, Entamoeba dispar
KPEGMLLTDCYLEYLKIATSDR

SEQ ID NO: 2530299 - protein, 28 aa, Entamoeba dispar
KPEIHRLIFTILKILIKYHSFIPSSDVF

SEQ ID NO: 2530300 - protein, 35 aa, Entamoeba dispar
KPEIKIIARHLAVIKTRPIIWRSNHSYLVADRVED

SEQ ID NO: 2530301 - protein, 25 aa, Entamoeba dispar
KPENQPLGFWIFDTKGAEKAVERWK

SEQ ID NO: 2530302 - protein, 26 aa, Entamoeba dispar
KPESSQTLLFTRMYQNPKKRIDDGEA

SEQ ID NO: 2530303 - protein, 20 aa, Entamoeba dispar
KPEWNIHCYGFAPAATLSEN

SEQ ID NO: 2530304 - protein, 25 aa, Entamoeba dispar
KPFEQFIDLNLFEKAMSLSTTLTSY

SEQ ID NO: 2530305 - protein, 18 aa, Entamoeba dispar
KPFRAVPVQPKPVKIDVP

SEQ ID NO: 2530306 - protein, 17 aa, Entamoeba dispar
KPFYIPDDNPYDLNFFF

SEQ ID NO: 2530307 - protein, 24 aa, Entamoeba dispar
KPGKDESFFRKLSLVYNDIDDVYL

SEQ ID NO: 2530308 - protein, 24 aa, Entamoeba dispar
KPGWDNMTLLVVKFKSFNPQPDTT

SEQ ID NO: 2530309 - protein, 25 aa, Entamoeba dispar
KPHQTDCLCFLLPSYCPVSQSQILC

SEQ ID NO: 2530310 - protein, 23 aa, Entamoeba dispar
KPHTILMKRYDSPVISLTPNSFT

SEQ ID NO: 2530311 - protein, 20 aa, Entamoeba dispar
KPIFIGGCSFYILGVEFKTK

SEQ ID NO: 2530312 - protein, 28 aa, Entamoeba dispar
KPILTIEMWYEMLWDIGLSEYYKNQVGL

SEQ ID NO: 2530313 - protein, 21 aa, Entamoeba dispar
KPIVLSALMDSLPPTLLLEGL

SEQ ID NO: 2530314 - protein, 25 aa, Entamoeba dispar
KPIVRRNDIIIKQQKPKLIINDESS

SEQ ID NO: 2530315 - protein, 20 aa, Entamoeba dispar
KPKGYDLLIKNARELYTEFT

SEQ ID NO: 2530316 - protein, 27 aa, Entamoeba dispar
KPKIKEGEYFYIDSTLTYTSEGIPYMF

SEQ ID NO: 2530317 - protein, 33 aa, Entamoeba dispar
KPKKIPKKRLIPIKNFQKIRKHNLRPRIQSSKA

SEQ ID NO: 2530318 - protein, 40 aa, Entamoeba dispar
KPKKNEPQITKSLVKKIYSQLKLVPPENGRYISTEESVLD

SEQ ID NO: 2530319 - protein, 24 aa, Entamoeba dispar
KPKKRYFYLFNDILVYGRMQLQLF

SEQ ID NO: 2530320 - protein, 25 aa, Entamoeba dispar
KPKNEWLQPVISKTPPEKVLIHQNR

SEQ ID NO: 2530321 - protein, 19 aa, Entamoeba dispar
KPKRIIFKSIEEYIKVPLK

SEQ ID NO: 2530322 - protein, 19 aa, Entamoeba dispar
KPLGTYPIRIDTTGAGDTT

SEQ ID NO: 2530323 - protein, 17 aa, Entamoeba dispar
KPLHLAPQPRRPNKAAP

SEQ ID NO: 2530324 - protein, 24 aa, Entamoeba dispar
KPLHNLPHPLQLLEKRKPGVDQRT

SEQ ID NO: 2530325 - protein, 17 aa, Entamoeba dispar
KPLILRVEFSGCSNLTI

SEQ ID NO: 2530326 - protein, 17 aa, Entamoeba dispar
KPLQIKPKPKQPRIEYN

SEQ ID NO: 2530327 - protein, 39 aa, Entamoeba dispar
KPLRNKLVHHLIMEYGIYKRLNIYKPWRATNEQMEMFHS

SEQ ID NO: 2530328 - protein, 20 aa, Entamoeba dispar
KPLVCIGSCYALCKPSQFPV

SEQ ID NO: 2530329 - protein, 26 aa, Entamoeba dispar
KPNEPLNYRINFIGTFYISKDNVKEK

SEQ ID NO: 2530330 - protein, 26 aa, Entamoeba dispar
KPNGNGWVCILLLHIGKGAINQTTKD

SEQ ID NO: 2530331 - protein, 19 aa, Entamoeba dispar
KPNLFPWKEDSEEIQTIRK

SEQ ID NO: 2530332 - protein, 31 aa, Entamoeba dispar
KPNTIAVVTIFFVLRYYNVLNGSIEKIITSN

SEQ ID NO: 2530333 - protein, 24 aa, Entamoeba dispar
KPNTNTRLNYLKKLKLCLDNYCKD

SEQ ID NO: 2530334 - protein, 21 aa, Entamoeba dispar
KPPKGVILYGPPGTGKTLLAK

SEQ ID NO: 2530335 - protein, 24 aa, Entamoeba dispar
KPPKKFIDIITKIYKRMFRVYAHM

SEQ ID NO: 2530336 - protein, 21 aa, Entamoeba dispar
KPQQFSQIIAWFNQVDKDHSG

SEQ ID NO: 2530337 - protein, 26 aa, Entamoeba dispar
KPRPPFFDGFIDLLKRFKEQGGIVAV

SEQ ID NO: 2530338 - protein, 24 aa, Entamoeba dispar
KPSFNIEIPYYFNKEMHLFSMNMY

SEQ ID NO: 2530339 - protein, 18 aa, Entamoeba dispar
KPSIGFLSDIRRMNVALT

SEQ ID NO: 2530340 - protein, 23 aa, Entamoeba dispar
KPSKFTTQPIPAKTLYLWEKNGE

SEQ ID NO: 2530341 - protein, 21 aa, Entamoeba dispar
KPSKGGLMLDKSRCSEFKRKL

SEQ ID NO: 2530342 - protein, 31 aa, Entamoeba dispar
KPSLILNIGYYQLRLVFNPKTKTPSILLTKA

SEQ ID NO: 2530343 - protein, 18 aa, Entamoeba dispar
KPSPGFKMPCKEILHGVG

SEQ ID NO: 2530344 - protein, 17 aa, Entamoeba dispar
KPSPHPLISLKKQIKYF

SEQ ID NO: 2530345 - protein, 27 aa, Entamoeba dispar
KPSPVDTMLTLFTPLPPILQQYNTLSQ

SEQ ID NO: 2530346 - protein, 19 aa, Entamoeba dispar
KPTIIVGTPGRLASLNNSG

SEQ ID NO: 2530347 - protein, 21 aa, Entamoeba dispar
KPTLMKILPQLSFGYDKDEEF

SEQ ID NO: 2530348 - protein, 28 aa, Entamoeba dispar
KPTTKPKINYLDLYLSDDFSQNKPVQED

SEQ ID NO: 2530349 - protein, 23 aa, Entamoeba dispar
KPVKHLFIHFLNKLTSNLNCAIS

SEQ ID NO: 2530350 - protein, 19 aa, Entamoeba dispar
KPWKELSVEQKQKFLTMEK

SEQ ID NO: 2530351 - protein, 18 aa, Entamoeba dispar
KPYAFIVATEIEYFIFGR

SEQ ID NO: 2530352 - protein, 24 aa, Entamoeba dispar
KPYDQLINEILGIRIKRSANLNSL

SEQ ID NO: 2530353 - protein, 18 aa, Entamoeba dispar
KPYIIQCGILNKIIQKLP

SEQ ID NO: 2530354 - protein, 22 aa, Entamoeba dispar
KPYISCILSVFYEKVKEELKEN

SEQ ID NO: 2530355 - protein, 18 aa, Entamoeba dispar
KPYSIIHKWIIDKASSSF

SEQ ID NO: 2530356 - protein, 28 aa, Entamoeba dispar
KPYSLEELYIFYIQLRSLIPNELLCPSI

SEQ ID NO: 2530357 - protein, 17 aa, Entamoeba dispar
KQAILALRESLTTTNDK

SEQ ID NO: 2530358 - protein, 26 aa, Entamoeba dispar
KQAKQHGCLTLWNPAPAPKEINRNII

SEQ ID NO: 2530359 - protein, 19 aa, Entamoeba dispar
KQCEPYLSEGIHPRLLVEG

SEQ ID NO: 2530360 - protein, 24 aa, Entamoeba dispar
KQCFNCPICYKPVPIKEVVIDNKV

SEQ ID NO: 2530361 - protein, 27 aa, Entamoeba dispar
KQCVFEWQLLPQFIYATNLDIELNIDY

SEQ ID NO: 2530362 - protein, 23 aa, Entamoeba dispar
KQDLSLIPLDILHLYPLDLEETE

SEQ ID NO: 2530363 - protein, 19 aa, Entamoeba dispar
KQDTMAVQAIFLLDQLEKD

SEQ ID NO: 2530364 - protein, 28 aa, Entamoeba dispar
KQDVVIKICWLIDKFGPDIKWKFDSMLE

SEQ ID NO: 2530365 - protein, 17 aa, Entamoeba dispar
KQDWKSFLFPFAADIRP

SEQ ID NO: 2530366 - protein, 23 aa, Entamoeba dispar
KQEDARIVAEVRASPRKAAEAKA

SEQ ID NO: 2530367 - protein, 31 aa, Entamoeba dispar
KQEDLIEFYMFFINALLPLTQSFQGQIQIEE

SEQ ID NO: 2530368 - protein, 17 aa, Entamoeba dispar
KQEIGVIINKWDIFEQK

SEQ ID NO: 2530369 - protein, 17 aa, Entamoeba dispar
KQEINVIPFSQPLTETT

SEQ ID NO: 2530370 - protein, 26 aa, Entamoeba dispar
KQELPKILSFWEKQKMFLFNLNQKLS

SEQ ID NO: 2530371 - protein, 33 aa, Entamoeba dispar
KQEQTKRASFMNYLWRGYSVDGLPQNVSKDLST

SEQ ID NO: 2530372 - protein, 20 aa, Entamoeba dispar
KQFNFFIKKDRITNQFIGLT

SEQ ID NO: 2530373 - protein, 24 aa, Entamoeba dispar
KQFTTFINKQECLDIVPPESPIEN

SEQ ID NO: 2530374 - protein, 17 aa, Entamoeba dispar
KQFYEKFKDNALRETED

SEQ ID NO: 2530375 - protein, 18 aa, Entamoeba dispar
KQGAATGGVKKVKKVKKV

SEQ ID NO: 2530376 - protein, 24 aa, Entamoeba dispar
KQGDFMLISLLKSSIEMKRFKEDT

SEQ ID NO: 2530377 - protein, 27 aa, Entamoeba dispar
KQGDKLMINWFKIRSIGNLVKEIMVKQ

SEQ ID NO: 2530378 - protein, 21 aa, Entamoeba dispar
KQGKPILCKVLVNVSVDVNEI

SEQ ID NO: 2530379 - protein, 30 aa, Entamoeba dispar
KQHDFFSNIKFALIRNMTPPIIPRLNGRRD

SEQ ID NO: 2530380 - protein, 22 aa, Entamoeba dispar
KQHEFYINWKAQQAMNYLTMNS

SEQ ID NO: 2530381 - protein, 24 aa, Entamoeba dispar
KQHGLTAFTYLRMTRGLLDDGNAW

SEQ ID NO: 2530382 - protein, 24 aa, Entamoeba dispar
KQIDLFFEILKFGVNLEEAINYTK

SEQ ID NO: 2530383 - protein, 28 aa, Entamoeba dispar
KQIHINDSIILCYFFSKLNQLKGTDITE

SEQ ID NO: 2530384 - protein, 30 aa, Entamoeba dispar
KQIKTITHPILCGYYYILYEEKDSTETCKY

SEQ ID NO: 2530385 - protein, 26 aa, Entamoeba dispar
KQILITALPIFDFLCKHGKKLEIFER

SEQ ID NO: 2530386 - protein, 20 aa, Entamoeba dispar
KQILKLLKSGSIRAVRVKTN

SEQ ID NO: 2530387 - protein, 17 aa, Entamoeba dispar
KQIRRYFQTWDFIKERI

SEQ ID NO: 2530388 - protein, 25 aa, Entamoeba dispar
KQISSWLINTLFSSNFYNKGDDRKN

SEQ ID NO: 2530389 - protein, 18 aa, Entamoeba dispar
KQISVYYHYIIEKTIEII

SEQ ID NO: 2530390 - protein, 19 aa, Entamoeba dispar
KQIVYFTMILKELIKRNDI

SEQ ID NO: 2530391 - protein, 18 aa, Entamoeba dispar
KQIYFVQTTYLLKTLSIG

SEQ ID NO: 2530392 - protein, 21 aa, Entamoeba dispar
KQKHFYLSPTNKSKKLDDCLL

SEQ ID NO: 2530393 - protein, 31 aa, Entamoeba dispar
KQKIISTWSRTFFFLLDGISQYRRHFRCDEV

SEQ ID NO: 2530394 - protein, 23 aa, Entamoeba dispar
KQKIRCLIPCAIDQDPYFRMTRD

SEQ ID NO: 2530395 - protein, 24 aa, Entamoeba dispar
KQKLTLYHYYNGGMSFYVPIGDEP

SEQ ID NO: 2530396 - protein, 22 aa, Entamoeba dispar
KQKPILGIPVTTPGYSYYNKLL

SEQ ID NO: 2530397 - protein, 38 aa, Entamoeba dispar
KQKRIPIDQFLIQPIQRLPRYVLLLKELIKTTPEIIVD

SEQ ID NO: 2530398 - protein, 26 aa, Entamoeba dispar
KQKTFLPIQYLLIYSFDPLFGKSLDT

SEQ ID NO: 2530399 - protein, 20 aa, Entamoeba dispar
KQKVNIIRIGNYAGINSKVN

SEQ ID NO: 2530400 - protein, 19 aa, Entamoeba dispar
KQKVSVGSLVYIPSVTENK

SEQ ID NO: 2530401 - protein, 23 aa, Entamoeba dispar
KQLDDFFVPNIIGVLILSMSKRI

SEQ ID NO: 2530402 - protein, 21 aa, Entamoeba dispar
KQLFDYLEIFYNDLPVLLVDF

SEQ ID NO: 2530403 - protein, 17 aa, Entamoeba dispar
KQLFVIESIWKEGINCF

SEQ ID NO: 2530404 - protein, 22 aa, Entamoeba dispar
KQLHFKISLYGLELRFDSLFGI

SEQ ID NO: 2530405 - protein, 21 aa, Entamoeba dispar
KQLKWMLVRCHYPEITLITKS

SEQ ID NO: 2530406 - protein, 33 aa, Entamoeba dispar
KQLLESKKLLRLMEVILLIGNYLNQGTARAKCH

SEQ ID NO: 2530407 - protein, 25 aa, Entamoeba dispar
KQLQKYHLFHELILPNQVTLTQQII

SEQ ID NO: 2530408 - protein, 17 aa, Entamoeba dispar
KQLQQKLGFKTLTQLID

SEQ ID NO: 2530409 - protein, 25 aa, Entamoeba dispar
KQLSLSLLILRRILVKRLEDGLSIV

SEQ ID NO: 2530410 - protein, 18 aa, Entamoeba dispar
KQMGIVLKKALREKKKNV

SEQ ID NO: 2530411 - protein, 22 aa, Entamoeba dispar
KQMIPIFIESLIKEFNYPKGND

SEQ ID NO: 2530412 - protein, 20 aa, Entamoeba dispar
KQMTLLFNNKVYFKDTSDGY

SEQ ID NO: 2530413 - protein, 25 aa, Entamoeba dispar
KQNERFIFPNLIISFNISKLEFVLS

SEQ ID NO: 2530414 - protein, 23 aa, Entamoeba dispar
KQNGIGLHCGLQEKYNSPSAKKY

SEQ ID NO: 2530415 - protein, 25 aa, Entamoeba dispar
KQNILIKQLFIIKNSLKRNGFEIIQ

SEQ ID NO: 2530416 - protein, 33 aa, Entamoeba dispar
KQNKTMLYVIYEVIVLWISTIKITQEWLQGKDN

SEQ ID NO: 2530417 - protein, 18 aa, Entamoeba dispar
KQNPLSVFKPLDHSLFCV

SEQ ID NO: 2530418 - protein, 20 aa, Entamoeba dispar
KQNTIIKDKLLPEFQINKIQ

SEQ ID NO: 2530419 - protein, 38 aa, Entamoeba dispar
KQNYLTVLNVITISSPIIFNILIDHINIDTIAVANTFN

SEQ ID NO: 2530420 - protein, 33 aa, Entamoeba dispar
KQPENAFIMWDKNNNYLFGFGVSDIRIGKIQNK

SEQ ID NO: 2530421 - protein, 19 aa, Entamoeba dispar
KQPKIILSDQLNKTKKDKK

SEQ ID NO: 2530422 - protein, 24 aa, Entamoeba dispar
KQPKPLFKYCQIAKIFICYYFIIY

SEQ ID NO: 2530423 - protein, 21 aa, Entamoeba dispar
KQQEIKKIIPFGLIGKTEKQI

SEQ ID NO: 2530424 - protein, 19 aa, Entamoeba dispar
KQQFKPFKKAKLDIELKNY

SEQ ID NO: 2530425 - protein, 21 aa, Entamoeba dispar
KQQIKLLTIIFWSLNSQKTED

SEQ ID NO: 2530426 - protein, 27 aa, Entamoeba dispar
KQQKYCPPNLFSIVFKGFNDVYRINSN

SEQ ID NO: 2530427 - protein, 24 aa, Entamoeba dispar
KQQPNTMDLFAGLSAPNQPNQQQN

SEQ ID NO: 2530428 - protein, 17 aa, Entamoeba dispar
KQQPSIPKQDSFSPQRV

SEQ ID NO: 2530429 - protein, 34 aa, Entamoeba dispar
KQQTLQCWRRSESALFLLFCSDPLMQKENIEKRG

SEQ ID NO: 2530430 - protein, 22 aa, Entamoeba dispar
KQQTRRSMYPRFGMNDYNDGYD

SEQ ID NO: 2530431 - protein, 23 aa, Entamoeba dispar
KQQTRRSMYPRFGMNDYNDGYDD

SEQ ID NO: 2530432 - protein, 26 aa, Entamoeba dispar
KQQTWRWFVCLFSREFTVEKVIVIWD

SEQ ID NO: 2530433 - protein, 22 aa, Entamoeba dispar
KQRMVSFFLSLLDSMNLAVKFN

SEQ ID NO: 2530434 - protein, 24 aa, Entamoeba dispar
KQRTQLFITSGKHKVLIASFIPGI

SEQ ID NO: 2530435 - protein, 31 aa, Entamoeba dispar
KQSERVTLFVFRILTNLLAFQQLQTTTFNKI

SEQ ID NO: 2530436 - protein, 24 aa, Entamoeba dispar
KQSKPLNWIFINKGWYYEVSKSIF

SEQ ID NO: 2530437 - protein, 23 aa, Entamoeba dispar
KQSMNYHARWNYIAKIKEQLKIP

SEQ ID NO: 2530438 - protein, 21 aa, Entamoeba dispar
KQSRFLLRRLNPERYNPPEIS

SEQ ID NO: 2530439 - protein, 18 aa, Entamoeba dispar
KQSRKYIVIKSKKGKNPY

SEQ ID NO: 2530440 - protein, 30 aa, Entamoeba dispar
KQTEYNCFFFPSQMLLVDYLSDSGSSAMTD

SEQ ID NO: 2530441 - protein, 25 aa, Entamoeba dispar
KQTGSLPVPLHIRNAPTSLMESMGY

SEQ ID NO: 2530442 - protein, 22 aa, Entamoeba dispar
KQTIKMLLPETVVLNNTTYDQS

SEQ ID NO: 2530443 - protein, 25 aa, Entamoeba dispar
KQTINDLKLKIKQSGDEKNELTMKI

SEQ ID NO: 2530444 - protein, 25 aa, Entamoeba dispar
KQTIWKPVVIVLTTISILIVEIHNN

SEQ ID NO: 2530445 - protein, 29 aa, Entamoeba dispar
KQTLQDTLRLLTILFKFGKYYEVEHAISS

SEQ ID NO: 2530446 - protein, 22 aa, Entamoeba dispar
KQTLQKVSYVMSFFGSKAFPTN

SEQ ID NO: 2530447 - protein, 20 aa, Entamoeba dispar
KQTPLLWRKYYLQYHKFHSL

SEQ ID NO: 2530448 - protein, 25 aa, Entamoeba dispar
KQTQNNLLFILDRYAPGYISNSLRF

SEQ ID NO: 2530449 - protein, 23 aa, Entamoeba dispar
KQVFRYILGFTDFAFFQPTVFGI

SEQ ID NO: 2530450 - protein, 17 aa, Entamoeba dispar
KQVHLEYGCWYINPILL

SEQ ID NO: 2530451 - protein, 33 aa, Entamoeba dispar
KQVSHLLLQISKFPRINVFIKPINNIHLDDKVF

SEQ ID NO: 2530452 - protein, 26 aa, Entamoeba dispar
KQVTLIEYDLFMKIHISELYSWNNSN

SEQ ID NO: 2530453 - protein, 31 aa, Entamoeba dispar
KQVVKVISDIFLFSEFWKHTCIVWTKCYNFI

SEQ ID NO: 2530454 - protein, 17 aa, Entamoeba dispar
KQWSMLKNIILSCIHSE

SEQ ID NO: 2530455 - protein, 22 aa, Entamoeba dispar
KQWTGLTKYRIIYNTEIDEFTT

SEQ ID NO: 2530456 - protein, 17 aa, Entamoeba dispar
KQYFSQWKKMTSLENEA

SEQ ID NO: 2530457 - protein, 27 aa, Entamoeba dispar
KQYKEEKYIIFIKKIEGIKKIKQGRIE

SEQ ID NO: 2530458 - protein, 31 aa, Entamoeba dispar
KQYKEWPPLPQQKLKMIIDVKLSTINLLLRK

SEQ ID NO: 2530459 - protein, 23 aa, Entamoeba dispar
KQYKMVQSLYYFEPNEENELQLN

SEQ ID NO: 2530460 - protein, 23 aa, Entamoeba dispar
KQYKTIFWEVLPIYHINCIFLHR

SEQ ID NO: 2530461 - protein, 33 aa, Entamoeba dispar
KQYLFKKHQLNYVRLIFLNSIDMDFINSLQLYH

SEQ ID NO: 2530462 - protein, 30 aa, Entamoeba dispar
KQYMVLNNYLSARIYFLLAASYTNYKNIEI

SEQ ID NO: 2530463 - protein, 20 aa, Entamoeba dispar
KRAFKFPTMGKKARLICIPT

SEQ ID NO: 2530464 - protein, 27 aa, Entamoeba dispar
KRAPKAIKIIRFLAIKTMKTHNVKFDM

SEQ ID NO: 2530465 - protein, 17 aa, Entamoeba dispar
KRCCVLLEYISFDLKNI

SEQ ID NO: 2530466 - protein, 18 aa, Entamoeba dispar
KRCERMSLFLDEHNIGLA

SEQ ID NO: 2530467 - protein, 26 aa, Entamoeba dispar
KRCVLLHYPFILDYMIIKIIHNTNVY

SEQ ID NO: 2530468 - protein, 32 aa, Entamoeba dispar
KRDDESFFLTTYPLDLLTFKLEVKIIRCIDNQ

SEQ ID NO: 2530469 - protein, 26 aa, Entamoeba dispar
KRDIPKAFSKFLARNTFYFGSNEQLM

SEQ ID NO: 2530470 - protein, 24 aa, Entamoeba dispar
KRDITTIMSLLFQPSFNNKQIIKE

SEQ ID NO: 2530471 - protein, 24 aa, Entamoeba dispar
KRDKNVFIASFRSPLRKAKDVFVI

SEQ ID NO: 2530472 - protein, 17 aa, Entamoeba dispar
KRDLVFAMCSNAVYRGT

SEQ ID NO: 2530473 - protein, 25 aa, Entamoeba dispar
KRDRTNYFGILSNLFLIAGNIISGR

SEQ ID NO: 2530474 - protein, 32 aa, Entamoeba dispar
KREDVVIYKGYPSILTLSLFKEFSKLIELGDL

SEQ ID NO: 2530475 - protein, 28 aa, Entamoeba dispar
KREELIDFIHACSERIQASKKKIVELQV

SEQ ID NO: 2530476 - protein, 24 aa, Entamoeba dispar
KREHHLYFLGYRDTSVYLSDLLYN

SEQ ID NO: 2530477 - protein, 18 aa, Entamoeba dispar
KREIAKLNYLNGLKKKYK

SEQ ID NO: 2530478 - protein, 19 aa, Entamoeba dispar
KREIAKLNYLNGLKKKYKD

SEQ ID NO: 2530479 - protein, 26 aa, Entamoeba dispar
KREIGKSISFVWKLNLEYGEYDLQYF

SEQ ID NO: 2530480 - protein, 20 aa, Entamoeba dispar
KREMIWMNQIIPKKEIKTIE

SEQ ID NO: 2530481 - protein, 24 aa, Entamoeba dispar
KREMPVLFHFQQISSLMFPDISGK

SEQ ID NO: 2530482 - protein, 25 aa, Entamoeba dispar
KRENVHLLNLPFYQTGKTGKKPVGQ

SEQ ID NO: 2530483 - protein, 18 aa, Entamoeba dispar
KRFEAYNWNVLKCNGDEV

SEQ ID NO: 2530484 - protein, 20 aa, Entamoeba dispar
KRFGALIIRITNPKTTALVF

SEQ ID NO: 2530485 - protein, 17 aa, Entamoeba dispar
KRFITASADKTCKIWNA

SEQ ID NO: 2530486 - protein, 19 aa, Entamoeba dispar
KRFLFKIGLIVTDGYGTSE

SEQ ID NO: 2530487 - protein, 25 aa, Entamoeba dispar
KRGKISSQMMVFKRMVNFDGQDLDP

SEQ ID NO: 2530488 - protein, 17 aa, Entamoeba dispar
KRGLFHFKSTVGISKKT

SEQ ID NO: 2530489 - protein, 18 aa, Entamoeba dispar
KRGNYYLNYIPIQFVNKE

SEQ ID NO: 2530490 - protein, 21 aa, Entamoeba dispar
KRGTICWSPKGNLLAVGTTAD

SEQ ID NO: 2530491 - protein, 25 aa, Entamoeba dispar
KRGVEDKCFFFMDNEWKEVIIDEVP

SEQ ID NO: 2530492 - protein, 26 aa, Entamoeba dispar
KRHNSIKKILFKPLKVFGSAAKLTVE

SEQ ID NO: 2530493 - protein, 24 aa, Entamoeba dispar
KRHPTIGDFVVIGAGAKVLGNITI

SEQ ID NO: 2530494 - protein, 17 aa, Entamoeba dispar
KRHPTLLPIGIGHDFFI

SEQ ID NO: 2530495 - protein, 18 aa, Entamoeba dispar
KRHVGNDVVVLIFKEQSS

SEQ ID NO: 2530496 - protein, 25 aa, Entamoeba dispar
KRIDIELFPLKLYSFIHIRGELEIP

SEQ ID NO: 2530497 - protein, 28 aa, Entamoeba dispar
KRIEMFDSWEILVLKYSLDEISQWCYSN

SEQ ID NO: 2530498 - protein, 21 aa, Entamoeba dispar
KRIFNELPHLSLKIPVIEIWK

SEQ ID NO: 2530499 - protein, 23 aa, Entamoeba dispar
KRIIVHYLMKLFEKNLDEKRYIR

SEQ ID NO: 2530500 - protein, 24 aa, Entamoeba dispar
KRIKKIAIFICCDEYLFGVYHHSQ

SEQ ID NO: 2530501 - protein, 17 aa, Entamoeba dispar
KRIKRQTINKQIVLLIL

SEQ ID NO: 2530502 - protein, 24 aa, Entamoeba dispar
KRIMNEVILPLKEYLKQFKVIDKR

SEQ ID NO: 2530503 - protein, 26 aa, Entamoeba dispar
KRINKQFVSMLRKKAFIYLYTEEGME

SEQ ID NO: 2530504 - protein, 24 aa, Entamoeba dispar
KRINQIESFTSPMKKKSTNFIGEE

SEQ ID NO: 2530505 - protein, 26 aa, Entamoeba dispar
KRINVDELFIALGRKLLQINHKGEDA

SEQ ID NO: 2530506 - protein, 22 aa, Entamoeba dispar
KRKEAFYIGKPIKFKVTQCLSN

SEQ ID NO: 2530507 - protein, 20 aa, Entamoeba dispar
KRKEEWHPYLLFCKEHREEL

SEQ ID NO: 2530508 - protein, 17 aa, Entamoeba dispar
KRKELTPPWIPPVKSQT

SEQ ID NO: 2530509 - protein, 22 aa, Entamoeba dispar
KRKIINLQYYNESNCLLIQFEE

SEQ ID NO: 2530510 - protein, 21 aa, Entamoeba dispar
KRKKDMKLEIQRNVFAQYEEE

SEQ ID NO: 2530511 - protein, 26 aa, Entamoeba dispar
KRKKISLPGLLFKFITIKPCDRKIFV

SEQ ID NO: 2530512 - protein, 22 aa, Entamoeba dispar
KRKKLACSYLISITKKYQESKE

SEQ ID NO: 2530513 - protein, 18 aa, Entamoeba dispar
KRKKQFYEKFKDNALRET

SEQ ID NO: 2530514 - protein, 31 aa, Entamoeba dispar
KRKKQIKRIIKWLDTIFPKAVQLRWAITDCT

SEQ ID NO: 2530515 - protein, 18 aa, Entamoeba dispar
KRKKYFPIIVKTTEIDLS

SEQ ID NO: 2530516 - protein, 24 aa, Entamoeba dispar
KRKLKGYLITLQRSSYLPLIKYCK

SEQ ID NO: 2530517 - protein, 25 aa, Entamoeba dispar
KRKLLNKLWEELPKSWKILVVDKEA

SEQ ID NO: 2530518 - protein, 21 aa, Entamoeba dispar
KRKLLPIVGYIYDDIDLTRFS

SEQ ID NO: 2530519 - protein, 22 aa, Entamoeba dispar
KRKLRLFKIDEVYKNLTRVEQV

SEQ ID NO: 2530520 - protein, 28 aa, Entamoeba dispar
KRKQELYQSLITLYLEPSLVQLCQNVYD

SEQ ID NO: 2530521 - protein, 18 aa, Entamoeba dispar
KRLACEVVNIPTGSFFSK

SEQ ID NO: 2530522 - protein, 27 aa, Entamoeba dispar
KRLAWTTLCRLVFLSIYQRSPVDFINV

SEQ ID NO: 2530523 - protein, 28 aa, Entamoeba dispar
KRLDELCKIILLIIDSYNPHVRYGAALA

SEQ ID NO: 2530524 - protein, 20 aa, Entamoeba dispar
KRLIFQVLTSKMNLSKEIDL

SEQ ID NO: 2530525 - protein, 21 aa, Entamoeba dispar
KRLIGRPFQPSLVKQEKRMIN

SEQ ID NO: 2530526 - protein, 34 aa, Entamoeba dispar
KRLIPIEIPQLPEFVKHFSIKAIYSKFIINNKQL

SEQ ID NO: 2530527 - protein, 21 aa, Entamoeba dispar
KRLLGLSQETTQTGLFSYFFG

SEQ ID NO: 2530528 - protein, 20 aa, Entamoeba dispar
KRLLKCWTLYNFDGGYQQGM

SEQ ID NO: 2530529 - protein, 22 aa, Entamoeba dispar
KRLRVGFKLVFEFEKNEWFEET

SEQ ID NO: 2530530 - protein, 36 aa, Entamoeba dispar
KRLYGFFDEDIIFPKLPKVYIYKTQKYVIKESIPIH

SEQ ID NO: 2530531 - protein, 19 aa, Entamoeba dispar
KRMKFLLKEMLVFDQNKRP

SEQ ID NO: 2530532 - protein, 22 aa, Entamoeba dispar
KRMLEKLWGDNYWDAKAKKWKK

SEQ ID NO: 2530533 - protein, 30 aa, Entamoeba dispar
KRNAELMIILITFLPRFSMFDFKLLASSCV

SEQ ID NO: 2530534 - protein, 26 aa, Entamoeba dispar
KRNHPSTPLFYKLSKSVSPQNVINHN

SEQ ID NO: 2530535 - protein, 24 aa, Entamoeba dispar
KRNPHLFLMGFNQPGDLFHFEKII

SEQ ID NO: 2530536 - protein, 18 aa, Entamoeba dispar
KRNSVILSRVPLEILNTL

SEQ ID NO: 2530537 - protein, 17 aa, Entamoeba dispar
KRPMPLLEIVKQSFNSK

SEQ ID NO: 2530538 - protein, 19 aa, Entamoeba dispar
KRQLLLKEIDLEKSKIERL

SEQ ID NO: 2530539 - protein, 26 aa, Entamoeba dispar
KRQTINKQIVLLILQSCYELSQESDV

SEQ ID NO: 2530540 - protein, 23 aa, Entamoeba dispar
KRQTLMFSATFPKQIQRLAADFL

SEQ ID NO: 2530541 - protein, 19 aa, Entamoeba dispar
KRQVHLDWKGKKLIHFGAV

SEQ ID NO: 2530542 - protein, 22 aa, Entamoeba dispar
KRRGFAIVEFASLASVEKALEL

SEQ ID NO: 2530543 - protein, 23 aa, Entamoeba dispar
KRRIDFFSRPPICFKGTSSTARL

SEQ ID NO: 2530544 - protein, 20 aa, Entamoeba dispar
KRRIQIGVRLPNGEIKKAVF

SEQ ID NO: 2530545 - protein, 29 aa, Entamoeba dispar
KRRKHDYMPLALNLILFLGKHHKLEQEVE

SEQ ID NO: 2530546 - protein, 36 aa, Entamoeba dispar
KRRKYILSGCYYLITKGWSFLFSKEKRIAGKLNHFF

SEQ ID NO: 2530547 - protein, 20 aa, Entamoeba dispar
KRRNTRTIGEYGTTSIIGGT

SEQ ID NO: 2530548 - protein, 18 aa, Entamoeba dispar
KRRPPKRDREEAGEPQPS

SEQ ID NO: 2530549 - protein, 27 aa, Entamoeba dispar
KRRRIINPHFAAMYVYLLKPGEGMLYT

SEQ ID NO: 2530550 - protein, 20 aa, Entamoeba dispar
KRRVNDVIIPPIYHDIFFNK

SEQ ID NO: 2530551 - protein, 24 aa, Entamoeba dispar
KRSKGILFFGPPGTGKTMLAKAVA

SEQ ID NO: 2530552 - protein, 30 aa, Entamoeba dispar
KRSPGSYIKILLRSAISSSPYKALEIYGNI

SEQ ID NO: 2530553 - protein, 42 aa, Entamoeba dispar
KRSTKFVKILSHLAIPNYPDKLLPTLIVYRNTNHVKQFIGLA

SEQ ID NO: 2530554 - protein, 25 aa, Entamoeba dispar
KRSVKYLIKKLPKYLTFVIKRFERN

SEQ ID NO: 2530555 - protein, 20 aa, Entamoeba dispar
KRTAVLVLGFILNKRLDELC

SEQ ID NO: 2530556 - protein, 24 aa, Entamoeba dispar
KRTDGLFCLILTPTRELTQQVYDV

SEQ ID NO: 2530557 - protein, 19 aa, Entamoeba dispar
KRTERVLDKCKEAVLCKDK

SEQ ID NO: 2530558 - protein, 27 aa, Entamoeba dispar
KRTEYRMLYFNFKTRKIFFLRHAKVRE

SEQ ID NO: 2530559 - protein, 17 aa, Entamoeba dispar
KRTIFKELVRYINNFKL

SEQ ID NO: 2530560 - protein, 18 aa, Entamoeba dispar
KRTMLKTQYRMHPAIVEF

SEQ ID NO: 2530561 - protein, 40 aa, Entamoeba dispar
KRTSTFIKFEEFKFFIPSINDIYIMNKTKELYIFGNEKIT

SEQ ID NO: 2530562 - protein, 25 aa, Entamoeba dispar
KRTSVTLKRRTCTPSIYTLLLVSQS

SEQ ID NO: 2530563 - protein, 25 aa, Entamoeba dispar
KRTTTTLQFLYIKELRFKNYSINIT

SEQ ID NO: 2530564 - protein, 25 aa, Entamoeba dispar
KRVAWTIICKYILKALANINEKQYY

SEQ ID NO: 2530565 - protein, 26 aa, Entamoeba dispar
KRVHRQIFFYYNRKTTFIMKELAKLN

SEQ ID NO: 2530566 - protein, 26 aa, Entamoeba dispar
KRVKIYRTLYSLAKFKDGNWLIRRNV

SEQ ID NO: 2530567 - protein, 33 aa, Entamoeba dispar
KRVKQLNLLLCKYSCFPNLKSQFMYLKEQLVNA

SEQ ID NO: 2530568 - protein, 25 aa, Entamoeba dispar
KRVPTYFETYSSRNWGRCILQHFFQ

SEQ ID NO: 2530569 - protein, 21 aa, Entamoeba dispar
KRVYLGALKFLPHAVYKLLEN

SEQ ID NO: 2530570 - protein, 20 aa, Entamoeba dispar
KRWDDIENFIYLGNDLISSI

SEQ ID NO: 2530571 - protein, 17 aa, Entamoeba dispar
KRWLFPNEVKSIGRRMK

SEQ ID NO: 2530572 - protein, 23 aa, Entamoeba dispar
KRYDVFLVEIRVCHLLSVLFNGR

SEQ ID NO: 2530573 - protein, 29 aa, Entamoeba dispar
KRYECITTFFQLLIKLIQKKNFNSFVSVM

SEQ ID NO: 2530574 - protein, 24 aa, Entamoeba dispar
KRYEYPFHSFLNKVPFNLLNNKTN

SEQ ID NO: 2530575 - protein, 25 aa, Entamoeba dispar
KRYKHTDVILFMLGGGNYMEYTNIS

SEQ ID NO: 2530576 - protein, 18 aa, Entamoeba dispar
KRYYNYLDPTIDGTGFTF

SEQ ID NO: 2530577 - protein, 25 aa, Entamoeba dispar
KSAFSSFLFPIYSQITKYITLKENL

SEQ ID NO: 2530578 - protein, 24 aa, Entamoeba dispar
KSAGWRLDYFFISKDLVDSVTQIY

SEQ ID NO: 2530579 - protein, 22 aa, Entamoeba dispar
KSAGYIPSVPKKRSLFDDTSDR

SEQ ID NO: 2530580 - protein, 24 aa, Entamoeba dispar
KSAKKTIQMIKIKEIGIGEEWKMK

SEQ ID NO: 2530581 - protein, 25 aa, Entamoeba dispar
KSALESPICKFALFFGNRISEEVEL

SEQ ID NO: 2530582 - protein, 26 aa, Entamoeba dispar
KSALESPMCKFALFFGNRISEEVELN

SEQ ID NO: 2530583 - protein, 27 aa, Entamoeba dispar
KSATKSYKQLRMLLGKKSTNNLESFIS

SEQ ID NO: 2530584 - protein, 23 aa, Entamoeba dispar
KSATLNLRPTIPASTPLSLTNLI

SEQ ID NO: 2530585 - protein, 31 aa, Entamoeba dispar
KSAVITTLRKLIIILFLPIHTKSTKVNKNNI

SEQ ID NO: 2530586 - protein, 31 aa, Entamoeba dispar
KSAVITTLRKLIIILFLPIHTKSTKVNKNNL

SEQ ID NO: 2530587 - protein, 20 aa, Entamoeba dispar
KSCHPTIIPHPILTQINQQN

SEQ ID NO: 2530588 - protein, 21 aa, Entamoeba dispar
KSCINLYFDEIFFKANKETGA

SEQ ID NO: 2530589 - protein, 19 aa, Entamoeba dispar
KSCIVCEDGYVYDSYTKQC

SEQ ID NO: 2530590 - protein, 29 aa, Entamoeba dispar
KSCKINMNAPWNMRYALPQCERYKQMLKD

SEQ ID NO: 2530591 - protein, 22 aa, Entamoeba dispar
KSCLIAKPFYLIDEETIKIINE

SEQ ID NO: 2530592 - protein, 24 aa, Entamoeba dispar
KSDEWVVELSLLEGLRPLCDHSLE

SEQ ID NO: 2530593 - protein, 19 aa, Entamoeba dispar
KSDFMTKLKQIIVAIPNSE

SEQ ID NO: 2530594 - protein, 17 aa, Entamoeba dispar
KSDIWSLGITILELRER

SEQ ID NO: 2530595 - protein, 28 aa, Entamoeba dispar
KSDIYSFGIILWQLVYKCIYNVYSKPFE

SEQ ID NO: 2530596 - protein, 33 aa, Entamoeba dispar
KSDIYSLGIVFWEIFRRVVFGSYTKPWFKEYNI

SEQ ID NO: 2530597 - protein, 23 aa, Entamoeba dispar
KSDLQFKYQPVSGLFQQYIDPKK

SEQ ID NO: 2530598 - protein, 26 aa, Entamoeba dispar
KSDMNDLCWFLPQIAIATNSGVVLWN

SEQ ID NO: 2530599 - protein, 26 aa, Entamoeba dispar
KSDNPLVDYLPLLPLSLIEVHETTNS

SEQ ID NO: 2530600 - protein, 25 aa, Entamoeba dispar
KSDVFSYAIILWELKNKQPPYKNFK

SEQ ID NO: 2530601 - protein, 32 aa, Entamoeba dispar
KSDVWSFGMLIFKLLVGRLPFELMQMDSLSAI

SEQ ID NO: 2530602 - protein, 17 aa, Entamoeba dispar
KSEFYIPGYWKAQATGY

SEQ ID NO: 2530603 - protein, 17 aa, Entamoeba dispar
KSEIAPFVKLLTDSKEL

SEQ ID NO: 2530604 - protein, 27 aa, Entamoeba dispar
KSEKALYPLNPPLPLLNKREVSSEKEY

SEQ ID NO: 2530605 - protein, 17 aa, Entamoeba dispar
KSELIAESLPKVNVQSD

SEQ ID NO: 2530606 - protein, 22 aa, Entamoeba dispar
KSELRCISLIKLINFLSTNLKD

SEQ ID NO: 2530607 - protein, 25 aa, Entamoeba dispar
KSEPLYEDIPYINFKPLSISSKANE

SEQ ID NO: 2530608 - protein, 26 aa, Entamoeba dispar
KSEQLSSLVPLLLSKSFRLKTGILRI

SEQ ID NO: 2530609 - protein, 28 aa, Entamoeba dispar
KSEVKQKILRLLTDKNPNLLLKADNLEE

SEQ ID NO: 2530610 - protein, 20 aa, Entamoeba dispar
KSEWIKYIQILLQSTQTVSN

SEQ ID NO: 2530611 - protein, 23 aa, Entamoeba dispar
KSEYNFYPQFCYVNNQVTVQGEN

SEQ ID NO: 2530612 - protein, 20 aa, Entamoeba dispar
KSFFEKLAKYIGRNIRFLID

SEQ ID NO: 2530613 - protein, 19 aa, Entamoeba dispar
KSFIPEKRYKHTDVILFML

SEQ ID NO: 2530614 - protein, 23 aa, Entamoeba dispar
KSFISFHTLSPYYKTILNCIELF

SEQ ID NO: 2530615 - protein, 24 aa, Entamoeba dispar
KSFKSFYLPIYLDLNGVQIRYTID

SEQ ID NO: 2530616 - protein, 21 aa, Entamoeba dispar
KSFLDFLGNVGGALFELIMNG

SEQ ID NO: 2530617 - protein, 17 aa, Entamoeba dispar
KSFLNIVTVMWDWPKES

SEQ ID NO: 2530618 - protein, 19 aa, Entamoeba dispar
KSFNILNMKLIHVNILPLS

SEQ ID NO: 2530619 - protein, 17 aa, Entamoeba dispar
KSFPPNIQCLSLPSIKQ

SEQ ID NO: 2530620 - protein, 18 aa, Entamoeba dispar
KSFQYTISPSLSPHNNEP

SEQ ID NO: 2530621 - protein, 17 aa, Entamoeba dispar
KSFRSFGGTLIKRKDLK

SEQ ID NO: 2530622 - protein, 19 aa, Entamoeba dispar
KSFSLLNRKQFCIHCGLCV

SEQ ID NO: 2530623 - protein, 23 aa, Entamoeba dispar
KSFSYTVQSPYLTYYQLDSQMNL

SEQ ID NO: 2530624 - protein, 24 aa, Entamoeba dispar
KSGDVQYIAMMPYYLVIDGDEGKD

SEQ ID NO: 2530625 - protein, 22 aa, Entamoeba dispar
KSGDWWSGELNGVKGIFPSNYV

SEQ ID NO: 2530626 - protein, 24 aa, Entamoeba dispar
KSGFLPQVLICLLNWLTSVSDDDV

SEQ ID NO: 2530627 - protein, 21 aa, Entamoeba dispar
KSGHWYLFIVCCQLYKKSEEK

SEQ ID NO: 2530628 - protein, 17 aa, Entamoeba dispar
KSGILEMKIGGGIIRVI

SEQ ID NO: 2530629 - protein, 23 aa, Entamoeba dispar
KSGKIIPQYLYDDQLSLAAQEKA

SEQ ID NO: 2530630 - protein, 25 aa, Entamoeba dispar
KSGLIKLFCRLINGININCGYYEAH

SEQ ID NO: 2530631 - protein, 23 aa, Entamoeba dispar
KSGMIIRCPFISMEVIKKVVNSF

SEQ ID NO: 2530632 - protein, 23 aa, Entamoeba dispar
KSGSNMFSIQELSFKTPTEKSTT

SEQ ID NO: 2530633 - protein, 27 aa, Entamoeba dispar
KSGWRYPVPFFRSIQYLRYNGGITTEG

SEQ ID NO: 2530634 - protein, 23 aa, Entamoeba dispar
KSHPWFEGINWNTLLSESREDIF

SEQ ID NO: 2530635 - protein, 27 aa, Entamoeba dispar
KSHVFTLCDVSYVIQCLLMALEYIHSQ

SEQ ID NO: 2530636 - protein, 19 aa, Entamoeba dispar
KSICLLKIYSGIKTSILLP

SEQ ID NO: 2530637 - protein, 22 aa, Entamoeba dispar
KSIFIEELPRMLGLPDTSKLAQ

SEQ ID NO: 2530638 - protein, 20 aa, Entamoeba dispar
KSIFLIAGTLRPETMYGQTN

SEQ ID NO: 2530639 - protein, 22 aa, Entamoeba dispar
KSIFSLFPFFHYHMYFKDNCLL

SEQ ID NO: 2530640 - protein, 20 aa, Entamoeba dispar
KSIIKIFSPIITEGLLPRFL

SEQ ID NO: 2530641 - protein, 18 aa, Entamoeba dispar
KSIKLIHEILAGLSPNEI

SEQ ID NO: 2530642 - protein, 23 aa, Entamoeba dispar
KSIKNLLLPQQLYSLKLEDASDS

SEQ ID NO: 2530643 - protein, 27 aa, Entamoeba dispar
KSIKRKRKPLLFANRLNNEEVNDNIID

SEQ ID NO: 2530644 - protein, 25 aa, Entamoeba dispar
KSIKSLLLNMFIGKINLENIKESVE

SEQ ID NO: 2530645 - protein, 18 aa, Entamoeba dispar
KSILPRLSMTRRPRNKIL

SEQ ID NO: 2530646 - protein, 21 aa, Entamoeba dispar
KSIMERLVSVPKLLDDASLQP

SEQ ID NO: 2530647 - protein, 25 aa, Entamoeba dispar
KSIMKHRVLFKGLLNEVFHVIYIPL

SEQ ID NO: 2530648 - protein, 17 aa, Entamoeba dispar
KSINIPSSIIKLGYYCF

SEQ ID NO: 2530649 - protein, 17 aa, Entamoeba dispar
KSINIPSSITKLGYECF

SEQ ID NO: 2530650 - protein, 21 aa, Entamoeba dispar
KSINIPSSVISIGYWCFYECS

SEQ ID NO: 2530651 - protein, 26 aa, Entamoeba dispar
KSIPTEMTIYILTKLKEQNPNYFKAY

SEQ ID NO: 2530652 - protein, 18 aa, Entamoeba dispar
KSIRKEVKEIRKGLDELI

SEQ ID NO: 2530653 - protein, 25 aa, Entamoeba dispar
KSITKIQMIPLKFRKQKSSVTHQKT

SEQ ID NO: 2530654 - protein, 29 aa, Entamoeba dispar
KSIVYNKRILFLLLHIVETISKMNTSNPL

SEQ ID NO: 2530655 - protein, 31 aa, Entamoeba dispar
KSKDHIFNCAYFFVLKRKEGKFFDSFDKAYG

SEQ ID NO: 2530656 - protein, 21 aa, Entamoeba dispar
KSKEILLKRIQGGTSTLFGQE

SEQ ID NO: 2530657 - protein, 22 aa, Entamoeba dispar
KSKEVFFNEIAPFQMKKYVISE

SEQ ID NO: 2530658 - protein, 17 aa, Entamoeba dispar
KSKFYDRLIFFGCETNN

SEQ ID NO: 2530659 - protein, 30 aa, Entamoeba dispar
KSKGFDLLNNRFLILQGEVERIALMPARSK

SEQ ID NO: 2530660 - protein, 29 aa, Entamoeba dispar
KSKKLDDCLLSIPLPLRTPTKRSVPITVP

SEQ ID NO: 2530661 - protein, 23 aa, Entamoeba dispar
KSKPFLKRNLCVCLGRIALRKPE

SEQ ID NO: 2530662 - protein, 33 aa, Entamoeba dispar
KSKTSYPHVFLEWLYALLLFLQSPFEPEVSATL

SEQ ID NO: 2530663 - protein, 25 aa, Entamoeba dispar
KSKTVFVYSSLPTQFQGRRIQQLGK

SEQ ID NO: 2530664 - protein, 23 aa, Entamoeba dispar
KSKVSLDNFFKVKAKPIEQKTKK

SEQ ID NO: 2530665 - protein, 23 aa, Entamoeba dispar
KSKYIPFYSFLKQKKIDPFEFII

SEQ ID NO: 2530666 - protein, 37 aa, Entamoeba dispar
KSKYVIYHELLLTTKSYMRCITSIEGKWLPELGEIFF

SEQ ID NO: 2530667 - protein, 25 aa, Entamoeba dispar
KSLATLLYCLNINPVIRYINKPNEE

SEQ ID NO: 2530668 - protein, 26 aa, Entamoeba dispar
KSLCEGKLFFCDFPELAVDDEILNEK

SEQ ID NO: 2530669 - protein, 26 aa, Entamoeba dispar
KSLCIWNSSCRVYTFTVKRFMRITKK

SEQ ID NO: 2530670 - protein, 20 aa, Entamoeba dispar
KSLFETCYLYAAFNKFCYSF

SEQ ID NO: 2530671 - protein, 18 aa, Entamoeba dispar
KSLIEIRTEDYKANNGNK

SEQ ID NO: 2530672 - protein, 21 aa, Entamoeba dispar
KSLILAGFPNVGKSSLMNVIT

SEQ ID NO: 2530673 - protein, 30 aa, Entamoeba dispar
KSLISIKTRNPIVFSFHPSALKCSIMAAKI

SEQ ID NO: 2530674 - protein, 20 aa, Entamoeba dispar
KSLIYYLRSEEDIKIFITQF

SEQ ID NO: 2530675 - protein, 25 aa, Entamoeba dispar
KSLKNWDLFFLKQKKQKTFLPIQYL

SEQ ID NO: 2530676 - protein, 21 aa, Entamoeba dispar
KSLNILLKKQAPNKYQAFVCD

SEQ ID NO: 2530677 - protein, 18 aa, Entamoeba dispar
KSLPPIHPDFLHIKQLFK

SEQ ID NO: 2530678 - protein, 17 aa, Entamoeba dispar
KSLPPSIGDLRQLNRLE

SEQ ID NO: 2530679 - protein, 24 aa, Entamoeba dispar
KSLQKLNELSKGYRTKRNEFISNE

SEQ ID NO: 2530680 - protein, 18 aa, Entamoeba dispar
KSLTFKQMKELYITRENA

SEQ ID NO: 2530681 - protein, 22 aa, Entamoeba dispar
KSMTAFQEMLRLLSVHPFGNKE

SEQ ID NO: 2530682 - protein, 34 aa, Entamoeba dispar
KSNASKCYFFKRLPWVLPIQLKRFTWDEKKINGK

SEQ ID NO: 2530683 - protein, 18 aa, Entamoeba dispar
KSNFLFTINKAEWKSCQA

SEQ ID NO: 2530684 - protein, 21 aa, Entamoeba dispar
KSNIKIIYNPTVSPANEKLFK

SEQ ID NO: 2530685 - protein, 29 aa, Entamoeba dispar
KSNIPTIQLIKFYTLLLSSPLLNNNIILL

SEQ ID NO: 2530686 - protein, 31 aa, Entamoeba dispar
KSNKIEDEFLMFLFYYAQGTELQLQAAEMLK

SEQ ID NO: 2530687 - protein, 18 aa, Entamoeba dispar
KSNKIQILITTATLAWGV

SEQ ID NO: 2530688 - protein, 26 aa, Entamoeba dispar
KSNKPRYFYLFNDVMVYGIGHQRITV

SEQ ID NO: 2530689 - protein, 18 aa, Entamoeba dispar
KSNLLLRFTRNEFDPDKR

SEQ ID NO: 2530690 - protein, 27 aa, Entamoeba dispar
KSNQLFLERFLLCLLPISFNKKPQVIQ

SEQ ID NO: 2530691 - protein, 19 aa, Entamoeba dispar
KSNRFIAFIDFDSYENAVA

SEQ ID NO: 2530692 - protein, 27 aa, Entamoeba dispar
KSNYPKLPILFVWMGDLFHTNELPVMF

SEQ ID NO: 2530693 - protein, 17 aa, Entamoeba dispar
KSNYVFCVPYAFAIVGS

SEQ ID NO: 2530694 - protein, 39 aa, Entamoeba dispar
KSPEIKRIITNEFMYVNTLTLLIDRYYIDISNNPVIVQC

SEQ ID NO: 2530695 - protein, 26 aa, Entamoeba dispar
KSPFDYTPIYVVNWLNKQIGKEQYAI

SEQ ID NO: 2530696 - protein, 27 aa, Entamoeba dispar
KSPFDYTPIYVVNWLNKQIGKEQYAIV

SEQ ID NO: 2530697 - protein, 26 aa, Entamoeba dispar
KSPILEPLSSIYYLSTSYIIGGTVSG

SEQ ID NO: 2530698 - protein, 23 aa, Entamoeba dispar
KSPLCYFHNLGYDGRFLAKYGIN

SEQ ID NO: 2530699 - protein, 36 aa, Entamoeba dispar
KSPMENLYFPESLLSRFDLIFIILDSSTEELDRRLS

SEQ ID NO: 2530700 - protein, 24 aa, Entamoeba dispar
KSPNLIITPIKLLESPQLQIQYNQ

SEQ ID NO: 2530701 - protein, 33 aa, Entamoeba dispar
KSPYINYLSAIGEAVPVFGWICVEKTPAPYVAD

SEQ ID NO: 2530702 - protein, 24 aa, Entamoeba dispar
KSQEKYTHFLPTTNEQSRINIIKR

SEQ ID NO: 2530703 - protein, 17 aa, Entamoeba dispar
KSQFFFESFQPVYSLVS

SEQ ID NO: 2530704 - protein, 25 aa, Entamoeba dispar
KSQKPDIYLYDRFWSYFTNNTFNLD

SEQ ID NO: 2530705 - protein, 26 aa, Entamoeba dispar
KSQSQLLILKLFGVSHLKYLNTPFPS

SEQ ID NO: 2530706 - protein, 25 aa, Entamoeba dispar
KSQWSIEEIIWLFSCVNLSDIKLSI

SEQ ID NO: 2530707 - protein, 17 aa, Entamoeba dispar
KSRLDYIFQLKRPNEDP

SEQ ID NO: 2530708 - protein, 32 aa, Entamoeba dispar
KSRLVFAEICWKKPHLLLLDEPTNHLDADSIE

SEQ ID NO: 2530709 - protein, 18 aa, Entamoeba dispar
KSRRLLFKCLLMIISQSE

SEQ ID NO: 2530710 - protein, 17 aa, Entamoeba dispar
KSRVVFADLAYKQPHLL

SEQ ID NO: 2530711 - protein, 17 aa, Entamoeba dispar
KSRWRVPNIIYRCIEFL

SEQ ID NO: 2530712 - protein, 32 aa, Entamoeba dispar
KSSDEKIFIFLDYYHNVFGIYLPNGLVESNQS

SEQ ID NO: 2530713 - protein, 25 aa, Entamoeba dispar
KSSDLLVMQRTQALKKEIRSFRDEI

SEQ ID NO: 2530714 - protein, 36 aa, Entamoeba dispar
KSSFITYTVIYSDGFLFFYKIKRKPSLILNIGYYQL

SEQ ID NO: 2530715 - protein, 21 aa, Entamoeba dispar
KSSILLHSIFNHPKNNFLSQS

SEQ ID NO: 2530716 - protein, 30 aa, Entamoeba dispar
KSSKIQLFFVQLYMQILKSLRYNTSSNNHI

SEQ ID NO: 2530717 - protein, 24 aa, Entamoeba dispar
KSSKLIMNLFQLMTDSNIAVFQEM

SEQ ID NO: 2530718 - protein, 27 aa, Entamoeba dispar
KSSLELRYVKNLKKLKLRGVNKLKINE

SEQ ID NO: 2530719 - protein, 22 aa, Entamoeba dispar
KSSLGNFILKKLNKFKVGDGAN

SEQ ID NO: 2530720 - protein, 17 aa, Entamoeba dispar
KSSLGNFILKKNVFSVS

SEQ ID NO: 2530721 - protein, 25 aa, Entamoeba dispar
KSSLQLLCDKGIHPSLIITNDWFTG

SEQ ID NO: 2530722 - protein, 31 aa, Entamoeba dispar
KSSMTLCLVLLLRNGRNIPWDKDVFTAPVLR

SEQ ID NO: 2530723 - protein, 17 aa, Entamoeba dispar
KSSSFTRHIFLSGGLAV

SEQ ID NO: 2530724 - protein, 18 aa, Entamoeba dispar
KSSYFLAYSPINDVFYYN

SEQ ID NO: 2530725 - protein, 23 aa, Entamoeba dispar
KSTEHYINCFKPILFDEIRATIQ

SEQ ID NO: 2530726 - protein, 29 aa, Entamoeba dispar
KSTEPLFYTKRYLLIFNKCIEKLLEIPEF

SEQ ID NO: 2530727 - protein, 27 aa, Entamoeba dispar
KSTILEIGYFYTITLEEICSLNMSFNS

SEQ ID NO: 2530728 - protein, 23 aa, Entamoeba dispar
KSTKLYYEWNIFESIYSKNPTDV

SEQ ID NO: 2530729 - protein, 23 aa, Entamoeba dispar
KSTKYYMDPISLNLLIVDTSTKY

SEQ ID NO: 2530730 - protein, 22 aa, Entamoeba dispar
KSTLIRRLKRSLPKGESIFVKE

SEQ ID NO: 2530731 - protein, 17 aa, Entamoeba dispar
KSTLKYVILLEEKTNDQ

SEQ ID NO: 2530732 - protein, 17 aa, Entamoeba dispar
KSTLLDYGITDKSIIYL

SEQ ID NO: 2530733 - protein, 23 aa, Entamoeba dispar
KSTNALIRYRALTLASSIIKKGL

SEQ ID NO: 2530734 - protein, 23 aa, Entamoeba dispar
KSTNEHILLTLLKDPRIDVNVKI

SEQ ID NO: 2530735 - protein, 23 aa, Entamoeba dispar
KSTNEHILLTLLKDPRIDVNVKN

SEQ ID NO: 2530736 - protein, 27 aa, Entamoeba dispar
KSTPDYSSWPLLLQNFDQLEIKTGHYT

SEQ ID NO: 2530737 - protein, 28 aa, Entamoeba dispar
KSTTNEQPLFLRRFNQTFNSPYRGNGMV

SEQ ID NO: 2530738 - protein, 32 aa, Entamoeba dispar
KSTVIHIVLAGVYLFLYKSTLDFIEKKKPLHT

SEQ ID NO: 2530739 - protein, 19 aa, Entamoeba dispar
KSVDIPSPIIKIGYLCFEG

SEQ ID NO: 2530740 - protein, 29 aa, Entamoeba dispar
KSVEIQRQFLMKVIDWKIQMDLMINKQLS

SEQ ID NO: 2530741 - protein, 30 aa, Entamoeba dispar
KSVEIQRQFLMKVIDWKIQMDLMINKQLSK

SEQ ID NO: 2530742 - protein, 19 aa, Entamoeba dispar
KSVFLWLCDLNDEKMNRNE

SEQ ID NO: 2530743 - protein, 23 aa, Entamoeba dispar
KSVGAPLYIVHLSSKGAINIIEK

SEQ ID NO: 2530744 - protein, 23 aa, Entamoeba dispar
KSVKEYILLYDGIDFNCISKGCK

SEQ ID NO: 2530745 - protein, 24 aa, Entamoeba dispar
KSVNKILSPPIYRDIFSNKRQSVY

SEQ ID NO: 2530746 - protein, 23 aa, Entamoeba dispar
KSVNYIGSFLQPKKKREKKRNSS

SEQ ID NO: 2530747 - protein, 25 aa, Entamoeba dispar
KSVPAIFLINAPPHIFHHFKLYSEG

SEQ ID NO: 2530748 - protein, 28 aa, Entamoeba dispar
KSVRCHPCLPFTIVLQQKSTKLYYEWNI

SEQ ID NO: 2530749 - protein, 27 aa, Entamoeba dispar
KSVYSVPTLLRLLYKGYFGDFIVSQTI

SEQ ID NO: 2530750 - protein, 24 aa, Entamoeba dispar
KSWIKRLNIVISFLRDMRLIQRDI

SEQ ID NO: 2530751 - protein, 26 aa, Entamoeba dispar
KSWKKRWCVLTPTGMIFYFKDKKDVN

SEQ ID NO: 2530752 - protein, 23 aa, Entamoeba dispar
KSWKRRFFVFDQTTLSYYKDQLL

SEQ ID NO: 2530753 - protein, 24 aa, Entamoeba dispar
KSYENISYEILLEELSNYGNEINY

SEQ ID NO: 2530754 - protein, 21 aa, Entamoeba dispar
KSYLHLGVFLSVMNYLIHTNS

SEQ ID NO: 2530755 - protein, 20 aa, Entamoeba dispar
KSYNKFIVSRVLQDFKRENP

SEQ ID NO: 2530756 - protein, 19 aa, Entamoeba dispar
KSYPLFARHLNHIFIIQSF

SEQ ID NO: 2530757 - protein, 19 aa, Entamoeba dispar
KSYQLFHAIPQPKPRKEGI

SEQ ID NO: 2530758 - protein, 26 aa, Entamoeba dispar
KSYTPYFNTLISIIVFRYDDKESFKN

SEQ ID NO: 2530759 - protein, 33 aa, Entamoeba dispar
KTAITIWDVLSNKLLFSLPIPYEQHNKEFIPVE

SEQ ID NO: 2530760 - protein, 27 aa, Entamoeba dispar
KTAQQYFDLHYSKQCHFVGMKPKEQNV

SEQ ID NO: 2530761 - protein, 33 aa, Entamoeba dispar
KTAQTRVARYWPMFPRTFGLFKKLFEEESGASK

SEQ ID NO: 2530762 - protein, 20 aa, Entamoeba dispar
KTCDMAEFIIHAVNPSGEPC

SEQ ID NO: 2530763 - protein, 17 aa, Entamoeba dispar
KTCVLMMVGLQGAGKTT

SEQ ID NO: 2530764 - protein, 24 aa, Entamoeba dispar
KTDAYINLSLDTSKGKLIISRKLG

SEQ ID NO: 2530765 - protein, 26 aa, Entamoeba dispar
KTDDRLYYLCRGAIRVFEFSGKKDSG

SEQ ID NO: 2530766 - protein, 23 aa, Entamoeba dispar
KTDRSLYRFIITNTLEATKAVLR

SEQ ID NO: 2530767 - protein, 36 aa, Entamoeba dispar
KTEAIACIFTSLIDWAFSPSCIFPKALTPELTVNLL

SEQ ID NO: 2530768 - protein, 27 aa, Entamoeba dispar
KTEFAIQEIFMKYNTFLLRGDSLFDSY

SEQ ID NO: 2530769 - protein, 28 aa, Entamoeba dispar
KTEFAIQEIFMKYPTFMLRGDSLFDSYD

SEQ ID NO: 2530770 - protein, 21 aa, Entamoeba dispar
KTEFNKRLALWFTQQDIWNRM

SEQ ID NO: 2530771 - protein, 24 aa, Entamoeba dispar
KTEKAVIFGLNALINLCSNKETRE

SEQ ID NO: 2530772 - protein, 26 aa, Entamoeba dispar
KTEKELYFHVWMNSFFKESIGTLTIQ

SEQ ID NO: 2530773 - protein, 19 aa, Entamoeba dispar
KTEKVFWVCRECGYIFEST

SEQ ID NO: 2530774 - protein, 26 aa, Entamoeba dispar
KTEQKKIITLYEFSFREFPKNWTKDK

SEQ ID NO: 2530775 - protein, 19 aa, Entamoeba dispar
KTEVLLSLLTFLVSNLSTE

SEQ ID NO: 2530776 - protein, 20 aa, Entamoeba dispar
KTEWGYKSLRKLCRYYGKAN

SEQ ID NO: 2530777 - protein, 23 aa, Entamoeba dispar
KTFDCLPICALLHSELGKFFCVH

SEQ ID NO: 2530778 - protein, 18 aa, Entamoeba dispar
KTFSWDIFKALCSTRGES

SEQ ID NO: 2530779 - protein, 28 aa, Entamoeba dispar
KTGEIPPPPPLHIDSTGNPILSSSPRIN

SEQ ID NO: 2530780 - protein, 22 aa, Entamoeba dispar
KTGIRIELFKKILTYLRNNNAE

SEQ ID NO: 2530781 - protein, 25 aa, Entamoeba dispar
KTGIVLINFFEIISKKILRERYNHA

SEQ ID NO: 2530782 - protein, 26 aa, Entamoeba dispar
KTGLVLNPYFSASKIMWIFNHVECAK

SEQ ID NO: 2530783 - protein, 25 aa, Entamoeba dispar
KTHEKYHKEFLLPPKLQIKNNEYNI

SEQ ID NO: 2530784 - protein, 17 aa, Entamoeba dispar
KTHIIIRNIHDCNIKIN

SEQ ID NO: 2530785 - protein, 19 aa, Entamoeba dispar
KTHIIIRNIHDCNIKIRSN

SEQ ID NO: 2530786 - protein, 28 aa, Entamoeba dispar
KTHLSKGYGFIYFYTSIIANNVIDNYNE

SEQ ID NO: 2530787 - protein, 24 aa, Entamoeba dispar
KTIDNMLKIVFIPNYSVSLAEVII

SEQ ID NO: 2530788 - protein, 25 aa, Entamoeba dispar
KTIDNMLKIVFIPNYSVSLAEVIIP

SEQ ID NO: 2530789 - protein, 20 aa, Entamoeba dispar
KTIIAWLDKFIKKQKKEHAN

SEQ ID NO: 2530790 - protein, 20 aa, Entamoeba dispar
KTIITSHNFLQMASGSNLIV

SEQ ID NO: 2530791 - protein, 18 aa, Entamoeba dispar
KTIKILPRRLFIQNDTNE

SEQ ID NO: 2530792 - protein, 21 aa, Entamoeba dispar
KTIKQPYNILLRTKAKEKKER

SEQ ID NO: 2530793 - protein, 23 aa, Entamoeba dispar
KTIKRLMRIFDIDLSGSIGFFEF

SEQ ID NO: 2530794 - protein, 22 aa, Entamoeba dispar
KTIKTIIFKPQCINKDIAAALI

SEQ ID NO: 2530795 - protein, 22 aa, Entamoeba dispar
KTIKTIIFKPQCINKDIAAALV

SEQ ID NO: 2530796 - protein, 20 aa, Entamoeba dispar
KTILKFIRTAYEKQKTEEPP

SEQ ID NO: 2530797 - protein, 17 aa, Entamoeba dispar
KTILYMQFIYNDSLDYN

SEQ ID NO: 2530798 - protein, 18 aa, Entamoeba dispar
KTIMIPPGITIVQAVSVS

SEQ ID NO: 2530799 - protein, 25 aa, Entamoeba dispar
KTINDFFKVTKPIPKGLLTFANEVD

SEQ ID NO: 2530800 - protein, 29 aa, Entamoeba dispar
KTINGPIHLEWYYLVKVHNKIQRIEEVHG

SEQ ID NO: 2530801 - protein, 24 aa, Entamoeba dispar
KTINNLPSKYIVELLNIVCDIFNN

SEQ ID NO: 2530802 - protein, 28 aa, Entamoeba dispar
KTIQQFLSSPKYHLLLENSNETHFIDIY

SEQ ID NO: 2530803 - protein, 30 aa, Entamoeba dispar
KTIQQTLLLIHLTGFVRLKIRVGDSIVTQV

SEQ ID NO: 2530804 - protein, 30 aa, Entamoeba dispar
KTIRDTYLPKLIELIKKYWDGNILGEACAF

SEQ ID NO: 2530805 - protein, 18 aa, Entamoeba dispar
KTIRKWIKCASGDKYRMG

SEQ ID NO: 2530806 - protein, 18 aa, Entamoeba dispar
KTIRKWIKCASGDRYRMG

SEQ ID NO: 2530807 - protein, 26 aa, Entamoeba dispar
KTIVKRICYLFNDSILFVRERGKKKI

SEQ ID NO: 2530808 - protein, 19 aa, Entamoeba dispar
KTIVYGCIYGIGPFSLADQ

SEQ ID NO: 2530809 - protein, 24 aa, Entamoeba dispar
KTKELYIFGNEKITFVKKINYDFG

SEQ ID NO: 2530810 - protein, 26 aa, Entamoeba dispar
KTKERTLELFCLFIEIGLTEEVLNAL

SEQ ID NO: 2530811 - protein, 17 aa, Entamoeba dispar
KTKFSGHYISYCKTPSG

SEQ ID NO: 2530812 - protein, 27 aa, Entamoeba dispar
KTKKCVILIISDAILFIVNKSLTDLSK

SEQ ID NO: 2530813 - protein, 26 aa, Entamoeba dispar
KTKKLEEFCCFLLSDYFLMTKVKRED

SEQ ID NO: 2530814 - protein, 26 aa, Entamoeba dispar
KTKKYQLHFNYHPIPFSFFMENGTKT

SEQ ID NO: 2530815 - protein, 17 aa, Entamoeba dispar
KTKKYRKSILSPNIIWT

SEQ ID NO: 2530816 - protein, 22 aa, Entamoeba dispar
KTKLDPRFKKALKSNLFHEDTQ

SEQ ID NO: 2530817 - protein, 23 aa, Entamoeba dispar
KTKNFFHSLFYSLNPPQFTTTSN

SEQ ID NO: 2530818 - protein, 23 aa, Entamoeba dispar
KTKNFPFLLSRLKHPKTYKVITS

SEQ ID NO: 2530819 - protein, 19 aa, Entamoeba dispar
KTKPLMIGVQQLLKKPPTP

SEQ ID NO: 2530820 - protein, 23 aa, Entamoeba dispar
KTKPLVLEYFSVTTTIQLKKEHS

SEQ ID NO: 2530821 - protein, 26 aa, Entamoeba dispar
KTKQDALFVLLTNPSLSLASLIYRQY

SEQ ID NO: 2530822 - protein, 25 aa, Entamoeba dispar
KTKQNTFFTCQRFKEPTLLTCEKGI

SEQ ID NO: 2530823 - protein, 33 aa, Entamoeba dispar
KTKSLTTMFFKSANIVFIVYQIGHPETAEHLNA

SEQ ID NO: 2530824 - protein, 22 aa, Entamoeba dispar
KTKSLYLHAYQSYVWNQVVSKR

SEQ ID NO: 2530825 - protein, 26 aa, Entamoeba dispar
KTKTPLFNFTLFKTKEQLRKGYENDF

SEQ ID NO: 2530826 - protein, 21 aa, Entamoeba dispar
KTLDGLIKKYKNMRKVLLEIV

SEQ ID NO: 2530827 - protein, 23 aa, Entamoeba dispar
KTLGNWFCQCDMNDFVWNNDGRL

SEQ ID NO: 2530828 - protein, 24 aa, Entamoeba dispar
KTLKIHMCIKLMSIQFPSSIQSVD

SEQ ID NO: 2530829 - protein, 25 aa, Entamoeba dispar
KTLLKKYLAMSIEKKLVIFEYQRII

SEQ ID NO: 2530830 - protein, 22 aa, Entamoeba dispar
KTLLSICEYLIDSGINSDLFEQ

SEQ ID NO: 2530831 - protein, 24 aa, Entamoeba dispar
KTLNEILMQHILKTLPSLRITITE

SEQ ID NO: 2530832 - protein, 19 aa, Entamoeba dispar
KTLPKYLNSLNLIKLDLSD

SEQ ID NO: 2530833 - protein, 20 aa, Entamoeba dispar
KTLPMRMKVHMENGLKVAKF

SEQ ID NO: 2530834 - protein, 28 aa, Entamoeba dispar
KTLQKFSEKLPILINKERPKYQIKEHEV

SEQ ID NO: 2530835 - protein, 20 aa, Entamoeba dispar
KTLRNVIWMICEYCNHYDEV

SEQ ID NO: 2530836 - protein, 17 aa, Entamoeba dispar
KTLSLEILTILYSRDLT

SEQ ID NO: 2530837 - protein, 27 aa, Entamoeba dispar
KTLSLVGICTVPFLHQIRHILLTLVQA

SEQ ID NO: 2530838 - protein, 23 aa, Entamoeba dispar
KTLTHLTALTLWKCPKINELELP

SEQ ID NO: 2530839 - protein, 20 aa, Entamoeba dispar
KTLTNLYQFCPCKHVFCLDC

SEQ ID NO: 2530840 - protein, 25 aa, Entamoeba dispar
KTLVEYAFALTYFRDIVVARFSDES

SEQ ID NO: 2530841 - protein, 27 aa, Entamoeba dispar
KTLYKNGGPTMFFPYINGNKKQIHSFY

SEQ ID NO: 2530842 - protein, 17 aa, Entamoeba dispar
KTMFLSSKYPIENRPQE

SEQ ID NO: 2530843 - protein, 20 aa, Entamoeba dispar
KTMIQIISNVFPIYDFWEHV

SEQ ID NO: 2530844 - protein, 17 aa, Entamoeba dispar
KTMIRNHQIGWDKRTIG

SEQ ID NO: 2530845 - protein, 23 aa, Entamoeba dispar
KTMKTFLTKYLEFEIKYGDESKQ

SEQ ID NO: 2530846 - protein, 25 aa, Entamoeba dispar
KTMLKLICNVFPTEGFWEHVCIVWT

SEQ ID NO: 2530847 - protein, 20 aa, Entamoeba dispar
KTMMLFKEKGQAKAEIVIPL

SEQ ID NO: 2530848 - protein, 17 aa, Entamoeba dispar
KTNLGPKGTLKMLVSGS

SEQ ID NO: 2530849 - protein, 25 aa, Entamoeba dispar
KTNLTTIISLLPPTTRIGLITFGQC

SEQ ID NO: 2530850 - protein, 26 aa, Entamoeba dispar
KTNPKCFHWPYINVLPKTYDCPLSYT

SEQ ID NO: 2530851 - protein, 26 aa, Entamoeba dispar
KTNPRKVFWTAIYRQLNKKGQQNELV

SEQ ID NO: 2530852 - protein, 24 aa, Entamoeba dispar
KTNSELDRQLIYNKALQINDTTPE

SEQ ID NO: 2530853 - protein, 25 aa, Entamoeba dispar
KTNSFQILVLILYSKHSLISQGVLQ

SEQ ID NO: 2530854 - protein, 24 aa, Entamoeba dispar
KTNSMIDFLPLFIKDNCFSVIKTT

SEQ ID NO: 2530855 - protein, 23 aa, Entamoeba dispar
KTNSWFIYKLYYVPTQIENNKDI

SEQ ID NO: 2530856 - protein, 26 aa, Entamoeba dispar
KTNVTGEIKLLSSSKLKDLSLISEDD

SEQ ID NO: 2530857 - protein, 24 aa, Entamoeba dispar
KTPEEYFIHYSKYYANVCFSTYPV

SEQ ID NO: 2530858 - protein, 37 aa, Entamoeba dispar
KTPNCKLIPFYFIPTETFYTLLLPIQKIEYAEMISCD

SEQ ID NO: 2530859 - protein, 17 aa, Entamoeba dispar
KTPVNVRFIIDSSGLFT

SEQ ID NO: 2530860 - protein, 26 aa, Entamoeba dispar
KTQFDTFKKLYLLRDKIARIEDESPE

SEQ ID NO: 2530861 - protein, 25 aa, Entamoeba dispar
KTQIYYQLLTKHNFKYGYTGKLEPI

SEQ ID NO: 2530862 - protein, 28 aa, Entamoeba dispar
KTQNPQTLLFILILIEKQPKDKIKEIVE

SEQ ID NO: 2530863 - protein, 18 aa, Entamoeba dispar
KTQQDALKGITKPAIRRL

SEQ ID NO: 2530864 - protein, 33 aa, Entamoeba dispar
KTQQDALKGITKPAIRRLARRGGVKRINGAVYD

SEQ ID NO: 2530865 - protein, 21 aa, Entamoeba dispar
KTQYFWEHLLGRSGAAPFTCP

SEQ ID NO: 2530866 - protein, 26 aa, Entamoeba dispar
KTRACVLAHLITAGITPKFLGSINVV

SEQ ID NO: 2530867 - protein, 25 aa, Entamoeba dispar
KTREFMCHHLTFMTRYVPVHCVIET

SEQ ID NO: 2530868 - protein, 19 aa, Entamoeba dispar
KTRHIAIHLTYIGIDYNGI

SEQ ID NO: 2530869 - protein, 27 aa, Entamoeba dispar
KTRNVMKLIYLDLLGYNTQFAQIECLA

SEQ ID NO: 2530870 - protein, 19 aa, Entamoeba dispar
KTRQYIKIFLKHSSNLNNS

SEQ ID NO: 2530871 - protein, 23 aa, Entamoeba dispar
KTSILLPQSFQYISLERLIDTDD

SEQ ID NO: 2530872 - protein, 23 aa, Entamoeba dispar
KTSLWIVCELFRIIVSSNLQEFD

SEQ ID NO: 2530873 - protein, 29 aa, Entamoeba dispar
KTSPFDEFFKMIFLQYPPRIVQSLKRHFA

SEQ ID NO: 2530874 - protein, 17 aa, Entamoeba dispar
KTSSLENVLLWAKSNMI

SEQ ID NO: 2530875 - protein, 23 aa, Entamoeba dispar
KTTAQICIRWLIQNGIIAIPKST

SEQ ID NO: 2530876 - protein, 27 aa, Entamoeba dispar
KTTDEFTQMFWELGMKSFDEFIKKLIK

SEQ ID NO: 2530877 - protein, 27 aa, Entamoeba dispar
KTTDEFTQMFWQLGMKNFDEFIKKLIK

SEQ ID NO: 2530878 - protein, 27 aa, Entamoeba dispar
KTTDVTNILNFLMKYIPDDLSTNKSIR

SEQ ID NO: 2530879 - protein, 25 aa, Entamoeba dispar
KTTDVTNILNFLTKYIPDDLSTNKS

SEQ ID NO: 2530880 - protein, 31 aa, Entamoeba dispar
KTTEKGTMFYYFGWNSWNGWIPAWCVNKATK

SEQ ID NO: 2530881 - protein, 32 aa, Entamoeba dispar
KTTEKGTMFYYFGWNSWNGWIPAWCVNKATKT

SEQ ID NO: 2530882 - protein, 34 aa, Entamoeba dispar
KTTFKTTSTAAALLWVFYIRQSFIKQHGFDKTKP

SEQ ID NO: 2530883 - protein, 25 aa, Entamoeba dispar
KTTGDYFYNYFSQGFDILFDSTTHC

SEQ ID NO: 2530884 - protein, 23 aa, Entamoeba dispar
KTTIRWRITFISGNTRLAPYALC

SEQ ID NO: 2530885 - protein, 22 aa, Entamoeba dispar
KTTLKGFKLLRLASQTDNVGVV

SEQ ID NO: 2530886 - protein, 31 aa, Entamoeba dispar
KTTLLNSFVNALYGIKITDDFRYIIINEDNL

SEQ ID NO: 2530887 - protein, 32 aa, Entamoeba dispar
KTTLLNSFVNALYGIKITDDFRYIIINEDNLA

SEQ ID NO: 2530888 - protein, 33 aa, Entamoeba dispar
KTTLLNSFVNALYGIKITDDFRYIIINEDNLKQ

SEQ ID NO: 2530889 - protein, 31 aa, Entamoeba dispar
KTTLLNSFVNALYGIKITDDFRYIIINEDNS

SEQ ID NO: 2530890 - protein, 23 aa, Entamoeba dispar
KTTNFLYFLLSQNTIETILSFPI

SEQ ID NO: 2530891 - protein, 22 aa, Entamoeba dispar
KTTPLICSLISDHFGKRFSDLT

SEQ ID NO: 2530892 - protein, 25 aa, Entamoeba dispar
KTTRCLLFYLMYSLGNSQIFEGNES

SEQ ID NO: 2530893 - protein, 25 aa, Entamoeba dispar
KTTRHLNLIIADRMFDLITPLVTEF

SEQ ID NO: 2530894 - protein, 18 aa, Entamoeba dispar
KTTRLCVLILSSLRCLKP

SEQ ID NO: 2530895 - protein, 30 aa, Entamoeba dispar
KTTRLLNIIYLNQGIGFLFHCLSPLFDEIE

SEQ ID NO: 2530896 - protein, 25 aa, Entamoeba dispar
KTTTITKLALYYKNRGYKPAVVGAD

SEQ ID NO: 2530897 - protein, 27 aa, Entamoeba dispar
KTVKDLVVLLFETALLSSGFSLDEPAA

SEQ ID NO: 2530898 - protein, 31 aa, Entamoeba dispar
KTVKYYKIYYSLRPIFKRLYLNYTQMKDFHK

SEQ ID NO: 2530899 - protein, 28 aa, Entamoeba dispar
KTVMNIPHLLFICFGDYGNVYGTYCEFP

SEQ ID NO: 2530900 - protein, 32 aa, Entamoeba dispar
KTVSELYLRWTPLFWNFLRNPNISFDNKLKLF

SEQ ID NO: 2530901 - protein, 18 aa, Entamoeba dispar
KTVTALTLAIRRIDPIKR

SEQ ID NO: 2530902 - protein, 29 aa, Entamoeba dispar
KTVTNYILSFLFYFIQKNALIDCAANSIG

SEQ ID NO: 2530903 - protein, 17 aa, Entamoeba dispar
KTWFPDMPSHFITKENE

SEQ ID NO: 2530904 - protein, 21 aa, Entamoeba dispar
KTWYNNLIHTVGTDVAIIIVG

SEQ ID NO: 2530905 - protein, 22 aa, Entamoeba dispar
KVAKDAFITPGVFLIGDVEVES

SEQ ID NO: 2530906 - protein, 25 aa, Entamoeba dispar
KVAPHLVPCGNVCDFTFTPYSSIQQ

SEQ ID NO: 2530907 - protein, 30 aa, Entamoeba dispar
KVARGEIIQVKPICALALLDGGETDWKVIG

SEQ ID NO: 2530908 - protein, 28 aa, Entamoeba dispar
KVAYIKNYVWLDAFPMVLTGWLRLDHGF

SEQ ID NO: 2530909 - protein, 20 aa, Entamoeba dispar
KVCDHPYLMPGAEPEPYVNG

SEQ ID NO: 2530910 - protein, 18 aa, Entamoeba dispar
KVDCFSPFLFTKKENWNR

SEQ ID NO: 2530911 - protein, 20 aa, Entamoeba dispar
KVDFDWFVEKIALCYIEVAK

SEQ ID NO: 2530912 - protein, 25 aa, Entamoeba dispar
KVDGFLTLLNLLLPSNERKIARLVV

SEQ ID NO: 2530913 - protein, 23 aa, Entamoeba dispar
KVDGKSWRLLIQSSPFQSTVNQL

SEQ ID NO: 2530914 - protein, 24 aa, Entamoeba dispar
KVDGTYLIRMSFTDAKKNPFTLTR

SEQ ID NO: 2530915 - protein, 22 aa, Entamoeba dispar
KVDLMNIFGTYFLRSLSSSEEI

SEQ ID NO: 2530916 - protein, 25 aa, Entamoeba dispar
KVDSQFIYNCFLFLVNTNPTLSLQS

SEQ ID NO: 2530917 - protein, 20 aa, Entamoeba dispar
KVEAAFRDLVTKIVQSENLP

SEQ ID NO: 2530918 - protein, 25 aa, Entamoeba dispar
KVEAGKLLYDPYFNVNPNWSQRRER

SEQ ID NO: 2530919 - protein, 32 aa, Entamoeba dispar
KVEIEKEMVCHVLTFKYPFNSEITRFDCPPSE

SEQ ID NO: 2530920 - protein, 20 aa, Entamoeba dispar
KVEKERFVLQSIGAIIGSEL

SEQ ID NO: 2530921 - protein, 23 aa, Entamoeba dispar
KVEKQNLVFVIPPGLKSLTIYEC

SEQ ID NO: 2530922 - protein, 24 aa, Entamoeba dispar
KVEKQNLVFVIPPGLKSLTIYECK

SEQ ID NO: 2530923 - protein, 20 aa, Entamoeba dispar
KVETLPRRPTQSIPNKKKMS

SEQ ID NO: 2530924 - protein, 24 aa, Entamoeba dispar
KVETNLFCLRVMTGSIILNDIISP

SEQ ID NO: 2530925 - protein, 20 aa, Entamoeba dispar
KVFDYIHYYTKKPTIVSLSS

SEQ ID NO: 2530926 - protein, 28 aa, Entamoeba dispar
KVFHGCDFDMIWLSYNFGLYVVNCIDSG

SEQ ID NO: 2530927 - protein, 17 aa, Entamoeba dispar
KVFIDYIKKIGYATLSL

SEQ ID NO: 2530928 - protein, 27 aa, Entamoeba dispar
KVFKKRIMQLYSRLIRRYPRMLSYYME

SEQ ID NO: 2530929 - protein, 23 aa, Entamoeba dispar
KVFLEFTPFLKMYSDYCRIYNNI

SEQ ID NO: 2530930 - protein, 17 aa, Entamoeba dispar
KVFLSEVVHYLKSLENV

SEQ ID NO: 2530931 - protein, 20 aa, Entamoeba dispar
KVFNRLPKCQVLLESNKKID

SEQ ID NO: 2530932 - protein, 18 aa, Entamoeba dispar
KVFSNRFELYFKGYIFNI

SEQ ID NO: 2530933 - protein, 19 aa, Entamoeba dispar
KVFTKLAGFIPDYPYKSFR

SEQ ID NO: 2530934 - protein, 26 aa, Entamoeba dispar
KVGKTSMILRYTQNFFTPEEGPRTTQ

SEQ ID NO: 2530935 - protein, 28 aa, Entamoeba dispar
KVGSGCFYLCYSLTYINIPSSISEIGDW

SEQ ID NO: 2530936 - protein, 17 aa, Entamoeba dispar
KVGYRFTFNDCNGDTFL

SEQ ID NO: 2530937 - protein, 23 aa, Entamoeba dispar
KVHCKLLIRYATSYGLLREVLSS

SEQ ID NO: 2530938 - protein, 32 aa, Entamoeba dispar
KVHDDIIRVCFLFNTMFIITKIKTFQGKVLDK

SEQ ID NO: 2530939 - protein, 21 aa, Entamoeba dispar
KVHMENGLKVAKFLEQHPKIK

SEQ ID NO: 2530940 - protein, 33 aa, Entamoeba dispar
KVHSLTVPQIQYPDLLLFELQRKYPSETWLEQI

SEQ ID NO: 2530941 - protein, 21 aa, Entamoeba dispar
KVIDGYNCTFFAYGQTGTGKT

SEQ ID NO: 2530942 - protein, 21 aa, Entamoeba dispar
KVIEETILKRTYKITKYIRCK

SEQ ID NO: 2530943 - protein, 30 aa, Entamoeba dispar
KVIEQIFLHVQYPQIKLLIPFHTMKKNIHK

SEQ ID NO: 2530944 - protein, 18 aa, Entamoeba dispar
KVIFLSDCVGEEVIKACA

SEQ ID NO: 2530945 - protein, 20 aa, Entamoeba dispar
KVIHFYVWDSIITPSGHEIT

SEQ ID NO: 2530946 - protein, 25 aa, Entamoeba dispar
KVILENELKPFFNKAMETVLVIIEE

SEQ ID NO: 2530947 - protein, 24 aa, Entamoeba dispar
KVILGYLPQFIQVLKFESYTCSSL

SEQ ID NO: 2530948 - protein, 20 aa, Entamoeba dispar
KVINNLFTKLYTMKPKIFDK

SEQ ID NO: 2530949 - protein, 28 aa, Entamoeba dispar
KVIQNPPTLMKILIFMKNCLTAKDPEKA

SEQ ID NO: 2530950 - protein, 27 aa, Entamoeba dispar
KVISDAFPIKDFWKHVCIVWTKCYNCY

SEQ ID NO: 2530951 - protein, 39 aa, Entamoeba dispar
KVISDVFNLKDIWKRVCIVWTRCYNYLPQKIIEKYKIEK

SEQ ID NO: 2530952 - protein, 24 aa, Entamoeba dispar
KVISLLSLSTFDLAVIYLLQNGYI

SEQ ID NO: 2530953 - protein, 27 aa, Entamoeba dispar
KVISWQLLCRSILYSLSIVNAPRVYFS

SEQ ID NO: 2530954 - protein, 19 aa, Entamoeba dispar
KVIVKLVPRFNIAHFQEIA

SEQ ID NO: 2530955 - protein, 28 aa, Entamoeba dispar
KVKAPMILKCFLTFAERLNIDDSLYIII

SEQ ID NO: 2530956 - protein, 28 aa, Entamoeba dispar
KVKDKYLTLKDYVQTYLYLSIVEKKEDR

SEQ ID NO: 2530957 - protein, 30 aa, Entamoeba dispar
KVKDKYLTLKDYVQTYLYLSIVEKKEDRRV

SEQ ID NO: 2530958 - protein, 24 aa, Entamoeba dispar
KVKEMLMTFKLYYSYDLDITLTLQ

SEQ ID NO: 2530959 - protein, 24 aa, Entamoeba dispar
KVKKEYEVIYFELAQKLISHRRIV

SEQ ID NO: 2530960 - protein, 25 aa, Entamoeba dispar
KVKKEYEVIYFELAQKLISHRRIVR

SEQ ID NO: 2530961 - protein, 27 aa, Entamoeba dispar
KVKSQLRLVVPWKRQLGSKGDQTKMNC

SEQ ID NO: 2530962 - protein, 28 aa, Entamoeba dispar
KVKTIKRRWFVLTTNKLFYFTSQNATEA

SEQ ID NO: 2530963 - protein, 18 aa, Entamoeba dispar
KVKVFIAPLSNKLCLNDD

SEQ ID NO: 2530964 - protein, 23 aa, Entamoeba dispar
KVKVIICQKLYPNQWKKISTFIP

SEQ ID NO: 2530965 - protein, 26 aa, Entamoeba dispar
KVLAEASLVFPLIVSKTFAVTKRFDG

SEQ ID NO: 2530966 - protein, 24 aa, Entamoeba dispar
KVLDLNAICFVAQSSNARLTVNQK

SEQ ID NO: 2530967 - protein, 17 aa, Entamoeba dispar
KVLFESIKKLYTKLFEI

SEQ ID NO: 2530968 - protein, 17 aa, Entamoeba dispar
KVLFFETSAKAKINITE

SEQ ID NO: 2530969 - protein, 36 aa, Entamoeba dispar
KVLIFVNSIQKCFYVKLFLDLFSIPSVVLNSDLPRE

SEQ ID NO: 2530970 - protein, 31 aa, Entamoeba dispar
KVLKITFWDTPRQISFFGPTPYYRGADLIGL

SEQ ID NO: 2530971 - protein, 19 aa, Entamoeba dispar
KVLKKPLRKSMKTLSKKFK

SEQ ID NO: 2530972 - protein, 28 aa, Entamoeba dispar
KVLKLLHEYGILYSFRKSQFRSLNYPKL

SEQ ID NO: 2530973 - protein, 17 aa, Entamoeba dispar
KVLLLQPSSPLLSAYIN

SEQ ID NO: 2530974 - protein, 28 aa, Entamoeba dispar
KVLLSTLNRVIIKLVIDLNTFKSNSEIL

SEQ ID NO: 2530975 - protein, 29 aa, Entamoeba dispar
KVLQRSTELLLRKAPFQALVREIAQVSKS

SEQ ID NO: 2530976 - protein, 20 aa, Entamoeba dispar
KVLSKVFCEFIRCAYHRTRE

SEQ ID NO: 2530977 - protein, 30 aa, Entamoeba dispar
KVLVENIFYFDNLVLMPFSSHELHIYNNKE

SEQ ID NO: 2530978 - protein, 17 aa, Entamoeba dispar
KVLVIGESSVGKTAIME

SEQ ID NO: 2530979 - protein, 25 aa, Entamoeba dispar
KVLYSVKRFYKLNKMSNSLITKKFA

SEQ ID NO: 2530980 - protein, 17 aa, Entamoeba dispar
KVMFSVTQAPSITEREE

SEQ ID NO: 2530981 - protein, 18 aa, Entamoeba dispar
KVMGLRRAKRRNMERLTL

SEQ ID NO: 2530982 - protein, 19 aa, Entamoeba dispar
KVMRECPLFILSNNSDLSS

SEQ ID NO: 2530983 - protein, 26 aa, Entamoeba dispar
KVMSTYTILFFEKPLDRKVICPRMLI

SEQ ID NO: 2530984 - protein, 22 aa, Entamoeba dispar
KVNDITSILKISSGFPTKSIQQ

SEQ ID NO: 2530985 - protein, 19 aa, Entamoeba dispar
KVNELFEIIKSHHFSDCYT

SEQ ID NO: 2530986 - protein, 26 aa, Entamoeba dispar
KVNIDEEFARRLTVRKVNTDTNEEEK

SEQ ID NO: 2530987 - protein, 26 aa, Entamoeba dispar
KVNKKYIEFLFKMKRINMVTAQNVID

SEQ ID NO: 2530988 - protein, 20 aa, Entamoeba dispar
KVNLFDNSEVLAWYGAACTG

SEQ ID NO: 2530989 - protein, 19 aa, Entamoeba dispar
KVNQLYEYCKINLIESSNV

SEQ ID NO: 2530990 - protein, 22 aa, Entamoeba dispar
KVNTFILKSFISFHTLSPYYKT

SEQ ID NO: 2530991 - protein, 31 aa, Entamoeba dispar
KVNTFILKSFISFHTLSPYYKTILNCIELFD

SEQ ID NO: 2530992 - protein, 19 aa, Entamoeba dispar
KVNTLVRLDGLKKAFVRLA

SEQ ID NO: 2530993 - protein, 17 aa, Entamoeba dispar
KVPERVYVKKPVILLYD

SEQ ID NO: 2530994 - protein, 26 aa, Entamoeba dispar
KVPKYKQYYIFFTSPINESIIETLAE

SEQ ID NO: 2530995 - protein, 17 aa, Entamoeba dispar
KVPVPWKPKVSGADDVS

SEQ ID NO: 2530996 - protein, 26 aa, Entamoeba dispar
KVQFIQGLILFMKTIQQLKDIHFLVA

SEQ ID NO: 2530997 - protein, 26 aa, Entamoeba dispar
KVQFIQGLILFMRRLQQLKDIHFLVS

SEQ ID NO: 2530998 - protein, 19 aa, Entamoeba dispar
KVQFRYNKKPKMRVAKLEN

SEQ ID NO: 2530999 - protein, 23 aa, Entamoeba dispar
KVQFYLYNNLVLPSQKSSKEDLK

SEQ ID NO: 2531000 - protein, 20 aa, Entamoeba dispar
KVQIVKPFSSLFLSGSADRT

SEQ ID NO: 2531001 - protein, 27 aa, Entamoeba dispar
KVQLINYHHLHQAILFTYSEHLRKVCS

SEQ ID NO: 2531002 - protein, 25 aa, Entamoeba dispar
KVQLQSLPLGMLWINCMRNEMQSYL

SEQ ID NO: 2531003 - protein, 29 aa, Entamoeba dispar
KVQNEGFYNLFFSKKYVCLLKGKDTVLIL

SEQ ID NO: 2531004 - protein, 17 aa, Entamoeba dispar
KVQQIWNGIFKEQERKT

SEQ ID NO: 2531005 - protein, 21 aa, Entamoeba dispar
KVRELIAVWGTYFPCELSEYK

SEQ ID NO: 2531006 - protein, 28 aa, Entamoeba dispar
KVRGMSYELFISCFPQLKTKSFNKDEIK

SEQ ID NO: 2531007 - protein, 21 aa, Entamoeba dispar
KVRLILCQIITSITSTFPDVL

SEQ ID NO: 2531008 - protein, 22 aa, Entamoeba dispar
KVRQQDFCFVMILSLLGESELP

SEQ ID NO: 2531009 - protein, 26 aa, Entamoeba dispar
KVRRHYIHFVIVQTLHRMKFINSDTA

SEQ ID NO: 2531010 - protein, 19 aa, Entamoeba dispar
KVRSMPTFVLVKDGIEQKR

SEQ ID NO: 2531011 - protein, 17 aa, Entamoeba dispar
KVRTDFYRFIDIKTSKI

SEQ ID NO: 2531012 - protein, 20 aa, Entamoeba dispar
KVRTVIALKGLLLDAFEECD

SEQ ID NO: 2531013 - protein, 21 aa, Entamoeba dispar
KVSERCKCQWLLELISFSIED

SEQ ID NO: 2531014 - protein, 23 aa, Entamoeba dispar
KVSEVHHFLMDTLQLQGYEYESF

SEQ ID NO: 2531015 - protein, 23 aa, Entamoeba dispar
KVSFNTVWNTNYAYRVSTDNGVN

SEQ ID NO: 2531016 - protein, 20 aa, Entamoeba dispar
KVSFRVIRCLEPFVKESENE

SEQ ID NO: 2531017 - protein, 22 aa, Entamoeba dispar
KVSGFLVKKELGYFAKAFDHIN

SEQ ID NO: 2531018 - protein, 17 aa, Entamoeba dispar
KVSHIKAVIAPVAVIFG

SEQ ID NO: 2531019 - protein, 25 aa, Entamoeba dispar
KVSNHPWLIQDFVKTFPEVLDGILP

SEQ ID NO: 2531020 - protein, 24 aa, Entamoeba dispar
KVSPSSICRYMKKQEAREIYERIQ

SEQ ID NO: 2531021 - protein, 20 aa, Entamoeba dispar
KVSQLIISLLKRFGKHYEDW

SEQ ID NO: 2531022 - protein, 26 aa, Entamoeba dispar
KVSRQELLVLHDFKKKGHYNLIGSPA

SEQ ID NO: 2531023 - protein, 20 aa, Entamoeba dispar
KVTFAGYDIFTGKRLDDSCP

SEQ ID NO: 2531024 - protein, 23 aa, Entamoeba dispar
KVTKQVNSAPWPVAAREFVSVLI

SEQ ID NO: 2531025 - protein, 27 aa, Entamoeba dispar
KVTQLYHPFCQLLCGLLNFVKGITHFP

SEQ ID NO: 2531026 - protein, 27 aa, Entamoeba dispar
KVTSLRIFQFMPFIDKMKYLQELKLDK

SEQ ID NO: 2531027 - protein, 19 aa, Entamoeba dispar
KVTTLKIPQILYNSKTDKL

SEQ ID NO: 2531028 - protein, 23 aa, Entamoeba dispar
KVTTPIAVQCGLLLSPNSNQYIV

SEQ ID NO: 2531029 - protein, 23 aa, Entamoeba dispar
KVTYFFCHHIPLTTPFQPKTRME

SEQ ID NO: 2531030 - protein, 24 aa, Entamoeba dispar
KVTYFIFGRIDGCLDLLEFKNKSF

SEQ ID NO: 2531031 - protein, 25 aa, Entamoeba dispar
KVVDFYFHRNLLYMVMEYHPSDLEK

SEQ ID NO: 2531032 - protein, 17 aa, Entamoeba dispar
KVVFIPNYSVSLAEVII

SEQ ID NO: 2531033 - protein, 21 aa, Entamoeba dispar
KVVGIKLTKKCCFSYPGKIQS

SEQ ID NO: 2531034 - protein, 35 aa, Entamoeba dispar
KVVIKLMDTSRVHKFRLYEFNELCLQIAFVEQKVG

SEQ ID NO: 2531035 - protein, 24 aa, Entamoeba dispar
KVVIYQILSALKYIKAHNIIHRDI

SEQ ID NO: 2531036 - protein, 25 aa, Entamoeba dispar
KVVKITPLFIFEVQYDLFVNIFKTF

SEQ ID NO: 2531037 - protein, 22 aa, Entamoeba dispar
KVVLDILFKKAVNEKKFTSLYV

SEQ ID NO: 2531038 - protein, 19 aa, Entamoeba dispar
KVVVTIPVSFTPKQKKETI

SEQ ID NO: 2531039 - protein, 19 aa, Entamoeba dispar
KVVVTIPVSFTPRQKKETI

SEQ ID NO: 2531040 - protein, 30 aa, Entamoeba dispar
KVWQMNAPYYYDVFIDFYTPHPTISFDWTR

SEQ ID NO: 2531041 - protein, 26 aa, Entamoeba dispar
KVYAEPFRFFLSFTPTKFPCFNQNMM

SEQ ID NO: 2531042 - protein, 17 aa, Entamoeba dispar
KVYKLIMAVGDDKVCFW

SEQ ID NO: 2531043 - protein, 17 aa, Entamoeba dispar
KVYKMLHVINKSEFYIP

SEQ ID NO: 2531044 - protein, 18 aa, Entamoeba dispar
KVYKRWVVLKSKTMMLFK

SEQ ID NO: 2531045 - protein, 31 aa, Entamoeba dispar
KVYQYEQDKLKYYFAVAVFDSIETANEVYNA

SEQ ID NO: 2531046 - protein, 21 aa, Entamoeba dispar
KWAPNIPWFKEYIPTVIQAKK

SEQ ID NO: 2531047 - protein, 19 aa, Entamoeba dispar
KWCDDLINMFPLSSKSFKS

SEQ ID NO: 2531048 - protein, 26 aa, Entamoeba dispar
KWEQQKVLSFIPPDGKFTLFNYRVRG

SEQ ID NO: 2531049 - protein, 20 aa, Entamoeba dispar
KWFEQTWSDTYRRNDVKILL

SEQ ID NO: 2531050 - protein, 21 aa, Entamoeba dispar
KWFKPIELFTKQGVCGNILCS

SEQ ID NO: 2531051 - protein, 18 aa, Entamoeba dispar
KWIEFANAYTSRIDGLKK

SEQ ID NO: 2531052 - protein, 18 aa, Entamoeba dispar
KWIIEPLVEPFDIKGKCI

SEQ ID NO: 2531053 - protein, 20 aa, Entamoeba dispar
KWKLISEDHVIVIWNENYQE

SEQ ID NO: 2531054 - protein, 26 aa, Entamoeba dispar
KWKTQTLWIRLFRGKEKLISVKGIED

SEQ ID NO: 2531055 - protein, 17 aa, Entamoeba dispar
KWLGVERIPVQTGSSDS

SEQ ID NO: 2531056 - protein, 27 aa, Entamoeba dispar
KWRYDRYDLIFYISQVPCGDCCISSNG

SEQ ID NO: 2531057 - protein, 29 aa, Entamoeba dispar
KYADQWVVLARYLLPYTTDYNYAKAIFDK

SEQ ID NO: 2531058 - protein, 23 aa, Entamoeba dispar
KYAFKSSILLQTPIIPNGCIVDP

SEQ ID NO: 2531059 - protein, 26 aa, Entamoeba dispar
KYAMVKWLEFVLQKEIGSFERINGLI

SEQ ID NO: 2531060 - protein, 20 aa, Entamoeba dispar
KYASYKQYRIPVVFGKSINK

SEQ ID NO: 2531061 - protein, 20 aa, Entamoeba dispar
KYCHGVFDQLYRATIGVDFA

SEQ ID NO: 2531062 - protein, 24 aa, Entamoeba dispar
KYDAKCIAYMLLLKKIFSNTRSNG

SEQ ID NO: 2531063 - protein, 20 aa, Entamoeba dispar
KYDEDFYCWVKTGEKIKFEL

SEQ ID NO: 2531064 - protein, 20 aa, Entamoeba dispar
KYDPNLLDPKFVFAKEEETQ

SEQ ID NO: 2531065 - protein, 24 aa, Entamoeba dispar
KYDRAVLFLLTLGQEKVLLPKEDY

SEQ ID NO: 2531066 - protein, 18 aa, Entamoeba dispar
KYDYEKWYKEARAAINER

SEQ ID NO: 2531067 - protein, 20 aa, Entamoeba dispar
KYDYLVSPLMKQADFEAKPM

SEQ ID NO: 2531068 - protein, 20 aa, Entamoeba dispar
KYEDQCFTSPFKIKAFREDF

SEQ ID NO: 2531069 - protein, 20 aa, Entamoeba dispar
KYEEKLQKKVMKPLKMYLET

SEQ ID NO: 2531070 - protein, 24 aa, Entamoeba dispar
KYEKPNAFLVEKYIFIANDLKQRD

SEQ ID NO: 2531071 - protein, 25 aa, Entamoeba dispar
KYEKSYYALLSFIPRSPLNSYNSFV

SEQ ID NO: 2531072 - protein, 18 aa, Entamoeba dispar
KYEQIIKLFGGKTELGYP

SEQ ID NO: 2531073 - protein, 25 aa, Entamoeba dispar
KYERSLDLYNYLRTELVEDMKNIIS

SEQ ID NO: 2531074 - protein, 22 aa, Entamoeba dispar
KYFNRIRHTFKILTGILMSEAG

SEQ ID NO: 2531075 - protein, 17 aa, Entamoeba dispar
KYGNLPRTDITSKDIIT

SEQ ID NO: 2531076 - protein, 23 aa, Entamoeba dispar
KYGNVFGIFFHSVKILRNQTFVC

SEQ ID NO: 2531077 - protein, 23 aa, Entamoeba dispar
KYGSKVIILHRRDTFRASKTMQE

SEQ ID NO: 2531078 - protein, 26 aa, Entamoeba dispar
KYGSRCRFIHVLPGEPSPVSDCVDIP

SEQ ID NO: 2531079 - protein, 19 aa, Entamoeba dispar
KYGVIFGSTFIARAEAKNK

SEQ ID NO: 2531080 - protein, 18 aa, Entamoeba dispar
KYHFFSSSLLFVYDAESY

SEQ ID NO: 2531081 - protein, 23 aa, Entamoeba dispar
KYHGWSVRHPFNGKILPIIEDDE

SEQ ID NO: 2531082 - protein, 18 aa, Entamoeba dispar
KYHITACTKPSINPFPPF

SEQ ID NO: 2531083 - protein, 26 aa, Entamoeba dispar
KYHNNLYYILLLMPETIKLKFTTSLL

SEQ ID NO: 2531084 - protein, 18 aa, Entamoeba dispar
KYHPKIFYHLKSKEYDFD

SEQ ID NO: 2531085 - protein, 17 aa, Entamoeba dispar
KYHTKLSFISFLCEKFD

SEQ ID NO: 2531086 - protein, 26 aa, Entamoeba dispar
KYHTVKMLDYFLFHGHVCIVTELLSI

SEQ ID NO: 2531087 - protein, 19 aa, Entamoeba dispar
KYIERYPSLLLLLKEKDIC

SEQ ID NO: 2531088 - protein, 20 aa, Entamoeba dispar
KYIKFFTKYCVKYYHKLKKG

SEQ ID NO: 2531089 - protein, 28 aa, Entamoeba dispar
KYIKNDKDFFVFSLRSKELTQPVMIQRK

SEQ ID NO: 2531090 - protein, 20 aa, Entamoeba dispar
KYILMTLAVYTKFQGKGYGS

SEQ ID NO: 2531091 - protein, 20 aa, Entamoeba dispar
KYISNFSWNVQKKIFIELIQ

SEQ ID NO: 2531092 - protein, 20 aa, Entamoeba dispar
KYIVIKSKKGKNPYIKFCQE

SEQ ID NO: 2531093 - protein, 29 aa, Entamoeba dispar
KYKDILLRIRTLVKTIYPIANLESVNRLS

SEQ ID NO: 2531094 - protein, 25 aa, Entamoeba dispar
KYKFDQLLFVRDSEFLRCYCAEFVK

SEQ ID NO: 2531095 - protein, 28 aa, Entamoeba dispar
KYKGKMLFMSPFFLNKLQSYFSLQEYQS

SEQ ID NO: 2531096 - protein, 30 aa, Entamoeba dispar
KYKNDSVWLKYLVTLPYQFYKEGLEINGNE

SEQ ID NO: 2531097 - protein, 25 aa, Entamoeba dispar
KYKQINFIIILNEYGFIFSQCFDQI

SEQ ID NO: 2531098 - protein, 29 aa, Entamoeba dispar
KYKWNVEESIPWIIDNIRTFPKPEKQEKK

SEQ ID NO: 2531099 - protein, 39 aa, Entamoeba dispar
KYLENNTLMFFIPLINKGIYFLKYFRKPVREPTQFSPFI

SEQ ID NO: 2531100 - protein, 23 aa, Entamoeba dispar
KYLKEFIMSIIINASYSTSVSGV

SEQ ID NO: 2531101 - protein, 20 aa, Entamoeba dispar
KYLKKQVTLSLPKISKPLFV

SEQ ID NO: 2531102 - protein, 20 aa, Entamoeba dispar
KYLNCMLEHLSLIFTQRSCS

SEQ ID NO: 2531103 - protein, 22 aa, Entamoeba dispar
KYLNTPFPSLTSYQLFIITKCF

SEQ ID NO: 2531104 - protein, 24 aa, Entamoeba dispar
KYLQDMQMKIRESILLIVSSEEED

SEQ ID NO: 2531105 - protein, 19 aa, Entamoeba dispar
KYLRAICDSIIIYYEMFKN

SEQ ID NO: 2531106 - protein, 19 aa, Entamoeba dispar
KYLRILEKEAYLIEDIALT

SEQ ID NO: 2531107 - protein, 21 aa, Entamoeba dispar
KYLSFIVSWEQEGVNLGLAVS

SEQ ID NO: 2531108 - protein, 17 aa, Entamoeba dispar
KYLSLRRQELEMAMGSV

SEQ ID NO: 2531109 - protein, 18 aa, Entamoeba dispar
KYMMATVKQIIAFDMSIK

SEQ ID NO: 2531110 - protein, 17 aa, Entamoeba dispar
KYMYFFKNAFELYENIP

SEQ ID NO: 2531111 - protein, 24 aa, Entamoeba dispar
KYNDIPFFVKNGFKGVARSMPTSA

SEQ ID NO: 2531112 - protein, 28 aa, Entamoeba dispar
KYNDKYDSVFRFVLNNTLLVDTLDNARK

SEQ ID NO: 2531113 - protein, 17 aa, Entamoeba dispar
KYNEFFIAITFTTKVSK

SEQ ID NO: 2531114 - protein, 26 aa, Entamoeba dispar
KYNGGYSWWKRNSLTVFIDKKLYKDP

SEQ ID NO: 2531115 - protein, 26 aa, Entamoeba dispar
KYNGGYSWWRRNSLTVFIDDKLYKDP

SEQ ID NO: 2531116 - protein, 27 aa, Entamoeba dispar
KYNGTTNVPFLPPTGKLIIVIGSVSTT

SEQ ID NO: 2531117 - protein, 23 aa, Entamoeba dispar
KYNNLIYVRIQDTVLIINMETSD

SEQ ID NO: 2531118 - protein, 20 aa, Entamoeba dispar
KYNNLWDYCSLYLSKDVETI

SEQ ID NO: 2531119 - protein, 31 aa, Entamoeba dispar
KYNSRGTFKCPILIPSADLLYEYTVAYFAKN

SEQ ID NO: 2531120 - protein, 23 aa, Entamoeba dispar
KYNTLFIIHSLYSKLFKNECTII

SEQ ID NO: 2531121 - protein, 24 aa, Entamoeba dispar
KYPALKVWIQQLCPTYPPCVVIPS

SEQ ID NO: 2531122 - protein, 21 aa, Entamoeba dispar
KYPFVCFAKITWEDSNKPFPE

SEQ ID NO: 2531123 - protein, 18 aa, Entamoeba dispar
KYPLLKIADYGFSRGIDG

SEQ ID NO: 2531124 - protein, 27 aa, Entamoeba dispar
KYPQSTLLEKCGIYYHYIQIKGNEIII

SEQ ID NO: 2531125 - protein, 18 aa, Entamoeba dispar
KYQILLNYLDKCSLQMRI

SEQ ID NO: 2531126 - protein, 18 aa, Entamoeba dispar
KYQINYTNLRLYSRKFIG

SEQ ID NO: 2531127 - protein, 23 aa, Entamoeba dispar
KYQLKFVGAIPIEPKICLAGETG

SEQ ID NO: 2531128 - protein, 31 aa, Entamoeba dispar
KYQQIVDELLKMPYFLERFSLDDVADTFRPL

SEQ ID NO: 2531129 - protein, 28 aa, Entamoeba dispar
KYQSIVCTFLIKYYPLIFRDTCDTKGLL

SEQ ID NO: 2531130 - protein, 19 aa, Entamoeba dispar
KYRAITDAYYRGAEGAMCV

SEQ ID NO: 2531131 - protein, 17 aa, Entamoeba dispar
KYRFIFERDYIYIGGRY

SEQ ID NO: 2531132 - protein, 20 aa, Entamoeba dispar
KYRHKIILTALNPNKIEVIK

SEQ ID NO: 2531133 - protein, 25 aa, Entamoeba dispar
KYRKELVPYFILQLNKMIEVMKKRE

SEQ ID NO: 2531134 - protein, 19 aa, Entamoeba dispar
KYRKHEVIIKAIFVDKVRK

SEQ ID NO: 2531135 - protein, 23 aa, Entamoeba dispar
KYRMGNLFIVGPTKTGKTEFAVQ

SEQ ID NO: 2531136 - protein, 20 aa, Entamoeba dispar
KYRSLTTTYFKNASKVFLTY

SEQ ID NO: 2531137 - protein, 24 aa, Entamoeba dispar
KYRSMVGMYYRGATVALICYDITS

SEQ ID NO: 2531138 - protein, 22 aa, Entamoeba dispar
KYRSMVSMYYRGSLGAMLVYDV

SEQ ID NO: 2531139 - protein, 25 aa, Entamoeba dispar
KYRTYKAMLACLFPVLKQVIYKEGC

SEQ ID NO: 2531140 - protein, 29 aa, Entamoeba dispar
KYSELKRYTLLLTNLPHKRLRDVAARVKY

SEQ ID NO: 2531141 - protein, 27 aa, Entamoeba dispar
KYSICFHWLSIPFRRKRMALLDFCRTE

SEQ ID NO: 2531142 - protein, 22 aa, Entamoeba dispar
KYSIRAIINWATLLGVLISKDF

SEQ ID NO: 2531143 - protein, 17 aa, Entamoeba dispar
KYSKLVKLVYQIAEMDI

SEQ ID NO: 2531144 - protein, 18 aa, Entamoeba dispar
KYSNIIIQLIKLGNSITL

SEQ ID NO: 2531145 - protein, 29 aa, Entamoeba dispar
KYSTEEIIIPMLGIFFNFSQTDSKEVEVH

SEQ ID NO: 2531146 - protein, 20 aa, Entamoeba dispar
KYTAKLKWKRFSIKKFGSLS

SEQ ID NO: 2531147 - protein, 33 aa, Entamoeba dispar
KYTDIQKQFNFIETQLKLDEEALMKCISEGQMK

SEQ ID NO: 2531148 - protein, 28 aa, Entamoeba dispar
KYTEAVSIILKRLPFPNICGRVCPHYCQ

SEQ ID NO: 2531149 - protein, 34 aa, Entamoeba dispar
KYTEFKRLALLLTNLPTKRLRDISLRLQFMKAKE

SEQ ID NO: 2531150 - protein, 18 aa, Entamoeba dispar
KYTVYEVNFCGFKIAKKG

SEQ ID NO: 2531151 - protein, 22 aa, Entamoeba dispar
KYVICQPKIWSKAIDSSLQFII

SEQ ID NO: 2531152 - protein, 18 aa, Entamoeba dispar
KYVIIRNIHDHNIKIRSN

SEQ ID NO: 2531153 - protein, 19 aa, Entamoeba dispar
KYVYIPFNDVIESLQVSLR

SEQ ID NO: 2531154 - protein, 18 aa, Entamoeba dispar
KYYCYYCRRGLIPELPQV

SEQ ID NO: 2531155 - protein, 26 aa, Entamoeba dispar
KYYKHTNFCGFSRQLSLYGFKKFDNE

SEQ ID NO: 2531156 - protein, 17 aa, Entamoeba dispar
KYYLNRGLKRNDQITFY

SEQ ID NO: 2531157 - protein, 19 aa, Entamoeba dispar
LAALCGGYIMMPLNPLYTK

SEQ ID NO: 2531158 - protein, 39 aa, Entamoeba dispar
LAAPALKILVRLCSLFPLIKKYVLACELFREKLKEYSGT

SEQ ID NO: 2531159 - protein, 17 aa, Entamoeba dispar
LAAVIEKLPLPSTLFEL

SEQ ID NO: 2531160 - protein, 27 aa, Entamoeba dispar
LACKRGFLPIAEYLLFHSNGLAPTAID

SEQ ID NO: 2531161 - protein, 25 aa, Entamoeba dispar
LADAPNHMIFILTGPVQNGEELPDI

SEQ ID NO: 2531162 - protein, 18 aa, Entamoeba dispar
LADFEVREIFKNKNFTTE

SEQ ID NO: 2531163 - protein, 19 aa, Entamoeba dispar
LADGTFWPIPITMSVSEEE

SEQ ID NO: 2531164 - protein, 29 aa, Entamoeba dispar
LADKEMWEEFQQFVRFKQILQQKENNNQE

SEQ ID NO: 2531165 - protein, 27 aa, Entamoeba dispar
LADNLRVLYKLYSSFKMPHLPKVGVLY

SEQ ID NO: 2531166 - protein, 25 aa, Entamoeba dispar
LAEHNGKWMRSLITTGTYNDKIKAL

SEQ ID NO: 2531167 - protein, 23 aa, Entamoeba dispar
LAEIIFKIIWRKYTPSTIENILE

SEQ ID NO: 2531168 - protein, 27 aa, Entamoeba dispar
LAETIQFINAIHLFLEKLNRGVLTEFS

SEQ ID NO: 2531169 - protein, 17 aa, Entamoeba dispar
LAEVLLALEYLHLNGII

SEQ ID NO: 2531170 - protein, 20 aa, Entamoeba dispar
LAEWKYLERAILNIKTIEDL

SEQ ID NO: 2531171 - protein, 35 aa, Entamoeba dispar
LAFEIIKTYLKRLAEPILGIYYFDIKKGLATEDLV

SEQ ID NO: 2531172 - protein, 18 aa, Entamoeba dispar
LAFEYPSYGLFDQPYSDE

SEQ ID NO: 2531173 - protein, 25 aa, Entamoeba dispar
LAFGGIQMIICGDFCQLPPISRNGT

SEQ ID NO: 2531174 - protein, 32 aa, Entamoeba dispar
LAFSSFVIQYYGLILDILLLGPRRALEIAGTS

SEQ ID NO: 2531175 - protein, 27 aa, Entamoeba dispar
LAGDKYRRFIMGGFVRLQGHPTKFNLQ

SEQ ID NO: 2531176 - protein, 17 aa, Entamoeba dispar
LAGLLNALKLVKKDIHE

SEQ ID NO: 2531177 - protein, 32 aa, Entamoeba dispar
LAHMWFGDLVTMKWWNDLWLNEGFASYMGDLF

SEQ ID NO: 2531178 - protein, 31 aa, Entamoeba dispar
LAHNKALHFTSRFMYLTLWGDEISNQTQFKE

SEQ ID NO: 2531179 - protein, 30 aa, Entamoeba dispar
LAHNKALHFTSRYMYLTLWGDEISNQTQFK

SEQ ID NO: 2531180 - protein, 29 aa, Entamoeba dispar
LAHNKALHFTSRYMYLTLWGDEVSNQTQF

SEQ ID NO: 2531181 - protein, 17 aa, Entamoeba dispar
LAICKFTNQLYSLSKVI

SEQ ID NO: 2531182 - protein, 20 aa, Entamoeba dispar
LAIEMIPLPGAGKKKKKGIF

SEQ ID NO: 2531183 - protein, 27 aa, Entamoeba dispar
LAIGNECLYFYCSPYFSQQVKFTNYCE

SEQ ID NO: 2531184 - protein, 18 aa, Entamoeba dispar
LAIRQYYPSIITLIELML

SEQ ID NO: 2531185 - protein, 19 aa, Entamoeba dispar
LAIYLKHLPPYHNEDIFYQ

SEQ ID NO: 2531186 - protein, 28 aa, Entamoeba dispar
LAIYNGIILDAKLPIVVYKKILGINLQM

SEQ ID NO: 2531187 - protein, 17 aa, Entamoeba dispar
LAKEGVLLFGTIDTWII

SEQ ID NO: 2531188 - protein, 37 aa, Entamoeba dispar
LAKIPCLQCVEDCVCIGLYYWTYDITSFITINNKETT

SEQ ID NO: 2531189 - protein, 32 aa, Entamoeba dispar
LAKKAKKTLKKRFWRETYAGAKLFNLSGITHG

SEQ ID NO: 2531190 - protein, 23 aa, Entamoeba dispar
LAKKYDIPFFFDAARFAENAYFI

SEQ ID NO: 2531191 - protein, 21 aa, Entamoeba dispar
LAKLNLVPGAILLIVFEDYKS

SEQ ID NO: 2531192 - protein, 31 aa, Entamoeba dispar
LAKQAYSAYEKKIHWLNQKDTQKSYQQYKQN

SEQ ID NO: 2531193 - protein, 25 aa, Entamoeba dispar
LALDILKCLISYLPTERYGCICQII

SEQ ID NO: 2531194 - protein, 29 aa, Entamoeba dispar
LALKGTLITSILVPERYITLLVNSGIPIF

SEQ ID NO: 2531195 - protein, 30 aa, Entamoeba dispar
LALTPEIVSLIPLRLHLLIKALGDEYGGRQ

SEQ ID NO: 2531196 - protein, 24 aa, Entamoeba dispar
LAMIYIKYIEYVSNLFKTFVGIVQ

SEQ ID NO: 2531197 - protein, 33 aa, Entamoeba dispar
LAMKSGEYRWCYESWIVLGFEALGLNKNSEAVT

SEQ ID NO: 2531198 - protein, 28 aa, Entamoeba dispar
LANAFKVLQSLTFSLLPPGDSVTADILL

SEQ ID NO: 2531199 - protein, 25 aa, Entamoeba dispar
LANDRNICIWASDGKLLKTLPRTDE

SEQ ID NO: 2531200 - protein, 17 aa, Entamoeba dispar
LANWPFKVKDRENGSVY

SEQ ID NO: 2531201 - protein, 24 aa, Entamoeba dispar
LAPFQVLDRCSLNMLIPAEQSIPS

SEQ ID NO: 2531202 - protein, 21 aa, Entamoeba dispar
LAPHIFRYRKQDELKVLGILS

SEQ ID NO: 2531203 - protein, 26 aa, Entamoeba dispar
LAQQKPIQKSLPVIPQKRTQQTAIDN

SEQ ID NO: 2531204 - protein, 28 aa, Entamoeba dispar
LAQRKHFPAVNWNISFSKYIKSLDSYYN

SEQ ID NO: 2531205 - protein, 17 aa, Entamoeba dispar
LAQSKSLWERRIAMVTT

SEQ ID NO: 2531206 - protein, 21 aa, Entamoeba dispar
LAQTFVPYKFNFFTSVNNTSF

SEQ ID NO: 2531207 - protein, 19 aa, Entamoeba dispar
LAQTKLPFNCLVVALVFDV

SEQ ID NO: 2531208 - protein, 18 aa, Entamoeba dispar
LARITGRRNSLEKISPFL

SEQ ID NO: 2531209 - protein, 25 aa, Entamoeba dispar
LARSLFPKIIHFKCPFDFSLLNDNE

SEQ ID NO: 2531210 - protein, 19 aa, Entamoeba dispar
LASCGLVNYLIPKSFEEEK

SEQ ID NO: 2531211 - protein, 33 aa, Entamoeba dispar
LASDLIKLPPLDQGVYKILFKKVEYDYESTRSE

SEQ ID NO: 2531212 - protein, 17 aa, Entamoeba dispar
LASEPPTDYVWKCVCIH

SEQ ID NO: 2531213 - protein, 17 aa, Entamoeba dispar
LASIALKTLIQIIKNIK

SEQ ID NO: 2531214 - protein, 17 aa, Entamoeba dispar
LASIRRIAFIIAKTEYN

SEQ ID NO: 2531215 - protein, 27 aa, Entamoeba dispar
LASLPTLFLNEYAFPLLLTLSTTNKGC

SEQ ID NO: 2531216 - protein, 26 aa, Entamoeba dispar
LASMKLYQPILIPRTLWLLQQYEEAL

SEQ ID NO: 2531217 - protein, 27 aa, Entamoeba dispar
LASPKWKFTFIQLIATLPAETKMIYSV

SEQ ID NO: 2531218 - protein, 22 aa, Entamoeba dispar
LASTLCDLYKTIKSKIFVASVP

SEQ ID NO: 2531219 - protein, 26 aa, Entamoeba dispar
LATKLSAWIERLGGKITIRPKDADVI

SEQ ID NO: 2531220 - protein, 17 aa, Entamoeba dispar
LAVASYDATIRIIDITG

SEQ ID NO: 2531221 - protein, 27 aa, Entamoeba dispar
LAVGGTCYIPLVRKSISKMLGEIKLAY

SEQ ID NO: 2531222 - protein, 25 aa, Entamoeba dispar
LAVGTTYGFIVLSIKNGKFTKRFHR

SEQ ID NO: 2531223 - protein, 18 aa, Entamoeba dispar
LAVGYYNRFPTIQSYKLL

SEQ ID NO: 2531224 - protein, 19 aa, Entamoeba dispar
LAVMKTFTQALFAAAVEYL

SEQ ID NO: 2531225 - protein, 33 aa, Entamoeba dispar
LAVNVLAPFIITCKLLPLIRKTLNSRIIEVGSI

SEQ ID NO: 2531226 - protein, 24 aa, Entamoeba dispar
LAVTQMIINLYYKINFKEINEKKI

SEQ ID NO: 2531227 - protein, 24 aa, Entamoeba dispar
LAYKQPHLLLLDEPSNHLDIETVE

SEQ ID NO: 2531228 - protein, 40 aa, Entamoeba dispar
LAYYVIILFDENCDIHFENLRIITKLLNKWNVLNKENIHQ

SEQ ID NO: 2531229 - protein, 26 aa, Entamoeba dispar
LCANYGINKLYIVNPLCKIGEESIKV

SEQ ID NO: 2531230 - protein, 19 aa, Entamoeba dispar
LCCECSCYKPELYGELKTK

SEQ ID NO: 2531231 - protein, 23 aa, Entamoeba dispar
LCCKSFLHLYSSKQINLIKFPNQ

SEQ ID NO: 2531232 - protein, 18 aa, Entamoeba dispar
LCCYPSYDFVHCLVDSFE

SEQ ID NO: 2531233 - protein, 17 aa, Entamoeba dispar
LCDCKVSLMVFKDDKLV

SEQ ID NO: 2531234 - protein, 30 aa, Entamoeba dispar
LCDFEGVQKWYKKAVILIHPDKNQFRSADQ

SEQ ID NO: 2531235 - protein, 28 aa, Entamoeba dispar
LCDFSIPILFTTLPLNIILDLFESILLE

SEQ ID NO: 2531236 - protein, 27 aa, Entamoeba dispar
LCEIMLDPFFRTIDGFIILIEKDWKSF

SEQ ID NO: 2531237 - protein, 22 aa, Entamoeba dispar
LCEPPCIPFLGSTLGDLVFTKE

SEQ ID NO: 2531238 - protein, 29 aa, Entamoeba dispar
LCESKSFLKLLEVILIIGNYMNKASKKPI

SEQ ID NO: 2531239 - protein, 27 aa, Entamoeba dispar
LCETEGLEFILLNPPLEEMEKQMELHC

SEQ ID NO: 2531240 - protein, 19 aa, Entamoeba dispar
LCEYGFDDSIVLNNSTNIE

SEQ ID NO: 2531241 - protein, 24 aa, Entamoeba dispar
LCFQLQPVLTERITIVISPLIALM

SEQ ID NO: 2531242 - protein, 17 aa, Entamoeba dispar
LCFVKGMSLLMKGYEEH

SEQ ID NO: 2531243 - protein, 20 aa, Entamoeba dispar
LCGFHYFYNPAAAVGVFILN

SEQ ID NO: 2531244 - protein, 25 aa, Entamoeba dispar
LCGGDWFIGLFVRQLSCVNQRKKIA

SEQ ID NO: 2531245 - protein, 18 aa, Entamoeba dispar
LCGKQWKSFFTTKRIIVM

SEQ ID NO: 2531246 - protein, 25 aa, Entamoeba dispar
LCGPTSFVPLIKRAIKIVKETKQYH

SEQ ID NO: 2531247 - protein, 18 aa, Entamoeba dispar
LCGTFRQLLRSSNGILRA

SEQ ID NO: 2531248 - protein, 19 aa, Entamoeba dispar
LCGTPTYFSPELLRGWNEY

SEQ ID NO: 2531249 - protein, 18 aa, Entamoeba dispar
LCGVMFMNIPFYQNTRFV

SEQ ID NO: 2531250 - protein, 20 aa, Entamoeba dispar
LCHKNILLPFSLIKIHFNGL

SEQ ID NO: 2531251 - protein, 18 aa, Entamoeba dispar
LCHPLRIEFIEEFNKIFS

SEQ ID NO: 2531252 - protein, 27 aa, Entamoeba dispar
LCKFENFFTYKRYKFGVLYAAPGQTKE

SEQ ID NO: 2531253 - protein, 29 aa, Entamoeba dispar
LCKTKRVCILYPSFSDIYYVFSQFDIPIV

SEQ ID NO: 2531254 - protein, 25 aa, Entamoeba dispar
LCKTRNPFVLGFLQVKQNSDMTTCL

SEQ ID NO: 2531255 - protein, 30 aa, Entamoeba dispar
LCLAKTMMSLFIRSIPETQLRSLLFTFFLC

SEQ ID NO: 2531256 - protein, 18 aa, Entamoeba dispar
LCLALQYITDVTPFFGFE

SEQ ID NO: 2531257 - protein, 19 aa, Entamoeba dispar
LCLIFPYSPPHFSYSLDAR

SEQ ID NO: 2531258 - protein, 17 aa, Entamoeba dispar
LCLLGNPLPEVDSLFLI

SEQ ID NO: 2531259 - protein, 19 aa, Entamoeba dispar
LCLVYALKARYPQQFFIIR

SEQ ID NO: 2531260 - protein, 29 aa, Entamoeba dispar
LCNKCFCKCKTLKLISIPSSINTIDYWCF

SEQ ID NO: 2531261 - protein, 18 aa, Entamoeba dispar
LCPFNRLPPKESYGFVDC

SEQ ID NO: 2531262 - protein, 27 aa, Entamoeba dispar
LCPHKTEFLMMLLENYRALMNGQSFPI

SEQ ID NO: 2531263 - protein, 27 aa, Entamoeba dispar
LCPIQDLVSFIYSLFESLINWIDSVLN

SEQ ID NO: 2531264 - protein, 17 aa, Entamoeba dispar
LCQAGVVFGYRVNIVMP

SEQ ID NO: 2531265 - protein, 17 aa, Entamoeba dispar
LCQEFITWISNNQKIAA

SEQ ID NO: 2531266 - protein, 26 aa, Entamoeba dispar
LCREQPQIIEPFLQHIESENPQLAQL

SEQ ID NO: 2531267 - protein, 24 aa, Entamoeba dispar
LCRFELKQLFLQAPMVGLAYTIGE

SEQ ID NO: 2531268 - protein, 22 aa, Entamoeba dispar
LCSEKILAQPWTTKTELQFIYE

SEQ ID NO: 2531269 - protein, 24 aa, Entamoeba dispar
LCSIDGIITLKYIPTLNLQTNSTE

SEQ ID NO: 2531270 - protein, 29 aa, Entamoeba dispar
LCSLKILGLVSYLILLPTSLTSLTVSCFG

SEQ ID NO: 2531271 - protein, 25 aa, Entamoeba dispar
LCSSENAPFQLFVSKLRSFSRIAED

SEQ ID NO: 2531272 - protein, 19 aa, Entamoeba dispar
LCSTFDQTGLRFFTGCVDK

SEQ ID NO: 2531273 - protein, 34 aa, Entamoeba dispar
LCVNTFQYLNSLKLLFHYFKFSNTIVNSLQSSDI

SEQ ID NO: 2531274 - protein, 17 aa, Entamoeba dispar
LCYLFGTPITKKSMVAQ

SEQ ID NO: 2531275 - protein, 26 aa, Entamoeba dispar
LCYSFKNDTFFFKKKELPMIPNIIIE

SEQ ID NO: 2531276 - protein, 18 aa, Entamoeba dispar
LCYYKIIQYAPDSIRFVS

SEQ ID NO: 2531277 - protein, 22 aa, Entamoeba dispar
LDAALIRAMFDKGIKVGGSLLG

SEQ ID NO: 2531278 - protein, 27 aa, Entamoeba dispar
LDAHISEFILLYKDIVYSMLQLTSFYD

SEQ ID NO: 2531279 - protein, 37 aa, Entamoeba dispar
LDAIRIGMCFFWHSKVDLPFRIVIIGAGGCTLTLGIK

SEQ ID NO: 2531280 - protein, 22 aa, Entamoeba dispar
LDAKYLEMLSFPVNLTSLILHG

SEQ ID NO: 2531281 - protein, 26 aa, Entamoeba dispar
LDALEYIHRMYLKVGFYLTGEITDFN

SEQ ID NO: 2531282 - protein, 17 aa, Entamoeba dispar
LDAMIHCNLFESGKSTV

SEQ ID NO: 2531283 - protein, 18 aa, Entamoeba dispar
LDCGKTYLLKFEVPGIDK

SEQ ID NO: 2531284 - protein, 21 aa, Entamoeba dispar
LDCGYTSMQGWRRTMEDAHIV

SEQ ID NO: 2531285 - protein, 26 aa, Entamoeba dispar
LDCHLLEYFITFNYKDKLIDIAYGKL

SEQ ID NO: 2531286 - protein, 24 aa, Entamoeba dispar
LDCKIKELYFPRALALFCEYPLFN

SEQ ID NO: 2531287 - protein, 23 aa, Entamoeba dispar
LDCVPPIFRPIMSDLICVSPELK

SEQ ID NO: 2531288 - protein, 20 aa, Entamoeba dispar
LDCYHIMVIAKYFEYESDFI

SEQ ID NO: 2531289 - protein, 17 aa, Entamoeba dispar
LDDCKLAEKLAKEPNER

SEQ ID NO: 2531290 - protein, 25 aa, Entamoeba dispar
LDDDCFYKCLLLTTLHIPRTVTKIG

SEQ ID NO: 2531291 - protein, 32 aa, Entamoeba dispar
LDDENIIRYDAIQDFLFYSLKSSLERQINEIS

SEQ ID NO: 2531292 - protein, 17 aa, Entamoeba dispar
LDDKYLPSILALLKDNN

SEQ ID NO: 2531293 - protein, 29 aa, Entamoeba dispar
LDDMCYRLNKFIITLFPEYKDVFNGNELQ

SEQ ID NO: 2531294 - protein, 37 aa, Entamoeba dispar
LDDYTCKFVFFLFKPFYFRIFLMYRKLTWTSGHIWKG

SEQ ID NO: 2531295 - protein, 28 aa, Entamoeba dispar
LDEALLRPGRFDRILYVGLPDFDTRKQI

SEQ ID NO: 2531296 - protein, 26 aa, Entamoeba dispar
LDEASSRYFTWYINNTRLSVVKLMRD

SEQ ID NO: 2531297 - protein, 28 aa, Entamoeba dispar
LDEEIKYIYTIIKGIRSLNGIYSQAIIS

SEQ ID NO: 2531298 - protein, 25 aa, Entamoeba dispar
LDEIPLSLHWIYYDISDPDLLDCDE

SEQ ID NO: 2531299 - protein, 24 aa, Entamoeba dispar
LDEKYWDTLAIRIRYEELQYALGT

SEQ ID NO: 2531300 - protein, 23 aa, Entamoeba dispar
LDFIDILMILLTNAVEQQQYIFI

SEQ ID NO: 2531301 - protein, 17 aa, Entamoeba dispar
LDFIHLNESLKSNKPLH

SEQ ID NO: 2531302 - protein, 18 aa, Entamoeba dispar
LDFIQRSFVLFPGNALDC

SEQ ID NO: 2531303 - protein, 19 aa, Entamoeba dispar
LDFLFDFTLDQQRLIKNFL

SEQ ID NO: 2531304 - protein, 24 aa, Entamoeba dispar
LDFSCHQYYLFDSIKSLSPQQITA

SEQ ID NO: 2531305 - protein, 28 aa, Entamoeba dispar
LDGDEYLIIWNPLFLPKPEINSHPPAIY

SEQ ID NO: 2531306 - protein, 29 aa, Entamoeba dispar
LDGEDVLLTCRWFFYIREKDSSISSSFSS

SEQ ID NO: 2531307 - protein, 20 aa, Entamoeba dispar
LDGIVYNLQRKKVQFIRIDG

SEQ ID NO: 2531308 - protein, 17 aa, Entamoeba dispar
LDGLKSLHWKYLDFIFI

SEQ ID NO: 2531309 - protein, 24 aa, Entamoeba dispar
LDGPEALAFLKKQAIKFNAICSEP

SEQ ID NO: 2531310 - protein, 17 aa, Entamoeba dispar
LDHFVFHNHVCIVTELL

SEQ ID NO: 2531311 - protein, 22 aa, Entamoeba dispar
LDHHVFIIEVKQTSVFKLKKKC

SEQ ID NO: 2531312 - protein, 20 aa, Entamoeba dispar
LDHLPYLPTRFLFSLLSDYS

SEQ ID NO: 2531313 - protein, 21 aa, Entamoeba dispar
LDIEHYTRTDLFPWREEMPEV

SEQ ID NO: 2531314 - protein, 21 aa, Entamoeba dispar
LDIFGFEIFPVNGFEQFCINY

SEQ ID NO: 2531315 - protein, 17 aa, Entamoeba dispar
LDIFQFHLGSHLKHLSI

SEQ ID NO: 2531316 - protein, 26 aa, Entamoeba dispar
LDIGDNIEVVLKWRRGDKKENKGTIE

SEQ ID NO: 2531317 - protein, 18 aa, Entamoeba dispar
LDIIMDRIKQQKSIPIID

SEQ ID NO: 2531318 - protein, 31 aa, Entamoeba dispar
LDIIQSLQMHSFQPLYYLVTEYNEITAKLIG

SEQ ID NO: 2531319 - protein, 24 aa, Entamoeba dispar
LDIKHFFNDYGLLNIYYNGWSAPE

SEQ ID NO: 2531320 - protein, 19 aa, Entamoeba dispar
LDIKIIKIPKEINLGIVMG

SEQ ID NO: 2531321 - protein, 18 aa, Entamoeba dispar
LDIKPIKLPNHLNLTIVE

SEQ ID NO: 2531322 - protein, 25 aa, Entamoeba dispar
LDINDGIFPYLYDYGTTTPLYIQIP

SEQ ID NO: 2531323 - protein, 27 aa, Entamoeba dispar
LDIPFDELINLYYLLEHPLLPNNVTSL

SEQ ID NO: 2531324 - protein, 21 aa, Entamoeba dispar
LDIPLDIIIPFISNEWSRKYV

SEQ ID NO: 2531325 - protein, 20 aa, Entamoeba dispar
LDISCNLISLFPKNLPITLT

SEQ ID NO: 2531326 - protein, 25 aa, Entamoeba dispar
LDISSLIGICFLNIPLYGGGAHPWG

SEQ ID NO: 2531327 - protein, 17 aa, Entamoeba dispar
LDIVMNGIYMQYDNKEI

SEQ ID NO: 2531328 - protein, 24 aa, Entamoeba dispar
LDKEGNFPEWYSQIVVQSGLIEYY

SEQ ID NO: 2531329 - protein, 28 aa, Entamoeba dispar
LDKFRSEYIIHFYGAVFIPNKICMVTEY

SEQ ID NO: 2531330 - protein, 31 aa, Entamoeba dispar
LDKFRSEYIIHFYGVFIPNKICMITEYAKYG

SEQ ID NO: 2531331 - protein, 28 aa, Entamoeba dispar
LDKFRSEYIIQFYGAVFIPNKICIVTEY

SEQ ID NO: 2531332 - protein, 27 aa, Entamoeba dispar
LDKFRSEYIIQFYGAVFIPNKICMITE

SEQ ID NO: 2531333 - protein, 29 aa, Entamoeba dispar
LDKFRSEYIIQFYGAVFIPNKICMITEYA

SEQ ID NO: 2531334 - protein, 17 aa, Entamoeba dispar
LDKGFIPSAIIIKYYID

SEQ ID NO: 2531335 - protein, 19 aa, Entamoeba dispar
LDKIMFCYGIGYKNPRKEG

SEQ ID NO: 2531336 - protein, 24 aa, Entamoeba dispar
LDKIPIECSLLRSIILILRNKRIE

SEQ ID NO: 2531337 - protein, 27 aa, Entamoeba dispar
LDKITLKSLLLESLLNTIIFITCDYCL

SEQ ID NO: 2531338 - protein, 25 aa, Entamoeba dispar
LDKLHKYFHVFDRWENPISSVSPLT

SEQ ID NO: 2531339 - protein, 25 aa, Entamoeba dispar
LDKLKEMIWEQLNLVRVYTKVPGAF

SEQ ID NO: 2531340 - protein, 23 aa, Entamoeba dispar
LDKLSSRLFFKSTIIYVGENDMS

SEQ ID NO: 2531341 - protein, 31 aa, Entamoeba dispar
LDKPAWNLEKLRKSIVPGAILIIVAGKYAGK

SEQ ID NO: 2531342 - protein, 25 aa, Entamoeba dispar
LDKQNTLQYLFILAQIGISCCPIYD

SEQ ID NO: 2531343 - protein, 21 aa, Entamoeba dispar
LDKRQNGCFLVRLSSKTVEHP

SEQ ID NO: 2531344 - protein, 28 aa, Entamoeba dispar
LDKSKESLLPLMRNILGILLHICFDENQ

SEQ ID NO: 2531345 - protein, 25 aa, Entamoeba dispar
LDKYPIVQHFLFGKVLLYEPLVKGS

SEQ ID NO: 2531346 - protein, 22 aa, Entamoeba dispar
LDKYYHLAKQYGYRARSAFKLV

SEQ ID NO: 2531347 - protein, 22 aa, Entamoeba dispar
LDLLIQIIDLLNRNILKEVQYL

SEQ ID NO: 2531348 - protein, 21 aa, Entamoeba dispar
LDLNAICFVAQSSNARLTASQ

SEQ ID NO: 2531349 - protein, 19 aa, Entamoeba dispar
LDLNAICFVAQSSNPRLTA

SEQ ID NO: 2531350 - protein, 20 aa, Entamoeba dispar
LDLNAICFVAQSSNPRLTAN

SEQ ID NO: 2531351 - protein, 22 aa, Entamoeba dispar
LDLNAICFVAQSSNPRLTASQK

SEQ ID NO: 2531352 - protein, 19 aa, Entamoeba dispar
LDLNAICFVAQSSNPRLTE

SEQ ID NO: 2531353 - protein, 19 aa, Entamoeba dispar
LDLNAICFVAQSSNPRLTL

SEQ ID NO: 2531354 - protein, 22 aa, Entamoeba dispar
LDLNAICFVAQSSNVRLTASQK

SEQ ID NO: 2531355 - protein, 26 aa, Entamoeba dispar
LDLQYYIHKGVWFLMNFVREEFSNAQ

SEQ ID NO: 2531356 - protein, 37 aa, Entamoeba dispar
LDLRGFLIMPVQRLPRYNLLLTDLLKRTPNTYVDYPK

SEQ ID NO: 2531357 - protein, 35 aa, Entamoeba dispar
LDLRSYLIMPVQRLPRYVLLFTDLIKHTPEKFPDY

SEQ ID NO: 2531358 - protein, 27 aa, Entamoeba dispar
LDNEKIFYLTLINQPEFFPKEGLVFSL

SEQ ID NO: 2531359 - protein, 37 aa, Entamoeba dispar
LDNGKVTLRFIFKKQEFFIPVVLLLRVYGGMSDREIF

SEQ ID NO: 2531360 - protein, 17 aa, Entamoeba dispar
LDNLTYKPGFEQLKQVI

SEQ ID NO: 2531361 - protein, 24 aa, Entamoeba dispar
LDNTGLFYDIPPQSPQIVKLENIV

SEQ ID NO: 2531362 - protein, 25 aa, Entamoeba dispar
LDNYKFYIEKIVLQLTFVFAHKPSS

SEQ ID NO: 2531363 - protein, 51 aa, Entamoeba dispar
LDPNYINAFSKNLQSLLFLTDELAKPSSLPFLKLVLSIPPSLAQQINQLQT

SEQ ID NO: 2531364 - protein, 25 aa, Entamoeba dispar
LDQANLRAYLKYLKQMFLEENKIQK

SEQ ID NO: 2531365 - protein, 19 aa, Entamoeba dispar
LDQFFLPKQKKESTITNNV

SEQ ID NO: 2531366 - protein, 22 aa, Entamoeba dispar
LDQIEMFLPMLLQVNQFPQQPT

SEQ ID NO: 2531367 - protein, 24 aa, Entamoeba dispar
LDQTYLPEKLINTKLVFYDRFVKP

SEQ ID NO: 2531368 - protein, 18 aa, Entamoeba dispar
LDSFQIQSIFVLTTHLAN

SEQ ID NO: 2531369 - protein, 23 aa, Entamoeba dispar
LDSKNVILSLPPLINGNHSKITL

SEQ ID NO: 2531370 - protein, 26 aa, Entamoeba dispar
LDSLDYSVFILFNQYLLLSPVELIAS

SEQ ID NO: 2531371 - protein, 31 aa, Entamoeba dispar
LDSLLNDEMLLNTPFLILGNKIDIPGAVSEA

SEQ ID NO: 2531372 - protein, 24 aa, Entamoeba dispar
LDSTGKICLCIGKKYMKVVDLYRG

SEQ ID NO: 2531373 - protein, 21 aa, Entamoeba dispar
LDTDLLFNFLSQVEGRKIFTQ

SEQ ID NO: 2531374 - protein, 24 aa, Entamoeba dispar
LDTEYNGFLTLQKYSRFLQKSGFD

SEQ ID NO: 2531375 - protein, 17 aa, Entamoeba dispar
LDTLRRVGGLDISFSTN

SEQ ID NO: 2531376 - protein, 28 aa, Entamoeba dispar
LDTVFNLIINLAHPILPLSFNDIQTLNA

SEQ ID NO: 2531377 - protein, 17 aa, Entamoeba dispar
LDTWCKKKNIPSFFVSA

SEQ ID NO: 2531378 - protein, 18 aa, Entamoeba dispar
LDVFSIPIQISLLKDIKN

SEQ ID NO: 2531379 - protein, 33 aa, Entamoeba dispar
LDVGIEKIKIWRITKPIIIWETLPQKSQTVIVQ

SEQ ID NO: 2531380 - protein, 25 aa, Entamoeba dispar
LDVVDFWEGYGSGLLPKIILVVIEE

SEQ ID NO: 2531381 - protein, 18 aa, Entamoeba dispar
LDWKLYFPNGKPAEMLDI

SEQ ID NO: 2531382 - protein, 17 aa, Entamoeba dispar
LDYEFIPFFVKGNTILL

SEQ ID NO: 2531383 - protein, 34 aa, Entamoeba dispar
LDYNEYIDWWGLGILIYEMLFTQSPFLAETMEEL

SEQ ID NO: 2531384 - protein, 17 aa, Entamoeba dispar
LDYTIRFFVKNINVDNK

SEQ ID NO: 2531385 - protein, 17 aa, Entamoeba dispar
LEAFQKGTAACYPLGGY

SEQ ID NO: 2531386 - protein, 21 aa, Entamoeba dispar
LEAFVYSMKDKLLFGNLAEFT

SEQ ID NO: 2531387 - protein, 20 aa, Entamoeba dispar
LEAILKTNLGPKGTLKMLVS

SEQ ID NO: 2531388 - protein, 21 aa, Entamoeba dispar
LEAILRNYMTLTLNTTITFQM

SEQ ID NO: 2531389 - protein, 26 aa, Entamoeba dispar
LEAKELFMVFVFLLNNNTSINGPQIA

SEQ ID NO: 2531390 - protein, 25 aa, Entamoeba dispar
LEANHFSEYLLLKEVKIPTTVTSLG

SEQ ID NO: 2531391 - protein, 25 aa, Entamoeba dispar
LEASLPFMHFFDGFRTSHEIQKIHQ

SEQ ID NO: 2531392 - protein, 17 aa, Entamoeba dispar
LECGKLAHQEGMKNVFV

SEQ ID NO: 2531393 - protein, 22 aa, Entamoeba dispar
LECLSKITLWLEKDRVISSFVN

SEQ ID NO: 2531394 - protein, 18 aa, Entamoeba dispar
LECRLDVNNRNRIIRRFI

SEQ ID NO: 2531395 - protein, 27 aa, Entamoeba dispar
LECVRWLQEYLQLPLEIISYIETYGMT

SEQ ID NO: 2531396 - protein, 29 aa, Entamoeba dispar
LEDANGKILPKLLIRTLFYNIDQVMTAAC

SEQ ID NO: 2531397 - protein, 21 aa, Entamoeba dispar
LEDDIFLPTLKKRVIDIKVES

SEQ ID NO: 2531398 - protein, 26 aa, Entamoeba dispar
LEDKRLLEILQIPRTIELLKIVQEEG

SEQ ID NO: 2531399 - protein, 25 aa, Entamoeba dispar
LEDLGNLKWIVVGKLFGLRTIVNKK

SEQ ID NO: 2531400 - protein, 27 aa, Entamoeba dispar
LEDLSSCLWTCRKLRSFILSDDLIWQN

SEQ ID NO: 2531401 - protein, 27 aa, Entamoeba dispar
LEDQPLSFYKSFKLVISGLDNLGARRW

SEQ ID NO: 2531402 - protein, 18 aa, Entamoeba dispar
LEDSPLEAFSIFIGSSNK

SEQ ID NO: 2531403 - protein, 22 aa, Entamoeba dispar
LEDVTIKLIRVGPLTLEDTRSL

SEQ ID NO: 2531404 - protein, 17 aa, Entamoeba dispar
LEEARIKEEAEKKAKEE

SEQ ID NO: 2531405 - protein, 25 aa, Entamoeba dispar
LEEAYKAHLIAIDSAAPTLKSYLDK

SEQ ID NO: 2531406 - protein, 26 aa, Entamoeba dispar
LEEDYSKLMFLLTDKTIEFHNKGGIQ

SEQ ID NO: 2531407 - protein, 32 aa, Entamoeba dispar
LEEERMTIARPIMSSLLVCYTKYLKSVSKEWK

SEQ ID NO: 2531408 - protein, 27 aa, Entamoeba dispar
LEEFIMKFPGLLPDIYIKHFLGDIALG

SEQ ID NO: 2531409 - protein, 24 aa, Entamoeba dispar
LEEFRKLLPRLSKKVDIKSYEENT

SEQ ID NO: 2531410 - protein, 24 aa, Entamoeba dispar
LEEMQLNVIVWKKSNKTSINPYYE

SEQ ID NO: 2531411 - protein, 31 aa, Entamoeba dispar
LEEQQLYAYTNFINYILIEEPFVNDILTDLK

SEQ ID NO: 2531412 - protein, 19 aa, Entamoeba dispar
LEERALSSIGFILSILSIH

SEQ ID NO: 2531413 - protein, 19 aa, Entamoeba dispar
LEESFFENCGFIQVSLPST

SEQ ID NO: 2531414 - protein, 34 aa, Entamoeba dispar
LEESSFSILFPKYREAYLKGMWYVINKALDEVCL

SEQ ID NO: 2531415 - protein, 29 aa, Entamoeba dispar
LEESVKFLLQIISALKYIHKWQICHRDIK

SEQ ID NO: 2531416 - protein, 26 aa, Entamoeba dispar
LEEYFEKYFPLDKIPQLPPQEGESGT

SEQ ID NO: 2531417 - protein, 22 aa, Entamoeba dispar
LEFEISICIVIFDGYGNVIGFE

SEQ ID NO: 2531418 - protein, 19 aa, Entamoeba dispar
LEFMGSRYEAMEKMKVGVN

SEQ ID NO: 2531419 - protein, 32 aa, Entamoeba dispar
LEGFMTLFIRPLLGRTGILKDFNLILGTDKTG

SEQ ID NO: 2531420 - protein, 25 aa, Entamoeba dispar
LEGHNWLVFNWCRGKGCILADEMGL

SEQ ID NO: 2531421 - protein, 18 aa, Entamoeba dispar
LEGLFRGIKGYYNYSLII

SEQ ID NO: 2531422 - protein, 22 aa, Entamoeba dispar
LEGLKIVGKLPGAAAWKVNKKV

SEQ ID NO: 2531423 - protein, 18 aa, Entamoeba dispar
LEGNIELILYVISDGRDD

SEQ ID NO: 2531424 - protein, 37 aa, Entamoeba dispar
LEGQKKLMVVVFPIYYEPFGCYINHPFKKEGWNGDIH

SEQ ID NO: 2531425 - protein, 24 aa, Entamoeba dispar
LEGYDTNFVLFLSNEFLLQAQKDY

SEQ ID NO: 2531426 - protein, 25 aa, Entamoeba dispar
LEHLGTIYFILRYYSGRSQLKENLI

SEQ ID NO: 2531427 - protein, 29 aa, Entamoeba dispar
LEHNKALHFTSKYLYLTLWGDEVANQTQF

SEQ ID NO: 2531428 - protein, 17 aa, Entamoeba dispar
LEHPLLPNNVTSLQLDG

SEQ ID NO: 2531429 - protein, 35 aa, Entamoeba dispar
LEIANQLMICEFSFLELLQPKDYYINIFSTTRPNS

SEQ ID NO: 2531430 - protein, 27 aa, Entamoeba dispar
LEIEGNICAIIYYNGKVYIGKTNSVIE

SEQ ID NO: 2531431 - protein, 27 aa, Entamoeba dispar
LEIEYGKKLLGLTTYLNTPSFGKEDPK

SEQ ID NO: 2531432 - protein, 17 aa, Entamoeba dispar
LEIGFDEIKYHEQLGFP

SEQ ID NO: 2531433 - protein, 21 aa, Entamoeba dispar
LEIKPSTEPIPFLSSVRQWFQ

SEQ ID NO: 2531434 - protein, 26 aa, Entamoeba dispar
LEIKQLKYLFSLPNEYIFSGFKVSTM

SEQ ID NO: 2531435 - protein, 19 aa, Entamoeba dispar
LEILKEVYLFPITKSTNSE

SEQ ID NO: 2531436 - protein, 22 aa, Entamoeba dispar
LEILTYLIVQCQPPMLYSNISF

SEQ ID NO: 2531437 - protein, 24 aa, Entamoeba dispar
LEINNYFILPFNSYQNKLLHFQNN

SEQ ID NO: 2531438 - protein, 27 aa, Entamoeba dispar
LEINSPLYCLTLLQLGLTSITIPSTII

SEQ ID NO: 2531439 - protein, 23 aa, Entamoeba dispar
LEIVYCYLNFCIAAQPDLLKTFK

SEQ ID NO: 2531440 - protein, 21 aa, Entamoeba dispar
LEIWIPVYVINNSIIPIMWNE

SEQ ID NO: 2531441 - protein, 22 aa, Entamoeba dispar
LEIYELVQPLYRKAYGNDGVHD

SEQ ID NO: 2531442 - protein, 24 aa, Entamoeba dispar
LEKAYDYFHKLPEPKIIQEGMSQQ

SEQ ID NO: 2531443 - protein, 24 aa, Entamoeba dispar
LEKGKNCFFEIVKSYRKMIRTIKQ

SEQ ID NO: 2531444 - protein, 22 aa, Entamoeba dispar
LEKHDLDVSVKFKPKKMRGSTS

SEQ ID NO: 2531445 - protein, 24 aa, Entamoeba dispar
LEKHDLDVSVKFKPKKMRGSTSLV

SEQ ID NO: 2531446 - protein, 17 aa, Entamoeba dispar
LEKIFKVFGYELPTDPK

SEQ ID NO: 2531447 - protein, 27 aa, Entamoeba dispar
LEKIGTPIYSFLCSYLLKTNTPQSKGL

SEQ ID NO: 2531448 - protein, 18 aa, Entamoeba dispar
LEKIGTPVYNFLCSYLLK

SEQ ID NO: 2531449 - protein, 28 aa, Entamoeba dispar
LEKIGTPVYNFLCSYLLKTNTPQSKGLF

SEQ ID NO: 2531450 - protein, 29 aa, Entamoeba dispar
LEKIGTPVYNFLCSYLLKTNTPQSKGLFV

SEQ ID NO: 2531451 - protein, 19 aa, Entamoeba dispar
LEKLFYHLISISHPTIQDI

SEQ ID NO: 2531452 - protein, 27 aa, Entamoeba dispar
LEKLRGVYAKWILSIAYKKLDNFSGDR

SEQ ID NO: 2531453 - protein, 23 aa, Entamoeba dispar
LEKNINFYIIKYFNNQYKEEIMK

SEQ ID NO: 2531454 - protein, 18 aa, Entamoeba dispar
LEKNRYIFNIPEGVQRCC

SEQ ID NO: 2531455 - protein, 29 aa, Entamoeba dispar
LEKQKFVDLIEICRLFCLGGASKEKTKEK

SEQ ID NO: 2531456 - protein, 24 aa, Entamoeba dispar
LEKRPTMINFVSQFSYFNDTEREC

SEQ ID NO: 2531457 - protein, 24 aa, Entamoeba dispar
LEKSYFVIEIKKFFISPISLLKKD

SEQ ID NO: 2531458 - protein, 17 aa, Entamoeba dispar
LEKTDILEWLKKQLKEI

SEQ ID NO: 2531459 - protein, 17 aa, Entamoeba dispar
LEKTGIVPYIKSGSHFI

SEQ ID NO: 2531460 - protein, 18 aa, Entamoeba dispar
LEKWFSIDQIILYDKSCL

SEQ ID NO: 2531461 - protein, 18 aa, Entamoeba dispar
LEKWNPIFDLNLFKEIKE

SEQ ID NO: 2531462 - protein, 17 aa, Entamoeba dispar
LEKYCFAGLPSLSSICI

SEQ ID NO: 2531463 - protein, 28 aa, Entamoeba dispar
LEKYKGKWFMYVYGVVDKLLTKVQSEPK

SEQ ID NO: 2531464 - protein, 26 aa, Entamoeba dispar
LELAWSQIQTFLIKVLNNRIFESEHS

SEQ ID NO: 2531465 - protein, 24 aa, Entamoeba dispar
LELMNFILNCMFLAGCDLFFQVPS

SEQ ID NO: 2531466 - protein, 17 aa, Entamoeba dispar
LELRLSIYGRSLDEWEK

SEQ ID NO: 2531467 - protein, 25 aa, Entamoeba dispar
LELSKKYFIPPPPNANLSDALKGVV

SEQ ID NO: 2531468 - protein, 28 aa, Entamoeba dispar
LELSSYQGIFVLLKNFCIYAKSNSKIIE

SEQ ID NO: 2531469 - protein, 27 aa, Entamoeba dispar
LEMEKKRMLIKLTLKDYIFARHDIGKG

SEQ ID NO: 2531470 - protein, 18 aa, Entamoeba dispar
LEMFVYLNNVDPVKYAPH

SEQ ID NO: 2531471 - protein, 17 aa, Entamoeba dispar
LEMIYPGNPIIDNVEEC

SEQ ID NO: 2531472 - protein, 20 aa, Entamoeba dispar
LEMKIHAFDYYRAEKKFKDL

SEQ ID NO: 2531473 - protein, 19 aa, Entamoeba dispar
LEMYKGIIPFKWLKEEENE

SEQ ID NO: 2531474 - protein, 18 aa, Entamoeba dispar
LEMYYCLCFMDYAVKRNS

SEQ ID NO: 2531475 - protein, 19 aa, Entamoeba dispar
LENAYHFKRYPITPTFITI

SEQ ID NO: 2531476 - protein, 31 aa, Entamoeba dispar
LENEKVVILLDFLVDICLNLGYFFETTRMRN

SEQ ID NO: 2531477 - protein, 29 aa, Entamoeba dispar
LENELSEHWFIIPDILKSDIRRITQRGEP

SEQ ID NO: 2531478 - protein, 18 aa, Entamoeba dispar
LENIGIALGVYSPSPDLL

SEQ ID NO: 2531479 - protein, 32 aa, Entamoeba dispar
LENNQITNLCPFGIFLQLRYLSLKNNRIEDLD

SEQ ID NO: 2531480 - protein, 19 aa, Entamoeba dispar
LENPSLEQLFPFLGDQDPS

SEQ ID NO: 2531481 - protein, 28 aa, Entamoeba dispar
LENQNTLWYIFSFLRRVLEQQNINKMNI

SEQ ID NO: 2531482 - protein, 27 aa, Entamoeba dispar
LENQQFQPIPFPPSNYKYDTKLLVLAL

SEQ ID NO: 2531483 - protein, 26 aa, Entamoeba dispar
LENRGWHYLIRRLIKQAHPQALVSNI

SEQ ID NO: 2531484 - protein, 29 aa, Entamoeba dispar
LENRLSIKILFLIIYQLIQENLLSKYQMQ

SEQ ID NO: 2531485 - protein, 24 aa, Entamoeba dispar
LENRSIKIPAQIRYLVLNQFVRHL

SEQ ID NO: 2531486 - protein, 19 aa, Entamoeba dispar
LENVGFKNFLKKVKPSLYT

SEQ ID NO: 2531487 - protein, 20 aa, Entamoeba dispar
LEPKFEGCILPRIPQVYYKP

SEQ ID NO: 2531488 - protein, 18 aa, Entamoeba dispar
LEPNIFMQYWNTIGNTTE

SEQ ID NO: 2531489 - protein, 32 aa, Entamoeba dispar
LEPVGKSYLLLMERLFRLLQMIDKNSGVNKMT

SEQ ID NO: 2531490 - protein, 20 aa, Entamoeba dispar
LEPYSFIILSDNSIPPCIES

SEQ ID NO: 2531491 - protein, 21 aa, Entamoeba dispar
LEQESLPPPLQLEQPIIDEEP

SEQ ID NO: 2531492 - protein, 18 aa, Entamoeba dispar
LEQILYYSSNEEIQRKGI

SEQ ID NO: 2531493 - protein, 19 aa, Entamoeba dispar
LEQIYRRYEIPLLTNNNVS

SEQ ID NO: 2531494 - protein, 26 aa, Entamoeba dispar
LEQKIEEEFLLFSGPLIVSDEDSLVA

SEQ ID NO: 2531495 - protein, 17 aa, Entamoeba dispar
LEQKKEIEFLKEGAKKE

SEQ ID NO: 2531496 - protein, 24 aa, Entamoeba dispar
LEQLKSRLYSKLSGEFPFNRSIEH

SEQ ID NO: 2531497 - protein, 33 aa, Entamoeba dispar
LEQQEYILILLEYFQIIFVLRKSFFERIGLADE

SEQ ID NO: 2531498 - protein, 23 aa, Entamoeba dispar
LEQQHDSFYKITCYLRSLHVIER

SEQ ID NO: 2531499 - protein, 29 aa, Entamoeba dispar
LERATNLLPMVYKLWFKYVRLEETVENFD

SEQ ID NO: 2531500 - protein, 22 aa, Entamoeba dispar
LERHTIPLEKWNPIFDLNLFKE

SEQ ID NO: 2531501 - protein, 17 aa, Entamoeba dispar
LERKAAVAAIRKQNIHF

SEQ ID NO: 2531502 - protein, 18 aa, Entamoeba dispar
LERLLKKMGLQIESDDIE

SEQ ID NO: 2531503 - protein, 19 aa, Entamoeba dispar
LERPKTRLRERKNIGMIDF

SEQ ID NO: 2531504 - protein, 29 aa, Entamoeba dispar
LERQESFETPLISTPPLNIPQDRRSYIPD

SEQ ID NO: 2531505 - protein, 18 aa, Entamoeba dispar
LERRFISLFMRKGNEDFF

SEQ ID NO: 2531506 - protein, 22 aa, Entamoeba dispar
LERTAELYLLLKENDKALELYK

SEQ ID NO: 2531507 - protein, 23 aa, Entamoeba dispar
LERYIKLINGYLADLRKHRRYNA

SEQ ID NO: 2531508 - protein, 19 aa, Entamoeba dispar
LESFMKIQLIDLSHDLPAS

SEQ ID NO: 2531509 - protein, 27 aa, Entamoeba dispar
LESFQQAVLIYLLSRAGVTVEIKKQKK

SEQ ID NO: 2531510 - protein, 24 aa, Entamoeba dispar
LESGLIYELFNYLDYPFNDQTTQQ

SEQ ID NO: 2531511 - protein, 22 aa, Entamoeba dispar
LESISLLGYLYHVQDCHGPHIV

SEQ ID NO: 2531512 - protein, 32 aa, Entamoeba dispar
LESKWFGEAEKFVKALFSLAAKLSPCVIFIDE

SEQ ID NO: 2531513 - protein, 18 aa, Entamoeba dispar
LESKYLYKISSLNELYLQ

SEQ ID NO: 2531514 - protein, 17 aa, Entamoeba dispar
LESLSVLKKLKALYLQS

SEQ ID NO: 2531515 - protein, 32 aa, Entamoeba dispar
LESMNYLIQIYAKKILFDPNLALSGFSIDDVN

SEQ ID NO: 2531516 - protein, 25 aa, Entamoeba dispar
LESPRVPIISIFLKDVISFKEMESF

SEQ ID NO: 2531517 - protein, 19 aa, Entamoeba dispar
LESRIQAKKRMLNDKLRSK

SEQ ID NO: 2531518 - protein, 20 aa, Entamoeba dispar
LESSQPLLSSFRRAYEESVI

SEQ ID NO: 2531519 - protein, 17 aa, Entamoeba dispar
LESYKQMLLKKNFHITR

SEQ ID NO: 2531520 - protein, 27 aa, Entamoeba dispar
LETGMDFKGIFRFSPYANLKEIEEGTR

SEQ ID NO: 2531521 - protein, 24 aa, Entamoeba dispar
LETKEKYMLVEYQGKLQELQEWCE

SEQ ID NO: 2531522 - protein, 20 aa, Entamoeba dispar
LETLLSFLDNEDSLDLMLND

SEQ ID NO: 2531523 - protein, 17 aa, Entamoeba dispar
LETLPYDLELSEPKQED

SEQ ID NO: 2531524 - protein, 23 aa, Entamoeba dispar
LETPKRNIYWIGVNALLVKRINT

SEQ ID NO: 2531525 - protein, 25 aa, Entamoeba dispar
LETPNIIKCFYYNCPLLSVEQFNTN

SEQ ID NO: 2531526 - protein, 23 aa, Entamoeba dispar
LETPQFYQIISLLNFHTSPSMFS

SEQ ID NO: 2531527 - protein, 20 aa, Entamoeba dispar
LEVAADLKYYAIPEAEKKNE

SEQ ID NO: 2531528 - protein, 19 aa, Entamoeba dispar
LEVAADLKYYAIPEAEKRM

SEQ ID NO: 2531529 - protein, 33 aa, Entamoeba dispar
LEYENDICILRKSIKWFIQLYGNLINSTTNLFI

SEQ ID NO: 2531530 - protein, 28 aa, Entamoeba dispar
LEYIDNPIIKYYLLKHFGVIDREKQIKI

SEQ ID NO: 2531531 - protein, 18 aa, Entamoeba dispar
LEYINIPTTINKIGYECF

SEQ ID NO: 2531532 - protein, 25 aa, Entamoeba dispar
LEYKIQLMKLWKLKIGIGSEDCVRD

SEQ ID NO: 2531533 - protein, 22 aa, Entamoeba dispar
LEYPSNIIIYRKANKTSLLKIK

SEQ ID NO: 2531534 - protein, 19 aa, Entamoeba dispar
LEYTPFGPRFDNTVLHLLL

SEQ ID NO: 2531535 - protein, 18 aa, Entamoeba dispar
LFADFEWFTNSDYHKPFC

SEQ ID NO: 2531536 - protein, 26 aa, Entamoeba dispar
LFAFCVALLSKYFRIEIGLPHTHSTK

SEQ ID NO: 2531537 - protein, 19 aa, Entamoeba dispar
LFCATIFREFKNPDGKYYT

SEQ ID NO: 2531538 - protein, 19 aa, Entamoeba dispar
LFCCEKHLSGTRIVIEIKF

SEQ ID NO: 2531539 - protein, 18 aa, Entamoeba dispar
LFCLQCAENFYFVSSNIC

SEQ ID NO: 2531540 - protein, 26 aa, Entamoeba dispar
LFCVCPTIVLSLFYENGFKTLRLQDD

SEQ ID NO: 2531541 - protein, 18 aa, Entamoeba dispar
LFDCFLKDMLLSIDKNYL

SEQ ID NO: 2531542 - protein, 17 aa, Entamoeba dispar
LFDFYNPVFSTGSIVSE

SEQ ID NO: 2531543 - protein, 18 aa, Entamoeba dispar
LFDIQWGMRSNTAAVREP

SEQ ID NO: 2531544 - protein, 31 aa, Entamoeba dispar
LFDKNGHMNPSPIPIAFFLDDMDDEDREVQR

SEQ ID NO: 2531545 - protein, 36 aa, Entamoeba dispar
LFDLKTNTLLPLCLPFKPLFFFNRENYLVLLNEKEI

SEQ ID NO: 2531546 - protein, 28 aa, Entamoeba dispar
LFDNILAGKFEFRSPFWDNKSLELKDLI

SEQ ID NO: 2531547 - protein, 31 aa, Entamoeba dispar
LFDPQYKIIIRDFFVGLFNPEAPIFKQTVRN

SEQ ID NO: 2531548 - protein, 18 aa, Entamoeba dispar
LFEEILKIAKKLRLLSIE

SEQ ID NO: 2531549 - protein, 17 aa, Entamoeba dispar
LFEIVHNESLLAIDISG

SEQ ID NO: 2531550 - protein, 17 aa, Entamoeba dispar
LFEKYKILRKEFLQKAQ

SEQ ID NO: 2531551 - protein, 17 aa, Entamoeba dispar
LFELPYKISNCEFIQRI

SEQ ID NO: 2531552 - protein, 19 aa, Entamoeba dispar
LFEQSVRGLMNCWSTLRLC

SEQ ID NO: 2531553 - protein, 19 aa, Entamoeba dispar
LFESIKKLYTKLFEIIKKD

SEQ ID NO: 2531554 - protein, 18 aa, Entamoeba dispar
LFESYKKLHPSISLLFDC

SEQ ID NO: 2531555 - protein, 20 aa, Entamoeba dispar
LFETPLYFIADNNTSLPFSE

SEQ ID NO: 2531556 - protein, 18 aa, Entamoeba dispar
LFETRNFLQRIYEIVENI

SEQ ID NO: 2531557 - protein, 18 aa, Entamoeba dispar
LFFEIDLSPLLEQSDQKQ

SEQ ID NO: 2531558 - protein, 18 aa, Entamoeba dispar
LFFEYNKVFFELMSTTFI

SEQ ID NO: 2531559 - protein, 17 aa, Entamoeba dispar
LFFGMLLKRTLCDCGNY

SEQ ID NO: 2531560 - protein, 21 aa, Entamoeba dispar
LFFQNFLKNVLELLTKSTISL

SEQ ID NO: 2531561 - protein, 21 aa, Entamoeba dispar
LFFSIKSIPTEYNQLLLSILE

SEQ ID NO: 2531562 - protein, 20 aa, Entamoeba dispar
LFFYGLSNWSDIGTVISEFN

SEQ ID NO: 2531563 - protein, 19 aa, Entamoeba dispar
LFGDIVLNGLLLPSSVKYL

SEQ ID NO: 2531564 - protein, 20 aa, Entamoeba dispar
LFGELLTYFMKWLSSSRLHS

SEQ ID NO: 2531565 - protein, 20 aa, Entamoeba dispar
LFHFFSKKEISYEDKFILFK

SEQ ID NO: 2531566 - protein, 17 aa, Entamoeba dispar
LFHFTPVLSKERCRTDT

SEQ ID NO: 2531567 - protein, 25 aa, Entamoeba dispar
LFHIDFGHFLGNIIKLGFYNKESAP

SEQ ID NO: 2531568 - protein, 17 aa, Entamoeba dispar
LFHRLSVSDISSFPWET

SEQ ID NO: 2531569 - protein, 22 aa, Entamoeba dispar
LFHSSFPIFYDLAFCKLRRTLY

SEQ ID NO: 2531570 - protein, 25 aa, Entamoeba dispar
LFIGKSLFFQTIALKLYSSASLNDG

SEQ ID NO: 2531571 - protein, 17 aa, Entamoeba dispar
LFIKEMMKKFKEQYLPN

SEQ ID NO: 2531572 - protein, 25 aa, Entamoeba dispar
LFIKPSHLQIKLYKIMLKELDKKKL

SEQ ID NO: 2531573 - protein, 20 aa, Entamoeba dispar
LFKILIIGESGVGKTAIMQR

SEQ ID NO: 2531574 - protein, 19 aa, Entamoeba dispar
LFKILIVGDSGVGKTAILQ

SEQ ID NO: 2531575 - protein, 25 aa, Entamoeba dispar
LFKKQNLLLLLLSNHYLNTLLTIIL

SEQ ID NO: 2531576 - protein, 17 aa, Entamoeba dispar
LFKLFNKALNNPIKTTL

SEQ ID NO: 2531577 - protein, 17 aa, Entamoeba dispar
LFKLQYFNEPAYLTQSS

SEQ ID NO: 2531578 - protein, 18 aa, Entamoeba dispar
LFKNLNFALNMESRIALV

SEQ ID NO: 2531579 - protein, 17 aa, Entamoeba dispar
LFKPTWKISCELIVKTI

SEQ ID NO: 2531580 - protein, 17 aa, Entamoeba dispar
LFLFNNPITNVFTSYSN

SEQ ID NO: 2531581 - protein, 18 aa, Entamoeba dispar
LFLHPDVADFSDYKLEWN

SEQ ID NO: 2531582 - protein, 19 aa, Entamoeba dispar
LFLHQLHNILNYGPEIIVC

SEQ ID NO: 2531583 - protein, 17 aa, Entamoeba dispar
LFLPLQMSVELSLESFF

SEQ ID NO: 2531584 - protein, 25 aa, Entamoeba dispar
LFLRNVLFYLPNLYEIMKFESVSKS

SEQ ID NO: 2531585 - protein, 19 aa, Entamoeba dispar
LFLVNTNPTLSLQSLCIHQ

SEQ ID NO: 2531586 - protein, 17 aa, Entamoeba dispar
LFLYGTHYSTPAYVVFF

SEQ ID NO: 2531587 - protein, 17 aa, Entamoeba dispar
LFNEMFGGMGGIPKGGR

SEQ ID NO: 2531588 - protein, 26 aa, Entamoeba dispar
LFNEMSEWLWGIYNKNFLKCGKIGNN

SEQ ID NO: 2531589 - protein, 18 aa, Entamoeba dispar
LFNILCDLAMEKKSSYIE

SEQ ID NO: 2531590 - protein, 20 aa, Entamoeba dispar
LFNKLVYKFKNDVGLIVCFL

SEQ ID NO: 2531591 - protein, 18 aa, Entamoeba dispar
LFNLCFVFDEGTTDGTIS

SEQ ID NO: 2531592 - protein, 33 aa, Entamoeba dispar
LFNNDGYFSIFFYVFALKYIPKFFQSAIHLIYD

SEQ ID NO: 2531593 - protein, 22 aa, Entamoeba dispar
LFNNIYSMRTFTKCGGFTGVYE

SEQ ID NO: 2531594 - protein, 18 aa, Entamoeba dispar
LFNNYIFCNTTQSIIKVS

SEQ ID NO: 2531595 - protein, 30 aa, Entamoeba dispar
LFPEKQHLMLLFSDIVLFIPATKPSKIIED

SEQ ID NO: 2531596 - protein, 17 aa, Entamoeba dispar
LFPFVVFHSSPLIPFNS

SEQ ID NO: 2531597 - protein, 17 aa, Entamoeba dispar
LFPKVTPLLPITSKKIK

SEQ ID NO: 2531598 - protein, 18 aa, Entamoeba dispar
LFPLKITAYYFVDNIDIR

SEQ ID NO: 2531599 - protein, 33 aa, Entamoeba dispar
LFPWREEMEEIQLIRKWLKCASGNKYRMGNLFI

SEQ ID NO: 2531600 - protein, 19 aa, Entamoeba dispar
LFQAIFSSTQLINKLLFDC

SEQ ID NO: 2531601 - protein, 17 aa, Entamoeba dispar
LFQFFKSKKDSETEQNL

SEQ ID NO: 2531602 - protein, 19 aa, Entamoeba dispar
LFQFFKSKKDSETEQNLVV

SEQ ID NO: 2531603 - protein, 17 aa, Entamoeba dispar
LFQGDLYIASPVNLKVL

SEQ ID NO: 2531604 - protein, 20 aa, Entamoeba dispar
LFQIRDIFILPIQEYSTIYG

SEQ ID NO: 2531605 - protein, 56 aa, Entamoeba dispar
LFQQSLNELYLYILDDYYIQLWQLLIIPKLLLEPNLFKFLYFNKKNYCSKLRYSVL

SEQ ID NO: 2531606 - protein, 20 aa, Entamoeba dispar
LFQRHIVALGMLLLSKWFKL

SEQ ID NO: 2531607 - protein, 17 aa, Entamoeba dispar
LFQYVGHPFSLKTVLMI

SEQ ID NO: 2531608 - protein, 17 aa, Entamoeba dispar
LFRATFFPTWEGLFWEK

SEQ ID NO: 2531609 - protein, 28 aa, Entamoeba dispar
LFRDVVRHWYQLEKSFIYPCVNIKRKDF

SEQ ID NO: 2531610 - protein, 32 aa, Entamoeba dispar
LFRGNTPFIRFYNFYLFFYCNEYLTKTTSAII

SEQ ID NO: 2531611 - protein, 31 aa, Entamoeba dispar
LFRGNTPFIRLYSYYLFFYCSDFMNKTTSEV

SEQ ID NO: 2531612 - protein, 34 aa, Entamoeba dispar
LFRNYDSLKRYDAFVLNMVLFNLHKRQQVSLELL

SEQ ID NO: 2531613 - protein, 18 aa, Entamoeba dispar
LFSFMPNEAPCAGVAEVL

SEQ ID NO: 2531614 - protein, 17 aa, Entamoeba dispar
LFSLFRSNDEDLMKGVN

SEQ ID NO: 2531615 - protein, 18 aa, Entamoeba dispar
LFSLLFGSHSKPSSPVIC

SEQ ID NO: 2531616 - protein, 17 aa, Entamoeba dispar
LFSSLKKISFASNKLRE

SEQ ID NO: 2531617 - protein, 19 aa, Entamoeba dispar
LFTIELLELIKKTPTIIFF

SEQ ID NO: 2531618 - protein, 17 aa, Entamoeba dispar
LFTLGGDGTLRGANRIN

SEQ ID NO: 2531619 - protein, 30 aa, Entamoeba dispar
LFTSFPDGFYLYFYKRFPGLLILVYNIVKK

SEQ ID NO: 2531620 - protein, 24 aa, Entamoeba dispar
LFVATEFCLYQFTVPLNYGKEDEP

SEQ ID NO: 2531621 - protein, 18 aa, Entamoeba dispar
LFVIESIWKEGINCFDID

SEQ ID NO: 2531622 - protein, 17 aa, Entamoeba dispar
LFVIRKNFWSYNCFTVY

SEQ ID NO: 2531623 - protein, 18 aa, Entamoeba dispar
LFVNKLDYFIKITDFGLS

SEQ ID NO: 2531624 - protein, 20 aa, Entamoeba dispar
LFYELDLHDIEMVKKVFGEI

SEQ ID NO: 2531625 - protein, 24 aa, Entamoeba dispar
LFYGCSNLTLIDFGYGWNTIKEGT

SEQ ID NO: 2531626 - protein, 17 aa, Entamoeba dispar
LFYLTPSTKKRASNELR

SEQ ID NO: 2531627 - protein, 27 aa, Entamoeba dispar
LFYSPNVPLRQLLFTALRSVIPYACDV

SEQ ID NO: 2531628 - protein, 17 aa, Entamoeba dispar
LFYYCISLKSIEIPSKI

SEQ ID NO: 2531629 - protein, 26 aa, Entamoeba dispar
LGALRTTAPYTLYFAAGTNAASGKKN

SEQ ID NO: 2531630 - protein, 25 aa, Entamoeba dispar
LGAQPGLGGLPPIGGLGGLPPVGGL

SEQ ID NO: 2531631 - protein, 17 aa, Entamoeba dispar
LGARRKVEPQTTPKPED

SEQ ID NO: 2531632 - protein, 22 aa, Entamoeba dispar
LGATFVPLLSQMEKVRLLTVVS

SEQ ID NO: 2531633 - protein, 19 aa, Entamoeba dispar
LGCALDLLKRIDIDFKLNG

SEQ ID NO: 2531634 - protein, 22 aa, Entamoeba dispar
LGCDCFSYCLLLKSINIPSSIN

SEQ ID NO: 2531635 - protein, 17 aa, Entamoeba dispar
LGCDGLWDTLNGIQIKE

SEQ ID NO: 2531636 - protein, 25 aa, Entamoeba dispar
LGDAKWKIEPLFNNQWKKFKLQIDK

SEQ ID NO: 2531637 - protein, 25 aa, Entamoeba dispar
LGDAKWKVEQLLNNQWKKLELEINK

SEQ ID NO: 2531638 - protein, 41 aa, Entamoeba dispar
LGDAMQLKIDSINRQYLDLKSKYDQLKSDNLMVLSEKEDIE

SEQ ID NO: 2531639 - protein, 18 aa, Entamoeba dispar
LGDFYFKGKELYPNGYNR

SEQ ID NO: 2531640 - protein, 17 aa, Entamoeba dispar
LGDLFRILPNSSTIEYF

SEQ ID NO: 2531641 - protein, 39 aa, Entamoeba dispar
LGDRTFQNIPLIQLYIQKYILVNLKYQTIIPFDKLPLKE

SEQ ID NO: 2531642 - protein, 18 aa, Entamoeba dispar
LGDYCFFGCCSLTSISIP

SEQ ID NO: 2531643 - protein, 30 aa, Entamoeba dispar
LGEAFSQFIPMMNVYKLFLGNSDTSLQFLV

SEQ ID NO: 2531644 - protein, 20 aa, Entamoeba dispar
LGEIINGKPLFPGSSTLNQL

SEQ ID NO: 2531645 - protein, 19 aa, Entamoeba dispar
LGEPSFYYNFFDVSHGILS

SEQ ID NO: 2531646 - protein, 18 aa, Entamoeba dispar
LGEVCQMLNWTSFSFDEY

SEQ ID NO: 2531647 - protein, 18 aa, Entamoeba dispar
LGFALKDYIATIKQIHVV

SEQ ID NO: 2531648 - protein, 19 aa, Entamoeba dispar
LGFILNKRLDELCKIILLI

SEQ ID NO: 2531649 - protein, 19 aa, Entamoeba dispar
LGFKENLPILATHLSLRVN

SEQ ID NO: 2531650 - protein, 19 aa, Entamoeba dispar
LGFMFHPLQINIGNPDLHA

SEQ ID NO: 2531651 - protein, 24 aa, Entamoeba dispar
LGFNDIAFEIMKLQNFNYATPDLN

SEQ ID NO: 2531652 - protein, 29 aa, Entamoeba dispar
LGGFEFYKRLYKYWNWSLESIPINGVTED

SEQ ID NO: 2531653 - protein, 27 aa, Entamoeba dispar
LGGITPWYLEYICSFLIKIILEEKKEN

SEQ ID NO: 2531654 - protein, 17 aa, Entamoeba dispar
LGIETAGGIMTALIGRN

SEQ ID NO: 2531655 - protein, 20 aa, Entamoeba dispar
LGINIVPIFDTLVSQNQLEV

SEQ ID NO: 2531656 - protein, 29 aa, Entamoeba dispar
LGIVPFGFDVFLDFGVKLDLGLTGTAIVE

SEQ ID NO: 2531657 - protein, 25 aa, Entamoeba dispar
LGKEITLIELAQLKPPTFNSEQKDE

SEQ ID NO: 2531658 - protein, 22 aa, Entamoeba dispar
LGKGIILLDDAGLLEDEKHEIV

SEQ ID NO: 2531659 - protein, 19 aa, Entamoeba dispar
LGKPIVIKDGAWLGAGVIV

SEQ ID NO: 2531660 - protein, 17 aa, Entamoeba dispar
LGKTLQALALVSAYPEN

SEQ ID NO: 2531661 - protein, 28 aa, Entamoeba dispar
LGKTLQTITLIWTVYKQCNIKKIVIVCP

SEQ ID NO: 2531662 - protein, 33 aa, Entamoeba dispar
LGLENQIEVWPRIVKIYHYIGNESDILLDGTFE

SEQ ID NO: 2531663 - protein, 26 aa, Entamoeba dispar
LGLGTKQYYYIKGKNLILFNEKKGES

SEQ ID NO: 2531664 - protein, 27 aa, Entamoeba dispar
LGLGTKQYYYIKGKNLILFNEKKGESI

SEQ ID NO: 2531665 - protein, 32 aa, Entamoeba dispar
LGLIVSARIQLPLTYAWGLSIHKSQGLTLPAA

SEQ ID NO: 2531666 - protein, 18 aa, Entamoeba dispar
LGLMRKELNKYKTLLLYP

SEQ ID NO: 2531667 - protein, 26 aa, Entamoeba dispar
LGLVKIAFIDCKYLRLLDGMADLTTL

SEQ ID NO: 2531668 - protein, 17 aa, Entamoeba dispar
LGMAAAIERYKVVASSV

SEQ ID NO: 2531669 - protein, 22 aa, Entamoeba dispar
LGMCLPFIENLAHQLKCNVVGY

SEQ ID NO: 2531670 - protein, 26 aa, Entamoeba dispar
LGMSLIDIELPLTLFSELWEVFMNQN

SEQ ID NO: 2531671 - protein, 23 aa, Entamoeba dispar
LGNDLPLIIFLSTKVEYREYAIN

SEQ ID NO: 2531672 - protein, 24 aa, Entamoeba dispar
LGNKCFALCWMLTSITIPTSVIKI

SEQ ID NO: 2531673 - protein, 18 aa, Entamoeba dispar
LGNKPWKELSVEQKQKFL

SEQ ID NO: 2531674 - protein, 17 aa, Entamoeba dispar
LGNKTFLWNERFPEVPE

SEQ ID NO: 2531675 - protein, 29 aa, Entamoeba dispar
LGNRCFSRCYSLISLHLPTTITSFGEHCF

SEQ ID NO: 2531676 - protein, 27 aa, Entamoeba dispar
LGNWCFSRCYSLISLHLPTTITSFGEH

SEQ ID NO: 2531677 - protein, 31 aa, Entamoeba dispar
LGNYAIKVPGRIWPLMINPTTVIISSYDTID

SEQ ID NO: 2531678 - protein, 22 aa, Entamoeba dispar
LGQITFKHFIILFNQDKTKKSA

SEQ ID NO: 2531679 - protein, 18 aa, Entamoeba dispar
LGQSLLQFTPSDLVKFQL

SEQ ID NO: 2531680 - protein, 17 aa, Entamoeba dispar
LGQSSMHWAAHSGYPNT

SEQ ID NO: 2531681 - protein, 25 aa, Entamoeba dispar
LGQTTLLLKVRCTCVPEGQCVFVGG

SEQ ID NO: 2531682 - protein, 22 aa, Entamoeba dispar
LGRIQQRLFVGKSKKGFGYITD

SEQ ID NO: 2531683 - protein, 22 aa, Entamoeba dispar
LGRPIHPLIYQILISSCKSKLP

SEQ ID NO: 2531684 - protein, 24 aa, Entamoeba dispar
LGRREIGFLAALLYSVTRETNPKK

SEQ ID NO: 2531685 - protein, 26 aa, Entamoeba dispar
LGSAELKLLLKWRDIIVKKIKKEQEE

SEQ ID NO: 2531686 - protein, 18 aa, Entamoeba dispar
LGSFHKKTPIRIKECIMQ

SEQ ID NO: 2531687 - protein, 26 aa, Entamoeba dispar
LGSMITMKIMEYLGGLFYGVKVEKER

SEQ ID NO: 2531688 - protein, 17 aa, Entamoeba dispar
LGSPYPVLLLTHKEKDS

SEQ ID NO: 2531689 - protein, 18 aa, Entamoeba dispar
LGSQLYLFEGCLLVFSNQ

SEQ ID NO: 2531690 - protein, 22 aa, Entamoeba dispar
LGTACGRYFSVSVLSIIDGGDS

SEQ ID NO: 2531691 - protein, 18 aa, Entamoeba dispar
LGTTFSCMAVWKENSKRV

SEQ ID NO: 2531692 - protein, 24 aa, Entamoeba dispar
LGTTKYCSHFLRGKQCINPDCTYL

SEQ ID NO: 2531693 - protein, 24 aa, Entamoeba dispar
LGVERLVMWLLGEDHIRKVCLYPR

SEQ ID NO: 2531694 - protein, 19 aa, Entamoeba dispar
LGVLKLLLSIPDNFDIIVD

SEQ ID NO: 2531695 - protein, 27 aa, Entamoeba dispar
LGVQWEEFISLFKYSTPEDLFDLLIQS

SEQ ID NO: 2531696 - protein, 18 aa, Entamoeba dispar
LGVRLPHDSFSLNVIRDK

SEQ ID NO: 2531697 - protein, 17 aa, Entamoeba dispar
LGWMAPLYKEYPGGEEV

SEQ ID NO: 2531698 - protein, 20 aa, Entamoeba dispar
LGYQCFKYCYGLTTINIPSS

SEQ ID NO: 2531699 - protein, 17 aa, Entamoeba dispar
LGYWCFYKCVSLTTINI

SEQ ID NO: 2531700 - protein, 27 aa, Entamoeba dispar
LHCEQFNFYQFKYLSSLTLSCCELYSV

SEQ ID NO: 2531701 - protein, 32 aa, Entamoeba dispar
LHCIDEFMYSIPFFFHLKKLKIGYSSYFNFNK

SEQ ID NO: 2531702 - protein, 20 aa, Entamoeba dispar
LHDALCVLHIIRKDTKMICG

SEQ ID NO: 2531703 - protein, 26 aa, Entamoeba dispar
LHDDQVSFVLLALRLELQGIPDQVRL

SEQ ID NO: 2531704 - protein, 38 aa, Entamoeba dispar
LHDGIARPTFVQLLLKVNPAMYLYPLQTKPIGDCTSVI

SEQ ID NO: 2531705 - protein, 17 aa, Entamoeba dispar
LHDIFSLRLPGCTRMIV

SEQ ID NO: 2531706 - protein, 26 aa, Entamoeba dispar
LHDNCGIVYYKMGIISYMNFERIEGI

SEQ ID NO: 2531707 - protein, 33 aa, Entamoeba dispar
LHDYAVEQLPIPLRHARLFTYQLCRGLSYIHSK

SEQ ID NO: 2531708 - protein, 22 aa, Entamoeba dispar
LHEECLYCCYLYDILSKTNKEY

SEQ ID NO: 2531709 - protein, 39 aa, Entamoeba dispar
LHELDKCGFIGLYYNQLHQWTGLTAPRVIYSCSNFRRIE

SEQ ID NO: 2531710 - protein, 18 aa, Entamoeba dispar
LHFFTIDSSWKEIDLGIC

SEQ ID NO: 2531711 - protein, 23 aa, Entamoeba dispar
LHFGKFYDFFDHIARLIPSMKRP

SEQ ID NO: 2531712 - protein, 20 aa, Entamoeba dispar
LHFIGYSKLIILVYRIITED

SEQ ID NO: 2531713 - protein, 19 aa, Entamoeba dispar
LHFLQFLLQQNLEIEDICQ

SEQ ID NO: 2531714 - protein, 18 aa, Entamoeba dispar
LHFTITEPIVFQQNDFNE

SEQ ID NO: 2531715 - protein, 17 aa, Entamoeba dispar
LHFYLQDALNNINFIAI

SEQ ID NO: 2531716 - protein, 20 aa, Entamoeba dispar
LHGIKITDDFRYIIINEDNL

SEQ ID NO: 2531717 - protein, 25 aa, Entamoeba dispar
LHGNDFFWVHGYNKGVPKDVDLLKI

SEQ ID NO: 2531718 - protein, 19 aa, Entamoeba dispar
LHGPPGCGKTLLAKAIAGE

SEQ ID NO: 2531719 - protein, 19 aa, Entamoeba dispar
LHGQFYDMLTIFDVRPPEN

SEQ ID NO: 2531720 - protein, 25 aa, Entamoeba dispar
LHILLRWQDLMVISLLLLKMEQRFH

SEQ ID NO: 2531721 - protein, 18 aa, Entamoeba dispar
LHIQDSFFFLLQKSLEES

SEQ ID NO: 2531722 - protein, 20 aa, Entamoeba dispar
LHIQIPLYELGSNDVINFAS

SEQ ID NO: 2531723 - protein, 19 aa, Entamoeba dispar
LHIWKALNPSFKTQIATII

SEQ ID NO: 2531724 - protein, 17 aa, Entamoeba dispar
LHLIIYDIYRVELHKVI

SEQ ID NO: 2531725 - protein, 25 aa, Entamoeba dispar
LHNANIIHLDIKPANILISDDCEIK

SEQ ID NO: 2531726 - protein, 18 aa, Entamoeba dispar
LHNLVYPSPILSFDMNKD

SEQ ID NO: 2531727 - protein, 30 aa, Entamoeba dispar
LHNVFKEHFMYPILIIRISRIIDNCLWPKL

SEQ ID NO: 2531728 - protein, 17 aa, Entamoeba dispar
LHPTGMFLANCIVLGDT

SEQ ID NO: 2531729 - protein, 19 aa, Entamoeba dispar
LHQIIKYLDTVDIKQMGVQ

SEQ ID NO: 2531730 - protein, 19 aa, Entamoeba dispar
LHQQPIKYPTPLKRKAITP

SEQ ID NO: 2531731 - protein, 20 aa, Entamoeba dispar
LHQQSIQLPIFLLNKMNSVI

SEQ ID NO: 2531732 - protein, 26 aa, Entamoeba dispar
LHRDLKLANFLLKRSKEYPFPIVKLC

SEQ ID NO: 2531733 - protein, 20 aa, Entamoeba dispar
LHRDLKLDNFLLKTPTQISQ

SEQ ID NO: 2531734 - protein, 18 aa, Entamoeba dispar
LHRELIPKGIEALKELLL

SEQ ID NO: 2531735 - protein, 17 aa, Entamoeba dispar
LHSFIGLIGNEFIPIPS

SEQ ID NO: 2531736 - protein, 18 aa, Entamoeba dispar
LHSIKIIHHDIKAGNILL

SEQ ID NO: 2531737 - protein, 17 aa, Entamoeba dispar
LHSLNTLKENRFAVGID

SEQ ID NO: 2531738 - protein, 29 aa, Entamoeba dispar
LHSSFFTSYPFPFFPWQMVKFQSTLETHI

SEQ ID NO: 2531739 - protein, 22 aa, Entamoeba dispar
LHVPKECYFYLTGHFQFEVLQG

SEQ ID NO: 2531740 - protein, 18 aa, Entamoeba dispar
LHVVKGLSVIRFVAGEKI

SEQ ID NO: 2531741 - protein, 18 aa, Entamoeba dispar
LHVYLSFLTTTFNDFRSF

SEQ ID NO: 2531742 - protein, 20 aa, Entamoeba dispar
LHYRILGFYAIPHENELIMI

SEQ ID NO: 2531743 - protein, 18 aa, Entamoeba dispar
LIAFKEFLSYERIGDTLY

SEQ ID NO: 2531744 - protein, 24 aa, Entamoeba dispar
LIAMDYFFSTLPHSLPSPTLMKEI

SEQ ID NO: 2531745 - protein, 20 aa, Entamoeba dispar
LIANLFELGLVNERLPLTCL

SEQ ID NO: 2531746 - protein, 18 aa, Entamoeba dispar
LIAPGIRAFIPEALKVIK

SEQ ID NO: 2531747 - protein, 22 aa, Entamoeba dispar
LICGKKFITQKWFSAIQDIEHS

SEQ ID NO: 2531748 - protein, 18 aa, Entamoeba dispar
LICLPSIIKNIHLIEIDI

SEQ ID NO: 2531749 - protein, 20 aa, Entamoeba dispar
LICPQFCLRFNDLDNIGISG

SEQ ID NO: 2531750 - protein, 20 aa, Entamoeba dispar
LIDARPLLPTLKFSEGVSEW

SEQ ID NO: 2531751 - protein, 17 aa, Entamoeba dispar
LIDCRFPYEFAGGRIHG

SEQ ID NO: 2531752 - protein, 19 aa, Entamoeba dispar
LIDIFLVEGGYERIFEEYP

SEQ ID NO: 2531753 - protein, 19 aa, Entamoeba dispar
LIDKLLLYQAIKHVEITYK

SEQ ID NO: 2531754 - protein, 18 aa, Entamoeba dispar
LIDKSPLIIYGTSKLTQI

SEQ ID NO: 2531755 - protein, 19 aa, Entamoeba dispar
LIDLIPEELVWDFPTELEN

SEQ ID NO: 2531756 - protein, 18 aa, Entamoeba dispar
LIDLLGIQLLDSLKNLLS

SEQ ID NO: 2531757 - protein, 17 aa, Entamoeba dispar
LIDLLKEKTIHLIGTTT

SEQ ID NO: 2531758 - protein, 20 aa, Entamoeba dispar
LIDLVWSNDGFFKDQQFLVL

SEQ ID NO: 2531759 - protein, 20 aa, Entamoeba dispar
LIDNLKKMRKMELPFTLIVD

SEQ ID NO: 2531760 - protein, 20 aa, Entamoeba dispar
LIDSLPYNFANQIKMILLNE

SEQ ID NO: 2531761 - protein, 23 aa, Entamoeba dispar
LIEFAFYVIFHEGPAFSSAALSF

SEQ ID NO: 2531762 - protein, 18 aa, Entamoeba dispar
LIEFLKVTVIDKLSELDV

SEQ ID NO: 2531763 - protein, 26 aa, Entamoeba dispar
LIEIEGHIYSLYAIFDGHGGRTAAQH

SEQ ID NO: 2531764 - protein, 25 aa, Entamoeba dispar
LIEIKLSFILLTLKNLNIKKVPKTY

SEQ ID NO: 2531765 - protein, 24 aa, Entamoeba dispar
LIEKEWVLMGYPFAQYIGIDNDYF

SEQ ID NO: 2531766 - protein, 18 aa, Entamoeba dispar
LIEKIKEKYQIKSLLIIK

SEQ ID NO: 2531767 - protein, 27 aa, Entamoeba dispar
LIEKQLPIYFEFLINPNGPPTYSNEIF

SEQ ID NO: 2531768 - protein, 17 aa, Entamoeba dispar
LIELMFDGRTRKQIKAK

SEQ ID NO: 2531769 - protein, 18 aa, Entamoeba dispar
LIELPIELNNPVDPLIYM

SEQ ID NO: 2531770 - protein, 18 aa, Entamoeba dispar
LIELVLPQTVNTLGNCCC

SEQ ID NO: 2531771 - protein, 35 aa, Entamoeba dispar
LIELVTHPFNFPGLILHDIILRFIPEQNEFFLTKG

SEQ ID NO: 2531772 - protein, 23 aa, Entamoeba dispar
LIENFTILRPFGTEMWDIEMINF

SEQ ID NO: 2531773 - protein, 23 aa, Entamoeba dispar
LIENGVFLVEPLLHGEFIKFNCN

SEQ ID NO: 2531774 - protein, 28 aa, Entamoeba dispar
LIEPLSWPHPIVTLLPRCYSELVDLPTP

SEQ ID NO: 2531775 - protein, 26 aa, Entamoeba dispar
LIEQLEIEKNIIFNILVDHTNIDTIA

SEQ ID NO: 2531776 - protein, 25 aa, Entamoeba dispar
LIERYEVPLPSHKWDQPLFNIQPGE

SEQ ID NO: 2531777 - protein, 17 aa, Entamoeba dispar
LIESGILTKYGITKATF

SEQ ID NO: 2531778 - protein, 18 aa, Entamoeba dispar
LIESVSYLLLHGLMCPLL

SEQ ID NO: 2531779 - protein, 27 aa, Entamoeba dispar
LIETKKNFAMLLKSLIKANPKPSEIQF

SEQ ID NO: 2531780 - protein, 17 aa, Entamoeba dispar
LIETLKALGANLRWASC

SEQ ID NO: 2531781 - protein, 26 aa, Entamoeba dispar
LIETTLNHIPPMTKKFFISSQKVNFK

SEQ ID NO: 2531782 - protein, 18 aa, Entamoeba dispar
LIEVPLDITIKEVSDILD

SEQ ID NO: 2531783 - protein, 26 aa, Entamoeba dispar
LIEYPYQQYQIGYPEKKPKAPSIDGS

SEQ ID NO: 2531784 - protein, 24 aa, Entamoeba dispar
LIFPELEAPFFKQGLYEMFAGCLD

SEQ ID NO: 2531785 - protein, 21 aa, Entamoeba dispar
LIFREYELVFILRGHNDSVTD

SEQ ID NO: 2531786 - protein, 19 aa, Entamoeba dispar
LIFSGIELIRRLHSGILRK

SEQ ID NO: 2531787 - protein, 25 aa, Entamoeba dispar
LIFVKQAIYLYSSISRLCLLFKKEY

SEQ ID NO: 2531788 - protein, 21 aa, Entamoeba dispar
LIGARLICHTGSLINLAKAPG

SEQ ID NO: 2531789 - protein, 18 aa, Entamoeba dispar
LIGCIQYPMKLVCSKEYI

SEQ ID NO: 2531790 - protein, 26 aa, Entamoeba dispar
LIGIIGMISIFHLYSKFQIQQGELIR

SEQ ID NO: 2531791 - protein, 24 aa, Entamoeba dispar
LIGKGQYEIILSGSFFLNDNIVQL

SEQ ID NO: 2531792 - protein, 22 aa, Entamoeba dispar
LIGLGCGCLCNLLLDSPLILKY

SEQ ID NO: 2531793 - protein, 24 aa, Entamoeba dispar
LIGLPLPLFQLLPNDFETDFAAII

SEQ ID NO: 2531794 - protein, 28 aa, Entamoeba dispar
LIGMKELPFVILRPAIIYGPGDVTGIAP

SEQ ID NO: 2531795 - protein, 30 aa, Entamoeba dispar
LIGRTFGPDILLRFLYENNLKFIVRSHEVK

SEQ ID NO: 2531796 - protein, 20 aa, Entamoeba dispar
LIHFKKIRYYYRFISDEMCN

SEQ ID NO: 2531797 - protein, 17 aa, Entamoeba dispar
LIHIFIGSEINPTDCKF

SEQ ID NO: 2531798 - protein, 19 aa, Entamoeba dispar
LIIDYSIAELYGKLRDNRV

SEQ ID NO: 2531799 - protein, 17 aa, Entamoeba dispar
LIIKIPNLIESKEKYQI

SEQ ID NO: 2531800 - protein, 17 aa, Entamoeba dispar
LIILKECGIFLKNKQRY

SEQ ID NO: 2531801 - protein, 26 aa, Entamoeba dispar
LIIQKFLFENPLDLSILLLPSISFIC

SEQ ID NO: 2531802 - protein, 17 aa, Entamoeba dispar
LIIQLIQLIIYSSYHSI

SEQ ID NO: 2531803 - protein, 22 aa, Entamoeba dispar
LIISFFCNILNTPNEVLLEYET

SEQ ID NO: 2531804 - protein, 25 aa, Entamoeba dispar
LIISKGYFDFLIDITIMQPEKMIDS

SEQ ID NO: 2531805 - protein, 20 aa, Entamoeba dispar
LIITNDYFGFYLKYKNNLTI

SEQ ID NO: 2531806 - protein, 26 aa, Entamoeba dispar
LIIYRIVIQLLQLYIEQIKIYLYECQ

SEQ ID NO: 2531807 - protein, 17 aa, Entamoeba dispar
LIKAGFTNSLTINHCNN

SEQ ID NO: 2531808 - protein, 27 aa, Entamoeba dispar
LIKIEEYNNLIYKKAKEFSLTKEKTPK

SEQ ID NO: 2531809 - protein, 18 aa, Entamoeba dispar
LIKIIKQRSLKINEVVQS

SEQ ID NO: 2531810 - protein, 26 aa, Entamoeba dispar
LIKKTPTIIFFIYQFIHQNLIEYLPS

SEQ ID NO: 2531811 - protein, 17 aa, Entamoeba dispar
LIKLIEHVIRYSFKKDS

SEQ ID NO: 2531812 - protein, 19 aa, Entamoeba dispar
LIKNVYFIDEPFSTQNDLL

SEQ ID NO: 2531813 - protein, 24 aa, Entamoeba dispar
LIKQSWMFHLFKRNKSDLPNDPKT

SEQ ID NO: 2531814 - protein, 31 aa, Entamoeba dispar
LIKSGNCTAFIRGLPLKWGDIEFSKYFKKYH

SEQ ID NO: 2531815 - protein, 19 aa, Entamoeba dispar
LIKSIDFPPFLKELHTSCF

SEQ ID NO: 2531816 - protein, 18 aa, Entamoeba dispar
LIKSMVLNFLYLEQQTHR

SEQ ID NO: 2531817 - protein, 19 aa, Entamoeba dispar
LIKTNVVIFCDIPSSWKTK

SEQ ID NO: 2531818 - protein, 20 aa, Entamoeba dispar
LIKTPEISGITFFNDYQVHC

SEQ ID NO: 2531819 - protein, 24 aa, Entamoeba dispar
LIKTPIYGMNYEKFMPALMQYYKQ

SEQ ID NO: 2531820 - protein, 17 aa, Entamoeba dispar
LIKYFNYTDGILEANSG

SEQ ID NO: 2531821 - protein, 17 aa, Entamoeba dispar
LIKYGDLLVWNAFVSTF

SEQ ID NO: 2531822 - protein, 18 aa, Entamoeba dispar
LILFTMTSTDVYLNKFLT

SEQ ID NO: 2531823 - protein, 20 aa, Entamoeba dispar
LILGDFSRLIKDISLINEKC

SEQ ID NO: 2531824 - protein, 26 aa, Entamoeba dispar
LILKGNFLISKLFLVFNHITIPTIEC

SEQ ID NO: 2531825 - protein, 22 aa, Entamoeba dispar
LILKRNMERINKRAWEDVLKKD

SEQ ID NO: 2531826 - protein, 17 aa, Entamoeba dispar
LILLFCSNTDEQFNRII

SEQ ID NO: 2531827 - protein, 18 aa, Entamoeba dispar
LILNELRIEYLDQMRPCD

SEQ ID NO: 2531828 - protein, 19 aa, Entamoeba dispar
LILNLKILRYYKTQYTYYN

SEQ ID NO: 2531829 - protein, 17 aa, Entamoeba dispar
LILNRRITIWINGVEVI

SEQ ID NO: 2531830 - protein, 20 aa, Entamoeba dispar
LILQKLVAFHILFDNNLSFL

SEQ ID NO: 2531831 - protein, 19 aa, Entamoeba dispar
LILSFLKSDYPITAQFYAL

SEQ ID NO: 2531832 - protein, 25 aa, Entamoeba dispar
LILTPQFITKLINTLNIMFDGNDII

SEQ ID NO: 2531833 - protein, 17 aa, Entamoeba dispar
LIMIVRDVVDYEKDYKL

SEQ ID NO: 2531834 - protein, 31 aa, Entamoeba dispar
LINDIPHPITPPLRPKYFLGDKPLYDAPKYK

SEQ ID NO: 2531835 - protein, 20 aa, Entamoeba dispar
LINDLLIMKPNITFQDCKVV

SEQ ID NO: 2531836 - protein, 25 aa, Entamoeba dispar
LINEKPIYRLVERIGFIRRNIGIKT

SEQ ID NO: 2531837 - protein, 17 aa, Entamoeba dispar
LINFNIPSTLHTLELKN

SEQ ID NO: 2531838 - protein, 17 aa, Entamoeba dispar
LINHSFGLLLGQQITPL

SEQ ID NO: 2531839 - protein, 17 aa, Entamoeba dispar
LINHSIPLLIDQKKLFI

SEQ ID NO: 2531840 - protein, 19 aa, Entamoeba dispar
LINKLPDVNKNTLWYLCYF

SEQ ID NO: 2531841 - protein, 19 aa, Entamoeba dispar
LINLKIFSLSTNNLSTLPK

SEQ ID NO: 2531842 - protein, 20 aa, Entamoeba dispar
LINLTDEDLPLWPQDKDIKN

SEQ ID NO: 2531843 - protein, 17 aa, Entamoeba dispar
LINMVIPSSVKTINERP

SEQ ID NO: 2531844 - protein, 25 aa, Entamoeba dispar
LINNHPLLLAYLQSIPVDIFCQTTF

SEQ ID NO: 2531845 - protein, 22 aa, Entamoeba dispar
LINNINLYLPYIETIKSEIIDN

SEQ ID NO: 2531846 - protein, 21 aa, Entamoeba dispar
LINNIPLMQILPSITPLMKSD

SEQ ID NO: 2531847 - protein, 18 aa, Entamoeba dispar
LINQPFAVAKSFFDPKES

SEQ ID NO: 2531848 - protein, 25 aa, Entamoeba dispar
LINTKLFDHIHWQLDVCWDAPAYVS

SEQ ID NO: 2531849 - protein, 19 aa, Entamoeba dispar
LINYDDLPSFAFKSKQTRI

SEQ ID NO: 2531850 - protein, 21 aa, Entamoeba dispar
LINYDDLPSFAFKSKQTRINW

SEQ ID NO: 2531851 - protein, 18 aa, Entamoeba dispar
LIPCLIFGRGDEECISYY

SEQ ID NO: 2531852 - protein, 27 aa, Entamoeba dispar
LIPKSSIPYFLGWYDSLKQLEKNSEPE

SEQ ID NO: 2531853 - protein, 23 aa, Entamoeba dispar
LIQDSLRWNYSFSGIKFSESLRF

SEQ ID NO: 2531854 - protein, 19 aa, Entamoeba dispar
LIQLENLEFLSLSVNYIHS

SEQ ID NO: 2531855 - protein, 19 aa, Entamoeba dispar
LIQLIPLVQNNNLSSLCAC

SEQ ID NO: 2531856 - protein, 26 aa, Entamoeba dispar
LIQNKIDPFILPPINDRITHFSFDHM

SEQ ID NO: 2531857 - protein, 17 aa, Entamoeba dispar
LIQRVCKALALLQTIAS

SEQ ID NO: 2531858 - protein, 35 aa, Entamoeba dispar
LIQSSTTMFLIHIPTIIQDLVYQQIIYSFSSFNIV

SEQ ID NO: 2531859 - protein, 24 aa, Entamoeba dispar
LIQYMTDGMLLRGFLNQPDLSEYS

SEQ ID NO: 2531860 - protein, 23 aa, Entamoeba dispar
LIRMDINRLPIRSIFNCFHRTSV

SEQ ID NO: 2531861 - protein, 27 aa, Entamoeba dispar
LIRRNLLLTIETIGFTFFLIKKNNSFN

SEQ ID NO: 2531862 - protein, 27 aa, Entamoeba dispar
LIRSRIKLFRFTKNKKWRKGAVLNLLG

SEQ ID NO: 2531863 - protein, 19 aa, Entamoeba dispar
LIRVAERKLMLNRLVMQSG

SEQ ID NO: 2531864 - protein, 24 aa, Entamoeba dispar
LISATLSGYIDLITKRKKEAQLAE

SEQ ID NO: 2531865 - protein, 20 aa, Entamoeba dispar
LISELYKSGLVKSALPVLCM

SEQ ID NO: 2531866 - protein, 17 aa, Entamoeba dispar
LISFIRKRIEYDSRIKQ

SEQ ID NO: 2531867 - protein, 17 aa, Entamoeba dispar
LISIKIPRNLKIINGKN

SEQ ID NO: 2531868 - protein, 18 aa, Entamoeba dispar
LISILIRKRSTTINISKL

SEQ ID NO: 2531869 - protein, 18 aa, Entamoeba dispar
LISINIPSPIIKIGDECF

SEQ ID NO: 2531870 - protein, 17 aa, Entamoeba dispar
LISINIPSSIKEIGWSC

SEQ ID NO: 2531871 - protein, 26 aa, Entamoeba dispar
LISKKSCIICIQLLFHRIDESTGKYQ

SEQ ID NO: 2531872 - protein, 24 aa, Entamoeba dispar
LISLFLGLYKIKPIESLSAFIYRL

SEQ ID NO: 2531873 - protein, 28 aa, Entamoeba dispar
LISLMTDKFGHYCILYLLRHVDDKMALK

SEQ ID NO: 2531874 - protein, 18 aa, Entamoeba dispar
LISSFIQKPLTGSLPSLF

SEQ ID NO: 2531875 - protein, 25 aa, Entamoeba dispar
LISSVSPLFYSMNPAVVVQATLLYF

SEQ ID NO: 2531876 - protein, 18 aa, Entamoeba dispar
LISSYRRERDRFWNIGIH

SEQ ID NO: 2531877 - protein, 20 aa, Entamoeba dispar
LISVPRIDMIYKAESYYLAE

SEQ ID NO: 2531878 - protein, 18 aa, Entamoeba dispar
LITAPFNYITDFLENLER

SEQ ID NO: 2531879 - protein, 19 aa, Entamoeba dispar
LITDLGRTQIAPNTITVLG

SEQ ID NO: 2531880 - protein, 25 aa, Entamoeba dispar
LITDSNHFLFSLKKKNHLQPIQILP

SEQ ID NO: 2531881 - protein, 20 aa, Entamoeba dispar
LITIFGEIFKRCKCLYIPYV

SEQ ID NO: 2531882 - protein, 17 aa, Entamoeba dispar
LITINIPTYVRYYCFKK

SEQ ID NO: 2531883 - protein, 18 aa, Entamoeba dispar
LITKGDAFIVMYSVTNKD

SEQ ID NO: 2531884 - protein, 17 aa, Entamoeba dispar
LITNMMKCIAIALPIHL

SEQ ID NO: 2531885 - protein, 25 aa, Entamoeba dispar
LITNYVVLDLLIQSLNYYQDERVLP

SEQ ID NO: 2531886 - protein, 23 aa, Entamoeba dispar
LITPRDFLFVQTNYKFEGDQYIV

SEQ ID NO: 2531887 - protein, 18 aa, Entamoeba dispar
LITQITKMNDLFNSLVLL

SEQ ID NO: 2531888 - protein, 18 aa, Entamoeba dispar
LITRLFSAPIKVTSKLES

SEQ ID NO: 2531889 - protein, 21 aa, Entamoeba dispar
LITSISRLYPQIIRVINGFAK

SEQ ID NO: 2531890 - protein, 17 aa, Entamoeba dispar
LIVIDNWGSSIFTIDPK

SEQ ID NO: 2531891 - protein, 17 aa, Entamoeba dispar
LIVLECNGIIKIYNNQF

SEQ ID NO: 2531892 - protein, 17 aa, Entamoeba dispar
LIVLQQWTDMENFNIIY

SEQ ID NO: 2531893 - protein, 24 aa, Entamoeba dispar
LIYDHLYNKKVIYSPPLPSQIISV

SEQ ID NO: 2531894 - protein, 19 aa, Entamoeba dispar
LIYDMLQIDPLKRITAIEI

SEQ ID NO: 2531895 - protein, 18 aa, Entamoeba dispar
LIYHRLLILQSCIDSYII

SEQ ID NO: 2531896 - protein, 17 aa, Entamoeba dispar
LIYPKMFDTNLKTQGTK

SEQ ID NO: 2531897 - protein, 19 aa, Entamoeba dispar
LIYPLRQHIEYYDDLQRRI

SEQ ID NO: 2531898 - protein, 18 aa, Entamoeba dispar
LKALFNSITVKYPRWFEF

SEQ ID NO: 2531899 - protein, 17 aa, Entamoeba dispar
LKCFAYENGKEIDSFVL

SEQ ID NO: 2531900 - protein, 18 aa, Entamoeba dispar
LKCLGITNSVEFFDICRI

SEQ ID NO: 2531901 - protein, 22 aa, Entamoeba dispar
LKDFLNLNAIPLPPLLDFPSSP

SEQ ID NO: 2531902 - protein, 27 aa, Entamoeba dispar
LKDGGYGISVSYLSKTIKKMGIKRKPS

SEQ ID NO: 2531903 - protein, 19 aa, Entamoeba dispar
LKDGTPSLLFKYNVNFIFG

SEQ ID NO: 2531904 - protein, 23 aa, Entamoeba dispar
LKDHIPVGRIQQPTPREFHIYCE

SEQ ID NO: 2531905 - protein, 17 aa, Entamoeba dispar
LKDHQISFVFVNNLFIP

SEQ ID NO: 2531906 - protein, 25 aa, Entamoeba dispar
LKDIKGHFIKFPLGFGKDEKASLGM

SEQ ID NO: 2531907 - protein, 26 aa, Entamoeba dispar
LKDIYEFWGFLWSQMFKILQEHCDGL

SEQ ID NO: 2531908 - protein, 26 aa, Entamoeba dispar
LKDLKDGLVLIRLLRNLSGCDIPNSV

SEQ ID NO: 2531909 - protein, 22 aa, Entamoeba dispar
LKDQWLKQFYLKTVPLIPSFKY

SEQ ID NO: 2531910 - protein, 36 aa, Entamoeba dispar
LKEAGVIVLPYNSFFQLLEKFMFGPTIYYSELFTNL

SEQ ID NO: 2531911 - protein, 23 aa, Entamoeba dispar
LKEAKPVPDFIPLESVDIPNEVE

SEQ ID NO: 2531912 - protein, 25 aa, Entamoeba dispar
LKEAYKIYYFFTTLINSRCKQKDLL

SEQ ID NO: 2531913 - protein, 19 aa, Entamoeba dispar
LKECIEYIKGNVKLITEFI

SEQ ID NO: 2531914 - protein, 24 aa, Entamoeba dispar
LKEERINYLFSISSLMTQFHPVTG

SEQ ID NO: 2531915 - protein, 20 aa, Entamoeba dispar
LKEEYKMCGLKNSLNKQELK

SEQ ID NO: 2531916 - protein, 34 aa, Entamoeba dispar
LKEFLKDKLVPFSIPTYIFAIEDMPRTSFGKVYA

SEQ ID NO: 2531917 - protein, 24 aa, Entamoeba dispar
LKEGEFNMIYLTRVNTSGLVEVEI

SEQ ID NO: 2531918 - protein, 25 aa, Entamoeba dispar
LKEGLFYVIPYLNIKDIILLKQVSK

SEQ ID NO: 2531919 - protein, 29 aa, Entamoeba dispar
LKEHSRLLLILPSLLQFYQPENLIVYLNE

SEQ ID NO: 2531920 - protein, 23 aa, Entamoeba dispar
LKEIAYQSGWFKPVGGILEESLY

SEQ ID NO: 2531921 - protein, 23 aa, Entamoeba dispar
LKEIEFPPLIRSLGKSTFFDCSS

SEQ ID NO: 2531922 - protein, 31 aa, Entamoeba dispar
LKEIIKSCFVIINILPQYFIQQQFIGLMNSN

SEQ ID NO: 2531923 - protein, 17 aa, Entamoeba dispar
LKEIQSIFIEQLNKDPS

SEQ ID NO: 2531924 - protein, 20 aa, Entamoeba dispar
LKEIVLPPCFISLSDMCFVS

SEQ ID NO: 2531925 - protein, 18 aa, Entamoeba dispar
LKEKMFDIIAKDIKIVIS

SEQ ID NO: 2531926 - protein, 18 aa, Entamoeba dispar
LKELFARVPFTYTDPIVS

SEQ ID NO: 2531927 - protein, 33 aa, Entamoeba dispar
LKELFIRIENFIQKLIIFYRINTSRDPTSIVYD

SEQ ID NO: 2531928 - protein, 23 aa, Entamoeba dispar
LKEMLPCFKYLYGHFEGLLEVCH

SEQ ID NO: 2531929 - protein, 24 aa, Entamoeba dispar
LKENPHFWHNILPEIRGCSEETTT

SEQ ID NO: 2531930 - protein, 19 aa, Entamoeba dispar
LKERRQVQMEGGVKTKKGS

SEQ ID NO: 2531931 - protein, 22 aa, Entamoeba dispar
LKETFGEQMLYKGLGYYNDKAA

SEQ ID NO: 2531932 - protein, 26 aa, Entamoeba dispar
LKETKTILPYFFRTLKIDSSSQELIY

SEQ ID NO: 2531933 - protein, 23 aa, Entamoeba dispar
LKEVKAIFSVKLPAGPIDYQTLY

SEQ ID NO: 2531934 - protein, 43 aa, Entamoeba dispar
LKEVKEIKIRPLDPYFYCSKNYKIVMKGLLQGFHCVYSGMVLS

SEQ ID NO: 2531935 - protein, 24 aa, Entamoeba dispar
LKEVVSFLVMVWTKVKPPMENDIG

SEQ ID NO: 2531936 - protein, 23 aa, Entamoeba dispar
LKEYKFYVDKLKELSFNEFEIYV

SEQ ID NO: 2531937 - protein, 25 aa, Entamoeba dispar
LKEYPPNPLLIFKPKQRLDIIAHTV

SEQ ID NO: 2531938 - protein, 31 aa, Entamoeba dispar
LKEYPSLKRLVLRPIGWLSLSQLFIDKSHRI

SEQ ID NO: 2531939 - protein, 21 aa, Entamoeba dispar
LKEYTLTLTTGQKYTLEESLS

SEQ ID NO: 2531940 - protein, 19 aa, Entamoeba dispar
LKFASKLGPRHIQTTGGGT

SEQ ID NO: 2531941 - protein, 19 aa, Entamoeba dispar
LKFIFDKFYAIDSSPSTIL

SEQ ID NO: 2531942 - protein, 23 aa, Entamoeba dispar
LKFYNIAVEWLRQSLFSERILPD

SEQ ID NO: 2531943 - protein, 25 aa, Entamoeba dispar
LKGDPIQYGIYLHAWRYIVDDEIFE

SEQ ID NO: 2531944 - protein, 26 aa, Entamoeba dispar
LKGELIQRPWFFQSLESLRFKEEIEG

SEQ ID NO: 2531945 - protein, 27 aa, Entamoeba dispar
LKGGEGMFKFYYIPVGKTCELMTVLDG

SEQ ID NO: 2531946 - protein, 25 aa, Entamoeba dispar
LKGICDYLINFITGNKSKGPVSISC

SEQ ID NO: 2531947 - protein, 25 aa, Entamoeba dispar
LKGNTPFIRLYKSYVLNWCNRYLDE

SEQ ID NO: 2531948 - protein, 24 aa, Entamoeba dispar
LKGYMKQLLIGIRYLHSIGIVHRD

SEQ ID NO: 2531949 - protein, 23 aa, Entamoeba dispar
LKHQHTMVVPTKRLSFGDIDDEV

SEQ ID NO: 2531950 - protein, 30 aa, Entamoeba dispar
LKHSFKHVFFKYLIKKINLFNILINIISES

SEQ ID NO: 2531951 - protein, 19 aa, Entamoeba dispar
LKIALVMNTLIRGIVDTGI

SEQ ID NO: 2531952 - protein, 20 aa, Entamoeba dispar
LKICFYCRISYQRSLKEIKK

SEQ ID NO: 2531953 - protein, 25 aa, Entamoeba dispar
LKIDLPACLTYLDVYSFFNCISLHS

SEQ ID NO: 2531954 - protein, 18 aa, Entamoeba dispar
LKIFYEKLSNEFFTCPKV

SEQ ID NO: 2531955 - protein, 20 aa, Entamoeba dispar
LKIIHNMYIRGYKAKEIAII

SEQ ID NO: 2531956 - protein, 28 aa, Entamoeba dispar
LKIKIEKLIRIVLLIIHNLLNVDWYVRL

SEQ ID NO: 2531957 - protein, 18 aa, Entamoeba dispar
LKIKLNDKLFKTIELDKK

SEQ ID NO: 2531958 - protein, 21 aa, Entamoeba dispar
LKIKSFDFLNKCSVLTSLELT

SEQ ID NO: 2531959 - protein, 19 aa, Entamoeba dispar
LKINNNYFEFFLKRKDSQL

SEQ ID NO: 2531960 - protein, 27 aa, Entamoeba dispar
LKINVICMFIQLLSKFILVWSSIYGDS

SEQ ID NO: 2531961 - protein, 25 aa, Entamoeba dispar
LKIRSKYYLNLIDTNLMKLKEIVFL

SEQ ID NO: 2531962 - protein, 17 aa, Entamoeba dispar
LKITMSRCKILVKNTKR

SEQ ID NO: 2531963 - protein, 24 aa, Entamoeba dispar
LKIVCGNLFFKDSQPMFWEVACIL

SEQ ID NO: 2531964 - protein, 24 aa, Entamoeba dispar
LKIVRKYLLGPLGMKTLDPTDWNY

SEQ ID NO: 2531965 - protein, 19 aa, Entamoeba dispar
LKIYSPYVVDLTLVDLPGL

SEQ ID NO: 2531966 - protein, 29 aa, Entamoeba dispar
LKKACFSWCETLRTITIPPSVIELGIGCF

SEQ ID NO: 2531967 - protein, 30 aa, Entamoeba dispar
LKKACFSWCETLRTITIPPSVIELGIGCFK

SEQ ID NO: 2531968 - protein, 24 aa, Entamoeba dispar
LKKAQTKLIKSYRALKYEQDHNPK

SEQ ID NO: 2531969 - protein, 18 aa, Entamoeba dispar
LKKAYRKKALKYHPDKNP

SEQ ID NO: 2531970 - protein, 23 aa, Entamoeba dispar
LKKEFKKTMSKAFKKIQMNYIQN

SEQ ID NO: 2531971 - protein, 20 aa, Entamoeba dispar
LKKEKYPCGILYGRMEEYLR

SEQ ID NO: 2531972 - protein, 27 aa, Entamoeba dispar
LKKGDILSMLPLIKTPSALPIVVELFT

SEQ ID NO: 2531973 - protein, 17 aa, Entamoeba dispar
LKKIKLTYEQKLKFMID

SEQ ID NO: 2531974 - protein, 23 aa, Entamoeba dispar
LKKKWINQHWIYHGFNSSYEVAK

SEQ ID NO: 2531975 - protein, 24 aa, Entamoeba dispar
LKKPNFWKLRRRDCPWIKQKRCNI

SEQ ID NO: 2531976 - protein, 25 aa, Entamoeba dispar
LKKRCNAVIYLLIRGGLKNELLNYL

SEQ ID NO: 2531977 - protein, 24 aa, Entamoeba dispar
LKKRNYFVRFPLDGDVKNGRPTDL

SEQ ID NO: 2531978 - protein, 20 aa, Entamoeba dispar
LKKVLFLSLFIRITNINQQD

SEQ ID NO: 2531979 - protein, 22 aa, Entamoeba dispar
LKKVYLHNYLTDLAIHDGITII

SEQ ID NO: 2531980 - protein, 18 aa, Entamoeba dispar
LKKYDVLYPAPYGSTYNS

SEQ ID NO: 2531981 - protein, 21 aa, Entamoeba dispar
LKLCDGFFLAMLHYIRNDIVE

SEQ ID NO: 2531982 - protein, 18 aa, Entamoeba dispar
LKLFQRWLQTDNKPAPMK

SEQ ID NO: 2531983 - protein, 24 aa, Entamoeba dispar
LKLGGFVVIEKFPCKITEFNKTKD

SEQ ID NO: 2531984 - protein, 21 aa, Entamoeba dispar
LKLIIEYGYLFPNIELIHITN

SEQ ID NO: 2531985 - protein, 31 aa, Entamoeba dispar
LKLIQLITLPQYYLSFLIGGGLKLLLDYGCV

SEQ ID NO: 2531986 - protein, 17 aa, Entamoeba dispar
LKLLKKHRCGDLIRVSI

SEQ ID NO: 2531987 - protein, 26 aa, Entamoeba dispar
LKLMQEKGIFVLIMKCSIYNDKISST

SEQ ID NO: 2531988 - protein, 20 aa, Entamoeba dispar
LKLNNCTFSIRTSIDDQSLG

SEQ ID NO: 2531989 - protein, 27 aa, Entamoeba dispar
LKLYRRDAIQIIPWKNITSITISTTSK

SEQ ID NO: 2531990 - protein, 17 aa, Entamoeba dispar
LKMEGYSKFYHFENLFL

SEQ ID NO: 2531991 - protein, 31 aa, Entamoeba dispar
LKMEHSIISSFLYLPNLKILEIDYLPTSLDN

SEQ ID NO: 2531992 - protein, 25 aa, Entamoeba dispar
LKMKIYYFYAHFLETVKQIDINDSI

SEQ ID NO: 2531993 - protein, 18 aa, Entamoeba dispar
LKMKSLQADLDHLRLIDG

SEQ ID NO: 2531994 - protein, 23 aa, Entamoeba dispar
LKMKTLQFNRYYNYILQNTENQS

SEQ ID NO: 2531995 - protein, 26 aa, Entamoeba dispar
LKMPIELRDIIFYRSLYRCLNTDLPS

SEQ ID NO: 2531996 - protein, 20 aa, Entamoeba dispar
LKMTQPFGTSVLRQIEKNNV

SEQ ID NO: 2531997 - protein, 18 aa, Entamoeba dispar
LKMVIVHFIKRPIFFNYF

SEQ ID NO: 2531998 - protein, 17 aa, Entamoeba dispar
LKMYLNEIMYTIGASKV

SEQ ID NO: 2531999 - protein, 17 aa, Entamoeba dispar
LKNEFKNYVYFTSKVEC

SEQ ID NO: 2532000 - protein, 36 aa, Entamoeba dispar
LKNELGDPFYFISDALRFALVPFLDAAKGIETKYGK

SEQ ID NO: 2532001 - protein, 18 aa, Entamoeba dispar
LKNGKYLNMYVLSTKPEI

SEQ ID NO: 2532002 - protein, 32 aa, Entamoeba dispar
LKNIKNTYWGLGDLLYHPFFDSLRVQPKFTKS

SEQ ID NO: 2532003 - protein, 26 aa, Entamoeba dispar
LKNKAQITKLPWKAAISYFKAAFISE

SEQ ID NO: 2532004 - protein, 30 aa, Entamoeba dispar
LKNKQTLPLLSHRFQPKVLAPLPQTIPRNS

SEQ ID NO: 2532005 - protein, 18 aa, Entamoeba dispar
LKNLKILEDQSKLYHAYW

SEQ ID NO: 2532006 - protein, 28 aa, Entamoeba dispar
LKNNMSLTCFLFLMKTSFSVARIVVDIL

SEQ ID NO: 2532007 - protein, 20 aa, Entamoeba dispar
LKNNSFWWKEDRDWTDEERN

SEQ ID NO: 2532008 - protein, 20 aa, Entamoeba dispar
LKNVLLYLPTLKDIGKFAQI

SEQ ID NO: 2532009 - protein, 21 aa, Entamoeba dispar
LKNVLLYLPTLKDVGRFAQVC

SEQ ID NO: 2532010 - protein, 23 aa, Entamoeba dispar
LKNVLLYLPTLKDVGRFAQVCKS

SEQ ID NO: 2532011 - protein, 21 aa, Entamoeba dispar
LKNVLLYLPTLKDVGRFTQVC

SEQ ID NO: 2532012 - protein, 23 aa, Entamoeba dispar
LKNWDGTLLIVSHQRQFLNSVVT

SEQ ID NO: 2532013 - protein, 24 aa, Entamoeba dispar
LKNYKHLFEWYWQGIWNEEKEQTL

SEQ ID NO: 2532014 - protein, 27 aa, Entamoeba dispar
LKPLVCIGSCYALCKPSQFPVGGCCYC

SEQ ID NO: 2532015 - protein, 22 aa, Entamoeba dispar
LKQCRLLRRHGRLGKKVSLHLN

SEQ ID NO: 2532016 - protein, 29 aa, Entamoeba dispar
LKQDPDVLDTWFSSGLFPFSVMGWPEKTK

SEQ ID NO: 2532017 - protein, 26 aa, Entamoeba dispar
LKQFGYLFQLLILKCTSMGLSTVWLG

SEQ ID NO: 2532018 - protein, 24 aa, Entamoeba dispar
LKQIETFVLKFPLIVKGISLEERE

SEQ ID NO: 2532019 - protein, 26 aa, Entamoeba dispar
LKQIHHQYHLKYSLLTLGEKGSYVYD

SEQ ID NO: 2532020 - protein, 24 aa, Entamoeba dispar
LKQKEVTLRGLLEKSTETLEKERA

SEQ ID NO: 2532021 - protein, 22 aa, Entamoeba dispar
LKQLIICGNKIKSIPSLERCPI

SEQ ID NO: 2532022 - protein, 22 aa, Entamoeba dispar
LKQLLESLVILFRNGIIHCDLK

SEQ ID NO: 2532023 - protein, 24 aa, Entamoeba dispar
LKQLVRVYFTLMTTTHFTSGIPFH

SEQ ID NO: 2532024 - protein, 18 aa, Entamoeba dispar
LKQLYSIIAEELLDSKKG

SEQ ID NO: 2532025 - protein, 24 aa, Entamoeba dispar
LKQNHLPFYLLQNCHSKDGIFFFD

SEQ ID NO: 2532026 - protein, 26 aa, Entamoeba dispar
LKQRKWKYHKGYQKWFKKLNDPIYTS

SEQ ID NO: 2532027 - protein, 32 aa, Entamoeba dispar
LKQSQTLLHLFLQNFPFPFLDLMQPFIETDAP

SEQ ID NO: 2532028 - protein, 20 aa, Entamoeba dispar
LKRCFQAGFGFALTKTYPLE

SEQ ID NO: 2532029 - protein, 22 aa, Entamoeba dispar
LKRLVVGAVQYPSLYKKFGVDT

SEQ ID NO: 2532030 - protein, 18 aa, Entamoeba dispar
LKRMRFEVLKYINSVTSL

SEQ ID NO: 2532031 - protein, 23 aa, Entamoeba dispar
LKRRAMILITLLLDYIDTPKGVL

SEQ ID NO: 2532032 - protein, 25 aa, Entamoeba dispar
LKRSDPYIIFIANKEKYKTKVIENV

SEQ ID NO: 2532033 - protein, 32 aa, Entamoeba dispar
LKSFTDLKTMWLPDIFLYCNIDTQIIIIGNKK

SEQ ID NO: 2532034 - protein, 17 aa, Entamoeba dispar
LKSFTFINKKSLMQFLR

SEQ ID NO: 2532035 - protein, 20 aa, Entamoeba dispar
LKSINIPISIIKLGDYCFYG

SEQ ID NO: 2532036 - protein, 17 aa, Entamoeba dispar
LKSINIPSLITLFGRGC

SEQ ID NO: 2532037 - protein, 18 aa, Entamoeba dispar
LKSINIPSSITKLGYECF

SEQ ID NO: 2532038 - protein, 18 aa, Entamoeba dispar
LKSINIPSSVSKLGNYCF

SEQ ID NO: 2532039 - protein, 19 aa, Entamoeba dispar
LKSINLPLSITSFGNYCFY

SEQ ID NO: 2532040 - protein, 19 aa, Entamoeba dispar
LKSISVAVPIPFKPGVIGG

SEQ ID NO: 2532041 - protein, 19 aa, Entamoeba dispar
LKSITIPSSIRRLGKDCFK

SEQ ID NO: 2532042 - protein, 23 aa, Entamoeba dispar
LKSITIPTTISKIGWNCFYECSS

SEQ ID NO: 2532043 - protein, 18 aa, Entamoeba dispar
LKSKTFLRIVDESLYTEL

SEQ ID NO: 2532044 - protein, 23 aa, Entamoeba dispar
LKSKWLEVIYLRHTKVTDKSIET

SEQ ID NO: 2532045 - protein, 21 aa, Entamoeba dispar
LKSLYLPFNELVELCLPLPST

SEQ ID NO: 2532046 - protein, 23 aa, Entamoeba dispar
LKSQQAWLISTFGINVNLGNISP

SEQ ID NO: 2532047 - protein, 29 aa, Entamoeba dispar
LKSSLDSGLPNLLFFGPPGSGKTTSILAV

SEQ ID NO: 2532048 - protein, 27 aa, Entamoeba dispar
LKSTAFLEYLFKPVSFKEFNGPSEDNI

SEQ ID NO: 2532049 - protein, 28 aa, Entamoeba dispar
LKTCIRQYELFPHFGLILIHGGSGVGKT

SEQ ID NO: 2532050 - protein, 24 aa, Entamoeba dispar
LKTEFASFIMSRYGINITDVLNGE

SEQ ID NO: 2532051 - protein, 27 aa, Entamoeba dispar
LKTIKQIHQLLSQYSLLHIQRSNTFLD

SEQ ID NO: 2532052 - protein, 38 aa, Entamoeba dispar
LKTKFADIPVLLMIPWKDDPLYKVYYFVSEGISHQVEI

SEQ ID NO: 2532053 - protein, 26 aa, Entamoeba dispar
LKTLFKDTGIYFAFARDFDKIDDSIC

SEQ ID NO: 2532054 - protein, 40 aa, Entamoeba dispar
LKTLIEIMCNIFSFYEFWEHVCIVWTKCYCYIPQKELETH

SEQ ID NO: 2532055 - protein, 36 aa, Entamoeba dispar
LKTLKIEMQLFLLRWVRLLFCQVYPINTIKPMWDVI

SEQ ID NO: 2532056 - protein, 33 aa, Entamoeba dispar
LKTMIETMCFIFPFFDFWDHVCIVWTKCYYYTP

SEQ ID NO: 2532057 - protein, 25 aa, Entamoeba dispar
LKTNQYLFALAYYVQQRKIVIELSN

SEQ ID NO: 2532058 - protein, 24 aa, Entamoeba dispar
LKTQNLIHFIRFAVKTKTLNEFLI

SEQ ID NO: 2532059 - protein, 27 aa, Entamoeba dispar
LKTTQYFYIQQLFYFDEKVDFEYSIDK

SEQ ID NO: 2532060 - protein, 34 aa, Entamoeba dispar
LKTVKYYKIYYSLRPIFKRLYLNYTQMKDFHKEQ

SEQ ID NO: 2532061 - protein, 18 aa, Entamoeba dispar
LKVLNYFIDIFSLEIQQN

SEQ ID NO: 2532062 - protein, 18 aa, Entamoeba dispar
LKVLSTVFQWIIGDSQIT

SEQ ID NO: 2532063 - protein, 32 aa, Entamoeba dispar
LKVPMPALNVYKLTVLLLISLKKIETASSTLL

SEQ ID NO: 2532064 - protein, 23 aa, Entamoeba dispar
LKVYEEYFILYHKNIKVFENIRK

SEQ ID NO: 2532065 - protein, 31 aa, Entamoeba dispar
LKYIKESIPFFYKWTKLNQCRLVFDSTIEYD

SEQ ID NO: 2532066 - protein, 22 aa, Entamoeba dispar
LKYLINYDELPSFAFKSKQTII

SEQ ID NO: 2532067 - protein, 23 aa, Entamoeba dispar
LKYPNEYYSFIKQDIIDFICHSF

SEQ ID NO: 2532068 - protein, 26 aa, Entamoeba dispar
LKYTPKGVFCLMTFYGPACPSNSGII

SEQ ID NO: 2532069 - protein, 25 aa, Entamoeba dispar
LLAESYNYIPLLQTDPNDLDKFIQL

SEQ ID NO: 2532070 - protein, 25 aa, Entamoeba dispar
LLAHSASLFLIAPATADIIAKLAAG

SEQ ID NO: 2532071 - protein, 17 aa, Entamoeba dispar
LLALLNKHFEITLQIPT

SEQ ID NO: 2532072 - protein, 29 aa, Entamoeba dispar
LLASSCVYFFLKEFIPIFQFNPCLIFGET

SEQ ID NO: 2532073 - protein, 26 aa, Entamoeba dispar
LLCCQEKLCFRFINKIKLYKEVTPEI

SEQ ID NO: 2532074 - protein, 27 aa, Entamoeba dispar
LLCNFSYCIVYLLTSFYPVLLSIFECT

SEQ ID NO: 2532075 - protein, 18 aa, Entamoeba dispar
LLCSLPSLSFLNLSFKII

SEQ ID NO: 2532076 - protein, 24 aa, Entamoeba dispar
LLDDEVIVPTFPSQPIQLSQSTSM

SEQ ID NO: 2532077 - protein, 25 aa, Entamoeba dispar
LLDKFRFNPIPLNNQSKKLFHCIET

SEQ ID NO: 2532078 - protein, 17 aa, Entamoeba dispar
LLDLPVFCEDTTEPYFR

SEQ ID NO: 2532079 - protein, 39 aa, Entamoeba dispar
LLDNTDDFILMSLEYLYFDSVWVTLKMELLDEEDLDDSI

SEQ ID NO: 2532080 - protein, 19 aa, Entamoeba dispar
LLEDIKVNVLLDFHNVVKE

SEQ ID NO: 2532081 - protein, 20 aa, Entamoeba dispar
LLEDVPLKEGLPLPVYDSLK

SEQ ID NO: 2532082 - protein, 32 aa, Entamoeba dispar
LLEEIRSLLLQFKSGLLLLNGKYLEDYHEYMK

SEQ ID NO: 2532083 - protein, 25 aa, Entamoeba dispar
LLEGRSRFARLGLFVHITASFMNPG

SEQ ID NO: 2532084 - protein, 18 aa, Entamoeba dispar
LLEIMTNSSLTQLSQSIE

SEQ ID NO: 2532085 - protein, 39 aa, Entamoeba dispar
LLEKIRCLYSLAIFIKKLDYVPVKFSAPTLFTPRMNHLG

SEQ ID NO: 2532086 - protein, 20 aa, Entamoeba dispar
LLELEPTMYHKFQLGNTGIT

SEQ ID NO: 2532087 - protein, 18 aa, Entamoeba dispar
LLELHHWIPSIFEQCFVR

SEQ ID NO: 2532088 - protein, 27 aa, Entamoeba dispar
LLEMETKSLITHYKFGVIYVKPDQTEE

SEQ ID NO: 2532089 - protein, 25 aa, Entamoeba dispar
LLENAFGTLSFYYGEAMLSNIQVLE

SEQ ID NO: 2532090 - protein, 17 aa, Entamoeba dispar
LLESKIFYVCEKGNEGL

SEQ ID NO: 2532091 - protein, 25 aa, Entamoeba dispar
LLESLYSHFLQSPLFPKCKILKQTE

SEQ ID NO: 2532092 - protein, 17 aa, Entamoeba dispar
LLFEEFCLEINAMEFSQ

SEQ ID NO: 2532093 - protein, 17 aa, Entamoeba dispar
LLFFIVEGPIISGHGKE

SEQ ID NO: 2532094 - protein, 20 aa, Entamoeba dispar
LLFGCNGFVGKFILRELIGK

SEQ ID NO: 2532095 - protein, 18 aa, Entamoeba dispar
LLFRKAFKKDLGEIPKLP

SEQ ID NO: 2532096 - protein, 22 aa, Entamoeba dispar
LLGLKGHALYKEKSKQYKLLVK

SEQ ID NO: 2532097 - protein, 17 aa, Entamoeba dispar
LLGLLHKDPIINSYFEE

SEQ ID NO: 2532098 - protein, 21 aa, Entamoeba dispar
LLGLMYCGIPSINSLESLYMC

SEQ ID NO: 2532099 - protein, 39 aa, Entamoeba dispar
LLGNGYGFAVDWWSYGTLIYEMLLGLPPFFDNDVQTMYQ

SEQ ID NO: 2532100 - protein, 28 aa, Entamoeba dispar
LLGNVLKKYLNLMPNKLPISLQTVDVDN

SEQ ID NO: 2532101 - protein, 24 aa, Entamoeba dispar
LLGSYFHPMQFIKIEELTIKGSTV

SEQ ID NO: 2532102 - protein, 20 aa, Entamoeba dispar
LLHHVQIQIYPTRPIPHPPS

SEQ ID NO: 2532103 - protein, 25 aa, Entamoeba dispar
LLHILLQHFALINQLPPVTISLLFT

SEQ ID NO: 2532104 - protein, 18 aa, Entamoeba dispar
LLHLIYKGKNLKNDKSTL

SEQ ID NO: 2532105 - protein, 22 aa, Entamoeba dispar
LLHQRPMEFFEIIYVTGTVLRG

SEQ ID NO: 2532106 - protein, 18 aa, Entamoeba dispar
LLHTIKDHTWNIFNTSAI

SEQ ID NO: 2532107 - protein, 20 aa, Entamoeba dispar
LLICNKRFALNRKSAFSYEL

SEQ ID NO: 2532108 - protein, 18 aa, Entamoeba dispar
LLICRNYYGKQCYLLNML

SEQ ID NO: 2532109 - protein, 21 aa, Entamoeba dispar
LLICSKYFRYKSDFINVICVC

SEQ ID NO: 2532110 - protein, 20 aa, Entamoeba dispar
LLIDKWFMKLFNHWNNTVRQ

SEQ ID NO: 2532111 - protein, 40 aa, Entamoeba dispar
LLIEITHPTLLFIQNWFSYDPFLFIKEFRKYILQNPLIEV

SEQ ID NO: 2532112 - protein, 21 aa, Entamoeba dispar
LLIERKFIHCGGLVGHIEDIV

SEQ ID NO: 2532113 - protein, 21 aa, Entamoeba dispar
LLIGIKYLHDAGIVYRDLKPE

SEQ ID NO: 2532114 - protein, 18 aa, Entamoeba dispar
LLIICRRGSYIFGVFVAE

SEQ ID NO: 2532115 - protein, 20 aa, Entamoeba dispar
LLIKFRDEVLIDSTLNKIFS

SEQ ID NO: 2532116 - protein, 17 aa, Entamoeba dispar
LLILQSCIDSYIIGMRE

SEQ ID NO: 2532117 - protein, 18 aa, Entamoeba dispar
LLITFLTKYPLSKSQYKM

SEQ ID NO: 2532118 - protein, 26 aa, Entamoeba dispar
LLKDVKPFVKLYYNSFNILQQRYENN

SEQ ID NO: 2532119 - protein, 18 aa, Entamoeba dispar
LLKIFRVLGYPDEQEWPD

SEQ ID NO: 2532120 - protein, 19 aa, Entamoeba dispar
LLKKDNVQIFEFIQVALAA

SEQ ID NO: 2532121 - protein, 24 aa, Entamoeba dispar
LLKKVLKIIYAYIKSLHKIDFTNG

SEQ ID NO: 2532122 - protein, 29 aa, Entamoeba dispar
LLKKYIEIQIKLLYPIAPHFCDYVWRDLL

SEQ ID NO: 2532123 - protein, 26 aa, Entamoeba dispar
LLKLFDGQTWKSLFSNLFNFLYSIWN

SEQ ID NO: 2532124 - protein, 20 aa, Entamoeba dispar
LLKNQTTSFLPLLRTVSFIN

SEQ ID NO: 2532125 - protein, 20 aa, Entamoeba dispar
LLKPFNAYFEIGIIKEKYKA

SEQ ID NO: 2532126 - protein, 18 aa, Entamoeba dispar
LLKRIIAQYIQYASAFPN

SEQ ID NO: 2532127 - protein, 37 aa, Entamoeba dispar
LLKRKLEILEWFNKELALLINEKERRLRQLEIESFLS

SEQ ID NO: 2532128 - protein, 20 aa, Entamoeba dispar
LLKRKVFFLMDKKTYIEQRN

SEQ ID NO: 2532129 - protein, 17 aa, Entamoeba dispar
LLKSINIPSSITSFGNC

SEQ ID NO: 2532130 - protein, 23 aa, Entamoeba dispar
LLKYSQFNEFWKLTNKYIKQIKQ

SEQ ID NO: 2532131 - protein, 17 aa, Entamoeba dispar
LLLAFAEGKAKIIARAI

SEQ ID NO: 2532132 - protein, 20 aa, Entamoeba dispar
LLLALNKMNIIKSPEFLLGN

SEQ ID NO: 2532133 - protein, 18 aa, Entamoeba dispar
LLLANAIVRVILQMVQFY

SEQ ID NO: 2532134 - protein, 22 aa, Entamoeba dispar
LLLEILLRFYGAQHTSIFMDLL

SEQ ID NO: 2532135 - protein, 18 aa, Entamoeba dispar
LLLFKLTINNKVTSFATC

SEQ ID NO: 2532136 - protein, 20 aa, Entamoeba dispar
LLLGCTSRCRTIFDTYVKRL

SEQ ID NO: 2532137 - protein, 21 aa, Entamoeba dispar
LLLHGLMCPLLAPRISKKLCS

SEQ ID NO: 2532138 - protein, 17 aa, Entamoeba dispar
LLLIMDLHSRLINHSFG

SEQ ID NO: 2532139 - protein, 17 aa, Entamoeba dispar
LLLKKPLIESNKTFNFN

SEQ ID NO: 2532140 - protein, 17 aa, Entamoeba dispar
LLLLIETGDAFFYKLEN

SEQ ID NO: 2532141 - protein, 17 aa, Entamoeba dispar
LLLLKKSGNELKEELII

SEQ ID NO: 2532142 - protein, 18 aa, Entamoeba dispar
LLLNELFPGFGFEKKKTG

SEQ ID NO: 2532143 - protein, 27 aa, Entamoeba dispar
LLLNTVQQFILLLQKNKIIQFNNQGRV

SEQ ID NO: 2532144 - protein, 21 aa, Entamoeba dispar
LLLQIIQTPPVSLLSRSFLSN

SEQ ID NO: 2532145 - protein, 17 aa, Entamoeba dispar
LLLSSGYYRVRLMNLLP

SEQ ID NO: 2532146 - protein, 27 aa, Entamoeba dispar
LLLVLCNYFQQWLIQNNIKFIQDVLSL

SEQ ID NO: 2532147 - protein, 19 aa, Entamoeba dispar
LLMNELLNEQPGASFSSCV

SEQ ID NO: 2532148 - protein, 19 aa, Entamoeba dispar
LLMYVQLISIQQIDFTLLS

SEQ ID NO: 2532149 - protein, 18 aa, Entamoeba dispar
LLNAFKRCNFADGICASE

SEQ ID NO: 2532150 - protein, 20 aa, Entamoeba dispar
LLNAIYTIKLPPSQPIYEGY

SEQ ID NO: 2532151 - protein, 18 aa, Entamoeba dispar
LLNCIAWGNTNYPRNCEF

SEQ ID NO: 2532152 - protein, 19 aa, Entamoeba dispar
LLNDFKYALVWGNSVAHSP

SEQ ID NO: 2532153 - protein, 25 aa, Entamoeba dispar
LLNEVNGIIIIQFLEKLSSVKYKTT

SEQ ID NO: 2532154 - protein, 25 aa, Entamoeba dispar
LLNGITFGIPLQRLNQIPTIITLIC

SEQ ID NO: 2532155 - protein, 18 aa, Entamoeba dispar
LLNINQKLNSLLSSQIQI

SEQ ID NO: 2532156 - protein, 19 aa, Entamoeba dispar
LLNKSIIFRELCDCFDQFK

SEQ ID NO: 2532157 - protein, 26 aa, Entamoeba dispar
LLNKYSLEFPSLLKLLLIENKTIFLS

SEQ ID NO: 2532158 - protein, 17 aa, Entamoeba dispar
LLNLFIYRKPSLVTTES

SEQ ID NO: 2532159 - protein, 18 aa, Entamoeba dispar
LLNLFYQGIEHIKNEFKG

SEQ ID NO: 2532160 - protein, 18 aa, Entamoeba dispar
LLNLLYHEIPFKKNDRKS

SEQ ID NO: 2532161 - protein, 25 aa, Entamoeba dispar
LLNNGNILIFFINKQAILVNSKKKK

SEQ ID NO: 2532162 - protein, 17 aa, Entamoeba dispar
LLNNMYIPKKVIFHPTL

SEQ ID NO: 2532163 - protein, 19 aa, Entamoeba dispar
LLNPKDFPDIPPFDPATTE

SEQ ID NO: 2532164 - protein, 21 aa, Entamoeba dispar
LLNQSLDVIVLLLSVGDCRLD

SEQ ID NO: 2532165 - protein, 21 aa, Entamoeba dispar
LLNSKIMCDIFDGAKRQILEE

SEQ ID NO: 2532166 - protein, 29 aa, Entamoeba dispar
LLNTETRKLLFNYVALGVKLMNASNSNKN

SEQ ID NO: 2532167 - protein, 19 aa, Entamoeba dispar
LLNVVLYLDYMNARRFSLI

SEQ ID NO: 2532168 - protein, 18 aa, Entamoeba dispar
LLPELVPESKLKLPSILH

SEQ ID NO: 2532169 - protein, 23 aa, Entamoeba dispar
LLPHVNGMLRIKLFNITASHINA

SEQ ID NO: 2532170 - protein, 18 aa, Entamoeba dispar
LLPILISIEGSHQVSIHG

SEQ ID NO: 2532171 - protein, 17 aa, Entamoeba dispar
LLPKLIQLLRTSFGDNL

SEQ ID NO: 2532172 - protein, 18 aa, Entamoeba dispar
LLPLINKLNWNGIYNQIP

SEQ ID NO: 2532173 - protein, 24 aa, Entamoeba dispar
LLPQGWSCGYFRNERYFINTLTNE

SEQ ID NO: 2532174 - protein, 29 aa, Entamoeba dispar
LLPSYHSVPVLVEPIKYMESYGYNHCTNH

SEQ ID NO: 2532175 - protein, 20 aa, Entamoeba dispar
LLPVIPSTCLSWDISCDIAL

SEQ ID NO: 2532176 - protein, 17 aa, Entamoeba dispar
LLPYPECSLKFWDCSCD

SEQ ID NO: 2532177 - protein, 20 aa, Entamoeba dispar
LLQELLILNTLSYSVENHKF

SEQ ID NO: 2532178 - protein, 18 aa, Entamoeba dispar
LLQKIKAFRKDTGSLMSP

SEQ ID NO: 2532179 - protein, 17 aa, Entamoeba dispar
LLQPYGKISEVKRILKM

SEQ ID NO: 2532180 - protein, 18 aa, Entamoeba dispar
LLQQCYLNCLNKAIESGC

SEQ ID NO: 2532181 - protein, 20 aa, Entamoeba dispar
LLQRFEECFYNFFNKIKTNK

SEQ ID NO: 2532182 - protein, 22 aa, Entamoeba dispar
LLQRQTIGWKLVFDLAIQIIDA

SEQ ID NO: 2532183 - protein, 23 aa, Entamoeba dispar
LLQTIICSFVERPFIFTSFHDNE

SEQ ID NO: 2532184 - protein, 17 aa, Entamoeba dispar
LLQYITQFQQSDPILIV

SEQ ID NO: 2532185 - protein, 18 aa, Entamoeba dispar
LLRAVAGVAPRSVYTTGK

SEQ ID NO: 2532186 - protein, 25 aa, Entamoeba dispar
LLRCLALFLEYAWMKGIDGFNNEVN

SEQ ID NO: 2532187 - protein, 31 aa, Entamoeba dispar
LLRDELRVPYWKLVYSLADKLRFNAFSTNEK

SEQ ID NO: 2532188 - protein, 29 aa, Entamoeba dispar
LLREARLFRSPFIKSFHIYCQQKDIISAQ

SEQ ID NO: 2532189 - protein, 18 aa, Entamoeba dispar
LLRGGRLGDWIYLGLPSD

SEQ ID NO: 2532190 - protein, 22 aa, Entamoeba dispar
LLRIIETIITIIRWIQIENIEQ

SEQ ID NO: 2532191 - protein, 17 aa, Entamoeba dispar
LLRKFIERWGYSQPLNT

SEQ ID NO: 2532192 - protein, 26 aa, Entamoeba dispar
LLRKRSVKFIQIFTKTIKDLLNGKCG

SEQ ID NO: 2532193 - protein, 17 aa, Entamoeba dispar
LLRRLESAKIKPLSNSA

SEQ ID NO: 2532194 - protein, 20 aa, Entamoeba dispar
LLRVFLQEGYPTEINYLFLG

SEQ ID NO: 2532195 - protein, 17 aa, Entamoeba dispar
LLRVHSIVRTYEMLRLA

SEQ ID NO: 2532196 - protein, 17 aa, Entamoeba dispar
LLSIDTINPKLLKSISI

SEQ ID NO: 2532197 - protein, 17 aa, Entamoeba dispar
LLSIINNGNQYSLKLTN

SEQ ID NO: 2532198 - protein, 23 aa, Entamoeba dispar
LLSIKQCMLFKIIGKDGQVKKNA

SEQ ID NO: 2532199 - protein, 23 aa, Entamoeba dispar
LLSKLLQSLLSPIPTQSYWKNWM

SEQ ID NO: 2532200 - protein, 26 aa, Entamoeba dispar
LLSLHDFCFYRCSSLVFISIPSTVTS

SEQ ID NO: 2532201 - protein, 24 aa, Entamoeba dispar
LLSLSLQQIMKFSSAFAAALNGTS

SEQ ID NO: 2532202 - protein, 25 aa, Entamoeba dispar
LLSLTLQKSIGILPILIQILQNHNT

SEQ ID NO: 2532203 - protein, 23 aa, Entamoeba dispar
LLSNGINAVRWVGGVELELLAIA

SEQ ID NO: 2532204 - protein, 18 aa, Entamoeba dispar
LLSSFRRAYEESVIKSRV

SEQ ID NO: 2532205 - protein, 19 aa, Entamoeba dispar
LLSSYLPNLPYELLKKYCV

SEQ ID NO: 2532206 - protein, 31 aa, Entamoeba dispar
LLSTKQGIYAYLLFLLTKIEPLKKLSNKIIN

SEQ ID NO: 2532207 - protein, 17 aa, Entamoeba dispar
LLSVIRKNDRKLLSCEQ

SEQ ID NO: 2532208 - protein, 28 aa, Entamoeba dispar
LLSYEEFLHLFYCYSIHTQKGFFKIQVD

SEQ ID NO: 2532209 - protein, 17 aa, Entamoeba dispar
LLSYGRLWHDISIEDTF

SEQ ID NO: 2532210 - protein, 26 aa, Entamoeba dispar
LLSYTGYFMFYRFVGNYIASSSNETQ

SEQ ID NO: 2532211 - protein, 27 aa, Entamoeba dispar
LLTKYATLLIKFFSKSQRVGSSFRCLC

SEQ ID NO: 2532212 - protein, 21 aa, Entamoeba dispar
LLTMAYGKFEEKHWKRKCPLT

SEQ ID NO: 2532213 - protein, 17 aa, Entamoeba dispar
LLTPEQIKLIFGGVSVI

SEQ ID NO: 2532214 - protein, 17 aa, Entamoeba dispar
LLTPIDNSPRINPPSSA

SEQ ID NO: 2532215 - protein, 19 aa, Entamoeba dispar
LLTQMIWKEILRNSVMMGA

SEQ ID NO: 2532216 - protein, 18 aa, Entamoeba dispar
LLTRIRVVYGIDAVRPYQ

SEQ ID NO: 2532217 - protein, 22 aa, Entamoeba dispar
LLTSLVSCYFYKLNDTDLQKIK

SEQ ID NO: 2532218 - protein, 17 aa, Entamoeba dispar
LLTSSFDHSIKLWSLKN

SEQ ID NO: 2532219 - protein, 18 aa, Entamoeba dispar
LLTTINIPSSITKIGSYC

SEQ ID NO: 2532220 - protein, 27 aa, Entamoeba dispar
LLTTRHPFIVHLYWSFATETCFYFIMD

SEQ ID NO: 2532221 - protein, 17 aa, Entamoeba dispar
LLTYLNTNYSYGKAINK

SEQ ID NO: 2532222 - protein, 25 aa, Entamoeba dispar
LLVHHIKLWADRYPFRAKIKGGSVR

SEQ ID NO: 2532223 - protein, 17 aa, Entamoeba dispar
LLVIGGRPTINWYNLFK

SEQ ID NO: 2532224 - protein, 23 aa, Entamoeba dispar
LLVILEIIMHCFNKRFLSSGNEV

SEQ ID NO: 2532225 - protein, 21 aa, Entamoeba dispar
LLVINQCMMYRIKPMTSPNMK

SEQ ID NO: 2532226 - protein, 17 aa, Entamoeba dispar
LLVLCNDIILICSKPNR

SEQ ID NO: 2532227 - protein, 20 aa, Entamoeba dispar
LLYDIPELKLVPYVSQKPIS

SEQ ID NO: 2532228 - protein, 18 aa, Entamoeba dispar
LLYFPDENHWVLKPQNGM

SEQ ID NO: 2532229 - protein, 17 aa, Entamoeba dispar
LLYFSDYIDFLQFSFIN

SEQ ID NO: 2532230 - protein, 19 aa, Entamoeba dispar
LLYISIKCVSGGIPLQYQP

SEQ ID NO: 2532231 - protein, 17 aa, Entamoeba dispar
LLYSIRDINRKASSIRD

SEQ ID NO: 2532232 - protein, 20 aa, Entamoeba dispar
LLYSLFHIVWLQSFDEKLVE

SEQ ID NO: 2532233 - protein, 21 aa, Entamoeba dispar
LLYSYTLNKKIIKYLVYFVSK

SEQ ID NO: 2532234 - protein, 24 aa, Entamoeba dispar
LMAQKNCKFCPKCEAGLLMTDNKL

SEQ ID NO: 2532235 - protein, 18 aa, Entamoeba dispar
LMAVFQSFDSDCSLSVSL

SEQ ID NO: 2532236 - protein, 21 aa, Entamoeba dispar
LMCEYMTFLLECHSKYNIKIY

SEQ ID NO: 2532237 - protein, 18 aa, Entamoeba dispar
LMCEYMTFLLECNNKYNM

SEQ ID NO: 2532238 - protein, 22 aa, Entamoeba dispar
LMDDKMLRYYNPSGRFVIGGPM

SEQ ID NO: 2532239 - protein, 23 aa, Entamoeba dispar
LMDDKMLRYYNPSGRFVIGGPMG

SEQ ID NO: 2532240 - protein, 25 aa, Entamoeba dispar
LMDPSGKAPLMWRYDEINAPTYFEV

SEQ ID NO: 2532241 - protein, 20 aa, Entamoeba dispar
LMDVTIASFLCKVHYSYFSG

SEQ ID NO: 2532242 - protein, 28 aa, Entamoeba dispar
LMDYSQGKNFFLKLPNRKTPITLDGIGD

SEQ ID NO: 2532243 - protein, 19 aa, Entamoeba dispar
LMEEYLNHLTWPYDQLKRG

SEQ ID NO: 2532244 - protein, 18 aa, Entamoeba dispar
LMEHLKICTLAVSLGCVD

SEQ ID NO: 2532245 - protein, 17 aa, Entamoeba dispar
LMEIAGRFILTQYSFYF

SEQ ID NO: 2532246 - protein, 26 aa, Entamoeba dispar
LMEKLYGVFEWAYSAQILLSFEPPEP

SEQ ID NO: 2532247 - protein, 17 aa, Entamoeba dispar
LMELEAELIVRLNDITE

SEQ ID NO: 2532248 - protein, 24 aa, Entamoeba dispar
LMELNNIFLITKKDYKMIIYETLI

SEQ ID NO: 2532249 - protein, 18 aa, Entamoeba dispar
LMFESMLASVIYARDKYL

SEQ ID NO: 2532250 - protein, 18 aa, Entamoeba dispar
LMGFIKLSNCIICIGIKG

SEQ ID NO: 2532251 - protein, 17 aa, Entamoeba dispar
LMGVTRSMLNHRIDLWK

SEQ ID NO: 2532252 - protein, 25 aa, Entamoeba dispar
LMIGVQQLLKKPPTPTKKRITETTH

SEQ ID NO: 2532253 - protein, 18 aa, Entamoeba dispar
LMIHCSMDDVFYVSRAFC

SEQ ID NO: 2532254 - protein, 17 aa, Entamoeba dispar
LMIRKTIIGLFSNDTII

SEQ ID NO: 2532255 - protein, 17 aa, Entamoeba dispar
LMKCQIYHQYKAFVLPP

SEQ ID NO: 2532256 - protein, 26 aa, Entamoeba dispar
LMKEFINAFFIIKNYFSVLSIHNGNR

SEQ ID NO: 2532257 - protein, 17 aa, Entamoeba dispar
LMKIIQRPVCHLNAIDV

SEQ ID NO: 2532258 - protein, 19 aa, Entamoeba dispar
LMKLLKKIHPIIKEKESRK

SEQ ID NO: 2532259 - protein, 18 aa, Entamoeba dispar
LMKNYRHDLFVLLYCGDL

SEQ ID NO: 2532260 - protein, 18 aa, Entamoeba dispar
LMKTWEKLSLAARVIAGI

SEQ ID NO: 2532261 - protein, 25 aa, Entamoeba dispar
LMKVYLDAVFLPRVRNDIYPFYQEG

SEQ ID NO: 2532262 - protein, 17 aa, Entamoeba dispar
LMLAEFLHKEAAIVVPM

SEQ ID NO: 2532263 - protein, 17 aa, Entamoeba dispar
LMLITNRNHDISAGLLH

SEQ ID NO: 2532264 - protein, 24 aa, Entamoeba dispar
LMLKAFFTMLKRFYPDRIDLLKQM

SEQ ID NO: 2532265 - protein, 17 aa, Entamoeba dispar
LMLQKQFQDLVLQPTKT

SEQ ID NO: 2532266 - protein, 30 aa, Entamoeba dispar
LMMMRETIGLFPPSLLLRASQDITNIFTLD

SEQ ID NO: 2532267 - protein, 31 aa, Entamoeba dispar
LMNDLYNLFRSYFILNNIPTIASSPFVPNKT

SEQ ID NO: 2532268 - protein, 21 aa, Entamoeba dispar
LMNELYNLKLILRSDVREENV

SEQ ID NO: 2532269 - protein, 30 aa, Entamoeba dispar
LMNKLNHQTAWLRKHLFRPNILLSAVEKHI

SEQ ID NO: 2532270 - protein, 24 aa, Entamoeba dispar
LMNVAKIQALWRTTEFKPTVQQFG

SEQ ID NO: 2532271 - protein, 19 aa, Entamoeba dispar
LMNVALYFDTTKNLKLFMS

SEQ ID NO: 2532272 - protein, 28 aa, Entamoeba dispar
LMNVNTEKLLFTFKFPEKIVGIAQSPDV

SEQ ID NO: 2532273 - protein, 26 aa, Entamoeba dispar
LMPQLPQLIPMFFDLLPHGGDEDSVN

SEQ ID NO: 2532274 - protein, 19 aa, Entamoeba dispar
LMQDLLIEYGYYFKEKKSN

SEQ ID NO: 2532275 - protein, 17 aa, Entamoeba dispar
LMQQYTLPDGRVIKLGP

SEQ ID NO: 2532276 - protein, 18 aa, Entamoeba dispar
LMRIVTLLGTSRKYFAIG

SEQ ID NO: 2532277 - protein, 18 aa, Entamoeba dispar
LMRVYGALMWSLGKVMQT

SEQ ID NO: 2532278 - protein, 30 aa, Entamoeba dispar
LMRYVVHFNIILLLPPIDIIKDIPISVAIV

SEQ ID NO: 2532279 - protein, 19 aa, Entamoeba dispar
LMSCVEITFSLVPPKDINV

SEQ ID NO: 2532280 - protein, 25 aa, Entamoeba dispar
LMSELIFEILIKKKAFDGKEDLLEA

SEQ ID NO: 2532281 - protein, 20 aa, Entamoeba dispar
LMSIMSYLSQPSLNETIFCM

SEQ ID NO: 2532282 - protein, 28 aa, Entamoeba dispar
LMSLFKDPIAQETLLWGLACHLHLLVIQ

SEQ ID NO: 2532283 - protein, 26 aa, Entamoeba dispar
LMSQKKFYPYCSFTLNGSVYSTYYVD

SEQ ID NO: 2532284 - protein, 18 aa, Entamoeba dispar
LMSRFDLFFVVLDEPNEE

SEQ ID NO: 2532285 - protein, 19 aa, Entamoeba dispar
LMSSLHFLQFLLQQNLEIE

SEQ ID NO: 2532286 - protein, 25 aa, Entamoeba dispar
LMTCEQFIRPPVIIKVRTFTSNKLA

SEQ ID NO: 2532287 - protein, 18 aa, Entamoeba dispar
LMTNKRYNSYLSKRMRVI

SEQ ID NO: 2532288 - protein, 20 aa, Entamoeba dispar
LMVMELLGPSLEDLFTYCGR

SEQ ID NO: 2532289 - protein, 17 aa, Entamoeba dispar
LMYIVQTNDNNVFGTYN

SEQ ID NO: 2532290 - protein, 18 aa, Entamoeba dispar
LMYSILEKSDKYLTQKSK

SEQ ID NO: 2532291 - protein, 28 aa, Entamoeba dispar
LNAIEGMCSLIQWIKKDLPLSPDDTNQT

SEQ ID NO: 2532292 - protein, 19 aa, Entamoeba dispar
LNALKKFFPGMETLSLINP

SEQ ID NO: 2532293 - protein, 17 aa, Entamoeba dispar
LNALLKKNLRSIDYKYC

SEQ ID NO: 2532294 - protein, 22 aa, Entamoeba dispar
LNAPHHWMLSKLGGTFAPKPSH

SEQ ID NO: 2532295 - protein, 27 aa, Entamoeba dispar
LNAVIWLEHYLMNWKKSLLLVSHDTSF

SEQ ID NO: 2532296 - protein, 17 aa, Entamoeba dispar
LNAYIQRQEQYKQDEIE

SEQ ID NO: 2532297 - protein, 28 aa, Entamoeba dispar
LNCGKTTFLNLLQSLPFDKQYNPSSDKE

SEQ ID NO: 2532298 - protein, 30 aa, Entamoeba dispar
LNCIMIDPEILFITPSPYPQEIKILIFNYS

SEQ ID NO: 2532299 - protein, 29 aa, Entamoeba dispar
LNCKNLHCLLLHNYPMFEKELKSIEGKTI

SEQ ID NO: 2532300 - protein, 21 aa, Entamoeba dispar
LNCLEFDAFKLVIDVMKEKQL

SEQ ID NO: 2532301 - protein, 23 aa, Entamoeba dispar
LNCNPLGVNVLWSDGSLSWYSSD

SEQ ID NO: 2532302 - protein, 17 aa, Entamoeba dispar
LNCPFYTRNGKLIKVIP

SEQ ID NO: 2532303 - protein, 17 aa, Entamoeba dispar
LNCPLKVITFKKGNHFH

SEQ ID NO: 2532304 - protein, 25 aa, Entamoeba dispar
LNCTDKMILPILKFIHGIVSIELVD

SEQ ID NO: 2532305 - protein, 23 aa, Entamoeba dispar
LNCYQNLLYHLYMKKKSIEESID

SEQ ID NO: 2532306 - protein, 26 aa, Entamoeba dispar
LNDEKLKMEIFYPSIVIHVVKKKDLG

SEQ ID NO: 2532307 - protein, 17 aa, Entamoeba dispar
LNDFVIGIAKYQLYATI

SEQ ID NO: 2532308 - protein, 26 aa, Entamoeba dispar
LNDHDELTLMYSKTTFLRGTAMILKS

SEQ ID NO: 2532309 - protein, 23 aa, Entamoeba dispar
LNDIWRLRRSLFIICKQNKESFE

SEQ ID NO: 2532310 - protein, 23 aa, Entamoeba dispar
LNDKLNFIHLRQMTSLTSLTINP

SEQ ID NO: 2532311 - protein, 20 aa, Entamoeba dispar
LNDLQIKQDNKIIELNNIIN

SEQ ID NO: 2532312 - protein, 28 aa, Entamoeba dispar
LNDLYNNPIDFQPLFGRGNCGGLDIVIK

SEQ ID NO: 2532313 - protein, 26 aa, Entamoeba dispar
LNDLYSNAITFYFTPTELVEQNQKRL

SEQ ID NO: 2532314 - protein, 32 aa, Entamoeba dispar
LNDNYLNILFNYYSIIIFDIQHYFEIFNQYDS

SEQ ID NO: 2532315 - protein, 25 aa, Entamoeba dispar
LNDPYSYFMISRINNPLISKKSCII

SEQ ID NO: 2532316 - protein, 27 aa, Entamoeba dispar
LNDVIMGSLFIRLLHVKICRVEMNLIR

SEQ ID NO: 2532317 - protein, 23 aa, Entamoeba dispar
LNDYFTQLLNLHLQYERGTRSLW

SEQ ID NO: 2532318 - protein, 24 aa, Entamoeba dispar
LNEDDMWMKLYGKDIFEGNCSSYN

SEQ ID NO: 2532319 - protein, 23 aa, Entamoeba dispar
LNEFFADMFTLKDICDDFVELFK

SEQ ID NO: 2532320 - protein, 19 aa, Entamoeba dispar
LNEFIKITLRMFCGEIGKG

SEQ ID NO: 2532321 - protein, 17 aa, Entamoeba dispar
LNEFPTNLVPFPRDHFA

SEQ ID NO: 2532322 - protein, 21 aa, Entamoeba dispar
LNEFQNIIEWYDGSKPEEFIP

SEQ ID NO: 2532323 - protein, 26 aa, Entamoeba dispar
LNEHSRKFFPNIETFYIYIISDEEFD

SEQ ID NO: 2532324 - protein, 18 aa, Entamoeba dispar
LNEIHDLFDALPLAALVE

SEQ ID NO: 2532325 - protein, 17 aa, Entamoeba dispar
LNEILNYELNPFLLTTH

SEQ ID NO: 2532326 - protein, 20 aa, Entamoeba dispar
LNEKVPSSCFIFINMKNQNI

SEQ ID NO: 2532327 - protein, 17 aa, Entamoeba dispar
LNELFNRDSIWMDKVLS

SEQ ID NO: 2532328 - protein, 17 aa, Entamoeba dispar
LNELIIPFNGSELLEYC

SEQ ID NO: 2532329 - protein, 26 aa, Entamoeba dispar
LNELPIEFIGLYLLVKTILNIFNLTL

SEQ ID NO: 2532330 - protein, 23 aa, Entamoeba dispar
LNEPDLLFVKSLDELIALCQKHK

SEQ ID NO: 2532331 - protein, 24 aa, Entamoeba dispar
LNEPLFIISPQYDNVFVNKIMIGY

SEQ ID NO: 2532332 - protein, 24 aa, Entamoeba dispar
LNEQKEIIMLQGDTIRYLENELKT

SEQ ID NO: 2532333 - protein, 23 aa, Entamoeba dispar
LNEQQEFLEFNTIDDIKVDELTK

SEQ ID NO: 2532334 - protein, 28 aa, Entamoeba dispar
LNESRFIEIFFKLYIAYCQFGELNRKSS

SEQ ID NO: 2532335 - protein, 21 aa, Entamoeba dispar
LNETIFCMKKESKFFTGEIIK

SEQ ID NO: 2532336 - protein, 26 aa, Entamoeba dispar
LNETLKKFRWNPISIKTKKLFPLIQT

SEQ ID NO: 2532337 - protein, 17 aa, Entamoeba dispar
LNFAKMKFLATNYSHED

SEQ ID NO: 2532338 - protein, 23 aa, Entamoeba dispar
LNFDLICPLVYKDSVLIACYEDK

SEQ ID NO: 2532339 - protein, 18 aa, Entamoeba dispar
LNFFKIIGKGKKVYMRKI

SEQ ID NO: 2532340 - protein, 34 aa, Entamoeba dispar
LNFVLLNPQYPLLNLPNELIPIFDFIKSKIIDQY

SEQ ID NO: 2532341 - protein, 26 aa, Entamoeba dispar
LNFVVCNMLFNWNLPSIVNSSDPLIL

SEQ ID NO: 2532342 - protein, 17 aa, Entamoeba dispar
LNFYKYDSGIEIIQNIV

SEQ ID NO: 2532343 - protein, 17 aa, Entamoeba dispar
LNGFSSTLRIFGNKTFL

SEQ ID NO: 2532344 - protein, 22 aa, Entamoeba dispar
LNGFTLERNILGQRLNFINFDK

SEQ ID NO: 2532345 - protein, 25 aa, Entamoeba dispar
LNGKLYYVTFIYSYSSVLTLEKAEQ

SEQ ID NO: 2532346 - protein, 28 aa, Entamoeba dispar
LNGLEETLISMLRPFLSKDVLYEPIKEL

SEQ ID NO: 2532347 - protein, 24 aa, Entamoeba dispar
LNGTSVLFNWCKKGHILLATTSTD

SEQ ID NO: 2532348 - protein, 24 aa, Entamoeba dispar
LNHFIIICFGLDDCFIPLLQTVQS

SEQ ID NO: 2532349 - protein, 19 aa, Entamoeba dispar
LNHFLFSLSSPYLTEPTKF

SEQ ID NO: 2532350 - protein, 17 aa, Entamoeba dispar
LNHIEICYYLNELLKAL

SEQ ID NO: 2532351 - protein, 26 aa, Entamoeba dispar
LNHKHYLCTGFDLFTTHEPCLMCGMA

SEQ ID NO: 2532352 - protein, 18 aa, Entamoeba dispar
LNHPILSTRLRDITTTLL

SEQ ID NO: 2532353 - protein, 18 aa, Entamoeba dispar
LNHSILVAYLAIISKQMN

SEQ ID NO: 2532354 - protein, 17 aa, Entamoeba dispar
LNIIDQFVSGLIDPLSE

SEQ ID NO: 2532355 - protein, 28 aa, Entamoeba dispar
LNIIEKYLKYKGYFYERLDGSIKSEDRQ

SEQ ID NO: 2532356 - protein, 22 aa, Entamoeba dispar
LNIILQIFQYSFVKYEALYEMC

SEQ ID NO: 2532357 - protein, 20 aa, Entamoeba dispar
LNIIVIYLNKIHNILIQVCD

SEQ ID NO: 2532358 - protein, 25 aa, Entamoeba dispar
LNIKESYWYLGLLYEYGVGGIQNQS

SEQ ID NO: 2532359 - protein, 21 aa, Entamoeba dispar
LNILLTKSFIMRNINLMGIVK

SEQ ID NO: 2532360 - protein, 24 aa, Entamoeba dispar
LNINYKIFSFDLFNALQTQLYQAV

SEQ ID NO: 2532361 - protein, 17 aa, Entamoeba dispar
LNIPSQRGMIRIPPPSQ

SEQ ID NO: 2532362 - protein, 24 aa, Entamoeba dispar
LNIRKNLLMPYISKLLITLQQINP

SEQ ID NO: 2532363 - protein, 24 aa, Entamoeba dispar
LNKENLLFIYQTNLKSHIAGIFIK

SEQ ID NO: 2532364 - protein, 24 aa, Entamoeba dispar
LNKGMPPLCFLIESIHLKGGLEHL

SEQ ID NO: 2532365 - protein, 18 aa, Entamoeba dispar
LNKIAKSAPKRKTTKRIT

SEQ ID NO: 2532366 - protein, 26 aa, Entamoeba dispar
LNKILVKPWIYRDIYDRARSSCFRGI

SEQ ID NO: 2532367 - protein, 26 aa, Entamoeba dispar
LNKKIIKYLVYFVSKQPFCESEGQNV

SEQ ID NO: 2532368 - protein, 22 aa, Entamoeba dispar
LNKKLHNMFIELKGIKEEREKL

SEQ ID NO: 2532369 - protein, 21 aa, Entamoeba dispar
LNKKMIINFSIRRCGIIVLNE

SEQ ID NO: 2532370 - protein, 17 aa, Entamoeba dispar
LNKLKKYTKKWANTHIK

SEQ ID NO: 2532371 - protein, 33 aa, Entamoeba dispar
LNKNNITFEFIVKWLLMLFKREFNSKEVLRLWD

SEQ ID NO: 2532372 - protein, 23 aa, Entamoeba dispar
LNKNYAPALIGLALCELKDHKDG

SEQ ID NO: 2532373 - protein, 28 aa, Entamoeba dispar
LNKRSTIGRIFFWLIKSELHIPETQRRF

SEQ ID NO: 2532374 - protein, 28 aa, Entamoeba dispar
LNKSAVILWNQFQILIKDLRGISIQISK

SEQ ID NO: 2532375 - protein, 27 aa, Entamoeba dispar
LNKSENDFILPITKLIISIISHPSFQH

SEQ ID NO: 2532376 - protein, 25 aa, Entamoeba dispar
LNKTEGVMFLFSDTLMFTKSNKEHE

SEQ ID NO: 2532377 - protein, 26 aa, Entamoeba dispar
LNKTTQLYGLLKRDIINVKSLYLRDT

SEQ ID NO: 2532378 - protein, 25 aa, Entamoeba dispar
LNLEEFYRFKSLAPLIDLKVAPATS

SEQ ID NO: 2532379 - protein, 26 aa, Entamoeba dispar
LNLEQWKGIILKYENEKWLKIHLQHV

SEQ ID NO: 2532380 - protein, 22 aa, Entamoeba dispar
LNLETFCVELPRICIDKGMNIT

SEQ ID NO: 2532381 - protein, 33 aa, Entamoeba dispar
LNLGDIHLKFIYQPFLHWPDTMITLIEEMNVLV

SEQ ID NO: 2532382 - protein, 20 aa, Entamoeba dispar
LNLIGCSRLILFDPDWNPAK

SEQ ID NO: 2532383 - protein, 17 aa, Entamoeba dispar
LNLIIDNKQLEYLEVGS

SEQ ID NO: 2532384 - protein, 19 aa, Entamoeba dispar
LNLIIYKFYVIHFSTGNAL

SEQ ID NO: 2532385 - protein, 29 aa, Entamoeba dispar
LNLISFNGFFDFKNIKLPPSIKKLILEFT

SEQ ID NO: 2532386 - protein, 25 aa, Entamoeba dispar
LNLKQLPFNSITLPLNLQILELFSV

SEQ ID NO: 2532387 - protein, 26 aa, Entamoeba dispar
LNLLKSVYQRFGLIPLQTLFEEATNL

SEQ ID NO: 2532388 - protein, 25 aa, Entamoeba dispar
LNLMKKIYKIFGFKTEIALSTRNEK

SEQ ID NO: 2532389 - protein, 20 aa, Entamoeba dispar
LNLNIFDIPKQEDKDNPFLK

SEQ ID NO: 2532390 - protein, 26 aa, Entamoeba dispar
LNLQELLHIKIEGFEYTFLNEGFGYD

SEQ ID NO: 2532391 - protein, 28 aa, Entamoeba dispar
LNLQEMNLFFFPIHPSFPILNGITKLDL

SEQ ID NO: 2532392 - protein, 17 aa, Entamoeba dispar
LNLSHAVGIALNYMHMR

SEQ ID NO: 2532393 - protein, 18 aa, Entamoeba dispar
LNLSTFCGIPLWNVTDDD

SEQ ID NO: 2532394 - protein, 20 aa, Entamoeba dispar
LNLVGPFCYLDLPDLLFIDK

SEQ ID NO: 2532395 - protein, 24 aa, Entamoeba dispar
LNMKLIHVNILPLSKYPTTLTSLS

SEQ ID NO: 2532396 - protein, 25 aa, Entamoeba dispar
LNMLQPYFTHLYPSIQKGLFCLMHI

SEQ ID NO: 2532397 - protein, 31 aa, Entamoeba dispar
LNNEPLKVNQLFPNALQPLSLLRINHCKNYK

SEQ ID NO: 2532398 - protein, 17 aa, Entamoeba dispar
LNNILSFCGFENDDQVE

SEQ ID NO: 2532399 - protein, 20 aa, Entamoeba dispar
LNNIVYRQLQRGIKFHGSDE

SEQ ID NO: 2532400 - protein, 27 aa, Entamoeba dispar
LNNKVDLTFLIRPSKTNPKFPFTISKR

SEQ ID NO: 2532401 - protein, 31 aa, Entamoeba dispar
LNNLKMPSINPKNPMWHPERKFVKKLTNQTR

SEQ ID NO: 2532402 - protein, 25 aa, Entamoeba dispar
LNNMPFGLQRIFGDLTFSNVLSIVS

SEQ ID NO: 2532403 - protein, 25 aa, Entamoeba dispar
LNNNSFRIFPWKKRSKLVFCVPGAF

SEQ ID NO: 2532404 - protein, 30 aa, Entamoeba dispar
LNNPSFVVSSFLPISAYLLAPVSHFSVYPQ

SEQ ID NO: 2532405 - protein, 23 aa, Entamoeba dispar
LNNPTFLPIIHSISSHISSCTSI

SEQ ID NO: 2532406 - protein, 28 aa, Entamoeba dispar
LNNSIIEFQIYQKLFKLFNKALNNPIKT

SEQ ID NO: 2532407 - protein, 24 aa, Entamoeba dispar
LNNSRFLNQRFLLKMVIQAADAFK

SEQ ID NO: 2532408 - protein, 22 aa, Entamoeba dispar
LNNTFYSRLIFNLYYEDRQIDV

SEQ ID NO: 2532409 - protein, 25 aa, Entamoeba dispar
LNNTPIGLCWSFLFGEEGLQLDPKK

SEQ ID NO: 2532410 - protein, 18 aa, Entamoeba dispar
LNNVQIIRKYHIIERIHS

SEQ ID NO: 2532411 - protein, 27 aa, Entamoeba dispar
LNPFRQKLPLYLFPQDQIDSIWPNKNE

SEQ ID NO: 2532412 - protein, 17 aa, Entamoeba dispar
LNPIYTSDYTYQATVKQ

SEQ ID NO: 2532413 - protein, 26 aa, Entamoeba dispar
LNPNIVFIQNLILKNGTIRKLLEYPE

SEQ ID NO: 2532414 - protein, 26 aa, Entamoeba dispar
LNPSDKFLQLFLLYVSKELTVDEEIQ

SEQ ID NO: 2532415 - protein, 20 aa, Entamoeba dispar
LNPSLIIPYLPIITSEDLLP

SEQ ID NO: 2532416 - protein, 17 aa, Entamoeba dispar
LNPSMIYLYAKGVNSDS

SEQ ID NO: 2532417 - protein, 21 aa, Entamoeba dispar
LNPWKTMPDIFYAFPKHFYDN

SEQ ID NO: 2532418 - protein, 23 aa, Entamoeba dispar
LNPWNSYVLLCKEGIYVWRGQYS

SEQ ID NO: 2532419 - protein, 21 aa, Entamoeba dispar
LNPYLIYKEIYVIENGFLSVL

SEQ ID NO: 2532420 - protein, 20 aa, Entamoeba dispar
LNQCYIDFYVKLITEKTSSK

SEQ ID NO: 2532421 - protein, 30 aa, Entamoeba dispar
LNQEETLEFHYYLWKVFEFEMKKLNLDTNV

SEQ ID NO: 2532422 - protein, 22 aa, Entamoeba dispar
LNQICMSIKLIFDLFNEFYQFK

SEQ ID NO: 2532423 - protein, 26 aa, Entamoeba dispar
LNQIPNRRFTLWWSPTINRGSVYVGF

SEQ ID NO: 2532424 - protein, 25 aa, Entamoeba dispar
LNQKPYFIFQCIHPNKFYDDPFVML

SEQ ID NO: 2532425 - protein, 28 aa, Entamoeba dispar
LNQLSGRVTINLHFTWYDTYLQEDSKPK

SEQ ID NO: 2532426 - protein, 20 aa, Entamoeba dispar
LNQQFILQPIDPIKSELFRR

SEQ ID NO: 2532427 - protein, 27 aa, Entamoeba dispar
LNQSTKTMRRPLPPLPIQETKTRSTET

SEQ ID NO: 2532428 - protein, 29 aa, Entamoeba dispar
LNQSTKTMRRPLPPLPIQETKTRSTETLS

SEQ ID NO: 2532429 - protein, 28 aa, Entamoeba dispar
LNQTLENLRFWPSILLHVVIKNIGEKKE

SEQ ID NO: 2532430 - protein, 23 aa, Entamoeba dispar
LNQVVAPELPPKSSNPYFPKSKI

SEQ ID NO: 2532431 - protein, 21 aa, Entamoeba dispar
LNRFALNTSLIFLSKHREFLP

SEQ ID NO: 2532432 - protein, 26 aa, Entamoeba dispar
LNRKRIVNEFLLKNKNHQLLIKSAEK

SEQ ID NO: 2532433 - protein, 28 aa, Entamoeba dispar
LNRYFGTDILLFVDLLEGSTIVLMFNPS

SEQ ID NO: 2532434 - protein, 18 aa, Entamoeba dispar
LNSFKRPIIISESDIFIS

SEQ ID NO: 2532435 - protein, 21 aa, Entamoeba dispar
LNSFSTWNKKFAKKRSKAVVN

SEQ ID NO: 2532436 - protein, 17 aa, Entamoeba dispar
LNSGDVFIIDKVDKIYV

SEQ ID NO: 2532437 - protein, 23 aa, Entamoeba dispar
LNSILDMYATILRVLGQHPPKEP

SEQ ID NO: 2532438 - protein, 19 aa, Entamoeba dispar
LNSIRQYNFFGGKTNAIAL

SEQ ID NO: 2532439 - protein, 20 aa, Entamoeba dispar
LNSIRQYNFFGGKTNAIALA

SEQ ID NO: 2532440 - protein, 26 aa, Entamoeba dispar
LNSKNKRFMDLLKKLSLQKEVKNLNI

SEQ ID NO: 2532441 - protein, 17 aa, Entamoeba dispar
LNSLDLVSMLIQCLVKR

SEQ ID NO: 2532442 - protein, 23 aa, Entamoeba dispar
LNSLEKAFYFKYLNDVRLEMKHI

SEQ ID NO: 2532443 - protein, 17 aa, Entamoeba dispar
LNSLKRKAKLLHSVLNE

SEQ ID NO: 2532444 - protein, 37 aa, Entamoeba dispar
LNSMKELFFYDLPSTLFKYLLYPIIFKDSFSQQSIIL

SEQ ID NO: 2532445 - protein, 23 aa, Entamoeba dispar
LNSTFSRMLLFIETTFAPVTQIE

SEQ ID NO: 2532446 - protein, 19 aa, Entamoeba dispar
LNSYLSLPQTQRIPQLLRF

SEQ ID NO: 2532447 - protein, 22 aa, Entamoeba dispar
LNSYNAWVKRKYGKTAKKDMRM

SEQ ID NO: 2532448 - protein, 33 aa, Entamoeba dispar
LNTAIDPPLLSRFDIILLLLDDRSKIWDEQVSD

SEQ ID NO: 2532449 - protein, 21 aa, Entamoeba dispar
LNTDILIGILSRIVKLRNKRG

SEQ ID NO: 2532450 - protein, 22 aa, Entamoeba dispar
LNTDILIGILSRIVKLRNKRGE

SEQ ID NO: 2532451 - protein, 23 aa, Entamoeba dispar
LNTFYQLIPIDLTTGTTGLLPHH

SEQ ID NO: 2532452 - protein, 28 aa, Entamoeba dispar
LNTGTFSLLMPIFRWVISKKDKTTEIVK

SEQ ID NO: 2532453 - protein, 22 aa, Entamoeba dispar
LNTIVFKLTAFGSRAGIFVKAI

SEQ ID NO: 2532454 - protein, 18 aa, Entamoeba dispar
LNTMLIPGLRELFIKYKQ

SEQ ID NO: 2532455 - protein, 49 aa, Entamoeba dispar
LNTPMLLTNLQYDSLLLFITSLQPCFPRYLSLLFPNDLPTTFWQRCNIS

SEQ ID NO: 2532456 - protein, 25 aa, Entamoeba dispar
LNTRKFLHTLFENVIFIFNNESGEI

SEQ ID NO: 2532457 - protein, 28 aa, Entamoeba dispar
LNVLKQGYLSFIIKLKMECLEKLMDDFD

SEQ ID NO: 2532458 - protein, 19 aa, Entamoeba dispar
LNVLPLTRFDDEIIFTMFT

SEQ ID NO: 2532459 - protein, 35 aa, Entamoeba dispar
LNVLYDCCLELPLNLIIPVLYFAFNNMLNHEKVWD

SEQ ID NO: 2532460 - protein, 27 aa, Entamoeba dispar
LNVSAFVNSLILFLLELSHCGSQTNTS

SEQ ID NO: 2532461 - protein, 17 aa, Entamoeba dispar
LNVTLGIVPFGFDVFLD

SEQ ID NO: 2532462 - protein, 24 aa, Entamoeba dispar
LNVTQILKRLWKGVWKVVCGIIKE

SEQ ID NO: 2532463 - protein, 18 aa, Entamoeba dispar
LNVVRLIMKFINSNTILL

SEQ ID NO: 2532464 - protein, 32 aa, Entamoeba dispar
LNVWDRIFAYPERKLYYFICSAIILKNGDQIV

SEQ ID NO: 2532465 - protein, 18 aa, Entamoeba dispar
LNYCLKIFLKSEDMWMKY

SEQ ID NO: 2532466 - protein, 28 aa, Entamoeba dispar
LNYGEQTLPPIYWKYSFEDGIWSDQIPL

SEQ ID NO: 2532467 - protein, 34 aa, Entamoeba dispar
LNYHNGPEWIWPYGYYVMAILIYNPDNLNKDDLQ

SEQ ID NO: 2532468 - protein, 30 aa, Entamoeba dispar
LNYLEGDLELILYFLTRYTNYGREKFIKIP

SEQ ID NO: 2532469 - protein, 21 aa, Entamoeba dispar
LNYNELVIMNILNEYYNKYED

SEQ ID NO: 2532470 - protein, 31 aa, Entamoeba dispar
LNYNPQLGNWLFLWKQSLPLPLPSSSSTFDP

SEQ ID NO: 2532471 - protein, 30 aa, Entamoeba dispar
LNYSKQINRLFSFILKNILTIFPSSKRCFN

SEQ ID NO: 2532472 - protein, 29 aa, Entamoeba dispar
LPAALVSRFDLLFVLLDDATQDFDKELAL

SEQ ID NO: 2532473 - protein, 25 aa, Entamoeba dispar
LPAKEYHYLFISLNEKEFRYDLSST

SEQ ID NO: 2532474 - protein, 17 aa, Entamoeba dispar
LPALIKLAKETTGDELI

SEQ ID NO: 2532475 - protein, 30 aa, Entamoeba dispar
LPANDEFILPFKNCLIKLIQKHIITVDKLL

SEQ ID NO: 2532476 - protein, 17 aa, Entamoeba dispar
LPCIPTLTLYNVLSEPL

SEQ ID NO: 2532477 - protein, 18 aa, Entamoeba dispar
LPCRIGTDSYKYSVRPYP

SEQ ID NO: 2532478 - protein, 26 aa, Entamoeba dispar
LPDISYNCFAKLEALLLGINIIDRLP

SEQ ID NO: 2532479 - protein, 18 aa, Entamoeba dispar
LPDITIINLLPSLNKILP

SEQ ID NO: 2532480 - protein, 30 aa, Entamoeba dispar
LPDIYNYILDTYLFVRKYFTLDNEGKMQLL

SEQ ID NO: 2532481 - protein, 28 aa, Entamoeba dispar
LPDMNEFYRNILIKQNTIIKDKLLPEFQ

SEQ ID NO: 2532482 - protein, 27 aa, Entamoeba dispar
LPDVNKNTLWYLCYFCQEVVKNVEKTQ

SEQ ID NO: 2532483 - protein, 28 aa, Entamoeba dispar
LPEELSNMIALKILRIGFNKLSGNIDVL

SEQ ID NO: 2532484 - protein, 17 aa, Entamoeba dispar
LPEFLVSLHYNFHTLLY

SEQ ID NO: 2532485 - protein, 17 aa, Entamoeba dispar
LPEKKQFVLEKPQVVIK

SEQ ID NO: 2532486 - protein, 28 aa, Entamoeba dispar
LPEKLKNKLWYSNIYCGIIRGSLEMLKY

SEQ ID NO: 2532487 - protein, 21 aa, Entamoeba dispar
LPEMIEVMILLILETGMDFKG

SEQ ID NO: 2532488 - protein, 24 aa, Entamoeba dispar
LPESIKYISFSLSDSKLIMSNKHI

SEQ ID NO: 2532489 - protein, 20 aa, Entamoeba dispar
LPGAIRILNYFKKHHIPIAL

SEQ ID NO: 2532490 - protein, 19 aa, Entamoeba dispar
LPGKLILPSSLTSLTTPYL

SEQ ID NO: 2532491 - protein, 19 aa, Entamoeba dispar
LPGLIRHAALNYSRPVYLA

SEQ ID NO: 2532492 - protein, 17 aa, Entamoeba dispar
LPGLYWVGVMDYELKKY

SEQ ID NO: 2532493 - protein, 27 aa, Entamoeba dispar
LPGPYIKYFVQSIGPAGLYKMAKGFND

SEQ ID NO: 2532494 - protein, 24 aa, Entamoeba dispar
LPHHECLVFDYYELGPLNKIISER

SEQ ID NO: 2532495 - protein, 20 aa, Entamoeba dispar
LPHLRNLFKALNLTYKKMST

SEQ ID NO: 2532496 - protein, 22 aa, Entamoeba dispar
LPHNLIIDILVKGTEYLRLTDN

SEQ ID NO: 2532497 - protein, 20 aa, Entamoeba dispar
LPHSLFKMICIFNIDSISSP

SEQ ID NO: 2532498 - protein, 18 aa, Entamoeba dispar
LPHTLLLGLLHKDPIINS

SEQ ID NO: 2532499 - protein, 20 aa, Entamoeba dispar
LPIAEHICALLFPSFSKTIT

SEQ ID NO: 2532500 - protein, 19 aa, Entamoeba dispar
LPIDVFSFGMTMYHIFTNE

SEQ ID NO: 2532501 - protein, 18 aa, Entamoeba dispar
LPIIYKSEWIKYIQILLQ

SEQ ID NO: 2532502 - protein, 17 aa, Entamoeba dispar
LPILATHLSLRVNKIKI

SEQ ID NO: 2532503 - protein, 17 aa, Entamoeba dispar
LPILRTMSFYDDVLVKL

SEQ ID NO: 2532504 - protein, 20 aa, Entamoeba dispar
LPIVICTPFISSVQCIEFLA

SEQ ID NO: 2532505 - protein, 25 aa, Entamoeba dispar
LPIYHINCIFLHRFERYYGSINVIE

SEQ ID NO: 2532506 - protein, 19 aa, Entamoeba dispar
LPKDNLPILPIKMTEHQIG

SEQ ID NO: 2532507 - protein, 20 aa, Entamoeba dispar
LPKEVILAIRRIPTKVQQVV

SEQ ID NO: 2532508 - protein, 34 aa, Entamoeba dispar
LPKNTFLFTSYYYNLINQTLFPYPLLSKQQNKKI

SEQ ID NO: 2532509 - protein, 20 aa, Entamoeba dispar
LPKQLATQPLPKYFSSPIGE

SEQ ID NO: 2532510 - protein, 30 aa, Entamoeba dispar
LPKTQTELYFLQSDYYKIGLFGLNGEYYES

SEQ ID NO: 2532511 - protein, 18 aa, Entamoeba dispar
LPLCFALALQNIDVWEFV

SEQ ID NO: 2532512 - protein, 18 aa, Entamoeba dispar
LPLIHSPEECQYDYIVSC

SEQ ID NO: 2532513 - protein, 17 aa, Entamoeba dispar
LPLIITQFKNEVLDAFM

SEQ ID NO: 2532514 - protein, 17 aa, Entamoeba dispar
LPLLQNGLIPPSYIQGN

SEQ ID NO: 2532515 - protein, 18 aa, Entamoeba dispar
LPLLTSKIESYWGYFPLK

SEQ ID NO: 2532516 - protein, 23 aa, Entamoeba dispar
LPLSLQKLFIFSSKFTIPNLNDI

SEQ ID NO: 2532517 - protein, 21 aa, Entamoeba dispar
LPLVNIFEIIISQLKLIPLQS

SEQ ID NO: 2532518 - protein, 25 aa, Entamoeba dispar
LPMHQSFFVFEFCVYAIQFGQWETT

SEQ ID NO: 2532519 - protein, 22 aa, Entamoeba dispar
LPMSWTSGHIWVGKKTINGPIH

SEQ ID NO: 2532520 - protein, 27 aa, Entamoeba dispar
LPNDCYIILHQLDFSDVLLLTTSVTKV

SEQ ID NO: 2532521 - protein, 26 aa, Entamoeba dispar
LPNDGLPEHNFYQFGGRPYNPPIPDE

SEQ ID NO: 2532522 - protein, 19 aa, Entamoeba dispar
LPNDIFFFDIKKNKMQIIS

SEQ ID NO: 2532523 - protein, 18 aa, Entamoeba dispar
LPNIILSFNFQQLLTYIG

SEQ ID NO: 2532524 - protein, 25 aa, Entamoeba dispar
LPNNYFQMFNWMRSVEIPTTITSIG

SEQ ID NO: 2532525 - protein, 24 aa, Entamoeba dispar
LPNSHINLFHFIRDGKIEDIKKMI

SEQ ID NO: 2532526 - protein, 28 aa, Entamoeba dispar
LPPAGTLFQPLVASLLRCFLHNPLSPKV

SEQ ID NO: 2532527 - protein, 28 aa, Entamoeba dispar
LPPGIHRFPFSFILPQTHCPMLVLPNEE

SEQ ID NO: 2532528 - protein, 35 aa, Entamoeba dispar
LPPKMEIKIFVQLTPFQKVWYRKVLMGDVTVIIGD

SEQ ID NO: 2532529 - protein, 27 aa, Entamoeba dispar
LPPQQPIQEILPYQQIIIKPEQKKKSP

SEQ ID NO: 2532530 - protein, 17 aa, Entamoeba dispar
LPQGYVMYYYRNKWCFI

SEQ ID NO: 2532531 - protein, 26 aa, Entamoeba dispar
LPQLSLFDLRRYFTTYPVTSITGLNL

SEQ ID NO: 2532532 - protein, 26 aa, Entamoeba dispar
LPQNQRIPQLLRIISSLNPQENALIS

SEQ ID NO: 2532533 - protein, 25 aa, Entamoeba dispar
LPQNTNELFLYKNFAKFGAIEQCNC

SEQ ID NO: 2532534 - protein, 35 aa, Entamoeba dispar
LPQPQAYTPLIIPKEIWRLCNYVLPFIHDPNFISL

SEQ ID NO: 2532535 - protein, 25 aa, Entamoeba dispar
LPQTYLNSIVLLLNNVREILNEIGS

SEQ ID NO: 2532536 - protein, 21 aa, Entamoeba dispar
LPSFNILPKKMSHDQKRFQVF

SEQ ID NO: 2532537 - protein, 17 aa, Entamoeba dispar
LPSIIFPDTSKFIIKSK

SEQ ID NO: 2532538 - protein, 17 aa, Entamoeba dispar
LPSIKKILKTDLIAAYA

SEQ ID NO: 2532539 - protein, 17 aa, Entamoeba dispar
LPSLLQLLLPHTVLTDR

SEQ ID NO: 2532540 - protein, 18 aa, Entamoeba dispar
LPSPIQFCSTIKRLIING

SEQ ID NO: 2532541 - protein, 29 aa, Entamoeba dispar
LPSRDVFESLFWKTLYGRIVSGKIKSIDT

SEQ ID NO: 2532542 - protein, 21 aa, Entamoeba dispar
LPSSNYRIELWARGSLKEIEI

SEQ ID NO: 2532543 - protein, 17 aa, Entamoeba dispar
LPTCRFILNTNTVDGPY

SEQ ID NO: 2532544 - protein, 18 aa, Entamoeba dispar
LPTGCYCTYSLISKQECI

SEQ ID NO: 2532545 - protein, 21 aa, Entamoeba dispar
LPTIQLIIIMEIPYLAIHFNV

SEQ ID NO: 2532546 - protein, 17 aa, Entamoeba dispar
LPTTFPITLNQPNLQSF

SEQ ID NO: 2532547 - protein, 17 aa, Entamoeba dispar
LPTTLTTLNMRGLRRMP

SEQ ID NO: 2532548 - protein, 17 aa, Entamoeba dispar
LPTVFKLIQNKAEQTIC

SEQ ID NO: 2532549 - protein, 19 aa, Entamoeba dispar
LPTYLESICLMLVSFKSVE

SEQ ID NO: 2532550 - protein, 20 aa, Entamoeba dispar
LPVCTFFNCIKLEKIEIPSS

SEQ ID NO: 2532551 - protein, 20 aa, Entamoeba dispar
LPVHIIPEVKTRLYKFCQTH

SEQ ID NO: 2532552 - protein, 17 aa, Entamoeba dispar
LPVIISKGILKTLEVEV

SEQ ID NO: 2532553 - protein, 20 aa, Entamoeba dispar
LPVLKVNTKPVLRSAKTQPK

SEQ ID NO: 2532554 - protein, 18 aa, Entamoeba dispar
LPVLPLPQKEHFKEVLDL

SEQ ID NO: 2532555 - protein, 26 aa, Entamoeba dispar
LPYHRRREIFLQLFKESKLSEEHLSG

SEQ ID NO: 2532556 - protein, 27 aa, Entamoeba dispar
LPYSHPIDMWSLGCILPELLTTEPLFP

SEQ ID NO: 2532557 - protein, 22 aa, Entamoeba dispar
LQAISIAQYYKTDWPLLVICPS

SEQ ID NO: 2532558 - protein, 25 aa, Entamoeba dispar
LQCHDPPLFAIPKIFFCDIHTPKKE

SEQ ID NO: 2532559 - protein, 20 aa, Entamoeba dispar
LQCIRKWKSWKITELGLTSV

SEQ ID NO: 2532560 - protein, 25 aa, Entamoeba dispar
LQCVSNLLGIPREVPVIIPPSELIE

SEQ ID NO: 2532561 - protein, 17 aa, Entamoeba dispar
LQDAIVKTLNKPLSKTI

SEQ ID NO: 2532562 - protein, 28 aa, Entamoeba dispar
LQDALKLNAILILPPVYSINDIDLTKDF

SEQ ID NO: 2532563 - protein, 36 aa, Entamoeba dispar
LQDQRIIVVTFGNKLYFWAKLEVRLTEIIKLLKTMM

SEQ ID NO: 2532564 - protein, 18 aa, Entamoeba dispar
LQEIVKILIPFTSNFKMP

SEQ ID NO: 2532565 - protein, 20 aa, Entamoeba dispar
LQEIYLIVKGISRTLLSEIN

SEQ ID NO: 2532566 - protein, 32 aa, Entamoeba dispar
LQEKGIENALFLFRWMSLLLTEELPINSLVMF

SEQ ID NO: 2532567 - protein, 28 aa, Entamoeba dispar
LQEQVIFISRLLFSIYSPSLQNKNTLKC

SEQ ID NO: 2532568 - protein, 25 aa, Entamoeba dispar
LQETNRRCLSLPNLLLKIFNCKSTI

SEQ ID NO: 2532569 - protein, 25 aa, Entamoeba dispar
LQEWSGLLNCEILFDSDNDDAENDN

SEQ ID NO: 2532570 - protein, 17 aa, Entamoeba dispar
LQFEKLRYQLEVNKYNI

SEQ ID NO: 2532571 - protein, 27 aa, Entamoeba dispar
LQFESTPLYPIPSFVLSPLTGRVKLYN

SEQ ID NO: 2532572 - protein, 19 aa, Entamoeba dispar
LQFILPQTPEAVLSWIQSC

SEQ ID NO: 2532573 - protein, 22 aa, Entamoeba dispar
LQFISQERIFINEPVLVSIKIP

SEQ ID NO: 2532574 - protein, 18 aa, Entamoeba dispar
LQFITPLLEYSISYNTMA

SEQ ID NO: 2532575 - protein, 19 aa, Entamoeba dispar
LQFKFELFKMLYREMTMGV

SEQ ID NO: 2532576 - protein, 17 aa, Entamoeba dispar
LQFLVELEKSCKFNDVL

SEQ ID NO: 2532577 - protein, 18 aa, Entamoeba dispar
LQFNIYGQPVNIPINCSV

SEQ ID NO: 2532578 - protein, 25 aa, Entamoeba dispar
LQFQQQRQRPIQFAHGGFQPTIPGT

SEQ ID NO: 2532579 - protein, 24 aa, Entamoeba dispar
LQFSSIQCELLYSASLLLVYNKIE

SEQ ID NO: 2532580 - protein, 17 aa, Entamoeba dispar
LQFYTSYVQRNITSLRK

SEQ ID NO: 2532581 - protein, 51 aa, Entamoeba dispar
LQGIVLTMNFNKFRLSHNLKYIVKFISDIFPLKDIWKHVCIARRLKPIDEK

SEQ ID NO: 2532582 - protein, 25 aa, Entamoeba dispar
LQGLKLEGEFFVLTKRQFKRTRDGK

SEQ ID NO: 2532583 - protein, 21 aa, Entamoeba dispar
LQHAISWLFLNMCRGTIINYN

SEQ ID NO: 2532584 - protein, 27 aa, Entamoeba dispar
LQHVNHPFIVQLYYAFQTPEKLYMVME

SEQ ID NO: 2532585 - protein, 27 aa, Entamoeba dispar
LQIDITANILLKWISYLRSEGILLSNL

SEQ ID NO: 2532586 - protein, 22 aa, Entamoeba dispar
LQIEYFLKTPFLEELSLCDCSN

SEQ ID NO: 2532587 - protein, 17 aa, Entamoeba dispar
LQILIAIGDYAEALIFC

SEQ ID NO: 2532588 - protein, 17 aa, Entamoeba dispar
LQILLTNCPAVIAALFS

SEQ ID NO: 2532589 - protein, 34 aa, Entamoeba dispar
LQINGIFPLKDTIDAIGFYNLPYSVTVRKLHSNL

SEQ ID NO: 2532590 - protein, 19 aa, Entamoeba dispar
LQIQLQKYWNKIKSLRTSE

SEQ ID NO: 2532591 - protein, 28 aa, Entamoeba dispar
LQKIPEMRMAVLKPKLRGDFSSIIELLG

SEQ ID NO: 2532592 - protein, 17 aa, Entamoeba dispar
LQKKIGELLFDLKREEE

SEQ ID NO: 2532593 - protein, 17 aa, Entamoeba dispar
LQKLFVDMLKGINSATQ

SEQ ID NO: 2532594 - protein, 17 aa, Entamoeba dispar
LQKTLYILKIKTTFYNF

SEQ ID NO: 2532595 - protein, 20 aa, Entamoeba dispar
LQKVIAVYYPTSIFIRGHTS

SEQ ID NO: 2532596 - protein, 18 aa, Entamoeba dispar
LQKYVELRLAEREKELID

SEQ ID NO: 2532597 - protein, 17 aa, Entamoeba dispar
LQLDLSTSNLPYPSLTI

SEQ ID NO: 2532598 - protein, 18 aa, Entamoeba dispar
LQLEYFTGRTITPPTLIP

SEQ ID NO: 2532599 - protein, 24 aa, Entamoeba dispar
LQLGEDIIDLPLQIRGIGSIDNKP

SEQ ID NO: 2532600 - protein, 17 aa, Entamoeba dispar
LQLKKNQIPKRTITYSR

SEQ ID NO: 2532601 - protein, 38 aa, Entamoeba dispar
LQLKYNVICERPYKFKIKSLPFFKVKTLYNVYESIDVQ

SEQ ID NO: 2532602 - protein, 24 aa, Entamoeba dispar
LQLLPLCIDGFLWSRKSMADDVAK

SEQ ID NO: 2532603 - protein, 20 aa, Entamoeba dispar
LQLNGWFCNGTEIRFNLPQW

SEQ ID NO: 2532604 - protein, 31 aa, Entamoeba dispar
LQLNKQYDCIWIQWSILYLRDDDLIDMLKKC

SEQ ID NO: 2532605 - protein, 26 aa, Entamoeba dispar
LQMANYIEAEWWSKLIARFPSSKSKI

SEQ ID NO: 2532606 - protein, 23 aa, Entamoeba dispar
LQMKAVGMSWWELAIPIENIREA

SEQ ID NO: 2532607 - protein, 19 aa, Entamoeba dispar
LQMLKKAMPIIFEAGTLLR

SEQ ID NO: 2532608 - protein, 19 aa, Entamoeba dispar
LQMQSKMGGIPWKTEIDSG

SEQ ID NO: 2532609 - protein, 18 aa, Entamoeba dispar
LQMTAEYFVQPLLNGLDD

SEQ ID NO: 2532610 - protein, 20 aa, Entamoeba dispar
LQNFHRPLLPARDAEKMHIK

SEQ ID NO: 2532611 - protein, 24 aa, Entamoeba dispar
LQNFLNAFTFPDHTMYPIATTNEV

SEQ ID NO: 2532612 - protein, 25 aa, Entamoeba dispar
LQNGRFIPCVLYGAKAQLPGMNGDE

SEQ ID NO: 2532613 - protein, 25 aa, Entamoeba dispar
LQNGRFIPCVLYGAKAQLPGMTGDE

SEQ ID NO: 2532614 - protein, 21 aa, Entamoeba dispar
LQNIIKLKNILHEAALLQVEI

SEQ ID NO: 2532615 - protein, 25 aa, Entamoeba dispar
LQNISRLLEIYKTWGKNVRPGISFE

SEQ ID NO: 2532616 - protein, 24 aa, Entamoeba dispar
LQNKFFTHNLVFSHSLVTNVLFDD

SEQ ID NO: 2532617 - protein, 28 aa, Entamoeba dispar
LQNKIPQLPEYIKYICLQARMPNLIIDD

SEQ ID NO: 2532618 - protein, 22 aa, Entamoeba dispar
LQNKKCILYKEPCNYFKGDICY

SEQ ID NO: 2532619 - protein, 20 aa, Entamoeba dispar
LQNLPLLKRSISWHTGSILT

SEQ ID NO: 2532620 - protein, 26 aa, Entamoeba dispar
LQPDARIFVWKLVLGYYQFDMTTKQR

SEQ ID NO: 2532621 - protein, 25 aa, Entamoeba dispar
LQQAQEELLRMRRARYGNAKKPIPS

SEQ ID NO: 2532622 - protein, 21 aa, Entamoeba dispar
LQQFLTLPEGPKLMKFVIIHS

SEQ ID NO: 2532623 - protein, 23 aa, Entamoeba dispar
LQQGIIRGGLLYLLNHFVNDNEF

SEQ ID NO: 2532624 - protein, 23 aa, Entamoeba dispar
LQQGIIRGGLLYLLNHFVNDNEL

SEQ ID NO: 2532625 - protein, 20 aa, Entamoeba dispar
LQQLFSTDRFLYFFVLINNL

SEQ ID NO: 2532626 - protein, 34 aa, Entamoeba dispar
LQQTSNFMIIRGMKLFYFIINSSFPFGKKLIEQI

SEQ ID NO: 2532627 - protein, 17 aa, Entamoeba dispar
LQRALKLYKLPEQPNSI

SEQ ID NO: 2532628 - protein, 38 aa, Entamoeba dispar
LQRFDLLSLLITPIQRLPRYRLLLKDLLKHLRPSDIDY

SEQ ID NO: 2532629 - protein, 18 aa, Entamoeba dispar
LQRGFVQFCFDPITKLFN

SEQ ID NO: 2532630 - protein, 20 aa, Entamoeba dispar
LQRHGPQILLVPGRPSINQL

SEQ ID NO: 2532631 - protein, 21 aa, Entamoeba dispar
LQRLLMGILCANVNGGLFAIC

SEQ ID NO: 2532632 - protein, 19 aa, Entamoeba dispar
LQRRYLFLCSLKELKLTDY

SEQ ID NO: 2532633 - protein, 31 aa, Entamoeba dispar
LQRSGRTEAYFPYKIPTRTIYGGKNIDILLN

SEQ ID NO: 2532634 - protein, 18 aa, Entamoeba dispar
LQRTKADIKLFAKIFRFD

SEQ ID NO: 2532635 - protein, 20 aa, Entamoeba dispar
LQSIHRSMFSPITLPNQNEM

SEQ ID NO: 2532636 - protein, 21 aa, Entamoeba dispar
LQSIIMESVHIQPPGIANLIR

SEQ ID NO: 2532637 - protein, 17 aa, Entamoeba dispar
LQSISLLMNIPTAKWEN

SEQ ID NO: 2532638 - protein, 18 aa, Entamoeba dispar
LQSLYQYGNNMEQILSNN

SEQ ID NO: 2532639 - protein, 26 aa, Entamoeba dispar
LQSTDNFLLILDIQRSSKPLIIQKIP

SEQ ID NO: 2532640 - protein, 27 aa, Entamoeba dispar
LQSVKPIVLFWALRITSILLCSSADES

SEQ ID NO: 2532641 - protein, 24 aa, Entamoeba dispar
LQTAVQFCPLDYSIHARDLSHADI

SEQ ID NO: 2532642 - protein, 28 aa, Entamoeba dispar
LQTFFAAFNMKLFPRIMIYFGQTDNETR

SEQ ID NO: 2532643 - protein, 18 aa, Entamoeba dispar
LQTINIPTSISKIGYGCF

SEQ ID NO: 2532644 - protein, 28 aa, Entamoeba dispar
LQTLDTPFIVFPLLDILEVYENMKADFT

SEQ ID NO: 2532645 - protein, 19 aa, Entamoeba dispar
LQTVYSLIQLKSLYFEGST

SEQ ID NO: 2532646 - protein, 39 aa, Entamoeba dispar
LQVARFVKYLWTQQIKPLDALMLLGYRCPYRAVRAYCIS

SEQ ID NO: 2532647 - protein, 24 aa, Entamoeba dispar
LQVDFECVLLALLSPHYEFVMTKP

SEQ ID NO: 2532648 - protein, 30 aa, Entamoeba dispar
LQVDLFDFHLYVYEKMSIVAYLDLLRNVEN

SEQ ID NO: 2532649 - protein, 23 aa, Entamoeba dispar
LQVNLNCFIPMLKSILQERIEER

SEQ ID NO: 2532650 - protein, 33 aa, Entamoeba dispar
LQYIKQEKLECPLLFLWGNLYGNLQFVKEQNEN

SEQ ID NO: 2532651 - protein, 28 aa, Entamoeba dispar
LQYRAKTFLPYYIQPLLNLIPVDSTGLE

SEQ ID NO: 2532652 - protein, 17 aa, Entamoeba dispar
LQYYLPMDSVDFAGNSI

SEQ ID NO: 2532653 - protein, 23 aa, Entamoeba dispar
LRAGYLSYWNLINQKKREADNNY

SEQ ID NO: 2532654 - protein, 24 aa, Entamoeba dispar
LRANARLEALEPLLNQLTPAQNAV

SEQ ID NO: 2532655 - protein, 19 aa, Entamoeba dispar
LRANLYQILAKIIPRMTFY

SEQ ID NO: 2532656 - protein, 19 aa, Entamoeba dispar
LRCDPQDHYFLLTEPPMNP

SEQ ID NO: 2532657 - protein, 18 aa, Entamoeba dispar
LRCNGVLEGIRITRMGYP

SEQ ID NO: 2532658 - protein, 17 aa, Entamoeba dispar
LRDAIIWCDSRGVSYGC

SEQ ID NO: 2532659 - protein, 17 aa, Entamoeba dispar
LRDCFYLYITSFLFHKN

SEQ ID NO: 2532660 - protein, 25 aa, Entamoeba dispar
LRDMIAPFFLRRIKKEVLPSLPTRQ

SEQ ID NO: 2532661 - protein, 30 aa, Entamoeba dispar
LRDVCWSILFIINIKFFLTSQLVIEGERYL

SEQ ID NO: 2532662 - protein, 32 aa, Entamoeba dispar
LRECDNSFLQKFLLFDFHLKSIEGSLSFLQMF

SEQ ID NO: 2532663 - protein, 17 aa, Entamoeba dispar
LREDMIYSKAYDLYINN

SEQ ID NO: 2532664 - protein, 24 aa, Entamoeba dispar
LREEDALLAWVRQTTEGYAGVNIS

SEQ ID NO: 2532665 - protein, 21 aa, Entamoeba dispar
LREELKFYYSLYQTCIPMINK

SEQ ID NO: 2532666 - protein, 25 aa, Entamoeba dispar
LREIPIEILINPNIQFVLNVKRAFD

SEQ ID NO: 2532667 - protein, 21 aa, Entamoeba dispar
LRELRFLKMKEEKTRSLRTQI

SEQ ID NO: 2532668 - protein, 29 aa, Entamoeba dispar
LREPYSIVRFFLERLPLDKIYSIELTPNM

SEQ ID NO: 2532669 - protein, 23 aa, Entamoeba dispar
LRERALKLLCRFLDLGPWACDQA

SEQ ID NO: 2532670 - protein, 23 aa, Entamoeba dispar
LRFGARIFSLFPEASKAKVASVV

SEQ ID NO: 2532671 - protein, 19 aa, Entamoeba dispar
LRFHINTLVKPNISLAQTA

SEQ ID NO: 2532672 - protein, 18 aa, Entamoeba dispar
LRFMRIFDTSRTGHLNIY

SEQ ID NO: 2532673 - protein, 26 aa, Entamoeba dispar
LRGDFSSIIELLGNINLHLINKDYSS

SEQ ID NO: 2532674 - protein, 19 aa, Entamoeba dispar
LRGQYPYQWKRKASEMAAY

SEQ ID NO: 2532675 - protein, 18 aa, Entamoeba dispar
LRGRGVELLYLYIKNNFI

SEQ ID NO: 2532676 - protein, 25 aa, Entamoeba dispar
LRGWCFKNCKLLTSIEIPLTITSIG

SEQ ID NO: 2532677 - protein, 27 aa, Entamoeba dispar
LRHKYQLKHMLYIKFLENPELLDKIEK

SEQ ID NO: 2532678 - protein, 26 aa, Entamoeba dispar
LRHQAKAEYRALYRKCTKKIIKILLN

SEQ ID NO: 2532679 - protein, 28 aa, Entamoeba dispar
LRIGKKLIRYGFAPRISFLTSRTVQLGI

SEQ ID NO: 2532680 - protein, 35 aa, Entamoeba dispar
LRIHHVIGELPTYGYRRVWALLRRQAELDGMPAIN

SEQ ID NO: 2532681 - protein, 18 aa, Entamoeba dispar
LRIKQLRCKNQLNEFKRR

SEQ ID NO: 2532682 - protein, 19 aa, Entamoeba dispar
LRIRKLVDMAYKRDFRIIK

SEQ ID NO: 2532683 - protein, 19 aa, Entamoeba dispar
LRKAFDKLYKNTISQEIQS

SEQ ID NO: 2532684 - protein, 18 aa, Entamoeba dispar
LRKEIYHNPIIQYQLEEI

SEQ ID NO: 2532685 - protein, 24 aa, Entamoeba dispar
LRKHVRRIAAMPSLPLTDIQYLDN

SEQ ID NO: 2532686 - protein, 20 aa, Entamoeba dispar
LRKRNKYLLKIKNWIEEKCK

SEQ ID NO: 2532687 - protein, 26 aa, Entamoeba dispar
LRKSTILDLAKYFKQVYVWQGGDDIN

SEQ ID NO: 2532688 - protein, 17 aa, Entamoeba dispar
LRKYYFVKDLSHSHSSV

SEQ ID NO: 2532689 - protein, 17 aa, Entamoeba dispar
LRLESFSTIPISITELL

SEQ ID NO: 2532690 - protein, 36 aa, Entamoeba dispar
LRLINLGKIKFISEERIFMNEPLLISIEIPENLQII

SEQ ID NO: 2532691 - protein, 28 aa, Entamoeba dispar
LRLINLGKIKFISEERIFMNEPVLISIE

SEQ ID NO: 2532692 - protein, 18 aa, Entamoeba dispar
LRMRNKVFLPVQTNIKIP

SEQ ID NO: 2532693 - protein, 29 aa, Entamoeba dispar
LRNKNIIGHQFFWFLKAEMHDNRVTERYG

SEQ ID NO: 2532694 - protein, 29 aa, Entamoeba dispar
LRNKNRIGHQFFWFLKAELHDNRVTERYG

SEQ ID NO: 2532695 - protein, 21 aa, Entamoeba dispar
LRNRKSCQFIPKKLSEDQQRR

SEQ ID NO: 2532696 - protein, 17 aa, Entamoeba dispar
LRNTHLLERIYIYLESH

SEQ ID NO: 2532697 - protein, 30 aa, Entamoeba dispar
LRNVLRRVLRMFLYIHPKGYFQGLNDIVSI

SEQ ID NO: 2532698 - protein, 17 aa, Entamoeba dispar
LRNYILDCVKSILPSST

SEQ ID NO: 2532699 - protein, 20 aa, Entamoeba dispar
LRNYLANRWGLELSKRQIEI

SEQ ID NO: 2532700 - protein, 27 aa, Entamoeba dispar
LRPHINSSIYPIYIARALTVGSENSLI

SEQ ID NO: 2532701 - protein, 27 aa, Entamoeba dispar
LRPKAWQILLGYLPPNQFEWGLEIQQK

SEQ ID NO: 2532702 - protein, 19 aa, Entamoeba dispar
LRPTSETIIYPAFKNWISG

SEQ ID NO: 2532703 - protein, 24 aa, Entamoeba dispar
LRPYWKCYYEKCSAIIFVVDSTAT

SEQ ID NO: 2532704 - protein, 27 aa, Entamoeba dispar
LRQCDINIFFSLHYLFNQAKDNHLISP

SEQ ID NO: 2532705 - protein, 33 aa, Entamoeba dispar
LRQDCLILRAFKLFDNLWRMNGLDWRITPFRVI

SEQ ID NO: 2532706 - protein, 31 aa, Entamoeba dispar
LRQEKQNIKFFKYPTFTAVEINLYKAIGGLQ

SEQ ID NO: 2532707 - protein, 18 aa, Entamoeba dispar
LRQGILGPGLNKAGKFPT

SEQ ID NO: 2532708 - protein, 24 aa, Entamoeba dispar
LRQPLIALKVLLPLLKVPMPALNV

SEQ ID NO: 2532709 - protein, 28 aa, Entamoeba dispar
LRQTLGTLPLFLPYLTPQQQTYLYHETI

SEQ ID NO: 2532710 - protein, 17 aa, Entamoeba dispar
LRQYPTYKKLYAMQEKI

SEQ ID NO: 2532711 - protein, 17 aa, Entamoeba dispar
LRRQSLTPIIQMITLQM

SEQ ID NO: 2532712 - protein, 24 aa, Entamoeba dispar
LRRTEDMIYLLNSLVLDMNEVDAR

SEQ ID NO: 2532713 - protein, 19 aa, Entamoeba dispar
LRRTSVFISTPLTTLSDGS

SEQ ID NO: 2532714 - protein, 23 aa, Entamoeba dispar
LRSFFVNYIKLLKVNYLPLQEIQ

SEQ ID NO: 2532715 - protein, 26 aa, Entamoeba dispar
LRSPCRIVVVLLFHYLNKMYELNYDI

SEQ ID NO: 2532716 - protein, 28 aa, Entamoeba dispar
LRSRIIYKEKLIFVFKTENGFIGFYQSD

SEQ ID NO: 2532717 - protein, 28 aa, Entamoeba dispar
LRSRLNQFAIKYKYLYLTNEETILKITM

SEQ ID NO: 2532718 - protein, 30 aa, Entamoeba dispar
LRSYKMIIREGFLFFYSSKETFVVALGYYK

SEQ ID NO: 2532719 - protein, 21 aa, Entamoeba dispar
LRSYNIFLRHRFGYSERLLEE

SEQ ID NO: 2532720 - protein, 18 aa, Entamoeba dispar
LRTIIGKGEFPIPVMYII

SEQ ID NO: 2532721 - protein, 19 aa, Entamoeba dispar
LRTKLYPDQYNEHPHCGFF

SEQ ID NO: 2532722 - protein, 30 aa, Entamoeba dispar
LRTTLITLFVYIQTKRLFKPTWKISCELIV

SEQ ID NO: 2532723 - protein, 21 aa, Entamoeba dispar
LRVACLKSGWRYPVPFFRSIQ

SEQ ID NO: 2532724 - protein, 21 aa, Entamoeba dispar
LRVIYHRDFFPKEASLPTFNS

SEQ ID NO: 2532725 - protein, 27 aa, Entamoeba dispar
LRVKEATSFPIVFVANKVDLVKDRDVS

SEQ ID NO: 2532726 - protein, 17 aa, Entamoeba dispar
LRVLNSYFIGQDSTYRF

SEQ ID NO: 2532727 - protein, 17 aa, Entamoeba dispar
LRVQDYRHYCENKMLLP

SEQ ID NO: 2532728 - protein, 24 aa, Entamoeba dispar
LRVTKQIYSWLFNKGQKSEQIKKS

SEQ ID NO: 2532729 - protein, 20 aa, Entamoeba dispar
LRVYCAFSITETLDINFRPD

SEQ ID NO: 2532730 - protein, 25 aa, Entamoeba dispar
LRYANPYSFIPKNTYKLSITGQLPL

SEQ ID NO: 2532731 - protein, 28 aa, Entamoeba dispar
LRYEKLGYYQLCGVVLYVFFNKKIQNEI

SEQ ID NO: 2532732 - protein, 19 aa, Entamoeba dispar
LRYERAIYNPKIPNTLEIG

SEQ ID NO: 2532733 - protein, 25 aa, Entamoeba dispar
LRYNTSLNNAILPFGSPRNTVISYT

SEQ ID NO: 2532734 - protein, 21 aa, Entamoeba dispar
LRYSIQLISLAMLKAKKRGAE

SEQ ID NO: 2532735 - protein, 17 aa, Entamoeba dispar
LSALRTNKYFTKLNIES

SEQ ID NO: 2532736 - protein, 35 aa, Entamoeba dispar
LSALYQHLLFDFDPYYLYSVYNPIIYIFTNNYQQP

SEQ ID NO: 2532737 - protein, 35 aa, Entamoeba dispar
LSANIKAMIKLLCTIFPISDFWEHVCIVWTKCFNY

SEQ ID NO: 2532738 - protein, 20 aa, Entamoeba dispar
LSAQIHMALLPLINTIAILH

SEQ ID NO: 2532739 - protein, 24 aa, Entamoeba dispar
LSASLFQRLYSLNSPILLNLQYRC

SEQ ID NO: 2532740 - protein, 19 aa, Entamoeba dispar
LSCFIKADQNLFKVINGGP

SEQ ID NO: 2532741 - protein, 18 aa, Entamoeba dispar
LSCFSSAMKVTEESSLQQ

SEQ ID NO: 2532742 - protein, 18 aa, Entamoeba dispar
LSCKLLQPYLNLKELKHK

SEQ ID NO: 2532743 - protein, 18 aa, Entamoeba dispar
LSDCDDFLIKQLLASIIL

SEQ ID NO: 2532744 - protein, 19 aa, Entamoeba dispar
LSDDYHFIFTLQTSLSNVP

SEQ ID NO: 2532745 - protein, 20 aa, Entamoeba dispar
LSDEKVGLKVLYKLMDADGD

SEQ ID NO: 2532746 - protein, 19 aa, Entamoeba dispar
LSDIKKYFFIGKETELFEM

SEQ ID NO: 2532747 - protein, 18 aa, Entamoeba dispar
LSDILNKLESMGIKEELV

SEQ ID NO: 2532748 - protein, 18 aa, Entamoeba dispar
LSDILWADPLDEPPEEDL

SEQ ID NO: 2532749 - protein, 24 aa, Entamoeba dispar
LSDKHVLFCLGGPGAGKGTQCQKI

SEQ ID NO: 2532750 - protein, 23 aa, Entamoeba dispar
LSDLENCLLLKEALNFREVIEDA

SEQ ID NO: 2532751 - protein, 21 aa, Entamoeba dispar
LSDLLYLILNCKSEIIRNSSI

SEQ ID NO: 2532752 - protein, 22 aa, Entamoeba dispar
LSDLPLLTIPVILSTPFGDSFV

SEQ ID NO: 2532753 - protein, 40 aa, Entamoeba dispar
LSDNIKKMIRLICKIFPISDFWEHVSIVWAKCFCDISPKK

SEQ ID NO: 2532754 - protein, 27 aa, Entamoeba dispar
LSDNPILQIYILQKLVQKFPMFIAKCN

SEQ ID NO: 2532755 - protein, 22 aa, Entamoeba dispar
LSDVVLRSFATPGLFTCHQSFV

SEQ ID NO: 2532756 - protein, 19 aa, Entamoeba dispar
LSDYCFYLEELYGTADLNI

SEQ ID NO: 2532757 - protein, 28 aa, Entamoeba dispar
LSDYKDWCLYWLGLNNFEPPLTGETPED

SEQ ID NO: 2532758 - protein, 24 aa, Entamoeba dispar
LSDYLICYLSSYGPYLCCFENWLS

SEQ ID NO: 2532759 - protein, 19 aa, Entamoeba dispar
LSEAMWVLRNLFIPEGNPH

SEQ ID NO: 2532760 - protein, 34 aa, Entamoeba dispar
LSEDGKNWREIYKSLLVLDNILKNGSEEAVNIAL

SEQ ID NO: 2532761 - protein, 23 aa, Entamoeba dispar
LSELLFDVCHLNCIPNICECEED

SEQ ID NO: 2532762 - protein, 25 aa, Entamoeba dispar
LSEQSMLLMKKYKHKELTEIQMLCL

SEQ ID NO: 2532763 - protein, 26 aa, Entamoeba dispar
LSESDNFYHNRKLSTITAPSDVLKDV

SEQ ID NO: 2532764 - protein, 17 aa, Entamoeba dispar
LSEWKEFKYMRRLSQTF

SEQ ID NO: 2532765 - protein, 30 aa, Entamoeba dispar
LSFEWQIPKQVILGQLLIIKCTTLLKRIDL

SEQ ID NO: 2532766 - protein, 17 aa, Entamoeba dispar
LSFGYLFDQPEISYKLF

SEQ ID NO: 2532767 - protein, 19 aa, Entamoeba dispar
LSFIELPWMRTSETKSLLL

SEQ ID NO: 2532768 - protein, 25 aa, Entamoeba dispar
LSGCTSLVYFKIPISITSIGNGCFK

SEQ ID NO: 2532769 - protein, 39 aa, Entamoeba dispar
LSGGQKSLLALSLILAILLYKPSPLYILDEVDAALDVSN

SEQ ID NO: 2532770 - protein, 33 aa, Entamoeba dispar
LSGHTMDLTSDYYWALFTNLYNTIRIRNTKSYK

SEQ ID NO: 2532771 - protein, 17 aa, Entamoeba dispar
LSGLHKCVIFYSFTDSD

SEQ ID NO: 2532772 - protein, 21 aa, Entamoeba dispar
LSGYALLQKTACRAAFESPTL

SEQ ID NO: 2532773 - protein, 24 aa, Entamoeba dispar
LSHITLINYTLMSETLYANQNASR

SEQ ID NO: 2532774 - protein, 20 aa, Entamoeba dispar
LSHRVIHPLLSKILKRKENR

SEQ ID NO: 2532775 - protein, 24 aa, Entamoeba dispar
LSHTTIVIPPKSPPVMTPIKAIPN

SEQ ID NO: 2532776 - protein, 27 aa, Entamoeba dispar
LSHTWCCDVLLFVIRLLKEAKGIFNKQ

SEQ ID NO: 2532777 - protein, 18 aa, Entamoeba dispar
LSIDIFNPLFLLVPQNVQ

SEQ ID NO: 2532778 - protein, 20 aa, Entamoeba dispar
LSIEILIKLCHVKSILIFLS

SEQ ID NO: 2532779 - protein, 23 aa, Entamoeba dispar
LSIEKNIWIDEGVKYINEAKATL

SEQ ID NO: 2532780 - protein, 19 aa, Entamoeba dispar
LSIIRHFSHLFNLTYCYAS

SEQ ID NO: 2532781 - protein, 19 aa, Entamoeba dispar
LSILAIIPATNVKSISVIS

SEQ ID NO: 2532782 - protein, 19 aa, Entamoeba dispar
LSILGVVAGLIPYPHHNQS

SEQ ID NO: 2532783 - protein, 24 aa, Entamoeba dispar
LSINGILPRFLQVISHILYFEYIC

SEQ ID NO: 2532784 - protein, 22 aa, Entamoeba dispar
LSIPFLTRCCINLVTALQYLSS

SEQ ID NO: 2532785 - protein, 27 aa, Entamoeba dispar
LSIPLENYTCLKYLVALLYELSKNPKS

SEQ ID NO: 2532786 - protein, 17 aa, Entamoeba dispar
LSKFQKVSHIKAVIAPV

SEQ ID NO: 2532787 - protein, 25 aa, Entamoeba dispar
LSKKFKDFTAWVKKLGRNTSTHKMY

SEQ ID NO: 2532788 - protein, 17 aa, Entamoeba dispar
LSKKISNFLPYLSQHFL

SEQ ID NO: 2532789 - protein, 20 aa, Entamoeba dispar
LSKLIENPAYKRRLTCVLHG

SEQ ID NO: 2532790 - protein, 23 aa, Entamoeba dispar
LSKLLYAQLPSNENRLLFAQCLY

SEQ ID NO: 2532791 - protein, 38 aa, Entamoeba dispar
LSKNPVLTEYFKFNFSFRLIEILTLVALCRDEQKKSVL

SEQ ID NO: 2532792 - protein, 17 aa, Entamoeba dispar
LSKPIQVIPIKPKLPEI

SEQ ID NO: 2532793 - protein, 24 aa, Entamoeba dispar
LSKPTPLPLICSFLIDGKLCFHTY

SEQ ID NO: 2532794 - protein, 18 aa, Entamoeba dispar
LSKRNYHRRKVIIEFISW

SEQ ID NO: 2532795 - protein, 32 aa, Entamoeba dispar
LSKRSFCIKFIPIIFQFKFKTGMNTLFRSQFD

SEQ ID NO: 2532796 - protein, 17 aa, Entamoeba dispar
LSKSLNYCLKIFLKSED

SEQ ID NO: 2532797 - protein, 24 aa, Entamoeba dispar
LSKSNVCLLLFNENLFITETIRKT

SEQ ID NO: 2532798 - protein, 18 aa, Entamoeba dispar
LSKTIKKMGIKRKPSQQN

SEQ ID NO: 2532799 - protein, 27 aa, Entamoeba dispar
LSKVILQFFPVLFEKIIFRQIMVTHNE

SEQ ID NO: 2532800 - protein, 21 aa, Entamoeba dispar
LSKYIDLKKTLLPWSCFVKVA

SEQ ID NO: 2532801 - protein, 26 aa, Entamoeba dispar
LSLDFLEKVFPLIEKYTRISKKRRFN

SEQ ID NO: 2532802 - protein, 21 aa, Entamoeba dispar
LSLEDLLISPIQRLMRYHTLL

SEQ ID NO: 2532803 - protein, 29 aa, Entamoeba dispar
LSLEKQFRNIWSYFFGYWKDPNTENFSTR

SEQ ID NO: 2532804 - protein, 27 aa, Entamoeba dispar
LSLESSGIILFYPLDTIPLGVDYHFPK

SEQ ID NO: 2532805 - protein, 27 aa, Entamoeba dispar
LSLIGGFVFLRLFCPALAAPEGSNLCG

SEQ ID NO: 2532806 - protein, 19 aa, Entamoeba dispar
LSLKSINIPSSITSFGWGC

SEQ ID NO: 2532807 - protein, 22 aa, Entamoeba dispar
LSLLTNLYQLSLFANKIHTLPY

SEQ ID NO: 2532808 - protein, 28 aa, Entamoeba dispar
LSLPQTQRIPQLLRFVSDLSPQESMVIN

SEQ ID NO: 2532809 - protein, 31 aa, Entamoeba dispar
LSLRKQGSLFIYLFRLMLATGIPELKNEDDI

SEQ ID NO: 2532810 - protein, 29 aa, Entamoeba dispar
LSLSDIPYPPSFLLFLKTSMKIISLMIDD

SEQ ID NO: 2532811 - protein, 21 aa, Entamoeba dispar
LSLVHSIHLPSKGKHILVFDL

SEQ ID NO: 2532812 - protein, 22 aa, Entamoeba dispar
LSLYNFVRYWLDSDSPYLDDTD

SEQ ID NO: 2532813 - protein, 29 aa, Entamoeba dispar
LSMDDYINLINYFRTFFSIATESAILDVV

SEQ ID NO: 2532814 - protein, 19 aa, Entamoeba dispar
LSMFEIYNDSFYDLMNEGK

SEQ ID NO: 2532815 - protein, 26 aa, Entamoeba dispar
LSMKLQLISIWNTMKLKLIMPKGIWE

SEQ ID NO: 2532816 - protein, 18 aa, Entamoeba dispar
LSMKYHILCKETAFIAID

SEQ ID NO: 2532817 - protein, 24 aa, Entamoeba dispar
LSMTNLNFKPNLKTSFPLTDEELQ

SEQ ID NO: 2532818 - protein, 25 aa, Entamoeba dispar
LSNELLHQIFSYLPLEDLSSCLWTC

SEQ ID NO: 2532819 - protein, 27 aa, Entamoeba dispar
LSNIDQRYKWFLDKIKVAKQRYDNTLP

SEQ ID NO: 2532820 - protein, 24 aa, Entamoeba dispar
LSNKIKKYYYVLEGNKLILYKDED

SEQ ID NO: 2532821 - protein, 18 aa, Entamoeba dispar
LSNKLYLKDIDPTLIAQA

SEQ ID NO: 2532822 - protein, 29 aa, Entamoeba dispar
LSNLMIHSNWYSIPLKRIALSYLDDFDPH

SEQ ID NO: 2532823 - protein, 22 aa, Entamoeba dispar
LSNQLKKLPEYFLRGCRCIELV

SEQ ID NO: 2532824 - protein, 17 aa, Entamoeba dispar
LSNVLWSLGIIIQRYTS

SEQ ID NO: 2532825 - protein, 23 aa, Entamoeba dispar
LSNVPTRWFPSAKRSKYILNIPL

SEQ ID NO: 2532826 - protein, 25 aa, Entamoeba dispar
LSPDPLQTLLLPLNNDIPAGVLKYF

SEQ ID NO: 2532827 - protein, 22 aa, Entamoeba dispar
LSPKHRAPPPPLSPRINGLNDV

SEQ ID NO: 2532828 - protein, 26 aa, Entamoeba dispar
LSPNFSIYPQFMFHLRRSHFLKVFNC

SEQ ID NO: 2532829 - protein, 24 aa, Entamoeba dispar
LSPNQFKLLLDFVKTFFSSDQSNE

SEQ ID NO: 2532830 - protein, 22 aa, Entamoeba dispar
LSPQLVLSFLDTYKHFCIDGHD

SEQ ID NO: 2532831 - protein, 23 aa, Entamoeba dispar
LSPTHPLFNPRIPYRSPTIASFT

SEQ ID NO: 2532832 - protein, 26 aa, Entamoeba dispar
LSPTIQMYFSFRFLKQESAEEKRIGT

SEQ ID NO: 2532833 - protein, 28 aa, Entamoeba dispar
LSPVEVSSQILLYLKQQAINSINNKNLS

SEQ ID NO: 2532834 - protein, 17 aa, Entamoeba dispar
LSPVLRTTRRMFSHKEL

SEQ ID NO: 2532835 - protein, 22 aa, Entamoeba dispar
LSPYKYAGYGLLVPVLDDKELR

SEQ ID NO: 2532836 - protein, 23 aa, Entamoeba dispar
LSQDKPSCFPAFILKPPENSICI

SEQ ID NO: 2532837 - protein, 23 aa, Entamoeba dispar
LSQEDRFWIKSWSTKVDGRSPSI

SEQ ID NO: 2532838 - protein, 20 aa, Entamoeba dispar
LSQGINMFSDLELELLGKEC

SEQ ID NO: 2532839 - protein, 18 aa, Entamoeba dispar
LSQHPYTNTLSTFLGNSP

SEQ ID NO: 2532840 - protein, 26 aa, Entamoeba dispar
LSQITSPLLFSIYIDVLTLIDTEIKN

SEQ ID NO: 2532841 - protein, 29 aa, Entamoeba dispar
LSQLSLYNLTYELAHLYFNGANSVCFPTP

SEQ ID NO: 2532842 - protein, 19 aa, Entamoeba dispar
LSQPPPPPPPAPDKSMQQV

SEQ ID NO: 2532843 - protein, 30 aa, Entamoeba dispar
LSQQQQYEIILKWLQDILSLYEIDLSSTTK

SEQ ID NO: 2532844 - protein, 28 aa, Entamoeba dispar
LSQQSRDLLDWLFSLLVHVSLFKDQNKM

SEQ ID NO: 2532845 - protein, 24 aa, Entamoeba dispar
LSQQWLFDCLYNQRLLSINPYLLN

SEQ ID NO: 2532846 - protein, 23 aa, Entamoeba dispar
LSQSGDLLIPFIENLINQNAEVL

SEQ ID NO: 2532847 - protein, 28 aa, Entamoeba dispar
LSRGNIQQFLSLVFFIAKKSNTRIEKKR

SEQ ID NO: 2532848 - protein, 22 aa, Entamoeba dispar
LSRPVFTILSVCFKQYILCHFK

SEQ ID NO: 2532849 - protein, 26 aa, Entamoeba dispar
LSRSLGDKLLQPPLTYNPDISIHSLS

SEQ ID NO: 2532850 - protein, 33 aa, Entamoeba dispar
LSRTDKLRIIAFSLYSILSPFTKIHYQYLQIQL

SEQ ID NO: 2532851 - protein, 22 aa, Entamoeba dispar
LSSFIFHAIDFLTNLRKANKKN

SEQ ID NO: 2532852 - protein, 22 aa, Entamoeba dispar
LSSFKRVFAIPIQKAQDGNASI

SEQ ID NO: 2532853 - protein, 26 aa, Entamoeba dispar
LSSHNHRVYYFYPLIEIHSNKEIEIL

SEQ ID NO: 2532854 - protein, 30 aa, Entamoeba dispar
LSSIFQENILFRFYLKFIGSPIATKIFEKT

SEQ ID NO: 2532855 - protein, 17 aa, Entamoeba dispar
LSSILYDNKINITTEIL

SEQ ID NO: 2532856 - protein, 25 aa, Entamoeba dispar
LSSISNCMILILDTAGNLFGIFAPS

SEQ ID NO: 2532857 - protein, 19 aa, Entamoeba dispar
LSSLDDPIIPYFRYDEFVK

SEQ ID NO: 2532858 - protein, 18 aa, Entamoeba dispar
LSSLPKKPLHDLYIQQYP

SEQ ID NO: 2532859 - protein, 31 aa, Entamoeba dispar
LSSPIKQVLFSPLSFVLPLLKDSSVFRQYIP

SEQ ID NO: 2532860 - protein, 17 aa, Entamoeba dispar
LSSQFFYRADRLILHSY

SEQ ID NO: 2532861 - protein, 28 aa, Entamoeba dispar
LSSQKLFRSPFGMKLPPVIDQSWKIIND

SEQ ID NO: 2532862 - protein, 25 aa, Entamoeba dispar
LSSQTIYRFRSFTLTLTVSEDWRII

SEQ ID NO: 2532863 - protein, 24 aa, Entamoeba dispar
LSSQYYPLILHQLKSVPLHPEIKP

SEQ ID NO: 2532864 - protein, 25 aa, Entamoeba dispar
LSSRFRPQIPLVKRTIESLIEREYI

SEQ ID NO: 2532865 - protein, 32 aa, Entamoeba dispar
LSSTSSTLLLRSALYYIQKMLKVFGIEEKQVS

SEQ ID NO: 2532866 - protein, 25 aa, Entamoeba dispar
LSSVEFCLFPSFFTGLASFKDQKKS

SEQ ID NO: 2532867 - protein, 25 aa, Entamoeba dispar
LSSVERIALIQKFKLLPNVPEVKEI

SEQ ID NO: 2532868 - protein, 31 aa, Entamoeba dispar
LSTEIVVFAFPIYYFNMPGPIKTLLDRFVPS

SEQ ID NO: 2532869 - protein, 18 aa, Entamoeba dispar
LSTGKPLSFLMQINFEEF

SEQ ID NO: 2532870 - protein, 35 aa, Entamoeba dispar
LSTIAELDRFIQYRKITISLVESWNGVMKGYIEQT

SEQ ID NO: 2532871 - protein, 18 aa, Entamoeba dispar
LSTIFSYDYSFQQMPLCL

SEQ ID NO: 2532872 - protein, 22 aa, Entamoeba dispar
LSTIPEVQYILSRYPLDRTIDH

SEQ ID NO: 2532873 - protein, 19 aa, Entamoeba dispar
LSTIVPPFRYVAMKPEEIK

SEQ ID NO: 2532874 - protein, 17 aa, Entamoeba dispar
LSTLRLDKDWSPVSTLN

SEQ ID NO: 2532875 - protein, 25 aa, Entamoeba dispar
LSTLSIVNQRKPFYPHCILFDENEL

SEQ ID NO: 2532876 - protein, 26 aa, Entamoeba dispar
LSTNNKLLDIYKGSKSWVFGIEKGFW

SEQ ID NO: 2532877 - protein, 22 aa, Entamoeba dispar
LSTWNSLWRYIGIEKHATYGFY

SEQ ID NO: 2532878 - protein, 38 aa, Entamoeba dispar
LSVAHSLIIPLLKYPVRIPFMAILPRPISEPWEVQSFF

SEQ ID NO: 2532879 - protein, 25 aa, Entamoeba dispar
LSVAYKNVIGAKRASWRIISSLEQK

SEQ ID NO: 2532880 - protein, 24 aa, Entamoeba dispar
LSVAYKNVIGSRRASWRIITSLEQ

SEQ ID NO: 2532881 - protein, 25 aa, Entamoeba dispar
LSVEGKMTISQYNEALLAMKKDQIK

SEQ ID NO: 2532882 - protein, 17 aa, Entamoeba dispar
LSVLEFATHKHRFQLRK

SEQ ID NO: 2532883 - protein, 21 aa, Entamoeba dispar
LSVLHRVRFIFQPNQLMKTTE

SEQ ID NO: 2532884 - protein, 26 aa, Entamoeba dispar
LSVLKSLFVILSYDPLFPSNKRPNFL

SEQ ID NO: 2532885 - protein, 24 aa, Entamoeba dispar
LSVQKTFLMQILKKVFIEEKSDGE

SEQ ID NO: 2532886 - protein, 21 aa, Entamoeba dispar
LSVSSLLYRDIPSKSLWNAFI

SEQ ID NO: 2532887 - protein, 23 aa, Entamoeba dispar
LSWSEFEYCVVLPFKMIKDEQIS

SEQ ID NO: 2532888 - protein, 22 aa, Entamoeba dispar
LSYLHIEWISEEQFLLLGGGNV

SEQ ID NO: 2532889 - protein, 27 aa, Entamoeba dispar
LSYNDLLQVIFQLLWSLNIAEESFGYS

SEQ ID NO: 2532890 - protein, 26 aa, Entamoeba dispar
LSYNLYDFLMKKNGSLGLSLVRRFAF

SEQ ID NO: 2532891 - protein, 17 aa, Entamoeba dispar
LSYWPLDMVLRDKYKFS

SEQ ID NO: 2532892 - protein, 27 aa, Entamoeba dispar
LTALHAGEWILPKQLPIKYMGFSTNFR

SEQ ID NO: 2532893 - protein, 19 aa, Entamoeba dispar
LTALKHPFCCLSVLNLIVA

SEQ ID NO: 2532894 - protein, 20 aa, Entamoeba dispar
LTAMLDFFPEFSLSERHIAY

SEQ ID NO: 2532895 - protein, 25 aa, Entamoeba dispar
LTAQGYIYILNITQLIELVTHPFNF

SEQ ID NO: 2532896 - protein, 26 aa, Entamoeba dispar
LTDGFNFVLNLLILPGNRICADCLFR

SEQ ID NO: 2532897 - protein, 35 aa, Entamoeba dispar
LTDLASFILQYLKFIPTHFIIILSKIFQKITYVHD

SEQ ID NO: 2532898 - protein, 27 aa, Entamoeba dispar
LTDLKDGLILIRFLTNISGKEVLKTIE

SEQ ID NO: 2532899 - protein, 25 aa, Entamoeba dispar
LTDRILPFISMLIQWEILHTNNKEN

SEQ ID NO: 2532900 - protein, 29 aa, Entamoeba dispar
LTDSPTLKYLYLLTQIGITMSPMANHLTQ

SEQ ID NO: 2532901 - protein, 22 aa, Entamoeba dispar
LTDYLMKILTERGYAFTTTAER

SEQ ID NO: 2532902 - protein, 19 aa, Entamoeba dispar
LTEQFIGFGYLSVENILSM

SEQ ID NO: 2532903 - protein, 29 aa, Entamoeba dispar
LTETALIQFIYRSPRLRVLFLSNTTAVTN

SEQ ID NO: 2532904 - protein, 18 aa, Entamoeba dispar
LTETLLQIGSIPGASNGS

SEQ ID NO: 2532905 - protein, 18 aa, Entamoeba dispar
LTETLLQIGTIPGGPNDL

SEQ ID NO: 2532906 - protein, 19 aa, Entamoeba dispar
LTETLLQIGTIPGGPNDLE

SEQ ID NO: 2532907 - protein, 20 aa, Entamoeba dispar
LTFTPPPPSYFNHNFMMIRK

SEQ ID NO: 2532908 - protein, 24 aa, Entamoeba dispar
LTFTSQPLVLSFMNSLHSIRFEDG

SEQ ID NO: 2532909 - protein, 17 aa, Entamoeba dispar
LTGEPIIGAIILSTQKQ

SEQ ID NO: 2532910 - protein, 28 aa, Entamoeba dispar
LTGKLAEPYLMKYFPGISLTDVRIEHEH

SEQ ID NO: 2532911 - protein, 19 aa, Entamoeba dispar
LTGTPIKIGKRKATIRGLF

SEQ ID NO: 2532912 - protein, 18 aa, Entamoeba dispar
LTHFPYIYDFIIPLCERV

SEQ ID NO: 2532913 - protein, 26 aa, Entamoeba dispar
LTHHNISYLFNLMRKYRVAIREGKSK

SEQ ID NO: 2532914 - protein, 33 aa, Entamoeba dispar
LTIEGKWLDDEKMKIFTINLNKPIDLQFSIHEI

SEQ ID NO: 2532915 - protein, 21 aa, Entamoeba dispar
LTIHLKLNCIVFRPVINTYLI

SEQ ID NO: 2532916 - protein, 20 aa, Entamoeba dispar
LTINEVYYNGLPLRFGYSIE

SEQ ID NO: 2532917 - protein, 24 aa, Entamoeba dispar
LTINEVYYNGLPLRFGYSIEDFCE

SEQ ID NO: 2532918 - protein, 18 aa, Entamoeba dispar
LTIPYDFILSLNSLFDEL

SEQ ID NO: 2532919 - protein, 19 aa, Entamoeba dispar
LTISSFLTEIGRDSFKMCN

SEQ ID NO: 2532920 - protein, 19 aa, Entamoeba dispar
LTIVLRTLLKFLQFNKVHN

SEQ ID NO: 2532921 - protein, 36 aa, Entamoeba dispar
LTKDFFYSHFILLDKQSLHFITLTQIPGIISDSSLR

SEQ ID NO: 2532922 - protein, 20 aa, Entamoeba dispar
LTKDIPIEIPKFTMTERRGT

SEQ ID NO: 2532923 - protein, 23 aa, Entamoeba dispar
LTKIIDMLGPIPDYLLRKGTKTE

SEQ ID NO: 2532924 - protein, 18 aa, Entamoeba dispar
LTKITLPSSLTKIGNYSF

SEQ ID NO: 2532925 - protein, 24 aa, Entamoeba dispar
LTKIVHHIISFCLNPFYLNEQNYG

SEQ ID NO: 2532926 - protein, 17 aa, Entamoeba dispar
LTKKFDLCDVVLGKAYA

SEQ ID NO: 2532927 - protein, 17 aa, Entamoeba dispar
LTKLSYLSGYTLSLEEY

SEQ ID NO: 2532928 - protein, 33 aa, Entamoeba dispar
LTKSEIKFELPKQPLAFLRRKSIETKPVSETQI

SEQ ID NO: 2532929 - protein, 25 aa, Entamoeba dispar
LTKSKWKIPYQLIDSFGFDGNNIVV

SEQ ID NO: 2532930 - protein, 23 aa, Entamoeba dispar
LTKTIKYQVKRINKLTAKEYNEI

SEQ ID NO: 2532931 - protein, 19 aa, Entamoeba dispar
LTKTIYWTTLDTKEFCTIF

SEQ ID NO: 2532932 - protein, 24 aa, Entamoeba dispar
LTKTKLVYDILKKGSYKKGSGKIV

SEQ ID NO: 2532933 - protein, 19 aa, Entamoeba dispar
LTKTMELMRKYLMGTPKNS

SEQ ID NO: 2532934 - protein, 24 aa, Entamoeba dispar
LTKTRFYEAIFKILDSDKSGLLER

SEQ ID NO: 2532935 - protein, 17 aa, Entamoeba dispar
LTLDQLYEKEADPEEFK

SEQ ID NO: 2532936 - protein, 19 aa, Entamoeba dispar
LTLDRLVDYLDTFHIFGIV

SEQ ID NO: 2532937 - protein, 21 aa, Entamoeba dispar
LTLGALIDINFGKLTFNIETH

SEQ ID NO: 2532938 - protein, 18 aa, Entamoeba dispar
LTLGLNWGKTLNTSSKIL

SEQ ID NO: 2532939 - protein, 18 aa, Entamoeba dispar
LTLLDVFMLYQTSTLPAT

SEQ ID NO: 2532940 - protein, 19 aa, Entamoeba dispar
LTLNQLFEHWLKTIDTEYY

SEQ ID NO: 2532941 - protein, 19 aa, Entamoeba dispar
LTLPPFKETFQNESHFLFS

SEQ ID NO: 2532942 - protein, 28 aa, Entamoeba dispar
LTLTCRKIITVPYISGFLGFREVEVYHE

SEQ ID NO: 2532943 - protein, 28 aa, Entamoeba dispar
LTLTCRKIVTVPYISGFLGFREVEVYHE

SEQ ID NO: 2532944 - protein, 24 aa, Entamoeba dispar
LTLTTNHLFFITQRRQLSLNELLN

SEQ ID NO: 2532945 - protein, 17 aa, Entamoeba dispar
LTMAGLKVPIITVMVGE

SEQ ID NO: 2532946 - protein, 27 aa, Entamoeba dispar
LTMDERLTLLSIPLEKEIPPTNRLHTS

SEQ ID NO: 2532947 - protein, 29 aa, Entamoeba dispar
LTMNFDHWDCLILLITIETIVFSLLHLEN

SEQ ID NO: 2532948 - protein, 20 aa, Entamoeba dispar
LTMYLDKRPISLLNGLSIMK

SEQ ID NO: 2532949 - protein, 24 aa, Entamoeba dispar
LTNDKYYIYINALAPMIQDACQTP

SEQ ID NO: 2532950 - protein, 22 aa, Entamoeba dispar
LTNDQLPFNSSLLKVPTERKNR

SEQ ID NO: 2532951 - protein, 24 aa, Entamoeba dispar
LTNEIRKMARLGRTNTVKVMAADL

SEQ ID NO: 2532952 - protein, 23 aa, Entamoeba dispar
LTNEIRPGFTKSWEDFDRIFRDV

SEQ ID NO: 2532953 - protein, 24 aa, Entamoeba dispar
LTNGNILVYYRNAFSKHIHLGILS

SEQ ID NO: 2532954 - protein, 23 aa, Entamoeba dispar
LTNHAFLIIGYDLNQPFSLTPKY

SEQ ID NO: 2532955 - protein, 24 aa, Entamoeba dispar
LTNIFDIWRLLIDILRGIDQLLLP

SEQ ID NO: 2532956 - protein, 18 aa, Entamoeba dispar
LTNIIIPTSVTKLGDICF

SEQ ID NO: 2532957 - protein, 22 aa, Entamoeba dispar
LTNKNHYHLLNPSINQLHCPSQ

SEQ ID NO: 2532958 - protein, 17 aa, Entamoeba dispar
LTNLADVNWTFNIRAHD

SEQ ID NO: 2532959 - protein, 18 aa, Entamoeba dispar
LTNLTLRQFVFKATEPLA

SEQ ID NO: 2532960 - protein, 18 aa, Entamoeba dispar
LTNTLKYLDAPLPMDGKL

SEQ ID NO: 2532961 - protein, 22 aa, Entamoeba dispar
LTNVLRQFYSLRGVIIEEDNIL

SEQ ID NO: 2532962 - protein, 20 aa, Entamoeba dispar
LTNWARDITYYASPKCVVVL

SEQ ID NO: 2532963 - protein, 19 aa, Entamoeba dispar
LTNWLNYTLKLCDEKKVSY

SEQ ID NO: 2532964 - protein, 17 aa, Entamoeba dispar
LTPGSFSVIFPKEIGVF

SEQ ID NO: 2532965 - protein, 20 aa, Entamoeba dispar
LTPILNKFLNYQVIYCTRHI

SEQ ID NO: 2532966 - protein, 17 aa, Entamoeba dispar
LTPKHSLQIQPPPSKLM

SEQ ID NO: 2532967 - protein, 20 aa, Entamoeba dispar
LTPLDREVMRKERLSSGINS

SEQ ID NO: 2532968 - protein, 21 aa, Entamoeba dispar
LTPLSYYRDTSEWLDLLFGLV

SEQ ID NO: 2532969 - protein, 28 aa, Entamoeba dispar
LTPTLLNTLLYEWYELRKLKAIDYRVLK

SEQ ID NO: 2532970 - protein, 18 aa, Entamoeba dispar
LTQDDIQLLVRLKKMFNI

SEQ ID NO: 2532971 - protein, 36 aa, Entamoeba dispar
LTQEYFSLQLEPHLPFFFKYPILFEPHSFVLEKDLS

SEQ ID NO: 2532972 - protein, 26 aa, Entamoeba dispar
LTQINDILYFQLFNGIIITSKKITPN

SEQ ID NO: 2532973 - protein, 22 aa, Entamoeba dispar
LTQIPGLIQFKGPMNLKHNRGS

SEQ ID NO: 2532974 - protein, 21 aa, Entamoeba dispar
LTQLHFNFSQFTSLSKLCLFA

SEQ ID NO: 2532975 - protein, 26 aa, Entamoeba dispar
LTQLIEYSFALVYFRDVVIARFSDET

SEQ ID NO: 2532976 - protein, 19 aa, Entamoeba dispar
LTQLTKYMLVILKEKRIAH

SEQ ID NO: 2532977 - protein, 20 aa, Entamoeba dispar
LTQMAWDVLQPHHGQLEVLS

SEQ ID NO: 2532978 - protein, 25 aa, Entamoeba dispar
LTQNEFMVFDLLKQTVLHFKLSTII

SEQ ID NO: 2532979 - protein, 24 aa, Entamoeba dispar
LTQNPQAMRAMLMMNPQTAQMMNN

SEQ ID NO: 2532980 - protein, 17 aa, Entamoeba dispar
LTRKYIMTGEEKELLFS

SEQ ID NO: 2532981 - protein, 23 aa, Entamoeba dispar
LTRLTKLFILRRTSKVNQKYLPP

SEQ ID NO: 2532982 - protein, 19 aa, Entamoeba dispar
LTSFLDIYKLGLTNTNILL

SEQ ID NO: 2532983 - protein, 18 aa, Entamoeba dispar
LTSILYDNKINITEKIVP

SEQ ID NO: 2532984 - protein, 24 aa, Entamoeba dispar
LTSIMPRYITPKDIMYVGIRSIDV

SEQ ID NO: 2532985 - protein, 19 aa, Entamoeba dispar
LTSINIPSSISKIGWNCFY

SEQ ID NO: 2532986 - protein, 35 aa, Entamoeba dispar
LTSINIPSTITSIGYRWFYGCKSLKSINIPSSIIK

SEQ ID NO: 2532987 - protein, 19 aa, Entamoeba dispar
LTSITIPTTISKLGYCCFY

SEQ ID NO: 2532988 - protein, 19 aa, Entamoeba dispar
LTSIYFLNVKFSVSLLCPH

SEQ ID NO: 2532989 - protein, 17 aa, Entamoeba dispar
LTSLQKQLAERPTTVVI

SEQ ID NO: 2532990 - protein, 23 aa, Entamoeba dispar
LTSLRLFRLNLLSNIKFNSSIEK

SEQ ID NO: 2532991 - protein, 24 aa, Entamoeba dispar
LTSLTMIIMDPYYRTFKGFETIIE

SEQ ID NO: 2532992 - protein, 29 aa, Entamoeba dispar
LTSSSLLTQQFLYPVLLSLIQQQPNVFVD

SEQ ID NO: 2532993 - protein, 20 aa, Entamoeba dispar
LTSTFFYRRIRSNPSYYFVE

SEQ ID NO: 2532994 - protein, 18 aa, Entamoeba dispar
LTSVPFKLDINSSPQIFG

SEQ ID NO: 2532995 - protein, 21 aa, Entamoeba dispar
LTSVVPIISPITPPAIFDSHR

SEQ ID NO: 2532996 - protein, 19 aa, Entamoeba dispar
LTSVVSLPFILTYSYEELT

SEQ ID NO: 2532997 - protein, 21 aa, Entamoeba dispar
LTTDKLLRRFIFNLNVKMCKD

SEQ ID NO: 2532998 - protein, 27 aa, Entamoeba dispar
LTTEVNGLIIFSLNLLRMVSSDDKNYG

SEQ ID NO: 2532999 - protein, 24 aa, Entamoeba dispar
LTTGWTYWFDLGMNQVFSTSGVTA

SEQ ID NO: 2533000 - protein, 18 aa, Entamoeba dispar
LTTINFFVRMFANGNKDL

SEQ ID NO: 2533001 - protein, 17 aa, Entamoeba dispar
LTTINIPSSISKIGSYC

SEQ ID NO: 2533002 - protein, 18 aa, Entamoeba dispar
LTTINIPTSVSKIGYGCF

SEQ ID NO: 2533003 - protein, 19 aa, Entamoeba dispar
LTTMTGFTPKGLRISIVTH

SEQ ID NO: 2533004 - protein, 25 aa, Entamoeba dispar
LTTNDPSFLFLLYNIIHNNEPTTLP

SEQ ID NO: 2533005 - protein, 21 aa, Entamoeba dispar
LTTSQKYIFGNIIDLFGNDVI

SEQ ID NO: 2533006 - protein, 34 aa, Entamoeba dispar
LTTVTITLTFIIPFKKFDLLLCFVSQSENTLVVV

SEQ ID NO: 2533007 - protein, 32 aa, Entamoeba dispar
LTTYEFIRIHKDILSEYPWFCIVLDEGHKIKN

SEQ ID NO: 2533008 - protein, 25 aa, Entamoeba dispar
LTTYKLTHPDLPFDSEFELCSFIGK

SEQ ID NO: 2533009 - protein, 25 aa, Entamoeba dispar
LTVEKLLQFIGEKVNILYTDEYGLK

SEQ ID NO: 2533010 - protein, 25 aa, Entamoeba dispar
LTVFDLYQKFLFNYLKIETHPEVRE

SEQ ID NO: 2533011 - protein, 28 aa, Entamoeba dispar
LTVHGELRVYLVYFYDDNLQRNGNDLTV

SEQ ID NO: 2533012 - protein, 20 aa, Entamoeba dispar
LTVKMRIRKAYYELYAMVKS

SEQ ID NO: 2533013 - protein, 25 aa, Entamoeba dispar
LTVLQNMFEFFMKKAPNILSTMFSN

SEQ ID NO: 2533014 - protein, 17 aa, Entamoeba dispar
LTVPIKFFRKIDAVRSP

SEQ ID NO: 2533015 - protein, 19 aa, Entamoeba dispar
LTVSTLHDFYLDLDDLHDL

SEQ ID NO: 2533016 - protein, 23 aa, Entamoeba dispar
LTVYRDFITPIELLNKFIQIKDQ

SEQ ID NO: 2533017 - protein, 23 aa, Entamoeba dispar
LTYDLDLLRITAPLFVESGYGLN

SEQ ID NO: 2533018 - protein, 20 aa, Entamoeba dispar
LTYGLYEWLRVCTGAYIMQS

SEQ ID NO: 2533019 - protein, 18 aa, Entamoeba dispar
LTYIKFLTFNIQPLKIQT

SEQ ID NO: 2533020 - protein, 18 aa, Entamoeba dispar
LTYLCTYYKINVSTGLIQ

SEQ ID NO: 2533021 - protein, 24 aa, Entamoeba dispar
LTYNELVIMNILNEYYNKYKDIGC

SEQ ID NO: 2533022 - protein, 24 aa, Entamoeba dispar
LTYTELYRENISPLIIACIARLRE

SEQ ID NO: 2533023 - protein, 25 aa, Entamoeba dispar
LTYTNNVALIKPLGTYPIRIDTTGA

SEQ ID NO: 2533024 - protein, 23 aa, Entamoeba dispar
LTYTNNVALLKPLGTYTIRIDTT

SEQ ID NO: 2533025 - protein, 20 aa, Entamoeba dispar
LTYYKNPWSLTLKDSTLNIQ

SEQ ID NO: 2533026 - protein, 17 aa, Entamoeba dispar
LVALCRDEQKKSVLLII

SEQ ID NO: 2533027 - protein, 33 aa, Entamoeba dispar
LVASLPDTNKYTLWYLCDFLVDVLNHQSVNQMG

SEQ ID NO: 2533028 - protein, 25 aa, Entamoeba dispar
LVCEFRISGPFKALILNDMFKVLNI

SEQ ID NO: 2533029 - protein, 22 aa, Entamoeba dispar
LVCFEEGFHYNEFWDILHGVEK

SEQ ID NO: 2533030 - protein, 17 aa, Entamoeba dispar
LVCIMQIFLTSPIYRLK

SEQ ID NO: 2533031 - protein, 17 aa, Entamoeba dispar
LVDEFMLCISVYGFGNM

SEQ ID NO: 2533032 - protein, 32 aa, Entamoeba dispar
LVDGICSIYCSKGIYHICGYYDSLHNIVCKEI

SEQ ID NO: 2533033 - protein, 22 aa, Entamoeba dispar
LVDIKKMFVGQFGTTLIAETTE

SEQ ID NO: 2533034 - protein, 19 aa, Entamoeba dispar
LVDILSEFGYFFQVSRTIG

SEQ ID NO: 2533035 - protein, 25 aa, Entamoeba dispar
LVDLDISFNIPKFKFICNGTLCNED

SEQ ID NO: 2533036 - protein, 26 aa, Entamoeba dispar
LVDSKVIFKIICFICSFITEKEEIQE

SEQ ID NO: 2533037 - protein, 35 aa, Entamoeba dispar
LVDVKKMRKRFWFEKFHWFLSSENFIIISGKDALQ

SEQ ID NO: 2533038 - protein, 26 aa, Entamoeba dispar
LVDVVSFIHFISKYPIIPFKITDYIN

SEQ ID NO: 2533039 - protein, 18 aa, Entamoeba dispar
LVEADYKMFKCHGATFEK

SEQ ID NO: 2533040 - protein, 25 aa, Entamoeba dispar
LVEFVKYCLALNHLFDFSKGGEITK

SEQ ID NO: 2533041 - protein, 29 aa, Entamoeba dispar
LVEHPKLFWRYILELLLLCELKVVKVYCK

SEQ ID NO: 2533042 - protein, 23 aa, Entamoeba dispar
LVEKGIVDLFITLHKRFPEKKQL

SEQ ID NO: 2533043 - protein, 24 aa, Entamoeba dispar
LVEVKIIFIGIDKNPSQKLVDLYV

SEQ ID NO: 2533044 - protein, 21 aa, Entamoeba dispar
LVFALKVKYPDRFFLLRGNHE

SEQ ID NO: 2533045 - protein, 20 aa, Entamoeba dispar
LVFIREFRVPVNTMVWQLAA

SEQ ID NO: 2533046 - protein, 18 aa, Entamoeba dispar
LVGTIWFDKMIHICCEND

SEQ ID NO: 2533047 - protein, 26 aa, Entamoeba dispar
LVHQQAVLIGLLNRYYDINLKRSRKV

SEQ ID NO: 2533048 - protein, 17 aa, Entamoeba dispar
LVIEGFATLINYYKEIF

SEQ ID NO: 2533049 - protein, 17 aa, Entamoeba dispar
LVIFDYNGDSRFHLNAI

SEQ ID NO: 2533050 - protein, 18 aa, Entamoeba dispar
LVIFPNRGTNLFTIFGCY

SEQ ID NO: 2533051 - protein, 27 aa, Entamoeba dispar
LVIGKKNLFFIIFDSDENIFGGYIDKT

SEQ ID NO: 2533052 - protein, 17 aa, Entamoeba dispar
LVILFRNGIIHCDLKPE

SEQ ID NO: 2533053 - protein, 17 aa, Entamoeba dispar
LVIQIPEMLLQLSNDEQ

SEQ ID NO: 2533054 - protein, 26 aa, Entamoeba dispar
LVITEKHSSGWWFATNSQGQSGFVPE

SEQ ID NO: 2533055 - protein, 17 aa, Entamoeba dispar
LVIWLPESKQKTLFIST

SEQ ID NO: 2533056 - protein, 18 aa, Entamoeba dispar
LVKFIFSFVLAISKMVAK

SEQ ID NO: 2533057 - protein, 27 aa, Entamoeba dispar
LVKGDIIPVRFFLKNLQLTPTQTNIAD

SEQ ID NO: 2533058 - protein, 18 aa, Entamoeba dispar
LVKILTLKTPASYWSFQK

SEQ ID NO: 2533059 - protein, 31 aa, Entamoeba dispar
LVKKISADFADRFWYFLKKEYVELQGNVFCP

SEQ ID NO: 2533060 - protein, 24 aa, Entamoeba dispar
LVKNNSIIFITIPAIVISSSEQKS

SEQ ID NO: 2533061 - protein, 27 aa, Entamoeba dispar
LVKQNEMLLSIRLAIQCTLCGLNNGID

SEQ ID NO: 2533062 - protein, 24 aa, Entamoeba dispar
LVKQYHTVVLPAFYKRFDVQFQSA

SEQ ID NO: 2533063 - protein, 30 aa, Entamoeba dispar
LVKRCFCNCVWLKEIILPTSISKIENYCFK

SEQ ID NO: 2533064 - protein, 49 aa, Entamoeba dispar
LVKTIEIFKILLFPLEWVCISIALLPRLLLNQLTSPFPYIMGVPSEYFK

SEQ ID NO: 2533065 - protein, 23 aa, Entamoeba dispar
LVKYMKQHFCLAFIKIMINEYRN

SEQ ID NO: 2533066 - protein, 18 aa, Entamoeba dispar
LVLEKKILHRDLKLANFL

SEQ ID NO: 2533067 - protein, 18 aa, Entamoeba dispar
LVLGIQHQVKYYLSKVHV

SEQ ID NO: 2533068 - protein, 29 aa, Entamoeba dispar
LVLKEMVIELIILDILLTSPDYHNEQFEY

SEQ ID NO: 2533069 - protein, 17 aa, Entamoeba dispar
LVLNLYNRYHVNNIFGL

SEQ ID NO: 2533070 - protein, 25 aa, Entamoeba dispar
LVLQKKVILFCPFPSQLNKFKEFSL

SEQ ID NO: 2533071 - protein, 18 aa, Entamoeba dispar
LVLQQFLQQLMTFNLKNP

SEQ ID NO: 2533072 - protein, 19 aa, Entamoeba dispar
LVLRTLYNIFIQKNYSRKV

SEQ ID NO: 2533073 - protein, 40 aa, Entamoeba dispar
LVLSNPEYYPFFLKTNFISFLFEILPFKPPLTYEKINVTS

SEQ ID NO: 2533074 - protein, 26 aa, Entamoeba dispar
LVLSQNYHLYFYLTTDEFSFPVIDIS

SEQ ID NO: 2533075 - protein, 18 aa, Entamoeba dispar
LVMDTVVRKPFVAGTKTI

SEQ ID NO: 2533076 - protein, 17 aa, Entamoeba dispar
LVMFMNGLAHPSFGKRN

SEQ ID NO: 2533077 - protein, 27 aa, Entamoeba dispar
LVMHKMCLTLIILLRIAINHSTYEEVP

SEQ ID NO: 2533078 - protein, 19 aa, Entamoeba dispar
LVMMGIGGFSPLKGFMKKE

SEQ ID NO: 2533079 - protein, 24 aa, Entamoeba dispar
LVNDIMRKVLAYQVSKKLLTRDDI

SEQ ID NO: 2533080 - protein, 21 aa, Entamoeba dispar
LVNEIMDVPLYISADKTKQIG

SEQ ID NO: 2533081 - protein, 19 aa, Entamoeba dispar
LVNEKLEFLSLYIVGKITK

SEQ ID NO: 2533082 - protein, 19 aa, Entamoeba dispar
LVNFISKTYKGRIIRIILP

SEQ ID NO: 2533083 - protein, 22 aa, Entamoeba dispar
LVNFLAKIIKLPITNYESTTAP

SEQ ID NO: 2533084 - protein, 23 aa, Entamoeba dispar
LVNIGKMKLLKRCKIDIGRQKFN

SEQ ID NO: 2533085 - protein, 41 aa, Entamoeba dispar
LVNKISFKLPFYSLKPFTICTWFYIHSFPEYQTPSVSLFSF

SEQ ID NO: 2533086 - protein, 17 aa, Entamoeba dispar
LVNLPEAWVRNRNVFTC

SEQ ID NO: 2533087 - protein, 19 aa, Entamoeba dispar
LVNMKIISFSLSGNKFDNV

SEQ ID NO: 2533088 - protein, 24 aa, Entamoeba dispar
LVNMPMGIFMAKLDFIIANEQNFN

SEQ ID NO: 2533089 - protein, 18 aa, Entamoeba dispar
LVPFINPPHQLSFNSNLF

SEQ ID NO: 2533090 - protein, 18 aa, Entamoeba dispar
LVPFYDKLTTIPNYNNIP

SEQ ID NO: 2533091 - protein, 26 aa, Entamoeba dispar
LVPIRLKVMGLLRMWIQNRKADFQNE

SEQ ID NO: 2533092 - protein, 41 aa, Entamoeba dispar
LVPQNKYLIWLFNNFSFLSPKINFDLYKPCFDYLLSCLATN

SEQ ID NO: 2533093 - protein, 17 aa, Entamoeba dispar
LVPRVKIFAGKAAIGYD

SEQ ID NO: 2533094 - protein, 19 aa, Entamoeba dispar
LVPVFVNKEKFKRIMKTKI

SEQ ID NO: 2533095 - protein, 25 aa, Entamoeba dispar
LVQDTRFVMLPLTAINLQERPSNTL

SEQ ID NO: 2533096 - protein, 19 aa, Entamoeba dispar
LVQENLYDTIEKKDKESIK

SEQ ID NO: 2533097 - protein, 21 aa, Entamoeba dispar
LVQKKYYRALYDKNREFLNKG

SEQ ID NO: 2533098 - protein, 19 aa, Entamoeba dispar
LVQLLKFIVGLIRNEKEIP

SEQ ID NO: 2533099 - protein, 18 aa, Entamoeba dispar
LVQLYLSSLIKICCVGAS

SEQ ID NO: 2533100 - protein, 18 aa, Entamoeba dispar
LVQNIITKFLKYFKEQAT

SEQ ID NO: 2533101 - protein, 19 aa, Entamoeba dispar
LVQPNTPYEIIYEYGRIMM

SEQ ID NO: 2533102 - protein, 21 aa, Entamoeba dispar
LVQPNTPYEIIYEYGRIMMNE

SEQ ID NO: 2533103 - protein, 19 aa, Entamoeba dispar
LVQQIFTPLSYYIPESFKA

SEQ ID NO: 2533104 - protein, 24 aa, Entamoeba dispar
LVQQLMKQIVNYIAIHVIELLVEN

SEQ ID NO: 2533105 - protein, 25 aa, Entamoeba dispar
LVQSSFPFLVFLLQSPNNEIVAITS

SEQ ID NO: 2533106 - protein, 23 aa, Entamoeba dispar
LVQYLKAFDIINLVLQTKANIER

SEQ ID NO: 2533107 - protein, 27 aa, Entamoeba dispar
LVRDEALFYILTYMKPGKTLVFVNAIT

SEQ ID NO: 2533108 - protein, 27 aa, Entamoeba dispar
LVRKEDLFPLLIQFLQSEDPQYKIGFE

SEQ ID NO: 2533109 - protein, 20 aa, Entamoeba dispar
LVRRFAFQILSALNFLQQPG

SEQ ID NO: 2533110 - protein, 24 aa, Entamoeba dispar
LVSDFLKFNYADGIFMLSPNPKQP

SEQ ID NO: 2533111 - protein, 19 aa, Entamoeba dispar
LVSFFTIRACHCIENGRCT

SEQ ID NO: 2533112 - protein, 19 aa, Entamoeba dispar
LVSFLEQLNYEDYCLTKTQ

SEQ ID NO: 2533113 - protein, 29 aa, Entamoeba dispar
LVSKPTQWNYFFLFSDRLIGTVIKKYHGK

SEQ ID NO: 2533114 - protein, 24 aa, Entamoeba dispar
LVSLHYNFHTLLYPSNTILVTPVF

SEQ ID NO: 2533115 - protein, 25 aa, Entamoeba dispar
LVSNEIWEWILLPKEKFQKRKKTII

SEQ ID NO: 2533116 - protein, 17 aa, Entamoeba dispar
LVSNLCLFTPKPSYSIF

SEQ ID NO: 2533117 - protein, 18 aa, Entamoeba dispar
LVSPMKRSWRKSRIQSAI

SEQ ID NO: 2533118 - protein, 26 aa, Entamoeba dispar
LVSQLLNEFFIPPIPFINSISSQQTP

SEQ ID NO: 2533119 - protein, 18 aa, Entamoeba dispar
LVSSWKNTESMIINNVNM

SEQ ID NO: 2533120 - protein, 18 aa, Entamoeba dispar
LVTCIRSKYLKIKELSLE

SEQ ID NO: 2533121 - protein, 18 aa, Entamoeba dispar
LVTFFRQTIKVQGRAGNT

SEQ ID NO: 2533122 - protein, 24 aa, Entamoeba dispar
LVVATRFIRQLGLYSYENDQHNTI

SEQ ID NO: 2533123 - protein, 18 aa, Entamoeba dispar
LVVFCRNFTHLFFGSKQP

SEQ ID NO: 2533124 - protein, 18 aa, Entamoeba dispar
LVVPLIVGNIFLQPETIA

SEQ ID NO: 2533125 - protein, 19 aa, Entamoeba dispar
LVYASCSLSLNEIFYSGFT

SEQ ID NO: 2533126 - protein, 27 aa, Entamoeba dispar
LVYLMNVVLFFPTYRDVYRFIKVNRKC

SEQ ID NO: 2533127 - protein, 26 aa, Entamoeba dispar
LVYMNKMPVIWKLYIEWLIENREITQ

SEQ ID NO: 2533128 - protein, 18 aa, Entamoeba dispar
LVYSLKDWVFTSIDSILN

SEQ ID NO: 2533129 - protein, 17 aa, Entamoeba dispar
LWDIYLDITLHLELYEK

SEQ ID NO: 2533130 - protein, 21 aa, Entamoeba dispar
LWEDSMIWIQLYYQKINESKA

SEQ ID NO: 2533131 - protein, 19 aa, Entamoeba dispar
LWEKYIGFKIIYDSDTFDL

SEQ ID NO: 2533132 - protein, 19 aa, Entamoeba dispar
LWLQNDILNFMIHKLGILD

SEQ ID NO: 2533133 - protein, 19 aa, Entamoeba dispar
LWNNNIIWEFAKGLSPGVD

SEQ ID NO: 2533134 - protein, 19 aa, Entamoeba dispar
LYAISFWVHQLIFVKEYEY

SEQ ID NO: 2533135 - protein, 19 aa, Entamoeba dispar
LYAKYPLLIEYEEKNSIVI

SEQ ID NO: 2533136 - protein, 17 aa, Entamoeba dispar
LYAYQRISGAFPVQDIC

SEQ ID NO: 2533137 - protein, 20 aa, Entamoeba dispar
LYAYTNFINYIINEEPFVHN

SEQ ID NO: 2533138 - protein, 27 aa, Entamoeba dispar
LYCIRKNFFLWLLENKPSSALSYLQNE

SEQ ID NO: 2533139 - protein, 23 aa, Entamoeba dispar
LYDCISEMKFINPKSYLVNGVLK

SEQ ID NO: 2533140 - protein, 27 aa, Entamoeba dispar
LYDDNDHFLFVLRKKGVSDVKKFTRKT

SEQ ID NO: 2533141 - protein, 25 aa, Entamoeba dispar
LYDKDYILHDFYIFSMSYLNCYQNE

SEQ ID NO: 2533142 - protein, 21 aa, Entamoeba dispar
LYDMGPLGCALKQNILQFWRK

SEQ ID NO: 2533143 - protein, 18 aa, Entamoeba dispar
LYDPNYIYSIILPNTPEA

SEQ ID NO: 2533144 - protein, 25 aa, Entamoeba dispar
LYDPSPIINTFLPSLTNIFIKDISG

SEQ ID NO: 2533145 - protein, 18 aa, Entamoeba dispar
LYDTLLKELYEKFIAPTD

SEQ ID NO: 2533146 - protein, 24 aa, Entamoeba dispar
LYDYINRIFYYYQLTNFTLNNEDS

SEQ ID NO: 2533147 - protein, 19 aa, Entamoeba dispar
LYEFLYDVPVNCQVYQIVF

SEQ ID NO: 2533148 - protein, 18 aa, Entamoeba dispar
LYEHIMKMLFEPLNPKED

SEQ ID NO: 2533149 - protein, 31 aa, Entamoeba dispar
LYELFCSYCLPFLFYKQIILVNRDLLMKHTD

SEQ ID NO: 2533150 - protein, 18 aa, Entamoeba dispar
LYENIFRFKSYPVNSVCF

SEQ ID NO: 2533151 - protein, 20 aa, Entamoeba dispar
LYERYIIFKSKSNKQRKHVW

SEQ ID NO: 2533152 - protein, 17 aa, Entamoeba dispar
LYFDTIRVSNRLSAELY

SEQ ID NO: 2533153 - protein, 46 aa, Entamoeba dispar
LYFEDENNLLLWIIKFLSKEFFQEILILPPPIIQYPFYSHIQLKHP

SEQ ID NO: 2533154 - protein, 18 aa, Entamoeba dispar
LYFEMFFDNTSQLCTMND

SEQ ID NO: 2533155 - protein, 27 aa, Entamoeba dispar
LYGCTVSLFTHWLPRFGIEVDLVDTSD

SEQ ID NO: 2533156 - protein, 21 aa, Entamoeba dispar
LYGLIHQRFIVTGSGLKRMYE

SEQ ID NO: 2533157 - protein, 23 aa, Entamoeba dispar
LYGLVYWFRIWDHEYNLFRTKYL

SEQ ID NO: 2533158 - protein, 19 aa, Entamoeba dispar
LYGTYVYDILNLLLTGFED

SEQ ID NO: 2533159 - protein, 18 aa, Entamoeba dispar
LYHLLQNTVPPQKRFCFC

SEQ ID NO: 2533160 - protein, 18 aa, Entamoeba dispar
LYIPAVFCSIFGLSLDTK

SEQ ID NO: 2533161 - protein, 18 aa, Entamoeba dispar
LYIPRHCSVTHTLIAADD

SEQ ID NO: 2533162 - protein, 18 aa, Entamoeba dispar
LYIRCEVVALLDDEKKLK

SEQ ID NO: 2533163 - protein, 20 aa, Entamoeba dispar
LYITDSLLLTTFKNAFFPTY

SEQ ID NO: 2533164 - protein, 26 aa, Entamoeba dispar
LYKLPFKCFNNCKSLIKINIEYVTYI

SEQ ID NO: 2533165 - protein, 19 aa, Entamoeba dispar
LYKNTILSSQWILDSMTSL

SEQ ID NO: 2533166 - protein, 25 aa, Entamoeba dispar
LYLREMLEPLIPFNLYEQFIQLPKG

SEQ ID NO: 2533167 - protein, 19 aa, Entamoeba dispar
LYLSFFYDGIVDYSGNCIC

SEQ ID NO: 2533168 - protein, 18 aa, Entamoeba dispar
LYLSINQYCLTQQGFIVQ

SEQ ID NO: 2533169 - protein, 17 aa, Entamoeba dispar
LYLVEDCGHNDIFSNIE

SEQ ID NO: 2533170 - protein, 24 aa, Entamoeba dispar
LYMWDFCQCDPKRCSGRKLVRQKL

SEQ ID NO: 2533171 - protein, 18 aa, Entamoeba dispar
LYNAFLKTDQEVLKRSEA

SEQ ID NO: 2533172 - protein, 26 aa, Entamoeba dispar
LYNDQSIFWKLYYKSTVYNNEHVLLT

SEQ ID NO: 2533173 - protein, 17 aa, Entamoeba dispar
LYNILRQRIGNKKIGKV

SEQ ID NO: 2533174 - protein, 26 aa, Entamoeba dispar
LYNIRYSLDFIPPTRKINPHCIVPIK

SEQ ID NO: 2533175 - protein, 26 aa, Entamoeba dispar
LYNKDKTLLIQYPIGNSRTSYSIPPS

SEQ ID NO: 2533176 - protein, 17 aa, Entamoeba dispar
LYNYPLLDHDQVCSLCF

SEQ ID NO: 2533177 - protein, 26 aa, Entamoeba dispar
LYPNEIIPCSLLKELFVRFQDEINKK

SEQ ID NO: 2533178 - protein, 17 aa, Entamoeba dispar
LYPNHYPLYLNSYSIQN

SEQ ID NO: 2533179 - protein, 28 aa, Entamoeba dispar
LYPQMQALRFPIFPSFHKFGVRYCNAKV

SEQ ID NO: 2533180 - protein, 36 aa, Entamoeba dispar
LYPSAIHRLRLPTGYPFLMTKPINWYWERLMSEDQV

SEQ ID NO: 2533181 - protein, 23 aa, Entamoeba dispar
LYQFKEIIQYFYNKTDYEVFSMI

SEQ ID NO: 2533182 - protein, 18 aa, Entamoeba dispar
LYQQASSPVLSPIGKPQI

SEQ ID NO: 2533183 - protein, 19 aa, Entamoeba dispar
LYREIPTYALWNAFVSSGF

SEQ ID NO: 2533184 - protein, 31 aa, Entamoeba dispar
LYRFRIERIPFEKILPFYNKISTLKIGVYNG

SEQ ID NO: 2533185 - protein, 23 aa, Entamoeba dispar
LYRNYFGISIKRLLEEENRMNAQ

SEQ ID NO: 2533186 - protein, 30 aa, Entamoeba dispar
LYRPIEVTCYPFMFMQTPQPPQPTDKVVFP

SEQ ID NO: 2533187 - protein, 17 aa, Entamoeba dispar
LYRTLFKQLNEESQIKG

SEQ ID NO: 2533188 - protein, 30 aa, Entamoeba dispar
LYSDYEYHMIYWYISILFSMSYEHLNEFRI

SEQ ID NO: 2533189 - protein, 26 aa, Entamoeba dispar
LYSIFENFGIILDLKQIKTITHPILC

SEQ ID NO: 2533190 - protein, 17 aa, Entamoeba dispar
LYSIPCVVANKTFTFQQ

SEQ ID NO: 2533191 - protein, 23 aa, Entamoeba dispar
LYSLGVILYYMATKEFPFTDIPD

SEQ ID NO: 2533192 - protein, 17 aa, Entamoeba dispar
LYSLSIVNAPRVYFSLK

SEQ ID NO: 2533193 - protein, 26 aa, Entamoeba dispar
LYTYTFKYIAMKIVLLWLSTKIITVS

SEQ ID NO: 2533194 - protein, 23 aa, Entamoeba dispar
LYVYSPSILYPGKWWKCDYCQQV

SEQ ID NO: 2533195 - protein, 20 aa, Entamoeba dispar
LYYDLILLVNLSSSFPCLQI

SEQ ID NO: 2533196 - protein, 26 aa, Entamoeba dispar
LYYTSNQFIIWFNSIKQYIINKLNEL

SEQ ID NO: 2533197 - protein, 25 aa, Entamoeba dispar
MAAFFHEPITFFALLPYAEELECSI

SEQ ID NO: 2533198 - protein, 18 aa, Entamoeba dispar
MAAWMKYGLPQTQQEVIN

SEQ ID NO: 2533199 - protein, 33 aa, Entamoeba dispar
MAECKMKYSLILYRQFCSLFDSLPLVCIVHRDI

SEQ ID NO: 2533200 - protein, 32 aa, Entamoeba dispar
MAEGDPPYMEFPPLRALFLITTKGIPPLKNAE

SEQ ID NO: 2533201 - protein, 25 aa, Entamoeba dispar
MAGFEDVYLLEEPFASILEYKREHH

SEQ ID NO: 2533202 - protein, 19 aa, Entamoeba dispar
MAGKLYKFIPENQNGRFYP

SEQ ID NO: 2533203 - protein, 20 aa, Entamoeba dispar
MAGKLYKFIPENQNGRFYPF

SEQ ID NO: 2533204 - protein, 19 aa, Entamoeba dispar
MAHHWPVRKPRPTAEKITS

SEQ ID NO: 2533205 - protein, 17 aa, Entamoeba dispar
MAIPKIEDFTYPGLLKE

SEQ ID NO: 2533206 - protein, 23 aa, Entamoeba dispar
MAKDDYAWWKGRLSQMSQYFNAY

SEQ ID NO: 2533207 - protein, 17 aa, Entamoeba dispar
MAKFGTIPPLPGDTIFS

SEQ ID NO: 2533208 - protein, 22 aa, Entamoeba dispar
MAKKIGAFFFETSALDGKNVET

SEQ ID NO: 2533209 - protein, 19 aa, Entamoeba dispar
MALVDLFSVYGSELAPLIP

SEQ ID NO: 2533210 - protein, 18 aa, Entamoeba dispar
MANKTKALKILSKYIKES

SEQ ID NO: 2533211 - protein, 23 aa, Entamoeba dispar
MANNLIELLLIFSSKKKMSKELL

SEQ ID NO: 2533212 - protein, 19 aa, Entamoeba dispar
MAPELYRRLPYGNKIDCWS

SEQ ID NO: 2533213 - protein, 34 aa, Entamoeba dispar
MAPMDAFLCARGMKTLPMRMKIHMENGLKVAKFL

SEQ ID NO: 2533214 - protein, 23 aa, Entamoeba dispar
MATAINEMKLEIASLAQSQTKAI

SEQ ID NO: 2533215 - protein, 18 aa, Entamoeba dispar
MATVFFMSVLDESILLDT

SEQ ID NO: 2533216 - protein, 20 aa, Entamoeba dispar
MAYSYATLYFSYCKLKDDQT

SEQ ID NO: 2533217 - protein, 18 aa, Entamoeba dispar
MCDIFDGAKRQILEELVV

SEQ ID NO: 2533218 - protein, 18 aa, Entamoeba dispar
MCDSVLLALPTQPLLAHL

SEQ ID NO: 2533219 - protein, 25 aa, Entamoeba dispar
MCEDIFIDFIIKTRWTWYDFQESRE

SEQ ID NO: 2533220 - protein, 26 aa, Entamoeba dispar
MCFNHKHLLLPYCELFIKNVLNQLEI

SEQ ID NO: 2533221 - protein, 33 aa, Entamoeba dispar
MCIDGNIYYELFLVKTLPIFKDLINKKILITKV

SEQ ID NO: 2533222 - protein, 31 aa, Entamoeba dispar
MCKELAPLNPDWIYIRAAAIARKVYLNNGIG

SEQ ID NO: 2533223 - protein, 24 aa, Entamoeba dispar
MCKEMEVKFLGKIPLDPIIAHSCD

SEQ ID NO: 2533224 - protein, 23 aa, Entamoeba dispar
MCLFLCNGLFKETMNPLPLSCIE

SEQ ID NO: 2533225 - protein, 19 aa, Entamoeba dispar
MCLMMNMVVKYRSTLFRAV

SEQ ID NO: 2533226 - protein, 23 aa, Entamoeba dispar
MCMICFQTVRQGMNTLKCCKGKR

SEQ ID NO: 2533227 - protein, 19 aa, Entamoeba dispar
MCTSEGGVFFVTGANKVEE

SEQ ID NO: 2533228 - protein, 24 aa, Entamoeba dispar
MCVAKIMWMLYEHPEIKIKDIPTQ

SEQ ID NO: 2533229 - protein, 17 aa, Entamoeba dispar
MDAIIGVIVDRKKYMED

SEQ ID NO: 2533230 - protein, 24 aa, Entamoeba dispar
MDAKVIAPYLNTILDRMFEMIEFV

SEQ ID NO: 2533231 - protein, 22 aa, Entamoeba dispar
MDDKGFISTEILAKLLACSPEN

SEQ ID NO: 2533232 - protein, 25 aa, Entamoeba dispar
MDDKTKALIIFLEKTKRPSQRVTTS

SEQ ID NO: 2533233 - protein, 17 aa, Entamoeba dispar
MDFSPFKQFLISTSSVG

SEQ ID NO: 2533234 - protein, 27 aa, Entamoeba dispar
MDFTKKLQLPILSSPFQFIIPNRRCFL

SEQ ID NO: 2533235 - protein, 17 aa, Entamoeba dispar
MDGGWFMLTEHSPNVIK

SEQ ID NO: 2533236 - protein, 21 aa, Entamoeba dispar
MDIKGLLTRWSYENQIYCGIT

SEQ ID NO: 2533237 - protein, 18 aa, Entamoeba dispar
MDKTPILPETSLFRLHGD

SEQ ID NO: 2533238 - protein, 20 aa, Entamoeba dispar
MDKYFRIPLKEMANKGLLNE

SEQ ID NO: 2533239 - protein, 32 aa, Entamoeba dispar
MDNIKGILMTRISLLLPLFLEFIKQNKLNERY

SEQ ID NO: 2533240 - protein, 25 aa, Entamoeba dispar
MDNSHIYMFKTLRSFVFDEKCPNPL

SEQ ID NO: 2533241 - protein, 33 aa, Entamoeba dispar
MDPAWKELMTLIQDIWFNPIIQKYNCPPYHDDI

SEQ ID NO: 2533242 - protein, 18 aa, Entamoeba dispar
MDQLPKALVIIFECMYNK

SEQ ID NO: 2533243 - protein, 23 aa, Entamoeba dispar
MDSTLKEHRLVLDVLSKVEPSRK

SEQ ID NO: 2533244 - protein, 24 aa, Entamoeba dispar
MDTFCKLAHMFGTKLVDCVHLLPS

SEQ ID NO: 2533245 - protein, 18 aa, Entamoeba dispar
MDTITIGIYLDGESFMKK

SEQ ID NO: 2533246 - protein, 23 aa, Entamoeba dispar
MDTMVVDHWTFNWKTFNGGSYKI

SEQ ID NO: 2533247 - protein, 25 aa, Entamoeba dispar
MDVGYQCLFLRTSSSSLYCFDLNTN

SEQ ID NO: 2533248 - protein, 17 aa, Entamoeba dispar
MDVLIGENIILQKKIET

SEQ ID NO: 2533249 - protein, 24 aa, Entamoeba dispar
MDVLYGRVYPLKLGYVGVLNRSQH

SEQ ID NO: 2533250 - protein, 17 aa, Entamoeba dispar
MDWAVLGMRFLFTDMKY

SEQ ID NO: 2533251 - protein, 36 aa, Entamoeba dispar
MECNASLLMILNTPLILYIIDHLLTQNVEQIFIACS

SEQ ID NO: 2533252 - protein, 28 aa, Entamoeba dispar
MEDFESLIQLPLIGLTININEKIQLKNG

SEQ ID NO: 2533253 - protein, 24 aa, Entamoeba dispar
MEDKLALEFLDKFEQKFISQDYYE

SEQ ID NO: 2533254 - protein, 18 aa, Entamoeba dispar
MEDKRALYALAIHSLKNQ

SEQ ID NO: 2533255 - protein, 31 aa, Entamoeba dispar
MEDWKILKDITVLKWTLLKKDTGILTPIELC

SEQ ID NO: 2533256 - protein, 32 aa, Entamoeba dispar
MEDWKILKDITVLKWTLLKKDTGILTPIELCQ

SEQ ID NO: 2533257 - protein, 18 aa, Entamoeba dispar
MEEDLLDLPWNRCWIDGN

SEQ ID NO: 2533258 - protein, 23 aa, Entamoeba dispar
MEEEQLRHFFSKVGEIESVKIVR

SEQ ID NO: 2533259 - protein, 19 aa, Entamoeba dispar
MEEEVPCDFIINQEIFKSL

SEQ ID NO: 2533260 - protein, 18 aa, Entamoeba dispar
MEERIQNLHYEELSEKYT

SEQ ID NO: 2533261 - protein, 18 aa, Entamoeba dispar
MEFFLRLDEKQAAMDDET

SEQ ID NO: 2533262 - protein, 25 aa, Entamoeba dispar
MEFKGEACVLKFYLAPKFDEEDEPQ

SEQ ID NO: 2533263 - protein, 21 aa, Entamoeba dispar
MEGLMMWVNALLDGSGIEVED

SEQ ID NO: 2533264 - protein, 17 aa, Entamoeba dispar
MEGYDWKFNKLVCTVWS

SEQ ID NO: 2533265 - protein, 23 aa, Entamoeba dispar
MEHKLFSEWTFWFDGFSNKSTET

SEQ ID NO: 2533266 - protein, 25 aa, Entamoeba dispar
MEIKKPLFVIGLPRSGTTFLHHLLA

SEQ ID NO: 2533267 - protein, 20 aa, Entamoeba dispar
MEKEIGRIYSKIYQGRGSNE

SEQ ID NO: 2533268 - protein, 19 aa, Entamoeba dispar
MEKIMGRIDLPFIQRIYNS

SEQ ID NO: 2533269 - protein, 30 aa, Entamoeba dispar
MEKVRLLTVVSLLELYRSLKVLFVKGTHIK

SEQ ID NO: 2533270 - protein, 29 aa, Entamoeba dispar
MELAQMKYVTLYKYWWDGLKEKVDIERWS

SEQ ID NO: 2533271 - protein, 18 aa, Entamoeba dispar
MELIRLRNAINSRKEECA

SEQ ID NO: 2533272 - protein, 18 aa, Entamoeba dispar
MELITWAIDIDFLSTDTL

SEQ ID NO: 2533273 - protein, 19 aa, Entamoeba dispar
MELSGKTAFLAKLLAFLRK

SEQ ID NO: 2533274 - protein, 25 aa, Entamoeba dispar
MEMNELLLCSPFLRTTQSYLSQIVS

SEQ ID NO: 2533275 - protein, 19 aa, Entamoeba dispar
MENGVVYVLTSLRLREFKY

SEQ ID NO: 2533276 - protein, 24 aa, Entamoeba dispar
MENILTGFGYIIQILDNELYNVIM

SEQ ID NO: 2533277 - protein, 22 aa, Entamoeba dispar
MENLMYQYKRPFVLDLKIGTQT

SEQ ID NO: 2533278 - protein, 41 aa, Entamoeba dispar
MENVWYRWLENIHDWCISRQLWWGHRIPAYLIKNKKEKETN

SEQ ID NO: 2533279 - protein, 25 aa, Entamoeba dispar
MEPGKDWLLFPNMGAYTISMATNFN

SEQ ID NO: 2533280 - protein, 18 aa, Entamoeba dispar
MEQILKSLREVIDLEYDN

SEQ ID NO: 2533281 - protein, 25 aa, Entamoeba dispar
MEQKTWGNTLIPFSFRNGGSFFIII

SEQ ID NO: 2533282 - protein, 26 aa, Entamoeba dispar
MEQLTILLYKTLISGITKLLLALNKM

SEQ ID NO: 2533283 - protein, 24 aa, Entamoeba dispar
MERFHFNPIPLDEYSRKFFPGIET

SEQ ID NO: 2533284 - protein, 23 aa, Entamoeba dispar
MERFHFNPIPLDEYSRKLFPNIE

SEQ ID NO: 2533285 - protein, 25 aa, Entamoeba dispar
MERFHFNPIPLDEYSRRFFPNIETF

SEQ ID NO: 2533286 - protein, 25 aa, Entamoeba dispar
MERFHFNPIPLDKYSKKLFHNIEIF

SEQ ID NO: 2533287 - protein, 25 aa, Entamoeba dispar
MERFHFNPIPLDKYSRKLFTNIETF

SEQ ID NO: 2533288 - protein, 26 aa, Entamoeba dispar
MERFHFNPIPLDRYSRKLFPNIETFH

SEQ ID NO: 2533289 - protein, 23 aa, Entamoeba dispar
MERFHFNPIPLNEHSRKFFPNIE

SEQ ID NO: 2533290 - protein, 22 aa, Entamoeba dispar
MERFHFNPIPLNEHSRKLFPNI

SEQ ID NO: 2533291 - protein, 23 aa, Entamoeba dispar
MERFHFNPIPLNERSRKLFPNIE

SEQ ID NO: 2533292 - protein, 24 aa, Entamoeba dispar
MERFHFNPIPLNEYSRKFFPNIET

SEQ ID NO: 2533293 - protein, 20 aa, Entamoeba dispar
MERFHFNPIPLNEYSRKLFT

SEQ ID NO: 2533294 - protein, 23 aa, Entamoeba dispar
MERFHFNPIPLNEYSRKLFTNIE

SEQ ID NO: 2533295 - protein, 24 aa, Entamoeba dispar
MERFHFNPIPLNEYSRKLFTNIET

SEQ ID NO: 2533296 - protein, 24 aa, Entamoeba dispar
MERFHFNPIPLNEYSRRFFPNIET

SEQ ID NO: 2533297 - protein, 25 aa, Entamoeba dispar
MERFHFNPIPLNEYSRRFFPNIETF

SEQ ID NO: 2533298 - protein, 26 aa, Entamoeba dispar
MERFHFNPIPLNKYSRKFFPNIETFH

SEQ ID NO: 2533299 - protein, 25 aa, Entamoeba dispar
MERFHFNPIPLNKYSRRFFPNIETF

SEQ ID NO: 2533300 - protein, 25 aa, Entamoeba dispar
MERFHFNPIPLNQYSRRLFTDIETF

SEQ ID NO: 2533301 - protein, 24 aa, Entamoeba dispar
MERFHFNPISLNEYSRRLFPNIET

SEQ ID NO: 2533302 - protein, 26 aa, Entamoeba dispar
MERFHFNPISLNKYSRKLFPNIETFH

SEQ ID NO: 2533303 - protein, 23 aa, Entamoeba dispar
MERFREQFAYIMKNNLENLCMKY

SEQ ID NO: 2533304 - protein, 23 aa, Entamoeba dispar
MERIRPELMKIQKKIEAVEQRKK

SEQ ID NO: 2533305 - protein, 25 aa, Entamoeba dispar
MERSKIMLQLAFKRNQMLQNEKKRL

SEQ ID NO: 2533306 - protein, 19 aa, Entamoeba dispar
MEYLFKLYDAVDQTITLLS

SEQ ID NO: 2533307 - protein, 22 aa, Entamoeba dispar
MEYNERVNYLAGLHPGDIKFEE

SEQ ID NO: 2533308 - protein, 18 aa, Entamoeba dispar
MFCDSIGFLSANFYSKNL

SEQ ID NO: 2533309 - protein, 19 aa, Entamoeba dispar
MFCIEINGVKILYTGDFSG

SEQ ID NO: 2533310 - protein, 18 aa, Entamoeba dispar
MFDFTIMDSRFLPFRELQ

SEQ ID NO: 2533311 - protein, 17 aa, Entamoeba dispar
MFDIIKQKLEDNANAGL

SEQ ID NO: 2533312 - protein, 25 aa, Entamoeba dispar
MFEIGLRFFFTDVKLLIDFATKLIQ

SEQ ID NO: 2533313 - protein, 18 aa, Entamoeba dispar
MFGAADWFNKLIGQFWGG

SEQ ID NO: 2533314 - protein, 18 aa, Entamoeba dispar
MFHIDFGYILGKECKPFP

SEQ ID NO: 2533315 - protein, 18 aa, Entamoeba dispar
MFHPIEWYLEHLMDEQQF

SEQ ID NO: 2533316 - protein, 27 aa, Entamoeba dispar
MFICSNERILFLLIKSILNIFEVESNY

SEQ ID NO: 2533317 - protein, 22 aa, Entamoeba dispar
MFIKISHWIVGGDGWAYDIGYN

SEQ ID NO: 2533318 - protein, 17 aa, Entamoeba dispar
MFIKYRPVDFNENMLDF

SEQ ID NO: 2533319 - protein, 27 aa, Entamoeba dispar
MFILDEEWEYWINVLYECLVMDPAVPT

SEQ ID NO: 2533320 - protein, 17 aa, Entamoeba dispar
MFMRLMCIEKSSIYQEQ

SEQ ID NO: 2533321 - protein, 23 aa, Entamoeba dispar
MFNAVERLPIVVKMILSNTLEER

SEQ ID NO: 2533322 - protein, 21 aa, Entamoeba dispar
MFQIITIDLFNLFDPAEIVTF

SEQ ID NO: 2533323 - protein, 21 aa, Entamoeba dispar
MFQTALHEAIPYLAEAMNIPL

SEQ ID NO: 2533324 - protein, 19 aa, Entamoeba dispar
MFQVHIKNKLKKFQCKVCG

SEQ ID NO: 2533325 - protein, 29 aa, Entamoeba dispar
MFSCKNEWLLTFGYSVRWPEKSDIAIIKS

SEQ ID NO: 2533326 - protein, 25 aa, Entamoeba dispar
MFSQFIKLCYKIHTYSDINLMNAKN

SEQ ID NO: 2533327 - protein, 24 aa, Entamoeba dispar
MFTAAQSMKCSCLLPHTPNFEVII

SEQ ID NO: 2533328 - protein, 34 aa, Entamoeba dispar
MFTTTHQTLLLLSLITPYLHHYLSPNVIISGRIL

SEQ ID NO: 2533329 - protein, 17 aa, Entamoeba dispar
MGALIAGAQYRGQLKKD

SEQ ID NO: 2533330 - protein, 22 aa, Entamoeba dispar
MGCTSVVILIIDNTIYCGNAGD

SEQ ID NO: 2533331 - protein, 20 aa, Entamoeba dispar
MGDVQVMRYLQTLKRFTTTD

SEQ ID NO: 2533332 - protein, 18 aa, Entamoeba dispar
MGEIVALNALLKKNLRSI

SEQ ID NO: 2533333 - protein, 27 aa, Entamoeba dispar
MGEYDFNVFIFLYCSDLDEQFKRLIDR

SEQ ID NO: 2533334 - protein, 20 aa, Entamoeba dispar
MGIVIGNIKKWKFNCKDAEE

SEQ ID NO: 2533335 - protein, 20 aa, Entamoeba dispar
MGIYSIVAFLQRLDLDAKLQ

SEQ ID NO: 2533336 - protein, 17 aa, Entamoeba dispar
MGKLLKPISLLISGMEN

SEQ ID NO: 2533337 - protein, 30 aa, Entamoeba dispar
MGKTAVFVLSILNQGLFLGDHVSAIVVCHT

SEQ ID NO: 2533338 - protein, 20 aa, Entamoeba dispar
MGKVSWTVPQLILGQTDFYV

SEQ ID NO: 2533339 - protein, 26 aa, Entamoeba dispar
MGLPPNFMMKFFFRPAEKVSDEIEEL

SEQ ID NO: 2533340 - protein, 22 aa, Entamoeba dispar
MGLRRIKYWDNIFVDFVEQCFI

SEQ ID NO: 2533341 - protein, 35 aa, Entamoeba dispar
MGLVKPTVLVLFPFKTPAIIFIKTLLTIFGNQFQQ

SEQ ID NO: 2533342 - protein, 18 aa, Entamoeba dispar
MGLYFQKKIPRCEQQREI

SEQ ID NO: 2533343 - protein, 26 aa, Entamoeba dispar
MGNAGLIQWLIKLSDFNIFARKEMGV

SEQ ID NO: 2533344 - protein, 19 aa, Entamoeba dispar
MGNKYKIIRWAAPGSCVIG

SEQ ID NO: 2533345 - protein, 17 aa, Entamoeba dispar
MGPLLPQEVAAAYRRLI

SEQ ID NO: 2533346 - protein, 26 aa, Entamoeba dispar
MGRIDLPFIQRIYNSYMGFCINLLPR

SEQ ID NO: 2533347 - protein, 24 aa, Entamoeba dispar
MGRLIFPKVENKEPIFNCIWIGNG

SEQ ID NO: 2533348 - protein, 23 aa, Entamoeba dispar
MGRRADYMWGLGYRKALMIEKLK

SEQ ID NO: 2533349 - protein, 28 aa, Entamoeba dispar
MGSIGHSLIFLSPLEKSFILLMEKKNVK

SEQ ID NO: 2533350 - protein, 17 aa, Entamoeba dispar
MGSVPYIEIPNKTKIRF

SEQ ID NO: 2533351 - protein, 18 aa, Entamoeba dispar
MGVFNLFKDYEELLFEKR

SEQ ID NO: 2533352 - protein, 25 aa, Entamoeba dispar
MGYENLYEFVLGKQPIEKVKEFKES

SEQ ID NO: 2533353 - protein, 20 aa, Entamoeba dispar
MGYEVLVVSQFTLYAILNGT

SEQ ID NO: 2533354 - protein, 20 aa, Entamoeba dispar
MGYIRTLLKYFFDKFDRTGA

SEQ ID NO: 2533355 - protein, 17 aa, Entamoeba dispar
MGYNLLFEGMLASVITA

SEQ ID NO: 2533356 - protein, 18 aa, Entamoeba dispar
MGYYTMLSLFSIGSRRGK

SEQ ID NO: 2533357 - protein, 22 aa, Entamoeba dispar
MHAKLLIEITQRKFAPTTLKEA

SEQ ID NO: 2533358 - protein, 17 aa, Entamoeba dispar
MHDLRQIWKNGMTYNRV

SEQ ID NO: 2533359 - protein, 19 aa, Entamoeba dispar
MHFAHEQLTYRYFKEMQEI

SEQ ID NO: 2533360 - protein, 18 aa, Entamoeba dispar
MHFNSHYLARRLINKTVS

SEQ ID NO: 2533361 - protein, 18 aa, Entamoeba dispar
MHLVERMEKYWKINNIKV

SEQ ID NO: 2533362 - protein, 18 aa, Entamoeba dispar
MHRVLEETLYQNVKQQDE

SEQ ID NO: 2533363 - protein, 17 aa, Entamoeba dispar
MICLFTSVKHSHSRHRC

SEQ ID NO: 2533364 - protein, 23 aa, Entamoeba dispar
MIDKINLLKPIKPIIDSLYQYLH

SEQ ID NO: 2533365 - protein, 31 aa, Entamoeba dispar
MIDNDEWIYYLFILIKNILKKYPSLLIESVY

SEQ ID NO: 2533366 - protein, 18 aa, Entamoeba dispar
MIEASFRAIERKLAQQAL

SEQ ID NO: 2533367 - protein, 23 aa, Entamoeba dispar
MIENLLNMNLIPEDALRALCDKA

SEQ ID NO: 2533368 - protein, 21 aa, Entamoeba dispar
MIETSLFMIAITRESTQPKCI

SEQ ID NO: 2533369 - protein, 26 aa, Entamoeba dispar
MIGDESLPFVLLNYKDNQQLIDILKE

SEQ ID NO: 2533370 - protein, 61 aa, Entamoeba dispar
MIGGSDALFFFQYTKLPMNILSKIWSLSVPPKKPMYLSEFAKALVLIYYAQQNQPISNELF

SEQ ID NO: 2533371 - protein, 17 aa, Entamoeba dispar
MIHCSMDDVFYVSRAFC

SEQ ID NO: 2533372 - protein, 28 aa, Entamoeba dispar
MIIMGFNYLDILAIYHPMYYNNGFLPSR

SEQ ID NO: 2533373 - protein, 18 aa, Entamoeba dispar
MIISPKWVRMSEYYYLGG

SEQ ID NO: 2533374 - protein, 17 aa, Entamoeba dispar
MIITPGLVDLIIGTSSN

SEQ ID NO: 2533375 - protein, 17 aa, Entamoeba dispar
MIKPESKLSMIFNNIKK

SEQ ID NO: 2533376 - protein, 21 aa, Entamoeba dispar
MIKVINMIIGEILMINNEREK

SEQ ID NO: 2533377 - protein, 17 aa, Entamoeba dispar
MILLILETGMDFKGIFR

SEQ ID NO: 2533378 - protein, 17 aa, Entamoeba dispar
MIMNKKTLLDNTDDFIL

SEQ ID NO: 2533379 - protein, 18 aa, Entamoeba dispar
MINKFENNYFKIGKIKKS

SEQ ID NO: 2533380 - protein, 33 aa, Entamoeba dispar
MINNTFNCQIPIIHLLFPIALKYSLIQCSPKSI

SEQ ID NO: 2533381 - protein, 21 aa, Entamoeba dispar
MIQCIRLIPCLIFGRGDEECI

SEQ ID NO: 2533382 - protein, 17 aa, Entamoeba dispar
MIQFDDINKGKFMSCCM

SEQ ID NO: 2533383 - protein, 24 aa, Entamoeba dispar
MIQPTIELLFNYWKQNKKSVITVP

SEQ ID NO: 2533384 - protein, 39 aa, Entamoeba dispar
MIQYINWYNWLERDVYRYSLYFNLLKEKTAKELFSIYFQ

SEQ ID NO: 2533385 - protein, 18 aa, Entamoeba dispar
MIRILTPVIVLPYEHVLS

SEQ ID NO: 2533386 - protein, 27 aa, Entamoeba dispar
MIRMMKQTPIFYPKDRFGLIFYGSQNT

SEQ ID NO: 2533387 - protein, 18 aa, Entamoeba dispar
MISINIPTTITKIGWSCF

SEQ ID NO: 2533388 - protein, 28 aa, Entamoeba dispar
MITERNYLNIFPFRKWSDKEIPEFHEGE

SEQ ID NO: 2533389 - protein, 20 aa, Entamoeba dispar
MITFPAEKYTEFKRLALLLT

SEQ ID NO: 2533390 - protein, 21 aa, Entamoeba dispar
MIVGYYLQEGCLKQFIKYLIV

SEQ ID NO: 2533391 - protein, 17 aa, Entamoeba dispar
MIVILTMNRFKSIDIPT

SEQ ID NO: 2533392 - protein, 18 aa, Entamoeba dispar
MIVVVSYFKNTYLSKQVI

SEQ ID NO: 2533393 - protein, 18 aa, Entamoeba dispar
MIYNQYLVDIYEGLVKMI

SEQ ID NO: 2533394 - protein, 25 aa, Entamoeba dispar
MKCVSHFMTPIPFFNIMCSDEIEPR

SEQ ID NO: 2533395 - protein, 19 aa, Entamoeba dispar
MKDHYWGIMPQRILNCLDD

SEQ ID NO: 2533396 - protein, 23 aa, Entamoeba dispar
MKDPYIIYAILDLIHSHYQILKD

SEQ ID NO: 2533397 - protein, 21 aa, Entamoeba dispar
MKDYIFEELFDKCKKLYIDEC

SEQ ID NO: 2533398 - protein, 23 aa, Entamoeba dispar
MKEERISLINGIKGALGIKKECN

SEQ ID NO: 2533399 - protein, 18 aa, Entamoeba dispar
MKEFLKEKNQIRKKRIKI

SEQ ID NO: 2533400 - protein, 23 aa, Entamoeba dispar
MKEGPFIFSVDRHTLVGYLKEFP

SEQ ID NO: 2533401 - protein, 25 aa, Entamoeba dispar
MKEHMKPMYFKLADFLIHVIKKTVE

SEQ ID NO: 2533402 - protein, 19 aa, Entamoeba dispar
MKEILEKKGYQFQLIKKCI

SEQ ID NO: 2533403 - protein, 33 aa, Entamoeba dispar
MKEIRIELPKPPQTNLFIFIRMSDSTDSVAFIP

SEQ ID NO: 2533404 - protein, 22 aa, Entamoeba dispar
MKEIRIMKLFHHPNICAFFDYY

SEQ ID NO: 2533405 - protein, 41 aa, Entamoeba dispar
MKEKYELPLFKRCIWRYPPQYFYLLLNPRFVAQKLTEAHVG

SEQ ID NO: 2533406 - protein, 17 aa, Entamoeba dispar
MKELNFIDIFRKLTNFN

SEQ ID NO: 2533407 - protein, 18 aa, Entamoeba dispar
MKELNFIDIFRKLTNFND

SEQ ID NO: 2533408 - protein, 26 aa, Entamoeba dispar
MKETIKYAFFICETNIYPAPTLSGVI

SEQ ID NO: 2533409 - protein, 19 aa, Entamoeba dispar
MKEWAEELGASCFAHWFQP

SEQ ID NO: 2533410 - protein, 21 aa, Entamoeba dispar
MKEYIILYPVSFHKYHKHSCN

SEQ ID NO: 2533411 - protein, 17 aa, Entamoeba dispar
MKEYPFFRIISITTEND

SEQ ID NO: 2533412 - protein, 21 aa, Entamoeba dispar
MKFDELKYKYLSLPHGCSLHT

SEQ ID NO: 2533413 - protein, 26 aa, Entamoeba dispar
MKFDIKCGYLLALTCKKLNELFNRDS

SEQ ID NO: 2533414 - protein, 21 aa, Entamoeba dispar
MKFDRVLCDVPCSGDGTLRKN

SEQ ID NO: 2533415 - protein, 23 aa, Entamoeba dispar
MKFHLCTHRFVHIDFGYILNKKP

SEQ ID NO: 2533416 - protein, 26 aa, Entamoeba dispar
MKFINSNTILLFRKYQQRILQIMLRN

SEQ ID NO: 2533417 - protein, 29 aa, Entamoeba dispar
MKGECWINVYNLKTFKLIHKTPVEDICRA

SEQ ID NO: 2533418 - protein, 23 aa, Entamoeba dispar
MKGVSHFVSFAPMLDVFGKLEDK

SEQ ID NO: 2533419 - protein, 18 aa, Entamoeba dispar
MKGYHMIGLFDGHGGDTV

SEQ ID NO: 2533420 - protein, 19 aa, Entamoeba dispar
MKHPNLITMYGLYKEKDTI

SEQ ID NO: 2533421 - protein, 17 aa, Entamoeba dispar
MKIAVPPCLPFLGSTMS

SEQ ID NO: 2533422 - protein, 29 aa, Entamoeba dispar
MKINSFQQMFFPILYDAHSLQQIPTDTSS

SEQ ID NO: 2533423 - protein, 18 aa, Entamoeba dispar
MKIWCFNAGHILGAAMFC

SEQ ID NO: 2533424 - protein, 34 aa, Entamoeba dispar
MKKAESNPLLQFRLYQLLFKLLSEKKYPIDNYES

SEQ ID NO: 2533425 - protein, 17 aa, Entamoeba dispar
MKKFIALLVMKAGTKEK

SEQ ID NO: 2533426 - protein, 20 aa, Entamoeba dispar
MKKIRIIAEDIKKSFSGNTN

SEQ ID NO: 2533427 - protein, 20 aa, Entamoeba dispar
MKKKLITAPFSIGIEGRFGK

SEQ ID NO: 2533428 - protein, 19 aa, Entamoeba dispar
MKLIFYGLANIQATNHALL

SEQ ID NO: 2533429 - protein, 25 aa, Entamoeba dispar
MKLLIKLCEAVHLKEKIEAEFTGVK

SEQ ID NO: 2533430 - protein, 22 aa, Entamoeba dispar
MKLLVWGEDSLFWLGKKTMELV

SEQ ID NO: 2533431 - protein, 18 aa, Entamoeba dispar
MKLMDKYFRIPLKEMANK

SEQ ID NO: 2533432 - protein, 26 aa, Entamoeba dispar
MKMNLPSMFVIFNIQDIIGLRDYYIV

SEQ ID NO: 2533433 - protein, 21 aa, Entamoeba dispar
MKNIVLYLPTFHDISTFIRIN

SEQ ID NO: 2533434 - protein, 23 aa, Entamoeba dispar
MKQCEPYLSEGIHPRLLVEGIEL

SEQ ID NO: 2533435 - protein, 28 aa, Entamoeba dispar
MKQGNFYLSLLFLKYAQVFTPQYGDIYI

SEQ ID NO: 2533436 - protein, 23 aa, Entamoeba dispar
MKRILSLWAARHPASGYVQGIHD

SEQ ID NO: 2533437 - protein, 20 aa, Entamoeba dispar
MKRINDMQFMLNQSLKKVEM

SEQ ID NO: 2533438 - protein, 19 aa, Entamoeba dispar
MKRINDTQFMLDQSLKKVE

SEQ ID NO: 2533439 - protein, 25 aa, Entamoeba dispar
MKSCSLPFLFKPYCNCISGMIIQPN

SEQ ID NO: 2533440 - protein, 28 aa, Entamoeba dispar
MKSFDKFIEKLIKLPRKSLKQSREVLEK

SEQ ID NO: 2533441 - protein, 25 aa, Entamoeba dispar
MKSTLRSLKLLKKNKIFSNDSSIQI

SEQ ID NO: 2533442 - protein, 22 aa, Entamoeba dispar
MKTEPFKKLFSKKATTKEVRLF

SEQ ID NO: 2533443 - protein, 21 aa, Entamoeba dispar
MKTVIIFPNILIYTINGITSY

SEQ ID NO: 2533444 - protein, 26 aa, Entamoeba dispar
MKVIDEKLLIELLIESIEKNKFDIVM

SEQ ID NO: 2533445 - protein, 28 aa, Entamoeba dispar
MKVKTIHKLYSPLFFYTQTLISKNDNKG

SEQ ID NO: 2533446 - protein, 24 aa, Entamoeba dispar
MKVPKAMYKISYPSKINISQNDKF

SEQ ID NO: 2533447 - protein, 30 aa, Entamoeba dispar
MKWIKEDPQIYYLRILQLLLRNEELHHQIN

SEQ ID NO: 2533448 - protein, 22 aa, Entamoeba dispar
MKWKTEMFDLKESLQIEQKKEI

SEQ ID NO: 2533449 - protein, 27 aa, Entamoeba dispar
MKYNGGYSWWRHNSLTVFIDKKMYKDP

SEQ ID NO: 2533450 - protein, 21 aa, Entamoeba dispar
MKYTQFVISILPVLNPPYFKQ

SEQ ID NO: 2533451 - protein, 20 aa, Entamoeba dispar
MLATGIEMQPILPGCPEIDE

SEQ ID NO: 2533452 - protein, 25 aa, Entamoeba dispar
MLCTSQLPYLYVYITNNPVSVPYIT

SEQ ID NO: 2533453 - protein, 27 aa, Entamoeba dispar
MLDAECFAFLNRALESTLAPIVVFATN

SEQ ID NO: 2533454 - protein, 30 aa, Entamoeba dispar
MLDKFRSDYIIYFYGSVLFKNKRYLVTEYA

SEQ ID NO: 2533455 - protein, 25 aa, Entamoeba dispar
MLECFNKMLFFVDLLKEKRDKIINS

SEQ ID NO: 2533456 - protein, 25 aa, Entamoeba dispar
MLEECLITCQILFKASSQLNEEEND

SEQ ID NO: 2533457 - protein, 19 aa, Entamoeba dispar
MLEKMLIKKEMRGIGYRMK

SEQ ID NO: 2533458 - protein, 18 aa, Entamoeba dispar
MLELESKLNGHLAALRRS

SEQ ID NO: 2533459 - protein, 17 aa, Entamoeba dispar
MLFDQRLQAIVLNIVDV

SEQ ID NO: 2533460 - protein, 26 aa, Entamoeba dispar
MLGTFNYPHTVLNFGIGMKDFEKIEI

SEQ ID NO: 2533461 - protein, 17 aa, Entamoeba dispar
MLIIPKTLIENSGYDVI

SEQ ID NO: 2533462 - protein, 18 aa, Entamoeba dispar
MLIQIDSVRDGIIPCIRG

SEQ ID NO: 2533463 - protein, 18 aa, Entamoeba dispar
MLISFKLPENLQTINGKS

SEQ ID NO: 2533464 - protein, 26 aa, Entamoeba dispar
MLITNTAIVIALHICNFSIPMVYVKT

SEQ ID NO: 2533465 - protein, 17 aa, Entamoeba dispar
MLIVEEIKYRPTGKVLN

SEQ ID NO: 2533466 - protein, 17 aa, Entamoeba dispar
MLKAELIERYRASNTIR

SEQ ID NO: 2533467 - protein, 17 aa, Entamoeba dispar
MLKGLLEAGLIKGDLEE

SEQ ID NO: 2533468 - protein, 28 aa, Entamoeba dispar
MLKIQYRMHPLIREFPSKQFYSGELIDG

SEQ ID NO: 2533469 - protein, 20 aa, Entamoeba dispar
MLKLLSLPVDEQGAQLPEKC

SEQ ID NO: 2533470 - protein, 17 aa, Entamoeba dispar
MLKNLIEFLKVTVIDKL

SEQ ID NO: 2533471 - protein, 24 aa, Entamoeba dispar
MLLDCYDICYLWIGKDVSAIDKKF

SEQ ID NO: 2533472 - protein, 18 aa, Entamoeba dispar
MLLEYGLLDKILDKSLTQ

SEQ ID NO: 2533473 - protein, 17 aa, Entamoeba dispar
MLLIHLRGNKKSTYTEK

SEQ ID NO: 2533474 - protein, 17 aa, Entamoeba dispar
MLLPLIGVSLDICKDYI

SEQ ID NO: 2533475 - protein, 21 aa, Entamoeba dispar
MLLRIRDLTVPWTLIGNKIDL

SEQ ID NO: 2533476 - protein, 21 aa, Entamoeba dispar
MLMKNYRHDLFVLLYCGDLKE

SEQ ID NO: 2533477 - protein, 22 aa, Entamoeba dispar
MLNDLLLLKTYLLQNPNHYSSL

SEQ ID NO: 2533478 - protein, 22 aa, Entamoeba dispar
MLNIANMFSMWKNNLIEITDQF

SEQ ID NO: 2533479 - protein, 19 aa, Entamoeba dispar
MLNKWVLIKSIQFNKYSSF

SEQ ID NO: 2533480 - protein, 20 aa, Entamoeba dispar
MLNQEMIYFIIENLLNYYQL

SEQ ID NO: 2533481 - protein, 19 aa, Entamoeba dispar
MLNTQTLNRVLSCRCDIII

SEQ ID NO: 2533482 - protein, 17 aa, Entamoeba dispar
MLPELRVLKLSTSIVHL

SEQ ID NO: 2533483 - protein, 17 aa, Entamoeba dispar
MLPYILSGLCRFSEAND

SEQ ID NO: 2533484 - protein, 17 aa, Entamoeba dispar
MLQMLTQLYFSKGGTKK

SEQ ID NO: 2533485 - protein, 17 aa, Entamoeba dispar
MLQQVAPLDLCRYISIL

SEQ ID NO: 2533486 - protein, 39 aa, Entamoeba dispar
MLSHLRLLNISHNRLYQLPPYLPLSLRTLLINSNHLICL

SEQ ID NO: 2533487 - protein, 18 aa, Entamoeba dispar
MLSVLPKVTKNLLILNIQ

SEQ ID NO: 2533488 - protein, 27 aa, Entamoeba dispar
MLTSLPSNFFMYSQLRSLNLTHNRLSV

SEQ ID NO: 2533489 - protein, 17 aa, Entamoeba dispar
MLVGERCGHKFCLTCWN

SEQ ID NO: 2533490 - protein, 18 aa, Entamoeba dispar
MLVVLKRPRSYNAQPIFN

SEQ ID NO: 2533491 - protein, 25 aa, Entamoeba dispar
MLWNDFIQNIIIPTRTRILALVKML

SEQ ID NO: 2533492 - protein, 23 aa, Entamoeba dispar
MLYQIIQLKGSFPHKMIREGKLS

SEQ ID NO: 2533493 - protein, 19 aa, Entamoeba dispar
MMCHRFHGKNPSKNKIKRT

SEQ ID NO: 2533494 - protein, 26 aa, Entamoeba dispar
MMDARDFVYQLIRYHNKDKTDYILYS

SEQ ID NO: 2533495 - protein, 19 aa, Entamoeba dispar
MMEAQVWEPALIKLNAIAA

SEQ ID NO: 2533496 - protein, 25 aa, Entamoeba dispar
MMEAQVWEPALIKLNAIAAATEAAS

SEQ ID NO: 2533497 - protein, 19 aa, Entamoeba dispar
MMELFKNSLKRMMKTARAQ

SEQ ID NO: 2533498 - protein, 30 aa, Entamoeba dispar
MMENFFNGKILIALLDLFFDQHHCFYDWML

SEQ ID NO: 2533499 - protein, 23 aa, Entamoeba dispar
MMIICKYFINIKDIINVELVCKK

SEQ ID NO: 2533500 - protein, 18 aa, Entamoeba dispar
MMIISKYFNFSSDFIDIV

SEQ ID NO: 2533501 - protein, 18 aa, Entamoeba dispar
MMIKPESKLTMIFNNIKK

SEQ ID NO: 2533502 - protein, 18 aa, Entamoeba dispar
MMIVAQYFPAINDLFHVI

SEQ ID NO: 2533503 - protein, 20 aa, Entamoeba dispar
MMIYIPQYHILEAADNMMHA

SEQ ID NO: 2533504 - protein, 20 aa, Entamoeba dispar
MMKTMFCVIYREANTKNFED

SEQ ID NO: 2533505 - protein, 31 aa, Entamoeba dispar
MMNKNQHQLFYPLVSYIFSTYVKVFKTCTTS

SEQ ID NO: 2533506 - protein, 19 aa, Entamoeba dispar
MMRNCVGISHFFVFDVFDK

SEQ ID NO: 2533507 - protein, 19 aa, Entamoeba dispar
MMSEQWFWDEVEKFSYYQN

SEQ ID NO: 2533508 - protein, 20 aa, Entamoeba dispar
MMTIPTIMSGKLYEFKPEIQ

SEQ ID NO: 2533509 - protein, 19 aa, Entamoeba dispar
MMTIPTIMSGKLYEFKPEL

SEQ ID NO: 2533510 - protein, 33 aa, Entamoeba dispar
MMVMLGRYLDYLIDIVRPRKLLYLAVDGVAPRA

SEQ ID NO: 2533511 - protein, 18 aa, Entamoeba dispar
MMYEFDIIDLFLRNLRNE

SEQ ID NO: 2533512 - protein, 29 aa, Entamoeba dispar
MNACTLTIHWQFDVTLRGLRKVLTPNTEI

SEQ ID NO: 2533513 - protein, 20 aa, Entamoeba dispar
MNAGICQLLYHMRVNSHFSI

SEQ ID NO: 2533514 - protein, 19 aa, Entamoeba dispar
MNDKGLIQFNPLMKSSYIQ

SEQ ID NO: 2533515 - protein, 17 aa, Entamoeba dispar
MNDKILPGIALCAVDTL

SEQ ID NO: 2533516 - protein, 22 aa, Entamoeba dispar
MNEFSKQYLVFSLLCFYVDCEK

SEQ ID NO: 2533517 - protein, 18 aa, Entamoeba dispar
MNEIPEQYAIMKQLGYFD

SEQ ID NO: 2533518 - protein, 24 aa, Entamoeba dispar
MNELQFMVFVFESFFKVHKGSLNN

SEQ ID NO: 2533519 - protein, 29 aa, Entamoeba dispar
MNENPPYEYYLYYLYANITVLNGFRKEKK

SEQ ID NO: 2533520 - protein, 24 aa, Entamoeba dispar
MNEPVLISCEISYNLQIINGKNIF

SEQ ID NO: 2533521 - protein, 27 aa, Entamoeba dispar
MNGFQGHLRLLFLENMLDLGSYERKCN

SEQ ID NO: 2533522 - protein, 32 aa, Entamoeba dispar
MNGSKKITPFILQNPFDLIPVRFDPKVEMNFN

SEQ ID NO: 2533523 - protein, 18 aa, Entamoeba dispar
MNHHLNDISFLRRKKQES

SEQ ID NO: 2533524 - protein, 25 aa, Entamoeba dispar
MNHVALIIQKWRSWQLKSWNKIADN

SEQ ID NO: 2533525 - protein, 23 aa, Entamoeba dispar
MNIIEILVLPQLSQSFMCWKELN

SEQ ID NO: 2533526 - protein, 24 aa, Entamoeba dispar
MNINRISYICNQTTRFCMKDNHSE

SEQ ID NO: 2533527 - protein, 24 aa, Entamoeba dispar
MNIWNYFCEYIAFKLINNQLIVHG

SEQ ID NO: 2533528 - protein, 33 aa, Entamoeba dispar
MNKCNGFVFVYQWLILLFKREFSLSNIFRIWDS

SEQ ID NO: 2533529 - protein, 23 aa, Entamoeba dispar
MNKKYLYVPKDPIVIKSFNQLSQ

SEQ ID NO: 2533530 - protein, 17 aa, Entamoeba dispar
MNKMRILYDSVIDGSSC

SEQ ID NO: 2533531 - protein, 18 aa, Entamoeba dispar
MNKPIEWYLEHLMKEQQY

SEQ ID NO: 2533532 - protein, 24 aa, Entamoeba dispar
MNLIQLYLVNRERKYKTQITHLLF

SEQ ID NO: 2533533 - protein, 25 aa, Entamoeba dispar
MNNLLELWNIMDFTTDGALLGNYSQ

SEQ ID NO: 2533534 - protein, 17 aa, Entamoeba dispar
MNNQWLRKRRATAVSVI

SEQ ID NO: 2533535 - protein, 20 aa, Entamoeba dispar
MNNVRKFIFMKNQSIENIIA

SEQ ID NO: 2533536 - protein, 27 aa, Entamoeba dispar
MNQALAIALPLIRKILFPSLKTQTPIQ

SEQ ID NO: 2533537 - protein, 21 aa, Entamoeba dispar
MNQRYSLLDSILKDVVKSLEE

SEQ ID NO: 2533538 - protein, 18 aa, Entamoeba dispar
MNQYKFDIIEIRNIIEGN

SEQ ID NO: 2533539 - protein, 26 aa, Entamoeba dispar
MNREVQLLYLIRNELELHLSKKYYEE

SEQ ID NO: 2533540 - protein, 17 aa, Entamoeba dispar
MNRLVVLPKVHAATAKR

SEQ ID NO: 2533541 - protein, 19 aa, Entamoeba dispar
MNVLQPLYHQLYHSVYKSI

SEQ ID NO: 2533542 - protein, 18 aa, Entamoeba dispar
MNVMRIINEPTAAAIAYG

SEQ ID NO: 2533543 - protein, 34 aa, Entamoeba dispar
MNWVFNYYCGNTFSWKWGYKPHYAPLLCHFVDYF

SEQ ID NO: 2533544 - protein, 17 aa, Entamoeba dispar
MNYLVLHSINYTPKLYL

SEQ ID NO: 2533545 - protein, 17 aa, Entamoeba dispar
MNYPILNIGERVMSLLA

SEQ ID NO: 2533546 - protein, 28 aa, Entamoeba dispar
MPECNVAMMYVFALVLKAVEAKKEVNKM

SEQ ID NO: 2533547 - protein, 37 aa, Entamoeba dispar
MPGCYLSNFVQIPYYYNLNLIGVILPSDYYKGYNLLN

SEQ ID NO: 2533548 - protein, 18 aa, Entamoeba dispar
MPIIIKKIKGINHYVNEE

SEQ ID NO: 2533549 - protein, 19 aa, Entamoeba dispar
MPLPIPYFEEVYLELKRIT

SEQ ID NO: 2533550 - protein, 18 aa, Entamoeba dispar
MPQLTKAKWLSNSSFIVG

SEQ ID NO: 2533551 - protein, 26 aa, Entamoeba dispar
MPSKHKKACQYAFDNGIHVTIHAGEA

SEQ ID NO: 2533552 - protein, 27 aa, Entamoeba dispar
MPVAHVALPVPLPRTFDYLLPEGMTVK

SEQ ID NO: 2533553 - protein, 25 aa, Entamoeba dispar
MPVQKGIELSLIKLLTSELSKPETN

SEQ ID NO: 2533554 - protein, 18 aa, Entamoeba dispar
MPYGEKTPFWTLDNKQDK

SEQ ID NO: 2533555 - protein, 21 aa, Entamoeba dispar
MPYPYHLIGIGFFNSINHSDK

SEQ ID NO: 2533556 - protein, 25 aa, Entamoeba dispar
MQCFSHFSYFISKKSFIITDLQGIF

SEQ ID NO: 2533557 - protein, 25 aa, Entamoeba dispar
MQELYQMIQNIILVNNVGPNIISIY

SEQ ID NO: 2533558 - protein, 44 aa, Entamoeba dispar
MQFKHESRYRWFFRPLRKISPYHMYLFKALRNYFMTQACSNPIQ

SEQ ID NO: 2533559 - protein, 22 aa, Entamoeba dispar
MQFNIKMQFIGFRQQSLDDIYD

SEQ ID NO: 2533560 - protein, 23 aa, Entamoeba dispar
MQGKWMFEYMSKVASSMTIAGMM

SEQ ID NO: 2533561 - protein, 26 aa, Entamoeba dispar
MQGVAAELLYFPDENHWVLKPQNGML

SEQ ID NO: 2533562 - protein, 17 aa, Entamoeba dispar
MQIYITNYGIINFHCQQ

SEQ ID NO: 2533563 - protein, 17 aa, Entamoeba dispar
MQLLKIPNGFTIPSLVP

SEQ ID NO: 2533564 - protein, 23 aa, Entamoeba dispar
MQRTPRYPLLLNTLIKVTNENNN

SEQ ID NO: 2533565 - protein, 24 aa, Entamoeba dispar
MQRVGQFISFFNPNFKPFKREPSF

SEQ ID NO: 2533566 - protein, 24 aa, Entamoeba dispar
MQSIIYFHDGVILKDNIIPDDKTQ

SEQ ID NO: 2533567 - protein, 20 aa, Entamoeba dispar
MQTIVFGLKGICAYACHAHL

SEQ ID NO: 2533568 - protein, 26 aa, Entamoeba dispar
MQTKKKRWCILTKNKLFYFNCKPEND

SEQ ID NO: 2533569 - protein, 25 aa, Entamoeba dispar
MREDPELAMNYVLQNLQIGEDIDGD

SEQ ID NO: 2533570 - protein, 38 aa, Entamoeba dispar
MREFIPNNMPMEGFMHNNIPMRGFIPDNMPMGEDSEMD

SEQ ID NO: 2533571 - protein, 19 aa, Entamoeba dispar
MREWVLYSSEMRGLFGGDW

SEQ ID NO: 2533572 - protein, 18 aa, Entamoeba dispar
MRFDPILPNNLDLDCNNQ

SEQ ID NO: 2533573 - protein, 18 aa, Entamoeba dispar
MRGFGMMGGFTHNNIPMG

SEQ ID NO: 2533574 - protein, 22 aa, Entamoeba dispar
MRIKEWYSWHFPELYNILNNDN

SEQ ID NO: 2533575 - protein, 42 aa, Entamoeba dispar
MRILQTWGPLYPNELYDYQLMYDKYLSKGVYFPVLDKLPEQT

SEQ ID NO: 2533576 - protein, 19 aa, Entamoeba dispar
MRIVQSWGILFPQEFKVYT

SEQ ID NO: 2533577 - protein, 18 aa, Entamoeba dispar
MRKDGIIVTTLGSILYQI

SEQ ID NO: 2533578 - protein, 22 aa, Entamoeba dispar
MRKKQLLSHLDIITIGSGQLQF

SEQ ID NO: 2533579 - protein, 17 aa, Entamoeba dispar
MRKYLMGTPKNSFDVAY

SEQ ID NO: 2533580 - protein, 21 aa, Entamoeba dispar
MRLFSFDPVLGRRLDLFMKQL

SEQ ID NO: 2533581 - protein, 18 aa, Entamoeba dispar
MRLGGIVAILRYELNLED

SEQ ID NO: 2533582 - protein, 33 aa, Entamoeba dispar
MRMSDRVNEICFWVASLILSFPDLNNRAKMMTK

SEQ ID NO: 2533583 - protein, 48 aa, Entamoeba dispar
MRNEMQSYLYANRNCLPLLPNLPIGINPWYIWQIIPNINENDKCFICG

SEQ ID NO: 2533584 - protein, 19 aa, Entamoeba dispar
MRNSLSVQILLFIRQIYVT

SEQ ID NO: 2533585 - protein, 26 aa, Entamoeba dispar
MRQLRKDALLVKKLRFENSIERDKEA

SEQ ID NO: 2533586 - protein, 26 aa, Entamoeba dispar
MRQQRPWCLRFEYWKQILPMSASIVE

SEQ ID NO: 2533587 - protein, 20 aa, Entamoeba dispar
MRRQRINPMGYRPMAPQQIR

SEQ ID NO: 2533588 - protein, 31 aa, Entamoeba dispar
MRSLEIELDKIKRKYIAFKKVFEEHGEDVEY

SEQ ID NO: 2533589 - protein, 32 aa, Entamoeba dispar
MRSLEIELDKIKRKYIAFKKVFEEHGEDVEYL

SEQ ID NO: 2533590 - protein, 25 aa, Entamoeba dispar
MRVREWYGWHFPELSKYINDHMAYC

SEQ ID NO: 2533591 - protein, 24 aa, Entamoeba dispar
MSAAKLLTNMLIGPAVVLADEVKN

SEQ ID NO: 2533592 - protein, 18 aa, Entamoeba dispar
MSAPQWFVPVKAGDAKVP

SEQ ID NO: 2533593 - protein, 19 aa, Entamoeba dispar
MSAPQWFVPVKAGDAKVPA

SEQ ID NO: 2533594 - protein, 23 aa, Entamoeba dispar
MSDCSIAWFTAIKSVLKHFMTSE

SEQ ID NO: 2533595 - protein, 23 aa, Entamoeba dispar
MSDVYVFHVLSLGILSYVLTLTQ

SEQ ID NO: 2533596 - protein, 19 aa, Entamoeba dispar
MSFQSAFFNFIMKTAERFY

SEQ ID NO: 2533597 - protein, 25 aa, Entamoeba dispar
MSGEDPLKLDYWIKGKKKNTKKEFK

SEQ ID NO: 2533598 - protein, 20 aa, Entamoeba dispar
MSGRRNLILLSKVLQNLSNG

SEQ ID NO: 2533599 - protein, 22 aa, Entamoeba dispar
MSIIPYYTIDKIPIDKNVLYLI

SEQ ID NO: 2533600 - protein, 17 aa, Entamoeba dispar
MSKLPDDEILGNTLILI

SEQ ID NO: 2533601 - protein, 23 aa, Entamoeba dispar
MSKWMAFECITRMVGFYDLDRKD

SEQ ID NO: 2533602 - protein, 25 aa, Entamoeba dispar
MSLELMNCLPFKEVLFHSIVRDAQG

SEQ ID NO: 2533603 - protein, 26 aa, Entamoeba dispar
MSLERQMIMKAFGAELILTEGKKGIT

SEQ ID NO: 2533604 - protein, 18 aa, Entamoeba dispar
MSLFLSFSNSEIVTISLI

SEQ ID NO: 2533605 - protein, 24 aa, Entamoeba dispar
MSLKYLINYDDLPSFVFKSKQTII

SEQ ID NO: 2533606 - protein, 21 aa, Entamoeba dispar
MSMIHPFNYRTAYPGMVHFIV

SEQ ID NO: 2533607 - protein, 27 aa, Entamoeba dispar
MSMMGHKVRVLPFSTFRMNLCDTTPYN

SEQ ID NO: 2533608 - protein, 19 aa, Entamoeba dispar
MSMPGMMDTILNLGLNDKT

SEQ ID NO: 2533609 - protein, 29 aa, Entamoeba dispar
MSNKPNIILPFQFCNFVHLKQLIVENLHC

SEQ ID NO: 2533610 - protein, 23 aa, Entamoeba dispar
MSPSILLFNFGDRTVTIYPESSF

SEQ ID NO: 2533611 - protein, 25 aa, Entamoeba dispar
MSRNNALVLMPTGGGKSLCYQLPSY

SEQ ID NO: 2533612 - protein, 22 aa, Entamoeba dispar
MSSIRTTLLSYGRLWHDISIED

SEQ ID NO: 2533613 - protein, 26 aa, Entamoeba dispar
MSSLIVELQLFLRKMTPKQFLCVLGN

SEQ ID NO: 2533614 - protein, 36 aa, Entamoeba dispar
MSSQTIFRHVPFSIEFSAPPLWLSQNSIRPEDILYA

SEQ ID NO: 2533615 - protein, 23 aa, Entamoeba dispar
MSTCQYFFPEMNTDFFPRVWALR

SEQ ID NO: 2533616 - protein, 17 aa, Entamoeba dispar
MSVLPPKSKSCLPYQFH

SEQ ID NO: 2533617 - protein, 26 aa, Entamoeba dispar
MSVLPVKNILMLYKRENIVTRGQVPL

SEQ ID NO: 2533618 - protein, 24 aa, Entamoeba dispar
MSVQKTFLIKILKKVFVEETENKE

SEQ ID NO: 2533619 - protein, 20 aa, Entamoeba dispar
MSVYADALLAVPHALAENSG

SEQ ID NO: 2533620 - protein, 20 aa, Entamoeba dispar
MSYYPTIPFDYCDIGEIRED

SEQ ID NO: 2533621 - protein, 27 aa, Entamoeba dispar
MTCKCGYQFCWLCMQPYTKTHWKNNKT

SEQ ID NO: 2533622 - protein, 22 aa, Entamoeba dispar
MTDVWWNIITQCWDHIPSKRPP

SEQ ID NO: 2533623 - protein, 26 aa, Entamoeba dispar
MTDYSVDYILLVFVLSTISPSMFDQT

SEQ ID NO: 2533624 - protein, 33 aa, Entamoeba dispar
MTEDWKNFEHKYDSLKLNMKKVPFIDNDYTKTM

SEQ ID NO: 2533625 - protein, 23 aa, Entamoeba dispar
MTEENIVHLFNVYSKYITNTAKR

SEQ ID NO: 2533626 - protein, 33 aa, Entamoeba dispar
MTEGDPPYMELPPLRALFLITTKGIPPLKERDS

SEQ ID NO: 2533627 - protein, 23 aa, Entamoeba dispar
MTELNGFLSPFWSHSNPVDVLGD

SEQ ID NO: 2533628 - protein, 17 aa, Entamoeba dispar
MTFISLLLSKYNKFEHC

SEQ ID NO: 2533629 - protein, 24 aa, Entamoeba dispar
MTGDAIRIKYLAAPLIFVALRRRK

SEQ ID NO: 2533630 - protein, 34 aa, Entamoeba dispar
MTHHKIDLSYFIKLFQKFGEIYSIWGSSSGKIFF

SEQ ID NO: 2533631 - protein, 18 aa, Entamoeba dispar
MTIPTIMSGKLYEFKPEL

SEQ ID NO: 2533632 - protein, 29 aa, Entamoeba dispar
MTKHFQTLQYWTGFNHIQIIYDSNKNKFT

SEQ ID NO: 2533633 - protein, 27 aa, Entamoeba dispar
MTKKMSILQMLVYPYFRVRTYQAYVDD

SEQ ID NO: 2533634 - protein, 19 aa, Entamoeba dispar
MTKLKIVNLYITYGPIHSE

SEQ ID NO: 2533635 - protein, 19 aa, Entamoeba dispar
MTKTCKIYRALFSSITKKD

SEQ ID NO: 2533636 - protein, 17 aa, Entamoeba dispar
MTLIKRYSTMRFGFIQY

SEQ ID NO: 2533637 - protein, 31 aa, Entamoeba dispar
MTLKNFSMILGPLIIHIPYEINPLDSTCYQI

SEQ ID NO: 2533638 - protein, 17 aa, Entamoeba dispar
MTPMQRMKLVPRVKIFA

SEQ ID NO: 2533639 - protein, 23 aa, Entamoeba dispar
MTQKEKIILNKKLIRLKKESERV

SEQ ID NO: 2533640 - protein, 27 aa, Entamoeba dispar
MTQLDGSRLLWRYLTSWELFAMKNPMS

SEQ ID NO: 2533641 - protein, 24 aa, Entamoeba dispar
MTRGRQREFCQCDFDIAGEYDPMI

SEQ ID NO: 2533642 - protein, 32 aa, Entamoeba dispar
MTRMTMGIIPQPTILPCRCISRYDFIATSDKE

SEQ ID NO: 2533643 - protein, 23 aa, Entamoeba dispar
MTRNRYEWYILQFAMQRQGIIII

SEQ ID NO: 2533644 - protein, 18 aa, Entamoeba dispar
MTSFSHMFAGLTSIKTIN

SEQ ID NO: 2533645 - protein, 18 aa, Entamoeba dispar
MTSHCNLLGKFELTGIPP

SEQ ID NO: 2533646 - protein, 24 aa, Entamoeba dispar
MTSKLIKRYLIPRYQATLERRKSP

SEQ ID NO: 2533647 - protein, 24 aa, Entamoeba dispar
MTSPVVKDNLDFGTIAFTSGKTVP

SEQ ID NO: 2533648 - protein, 24 aa, Entamoeba dispar
MTTEDFFGLFKQFILTVESSIKKM

SEQ ID NO: 2533649 - protein, 25 aa, Entamoeba dispar
MTVDPVVFVCNVPIRAFKAKTMFLS

SEQ ID NO: 2533650 - protein, 25 aa, Entamoeba dispar
MTVGKLLELVSGKAGLMDGSFKYGT

SEQ ID NO: 2533651 - protein, 20 aa, Entamoeba dispar
MTWIRALLKDKGIEEYQDPV

SEQ ID NO: 2533652 - protein, 19 aa, Entamoeba dispar
MTWVRALLKDKGIEEYQDP

SEQ ID NO: 2533653 - protein, 24 aa, Entamoeba dispar
MTYCDRRFPHDYIPIMFDGIAVVR

SEQ ID NO: 2533654 - protein, 29 aa, Entamoeba dispar
MTYSFYSSLLQKIYKLLLSLLPNISQLLH

SEQ ID NO: 2533655 - protein, 25 aa, Entamoeba dispar
MVACGNGMIYWLTTGALKITQSFEI

SEQ ID NO: 2533656 - protein, 25 aa, Entamoeba dispar
MVAKSLEAKKLLYIPTVDLDEDCED

SEQ ID NO: 2533657 - protein, 29 aa, Entamoeba dispar
MVCTKYNKILTFYHYNPIAITSGMEEFFP

SEQ ID NO: 2533658 - protein, 17 aa, Entamoeba dispar
MVCWPWKYYHDSNQFTL

SEQ ID NO: 2533659 - protein, 31 aa, Entamoeba dispar
MVDEETINLWPKLTVLLKLLKMCEKTNEKVL

SEQ ID NO: 2533660 - protein, 20 aa, Entamoeba dispar
MVDIIVNWHPKKPNNVFQTE

SEQ ID NO: 2533661 - protein, 19 aa, Entamoeba dispar
MVDYISYLKQWTNKSHFKI

SEQ ID NO: 2533662 - protein, 34 aa, Entamoeba dispar
MVEFCQKFIHKNRYLVLNLLTRQLESLTQPTTEL

SEQ ID NO: 2533663 - protein, 17 aa, Entamoeba dispar
MVFIYHQSTNKLNYLTE

SEQ ID NO: 2533664 - protein, 18 aa, Entamoeba dispar
MVFNFKKDVPLPYFEFKY

SEQ ID NO: 2533665 - protein, 19 aa, Entamoeba dispar
MVGDPERVPKIAELIFDKS

SEQ ID NO: 2533666 - protein, 23 aa, Entamoeba dispar
MVGSGRWIDESPFLTLIGVHQKA

SEQ ID NO: 2533667 - protein, 28 aa, Entamoeba dispar
MVHADLSEYNLLWWKNKVYVIDVGQSIE

SEQ ID NO: 2533668 - protein, 24 aa, Entamoeba dispar
MVHLSKTFKYFVPSTELFFENYPI

SEQ ID NO: 2533669 - protein, 26 aa, Entamoeba dispar
MVIARATELFLVDLIKKTNTVAEEKK

SEQ ID NO: 2533670 - protein, 26 aa, Entamoeba dispar
MVKLSLIHSLQLIKFIPIPNNSNEDS

SEQ ID NO: 2533671 - protein, 17 aa, Entamoeba dispar
MVLKTFHFAGVASMNIA

SEQ ID NO: 2533672 - protein, 20 aa, Entamoeba dispar
MVLRTLYNILRQRIGNKKIG

SEQ ID NO: 2533673 - protein, 18 aa, Entamoeba dispar
MVLRTLYNVLKEKIGNKK

SEQ ID NO: 2533674 - protein, 17 aa, Entamoeba dispar
MVLVVTKVDQKEGRERN

SEQ ID NO: 2533675 - protein, 28 aa, Entamoeba dispar
MVMDGARVILFFFDLTRVMTLNNIKDWY

SEQ ID NO: 2533676 - protein, 29 aa, Entamoeba dispar
MVMTYKENFLLPCLSLADIPDLLNDKHPV

SEQ ID NO: 2533677 - protein, 17 aa, Entamoeba dispar
MVMYRTFFKFTDTYQRM

SEQ ID NO: 2533678 - protein, 36 aa, Entamoeba dispar
MVNKKTEIHLTLQAIREAHQLIEQMNRISIQGNKEI

SEQ ID NO: 2533679 - protein, 32 aa, Entamoeba dispar
MVNTTNYIFILRFLWILIVHRRARGITTNDIF

SEQ ID NO: 2533680 - protein, 18 aa, Entamoeba dispar
MVNYIKKQKGLQAIVICL

SEQ ID NO: 2533681 - protein, 20 aa, Entamoeba dispar
MVQFYKHSIPMQIDLMFLIS

SEQ ID NO: 2533682 - protein, 20 aa, Entamoeba dispar
MVRDLFDMAKSKKSCIIFFD

SEQ ID NO: 2533683 - protein, 30 aa, Entamoeba dispar
MVRVPDIRLFGITLLKTIITSHNFLQMASG

SEQ ID NO: 2533684 - protein, 25 aa, Entamoeba dispar
MVSFREKYFELISQSYPILLNHFKS

SEQ ID NO: 2533685 - protein, 17 aa, Entamoeba dispar
MVSLLQSPLPFIIGMKT

SEQ ID NO: 2533686 - protein, 20 aa, Entamoeba dispar
MVVAEFFRYFLDECYSYLQN

SEQ ID NO: 2533687 - protein, 18 aa, Entamoeba dispar
MVVLFERSVSLPQIGLSI

SEQ ID NO: 2533688 - protein, 17 aa, Entamoeba dispar
MWGFGCILGSLIFKKEP

SEQ ID NO: 2533689 - protein, 19 aa, Entamoeba dispar
MWKLSHIIAPWEDDKLSST

SEQ ID NO: 2533690 - protein, 30 aa, Entamoeba dispar
MWSIGVITYVLLCGYPPFFGDTLGEILSAV

SEQ ID NO: 2533691 - protein, 29 aa, Entamoeba dispar
MYASKKLFIPQFIPTIKILPELLNPPTSQ

SEQ ID NO: 2533692 - protein, 17 aa, Entamoeba dispar
MYETCNEKQLIKIKELI

SEQ ID NO: 2533693 - protein, 18 aa, Entamoeba dispar
MYFYRHSCDLSKQVIQLN

SEQ ID NO: 2533694 - protein, 19 aa, Entamoeba dispar
MYIPTLQIFCQSNIDSLSV

SEQ ID NO: 2533695 - protein, 26 aa, Entamoeba dispar
MYKDSTLIMQLLRDNLTLWTSDACDE

SEQ ID NO: 2533696 - protein, 33 aa, Entamoeba dispar
MYLNENGEFKWLPKHQSYFLSVVKGFSFQLVVV

SEQ ID NO: 2533697 - protein, 23 aa, Entamoeba dispar
MYQIRVRIKEGCRWKKGYKLVCC

SEQ ID NO: 2533698 - protein, 24 aa, Entamoeba dispar
MYRVKWPGTFELFISEEPDTFFTN

SEQ ID NO: 2533699 - protein, 19 aa, Entamoeba dispar
MYVDRLYQLSTTSGALRCE

SEQ ID NO: 2533700 - protein, 29 aa, Entamoeba dispar
MYVHTRLCFKLFKYIIYTKVPSFFNKETI

SEQ ID NO: 2533701 - protein, 27 aa, Entamoeba dispar
MYYNSSHFHFLNPAFEGFFRSINESIR

SEQ ID NO: 2533702 - protein, 20 aa, Entamoeba dispar
MYYRNTNGCLIVFGLNDPDS

SEQ ID NO: 2533703 - protein, 23 aa, Entamoeba dispar
NAADYLELLLTKTQTKIILPPTT

SEQ ID NO: 2533704 - protein, 28 aa, Entamoeba dispar
NAARMYPFAMSLYPFYAEALYQLKSWKE

SEQ ID NO: 2533705 - protein, 31 aa, Entamoeba dispar
NAARYLNIFKEVIYTLLPSRVGFDPSSLDSV

SEQ ID NO: 2533706 - protein, 30 aa, Entamoeba dispar
NACLTACDIFLIYLPTLSSSSFILLKQQIL

SEQ ID NO: 2533707 - protein, 25 aa, Entamoeba dispar
NACTLTIHWQFDVTLRGLRKVLVPN

SEQ ID NO: 2533708 - protein, 23 aa, Entamoeba dispar
NACYCLSSIAGLDSLYTCYYLRI

SEQ ID NO: 2533709 - protein, 24 aa, Entamoeba dispar
NADYTACHFPNYVKKYKLLEAAKP

SEQ ID NO: 2533710 - protein, 22 aa, Entamoeba dispar
NAETKTPAPFKIVTRNRAGEQL

SEQ ID NO: 2533711 - protein, 33 aa, Entamoeba dispar
NAFHSFFMNKNKVVLIPLVKKYFRVSKTMKLDP

SEQ ID NO: 2533712 - protein, 19 aa, Entamoeba dispar
NAFIRQIMEILKRGGKCLI

SEQ ID NO: 2533713 - protein, 22 aa, Entamoeba dispar
NAFTPLFMFLKDEYEGSLLALY

SEQ ID NO: 2533714 - protein, 27 aa, Entamoeba dispar
NAGELNMIIGNGKLLDWCIDNNIEYVD

SEQ ID NO: 2533715 - protein, 17 aa, Entamoeba dispar
NAHIKYLLPTGEVGIVQ

SEQ ID NO: 2533716 - protein, 18 aa, Entamoeba dispar
NAHPAWLKGCELMHIKPI

SEQ ID NO: 2533717 - protein, 27 aa, Entamoeba dispar
NAHQYILAKALVRTLLQSGGYPDNLPP

SEQ ID NO: 2533718 - protein, 28 aa, Entamoeba dispar
NAHQYILAKALVRTLLQSGGYPDNLPPV

SEQ ID NO: 2533719 - protein, 29 aa, Entamoeba dispar
NAHVTLTATLLPFKQLHPYLKNPWTEESN

SEQ ID NO: 2533720 - protein, 30 aa, Entamoeba dispar
NAICNKPNVMIIIVTKDGSIFGTFNSLPIP

SEQ ID NO: 2533721 - protein, 29 aa, Entamoeba dispar
NAICTLFFIHYLFPFFKNYSDIPRLGIVE

SEQ ID NO: 2533722 - protein, 26 aa, Entamoeba dispar
NAIFREGYLLFFRISDVYFEELSKNY

SEQ ID NO: 2533723 - protein, 27 aa, Entamoeba dispar
NAIKREMFFFDVFPLAKNISIFEIQRF

SEQ ID NO: 2533724 - protein, 37 aa, Entamoeba dispar
NAIPKAFLDCHLMIENPKRWVIDYVNAGASLITFHIE

SEQ ID NO: 2533725 - protein, 28 aa, Entamoeba dispar
NAKMIKCKLLQKTLFPSTLKRLTLEDCE

SEQ ID NO: 2533726 - protein, 36 aa, Entamoeba dispar
NALCSYGVFILLTPKTKFIWKGKFRNEKYVEFAVGL

SEQ ID NO: 2533727 - protein, 27 aa, Entamoeba dispar
NALEGFTLIQLLIPQNKLPAVEAWIVN

SEQ ID NO: 2533728 - protein, 18 aa, Entamoeba dispar
NALFTYLITNISDFIDVM

SEQ ID NO: 2533729 - protein, 17 aa, Entamoeba dispar
NALFVDAKQKIIEDMKS

SEQ ID NO: 2533730 - protein, 20 aa, Entamoeba dispar
NALKQIFPYSKLFLCRIHIE

SEQ ID NO: 2533731 - protein, 23 aa, Entamoeba dispar
NALLYQFHLKKGDAIGFISRNRY

SEQ ID NO: 2533732 - protein, 18 aa, Entamoeba dispar
NALYGIKITDDFRYIIIN

SEQ ID NO: 2533733 - protein, 22 aa, Entamoeba dispar
NANEIILSFGPKTKVKKWNIKN

SEQ ID NO: 2533734 - protein, 25 aa, Entamoeba dispar
NANIQPIDIILTKEFVMNLAHFAIL

SEQ ID NO: 2533735 - protein, 25 aa, Entamoeba dispar
NANITNVIKIANIILSKGVTISESN

SEQ ID NO: 2533736 - protein, 28 aa, Entamoeba dispar
NANQLLLEYFPLLKDNLITCSLCFCCFS

SEQ ID NO: 2533737 - protein, 34 aa, Entamoeba dispar
NANQLSHVSAPHCWSFMLGSLTWLKDAGDVVCEG

SEQ ID NO: 2533738 - protein, 18 aa, Entamoeba dispar
NANYIFGGRYISCQAPLT

SEQ ID NO: 2533739 - protein, 17 aa, Entamoeba dispar
NAPKFVRKPKKVEESTI

SEQ ID NO: 2533740 - protein, 17 aa, Entamoeba dispar
NAQEGMWIALLLTNNKY

SEQ ID NO: 2533741 - protein, 22 aa, Entamoeba dispar
NAQKLFQLIHQKCVMKLKILLK

SEQ ID NO: 2533742 - protein, 25 aa, Entamoeba dispar
NAQNLATIWIPCLFEIPQENPVVFS

SEQ ID NO: 2533743 - protein, 33 aa, Entamoeba dispar
NAQYLPDFVRMFFNRFFTLLREGDIEDVVIEKI

SEQ ID NO: 2533744 - protein, 24 aa, Entamoeba dispar
NARIDIVIGLFKKIGMIMNDVKII

SEQ ID NO: 2533745 - protein, 25 aa, Entamoeba dispar
NARKIAFSEYHRHKFRVITSIGSIV

SEQ ID NO: 2533746 - protein, 24 aa, Entamoeba dispar
NARYAKYFDPLIFEYPPSGYSYCT

SEQ ID NO: 2533747 - protein, 25 aa, Entamoeba dispar
NARYSTFICTLLISIAQQQIISEVV

SEQ ID NO: 2533748 - protein, 20 aa, Entamoeba dispar
NASHILIRQNEVPLTICQLY

SEQ ID NO: 2533749 - protein, 20 aa, Entamoeba dispar
NASILFIDKYFRINPNQKTI

SEQ ID NO: 2533750 - protein, 24 aa, Entamoeba dispar
NASLKDFYDMLSDMFKLAETAHIL

SEQ ID NO: 2533751 - protein, 17 aa, Entamoeba dispar
NASPIKYKIHQLTTHSV

SEQ ID NO: 2533752 - protein, 26 aa, Entamoeba dispar
NASVRKDIFLQKKLDKIINLKKLITE

SEQ ID NO: 2533753 - protein, 23 aa, Entamoeba dispar
NATTIIRLFLGKEQFDSGVDEDG

SEQ ID NO: 2533754 - protein, 30 aa, Entamoeba dispar
NAVDWWGLGILIYEMLYGTVPFYDENIQRL

SEQ ID NO: 2533755 - protein, 20 aa, Entamoeba dispar
NAVERLPIVVKMILSNTLEE

SEQ ID NO: 2533756 - protein, 18 aa, Entamoeba dispar
NAVITCLFILFDCIVQYT

SEQ ID NO: 2533757 - protein, 29 aa, Entamoeba dispar
NAVPFSRLLSFFSFIRLKQPIICVSVRVN

SEQ ID NO: 2533758 - protein, 23 aa, Entamoeba dispar
NAVPLLIDFSGYKMIFKLGDDLR

SEQ ID NO: 2533759 - protein, 21 aa, Entamoeba dispar
NAYVTMLPKPTKKVKNFQWQK

SEQ ID NO: 2533760 - protein, 29 aa, Entamoeba dispar
NCALIHILRVILWALREPISSNFFTCGLN

SEQ ID NO: 2533761 - protein, 21 aa, Entamoeba dispar
NCASFIRPSITILTHGLSMVV

SEQ ID NO: 2533762 - protein, 18 aa, Entamoeba dispar
NCATILHIFNGSSFTRLF

SEQ ID NO: 2533763 - protein, 18 aa, Entamoeba dispar
NCCIVIVGNKMDLIQQRK

SEQ ID NO: 2533764 - protein, 25 aa, Entamoeba dispar
NCCSLKIIQLPLSLIAIGSNAFYNC

SEQ ID NO: 2533765 - protein, 17 aa, Entamoeba dispar
NCDFRFISYSAPTSRPV

SEQ ID NO: 2533766 - protein, 25 aa, Entamoeba dispar
NCDVQLFVPLIPLVASRLGDKTPAI

SEQ ID NO: 2533767 - protein, 27 aa, Entamoeba dispar
NCELLVRTLIPSLLYRVLCSPTPDIMA

SEQ ID NO: 2533768 - protein, 23 aa, Entamoeba dispar
NCFNLIKCSLLKELMIQCYDIEF

SEQ ID NO: 2533769 - protein, 29 aa, Entamoeba dispar
NCFSQLFLDLFGRYFAFFEQQNIGFVFNN

SEQ ID NO: 2533770 - protein, 18 aa, Entamoeba dispar
NCGDWLKKVLEYLFENVQ

SEQ ID NO: 2533771 - protein, 22 aa, Entamoeba dispar
NCICKYIESWPKAWGLSVDEML

SEQ ID NO: 2533772 - protein, 17 aa, Entamoeba dispar
NCIIFSFKANKKEPIII

SEQ ID NO: 2533773 - protein, 17 aa, Entamoeba dispar
NCKAFSIILRYNLNTHE

SEQ ID NO: 2533774 - protein, 22 aa, Entamoeba dispar
NCKAQLFMKLPEDFDLLCIINS

SEQ ID NO: 2533775 - protein, 20 aa, Entamoeba dispar
NCKKKEAPFIPLQQMNDDTI

SEQ ID NO: 2533776 - protein, 24 aa, Entamoeba dispar
NCKPNEIILFYDTINYTIQFSDVS

SEQ ID NO: 2533777 - protein, 18 aa, Entamoeba dispar
NCLPKEKYIKMKRARMGE

SEQ ID NO: 2533778 - protein, 25 aa, Entamoeba dispar
NCLQLVKYIIEKFPHRLNYQDIYGK

SEQ ID NO: 2533779 - protein, 26 aa, Entamoeba dispar
NCLRCNKTCCYPCYISGDVKDGCYCI

SEQ ID NO: 2533780 - protein, 18 aa, Entamoeba dispar
NCLTLTSGILLINHINEQ

SEQ ID NO: 2533781 - protein, 18 aa, Entamoeba dispar
NCLWPKLFSVTPSPIELF

SEQ ID NO: 2533782 - protein, 17 aa, Entamoeba dispar
NCNAPPFKKRKGVEQPI

SEQ ID NO: 2533783 - protein, 25 aa, Entamoeba dispar
NCNEVQQWWKIILAIFASSIKMCRY

SEQ ID NO: 2533784 - protein, 19 aa, Entamoeba dispar
NCNLLTSIKLPLSLTKIGD

SEQ ID NO: 2533785 - protein, 17 aa, Entamoeba dispar
NCNSLTNIIIPTSVTKL

SEQ ID NO: 2533786 - protein, 23 aa, Entamoeba dispar
NCPLIDLTKYHFLPSSTLHSKTK

SEQ ID NO: 2533787 - protein, 17 aa, Entamoeba dispar
NCPVKMTDFTKWIKSIL

SEQ ID NO: 2533788 - protein, 19 aa, Entamoeba dispar
NCPVKMVHFAKWIKSSLKI

SEQ ID NO: 2533789 - protein, 23 aa, Entamoeba dispar
NCRRFMHMLFTYTEELFNEKSFG

SEQ ID NO: 2533790 - protein, 20 aa, Entamoeba dispar
NCRRNLILITKIIQNIANNV

SEQ ID NO: 2533791 - protein, 31 aa, Entamoeba dispar
NCRYWDVLHLSTFFPIIFRCSALSPDSLYIP

SEQ ID NO: 2533792 - protein, 27 aa, Entamoeba dispar
NCSNISQFIILIPALNKHLQTYDPVQM

SEQ ID NO: 2533793 - protein, 18 aa, Entamoeba dispar
NCYAHIWDAHLRTELSKP

SEQ ID NO: 2533794 - protein, 25 aa, Entamoeba dispar
NCYLINESIHLLIDLLNENRIQTSS

SEQ ID NO: 2533795 - protein, 18 aa, Entamoeba dispar
NCYSAFWMDTNGMISFNF

SEQ ID NO: 2533796 - protein, 26 aa, Entamoeba dispar
NDAFPTAFHIAGLWKIDRLIEEMKLC

SEQ ID NO: 2533797 - protein, 18 aa, Entamoeba dispar
NDAKVVLDILFKKAVNEK

SEQ ID NO: 2533798 - protein, 20 aa, Entamoeba dispar
NDCIILPYENKWTFWDCSIS

SEQ ID NO: 2533799 - protein, 36 aa, Entamoeba dispar
NDCLKLIQQALPLPEAMFILYKITKDVQYLMGAAEA

SEQ ID NO: 2533800 - protein, 25 aa, Entamoeba dispar
NDDDQFNLPLYLLTDNIYAIGNTMF

SEQ ID NO: 2533801 - protein, 21 aa, Entamoeba dispar
NDDFLPFNSLIIKLTLQRHNG

SEQ ID NO: 2533802 - protein, 31 aa, Entamoeba dispar
NDDIIINNIILLNLLFPSYASLHSHLPFRRY

SEQ ID NO: 2533803 - protein, 22 aa, Entamoeba dispar
NDDIVFWNAFIMDTTKSVKQFT

SEQ ID NO: 2533804 - protein, 24 aa, Entamoeba dispar
NDDKYGFIIMDGNGTLFGTLQGNT

SEQ ID NO: 2533805 - protein, 26 aa, Entamoeba dispar
NDEAKFANGVLALLKRRGYTFCEKKT

SEQ ID NO: 2533806 - protein, 39 aa, Entamoeba dispar
NDEERIKIIKEMFPELLQRILLASKISFEKSKEGGVLGK

SEQ ID NO: 2533807 - protein, 21 aa, Entamoeba dispar
NDEFKLELPFPLNENYQLIFN

SEQ ID NO: 2533808 - protein, 23 aa, Entamoeba dispar
NDEGISLLRWSLLRPSDTKGISP

SEQ ID NO: 2533809 - protein, 24 aa, Entamoeba dispar
NDEIFHYFEKFGEVSEIRDSADKP

SEQ ID NO: 2533810 - protein, 17 aa, Entamoeba dispar
NDEIFNRPVIQLDFKHI

SEQ ID NO: 2533811 - protein, 23 aa, Entamoeba dispar
NDEKYFIKFTPVTENKHYDGSFK

SEQ ID NO: 2533812 - protein, 25 aa, Entamoeba dispar
NDELFQYCMLIKGTQLKNILIEKKK

SEQ ID NO: 2533813 - protein, 26 aa, Entamoeba dispar
NDELKDLVYWYCLLNEPLDRLHYIYS

SEQ ID NO: 2533814 - protein, 38 aa, Entamoeba dispar
NDENFQFFSSLYTQPIVFPSVFFFNGAGLQKVFIKNEI

SEQ ID NO: 2533815 - protein, 25 aa, Entamoeba dispar
NDESLLYLPETFFDMIFDENIMAGG

SEQ ID NO: 2533816 - protein, 27 aa, Entamoeba dispar
NDETLISVFPLFRKIIEILYVQKTENT

SEQ ID NO: 2533817 - protein, 17 aa, Entamoeba dispar
NDEYITTLLSYSSLPFL

SEQ ID NO: 2533818 - protein, 19 aa, Entamoeba dispar
NDFDPNAFFPFLRVAVDER

SEQ ID NO: 2533819 - protein, 18 aa, Entamoeba dispar
NDFINLELGIKRFQGNME

SEQ ID NO: 2533820 - protein, 20 aa, Entamoeba dispar
NDFLPHIPSLDIRDGAVDLL

SEQ ID NO: 2533821 - protein, 17 aa, Entamoeba dispar
NDFLPRIPSLDIRDGGV

SEQ ID NO: 2533822 - protein, 33 aa, Entamoeba dispar
NDFNKEYVFLIDAGKIWLWFGSKALNETKKFSL

SEQ ID NO: 2533823 - protein, 27 aa, Entamoeba dispar
NDFPSNIVYLFLFNDIIVETKVIRFNG

SEQ ID NO: 2533824 - protein, 41 aa, Entamoeba dispar
NDFRFELQMKKYIRSDLREVLKINPKIYPTSYPSDPSMFGR

SEQ ID NO: 2533825 - protein, 23 aa, Entamoeba dispar
NDFSYYRRSFPRMKQFKREDELK

SEQ ID NO: 2533826 - protein, 23 aa, Entamoeba dispar
NDFTGCIIFSSKDPYYYVNTEFD

SEQ ID NO: 2533827 - protein, 27 aa, Entamoeba dispar
NDGALLLVSILRIIFSWYNKGSYCQQL

SEQ ID NO: 2533828 - protein, 24 aa, Entamoeba dispar
NDGDKILIFDFGAGTLDVSIVEMK

SEQ ID NO: 2533829 - protein, 23 aa, Entamoeba dispar
NDGKAILALCHAYTRLTGENGFE

SEQ ID NO: 2533830 - protein, 26 aa, Entamoeba dispar
NDGKIFKEVIWYKVDYSRYLKEKETG

SEQ ID NO: 2533831 - protein, 26 aa, Entamoeba dispar
NDGKIFKKIIWYKVDYSTYLKEKEQG

SEQ ID NO: 2533832 - protein, 19 aa, Entamoeba dispar
NDGKIFKKVIWYAISYSLY

SEQ ID NO: 2533833 - protein, 25 aa, Entamoeba dispar
NDGKIFKKVIWYKVSYSTYLQEKEQ

SEQ ID NO: 2533834 - protein, 25 aa, Entamoeba dispar
NDGKIFKKVIWYLVKDRYTYGNTIP

SEQ ID NO: 2533835 - protein, 24 aa, Entamoeba dispar
NDGKIFKKVIWYLVNYSTYLKEKE

SEQ ID NO: 2533836 - protein, 20 aa, Entamoeba dispar
NDGKIFKKVIWYTVDYSTYL

SEQ ID NO: 2533837 - protein, 19 aa, Entamoeba dispar
NDGKIFKKVTWYEVDYSTY

SEQ ID NO: 2533838 - protein, 26 aa, Entamoeba dispar
NDGKIFKQVIWYPVNYSKYLKEKEAW

SEQ ID NO: 2533839 - protein, 31 aa, Entamoeba dispar
NDGKIFKQVIWYQVEYWRYLFEKKQGNIYKN

SEQ ID NO: 2533840 - protein, 24 aa, Entamoeba dispar
NDGKIFKYVIWYKVSYSTYLQEKE

SEQ ID NO: 2533841 - protein, 27 aa, Entamoeba dispar
NDGKIFKYVIWYPVDYLTYLFKKEQGN

SEQ ID NO: 2533842 - protein, 27 aa, Entamoeba dispar
NDGKIFKYVIWYQVEYWRYLFEKNKEI

SEQ ID NO: 2533843 - protein, 23 aa, Entamoeba dispar
NDGKKVIIWFDKSPININKQTKE

SEQ ID NO: 2533844 - protein, 26 aa, Entamoeba dispar
NDGKLFKEIIWYKVDYSTYLKEKEAG

SEQ ID NO: 2533845 - protein, 26 aa, Entamoeba dispar
NDGQSPFIYFLRFHDEPTIVECLEAF

SEQ ID NO: 2533846 - protein, 26 aa, Entamoeba dispar
NDGRIFKKIIWYKVDYSKYLKEKETE

SEQ ID NO: 2533847 - protein, 26 aa, Entamoeba dispar
NDGRIFKKIIWYKVEYSTYLQEKESG

SEQ ID NO: 2533848 - protein, 26 aa, Entamoeba dispar
NDGRIFKKVIWYKVEYSKYLFEKEQG

SEQ ID NO: 2533849 - protein, 25 aa, Entamoeba dispar
NDGRIFKKVIWYLVDYSTYLKEKRN

SEQ ID NO: 2533850 - protein, 26 aa, Entamoeba dispar
NDGRIFKQVTWYLVDYSIYLFKKEKG

SEQ ID NO: 2533851 - protein, 27 aa, Entamoeba dispar
NDGRIFKYVIWYKVDYSRYLQEKKQGN

SEQ ID NO: 2533852 - protein, 26 aa, Entamoeba dispar
NDGRIFKYVIWYTVEYSKYLQEKEQG

SEQ ID NO: 2533853 - protein, 27 aa, Entamoeba dispar
NDGRIIKQVIWYLVNYSKYLQEKEQGN

SEQ ID NO: 2533854 - protein, 19 aa, Entamoeba dispar
NDGRLFMITFEDGRVELRD

SEQ ID NO: 2533855 - protein, 17 aa, Entamoeba dispar
NDGSIIPKIYRIPKNLN

SEQ ID NO: 2533856 - protein, 24 aa, Entamoeba dispar
NDGTTACVLLVTPNEYYTAHVGDS

SEQ ID NO: 2533857 - protein, 41 aa, Entamoeba dispar
NDGYFQECFVLAYRLVTTPGKLLELLGILFDPTIPEGMTWE

SEQ ID NO: 2533858 - protein, 26 aa, Entamoeba dispar
NDHDIRLLCFNLLTKMVILNPDPMVE

SEQ ID NO: 2533859 - protein, 31 aa, Entamoeba dispar
NDICYQQAFLILLLNQYLAITLKKQSKKCTI

SEQ ID NO: 2533860 - protein, 24 aa, Entamoeba dispar
NDIDPVELFFYNISSIHGVRERLT

SEQ ID NO: 2533861 - protein, 26 aa, Entamoeba dispar
NDIENIRIFIKACFIEKQWTTENIQN

SEQ ID NO: 2533862 - protein, 24 aa, Entamoeba dispar
NDIFIVLHDGRLYRFIDFDQFEEQ

SEQ ID NO: 2533863 - protein, 24 aa, Entamoeba dispar
NDIFIVLHDGRLYRFIDFDQFEEV

SEQ ID NO: 2533864 - protein, 27 aa, Entamoeba dispar
NDIGSIKALWVAWKLGAKDYKINENGF

SEQ ID NO: 2533865 - protein, 27 aa, Entamoeba dispar
NDIIKQEFALILPLINKSIKKVLSEEY

SEQ ID NO: 2533866 - protein, 21 aa, Entamoeba dispar
NDIKDFINLEIGIKRFQRNME

SEQ ID NO: 2533867 - protein, 24 aa, Entamoeba dispar
NDIKTINGFNFNLTSTFGSSTSST

SEQ ID NO: 2533868 - protein, 19 aa, Entamoeba dispar
NDILSQFFGGGFGGFGGGF

SEQ ID NO: 2533869 - protein, 21 aa, Entamoeba dispar
NDIQALQFVRKIGGIAIAMGN

SEQ ID NO: 2533870 - protein, 41 aa, Entamoeba dispar
NDISSFNCIDFWEGVKREIIPNYIILVDDQLIKLNRDTIRS

SEQ ID NO: 2533871 - protein, 26 aa, Entamoeba dispar
NDIYRIFCDILYQTIIYKDHRLFSKS

SEQ ID NO: 2533872 - protein, 23 aa, Entamoeba dispar
NDKCIFTLSFFTNQIPINAKTKC

SEQ ID NO: 2533873 - protein, 25 aa, Entamoeba dispar
NDKMTLFFEMIKPSTMYFIAQEDEK

SEQ ID NO: 2533874 - protein, 26 aa, Entamoeba dispar
NDKNIMVWDYRKPEIPLKILQNHTGE

SEQ ID NO: 2533875 - protein, 38 aa, Entamoeba dispar
NDKPITITLFATQSMIYFDLPHLDHILHFLYSDHEQKT

SEQ ID NO: 2533876 - protein, 28 aa, Entamoeba dispar
NDKTAMLWRVDPLVSMGAYACAGAVSSC

SEQ ID NO: 2533877 - protein, 24 aa, Entamoeba dispar
NDKTKALITFLEKTKRPSQRVTTS

SEQ ID NO: 2533878 - protein, 22 aa, Entamoeba dispar
NDKTQCLSIWKGLENKNNQIVN

SEQ ID NO: 2533879 - protein, 20 aa, Entamoeba dispar
NDLFAFFIKTLFDEFKRISD

SEQ ID NO: 2533880 - protein, 19 aa, Entamoeba dispar
NDLIFKQVPDGEIMHMICN

SEQ ID NO: 2533881 - protein, 24 aa, Entamoeba dispar
NDLKGMPFIIYVNKIDLKPYDPSF

SEQ ID NO: 2533882 - protein, 23 aa, Entamoeba dispar
NDLKYIIIGFSEGTIRVYKNDDK

SEQ ID NO: 2533883 - protein, 23 aa, Entamoeba dispar
NDLPLLQNGLIPPSYIQGNCMEE

SEQ ID NO: 2533884 - protein, 32 aa, Entamoeba dispar
NDLQEIYYKRLRFLQIKLFNTSLKSYSKLPIK

SEQ ID NO: 2533885 - protein, 17 aa, Entamoeba dispar
NDLTKRYEDLRLQLSHL

SEQ ID NO: 2533886 - protein, 21 aa, Entamoeba dispar
NDLVDLVVYLLKKLDKDSQNL

SEQ ID NO: 2533887 - protein, 22 aa, Entamoeba dispar
NDLVQFRIKECLRKLLVGKKFE

SEQ ID NO: 2533888 - protein, 26 aa, Entamoeba dispar
NDLVSSPWIQHTFFHQIKPSEHNSPF

SEQ ID NO: 2533889 - protein, 27 aa, Entamoeba dispar
NDLVVNYIMIFTIVASKLSSPPFELFN

SEQ ID NO: 2533890 - protein, 19 aa, Entamoeba dispar
NDLYIEKVILFQQKECCSA

SEQ ID NO: 2533891 - protein, 17 aa, Entamoeba dispar
NDLYWKKGLLSSKHRVA

SEQ ID NO: 2533892 - protein, 19 aa, Entamoeba dispar
NDMCPCIIFVPTKKNVMKY

SEQ ID NO: 2533893 - protein, 24 aa, Entamoeba dispar
NDMFNIFIDTLYHPIRYMDHNNYS

SEQ ID NO: 2533894 - protein, 20 aa, Entamoeba dispar
NDMRPVVSRIPEFEKLLGQY

SEQ ID NO: 2533895 - protein, 20 aa, Entamoeba dispar
NDMVHWIDDISAVIESITTS

SEQ ID NO: 2533896 - protein, 24 aa, Entamoeba dispar
NDNDLQFYFQQYNPIQSRVIYDDR

SEQ ID NO: 2533897 - protein, 24 aa, Entamoeba dispar
NDNFKIFLPQIQVTNIIQLIQSIQ

SEQ ID NO: 2533898 - protein, 18 aa, Entamoeba dispar
NDNKKFVKIVLIIQNRHS

SEQ ID NO: 2533899 - protein, 17 aa, Entamoeba dispar
NDPNFFVFTLSNPKKTN

SEQ ID NO: 2533900 - protein, 25 aa, Entamoeba dispar
NDPNGKVSIFLLSTRSGGLGINLQS

SEQ ID NO: 2533901 - protein, 27 aa, Entamoeba dispar
NDPTTKLIKTFITVLRGTRGMRGGYRG

SEQ ID NO: 2533902 - protein, 22 aa, Entamoeba dispar
NDQFLLFIIEDSTITFCHQKKE

SEQ ID NO: 2533903 - protein, 25 aa, Entamoeba dispar
NDQHSIYKALPFFKDFILSIEQHKN

SEQ ID NO: 2533904 - protein, 22 aa, Entamoeba dispar
NDQNQMWLFNQIVELCKIDMKD

SEQ ID NO: 2533905 - protein, 24 aa, Entamoeba dispar
NDQNYCSIRYKLGKIRSFIEEKEQ

SEQ ID NO: 2533906 - protein, 25 aa, Entamoeba dispar
NDQSGWIYYRWLLGTGMKCYNELNK

SEQ ID NO: 2533907 - protein, 23 aa, Entamoeba dispar
NDRLIRKRYPINPKDWNYYYQDS

SEQ ID NO: 2533908 - protein, 25 aa, Entamoeba dispar
NDRRIIKKVIWYQVDYSTYLKEKEQ

SEQ ID NO: 2533909 - protein, 23 aa, Entamoeba dispar
NDRRQAYELLKKDATNFMNAYDS

SEQ ID NO: 2533910 - protein, 27 aa, Entamoeba dispar
NDRSVIYWDIPFSEYKLGRNLTLIKEH

SEQ ID NO: 2533911 - protein, 21 aa, Entamoeba dispar
NDRSYIIPSFNKYYNDTTQVG

SEQ ID NO: 2533912 - protein, 31 aa, Entamoeba dispar
NDSFVDGKAFLALLCSLDKDQKTFDKYATET

SEQ ID NO: 2533913 - protein, 22 aa, Entamoeba dispar
NDSIVFTLLFNELNLIYINQRS

SEQ ID NO: 2533914 - protein, 21 aa, Entamoeba dispar
NDSIYTIPLLSESLGALWKTL

SEQ ID NO: 2533915 - protein, 25 aa, Entamoeba dispar
NDSNDCICLFLLVLCIRLSLNKNVN

SEQ ID NO: 2533916 - protein, 29 aa, Entamoeba dispar
NDSQSELKPILPSLDTFQSASSPIKEIKI

SEQ ID NO: 2533917 - protein, 26 aa, Entamoeba dispar
NDSSNLGFRMQWICPFNASQKTAGEK

SEQ ID NO: 2533918 - protein, 28 aa, Entamoeba dispar
NDSTAKVWYLANSRLRHSLTGHNGKVTC

SEQ ID NO: 2533919 - protein, 24 aa, Entamoeba dispar
NDTAHPVLYFTPLSHSEPKPQLCK

SEQ ID NO: 2533920 - protein, 25 aa, Entamoeba dispar
NDTELDLELLLLSDDYEFSTDFTIT

SEQ ID NO: 2533921 - protein, 36 aa, Entamoeba dispar
NDTFIYITDYLILESFRKYFRGITIPTFISTVTHQL

SEQ ID NO: 2533922 - protein, 17 aa, Entamoeba dispar
NDTFYKYDILTQSILCS

SEQ ID NO: 2533923 - protein, 29 aa, Entamoeba dispar
NDTIYNMFQLFFFKIFHNYFQCFKANPGG

SEQ ID NO: 2533924 - protein, 28 aa, Entamoeba dispar
NDTKDIMNLYLVFGTSSSFNKKFNLKIA

SEQ ID NO: 2533925 - protein, 25 aa, Entamoeba dispar
NDTKHFMFSIINPSKTEPLMFSMKL

SEQ ID NO: 2533926 - protein, 35 aa, Entamoeba dispar
NDVEFIRLFDITIIIPYFIDLLKEIPLSWYHRIIM

SEQ ID NO: 2533927 - protein, 25 aa, Entamoeba dispar
NDVFIRMLPLLIFIPDYICNVNYSL

SEQ ID NO: 2533928 - protein, 24 aa, Entamoeba dispar
NDVKEIIKWLSNNIIKLTKSKDTK

SEQ ID NO: 2533929 - protein, 24 aa, Entamoeba dispar
NDVKNRFFGRLKYQITKELKQNPL

SEQ ID NO: 2533930 - protein, 21 aa, Entamoeba dispar
NDVLLPQFIDFIFNSQDDFVV

SEQ ID NO: 2533931 - protein, 26 aa, Entamoeba dispar
NDVNVFKILIISSIKLGKDVTQFEET

SEQ ID NO: 2533932 - protein, 32 aa, Entamoeba dispar
NDVSITSFRWQYIKYLFKMSYNALHYTHLKTY

SEQ ID NO: 2533933 - protein, 25 aa, Entamoeba dispar
NDVTQYILNIITPDKILLSQTKNKS

SEQ ID NO: 2533934 - protein, 27 aa, Entamoeba dispar
NDVVQPIIAKLLRSSFDWLKSIKDSQV

SEQ ID NO: 2533935 - protein, 22 aa, Entamoeba dispar
NDVVTLALYRRVFPLPPLVSAN

SEQ ID NO: 2533936 - protein, 26 aa, Entamoeba dispar
NDWIKFYKIIYSIYQIIKILNNYSFK

SEQ ID NO: 2533937 - protein, 30 aa, Entamoeba dispar
NDYCNAICFYPFLNSDLIRFIRNIPEEFLV

SEQ ID NO: 2533938 - protein, 31 aa, Entamoeba dispar
NDYENKLLLYHSFFLSLPPESIHYLGFIDLV

SEQ ID NO: 2533939 - protein, 26 aa, Entamoeba dispar
NDYERELVFYQQAIKSVIQARKYFNA

SEQ ID NO: 2533940 - protein, 28 aa, Entamoeba dispar
NDYQCFIKHWILYIKDKEWLDVFQLKGY

SEQ ID NO: 2533941 - protein, 24 aa, Entamoeba dispar
NDYQVLFFDTGFTQQNWKSNDSSI

SEQ ID NO: 2533942 - protein, 19 aa, Entamoeba dispar
NDYRQLLEIGFDEIKYHEQ

SEQ ID NO: 2533943 - protein, 24 aa, Entamoeba dispar
NEAAKWFEQTWSDTYRRNDVKILL

SEQ ID NO: 2533944 - protein, 19 aa, Entamoeba dispar
NEAALIITLRIIPSICLSL

SEQ ID NO: 2533945 - protein, 17 aa, Entamoeba dispar
NEAFLDNLTYKPGFEQL

SEQ ID NO: 2533946 - protein, 22 aa, Entamoeba dispar
NEAISFFHLIGRIIHTEPVYNE

SEQ ID NO: 2533947 - protein, 34 aa, Entamoeba dispar
NECEGITCNEAMGALYLFPKIKFSNKYIDECKRK

SEQ ID NO: 2533948 - protein, 19 aa, Entamoeba dispar
NECILCYNGYQLQNKKCIL

SEQ ID NO: 2533949 - protein, 23 aa, Entamoeba dispar
NECKMCLQALFDAAFMLAEKMKE

SEQ ID NO: 2533950 - protein, 39 aa, Entamoeba dispar
NECYVFHYTYPWKNLFRHALFFWLGKNASILHRGKAAAL

SEQ ID NO: 2533951 - protein, 22 aa, Entamoeba dispar
NEDAMVVCMILSRLSSTNLINK

SEQ ID NO: 2533952 - protein, 25 aa, Entamoeba dispar
NEDIFKACIGCLWNLSIDPDVTPQM

SEQ ID NO: 2533953 - protein, 18 aa, Entamoeba dispar
NEDILEELPFHEANESHK

SEQ ID NO: 2533954 - protein, 22 aa, Entamoeba dispar
NEDKIISWPLLLEEFRETRRKQ

SEQ ID NO: 2533955 - protein, 24 aa, Entamoeba dispar
NEDKIISWPLLLEEFRETRRKQLD

SEQ ID NO: 2533956 - protein, 23 aa, Entamoeba dispar
NEDRAVFLFLNEFFRETYVIAQN

SEQ ID NO: 2533957 - protein, 25 aa, Entamoeba dispar
NEDSPCGFLLFKEMILFMRALAEQN

SEQ ID NO: 2533958 - protein, 21 aa, Entamoeba dispar
NEDTFRIIPNAQQLVPMKKNK

SEQ ID NO: 2533959 - protein, 26 aa, Entamoeba dispar
NEEEKEQWLPPRKRVSINTTEDKKED

SEQ ID NO: 2533960 - protein, 19 aa, Entamoeba dispar
NEEELILKGVERKLKSLES

SEQ ID NO: 2533961 - protein, 36 aa, Entamoeba dispar
NEEELSLLHQWTGKQKLHVFFNNKKERFTRENCLSI

SEQ ID NO: 2533962 - protein, 26 aa, Entamoeba dispar
NEEEYVTLDFLTLDRIEPTENELHLI

SEQ ID NO: 2533963 - protein, 42 aa, Entamoeba dispar
NEEGDLGYFTPILTPELSPEHPPRFSITKAPALSEKELENKK

SEQ ID NO: 2533964 - protein, 24 aa, Entamoeba dispar
NEEHFMYIVNMLTPDFVISVMEKI

SEQ ID NO: 2533965 - protein, 34 aa, Entamoeba dispar
NEEIFYTINGSFWKKFKIPWRSVAVAISFGRFHP

SEQ ID NO: 2533966 - protein, 20 aa, Entamoeba dispar
NEEIIIKVIMKNCGSYFVKN

SEQ ID NO: 2533967 - protein, 19 aa, Entamoeba dispar
NEEIYCENGKYINNNKCIE

SEQ ID NO: 2533968 - protein, 18 aa, Entamoeba dispar
NEEKLEFISFSDILLKYF

SEQ ID NO: 2533969 - protein, 33 aa, Entamoeba dispar
NEELEAPKVIFPTSGIFWETLKKALDDNNISVV

SEQ ID NO: 2533970 - protein, 30 aa, Entamoeba dispar
NEELLKSFLEKYPKVLFFKTTISDPEGIKK

SEQ ID NO: 2533971 - protein, 23 aa, Entamoeba dispar
NEEMRKIELIIKKGKYYHQEENN

SEQ ID NO: 2533972 - protein, 22 aa, Entamoeba dispar
NEENTFIFLGDYVDRGNFSTEI

SEQ ID NO: 2533973 - protein, 26 aa, Entamoeba dispar
NEEQTTLLSILPFGEERIKGINGLRE

SEQ ID NO: 2533974 - protein, 19 aa, Entamoeba dispar
NEERKWKLISEDHVIVIWN

SEQ ID NO: 2533975 - protein, 22 aa, Entamoeba dispar
NEESFIHLDKWWNEYQQEDSDK

SEQ ID NO: 2533976 - protein, 27 aa, Entamoeba dispar
NEETLVYNGLLYLLVKMGFDAQVKKTK

SEQ ID NO: 2533977 - protein, 28 aa, Entamoeba dispar
NEETLVYNGLLYLLVKMGFDAQVKKTKK

SEQ ID NO: 2533978 - protein, 25 aa, Entamoeba dispar
NEETSLFSFDRPNLSSLINSGLSRE

SEQ ID NO: 2533979 - protein, 17 aa, Entamoeba dispar
NEEVSVSIPWFFDNFDA

SEQ ID NO: 2533980 - protein, 30 aa, Entamoeba dispar
NEFAKALCLILKSPIALKRIDLSNIGLTDE

SEQ ID NO: 2533981 - protein, 17 aa, Entamoeba dispar
NEFIILSSISELGYCCF

SEQ ID NO: 2533982 - protein, 20 aa, Entamoeba dispar
NEFIIPITVNKLGDYCFYKC

SEQ ID NO: 2533983 - protein, 18 aa, Entamoeba dispar
NEFIIPSSITKLDRQCFY

SEQ ID NO: 2533984 - protein, 17 aa, Entamoeba dispar
NEFIIPSSITKLGDKCF

SEQ ID NO: 2533985 - protein, 18 aa, Entamoeba dispar
NEFIIPSSITKLGSGCFY

SEQ ID NO: 2533986 - protein, 18 aa, Entamoeba dispar
NEFIIPTQVNELGKWCFY

SEQ ID NO: 2533987 - protein, 21 aa, Entamoeba dispar
NEFIMLCCDILKFLFDTVPDL

SEQ ID NO: 2533988 - protein, 19 aa, Entamoeba dispar
NEFKLFEQSVRGLMNCWST

SEQ ID NO: 2533989 - protein, 17 aa, Entamoeba dispar
NEFKNMIEFYLKNSEEE

SEQ ID NO: 2533990 - protein, 18 aa, Entamoeba dispar
NEFNWNNCIFYIFDIEDI

SEQ ID NO: 2533991 - protein, 24 aa, Entamoeba dispar
NEFPKFLRKIPKISNLIITDSLIT

SEQ ID NO: 2533992 - protein, 27 aa, Entamoeba dispar
NEFTLINVVFFLQKDFYVPAVIDGFVT

SEQ ID NO: 2533993 - protein, 17 aa, Entamoeba dispar
NEGILNKIIMNISFDGI

SEQ ID NO: 2533994 - protein, 22 aa, Entamoeba dispar
NEGKLINFYKVRSIGIILMDLQ

SEQ ID NO: 2533995 - protein, 26 aa, Entamoeba dispar
NEGRNFVDEIEYIGYPQLSKQQEHKQ

SEQ ID NO: 2533996 - protein, 23 aa, Entamoeba dispar
NEGVTPLTLPPIIIAGNKCDLDD

SEQ ID NO: 2533997 - protein, 19 aa, Entamoeba dispar
NEHIILALLKNAPTIDVNK

SEQ ID NO: 2533998 - protein, 31 aa, Entamoeba dispar
NEHSPEMYSWFPLFFPLISPIEVKRGDVLEL

SEQ ID NO: 2533999 - protein, 32 aa, Entamoeba dispar
NEIDGKYQLIKKIPLVLLKKVSMKKATSDVIT

SEQ ID NO: 2534000 - protein, 27 aa, Entamoeba dispar
NEIGFYFSETYLFKFHYCDGTTILHPM

SEQ ID NO: 2534001 - protein, 25 aa, Entamoeba dispar
NEIICKRTCRFVDAGKYFFEEAIKM

SEQ ID NO: 2534002 - protein, 21 aa, Entamoeba dispar
NEIIVVVLSGLIRLIPTFNKF

SEQ ID NO: 2534003 - protein, 21 aa, Entamoeba dispar
NEIKELESLIIIIKEEIEQEN

SEQ ID NO: 2534004 - protein, 18 aa, Entamoeba dispar
NEILLRRKSSNELKKRKA

SEQ ID NO: 2534005 - protein, 26 aa, Entamoeba dispar
NEILRLFEEELLDSSLKDFRDVIDGD

SEQ ID NO: 2534006 - protein, 27 aa, Entamoeba dispar
NEILYQKYHWDIFASKSLLCIGPEEKS

SEQ ID NO: 2534007 - protein, 17 aa, Entamoeba dispar
NEIMLKYGNLPRTDITS

SEQ ID NO: 2534008 - protein, 24 aa, Entamoeba dispar
NEIRERIYRVLDKDPTQHIPICLV

SEQ ID NO: 2534009 - protein, 26 aa, Entamoeba dispar
NEIYKKYLYFIEKLITITPKISQFFN

SEQ ID NO: 2534010 - protein, 25 aa, Entamoeba dispar
NEKAKEFDLFIKNGRYNALFGDKAS

SEQ ID NO: 2534011 - protein, 31 aa, Entamoeba dispar
NEKDDIPLPILKALYSLYFSRRSLEGVFRIS

SEQ ID NO: 2534012 - protein, 18 aa, Entamoeba dispar
NEKDILLANKFKKQLTGK

SEQ ID NO: 2534013 - protein, 31 aa, Entamoeba dispar
NEKENIVRIGILLNEKPLIKKQLNKNSYLSD

SEQ ID NO: 2534014 - protein, 24 aa, Entamoeba dispar
NEKINFYFKQIITGIQYIHSKNII

SEQ ID NO: 2534015 - protein, 21 aa, Entamoeba dispar
NEKIPITKFFIKNFKEIKKYC

SEQ ID NO: 2534016 - protein, 19 aa, Entamoeba dispar
NEKITVDELLKIKKSIKNQ

SEQ ID NO: 2534017 - protein, 18 aa, Entamoeba dispar
NEKKGLFNITCATTSMPP

SEQ ID NO: 2534018 - protein, 34 aa, Entamoeba dispar
NEKLLEYNLKINQIFSFIISHTPVVFPSAKRCFT

SEQ ID NO: 2534019 - protein, 25 aa, Entamoeba dispar
NEKLNPPFVLPYSKRQTIPDFVYKI

SEQ ID NO: 2534020 - protein, 18 aa, Entamoeba dispar
NEKLPLKKTIPITPSEDN

SEQ ID NO: 2534021 - protein, 24 aa, Entamoeba dispar
NEKLTQLIQLLPLNYHGQIIDVDK

SEQ ID NO: 2534022 - protein, 26 aa, Entamoeba dispar
NEKNLPIEQFALLKSRMLGMLEEYNR

SEQ ID NO: 2534023 - protein, 25 aa, Entamoeba dispar
NEKPFNLFEPIKMVKIGFYSVEKEK

SEQ ID NO: 2534024 - protein, 27 aa, Entamoeba dispar
NEKQKRDGCFLWVLVQSFFSEICQKIS

SEQ ID NO: 2534025 - protein, 25 aa, Entamoeba dispar
NEKRTFVEFILEPIYKIVGICLSKE

SEQ ID NO: 2534026 - protein, 17 aa, Entamoeba dispar
NEKRVIPFLTFYSSRGK

SEQ ID NO: 2534027 - protein, 24 aa, Entamoeba dispar
NEKSRALLTWLFDLMIEVSKNRET

SEQ ID NO: 2534028 - protein, 28 aa, Entamoeba dispar
NEKTDQQIFFIIDIKMIALHKTKPNQFA

SEQ ID NO: 2534029 - protein, 18 aa, Entamoeba dispar
NEKTGIPHLQNLLKDFLL

SEQ ID NO: 2534030 - protein, 39 aa, Entamoeba dispar
NEKTLYYGILSQDNMYSAWNPQLLISLKAPQAVAAMNAC

SEQ ID NO: 2534031 - protein, 26 aa, Entamoeba dispar
NEKTPIPLINFVRYIVQYAPFDELPD

SEQ ID NO: 2534032 - protein, 17 aa, Entamoeba dispar
NEKVFIDYIKKIGYATL

SEQ ID NO: 2534033 - protein, 26 aa, Entamoeba dispar
NELEEYAFLYNKYKQRGVFFPELKKE

SEQ ID NO: 2534034 - protein, 20 aa, Entamoeba dispar
NELIHQIKVIDISELFQGNN

SEQ ID NO: 2534035 - protein, 23 aa, Entamoeba dispar
NELIPFDITPLIKVLESSKVMQR

SEQ ID NO: 2534036 - protein, 18 aa, Entamoeba dispar
NELIPFLRRESFGQYPTQ

SEQ ID NO: 2534037 - protein, 24 aa, Entamoeba dispar
NELITFIKQLLLERKCVTLSTIKN

SEQ ID NO: 2534038 - protein, 33 aa, Entamoeba dispar
NELIVFETSQLPEYIKYISFSLSDSKLIMNNKR

SEQ ID NO: 2534039 - protein, 18 aa, Entamoeba dispar
NELLFEKYQLQPDLPNDE

SEQ ID NO: 2534040 - protein, 23 aa, Entamoeba dispar
NELNERMQILLLSSLMGCTSDEH

SEQ ID NO: 2534041 - protein, 25 aa, Entamoeba dispar
NELPLHLILSWYEQKAVAVLLALLY

SEQ ID NO: 2534042 - protein, 24 aa, Entamoeba dispar
NELPNYFIPVFTLDDLRKYFGAFP

SEQ ID NO: 2534043 - protein, 17 aa, Entamoeba dispar
NELSRKFKLHCLLNSRK

SEQ ID NO: 2534044 - protein, 23 aa, Entamoeba dispar
NELTIIPMELFTMPSLQSIQFNK

SEQ ID NO: 2534045 - protein, 27 aa, Entamoeba dispar
NELTPTGHLFAYLSNSPKLAFFGHVDT

SEQ ID NO: 2534046 - protein, 20 aa, Entamoeba dispar
NEMEKLIAAGIMKQSDLPIE

SEQ ID NO: 2534047 - protein, 26 aa, Entamoeba dispar
NEMIQTPPLLQLLPLSCFEYSTQLRN

SEQ ID NO: 2534048 - protein, 22 aa, Entamoeba dispar
NEMKKFVQVAFRLPSSETIKQP

SEQ ID NO: 2534049 - protein, 18 aa, Entamoeba dispar
NEMKLNSTWYAKLGMWHK

SEQ ID NO: 2534050 - protein, 24 aa, Entamoeba dispar
NEMLNKVIISFKYDGKKTIKIIEE

SEQ ID NO: 2534051 - protein, 18 aa, Entamoeba dispar
NEMNEIFPYFLVDCKEIK

SEQ ID NO: 2534052 - protein, 19 aa, Entamoeba dispar
NEMQRRVAELLTELEGVKK

SEQ ID NO: 2534053 - protein, 18 aa, Entamoeba dispar
NENDLKKAYRKLALKWHP

SEQ ID NO: 2534054 - protein, 29 aa, Entamoeba dispar
NENEPPFVYILLGWLTHLIVMNPSVNEVF

SEQ ID NO: 2534055 - protein, 17 aa, Entamoeba dispar
NENIDIPMFFVDSQPEE

SEQ ID NO: 2534056 - protein, 27 aa, Entamoeba dispar
NENIPLLIASFYPLFEPSFNNNIIYPK

SEQ ID NO: 2534057 - protein, 28 aa, Entamoeba dispar
NENIVIDIMCILPNGKQIWININKDDDP

SEQ ID NO: 2534058 - protein, 27 aa, Entamoeba dispar
NENKFCKLYVRFIQTLRQQNGLTQNVA

SEQ ID NO: 2534059 - protein, 17 aa, Entamoeba dispar
NENMIDYHLLFESNFEI

SEQ ID NO: 2534060 - protein, 23 aa, Entamoeba dispar
NENNILIAGLINNGSIDIILFKR

SEQ ID NO: 2534061 - protein, 27 aa, Entamoeba dispar
NENQIKLFYLYLINKLDQYVNQEYIIV

SEQ ID NO: 2534062 - protein, 31 aa, Entamoeba dispar
NENTHWLTFHSGYDFGYMLKLLTCEKLPSNV

SEQ ID NO: 2534063 - protein, 29 aa, Entamoeba dispar
NENTKNQPFLPIFEIKLKKTSPIKKYEPP

SEQ ID NO: 2534064 - protein, 26 aa, Entamoeba dispar
NENVTIPFYPWYIIAVETTNKTKIGE

SEQ ID NO: 2534065 - protein, 37 aa, Entamoeba dispar
NENYVVLDHYLYKTLYGFIPLIYPIPKNYRNTDDYKN

SEQ ID NO: 2534066 - protein, 17 aa, Entamoeba dispar
NENYYITLSKLFLYCNN

SEQ ID NO: 2534067 - protein, 25 aa, Entamoeba dispar
NEPEKIIADPFKVKGPGLIQMHCNN

SEQ ID NO: 2534068 - protein, 23 aa, Entamoeba dispar
NEPIIEVPYMNVLSAFRPEDISA

SEQ ID NO: 2534069 - protein, 17 aa, Entamoeba dispar
NEPIIIPVRIKRSKPKY

SEQ ID NO: 2534070 - protein, 26 aa, Entamoeba dispar
NEPSQAFWKFMNLIASKVTLEGYQNY

SEQ ID NO: 2534071 - protein, 18 aa, Entamoeba dispar
NEPVAALLEYKRTHNDIL

SEQ ID NO: 2534072 - protein, 26 aa, Entamoeba dispar
NEQEQFFNYLLPLLIELIKEKDINIQ

SEQ ID NO: 2534073 - protein, 24 aa, Entamoeba dispar
NEQFKNFEFIKESEFLYLLCSFYN

SEQ ID NO: 2534074 - protein, 17 aa, Entamoeba dispar
NEQGTAVILYYSTKTYS

SEQ ID NO: 2534075 - protein, 19 aa, Entamoeba dispar
NEQILLKLIVRDCNQDCYP

SEQ ID NO: 2534076 - protein, 18 aa, Entamoeba dispar
NEQSSLLMKFFDEYKATD

SEQ ID NO: 2534077 - protein, 25 aa, Entamoeba dispar
NEQTIVYFINIIPQFDLYDLSNRIR

SEQ ID NO: 2534078 - protein, 23 aa, Entamoeba dispar
NEQTMFFMCDISYAIEYLSKNYS

SEQ ID NO: 2534079 - protein, 23 aa, Entamoeba dispar
NEREELIRIIKYSLSMIEQFQKN

SEQ ID NO: 2534080 - protein, 42 aa, Entamoeba dispar
NERFVDIFHGKPVKLFLDTLSSYKIIFPRIQYCKTLNSSTNI

SEQ ID NO: 2534081 - protein, 18 aa, Entamoeba dispar
NERHAEFAEALYLAEKAA

SEQ ID NO: 2534082 - protein, 25 aa, Entamoeba dispar
NERIHLLEILIKLTQKIFEINNNNQ

SEQ ID NO: 2534083 - protein, 25 aa, Entamoeba dispar
NERIPLLAQSFPYQPPYQPQIEMMN

SEQ ID NO: 2534084 - protein, 29 aa, Entamoeba dispar
NERISNISNLLFLNPYFGDSDDDLWSGEE

SEQ ID NO: 2534085 - protein, 19 aa, Entamoeba dispar
NERLVYTYFLLNEGVGEDE

SEQ ID NO: 2534086 - protein, 29 aa, Entamoeba dispar
NERMNRTILFMVSLWRMNGYKCSIRKSKR

SEQ ID NO: 2534087 - protein, 30 aa, Entamoeba dispar
NERMNRTILFMVSLWRMNGYKCSIRKSKRI

SEQ ID NO: 2534088 - protein, 30 aa, Entamoeba dispar
NERPAFNAMYKLLFFPMSINDFNAVLDTSI

SEQ ID NO: 2534089 - protein, 24 aa, Entamoeba dispar
NERPTSFDLLKHSWLSNAQVRLDT

SEQ ID NO: 2534090 - protein, 24 aa, Entamoeba dispar
NERRIREFMKLKYQDKKWFDQAAY

SEQ ID NO: 2534091 - protein, 30 aa, Entamoeba dispar
NESEINFIPLLRTVFYKFFGERNLTGFGDT

SEQ ID NO: 2534092 - protein, 21 aa, Entamoeba dispar
NESFYLVTSLLVFTTDYNISL

SEQ ID NO: 2534093 - protein, 25 aa, Entamoeba dispar
NESIDFMINQFAKIFPNLMELNLSN

SEQ ID NO: 2534094 - protein, 17 aa, Entamoeba dispar
NESIRINIYLDIPIVTE

SEQ ID NO: 2534095 - protein, 24 aa, Entamoeba dispar
NESLMKFYIYFDKAEKIKAGDIGG

SEQ ID NO: 2534096 - protein, 21 aa, Entamoeba dispar
NESLQKLFLKLIKNLIERDDI

SEQ ID NO: 2534097 - protein, 25 aa, Entamoeba dispar
NESLYEECYPQYGKGEFARVDDKSG

SEQ ID NO: 2534098 - protein, 27 aa, Entamoeba dispar
NESMNIFIELFLPYINRLLTSDSLFAK

SEQ ID NO: 2534099 - protein, 35 aa, Entamoeba dispar
NETDIFLTSQFIKQFSFRLLEIITLVSMCRDIQKQ

SEQ ID NO: 2534100 - protein, 25 aa, Entamoeba dispar
NETGLIMPVEELCKIAHAHGAFFHS

SEQ ID NO: 2534101 - protein, 24 aa, Entamoeba dispar
NETHFIDIYLPDVLEFDKNLYKCT

SEQ ID NO: 2534102 - protein, 20 aa, Entamoeba dispar
NETIHYFITVLSVADGYVFN

SEQ ID NO: 2534103 - protein, 25 aa, Entamoeba dispar
NETIKYDIRLFDDANLNDITWPEFK

SEQ ID NO: 2534104 - protein, 17 aa, Entamoeba dispar
NETLFACKLRYIIELDE

SEQ ID NO: 2534105 - protein, 23 aa, Entamoeba dispar
NETSFLNYYLYNIKLCTPANSVN

SEQ ID NO: 2534106 - protein, 18 aa, Entamoeba dispar
NEVEHVFFESSLLKFSSN

SEQ ID NO: 2534107 - protein, 25 aa, Entamoeba dispar
NEVKIKYLTPITILISYNEEKPSFQ

SEQ ID NO: 2534108 - protein, 29 aa, Entamoeba dispar
NEVKRLKYRNGRFLPFLMAGNPVNFGRPF

SEQ ID NO: 2534109 - protein, 24 aa, Entamoeba dispar
NEVQKIVMNLLYSKKKFNTQVIMT

SEQ ID NO: 2534110 - protein, 29 aa, Entamoeba dispar
NEVSTTFFGHLIHLFGVFYKSKDVFKSMI

SEQ ID NO: 2534111 - protein, 18 aa, Entamoeba dispar
NEWFGYWNKGLASRYKSL

SEQ ID NO: 2534112 - protein, 22 aa, Entamoeba dispar
NEWIGILQLITYPKWSVNGIST

SEQ ID NO: 2534113 - protein, 32 aa, Entamoeba dispar
NEWKKVNILIYQNLIFLLKPGSDTVIAIIYIN

SEQ ID NO: 2534114 - protein, 18 aa, Entamoeba dispar
NEWTVTLAPLTQSIGYFG

SEQ ID NO: 2534115 - protein, 28 aa, Entamoeba dispar
NEYKGKYVVLLFYPLDWTFVCPTEMIGY

SEQ ID NO: 2534116 - protein, 33 aa, Entamoeba dispar
NEYKGKYVVLLFYPLDWTFVCPTEMIGYSEVAG

SEQ ID NO: 2534117 - protein, 17 aa, Entamoeba dispar
NEYMDEKTKRILEQLQA

SEQ ID NO: 2534118 - protein, 23 aa, Entamoeba dispar
NEYNLQVILPKITPIVPVQSYPD

SEQ ID NO: 2534119 - protein, 27 aa, Entamoeba dispar
NEYVLYQPNIIIILIIDDCQFGVYQNQ

SEQ ID NO: 2534120 - protein, 18 aa, Entamoeba dispar
NFAPLIRKAIDIVRTTHS

SEQ ID NO: 2534121 - protein, 19 aa, Entamoeba dispar
NFCDELMSIDIPYSVSELG

SEQ ID NO: 2534122 - protein, 20 aa, Entamoeba dispar
NFCDELMSIDIPYSVSELGR

SEQ ID NO: 2534123 - protein, 28 aa, Entamoeba dispar
NFCQRSFIQAFLFIFRNSIDTANQQISA

SEQ ID NO: 2534124 - protein, 33 aa, Entamoeba dispar
NFCYVINNPLDWSYSYCLPLFIVSYGNHSEVDY

SEQ ID NO: 2534125 - protein, 21 aa, Entamoeba dispar
NFDDCLITIILDKIKQYIGDT

SEQ ID NO: 2534126 - protein, 24 aa, Entamoeba dispar
NFDEFIKKVKKLPRTSLEKSRDVL

SEQ ID NO: 2534127 - protein, 19 aa, Entamoeba dispar
NFDFKYLLERAKVLKVKDF

SEQ ID NO: 2534128 - protein, 28 aa, Entamoeba dispar
NFDGTVPIPAILKPVPKWTGKQVFTQIL

SEQ ID NO: 2534129 - protein, 17 aa, Entamoeba dispar
NFDPTLLDYNPIDIGID

SEQ ID NO: 2534130 - protein, 33 aa, Entamoeba dispar
NFDSTYCYALGYTAFILLALKKTGQICCISGLQ

SEQ ID NO: 2534131 - protein, 28 aa, Entamoeba dispar
NFDYNSLPFSIFRLIKNQLQLGKSLNNC

SEQ ID NO: 2534132 - protein, 21 aa, Entamoeba dispar
NFELFTSFILKWKYNKINEDH

SEQ ID NO: 2534133 - protein, 36 aa, Entamoeba dispar
NFELTSFLITPIQRIPRYKLLLNDLLKHTPQNHPDF

SEQ ID NO: 2534134 - protein, 18 aa, Entamoeba dispar
NFELYLVEDCGHNDIFSN

SEQ ID NO: 2534135 - protein, 27 aa, Entamoeba dispar
NFENACLPRYPIPLIEQVMVGGKSEEE

SEQ ID NO: 2534136 - protein, 22 aa, Entamoeba dispar
NFESRLLWRVYVFIADMHKKYV

SEQ ID NO: 2534137 - protein, 19 aa, Entamoeba dispar
NFFCIDKLAIGFRLSPHFL

SEQ ID NO: 2534138 - protein, 25 aa, Entamoeba dispar
NFFGLCAIIFALHKIQDFDYLKSNL

SEQ ID NO: 2534139 - protein, 17 aa, Entamoeba dispar
NFHESMMLVLSGIKDDN

SEQ ID NO: 2534140 - protein, 24 aa, Entamoeba dispar
NFHFDFFVFMTYKYKMMDSQFVQL

SEQ ID NO: 2534141 - protein, 17 aa, Entamoeba dispar
NFHYVIDEKVAITAYFI

SEQ ID NO: 2534142 - protein, 17 aa, Entamoeba dispar
NFHYVIDEKVPITSYFI

SEQ ID NO: 2534143 - protein, 29 aa, Entamoeba dispar
NFIDDDYAYSLPRCTVRPEIRIENAEKVQ

SEQ ID NO: 2534144 - protein, 19 aa, Entamoeba dispar
NFIEDLHNKILPFFKKEVE

SEQ ID NO: 2534145 - protein, 20 aa, Entamoeba dispar
NFISDIQWKPEVFGDSAIFA

SEQ ID NO: 2534146 - protein, 23 aa, Entamoeba dispar
NFKEYSWGKSQYLMTHTWHAKRC

SEQ ID NO: 2534147 - protein, 20 aa, Entamoeba dispar
NFKNLALLDLSFNDLTKSPN

SEQ ID NO: 2534148 - protein, 17 aa, Entamoeba dispar
NFKRPMPLLEIVKQSFN

SEQ ID NO: 2534149 - protein, 38 aa, Entamoeba dispar
NFKTLAFCRRYVDKIGFAKWQMPFKFLVDDGCVNPYPP

SEQ ID NO: 2534150 - protein, 31 aa, Entamoeba dispar
NFLIEVKKKVAILSPIPQLLEALKPLIKCEL

SEQ ID NO: 2534151 - protein, 20 aa, Entamoeba dispar
NFLIWQYLKEHQWNRSKHIF

SEQ ID NO: 2534152 - protein, 21 aa, Entamoeba dispar
NFLLKGMFTHEDLDIILSFCL

SEQ ID NO: 2534153 - protein, 19 aa, Entamoeba dispar
NFLQTLNDFALKVHPNTIN

SEQ ID NO: 2534154 - protein, 26 aa, Entamoeba dispar
NFMCHKHLILELSPQVNFIVGENGSG

SEQ ID NO: 2534155 - protein, 17 aa, Entamoeba dispar
NFMKIKFLAINYCNEDP

SEQ ID NO: 2534156 - protein, 18 aa, Entamoeba dispar
NFNFLFEHEYDWCDDDFE

SEQ ID NO: 2534157 - protein, 23 aa, Entamoeba dispar
NFNKFIYQFISTYNPPQNTVIAL

SEQ ID NO: 2534158 - protein, 17 aa, Entamoeba dispar
NFNKILFIPCWSVGNVG

SEQ ID NO: 2534159 - protein, 17 aa, Entamoeba dispar
NFNYLMYLNIKAGRSFN

SEQ ID NO: 2534160 - protein, 19 aa, Entamoeba dispar
NFPDFLDCFNYSLPTLMES

SEQ ID NO: 2534161 - protein, 17 aa, Entamoeba dispar
NFPFVYIVDVFADFLKK

SEQ ID NO: 2534162 - protein, 19 aa, Entamoeba dispar
NFQLALLQKFFSLSPNQCC

SEQ ID NO: 2534163 - protein, 22 aa, Entamoeba dispar
NFQQFSIQPKLFLYNQQQNSYS

SEQ ID NO: 2534164 - protein, 25 aa, Entamoeba dispar
NFQQLLTYIGFELPIPLILNTSKIY

SEQ ID NO: 2534165 - protein, 19 aa, Entamoeba dispar
NFRELNYGKTLIKFFDDVK

SEQ ID NO: 2534166 - protein, 22 aa, Entamoeba dispar
NFRLMYNTKRRFCLVPLTAEQA

SEQ ID NO: 2534167 - protein, 35 aa, Entamoeba dispar
NFSCYNELHPLLLKPSLFLLFNEAATKYSGDAKVC

SEQ ID NO: 2534168 - protein, 17 aa, Entamoeba dispar
NFSDNLLTLITIDNLKF

SEQ ID NO: 2534169 - protein, 26 aa, Entamoeba dispar
NFSEVYEYLILKEYYFACAVCLVMYK

SEQ ID NO: 2534170 - protein, 25 aa, Entamoeba dispar
NFSKSFLSLILTKVLVKYPEQVSWH

SEQ ID NO: 2534171 - protein, 36 aa, Entamoeba dispar
NFSTEILLYLCACKINYPHRFFLLRGNHESRIMSEN

SEQ ID NO: 2534172 - protein, 21 aa, Entamoeba dispar
NFTAPDFFLFAAIDGHLGSVV

SEQ ID NO: 2534173 - protein, 23 aa, Entamoeba dispar
NFTFTIDVTVPKKFKLKSGEHAT

SEQ ID NO: 2534174 - protein, 32 aa, Entamoeba dispar
NFTLQQTLCICLLSKWCRITIKKPTRRSCVTE

SEQ ID NO: 2534175 - protein, 19 aa, Entamoeba dispar
NFTSNNLHFFIGAYEFLIL

SEQ ID NO: 2534176 - protein, 21 aa, Entamoeba dispar
NFTVLIHLRYLSLSSNNLTTF

SEQ ID NO: 2534177 - protein, 36 aa, Entamoeba dispar
NFVHVLHAWFHIKILRLFTDSVLHYGLPTKYDLIVM

SEQ ID NO: 2534178 - protein, 20 aa, Entamoeba dispar
NFVSKPFYTLKVILEDHEGR

SEQ ID NO: 2534179 - protein, 24 aa, Entamoeba dispar
NFVSRLITPPSYLLGKKLKSIING

SEQ ID NO: 2534180 - protein, 27 aa, Entamoeba dispar
NFVVDAYGFYLGTYFLAKKLNYKQTSQ

SEQ ID NO: 2534181 - protein, 20 aa, Entamoeba dispar
NFYGMMKRKENTDLYSNVGL

SEQ ID NO: 2534182 - protein, 20 aa, Entamoeba dispar
NFYNGIIKIKFRCPNGKSVM

SEQ ID NO: 2534183 - protein, 20 aa, Entamoeba dispar
NGATFKVRLTPLVNIMVHVK

SEQ ID NO: 2534184 - protein, 25 aa, Entamoeba dispar
NGCDKTISWLLKKGATPMVENCMGQ

SEQ ID NO: 2534185 - protein, 21 aa, Entamoeba dispar
NGCFKNCFKLKKINIPTSIKN

SEQ ID NO: 2534186 - protein, 18 aa, Entamoeba dispar
NGCKSLKSITIPSSIRRL

SEQ ID NO: 2534187 - protein, 21 aa, Entamoeba dispar
NGCLFGFGGGYEGDICVYKEN

SEQ ID NO: 2534188 - protein, 23 aa, Entamoeba dispar
NGCRALFVQLARSILKQLLESLV

SEQ ID NO: 2534189 - protein, 24 aa, Entamoeba dispar
NGDDHFIYLNKFTENRSISHIHGY

SEQ ID NO: 2534190 - protein, 27 aa, Entamoeba dispar
NGDMVALYEYLYAGNPLIIDLAKYGAH

SEQ ID NO: 2534191 - protein, 28 aa, Entamoeba dispar
NGDMVALYEYLYAGNPLIIDLAKYGAHF

SEQ ID NO: 2534192 - protein, 27 aa, Entamoeba dispar
NGDMVALYEYLYAGNPLIIDLSKYGAH

SEQ ID NO: 2534193 - protein, 24 aa, Entamoeba dispar
NGDNISFILLKKGKYIGFISENSG

SEQ ID NO: 2534194 - protein, 35 aa, Entamoeba dispar
NGDNNNLFIVYLMRAFAHGYYRKPTFSLKAPYVVT

SEQ ID NO: 2534195 - protein, 24 aa, Entamoeba dispar
NGDRIVVIDFGGGILYVSCCKIVN

SEQ ID NO: 2534196 - protein, 26 aa, Entamoeba dispar
NGDYILYYQYFILKQTKSNQIHHLNA

SEQ ID NO: 2534197 - protein, 25 aa, Entamoeba dispar
NGECDDLLYFFTHIYHRVQDFYNEH

SEQ ID NO: 2534198 - protein, 24 aa, Entamoeba dispar
NGEIETAWIYYHKLKEIIESLDES

SEQ ID NO: 2534199 - protein, 27 aa, Entamoeba dispar
NGEKENALRLIKLRKIRESNLKKIQSQ

SEQ ID NO: 2534200 - protein, 23 aa, Entamoeba dispar
NGEKKRRILPPTPIRQKDINQRK

SEQ ID NO: 2534201 - protein, 24 aa, Entamoeba dispar
NGEKKRRILPPTPIRQKDINQRKR

SEQ ID NO: 2534202 - protein, 22 aa, Entamoeba dispar
NGELLLNGIDRKIQGYLSTQAV

SEQ ID NO: 2534203 - protein, 25 aa, Entamoeba dispar
NGERMAMFSPTFKLNYKKTIREQLK

SEQ ID NO: 2534204 - protein, 25 aa, Entamoeba dispar
NGEYSYYITNLYGAISFLLEINGNK

SEQ ID NO: 2534205 - protein, 21 aa, Entamoeba dispar
NGEYYLVKWKDYSILECSWVE

SEQ ID NO: 2534206 - protein, 18 aa, Entamoeba dispar
NGFAKINNYWISCSETSF

SEQ ID NO: 2534207 - protein, 22 aa, Entamoeba dispar
NGFGFRSPFISRLVAHEKIIDD

SEQ ID NO: 2534208 - protein, 30 aa, Entamoeba dispar
NGFITPTPSPTPDILMDPYLRGVREIPECC

SEQ ID NO: 2534209 - protein, 21 aa, Entamoeba dispar
NGFLLQYRWDKNIELVSSQFI

SEQ ID NO: 2534210 - protein, 28 aa, Entamoeba dispar
NGFLPSRLDLFFPSHPKMPNVPLSADLF

SEQ ID NO: 2534211 - protein, 17 aa, Entamoeba dispar
NGFSLIQSPLPITPVIL

SEQ ID NO: 2534212 - protein, 20 aa, Entamoeba dispar
NGFSYLLDKENIRDFGLAVN

SEQ ID NO: 2534213 - protein, 31 aa, Entamoeba dispar
NGFVLHSNALLYLLLKKGWTIQLTKTKTAKV

SEQ ID NO: 2534214 - protein, 24 aa, Entamoeba dispar
NGGDPFIFVVNKNTEWNIPYKPQA

SEQ ID NO: 2534215 - protein, 20 aa, Entamoeba dispar
NGGIFFITTRILISDLISNE

SEQ ID NO: 2534216 - protein, 24 aa, Entamoeba dispar
NGGNYISFELWNRTLRKLYDDQEA

SEQ ID NO: 2534217 - protein, 18 aa, Entamoeba dispar
NGHEAATLCRNKLKQVYG

SEQ ID NO: 2534218 - protein, 34 aa, Entamoeba dispar
NGHVFDLKKFPYEPLFNFVLPTERSYRKVTCSLD

SEQ ID NO: 2534219 - protein, 30 aa, Entamoeba dispar
NGIEFRKRFAFIDYMMFEYCKNIKDLFEKR

SEQ ID NO: 2534220 - protein, 30 aa, Entamoeba dispar
NGIELFIKKLIKVNVFNAYYDLVELPELFK

SEQ ID NO: 2534221 - protein, 19 aa, Entamoeba dispar
NGIEWFKQNLPHSNIYGFN

SEQ ID NO: 2534222 - protein, 28 aa, Entamoeba dispar
NGIEYSGCCGLLCIIEIKEKKRIIHMAN

SEQ ID NO: 2534223 - protein, 29 aa, Entamoeba dispar
NGIEYSGCCGLLCIIEIKEKKRIIHMANC

SEQ ID NO: 2534224 - protein, 25 aa, Entamoeba dispar
NGIKILSPLNSLKYLEVLRLSNVRV

SEQ ID NO: 2534225 - protein, 24 aa, Entamoeba dispar
NGIKVVWMRHEFDFIGGSLGCAEG

SEQ ID NO: 2534226 - protein, 25 aa, Entamoeba dispar
NGILHTLLYRMKNGLRMNKYFGILR

SEQ ID NO: 2534227 - protein, 24 aa, Entamoeba dispar
NGIRKLDLEYGDFPDDGYDYSQHF

SEQ ID NO: 2534228 - protein, 26 aa, Entamoeba dispar
NGKDIIKIGLPIIQLSSIDIGTIDIK

SEQ ID NO: 2534229 - protein, 22 aa, Entamoeba dispar
NGKDNLILKIGEIGNFVTMTNK

SEQ ID NO: 2534230 - protein, 22 aa, Entamoeba dispar
NGKEWCGNLIIVEFSETIESKR

SEQ ID NO: 2534231 - protein, 27 aa, Entamoeba dispar
NGKFSGKLIVLYKNNCLTLTSGILLIN

SEQ ID NO: 2534232 - protein, 17 aa, Entamoeba dispar
NGKIMNAGICQLLYHMR

SEQ ID NO: 2534233 - protein, 24 aa, Entamoeba dispar
NGKKKFGVGVTVKPKFAMDGDEIN

SEQ ID NO: 2534234 - protein, 23 aa, Entamoeba dispar
NGKLIKKLMIRYSKYNNKYDNNI

SEQ ID NO: 2534235 - protein, 19 aa, Entamoeba dispar
NGKMLLLLIETGDAFFYKL

SEQ ID NO: 2534236 - protein, 21 aa, Entamoeba dispar
NGKPFVMCLINSDPSSNKIHI

SEQ ID NO: 2534237 - protein, 25 aa, Entamoeba dispar
NGKQWQVECPMYFYRHSCDLSKQVI

SEQ ID NO: 2534238 - protein, 25 aa, Entamoeba dispar
NGKSALCNFILKKSFFKESNNPQSV

SEQ ID NO: 2534239 - protein, 26 aa, Entamoeba dispar
NGKTLLHYFEMVNWLLAKGAYVNAAD

SEQ ID NO: 2534240 - protein, 22 aa, Entamoeba dispar
NGKTYYDITLQQLFDLLGVKQF

SEQ ID NO: 2534241 - protein, 19 aa, Entamoeba dispar
NGKVWAGYIDYIIMKYGDD

SEQ ID NO: 2534242 - protein, 21 aa, Entamoeba dispar
NGLFLDMCTLVLKTLRHNKSV

SEQ ID NO: 2534243 - protein, 21 aa, Entamoeba dispar
NGLIQLQTFLKEQIIIKKKQQ

SEQ ID NO: 2534244 - protein, 25 aa, Entamoeba dispar
NGLKEHMYYMAPMPKIPGMDFGDLM

SEQ ID NO: 2534245 - protein, 55 aa, Entamoeba dispar
NGLKEYYITQFKGYPFTEWFWMIEFQDKYFGFQTIFTMKKAYSLSIRKYVQIDNQ

SEQ ID NO: 2534246 - protein, 23 aa, Entamoeba dispar
NGLKKYIRLMLSLDFSCHQYYLF

SEQ ID NO: 2534247 - protein, 21 aa, Entamoeba dispar
NGLKVMLFSGINKYSTYLIYS

SEQ ID NO: 2534248 - protein, 26 aa, Entamoeba dispar
NGLLRLHTLLQWIKETLQLIKDNKCC

SEQ ID NO: 2534249 - protein, 17 aa, Entamoeba dispar
NGLLVFGYCTCKDTELL

SEQ ID NO: 2534250 - protein, 24 aa, Entamoeba dispar
NGLPVTVRLLDPPLHEFLPTLEEL

SEQ ID NO: 2534251 - protein, 20 aa, Entamoeba dispar
NGLRYILIECWGAISNKIEV

SEQ ID NO: 2534252 - protein, 29 aa, Entamoeba dispar
NGLSRFVVCGTAFVWHQVRYMVGALFAIG

SEQ ID NO: 2534253 - protein, 29 aa, Entamoeba dispar
NGNHPIIVHTPFRMTGTFDGVMSFDHNRF

SEQ ID NO: 2534254 - protein, 17 aa, Entamoeba dispar
NGNIMGLYFQKKIPRCE

SEQ ID NO: 2534255 - protein, 21 aa, Entamoeba dispar
NGNIRIVVSPTLILIHEKEHH

SEQ ID NO: 2534256 - protein, 17 aa, Entamoeba dispar
NGNLLNFYKYDSGIEII

SEQ ID NO: 2534257 - protein, 20 aa, Entamoeba dispar
NGNLRVYWGTSPFINCEEGG

SEQ ID NO: 2534258 - protein, 21 aa, Entamoeba dispar
NGNNWYQIISINPRVEENQYQ

SEQ ID NO: 2534259 - protein, 24 aa, Entamoeba dispar
NGNSAICFATFRRDLRSNSIGKNK

SEQ ID NO: 2534260 - protein, 20 aa, Entamoeba dispar
NGNYDEILSWYKKALFEKDE

SEQ ID NO: 2534261 - protein, 29 aa, Entamoeba dispar
NGPIVTQIRALLLPQPMKDLRVKTPYIVQ

SEQ ID NO: 2534262 - protein, 26 aa, Entamoeba dispar
NGPVNVLIGFRSLKGIMQCDNCMGAI

SEQ ID NO: 2534263 - protein, 26 aa, Entamoeba dispar
NGQDFSSFFTNNQQPFGFGTTNNLSF

SEQ ID NO: 2534264 - protein, 18 aa, Entamoeba dispar
NGQIMVTRSIGDRSLHPP

SEQ ID NO: 2534265 - protein, 21 aa, Entamoeba dispar
NGQVNLISRFLLVFDISQSHV

SEQ ID NO: 2534266 - protein, 18 aa, Entamoeba dispar
NGQYVLPSLLNLLTNYIN

SEQ ID NO: 2534267 - protein, 27 aa, Entamoeba dispar
NGRNDLMFYKIALDQLSLILFPGSSKQ

SEQ ID NO: 2534268 - protein, 29 aa, Entamoeba dispar
NGRSNLTFVILTSDKWVFGCFSQARIPKI

SEQ ID NO: 2534269 - protein, 32 aa, Entamoeba dispar
NGRTASISGLWISILLVMKTGGDVFFCTDGMQ

SEQ ID NO: 2534270 - protein, 19 aa, Entamoeba dispar
NGSEFLSYPTILGSLPNIT

SEQ ID NO: 2534271 - protein, 27 aa, Entamoeba dispar
NGSFCNLPLLEHLTFIDSPGVLSGEKQ

SEQ ID NO: 2534272 - protein, 23 aa, Entamoeba dispar
NGSFDIFIRSKDSTWTALLGTSA

SEQ ID NO: 2534273 - protein, 18 aa, Entamoeba dispar
NGSFDIFIRSKDSTWTAV

SEQ ID NO: 2534274 - protein, 20 aa, Entamoeba dispar
NGSILILNALFARYIPLIVN

SEQ ID NO: 2534275 - protein, 26 aa, Entamoeba dispar
NGSKKAFGFVFHSLTIEGKWLDDEKM

SEQ ID NO: 2534276 - protein, 25 aa, Entamoeba dispar
NGSSSIIYWNPSLAPVVTLKTAHSE

SEQ ID NO: 2534277 - protein, 29 aa, Entamoeba dispar
NGSTISPINYPTLIIDLPTNTEESSWSEL

SEQ ID NO: 2534278 - protein, 26 aa, Entamoeba dispar
NGTEIRFNLPQWQKFPIFAKIRESQI

SEQ ID NO: 2534279 - protein, 21 aa, Entamoeba dispar
NGTLIFDTPLHAFCWKEMAKR

SEQ ID NO: 2534280 - protein, 33 aa, Entamoeba dispar
NGTSNPNQLFALRALFLCFFYIINEVSDEFRQT

SEQ ID NO: 2534281 - protein, 19 aa, Entamoeba dispar
NGVFKYLYDRGMSYHYNQT

SEQ ID NO: 2534282 - protein, 24 aa, Entamoeba dispar
NGVNSAYFFLFNDVLIETQVIKHH

SEQ ID NO: 2534283 - protein, 26 aa, Entamoeba dispar
NGVTKLPFYLSTFPKWKAKDLHTIFH

SEQ ID NO: 2534284 - protein, 27 aa, Entamoeba dispar
NGYIQTKWMNELYLNKLRSFGYKIGIL

SEQ ID NO: 2534285 - protein, 25 aa, Entamoeba dispar
NHCIGLTSIPLIYKLSVGLFEYCES

SEQ ID NO: 2534286 - protein, 25 aa, Entamoeba dispar
NHEEGKLKIYLYPNEPFNSKDESDA

SEQ ID NO: 2534287 - protein, 27 aa, Entamoeba dispar
NHEEGKLKIYLYPNKPFNPKDENDAIA

SEQ ID NO: 2534288 - protein, 26 aa, Entamoeba dispar
NHEEYSFYCLWILQSIVQNNPIGQHG

SEQ ID NO: 2534289 - protein, 26 aa, Entamoeba dispar
NHEKGKLKIYLYPNEPFNPKDENDAI

SEQ ID NO: 2534290 - protein, 26 aa, Entamoeba dispar
NHEKGKLKIYLYPNERFNTIDESEAI

SEQ ID NO: 2534291 - protein, 24 aa, Entamoeba dispar
NHELKRYLTFIKFNPWTYCGDMLF

SEQ ID NO: 2534292 - protein, 26 aa, Entamoeba dispar
NHETGKLKIYLYPNEPFNPKDESDAI

SEQ ID NO: 2534293 - protein, 33 aa, Entamoeba dispar
NHFVKNLNIGMIGTPYISPIIELESGDEIILCS

SEQ ID NO: 2534294 - protein, 18 aa, Entamoeba dispar
NHGIYYCKVHFQQMFKEK

SEQ ID NO: 2534295 - protein, 21 aa, Entamoeba dispar
NHGLIAYIQFATDHGVTRVLE

SEQ ID NO: 2534296 - protein, 25 aa, Entamoeba dispar
NHILLIRLCECIEYLTWDSSIKFII

SEQ ID NO: 2534297 - protein, 17 aa, Entamoeba dispar
NHILSQTYCQYEFTKQA

SEQ ID NO: 2534298 - protein, 29 aa, Entamoeba dispar
NHKFDIYADSLPRWVVTAAPLNQSTVLAS

SEQ ID NO: 2534299 - protein, 25 aa, Entamoeba dispar
NHLARAVLIIGAPYLQSSPIPIKER

SEQ ID NO: 2534300 - protein, 27 aa, Entamoeba dispar
NHLDEIIKLWRVSLLQHQIVLNDECLE

SEQ ID NO: 2534301 - protein, 21 aa, Entamoeba dispar
NHLEDFFLPEQSSMVYAESKF

SEQ ID NO: 2534302 - protein, 30 aa, Entamoeba dispar
NHLSNLYLHSIILILIKPFLSPNDFKTKQT

SEQ ID NO: 2534303 - protein, 28 aa, Entamoeba dispar
NHNDAYIYDDLKYIYVWVGKKCNDFKKA

SEQ ID NO: 2534304 - protein, 19 aa, Entamoeba dispar
NHNIPWKERLQIAISIAKG

SEQ ID NO: 2534305 - protein, 28 aa, Entamoeba dispar
NHPEDVQLLKLLRLLSSNEIKRIETRSK

SEQ ID NO: 2534306 - protein, 20 aa, Entamoeba dispar
NHPNFLALKGIVLTPLALLV

SEQ ID NO: 2534307 - protein, 49 aa, Entamoeba dispar
NHPNILKLFGFFEDENRWFLVLEYCKKGELYGLLQKAGRFDEKRAARYI

SEQ ID NO: 2534308 - protein, 24 aa, Entamoeba dispar
NHTILQKICLYLTENDIKNLKATN

SEQ ID NO: 2534309 - protein, 25 aa, Entamoeba dispar
NHTKGLIKLIPKLQKLLQSSSTCTK

SEQ ID NO: 2534310 - protein, 18 aa, Entamoeba dispar
NHTSFFPKDVINHAKKII

SEQ ID NO: 2534311 - protein, 31 aa, Entamoeba dispar
NHVQPGVEKYIYPPAIPKLKGNWLVDKEKSG

SEQ ID NO: 2534312 - protein, 30 aa, Entamoeba dispar
NHVWTVTLTIPPRSTRWWYSVTRANQIIRV

SEQ ID NO: 2534313 - protein, 26 aa, Entamoeba dispar
NIAMGKLVLGIYLMGKKIIPKHSTIP

SEQ ID NO: 2534314 - protein, 18 aa, Entamoeba dispar
NIANVMYFIYPDVPKIVK

SEQ ID NO: 2534315 - protein, 25 aa, Entamoeba dispar
NIAPDYWLIANQIMLTTLKSVEDKD

SEQ ID NO: 2534316 - protein, 18 aa, Entamoeba dispar
NIASFVRQLNIYGFHKLD

SEQ ID NO: 2534317 - protein, 17 aa, Entamoeba dispar
NICFFNFDENENIFGVF

SEQ ID NO: 2534318 - protein, 17 aa, Entamoeba dispar
NICKAIQILHTREFVHN

SEQ ID NO: 2534319 - protein, 19 aa, Entamoeba dispar
NICLLFKQIAKHDIDISSI

SEQ ID NO: 2534320 - protein, 26 aa, Entamoeba dispar
NICNTFGRGHPRFRKPRIGGDGVYEF

SEQ ID NO: 2534321 - protein, 25 aa, Entamoeba dispar
NIDELWTLLNFINPENFPSLENFHE

SEQ ID NO: 2534322 - protein, 17 aa, Entamoeba dispar
NIDFEIYGNKKLLEVID

SEQ ID NO: 2534323 - protein, 18 aa, Entamoeba dispar
NIDKLFSIAFQSLDMMIQ

SEQ ID NO: 2534324 - protein, 19 aa, Entamoeba dispar
NIDLLPNDCYIILHQLDFS

SEQ ID NO: 2534325 - protein, 22 aa, Entamoeba dispar
NIDQLIHNYLPFNMQLKYSKEC

SEQ ID NO: 2534326 - protein, 31 aa, Entamoeba dispar
NIDRLSLNRLLYYVNDWWLRDGIAAAWNVLL

SEQ ID NO: 2534327 - protein, 20 aa, Entamoeba dispar
NIDYLLAFLTYLNQNQKEVI

SEQ ID NO: 2534328 - protein, 17 aa, Entamoeba dispar
NIEALYNLSYCLLHGEG

SEQ ID NO: 2534329 - protein, 27 aa, Entamoeba dispar
NIEDKPIFIDLSWRLDIVLSYKNVYKL

SEQ ID NO: 2534330 - protein, 24 aa, Entamoeba dispar
NIEDLETLIYVFTRLSGHCELAET

SEQ ID NO: 2534331 - protein, 20 aa, Entamoeba dispar
NIEELWLPEVAFYDEGAYLG

SEQ ID NO: 2534332 - protein, 23 aa, Entamoeba dispar
NIEFNFAYPLLYKEYDEKMSFQI

SEQ ID NO: 2534333 - protein, 27 aa, Entamoeba dispar
NIEGVLTHQWLCGASVYSNPYFANLLK

SEQ ID NO: 2534334 - protein, 23 aa, Entamoeba dispar
NIEKAFMTLTELVLRDVSSGKIS

SEQ ID NO: 2534335 - protein, 24 aa, Entamoeba dispar
NIELLIDILNIYIIHFIRDNSEIT

SEQ ID NO: 2534336 - protein, 19 aa, Entamoeba dispar
NIELLIKFITGSESLALFD

SEQ ID NO: 2534337 - protein, 24 aa, Entamoeba dispar
NIELSPAIQKKYPKLAKPNQPLGS

SEQ ID NO: 2534338 - protein, 26 aa, Entamoeba dispar
NIEMMNTVLFEWVEVLQQILDTPVQP

SEQ ID NO: 2534339 - protein, 19 aa, Entamoeba dispar
NIENIYYIQGLNTFYQLIP

SEQ ID NO: 2534340 - protein, 24 aa, Entamoeba dispar
NIENKLIEHLYKGIQKDRVKQEEK

SEQ ID NO: 2534341 - protein, 28 aa, Entamoeba dispar
NIENSCLFSHFSIDEIYGWQSFVSKKEY

SEQ ID NO: 2534342 - protein, 24 aa, Entamoeba dispar
NIERFHFNPIPLDEYSRKLFTNIE

SEQ ID NO: 2534343 - protein, 21 aa, Entamoeba dispar
NIERFHFNPIPLNEHSRKLFS

SEQ ID NO: 2534344 - protein, 25 aa, Entamoeba dispar
NIERFHFNPIPLNEYSRKLFANIET

SEQ ID NO: 2534345 - protein, 25 aa, Entamoeba dispar
NIERFHFNPIPLNEYSRKLFPNIET

SEQ ID NO: 2534346 - protein, 26 aa, Entamoeba dispar
NIERFHFNPIPLNEYSRKLFPNIETF

SEQ ID NO: 2534347 - protein, 24 aa, Entamoeba dispar
NIERFHFNPIPLNEYSRKLFTNIE

SEQ ID NO: 2534348 - protein, 26 aa, Entamoeba dispar
NIERFHFNPIPLNKYSRKLFTNIETF

SEQ ID NO: 2534349 - protein, 27 aa, Entamoeba dispar
NIERFHFNPIPLNKYSRKLFTNIETFH

SEQ ID NO: 2534350 - protein, 27 aa, Entamoeba dispar
NIERFHFNPIPLNQYSRKFFPNIETFH

SEQ ID NO: 2534351 - protein, 17 aa, Entamoeba dispar
NIESLLKIIPYLSHYRE

SEQ ID NO: 2534352 - protein, 27 aa, Entamoeba dispar
NIETPLSNPFSLNGFSFGISTDKQKDT

SEQ ID NO: 2534353 - protein, 24 aa, Entamoeba dispar
NIEVQNYLINKIMKEIKGERISEE

SEQ ID NO: 2534354 - protein, 17 aa, Entamoeba dispar
NIFAPKYGFNGSHSEFF

SEQ ID NO: 2534355 - protein, 17 aa, Entamoeba dispar
NIFCWYGNNSSVGKKGV

SEQ ID NO: 2534356 - protein, 18 aa, Entamoeba dispar
NIFFGPIKEKFGGKLQII

SEQ ID NO: 2534357 - protein, 17 aa, Entamoeba dispar
NIFGFHVSVAPSQKNLA

SEQ ID NO: 2534358 - protein, 19 aa, Entamoeba dispar
NIFGSYHTIIPPKPSQWVI

SEQ ID NO: 2534359 - protein, 26 aa, Entamoeba dispar
NIFKQTIINFLLPEVSSFKIILQLFS

SEQ ID NO: 2534360 - protein, 23 aa, Entamoeba dispar
NIFLIEPLLKERFTYWNKNDGKV

SEQ ID NO: 2534361 - protein, 21 aa, Entamoeba dispar
NIFNEIKRLLKKKYVTTISSI

SEQ ID NO: 2534362 - protein, 19 aa, Entamoeba dispar
NIFSIKTGVIVGSLFHHTA

SEQ ID NO: 2534363 - protein, 18 aa, Entamoeba dispar
NIFSISWKTPISLDLSLP

SEQ ID NO: 2534364 - protein, 19 aa, Entamoeba dispar
NIFYIANIGDCRCLLIGDD

SEQ ID NO: 2534365 - protein, 18 aa, Entamoeba dispar
NIGDCRCLLIGDDYFLPL

SEQ ID NO: 2534366 - protein, 22 aa, Entamoeba dispar
NIGINIWLQLFTQIINRVRLTK

SEQ ID NO: 2534367 - protein, 24 aa, Entamoeba dispar
NIGYNSFTAPLLMIGNSLLTIKSA

SEQ ID NO: 2534368 - protein, 23 aa, Entamoeba dispar
NIHGMPLACAVGLGPQRLTSIMP

SEQ ID NO: 2534369 - protein, 19 aa, Entamoeba dispar
NIHIEGCIKTFFSSTKILD

SEQ ID NO: 2534370 - protein, 23 aa, Entamoeba dispar
NIHIHSLFFNKLVKILLTCTNEL

SEQ ID NO: 2534371 - protein, 38 aa, Entamoeba dispar
NIHKYRMRGANKHLFIAYYTLFVKPVFEIYQKTSKSRD

SEQ ID NO: 2534372 - protein, 39 aa, Entamoeba dispar
NIHKYRMRGANKHLFIAYYTLFVKPVFEIYQKTSKSRDI

SEQ ID NO: 2534373 - protein, 21 aa, Entamoeba dispar
NIHLKLLSKIDKPLLLTFNSK

SEQ ID NO: 2534374 - protein, 19 aa, Entamoeba dispar
NIHYIHFKTKYKQLSLEST

SEQ ID NO: 2534375 - protein, 23 aa, Entamoeba dispar
NIIEKEIEFGYYLEAGICEIQAV

SEQ ID NO: 2534376 - protein, 32 aa, Entamoeba dispar
NIIIKQNRWYPKFSIYPVNEITIFFNYAQIDV

SEQ ID NO: 2534377 - protein, 17 aa, Entamoeba dispar
NIIIRGFSSFRLLTIKT

SEQ ID NO: 2534378 - protein, 19 aa, Entamoeba dispar
NIIITPLFTNFKVYCSESN

SEQ ID NO: 2534379 - protein, 24 aa, Entamoeba dispar
NIIKNNLVILKLFDWKLCHFIQKE

SEQ ID NO: 2534380 - protein, 20 aa, Entamoeba dispar
NIILLHEWLSYIQQIQFTME

SEQ ID NO: 2534381 - protein, 23 aa, Entamoeba dispar
NIINYFHIELHATSLDDLVEEEI

SEQ ID NO: 2534382 - protein, 18 aa, Entamoeba dispar
NIIRSIGIIILDDLQRVG

SEQ ID NO: 2534383 - protein, 33 aa, Entamoeba dispar
NIISTNETFWLMYKLIELLSRYVIILLDEENPI

SEQ ID NO: 2534384 - protein, 20 aa, Entamoeba dispar
NIITMEAVIRGFLIRRELSI

SEQ ID NO: 2534385 - protein, 18 aa, Entamoeba dispar
NIITVPITISKIGNYCFY

SEQ ID NO: 2534386 - protein, 21 aa, Entamoeba dispar
NIIYLTPGVLLQQLMRREGRR

SEQ ID NO: 2534387 - protein, 17 aa, Entamoeba dispar
NIKDLNIQFLRNQIGLV

SEQ ID NO: 2534388 - protein, 21 aa, Entamoeba dispar
NIKDLNIQFLRNQIGLVGQEP

SEQ ID NO: 2534389 - protein, 28 aa, Entamoeba dispar
NIKEVRELFRTYGTLRGVRLPKKVDGQN

SEQ ID NO: 2534390 - protein, 18 aa, Entamoeba dispar
NIKIIQSLYLPLNLSFHG

SEQ ID NO: 2534391 - protein, 20 aa, Entamoeba dispar
NIKIKYVSPKINKVITQLPL

SEQ ID NO: 2534392 - protein, 30 aa, Entamoeba dispar
NIKINNFIIPIELQEFYLKSEWKFADDLRL

SEQ ID NO: 2534393 - protein, 25 aa, Entamoeba dispar
NIKKNILPKYFQYFNSYISDVKCVD

SEQ ID NO: 2534394 - protein, 23 aa, Entamoeba dispar
NIKKPIIHNGIKLVLQGIFECQS

SEQ ID NO: 2534395 - protein, 19 aa, Entamoeba dispar
NIKLPLISTSLQQPIPLTT

SEQ ID NO: 2534396 - protein, 24 aa, Entamoeba dispar
NIKLPPHKNYLYYSSLHDIIMKNP

SEQ ID NO: 2534397 - protein, 25 aa, Entamoeba dispar
NIKNLSSCFLYLNDDMLLGKELKPE

SEQ ID NO: 2534398 - protein, 26 aa, Entamoeba dispar
NIKNLSSCFLYLNDDMLLGKKLDIKH

SEQ ID NO: 2534399 - protein, 26 aa, Entamoeba dispar
NIKPIYISSPLFDLISPMKLINSKVL

SEQ ID NO: 2534400 - protein, 20 aa, Entamoeba dispar
NIKPSKKLIPLINAFQATHK

SEQ ID NO: 2534401 - protein, 18 aa, Entamoeba dispar
NIKPTSLYVTKALEVKIF

SEQ ID NO: 2534402 - protein, 25 aa, Entamoeba dispar
NIKPYIIIHIITQINSFDLIIQENQ

SEQ ID NO: 2534403 - protein, 17 aa, Entamoeba dispar
NIKRIIYNNKINKGIIG

SEQ ID NO: 2534404 - protein, 17 aa, Entamoeba dispar
NIKSILLEIIRTDRHLG

SEQ ID NO: 2534405 - protein, 25 aa, Entamoeba dispar
NIKTGLTPFYFKEFVETLIGKSIGK

SEQ ID NO: 2534406 - protein, 17 aa, Entamoeba dispar
NIKTIEIQYLRRNKRIT

SEQ ID NO: 2534407 - protein, 18 aa, Entamoeba dispar
NIKYILPSSLKELKILNF

SEQ ID NO: 2534408 - protein, 17 aa, Entamoeba dispar
NILFEKYKILRKEFLQK

SEQ ID NO: 2534409 - protein, 21 aa, Entamoeba dispar
NILGTFVYKCECCKAILCGEC

SEQ ID NO: 2534410 - protein, 20 aa, Entamoeba dispar
NILKPMLSRGELRCIGATTI

SEQ ID NO: 2534411 - protein, 20 aa, Entamoeba dispar
NILLDLPVFCEDTTEPYFRA

SEQ ID NO: 2534412 - protein, 25 aa, Entamoeba dispar
NILRLLEIYMKIYKQFKLEWSELTK

SEQ ID NO: 2534413 - protein, 21 aa, Entamoeba dispar
NILSKARLFILKDLKDVKKGS

SEQ ID NO: 2534414 - protein, 25 aa, Entamoeba dispar
NILSPSCLCRILLKTLGITSFENKY

SEQ ID NO: 2534415 - protein, 18 aa, Entamoeba dispar
NIMFSLKLNIELIELINK

SEQ ID NO: 2534416 - protein, 18 aa, Entamoeba dispar
NINCGQALDFRLISLYVK

SEQ ID NO: 2534417 - protein, 25 aa, Entamoeba dispar
NINHLFDIIVREWISFHPEENNASC

SEQ ID NO: 2534418 - protein, 20 aa, Entamoeba dispar
NINIISNDSFVDGKAFLALL

SEQ ID NO: 2534419 - protein, 17 aa, Entamoeba dispar
NINIRYIPISGLSGENL

SEQ ID NO: 2534420 - protein, 34 aa, Entamoeba dispar
NINIYYEFCESFNYLPLGVIIKRKIGKFFCCHGG

SEQ ID NO: 2534421 - protein, 25 aa, Entamoeba dispar
NINKINIILGLSLIKELYAPFKNET

SEQ ID NO: 2534422 - protein, 23 aa, Entamoeba dispar
NINKLKQLILSDPIEKLFGSIFT

SEQ ID NO: 2534423 - protein, 19 aa, Entamoeba dispar
NINNIFLRMDIRTELICLG

SEQ ID NO: 2534424 - protein, 26 aa, Entamoeba dispar
NINPEPYIIGIGFFINMISLVLEQDD

SEQ ID NO: 2534425 - protein, 21 aa, Entamoeba dispar
NINQLLPFNTNHIKSFELEPI

SEQ ID NO: 2534426 - protein, 20 aa, Entamoeba dispar
NINRSLVVFGRVIHGLVQAS

SEQ ID NO: 2534427 - protein, 18 aa, Entamoeba dispar
NINSIFPIIKCTTIKSLS

SEQ ID NO: 2534428 - protein, 20 aa, Entamoeba dispar
NINSIPHKITKVTRLSTGRV

SEQ ID NO: 2534429 - protein, 33 aa, Entamoeba dispar
NINTIQGPFNLRYLRRIIIYLNNTSTSLKTIKT

SEQ ID NO: 2534430 - protein, 21 aa, Entamoeba dispar
NINYLAWKYSFEKRGIYLTKE

SEQ ID NO: 2534431 - protein, 28 aa, Entamoeba dispar
NIPDDEIIFILNTKPFLEIKLINKLFEV

SEQ ID NO: 2534432 - protein, 32 aa, Entamoeba dispar
NIPESLALHLFRFRHYYLHHYFNKIGFFVLKS

SEQ ID NO: 2534433 - protein, 18 aa, Entamoeba dispar
NIPIDFIYSLTSLTKINI

SEQ ID NO: 2534434 - protein, 26 aa, Entamoeba dispar
NIPIDNPCILLMQDTSKTFLTATRAE

SEQ ID NO: 2534435 - protein, 22 aa, Entamoeba dispar
NIPKDFIVYTSSNDLQIYLNQC

SEQ ID NO: 2534436 - protein, 28 aa, Entamoeba dispar
NIPKEILKILKKVKWLELKKQLLVLNVK

SEQ ID NO: 2534437 - protein, 28 aa, Entamoeba dispar
NIPNTWYINNQLIYVPIPDSIQDFKHDS

SEQ ID NO: 2534438 - protein, 19 aa, Entamoeba dispar
NIPPTVSKIGYYCFYGCSS

SEQ ID NO: 2534439 - protein, 17 aa, Entamoeba dispar
NIPPYLPKLSSMFDTSN

SEQ ID NO: 2534440 - protein, 20 aa, Entamoeba dispar
NIPSSISKIGWNCFYKCSSL

SEQ ID NO: 2534441 - protein, 25 aa, Entamoeba dispar
NIPTSVSKLGYWCFYGCTSLKSINI

SEQ ID NO: 2534442 - protein, 18 aa, Entamoeba dispar
NIQCLSLPSIKQLNQLEF

SEQ ID NO: 2534443 - protein, 31 aa, Entamoeba dispar
NIQDAFIKAAPFFLYMREFIGNNSHALKIVN

SEQ ID NO: 2534444 - protein, 22 aa, Entamoeba dispar
NIQFISEERIFINEPVLLSMET

SEQ ID NO: 2534445 - protein, 24 aa, Entamoeba dispar
NIQIICKIMISGGFMRTFGIDLFI

SEQ ID NO: 2534446 - protein, 27 aa, Entamoeba dispar
NIQIKLNSMIYLSLNKYFTQLIKSINN

SEQ ID NO: 2534447 - protein, 18 aa, Entamoeba dispar
NIQILLNVYCDNLKYIVK

SEQ ID NO: 2534448 - protein, 21 aa, Entamoeba dispar
NIQIPFPETEKLKLYFRCFKT

SEQ ID NO: 2534449 - protein, 20 aa, Entamoeba dispar
NIQLLYNKTTIDLPGPIMYY

SEQ ID NO: 2534450 - protein, 32 aa, Entamoeba dispar
NIQMPPSLLSRFDLIYLILDQPNPERDRKLAR

SEQ ID NO: 2534451 - protein, 17 aa, Entamoeba dispar
NIQNMTERFNWIGDTIV

SEQ ID NO: 2534452 - protein, 18 aa, Entamoeba dispar
NIQQAILLRKKYLNFSDG

SEQ ID NO: 2534453 - protein, 30 aa, Entamoeba dispar
NIQQLYQKILYSPVIFPTTSPVSAVCKDFI

SEQ ID NO: 2534454 - protein, 22 aa, Entamoeba dispar
NIQRKLVPAINDSNTFIKDSKD

SEQ ID NO: 2534455 - protein, 22 aa, Entamoeba dispar
NIQRLYHNILYNQLTFSEQTEI

SEQ ID NO: 2534456 - protein, 21 aa, Entamoeba dispar
NIQTYRCFINFLIDAKTNCHF

SEQ ID NO: 2534457 - protein, 26 aa, Entamoeba dispar
NIREKRILYRTLIEPKFKDIKNASLQ

SEQ ID NO: 2534458 - protein, 28 aa, Entamoeba dispar
NIREPKYREIFLLMYRLYTSPECVINYL

SEQ ID NO: 2534459 - protein, 32 aa, Entamoeba dispar
NIRHQLLSNNITWINKALFFHPEHHHWLKINF

SEQ ID NO: 2534460 - protein, 25 aa, Entamoeba dispar
NIRIVEMVFLLMDILTELGYLFDTS

SEQ ID NO: 2534461 - protein, 17 aa, Entamoeba dispar
NIRNQIIQYFRVIVKKY

SEQ ID NO: 2534462 - protein, 25 aa, Entamoeba dispar
NIRTRVNLFRNWMDKTSLKENIQNT

SEQ ID NO: 2534463 - protein, 17 aa, Entamoeba dispar
NIRYIPISGLSGENLIK

SEQ ID NO: 2534464 - protein, 26 aa, Entamoeba dispar
NISDLYHIETQLLHLIYKGKNLKNDK

SEQ ID NO: 2534465 - protein, 18 aa, Entamoeba dispar
NISILLNNIHLANTLSLV

SEQ ID NO: 2534466 - protein, 19 aa, Entamoeba dispar
NISKLFGNVLKFSPPTGEL

SEQ ID NO: 2534467 - protein, 23 aa, Entamoeba dispar
NISKLLNYPVGSIALCLEPLLSS

SEQ ID NO: 2534468 - protein, 20 aa, Entamoeba dispar
NISLFIHSIVLWKVSNTDSD

SEQ ID NO: 2534469 - protein, 23 aa, Entamoeba dispar
NISSFIKQFIYLTFTTDDIDDNL

SEQ ID NO: 2534470 - protein, 29 aa, Entamoeba dispar
NISSGINWLFKTFPNINTIQGPFNLRYLR

SEQ ID NO: 2534471 - protein, 24 aa, Entamoeba dispar
NISTRLLYYYYSNQLSLSYIEICK

SEQ ID NO: 2534472 - protein, 22 aa, Entamoeba dispar
NISYICSRYYRAPELIFGATRY

SEQ ID NO: 2534473 - protein, 25 aa, Entamoeba dispar
NISYLRINLLVRPVPPKFSKKPTKV

SEQ ID NO: 2534474 - protein, 22 aa, Entamoeba dispar
NITADYLIDFFTYGIPAEIRCS

SEQ ID NO: 2534475 - protein, 26 aa, Entamoeba dispar
NITFESVLHYFSFFGKVRAITQDGND

SEQ ID NO: 2534476 - protein, 18 aa, Entamoeba dispar
NITIYPPLIFDNSDLDPS

SEQ ID NO: 2534477 - protein, 22 aa, Entamoeba dispar
NITLKMKKIKHLKYRSVNWDSE

SEQ ID NO: 2534478 - protein, 20 aa, Entamoeba dispar
NITNLFDLSLPRKTMLLLKE

SEQ ID NO: 2534479 - protein, 20 aa, Entamoeba dispar
NITNLLLFNSPEVTIPHLMD

SEQ ID NO: 2534480 - protein, 35 aa, Entamoeba dispar
NITNTLYSFRWVTLLFAQEFPIESVLLVWDCILVD

SEQ ID NO: 2534481 - protein, 23 aa, Entamoeba dispar
NITQCGIGLFVSEKGRGCITDTL

SEQ ID NO: 2534482 - protein, 25 aa, Entamoeba dispar
NITSEGLFLRFFNSNIRGLCHCSKI

SEQ ID NO: 2534483 - protein, 29 aa, Entamoeba dispar
NITTEILILHQIIIQHIKNVPIKGSELLK

SEQ ID NO: 2534484 - protein, 26 aa, Entamoeba dispar
NITTKPVQYLFFTSKIPSLIELVIPW

SEQ ID NO: 2534485 - protein, 19 aa, Entamoeba dispar
NITWKCRSIGAYYGEPSYS

SEQ ID NO: 2534486 - protein, 33 aa, Entamoeba dispar
NIVDGNLTLILGLLWTLILKYQIAQNKMDASKN

SEQ ID NO: 2534487 - protein, 20 aa, Entamoeba dispar
NIVEGMVLDQGFLSRYFTTD

SEQ ID NO: 2534488 - protein, 19 aa, Entamoeba dispar
NIVFYGSLFNFRKPAHLDV

SEQ ID NO: 2534489 - protein, 17 aa, Entamoeba dispar
NIVKMKGVFKTNQYLYI

SEQ ID NO: 2534490 - protein, 32 aa, Entamoeba dispar
NIVKSIPISSILGILFLQIKILANMINYHFSS

SEQ ID NO: 2534491 - protein, 29 aa, Entamoeba dispar
NIVKYVECYLINDMLWLVTELMDAGELTN

SEQ ID NO: 2534492 - protein, 18 aa, Entamoeba dispar
NIVKYYQSFSGIFNKYII

SEQ ID NO: 2534493 - protein, 17 aa, Entamoeba dispar
NIVLLIDLNCPVLEYVI

SEQ ID NO: 2534494 - protein, 21 aa, Entamoeba dispar
NIVNRLYYNGLLQNAPNVYNQ

SEQ ID NO: 2534495 - protein, 22 aa, Entamoeba dispar
NIVNRLYYNGLLQNAPNVYNQL

SEQ ID NO: 2534496 - protein, 20 aa, Entamoeba dispar
NIWSEFFDIPVGALSRKSNF

SEQ ID NO: 2534497 - protein, 21 aa, Entamoeba dispar
NIYDTSYWVLPPSGPDAWHGF

SEQ ID NO: 2534498 - protein, 22 aa, Entamoeba dispar
NIYEILYIFNTPEKVQHETFIS

SEQ ID NO: 2534499 - protein, 20 aa, Entamoeba dispar
NIYKLLCELVGDISITIQKE

SEQ ID NO: 2534500 - protein, 19 aa, Entamoeba dispar
NIYLATKLELFVYSIEGKE

SEQ ID NO: 2534501 - protein, 26 aa, Entamoeba dispar
NIYNDKVLTHHLLLTKKPTSVCEIDN

SEQ ID NO: 2534502 - protein, 27 aa, Entamoeba dispar
NIYTVEPGIYFIPFLLESGFKNEQVKK

SEQ ID NO: 2534503 - protein, 17 aa, Entamoeba dispar
NIYVLLRIEINIASNKA

SEQ ID NO: 2534504 - protein, 31 aa, Entamoeba dispar
NIYYEFCESFNYLPLGVIIKRKIGKFFCCHG

SEQ ID NO: 2534505 - protein, 32 aa, Entamoeba dispar
NKAFFDEKFHLMITNVLRTPPGYRCVFSQSGK

SEQ ID NO: 2534506 - protein, 20 aa, Entamoeba dispar
NKALLNRLMKLCYRISLNHD

SEQ ID NO: 2534507 - protein, 28 aa, Entamoeba dispar
NKAMVQWCGLLLNRIVLEQLENIWQMKP

SEQ ID NO: 2534508 - protein, 17 aa, Entamoeba dispar
NKASLSLKTLFGISSSD

SEQ ID NO: 2534509 - protein, 17 aa, Entamoeba dispar
NKASLSLKTMFGISISD

SEQ ID NO: 2534510 - protein, 35 aa, Entamoeba dispar
NKATQMLLPFYRFKSQYLLLLKVYIDSVQSFDKNP

SEQ ID NO: 2534511 - protein, 20 aa, Entamoeba dispar
NKCELRKMSVNKTTWRMVFK

SEQ ID NO: 2534512 - protein, 22 aa, Entamoeba dispar
NKCGQIPLYLLVRGDTEKELNR

SEQ ID NO: 2534513 - protein, 25 aa, Entamoeba dispar
NKCKYTIWKILRSYKPFLNSWINST

SEQ ID NO: 2534514 - protein, 17 aa, Entamoeba dispar
NKCLNPDAPKRASAEEL

SEQ ID NO: 2534515 - protein, 25 aa, Entamoeba dispar
NKDCFNFEENAFGYVSLNNQSDDEN

SEQ ID NO: 2534516 - protein, 22 aa, Entamoeba dispar
NKDILIIIETYLQFLCLTCKND

SEQ ID NO: 2534517 - protein, 29 aa, Entamoeba dispar
NKDILKELIYILPPPNLYRGKKIDILQLL

SEQ ID NO: 2534518 - protein, 27 aa, Entamoeba dispar
NKDKDMKFYIYFVRAKNIIANDLGGTS

SEQ ID NO: 2534519 - protein, 25 aa, Entamoeba dispar
NKDLIDWIGLIPHFFNSFTLNNDTF

SEQ ID NO: 2534520 - protein, 31 aa, Entamoeba dispar
NKDNHMHIPFPLILIWALNQWRKEKNQTGIP

SEQ ID NO: 2534521 - protein, 26 aa, Entamoeba dispar
NKDNYKYWHRWALINFEVVNYYENMK

SEQ ID NO: 2534522 - protein, 21 aa, Entamoeba dispar
NKDQQLIAFKKQLSIAKRFNK

SEQ ID NO: 2534523 - protein, 28 aa, Entamoeba dispar
NKEAAFSNFLAYKLLMNGFTLTCQVSAQ

SEQ ID NO: 2534524 - protein, 25 aa, Entamoeba dispar
NKEEKIIWIIIMIEHIKEYKGININ

SEQ ID NO: 2534525 - protein, 34 aa, Entamoeba dispar
NKEFKLLLNDSFSIPLLNFFSLKELTDISIGYNL

SEQ ID NO: 2534526 - protein, 24 aa, Entamoeba dispar
NKEGKLKIYLYPNEPFNQKDESEA

SEQ ID NO: 2534527 - protein, 17 aa, Entamoeba dispar
NKEMKSIKNMPIDLEVK

SEQ ID NO: 2534528 - protein, 23 aa, Entamoeba dispar
NKENIYCLLPNYLFEQKELGKCT

SEQ ID NO: 2534529 - protein, 21 aa, Entamoeba dispar
NKERIDILNKFKLKEINYIGM

SEQ ID NO: 2534530 - protein, 31 aa, Entamoeba dispar
NKESKYYRNLIPRPLFEEYFNNIKKLSIDFL

SEQ ID NO: 2534531 - protein, 24 aa, Entamoeba dispar
NKESPYYRELIPRPMFEGIYAKVK

SEQ ID NO: 2534532 - protein, 22 aa, Entamoeba dispar
NKFEDKWYVLEVDKKWIKEINK

SEQ ID NO: 2534533 - protein, 20 aa, Entamoeba dispar
NKFFYNAYELTSIDIPSSVS

SEQ ID NO: 2534534 - protein, 17 aa, Entamoeba dispar
NKFIIPSSITKLDDCCF

SEQ ID NO: 2534535 - protein, 18 aa, Entamoeba dispar
NKFIIPSSITKLGYKCFY

SEQ ID NO: 2534536 - protein, 18 aa, Entamoeba dispar
NKFIIPSSITKLGYRCFK

SEQ ID NO: 2534537 - protein, 18 aa, Entamoeba dispar
NKFIPCLPSVLQSLSKLS

SEQ ID NO: 2534538 - protein, 29 aa, Entamoeba dispar
NKFIPKYVELKILPANPFEILDRPGVGEV

SEQ ID NO: 2534539 - protein, 40 aa, Entamoeba dispar
NKFKKISVFIPQSPQLPFNPSLFQFRFTSVPSTHLDSLNS

SEQ ID NO: 2534540 - protein, 25 aa, Entamoeba dispar
NKFLLSKFFLLPERTMNWINNAFED

SEQ ID NO: 2534541 - protein, 31 aa, Entamoeba dispar
NKFNLNECLLNKLWFNKLLDIDIKNTLFDDK

SEQ ID NO: 2534542 - protein, 31 aa, Entamoeba dispar
NKFSIYFNKAPIIYIPGRTFPVEKLYLEEPE

SEQ ID NO: 2534543 - protein, 26 aa, Entamoeba dispar
NKFTSFPNILLNLSNLSKLYISSNYF

SEQ ID NO: 2534544 - protein, 26 aa, Entamoeba dispar
NKFYDDPFVMLNYNDLPLLQNGLFHH

SEQ ID NO: 2534545 - protein, 24 aa, Entamoeba dispar
NKGLIVEGFFGYLKKIINHSNLPL

SEQ ID NO: 2534546 - protein, 25 aa, Entamoeba dispar
NKGTQWYSSLTFIKRLKCFSDKEIM

SEQ ID NO: 2534547 - protein, 26 aa, Entamoeba dispar
NKHKMEIIPLLIIITTLFEMYGDQTN

SEQ ID NO: 2534548 - protein, 28 aa, Entamoeba dispar
NKIETPRKRASVSRITLLEDSKKNQKPE

SEQ ID NO: 2534549 - protein, 23 aa, Entamoeba dispar
NKIEYRVWNPYRSKLGCTILKGV

SEQ ID NO: 2534550 - protein, 32 aa, Entamoeba dispar
NKIFEQIHLLIDLSFIMGYSFRSSFTSGNNHS

SEQ ID NO: 2534551 - protein, 17 aa, Entamoeba dispar
NKIGIHTLSPKELFYTI

SEQ ID NO: 2534552 - protein, 22 aa, Entamoeba dispar
NKIHVLLYSKLEKRDKIEKDPF

SEQ ID NO: 2534553 - protein, 17 aa, Entamoeba dispar
NKIKKYYYVLEGNKLML

SEQ ID NO: 2534554 - protein, 21 aa, Entamoeba dispar
NKIKMLIPLEILRAQNQKEKY

SEQ ID NO: 2534555 - protein, 18 aa, Entamoeba dispar
NKILRVKEATSFPIVFVA

SEQ ID NO: 2534556 - protein, 26 aa, Entamoeba dispar
NKIMLALVFKKWWGDSLVQSIIPPIA

SEQ ID NO: 2534557 - protein, 24 aa, Entamoeba dispar
NKINQDSFELISEKQTISLTNIPD

SEQ ID NO: 2534558 - protein, 20 aa, Entamoeba dispar
NKIPQLPEYIKYICVQARMP

SEQ ID NO: 2534559 - protein, 18 aa, Entamoeba dispar
NKIQKNQKIFCRVIFIFL

SEQ ID NO: 2534560 - protein, 31 aa, Entamoeba dispar
NKISKIFGRPDSITTIALLLQSSSPNEAIIN

SEQ ID NO: 2534561 - protein, 22 aa, Entamoeba dispar
NKISQPPFYQKPSNILITFKID

SEQ ID NO: 2534562 - protein, 21 aa, Entamoeba dispar
NKITLQMSQKVPSLGSLNSSQ

SEQ ID NO: 2534563 - protein, 25 aa, Entamoeba dispar
NKITRLGCLVVIFQMSIHLELEQSQ

SEQ ID NO: 2534564 - protein, 30 aa, Entamoeba dispar
NKKCFKEQAIWMLNALWPTHKDTVAEEIWK

SEQ ID NO: 2534565 - protein, 25 aa, Entamoeba dispar
NKKCYDVLLMIKVNPLKISQDISSI

SEQ ID NO: 2534566 - protein, 25 aa, Entamoeba dispar
NKKCYEAVFFIKTNPLILPTKESRD

SEQ ID NO: 2534567 - protein, 25 aa, Entamoeba dispar
NKKDQYTLCIILNLAEAIIQYKDIN

SEQ ID NO: 2534568 - protein, 23 aa, Entamoeba dispar
NKKEIYHNPIIQYQIEEINGIRN

SEQ ID NO: 2534569 - protein, 24 aa, Entamoeba dispar
NKKEIYHNPIIQYQLEEINGIRNE

SEQ ID NO: 2534570 - protein, 25 aa, Entamoeba dispar
NKKESWVRYFLHTGHLHINGLKMSK

SEQ ID NO: 2534571 - protein, 18 aa, Entamoeba dispar
NKKIPFKKFALEVFKSDE

SEQ ID NO: 2534572 - protein, 25 aa, Entamoeba dispar
NKKITGFRRGGFARPEQLIDTSQLE

SEQ ID NO: 2534573 - protein, 24 aa, Entamoeba dispar
NKKKKGIKLVDETYLLLGNDINSS

SEQ ID NO: 2534574 - protein, 32 aa, Entamoeba dispar
NKKKTLARSILIQDIIGLFMRARPLHLNIALN

SEQ ID NO: 2534575 - protein, 22 aa, Entamoeba dispar
NKKLFIHPTFKANTITFCIQLL

SEQ ID NO: 2534576 - protein, 17 aa, Entamoeba dispar
NKKNLIIVMEYARGGDL

SEQ ID NO: 2534577 - protein, 27 aa, Entamoeba dispar
NKKNRNLYCLVYYLLLGEITLNKKVIL

SEQ ID NO: 2534578 - protein, 23 aa, Entamoeba dispar
NKKPTNIQFINHKNIIVSFDNEM

SEQ ID NO: 2534579 - protein, 28 aa, Entamoeba dispar
NKKQDIKMFIRVLGKIISYYPKWIEGDE

SEQ ID NO: 2534580 - protein, 18 aa, Entamoeba dispar
NKKQIIFDNNKEIERLKE

SEQ ID NO: 2534581 - protein, 21 aa, Entamoeba dispar
NKKRLIIIDKMIYKIRTYLHL

SEQ ID NO: 2534582 - protein, 28 aa, Entamoeba dispar
NKKRMAIKNLRRRDDIAPYLKDLKDKND

SEQ ID NO: 2534583 - protein, 28 aa, Entamoeba dispar
NKKRMAIKNLRRRDDIAPYLKDLNDKND

SEQ ID NO: 2534584 - protein, 27 aa, Entamoeba dispar
NKKTDGLHLLMDLLNELGFEFNTKLTE

SEQ ID NO: 2534585 - protein, 23 aa, Entamoeba dispar
NKKTFKLFYDSLVNDLSQIQSFI

SEQ ID NO: 2534586 - protein, 21 aa, Entamoeba dispar
NKKVYFLCDPILGDNGKMYTK

SEQ ID NO: 2534587 - protein, 30 aa, Entamoeba dispar
NKLDDLIITPRSLLAIIRLAQSVARLRFSN

SEQ ID NO: 2534588 - protein, 22 aa, Entamoeba dispar
NKLIDPFFLDQYQFLASKKSDL

SEQ ID NO: 2534589 - protein, 25 aa, Entamoeba dispar
NKLILISIVFTYLYPRIDINVSVQL

SEQ ID NO: 2534590 - protein, 24 aa, Entamoeba dispar
NKLIPFIGQIMDGLLILITTNNQP

SEQ ID NO: 2534591 - protein, 20 aa, Entamoeba dispar
NKLIPPIMALERRISRMFTF

SEQ ID NO: 2534592 - protein, 21 aa, Entamoeba dispar
NKLKKKKIIQLTKTEIPKKCF

SEQ ID NO: 2534593 - protein, 21 aa, Entamoeba dispar
NKLLNLSFASTLRKIKAIQTF

SEQ ID NO: 2534594 - protein, 25 aa, Entamoeba dispar
NKLQEYWGQILKFIGGYLKVNTEIP

SEQ ID NO: 2534595 - protein, 25 aa, Entamoeba dispar
NKLQKTLIGTPYWMAPEVILESGHN

SEQ ID NO: 2534596 - protein, 18 aa, Entamoeba dispar
NKLVDACYTFWQASIFGI

SEQ ID NO: 2534597 - protein, 18 aa, Entamoeba dispar
NKLYAYLCDEIRANFDSE

SEQ ID NO: 2534598 - protein, 24 aa, Entamoeba dispar
NKMEDHPILQLMELGIPCTINTDN

SEQ ID NO: 2534599 - protein, 18 aa, Entamoeba dispar
NKMFNIEQIFLEGNPTAE

SEQ ID NO: 2534600 - protein, 24 aa, Entamoeba dispar
NKMRNNGQYYWKFGKYAVKSIRDL

SEQ ID NO: 2534601 - protein, 23 aa, Entamoeba dispar
NKMSKRLKLLRTYENTRLEEELQ

SEQ ID NO: 2534602 - protein, 24 aa, Entamoeba dispar
NKNAYPFCLPAPLSLPKKNYNKIF

SEQ ID NO: 2534603 - protein, 17 aa, Entamoeba dispar
NKNGKWFLTCSKDFKII

SEQ ID NO: 2534604 - protein, 29 aa, Entamoeba dispar
NKNGSFVIEKLFIKSSIDGKLKIIEEMNS

SEQ ID NO: 2534605 - protein, 26 aa, Entamoeba dispar
NKNISLLFDTLINCYLKRVTQPIEIL

SEQ ID NO: 2534606 - protein, 27 aa, Entamoeba dispar
NKNKYHSWRTLFDSCYVSSNNITYLLF

SEQ ID NO: 2534607 - protein, 32 aa, Entamoeba dispar
NKNNENKLFRTFWFYCVVLKFVIKEEYNEIYY

SEQ ID NO: 2534608 - protein, 27 aa, Entamoeba dispar
NKPFGGICFRPFPTQGFVEIVFCAVDS

SEQ ID NO: 2534609 - protein, 19 aa, Entamoeba dispar
NKPIADIFGFIFEIAKEGN

SEQ ID NO: 2534610 - protein, 23 aa, Entamoeba dispar
NKPLNHLKFIFDGYSLSPNDSCQ

SEQ ID NO: 2534611 - protein, 18 aa, Entamoeba dispar
NKPNGLTLSLNLNPNEIP

SEQ ID NO: 2534612 - protein, 27 aa, Entamoeba dispar
NKPNKPAIFLPLITSLTKFFSNHLNAK

SEQ ID NO: 2534613 - protein, 25 aa, Entamoeba dispar
NKPQLSRLFLMLKQHTKQSSIYQQT

SEQ ID NO: 2534614 - protein, 27 aa, Entamoeba dispar
NKPQTIIHTPLLFLKSAYCNQLKLPLS

SEQ ID NO: 2534615 - protein, 32 aa, Entamoeba dispar
NKPRYLMGVGYPVEMLLCVLFGVDMFDCVYPT

SEQ ID NO: 2534616 - protein, 23 aa, Entamoeba dispar
NKQETLIPKIRRSRHNKGRKDKE

SEQ ID NO: 2534617 - protein, 24 aa, Entamoeba dispar
NKQFSFIDILPYFSTQTYSIVLKE

SEQ ID NO: 2534618 - protein, 22 aa, Entamoeba dispar
NKQITWYEVYYSRYLKEKEAGN

SEQ ID NO: 2534619 - protein, 23 aa, Entamoeba dispar
NKQLVYLIRIIAQQMLFGFDIES

SEQ ID NO: 2534620 - protein, 21 aa, Entamoeba dispar
NKQLYVKLLVDYKLNKSVKKQ

SEQ ID NO: 2534621 - protein, 25 aa, Entamoeba dispar
NKRIVDMYLQPLQMMINQGIIPVVH

SEQ ID NO: 2534622 - protein, 35 aa, Entamoeba dispar
NKRKYILSGCYYLITKGWSFLFSKEKRTAKKLDHF

SEQ ID NO: 2534623 - protein, 26 aa, Entamoeba dispar
NKRLSSEFPLFSTYIALFRCGHKIPY

SEQ ID NO: 2534624 - protein, 17 aa, Entamoeba dispar
NKRQIISVMFKTFESSN

SEQ ID NO: 2534625 - protein, 18 aa, Entamoeba dispar
NKRSLFIKGFGKDATRQE

SEQ ID NO: 2534626 - protein, 31 aa, Entamoeba dispar
NKRSNFHISMKRFEFKKPNLISKPLKDRMKD

SEQ ID NO: 2534627 - protein, 30 aa, Entamoeba dispar
NKRTEYRMLWFRFDIRKLYFLRHGDPREEL

SEQ ID NO: 2534628 - protein, 18 aa, Entamoeba dispar
NKSATITYFGGLNEMDDK

SEQ ID NO: 2534629 - protein, 27 aa, Entamoeba dispar
NKSAVYYEMKQWRFVIQICSNLINKIT

SEQ ID NO: 2534630 - protein, 18 aa, Entamoeba dispar
NKSFRYELKCHCKSIAST

SEQ ID NO: 2534631 - protein, 25 aa, Entamoeba dispar
NKSFYDCVLFFSPSKKRCIKNPLQC

SEQ ID NO: 2534632 - protein, 17 aa, Entamoeba dispar
NKSIKFAYIFTGAKGGV

SEQ ID NO: 2534633 - protein, 25 aa, Entamoeba dispar
NKSNSKMFFFNSAYVLLSKDINGYW

SEQ ID NO: 2534634 - protein, 27 aa, Entamoeba dispar
NKSTINFPYLPLLPYEPEILMNFNNNN

SEQ ID NO: 2534635 - protein, 19 aa, Entamoeba dispar
NKTHFIYSTKMKKKYQLKD

SEQ ID NO: 2534636 - protein, 19 aa, Entamoeba dispar
NKTIILRWDLQNDLSVIEP

SEQ ID NO: 2534637 - protein, 17 aa, Entamoeba dispar
NKTIKCFILSIGSTNKI

SEQ ID NO: 2534638 - protein, 45 aa, Entamoeba dispar
NKTKDEFTQMFWQLGMKNFDEFIKKLKKLPRISLKQSREVLKRRE

SEQ ID NO: 2534639 - protein, 21 aa, Entamoeba dispar
NKTLKFEYYLNYITAVQQSKI

SEQ ID NO: 2534640 - protein, 24 aa, Entamoeba dispar
NKTLLHCTTIQYCILYHFHSKYEC

SEQ ID NO: 2534641 - protein, 29 aa, Entamoeba dispar
NKTNIISHVLLKKYIAYARQNCHPKWSGT

SEQ ID NO: 2534642 - protein, 29 aa, Entamoeba dispar
NKTRDNLTLYPQLKKVYMDSYEICFDSKN

SEQ ID NO: 2534643 - protein, 38 aa, Entamoeba dispar
NKTRILHHLPNSYYLERLFCFYIPIITRCSISIIDSTS

SEQ ID NO: 2534644 - protein, 25 aa, Entamoeba dispar
NKTRQFWFCSFADDLQDFKLIGIVL

SEQ ID NO: 2534645 - protein, 33 aa, Entamoeba dispar
NKTSINPYYELFSRLLMIKDYLIKEIIQKQCDN

SEQ ID NO: 2534646 - protein, 29 aa, Entamoeba dispar
NKTVPFNCRLYFEVILPNEQRKALWINKN

SEQ ID NO: 2534647 - protein, 29 aa, Entamoeba dispar
NKVKELHKTYLMLVQKSNIQLQVLNERKI

SEQ ID NO: 2534648 - protein, 31 aa, Entamoeba dispar
NKVLDSFQFIFLFLHLSFAFNHHISHPSYLP

SEQ ID NO: 2534649 - protein, 28 aa, Entamoeba dispar
NKVQIYQQIISLLLPNENSKKAICRLKK

SEQ ID NO: 2534650 - protein, 25 aa, Entamoeba dispar
NKVSDLLMMCQHLSVLRLRKLEAIT

SEQ ID NO: 2534651 - protein, 20 aa, Entamoeba dispar
NKVSIINFINLSSINIFIES

SEQ ID NO: 2534652 - protein, 17 aa, Entamoeba dispar
NKVTFSCDVYALGLIMW

SEQ ID NO: 2534653 - protein, 39 aa, Entamoeba dispar
NKWNNWSVVWVKQKGYPWWPAKIIIMDKLNEKKKRQLEK

SEQ ID NO: 2534654 - protein, 17 aa, Entamoeba dispar
NKWTIIASYLEGRSPND

SEQ ID NO: 2534655 - protein, 19 aa, Entamoeba dispar
NKYDNNIPFLADEIKVLLK

SEQ ID NO: 2534656 - protein, 23 aa, Entamoeba dispar
NKYPKVLKDYPFINTPKLMPQED

SEQ ID NO: 2534657 - protein, 38 aa, Entamoeba dispar
NKYQLAQMFINCGGLSLFYQVLTLKYDGKHQTTINIIL

SEQ ID NO: 2534658 - protein, 24 aa, Entamoeba dispar
NKYSSFITLDYRLIKQLEPTDSEV

SEQ ID NO: 2534659 - protein, 20 aa, Entamoeba dispar
NKYVFLGDYVDRGDFGCEVL

SEQ ID NO: 2534660 - protein, 22 aa, Entamoeba dispar
NKYVRCIAALIIRYSIQFNLLL

SEQ ID NO: 2534661 - protein, 21 aa, Entamoeba dispar
NKYYAIFEYEPNRYIGVTFNF

SEQ ID NO: 2534662 - protein, 20 aa, Entamoeba dispar
NLATVFAPVLFSLSIEELMN

SEQ ID NO: 2534663 - protein, 17 aa, Entamoeba dispar
NLAYKYFSIKKICDLAE

SEQ ID NO: 2534664 - protein, 20 aa, Entamoeba dispar
NLCFGNYLYLVLCKRCLEHC

SEQ ID NO: 2534665 - protein, 17 aa, Entamoeba dispar
NLCLDAMNEGRTPPIVI

SEQ ID NO: 2534666 - protein, 17 aa, Entamoeba dispar
NLCYSRNDFLLLNKIYS

SEQ ID NO: 2534667 - protein, 18 aa, Entamoeba dispar
NLDGFYEPLYGQPHSEPA

SEQ ID NO: 2534668 - protein, 23 aa, Entamoeba dispar
NLDLHAIKNLNPINSPTITVSNW

SEQ ID NO: 2534669 - protein, 28 aa, Entamoeba dispar
NLDLPQGQWPELMPFLLTDSNVAKLKTI

SEQ ID NO: 2534670 - protein, 36 aa, Entamoeba dispar
NLDLRSYLIMPVQRLPRYELLLKDLLKNTKPDHPDY

SEQ ID NO: 2534671 - protein, 23 aa, Entamoeba dispar
NLDRPKLVLHDDVDLLWNSMKKG

SEQ ID NO: 2534672 - protein, 25 aa, Entamoeba dispar
NLDRPTLKLLIPYFNDWYIRDGISG

SEQ ID NO: 2534673 - protein, 21 aa, Entamoeba dispar
NLEEIKFNKSLKTFQCMRCMK

SEQ ID NO: 2534674 - protein, 25 aa, Entamoeba dispar
NLEEKLIIDWFSRFGIEVGDFKTSF

SEQ ID NO: 2534675 - protein, 26 aa, Entamoeba dispar
NLEGKVKCFGIFPKGFEKAAGPSFAP

SEQ ID NO: 2534676 - protein, 29 aa, Entamoeba dispar
NLEPKYPHQLLLQAFYLTVTSSESDPLHI

SEQ ID NO: 2534677 - protein, 23 aa, Entamoeba dispar
NLERIMGFYYFYMSHGIKNHYYT

SEQ ID NO: 2534678 - protein, 19 aa, Entamoeba dispar
NLFDEIFAVLIRISNPQKR

SEQ ID NO: 2534679 - protein, 24 aa, Entamoeba dispar
NLFEADPTIPVSCTLYINNLDQSI

SEQ ID NO: 2534680 - protein, 29 aa, Entamoeba dispar
NLFHFPQSIFDLITLKTLFISNNYITNIP

SEQ ID NO: 2534681 - protein, 39 aa, Entamoeba dispar
NLFKACRKLFDLVIESFDLLPPGVKLLARIFNEYAAQFF

SEQ ID NO: 2534682 - protein, 25 aa, Entamoeba dispar
NLFKELSICICGQPKILATKLSAWI

SEQ ID NO: 2534683 - protein, 20 aa, Entamoeba dispar
NLFKIIILGDSGVGKTSLLN

SEQ ID NO: 2534684 - protein, 19 aa, Entamoeba dispar
NLFQTVAIPQAYRNQMFQC

SEQ ID NO: 2534685 - protein, 20 aa, Entamoeba dispar
NLFSLVFIDDEICKQCFGCI

SEQ ID NO: 2534686 - protein, 29 aa, Entamoeba dispar
NLFSSIIKLMKLLLLPFKTVVYSSKPSES

SEQ ID NO: 2534687 - protein, 25 aa, Entamoeba dispar
NLGDKNQYLLKKYGIEGYVHKGLVA

SEQ ID NO: 2534688 - protein, 24 aa, Entamoeba dispar
NLGELWTLLNYIEPKTFSSLEEFD

SEQ ID NO: 2534689 - protein, 24 aa, Entamoeba dispar
NLGKHGHLLILNSNDIWNYIKPKV

SEQ ID NO: 2534690 - protein, 18 aa, Entamoeba dispar
NLGKINELLFEKYQLQPD

SEQ ID NO: 2534691 - protein, 19 aa, Entamoeba dispar
NLGLWLNISERGGMDGGWF

SEQ ID NO: 2534692 - protein, 26 aa, Entamoeba dispar
NLGVLDFLIKPIQRITKYPLFVKNLK

SEQ ID NO: 2534693 - protein, 30 aa, Entamoeba dispar
NLHFFIGAYEFLILQHLFQQLNDNLKVFFK

SEQ ID NO: 2534694 - protein, 27 aa, Entamoeba dispar
NLHIPIGCLYSPLLPKPLIADRAPIKC

SEQ ID NO: 2534695 - protein, 24 aa, Entamoeba dispar
NLHLFNQILHALKCIPKAIPSLVC

SEQ ID NO: 2534696 - protein, 23 aa, Entamoeba dispar
NLHSIILNHYLSHTLHINTSPQA

SEQ ID NO: 2534697 - protein, 23 aa, Entamoeba dispar
NLHYVIDYCPGGELYSLMKKEQT

SEQ ID NO: 2534698 - protein, 19 aa, Entamoeba dispar
NLIDLPLTKRLFVGGIDKS

SEQ ID NO: 2534699 - protein, 23 aa, Entamoeba dispar
NLIDSELFIPCLTFIGNLAIDNI

SEQ ID NO: 2534700 - protein, 19 aa, Entamoeba dispar
NLIKEIKRVYPFASIIVLG

SEQ ID NO: 2534701 - protein, 20 aa, Entamoeba dispar
NLIKNAFFEKGIESRKVNYL

SEQ ID NO: 2534702 - protein, 22 aa, Entamoeba dispar
NLIKNIISKYYKPTTPTLLTRA

SEQ ID NO: 2534703 - protein, 17 aa, Entamoeba dispar
NLIPLNDYSRKFFPNIE

SEQ ID NO: 2534704 - protein, 23 aa, Entamoeba dispar
NLIRKMIELPTLKKVIILCTNNE

SEQ ID NO: 2534705 - protein, 17 aa, Entamoeba dispar
NLIRPFFSLVQDANKPN

SEQ ID NO: 2534706 - protein, 17 aa, Entamoeba dispar
NLISKPLKDRMKDSTKQ

SEQ ID NO: 2534707 - protein, 25 aa, Entamoeba dispar
NLITKPFQRKIIFNNYLLDIDVIVS

SEQ ID NO: 2534708 - protein, 23 aa, Entamoeba dispar
NLKDIRLRPRYLMKFLDTDGDWV

SEQ ID NO: 2534709 - protein, 30 aa, Entamoeba dispar
NLKDKPKDLYYFFLFKDIFVQTKVKKLHGE

SEQ ID NO: 2534710 - protein, 26 aa, Entamoeba dispar
NLKDLSIRIFKKSKFNLYLSNSIQNL

SEQ ID NO: 2534711 - protein, 17 aa, Entamoeba dispar
NLKKLMLYDFPSLLDNG

SEQ ID NO: 2534712 - protein, 18 aa, Entamoeba dispar
NLKLYKRKGLYQLTEMKE

SEQ ID NO: 2534713 - protein, 19 aa, Entamoeba dispar
NLKQNNLFISFGRKSIDCS

SEQ ID NO: 2534714 - protein, 30 aa, Entamoeba dispar
NLKQPHLFVMNKGVLSLFLTPMISGTTNSQ

SEQ ID NO: 2534715 - protein, 22 aa, Entamoeba dispar
NLKRLYNDLYQPLLESMKKRTR

SEQ ID NO: 2534716 - protein, 18 aa, Entamoeba dispar
NLKTLHLDNIILQSISLL

SEQ ID NO: 2534717 - protein, 23 aa, Entamoeba dispar
NLKTTILSRFDMIFMIRDKHDAK

SEQ ID NO: 2534718 - protein, 19 aa, Entamoeba dispar
NLKVLLFFRNEYGGIPSRE

SEQ ID NO: 2534719 - protein, 17 aa, Entamoeba dispar
NLLADLGLAYKSGKMLF

SEQ ID NO: 2534720 - protein, 18 aa, Entamoeba dispar
NLLADLGLAYKSGKMLFL

SEQ ID NO: 2534721 - protein, 24 aa, Entamoeba dispar
NLLDISVVYIVFDISNIDSYNYAL

SEQ ID NO: 2534722 - protein, 17 aa, Entamoeba dispar
NLLKIFYEKLSNEFFTC

SEQ ID NO: 2534723 - protein, 17 aa, Entamoeba dispar
NLLLLEPGEQYLNDCAC

SEQ ID NO: 2534724 - protein, 30 aa, Entamoeba dispar
NLLNTETRKLLFNYVALGVKLMNASNSNKN

SEQ ID NO: 2534725 - protein, 20 aa, Entamoeba dispar
NLLNYLINLIDYPPSDKDIC

SEQ ID NO: 2534726 - protein, 17 aa, Entamoeba dispar
NLLPIAQLEKRGLKIKW

SEQ ID NO: 2534727 - protein, 27 aa, Entamoeba dispar
NLLPSSDIQFLPFWFKKDSVVCAGETL

SEQ ID NO: 2534728 - protein, 26 aa, Entamoeba dispar
NLLTNYINHFNKLFPRFADPINQQQK

SEQ ID NO: 2534729 - protein, 19 aa, Entamoeba dispar
NLLTYFINQNFYFNFEQIH

SEQ ID NO: 2534730 - protein, 18 aa, Entamoeba dispar
NLLTYLNTNYSYGKTINK

SEQ ID NO: 2534731 - protein, 21 aa, Entamoeba dispar
NLMCYLGVGLIIGKEIYLGNY

SEQ ID NO: 2534732 - protein, 27 aa, Entamoeba dispar
NLMEDLLSNVWPYIRFSIDYNIAQSEL

SEQ ID NO: 2534733 - protein, 25 aa, Entamoeba dispar
NLMKKILLSLFEYSSPPVIPTNPPI

SEQ ID NO: 2534734 - protein, 17 aa, Entamoeba dispar
NLMRRCIPLLPTSFDFI

SEQ ID NO: 2534735 - protein, 25 aa, Entamoeba dispar
NLMTTSGLLYYIEWSQKGNKFRIEL

SEQ ID NO: 2534736 - protein, 23 aa, Entamoeba dispar
NLMVDKFFSFSLQSNLKLQDIRI

SEQ ID NO: 2534737 - protein, 18 aa, Entamoeba dispar
NLMYFLKGQIKGSDIVLV

SEQ ID NO: 2534738 - protein, 26 aa, Entamoeba dispar
NLNDIAHLIPLKRLLIITNNKVTEEK

SEQ ID NO: 2534739 - protein, 20 aa, Entamoeba dispar
NLNILLGLVKSCYGNDVMFD

SEQ ID NO: 2534740 - protein, 28 aa, Entamoeba dispar
NLNKGIIKSFIPSLQQWTGMQKYDVIYN

SEQ ID NO: 2534741 - protein, 23 aa, Entamoeba dispar
NLNLENVDWHNLCYATNSNIKNP

SEQ ID NO: 2534742 - protein, 18 aa, Entamoeba dispar
NLNLTLEEIFFGTKKEVR

SEQ ID NO: 2534743 - protein, 24 aa, Entamoeba dispar
NLNPYFRKMLFTGSAEKKGCQLLK

SEQ ID NO: 2534744 - protein, 26 aa, Entamoeba dispar
NLNQKPYFIFQCIHPNKFYDDPFVML

SEQ ID NO: 2534745 - protein, 25 aa, Entamoeba dispar
NLNQLLNNEIFRTVIRRSQQEHYEE

SEQ ID NO: 2534746 - protein, 31 aa, Entamoeba dispar
NLPENYNLQLYYYHLILYPTSFVAVTPDNKI

SEQ ID NO: 2534747 - protein, 26 aa, Entamoeba dispar
NLPIKHQNFLIKPISVFIQFGNCVNK

SEQ ID NO: 2534748 - protein, 48 aa, Entamoeba dispar
NLPKRSMVGIFFPNRAEWIIISQALHRIGLIPIPLYATLGVQSINYII

SEQ ID NO: 2534749 - protein, 19 aa, Entamoeba dispar
NLQEQFSLVVYLSYFMNYA

SEQ ID NO: 2534750 - protein, 23 aa, Entamoeba dispar
NLQHYAITLFNFIIPYCASTHDF

SEQ ID NO: 2534751 - protein, 25 aa, Entamoeba dispar
NLQSVNLWICPPVENFDKIINQGCE

SEQ ID NO: 2534752 - protein, 20 aa, Entamoeba dispar
NLQVAQLRRYLPLYEKKYDQ

SEQ ID NO: 2534753 - protein, 25 aa, Entamoeba dispar
NLRQLHVLGEIFAENGFLVRSDARS

SEQ ID NO: 2534754 - protein, 23 aa, Entamoeba dispar
NLRTLKEVYLSPIIKLVNKEHVT

SEQ ID NO: 2534755 - protein, 32 aa, Entamoeba dispar
NLRTTLITLFVYIQTKRLFKPTWKISCELIVK

SEQ ID NO: 2534756 - protein, 49 aa, Entamoeba dispar
NLSELWSLFDFVYPGKLGTLPLFQQQFIKPIRYGSYTSASYFQFMAALK

SEQ ID NO: 2534757 - protein, 24 aa, Entamoeba dispar
NLSIRLWAVGILIKSSPNGIENLF

SEQ ID NO: 2534758 - protein, 29 aa, Entamoeba dispar
NLSKRIRLLLMNIIQMMESGWTVSPFGSM

SEQ ID NO: 2534759 - protein, 18 aa, Entamoeba dispar
NLSKVELLTNLKPKINEQ

SEQ ID NO: 2534760 - protein, 18 aa, Entamoeba dispar
NLSLLRNHLSREGILHPD

SEQ ID NO: 2534761 - protein, 18 aa, Entamoeba dispar
NLSLLRNHLSREGVLHPD

SEQ ID NO: 2534762 - protein, 37 aa, Entamoeba dispar
NLSLQDIKVIALAVRYVREKLPFLELAKHPGDSRKVM

SEQ ID NO: 2534763 - protein, 42 aa, Entamoeba dispar
NLSTNEGFLFPMSDSFIFVFKRIRIIMFKDIKSVDILRMNAS

SEQ ID NO: 2534764 - protein, 25 aa, Entamoeba dispar
NLSVFLFPCFAINNKINLTTFKEVT

SEQ ID NO: 2534765 - protein, 20 aa, Entamoeba dispar
NLSWIILKEHFKNNKLILIS

SEQ ID NO: 2534766 - protein, 29 aa, Entamoeba dispar
NLTDDFGFPLQFKIPLAFSLSVVANIKDY

SEQ ID NO: 2534767 - protein, 25 aa, Entamoeba dispar
NLTEPIISRFDLIMIVRDVVDYEKD

SEQ ID NO: 2534768 - protein, 24 aa, Entamoeba dispar
NLTEQIYILPFDNLNISLPSNNIN

SEQ ID NO: 2534769 - protein, 20 aa, Entamoeba dispar
NLTINIPQINGINYSLDDSS

SEQ ID NO: 2534770 - protein, 18 aa, Entamoeba dispar
NLTLYQSFDKIIRIFPNL

SEQ ID NO: 2534771 - protein, 25 aa, Entamoeba dispar
NLTPTLLRLSIHIPQIKMICAVGCC

SEQ ID NO: 2534772 - protein, 24 aa, Entamoeba dispar
NLTQLIIVDIPITQPFLIDDFSFV

SEQ ID NO: 2534773 - protein, 24 aa, Entamoeba dispar
NLTRLVRYRLHKHGIRSGFNCVFS

SEQ ID NO: 2534774 - protein, 30 aa, Entamoeba dispar
NLTSLFIKSPVLLKMYLVNRLRSIYEKEGS

SEQ ID NO: 2534775 - protein, 20 aa, Entamoeba dispar
NLTVPNTLRYSLKGLEIKCQ

SEQ ID NO: 2534776 - protein, 24 aa, Entamoeba dispar
NLVCIDGVLHIPYGIIKSGIISEA

SEQ ID NO: 2534777 - protein, 25 aa, Entamoeba dispar
NLVIRRQFNLSNQSNWFINGRTASH

SEQ ID NO: 2534778 - protein, 26 aa, Entamoeba dispar
NLVNLKISQIPYKFSCSTLLESDTWN

SEQ ID NO: 2534779 - protein, 18 aa, Entamoeba dispar
NLVSLIDSICPCAFFETS

SEQ ID NO: 2534780 - protein, 19 aa, Entamoeba dispar
NLYDTKWIFKREKGMKLWA

SEQ ID NO: 2534781 - protein, 34 aa, Entamoeba dispar
NLYEIGSIRIALLLWKHFFLSLPNPVIEEDVYNE

SEQ ID NO: 2534782 - protein, 20 aa, Entamoeba dispar
NLYGTSWKLLLKIICEKEKE

SEQ ID NO: 2534783 - protein, 18 aa, Entamoeba dispar
NLYKAILRAQQDNLKNVH

SEQ ID NO: 2534784 - protein, 31 aa, Entamoeba dispar
NLYKKIPYQFTPVYQIISLILRGMSEVEYMV

SEQ ID NO: 2534785 - protein, 29 aa, Entamoeba dispar
NLYNRYHVNNIFGLKWGYEGLVPELSEVQ

SEQ ID NO: 2534786 - protein, 25 aa, Entamoeba dispar
NLYQFGYNPFRLLPKPNGIQPHPNS

SEQ ID NO: 2534787 - protein, 18 aa, Entamoeba dispar
NLYSFDDYPPKILQIDNK

SEQ ID NO: 2534788 - protein, 25 aa, Entamoeba dispar
NMARRSEILIARYALHKLYPDVEMT

SEQ ID NO: 2534789 - protein, 27 aa, Entamoeba dispar
NMEKLYYNPIPLNDYSRKLFPNISKIN

SEQ ID NO: 2534790 - protein, 25 aa, Entamoeba dispar
NMEQFHFNPFPLNAYSRRLFPNIET

SEQ ID NO: 2534791 - protein, 24 aa, Entamoeba dispar
NMERFHFNPIPLNEYSRKFFHNIE

SEQ ID NO: 2534792 - protein, 26 aa, Entamoeba dispar
NMERFHFNPIPLNEYSRKFFPNIETF

SEQ ID NO: 2534793 - protein, 26 aa, Entamoeba dispar
NMERFHFNPIPLNEYSRKFFPNIETL

SEQ ID NO: 2534794 - protein, 24 aa, Entamoeba dispar
NMERFHFNPIPLNEYSRKLFHNIE

SEQ ID NO: 2534795 - protein, 26 aa, Entamoeba dispar
NMERFHFNPIPLNEYSRKLFPSIETF

SEQ ID NO: 2534796 - protein, 40 aa, Entamoeba dispar
NMERFHFNPIPLNEYSRRFFPNIETFYIYCYNDEIFDDGR

SEQ ID NO: 2534797 - protein, 26 aa, Entamoeba dispar
NMERFHFNPIPLNEYSRRLFPNIETF

SEQ ID NO: 2534798 - protein, 26 aa, Entamoeba dispar
NMERFHFNPIPLNHYSRKLFPNIETF

SEQ ID NO: 2534799 - protein, 27 aa, Entamoeba dispar
NMERFHFNPIPLNKYSRKLFPNIETFH

SEQ ID NO: 2534800 - protein, 26 aa, Entamoeba dispar
NMERFHFNPIPLNKYSRKLFTNIETF

SEQ ID NO: 2534801 - protein, 27 aa, Entamoeba dispar
NMERFHFNPIPLNKYSRKLFTNIETFH

SEQ ID NO: 2534802 - protein, 25 aa, Entamoeba dispar
NMERFHFNPIPLNNYSRKLFTNIET

SEQ ID NO: 2534803 - protein, 27 aa, Entamoeba dispar
NMERFHFNPIPLNQYSRKFFPNIETFH

SEQ ID NO: 2534804 - protein, 26 aa, Entamoeba dispar
NMERFHFNPIPLNQYSRKLFTNIETF

SEQ ID NO: 2534805 - protein, 26 aa, Entamoeba dispar
NMERFRFNPIPLNHYSRKLFPNIETF

SEQ ID NO: 2534806 - protein, 20 aa, Entamoeba dispar
NMFGIFFNNTTKSLFKIISP

SEQ ID NO: 2534807 - protein, 19 aa, Entamoeba dispar
NMFIEPQPIPLLKEFFYMI

SEQ ID NO: 2534808 - protein, 19 aa, Entamoeba dispar
NMFSDLELELLGKECVVPS

SEQ ID NO: 2534809 - protein, 19 aa, Entamoeba dispar
NMIRLHRMTRYNLKVKLGD

SEQ ID NO: 2534810 - protein, 21 aa, Entamoeba dispar
NMISDLLQNKLDLSMLIISKT

SEQ ID NO: 2534811 - protein, 25 aa, Entamoeba dispar
NMKATYNILFEYIRNIALSTKNCNT

SEQ ID NO: 2534812 - protein, 25 aa, Entamoeba dispar
NMKIYNEFLTLFDSLPLSALIEGNI

SEQ ID NO: 2534813 - protein, 22 aa, Entamoeba dispar
NMKRAFSKLFSLTDIHLEGNPV

SEQ ID NO: 2534814 - protein, 25 aa, Entamoeba dispar
NMKRFHFNPIPLNEYSRKFFPNIET

SEQ ID NO: 2534815 - protein, 22 aa, Entamoeba dispar
NMLKQLIKYIKTEKFLGSDVKS

SEQ ID NO: 2534816 - protein, 23 aa, Entamoeba dispar
NMLTQFRHPCIVNLVGAVYTEGE

SEQ ID NO: 2534817 - protein, 20 aa, Entamoeba dispar
NMLYHFIPMEQSDITYILIS

SEQ ID NO: 2534818 - protein, 22 aa, Entamoeba dispar
NMNHNIILIIRLNNVEYVCVNQ

SEQ ID NO: 2534819 - protein, 24 aa, Entamoeba dispar
NMNKASIYQFSFIRMTSGYSFEEF

SEQ ID NO: 2534820 - protein, 18 aa, Entamoeba dispar
NMNLTKLEGIIGTVIHQQ

SEQ ID NO: 2534821 - protein, 23 aa, Entamoeba dispar
NMNSREILLTQLFAVCFYKEILT

SEQ ID NO: 2534822 - protein, 21 aa, Entamoeba dispar
NMQQLLGQIDLIIGAADCARS

SEQ ID NO: 2534823 - protein, 17 aa, Entamoeba dispar
NMRLQGKIVIDIRPKEG

SEQ ID NO: 2534824 - protein, 19 aa, Entamoeba dispar
NMSLKYLINYDDLPSFAFK

SEQ ID NO: 2534825 - protein, 24 aa, Entamoeba dispar
NMSYICWDPMGLFLGAVRSYVYSP

SEQ ID NO: 2534826 - protein, 18 aa, Entamoeba dispar
NMVIKEKAPFIPTEQFVQ

SEQ ID NO: 2534827 - protein, 17 aa, Entamoeba dispar
NMVYKGLMKCQIYHQYK

SEQ ID NO: 2534828 - protein, 25 aa, Entamoeba dispar
NMYEYYCQLFPVITMYIERANCVNP

SEQ ID NO: 2534829 - protein, 26 aa, Entamoeba dispar
NNAIAQFLLMLIRGYSRKTAMECLDI

SEQ ID NO: 2534830 - protein, 34 aa, Entamoeba dispar
NNAIYDLFCEFFNTIPLAALFKCSLGSFLLCHGG

SEQ ID NO: 2534831 - protein, 20 aa, Entamoeba dispar
NNALEFLINYSAGNVLRPHV

SEQ ID NO: 2534832 - protein, 25 aa, Entamoeba dispar
NNALNIFSWIIPCKKISTETVRSYR

SEQ ID NO: 2534833 - protein, 18 aa, Entamoeba dispar
NNCIIIVSFLVLQSTTID

SEQ ID NO: 2534834 - protein, 21 aa, Entamoeba dispar
NNCPSLVITLPLIENDHKMTT

SEQ ID NO: 2534835 - protein, 23 aa, Entamoeba dispar
NNCYATLVYLINEKKKYVKIFDC

SEQ ID NO: 2534836 - protein, 23 aa, Entamoeba dispar
NNDFFEDFSTILWIKCNNKHTEQ

SEQ ID NO: 2534837 - protein, 27 aa, Entamoeba dispar
NNDFNRVFMCSFPYFTNSKTVLQKLIE

SEQ ID NO: 2534838 - protein, 17 aa, Entamoeba dispar
NNDKMIVILTMNRFKSI

SEQ ID NO: 2534839 - protein, 32 aa, Entamoeba dispar
NNDPIVQRFRWSILILFRVITNLYDCLDKNKN

SEQ ID NO: 2534840 - protein, 23 aa, Entamoeba dispar
NNDSPFIYSPFIKNKSYGIEMSS

SEQ ID NO: 2534841 - protein, 22 aa, Entamoeba dispar
NNDSVIKFIKFLINLIKEVNEK

SEQ ID NO: 2534842 - protein, 23 aa, Entamoeba dispar
NNEGEVLIIKHIVGGLLKNKVKE

SEQ ID NO: 2534843 - protein, 17 aa, Entamoeba dispar
NNEGEVLIIKQIVDGLL

SEQ ID NO: 2534844 - protein, 37 aa, Entamoeba dispar
NNEILYFLGEICNGLWYLHFTKRLIHRDLKPANLLLQ

SEQ ID NO: 2534845 - protein, 23 aa, Entamoeba dispar
NNEKIPVLLIGNKADLLKSDEEK

SEQ ID NO: 2534846 - protein, 25 aa, Entamoeba dispar
NNELVLKLSGIERQLFEEKTRETQT

SEQ ID NO: 2534847 - protein, 38 aa, Entamoeba dispar
NNEVDVSYYIPPNYLQENSWIGIFDRFEMNMKNYINSA

SEQ ID NO: 2534848 - protein, 26 aa, Entamoeba dispar
NNFDDSLITIILDKIKQRIGDTEFQR

SEQ ID NO: 2534849 - protein, 19 aa, Entamoeba dispar
NNFELWKVNPYQKIKEFPI

SEQ ID NO: 2534850 - protein, 22 aa, Entamoeba dispar
NNFLYQNYCYECSKYNPNCLVC

SEQ ID NO: 2534851 - protein, 19 aa, Entamoeba dispar
NNFPGAMPVNFGRTSFDII

SEQ ID NO: 2534852 - protein, 24 aa, Entamoeba dispar
NNFYKSPFIVCTYNYILDPKVENV

SEQ ID NO: 2534853 - protein, 23 aa, Entamoeba dispar
NNGCKLNIRLSLKVLKQLYSMVK

SEQ ID NO: 2534854 - protein, 26 aa, Entamoeba dispar
NNGEIETAWIYYHKLKEIIESLDESN

SEQ ID NO: 2534855 - protein, 26 aa, Entamoeba dispar
NNGGDPFIFVVNKNTEWNIPYKPQAA

SEQ ID NO: 2534856 - protein, 17 aa, Entamoeba dispar
NNGIGVMALRRAYGDQY

SEQ ID NO: 2534857 - protein, 18 aa, Entamoeba dispar
NNGKLRIWGPSVTPGYVS

SEQ ID NO: 2534858 - protein, 32 aa, Entamoeba dispar
NNGRSLGYYVVPLLLILPFGKGSTTVTLNGIT

SEQ ID NO: 2534859 - protein, 25 aa, Entamoeba dispar
NNGSIDIILFKRNCRKAKPIGSNCR

SEQ ID NO: 2534860 - protein, 22 aa, Entamoeba dispar
NNIDFLPQFQFFTQLKEIVIEE

SEQ ID NO: 2534861 - protein, 22 aa, Entamoeba dispar
NNIFNEIKRLLKKKYVTTISSI

SEQ ID NO: 2534862 - protein, 24 aa, Entamoeba dispar
NNIIKMIDYYYGIEGCYIVFESCD

SEQ ID NO: 2534863 - protein, 28 aa, Entamoeba dispar
NNIILDISFPSILYKKLLGIPLTFDDYN

SEQ ID NO: 2534864 - protein, 23 aa, Entamoeba dispar
NNIISSSKFLYKVEYTELIGTGT

SEQ ID NO: 2534865 - protein, 24 aa, Entamoeba dispar
NNIPLNAFGYVQSKWMGEQICKRG

SEQ ID NO: 2534866 - protein, 26 aa, Entamoeba dispar
NNIPVILAVLGIWYNNLYQAQSHAIL

SEQ ID NO: 2534867 - protein, 24 aa, Entamoeba dispar
NNISTILRLVGLLNGRTIQQITTR

SEQ ID NO: 2534868 - protein, 21 aa, Entamoeba dispar
NNITIFCPALTDGLFGTCITE

SEQ ID NO: 2534869 - protein, 22 aa, Entamoeba dispar
NNITKVFLNGVWLKCSEQPQKL

SEQ ID NO: 2534870 - protein, 19 aa, Entamoeba dispar
NNIVSALIFLKECTQYAND

SEQ ID NO: 2534871 - protein, 26 aa, Entamoeba dispar
NNKDKLIYHYILKSIPSFIEHFNCDN

SEQ ID NO: 2534872 - protein, 22 aa, Entamoeba dispar
NNKELVELLLNYSPSKLTCQDI

SEQ ID NO: 2534873 - protein, 18 aa, Entamoeba dispar
NNKFFPVVDFGKGVIVTI

SEQ ID NO: 2534874 - protein, 43 aa, Entamoeba dispar
NNKHEIELYYYPLEYQALTIPSTILYLDNSVLFWGSKGGDSHL

SEQ ID NO: 2534875 - protein, 29 aa, Entamoeba dispar
NNKISELYILKLLPVLNLHIEKVWKYPYQ

SEQ ID NO: 2534876 - protein, 33 aa, Entamoeba dispar
NNKISQLPNNLFLFLPYLKILKLGINQLTTIPN

SEQ ID NO: 2534877 - protein, 30 aa, Entamoeba dispar
NNKISYNSFKKLFLQAFTPTFSQVLHDRVF

SEQ ID NO: 2534878 - protein, 17 aa, Entamoeba dispar
NNKLQIFYYNDDHKLQC

SEQ ID NO: 2534879 - protein, 25 aa, Entamoeba dispar
NNKNISFLRFFSIVGILNCENLKDY

SEQ ID NO: 2534880 - protein, 24 aa, Entamoeba dispar
NNKNNFFVISELFPQAIAATIDGK

SEQ ID NO: 2534881 - protein, 22 aa, Entamoeba dispar
NNKPATNNLFSFDLDEPKKENQ

SEQ ID NO: 2534882 - protein, 32 aa, Entamoeba dispar
NNKPTKAFIMTLWLKSIFEQDLAYLMSIKDVS

SEQ ID NO: 2534883 - protein, 19 aa, Entamoeba dispar
NNLFELHSLLLKAKELQKE

SEQ ID NO: 2534884 - protein, 33 aa, Entamoeba dispar
NNLIATDVIISIFLHPAIYINNFSESEQPSRRR

SEQ ID NO: 2534885 - protein, 20 aa, Entamoeba dispar
NNLLLLKEIIERKLTFEKLT

SEQ ID NO: 2534886 - protein, 18 aa, Entamoeba dispar
NNLLLSQYKWYSYSIISI

SEQ ID NO: 2534887 - protein, 21 aa, Entamoeba dispar
NNLLTTLLWHDDMLRCVKTNT

SEQ ID NO: 2534888 - protein, 18 aa, Entamoeba dispar
NNLLYTTAPVDLFGIVKE

SEQ ID NO: 2534889 - protein, 27 aa, Entamoeba dispar
NNLNKQMILLPLNPLMNDILPKTLPVM

SEQ ID NO: 2534890 - protein, 24 aa, Entamoeba dispar
NNLNWIPFSFMTLETPHLGVQKPL

SEQ ID NO: 2534891 - protein, 25 aa, Entamoeba dispar
NNLQPLFVKIIFSSLINYVQPSSRV

SEQ ID NO: 2534892 - protein, 31 aa, Entamoeba dispar
NNLSKRIRLLLMNIIQMMESGWTVSPFISLQ

SEQ ID NO: 2534893 - protein, 22 aa, Entamoeba dispar
NNLWSIPLHRGGGEFMMMLNEA

SEQ ID NO: 2534894 - protein, 23 aa, Entamoeba dispar
NNLWSTVKPLPGAIRILNYFKRH

SEQ ID NO: 2534895 - protein, 17 aa, Entamoeba dispar
NNMGKIRLIRFYNHIKE

SEQ ID NO: 2534896 - protein, 29 aa, Entamoeba dispar
NNMIDPSYYLFRWLTLLGASELPMDVTIK

SEQ ID NO: 2534897 - protein, 24 aa, Entamoeba dispar
NNMNLRFPQTLTIINIIGCQSVIC

SEQ ID NO: 2534898 - protein, 22 aa, Entamoeba dispar
NNMNQIILLIKLGIISIGTVLK

SEQ ID NO: 2534899 - protein, 24 aa, Entamoeba dispar
NNMPFPPFLNSSWMKKGFGFEDFM

SEQ ID NO: 2534900 - protein, 26 aa, Entamoeba dispar
NNNDLLIKPKKVPLGMNPLQMAMAGE

SEQ ID NO: 2534901 - protein, 25 aa, Entamoeba dispar
NNNDLNIIIKLLKLPTLKKVIIFCG

SEQ ID NO: 2534902 - protein, 27 aa, Entamoeba dispar
NNNEEELFWKVIIFDQFNSDLLSLQLR

SEQ ID NO: 2534903 - protein, 24 aa, Entamoeba dispar
NNNFQLFNLNKFIKLKKLNIICND

SEQ ID NO: 2534904 - protein, 25 aa, Entamoeba dispar
NNNIKTIYFNVYPQIKIGNKNIKIN

SEQ ID NO: 2534905 - protein, 25 aa, Entamoeba dispar
NNNKFLVLEYAPNTLISYLNKQKSK

SEQ ID NO: 2534906 - protein, 27 aa, Entamoeba dispar
NNNKIAFHLLFTLKQGLTRFIDELIVE

SEQ ID NO: 2534907 - protein, 24 aa, Entamoeba dispar
NNNPIIRKSAIEVILKIIEPMNLK

SEQ ID NO: 2534908 - protein, 22 aa, Entamoeba dispar
NNNQIIQRFKGKKVKLISTVVQ

SEQ ID NO: 2534909 - protein, 22 aa, Entamoeba dispar
NNNSILFKLIGDNNNILNIHIK

SEQ ID NO: 2534910 - protein, 23 aa, Entamoeba dispar
NNNSYIICIPRIYSRWKEEGYIN

SEQ ID NO: 2534911 - protein, 25 aa, Entamoeba dispar
NNPCALPYPIYNAAMLPPGWSIGQD

SEQ ID NO: 2534912 - protein, 26 aa, Entamoeba dispar
NNPKYNLREMFLPGFPGINKCAFVAM

SEQ ID NO: 2534913 - protein, 23 aa, Entamoeba dispar
NNPLLKPTIIPQLTIYFSSLELL

SEQ ID NO: 2534914 - protein, 24 aa, Entamoeba dispar
NNPNYIPFSFITLESPHAGVKKSQ

SEQ ID NO: 2534915 - protein, 30 aa, Entamoeba dispar
NNQCHKLNIPKYLMLPIPSEVLMESIIIPQ

SEQ ID NO: 2534916 - protein, 23 aa, Entamoeba dispar
NNQILALFQSFTLDQTKLSDNGK

SEQ ID NO: 2534917 - protein, 24 aa, Entamoeba dispar
NNQLIQTINQYYLIFISNVNTEIG

SEQ ID NO: 2534918 - protein, 20 aa, Entamoeba dispar
NNQLLLTREFLENIEIHPIS

SEQ ID NO: 2534919 - protein, 20 aa, Entamoeba dispar
NNQLPIITQLSFDSLENKII

SEQ ID NO: 2534920 - protein, 26 aa, Entamoeba dispar
NNQLQSFLNMVKFYELSKRINYKEKY

SEQ ID NO: 2534921 - protein, 21 aa, Entamoeba dispar
NNQPLGSSLFSFGVNNNKSAT

SEQ ID NO: 2534922 - protein, 18 aa, Entamoeba dispar
NNQPLKPIIFEKNLKKLS

SEQ ID NO: 2534923 - protein, 26 aa, Entamoeba dispar
NNQPNQIVFDYFNFALIALQSTDHCF

SEQ ID NO: 2534924 - protein, 19 aa, Entamoeba dispar
NNQRECLWIILEPISPLTV

SEQ ID NO: 2534925 - protein, 23 aa, Entamoeba dispar
NNQTYPYHFTYNSLLSKSKAGQL

SEQ ID NO: 2534926 - protein, 27 aa, Entamoeba dispar
NNREMVLLEWILFLDPVVNKTTKFNWN

SEQ ID NO: 2534927 - protein, 30 aa, Entamoeba dispar
NNRERWRRMLLETFRIIKLIKENDLVPLVE

SEQ ID NO: 2534928 - protein, 17 aa, Entamoeba dispar
NNRIYVGTNKGIKVIQG

SEQ ID NO: 2534929 - protein, 23 aa, Entamoeba dispar
NNRPFSLPHIYPTDISISNPRDA

SEQ ID NO: 2534930 - protein, 29 aa, Entamoeba dispar
NNRRRFKAVLYGVNQMLRFNTEKGKFEFD

SEQ ID NO: 2534931 - protein, 29 aa, Entamoeba dispar
NNRSRLSIGLMWWMLTREILRYQGKLARD

SEQ ID NO: 2534932 - protein, 30 aa, Entamoeba dispar
NNRSRLSIGLMWWMLTREILRYQGKLARDE

SEQ ID NO: 2534933 - protein, 25 aa, Entamoeba dispar
NNSAWSHRFYTLKSLNLLNDLNQLK

SEQ ID NO: 2534934 - protein, 29 aa, Entamoeba dispar
NNSFIIKYKKVYLIPKYSQIPYYVCFKND

SEQ ID NO: 2534935 - protein, 23 aa, Entamoeba dispar
NNSLLIKSLLQRGANHTGKYIGN

SEQ ID NO: 2534936 - protein, 23 aa, Entamoeba dispar
NNSPNCFHMFQAESMYLESMNYL

SEQ ID NO: 2534937 - protein, 25 aa, Entamoeba dispar
NNSQPLPITRLSKPLYIGIGSSWSR

SEQ ID NO: 2534938 - protein, 22 aa, Entamoeba dispar
NNTAFVLFRLIQEMAEFIGKNK

SEQ ID NO: 2534939 - protein, 28 aa, Entamoeba dispar
NNTAVNNPLLWKSYGTFETFNCGKIYGT

SEQ ID NO: 2534940 - protein, 20 aa, Entamoeba dispar
NNTEKCHIILLTDGYVDNKI

SEQ ID NO: 2534941 - protein, 28 aa, Entamoeba dispar
NNTGKPLNPIMLWYSEHRYRETYITSNG

SEQ ID NO: 2534942 - protein, 23 aa, Entamoeba dispar
NNTHNWTLFIRPFNEEDVELFNV

SEQ ID NO: 2534943 - protein, 31 aa, Entamoeba dispar
NNTRIGLMIYSDKITLFKYYNNHYSIDVFSE

SEQ ID NO: 2534944 - protein, 19 aa, Entamoeba dispar
NNTTIMWAAAAGQFELNVM

SEQ ID NO: 2534945 - protein, 18 aa, Entamoeba dispar
NNTVLFESSIFGCIFSLN

SEQ ID NO: 2534946 - protein, 28 aa, Entamoeba dispar
NNTYCHTPTYLPLYDADGLIIKQEGALN

SEQ ID NO: 2534947 - protein, 24 aa, Entamoeba dispar
NNVDWLNYLWEASSFIIPSRYQIQ

SEQ ID NO: 2534948 - protein, 27 aa, Entamoeba dispar
NNVFFIESSSWILKTKFADIPVLLMIP

SEQ ID NO: 2534949 - protein, 21 aa, Entamoeba dispar
NNVIPNGPLFNTIPLTQQYEN

SEQ ID NO: 2534950 - protein, 18 aa, Entamoeba dispar
NNVQIIRKYHIIERILSE

SEQ ID NO: 2534951 - protein, 23 aa, Entamoeba dispar
NNVQWFFDWCSINYEQTYILYGN

SEQ ID NO: 2534952 - protein, 21 aa, Entamoeba dispar
NNWNTILIWIEGGISMVEEKY

SEQ ID NO: 2534953 - protein, 22 aa, Entamoeba dispar
NNWSIALKYFIIDISVTSNMIF

SEQ ID NO: 2534954 - protein, 25 aa, Entamoeba dispar
NNYESLCPVYFSGGRMKVYGIPNSC

SEQ ID NO: 2534955 - protein, 18 aa, Entamoeba dispar
NNYFAWMGSVPYIEIPNK

SEQ ID NO: 2534956 - protein, 31 aa, Entamoeba dispar
NNYIKIVEPFFVKLFQNDILIRDIYNESLES

SEQ ID NO: 2534957 - protein, 18 aa, Entamoeba dispar
NNYLGMAEFSLLANLITK

SEQ ID NO: 2534958 - protein, 29 aa, Entamoeba dispar
NNYQKLPPKILAKQLILFDWRMTENINVN

SEQ ID NO: 2534959 - protein, 21 aa, Entamoeba dispar
NNYSKFYFCNLNKKEIESTNC

SEQ ID NO: 2534960 - protein, 19 aa, Entamoeba dispar
NNYWISCSETSFILLARGI

SEQ ID NO: 2534961 - protein, 18 aa, Entamoeba dispar
NNYYSPLHEIIRYEIKGK

SEQ ID NO: 2534962 - protein, 24 aa, Entamoeba dispar
NNYYTSLRNFYRVEKKEFIVFETI

SEQ ID NO: 2534963 - protein, 20 aa, Entamoeba dispar
NPCDNLLLRIYFEVDDNQYN

SEQ ID NO: 2534964 - protein, 18 aa, Entamoeba dispar
NPCFINDNSFKWFLNHFQ

SEQ ID NO: 2534965 - protein, 23 aa, Entamoeba dispar
NPCTSNIFFGKIFPVACFNNEGT

SEQ ID NO: 2534966 - protein, 23 aa, Entamoeba dispar
NPDKLTNSPFSLGGTSFGLLNEK

SEQ ID NO: 2534967 - protein, 21 aa, Entamoeba dispar
NPEHPYIPTSPKPKIPKALKI

SEQ ID NO: 2534968 - protein, 22 aa, Entamoeba dispar
NPEIPIALRISGHLLLGICRIY

SEQ ID NO: 2534969 - protein, 18 aa, Entamoeba dispar
NPELFKVLKMIIGSSFTD

SEQ ID NO: 2534970 - protein, 26 aa, Entamoeba dispar
NPEMNRFIFLLCTRAGGFGINLSEAD

SEQ ID NO: 2534971 - protein, 24 aa, Entamoeba dispar
NPETTILPLLMIKSILPRIESVFL

SEQ ID NO: 2534972 - protein, 22 aa, Entamoeba dispar
NPEYFIIAIAVRKGVVVLKRYK

SEQ ID NO: 2534973 - protein, 23 aa, Entamoeba dispar
NPEYLFDYALKQHFYTLFKIHDS

SEQ ID NO: 2534974 - protein, 21 aa, Entamoeba dispar
NPFCCKSLMKKIPIDTLLAVQ

SEQ ID NO: 2534975 - protein, 20 aa, Entamoeba dispar
NPFKEIFKLFSNIGNHTVSQ

SEQ ID NO: 2534976 - protein, 37 aa, Entamoeba dispar
NPFPISFALELYGRFYPIIPLKFTEGEFKWLGVKFDT

SEQ ID NO: 2534977 - protein, 27 aa, Entamoeba dispar
NPFSYIIQLRLKLFEILRYIFKSLTCY

SEQ ID NO: 2534978 - protein, 26 aa, Entamoeba dispar
NPFTEGVVFSVRPPKKAWKNITNLSG

SEQ ID NO: 2534979 - protein, 36 aa, Entamoeba dispar
NPFTTQYIEMVLFYIQVFRTPKLTKFFKIIITERND

SEQ ID NO: 2534980 - protein, 23 aa, Entamoeba dispar
NPGKRIWINGKKVCFKNFAEYAR

SEQ ID NO: 2534981 - protein, 21 aa, Entamoeba dispar
NPHCRYCLKPYQPFLNDCEKG

SEQ ID NO: 2534982 - protein, 18 aa, Entamoeba dispar
NPIAPVHILVIPKQHISS

SEQ ID NO: 2534983 - protein, 26 aa, Entamoeba dispar
NPICDYYQLLLYNNTIIQCLCDGCSI

SEQ ID NO: 2534984 - protein, 18 aa, Entamoeba dispar
NPIFITSLPRSGSTYLHN

SEQ ID NO: 2534985 - protein, 25 aa, Entamoeba dispar
NPIKEYPLTMLLKKIEDISGYSIKY

SEQ ID NO: 2534986 - protein, 26 aa, Entamoeba dispar
NPIKTLPTGFFKLKSLRFISLTNTLV

SEQ ID NO: 2534987 - protein, 19 aa, Entamoeba dispar
NPISSPIFRYITTQNLYSR

SEQ ID NO: 2534988 - protein, 24 aa, Entamoeba dispar
NPKALEIIPLQLPSSIKINFSFEI

SEQ ID NO: 2534989 - protein, 23 aa, Entamoeba dispar
NPKALNIFLTQAIDWEDPHEAAE

SEQ ID NO: 2534990 - protein, 17 aa, Entamoeba dispar
NPKFPFTISKRVKSKTV

SEQ ID NO: 2534991 - protein, 18 aa, Entamoeba dispar
NPKLIEMSMNGISLGIHS

SEQ ID NO: 2534992 - protein, 28 aa, Entamoeba dispar
NPLDANAWFVALAYTIKLSPRLNESKNI

SEQ ID NO: 2534993 - protein, 18 aa, Entamoeba dispar
NPLLITSPLDSRIKNDDL

SEQ ID NO: 2534994 - protein, 26 aa, Entamoeba dispar
NPLPFDMFILLFKSAVDDHYFIAAQT

SEQ ID NO: 2534995 - protein, 17 aa, Entamoeba dispar
NPLTLSAIITPRGSIRK

SEQ ID NO: 2534996 - protein, 18 aa, Entamoeba dispar
NPLYNYTNPMQNDIKCAL

SEQ ID NO: 2534997 - protein, 17 aa, Entamoeba dispar
NPMNYLVLHSINYTPKL

SEQ ID NO: 2534998 - protein, 23 aa, Entamoeba dispar
NPNDNILYFPRYTSQQLFSINSL

SEQ ID NO: 2534999 - protein, 22 aa, Entamoeba dispar
NPNINFCPILPNILGIVASCCT

SEQ ID NO: 2535000 - protein, 30 aa, Entamoeba dispar
NPNKINFVAYWTKQPHKIIFSSHFDTVPVG

SEQ ID NO: 2535001 - protein, 26 aa, Entamoeba dispar
NPNLGPPYHLLLDTNFIQFSIGKKVD

SEQ ID NO: 2535002 - protein, 30 aa, Entamoeba dispar
NPNLTTFIPVLIPEFLPLYETERLIQELMN

SEQ ID NO: 2535003 - protein, 28 aa, Entamoeba dispar
NPNMKSITLPTIYSRAFYLCLEKVVPFI

SEQ ID NO: 2535004 - protein, 22 aa, Entamoeba dispar
NPNNEIIILKNRINELLYQNEE

SEQ ID NO: 2535005 - protein, 21 aa, Entamoeba dispar
NPNNLFLRETFESYLLRISDE

SEQ ID NO: 2535006 - protein, 20 aa, Entamoeba dispar
NPPCLVELSLFLYQCDQINI

SEQ ID NO: 2535007 - protein, 22 aa, Entamoeba dispar
NPPEPIFFSSKYQPSQFPFKCF

SEQ ID NO: 2535008 - protein, 22 aa, Entamoeba dispar
NPQFHISVMALTLNLLKQPDVP

SEQ ID NO: 2535009 - protein, 18 aa, Entamoeba dispar
NPQLLISIKTPQSVNAVN

SEQ ID NO: 2535010 - protein, 32 aa, Entamoeba dispar
NPQNVKIISDLTWPAIYKLLQERIKSLEKEGY

SEQ ID NO: 2535011 - protein, 22 aa, Entamoeba dispar
NPQVKFVLIHEANNLFNNQFIS

SEQ ID NO: 2535012 - protein, 24 aa, Entamoeba dispar
NPRTQPTVFLPTEVTRLIPHVEHN

SEQ ID NO: 2535013 - protein, 23 aa, Entamoeba dispar
NPRVANFFACRAQYYNKAKKPNA

SEQ ID NO: 2535014 - protein, 26 aa, Entamoeba dispar
NPSATIPIILILCKADIEIPNIKKDL

SEQ ID NO: 2535015 - protein, 27 aa, Entamoeba dispar
NPSDPTNFLLLWNKINNFIWTFTKKCG

SEQ ID NO: 2535016 - protein, 23 aa, Entamoeba dispar
NPSIHDFILWLTSFCSNHENLPY

SEQ ID NO: 2535017 - protein, 25 aa, Entamoeba dispar
NPSKTEPLMFSMKLKTIDSLCIDSK

SEQ ID NO: 2535018 - protein, 17 aa, Entamoeba dispar
NPSNIVLVPLPSEKFKV

SEQ ID NO: 2535019 - protein, 27 aa, Entamoeba dispar
NPSNTPPVPLILFPKLDQSIVDECINQ

SEQ ID NO: 2535020 - protein, 27 aa, Entamoeba dispar
NPSPEEKLFILISEKLTFLKNLSTIST

SEQ ID NO: 2535021 - protein, 18 aa, Entamoeba dispar
NPTFFQRGVSTRPLMLIT

SEQ ID NO: 2535022 - protein, 25 aa, Entamoeba dispar
NPVIQKTMIFKTFLKGEVNRAKESF

SEQ ID NO: 2535023 - protein, 24 aa, Entamoeba dispar
NPVSCIVRILRIKQLRCKNQLNEF

SEQ ID NO: 2535024 - protein, 26 aa, Entamoeba dispar
NPVTRLRKLFEALFGCLKRGTRAVFQ

SEQ ID NO: 2535025 - protein, 19 aa, Entamoeba dispar
NPWIFWFESGKSSDRSTSI

SEQ ID NO: 2535026 - protein, 25 aa, Entamoeba dispar
NPWLTTPFSIIKFVYHFNPETVNCC

SEQ ID NO: 2535027 - protein, 18 aa, Entamoeba dispar
NPYFANLLKELSQQTMDK

SEQ ID NO: 2535028 - protein, 23 aa, Entamoeba dispar
NPYMPQQFYQPHSLQYQQQYQQN

SEQ ID NO: 2535029 - protein, 29 aa, Entamoeba dispar
NPYNELYHSILLELFNIKLGKLNSEESLK

SEQ ID NO: 2535030 - protein, 18 aa, Entamoeba dispar
NPYNLTLYQSFDKIIRIF

SEQ ID NO: 2535031 - protein, 30 aa, Entamoeba dispar
NPYQEVISIISKYFKKYTKEIYLYSFGDSI

SEQ ID NO: 2535032 - protein, 22 aa, Entamoeba dispar
NPYRKEFAFEYFNNAELSICNI

SEQ ID NO: 2535033 - protein, 20 aa, Entamoeba dispar
NPYRSKLGCTILKGVDNMTI

SEQ ID NO: 2535034 - protein, 20 aa, Entamoeba dispar
NPYVYIKSALLLSQEYRELC

SEQ ID NO: 2535035 - protein, 28 aa, Entamoeba dispar
NQANDLIPLFEFLLMFIENNISGTSWKN

SEQ ID NO: 2535036 - protein, 23 aa, Entamoeba dispar
NQAVFLFKGWGRSLDKRQSFKMF

SEQ ID NO: 2535037 - protein, 26 aa, Entamoeba dispar
NQCTLLTSIIFSTSLKIIESRAFMGC

SEQ ID NO: 2535038 - protein, 25 aa, Entamoeba dispar
NQDEMFRLYQFMRNDKECSLVLEND

SEQ ID NO: 2535039 - protein, 32 aa, Entamoeba dispar
NQDLTPIELPRLPEYIKYLCVHSINSNIVINQ

SEQ ID NO: 2535040 - protein, 26 aa, Entamoeba dispar
NQEFERFIRIYPLCQFNSISEMYDSF

SEQ ID NO: 2535041 - protein, 24 aa, Entamoeba dispar
NQEIKMDYMYLIKTQLIESMTLNG

SEQ ID NO: 2535042 - protein, 27 aa, Entamoeba dispar
NQELKYPLNNLIPFFSKSLEQITLDNV

SEQ ID NO: 2535043 - protein, 26 aa, Entamoeba dispar
NQELVVHLLKVLFTILYKIMKSSLIN

SEQ ID NO: 2535044 - protein, 18 aa, Entamoeba dispar
NQEWTVSQIYALVKKETN

SEQ ID NO: 2535045 - protein, 25 aa, Entamoeba dispar
NQEYNEIFIKLYDLAIFPQVTGASL

SEQ ID NO: 2535046 - protein, 20 aa, Entamoeba dispar
NQFGVIMPQCTLFRNSNGYE

SEQ ID NO: 2535047 - protein, 18 aa, Entamoeba dispar
NQFILTNKYSYIEFTKER

SEQ ID NO: 2535048 - protein, 22 aa, Entamoeba dispar
NQFYVFTLRNHCGIPPMKFTKK

SEQ ID NO: 2535049 - protein, 25 aa, Entamoeba dispar
NQGEFLFILFIRRFVELLKSNGCKL

SEQ ID NO: 2535050 - protein, 22 aa, Entamoeba dispar
NQGFHELVGVLYYCISRDIQSW

SEQ ID NO: 2535051 - protein, 26 aa, Entamoeba dispar
NQGGGKLKIYLYPNEPFNPKDENDAI

SEQ ID NO: 2535052 - protein, 23 aa, Entamoeba dispar
NQGNLFGGFGNNASFGTSNISSF

SEQ ID NO: 2535053 - protein, 24 aa, Entamoeba dispar
NQIEELFPLLKIIASSPLLQHFEL

SEQ ID NO: 2535054 - protein, 21 aa, Entamoeba dispar
NQIFKIVAGMLHLGNVEYSQG

SEQ ID NO: 2535055 - protein, 23 aa, Entamoeba dispar
NQIGRLCEIGFPDGFISVAKTTL

SEQ ID NO: 2535056 - protein, 18 aa, Entamoeba dispar
NQIIDRMINIKEKKLREV

SEQ ID NO: 2535057 - protein, 17 aa, Entamoeba dispar
NQIIPKILKYTKEPLLS

SEQ ID NO: 2535058 - protein, 26 aa, Entamoeba dispar
NQIKLTIPISMWYPQFIEAMKCYARA

SEQ ID NO: 2535059 - protein, 22 aa, Entamoeba dispar
NQILDFCCKRYHSGLSSIHCVD

SEQ ID NO: 2535060 - protein, 26 aa, Entamoeba dispar
NQINAHPIFYAFEPIITLFSRILPIE

SEQ ID NO: 2535061 - protein, 26 aa, Entamoeba dispar
NQIPLKLNIIVFSKFLFNAHDIYCSI

SEQ ID NO: 2535062 - protein, 26 aa, Entamoeba dispar
NQIQFHMIKMFPMLRRMKFDESFLQG

SEQ ID NO: 2535063 - protein, 25 aa, Entamoeba dispar
NQIQKYLLRILNQIICNLTIKENKE

SEQ ID NO: 2535064 - protein, 24 aa, Entamoeba dispar
NQIQKYLLRILNQIISNLTIKENK

SEQ ID NO: 2535065 - protein, 24 aa, Entamoeba dispar
NQIQQPMPIPPKPIGYLPPSYPQQ

SEQ ID NO: 2535066 - protein, 24 aa, Entamoeba dispar
NQIQTFLPDKLAFNKVIEYDRFTK

SEQ ID NO: 2535067 - protein, 24 aa, Entamoeba dispar
NQKDRIMHLFSVFVPKEKTGIVYI

SEQ ID NO: 2535068 - protein, 29 aa, Entamoeba dispar
NQKGKKVKHFYLFNDRLISGKPGNEIIVS

SEQ ID NO: 2535069 - protein, 26 aa, Entamoeba dispar
NQKKYMVTFPFPYMNGRLHLGHTFTV

SEQ ID NO: 2535070 - protein, 23 aa, Entamoeba dispar
NQKNYFIETFISPNIDALRRNTH

SEQ ID NO: 2535071 - protein, 21 aa, Entamoeba dispar
NQKPEFIVIKEDVIPHKKESI

SEQ ID NO: 2535072 - protein, 24 aa, Entamoeba dispar
NQKPFSIEIKFITIQLKLTMEKED

SEQ ID NO: 2535073 - protein, 22 aa, Entamoeba dispar
NQKPLPPLPVKKQEIKPENNNV

SEQ ID NO: 2535074 - protein, 17 aa, Entamoeba dispar
NQKVLFGDIVLNGLLLP

SEQ ID NO: 2535075 - protein, 21 aa, Entamoeba dispar
NQKYYDFRKIFGKVGIMTGDV

SEQ ID NO: 2535076 - protein, 30 aa, Entamoeba dispar
NQLDDNSLVLYLSYFIIKDNRFGPNDMKVA

SEQ ID NO: 2535077 - protein, 38 aa, Entamoeba dispar
NQLDLRSYLIMPVQRLPRYKLLLTDLIKHTDDGFVDKP

SEQ ID NO: 2535078 - protein, 17 aa, Entamoeba dispar
NQLHFFTIDSSWKEIDL

SEQ ID NO: 2535079 - protein, 33 aa, Entamoeba dispar
NQLIDIGIIVFPFIEIPFIPIQVIRVRFDCVEE

SEQ ID NO: 2535080 - protein, 19 aa, Entamoeba dispar
NQLIFTKNGGYSSQLSYIV

SEQ ID NO: 2535081 - protein, 23 aa, Entamoeba dispar
NQLLDILRDFFGFSFEECVKKKP

SEQ ID NO: 2535082 - protein, 17 aa, Entamoeba dispar
NQLLINKASLSLKTLFG

SEQ ID NO: 2535083 - protein, 19 aa, Entamoeba dispar
NQLLQIVRLLILSKESIKS

SEQ ID NO: 2535084 - protein, 17 aa, Entamoeba dispar
NQLLSLIINAFYSNKDI

SEQ ID NO: 2535085 - protein, 26 aa, Entamoeba dispar
NQLNFPLCFTIFGATHYSFKNKAAVM

SEQ ID NO: 2535086 - protein, 27 aa, Entamoeba dispar
NQLNFPLCFTIFGATHYSFKNKAAVML

SEQ ID NO: 2535087 - protein, 29 aa, Entamoeba dispar
NQLPEELKTLFIHLLRLCNKIAQNEQINS

SEQ ID NO: 2535088 - protein, 31 aa, Entamoeba dispar
NQLTINGILIERAAFIILGALIAPVLESSIV

SEQ ID NO: 2535089 - protein, 19 aa, Entamoeba dispar
NQLYLMNVNTEKLLFTFKF

SEQ ID NO: 2535090 - protein, 17 aa, Entamoeba dispar
NQMFHPIEWYLEHLMDE

SEQ ID NO: 2535091 - protein, 18 aa, Entamoeba dispar
NQMIPSKRLSLLSSVGTL

SEQ ID NO: 2535092 - protein, 23 aa, Entamoeba dispar
NQNDFKIPIIKKKQIKPQPRRQT

SEQ ID NO: 2535093 - protein, 28 aa, Entamoeba dispar
NQNDPIDPLLHFQLPIVNDSEPLRLESF

SEQ ID NO: 2535094 - protein, 32 aa, Entamoeba dispar
NQNEMTIIANQAWIVMKIVDENWIIGKRSGVE

SEQ ID NO: 2535095 - protein, 26 aa, Entamoeba dispar
NQNGRFYPFIMYGAKATLPTGAGDIT

SEQ ID NO: 2535096 - protein, 26 aa, Entamoeba dispar
NQNGRFYPFIMYGAKATLPTGDGDIT

SEQ ID NO: 2535097 - protein, 31 aa, Entamoeba dispar
NQNINLEPYLHQLFPIILTLVVTKQIGTNSY

SEQ ID NO: 2535098 - protein, 25 aa, Entamoeba dispar
NQNPDLLCTWYLDNTCCVWNVETRR

SEQ ID NO: 2535099 - protein, 26 aa, Entamoeba dispar
NQNYFCINTPLLFNKINFSKEIVLSS

SEQ ID NO: 2535100 - protein, 22 aa, Entamoeba dispar
NQNYILRFGGWNENIKIGRLNK

SEQ ID NO: 2535101 - protein, 22 aa, Entamoeba dispar
NQPELQLDIIWTYCNISSETVD

SEQ ID NO: 2535102 - protein, 20 aa, Entamoeba dispar
NQPFNVVWTRVEKALRKEGV

SEQ ID NO: 2535103 - protein, 24 aa, Entamoeba dispar
NQPFSQFFHVLFKKFMEVEGVQEQ

SEQ ID NO: 2535104 - protein, 26 aa, Entamoeba dispar
NQPIQYQHILQKPLYNPIPIREEPQT

SEQ ID NO: 2535105 - protein, 25 aa, Entamoeba dispar
NQPKYQQLLNIIKASSEPGEEFFDI

SEQ ID NO: 2535106 - protein, 23 aa, Entamoeba dispar
NQPNIELYYYPEKDTIFSCINAF

SEQ ID NO: 2535107 - protein, 29 aa, Entamoeba dispar
NQPQNLMCDWYIPIDLKYKHLINQTQTMG

SEQ ID NO: 2535108 - protein, 24 aa, Entamoeba dispar
NQQETIQTLKFLNKLKTIKNVPIY

SEQ ID NO: 2535109 - protein, 36 aa, Entamoeba dispar
NQQFEFKKLFALCVFLAWHYKMPLKKLINAPQGAQS

SEQ ID NO: 2535110 - protein, 21 aa, Entamoeba dispar
NQQFVEIFEKELIKFKEQIEE

SEQ ID NO: 2535111 - protein, 23 aa, Entamoeba dispar
NQQKKLIPLFNKITTLTFYKTKE

SEQ ID NO: 2535112 - protein, 23 aa, Entamoeba dispar
NQQSIPMYLPQQNNFIYFQDIPS

SEQ ID NO: 2535113 - protein, 25 aa, Entamoeba dispar
NQQWKELVFLYVQVDQVKAIETMIS

SEQ ID NO: 2535114 - protein, 38 aa, Entamoeba dispar
NQRFARYVIFIKKPKRFVVESLFDIPLMKSLEPNITEM

SEQ ID NO: 2535115 - protein, 17 aa, Entamoeba dispar
NQRKINEAFFKLRNYQV

SEQ ID NO: 2535116 - protein, 17 aa, Entamoeba dispar
NQRLPLSDIRPSLNDPR

SEQ ID NO: 2535117 - protein, 19 aa, Entamoeba dispar
NQRTAMLLHRLFARGMAFC

SEQ ID NO: 2535118 - protein, 20 aa, Entamoeba dispar
NQRVPLGNYLKFAPVHSVLP

SEQ ID NO: 2535119 - protein, 21 aa, Entamoeba dispar
NQSDEIWICRGDMGVQLGFVG

SEQ ID NO: 2535120 - protein, 20 aa, Entamoeba dispar
NQSFDYLTILELEKAQPIII

SEQ ID NO: 2535121 - protein, 31 aa, Entamoeba dispar
NQSHCIECEYGYYLNLNTKTCEEFKNGCKIG

SEQ ID NO: 2535122 - protein, 27 aa, Entamoeba dispar
NQSLTLFEPSQLPEYIKYLCVHSTNSN

SEQ ID NO: 2535123 - protein, 36 aa, Entamoeba dispar
NQSVVKLYYAFQDKCSLFLVMEFCPGGDLACLIREV

SEQ ID NO: 2535124 - protein, 24 aa, Entamoeba dispar
NQTESWCWFNGCMSLTAITITTRV

SEQ ID NO: 2535125 - protein, 19 aa, Entamoeba dispar
NQTFLLYDAAPEVCIFLFK

SEQ ID NO: 2535126 - protein, 17 aa, Entamoeba dispar
NQTLLNSLLQFRKDKNI

SEQ ID NO: 2535127 - protein, 22 aa, Entamoeba dispar
NQTLLPLIYNNISLPTNGSLVP

SEQ ID NO: 2535128 - protein, 30 aa, Entamoeba dispar
NQTPVQITVLPYIPISPKQPGLSSSRVTSR

SEQ ID NO: 2535129 - protein, 25 aa, Entamoeba dispar
NQTSIKFNIYKGFGKCVNSYKMEYI

SEQ ID NO: 2535130 - protein, 25 aa, Entamoeba dispar
NQTTPSIIPFIPSINEGKLPSVQQF

SEQ ID NO: 2535131 - protein, 20 aa, Entamoeba dispar
NQVAQYIRSISDPAMRAGAK

SEQ ID NO: 2535132 - protein, 23 aa, Entamoeba dispar
NQVAQYIRSISDPAMRAGAKRRF

SEQ ID NO: 2535133 - protein, 36 aa, Entamoeba dispar
NQVCHFLNVFKGCIQDITWLPGGLRMMACSVDGFVA

SEQ ID NO: 2535134 - protein, 32 aa, Entamoeba dispar
NQVIRLLPEQVSALILLKVKELILKIHKNVTI

SEQ ID NO: 2535135 - protein, 31 aa, Entamoeba dispar
NQVKELCEKFFFNYQIPKQTTIYKQTVVIAK

SEQ ID NO: 2535136 - protein, 23 aa, Entamoeba dispar
NQVLRKTVFDLTSYLTNLKVVSP

SEQ ID NO: 2535137 - protein, 22 aa, Entamoeba dispar
NQVQRIFFMLEDHKKITTIYSF

SEQ ID NO: 2535138 - protein, 26 aa, Entamoeba dispar
NQWNKVNIMFIQIKEYYLLFKTKINE

SEQ ID NO: 2535139 - protein, 29 aa, Entamoeba dispar
NQWVSNICEILFVATLDFLLEQHEYCMLL

SEQ ID NO: 2535140 - protein, 19 aa, Entamoeba dispar
NQYETLLMGYLPTNYTQQP

SEQ ID NO: 2535141 - protein, 21 aa, Entamoeba dispar
NQYLMLKKQCSERHIISSSST

SEQ ID NO: 2535142 - protein, 24 aa, Entamoeba dispar
NQYLYIIMEYVRGGELLDALKKEK

SEQ ID NO: 2535143 - protein, 33 aa, Entamoeba dispar
NQYPILEIAQLLNSIILVIPRFVQKTLNCLEQI

SEQ ID NO: 2535144 - protein, 23 aa, Entamoeba dispar
NRAPALLIAYLIQNNKMSFMNAF

SEQ ID NO: 2535145 - protein, 19 aa, Entamoeba dispar
NRCFYKCYSLTTINIPSTI

SEQ ID NO: 2535146 - protein, 25 aa, Entamoeba dispar
NRCGLKVLVPLWQKDQKDVLDEIIE

SEQ ID NO: 2535147 - protein, 25 aa, Entamoeba dispar
NRDEFLCHIVTLNRTFHLRELLPFD

SEQ ID NO: 2535148 - protein, 25 aa, Entamoeba dispar
NRDTIRSLYPSIPIICATSNQEEED

SEQ ID NO: 2535149 - protein, 32 aa, Entamoeba dispar
NRDWMHYGRRPSGICGVALYLAGRLHGEPRTL

SEQ ID NO: 2535150 - protein, 20 aa, Entamoeba dispar
NREDPFCQVIIIVNTRELAR

SEQ ID NO: 2535151 - protein, 19 aa, Entamoeba dispar
NREFGEKMRKYLMKQEKAV

SEQ ID NO: 2535152 - protein, 17 aa, Entamoeba dispar
NREILILQDLRDGPNII

SEQ ID NO: 2535153 - protein, 17 aa, Entamoeba dispar
NRELIGIKLPTSLKEIN

SEQ ID NO: 2535154 - protein, 26 aa, Entamoeba dispar
NRELKLIEPLLCPISFDGDISISISH

SEQ ID NO: 2535155 - protein, 20 aa, Entamoeba dispar
NRFFSHLHPEYRKKLRENKI

SEQ ID NO: 2535156 - protein, 32 aa, Entamoeba dispar
NRFSNNLKYIIKFIYDILPFSDIWKHICIVWT

SEQ ID NO: 2535157 - protein, 29 aa, Entamoeba dispar
NRGIPLNRILMFISIFYLECFRCSQLRFE

SEQ ID NO: 2535158 - protein, 22 aa, Entamoeba dispar
NRGTVSSYFKKAKIHLLVGSTQ

SEQ ID NO: 2535159 - protein, 24 aa, Entamoeba dispar
NRHIIVWDRRFTKGIKFFDLKAKY

SEQ ID NO: 2535160 - protein, 23 aa, Entamoeba dispar
NRHIIVWDRRFTKGIKFFDLKAN

SEQ ID NO: 2535161 - protein, 24 aa, Entamoeba dispar
NRHLPIKIILIVEGLTFYQKGIDA

SEQ ID NO: 2535162 - protein, 18 aa, Entamoeba dispar
NRIKLFEGILEIIDGSYE

SEQ ID NO: 2535163 - protein, 20 aa, Entamoeba dispar
NRIKTYILCIAPSFIEEIKN

SEQ ID NO: 2535164 - protein, 20 aa, Entamoeba dispar
NRINLILQKEKNESWSSFEK

SEQ ID NO: 2535165 - protein, 17 aa, Entamoeba dispar
NRKILPEPISPIGLELS

SEQ ID NO: 2535166 - protein, 18 aa, Entamoeba dispar
NRKKYYGIPYNWNELENN

SEQ ID NO: 2535167 - protein, 18 aa, Entamoeba dispar
NRKTLYKKIIGEKNIMFY

SEQ ID NO: 2535168 - protein, 23 aa, Entamoeba dispar
NRKTVIHWFLDFYNVECPYSIHS

SEQ ID NO: 2535169 - protein, 18 aa, Entamoeba dispar
NRLAIYLSIALEPNELCK

SEQ ID NO: 2535170 - protein, 21 aa, Entamoeba dispar
NRLEIFWEQFLLSVLSFCLKE

SEQ ID NO: 2535171 - protein, 26 aa, Entamoeba dispar
NRLGQLLWDFGVPTAMSIWEASQCSL

SEQ ID NO: 2535172 - protein, 26 aa, Entamoeba dispar
NRLINRLQYLNRLWEAGIYAETLQRV

SEQ ID NO: 2535173 - protein, 25 aa, Entamoeba dispar
NRLNWCIPPLVFALLKAGRVQESLR

SEQ ID NO: 2535174 - protein, 18 aa, Entamoeba dispar
NRLQKKKIFNREKRIVFD

SEQ ID NO: 2535175 - protein, 24 aa, Entamoeba dispar
NRMAGAKIIATKLAERNGINLNEF

SEQ ID NO: 2535176 - protein, 20 aa, Entamoeba dispar
NRNLLLKKINIWLGDNRSQS

SEQ ID NO: 2535177 - protein, 27 aa, Entamoeba dispar
NRNRRNEWFIKQFHPINLRERRMAKQR

SEQ ID NO: 2535178 - protein, 22 aa, Entamoeba dispar
NRPELIVLDPPRTGIHPTALSK

SEQ ID NO: 2535179 - protein, 17 aa, Entamoeba dispar
NRPISEHFKYGIINLDK

SEQ ID NO: 2535180 - protein, 22 aa, Entamoeba dispar
NRPNTFCLFGDNFAQIITVEGN

SEQ ID NO: 2535181 - protein, 17 aa, Entamoeba dispar
NRQFQKDGFLKTVVPKN

SEQ ID NO: 2535182 - protein, 26 aa, Entamoeba dispar
NRQIYPPINVLPSLSRLMKSAIGEGM

SEQ ID NO: 2535183 - protein, 27 aa, Entamoeba dispar
NRRRIGHNLFWFLKAEIHDARVTGRYG

SEQ ID NO: 2535184 - protein, 26 aa, Entamoeba dispar
NRSEGYYAFCILLKGIDLNLFTFEED

SEQ ID NO: 2535185 - protein, 23 aa, Entamoeba dispar
NRSKEFFKYILSFITDNEIVIGE

SEQ ID NO: 2535186 - protein, 21 aa, Entamoeba dispar
NRSSFTPIIEKSNSLANILND

SEQ ID NO: 2535187 - protein, 29 aa, Entamoeba dispar
NRSVIPSHYYLFSLIGWIANQLMTQPIPN

SEQ ID NO: 2535188 - protein, 30 aa, Entamoeba dispar
NRTMFHFFERFLLCNNLYLTTYRIVLFESF

SEQ ID NO: 2535189 - protein, 17 aa, Entamoeba dispar
NRTNLYAFLALARVMAK

SEQ ID NO: 2535190 - protein, 26 aa, Entamoeba dispar
NRVDKIYTQRIILFVGSPLNINSEEA

SEQ ID NO: 2535191 - protein, 18 aa, Entamoeba dispar
NRVLSCRCDIIIKNGQVE

SEQ ID NO: 2535192 - protein, 19 aa, Entamoeba dispar
NRVVPWFETTFVPNWVRRY

SEQ ID NO: 2535193 - protein, 26 aa, Entamoeba dispar
NRYDTPLKCNPLYLLDEKTKNCVLQA

SEQ ID NO: 2535194 - protein, 19 aa, Entamoeba dispar
NRYEILDFLGVGGFGVVRK

SEQ ID NO: 2535195 - protein, 28 aa, Entamoeba dispar
NRYNFKTKIIYLALMVNWILKADETGEL

SEQ ID NO: 2535196 - protein, 24 aa, Entamoeba dispar
NSAKIRVVFETFLEQFNSIFGDIA

SEQ ID NO: 2535197 - protein, 25 aa, Entamoeba dispar
NSANILNVGFVKSLLITNCESIDFS

SEQ ID NO: 2535198 - protein, 34 aa, Entamoeba dispar
NSARNRILYIYRVIRPFRLIEVDVIPNVFAIALL

SEQ ID NO: 2535199 - protein, 19 aa, Entamoeba dispar
NSCIPLEGLFRGIKGYYNY

SEQ ID NO: 2535200 - protein, 23 aa, Entamoeba dispar
NSCIQLLFSMKSFVSYLSFNSPS

SEQ ID NO: 2535201 - protein, 17 aa, Entamoeba dispar
NSCLELAWSQIQTFLIK

SEQ ID NO: 2535202 - protein, 24 aa, Entamoeba dispar
NSCTLTIHWQFDVTLRGLRKVLVS

SEQ ID NO: 2535203 - protein, 26 aa, Entamoeba dispar
NSCVKFIREFKLFPYIDILTLNCSYF

SEQ ID NO: 2535204 - protein, 24 aa, Entamoeba dispar
NSCYILDCYSEMYMWVGTRVIKDR

SEQ ID NO: 2535205 - protein, 25 aa, Entamoeba dispar
NSDDVLNLKLFPFKKVTICLGSYHD

SEQ ID NO: 2535206 - protein, 17 aa, Entamoeba dispar
NSDEIWLQAIRLHPIEV

SEQ ID NO: 2535207 - protein, 17 aa, Entamoeba dispar
NSDFFYRGLKDCVVDIS

SEQ ID NO: 2535208 - protein, 25 aa, Entamoeba dispar
NSDFKYLLGLLFQVYMNHHKSNLLS

SEQ ID NO: 2535209 - protein, 25 aa, Entamoeba dispar
NSDFYLLKEYSLNNALNIFSWIIPC

SEQ ID NO: 2535210 - protein, 26 aa, Entamoeba dispar
NSDLEKLFNWTLWKEIPINAKKPIKK

SEQ ID NO: 2535211 - protein, 19 aa, Entamoeba dispar
NSDLVITIPGAFWVTSDGK

SEQ ID NO: 2535212 - protein, 23 aa, Entamoeba dispar
NSDPINSLFLLFGTRFNKDVPSQ

SEQ ID NO: 2535213 - protein, 18 aa, Entamoeba dispar
NSDTIYNFVYLSYSYDAD

SEQ ID NO: 2535214 - protein, 33 aa, Entamoeba dispar
NSEAKKKWLINRNPSLPLPKPNDIENIRIFIKA

SEQ ID NO: 2535215 - protein, 23 aa, Entamoeba dispar
NSEEFKKFCFNRDICTIEIKEIP

SEQ ID NO: 2535216 - protein, 29 aa, Entamoeba dispar
NSEELALFKLLYNHPITTPSLFIMNKGGL

SEQ ID NO: 2535217 - protein, 25 aa, Entamoeba dispar
NSEGFKLFVNLCCDTFLILRKNYHG

SEQ ID NO: 2535218 - protein, 25 aa, Entamoeba dispar
NSEIDLYNEILLFPGLPASIQNEIG

SEQ ID NO: 2535219 - protein, 31 aa, Entamoeba dispar
NSEIVRGFIFNLFEYKLYVILDKSVRVIQFG

SEQ ID NO: 2535220 - protein, 31 aa, Entamoeba dispar
NSEQRIQIIRKITPTFFIISKNIHGTRSIQK

SEQ ID NO: 2535221 - protein, 29 aa, Entamoeba dispar
NSESKIGGLFIKLAPFLKIYGEYCKNYPE

SEQ ID NO: 2535222 - protein, 17 aa, Entamoeba dispar
NSEWYKERLITRQKLEI

SEQ ID NO: 2535223 - protein, 17 aa, Entamoeba dispar
NSFFMKSELIAHVKEKH

SEQ ID NO: 2535224 - protein, 22 aa, Entamoeba dispar
NSFGYIELFDLLYSISKINNKD

SEQ ID NO: 2535225 - protein, 19 aa, Entamoeba dispar
NSFHFLLEGLTHEVFSVQP

SEQ ID NO: 2535226 - protein, 18 aa, Entamoeba dispar
NSFKILRCYIIDPNPHIN

SEQ ID NO: 2535227 - protein, 25 aa, Entamoeba dispar
NSFKKEFLPLIDLMFFKQRYNRDIN

SEQ ID NO: 2535228 - protein, 19 aa, Entamoeba dispar
NSFKPYIGFIGYARNNNGL

SEQ ID NO: 2535229 - protein, 23 aa, Entamoeba dispar
NSFNQLLSFGYLFDQSENSYKLF

SEQ ID NO: 2535230 - protein, 24 aa, Entamoeba dispar
NSFNQLLSFGYLFDQSENSYKLFL

SEQ ID NO: 2535231 - protein, 21 aa, Entamoeba dispar
NSFPKKYLPTVFDNYLAKVQY

SEQ ID NO: 2535232 - protein, 18 aa, Entamoeba dispar
NSFRQTLRWLTEEPNKEK

SEQ ID NO: 2535233 - protein, 26 aa, Entamoeba dispar
NSFVNALYGIKITDDFRYIIINEDNL

SEQ ID NO: 2535234 - protein, 26 aa, Entamoeba dispar
NSGCTAAVVLIIGRFLICANVGDSEV

SEQ ID NO: 2535235 - protein, 33 aa, Entamoeba dispar
NSGILFPMCLQLKRLYAKLLFQSSGIGSIKKNF

SEQ ID NO: 2535236 - protein, 18 aa, Entamoeba dispar
NSGKIKTLDLGNYHLKFL

SEQ ID NO: 2535237 - protein, 38 aa, Entamoeba dispar
NSGKIKTLDLGNYHLKFLIQPFLHWPDTMMTVIEELKV

SEQ ID NO: 2535238 - protein, 25 aa, Entamoeba dispar
NSHLPELHILLSKFVMIRRLKEEVL

SEQ ID NO: 2535239 - protein, 26 aa, Entamoeba dispar
NSIDASWIFTFDTYDFRLFVGNQEES

SEQ ID NO: 2535240 - protein, 25 aa, Entamoeba dispar
NSIEIKLFPSLIFKSSKCVFGGNIT

SEQ ID NO: 2535241 - protein, 23 aa, Entamoeba dispar
NSIESFWRAFGCLPSLELLQDQK

SEQ ID NO: 2535242 - protein, 35 aa, Entamoeba dispar
NSIHNVQYFPKLKRLILYNLLLSSSILHIIKNSPY

SEQ ID NO: 2535243 - protein, 29 aa, Entamoeba dispar
NSIIEHIYNIFLYNDIRLTSNPVLSSYSF

SEQ ID NO: 2535244 - protein, 20 aa, Entamoeba dispar
NSIIIIWKNNIKNVDNYLQQ

SEQ ID NO: 2535245 - protein, 22 aa, Entamoeba dispar
NSIIYIINPLSCNMCYAYNGHA

SEQ ID NO: 2535246 - protein, 31 aa, Entamoeba dispar
NSIKIWDIRSITPLCTIPFSTKMTAVCWNET

SEQ ID NO: 2535247 - protein, 18 aa, Entamoeba dispar
NSILESISFWYGNNDCRC

SEQ ID NO: 2535248 - protein, 17 aa, Entamoeba dispar
NSISFYNETIFLTAGSD

SEQ ID NO: 2535249 - protein, 17 aa, Entamoeba dispar
NSIVLITKCKIIKTKNG

SEQ ID NO: 2535250 - protein, 27 aa, Entamoeba dispar
NSKDAIFIWLNLLYEMNLNIPLESIIM

SEQ ID NO: 2535251 - protein, 26 aa, Entamoeba dispar
NSKDIMLRYHVITVFVLIAQKKLVPH

SEQ ID NO: 2535252 - protein, 17 aa, Entamoeba dispar
NSKDIQISILERKIDEL

SEQ ID NO: 2535253 - protein, 22 aa, Entamoeba dispar
NSKDYLIFVTNNQQLVIAQLND

SEQ ID NO: 2535254 - protein, 37 aa, Entamoeba dispar
NSKIVIPQVVFNLCWWIYTYGYLVEGVFRVSGDTEFT

SEQ ID NO: 2535255 - protein, 21 aa, Entamoeba dispar
NSKIYIITTLYHGPTKDGIIR

SEQ ID NO: 2535256 - protein, 23 aa, Entamoeba dispar
NSKKKIILYCWSIIMDIKSLQKS

SEQ ID NO: 2535257 - protein, 17 aa, Entamoeba dispar
NSKLFIGKSLFFQTIAL

SEQ ID NO: 2535258 - protein, 24 aa, Entamoeba dispar
NSKLISLLSFISTGPTIGGLTFDT

SEQ ID NO: 2535259 - protein, 17 aa, Entamoeba dispar
NSKLRGMKRPVYVAPEG

SEQ ID NO: 2535260 - protein, 17 aa, Entamoeba dispar
NSKLYCLYYCRQDVEIL

SEQ ID NO: 2535261 - protein, 23 aa, Entamoeba dispar
NSKPINFLNIPCTPFLISEPLNS

SEQ ID NO: 2535262 - protein, 28 aa, Entamoeba dispar
NSKYIPFTNNYFFKWQFNDTITCKLGIQ

SEQ ID NO: 2535263 - protein, 17 aa, Entamoeba dispar
NSLICWSEPLKGTAICV

SEQ ID NO: 2535264 - protein, 23 aa, Entamoeba dispar
NSLIKFKPTRRFLTVVKKSFPEE

SEQ ID NO: 2535265 - protein, 33 aa, Entamoeba dispar
NSLITYKNLIAQRSFLPIYLYGMSQHELFNNKQ

SEQ ID NO: 2535266 - protein, 18 aa, Entamoeba dispar
NSLKEPLTFTFSSSLKEG

SEQ ID NO: 2535267 - protein, 23 aa, Entamoeba dispar
NSLKFELTLPLSLQKLFIFSSKF

SEQ ID NO: 2535268 - protein, 28 aa, Entamoeba dispar
NSLNVVNPLLVFLSAVKLATDTVALILK

SEQ ID NO: 2535269 - protein, 18 aa, Entamoeba dispar
NSLQRILLPCGIDINKWY

SEQ ID NO: 2535270 - protein, 27 aa, Entamoeba dispar
NSLSSQQLDFLFPAPTSARHISQSSSP

SEQ ID NO: 2535271 - protein, 31 aa, Entamoeba dispar
NSLSTHLSVIRKTPQSLLKIGDSFLQIFNQE

SEQ ID NO: 2535272 - protein, 24 aa, Entamoeba dispar
NSLSVIICTLPDERLLSKLESSHK

SEQ ID NO: 2535273 - protein, 29 aa, Entamoeba dispar
NSLTGSFIMLRYINPAIFSPEKYGIVDDP

SEQ ID NO: 2535274 - protein, 24 aa, Entamoeba dispar
NSLVMFWDRILANLKSRQYLQCFC

SEQ ID NO: 2535275 - protein, 17 aa, Entamoeba dispar
NSLWLSMNSFVLSIFNY

SEQ ID NO: 2535276 - protein, 24 aa, Entamoeba dispar
NSLYFNPLSQLLKAYYPLFSHPNP

SEQ ID NO: 2535277 - protein, 24 aa, Entamoeba dispar
NSMFSKPISLLFPTSLTRLEITTS

SEQ ID NO: 2535278 - protein, 29 aa, Entamoeba dispar
NSMIIQQSITFIILSLTMLNGEAIFQEVL

SEQ ID NO: 2535279 - protein, 17 aa, Entamoeba dispar
NSMVFSSFIHNHATKFT

SEQ ID NO: 2535280 - protein, 23 aa, Entamoeba dispar
NSNDLMTLLPISHSHLLFLQQWS

SEQ ID NO: 2535281 - protein, 28 aa, Entamoeba dispar
NSNDNINLLLSLYLPSLQSFNLPSFSIV

SEQ ID NO: 2535282 - protein, 25 aa, Entamoeba dispar
NSNFSFYWDLLKICQMKIKEKQLPF

SEQ ID NO: 2535283 - protein, 28 aa, Entamoeba dispar
NSNFSILPQFMYHLRRSHFLQVFNCSPD

SEQ ID NO: 2535284 - protein, 26 aa, Entamoeba dispar
NSNGGRLFVRDPTMSATKKTDAYINL

SEQ ID NO: 2535285 - protein, 26 aa, Entamoeba dispar
NSNGSQLIRFPLLKNVYADTVLSNST

SEQ ID NO: 2535286 - protein, 36 aa, Entamoeba dispar
NSNGWAYCQVGYRFGYVPIKYLEKVNLAKELGGRNR

SEQ ID NO: 2535287 - protein, 23 aa, Entamoeba dispar
NSNINKQLKIKKLVRGCVGIKRK

SEQ ID NO: 2535288 - protein, 45 aa, Entamoeba dispar
NSPIRLDGLYRKMFIKHLWEVFTTSLFNFLWPPIIERNEGDVVFE

SEQ ID NO: 2535289 - protein, 19 aa, Entamoeba dispar
NSPRIAILEPWVDGLSSCT

SEQ ID NO: 2535290 - protein, 30 aa, Entamoeba dispar
NSPTNLFTIQFFFQVARILKLDGIFCLLTD

SEQ ID NO: 2535291 - protein, 26 aa, Entamoeba dispar
NSQFNKFLWGLLNSHPSFLKFKEALT

SEQ ID NO: 2535292 - protein, 25 aa, Entamoeba dispar
NSQFRVTYLLNCVVIPWLHETNVGI

SEQ ID NO: 2535293 - protein, 19 aa, Entamoeba dispar
NSQKLLPDKGFYLKDDQPN

SEQ ID NO: 2535294 - protein, 20 aa, Entamoeba dispar
NSQLKLYLKRTELSGYEKAR

SEQ ID NO: 2535295 - protein, 33 aa, Entamoeba dispar
NSQTTPIHLLPSKIFRKVMSIMLHGFIEETIIY

SEQ ID NO: 2535296 - protein, 30 aa, Entamoeba dispar
NSQVKKEPKKWWKYAFNVILEDVRKKNQPH

SEQ ID NO: 2535297 - protein, 33 aa, Entamoeba dispar
NSRIISMKIIGKYIIVLCFDMLFCFDQEIKYVF

SEQ ID NO: 2535298 - protein, 17 aa, Entamoeba dispar
NSRIWLNSALSGKTKRV

SEQ ID NO: 2535299 - protein, 17 aa, Entamoeba dispar
NSRIWLNSALSGRTKRI

SEQ ID NO: 2535300 - protein, 26 aa, Entamoeba dispar
NSRKKLTLIILYRGVVVTDIPVIRKK

SEQ ID NO: 2535301 - protein, 23 aa, Entamoeba dispar
NSRLDQWILHRLNVMITLVHQWF

SEQ ID NO: 2535302 - protein, 17 aa, Entamoeba dispar
NSRLLTIFSPHELELLI

SEQ ID NO: 2535303 - protein, 22 aa, Entamoeba dispar
NSRVVVDFYASWCGPCKMISPV

SEQ ID NO: 2535304 - protein, 17 aa, Entamoeba dispar
NSSANKAALNKALCLSK

SEQ ID NO: 2535305 - protein, 27 aa, Entamoeba dispar
NSSFVKYYLKCRFPLLFGVSLIDGERL

SEQ ID NO: 2535306 - protein, 17 aa, Entamoeba dispar
NSSIYRQYLNDIFTILI

SEQ ID NO: 2535307 - protein, 18 aa, Entamoeba dispar
NSSKFIDFCIISDSQIGV

SEQ ID NO: 2535308 - protein, 35 aa, Entamoeba dispar
NSSLIQRLQFDLSPSSSFLFIPIEDDDLLLMNCIN

SEQ ID NO: 2535309 - protein, 24 aa, Entamoeba dispar
NSSQNYLLECYGAFILESESSAKR

SEQ ID NO: 2535310 - protein, 34 aa, Entamoeba dispar
NSSSLKGIITVRIFNIPFTWKEHDVLEYFKEFHP

SEQ ID NO: 2535311 - protein, 17 aa, Entamoeba dispar
NSSTNIYKQLFGQKDFG

SEQ ID NO: 2535312 - protein, 19 aa, Entamoeba dispar
NSSWTLWYDQPSNESIPYG

SEQ ID NO: 2535313 - protein, 21 aa, Entamoeba dispar
NSTELFFTTLWSELDINDKQY

SEQ ID NO: 2535314 - protein, 22 aa, Entamoeba dispar
NSTHNKWIIQFPKRFVEIKGEN

SEQ ID NO: 2535315 - protein, 23 aa, Entamoeba dispar
NSVAYLLDYIIDTFPKHSIDSID

SEQ ID NO: 2535316 - protein, 26 aa, Entamoeba dispar
NSVETFLLLVALKVKYPDKIYLIRGN

SEQ ID NO: 2535317 - protein, 20 aa, Entamoeba dispar
NSVIFEKFYINKTTIRWRIT

SEQ ID NO: 2535318 - protein, 20 aa, Entamoeba dispar
NSVKNYFKLKTKGTLKKIVQ

SEQ ID NO: 2535319 - protein, 20 aa, Entamoeba dispar
NSVLVEWPSLTPFGFDKDLL

SEQ ID NO: 2535320 - protein, 21 aa, Entamoeba dispar
NSVLVSRIVRNVMRKLMLNSR

SEQ ID NO: 2535321 - protein, 23 aa, Entamoeba dispar
NSVSTIGEYAFYNCVSLTSIDVD

SEQ ID NO: 2535322 - protein, 27 aa, Entamoeba dispar
NSVVQIANALFYFSKDKPTVLSQSIVD

SEQ ID NO: 2535323 - protein, 17 aa, Entamoeba dispar
NSWTLDSLKLYLNQVMY

SEQ ID NO: 2535324 - protein, 19 aa, Entamoeba dispar
NSYKLRHLLFIINQIDRPD

SEQ ID NO: 2535325 - protein, 25 aa, Entamoeba dispar
NSYKRTPRLILLTKSLSNLEQLNHE

SEQ ID NO: 2535326 - protein, 21 aa, Entamoeba dispar
NSYQHCLQLLANQINMNQTLK

SEQ ID NO: 2535327 - protein, 23 aa, Entamoeba dispar
NSYYRDELFLKIIEIIKKDNYDN

SEQ ID NO: 2535328 - protein, 24 aa, Entamoeba dispar
NTAMRNCLIALRKAFAEPANATDA

SEQ ID NO: 2535329 - protein, 24 aa, Entamoeba dispar
NTANGLYEMLWNKLAYKSNIPLDI

SEQ ID NO: 2535330 - protein, 21 aa, Entamoeba dispar
NTATFLPGGRFIAIGTVGGSI

SEQ ID NO: 2535331 - protein, 29 aa, Entamoeba dispar
NTDDYKNWFFVFFNYLHPSNEISAVIIHK

SEQ ID NO: 2535332 - protein, 17 aa, Entamoeba dispar
NTDMVKLMKSLYVYLHE

SEQ ID NO: 2535333 - protein, 28 aa, Entamoeba dispar
NTDNMFEFWDWVGGRYSLWSAIGLTIMI

SEQ ID NO: 2535334 - protein, 23 aa, Entamoeba dispar
NTDSMGIVICPFELNKKMVERGT

SEQ ID NO: 2535335 - protein, 21 aa, Entamoeba dispar
NTEDFYFGRSLPLSTKEKNTL

SEQ ID NO: 2535336 - protein, 34 aa, Entamoeba dispar
NTEEPYLSGLKYSAMPPFKRFHDLEQLSGGEKTI

SEQ ID NO: 2535337 - protein, 29 aa, Entamoeba dispar
NTEFWQHLCIIWTNCYYHIPKLVKERKIS

SEQ ID NO: 2535338 - protein, 30 aa, Entamoeba dispar
NTEIVVFAFPIYYFNMPGPIKTLLDRFVPS

SEQ ID NO: 2535339 - protein, 28 aa, Entamoeba dispar
NTERGYLKYWIPRLSELFPSITFYQSEC

SEQ ID NO: 2535340 - protein, 24 aa, Entamoeba dispar
NTERMLKMFKIRDSIRGYSGELVN

SEQ ID NO: 2535341 - protein, 26 aa, Entamoeba dispar
NTETNHFLAIFEFMVIRLGKDPFAKE

SEQ ID NO: 2535342 - protein, 21 aa, Entamoeba dispar
NTEWPILTQLVIQKASIRQIS

SEQ ID NO: 2535343 - protein, 36 aa, Entamoeba dispar
NTFDFILCIIRMISCKRFFLLPKLQQKNDVNMIVIL

SEQ ID NO: 2535344 - protein, 17 aa, Entamoeba dispar
NTFEIIICCTDERCSFI

SEQ ID NO: 2535345 - protein, 28 aa, Entamoeba dispar
NTFNQIPLIDIIHFLPHILTSFLESKMV

SEQ ID NO: 2535346 - protein, 17 aa, Entamoeba dispar
NTFSRFHRPLFIEIHTI

SEQ ID NO: 2535347 - protein, 29 aa, Entamoeba dispar
NTFVKKLFHTMKEPSFLDWKLNVSGKVSD

SEQ ID NO: 2535348 - protein, 24 aa, Entamoeba dispar
NTFVKKLFHTMKEPSFLDWRLNVS

SEQ ID NO: 2535349 - protein, 23 aa, Entamoeba dispar
NTGHWDVFLMKIGDIKPVAVWRI

SEQ ID NO: 2535350 - protein, 21 aa, Entamoeba dispar
NTGMYYDVALTNPFGIELEKI

SEQ ID NO: 2535351 - protein, 19 aa, Entamoeba dispar
NTGYLPTKILKKVESELTP

SEQ ID NO: 2535352 - protein, 21 aa, Entamoeba dispar
NTHFRIPMMQLKNNGFILQKP

SEQ ID NO: 2535353 - protein, 26 aa, Entamoeba dispar
NTHWKQTCFYFDLPFDNAGSGDIIKG

SEQ ID NO: 2535354 - protein, 28 aa, Entamoeba dispar
NTHWLTFHSGYDFGYMLKLLTCEKLPSN

SEQ ID NO: 2535355 - protein, 19 aa, Entamoeba dispar
NTIDHCYYYFSKIAFFSKD

SEQ ID NO: 2535356 - protein, 30 aa, Entamoeba dispar
NTIDTAIKRFPLYHFFVKNTRLYPLECYPF

SEQ ID NO: 2535357 - protein, 21 aa, Entamoeba dispar
NTIIIAPFDRSNKTKTATPSV

SEQ ID NO: 2535358 - protein, 26 aa, Entamoeba dispar
NTIIQTIHFIWMSIKRSFNFISSLID

SEQ ID NO: 2535359 - protein, 25 aa, Entamoeba dispar
NTIKKYCAGLPNKLPLKLQITEGVS

SEQ ID NO: 2535360 - protein, 22 aa, Entamoeba dispar
NTIKVLYWRQNFAHIGKDVSVN

SEQ ID NO: 2535361 - protein, 20 aa, Entamoeba dispar
NTILTYCGVILSIQKFETQQ

SEQ ID NO: 2535362 - protein, 17 aa, Entamoeba dispar
NTILYSHSPICELSIGI

SEQ ID NO: 2535363 - protein, 23 aa, Entamoeba dispar
NTINIECKLAVLSSQHEDLLFRV

SEQ ID NO: 2535364 - protein, 18 aa, Entamoeba dispar
NTIPYWDKTLIKYSTYNE

SEQ ID NO: 2535365 - protein, 25 aa, Entamoeba dispar
NTIQLFHHFFPCANVFKISSSEIKT

SEQ ID NO: 2535366 - protein, 29 aa, Entamoeba dispar
NTIRLFDHFLYCNHVCIVTELLGINIYEL

SEQ ID NO: 2535367 - protein, 22 aa, Entamoeba dispar
NTKKLRIIDWGLAEFYHPGKEY

SEQ ID NO: 2535368 - protein, 26 aa, Entamoeba dispar
NTKLLIHSLLCQTQFIDPMPKNNISL

SEQ ID NO: 2535369 - protein, 17 aa, Entamoeba dispar
NTKMLILSWGKCGIEVG

SEQ ID NO: 2535370 - protein, 22 aa, Entamoeba dispar
NTKYQILFTKYEGINKLVTLID

SEQ ID NO: 2535371 - protein, 21 aa, Entamoeba dispar
NTLFDFGWVPIIADKKRKVGS

SEQ ID NO: 2535372 - protein, 25 aa, Entamoeba dispar
NTLKMNLLVKLWNEENDKMCIDTHI

SEQ ID NO: 2535373 - protein, 24 aa, Entamoeba dispar
NTLKRTVINFIINKVTITEEIKQM

SEQ ID NO: 2535374 - protein, 18 aa, Entamoeba dispar
NTLPPFKKDFYVESPITL

SEQ ID NO: 2535375 - protein, 25 aa, Entamoeba dispar
NTMDVLIYALRMNALIALKAKKNGI

SEQ ID NO: 2535376 - protein, 26 aa, Entamoeba dispar
NTMNDLLKIRFFVSNNPFDPVTAKVT

SEQ ID NO: 2535377 - protein, 22 aa, Entamoeba dispar
NTMPNQYIPPQQTYQVPCGNST

SEQ ID NO: 2535378 - protein, 21 aa, Entamoeba dispar
NTNCYFLLTTVETPIIENNEN

SEQ ID NO: 2535379 - protein, 23 aa, Entamoeba dispar
NTNELIYNLKEDIKTKDNIIIGL

SEQ ID NO: 2535380 - protein, 26 aa, Entamoeba dispar
NTNGSQFFITTVPCPWLDGKHVVFGQ

SEQ ID NO: 2535381 - protein, 24 aa, Entamoeba dispar
NTNKRICLLFFTDKGFIFGVCHKR

SEQ ID NO: 2535382 - protein, 26 aa, Entamoeba dispar
NTNMNLVDFPPIPLSLNIFSTISIIN

SEQ ID NO: 2535383 - protein, 17 aa, Entamoeba dispar
NTNNIFNEIKRLLKKKY

SEQ ID NO: 2535384 - protein, 24 aa, Entamoeba dispar
NTNSPYYRELIPKPMFDAIFEKAK

SEQ ID NO: 2535385 - protein, 24 aa, Entamoeba dispar
NTNTIIDMLIVLINTLRGSNYDNN

SEQ ID NO: 2535386 - protein, 24 aa, Entamoeba dispar
NTPFHYLKVMPPTPPKLAGCDPTL

SEQ ID NO: 2535387 - protein, 23 aa, Entamoeba dispar
NTPGEAFFTFLINKKEKRVKVNR

SEQ ID NO: 2535388 - protein, 23 aa, Entamoeba dispar
NTPHMSHIIQTIKEYLPIAQSHW

SEQ ID NO: 2535389 - protein, 19 aa, Entamoeba dispar
NTPLKKLMEAFCNKQGLNM

SEQ ID NO: 2535390 - protein, 20 aa, Entamoeba dispar
NTPMALCHYFDHYFVPRPVD

SEQ ID NO: 2535391 - protein, 29 aa, Entamoeba dispar
NTPPSKLMYIFLFNDVLLETKPLKIAGKS

SEQ ID NO: 2535392 - protein, 28 aa, Entamoeba dispar
NTPQPPQAFVQPPPPPPIDNSKIPNVST

SEQ ID NO: 2535393 - protein, 23 aa, Entamoeba dispar
NTPRDESFKLIYGKELIEAFKYC

SEQ ID NO: 2535394 - protein, 27 aa, Entamoeba dispar
NTQLSFSLPINILRYIQPLNQSVDFLN

SEQ ID NO: 2535395 - protein, 23 aa, Entamoeba dispar
NTQPFVFTMIKSETKLQFFGISH

SEQ ID NO: 2535396 - protein, 28 aa, Entamoeba dispar
NTQYLNDYRFFSFEFTGTEQRPVMEYQT

SEQ ID NO: 2535397 - protein, 24 aa, Entamoeba dispar
NTRLSLLTFVIPTTLGIGVICSDE

SEQ ID NO: 2535398 - protein, 17 aa, Entamoeba dispar
NTRQLLISQFRDVNKYI

SEQ ID NO: 2535399 - protein, 25 aa, Entamoeba dispar
NTRSVLLDWLFLVSQDEFATTIETY

SEQ ID NO: 2535400 - protein, 18 aa, Entamoeba dispar
NTSELLKMVDSCTSASLA

SEQ ID NO: 2535401 - protein, 17 aa, Entamoeba dispar
NTSFNLYSFDDYPPKIL

SEQ ID NO: 2535402 - protein, 26 aa, Entamoeba dispar
NTSIFILNKIYGNLFFSLIRQYNDIS

SEQ ID NO: 2535403 - protein, 27 aa, Entamoeba dispar
NTSKKYLMKITSLFFSIKSIPTEYNQL

SEQ ID NO: 2535404 - protein, 25 aa, Entamoeba dispar
NTSLIFLSKHREFLPFEMKYQDLIK

SEQ ID NO: 2535405 - protein, 27 aa, Entamoeba dispar
NTSLKRALLYAHFQRRVITDGRMVSVP

SEQ ID NO: 2535406 - protein, 22 aa, Entamoeba dispar
NTSLLIPLVNFITYLVGSNRST

SEQ ID NO: 2535407 - protein, 27 aa, Entamoeba dispar
NTSLLNFPFIIPVDYKMKFLHKEAKQE

SEQ ID NO: 2535408 - protein, 24 aa, Entamoeba dispar
NTSRIIDGRLLVSDLNSPIVTTSI

SEQ ID NO: 2535409 - protein, 23 aa, Entamoeba dispar
NTSRIIIINSIYQYIYLDKESIN

SEQ ID NO: 2535410 - protein, 26 aa, Entamoeba dispar
NTSRMTSFLFGAKSLIPFLENNNLTC

SEQ ID NO: 2535411 - protein, 33 aa, Entamoeba dispar
NTSWICLGGFIFLRYICPAIIRPLEWGLVYDIP

SEQ ID NO: 2535412 - protein, 26 aa, Entamoeba dispar
NTSYHLNYLLYISFKLSLNNSCSLKI

SEQ ID NO: 2535413 - protein, 26 aa, Entamoeba dispar
NTTGTLLNLLPLLKSLIQRLITEKDT

SEQ ID NO: 2535414 - protein, 25 aa, Entamoeba dispar
NTTHEKAYAALKKTKGDLVSAFFEF

SEQ ID NO: 2535415 - protein, 23 aa, Entamoeba dispar
NTTKFGPIKLLLNEKRIVIFVHP

SEQ ID NO: 2535416 - protein, 24 aa, Entamoeba dispar
NTTNLIIILKIIHQISLGITYQSV

SEQ ID NO: 2535417 - protein, 22 aa, Entamoeba dispar
NTTTNSFLSFSFEPSHLKTNST

SEQ ID NO: 2535418 - protein, 27 aa, Entamoeba dispar
NTTTQEILPTPTQFTKLPEFSKVQNQY

SEQ ID NO: 2535419 - protein, 26 aa, Entamoeba dispar
NTVFSSFFSILFSLSGKYLQMEMLSS

SEQ ID NO: 2535420 - protein, 21 aa, Entamoeba dispar
NTVHLFFNELFQFGDAFNLLA

SEQ ID NO: 2535421 - protein, 26 aa, Entamoeba dispar
NTVKPVCVIGWSTPNILAYLNILSKV

SEQ ID NO: 2535422 - protein, 27 aa, Entamoeba dispar
NTVKRDWYYLNIYYLKKVGAIVDDSKS

SEQ ID NO: 2535423 - protein, 31 aa, Entamoeba dispar
NTVKVYKLPTMQFYLSLYGHNLPVTALDISD

SEQ ID NO: 2535424 - protein, 23 aa, Entamoeba dispar
NTVRLVDHFLYHSHLCIVTELLG

SEQ ID NO: 2535425 - protein, 19 aa, Entamoeba dispar
NTVVYIRNFEQNKAIGLIA

SEQ ID NO: 2535426 - protein, 20 aa, Entamoeba dispar
NTYHFRIAILPPENEIQNIA

SEQ ID NO: 2535427 - protein, 23 aa, Entamoeba dispar
NTYLCHFQPVVLPPQLIMKYYSQ

SEQ ID NO: 2535428 - protein, 42 aa, Entamoeba dispar
NVALKPVLIVRLGDKLYPINKHAALICYIASGNVNKLIDIWI

SEQ ID NO: 2535429 - protein, 24 aa, Entamoeba dispar
NVALRWIDVAKPMTRLRCAGFTKE

SEQ ID NO: 2535430 - protein, 17 aa, Entamoeba dispar
NVAWDHLKLTDPVIEKA

SEQ ID NO: 2535431 - protein, 18 aa, Entamoeba dispar
NVCKCHYTHHANSSYRFE

SEQ ID NO: 2535432 - protein, 19 aa, Entamoeba dispar
NVCYVEFGGPVPPQLPLGT

SEQ ID NO: 2535433 - protein, 29 aa, Entamoeba dispar
NVDGFIKKLRIFFPNIIDLKYVTNQISQT

SEQ ID NO: 2535434 - protein, 28 aa, Entamoeba dispar
NVDVCLIKIIPYLIQLYPEEEEYFLNLM

SEQ ID NO: 2535435 - protein, 29 aa, Entamoeba dispar
NVDVMAYLFQILTLYLPQVSSLCEPILNL

SEQ ID NO: 2535436 - protein, 23 aa, Entamoeba dispar
NVEEAFMTLLKKIYDDSSKSVDG

SEQ ID NO: 2535437 - protein, 26 aa, Entamoeba dispar
NVEINSTIHPSFARFALECSEYKCVG

SEQ ID NO: 2535438 - protein, 21 aa, Entamoeba dispar
NVEIPLDRWTKGGLILKNSYG

SEQ ID NO: 2535439 - protein, 18 aa, Entamoeba dispar
NVEIYFIWGKKWSRKIEE

SEQ ID NO: 2535440 - protein, 22 aa, Entamoeba dispar
NVELPMKILGKLNKKQRHARTI

SEQ ID NO: 2535441 - protein, 21 aa, Entamoeba dispar
NVEMTSFLLSFDEIKGIVNDK

SEQ ID NO: 2535442 - protein, 19 aa, Entamoeba dispar
NVFGYYSPLGITKIGDYNY

SEQ ID NO: 2535443 - protein, 27 aa, Entamoeba dispar
NVFHKYAIIKRLRRKPIGLIRGKTDIL

SEQ ID NO: 2535444 - protein, 22 aa, Entamoeba dispar
NVFSFGNIDFGKGLNFGTSSNV

SEQ ID NO: 2535445 - protein, 25 aa, Entamoeba dispar
NVFVSRGFITLQDTFKFVINSKFTE

SEQ ID NO: 2535446 - protein, 21 aa, Entamoeba dispar
NVFYIEAFIDKNNPLFWGFKN

SEQ ID NO: 2535447 - protein, 22 aa, Entamoeba dispar
NVGFGIPEFPKLLPCMHMICRD

SEQ ID NO: 2535448 - protein, 17 aa, Entamoeba dispar
NVGLREMFRRVIYSRNF

SEQ ID NO: 2535449 - protein, 25 aa, Entamoeba dispar
NVGSQYYMTKPKKNNFIDQEIVEHE

SEQ ID NO: 2535450 - protein, 25 aa, Entamoeba dispar
NVHDPQACIPYYQKYFTSADHNNYI

SEQ ID NO: 2535451 - protein, 18 aa, Entamoeba dispar
NVHFVYIIDFGLSKKYIE

SEQ ID NO: 2535452 - protein, 34 aa, Entamoeba dispar
NVHNIQYQFPQSEPKILLNPNQQPTLNLSVINEQ

SEQ ID NO: 2535453 - protein, 21 aa, Entamoeba dispar
NVIFAAFVSPILYLINTTDSI

SEQ ID NO: 2535454 - protein, 33 aa, Entamoeba dispar
NVIKGISVGPFKLGMPLFEILKSLDIGPSATNS

SEQ ID NO: 2535455 - protein, 18 aa, Entamoeba dispar
NVILFCFISNIDRFNSFN

SEQ ID NO: 2535456 - protein, 19 aa, Entamoeba dispar
NVILLKDLDDMSKKCVYGE

SEQ ID NO: 2535457 - protein, 20 aa, Entamoeba dispar
NVILSYFPSLPYETLQIIEL

SEQ ID NO: 2535458 - protein, 32 aa, Entamoeba dispar
NVIPLFSRFRHISPPMLFFVTSNNQLVSVTFR

SEQ ID NO: 2535459 - protein, 22 aa, Entamoeba dispar
NVIQIFQIYKDSPGILLLCFQV

SEQ ID NO: 2535460 - protein, 32 aa, Entamoeba dispar
NVIQITMNLLFHILPNFHLSMSVLINYPPEDI

SEQ ID NO: 2535461 - protein, 19 aa, Entamoeba dispar
NVISFYKDYFNDFLGKINA

SEQ ID NO: 2535462 - protein, 24 aa, Entamoeba dispar
NVITKQNFLHCISIPKASTPVAPV

SEQ ID NO: 2535463 - protein, 23 aa, Entamoeba dispar
NVKDHFILPTKRIRAIKPKEQVK

SEQ ID NO: 2535464 - protein, 25 aa, Entamoeba dispar
NVKETFIQLFEAINFDEPHLPKGDI

SEQ ID NO: 2535465 - protein, 23 aa, Entamoeba dispar
NVKFFQMYPFEIIVQFDALGIFE

SEQ ID NO: 2535466 - protein, 19 aa, Entamoeba dispar
NVKKDKRPDHLKPSYLQNT

SEQ ID NO: 2535467 - protein, 19 aa, Entamoeba dispar
NVKMFPAIQTQYIYGNEEK

SEQ ID NO: 2535468 - protein, 23 aa, Entamoeba dispar
NVKPLIHVVGMEDIHLPLNNIVL

SEQ ID NO: 2535469 - protein, 25 aa, Entamoeba dispar
NVKSWKKRWFVFTTDGNISYYTNRQ

SEQ ID NO: 2535470 - protein, 23 aa, Entamoeba dispar
NVKYVTKFPPLKPIFYEFNLSIK

SEQ ID NO: 2535471 - protein, 19 aa, Entamoeba dispar
NVLFIGSKKEECISLKGIC

SEQ ID NO: 2535472 - protein, 24 aa, Entamoeba dispar
NVLGTVCWALFFVVTRAAKQNPTF

SEQ ID NO: 2535473 - protein, 17 aa, Entamoeba dispar
NVLKKIMKKLQSPTAIV

SEQ ID NO: 2535474 - protein, 17 aa, Entamoeba dispar
NVLLIQKSILREGVSDL

SEQ ID NO: 2535475 - protein, 26 aa, Entamoeba dispar
NVLNKPFIIQLVRYAALRGILVYPEI

SEQ ID NO: 2535476 - protein, 25 aa, Entamoeba dispar
NVLPMREMHFASKKAFLVVISSNEV

SEQ ID NO: 2535477 - protein, 29 aa, Entamoeba dispar
NVLQYFIDKLNCYYLNTSHIQNLRDLSTI

SEQ ID NO: 2535478 - protein, 17 aa, Entamoeba dispar
NVLSAFRPEDISAMLLR

SEQ ID NO: 2535479 - protein, 18 aa, Entamoeba dispar
NVMYFIYPDVPKIVKKED

SEQ ID NO: 2535480 - protein, 32 aa, Entamoeba dispar
NVNDVLRRSLATPGIASITPLLTPIDNSPRIN

SEQ ID NO: 2535481 - protein, 26 aa, Entamoeba dispar
NVNEMWKNWRIKLAANPKTASYLNDP

SEQ ID NO: 2535482 - protein, 18 aa, Entamoeba dispar
NVNFGCFGVSKINLRRNV

SEQ ID NO: 2535483 - protein, 18 aa, Entamoeba dispar
NVNLKIIATFIKVNKEYQ

SEQ ID NO: 2535484 - protein, 22 aa, Entamoeba dispar
NVNLSRYIIMKTFEKFDQNKTA

SEQ ID NO: 2535485 - protein, 30 aa, Entamoeba dispar
NVNSFMKRVFYLMKEPQYLDWRLNSDTRVE

SEQ ID NO: 2535486 - protein, 31 aa, Entamoeba dispar
NVNVLQYFIDKLNCYYLNTSHIQNLREISTI

SEQ ID NO: 2535487 - protein, 30 aa, Entamoeba dispar
NVNVLQYFIDKLNCYYLNVSHIQNLRDLST

SEQ ID NO: 2535488 - protein, 30 aa, Entamoeba dispar
NVNVLQYFIDKLNCYYLNVSHIQNLREIST

SEQ ID NO: 2535489 - protein, 21 aa, Entamoeba dispar
NVPELYLNDLVIRSVLDLSGL

SEQ ID NO: 2535490 - protein, 23 aa, Entamoeba dispar
NVPFLKELISFPIDKIVLVFLCD

SEQ ID NO: 2535491 - protein, 23 aa, Entamoeba dispar
NVPFVFTRSLIIVLGKYGRFFHD

SEQ ID NO: 2535492 - protein, 20 aa, Entamoeba dispar
NVPIKDWYSWLLETLSQKMM

SEQ ID NO: 2535493 - protein, 19 aa, Entamoeba dispar
NVPNAQPPYILVGAIDNSS

SEQ ID NO: 2535494 - protein, 19 aa, Entamoeba dispar
NVPNTVLPWVYISSQICVG

SEQ ID NO: 2535495 - protein, 35 aa, Entamoeba dispar
NVQANQQSVFLALINKYFTITLISPKKRSTVAQQM

SEQ ID NO: 2535496 - protein, 21 aa, Entamoeba dispar
NVQAWINAIPEHLGLLEEDMP

SEQ ID NO: 2535497 - protein, 26 aa, Entamoeba dispar
NVQDLPFKLVLYPPTTNTLTLLSKLH

SEQ ID NO: 2535498 - protein, 26 aa, Entamoeba dispar
NVQKSYFGNLFPFLKICCGMNDDLIQ

SEQ ID NO: 2535499 - protein, 27 aa, Entamoeba dispar
NVQQQNPFNLLFGQPLQNNVPSQSQNV

SEQ ID NO: 2535500 - protein, 23 aa, Entamoeba dispar
NVRIHLCHAIYLISSKYPNFIQI

SEQ ID NO: 2535501 - protein, 17 aa, Entamoeba dispar
NVRLRYYLRVSVNKKYS

SEQ ID NO: 2535502 - protein, 21 aa, Entamoeba dispar
NVRTYAILALKRFETSQLVNC

SEQ ID NO: 2535503 - protein, 23 aa, Entamoeba dispar
NVSFNTVWNTNYAYRVSTDDGVN

SEQ ID NO: 2535504 - protein, 23 aa, Entamoeba dispar
NVSFNTVWNTNYAYRVSTDNGVN

SEQ ID NO: 2535505 - protein, 30 aa, Entamoeba dispar
NVSGLTEYMSRLLRACGYIYTTSAQMELVR

SEQ ID NO: 2535506 - protein, 26 aa, Entamoeba dispar
NVSKDWMIFGVSRFEKMIICWIDIMG

SEQ ID NO: 2535507 - protein, 23 aa, Entamoeba dispar
NVSQALFALFNILTKIISDDDMV

SEQ ID NO: 2535508 - protein, 34 aa, Entamoeba dispar
NVSQICIPLRADISLWFIAHSCLSKIPPANSPFI

SEQ ID NO: 2535509 - protein, 17 aa, Entamoeba dispar
NVTHILCDPSCSGSGIL

SEQ ID NO: 2535510 - protein, 17 aa, Entamoeba dispar
NVTLLRSILKLCSKIDS

SEQ ID NO: 2535511 - protein, 19 aa, Entamoeba dispar
NVTTIKLEMIYPGNPIIDN

SEQ ID NO: 2535512 - protein, 20 aa, Entamoeba dispar
NVVIYFFEKKPLKKDTIIGS

SEQ ID NO: 2535513 - protein, 25 aa, Entamoeba dispar
NVVQSLNVFYLTKTVWLFEGEKISH

SEQ ID NO: 2535514 - protein, 21 aa, Entamoeba dispar
NVVVYLYDYHRIGWDVFMGAV

SEQ ID NO: 2535515 - protein, 30 aa, Entamoeba dispar
NVWKSETVKNYILYFGSVKSNEQLEKEKQE

SEQ ID NO: 2535516 - protein, 19 aa, Entamoeba dispar
NWAVTVLNHLVFYNPQNLR

SEQ ID NO: 2535517 - protein, 17 aa, Entamoeba dispar
NWCSMIEKYSYYPLFLL

SEQ ID NO: 2535518 - protein, 23 aa, Entamoeba dispar
NWEFGEFLSFQDIAIYGTLIGLL

SEQ ID NO: 2535519 - protein, 18 aa, Entamoeba dispar
NWIGRYYDREIREIRIEE

SEQ ID NO: 2535520 - protein, 20 aa, Entamoeba dispar
NWKHRWFVLDGTTLTYYKDQ

SEQ ID NO: 2535521 - protein, 18 aa, Entamoeba dispar
NWQDDAIAAFWWDDFCDG

SEQ ID NO: 2535522 - protein, 20 aa, Entamoeba dispar
NWTALMFAQFLMYNKINKKK

SEQ ID NO: 2535523 - protein, 33 aa, Entamoeba dispar
NYAAAYCTGLLLARRLLQKLGMDKQFVGVSDAA

SEQ ID NO: 2535524 - protein, 21 aa, Entamoeba dispar
NYAEYPMLFGVTLDNGERRVY

SEQ ID NO: 2535525 - protein, 23 aa, Entamoeba dispar
NYCEFEDWMDPLLLECLKQQNEH

SEQ ID NO: 2535526 - protein, 17 aa, Entamoeba dispar
NYCFYKCYSLTSVTIPS

SEQ ID NO: 2535527 - protein, 24 aa, Entamoeba dispar
NYCFYRCTSLKQIKFLSLPSDLGK

SEQ ID NO: 2535528 - protein, 17 aa, Entamoeba dispar
NYCLKCSNGYKIQNNQC

SEQ ID NO: 2535529 - protein, 18 aa, Entamoeba dispar
NYDMPLNREVYIHRIGRS

SEQ ID NO: 2535530 - protein, 32 aa, Entamoeba dispar
NYDYRIHGTSLGYWIIVLDGNGDYILYYQYFI

SEQ ID NO: 2535531 - protein, 26 aa, Entamoeba dispar
NYEHPVIHSNWIYLSELKFKNRKHFF

SEQ ID NO: 2535532 - protein, 17 aa, Entamoeba dispar
NYEYQKFFFVKENEEII

SEQ ID NO: 2535533 - protein, 23 aa, Entamoeba dispar
NYFCINTQLLFNKINFSKEIVLS

SEQ ID NO: 2535534 - protein, 21 aa, Entamoeba dispar
NYFGELLSKQIYFVQTTYLLK

SEQ ID NO: 2535535 - protein, 22 aa, Entamoeba dispar
NYFQNPSLSLYPSPRRVPDFQP

SEQ ID NO: 2535536 - protein, 17 aa, Entamoeba dispar
NYFQTCFYFIDNALSQK

SEQ ID NO: 2535537 - protein, 19 aa, Entamoeba dispar
NYGCFLCCACGRAHMLFPK

SEQ ID NO: 2535538 - protein, 20 aa, Entamoeba dispar
NYGLMEGVALWALRKPFNEV

SEQ ID NO: 2535539 - protein, 26 aa, Entamoeba dispar
NYGNKKWIITLLYELSVYKDQLLNVL

SEQ ID NO: 2535540 - protein, 27 aa, Entamoeba dispar
NYGWSLTCELSFLQSLYQYGNNMEQIL

SEQ ID NO: 2535541 - protein, 19 aa, Entamoeba dispar
NYHLILCYVLKSDKVKTID

SEQ ID NO: 2535542 - protein, 20 aa, Entamoeba dispar
NYHLWIHHLENEKRYCDECK

SEQ ID NO: 2535543 - protein, 19 aa, Entamoeba dispar
NYIEFKNYNIIGIRKRERI

SEQ ID NO: 2535544 - protein, 20 aa, Entamoeba dispar
NYIEPNTNCYFLLTTVETPI

SEQ ID NO: 2535545 - protein, 23 aa, Entamoeba dispar
NYIHQFVMMFDAGSVYFNENEAM

SEQ ID NO: 2535546 - protein, 17 aa, Entamoeba dispar
NYIIDQSTYRVGAVKIE

SEQ ID NO: 2535547 - protein, 25 aa, Entamoeba dispar
NYIKPTPIQAIGWPIVLQGKDVVGI

SEQ ID NO: 2535548 - protein, 18 aa, Entamoeba dispar
NYILSKLNILKKKSSEDP

SEQ ID NO: 2535549 - protein, 25 aa, Entamoeba dispar
NYIMVIDSHQLLMTKNMPLISNEIP

SEQ ID NO: 2535550 - protein, 21 aa, Entamoeba dispar
NYISLIVQYLLPVASSKDKPV

SEQ ID NO: 2535551 - protein, 28 aa, Entamoeba dispar
NYKCTVFNEFFLQRLLSTLLNFNHLTNS

SEQ ID NO: 2535552 - protein, 25 aa, Entamoeba dispar
NYKEFNYLFKTSLPEFPHAFTISAC

SEQ ID NO: 2535553 - protein, 19 aa, Entamoeba dispar
NYLGLTNYYDRICLALKLV

SEQ ID NO: 2535554 - protein, 24 aa, Entamoeba dispar
NYLIKEKYWQIFANKKKYLGIVCG

SEQ ID NO: 2535555 - protein, 17 aa, Entamoeba dispar
NYLNQFFRCNYQIYNEN

SEQ ID NO: 2535556 - protein, 19 aa, Entamoeba dispar
NYLSSFLIQKGMTLTCQVM

SEQ ID NO: 2535557 - protein, 19 aa, Entamoeba dispar
NYLYLVLCKRCLEHCLLFS

SEQ ID NO: 2535558 - protein, 21 aa, Entamoeba dispar
NYNELVIMNILNEYYNKYEDI

SEQ ID NO: 2535559 - protein, 22 aa, Entamoeba dispar
NYNELVIMNILNEYYNKYKDIG

SEQ ID NO: 2535560 - protein, 27 aa, Entamoeba dispar
NYNFKFFLMYPFLNIPPNYPNHGYPMY

SEQ ID NO: 2535561 - protein, 26 aa, Entamoeba dispar
NYNLVKTLFYHITALRFNDDLLHQFV

SEQ ID NO: 2535562 - protein, 20 aa, Entamoeba dispar
NYNPYIRHCMYGLDADLIML

SEQ ID NO: 2535563 - protein, 32 aa, Entamoeba dispar
NYNTLRYERVWQLIFNFLARKGCFMNYEKTKK

SEQ ID NO: 2535564 - protein, 27 aa, Entamoeba dispar
NYNYEHNSVFWAIKFYHTDTKTSRKIV

SEQ ID NO: 2535565 - protein, 19 aa, Entamoeba dispar
NYPEILIKLIQEGIKKLQD

SEQ ID NO: 2535566 - protein, 17 aa, Entamoeba dispar
NYPIIPNFEQLYNEEVQ

SEQ ID NO: 2535567 - protein, 21 aa, Entamoeba dispar
NYPIQLGCRLAKKAKVIKFKH

SEQ ID NO: 2535568 - protein, 17 aa, Entamoeba dispar
NYPLFLQNYNSRISTFQ

SEQ ID NO: 2535569 - protein, 20 aa, Entamoeba dispar
NYPLPKPEVLWGLMMSELVD

SEQ ID NO: 2535570 - protein, 35 aa, Entamoeba dispar
NYPPKEVFFELQQLQKIFFPDFFMNHQHISQAHIS

SEQ ID NO: 2535571 - protein, 20 aa, Entamoeba dispar
NYQNIPPPIKLTTDSFSKEI

SEQ ID NO: 2535572 - protein, 27 aa, Entamoeba dispar
NYQRKKLGRYLLKQVYSFILSDKDFDL

SEQ ID NO: 2535573 - protein, 19 aa, Entamoeba dispar
NYQVAQQSIFLALLNDYFE

SEQ ID NO: 2535574 - protein, 20 aa, Entamoeba dispar
NYRCVIPLGVDPAKYDKAFP

SEQ ID NO: 2535575 - protein, 20 aa, Entamoeba dispar
NYSFFTMTNLRILNLSQNHT

SEQ ID NO: 2535576 - protein, 26 aa, Entamoeba dispar
NYSILKLPLSSILMKRSRQVDQLKQR

SEQ ID NO: 2535577 - protein, 20 aa, Entamoeba dispar
NYSLLFEQPIKEQKPIENCM

SEQ ID NO: 2535578 - protein, 21 aa, Entamoeba dispar
NYSLLFEQPIKEQKPIENCMV

SEQ ID NO: 2535579 - protein, 22 aa, Entamoeba dispar
NYSLTYPILKIRDISLNPFSSV

SEQ ID NO: 2535580 - protein, 31 aa, Entamoeba dispar
NYTLKTRIPIKSYGFIIAPVKLLPIESSLKV

SEQ ID NO: 2535581 - protein, 26 aa, Entamoeba dispar
NYTLLDDIHFIDLFNHLQKKIVSQTQ

SEQ ID NO: 2535582 - protein, 30 aa, Entamoeba dispar
NYTSDLQDGIIFRDLLRALGVPCGNSLEDV

SEQ ID NO: 2535583 - protein, 28 aa, Entamoeba dispar
NYTTIGSTLFLYLYKKNINNKKQEGSLQ

SEQ ID NO: 2535584 - protein, 31 aa, Entamoeba dispar
NYTVFDYFHFSLIRIPFNSLSFTLSFSSFTH

SEQ ID NO: 2535585 - protein, 20 aa, Entamoeba dispar
NYVFCVPYAFAIVGSGKSAV

SEQ ID NO: 2535586 - protein, 19 aa, Entamoeba dispar
NYWECIEKILYALQGQIEK

SEQ ID NO: 2535587 - protein, 20 aa, Entamoeba dispar
NYYPQLIFIISPIVIENIQS

SEQ ID NO: 2535588 - protein, 26 aa, Entamoeba dispar
PAAPGLSLIIRCYPGFQAVVVYRIAH

SEQ ID NO: 2535589 - protein, 30 aa, Entamoeba dispar
PACPFPRVVLSPLAFILGVLYLSNGDEDLI

SEQ ID NO: 2535590 - protein, 28 aa, Entamoeba dispar
PAEYEKMKFGIWLKKLQLVLTEESKEII

SEQ ID NO: 2535591 - protein, 21 aa, Entamoeba dispar
PAFCYHGVLGKYILSPSVTEM

SEQ ID NO: 2535592 - protein, 19 aa, Entamoeba dispar
PAFHPFSISLLQINQKNKL

SEQ ID NO: 2535593 - protein, 32 aa, Entamoeba dispar
PAGFIRQFNPKRILLVGGVLRSEEQLTVMQAL

SEQ ID NO: 2535594 - protein, 23 aa, Entamoeba dispar
PAKQPYPYQFRKQHIFLGGSIAT

SEQ ID NO: 2535595 - protein, 18 aa, Entamoeba dispar
PALIQYYKQPQEKHLLII

SEQ ID NO: 2535596 - protein, 21 aa, Entamoeba dispar
PALLRSGRFDRKIEFPTPNEE

SEQ ID NO: 2535597 - protein, 21 aa, Entamoeba dispar
PALMRPGRLDRKIEISLPNDQ

SEQ ID NO: 2535598 - protein, 25 aa, Entamoeba dispar
PAMLACFPLQDILSLKLKYIEGRDP

SEQ ID NO: 2535599 - protein, 19 aa, Entamoeba dispar
PAMYVGIQAVLSLYASGRT

SEQ ID NO: 2535600 - protein, 23 aa, Entamoeba dispar
PANIPPPPIAPVIDNIPPPPVAP

SEQ ID NO: 2535601 - protein, 19 aa, Entamoeba dispar
PAPLLLMPGHDELTFLIPE

SEQ ID NO: 2535602 - protein, 23 aa, Entamoeba dispar
PAQPALYLLMKTFSVCVPRIPFD

SEQ ID NO: 2535603 - protein, 19 aa, Entamoeba dispar
PAQYIALMEQKKGPFKITR

SEQ ID NO: 2535604 - protein, 18 aa, Entamoeba dispar
PAQYPLQGYPQYPPAQYP

SEQ ID NO: 2535605 - protein, 25 aa, Entamoeba dispar
PASCLMKMTPFEKQYWNIKKDNYDV

SEQ ID NO: 2535606 - protein, 17 aa, Entamoeba dispar
PASPFPRLLVSPSCFII

SEQ ID NO: 2535607 - protein, 24 aa, Entamoeba dispar
PASTLQILGAEKALFRAIKTRGNT

SEQ ID NO: 2535608 - protein, 21 aa, Entamoeba dispar
PASWVLQILGNIDDPFIGFQL

SEQ ID NO: 2535609 - protein, 18 aa, Entamoeba dispar
PAVKIKYLTLINIFSYST

SEQ ID NO: 2535610 - protein, 17 aa, Entamoeba dispar
PAYIYKNNKIKKITKEH

SEQ ID NO: 2535611 - protein, 21 aa, Entamoeba dispar
PCARRCCFACVLTGAPSLLEP

SEQ ID NO: 2535612 - protein, 18 aa, Entamoeba dispar
PCDFIINQEIFKSLEECN

SEQ ID NO: 2535613 - protein, 22 aa, Entamoeba dispar
PCELLDCGTSYLLKFEVPGIDK

SEQ ID NO: 2535614 - protein, 19 aa, Entamoeba dispar
PCHITTRLVRVSSLTFGTK

SEQ ID NO: 2535615 - protein, 17 aa, Entamoeba dispar
PCISIFSASFYQGKFMN

SEQ ID NO: 2535616 - protein, 23 aa, Entamoeba dispar
PCLDNYIRYLLNDIKNFLVNYSN

SEQ ID NO: 2535617 - protein, 18 aa, Entamoeba dispar
PCLMCGMALLHSRFGRVF

SEQ ID NO: 2535618 - protein, 23 aa, Entamoeba dispar
PCLSRPELIPIYLSLIQVHHKTF

SEQ ID NO: 2535619 - protein, 18 aa, Entamoeba dispar
PCNDNRFIISWGQLKINI

SEQ ID NO: 2535620 - protein, 27 aa, Entamoeba dispar
PCPSKNLFPFIQYQPPNTSKVLCLFDY

SEQ ID NO: 2535621 - protein, 20 aa, Entamoeba dispar
PCQQPIISPLLHNPLIKQEI

SEQ ID NO: 2535622 - protein, 29 aa, Entamoeba dispar
PCSKILLFNHSIKPITEKWFKVTNLKRIE

SEQ ID NO: 2535623 - protein, 18 aa, Entamoeba dispar
PCVEATIGGLRIIGRLAV

SEQ ID NO: 2535624 - protein, 19 aa, Entamoeba dispar
PCVLFFDELDSIGKARGGG

SEQ ID NO: 2535625 - protein, 27 aa, Entamoeba dispar
PCVYHIPTYREVPPLFYQPPNYHERSR

SEQ ID NO: 2535626 - protein, 18 aa, Entamoeba dispar
PCYIPCYVELQFDSLLRY

SEQ ID NO: 2535627 - protein, 25 aa, Entamoeba dispar
PDATPPHPSGEAPVPEHRERKASFL

SEQ ID NO: 2535628 - protein, 25 aa, Entamoeba dispar
PDDDKLISVLWPCVHFLLSVFQDKT

SEQ ID NO: 2535629 - protein, 18 aa, Entamoeba dispar
PDDGFSFVRQYKSNVIIE

SEQ ID NO: 2535630 - protein, 17 aa, Entamoeba dispar
PDDIFSFDGFTSAPAQT

SEQ ID NO: 2535631 - protein, 22 aa, Entamoeba dispar
PDDMLCITLDRLSVDSLLTSDQ

SEQ ID NO: 2535632 - protein, 25 aa, Entamoeba dispar
PDDNNCFILFIQLQNFIKQYPFILN

SEQ ID NO: 2535633 - protein, 19 aa, Entamoeba dispar
PDDQLIQWFWSIVESFSEE

SEQ ID NO: 2535634 - protein, 24 aa, Entamoeba dispar
PDEMKFMAFDFLKIVKDLDDVKIP

SEQ ID NO: 2535635 - protein, 19 aa, Entamoeba dispar
PDEMSLPLDARFRFKKPVP

SEQ ID NO: 2535636 - protein, 18 aa, Entamoeba dispar
PDEPIFPTEFFISCEAKE

SEQ ID NO: 2535637 - protein, 18 aa, Entamoeba dispar
PDEYRPHTFGWCPNTYQL

SEQ ID NO: 2535638 - protein, 20 aa, Entamoeba dispar
PDFIHAFGYVKEATAYANCV

SEQ ID NO: 2535639 - protein, 21 aa, Entamoeba dispar
PDGFILIQLPHHSISGSHLHI

SEQ ID NO: 2535640 - protein, 28 aa, Entamoeba dispar
PDGRRDWECIEALRLGLLNDHLCGLMQG

SEQ ID NO: 2535641 - protein, 20 aa, Entamoeba dispar
PDKSFYGYSFIFEKKDYNDY

SEQ ID NO: 2535642 - protein, 23 aa, Entamoeba dispar
PDKSIPFLSSYLTLLDNICKSIS

SEQ ID NO: 2535643 - protein, 24 aa, Entamoeba dispar
PDLFNISILLKYSYPNYIETQIEN

SEQ ID NO: 2535644 - protein, 21 aa, Entamoeba dispar
PDLKYIINNISFFPRLRQITI

SEQ ID NO: 2535645 - protein, 17 aa, Entamoeba dispar
PDLLAILLAEYCNHIVS

SEQ ID NO: 2535646 - protein, 26 aa, Entamoeba dispar
PDNLKTKFVYYSRDWEDFLKSNNHSI

SEQ ID NO: 2535647 - protein, 18 aa, Entamoeba dispar
PDPKIPVLALLLGENIRS

SEQ ID NO: 2535648 - protein, 23 aa, Entamoeba dispar
PDSIIFVMDGAIGQAAFGQAKAF

SEQ ID NO: 2535649 - protein, 21 aa, Entamoeba dispar
PDSLWLMGRLNHSKGKTMCIH

SEQ ID NO: 2535650 - protein, 24 aa, Entamoeba dispar
PDSLYILGVMYYKGKYVFEDKTLA

SEQ ID NO: 2535651 - protein, 26 aa, Entamoeba dispar
PDSPHHPEFPSTYLKKGELYHHVCVY

SEQ ID NO: 2535652 - protein, 23 aa, Entamoeba dispar
PDSPMNFTLSFLGKDPISCIYLV

SEQ ID NO: 2535653 - protein, 23 aa, Entamoeba dispar
PDTIKQYYPKGENWQHVFTLGGI

SEQ ID NO: 2535654 - protein, 19 aa, Entamoeba dispar
PDTILSEAMWVLRNLFIPE

SEQ ID NO: 2535655 - protein, 21 aa, Entamoeba dispar
PDVFDILILDFSLFHRMEDPQ

SEQ ID NO: 2535656 - protein, 20 aa, Entamoeba dispar
PDVFFERRKLWEQLINQNKS

SEQ ID NO: 2535657 - protein, 17 aa, Entamoeba dispar
PDYLQILQQILPASGEA

SEQ ID NO: 2535658 - protein, 19 aa, Entamoeba dispar
PDYNPLLFLCLSKPLYKQP

SEQ ID NO: 2535659 - protein, 23 aa, Entamoeba dispar
PDYSNLYILFMKSLAQNSQTLNK

SEQ ID NO: 2535660 - protein, 29 aa, Entamoeba dispar
PEALETWPVPMFENLLPRHLQICYEINSR

SEQ ID NO: 2535661 - protein, 18 aa, Entamoeba dispar
PEANPFLTPVDPIAQNLP

SEQ ID NO: 2535662 - protein, 18 aa, Entamoeba dispar
PEANQIIPKILKYTKEPL

SEQ ID NO: 2535663 - protein, 18 aa, Entamoeba dispar
PEDNQMFVFSLKNSNKTG

SEQ ID NO: 2535664 - protein, 24 aa, Entamoeba dispar
PEDRYLPMNMLFSGKNHLPNLPLL

SEQ ID NO: 2535665 - protein, 25 aa, Entamoeba dispar
PEEISGIILKYLYEIAQAKLGNHPI

SEQ ID NO: 2535666 - protein, 25 aa, Entamoeba dispar
PEEISGIILKYLYEIAQAKLGNQPI

SEQ ID NO: 2535667 - protein, 26 aa, Entamoeba dispar
PEEKIVLFKAIVKLCHKIMLHSSKNL

SEQ ID NO: 2535668 - protein, 18 aa, Entamoeba dispar
PEELTLLPQGWSCGYFRN

SEQ ID NO: 2535669 - protein, 24 aa, Entamoeba dispar
PEEPADFTLLYNEKYFALLTHNGN

SEQ ID NO: 2535670 - protein, 29 aa, Entamoeba dispar
PEEQYKMPLSWIILKRVVQGRDWHYGRTD

SEQ ID NO: 2535671 - protein, 25 aa, Entamoeba dispar
PEFDGSFMNIIRYLERQAKKHGEEA

SEQ ID NO: 2535672 - protein, 18 aa, Entamoeba dispar
PEFDSIIADCWKVAKARP

SEQ ID NO: 2535673 - protein, 28 aa, Entamoeba dispar
PEFENRYHRLFIKLALKKFFNVDITKKD

SEQ ID NO: 2535674 - protein, 29 aa, Entamoeba dispar
PEFLNDNRLDFLRDYIISLGGKIPETKKE

SEQ ID NO: 2535675 - protein, 17 aa, Entamoeba dispar
PEFPGDYTVDIKLNGDK

SEQ ID NO: 2535676 - protein, 38 aa, Entamoeba dispar
PEGFFNKIVWVGKKIYCIIKLNLWYTKPKTIKYGNVEH

SEQ ID NO: 2535677 - protein, 40 aa, Entamoeba dispar
PEGFFNKIVWVGKKIYCMIKLNRWYIKPKTIKYGNVEHKI

SEQ ID NO: 2535678 - protein, 25 aa, Entamoeba dispar
PEGFFNKIVWVGKKIYCVIKLNRWY

SEQ ID NO: 2535679 - protein, 18 aa, Entamoeba dispar
PEGKWEFFNLFQVIENPS

SEQ ID NO: 2535680 - protein, 28 aa, Entamoeba dispar
PEGLRQKIIFYLWTPEGCKIREKMLYSA

SEQ ID NO: 2535681 - protein, 18 aa, Entamoeba dispar
PEGNLDEFLLHYYDLIHD

SEQ ID NO: 2535682 - protein, 32 aa, Entamoeba dispar
PEGNVKCLIKMKLALFYFQNAKLELALELLLE

SEQ ID NO: 2535683 - protein, 31 aa, Entamoeba dispar
PEGTKLSFFSWNSWNGWIPTWVVNKATKSMI

SEQ ID NO: 2535684 - protein, 18 aa, Entamoeba dispar
PEGTTQCMFWGLGSDGTV

SEQ ID NO: 2535685 - protein, 24 aa, Entamoeba dispar
PEGVLDFLGIWKDSLPTNTDMEAG

SEQ ID NO: 2535686 - protein, 24 aa, Entamoeba dispar
PEHGYYLMKCVSHFMTMVPFFNIM

SEQ ID NO: 2535687 - protein, 17 aa, Entamoeba dispar
PEHHHWLKINFSKAFDN

SEQ ID NO: 2535688 - protein, 29 aa, Entamoeba dispar
PEHWYNAYLYYMRSHFHFLNPAFEGLFRS

SEQ ID NO: 2535689 - protein, 24 aa, Entamoeba dispar
PEIDEPWYLKFNNSAIFANKTTDE

SEQ ID NO: 2535690 - protein, 23 aa, Entamoeba dispar
PEIDEPWYLKFNNSAIYDDNTGD

SEQ ID NO: 2535691 - protein, 24 aa, Entamoeba dispar
PEIDKPWYLKFNNSAIYADNTEDL

SEQ ID NO: 2535692 - protein, 29 aa, Entamoeba dispar
PEIEGLQSIIILTHLLYEVTKTWSTENNV

SEQ ID NO: 2535693 - protein, 17 aa, Entamoeba dispar
PEIKLALIFEKCLSEIQ

SEQ ID NO: 2535694 - protein, 19 aa, Entamoeba dispar
PEILKQLTVLPVESPVLLS

SEQ ID NO: 2535695 - protein, 26 aa, Entamoeba dispar
PEILSKIAWLFSNFCRFKPSIPEQQL

SEQ ID NO: 2535696 - protein, 24 aa, Entamoeba dispar
PEINEPWYLKFNNSAIFANKTKDE

SEQ ID NO: 2535697 - protein, 24 aa, Entamoeba dispar
PEINEPWYLKFNNSAIYDDNTGDL

SEQ ID NO: 2535698 - protein, 24 aa, Entamoeba dispar
PEINEPWYLKFNNSGIYDDSTGDL

SEQ ID NO: 2535699 - protein, 23 aa, Entamoeba dispar
PEIPIFPILKKLGPADFVELLGR

SEQ ID NO: 2535700 - protein, 17 aa, Entamoeba dispar
PEKFVFELFNRIQLVDE

SEQ ID NO: 2535701 - protein, 20 aa, Entamoeba dispar
PEKITGYIEKTKIGIQLDRK

SEQ ID NO: 2535702 - protein, 21 aa, Entamoeba dispar
PEKLAHYINFIGNALVEESID

SEQ ID NO: 2535703 - protein, 27 aa, Entamoeba dispar
PEKLPDVCYSWWVLTSLIILGKVDWID

SEQ ID NO: 2535704 - protein, 26 aa, Entamoeba dispar
PEKPKILPCRATVKQLYQPHSDKEIN

SEQ ID NO: 2535705 - protein, 30 aa, Entamoeba dispar
PELCEYYYEKDMFFILKATTNIGEILIYIP

SEQ ID NO: 2535706 - protein, 17 aa, Entamoeba dispar
PELEEYFFHANPRSFCG

SEQ ID NO: 2535707 - protein, 18 aa, Entamoeba dispar
PELIKIRSEFKFFNVIQL

SEQ ID NO: 2535708 - protein, 27 aa, Entamoeba dispar
PELKNEKYIFKTYPFTKFTKKGGKDIC

SEQ ID NO: 2535709 - protein, 26 aa, Entamoeba dispar
PELTERFELFILKREIANAYTELNNP

SEQ ID NO: 2535710 - protein, 21 aa, Entamoeba dispar
PELVNYLFDALLSENEKRMSA

SEQ ID NO: 2535711 - protein, 17 aa, Entamoeba dispar
PELYLNDIIIRSVLEIS

SEQ ID NO: 2535712 - protein, 20 aa, Entamoeba dispar
PEMMMIERTLLRNINKGFIN

SEQ ID NO: 2535713 - protein, 26 aa, Entamoeba dispar
PENDAFFLRSQAVLLLELKCPEDFTK

SEQ ID NO: 2535714 - protein, 26 aa, Entamoeba dispar
PENGHFLMKCVSHFMTMVPFFNIMCA

SEQ ID NO: 2535715 - protein, 18 aa, Entamoeba dispar
PENGIIPTIGLDGKPIGK

SEQ ID NO: 2535716 - protein, 26 aa, Entamoeba dispar
PENMILTSVPVPPIAIRPSVAMDGGN

SEQ ID NO: 2535717 - protein, 24 aa, Entamoeba dispar
PENMRDFFTIVIKLLDSDGDNELN

SEQ ID NO: 2535718 - protein, 18 aa, Entamoeba dispar
PENVYEISLFLGMLSKWC

SEQ ID NO: 2535719 - protein, 19 aa, Entamoeba dispar
PEPDFPNRLAIYLSIALEP

SEQ ID NO: 2535720 - protein, 18 aa, Entamoeba dispar
PEPKRKPPLPPNKPIPTP

SEQ ID NO: 2535721 - protein, 24 aa, Entamoeba dispar
PEQKNEFYFLIDFNKQFKDNDSFR

SEQ ID NO: 2535722 - protein, 23 aa, Entamoeba dispar
PEQPPQLPPPRRGTSPANRSLNP

SEQ ID NO: 2535723 - protein, 29 aa, Entamoeba dispar
PEQQQIIKWLINTVKTNNFWEVFDEQEPK

SEQ ID NO: 2535724 - protein, 26 aa, Entamoeba dispar
PEQTTIPYLLNINQFQSLFSRYNLIF

SEQ ID NO: 2535725 - protein, 32 aa, Entamoeba dispar
PERDGYISFLTNQILFIPLPNENRELLVNEIE

SEQ ID NO: 2535726 - protein, 24 aa, Entamoeba dispar
PERIASLLKILQVALKYIGDLNFD

SEQ ID NO: 2535727 - protein, 20 aa, Entamoeba dispar
PERVPKIAELIFDKSKDIFR

SEQ ID NO: 2535728 - protein, 21 aa, Entamoeba dispar
PERVYVKKPVILLYDDTIKEK

SEQ ID NO: 2535729 - protein, 22 aa, Entamoeba dispar
PESIKYISFSLSDSKLIMNNKH

SEQ ID NO: 2535730 - protein, 22 aa, Entamoeba dispar
PESIKYISFSLSDSKLIMSNKH

SEQ ID NO: 2535731 - protein, 24 aa, Entamoeba dispar
PESKFQIIWPTEDFIRTSETGYHG

SEQ ID NO: 2535732 - protein, 23 aa, Entamoeba dispar
PESPFLIKGGIFPIIKQIPSKEN

SEQ ID NO: 2535733 - protein, 25 aa, Entamoeba dispar
PETAQGIFTMFKRNLEFNGGKVPFG

SEQ ID NO: 2535734 - protein, 19 aa, Entamoeba dispar
PETEKLKLYFRCFKTNKKG

SEQ ID NO: 2535735 - protein, 29 aa, Entamoeba dispar
PETFDKLYLLLEALLSFIYPHFADQANYK

SEQ ID NO: 2535736 - protein, 25 aa, Entamoeba dispar
PETFKVMMMLKYNKSLINPGEPVGV

SEQ ID NO: 2535737 - protein, 26 aa, Entamoeba dispar
PETIAPFILRGGLCGTFRQLLRSSNG

SEQ ID NO: 2535738 - protein, 20 aa, Entamoeba dispar
PETIRVVTSCYVYIQCIGDQ

SEQ ID NO: 2535739 - protein, 25 aa, Entamoeba dispar
PETLFQKIVVFIKKLMSNEFFLDSH

SEQ ID NO: 2535740 - protein, 20 aa, Entamoeba dispar
PETLTYVNNIALIKPLSTGT

SEQ ID NO: 2535741 - protein, 24 aa, Entamoeba dispar
PETQRRFALLLEAFLMVCGAQRTV

SEQ ID NO: 2535742 - protein, 25 aa, Entamoeba dispar
PETQTNLWEGFALRNEKLSEKVSEE

SEQ ID NO: 2535743 - protein, 23 aa, Entamoeba dispar
PETRKCFQKLESASRKSRVLPES

SEQ ID NO: 2535744 - protein, 25 aa, Entamoeba dispar
PETRKKVYAYMRQSVYVKKTQEELD

SEQ ID NO: 2535745 - protein, 25 aa, Entamoeba dispar
PEVFNHIYKVLLPGDYIAFRMTGKA

SEQ ID NO: 2535746 - protein, 27 aa, Entamoeba dispar
PEVHKKAVVMMYQSLIRDLNITNEENK

SEQ ID NO: 2535747 - protein, 18 aa, Entamoeba dispar
PEVIIRKGMNIEPMKPLH

SEQ ID NO: 2535748 - protein, 20 aa, Entamoeba dispar
PEVIVAPPGFPVEYLEMFNS

SEQ ID NO: 2535749 - protein, 23 aa, Entamoeba dispar
PEVKEWFNLIETIFISVKKAIKY

SEQ ID NO: 2535750 - protein, 27 aa, Entamoeba dispar
PEWRVRSFVQLLLPEIVSFIGADLAQK

SEQ ID NO: 2535751 - protein, 24 aa, Entamoeba dispar
PEYFEKIMYKLYYEKEIEGAFRQC

SEQ ID NO: 2535752 - protein, 19 aa, Entamoeba dispar
PEYLAGQYILQSSSSWVSV

SEQ ID NO: 2535753 - protein, 23 aa, Entamoeba dispar
PEYRAPELISVYEYLPIGCKSDV

SEQ ID NO: 2535754 - protein, 26 aa, Entamoeba dispar
PFANSGLFKWKYMTHWTIDYGITTSE

SEQ ID NO: 2535755 - protein, 18 aa, Entamoeba dispar
PFCIIVMDENGLWKSFYG

SEQ ID NO: 2535756 - protein, 20 aa, Entamoeba dispar
PFCYLDLPDLLFIDKIQPQI

SEQ ID NO: 2535757 - protein, 17 aa, Entamoeba dispar
PFDGKLLDPFKTSFRLG

SEQ ID NO: 2535758 - protein, 29 aa, Entamoeba dispar
PFDKTIKFSIPLFTKPLFESAGIKTPFIK

SEQ ID NO: 2535759 - protein, 17 aa, Entamoeba dispar
PFDLDDAVLRRLSRRIL

SEQ ID NO: 2535760 - protein, 32 aa, Entamoeba dispar
PFEEKLTSTFFNPPRINNLPPQQPIQEIVPYQ

SEQ ID NO: 2535761 - protein, 19 aa, Entamoeba dispar
PFELFSQFGITQVIQEKNL

SEQ ID NO: 2535762 - protein, 17 aa, Entamoeba dispar
PFELMQMDSLSAIPAQV

SEQ ID NO: 2535763 - protein, 18 aa, Entamoeba dispar
PFENGFKTYLMATSSKFG

SEQ ID NO: 2535764 - protein, 19 aa, Entamoeba dispar
PFEQLMSVLPPKSKSCLPY

SEQ ID NO: 2535765 - protein, 23 aa, Entamoeba dispar
PFEQLMSVLPPRSKSCLPEQFHD

SEQ ID NO: 2535766 - protein, 31 aa, Entamoeba dispar
PFEVFIDDGEKLFLHGLHLYSKKLQDMEKQE

SEQ ID NO: 2535767 - protein, 21 aa, Entamoeba dispar
PFEYTFAIGLCPLRYKKDKFI

SEQ ID NO: 2535768 - protein, 27 aa, Entamoeba dispar
PFGPHPIEVFALIAALRILCPLNFVLL

SEQ ID NO: 2535769 - protein, 22 aa, Entamoeba dispar
PFIDCELPFSISLYPHHLKNIK

SEQ ID NO: 2535770 - protein, 22 aa, Entamoeba dispar
PFIDHILQFSIVDDRIWMRNYQ

SEQ ID NO: 2535771 - protein, 20 aa, Entamoeba dispar
PFIKHYFIVTMGQTPSFLNT

SEQ ID NO: 2535772 - protein, 20 aa, Entamoeba dispar
PFILNNRTPILLIQNPDYLI

SEQ ID NO: 2535773 - protein, 20 aa, Entamoeba dispar
PFIYSNRLIQCFGSFGWSGE

SEQ ID NO: 2535774 - protein, 24 aa, Entamoeba dispar
PFKPRLYSYWMDASRWSSKMLEKM

SEQ ID NO: 2535775 - protein, 18 aa, Entamoeba dispar
PFLINYRNFVYSLDSEPS

SEQ ID NO: 2535776 - protein, 17 aa, Entamoeba dispar
PFLIQKLNNINNTIPGI

SEQ ID NO: 2535777 - protein, 20 aa, Entamoeba dispar
PFLKDKYVSYSLKKLKFYGP

SEQ ID NO: 2535778 - protein, 25 aa, Entamoeba dispar
PFLSRFHHDLKFRSVPTTYAAAQMC

SEQ ID NO: 2535779 - protein, 38 aa, Entamoeba dispar
PFMFINNIRFIRFAFSLRYQFIDYWYSSFYYSRLSFLP

SEQ ID NO: 2535780 - protein, 22 aa, Entamoeba dispar
PFMMNVLLYIRDFRTITHFFQV

SEQ ID NO: 2535781 - protein, 19 aa, Entamoeba dispar
PFMSILTEYISNGTLTMYL

SEQ ID NO: 2535782 - protein, 28 aa, Entamoeba dispar
PFNHQDSLFPHYPFSYDQSGYQPTYDSF

SEQ ID NO: 2535783 - protein, 20 aa, Entamoeba dispar
PFNKTFWCSSLFYPVEFHED

SEQ ID NO: 2535784 - protein, 20 aa, Entamoeba dispar
PFNRLHIYDNRRLCTLFGIE

SEQ ID NO: 2535785 - protein, 24 aa, Entamoeba dispar
PFNRSIEHNIKLRKAFDKLYKNTI

SEQ ID NO: 2535786 - protein, 27 aa, Entamoeba dispar
PFPEKSLPGLLIYKGDCMVKSLFGSEA

SEQ ID NO: 2535787 - protein, 24 aa, Entamoeba dispar
PFPKTEFKFPWKIAEFISTGKRPP

SEQ ID NO: 2535788 - protein, 20 aa, Entamoeba dispar
PFPPYDPLCLDEYPLLLRMV

SEQ ID NO: 2535789 - protein, 20 aa, Entamoeba dispar
PFPQISPIELLLPLDHEFII

SEQ ID NO: 2535790 - protein, 28 aa, Entamoeba dispar
PFSENFTVFAYLYLLNSLIKKYGFKNVP

SEQ ID NO: 2535791 - protein, 24 aa, Entamoeba dispar
PFSIKSKKIFPKLTNQFLYSRNDN

SEQ ID NO: 2535792 - protein, 35 aa, Entamoeba dispar
PFSLENRWFTFPILLHQYILLQTPVFYYEVTILPT

SEQ ID NO: 2535793 - protein, 20 aa, Entamoeba dispar
PFSYGCLKNFPEQWRGLRNK

SEQ ID NO: 2535794 - protein, 25 aa, Entamoeba dispar
PFTCPPTEYYLYKKSKETLPHLCIL

SEQ ID NO: 2535795 - protein, 25 aa, Entamoeba dispar
PFTEMFMCGVIYKLTQQYILMNIHQ

SEQ ID NO: 2535796 - protein, 19 aa, Entamoeba dispar
PFTHSGLQLLFIGTNNERG

SEQ ID NO: 2535797 - protein, 17 aa, Entamoeba dispar
PFTISKRVKSKTVHTRI

SEQ ID NO: 2535798 - protein, 17 aa, Entamoeba dispar
PFTNFNHHFYYDDKTYN

SEQ ID NO: 2535799 - protein, 20 aa, Entamoeba dispar
PFTPYPYQHQSFYPPYGYNT

SEQ ID NO: 2535800 - protein, 37 aa, Entamoeba dispar
PFVHPELIKFTKSITSLYRTLLLTIPKGGMKHLSRVV

SEQ ID NO: 2535801 - protein, 17 aa, Entamoeba dispar
PFVLQAREKRSAKPSLE

SEQ ID NO: 2535802 - protein, 20 aa, Entamoeba dispar
PFYDLVVKRFKELYTEDKIQ

SEQ ID NO: 2535803 - protein, 25 aa, Entamoeba dispar
PFYGDLLNVLYDRDHYKLALAQLSI

SEQ ID NO: 2535804 - protein, 18 aa, Entamoeba dispar
PGAFPDFKTPIVLPARKA

SEQ ID NO: 2535805 - protein, 19 aa, Entamoeba dispar
PGAILFTTNCLMKPLPSYK

SEQ ID NO: 2535806 - protein, 23 aa, Entamoeba dispar
PGAIRILNYFKRHHIPIALATST

SEQ ID NO: 2535807 - protein, 23 aa, Entamoeba dispar
PGAPPPPPPGMPGAPPPPPMGKG

SEQ ID NO: 2535808 - protein, 24 aa, Entamoeba dispar
PGAPSIFLYSNFMGGLSALIPLQN

SEQ ID NO: 2535809 - protein, 26 aa, Entamoeba dispar
PGASSIPPPPPPPGASSIPPPPPPPG

SEQ ID NO: 2535810 - protein, 38 aa, Entamoeba dispar
PGAYPPPGYPPMQPGMMPPPGYPPMQPGMMPPPGAYPP

SEQ ID NO: 2535811 - protein, 32 aa, Entamoeba dispar
PGDEVIIFSPYFVEYIFYIKNYGGIPIKVQTR

SEQ ID NO: 2535812 - protein, 23 aa, Entamoeba dispar
PGDSTFFDFRHFTNYLSIGIDAA

SEQ ID NO: 2535813 - protein, 30 aa, Entamoeba dispar
PGFIKEVLNNHLFIYKLLENLELASSSPVK

SEQ ID NO: 2535814 - protein, 26 aa, Entamoeba dispar
PGFSGIYGCCECPITPDIYTAVFFGW

SEQ ID NO: 2535815 - protein, 19 aa, Entamoeba dispar
PGGFGFRPAAPKPNAYVTM

SEQ ID NO: 2535816 - protein, 17 aa, Entamoeba dispar
PGGQMIEMVLDRLPKWY

SEQ ID NO: 2535817 - protein, 17 aa, Entamoeba dispar
PGGSLQSILKRCGKIDI

SEQ ID NO: 2535818 - protein, 17 aa, Entamoeba dispar
PGGVGFDINCGVRLIRT

SEQ ID NO: 2535819 - protein, 25 aa, Entamoeba dispar
PGHGMMFVRNDAKVFWFCRSKCHKS

SEQ ID NO: 2535820 - protein, 40 aa, Entamoeba dispar
PGIGFWAPMWRVWIFLLRGLIPILERWLGNLLARQFEGRK

SEQ ID NO: 2535821 - protein, 20 aa, Entamoeba dispar
PGIISIFLGDVIQTLIDSIT

SEQ ID NO: 2535822 - protein, 22 aa, Entamoeba dispar
PGILLLCFQVYKEIVKNIKDTK

SEQ ID NO: 2535823 - protein, 17 aa, Entamoeba dispar
PGIVSGTKVNPINKLTG

SEQ ID NO: 2535824 - protein, 23 aa, Entamoeba dispar
PGKDLLEIVTINSISKPLIVLTV

SEQ ID NO: 2535825 - protein, 21 aa, Entamoeba dispar
PGKLDHSTLLAYKVIKRIDAF

SEQ ID NO: 2535826 - protein, 21 aa, Entamoeba dispar
PGKYRFIFERDYIYIGGRYRK

SEQ ID NO: 2535827 - protein, 19 aa, Entamoeba dispar
PGLDKAIALLLQRNEYIQV

SEQ ID NO: 2535828 - protein, 25 aa, Entamoeba dispar
PGLVPRCLELLFQKKTKTASVSLSM

SEQ ID NO: 2535829 - protein, 24 aa, Entamoeba dispar
PGMIIKELGLTKPIFQKTAVGGHF

SEQ ID NO: 2535830 - protein, 24 aa, Entamoeba dispar
PGMPGMPPPPPGFGFRPPGAPALK

SEQ ID NO: 2535831 - protein, 20 aa, Entamoeba dispar
PGMPGMPPPPPPPGMPGMPP

SEQ ID NO: 2535832 - protein, 17 aa, Entamoeba dispar
PGMYIAVQAVLAIVASW

SEQ ID NO: 2535833 - protein, 26 aa, Entamoeba dispar
PGNYGDLYIHFKIQNPTYLSQQQKDD

SEQ ID NO: 2535834 - protein, 19 aa, Entamoeba dispar
PGPMLEAFQKGTAACYPLG

SEQ ID NO: 2535835 - protein, 25 aa, Entamoeba dispar
PGQYGNLIVHFNIQNPTYLSQEQKD

SEQ ID NO: 2535836 - protein, 31 aa, Entamoeba dispar
PGRLKDLLSQSYLVLGQCYFVVLDEADKMID

SEQ ID NO: 2535837 - protein, 17 aa, Entamoeba dispar
PGRTLTIGDLIDLNTFR

SEQ ID NO: 2535838 - protein, 24 aa, Entamoeba dispar
PGSDTVIAIIYINKQYKLVYAENQ

SEQ ID NO: 2535839 - protein, 24 aa, Entamoeba dispar
PGSHTSVFILPTQPALKPKRKRGR

SEQ ID NO: 2535840 - protein, 18 aa, Entamoeba dispar
PGSTIQILGAEKALFRAL

SEQ ID NO: 2535841 - protein, 24 aa, Entamoeba dispar
PGTKVRLIRKLLEGLIVSVTNVHI

SEQ ID NO: 2535842 - protein, 32 aa, Entamoeba dispar
PGTLEFLHNCAPFIAKLYLLVNSPQSNSLICW

SEQ ID NO: 2535843 - protein, 23 aa, Entamoeba dispar
PGTVIRFIWDLADPTTLPIKGGD

SEQ ID NO: 2535844 - protein, 18 aa, Entamoeba dispar
PGVIKSLAMPDAHSGYGF

SEQ ID NO: 2535845 - protein, 40 aa, Entamoeba dispar
PGVPPMIPGAIPPGIPMYPPMGMIPPMGPPPQMNPMMPQP

SEQ ID NO: 2535846 - protein, 25 aa, Entamoeba dispar
PGYEKPIIFGNLHEFAYPLVNPKTG

SEQ ID NO: 2535847 - protein, 17 aa, Entamoeba dispar
PGYHFIAERLKGTCGLC

SEQ ID NO: 2535848 - protein, 23 aa, Entamoeba dispar
PGYSYYNKLLFKEWYHNQKNHSK

SEQ ID NO: 2535849 - protein, 20 aa, Entamoeba dispar
PHDAANLIKTYLRTLPVSIA

SEQ ID NO: 2535850 - protein, 17 aa, Entamoeba dispar
PHDIIRLDFDLNLVGLI

SEQ ID NO: 2535851 - protein, 17 aa, Entamoeba dispar
PHELTLPRRTPNFALKY

SEQ ID NO: 2535852 - protein, 20 aa, Entamoeba dispar
PHFMSVNPIKMQFGIMAYQH

SEQ ID NO: 2535853 - protein, 26 aa, Entamoeba dispar
PHFNTTPLRILILDEADRILDMGFKK

SEQ ID NO: 2535854 - protein, 18 aa, Entamoeba dispar
PHFRTIYFNYFNSYEKNE

SEQ ID NO: 2535855 - protein, 24 aa, Entamoeba dispar
PHFVKLLCTCYGYFFADIFMLIPE

SEQ ID NO: 2535856 - protein, 19 aa, Entamoeba dispar
PHGGACTVVLRGPSKQLLG

SEQ ID NO: 2535857 - protein, 17 aa, Entamoeba dispar
PHIKLSYSSPETLRPEE

SEQ ID NO: 2535858 - protein, 17 aa, Entamoeba dispar
PHKEVFAELQRLRKIFF

SEQ ID NO: 2535859 - protein, 23 aa, Entamoeba dispar
PHKRNWVIEWAKSSQIKEGDLDK

SEQ ID NO: 2535860 - protein, 18 aa, Entamoeba dispar
PHLISLTHFLAQCKNIAF

SEQ ID NO: 2535861 - protein, 20 aa, Entamoeba dispar
PHLQNLLKDFLLHQNEDYLQ

SEQ ID NO: 2535862 - protein, 31 aa, Entamoeba dispar
PHNDGEFLLVGWTPFLRCLFEIERLRQIASG

SEQ ID NO: 2535863 - protein, 27 aa, Entamoeba dispar
PHPHQHLLIVTKRPRSFKARPIIKHSD

SEQ ID NO: 2535864 - protein, 17 aa, Entamoeba dispar
PHPTISFDWTRQKTISN

SEQ ID NO: 2535865 - protein, 26 aa, Entamoeba dispar
PHQHMLIVTKRPRSFKARPIINHADG

SEQ ID NO: 2535866 - protein, 17 aa, Entamoeba dispar
PHQHMLVVLKRPRSYNA

SEQ ID NO: 2535867 - protein, 23 aa, Entamoeba dispar
PHQKIPFCRLTGMIKTSIKKDSD

SEQ ID NO: 2535868 - protein, 18 aa, Entamoeba dispar
PHQTDCLCFLLPSCCPVS

SEQ ID NO: 2535869 - protein, 19 aa, Entamoeba dispar
PHQTDCLCFLLPSCCPVSQ

SEQ ID NO: 2535870 - protein, 24 aa, Entamoeba dispar
PHTKKHTLLLRKLKVILLLPSLNS

SEQ ID NO: 2535871 - protein, 17 aa, Entamoeba dispar
PIAHHPLWEQILKELKK

SEQ ID NO: 2535872 - protein, 17 aa, Entamoeba dispar
PIALPPVLASKLIYRIS

SEQ ID NO: 2535873 - protein, 21 aa, Entamoeba dispar
PIAMRNVIGITMPPGYSTLQP

SEQ ID NO: 2535874 - protein, 21 aa, Entamoeba dispar
PIAVESIYNYLYDKGFTVPGI

SEQ ID NO: 2535875 - protein, 18 aa, Entamoeba dispar
PICQPIHRTISLYSDEFE

SEQ ID NO: 2535876 - protein, 19 aa, Entamoeba dispar
PIDFFIPDEHISPTMLIAM

SEQ ID NO: 2535877 - protein, 32 aa, Entamoeba dispar
PIDNEVQFYRFGGRPYVPYTPLAGSGGDNKEE

SEQ ID NO: 2535878 - protein, 20 aa, Entamoeba dispar
PIDPFKILEKYYKELPIAKH

SEQ ID NO: 2535879 - protein, 19 aa, Entamoeba dispar
PIDPVYEPLLYKIEPSLLS

SEQ ID NO: 2535880 - protein, 30 aa, Entamoeba dispar
PIDREKIQLVSWLNQQLLTDKKITQEYKYM

SEQ ID NO: 2535881 - protein, 27 aa, Entamoeba dispar
PIDSTLYLPYLQLLTSQIFKTILLIKQ

SEQ ID NO: 2535882 - protein, 18 aa, Entamoeba dispar
PIDYYFVKGPHKFDYQGM

SEQ ID NO: 2535883 - protein, 27 aa, Entamoeba dispar
PIEDQIWLHAWKYSFNSHNWIAEIPEW

SEQ ID NO: 2535884 - protein, 20 aa, Entamoeba dispar
PIEFKQEIVRFPPLNQIKKE

SEQ ID NO: 2535885 - protein, 18 aa, Entamoeba dispar
PIEHLFNHFSLKQLILTD

SEQ ID NO: 2535886 - protein, 22 aa, Entamoeba dispar
PIEHLSFYSRVMNLMESLGYNE

SEQ ID NO: 2535887 - protein, 26 aa, Entamoeba dispar
PIEIKNITYYPFILNNPSSSERDIVL

SEQ ID NO: 2535888 - protein, 22 aa, Entamoeba dispar
PIEIVLHLPILCEDKNVPYVFV

SEQ ID NO: 2535889 - protein, 25 aa, Entamoeba dispar
PIEKKPMFHFLPQTMTYSIATVGCN

SEQ ID NO: 2535890 - protein, 17 aa, Entamoeba dispar
PIERAHILKTIRAIKQY

SEQ ID NO: 2535891 - protein, 19 aa, Entamoeba dispar
PIFLQFIDCVYQFMRIFPK

SEQ ID NO: 2535892 - protein, 20 aa, Entamoeba dispar
PIFNRVPIVLESLKDFKPEM

SEQ ID NO: 2535893 - protein, 25 aa, Entamoeba dispar
PIFPQNYCKVAIINGFFDNILKLTE

SEQ ID NO: 2535894 - protein, 30 aa, Entamoeba dispar
PIFTETTICLLFPSPFFQLIPNKIDEHIYL

SEQ ID NO: 2535895 - protein, 25 aa, Entamoeba dispar
PIFVQFFPQYIAYTFFQIPEFRLEL

SEQ ID NO: 2535896 - protein, 30 aa, Entamoeba dispar
PIGDDGRPIPFWLYKLHGLGTEFKCEICGN

SEQ ID NO: 2535897 - protein, 25 aa, Entamoeba dispar
PIGSGSLLCGLALAVKTLDPRVKVY

SEQ ID NO: 2535898 - protein, 21 aa, Entamoeba dispar
PIHIRIPFENWTIQGKNTMLV

SEQ ID NO: 2535899 - protein, 30 aa, Entamoeba dispar
PIHMGHYYPMFFYPVVLEKPIPLFSIVFTP

SEQ ID NO: 2535900 - protein, 23 aa, Entamoeba dispar
PIHNDFFIMQFLERNKLEDFIPI

SEQ ID NO: 2535901 - protein, 19 aa, Entamoeba dispar
PIHSFVFLPSNSADDDVLF

SEQ ID NO: 2535902 - protein, 30 aa, Entamoeba dispar
PIIFDDIHMIPFLWIQLTFGCDGCIGYYER

SEQ ID NO: 2535903 - protein, 26 aa, Entamoeba dispar
PIIGDLLRWLIDIRNYSVRCINHTKI

SEQ ID NO: 2535904 - protein, 17 aa, Entamoeba dispar
PIIHFHCGHSYHKKCFT

SEQ ID NO: 2535905 - protein, 27 aa, Entamoeba dispar
PIIKNDFFILVRVYGIYCSCYNLDIDG

SEQ ID NO: 2535906 - protein, 30 aa, Entamoeba dispar
PIILDGLNCFYYFATKMFFALSPTTEFLHR

SEQ ID NO: 2535907 - protein, 25 aa, Entamoeba dispar
PIIMKKTIIYCFRYSFSLLGEGEQN

SEQ ID NO: 2535908 - protein, 19 aa, Entamoeba dispar
PIISDIPRFGSLIIEKMTP

SEQ ID NO: 2535909 - protein, 19 aa, Entamoeba dispar
PIISDIPRFGSLIIERMTI

SEQ ID NO: 2535910 - protein, 19 aa, Entamoeba dispar
PIISPRQKFTPRASMIQLV

SEQ ID NO: 2535911 - protein, 18 aa, Entamoeba dispar
PIISYYLMYQFGVVDEQK

SEQ ID NO: 2535912 - protein, 18 aa, Entamoeba dispar
PIKFVKREVNSYSTWLFP

SEQ ID NO: 2535913 - protein, 28 aa, Entamoeba dispar
PIKYPTPLKRKAITPLLESKRKSLAPNK

SEQ ID NO: 2535914 - protein, 26 aa, Entamoeba dispar
PILDEKVDLLSLRKLSNQSSEKSIYG

SEQ ID NO: 2535915 - protein, 21 aa, Entamoeba dispar
PILFHPIQRFISKLITFHPDI

SEQ ID NO: 2535916 - protein, 17 aa, Entamoeba dispar
PILPIKMTEHQIGVPEI

SEQ ID NO: 2535917 - protein, 19 aa, Entamoeba dispar
PILPVLAHGPQARQFFMQK

SEQ ID NO: 2535918 - protein, 27 aa, Entamoeba dispar
PILVDGSFFFWMAYCPIKPKSEKLSQI

SEQ ID NO: 2535919 - protein, 25 aa, Entamoeba dispar
PIMKEPFNYLIYTQLKKSNIHFTKF

SEQ ID NO: 2535920 - protein, 17 aa, Entamoeba dispar
PIMTVRRDPLDYVSDQR

SEQ ID NO: 2535921 - protein, 18 aa, Entamoeba dispar
PINGILNIPLKFGSIRVL

SEQ ID NO: 2535922 - protein, 22 aa, Entamoeba dispar
PINHVIITIVCSFLVSTNGDVL

SEQ ID NO: 2535923 - protein, 32 aa, Entamoeba dispar
PINITVCVIPPLPLLKPLSFPLSITVFPGETK

SEQ ID NO: 2535924 - protein, 19 aa, Entamoeba dispar
PINKIVMIIGFDPSEIKNI

SEQ ID NO: 2535925 - protein, 38 aa, Entamoeba dispar
PINKPLFNCDQLQCYILYVKMHFFPEMTEEAELVIQKY

SEQ ID NO: 2535926 - protein, 26 aa, Entamoeba dispar
PINLYPITHFSFSLAKSFLYDQFEYY

SEQ ID NO: 2535927 - protein, 25 aa, Entamoeba dispar
PINPFEFHSFFYLRTVKLSDEIKEI

SEQ ID NO: 2535928 - protein, 17 aa, Entamoeba dispar
PINSPTITVSNWLETEL

SEQ ID NO: 2535929 - protein, 17 aa, Entamoeba dispar
PIPLNQPLLHPLERSHQ

SEQ ID NO: 2535930 - protein, 22 aa, Entamoeba dispar
PIPPGLLVRQIIVKKLGEVERK

SEQ ID NO: 2535931 - protein, 20 aa, Entamoeba dispar
PIPRFKRILSGIDKLGRVVS

SEQ ID NO: 2535932 - protein, 23 aa, Entamoeba dispar
PIQAEIFLLLQHNMNNLLLLSNS

SEQ ID NO: 2535933 - protein, 22 aa, Entamoeba dispar
PIQEIVPYQQIIIKPEQKKKSP

SEQ ID NO: 2535934 - protein, 17 aa, Entamoeba dispar
PIQFIPQMVTGQNPQMI

SEQ ID NO: 2535935 - protein, 24 aa, Entamoeba dispar
PIQLLSSCLLIFKCLSEALSGIEE

SEQ ID NO: 2535936 - protein, 17 aa, Entamoeba dispar
PIQPFKPSGILLYGPSG

SEQ ID NO: 2535937 - protein, 20 aa, Entamoeba dispar
PIQPKFSFPSSFKAPPNIHL

SEQ ID NO: 2535938 - protein, 17 aa, Entamoeba dispar
PIQQPYIPPVPQQQSTS

SEQ ID NO: 2535939 - protein, 40 aa, Entamoeba dispar
PIQSKPIQPILQKPTILQKPILPILPKTTPIYSTPTIQPY

SEQ ID NO: 2535940 - protein, 19 aa, Entamoeba dispar
PIQVIPIKPKLPEIHHPII

SEQ ID NO: 2535941 - protein, 26 aa, Entamoeba dispar
PIRASLLLLELFDKFYSIFNKSIPLI

SEQ ID NO: 2535942 - protein, 26 aa, Entamoeba dispar
PIRLGLALNFSVFYFEIMNDADKACQ

SEQ ID NO: 2535943 - protein, 24 aa, Entamoeba dispar
PIRMYTRYIDKFYIVLRFTEEESK

SEQ ID NO: 2535944 - protein, 19 aa, Entamoeba dispar
PIRSFGRIKKITAKELNSK

SEQ ID NO: 2535945 - protein, 27 aa, Entamoeba dispar
PISCVEAVLYLFHQMKQWSVCIPKLNA

SEQ ID NO: 2535946 - protein, 22 aa, Entamoeba dispar
PISLGVCNLGVLFQKIIPSGTE

SEQ ID NO: 2535947 - protein, 17 aa, Entamoeba dispar
PISLQGRSCFTIIRDPS

SEQ ID NO: 2535948 - protein, 29 aa, Entamoeba dispar
PISMEDWIDCVWLIKIMETFKVIKFGYEE

SEQ ID NO: 2535949 - protein, 35 aa, Entamoeba dispar
PISNELFTKLPPYNSPIIDIPFFLKEDQIKHADNL

SEQ ID NO: 2535950 - protein, 25 aa, Entamoeba dispar
PISPDPYFPYSSFERTIYKQRVDSP

SEQ ID NO: 2535951 - protein, 19 aa, Entamoeba dispar
PISVYAYEFCGYPYHDTCI

SEQ ID NO: 2535952 - protein, 17 aa, Entamoeba dispar
PITASANILFLLNYLTH

SEQ ID NO: 2535953 - protein, 18 aa, Entamoeba dispar
PITFLNSPLIDKKVCSLS

SEQ ID NO: 2535954 - protein, 19 aa, Entamoeba dispar
PITKIKLFKTIEEQHLYGI

SEQ ID NO: 2535955 - protein, 27 aa, Entamoeba dispar
PITPSLTPHFQFSTPVLTLSKPSSPRR

SEQ ID NO: 2535956 - protein, 20 aa, Entamoeba dispar
PITPSPVEIKPITPSPVEVK

SEQ ID NO: 2535957 - protein, 18 aa, Entamoeba dispar
PITQYSYGKPIIFSFIIR

SEQ ID NO: 2535958 - protein, 22 aa, Entamoeba dispar
PITSQIILEMLKVGVSQGVMID

SEQ ID NO: 2535959 - protein, 27 aa, Entamoeba dispar
PITVESLYNILLPYLDSPKVLAQAITI

SEQ ID NO: 2535960 - protein, 20 aa, Entamoeba dispar
PITVLPFRYYNIPKEYEYIK

SEQ ID NO: 2535961 - protein, 21 aa, Entamoeba dispar
PIVQIILKRLLLKENPEAVVM

SEQ ID NO: 2535962 - protein, 18 aa, Entamoeba dispar
PIYFLIDETTMSIVSFIS

SEQ ID NO: 2535963 - protein, 20 aa, Entamoeba dispar
PIYGMNYEKFIPALIQYYKQ

SEQ ID NO: 2535964 - protein, 19 aa, Entamoeba dispar
PIYGMNYEKFMPALIQYYK

SEQ ID NO: 2535965 - protein, 18 aa, Entamoeba dispar
PIYGMNYEKFMPALMQYY

SEQ ID NO: 2535966 - protein, 19 aa, Entamoeba dispar
PIYGMNYEKFMPALMQYYK

SEQ ID NO: 2535967 - protein, 19 aa, Entamoeba dispar
PIYGMNYEKFMPTLIQYYK

SEQ ID NO: 2535968 - protein, 20 aa, Entamoeba dispar
PIYIPHKRNGFALLQSYVTY

SEQ ID NO: 2535969 - protein, 25 aa, Entamoeba dispar
PIYQKLREGILEHLIPYLTQNMKKN

SEQ ID NO: 2535970 - protein, 18 aa, Entamoeba dispar
PIYQQISDFHLLVFCLDY

SEQ ID NO: 2535971 - protein, 34 aa, Entamoeba dispar
PKALQKISRLNKFKILRDIAVGLAFIHSLAKIPH

SEQ ID NO: 2535972 - protein, 20 aa, Entamoeba dispar
PKCQLVIFKIYNIFCSKYLD

SEQ ID NO: 2535973 - protein, 40 aa, Entamoeba dispar
PKDFDSDDLLSLLTFSLLNSTMRHPFAISILLECFLTDED

SEQ ID NO: 2535974 - protein, 24 aa, Entamoeba dispar
PKDLAFVGYTYKGFLNVVNTPSKK

SEQ ID NO: 2535975 - protein, 25 aa, Entamoeba dispar
PKDLYKIISHYLSKQGWELSEEHLK

SEQ ID NO: 2535976 - protein, 24 aa, Entamoeba dispar
PKDTDFIHTISFADSFPLTLLNTR

SEQ ID NO: 2535977 - protein, 18 aa, Entamoeba dispar
PKDVILEVLCNTLSPLNK

SEQ ID NO: 2535978 - protein, 17 aa, Entamoeba dispar
PKEIIEKTKQWLKEFIL

SEQ ID NO: 2535979 - protein, 23 aa, Entamoeba dispar
PKEINRNIIKYVDTLIVNTNESM

SEQ ID NO: 2535980 - protein, 20 aa, Entamoeba dispar
PKELICFNKYFFDAVWSDSV

SEQ ID NO: 2535981 - protein, 31 aa, Entamoeba dispar
PKELNSNFKLLPKLILLDIINSFNNFEESEY

SEQ ID NO: 2535982 - protein, 25 aa, Entamoeba dispar
PKFASLYVEFFIQVKRNPKIYDKFV

SEQ ID NO: 2535983 - protein, 26 aa, Entamoeba dispar
PKGEYLFVLCLNSARNRILYIYRVIR

SEQ ID NO: 2535984 - protein, 31 aa, Entamoeba dispar
PKGKIYVDSFIYSFPLFLTKKEFIDLIIKQH

SEQ ID NO: 2535985 - protein, 26 aa, Entamoeba dispar
PKGVGALFIRAGKPITPLLHGGEQMG

SEQ ID NO: 2535986 - protein, 25 aa, Entamoeba dispar
PKGYGISRTLVYNKALKAIGLHKCY

SEQ ID NO: 2535987 - protein, 17 aa, Entamoeba dispar
PKIFFPCNPQRSTLTIV

SEQ ID NO: 2535988 - protein, 17 aa, Entamoeba dispar
PKIFYHLKSKEYDFDNW

SEQ ID NO: 2535989 - protein, 26 aa, Entamoeba dispar
PKILAEQLMIYDIDLFGNIPLNEITL

SEQ ID NO: 2535990 - protein, 23 aa, Entamoeba dispar
PKILSMMCDVILQDLPMLNGETG

SEQ ID NO: 2535991 - protein, 23 aa, Entamoeba dispar
PKISIMKIIVPPHTHLEKHHHLV

SEQ ID NO: 2535992 - protein, 24 aa, Entamoeba dispar
PKITAYDRMICSYKLAFISTLGYE

SEQ ID NO: 2535993 - protein, 34 aa, Entamoeba dispar
PKKERPQVGVSDKKLFVIGLPKDYSNEEFQTLMG

SEQ ID NO: 2535994 - protein, 31 aa, Entamoeba dispar
PKKEVYSQILSTLWQMSLIDMKYSMRRIEKE

SEQ ID NO: 2535995 - protein, 38 aa, Entamoeba dispar
PKKFFSLKGDMLWFVVDHWFLFGKLYQFRTNPNKWKKA

SEQ ID NO: 2535996 - protein, 21 aa, Entamoeba dispar
PKKLQFLTFERTKTLPIECEI

SEQ ID NO: 2535997 - protein, 20 aa, Entamoeba dispar
PKLHSILHYRGESPTSPISQ

SEQ ID NO: 2535998 - protein, 22 aa, Entamoeba dispar
PKLMKFVIIHSSAKARKGLLKE

SEQ ID NO: 2535999 - protein, 22 aa, Entamoeba dispar
PKLQYLCSFFSKINYDINTLTT

SEQ ID NO: 2536000 - protein, 20 aa, Entamoeba dispar
PKMKYICYTLQEIENLRSKA

SEQ ID NO: 2536001 - protein, 20 aa, Entamoeba dispar
PKMRIVFVGTFGVGKTSLIQ

SEQ ID NO: 2536002 - protein, 24 aa, Entamoeba dispar
PKNEKLLKFIFIHPPKHEKEEEED

SEQ ID NO: 2536003 - protein, 22 aa, Entamoeba dispar
PKNHVQELLKVFQFVCCSDYHA

SEQ ID NO: 2536004 - protein, 27 aa, Entamoeba dispar
PKNKEDYMIFLTSFLLILHRVNPTHEY

SEQ ID NO: 2536005 - protein, 25 aa, Entamoeba dispar
PKNKLDVIFLHFPDVQSMNSSFFEQ

SEQ ID NO: 2536006 - protein, 23 aa, Entamoeba dispar
PKNNIIGLNWIHCSPATSNHLIC

SEQ ID NO: 2536007 - protein, 30 aa, Entamoeba dispar
PKNRNVNVFLFNDNLVIAKILTTGTLHKGE

SEQ ID NO: 2536008 - protein, 27 aa, Entamoeba dispar
PKPHQHLLIVTKRPKSFKARPIINHAD

SEQ ID NO: 2536009 - protein, 24 aa, Entamoeba dispar
PKPSIKLSTFLQTLKQNESQPPED

SEQ ID NO: 2536010 - protein, 18 aa, Entamoeba dispar
PKPTYRPPQQTIPEPVQE

SEQ ID NO: 2536011 - protein, 28 aa, Entamoeba dispar
PKQETSLLFGIAFDRRLEKLKEQYAEQP

SEQ ID NO: 2536012 - protein, 26 aa, Entamoeba dispar
PKQFDISIKPKRLTKKAIHSVGTYIK

SEQ ID NO: 2536013 - protein, 21 aa, Entamoeba dispar
PKQFFTNFVSIGKGGFGEVFV

SEQ ID NO: 2536014 - protein, 25 aa, Entamoeba dispar
PKRDKLIILLRLVEKCNENQIDDII

SEQ ID NO: 2536015 - protein, 31 aa, Entamoeba dispar
PKREEKILCKIFPLYFSYIQENPQTLIPRFY

SEQ ID NO: 2536016 - protein, 25 aa, Entamoeba dispar
PKSDYIAQIFGYCINPLFVTMEFFN

SEQ ID NO: 2536017 - protein, 25 aa, Entamoeba dispar
PKSITFYFQFNFIDTLNLFKNGSFD

SEQ ID NO: 2536018 - protein, 24 aa, Entamoeba dispar
PKSTIIAFRYLLAYYRQPEVKQCE

SEQ ID NO: 2536019 - protein, 29 aa, Entamoeba dispar
PKTFDKSQFFLLFPSNIKITSTDFTCLHL

SEQ ID NO: 2536020 - protein, 30 aa, Entamoeba dispar
PKTKQLFRNLLTEQPFLFTLTEYFNQQKNI

SEQ ID NO: 2536021 - protein, 39 aa, Entamoeba dispar
PKTKQLKNYIIKKSMKFLVFMIIFVVSKGLEPIEVATEE

SEQ ID NO: 2536022 - protein, 25 aa, Entamoeba dispar
PKTQYSRVILIRDQILKLACDHFCH

SEQ ID NO: 2536023 - protein, 30 aa, Entamoeba dispar
PKTSSTNQIRIFPYPTKPISPNSSHQVTVP

SEQ ID NO: 2536024 - protein, 23 aa, Entamoeba dispar
PKVAWYCYHLMKERKNMSLKYLI

SEQ ID NO: 2536025 - protein, 18 aa, Entamoeba dispar
PKVFFEPFSIRYLAELKD

SEQ ID NO: 2536026 - protein, 24 aa, Entamoeba dispar
PKVIEPIYFAQWGTMWIAMRNEKA

SEQ ID NO: 2536027 - protein, 19 aa, Entamoeba dispar
PKVLAPLPQTIPRNSIPSN

SEQ ID NO: 2536028 - protein, 19 aa, Entamoeba dispar
PKVLIIQLVRIYSKKYPTQ

SEQ ID NO: 2536029 - protein, 22 aa, Entamoeba dispar
PKYQGKFPQNRFGIAPDYKWDG

SEQ ID NO: 2536030 - protein, 23 aa, Entamoeba dispar
PKYSEYKRYLNYTFLNDKRTSEL

SEQ ID NO: 2536031 - protein, 25 aa, Entamoeba dispar
PKYSFARYWILDSIRAQHFMKNIQE

SEQ ID NO: 2536032 - protein, 21 aa, Entamoeba dispar
PKYTKLIFTLFCNIGMVSCDD

SEQ ID NO: 2536033 - protein, 21 aa, Entamoeba dispar
PLAFYWTFWVDNFNDKNGTFE

SEQ ID NO: 2536034 - protein, 17 aa, Entamoeba dispar
PLAPTIQPSFAGSFNTI

SEQ ID NO: 2536035 - protein, 17 aa, Entamoeba dispar
PLCELTLIQCRKLQTLN

SEQ ID NO: 2536036 - protein, 17 aa, Entamoeba dispar
PLCIEYNSFIRRLQHRA

SEQ ID NO: 2536037 - protein, 36 aa, Entamoeba dispar
PLCKNYCFTFIPPVLDTIFQFVLIQPKSSYTDVITE

SEQ ID NO: 2536038 - protein, 26 aa, Entamoeba dispar
PLDANAWFVALAYTIKLSPRLNESKN

SEQ ID NO: 2536039 - protein, 24 aa, Entamoeba dispar
PLDCKLQYDYIIKSQLYSSLEIIP

SEQ ID NO: 2536040 - protein, 20 aa, Entamoeba dispar
PLDGKYLVVDDHNYHPNCFV

SEQ ID NO: 2536041 - protein, 18 aa, Entamoeba dispar
PLDLCRYISILDSGNDIA

SEQ ID NO: 2536042 - protein, 18 aa, Entamoeba dispar
PLDPAAYLHTLHQQTTCC

SEQ ID NO: 2536043 - protein, 18 aa, Entamoeba dispar
PLDVPKFKYKKVAPRQVT

SEQ ID NO: 2536044 - protein, 19 aa, Entamoeba dispar
PLDWIYDPNKSFFHIGLLL

SEQ ID NO: 2536045 - protein, 25 aa, Entamoeba dispar
PLEDEKLVLKLIWNEQLIVEHNETY

SEQ ID NO: 2536046 - protein, 25 aa, Entamoeba dispar
PLEEHMIINPPQRIIEWVHSIQHTI

SEQ ID NO: 2536047 - protein, 17 aa, Entamoeba dispar
PLEIFEQYLIPVAKYQV

SEQ ID NO: 2536048 - protein, 19 aa, Entamoeba dispar
PLEMAQSYHRVFYLFHCPF

SEQ ID NO: 2536049 - protein, 18 aa, Entamoeba dispar
PLFEEPWEELPPHALSFI

SEQ ID NO: 2536050 - protein, 19 aa, Entamoeba dispar
PLGILCDNLILSIQRSIIV

SEQ ID NO: 2536051 - protein, 39 aa, Entamoeba dispar
PLGTLQPPIPTLSSPTTTLPPPIPPTTYPLSAQELPLSR

SEQ ID NO: 2536052 - protein, 17 aa, Entamoeba dispar
PLHMLTTGWTYWFDLGM

SEQ ID NO: 2536053 - protein, 19 aa, Entamoeba dispar
PLHPSYRLVGVLDPYGILE

SEQ ID NO: 2536054 - protein, 17 aa, Entamoeba dispar
PLHTITFKSNYCIPLIL

SEQ ID NO: 2536055 - protein, 26 aa, Entamoeba dispar
PLIHSSIYCHVLFIQIPHIKSRESTQ

SEQ ID NO: 2536056 - protein, 17 aa, Entamoeba dispar
PLIIYGTSKLTQIESLV

SEQ ID NO: 2536057 - protein, 20 aa, Entamoeba dispar
PLILNTFNSIIQFIQILQQR

SEQ ID NO: 2536058 - protein, 22 aa, Entamoeba dispar
PLINTFGLFSYCKKIKTITATY

SEQ ID NO: 2536059 - protein, 38 aa, Entamoeba dispar
PLIQLPIKNTYIINIIFFNQYFLLESFLKSYQPIHLRI

SEQ ID NO: 2536060 - protein, 18 aa, Entamoeba dispar
PLIRQLKLMHSYSIFLRK

SEQ ID NO: 2536061 - protein, 26 aa, Entamoeba dispar
PLIRQRSVYIIMRILNSMPDNYTLTE

SEQ ID NO: 2536062 - protein, 21 aa, Entamoeba dispar
PLIVFNTYIQLRISVGFTGPE

SEQ ID NO: 2536063 - protein, 20 aa, Entamoeba dispar
PLKELILPPLEELRPFPSNR

SEQ ID NO: 2536064 - protein, 24 aa, Entamoeba dispar
PLKLRHQLLLKLLKIMDMFQLKKM

SEQ ID NO: 2536065 - protein, 21 aa, Entamoeba dispar
PLKLRKLLLSLPEEYQKSIIF

SEQ ID NO: 2536066 - protein, 20 aa, Entamoeba dispar
PLKMYLETVTVLEKRVKILD

SEQ ID NO: 2536067 - protein, 19 aa, Entamoeba dispar
PLKPIIFEKNLKKLSSSLQ

SEQ ID NO: 2536068 - protein, 20 aa, Entamoeba dispar
PLKQPKFIDLLILRDEPPFL

SEQ ID NO: 2536069 - protein, 17 aa, Entamoeba dispar
PLKSDFMTKLKQIIVAI

SEQ ID NO: 2536070 - protein, 19 aa, Entamoeba dispar
PLLFLCLSKPLYKQPQLSL

SEQ ID NO: 2536071 - protein, 17 aa, Entamoeba dispar
PLLIINLDDIMNTLLFH

SEQ ID NO: 2536072 - protein, 17 aa, Entamoeba dispar
PLLKTIFDIPQCMGMIG

SEQ ID NO: 2536073 - protein, 18 aa, Entamoeba dispar
PLLNYILEDAIQGNKNAL

SEQ ID NO: 2536074 - protein, 21 aa, Entamoeba dispar
PLLPTLKFSEGVSEWKVFDKH

SEQ ID NO: 2536075 - protein, 34 aa, Entamoeba dispar
PLLSESLGALWKTLPTLPFLPKSNQLKGVSLLYQ

SEQ ID NO: 2536076 - protein, 17 aa, Entamoeba dispar
PLLSKIVSILNFFKNYS

SEQ ID NO: 2536077 - protein, 17 aa, Entamoeba dispar
PLLTLSKNNRLLVEKAF

SEQ ID NO: 2536078 - protein, 18 aa, Entamoeba dispar
PLLTPEQIKLIFGGVSVI

SEQ ID NO: 2536079 - protein, 18 aa, Entamoeba dispar
PLMEFLSTYVIIMIDESN

SEQ ID NO: 2536080 - protein, 27 aa, Entamoeba dispar
PLNEALILWDYYFAKGCFNVVYITLAQ

SEQ ID NO: 2536081 - protein, 25 aa, Entamoeba dispar
PLNKLNNLILLLHSSILPIKRNLSH

SEQ ID NO: 2536082 - protein, 26 aa, Entamoeba dispar
PLNLLANEWISHFPVNIFNSSLNFLR

SEQ ID NO: 2536083 - protein, 18 aa, Entamoeba dispar
PLNLREILLKQMSMVLVA

SEQ ID NO: 2536084 - protein, 19 aa, Entamoeba dispar
PLNPLYTKPQLERLLPRVN

SEQ ID NO: 2536085 - protein, 18 aa, Entamoeba dispar
PLNQFKWKKQINEKRMFN

SEQ ID NO: 2536086 - protein, 25 aa, Entamoeba dispar
PLNTDLLNFLALDIQIEVIRLITLN

SEQ ID NO: 2536087 - protein, 24 aa, Entamoeba dispar
PLPDFIINKFVALAVRLYVKLMKK

SEQ ID NO: 2536088 - protein, 26 aa, Entamoeba dispar
PLPTKCAPPVPQKKVAPPIPGHSTIS

SEQ ID NO: 2536089 - protein, 19 aa, Entamoeba dispar
PLPVYDSLKYFKENPTLLE

SEQ ID NO: 2536090 - protein, 22 aa, Entamoeba dispar
PLQKQLIPFDYEKITLLEVCII

SEQ ID NO: 2536091 - protein, 18 aa, Entamoeba dispar
PLQLFKSLYQLFPEKYHN

SEQ ID NO: 2536092 - protein, 17 aa, Entamoeba dispar
PLQNRLLFNFSSSSFEL

SEQ ID NO: 2536093 - protein, 23 aa, Entamoeba dispar
PLQQIACIFLRQSISHTNMDVST

SEQ ID NO: 2536094 - protein, 33 aa, Entamoeba dispar
PLREKFLSNLVAPILYYFATIASPSLLTPPKVS

SEQ ID NO: 2536095 - protein, 33 aa, Entamoeba dispar
PLRHPQLFKNIGIKPPRGILLYGPPGCGKTMIA

SEQ ID NO: 2536096 - protein, 22 aa, Entamoeba dispar
PLRHPQLFQAIGIKPPKGVLLY

SEQ ID NO: 2536097 - protein, 23 aa, Entamoeba dispar
PLRLKIMNFVRTWMKNAWKDFEA

SEQ ID NO: 2536098 - protein, 29 aa, Entamoeba dispar
PLRNKLVHHLIMEYGIYKRLNIYKPWRAT

SEQ ID NO: 2536099 - protein, 18 aa, Entamoeba dispar
PLSIDKIVDEGCPAKFLV

SEQ ID NO: 2536100 - protein, 19 aa, Entamoeba dispar
PLSIVPIHDHLISRFSELE

SEQ ID NO: 2536101 - protein, 26 aa, Entamoeba dispar
PLSKPTYISLEPLFFESKEKNNNEPK

SEQ ID NO: 2536102 - protein, 26 aa, Entamoeba dispar
PLSLLNYLCVVLMLLPRSKICSGDGV

SEQ ID NO: 2536103 - protein, 18 aa, Entamoeba dispar
PLSQFLPKYYGKENIDLG

SEQ ID NO: 2536104 - protein, 26 aa, Entamoeba dispar
PLSQLMKAFQYLYSHGLFHGNVTKES

SEQ ID NO: 2536105 - protein, 20 aa, Entamoeba dispar
PLSTKLLMKYAPRDHLPGMP

SEQ ID NO: 2536106 - protein, 19 aa, Entamoeba dispar
PLSYLLPRGQQVKVITQLY

SEQ ID NO: 2536107 - protein, 25 aa, Entamoeba dispar
PLTARLAMKKAKPDGIYYLLTNIEE

SEQ ID NO: 2536108 - protein, 27 aa, Entamoeba dispar
PLTCNWCYRTVCFPEDSIKIISRKRAI

SEQ ID NO: 2536109 - protein, 17 aa, Entamoeba dispar
PLTFKELYLVNLSLPKR

SEQ ID NO: 2536110 - protein, 20 aa, Entamoeba dispar
PLTICQLYMNIPSSQRPKVI

SEQ ID NO: 2536111 - protein, 19 aa, Entamoeba dispar
PLTINDFMLIPNKIKKVIL

SEQ ID NO: 2536112 - protein, 25 aa, Entamoeba dispar
PLTKELLKIFPNIQTQYIYSTSERR

SEQ ID NO: 2536113 - protein, 19 aa, Entamoeba dispar
PLVDNPIPSFMLLEINDSE

SEQ ID NO: 2536114 - protein, 19 aa, Entamoeba dispar
PLVFTVFTSPGYDGANRGG

SEQ ID NO: 2536115 - protein, 17 aa, Entamoeba dispar
PLVKFTFSNGSLCCDDS

SEQ ID NO: 2536116 - protein, 17 aa, Entamoeba dispar
PLVLKWLQTSSTFVNIL

SEQ ID NO: 2536117 - protein, 26 aa, Entamoeba dispar
PLVRDAAMKFVLTYIDIFGTKGTKLS

SEQ ID NO: 2536118 - protein, 24 aa, Entamoeba dispar
PLVRRLVEMILLKNVSWDYTYEDE

SEQ ID NO: 2536119 - protein, 24 aa, Entamoeba dispar
PLVSNPPPVLQPQVPVAPQLRVQF

SEQ ID NO: 2536120 - protein, 20 aa, Entamoeba dispar
PLVTGQRILDSLFPCIQGGT

SEQ ID NO: 2536121 - protein, 26 aa, Entamoeba dispar
PLYDPYIMDNTFFSPSMSPPPFAQTY

SEQ ID NO: 2536122 - protein, 17 aa, Entamoeba dispar
PMDVQCEWILPTTITEL

SEQ ID NO: 2536123 - protein, 18 aa, Entamoeba dispar
PMDVQCEWILPTTITELS

SEQ ID NO: 2536124 - protein, 31 aa, Entamoeba dispar
PMEKFNTQLPHKFIKKPFKIPTINIIIKDDE

SEQ ID NO: 2536125 - protein, 31 aa, Entamoeba dispar
PMEKMVINSYFAFLPFIQMGRIIQSGEQTIP

SEQ ID NO: 2536126 - protein, 17 aa, Entamoeba dispar
PMGGFIPDNMPMGEDLE

SEQ ID NO: 2536127 - protein, 18 aa, Entamoeba dispar
PMIIPVQVNINQTLKDRC

SEQ ID NO: 2536128 - protein, 17 aa, Entamoeba dispar
PMINPMANFFIGVGVQQ

SEQ ID NO: 2536129 - protein, 17 aa, Entamoeba dispar
PMIRYLSDDIKFTFISF

SEQ ID NO: 2536130 - protein, 18 aa, Entamoeba dispar
PMKIIGKSLLNNTIYVRW

SEQ ID NO: 2536131 - protein, 17 aa, Entamoeba dispar
PMKKKSTNFIGEEQVKL

SEQ ID NO: 2536132 - protein, 27 aa, Entamoeba dispar
PMKTIPITYSIFLQFAGEYIILGTEEG

SEQ ID NO: 2536133 - protein, 20 aa, Entamoeba dispar
PMLQSVVDTFWAVGTPPSEI

SEQ ID NO: 2536134 - protein, 17 aa, Entamoeba dispar
PMLSRGELRCIGATTIE

SEQ ID NO: 2536135 - protein, 17 aa, Entamoeba dispar
PMPLLEIVKQSFNSKNL

SEQ ID NO: 2536136 - protein, 17 aa, Entamoeba dispar
PMPPSSKGAVLIAAPPP

SEQ ID NO: 2536137 - protein, 22 aa, Entamoeba dispar
PMPPSSPLPPQSSPLPPTATPP

SEQ ID NO: 2536138 - protein, 27 aa, Entamoeba dispar
PMPVQKATIPIVLAKRDLMSCAQTGSG

SEQ ID NO: 2536139 - protein, 24 aa, Entamoeba dispar
PMQLLRIPKCKICSAYFSPLTHWI

SEQ ID NO: 2536140 - protein, 37 aa, Entamoeba dispar
PMSSNGILSLLILPVQRIPRYVMLVKDLCKWTQRNQW

SEQ ID NO: 2536141 - protein, 20 aa, Entamoeba dispar
PMVKPIIKFDVMDPQDIPLS

SEQ ID NO: 2536142 - protein, 17 aa, Entamoeba dispar
PMVNYPMTLVDYNQYPL

SEQ ID NO: 2536143 - protein, 22 aa, Entamoeba dispar
PNADMVIRIDFIRAIHLGRNST

SEQ ID NO: 2536144 - protein, 23 aa, Entamoeba dispar
PNAIAMYDYLIPQVLPMVNAPQI

SEQ ID NO: 2536145 - protein, 18 aa, Entamoeba dispar
PNAKVGVIWFDAHPDMNI

SEQ ID NO: 2536146 - protein, 24 aa, Entamoeba dispar
PNALYEINYPKEQVFLFGFINEVE

SEQ ID NO: 2536147 - protein, 21 aa, Entamoeba dispar
PNAMADVFKGLQFTNPFSNQT

SEQ ID NO: 2536148 - protein, 23 aa, Entamoeba dispar
PNATIILKQCGISSPLYAGRNVN

SEQ ID NO: 2536149 - protein, 20 aa, Entamoeba dispar
PNCIGNIWVYVYDCPENEGR

SEQ ID NO: 2536150 - protein, 23 aa, Entamoeba dispar
PNCIGNIWVYVYDCPENEGRSGK

SEQ ID NO: 2536151 - protein, 38 aa, Entamoeba dispar
PNCKEWDIGIVTPYRQQLLLIKIAIESSPLLKEMSKLC

SEQ ID NO: 2536152 - protein, 19 aa, Entamoeba dispar
PNCYTPHFSLLQPQIEEDP

SEQ ID NO: 2536153 - protein, 18 aa, Entamoeba dispar
PNDEVFLNSFIPSSLHDL

SEQ ID NO: 2536154 - protein, 25 aa, Entamoeba dispar
PNDLPTTFWQRCNISHIESLAQLLR

SEQ ID NO: 2536155 - protein, 25 aa, Entamoeba dispar
PNDVDTLLKFIIIKSQMPHLASTLR

SEQ ID NO: 2536156 - protein, 27 aa, Entamoeba dispar
PNDYYKGYNLLNPPVPILFEQTGYSNI

SEQ ID NO: 2536157 - protein, 24 aa, Entamoeba dispar
PNDYYKGYNLLNSPVPILFEQTGC

SEQ ID NO: 2536158 - protein, 24 aa, Entamoeba dispar
PNDYYKGYNLLNSPVPTLFEQTGC

SEQ ID NO: 2536159 - protein, 24 aa, Entamoeba dispar
PNEEKFISFFIVKITVTNVGKHRK

SEQ ID NO: 2536160 - protein, 18 aa, Entamoeba dispar
PNEERIRFVLGKPIYRAH

SEQ ID NO: 2536161 - protein, 31 aa, Entamoeba dispar
PNFIPTVIVALVFNYLYPKETIEFRLGGVFS

SEQ ID NO: 2536162 - protein, 26 aa, Entamoeba dispar
PNFNQQIALLYLKKYIPQLPQLIIST

SEQ ID NO: 2536163 - protein, 31 aa, Entamoeba dispar
PNGQLVFYIAVHKFIIFLKSLSSNEKKNENL

SEQ ID NO: 2536164 - protein, 26 aa, Entamoeba dispar
PNGVNSAYFFLFNDVLIETQVIKHHN

SEQ ID NO: 2536165 - protein, 17 aa, Entamoeba dispar
PNHFGCFVCKAALKGKS

SEQ ID NO: 2536166 - protein, 24 aa, Entamoeba dispar
PNIARVVFVHWKGSKCKGMKVVRS

SEQ ID NO: 2536167 - protein, 27 aa, Entamoeba dispar
PNIEWHFIGRLQSNKLKLLISTPHLKC

SEQ ID NO: 2536168 - protein, 26 aa, Entamoeba dispar
PNIHKKIIFNILLGLNSPTTSMACNT

SEQ ID NO: 2536169 - protein, 29 aa, Entamoeba dispar
PNIIEQRFYHRLPIFLREESFRKKPKMKK

SEQ ID NO: 2536170 - protein, 18 aa, Entamoeba dispar
PNILINLTDEDLPLWPQD

SEQ ID NO: 2536171 - protein, 17 aa, Entamoeba dispar
PNISYDIKPIGLKQGYV

SEQ ID NO: 2536172 - protein, 22 aa, Entamoeba dispar
PNKDVLFILMKTICGHCNSSEK

SEQ ID NO: 2536173 - protein, 27 aa, Entamoeba dispar
PNKFYDDPFVMLNYNDLPLLQNGLIPP

SEQ ID NO: 2536174 - protein, 32 aa, Entamoeba dispar
PNKTTASLVLGFIWMLFDKFQEKNIKLSMKEE

SEQ ID NO: 2536175 - protein, 25 aa, Entamoeba dispar
PNKYDKIIIFQPTGWAKKTTCKGSF

SEQ ID NO: 2536176 - protein, 30 aa, Entamoeba dispar
PNNEGPTIPYLLCIICQVPVILPNYFDTIK

SEQ ID NO: 2536177 - protein, 26 aa, Entamoeba dispar
PNNFIQIIAPSWFIPMAMHPAAYKHY

SEQ ID NO: 2536178 - protein, 23 aa, Entamoeba dispar
PNNGPLSDILWADPLDEPPEEDL

SEQ ID NO: 2536179 - protein, 22 aa, Entamoeba dispar
PNNILNCYYIFLGPKDTPYEGG

SEQ ID NO: 2536180 - protein, 18 aa, Entamoeba dispar
PNNINLFFSILQWFWNYT

SEQ ID NO: 2536181 - protein, 28 aa, Entamoeba dispar
PNNKRMTYVLPLITPSLTYSGILRVVCY

SEQ ID NO: 2536182 - protein, 26 aa, Entamoeba dispar
PNNNKLRAKIWKLLLRYYTAEQKTWN

SEQ ID NO: 2536183 - protein, 29 aa, Entamoeba dispar
PNNNKLRAKIWKLLLRYYTAEQKTWNNSE

SEQ ID NO: 2536184 - protein, 29 aa, Entamoeba dispar
PNPCMWDLVAYRIKFFPHPVTGDRLCCYP

SEQ ID NO: 2536185 - protein, 26 aa, Entamoeba dispar
PNPHQHLLIVMKRPKSFNARPIFNHK

SEQ ID NO: 2536186 - protein, 26 aa, Entamoeba dispar
PNPHQHLLIVMKRPKSFNARPLFNHK

SEQ ID NO: 2536187 - protein, 26 aa, Entamoeba dispar
PNPILNIFKGLNQYYTYFVFGVTLCN

SEQ ID NO: 2536188 - protein, 24 aa, Entamoeba dispar
PNPKPFHQIKFQLNGKTTPISCST

SEQ ID NO: 2536189 - protein, 30 aa, Entamoeba dispar; identical to SEQ ID NO: 2499985

SEQ ID NO: 2536190 - protein, 19 aa, Entamoeba dispar
PNPYISFRKPFQFYHNQNV

SEQ ID NO: 2536191 - protein, 21 aa, Entamoeba dispar
PNQIQFIINALPRITSFSMQG

SEQ ID NO: 2536192 - protein, 32 aa, Entamoeba dispar
PNQLLQFISTPFYFFVLSYFIQLKDVPFSSAI

SEQ ID NO: 2536193 - protein, 25 aa, Entamoeba dispar
PNQSLQQMLSKMLGFFVIEHQVQQT

SEQ ID NO: 2536194 - protein, 17 aa, Entamoeba dispar
PNQTYVIPPLTSNKSIF

SEQ ID NO: 2536195 - protein, 18 aa, Entamoeba dispar
PNRNGCMFTYATSPLIKC

SEQ ID NO: 2536196 - protein, 28 aa, Entamoeba dispar
PNRPKKPQSAYFLYLNEHRASIKEEHPD

SEQ ID NO: 2536197 - protein, 29 aa, Entamoeba dispar
PNSDKRFVFTCFSAFWVLSDGIAYIHQGF

SEQ ID NO: 2536198 - protein, 19 aa, Entamoeba dispar
PNSLMIQFDDINKGKFMSC

SEQ ID NO: 2536199 - protein, 21 aa, Entamoeba dispar
PNSLMIQFDDINKGKFMSCCM

SEQ ID NO: 2536200 - protein, 24 aa, Entamoeba dispar
PNTAYICTRYYRAPELIFGCVDYT

SEQ ID NO: 2536201 - protein, 25 aa, Entamoeba dispar
PNTDLNKIIPWKTKSSTQTKIKKTK

SEQ ID NO: 2536202 - protein, 28 aa, Entamoeba dispar
PNTEKQFIFTMYSAFWLTTDGKVTFHQM

SEQ ID NO: 2536203 - protein, 21 aa, Entamoeba dispar
PNTPYEIIYEYGRIMMNEANP

SEQ ID NO: 2536204 - protein, 22 aa, Entamoeba dispar
PNTYPIEQLIKKYGFKPEEMVM

SEQ ID NO: 2536205 - protein, 17 aa, Entamoeba dispar
PNVFRHLLEIIISLNVV

SEQ ID NO: 2536206 - protein, 31 aa, Entamoeba dispar
PNVNSFMKRVFYLMKEPQYLDWRLNSDTRVE

SEQ ID NO: 2536207 - protein, 20 aa, Entamoeba dispar
PNVRNYFPNAPLYTPIDLET

SEQ ID NO: 2536208 - protein, 17 aa, Entamoeba dispar
PNYFEIIKTPMDLGTVI

SEQ ID NO: 2536209 - protein, 26 aa, Entamoeba dispar
PPDNNYQYLIIAAEPYQSIAFKIPNV

SEQ ID NO: 2536210 - protein, 19 aa, Entamoeba dispar
PPEFIDFLKKCFVFNPEER

SEQ ID NO: 2536211 - protein, 17 aa, Entamoeba dispar
PPEKVDIFAQLDTKPKQ

SEQ ID NO: 2536212 - protein, 22 aa, Entamoeba dispar
PPETKYFPLQSKLSLFITFYNE

SEQ ID NO: 2536213 - protein, 21 aa, Entamoeba dispar
PPFVHPLNISTFNDVVYGFDK

SEQ ID NO: 2536214 - protein, 25 aa, Entamoeba dispar
PPGIWCKHFQPLKPLLPSVAPSVFV

SEQ ID NO: 2536215 - protein, 22 aa, Entamoeba dispar
PPGKYSWLKYVEKMYNVLFETE

SEQ ID NO: 2536216 - protein, 20 aa, Entamoeba dispar
PPHPFAKPFSNRYSTGSEGF

SEQ ID NO: 2536217 - protein, 30 aa, Entamoeba dispar
PPHSELHAMRAIFLIPNRPPPTLSAPEEVS

SEQ ID NO: 2536218 - protein, 18 aa, Entamoeba dispar
PPIAIRPSVAMDGGNASN

SEQ ID NO: 2536219 - protein, 17 aa, Entamoeba dispar
PPIDARAPLDRPPLERT

SEQ ID NO: 2536220 - protein, 19 aa, Entamoeba dispar
PPIHPDFLGIKQLFKQMDK

SEQ ID NO: 2536221 - protein, 17 aa, Entamoeba dispar
PPIIAQPADDTLSDAEV

SEQ ID NO: 2536222 - protein, 32 aa, Entamoeba dispar
PPIYFINECNIIDLMPLNSVPLSLKLMYSHHI

SEQ ID NO: 2536223 - protein, 23 aa, Entamoeba dispar
PPKGVLLYGPPGTGKTLLARAVA

SEQ ID NO: 2536224 - protein, 20 aa, Entamoeba dispar
PPKVKVDFLAMRKTMNKPIR

SEQ ID NO: 2536225 - protein, 25 aa, Entamoeba dispar
PPLEGLFCDLLWADPISEKKFEEQP

SEQ ID NO: 2536226 - protein, 31 aa, Entamoeba dispar
PPLRTDLLTKFKQMIIALPNTSYVLGDHFDE

SEQ ID NO: 2536227 - protein, 18 aa, Entamoeba dispar
PPMGMPPMQQPGMPPMGY

SEQ ID NO: 2536228 - protein, 24 aa, Entamoeba dispar
PPNFNEILQGPLTLQQSHRFELIQ

SEQ ID NO: 2536229 - protein, 17 aa, Entamoeba dispar
PPNLKSLYLPFNELVEL

SEQ ID NO: 2536230 - protein, 24 aa, Entamoeba dispar
PPNPSYPRPNVFPQNSYLPSSIGR

SEQ ID NO: 2536231 - protein, 22 aa, Entamoeba dispar
PPNTILSFPFTYNGMFHIKEHP

SEQ ID NO: 2536232 - protein, 22 aa, Entamoeba dispar
PPPGMPGMPPPPPPPGMPGMPP

SEQ ID NO: 2536233 - protein, 29 aa, Entamoeba dispar
PPPNLNVPPPPNLNVPPPPPTLNTPSPST

SEQ ID NO: 2536234 - protein, 18 aa, Entamoeba dispar
PPPPGVTSVPPPPPPPGM

SEQ ID NO: 2536235 - protein, 19 aa, Entamoeba dispar
PPPPPGGFGFRPAAPKPNA

SEQ ID NO: 2536236 - protein, 19 aa, Entamoeba dispar
PPPPPGGFGFRPAAPVING

SEQ ID NO: 2536237 - protein, 37 aa, Entamoeba dispar
PPPPPGMPGMPPPPPLPGVPGMPPPPPPPGMPGMPPP

SEQ ID NO: 2536238 - protein, 37 aa, Entamoeba dispar
PPPPPGMPGMPPPPPPPPGMPGMPPPPPPPGMPGMPP

SEQ ID NO: 2536239 - protein, 18 aa, Entamoeba dispar
PPPSYREIIPLLYQNKTQ

SEQ ID NO: 2536240 - protein, 32 aa, Entamoeba dispar
PPQNSFMVFEINGTFWYFTTGNYKGNGLSNEC

SEQ ID NO: 2536241 - protein, 26 aa, Entamoeba dispar
PPQQPIQEIVPYQQIIIKPEQKKKKK

SEQ ID NO: 2536242 - protein, 26 aa, Entamoeba dispar
PPQYDLPALFHFILLGHQIGIGKTNE

SEQ ID NO: 2536243 - protein, 18 aa, Entamoeba dispar
PPQYPAFQPLVHLPFDIL

SEQ ID NO: 2536244 - protein, 20 aa, Entamoeba dispar
PPRLRSIPDLGFIDSEIPSP

SEQ ID NO: 2536245 - protein, 26 aa, Entamoeba dispar
PPRNTIHIFASTLLRYFDDQIKEIYD

SEQ ID NO: 2536246 - protein, 18 aa, Entamoeba dispar
PPSATRLMYSFNGSEFET

SEQ ID NO: 2536247 - protein, 29 aa, Entamoeba dispar
PPSFELQKKWYFPIIQSIKPQQFSQIIAW

SEQ ID NO: 2536248 - protein, 26 aa, Entamoeba dispar
PPSIRNTWWFPLINTIPLDQYTRIYQ

SEQ ID NO: 2536249 - protein, 30 aa, Entamoeba dispar
PPSTCFSSVLPFPFSVPISSPTPSPSICSQ

SEQ ID NO: 2536250 - protein, 26 aa, Entamoeba dispar
PPTPKKTLPFGLLVLRFDKPDIQIYL

SEQ ID NO: 2536251 - protein, 24 aa, Entamoeba dispar
PPTSLEIFKLIESIPTKPIRYYDV

SEQ ID NO: 2536252 - protein, 29 aa, Entamoeba dispar
PPYHDDIHFLSFLIPHMSKFLSVEYIPTI

SEQ ID NO: 2536253 - protein, 17 aa, Entamoeba dispar
PPYILVGAIDNSSAPSI

SEQ ID NO: 2536254 - protein, 24 aa, Entamoeba dispar
PQAKGFVKNSFFTGLNATEFFFHT

SEQ ID NO: 2536255 - protein, 21 aa, Entamoeba dispar
PQDHYFLLTEPPMNPPENREY

SEQ ID NO: 2536256 - protein, 19 aa, Entamoeba dispar
PQEDVTLLQFKKYFESVKT

SEQ ID NO: 2536257 - protein, 25 aa, Entamoeba dispar
PQEESAVIEPCKYSYEGKIVENEEW

SEQ ID NO: 2536258 - protein, 18 aa, Entamoeba dispar
PQESPFRKSFRTSKSEDY

SEQ ID NO: 2536259 - protein, 24 aa, Entamoeba dispar
PQFPFRKSRLTRLLICWIKIFKEI

SEQ ID NO: 2536260 - protein, 34 aa, Entamoeba dispar
PQGATASQVLGLLWQLIDYDLRKTLGSMDCEGDV

SEQ ID NO: 2536261 - protein, 22 aa, Entamoeba dispar
PQGQLIPFITSPPQLCEEVIKL

SEQ ID NO: 2536262 - protein, 24 aa, Entamoeba dispar
PQIFNSITLPFINSIPPSEFQWIY

SEQ ID NO: 2536263 - protein, 20 aa, Entamoeba dispar
PQIKYFWEIAKSLTLDQKKK

SEQ ID NO: 2536264 - protein, 19 aa, Entamoeba dispar
PQILKIDYIQDSSTSYVIE

SEQ ID NO: 2536265 - protein, 32 aa, Entamoeba dispar
PQINNKGVPFFWIRALSAVSLFLSYNTVEEDL

SEQ ID NO: 2536266 - protein, 23 aa, Entamoeba dispar
PQKKKLLCQVPIMNWDKVMELVK

SEQ ID NO: 2536267 - protein, 25 aa, Entamoeba dispar
PQKQVTPPAFVFGDFGTNEKTTPSF

SEQ ID NO: 2536268 - protein, 23 aa, Entamoeba dispar
PQLIAVIKEFFTKMGLPDVRFKP

SEQ ID NO: 2536269 - protein, 18 aa, Entamoeba dispar
PQLMNGLFQLVGNTLTTC

SEQ ID NO: 2536270 - protein, 21 aa, Entamoeba dispar
PQLSKFWTGAGYQPTYLRLTA

SEQ ID NO: 2536271 - protein, 18 aa, Entamoeba dispar
PQMMNSDFMILFERASEI

SEQ ID NO: 2536272 - protein, 22 aa, Entamoeba dispar
PQNIITFKDLWNIINKKYTYEE

SEQ ID NO: 2536273 - protein, 24 aa, Entamoeba dispar
PQNKITLFDAYKTLLACALEENKV

SEQ ID NO: 2536274 - protein, 23 aa, Entamoeba dispar
PQNLRIAAILFQNSISLPYSRFN

SEQ ID NO: 2536275 - protein, 24 aa, Entamoeba dispar
PQNVDLILFKIKREIRKQNIIDAR

SEQ ID NO: 2536276 - protein, 30 aa, Entamoeba dispar
PQQMNEMVFWYKYFSFLFKSENQNSLLEDL

SEQ ID NO: 2536277 - protein, 18 aa, Entamoeba dispar
PQQPIQEIVPYQQIIIKP

SEQ ID NO: 2536278 - protein, 24 aa, Entamoeba dispar
PQQPIQEIVPYQQIIIKPEQKKKK

SEQ ID NO: 2536279 - protein, 29 aa, Entamoeba dispar
PQQPIQEIVPYQQIIIKPEQKKKSPKKIQ

SEQ ID NO: 2536280 - protein, 17 aa, Entamoeba dispar
PQQPYPQQYQYLPPHGY

SEQ ID NO: 2536281 - protein, 21 aa, Entamoeba dispar
PQQVYMFTACSDDWNLYTYDI

SEQ ID NO: 2536282 - protein, 27 aa, Entamoeba dispar
PQRNLKILAFYMNLFYVFTINSDVHKM

SEQ ID NO: 2536283 - protein, 18 aa, Entamoeba dispar
PQRVFDYLFEHPDGKNIL

SEQ ID NO: 2536284 - protein, 17 aa, Entamoeba dispar
PQSAFGERIYGMYFALY

SEQ ID NO: 2536285 - protein, 21 aa, Entamoeba dispar
PQSCIQLTNPPPPPQKPSQQF

SEQ ID NO: 2536286 - protein, 18 aa, Entamoeba dispar
PQSFLNCSKLMKIDTQGM

SEQ ID NO: 2536287 - protein, 21 aa, Entamoeba dispar
PQSLQLLIDDIYFISDLLTLP

SEQ ID NO: 2536288 - protein, 26 aa, Entamoeba dispar
PQSNIFDLLLPYLSPDYPPALLSSVA

SEQ ID NO: 2536289 - protein, 29 aa, Entamoeba dispar
PQSNQYIFPYKTLPLLRKLRNIIGINNRI

SEQ ID NO: 2536290 - protein, 25 aa, Entamoeba dispar
PQSYIVLLPLLTKHLYCYPIDLQIN

SEQ ID NO: 2536291 - protein, 29 aa, Entamoeba dispar
PQTEIFKHCWLVLELLRKSIQQIGADENF

SEQ ID NO: 2536292 - protein, 20 aa, Entamoeba dispar
PQTYAFFMNTLLEIKIRKEL

SEQ ID NO: 2536293 - protein, 20 aa, Entamoeba dispar
PQVISYRTKFTPLAPTIQPS

SEQ ID NO: 2536294 - protein, 28 aa, Entamoeba dispar
PQVVYDLCRWIYMHGIEVEGIFRISGNN

SEQ ID NO: 2536295 - protein, 31 aa, Entamoeba dispar
PQYGDIYIEFLKLIILTKQWSMLKNIILSCI

SEQ ID NO: 2536296 - protein, 20 aa, Entamoeba dispar
PQYISTPFTSPSLPLPDSKT

SEQ ID NO: 2536297 - protein, 24 aa, Entamoeba dispar
PQYSNLLNDIYSRCLQLYVAPRRL

SEQ ID NO: 2536298 - protein, 26 aa, Entamoeba dispar
PRAIEEIFKILYTKGCYTKGIFRENS

SEQ ID NO: 2536299 - protein, 32 aa, Entamoeba dispar
PRAKSVLHLYRDILPFLINKPTHIFIENVPLF

SEQ ID NO: 2536300 - protein, 27 aa, Entamoeba dispar
PREDLLSFSILYGLINRLVKYSSIHMM

SEQ ID NO: 2536301 - protein, 35 aa, Entamoeba dispar
PRETNHHLLFFPKEKDELFYILGCWDIKTNDCVID

SEQ ID NO: 2536302 - protein, 33 aa, Entamoeba dispar
PRFDNTVLHLLLAYIRKPVPTGKKLYILATTCL

SEQ ID NO: 2536303 - protein, 25 aa, Entamoeba dispar
PRHRLRAADRRRRPRRRLRAAVLPV

SEQ ID NO: 2536304 - protein, 21 aa, Entamoeba dispar
PRHTRACFIVDLYIGNKNQLT

SEQ ID NO: 2536305 - protein, 17 aa, Entamoeba dispar
PRIKGMLIDFFGSEKVD

SEQ ID NO: 2536306 - protein, 32 aa, Entamoeba dispar
PRKKDLILNVVMYKNGFVVNDGPLRNYEDQNN

SEQ ID NO: 2536307 - protein, 26 aa, Entamoeba dispar
PRKRSKITLPFFNVIRISTEKEVVEI

SEQ ID NO: 2536308 - protein, 25 aa, Entamoeba dispar
PRLHELYRIVSLDSTILPINDFISK

SEQ ID NO: 2536309 - protein, 17 aa, Entamoeba dispar
PRLMCMYVDKVLSGSHA

SEQ ID NO: 2536310 - protein, 21 aa, Entamoeba dispar
PRLVFMPTGPLQKFLTRRITL

SEQ ID NO: 2536311 - protein, 18 aa, Entamoeba dispar
PRMINMDKIIAATRPKNL

SEQ ID NO: 2536312 - protein, 19 aa, Entamoeba dispar
PRMLSYYMEYANWCKSIEY

SEQ ID NO: 2536313 - protein, 20 aa, Entamoeba dispar
PRMLSYYMEYANWCKSIEYH

SEQ ID NO: 2536314 - protein, 18 aa, Entamoeba dispar
PRMRKCGQFLVRTPSIKN

SEQ ID NO: 2536315 - protein, 21 aa, Entamoeba dispar
PRPFLTIIQSPLPFIVDNSKI

SEQ ID NO: 2536316 - protein, 26 aa, Entamoeba dispar
PRPHQHLLIVTKRPRSFKARPIIKHS

SEQ ID NO: 2536317 - protein, 26 aa, Entamoeba dispar
PRPHQHLLIVTKRPRSFNARPIINHT

SEQ ID NO: 2536318 - protein, 28 aa, Entamoeba dispar
PRPHQHMLIVLKRPKSFKARPIITHADG

SEQ ID NO: 2536319 - protein, 28 aa, Entamoeba dispar
PRPHQHMLIVLKRPKSFKARPIITHSDG

SEQ ID NO: 2536320 - protein, 28 aa, Entamoeba dispar
PRPHQHMLIVLKRPRSFKARPIITHSDG

SEQ ID NO: 2536321 - protein, 24 aa, Entamoeba dispar
PRRTPNFALKYLPKCIYSLNISHT

SEQ ID NO: 2536322 - protein, 17 aa, Entamoeba dispar
PRSARQMVMKKIRKIDS

SEQ ID NO: 2536323 - protein, 22 aa, Entamoeba dispar
PRSCLQKPIALKSAISVFLSMN

SEQ ID NO: 2536324 - protein, 24 aa, Entamoeba dispar
PRSPRKFIPWGLSPSPTFSRSPSP

SEQ ID NO: 2536325 - protein, 20 aa, Entamoeba dispar
PRSYIYNGFLSFAMIATAAE

SEQ ID NO: 2536326 - protein, 24 aa, Entamoeba dispar
PRTHYFFSVSRDKSLRYWDADKQI

SEQ ID NO: 2536327 - protein, 30 aa, Entamoeba dispar
PRTKEYQIFIKSNFLKLIKPYDIDEFISNS

SEQ ID NO: 2536328 - protein, 27 aa, Entamoeba dispar
PRVINELFMTLEKRGLRYRMRVTHVEI

SEQ ID NO: 2536329 - protein, 26 aa, Entamoeba dispar
PSALAEQCLIWIKKYKNKEADQMQMF

SEQ ID NO: 2536330 - protein, 20 aa, Entamoeba dispar
PSCFDFLQFTNYTLKSIVSA

SEQ ID NO: 2536331 - protein, 23 aa, Entamoeba dispar
PSCKLRLQILKDQLLKQKQIQQG

SEQ ID NO: 2536332 - protein, 19 aa, Entamoeba dispar
PSDAKWFKPIELFTKQGVC

SEQ ID NO: 2536333 - protein, 26 aa, Entamoeba dispar
PSDELPIKIIIIGDLGVGKTSLIHKY

SEQ ID NO: 2536334 - protein, 23 aa, Entamoeba dispar
PSDFDKFHKLQLIKDTLLDTETR

SEQ ID NO: 2536335 - protein, 22 aa, Entamoeba dispar
PSDGFIYLAGCNSLRYLYLNES

SEQ ID NO: 2536336 - protein, 17 aa, Entamoeba dispar
PSDKIPSYVLSDKIDPW

SEQ ID NO: 2536337 - protein, 24 aa, Entamoeba dispar
PSDYYKGYNLLNPPVQILFEQTGC

SEQ ID NO: 2536338 - protein, 19 aa, Entamoeba dispar
PSELATTLTFSQLTLQSSQ

SEQ ID NO: 2536339 - protein, 27 aa, Entamoeba dispar
PSEQIRKPISWLVGRKVKRGTDWKWSD

SEQ ID NO: 2536340 - protein, 30 aa, Entamoeba dispar
PSESKFFIKIERILLVKLFTKEIKLCNLIE

SEQ ID NO: 2536341 - protein, 17 aa, Entamoeba dispar
PSFAPPPVKPFINYTNP

SEQ ID NO: 2536342 - protein, 17 aa, Entamoeba dispar
PSFYGRRVGTCFVKIVL

SEQ ID NO: 2536343 - protein, 30 aa, Entamoeba dispar
PSGGMPPPPPPPGAPPPPAGMPPPPSNHSM

SEQ ID NO: 2536344 - protein, 26 aa, Entamoeba dispar
PSGLGRVFIEFKTIDGAIRCWKEIVK

SEQ ID NO: 2536345 - protein, 19 aa, Entamoeba dispar
PSHSIILPQSLRYFTLNKT

SEQ ID NO: 2536346 - protein, 28 aa, Entamoeba dispar
PSIGIYAYELFNFYGVKRIIRIGSAGAF

SEQ ID NO: 2536347 - protein, 29 aa, Entamoeba dispar
PSIGIYAYELFNFYGVKRIIRIGSAGAFD

SEQ ID NO: 2536348 - protein, 21 aa, Entamoeba dispar
PSIIIIPVLLDNYCFVGPEGN

SEQ ID NO: 2536349 - protein, 20 aa, Entamoeba dispar
PSIKIYLEYLEEYYGINEDE

SEQ ID NO: 2536350 - protein, 18 aa, Entamoeba dispar
PSILSVTVPLLLSSGNTL

SEQ ID NO: 2536351 - protein, 22 aa, Entamoeba dispar
PSIPQPVMPPVPTPVVQPPIPS

SEQ ID NO: 2536352 - protein, 29 aa, Entamoeba dispar
PSIQTSLFLQPEYPWKQLKKLALRNCGIT

SEQ ID NO: 2536353 - protein, 21 aa, Entamoeba dispar
PSKGIFYIPPQFFNGQISICS

SEQ ID NO: 2536354 - protein, 26 aa, Entamoeba dispar
PSKGLFLRSYLLYVIKNYLPTTLIEN

SEQ ID NO: 2536355 - protein, 19 aa, Entamoeba dispar
PSKLYHKFFKELPNIKYVI

SEQ ID NO: 2536356 - protein, 22 aa, Entamoeba dispar
PSKLYHKFFKELPNIKYVIMPG

SEQ ID NO: 2536357 - protein, 23 aa, Entamoeba dispar
PSKQSIICAYANRYYQGLNNSTV

SEQ ID NO: 2536358 - protein, 27 aa, Entamoeba dispar
PSLDYPTLHLIIYNVPKTFDKSQFFLL

SEQ ID NO: 2536359 - protein, 17 aa, Entamoeba dispar
PSLIFKSSKCVFGGNIT

SEQ ID NO: 2536360 - protein, 18 aa, Entamoeba dispar
PSLLKELRHTIGNKLIDI

SEQ ID NO: 2536361 - protein, 22 aa, Entamoeba dispar
PSLLSMIQPSPPPPPPNKEIED

SEQ ID NO: 2536362 - protein, 26 aa, Entamoeba dispar
PSLMKPYFGDLLKRLLSLLNSNQKTV

SEQ ID NO: 2536363 - protein, 20 aa, Entamoeba dispar
PSLPGRPLGAPPRKPAAKPK

SEQ ID NO: 2536364 - protein, 17 aa, Entamoeba dispar
PSLPRSGSLSPKPGSRK

SEQ ID NO: 2536365 - protein, 29 aa, Entamoeba dispar
PSLSLDQWYIIIVCFLDFSLQDISKTTTV

SEQ ID NO: 2536366 - protein, 26 aa, Entamoeba dispar
PSLTIISFIVMLFRHSALSEDAYLII

SEQ ID NO: 2536367 - protein, 27 aa, Entamoeba dispar
PSLVDGSFFFWMAYCPIKPKSEKLIQI

SEQ ID NO: 2536368 - protein, 17 aa, Entamoeba dispar
PSMIYLYAKGVNSDSGS

SEQ ID NO: 2536369 - protein, 28 aa, Entamoeba dispar
PSNEFSWFEGYAWQIIVCESCGNHIGWK

SEQ ID NO: 2536370 - protein, 39 aa, Entamoeba dispar
PSNLQQTLLMLPTSNAILLLRWVVDWLEKDKRILMDVTI

SEQ ID NO: 2536371 - protein, 25 aa, Entamoeba dispar
PSNTNAYLLLAFANAYFLKGDLENA

SEQ ID NO: 2536372 - protein, 33 aa, Entamoeba dispar
PSNYLIEPVQRFPRYILLLESLIKATPTFTNEY

SEQ ID NO: 2536373 - protein, 20 aa, Entamoeba dispar
PSPMYTINSPFKKTARKEQN

SEQ ID NO: 2536374 - protein, 35 aa, Entamoeba dispar
PSQCIGQNFQLSDYPSMMTIYSAVSNLTTLTDDCI

SEQ ID NO: 2536375 - protein, 27 aa, Entamoeba dispar
PSQFDKLFFLVEVMLSYIYPNFAEEAQ

SEQ ID NO: 2536376 - protein, 18 aa, Entamoeba dispar
PSQFYQQFRIAKQLAQQH

SEQ ID NO: 2536377 - protein, 18 aa, Entamoeba dispar
PSQQIFYIPSAEIHTTTI

SEQ ID NO: 2536378 - protein, 19 aa, Entamoeba dispar
PSQRKVLWTCLEKNIMKEL

SEQ ID NO: 2536379 - protein, 19 aa, Entamoeba dispar
PSQYLRIGFERDETTWRVF

SEQ ID NO: 2536380 - protein, 34 aa, Entamoeba dispar
PSRLETLIKIMTRFCLLYSYFPLQETIDVYEEID

SEQ ID NO: 2536381 - protein, 18 aa, Entamoeba dispar
PSSCFIFINMKNQNIINK

SEQ ID NO: 2536382 - protein, 22 aa, Entamoeba dispar
PSSFNFYSKKFIPTTKRKQMII

SEQ ID NO: 2536383 - protein, 22 aa, Entamoeba dispar
PSSIEWCHMIGLNYVSCSSYRI

SEQ ID NO: 2536384 - protein, 22 aa, Entamoeba dispar
PSSIISLKLYNPPSSLPMNLVQ

SEQ ID NO: 2536385 - protein, 19 aa, Entamoeba dispar
PSSINITIKITLKTVKNGL

SEQ ID NO: 2536386 - protein, 18 aa, Entamoeba dispar
PSSLKEYPSLKRLVLRPI

SEQ ID NO: 2536387 - protein, 17 aa, Entamoeba dispar
PSSLSLWALQEMYIFLP

SEQ ID NO: 2536388 - protein, 24 aa, Entamoeba dispar
PSSNLLAFHFIKVRPKNLLLIDVL

SEQ ID NO: 2536389 - protein, 26 aa, Entamoeba dispar
PSSQIPTFPILSYRSGIFSSLINSLE

SEQ ID NO: 2536390 - protein, 23 aa, Entamoeba dispar
PSSTHGTLPPPPPGRKPPTSSSG

SEQ ID NO: 2536391 - protein, 25 aa, Entamoeba dispar
PSSVGTRFMLLLLGLKIVSLSQKEG

SEQ ID NO: 2536392 - protein, 25 aa, Entamoeba dispar
PSSVSKFGWGCFYKCGCKEELKKNK

SEQ ID NO: 2536393 - protein, 23 aa, Entamoeba dispar
PSSYIHSFIQWLAIKYESETLKN

SEQ ID NO: 2536394 - protein, 34 aa, Entamoeba dispar
PSTLKQYAMLITDKYRLAYLIACLRTFLKESIQR

SEQ ID NO: 2536395 - protein, 28 aa, Entamoeba dispar
PSTLRQINAPLPLKLIKPKEFNNPPKLE

SEQ ID NO: 2536396 - protein, 25 aa, Entamoeba dispar
PSTVLRCLFRLRPYTDMILKEMSGR

SEQ ID NO: 2536397 - protein, 38 aa, Entamoeba dispar
PSVDAFKTFYKITIGFNFLSNFIIIKDYAIYCVQTLAA

SEQ ID NO: 2536398 - protein, 20 aa, Entamoeba dispar
PSVPQLYPSIPPYYQQQNPA

SEQ ID NO: 2536399 - protein, 19 aa, Entamoeba dispar
PSVTYTFHCPLSFSEIIPN

SEQ ID NO: 2536400 - protein, 18 aa, Entamoeba dispar
PSYKISLSPLSKNSTPPL

SEQ ID NO: 2536401 - protein, 24 aa, Entamoeba dispar
PSYLSLTHLLLEKPLQRDLNKLEN

SEQ ID NO: 2536402 - protein, 26 aa, Entamoeba dispar
PSYNKYIIFLVFNESINDLIIQKIAT

SEQ ID NO: 2536403 - protein, 18 aa, Entamoeba dispar
PSYPIFFDELYNKSSKII

SEQ ID NO: 2536404 - protein, 17 aa, Entamoeba dispar
PSYPRPNAFPQNSYLPS

SEQ ID NO: 2536405 - protein, 19 aa, Entamoeba dispar
PSYSQYIYDLLYPLDQANL

SEQ ID NO: 2536406 - protein, 18 aa, Entamoeba dispar
PTAPMPYLIGIKTSLWEH

SEQ ID NO: 2536407 - protein, 23 aa, Entamoeba dispar
PTARRTLILLTKILQNIANNVRE

SEQ ID NO: 2536408 - protein, 26 aa, Entamoeba dispar
PTCDWEFEFPYFQLALCSVLSGNTLK

SEQ ID NO: 2536409 - protein, 22 aa, Entamoeba dispar
PTDVKILQFLYSISCHSFSYQI

SEQ ID NO: 2536410 - protein, 19 aa, Entamoeba dispar
PTECLPKVLPFPGHIETKG

SEQ ID NO: 2536411 - protein, 22 aa, Entamoeba dispar
PTEKWVAILALLQKNNEIIGKI

SEQ ID NO: 2536412 - protein, 23 aa, Entamoeba dispar
PTFDIIDDEQFFWDYKALKKFCQ

SEQ ID NO: 2536413 - protein, 17 aa, Entamoeba dispar
PTFFIAVPRVLQKIYDK

SEQ ID NO: 2536414 - protein, 24 aa, Entamoeba dispar
PTFNKNFIYLQIPKQTNSKLDINI

SEQ ID NO: 2536415 - protein, 27 aa, Entamoeba dispar
PTFQHGTIFYKVKLPKKIFSVNDSFMY

SEQ ID NO: 2536416 - protein, 34 aa, Entamoeba dispar
PTGGGKSLCYQLPSYFIKGITVVVSPLVSLIQDQ

SEQ ID NO: 2536417 - protein, 25 aa, Entamoeba dispar
PTGHTLRFLSLPSVLRDMLEKVIKL

SEQ ID NO: 2536418 - protein, 17 aa, Entamoeba dispar
PTGLFQFAANETLLNKT

SEQ ID NO: 2536419 - protein, 23 aa, Entamoeba dispar
PTGNFLAILYGTQPSKLILFDTS

SEQ ID NO: 2536420 - protein, 24 aa, Entamoeba dispar
PTGQQLTFFAIKAADAWILQNIQA

SEQ ID NO: 2536421 - protein, 17 aa, Entamoeba dispar
PTGSFMFLGPSGVGKTE

SEQ ID NO: 2536422 - protein, 21 aa, Entamoeba dispar
PTHACTKFLYLSQNKPFDDEI

SEQ ID NO: 2536423 - protein, 17 aa, Entamoeba dispar
PTIINLCYILSVIGKEE

SEQ ID NO: 2536424 - protein, 26 aa, Entamoeba dispar
PTINKFHWHFKNFDGFALFQNGEKIL

SEQ ID NO: 2536425 - protein, 43 aa, Entamoeba dispar
PTIQAFLNVLQPFMWQHILIPILPLFLSSYLSSILPCIIGCTR

SEQ ID NO: 2536426 - protein, 19 aa, Entamoeba dispar
PTKIKTLSLEILTILYSRD

SEQ ID NO: 2536427 - protein, 25 aa, Entamoeba dispar
PTKIQQLCIPPLLSFHNVLGGAETG

SEQ ID NO: 2536428 - protein, 22 aa, Entamoeba dispar
PTKRVWGKISTKPFVKICEENP

SEQ ID NO: 2536429 - protein, 25 aa, Entamoeba dispar
PTKTTFFIHLNLYKLLKQSQTLLHL

SEQ ID NO: 2536430 - protein, 24 aa, Entamoeba dispar
PTLDKLPELSLPNNLPKLSNIAEL

SEQ ID NO: 2536431 - protein, 18 aa, Entamoeba dispar
PTLIQYYKQPQEKHLLII

SEQ ID NO: 2536432 - protein, 29 aa, Entamoeba dispar
PTLKYKTFEWLFWDVSGAAKFRGLWKSYY

SEQ ID NO: 2536433 - protein, 24 aa, Entamoeba dispar
PTLTPIYEWFLLNTFSIEHSNSVF

SEQ ID NO: 2536434 - protein, 25 aa, Entamoeba dispar
PTMKTYFFEILLGASHKYELSVEPM

SEQ ID NO: 2536435 - protein, 17 aa, Entamoeba dispar
PTMYHKFQLGNTGITTF

SEQ ID NO: 2536436 - protein, 27 aa, Entamoeba dispar
PTNALQGGFFAILFKVTEGTTNMEKVS

SEQ ID NO: 2536437 - protein, 26 aa, Entamoeba dispar
PTNALQGGFFAILFNVVEGTTTREEV

SEQ ID NO: 2536438 - protein, 19 aa, Entamoeba dispar
PTNLLCKSLFEAIVPEVFV

SEQ ID NO: 2536439 - protein, 19 aa, Entamoeba dispar
PTNLLPYTSLVSYSEYLLL

SEQ ID NO: 2536440 - protein, 24 aa, Entamoeba dispar
PTNLMPIITKVLVGKLPQLSVFGN

SEQ ID NO: 2536441 - protein, 27 aa, Entamoeba dispar
PTNYTRFHRIIYYMIRKRGLDEMRESI

SEQ ID NO: 2536442 - protein, 25 aa, Entamoeba dispar
PTPEFYNDILSPVLKLMGITLNVQL

SEQ ID NO: 2536443 - protein, 19 aa, Entamoeba dispar
PTPFHNNVKWFPFPDHHNP

SEQ ID NO: 2536444 - protein, 28 aa, Entamoeba dispar
PTPFLSLISHCLLIPLLPQGQYNKLCDY

SEQ ID NO: 2536445 - protein, 26 aa, Entamoeba dispar
PTPLPLFSKQLLLPKQLKALGMNDFI

SEQ ID NO: 2536446 - protein, 19 aa, Entamoeba dispar
PTQPPLINPQLLALQTSIN

SEQ ID NO: 2536447 - protein, 23 aa, Entamoeba dispar
PTQSFDILLKDALNYYYQDIPDL

SEQ ID NO: 2536448 - protein, 23 aa, Entamoeba dispar
PTREYFTFLTGDKSKVLDYWISS

SEQ ID NO: 2536449 - protein, 26 aa, Entamoeba dispar
PTRQEKFIYCPLTPKQRSMYLEYVNS

SEQ ID NO: 2536450 - protein, 22 aa, Entamoeba dispar
PTRRREFIINGNKIIYASLDAL

SEQ ID NO: 2536451 - protein, 20 aa, Entamoeba dispar
PTRYVIIPRPITIQFHKLKS

SEQ ID NO: 2536452 - protein, 32 aa, Entamoeba dispar
PTSFDADALLSILQFLLIRSKIQHPFSIINFI

SEQ ID NO: 2536453 - protein, 23 aa, Entamoeba dispar
PTSINELGNWYFKGCTSLTRIDI

SEQ ID NO: 2536454 - protein, 22 aa, Entamoeba dispar
PTSIQIISLCKCKLLKQLILSK

SEQ ID NO: 2536455 - protein, 17 aa, Entamoeba dispar
PTSLYVTKALEVKIFGL

SEQ ID NO: 2536456 - protein, 30 aa, Entamoeba dispar
PTSREYIIMVELLARRIIPNFVVHEGREEQ

SEQ ID NO: 2536457 - protein, 24 aa, Entamoeba dispar
PTSVKSLDIFCFCGCKSLASIDIP

SEQ ID NO: 2536458 - protein, 25 aa, Entamoeba dispar
PTTFTYSIPPPIPKTNPVPSTTTLP

SEQ ID NO: 2536459 - protein, 25 aa, Entamoeba dispar
PTTINKIEYRCFYGCISLKTITIPT

SEQ ID NO: 2536460 - protein, 25 aa, Entamoeba dispar
PTTKQYQQIIQYTYHYQECREIMDF

SEQ ID NO: 2536461 - protein, 27 aa, Entamoeba dispar
PTTMHNQIFSPPTFQTPFSGFVEVATP

SEQ ID NO: 2536462 - protein, 18 aa, Entamoeba dispar
PTTNLYIHFNECYNFIES

SEQ ID NO: 2536463 - protein, 33 aa, Entamoeba dispar
PTTRYCDVYTKLLLVFLPYIKEFNSTLITMNTK

SEQ ID NO: 2536464 - protein, 23 aa, Entamoeba dispar
PTTYPQCKLLLKTLIQQLQLQQT

SEQ ID NO: 2536465 - protein, 26 aa, Entamoeba dispar
PTVCHSPVMMFLYDSGGDGKLTFEDF

SEQ ID NO: 2536466 - protein, 25 aa, Entamoeba dispar
PTVETIIRIRIIVSPLKTVKSESLL

SEQ ID NO: 2536467 - protein, 20 aa, Entamoeba dispar
PTVIRDELHFVPARVLKKDG

SEQ ID NO: 2536468 - protein, 31 aa, Entamoeba dispar
PTVKKVFYFSLNFIIDKIPQLTFLSNLRELE

SEQ ID NO: 2536469 - protein, 21 aa, Entamoeba dispar
PTVLVFILTTRVGGLGINLTG

SEQ ID NO: 2536470 - protein, 18 aa, Entamoeba dispar
PTWGDTFEFYNVVPGTMA

SEQ ID NO: 2536471 - protein, 24 aa, Entamoeba dispar
PTYDKLMMIAILSKEPVLKPIIEQ

SEQ ID NO: 2536472 - protein, 26 aa, Entamoeba dispar
PVADAYGFYRCRNFLIYSVNDGCGWG

SEQ ID NO: 2536473 - protein, 27 aa, Entamoeba dispar
PVADMGLEFLTRYLSELIGDIIIFSEH

SEQ ID NO: 2536474 - protein, 28 aa, Entamoeba dispar
PVADMGLEFLTRYLSELIGDIIIFSEHA

SEQ ID NO: 2536475 - protein, 30 aa, Entamoeba dispar
PVALQVPTYFSVIKRPMDLGTIKHNLSDKK

SEQ ID NO: 2536476 - protein, 25 aa, Entamoeba dispar
PVAPTSCFASWNISLINFVMNSLEK

SEQ ID NO: 2536477 - protein, 17 aa, Entamoeba dispar
PVAYAYAILNPNGSFLF

SEQ ID NO: 2536478 - protein, 21 aa, Entamoeba dispar
PVDALTRRNTIQRKPTIMCTQ

SEQ ID NO: 2536479 - protein, 20 aa, Entamoeba dispar
PVDELFPKNIPMFTANSKID

SEQ ID NO: 2536480 - protein, 42 aa, Entamoeba dispar
PVDIRMYPNYIPTCPFPIDFNLILQRLINDNYYRTYDQVEWE

SEQ ID NO: 2536481 - protein, 18 aa, Entamoeba dispar
PVDVLVFDEIPDALNCTA

SEQ ID NO: 2536482 - protein, 23 aa, Entamoeba dispar
PVEEIKSAFYLLDNARARYLGDL

SEQ ID NO: 2536483 - protein, 17 aa, Entamoeba dispar
PVEIKPITPSPVEVKQV

SEQ ID NO: 2536484 - protein, 17 aa, Entamoeba dispar
PVEPLEDPQFDFATSTI

SEQ ID NO: 2536485 - protein, 46 aa, Entamoeba dispar
PVFTHSVWRLLLWAADYYHHPIGDVLFHALPILLRQGRPAANAPMW

SEQ ID NO: 2536486 - protein, 17 aa, Entamoeba dispar
PVFVEKPGKNWGPACKK

SEQ ID NO: 2536487 - protein, 23 aa, Entamoeba dispar
PVGKYTQPFKTPFGYHIVLVEER

SEQ ID NO: 2536488 - protein, 23 aa, Entamoeba dispar
PVHRWEIVLKIKRLLDASHLFSD

SEQ ID NO: 2536489 - protein, 25 aa, Entamoeba dispar
PVIHKTLPIILPIIMRTIDCSIIEQ

SEQ ID NO: 2536490 - protein, 17 aa, Entamoeba dispar
PVILLYDDTIKEKEEFC

SEQ ID NO: 2536491 - protein, 25 aa, Entamoeba dispar
PVISKKSIDIFGVKLNLFVTDGKPI

SEQ ID NO: 2536492 - protein, 29 aa, Entamoeba dispar
PVITKYFYEPYLDELKKWTKKEICQVIYD

SEQ ID NO: 2536493 - protein, 19 aa, Entamoeba dispar
PVKRRPVIGMTQRGQRNSP

SEQ ID NO: 2536494 - protein, 20 aa, Entamoeba dispar
PVLQGLMDKVSILTKENDEL

SEQ ID NO: 2536495 - protein, 24 aa, Entamoeba dispar
PVMETIELFLYISEKFIKQETYTN

SEQ ID NO: 2536496 - protein, 26 aa, Entamoeba dispar
PVMIRVKTCFIEIWKFIFEKQKIEGN

SEQ ID NO: 2536497 - protein, 31 aa, Entamoeba dispar
PVMKRARERQERLKQIQAAREAARREAEERR

SEQ ID NO: 2536498 - protein, 18 aa, Entamoeba dispar
PVMMPMTQPVMNPMMASV

SEQ ID NO: 2536499 - protein, 20 aa, Entamoeba dispar
PVMSISWSSFTNAPLRCLYT

SEQ ID NO: 2536500 - protein, 17 aa, Entamoeba dispar
PVNLFQMNENAEKLIRM

SEQ ID NO: 2536501 - protein, 19 aa, Entamoeba dispar
PVRFILSKENPYNFTFFVF

SEQ ID NO: 2536502 - protein, 17 aa, Entamoeba dispar
PVSDYLEWVTYSILVHE

SEQ ID NO: 2536503 - protein, 19 aa, Entamoeba dispar
PVSPLFYEQVDGQVIYPIK

SEQ ID NO: 2536504 - protein, 26 aa, Entamoeba dispar
PVSRRSSFALPAPRQSIRRSIVPPRQ

SEQ ID NO: 2536505 - protein, 27 aa, Entamoeba dispar
PVSTLNHVVCGLLSLFLEPNPDDPLNT

SEQ ID NO: 2536506 - protein, 27 aa, Entamoeba dispar
PVSYSPVLYSDFPHWDISIGGFADGNI

SEQ ID NO: 2536507 - protein, 24 aa, Entamoeba dispar
PVVFDLIDFSPYNEIFIGGEWVGK

SEQ ID NO: 2536508 - protein, 20 aa, Entamoeba dispar
PVVIRLWPDDIENGDLWVLV

SEQ ID NO: 2536509 - protein, 17 aa, Entamoeba dispar
PVWLATISSNSITGRKC

SEQ ID NO: 2536510 - protein, 24 aa, Entamoeba dispar
PWGTRMRYLYIALEWLSQCSFYCK

SEQ ID NO: 2536511 - protein, 25 aa, Entamoeba dispar
PYCKDCFIAKFAKICARCGKPITTN

SEQ ID NO: 2536512 - protein, 24 aa, Entamoeba dispar
PYDDDGLIPVFGFGDKRTQGKAVF

SEQ ID NO: 2536513 - protein, 20 aa, Entamoeba dispar
PYDPCYLLPLTYHALDRAIV

SEQ ID NO: 2536514 - protein, 21 aa, Entamoeba dispar
PYDREFLKDQFLLDGFDFPNQ

SEQ ID NO: 2536515 - protein, 25 aa, Entamoeba dispar
PYDSGLVFSIFFPERNRFPGVIDLY

SEQ ID NO: 2536516 - protein, 30 aa, Entamoeba dispar
PYDTSPRKFLIVMPKFFYEPIQQIKSELSK

SEQ ID NO: 2536517 - protein, 45 aa, Entamoeba dispar
PYEEGIKYSIPLWLAVHFKQIGLCKLVIPHWLSLEELKETLEEEQ

SEQ ID NO: 2536518 - protein, 26 aa, Entamoeba dispar
PYEPNKIFLLLNIIEKIIIFQSNLLN

SEQ ID NO: 2536519 - protein, 26 aa, Entamoeba dispar
PYEYKRKIFIGKQATLPDFRIKGKSF

SEQ ID NO: 2536520 - protein, 25 aa, Entamoeba dispar
PYFEKEIYVSLPIEKIPLSPSINCE

SEQ ID NO: 2536521 - protein, 20 aa, Entamoeba dispar
PYFKTLYNYYLPQISINNSS

SEQ ID NO: 2536522 - protein, 21 aa, Entamoeba dispar
PYFKTSIFWKLCCVYDHIVVH

SEQ ID NO: 2536523 - protein, 22 aa, Entamoeba dispar
PYFQECFVLAYRLVTTPEKLLE

SEQ ID NO: 2536524 - protein, 19 aa, Entamoeba dispar
PYIIDVNHFPSYNKSFSLQ

SEQ ID NO: 2536525 - protein, 23 aa, Entamoeba dispar
PYIVKLFYTFQNPTSLFYVLELC

SEQ ID NO: 2536526 - protein, 17 aa, Entamoeba dispar
PYLPKLKSPFDTSNFDD

SEQ ID NO: 2536527 - protein, 19 aa, Entamoeba dispar
PYLVANLVKLFIKEIPGNL

SEQ ID NO: 2536528 - protein, 20 aa, Entamoeba dispar
PYMDDPPLRALFQISTKGVP

SEQ ID NO: 2536529 - protein, 20 aa, Entamoeba dispar
PYMPQQFYQPHSLQYQQQYQ

SEQ ID NO: 2536530 - protein, 28 aa, Entamoeba dispar
PYNDRLKEAVLFAYRFPQKAEDVRSMLQ

SEQ ID NO: 2536531 - protein, 18 aa, Entamoeba dispar
PYNYNDFIKLITTGELTE

SEQ ID NO: 2536532 - protein, 18 aa, Entamoeba dispar
PYPVFIRSLINNNPYVYI

SEQ ID NO: 2536533 - protein, 19 aa, Entamoeba dispar
PYREDGIVKLLFRTVTNGA

SEQ ID NO: 2536534 - protein, 22 aa, Entamoeba dispar
PYTTILSLFQKKTSYDFRRLIL

SEQ ID NO: 2536535 - protein, 32 aa, Entamoeba dispar
PYVHIYSFESMKLLPLKPLLTPHNRTIRRVKC

SEQ ID NO: 2536536 - protein, 20 aa, Entamoeba dispar
PYVSHHCYFFKTDTLKEMES

SEQ ID NO: 2536537 - protein, 17 aa, Entamoeba dispar
PYWVCPNGLIIIERDNK

SEQ ID NO: 2536538 - protein, 27 aa, Entamoeba dispar
QACTTKTFNLGWIPELDRFKRSQPQNV

SEQ ID NO: 2536539 - protein, 17 aa, Entamoeba dispar
QADKLTRLIKLKNPDLL

SEQ ID NO: 2536540 - protein, 24 aa, Entamoeba dispar
QADPLIQREWWYPLATSISGTEFK

SEQ ID NO: 2536541 - protein, 40 aa, Entamoeba dispar
QADRMFKFTPVHIRKGKYRFPGTDLWYNTIEEYKKLQKEY

SEQ ID NO: 2536542 - protein, 25 aa, Entamoeba dispar
QAEYYKKADVVPAYYRVADKESGEP

SEQ ID NO: 2536543 - protein, 26 aa, Entamoeba dispar
QAFSLQQFVVIPRDLFITHNNNTFVA

SEQ ID NO: 2536544 - protein, 24 aa, Entamoeba dispar
QAGRTLVALPFLQVVRIQLSEEDT

SEQ ID NO: 2536545 - protein, 21 aa, Entamoeba dispar
QAHLIIHHYITSLNPPLIPNY

SEQ ID NO: 2536546 - protein, 27 aa, Entamoeba dispar
QAISFYLITPIQRIPRYELLIRDMLKD

SEQ ID NO: 2536547 - protein, 19 aa, Entamoeba dispar
QAKLYFSLIPNIQMLGEFF

SEQ ID NO: 2536548 - protein, 24 aa, Entamoeba dispar
QALCKQLGVILDFVLAFDNKKVTN

SEQ ID NO: 2536549 - protein, 23 aa, Entamoeba dispar
QALELLDFRFPDEQVRLFALKCL

SEQ ID NO: 2536550 - protein, 22 aa, Entamoeba dispar
QALHVSYFIHLASTGAFVIDQD

SEQ ID NO: 2536551 - protein, 20 aa, Entamoeba dispar
QALILSILNVNGYGFKIKKP

SEQ ID NO: 2536552 - protein, 19 aa, Entamoeba dispar
QALKFELHHQSNLAYFLLR

SEQ ID NO: 2536553 - protein, 24 aa, Entamoeba dispar
QALKVFINLLQQHPEFLNDNRLDF

SEQ ID NO: 2536554 - protein, 27 aa, Entamoeba dispar
QALQLIAQLLPTIKRRGLIDNFISCVC

SEQ ID NO: 2536555 - protein, 18 aa, Entamoeba dispar
QALSVLKPNKKKVKERNG

SEQ ID NO: 2536556 - protein, 22 aa, Entamoeba dispar
QAMELINFFQTNTSLKQICMSE

SEQ ID NO: 2536557 - protein, 25 aa, Entamoeba dispar
QAMQHPFLMNKPLHPNYQPPHLPEP

SEQ ID NO: 2536558 - protein, 24 aa, Entamoeba dispar
QANKALIIELNKLKHQLELNYRCA

SEQ ID NO: 2536559 - protein, 25 aa, Entamoeba dispar
QAPTKNLMEFRNSLPTSNEESTVKV

SEQ ID NO: 2536560 - protein, 22 aa, Entamoeba dispar
QARDFYFYLRNEIIDDMKKLNN

SEQ ID NO: 2536561 - protein, 26 aa, Entamoeba dispar
QASGKTCLYNIWRGLSIPDEYIKTTE

SEQ ID NO: 2536562 - protein, 20 aa, Entamoeba dispar
QASLLFLNTFVCDELDYCVK

SEQ ID NO: 2536563 - protein, 28 aa, Entamoeba dispar
QATIEYLKALHPPFITFVASGDEITCRE

SEQ ID NO: 2536564 - protein, 33 aa, Entamoeba dispar
QAVDLNLQLMKWQLFRNLDLPAIQATKCLLIGA

SEQ ID NO: 2536565 - protein, 22 aa, Entamoeba dispar
QAVFNLTKYLRKGGLFIGTTIN

SEQ ID NO: 2536566 - protein, 24 aa, Entamoeba dispar
QAVLLALINRHFSLSLSAPKKKSV

SEQ ID NO: 2536567 - protein, 17 aa, Entamoeba dispar
QAVVIVLDFNKEVLSDN

SEQ ID NO: 2536568 - protein, 18 aa, Entamoeba dispar
QCCHSYFGVLLMNIHQSL

SEQ ID NO: 2536569 - protein, 28 aa, Entamoeba dispar
QCDLMNIPKYYQEKLYQFYIRDIEQKNE

SEQ ID NO: 2536570 - protein, 24 aa, Entamoeba dispar
QCFEFYSRPLWYHVQPTVLVKNKY

SEQ ID NO: 2536571 - protein, 19 aa, Entamoeba dispar
QCFSCKMFQVHIKNKLKKF

SEQ ID NO: 2536572 - protein, 30 aa, Entamoeba dispar
QCFVNKSHLIELPLQHLPPPVVKIKKELFE

SEQ ID NO: 2536573 - protein, 25 aa, Entamoeba dispar
QCGALKYIQLFTKLCNHPALISKYL

SEQ ID NO: 2536574 - protein, 37 aa, Entamoeba dispar
QCGIMDQSLPFFMFEWNYLWFIHSLKFELAIRVFDVI

SEQ ID NO: 2536575 - protein, 17 aa, Entamoeba dispar
QCGNLFNDLRPNKSCVS

SEQ ID NO: 2536576 - protein, 17 aa, Entamoeba dispar
QCHFVGMKPKEQNVDIQ

SEQ ID NO: 2536577 - protein, 19 aa, Entamoeba dispar
QCIDYCCVVYIALTRMYVS

SEQ ID NO: 2536578 - protein, 18 aa, Entamoeba dispar
QCIHYFKEEIPDLIELSI

SEQ ID NO: 2536579 - protein, 24 aa, Entamoeba dispar
QCIKEAFTLFFKERISFGVNVKAM

SEQ ID NO: 2536580 - protein, 18 aa, Entamoeba dispar
QCIMAILEKLPSIKKILK

SEQ ID NO: 2536581 - protein, 17 aa, Entamoeba dispar
QCIMAMLEKLPSIKKTL

SEQ ID NO: 2536582 - protein, 28 aa, Entamoeba dispar
QCLHYINPQFPIFNPYQRVIDAIGRALE

SEQ ID NO: 2536583 - protein, 25 aa, Entamoeba dispar
QCLIHTIPLVQFFQKEDWKKEININ

SEQ ID NO: 2536584 - protein, 17 aa, Entamoeba dispar
QCLSTLNMLTWKGLKFR

SEQ ID NO: 2536585 - protein, 20 aa, Entamoeba dispar
QCLVYCVQQFLKVSSQEVRL

SEQ ID NO: 2536586 - protein, 25 aa, Entamoeba dispar
QCNEVITLWYRPPELLYGAVEYSEE

SEQ ID NO: 2536587 - protein, 17 aa, Entamoeba dispar
QCPKCNILYCSIDCYKA

SEQ ID NO: 2536588 - protein, 17 aa, Entamoeba dispar
QCRSSCAYETVFARNFV

SEQ ID NO: 2536589 - protein, 35 aa, Entamoeba dispar
QCSQLSKIVLPPLKVLPKGLFYNCGFKEFDVPKGV

SEQ ID NO: 2536590 - protein, 23 aa, Entamoeba dispar
QCSVYSYILIPNEFTLQNLITPF

SEQ ID NO: 2536591 - protein, 33 aa, Entamoeba dispar
QCTEFDCLFPVVLSPRLVLLGDIQQLKPVLLSK

SEQ ID NO: 2536592 - protein, 23 aa, Entamoeba dispar
QCVSNLLGIPREVPVIIPPSELI

SEQ ID NO: 2536593 - protein, 23 aa, Entamoeba dispar
QCWDHIPSKRPPFKDITIILQNE

SEQ ID NO: 2536594 - protein, 25 aa, Entamoeba dispar
QCYGMHFFHTFKLFAVAQEKRLHIY

SEQ ID NO: 2536595 - protein, 29 aa, Entamoeba dispar
QCYTDDYWLLPSFITLPEITLLHSNYSKL

SEQ ID NO: 2536596 - protein, 30 aa, Entamoeba dispar
QDALKGITKPAIRRLARRGGVKRINGAVYD

SEQ ID NO: 2536597 - protein, 17 aa, Entamoeba dispar
QDAPDLMKLSWSSSDPN

SEQ ID NO: 2536598 - protein, 24 aa, Entamoeba dispar
QDDINLYLVMEYCPGGDLATLLEH

SEQ ID NO: 2536599 - protein, 23 aa, Entamoeba dispar
QDELRILTIRFLKNCIAVCDING

SEQ ID NO: 2536600 - protein, 27 aa, Entamoeba dispar
QDELRVFWNSKVIVYKHLIENGYKVRP

SEQ ID NO: 2536601 - protein, 24 aa, Entamoeba dispar
QDFFETLAKILLKQKLISTQKLSK

SEQ ID NO: 2536602 - protein, 25 aa, Entamoeba dispar
QDFKKRFSLLLGFEFKSMSAVDAFK

SEQ ID NO: 2536603 - protein, 19 aa, Entamoeba dispar
QDFLTTRDYLRDNIYCSKC

SEQ ID NO: 2536604 - protein, 25 aa, Entamoeba dispar
QDGYHALYLNNLPGQMIRPVIHRAT

SEQ ID NO: 2536605 - protein, 21 aa, Entamoeba dispar
QDHWTGYRHSILSIDKIRLFS

SEQ ID NO: 2536606 - protein, 22 aa, Entamoeba dispar
QDIAHPNTYFLRAKRLVNEQNR

SEQ ID NO: 2536607 - protein, 18 aa, Entamoeba dispar
QDIAIYGTLIGLLTQKHQ

SEQ ID NO: 2536608 - protein, 28 aa, Entamoeba dispar
QDIDAIFCFHYPGCALIFNWFSVSSKTR

SEQ ID NO: 2536609 - protein, 19 aa, Entamoeba dispar
QDIEFKKIKSLLAEKNRLL

SEQ ID NO: 2536610 - protein, 27 aa, Entamoeba dispar
QDIHGRTPLMSCLLNQSLDVIVLLLSV

SEQ ID NO: 2536611 - protein, 21 aa, Entamoeba dispar
QDIIFTTYFRDLGNRVFKVLC

SEQ ID NO: 2536612 - protein, 24 aa, Entamoeba dispar
QDIIVLFEDYYYFSYTIMRNNFYE

SEQ ID NO: 2536613 - protein, 22 aa, Entamoeba dispar
QDIKLIEKYYLTTLKKYMKEDG

SEQ ID NO: 2536614 - protein, 23 aa, Entamoeba dispar
QDILTLQMIRLMNAIWKNNGLDL

SEQ ID NO: 2536615 - protein, 26 aa, Entamoeba dispar
QDKLAYIYIALRIIEMTTIFVTGNVS

SEQ ID NO: 2536616 - protein, 26 aa, Entamoeba dispar
QDKPSTLQMLPTYAPIPTGKEVGTFM

SEQ ID NO: 2536617 - protein, 26 aa, Entamoeba dispar
QDKRYSVWAVLLFENNLVLKKIRIVL

SEQ ID NO: 2536618 - protein, 31 aa, Entamoeba dispar
QDLKKLTVNMIPYPRLHFFSSSIAPVSSALS

SEQ ID NO: 2536619 - protein, 17 aa, Entamoeba dispar
QDLLRRLESAKIKPLSN

SEQ ID NO: 2536620 - protein, 22 aa, Entamoeba dispar
QDLPIEFFISKEIDLLKTPDDF

SEQ ID NO: 2536621 - protein, 29 aa, Entamoeba dispar
QDMLTLQMFKLMDDLWKKNGIDFRMTIYN

SEQ ID NO: 2536622 - protein, 30 aa, Entamoeba dispar
QDNDVRILTFLQHKFPRIDAQTLLPVCTEL

SEQ ID NO: 2536623 - protein, 26 aa, Entamoeba dispar
QDNYRRKFVQFIKKDPYSHYVKELTD

SEQ ID NO: 2536624 - protein, 23 aa, Entamoeba dispar
QDPINPIVFFDISVGDRLIGRIK

SEQ ID NO: 2536625 - protein, 17 aa, Entamoeba dispar
QDQILFSLFNEKEIFIE

SEQ ID NO: 2536626 - protein, 23 aa, Entamoeba dispar
QDQISFQILYSSAYSFSVCYDDG

SEQ ID NO: 2536627 - protein, 23 aa, Entamoeba dispar
QDRSFVFYLQTLQQYIRLFKENE

SEQ ID NO: 2536628 - protein, 26 aa, Entamoeba dispar
QDSIPIQLPSLLPPIQFIYEIVPNNT

SEQ ID NO: 2536629 - protein, 23 aa, Entamoeba dispar
QDSRLFTHRPITSSPNIYTSPVR

SEQ ID NO: 2536630 - protein, 25 aa, Entamoeba dispar
QDSTYRFFEVILVDPFNAAIRNDPK

SEQ ID NO: 2536631 - protein, 28 aa, Entamoeba dispar
QDTPNLNEIPLQPLLPSKIYTTKRTSIS

SEQ ID NO: 2536632 - protein, 27 aa, Entamoeba dispar
QDTSLRLLLRMIKILQFIHKEGIVHCD

SEQ ID NO: 2536633 - protein, 24 aa, Entamoeba dispar
QDVLRLFVHYNKSYFQFIEHPLGN

SEQ ID NO: 2536634 - protein, 19 aa, Entamoeba dispar
QDYEQLFILQKSSLDCGEF

SEQ ID NO: 2536635 - protein, 24 aa, Entamoeba dispar
QEAFTKFLNILRGKPSEIVRQEIK

SEQ ID NO: 2536636 - protein, 26 aa, Entamoeba dispar
QEAKRWELLHLLMDLVTEYGYTVYAE

SEQ ID NO: 2536637 - protein, 24 aa, Entamoeba dispar
QEALQFVFYCWQDIPGNVKQLLND

SEQ ID NO: 2536638 - protein, 22 aa, Entamoeba dispar
QECFLIGLLQLKYNVICERPYK

SEQ ID NO: 2536639 - protein, 26 aa, Entamoeba dispar
QECREKGILPWLRPDSKSQVTLEYEE

SEQ ID NO: 2536640 - protein, 26 aa, Entamoeba dispar
QEDINIVLQPKFVKLLLAISLVRRHP

SEQ ID NO: 2536641 - protein, 22 aa, Entamoeba dispar
QEDKHLFLIIPFGVKSIEEYII

SEQ ID NO: 2536642 - protein, 32 aa, Entamoeba dispar
QEEECFNLMYYMYKFPFSVLDLNIYKQHTVDN

SEQ ID NO: 2536643 - protein, 23 aa, Entamoeba dispar
QEELLLFESKLIVTEYKFGVIYM

SEQ ID NO: 2536644 - protein, 24 aa, Entamoeba dispar
QEELPWPNYIQTLFSLTQEQGIIQ

SEQ ID NO: 2536645 - protein, 22 aa, Entamoeba dispar
QEEMEKYFAVFGKIKSCILMTQ

SEQ ID NO: 2536646 - protein, 27 aa, Entamoeba dispar
QEESTPLMIYLCKMKSILSELPIASTV

SEQ ID NO: 2536647 - protein, 24 aa, Entamoeba dispar
QEEVEGMPKYLWKQGVEDTVEIIE

SEQ ID NO: 2536648 - protein, 24 aa, Entamoeba dispar
QEFPNLYIDLLKLLLPRVQTTNYE

SEQ ID NO: 2536649 - protein, 23 aa, Entamoeba dispar
QEGFVEVRYIVIKGNAVAFIEFK

SEQ ID NO: 2536650 - protein, 23 aa, Entamoeba dispar
QEGKIKSRWLRKNARRIDMENYT

SEQ ID NO: 2536651 - protein, 26 aa, Entamoeba dispar
QEHLLDLYYMLLTLVPSTLIEQEEIE

SEQ ID NO: 2536652 - protein, 21 aa, Entamoeba dispar
QEHQPIVSINLDQLIRPNYES

SEQ ID NO: 2536653 - protein, 17 aa, Entamoeba dispar
QEIASVDFLNFSFGSKA

SEQ ID NO: 2536654 - protein, 17 aa, Entamoeba dispar
QEIKDTINILDKKVSTI

SEQ ID NO: 2536655 - protein, 26 aa, Entamoeba dispar
QEIKEAIHLLMRLGYKDIKIIMKELY

SEQ ID NO: 2536656 - protein, 23 aa, Entamoeba dispar
QEIKELFPKIPPKSIKEIINLCF

SEQ ID NO: 2536657 - protein, 29 aa, Entamoeba dispar
QEIKEYISQNYYLHAILLINRACNASKSP

SEQ ID NO: 2536658 - protein, 31 aa, Entamoeba dispar
QEIKKFIHNRLFKWKLKEITAKQLDKIGIKT

SEQ ID NO: 2536659 - protein, 30 aa, Entamoeba dispar
QEILESFFTKIFDLKLPDSFKYFMTTIGSH

SEQ ID NO: 2536660 - protein, 20 aa, Entamoeba dispar
QEILKLTKLINSDKSKLLLS

SEQ ID NO: 2536661 - protein, 23 aa, Entamoeba dispar
QEIMRKLISLINQKKRMNVLTPR

SEQ ID NO: 2536662 - protein, 34 aa, Entamoeba dispar
QEINNLRIPFGFYKRTLPHYWKEDYGFVSRGFVE

SEQ ID NO: 2536663 - protein, 18 aa, Entamoeba dispar
QEINSLTTSIEELKNYLE

SEQ ID NO: 2536664 - protein, 17 aa, Entamoeba dispar
QEKALIIPLQAISTANI

SEQ ID NO: 2536665 - protein, 17 aa, Entamoeba dispar
QEKALIIPLQAISTANL

SEQ ID NO: 2536666 - protein, 17 aa, Entamoeba dispar
QEKELFPTLGEGRNLPI

SEQ ID NO: 2536667 - protein, 26 aa, Entamoeba dispar
QEKFRSMIDLYFRKAVGAFIVYDVML

SEQ ID NO: 2536668 - protein, 25 aa, Entamoeba dispar
QEKQEWLDKLLFLKDKYKPKEHWID

SEQ ID NO: 2536669 - protein, 22 aa, Entamoeba dispar
QEKQFQFFDYVFSSAKQIAGLF

SEQ ID NO: 2536670 - protein, 17 aa, Entamoeba dispar
QEKQTIPRLIPTSAIDS

SEQ ID NO: 2536671 - protein, 19 aa, Entamoeba dispar
QEKRNLLTKSILEGEILTK

SEQ ID NO: 2536672 - protein, 24 aa, Entamoeba dispar
QEKYIAMTRVYYNGAHGAIIMYDL

SEQ ID NO: 2536673 - protein, 18 aa, Entamoeba dispar
QELIPLIHTFDGKSIPPK

SEQ ID NO: 2536674 - protein, 17 aa, Entamoeba dispar
QELISHIFVIDPEQRYS

SEQ ID NO: 2536675 - protein, 23 aa, Entamoeba dispar
QELKELIPVIPKKSMGYIEMKLM

SEQ ID NO: 2536676 - protein, 17 aa, Entamoeba dispar
QELLEKFLFVAIEDFSG

SEQ ID NO: 2536677 - protein, 21 aa, Entamoeba dispar
QELLWVLHCIYQKVLISRSKT

SEQ ID NO: 2536678 - protein, 30 aa, Entamoeba dispar
QELSNDFINLLKLKLALLEELPFGEIDINE

SEQ ID NO: 2536679 - protein, 22 aa, Entamoeba dispar
QELTATIPVSDSWIGKVVLDNA

SEQ ID NO: 2536680 - protein, 19 aa, Entamoeba dispar
QEMTYYKERYGESDYVLMF

SEQ ID NO: 2536681 - protein, 30 aa, Entamoeba dispar
QEMVLLSLLNQYFNITLRIPPKKASVYGQI

SEQ ID NO: 2536682 - protein, 20 aa, Entamoeba dispar
QEMWDRWICFIQQTTKSHWE

SEQ ID NO: 2536683 - protein, 29 aa, Entamoeba dispar
QEMYKSVALQFLTRELPLFKKNIESIDTI

SEQ ID NO: 2536684 - protein, 44 aa, Entamoeba dispar
QENHLRIEEQFKLLKSYVDKFNDKKWLCLMKEEEQIELLATIVV

SEQ ID NO: 2536685 - protein, 22 aa, Entamoeba dispar
QENIWTDIPFNSFRKVLATMEP

SEQ ID NO: 2536686 - protein, 18 aa, Entamoeba dispar
QENIYGEIPFTSFRKVLK

SEQ ID NO: 2536687 - protein, 17 aa, Entamoeba dispar
QENIYTFQNLELLRLDY

SEQ ID NO: 2536688 - protein, 25 aa, Entamoeba dispar
QENKQLKEPPLLPPKPKRLQKEEQL

SEQ ID NO: 2536689 - protein, 30 aa, Entamoeba dispar
QENNLFQSVAIPQAYRNQMFQCSIPCIDGD

SEQ ID NO: 2536690 - protein, 26 aa, Entamoeba dispar
QEQETIIPISLTKFLRINTPTTKLLS

SEQ ID NO: 2536691 - protein, 24 aa, Entamoeba dispar
QEQPLLLAKIKLNNAMKKITIGAN

SEQ ID NO: 2536692 - protein, 32 aa, Entamoeba dispar
QEQTKRASFMNYLWRGYSVDGLPQNVSQDLST

SEQ ID NO: 2536693 - protein, 24 aa, Entamoeba dispar
QEQVFTKWINSLISQKGIINNIKT

SEQ ID NO: 2536694 - protein, 25 aa, Entamoeba dispar
QEQYEHFFFDLYTLCSGFGQVVDMI

SEQ ID NO: 2536695 - protein, 20 aa, Entamoeba dispar
QERFRTITSSYYRGAQGIIV

SEQ ID NO: 2536696 - protein, 29 aa, Entamoeba dispar
QERPELLFELFNPLYQYKDPAISLAGIRP

SEQ ID NO: 2536697 - protein, 24 aa, Entamoeba dispar
QERPIHIFNNYFSIGLDAAIALVF

SEQ ID NO: 2536698 - protein, 22 aa, Entamoeba dispar
QERYRAITNAYYRGAVGALVVY

SEQ ID NO: 2536699 - protein, 24 aa, Entamoeba dispar
QESFDALQQLYLNIKKYGSHDMSL

SEQ ID NO: 2536700 - protein, 17 aa, Entamoeba dispar
QESIKPFFLRRMKNEVE

SEQ ID NO: 2536701 - protein, 24 aa, Entamoeba dispar
QESKNLLWGIINDPTIRSYPILVW

SEQ ID NO: 2536702 - protein, 38 aa, Entamoeba dispar
QESKSLRAYFFCILLKIFRVYMKIARYQTIGLGLSERV

SEQ ID NO: 2536703 - protein, 19 aa, Entamoeba dispar
QESLLLLNLEREFYTRLNQ

SEQ ID NO: 2536704 - protein, 22 aa, Entamoeba dispar
QESLPPPIVLDQPLEEVPSKRV

SEQ ID NO: 2536705 - protein, 27 aa, Entamoeba dispar
QETFSNELVIFLINGNRFAIPRSCLQK

SEQ ID NO: 2536706 - protein, 33 aa, Entamoeba dispar
QETLNLNKPLHFTSRYLYLTLWGDEVKNELQFK

SEQ ID NO: 2536707 - protein, 25 aa, Entamoeba dispar
QETPIMHTAPPRGMPPRGGPRGAPS

SEQ ID NO: 2536708 - protein, 24 aa, Entamoeba dispar
QETPYAPPIIAQPADDTLSDAEVQ

SEQ ID NO: 2536709 - protein, 24 aa, Entamoeba dispar
QETPYAPPIIAQPADDTLSDAEVS

SEQ ID NO: 2536710 - protein, 17 aa, Entamoeba dispar
QETRAVLTPSKLIDFIV

SEQ ID NO: 2536711 - protein, 25 aa, Entamoeba dispar
QETTQTGLFSYFFGKTDEYDEPPKY

SEQ ID NO: 2536712 - protein, 34 aa, Entamoeba dispar
QEVKELYKLFPKLFTLWISFYEFRKVFVQFILVI

SEQ ID NO: 2536713 - protein, 17 aa, Entamoeba dispar
QEVMLNRQRLLTQKNEN

SEQ ID NO: 2536714 - protein, 22 aa, Entamoeba dispar
QEVQLFIKFIEPNKNEYKIREE

SEQ ID NO: 2536715 - protein, 20 aa, Entamoeba dispar
QEWLEKIPEGLGLLAEDIPD

SEQ ID NO: 2536716 - protein, 21 aa, Entamoeba dispar
QEWLEKIPEGLGLLAEDIPDF

SEQ ID NO: 2536717 - protein, 20 aa, Entamoeba dispar
QEYIALLIQDMQTYYSCNEF

SEQ ID NO: 2536718 - protein, 23 aa, Entamoeba dispar
QEYMTELATEFLSFIASEAADVP

SEQ ID NO: 2536719 - protein, 23 aa, Entamoeba dispar
QEYMTFIFPEGFQGSIVLNGTEC

SEQ ID NO: 2536720 - protein, 20 aa, Entamoeba dispar
QEYWELWNCKSTCAIQLIQT

SEQ ID NO: 2536721 - protein, 19 aa, Entamoeba dispar
QEYWKQSKSALFLLYCSDP

SEQ ID NO: 2536722 - protein, 18 aa, Entamoeba dispar
QFALLQCVLNKFLCSFEK

SEQ ID NO: 2536723 - protein, 17 aa, Entamoeba dispar
QFCKELQKAQPICKDPR

SEQ ID NO: 2536724 - protein, 18 aa, Entamoeba dispar
QFCRVSIVTKPSISPFPP

SEQ ID NO: 2536725 - protein, 23 aa, Entamoeba dispar
QFDIMIQDILNLTSKKKSTLYLV

SEQ ID NO: 2536726 - protein, 19 aa, Entamoeba dispar
QFDLLIEVAARMAEDHFRI

SEQ ID NO: 2536727 - protein, 19 aa, Entamoeba dispar
QFECLICLDTAHNAVVTQC

SEQ ID NO: 2536728 - protein, 30 aa, Entamoeba dispar
QFELNVMEPVMFYDLLTSLEIMKNAFFTFR

SEQ ID NO: 2536729 - protein, 30 aa, Entamoeba dispar
QFEPEKSYFYIMRNCDMLRFLDSNNTPMFA

SEQ ID NO: 2536730 - protein, 34 aa, Entamoeba dispar
QFEPEKSYFYIMRNCNMLRFLDSNNTALFASTMK

SEQ ID NO: 2536731 - protein, 19 aa, Entamoeba dispar
QFESYIIVMINNKNDRYLE

SEQ ID NO: 2536732 - protein, 19 aa, Entamoeba dispar
QFFFESFQPVYSLVSVLHE

SEQ ID NO: 2536733 - protein, 17 aa, Entamoeba dispar
QFFKIIEIAQNIKICQK

SEQ ID NO: 2536734 - protein, 29 aa, Entamoeba dispar
QFGGPKFMKMLKQHKPKFMLGTPRIYEKI

SEQ ID NO: 2536735 - protein, 18 aa, Entamoeba dispar
QFGGRPYNPPIPDESLQN

SEQ ID NO: 2536736 - protein, 19 aa, Entamoeba dispar
QFGIIKPTKIQQLCIPPLL

SEQ ID NO: 2536737 - protein, 26 aa, Entamoeba dispar
QFHENCQIWYSVIPTEIVNHYMAMAG

SEQ ID NO: 2536738 - protein, 19 aa, Entamoeba dispar
QFIEIENPFLLLKPELKYD

SEQ ID NO: 2536739 - protein, 22 aa, Entamoeba dispar
QFIIKNNLKLHHKGMEYVFTIF

SEQ ID NO: 2536740 - protein, 20 aa, Entamoeba dispar
QFILQQFSFAISRSKVLCPI

SEQ ID NO: 2536741 - protein, 26 aa, Entamoeba dispar
QFINCKFYTRIFTNLTINLPSLPSLP

SEQ ID NO: 2536742 - protein, 25 aa, Entamoeba dispar
QFIQKKMMLISWMESILKVPINPDL

SEQ ID NO: 2536743 - protein, 20 aa, Entamoeba dispar
QFISEDRIFMNEPVLVSVQI

SEQ ID NO: 2536744 - protein, 19 aa, Entamoeba dispar
QFISEKRIFMNEPVLVSIE

SEQ ID NO: 2536745 - protein, 20 aa, Entamoeba dispar
QFISEKRIFMNEPVLVSIKI

SEQ ID NO: 2536746 - protein, 33 aa, Entamoeba dispar
QFISKERIFINEPLLFSIKIPKTLQIINGKNIE

SEQ ID NO: 2536747 - protein, 19 aa, Entamoeba dispar
QFISKKRIFMNEPVLVSIE

SEQ ID NO: 2536748 - protein, 19 aa, Entamoeba dispar
QFITILQHIIPNEKLNILL

SEQ ID NO: 2536749 - protein, 26 aa, Entamoeba dispar
QFIYNVDPCIPWHISAFHPDYLMDTT

SEQ ID NO: 2536750 - protein, 22 aa, Entamoeba dispar
QFKDHYWGIMPKKVIDCLAEVK

SEQ ID NO: 2536751 - protein, 23 aa, Entamoeba dispar
QFKLYDDLLVLYLHSSQKSPEIV

SEQ ID NO: 2536752 - protein, 30 aa, Entamoeba dispar
QFKQQNVMNLYLRILLRKTGDHSKKCIEID

SEQ ID NO: 2536753 - protein, 23 aa, Entamoeba dispar
QFKRDICWVFANLASENIKLRDE

SEQ ID NO: 2536754 - protein, 21 aa, Entamoeba dispar
QFKSKYIEILGCLISSNSLMV

SEQ ID NO: 2536755 - protein, 20 aa, Entamoeba dispar
QFLLQNATKIGLTQTQIVIL

SEQ ID NO: 2536756 - protein, 17 aa, Entamoeba dispar
QFLQIMTLDPFYTSNSP

SEQ ID NO: 2536757 - protein, 24 aa, Entamoeba dispar
QFMEDYIAFTPYICDFQTTFENFT

SEQ ID NO: 2536758 - protein, 19 aa, Entamoeba dispar
QFMRIFPKEFEFNETFLIE

SEQ ID NO: 2536759 - protein, 20 aa, Entamoeba dispar
QFNFLKLKCNSINLTCVECN

SEQ ID NO: 2536760 - protein, 27 aa, Entamoeba dispar
QFNHLPFYSMISPLKLMKCSFPNLPAD

SEQ ID NO: 2536761 - protein, 19 aa, Entamoeba dispar
QFNIINIYSTLFQKYKSDK

SEQ ID NO: 2536762 - protein, 26 aa, Entamoeba dispar
QFNKNDVVLLTNLFYTFLESSQSEKQ

SEQ ID NO: 2536763 - protein, 17 aa, Entamoeba dispar
QFNLYCTWMAKPRNQFK

SEQ ID NO: 2536764 - protein, 21 aa, Entamoeba dispar
QFNWSTLYMRQDTAVSAVAEE

SEQ ID NO: 2536765 - protein, 21 aa, Entamoeba dispar
QFNYYLGRLQDYFLQHKQNII

SEQ ID NO: 2536766 - protein, 18 aa, Entamoeba dispar
QFPPMQSPIDILLGKEDC

SEQ ID NO: 2536767 - protein, 17 aa, Entamoeba dispar
QFQKYVLGCYRKQFMKQ

SEQ ID NO: 2536768 - protein, 18 aa, Entamoeba dispar
QFQNDCILIFKICDVKDP

SEQ ID NO: 2536769 - protein, 25 aa, Entamoeba dispar
QFQNYILAILIKYPQFIRQYIDWVI

SEQ ID NO: 2536770 - protein, 23 aa, Entamoeba dispar
QFQSYFERIISNANLRNEKSPFA

SEQ ID NO: 2536771 - protein, 22 aa, Entamoeba dispar
QFSLVVYLSYFMNYAKKVPRKH

SEQ ID NO: 2536772 - protein, 19 aa, Entamoeba dispar
QFSNYLDMLLSIPTNSVCA

SEQ ID NO: 2536773 - protein, 19 aa, Entamoeba dispar
QFTLFNIFSTAFLNEKKCN

SEQ ID NO: 2536774 - protein, 21 aa, Entamoeba dispar
QFTSFINWIKEINFVRVVLII

SEQ ID NO: 2536775 - protein, 19 aa, Entamoeba dispar
QFTSPFRDKNYTCPSWVDT

SEQ ID NO: 2536776 - protein, 26 aa, Entamoeba dispar
QFTYMEASIFYKLEPSEFFGQAWAKA

SEQ ID NO: 2536777 - protein, 19 aa, Entamoeba dispar
QFVIQTFVNKQYDASLHAI

SEQ ID NO: 2536778 - protein, 20 aa, Entamoeba dispar
QFVITRDLIDLILEQYPMSP

SEQ ID NO: 2536779 - protein, 26 aa, Entamoeba dispar
QFVSENRIFLNEPILLSIRIPENIKE

SEQ ID NO: 2536780 - protein, 21 aa, Entamoeba dispar
QFYDILIGLLLIELDKRKIIN

SEQ ID NO: 2536781 - protein, 17 aa, Entamoeba dispar
QFYHRFGFETSTKYGIK

SEQ ID NO: 2536782 - protein, 28 aa, Entamoeba dispar
QGCEPKIFAELFNLRIVVKRGNYKDTIV

SEQ ID NO: 2536783 - protein, 29 aa, Entamoeba dispar
QGCQYHGIVPYFFLVERKAVIQYASVESV

SEQ ID NO: 2536784 - protein, 39 aa, Entamoeba dispar
QGDFAIIEFGKKMKFKWYKLKIPSFITSACVLKKMLHVG

SEQ ID NO: 2536785 - protein, 26 aa, Entamoeba dispar
QGDKTLINWFKIRGIGNLIKELMVKQ

SEQ ID NO: 2536786 - protein, 27 aa, Entamoeba dispar
QGEEFPLQGMTLVLRHLALEGDQKTSV

SEQ ID NO: 2536787 - protein, 21 aa, Entamoeba dispar
QGENVLMKTLLEKSYQLFHAI

SEQ ID NO: 2536788 - protein, 27 aa, Entamoeba dispar
QGFKDQMYTILKSLPSTVQVGMFSATM

SEQ ID NO: 2536789 - protein, 23 aa, Entamoeba dispar
QGFLKEMLLWFGWEEIESTPPAT

SEQ ID NO: 2536790 - protein, 20 aa, Entamoeba dispar
QGFVNFFPMNKRPHVFCFDE

SEQ ID NO: 2536791 - protein, 26 aa, Entamoeba dispar
QGIAELIPGVLFIDEIHMLDAECFAF

SEQ ID NO: 2536792 - protein, 17 aa, Entamoeba dispar
QGIGGMRIVLLDIINRY

SEQ ID NO: 2536793 - protein, 17 aa, Entamoeba dispar
QGITLRGFKHFYAFCRQ

SEQ ID NO: 2536794 - protein, 19 aa, Entamoeba dispar
QGIVLTMDFNNFRLSHNLK

SEQ ID NO: 2536795 - protein, 17 aa, Entamoeba dispar
QGKAVFDLSPEKKPFFG

SEQ ID NO: 2536796 - protein, 26 aa, Entamoeba dispar
QGKEKLCFEIFYDKVYTFCCPSQIEF

SEQ ID NO: 2536797 - protein, 25 aa, Entamoeba dispar
QGKFGNVYLVKYKKYDYVCALKVVF

SEQ ID NO: 2536798 - protein, 32 aa, Entamoeba dispar
QGLFFKPKEDWFFYAFSKFYFEAALKFSDKFP

SEQ ID NO: 2536799 - protein, 18 aa, Entamoeba dispar
QGLHYLLRGEKIFHRDLK

SEQ ID NO: 2536800 - protein, 17 aa, Entamoeba dispar
QGLKILNLSDCHLYEVP

SEQ ID NO: 2536801 - protein, 19 aa, Entamoeba dispar
QGMIFLGKDLLMSCEEKIV

SEQ ID NO: 2536802 - protein, 24 aa, Entamoeba dispar
QGNEVFWLGCLIQFRKELVRNDTL

SEQ ID NO: 2536803 - protein, 24 aa, Entamoeba dispar
QGNGFYILFKEGFVCIRFELFGNG

SEQ ID NO: 2536804 - protein, 30 aa, Entamoeba dispar
QGNMEKLHFNPFPLNYYSRKLFPNIETFHI

SEQ ID NO: 2536805 - protein, 30 aa, Entamoeba dispar
QGNMEQFHFNPFPLNYYSRKLLPNIETFHI

SEQ ID NO: 2536806 - protein, 29 aa, Entamoeba dispar
QGNMERFHFNPIPLNEYSRKLFPNIETFH

SEQ ID NO: 2536807 - protein, 30 aa, Entamoeba dispar
QGNMERFHFNPIPLNYYSRRFFPNIETFHI

SEQ ID NO: 2536808 - protein, 19 aa, Entamoeba dispar
QGPMLMPVTQPPSLQQSQQ

SEQ ID NO: 2536809 - protein, 24 aa, Entamoeba dispar
QGRVALIGTLFKKSKKIPTLLNQY

SEQ ID NO: 2536810 - protein, 17 aa, Entamoeba dispar
QGSFRVSIIFGDKNKWG

SEQ ID NO: 2536811 - protein, 23 aa, Entamoeba dispar
QGTESSSHFAHYSESSLMATDCS

SEQ ID NO: 2536812 - protein, 21 aa, Entamoeba dispar
QGTFLYPKEPWWDGYFKSETE

SEQ ID NO: 2536813 - protein, 22 aa, Entamoeba dispar
QGTMWWIQRELDEKKKYMPMRK

SEQ ID NO: 2536814 - protein, 31 aa, Entamoeba dispar
QGTTRLMLTEIPYFRDILLAHFQCPYCHYEN

SEQ ID NO: 2536815 - protein, 24 aa, Entamoeba dispar
QGTVALIGTLFKKSKKIPTLLNQY

SEQ ID NO: 2536816 - protein, 24 aa, Entamoeba dispar
QGVQAIVIVLNFNKEVLSENIKTM

SEQ ID NO: 2536817 - protein, 19 aa, Entamoeba dispar
QGVTLRKGYKKRTVQLVLL

SEQ ID NO: 2536818 - protein, 19 aa, Entamoeba dispar
QGYFPILQQNFHTKQNTLN

SEQ ID NO: 2536819 - protein, 23 aa, Entamoeba dispar
QHDNYPYLIILQDPREAKVKLNT

SEQ ID NO: 2536820 - protein, 17 aa, Entamoeba dispar
QHEFRILYDTDQQPFLQ

SEQ ID NO: 2536821 - protein, 17 aa, Entamoeba dispar
QHEPIQHTSPRQSPKKR

SEQ ID NO: 2536822 - protein, 23 aa, Entamoeba dispar
QHEYCMLLVDLIEFAFYVIFHEG

SEQ ID NO: 2536823 - protein, 20 aa, Entamoeba dispar
QHFNTWWFSQYLNYKKEWTE

SEQ ID NO: 2536824 - protein, 25 aa, Entamoeba dispar
QHGDDAYFFIPNPTQFKLKRIIAFE

SEQ ID NO: 2536825 - protein, 25 aa, Entamoeba dispar
QHGLDKIVVLWTATTERYVEIKEGL

SEQ ID NO: 2536826 - protein, 22 aa, Entamoeba dispar
QHGLTAFTYLRMTRGLLDDGNV

SEQ ID NO: 2536827 - protein, 19 aa, Entamoeba dispar
QHHYPTLMSSIKKSKTLPK

SEQ ID NO: 2536828 - protein, 24 aa, Entamoeba dispar
QHIKKPLFHSNFTSKLVLGKKSIT

SEQ ID NO: 2536829 - protein, 28 aa, Entamoeba dispar
QHILHPEDLLPFLRKPMLLIIDSDKQNS

SEQ ID NO: 2536830 - protein, 17 aa, Entamoeba dispar
QHKELIFTISKLSPKCP

SEQ ID NO: 2536831 - protein, 29 aa, Entamoeba dispar
QHKNKLEIIIPTFKNLTSKKQIIKPYVVC

SEQ ID NO: 2536832 - protein, 19 aa, Entamoeba dispar
QHLLNDIFITHIDYNQLKQ

SEQ ID NO: 2536833 - protein, 25 aa, Entamoeba dispar
QHNNLKFLSLHNIPLLSKIIIPQRL

SEQ ID NO: 2536834 - protein, 29 aa, Entamoeba dispar
QHNQLELPPLTFCYLLKPGEDVIKVDGLE

SEQ ID NO: 2536835 - protein, 23 aa, Entamoeba dispar
QHPGVFPFFIKTECSNQVNFISE

SEQ ID NO: 2536836 - protein, 18 aa, Entamoeba dispar
QHPKLRRGFETKVFKRFS

SEQ ID NO: 2536837 - protein, 29 aa, Entamoeba dispar
QHQKSMILLIVIWLYHKVQLDMHLNFLRE

SEQ ID NO: 2536838 - protein, 32 aa, Entamoeba dispar
QHQRANALKWIIQLLLHDCPITEKIRIVDFKA

SEQ ID NO: 2536839 - protein, 32 aa, Entamoeba dispar
QHSLSYFYQGQVNDLWLPLSKKGQIHIQVFSP

SEQ ID NO: 2536840 - protein, 26 aa, Entamoeba dispar
QHTEFYELSKFFLKVKLNGLSTVYPQ

SEQ ID NO: 2536841 - protein, 21 aa, Entamoeba dispar
QIAKMRFLCKKGALFFATLKR

SEQ ID NO: 2536842 - protein, 23 aa, Entamoeba dispar
QIAVQLIFYAHFDENWEGNITTD

SEQ ID NO: 2536843 - protein, 18 aa, Entamoeba dispar
QIAYVCRETLRALNFIHG

SEQ ID NO: 2536844 - protein, 18 aa, Entamoeba dispar
QICELRQMILKSSEKKPL

SEQ ID NO: 2536845 - protein, 19 aa, Entamoeba dispar
QICLPSEKQDWKSFLFPFA

SEQ ID NO: 2536846 - protein, 22 aa, Entamoeba dispar
QICWLKLKIYNTFVLPIDAGDN

SEQ ID NO: 2536847 - protein, 26 aa, Entamoeba dispar
QIDDYYLMPIVMDYLQILTLNECGNI

SEQ ID NO: 2536848 - protein, 30 aa, Entamoeba dispar
QIDFQVGSCLRVKQFSLPSPVLNKEMAQQI

SEQ ID NO: 2536849 - protein, 27 aa, Entamoeba dispar
QIDHYSKKLIFILKIQFEEELEEGQCQ

SEQ ID NO: 2536850 - protein, 26 aa, Entamoeba dispar
QIDIRYAFSITNLLPRTIYIGNKEET

SEQ ID NO: 2536851 - protein, 22 aa, Entamoeba dispar
QIDKLLPTLKATEKQIIFVCYN

SEQ ID NO: 2536852 - protein, 19 aa, Entamoeba dispar
QIDLFKEGFYSIIPFEMIN

SEQ ID NO: 2536853 - protein, 36 aa, Entamoeba dispar
QIDMVYIKNLIEQYLQYYYTYQQIIFELEKKGISKD

SEQ ID NO: 2536854 - protein, 25 aa, Entamoeba dispar
QIDVTFWHEFTRRKLEIFKLSEKVI

SEQ ID NO: 2536855 - protein, 17 aa, Entamoeba dispar
QIEDLTIFLVGSGAIGC

SEQ ID NO: 2536856 - protein, 25 aa, Entamoeba dispar
QIEEKLYLPQLYQDFLEYINKPQDK

SEQ ID NO: 2536857 - protein, 32 aa, Entamoeba dispar
QIEFDEWMSTLPLLTKVYGTFKYPLGCAVSKS

SEQ ID NO: 2536858 - protein, 19 aa, Entamoeba dispar
QIEHYIIVVLTSHSVDDYT

SEQ ID NO: 2536859 - protein, 27 aa, Entamoeba dispar
QIEIYERRTNILLQNYNKFHETNERLQ

SEQ ID NO: 2536860 - protein, 26 aa, Entamoeba dispar
QIEKNTMFLLKEINYCILFDSHLLLS

SEQ ID NO: 2536861 - protein, 24 aa, Entamoeba dispar
QIEKSLLQLVTIKAAKRISHLDIS

SEQ ID NO: 2536862 - protein, 25 aa, Entamoeba dispar
QIELLATIVVQYKLSHQQVYEKSVI

SEQ ID NO: 2536863 - protein, 21 aa, Entamoeba dispar
QIELMINILPTLIQYTNDLNT

SEQ ID NO: 2536864 - protein, 25 aa, Entamoeba dispar
QIENRGIAFVTFYDIRDAIKAHEEL

SEQ ID NO: 2536865 - protein, 27 aa, Entamoeba dispar
QIEQLLKLHTLFYKKLTDRIDQAGDDI

SEQ ID NO: 2536866 - protein, 28 aa, Entamoeba dispar
QIESVNTVFLIYELFPRNLSESIKSGRI

SEQ ID NO: 2536867 - protein, 27 aa, Entamoeba dispar
QIEVNQVQLLINKFSQNQNVSEGECFI

SEQ ID NO: 2536868 - protein, 17 aa, Entamoeba dispar
QIEYSLLNQLNSLDSQT

SEQ ID NO: 2536869 - protein, 20 aa, Entamoeba dispar
QIFDTDPYLVIDKSFRCLRT

SEQ ID NO: 2536870 - protein, 24 aa, Entamoeba dispar
QIFKELLEKTYYPMKGREIQPNED

SEQ ID NO: 2536871 - protein, 17 aa, Entamoeba dispar
QIFYIPSAEIHTTTIIP

SEQ ID NO: 2536872 - protein, 26 aa, Entamoeba dispar
QIGDKHFIISLFNKPIHKDNCIYVTN

SEQ ID NO: 2536873 - protein, 24 aa, Entamoeba dispar
QIGGDLIIVMYDVTRITTVTYAQN

SEQ ID NO: 2536874 - protein, 18 aa, Entamoeba dispar
QIGICWKELLIVPSEVVD

SEQ ID NO: 2536875 - protein, 31 aa, Entamoeba dispar
QIGLKSDEFFPFGDTALIKNNLKPSPSPQID

SEQ ID NO: 2536876 - protein, 22 aa, Entamoeba dispar
QIHFHKLLPPYTSLLNISDIAQ

SEQ ID NO: 2536877 - protein, 21 aa, Entamoeba dispar
QIHFPKLEWLDLSYNSINVLE

SEQ ID NO: 2536878 - protein, 23 aa, Entamoeba dispar
QIHKKYILMGLLFEIASIIIKNE

SEQ ID NO: 2536879 - protein, 25 aa, Entamoeba dispar
QIHRRSQLYKVLFPSSIKTPLNTRK

SEQ ID NO: 2536880 - protein, 17 aa, Entamoeba dispar
QIHTLFDCFPLAALIEG

SEQ ID NO: 2536881 - protein, 17 aa, Entamoeba dispar
QIIDCTLDPIWNEKFDV

SEQ ID NO: 2536882 - protein, 18 aa, Entamoeba dispar
QIIIREGLLTQILQYLPI

SEQ ID NO: 2536883 - protein, 23 aa, Entamoeba dispar
QIIKNHFISLLLVFMNDPTDYEY

SEQ ID NO: 2536884 - protein, 35 aa, Entamoeba dispar
QIIKQVFSSLFFLRYCFLPLVKYPSLLKILQKGVS

SEQ ID NO: 2536885 - protein, 18 aa, Entamoeba dispar
QIINNIQFLGFSFPINED

SEQ ID NO: 2536886 - protein, 20 aa, Entamoeba dispar
QIIQLKNQFLIEKKQMMEKQ

SEQ ID NO: 2536887 - protein, 23 aa, Entamoeba dispar
QIIQVPPIGVIDLFIKTYSSSIK

SEQ ID NO: 2536888 - protein, 24 aa, Entamoeba dispar
QIIYTCFIGFRYYFDRDELISMDE

SEQ ID NO: 2536889 - protein, 17 aa, Entamoeba dispar
QIKAFTKETFYKINCVV

SEQ ID NO: 2536890 - protein, 24 aa, Entamoeba dispar
QIKDFFISEYVWVSTLIHLNPQHE

SEQ ID NO: 2536891 - protein, 23 aa, Entamoeba dispar
QIKDGILMLKAMKEVYQKLEEIR

SEQ ID NO: 2536892 - protein, 36 aa, Entamoeba dispar
QIKEFIKTLPEPNLFVFKYLFMFLTKVMAESKINKM

SEQ ID NO: 2536893 - protein, 17 aa, Entamoeba dispar
QIKFLMHSELNKGIFSI

SEQ ID NO: 2536894 - protein, 34 aa, Entamoeba dispar
QIKGHQWFTGIDWDLLLQKKVPVPWKPKVSGADD

SEQ ID NO: 2536895 - protein, 23 aa, Entamoeba dispar
QIKHVVLYCIDKMTLHVDNGSLY

SEQ ID NO: 2536896 - protein, 25 aa, Entamoeba dispar
QIKIIDRKAFCFKTPQGCFVTPTVI

SEQ ID NO: 2536897 - protein, 23 aa, Entamoeba dispar
QIKKPIYIVALPRSGSTFTHTVL

SEQ ID NO: 2536898 - protein, 24 aa, Entamoeba dispar
QIKLKEKIIPLLERIEAETFDESI

SEQ ID NO: 2536899 - protein, 33 aa, Entamoeba dispar
QIKMLYIPFHQIFNFPYDLFNEKLLISFTCPTL

SEQ ID NO: 2536900 - protein, 17 aa, Entamoeba dispar
QIKPVVVEFLKQNPTYF

SEQ ID NO: 2536901 - protein, 20 aa, Entamoeba dispar
QIKRICHFCATASRLRTMKF

SEQ ID NO: 2536902 - protein, 30 aa, Entamoeba dispar
QIKRVHRQIFFYYNSFNIIIGKQGAGKTTF

SEQ ID NO: 2536903 - protein, 31 aa, Entamoeba dispar
QIKRVHRQIFFYYNSFNIIIGKQGAGKTTFI

SEQ ID NO: 2536904 - protein, 23 aa, Entamoeba dispar
QIKSFSFQLIRSLTYIHSLGICH

SEQ ID NO: 2536905 - protein, 17 aa, Entamoeba dispar
QIKSYPLFARHLNHIFI

SEQ ID NO: 2536906 - protein, 19 aa, Entamoeba dispar
QIKVISYLIDPLTIDFILK

SEQ ID NO: 2536907 - protein, 21 aa, Entamoeba dispar
QILIVLKQWMQSYPNDFSLLG

SEQ ID NO: 2536908 - protein, 24 aa, Entamoeba dispar
QILKELFPDFKEKSMAPIRGEPIY

SEQ ID NO: 2536909 - protein, 17 aa, Entamoeba dispar
QILRIMYTMLKNAELDI

SEQ ID NO: 2536910 - protein, 31 aa, Entamoeba dispar
QIMPKCTLAGFNWFNAYYTPGVSRISTNIRD

SEQ ID NO: 2536911 - protein, 17 aa, Entamoeba dispar
QINDIIVRLPKIEQNKL

SEQ ID NO: 2536912 - protein, 19 aa, Entamoeba dispar
QINDTMNIPFVPPSMNSPL

SEQ ID NO: 2536913 - protein, 27 aa, Entamoeba dispar
QINFNELPLLSKVNILLSYSVPKNLKK

SEQ ID NO: 2536914 - protein, 24 aa, Entamoeba dispar
QINGLPLFLHHFRIKFGECAKFMD

SEQ ID NO: 2536915 - protein, 19 aa, Entamoeba dispar
QINICVLTLVITFTSIRRI

SEQ ID NO: 2536916 - protein, 21 aa, Entamoeba dispar
QINKFLFNLVSSVVDPIVISN

SEQ ID NO: 2536917 - protein, 31 aa, Entamoeba dispar
QINYSFIPIIKQMMFIEIGLTKILEGMIKST

SEQ ID NO: 2536918 - protein, 19 aa, Entamoeba dispar
QIPELPEKFSLLTNLEILE

SEQ ID NO: 2536919 - protein, 18 aa, Entamoeba dispar
QIPIIPKKSPEQFLKSSL

SEQ ID NO: 2536920 - protein, 18 aa, Entamoeba dispar
QIPTLPNPMLVYSSAQMH

SEQ ID NO: 2536921 - protein, 30 aa, Entamoeba dispar
QIPVQPIPNYTYPQPVYLVKYYDGMYDVPL

SEQ ID NO: 2536922 - protein, 25 aa, Entamoeba dispar
QIPWRSPDIFYKKNQLFLDVIESVN

SEQ ID NO: 2536923 - protein, 18 aa, Entamoeba dispar
QIQENLNILLGLVKSCYG

SEQ ID NO: 2536924 - protein, 17 aa, Entamoeba dispar
QIQFFINTKTTPTTNRK

SEQ ID NO: 2536925 - protein, 20 aa, Entamoeba dispar
QIQFSIQIISIENIKYLKII

SEQ ID NO: 2536926 - protein, 18 aa, Entamoeba dispar
QIQLMNYIPLIFTQTFSL

SEQ ID NO: 2536927 - protein, 23 aa, Entamoeba dispar
QIQPDQFWYLIDAHFKENGLVKQ

SEQ ID NO: 2536928 - protein, 23 aa, Entamoeba dispar
QIQRVLKIYENKLDTMKFNEPTE

SEQ ID NO: 2536929 - protein, 28 aa, Entamoeba dispar
QIQTKYFQFISQLAFSLPIILTQQQQQF

SEQ ID NO: 2536930 - protein, 24 aa, Entamoeba dispar
QIREHSKFPGIYIASGKEEQLLTI

SEQ ID NO: 2536931 - protein, 18 aa, Entamoeba dispar
QIRKVLVNMLKYINPGTG

SEQ ID NO: 2536932 - protein, 19 aa, Entamoeba dispar
QISFLKRKYTKSSFDLKFT

SEQ ID NO: 2536933 - protein, 21 aa, Entamoeba dispar
QISIRYYLSKGILKRTIFAIK

SEQ ID NO: 2536934 - protein, 17 aa, Entamoeba dispar
QISMIKFGIKTEQEQIT

SEQ ID NO: 2536935 - protein, 22 aa, Entamoeba dispar
QISYFIISEIIYQMLLGEYENN

SEQ ID NO: 2536936 - protein, 23 aa, Entamoeba dispar
QITFAGNCLMSFPVALTSISSLS

SEQ ID NO: 2536937 - protein, 23 aa, Entamoeba dispar
QITGLDFGVLLPVVEWLMTKVEE

SEQ ID NO: 2536938 - protein, 31 aa, Entamoeba dispar
QITKKQINILNSLYLPIIRYKTIITNQVTNQ

SEQ ID NO: 2536939 - protein, 20 aa, Entamoeba dispar
QITLPTFLSNLIILQSRYFA

SEQ ID NO: 2536940 - protein, 20 aa, Entamoeba dispar
QITMKLLKSHKNLVTCVAWH

SEQ ID NO: 2536941 - protein, 27 aa, Entamoeba dispar
QITQKYNYYIFKVKIKPQFNEELVNIH

SEQ ID NO: 2536942 - protein, 20 aa, Entamoeba dispar
QITRRSPLIGYKSFGYTPSF

SEQ ID NO: 2536943 - protein, 26 aa, Entamoeba dispar
QITSNEMFLFVLNGKGAYPFKLERKD

SEQ ID NO: 2536944 - protein, 17 aa, Entamoeba dispar
QIVLAVSPLKDLVDDFK

SEQ ID NO: 2536945 - protein, 17 aa, Entamoeba dispar
QIVLYGLVYWFRIWDHE

SEQ ID NO: 2536946 - protein, 24 aa, Entamoeba dispar
QIVNIIIPKLYCNGALDGDEVSIS

SEQ ID NO: 2536947 - protein, 26 aa, Entamoeba dispar
QIVSSLFGIIRYLISYEGIQIEFMVL

SEQ ID NO: 2536948 - protein, 24 aa, Entamoeba dispar
QIVVIQIVNLLQYLSLNGISYGHL

SEQ ID NO: 2536949 - protein, 18 aa, Entamoeba dispar
QIYCVDLKRLGVIDEIID

SEQ ID NO: 2536950 - protein, 19 aa, Entamoeba dispar
QIYPTRPIPHPPSTGHLKY

SEQ ID NO: 2536951 - protein, 17 aa, Entamoeba dispar
QKALAKILKCNIALFVL

SEQ ID NO: 2536952 - protein, 30 aa, Entamoeba dispar
QKDENGLPILMYRVKWLGKELFLSDELSSF

SEQ ID NO: 2536953 - protein, 21 aa, Entamoeba dispar
QKDIQPMRRFIVRASIADSTS

SEQ ID NO: 2536954 - protein, 28 aa, Entamoeba dispar
QKDISSVPFLLFIPFSIPSVHEFLSTTS

SEQ ID NO: 2536955 - protein, 22 aa, Entamoeba dispar
QKDLSIQQLKSIKFEQSQKLSQ

SEQ ID NO: 2536956 - protein, 24 aa, Entamoeba dispar
QKDMPKWRELLVAQVIVGKLIVPR

SEQ ID NO: 2536957 - protein, 17 aa, Entamoeba dispar
QKDVHKLVPLKTDFIFT

SEQ ID NO: 2536958 - protein, 18 aa, Entamoeba dispar
QKDYIKTLLQMYENMYGI

SEQ ID NO: 2536959 - protein, 24 aa, Entamoeba dispar
QKECPLLVVFDLDDTLIHTHISNN

SEQ ID NO: 2536960 - protein, 32 aa, Entamoeba dispar
QKEHPLKFSFRALSGPIYDIAWTGDNQRICVV

SEQ ID NO: 2536961 - protein, 34 aa, Entamoeba dispar
QKEHPLKFSFRALSGPIYDIAWTGDNQRICVVGE

SEQ ID NO: 2536962 - protein, 30 aa, Entamoeba dispar
QKEIGSFERINGLILIRFIEEISHSKCNYP

SEQ ID NO: 2536963 - protein, 35 aa, Entamoeba dispar
QKEKPLFHTKPSRNLEWPDELKMPVLKVGVKAIGI

SEQ ID NO: 2536964 - protein, 26 aa, Entamoeba dispar
QKELPLLIIGSYYFRQRIQENNIIFE

SEQ ID NO: 2536965 - protein, 22 aa, Entamoeba dispar
QKEMKYLKKYYALLTIPNQICL

SEQ ID NO: 2536966 - protein, 29 aa, Entamoeba dispar
QKERGEEFWVIFGQLLNYSDTLPKFFKEN

SEQ ID NO: 2536967 - protein, 28 aa, Entamoeba dispar
QKERKTPIDFIILPPLKLKDQQSQVETI

SEQ ID NO: 2536968 - protein, 21 aa, Entamoeba dispar
QKFITNLEKKGFFNDCTQPQR

SEQ ID NO: 2536969 - protein, 22 aa, Entamoeba dispar
QKFKYESRHLHAMKRQRGEGGR

SEQ ID NO: 2536970 - protein, 19 aa, Entamoeba dispar
QKFYFREPEFYERARKYIE

SEQ ID NO: 2536971 - protein, 24 aa, Entamoeba dispar
QKGNEFFSFIIYKEHISPKISEVQ

SEQ ID NO: 2536972 - protein, 22 aa, Entamoeba dispar
QKGTFLYYRNQWNFMNCSSNDL

SEQ ID NO: 2536973 - protein, 22 aa, Entamoeba dispar
QKGVFLLLDAIWSLVKETNGKC

SEQ ID NO: 2536974 - protein, 19 aa, Entamoeba dispar
QKGWELRLWFGDITESGYS

SEQ ID NO: 2536975 - protein, 17 aa, Entamoeba dispar
QKHLLVNRVFGILDNTN

SEQ ID NO: 2536976 - protein, 28 aa, Entamoeba dispar
QKHPNEEVKWRLIKRISQQKNRNVLLNI

SEQ ID NO: 2536977 - protein, 36 aa, Entamoeba dispar
QKIEIIDGMRWVVPYVYWFEVIVKERWIGKEVKEIM

SEQ ID NO: 2536978 - protein, 26 aa, Entamoeba dispar
QKIEPFPRQYLIQRLQPIFDVFEIVD

SEQ ID NO: 2536979 - protein, 32 aa, Entamoeba dispar
QKIETPNILMPILFEYFFKRKAFIEERQEKLL

SEQ ID NO: 2536980 - protein, 18 aa, Entamoeba dispar
QKIFSQHSLLLTKEEIIQ

SEQ ID NO: 2536981 - protein, 18 aa, Entamoeba dispar
QKIIHDPVIFPNVSYPTA

SEQ ID NO: 2536982 - protein, 17 aa, Entamoeba dispar
QKIKKIDSFTLLNPIHS

SEQ ID NO: 2536983 - protein, 20 aa, Entamoeba dispar
QKILQKWCNCDNSKIIFDSK

SEQ ID NO: 2536984 - protein, 26 aa, Entamoeba dispar
QKITEPYVCGVLKRIISIMKSINEKK

SEQ ID NO: 2536985 - protein, 19 aa, Entamoeba dispar
QKIVYPNKIIIITEGVFQH

SEQ ID NO: 2536986 - protein, 26 aa, Entamoeba dispar
QKIYSELDLLCKQNNIIKVKKLDIRK

SEQ ID NO: 2536987 - protein, 25 aa, Entamoeba dispar
QKKENLRICYLAKKPLKNHLLTFEK

SEQ ID NO: 2536988 - protein, 21 aa, Entamoeba dispar
QKKHGIFSFLKKKSKSAKFEE

SEQ ID NO: 2536989 - protein, 27 aa, Entamoeba dispar
QKKIDGRALILITLSLMKKCLHSKELV

SEQ ID NO: 2536990 - protein, 22 aa, Entamoeba dispar
QKKIFEPAPPFTRKCIIATNIA

SEQ ID NO: 2536991 - protein, 26 aa, Entamoeba dispar
QKKIPEGMTLTPITPGFIQQQKQKEV

SEQ ID NO: 2536992 - protein, 24 aa, Entamoeba dispar
QKKLNLFLTTLEYFRDQGEGLLAE

SEQ ID NO: 2536993 - protein, 24 aa, Entamoeba dispar
QKKSVLLIISKWKNNHTFDISLCE

SEQ ID NO: 2536994 - protein, 17 aa, Entamoeba dispar
QKKTIIDLENRELKRDM

SEQ ID NO: 2536995 - protein, 26 aa, Entamoeba dispar
QKLERKRHIGNDIVVLVFLEEGVKHF

SEQ ID NO: 2536996 - protein, 18 aa, Entamoeba dispar
QKLFINIKGIIITISSIL

SEQ ID NO: 2536997 - protein, 34 aa, Entamoeba dispar
QKLFITKIHLIDALIRFIRKKELQYSFYCMSRAT

SEQ ID NO: 2536998 - protein, 40 aa, Entamoeba dispar
QKLKECFKWDIKCQNIKTFWKRMKRYGFKKRRIRGIDYFI

SEQ ID NO: 2536999 - protein, 25 aa, Entamoeba dispar
QKLLRKDFLPPLNSLKFTKKGKVLF

SEQ ID NO: 2537000 - protein, 19 aa, Entamoeba dispar
QKLLVQPKPLTIQGVVLRM

SEQ ID NO: 2537001 - protein, 19 aa, Entamoeba dispar
QKLNLLALKDSFISDCLQE

SEQ ID NO: 2537002 - protein, 22 aa, Entamoeba dispar
QKLRGLIVQFLIDNGANINVAN

SEQ ID NO: 2537003 - protein, 23 aa, Entamoeba dispar
QKLRLRLQLLDIGSSIKYHSIIS

SEQ ID NO: 2537004 - protein, 18 aa, Entamoeba dispar
QKMLRKKIAKKILVQRMM

SEQ ID NO: 2537005 - protein, 28 aa, Entamoeba dispar
QKNFSHYLLPLPYFFHFVSQFNNGMNYL

SEQ ID NO: 2537006 - protein, 21 aa, Entamoeba dispar
QKNGIIPVPLYATLGEKAIDY

SEQ ID NO: 2537007 - protein, 23 aa, Entamoeba dispar
QKNITDLMELGFSRSMATEAYIV

SEQ ID NO: 2537008 - protein, 42 aa, Entamoeba dispar
QKNPPTDLSIDKKLFRDITQEFFGWNQNKFIDDIVFNQLNSI

SEQ ID NO: 2537009 - protein, 24 aa, Entamoeba dispar
QKNQELIKLKEEKEKLSLDLTNGN

SEQ ID NO: 2537010 - protein, 23 aa, Entamoeba dispar
QKNSLFLVIYCLEHFKASINQKD

SEQ ID NO: 2537011 - protein, 17 aa, Entamoeba dispar
QKPELCQPSFTQSLGGA

SEQ ID NO: 2537012 - protein, 24 aa, Entamoeba dispar
QKPIFKISMFLFQQRDSKADKAIL

SEQ ID NO: 2537013 - protein, 18 aa, Entamoeba dispar
QKPIGYDSLLENIYLILN

SEQ ID NO: 2537014 - protein, 20 aa, Entamoeba dispar
QKPSNILITFKIDNNVFGLY

SEQ ID NO: 2537015 - protein, 22 aa, Entamoeba dispar
QKPYFIFQCIHPNKFYDDPFVM

SEQ ID NO: 2537016 - protein, 26 aa, Entamoeba dispar
QKQKKCIFVKGFPNSWKIKDLKERFD

SEQ ID NO: 2537017 - protein, 27 aa, Entamoeba dispar
QKQRIAIARALIRNPKVLLLDEATSAL

SEQ ID NO: 2537018 - protein, 27 aa, Entamoeba dispar
QKQTKIIVLIPPPLQYCTFESWKSTVN

SEQ ID NO: 2537019 - protein, 19 aa, Entamoeba dispar
QKRNYFFNIKLNGIPSKII

SEQ ID NO: 2537020 - protein, 31 aa, Entamoeba dispar
QKRQYYKKAITDAPFILSAGEQPLPAPKLDP

SEQ ID NO: 2537021 - protein, 23 aa, Entamoeba dispar
QKRRHGLIKKAMELSILCDCKVS

SEQ ID NO: 2537022 - protein, 31 aa, Entamoeba dispar
QKRVKIVKMIVKLLKMIKKTAEILPKNMSKQ

SEQ ID NO: 2537023 - protein, 25 aa, Entamoeba dispar
QKRYYFIHHILYNTSYQVPQFGVSL

SEQ ID NO: 2537024 - protein, 29 aa, Entamoeba dispar
QKSDINIVIIHYLELIWKIPDAHIIINSL

SEQ ID NO: 2537025 - protein, 28 aa, Entamoeba dispar
QKSGKTEAYFPYRLPSRAIYGGQNIEDS

SEQ ID NO: 2537026 - protein, 30 aa, Entamoeba dispar
QKSIILTPYHYIISSIFIQFFRDSLEQFDK

SEQ ID NO: 2537027 - protein, 25 aa, Entamoeba dispar
QKSRQSIFMLLQSYLEKYPESLISF

SEQ ID NO: 2537028 - protein, 34 aa, Entamoeba dispar
QKSSVIDLHLLGNGTPLFIKVNLNIDLKENIEEQ

SEQ ID NO: 2537029 - protein, 18 aa, Entamoeba dispar
QKTMDWWSCVIIGDEEID

SEQ ID NO: 2537030 - protein, 36 aa, Entamoeba dispar
QKTNPRILDLFEPEKWYNFPKTIQTKRYLSNCIDKI

SEQ ID NO: 2537031 - protein, 24 aa, Entamoeba dispar
QKVGLNIFSLNVISFRLLDTEYNG

SEQ ID NO: 2537032 - protein, 18 aa, Entamoeba dispar
QKVKTLPFKGLADCFDAL

SEQ ID NO: 2537033 - protein, 27 aa, Entamoeba dispar
QKVTSKTMNFYLWKSYKLPNGNNIDES

SEQ ID NO: 2537034 - protein, 29 aa, Entamoeba dispar
QKVYSSISLLPYRYSFIAITTPPISPEFD

SEQ ID NO: 2537035 - protein, 27 aa, Entamoeba dispar
QKWAKITIFMKIWTDLLPYDFHDKEIL

SEQ ID NO: 2537036 - protein, 24 aa, Entamoeba dispar
QKWKIDPMNNLRMWNRILSGIEKS

SEQ ID NO: 2537037 - protein, 33 aa, Entamoeba dispar
QKWMRYIDRFITGDKLWFIIQTKIDLGKMDIPV

SEQ ID NO: 2537038 - protein, 25 aa, Entamoeba dispar
QKYGLRPYGVGLLVIGYDTKPRLFE

SEQ ID NO: 2537039 - protein, 17 aa, Entamoeba dispar
QKYIKIPSYQDLSFLNN

SEQ ID NO: 2537040 - protein, 42 aa, Entamoeba dispar
QKYQYEISRFNQQLIKHFCIMRELSLISFISCKRSLYTESIE

SEQ ID NO: 2537041 - protein, 18 aa, Entamoeba dispar
QLAIRLYDGSLQFEIKKT

SEQ ID NO: 2537042 - protein, 21 aa, Entamoeba dispar
QLALKLLCNVVYGYTGAGLSG

SEQ ID NO: 2537043 - protein, 25 aa, Entamoeba dispar
QLAQDGFQWFFNNTLVTVWSAPKYY

SEQ ID NO: 2537044 - protein, 24 aa, Entamoeba dispar
QLAQQYISLMLFGAILEGGCSLKN

SEQ ID NO: 2537045 - protein, 27 aa, Entamoeba dispar
QLCFFKAVIQLLLNYKQFIGYTWISNE

SEQ ID NO: 2537046 - protein, 17 aa, Entamoeba dispar
QLDELMKKIWAFKPNLA

SEQ ID NO: 2537047 - protein, 20 aa, Entamoeba dispar
QLDKQLLLKKQKKIDELFKT

SEQ ID NO: 2537048 - protein, 29 aa, Entamoeba dispar
QLDKYKEKLLLFPSMPYLVWSTQTDSLKE

SEQ ID NO: 2537049 - protein, 38 aa, Entamoeba dispar
QLDLRSYLITPVQRLPRYNLLLNELLKHTPTDHPDYNN

SEQ ID NO: 2537050 - protein, 17 aa, Entamoeba dispar
QLEDVECLLLLLNKIIP

SEQ ID NO: 2537051 - protein, 23 aa, Entamoeba dispar
QLEDYSLLLIQQGSLREIKNVGP

SEQ ID NO: 2537052 - protein, 34 aa, Entamoeba dispar
QLEELMRKLKMTNPHFIRCILPNTQKKQRYFVDS

SEQ ID NO: 2537053 - protein, 19 aa, Entamoeba dispar
QLEHVMLVRKLTTGVGARA

SEQ ID NO: 2537054 - protein, 25 aa, Entamoeba dispar
QLEKYFQFNLYFGQRMESLINCIKK

SEQ ID NO: 2537055 - protein, 19 aa, Entamoeba dispar
QLFDLISYNKGSALIDMMI

SEQ ID NO: 2537056 - protein, 21 aa, Entamoeba dispar
QLFDYLEIFYNDLPVLLVDFT

SEQ ID NO: 2537057 - protein, 27 aa, Entamoeba dispar
QLFDYSIFNILQIQPFLELIYCIDQIG

SEQ ID NO: 2537058 - protein, 25 aa, Entamoeba dispar
QLFIINICIYLLRNISLNTQISSGY

SEQ ID NO: 2537059 - protein, 17 aa, Entamoeba dispar
QLFILQKSSLDCGEFEK

SEQ ID NO: 2537060 - protein, 20 aa, Entamoeba dispar
QLFISSLIKNVPKSIFEILN

SEQ ID NO: 2537061 - protein, 18 aa, Entamoeba dispar
QLFRVLEKEPDEHICMVL

SEQ ID NO: 2537062 - protein, 30 aa, Entamoeba dispar
QLFSTVGNVLLVTLPLTKSGVSKRYAYIEL

SEQ ID NO: 2537063 - protein, 23 aa, Entamoeba dispar
QLGLVLDFVLQFDNKKLGNSSIQ

SEQ ID NO: 2537064 - protein, 20 aa, Entamoeba dispar
QLGVCKAVILNPKNTIKCYL

SEQ ID NO: 2537065 - protein, 18 aa, Entamoeba dispar
QLHIIIATFPIKSEDCNN

SEQ ID NO: 2537066 - protein, 18 aa, Entamoeba dispar
QLHIIILDELDAICKQRG

SEQ ID NO: 2537067 - protein, 17 aa, Entamoeba dispar
QLHIIQYKIINDSILKL

SEQ ID NO: 2537068 - protein, 19 aa, Entamoeba dispar
QLIIGPMFSGKTTELIRLI

SEQ ID NO: 2537069 - protein, 18 aa, Entamoeba dispar
QLIKMRLYLTINYNTEFN

SEQ ID NO: 2537070 - protein, 18 aa, Entamoeba dispar
QLINRMYKLILNGDKEDI

SEQ ID NO: 2537071 - protein, 24 aa, Entamoeba dispar
QLIQQLYQYQCKCTELIQTRKQNQ

SEQ ID NO: 2537072 - protein, 31 aa, Entamoeba dispar
QLIRSSGKLVLLDKLLPKLYADHHKVLIFSQ

SEQ ID NO: 2537073 - protein, 25 aa, Entamoeba dispar
QLKDDGIVLVFDELQRKLDYFDTQW

SEQ ID NO: 2537074 - protein, 26 aa, Entamoeba dispar
QLKDIHFLVALAYTLPRLDLDSIKSK

SEQ ID NO: 2537075 - protein, 22 aa, Entamoeba dispar
QLKDQIIQLQSSLKKIQEENKK

SEQ ID NO: 2537076 - protein, 18 aa, Entamoeba dispar
QLKDYVVIDVFEKNIPKE

SEQ ID NO: 2537077 - protein, 21 aa, Entamoeba dispar
QLKGIASLLNGLLIATQPSEK

SEQ ID NO: 2537078 - protein, 24 aa, Entamoeba dispar
QLKIIFMLNHVIIPFNYTQWFDYS

SEQ ID NO: 2537079 - protein, 20 aa, Entamoeba dispar
QLKIVVELWKKQGIIDGFVD

SEQ ID NO: 2537080 - protein, 22 aa, Entamoeba dispar
QLKKDCIMPYLNTVHEYLEKLN

SEQ ID NO: 2537081 - protein, 24 aa, Entamoeba dispar
QLKKGIVPVLTFKQVYEYPIDDLL

SEQ ID NO: 2537082 - protein, 21 aa, Entamoeba dispar
QLKKYGFFPKGGGQIDCLVQS

SEQ ID NO: 2537083 - protein, 26 aa, Entamoeba dispar
QLKNNGFILQKPFDNVFLTLEDLIIC

SEQ ID NO: 2537084 - protein, 19 aa, Entamoeba dispar
QLKPDFYVGKILKEQKREF

SEQ ID NO: 2537085 - protein, 29 aa, Entamoeba dispar
QLKPFQIDALNWLIRRHHLGVNSILADEM

SEQ ID NO: 2537086 - protein, 25 aa, Entamoeba dispar
QLKQDFTLVDPRKALFKYNTDYPEL

SEQ ID NO: 2537087 - protein, 24 aa, Entamoeba dispar
QLKSHRILDLDYILSSLSIQKAEL

SEQ ID NO: 2537088 - protein, 24 aa, Entamoeba dispar
QLKSTIVFIKNLYVKSSFYELRIF

SEQ ID NO: 2537089 - protein, 31 aa, Entamoeba dispar
QLLDSKKFIHLMEVILLMGNFLNSGTAKGNV

SEQ ID NO: 2537090 - protein, 17 aa, Entamoeba dispar
QLLEIGFDEIKYHEQLG

SEQ ID NO: 2537091 - protein, 25 aa, Entamoeba dispar
QLLGGYLDAFLPKINRIVNTPQQLN

SEQ ID NO: 2537092 - protein, 19 aa, Entamoeba dispar
QLLGILYRMGVKQQQKPIE

SEQ ID NO: 2537093 - protein, 22 aa, Entamoeba dispar
QLLKHNLFGTRVLKKIAAIMPR

SEQ ID NO: 2537094 - protein, 27 aa, Entamoeba dispar
QLLKTHRPLHFTSKYAYLTLWGDEISN

SEQ ID NO: 2537095 - protein, 17 aa, Entamoeba dispar
QLLPTVTYFLFTKNNFL

SEQ ID NO: 2537096 - protein, 21 aa, Entamoeba dispar
QLLREFTDYLKKGELIKYVGA

SEQ ID NO: 2537097 - protein, 17 aa, Entamoeba dispar
QLLSFGYLFDQPEISYK

SEQ ID NO: 2537098 - protein, 17 aa, Entamoeba dispar
QLLTLKPILRTIVTSQN

SEQ ID NO: 2537099 - protein, 20 aa, Entamoeba dispar
QLLTLLYYSKKLQIKSLILS

SEQ ID NO: 2537100 - protein, 28 aa, Entamoeba dispar
QLMDGLGNLKWIVVGKLFGLRAIIGNSS

SEQ ID NO: 2537101 - protein, 18 aa, Entamoeba dispar
QLNELKRNLREAERNTRL

SEQ ID NO: 2537102 - protein, 23 aa, Entamoeba dispar
QLNFPLCFTIFGATHYSFKNKAA

SEQ ID NO: 2537103 - protein, 24 aa, Entamoeba dispar
QLNFPLCFTIFGATHYSFKNKAAV

SEQ ID NO: 2537104 - protein, 24 aa, Entamoeba dispar
QLNFVKLQLIKRMNLPKTKITQPL

SEQ ID NO: 2537105 - protein, 28 aa, Entamoeba dispar
QLNKFKEFSLLTNLYLPYIISEELFDTT

SEQ ID NO: 2537106 - protein, 19 aa, Entamoeba dispar
QLNLIKYILNESDKRYFNS

SEQ ID NO: 2537107 - protein, 22 aa, Entamoeba dispar
QLNNLRIIVPVKENVIVDSCEG

SEQ ID NO: 2537108 - protein, 23 aa, Entamoeba dispar
QLNNSYIIIGLYAHKRKDDKNYI

SEQ ID NO: 2537109 - protein, 24 aa, Entamoeba dispar
QLNQTLFSTFRYSPSQYLTYGCQF

SEQ ID NO: 2537110 - protein, 20 aa, Entamoeba dispar
QLPKEYCSILKYIIEHETVN

SEQ ID NO: 2537111 - protein, 22 aa, Entamoeba dispar
QLPKVEFILYTDYVYGACCVDD

SEQ ID NO: 2537112 - protein, 32 aa, Entamoeba dispar
QLPSIITHLSYFRIPLPDILHWMNIDISSSSG

SEQ ID NO: 2537113 - protein, 23 aa, Entamoeba dispar
QLQKESFKWTQEKHYSLSKPVFD

SEQ ID NO: 2537114 - protein, 20 aa, Entamoeba dispar
QLQLFYPNLYLRLNSVHIED

SEQ ID NO: 2537115 - protein, 17 aa, Entamoeba dispar
QLQQLNNMLFSLKLRID

SEQ ID NO: 2537116 - protein, 24 aa, Entamoeba dispar
QLQSKMTEIYYFLDELKKVQKELK

SEQ ID NO: 2537117 - protein, 17 aa, Entamoeba dispar
QLRAQILSMDYLHSAIQ

SEQ ID NO: 2537118 - protein, 28 aa, Entamoeba dispar
QLRLDSLGHVLFYPQKPLVSTRAAEYVK

SEQ ID NO: 2537119 - protein, 32 aa, Entamoeba dispar
QLRNDVDLLKCSILKRPWVNPFNQTTTNNPFI

SEQ ID NO: 2537120 - protein, 29 aa, Entamoeba dispar
QLSETNIFVKNLPFDLTDESFKKLFEKYE

SEQ ID NO: 2537121 - protein, 19 aa, Entamoeba dispar
QLSFMKFLCIGLDGLPPLT

SEQ ID NO: 2537122 - protein, 25 aa, Entamoeba dispar
QLSQDPINVYSIPDPKPLERHHLNL

SEQ ID NO: 2537123 - protein, 25 aa, Entamoeba dispar
QLSYDPSWLVLFAKSLLKTVVDPGC

SEQ ID NO: 2537124 - protein, 31 aa, Entamoeba dispar
QLSYTPRKIITHPTIPLLYILEGDNNSCKVG

SEQ ID NO: 2537125 - protein, 29 aa, Entamoeba dispar
QLTEAIRRKPYSVILFDEIEKAHPQVFNV

SEQ ID NO: 2537126 - protein, 19 aa, Entamoeba dispar
QLTFPINLKYISPGSFSCC

SEQ ID NO: 2537127 - protein, 19 aa, Entamoeba dispar
QLTINFYGPNKTQCILWEF

SEQ ID NO: 2537128 - protein, 17 aa, Entamoeba dispar
QLTKLKTLIINKSFISC

SEQ ID NO: 2537129 - protein, 28 aa, Entamoeba dispar
QLVAKRSQIPLQLAWAISIHKSQGMTLE

SEQ ID NO: 2537130 - protein, 17 aa, Entamoeba dispar
QLVMYLPQLVQALKFEL

SEQ ID NO: 2537131 - protein, 26 aa, Entamoeba dispar
QLVSLKNIIFLRSISNYFLRCTEDSY

SEQ ID NO: 2537132 - protein, 23 aa, Entamoeba dispar
QLVYLRQGMLELAILTLLNGYYD

SEQ ID NO: 2537133 - protein, 18 aa, Entamoeba dispar
QLYFNELIDKIGESGLSL

SEQ ID NO: 2537134 - protein, 29 aa, Entamoeba dispar
QLYNIAPLQAMLFGLQLQPLPTVKRILED

SEQ ID NO: 2537135 - protein, 17 aa, Entamoeba dispar
QMALQSLYIFSKINFVC

SEQ ID NO: 2537136 - protein, 17 aa, Entamoeba dispar
QMCLIDEIKTNQGITVF

SEQ ID NO: 2537137 - protein, 18 aa, Entamoeba dispar
QMCWIDEKKFIIYSKFRN

SEQ ID NO: 2537138 - protein, 19 aa, Entamoeba dispar
QMDILQIVKIITESKLFQD

SEQ ID NO: 2537139 - protein, 26 aa, Entamoeba dispar
QMDKDGIIFVLIFKNEQIIFARGRNN

SEQ ID NO: 2537140 - protein, 27 aa, Entamoeba dispar
QMDLSNTLFLRLNPFQLLIKTSAGNCV

SEQ ID NO: 2537141 - protein, 18 aa, Entamoeba dispar
QMEDAHLIIPDLNKMFKI

SEQ ID NO: 2537142 - protein, 27 aa, Entamoeba dispar
QMEFKYIIGEAFLIKNYPRIQTVITKT

SEQ ID NO: 2537143 - protein, 26 aa, Entamoeba dispar
QMEGLNWLVFNWCRGKGCILADEMGL

SEQ ID NO: 2537144 - protein, 24 aa, Entamoeba dispar
QMEIKPIITPIEVKPITTPSSVET

SEQ ID NO: 2537145 - protein, 19 aa, Entamoeba dispar
QMEILKKIINSTFIVRKNE

SEQ ID NO: 2537146 - protein, 17 aa, Entamoeba dispar
QMELGLFKYKQPMEKDD

SEQ ID NO: 2537147 - protein, 17 aa, Entamoeba dispar
QMFNMLCLMDYVCKRNV

SEQ ID NO: 2537148 - protein, 23 aa, Entamoeba dispar
QMFSVQNQIPWEMNWKGFKVIRR

SEQ ID NO: 2537149 - protein, 17 aa, Entamoeba dispar
QMHLLICLINSKLESFQ

SEQ ID NO: 2537150 - protein, 30 aa, Entamoeba dispar
QMHSSFIELFAMNHPPLSPSLLVRSGSLKI

SEQ ID NO: 2537151 - protein, 19 aa, Entamoeba dispar
QMIFECIKKCPLTSRRPLL

SEQ ID NO: 2537152 - protein, 20 aa, Entamoeba dispar
QMIPRIFDKGKSNYFYLLYC

SEQ ID NO: 2537153 - protein, 26 aa, Entamoeba dispar
QMIVNSKMFFTFNSLSLYTCVFKVIK

SEQ ID NO: 2537154 - protein, 20 aa, Entamoeba dispar
QMIYDIEYQCGEHPSRIIFV

SEQ ID NO: 2537155 - protein, 24 aa, Entamoeba dispar
QMKEKIIPQLLLKDILKKYDGKTE

SEQ ID NO: 2537156 - protein, 23 aa, Entamoeba dispar
QMKKKLDNLLISKEFIEAETQGI

SEQ ID NO: 2537157 - protein, 18 aa, Entamoeba dispar
QMKQYLIKTVFVPKKLKE

SEQ ID NO: 2537158 - protein, 24 aa, Entamoeba dispar
QMKTKVIFIIDWLHKEDIEEVNEL

SEQ ID NO: 2537159 - protein, 19 aa, Entamoeba dispar
QMKVHIHPTFRWGNDLGTI

SEQ ID NO: 2537160 - protein, 17 aa, Entamoeba dispar
QMLDQKMDSILNKTDES

SEQ ID NO: 2537161 - protein, 17 aa, Entamoeba dispar
QMLTPGDSPYYPLDSIF

SEQ ID NO: 2537162 - protein, 27 aa, Entamoeba dispar
QMNENAEKLIRMAKSFGLEVTCSASAI

SEQ ID NO: 2537163 - protein, 17 aa, Entamoeba dispar
QMNENDWRIIRENLNIF

SEQ ID NO: 2537164 - protein, 26 aa, Entamoeba dispar
QMNEQVMALQTQLSQSNISLEEVKKD

SEQ ID NO: 2537165 - protein, 22 aa, Entamoeba dispar
QMNFTGFFEFYSGLNSSAISRL

SEQ ID NO: 2537166 - protein, 18 aa, Entamoeba dispar
QMNKPLLLTFDDSFVRDI

SEQ ID NO: 2537167 - protein, 18 aa, Entamoeba dispar
QMNLLAQMKEPLPSTNSP

SEQ ID NO: 2537168 - protein, 25 aa, Entamoeba dispar
QMNSYESWRIMRKGSIIILKEQQIF

SEQ ID NO: 2537169 - protein, 20 aa, Entamoeba dispar
QMNTLFTEKNYKINIPPFIY

SEQ ID NO: 2537170 - protein, 21 aa, Entamoeba dispar
QMRVKLYQFLFEALKTVPKIS

SEQ ID NO: 2537171 - protein, 29 aa, Entamoeba dispar
QMSLPAFQPYYYGKRPLLFKIPEGLPPSH

SEQ ID NO: 2537172 - protein, 19 aa, Entamoeba dispar
QMTFDRLSSIIPVKNFIVV

SEQ ID NO: 2537173 - protein, 18 aa, Entamoeba dispar
QMTPVLQGLMDKVSILTK

SEQ ID NO: 2537174 - protein, 24 aa, Entamoeba dispar
QMTTQVIQLIILLQTPNALQTLIN

SEQ ID NO: 2537175 - protein, 18 aa, Entamoeba dispar
QMVHIELVQWFECIAEFD

SEQ ID NO: 2537176 - protein, 26 aa, Entamoeba dispar
QMVHNLHLAMQFLEKEMLVRNPGCFA

SEQ ID NO: 2537177 - protein, 23 aa, Entamoeba dispar
QMYEQVIITKLLPETMIDLRVQI

SEQ ID NO: 2537178 - protein, 33 aa, Entamoeba dispar
QNAARIFRALFELLLIKRWARPALKALELCKSV

SEQ ID NO: 2537179 - protein, 22 aa, Entamoeba dispar
QNAYDLLMKFNTIKRIGVVDKE

SEQ ID NO: 2537180 - protein, 23 aa, Entamoeba dispar
QNAYDLLMKFNTIKRIGVVDKEE

SEQ ID NO: 2537181 - protein, 25 aa, Entamoeba dispar
QNAYDSLFKIRRYEKFLGVKEEEVS

SEQ ID NO: 2537182 - protein, 24 aa, Entamoeba dispar
QNCFDIFYLISYIESTQLQKKQTF

SEQ ID NO: 2537183 - protein, 24 aa, Entamoeba dispar
QNDAHEFLLIFLEILEKELNTKDI

SEQ ID NO: 2537184 - protein, 25 aa, Entamoeba dispar
QNDASEFFLFLLDELDKEMRGTRSG

SEQ ID NO: 2537185 - protein, 18 aa, Entamoeba dispar
QNDELWMELIRVCGNDEK

SEQ ID NO: 2537186 - protein, 20 aa, Entamoeba dispar
QNDLIKLRSLFSLTSNYKRY

SEQ ID NO: 2537187 - protein, 24 aa, Entamoeba dispar
QNDTTFFECFGITKITNLSFEIQG

SEQ ID NO: 2537188 - protein, 25 aa, Entamoeba dispar
QNEFDSIYNMWGNDAFFKFHNNSIY

SEQ ID NO: 2537189 - protein, 19 aa, Entamoeba dispar
QNEIAAMRLLAVTSSEEGC

SEQ ID NO: 2537190 - protein, 19 aa, Entamoeba dispar
QNELILLKNIANFDPTKIT

SEQ ID NO: 2537191 - protein, 24 aa, Entamoeba dispar
QNENHQIKLPVFTNFNATPINQDI

SEQ ID NO: 2537192 - protein, 17 aa, Entamoeba dispar
QNENYYLQLLEQQTQQY

SEQ ID NO: 2537193 - protein, 26 aa, Entamoeba dispar
QNEQEIAFIIIVGNKIDLPSKVTNEQ

SEQ ID NO: 2537194 - protein, 28 aa, Entamoeba dispar
QNERKRIHLVWFVINSAVGRLQPFEEEI

SEQ ID NO: 2537195 - protein, 35 aa, Entamoeba dispar
QNESKLLLTPYEKNIQFWRQLWRTCEQSDVILQIV

SEQ ID NO: 2537196 - protein, 24 aa, Entamoeba dispar
QNEYKIIQLINLRLETIKSSIKNK

SEQ ID NO: 2537197 - protein, 20 aa, Entamoeba dispar
QNFHESMMLVLSGIKDDNSN

SEQ ID NO: 2537198 - protein, 26 aa, Entamoeba dispar
QNFIKQYPFILNSIYKLSIEYDSVTP

SEQ ID NO: 2537199 - protein, 26 aa, Entamoeba dispar
QNFLTCSALPQPFRYNKLKYPNEYYS

SEQ ID NO: 2537200 - protein, 17 aa, Entamoeba dispar
QNFPLSYSFSLPGTSPF

SEQ ID NO: 2537201 - protein, 21 aa, Entamoeba dispar
QNFRLVLINGKYYLQAESQEQ

SEQ ID NO: 2537202 - protein, 23 aa, Entamoeba dispar
QNGILIGVSSWDKTCKAFLVNSP

SEQ ID NO: 2537203 - protein, 17 aa, Entamoeba dispar
QNGLIPPSYIQGNCMEE

SEQ ID NO: 2537204 - protein, 24 aa, Entamoeba dispar
QNGMLKALLPYYRLTQAVQIGDLE

SEQ ID NO: 2537205 - protein, 22 aa, Entamoeba dispar
QNGYLGFHLLKQFYKTNYYEES

SEQ ID NO: 2537206 - protein, 20 aa, Entamoeba dispar
QNHCIECEYGYYLNLNTKTC

SEQ ID NO: 2537207 - protein, 26 aa, Entamoeba dispar
QNIEERIDILKGLIDKYPAFENQLKK

SEQ ID NO: 2537208 - protein, 25 aa, Entamoeba dispar
QNIFEPNYLEPWLIVDFDSDIVVAS

SEQ ID NO: 2537209 - protein, 18 aa, Entamoeba dispar
QNIFEQWKNIRKNILFVF

SEQ ID NO: 2537210 - protein, 21 aa, Entamoeba dispar
QNIFISLYHSPIFTRSNRCGC

SEQ ID NO: 2537211 - protein, 50 aa, Entamoeba dispar
QNIFSDICPITFGSFFYFIEKVVSLIIKMFPFKFDLIYKWLRREGKSILK

SEQ ID NO: 2537212 - protein, 20 aa, Entamoeba dispar
QNIIKLKNILHEAALLQVEI

SEQ ID NO: 2537213 - protein, 50 aa, Entamoeba dispar
QNILISLPIDISLPLYHSFPLINSYMSKPFPFIPLLLDENYRVAGVVNQR

SEQ ID NO: 2537214 - protein, 18 aa, Entamoeba dispar
QNILITSISRLYPQIIRV

SEQ ID NO: 2537215 - protein, 24 aa, Entamoeba dispar
QNILLPPPVILYKEGKVMFTRKQS

SEQ ID NO: 2537216 - protein, 19 aa, Entamoeba dispar
QNIMKKLYSIKKLGMFAVD

SEQ ID NO: 2537217 - protein, 24 aa, Entamoeba dispar
QNINKIKFIAETFKTFGFKSNESC

SEQ ID NO: 2537218 - protein, 23 aa, Entamoeba dispar
QNISMIFYHPKIMNLIICCYSII

SEQ ID NO: 2537219 - protein, 27 aa, Entamoeba dispar
QNIVSFRAYVTAALFLGPRQLGKMVVT

SEQ ID NO: 2537220 - protein, 25 aa, Entamoeba dispar
QNKGKLLGFYVRCKNNFNGKIFQTS

SEQ ID NO: 2537221 - protein, 21 aa, Entamoeba dispar
QNKIIFEKKYRAVINQECWGF

SEQ ID NO: 2537222 - protein, 25 aa, Entamoeba dispar
QNKLEKIILYFKKINCKIADFILRE

SEQ ID NO: 2537223 - protein, 22 aa, Entamoeba dispar
QNKLEVYYISYNNSDLKITMIS

SEQ ID NO: 2537224 - protein, 25 aa, Entamoeba dispar
QNKQINFIIILYQNGFTNNNLLNQI

SEQ ID NO: 2537225 - protein, 26 aa, Entamoeba dispar
QNKTVTYMDIVLAFENTTPKQAQNEL

SEQ ID NO: 2537226 - protein, 31 aa, Entamoeba dispar
QNKVLTNYIQFFSRLFIIKRVVKEDDLIQSI

SEQ ID NO: 2537227 - protein, 24 aa, Entamoeba dispar
QNKYFLNGGFWLSVDIFNKLLPHQ

SEQ ID NO: 2537228 - protein, 40 aa, Entamoeba dispar
QNLCLHSFQTHYLFFSQYLYSKLYLLSPNQYPSVGYASGY

SEQ ID NO: 2537229 - protein, 36 aa, Entamoeba dispar
QNLDLRDYLIMPVQRLPRYNLLLTDLLKNTPTNHCD

SEQ ID NO: 2537230 - protein, 21 aa, Entamoeba dispar
QNLTEFIVCISKLLELDESIH

SEQ ID NO: 2537231 - protein, 26 aa, Entamoeba dispar
QNLTRLVVKNLPITSIPGLSSLKMLC

SEQ ID NO: 2537232 - protein, 27 aa, Entamoeba dispar
QNLVPFTLYCCSILVMLNIPPSDYSVC

SEQ ID NO: 2537233 - protein, 37 aa, Entamoeba dispar
QNLYQFMRSLKKKVPIIYIRLFSYELIRGLAYIHSLN

SEQ ID NO: 2537234 - protein, 30 aa, Entamoeba dispar
QNMFISLETPFLNRIIHLIRLFSNPSDNKS

SEQ ID NO: 2537235 - protein, 18 aa, Entamoeba dispar
QNMTERFNWIGDTIVDCF

SEQ ID NO: 2537236 - protein, 24 aa, Entamoeba dispar
QNNCKYVKMILGHISLLFSPENRC

SEQ ID NO: 2537237 - protein, 23 aa, Entamoeba dispar
QNNDKMIVILTMNRFKSIDIPTE

SEQ ID NO: 2537238 - protein, 24 aa, Entamoeba dispar
QNNDKMIVILTMNRFKSIDIPTEE

SEQ ID NO: 2537239 - protein, 23 aa, Entamoeba dispar
QNNDKMIVILTMNRLKSIDIPTE

SEQ ID NO: 2537240 - protein, 26 aa, Entamoeba dispar
QNNINLAIQLPLSEKEFFIITNNNPI

SEQ ID NO: 2537241 - protein, 22 aa, Entamoeba dispar
QNNKKYILINKRNTELYEIIPK

SEQ ID NO: 2537242 - protein, 31 aa, Entamoeba dispar
QNNKRIELLHLLIDLLIIRGGYEFESKYAEG

SEQ ID NO: 2537243 - protein, 24 aa, Entamoeba dispar
QNNQGILELPPLDSLQNLTRLVVK

SEQ ID NO: 2537244 - protein, 24 aa, Entamoeba dispar
QNNTTLLYQQLLSQLMQLQKQNLE

SEQ ID NO: 2537245 - protein, 26 aa, Entamoeba dispar
QNPKKLMIETWKYIYNILKTNDNIIN

SEQ ID NO: 2537246 - protein, 42 aa, Entamoeba dispar
QNPKPYNVILPPFKEYSFHPIITTIPIHLILSNGSFIPMPDV

SEQ ID NO: 2537247 - protein, 17 aa, Entamoeba dispar
QNQLNSQKLLPDKGFYL

SEQ ID NO: 2537248 - protein, 19 aa, Entamoeba dispar
QNQSLIIKIIPKAGKSNSS

SEQ ID NO: 2537249 - protein, 20 aa, Entamoeba dispar
QNRAEYNPFLLFCRDHRENV

SEQ ID NO: 2537250 - protein, 26 aa, Entamoeba dispar
QNRKYLAWVGAALLAGMPTLQDEEQC

SEQ ID NO: 2537251 - protein, 28 aa, Entamoeba dispar
QNSIRPEDILYAGLRMRVLKVRTTDEVK

SEQ ID NO: 2537252 - protein, 24 aa, Entamoeba dispar
QNSKTYWPLVLDIATKNTVNRITR

SEQ ID NO: 2537253 - protein, 46 aa, Entamoeba dispar
QNSTFKENFFNDLSFLQTKVQQLDILIQSLILIPETLIKEETNSDL

SEQ ID NO: 2537254 - protein, 27 aa, Entamoeba dispar
QNSVLMQSLIQQFKQLEIIKKYANISD

SEQ ID NO: 2537255 - protein, 19 aa, Entamoeba dispar
QNTFSPYLNQHQIAVPLQP

SEQ ID NO: 2537256 - protein, 23 aa, Entamoeba dispar
QNTGDYVYVLITTSLDEINQIAC

SEQ ID NO: 2537257 - protein, 21 aa, Entamoeba dispar
QNTGFGQQSLFKPSSQQQTGF

SEQ ID NO: 2537258 - protein, 24 aa, Entamoeba dispar
QNTIFILKDLIFNIQPKAIKIMAI

SEQ ID NO: 2537259 - protein, 21 aa, Entamoeba dispar
QNTLLIIMPFIPNDLEKEIKK

SEQ ID NO: 2537260 - protein, 19 aa, Entamoeba dispar
QNTPCCLAAFYLRVSLEIA

SEQ ID NO: 2537261 - protein, 18 aa, Entamoeba dispar
QNTSVFCERIMYKKHIII

SEQ ID NO: 2537262 - protein, 23 aa, Entamoeba dispar
QNTYKTIILPQILQQIILCGDVH

SEQ ID NO: 2537263 - protein, 26 aa, Entamoeba dispar
QNVDDVLIPVKEAQAAAIAAARDPKN

SEQ ID NO: 2537264 - protein, 39 aa, Entamoeba dispar
QNVFEVFEKYFMMFGAFVECWPDDAFIQYPKQFVKKVVK

SEQ ID NO: 2537265 - protein, 25 aa, Entamoeba dispar
QNVKWYFPIGIIFDALHNGSLPMEI

SEQ ID NO: 2537266 - protein, 27 aa, Entamoeba dispar
QNVLSVFIPLFFQVLFESFNQYYEENE

SEQ ID NO: 2537267 - protein, 23 aa, Entamoeba dispar
QNVPNSFQILAKKSFSVIAKDEI

SEQ ID NO: 2537268 - protein, 30 aa, Entamoeba dispar
QNVSYPFLISNILRLLYNFPSLPKGYELMK

SEQ ID NO: 2537269 - protein, 33 aa, Entamoeba dispar
QNVTPINISLLPEYIKNLYIYSSDQKLIINQQS

SEQ ID NO: 2537270 - protein, 26 aa, Entamoeba dispar
QNVVPLLELCVKRKRPLVIISDTIDG

SEQ ID NO: 2537271 - protein, 26 aa, Entamoeba dispar
QNVVYFRVLMMIPKRDSYFTSLNQLR

SEQ ID NO: 2537272 - protein, 24 aa, Entamoeba dispar
QNWENLLYHNFHKYFYIPKEFNQD

SEQ ID NO: 2537273 - protein, 25 aa, Entamoeba dispar
QNYLSFNNIIISYPPLMLHGSHSLS

SEQ ID NO: 2537274 - protein, 21 aa, Entamoeba dispar
QNYSKRVGYPLILCSSYSGEN

SEQ ID NO: 2537275 - protein, 18 aa, Entamoeba dispar
QPCEVRILEYLKGEKIPL

SEQ ID NO: 2537276 - protein, 21 aa, Entamoeba dispar
QPCSLLKAYSKFYSKFQIIKE

SEQ ID NO: 2537277 - protein, 23 aa, Entamoeba dispar
QPDDRVCFHCGKPGHIGKNCPEQ

SEQ ID NO: 2537278 - protein, 19 aa, Entamoeba dispar
QPDYLSEISFEKCGFIQNI

SEQ ID NO: 2537279 - protein, 24 aa, Entamoeba dispar
QPEEYKMVFCVRNDLKMGKGKIAA

SEQ ID NO: 2537280 - protein, 33 aa, Entamoeba dispar
QPEIKRLPLESLCLQILLFGEKNPVQFLADALD

SEQ ID NO: 2537281 - protein, 20 aa, Entamoeba dispar
QPEVIIRKGMNIEPMKPLHK

SEQ ID NO: 2537282 - protein, 22 aa, Entamoeba dispar
QPFFFIDFGINYTTDETCVPIE

SEQ ID NO: 2537283 - protein, 24 aa, Entamoeba dispar
QPFKKPICLMYKNKEFKLIDKSKY

SEQ ID NO: 2537284 - protein, 21 aa, Entamoeba dispar
QPFLKTAFTHFNYFSNLVNEL

SEQ ID NO: 2537285 - protein, 20 aa, Entamoeba dispar
QPFTLFWNKIENLKQIQSII

SEQ ID NO: 2537286 - protein, 19 aa, Entamoeba dispar
QPFVPLRIPSQREDGKAIE

SEQ ID NO: 2537287 - protein, 24 aa, Entamoeba dispar
QPGKFIFSFDDLKMLLGCGKTLKK

SEQ ID NO: 2537288 - protein, 28 aa, Entamoeba dispar
QPGQNPPLFLYFATILETSSLNALEGFT

SEQ ID NO: 2537289 - protein, 31 aa, Entamoeba dispar
QPHRYEVITPYVYHLRLLISTMHQALNSYRP

SEQ ID NO: 2537290 - protein, 34 aa, Entamoeba dispar
QPIDNEVQFYRFGGRPYVPYTPLAGSGGDKKDDE

SEQ ID NO: 2537291 - protein, 28 aa, Entamoeba dispar
QPIDNEVQFYRYGVRPYVPYDRYYKNDE

SEQ ID NO: 2537292 - protein, 28 aa, Entamoeba dispar
QPIDNEVQFYRYGVRPYVPYDSYYKKND

SEQ ID NO: 2537293 - protein, 24 aa, Entamoeba dispar
QPIEIVLHLPILCEDKNVPYVFVG

SEQ ID NO: 2537294 - protein, 21 aa, Entamoeba dispar
QPIFEPFDFNKFEEVKPVPQQ

SEQ ID NO: 2537295 - protein, 25 aa, Entamoeba dispar
QPIFRDLQFGIYLKSRIGLVGPNGT

SEQ ID NO: 2537296 - protein, 22 aa, Entamoeba dispar
QPIIQKVIAMPPLELDPIKLQT

SEQ ID NO: 2537297 - protein, 33 aa, Entamoeba dispar
QPIKKKIVMNLLIDLLFEFGYLFEIQKETKEGY

SEQ ID NO: 2537298 - protein, 27 aa, Entamoeba dispar
QPINKEFIHQLFYETFDFENYTICKTH

SEQ ID NO: 2537299 - protein, 19 aa, Entamoeba dispar
QPIPGIPTNCTMNISNSFV

SEQ ID NO: 2537300 - protein, 29 aa, Entamoeba dispar
QPIPLLKEFFYMIYTIPGYITPLIPTNKP

SEQ ID NO: 2537301 - protein, 19 aa, Entamoeba dispar
QPIQIQPIQTVRPAAIRQV

SEQ ID NO: 2537302 - protein, 28 aa, Entamoeba dispar
QPISTLSPLLYFYTLILSVLMKNDLSID

SEQ ID NO: 2537303 - protein, 19 aa, Entamoeba dispar
QPKDVILEVLCNTLSPLNK

SEQ ID NO: 2537304 - protein, 26 aa, Entamoeba dispar
QPKEKSHIHFVFSSSPDPMTHSLTPT

SEQ ID NO: 2537305 - protein, 25 aa, Entamoeba dispar
QPKKMTGVLFMPNAIPNHVKLAPLQ

SEQ ID NO: 2537306 - protein, 24 aa, Entamoeba dispar
QPKNKLKAVQWQKIPERQLNNTIF

SEQ ID NO: 2537307 - protein, 20 aa, Entamoeba dispar
QPLAMGGFNYIINQLKQLNN

SEQ ID NO: 2537308 - protein, 26 aa, Entamoeba dispar
QPLFDRLGIFILTFNDNNIRLLKEHL

SEQ ID NO: 2537309 - protein, 21 aa, Entamoeba dispar
QPLGPQRITALGKSYHPDHFV

SEQ ID NO: 2537310 - protein, 18 aa, Entamoeba dispar
QPLHVYVCQNHLDEIIKL

SEQ ID NO: 2537311 - protein, 36 aa, Entamoeba dispar
QPLLDCLPPINKAMTIFIINFLQLISSYEEKTKMGI

SEQ ID NO: 2537312 - protein, 20 aa, Entamoeba dispar
QPLQYWLNDCQIEELPETEC

SEQ ID NO: 2537313 - protein, 29 aa, Entamoeba dispar
QPLSLHSSIILITTADYIRNCTLFGGKTR

SEQ ID NO: 2537314 - protein, 29 aa, Entamoeba dispar
QPLSSSLPPPPPPPGIPGVPPPPPTVPGA

SEQ ID NO: 2537315 - protein, 20 aa, Entamoeba dispar
QPLYHQLYHSVYKSIKLLNK

SEQ ID NO: 2537316 - protein, 20 aa, Entamoeba dispar
QPMCLVAAFLRLTLNENKVY

SEQ ID NO: 2537317 - protein, 26 aa, Entamoeba dispar
QPMNSFTLQLFLYYSGCIALYNHDLQ

SEQ ID NO: 2537318 - protein, 25 aa, Entamoeba dispar
QPNLTAIFPIPIYPEKNNYYVVYHN

SEQ ID NO: 2537319 - protein, 22 aa, Entamoeba dispar
QPPDFSVITLGHPKSPTPPPKE

SEQ ID NO: 2537320 - protein, 27 aa, Entamoeba dispar
QPPYNTEFWMDIPFNEIEMIQNAATAF

SEQ ID NO: 2537321 - protein, 24 aa, Entamoeba dispar
QPQNIYYLQPIFSRTHFSIDVTPM

SEQ ID NO: 2537322 - protein, 28 aa, Entamoeba dispar
QPQNVATDLFLKFIRVLESKVELHTNNQ

SEQ ID NO: 2537323 - protein, 26 aa, Entamoeba dispar
QPSIELIQFIYLLKTQTHFYHQISNE

SEQ ID NO: 2537324 - protein, 19 aa, Entamoeba dispar
QPSIMLDLIISIDGSGFSD

SEQ ID NO: 2537325 - protein, 25 aa, Entamoeba dispar
QPSLEFFIDKVLTKQGYLRRIIIQN

SEQ ID NO: 2537326 - protein, 19 aa, Entamoeba dispar
QPSLIIDRGIALHKMIRLV

SEQ ID NO: 2537327 - protein, 24 aa, Entamoeba dispar
QPSYIPQQRIIYVPMQQVIDPYTG

SEQ ID NO: 2537328 - protein, 28 aa, Entamoeba dispar
QPTKQLLNVLIIYLSSLISIYKSAKWIG

SEQ ID NO: 2537329 - protein, 26 aa, Entamoeba dispar
QPVQRIMRYPILLKQILKQTSKSHRD

SEQ ID NO: 2537330 - protein, 19 aa, Entamoeba dispar
QPYFKVRDYVVEDLPPYEI

SEQ ID NO: 2537331 - protein, 18 aa, Entamoeba dispar
QPYVPVKINSFIPKTNTE

SEQ ID NO: 2537332 - protein, 44 aa, Entamoeba dispar
QQADNNLLIIFPKKYGFFIVPNPIYIIIDFIDISFVLIKSITQT

SEQ ID NO: 2537333 - protein, 22 aa, Entamoeba dispar
QQAEIILHLFLLDSVDSDHPSE

SEQ ID NO: 2537334 - protein, 34 aa, Entamoeba dispar
QQAEKAKVHLPRKSSTILIEKGKTAQLLADNNID

SEQ ID NO: 2537335 - protein, 35 aa, Entamoeba dispar
QQAIRTISTLLYLRYLFIPFATYPSLLVEIQKVVT

SEQ ID NO: 2537336 - protein, 30 aa, Entamoeba dispar
QQAQLFKTMRPLFSQKPVVLVLNKIDICPM

SEQ ID NO: 2537337 - protein, 25 aa, Entamoeba dispar
QQARKQWFYYSVKLNKILKNNPNWL

SEQ ID NO: 2537338 - protein, 23 aa, Entamoeba dispar
QQARYYYYLGRIQCIHLKYSDAY

SEQ ID NO: 2537339 - protein, 24 aa, Entamoeba dispar
QQDSLEMDLIIIKVNMEDSSKNAR

SEQ ID NO: 2537340 - protein, 25 aa, Entamoeba dispar
QQEGKIKSRWLRKNARRIDMENYTK

SEQ ID NO: 2537341 - protein, 18 aa, Entamoeba dispar
QQEKPSRTLPLKKGDTVR

SEQ ID NO: 2537342 - protein, 24 aa, Entamoeba dispar
QQELLEIICYILPNISELSIRDYL

SEQ ID NO: 2537343 - protein, 25 aa, Entamoeba dispar
QQERDYIMNIFRKGEKRVLITTDVW

SEQ ID NO: 2537344 - protein, 35 aa, Entamoeba dispar
QQETKKHLHKIKWLLPSLRELFRRNDRRCSKKRIT

SEQ ID NO: 2537345 - protein, 24 aa, Entamoeba dispar
QQEYLNHALTYYTGLKALVLDSIT

SEQ ID NO: 2537346 - protein, 24 aa, Entamoeba dispar
QQFFLQNFNLILQRGFNSLASKYT

SEQ ID NO: 2537347 - protein, 18 aa, Entamoeba dispar
QQFGIGHWKLILNNFKFD

SEQ ID NO: 2537348 - protein, 19 aa, Entamoeba dispar
QQFLSLFDHNNTLFKCTYK

SEQ ID NO: 2537349 - protein, 24 aa, Entamoeba dispar
QQFNYELFFMGMYEYPSEPINKIY

SEQ ID NO: 2537350 - protein, 21 aa, Entamoeba dispar
QQGFHEIMAIIYHTFDTDITT

SEQ ID NO: 2537351 - protein, 25 aa, Entamoeba dispar
QQGGMDGGWFFPVDTELSIGKNAGD

SEQ ID NO: 2537352 - protein, 23 aa, Entamoeba dispar
QQIFYKNIFLMKKDEIQSVGTCI

SEQ ID NO: 2537353 - protein, 18 aa, Entamoeba dispar
QQIIIKPEQKKKSPKKIQ

SEQ ID NO: 2537354 - protein, 22 aa, Entamoeba dispar
QQILIKKLFDCSDDMIYKMMKD

SEQ ID NO: 2537355 - protein, 26 aa, Entamoeba dispar
QQILNDEVFFIEITKLKLTSSTTLNN

SEQ ID NO: 2537356 - protein, 20 aa, Entamoeba dispar
QQILNDEVLFIEITKLKLTS

SEQ ID NO: 2537357 - protein, 29 aa, Entamoeba dispar
QQINGKFDIIYSSPLRRALVTAKKIAGDK

SEQ ID NO: 2537358 - protein, 18 aa, Entamoeba dispar
QQITSRIKWCQIPSHSRP

SEQ ID NO: 2537359 - protein, 17 aa, Entamoeba dispar
QQIVDKYTFINSKDKSL

SEQ ID NO: 2537360 - protein, 26 aa, Entamoeba dispar
QQIVEIPLNIFLTGGTIEVAIANNSL

SEQ ID NO: 2537361 - protein, 24 aa, Entamoeba dispar
QQKETYLTPLYNFLKNISVINDVV

SEQ ID NO: 2537362 - protein, 29 aa, Entamoeba dispar
QQKIIVNEELYYFLKKYNLTHLIEKLLEA

SEQ ID NO: 2537363 - protein, 25 aa, Entamoeba dispar
QQKTHSILLFISLGSRVKKDEDIQK

SEQ ID NO: 2537364 - protein, 23 aa, Entamoeba dispar
QQLDLNAAHIRKAVEQSSSVLNE

SEQ ID NO: 2537365 - protein, 27 aa, Entamoeba dispar
QQLDYTKLLLVIAYKKMKEVPSVLEKK

SEQ ID NO: 2537366 - protein, 20 aa, Entamoeba dispar
QQLEPFINYLFNISNQDNPD

SEQ ID NO: 2537367 - protein, 18 aa, Entamoeba dispar
QQLFSTDRFLYFFVLINN

SEQ ID NO: 2537368 - protein, 19 aa, Entamoeba dispar
QQLNNMLFSLKLRIDEMEE

SEQ ID NO: 2537369 - protein, 28 aa, Entamoeba dispar
QQMEHYFQALFFFPISYDVKSIKEQPEI

SEQ ID NO: 2537370 - protein, 25 aa, Entamoeba dispar
QQMVSVRDQLNGLIIECIGLMGMHT

SEQ ID NO: 2537371 - protein, 26 aa, Entamoeba dispar
QQNAQTLYKQLLYWEPKDANGSVLDE

SEQ ID NO: 2537372 - protein, 24 aa, Entamoeba dispar
QQNEEIVPILYKNNGPHANDPKYK

SEQ ID NO: 2537373 - protein, 35 aa, Entamoeba dispar
QQNFEIATPYILSKYYFEHLLKNSYAQFLEILKNA

SEQ ID NO: 2537374 - protein, 21 aa, Entamoeba dispar
QQNLLLLLLSNHYLNTLLTII

SEQ ID NO: 2537375 - protein, 25 aa, Entamoeba dispar
QQNQIIYEFNDFEDFKWIVREINEN

SEQ ID NO: 2537376 - protein, 24 aa, Entamoeba dispar
QQNYFHGPFIKVPFFEAGKNLKNR

SEQ ID NO: 2537377 - protein, 19 aa, Entamoeba dispar
QQPEELIPPKVPPKRKSQK

SEQ ID NO: 2537378 - protein, 23 aa, Entamoeba dispar
QQPIRLHQQLIYTLPSSITSAIA

SEQ ID NO: 2537379 - protein, 23 aa, Entamoeba dispar
QQPLLPFMGTISRDLVLVSEYNA

SEQ ID NO: 2537380 - protein, 18 aa, Entamoeba dispar
QQPNLFNKQLIQMATHQM

SEQ ID NO: 2537381 - protein, 23 aa, Entamoeba dispar
QQPNTQIQPQKDIWGNPIQPQNG

SEQ ID NO: 2537382 - protein, 22 aa, Entamoeba dispar
QQPNTQIQPQKDIWGNSIQPQN

SEQ ID NO: 2537383 - protein, 22 aa, Entamoeba dispar
QQPTVSILNFTKGGGILSTNNV

SEQ ID NO: 2537384 - protein, 18 aa, Entamoeba dispar
QQPYIPPVPQQQSTSSQT

SEQ ID NO: 2537385 - protein, 26 aa, Entamoeba dispar
QQPYPGLLEFFLKKNLNKSVKKSHTQ

SEQ ID NO: 2537386 - protein, 20 aa, Entamoeba dispar
QQQFNVFSNDFSFDKQIVQT

SEQ ID NO: 2537387 - protein, 23 aa, Entamoeba dispar
QQQKVIPSFFHLFDDLKHEEEDG

SEQ ID NO: 2537388 - protein, 18 aa, Entamoeba dispar
QQQLIKDSNFYQSVVVSA

SEQ ID NO: 2537389 - protein, 26 aa, Entamoeba dispar
QQQNNYPLYQPISYTTPFSNLQNRTS

SEQ ID NO: 2537390 - protein, 24 aa, Entamoeba dispar
QQQSTPFGFIQPTTQFNFSNINLM

SEQ ID NO: 2537391 - protein, 24 aa, Entamoeba dispar
QQQYHQSTFYQQPIQYSGRGYVQQ

SEQ ID NO: 2537392 - protein, 19 aa, Entamoeba dispar
QQQYIFILDFSWFSTEEVT

SEQ ID NO: 2537393 - protein, 24 aa, Entamoeba dispar
QQQYRKWTKLGIQGNKLFKPVCQT

SEQ ID NO: 2537394 - protein, 22 aa, Entamoeba dispar
QQRIKEIERIYESLTQQEKDLV

SEQ ID NO: 2537395 - protein, 18 aa, Entamoeba dispar
QQRIYYGAIILKKKVCYN

SEQ ID NO: 2537396 - protein, 17 aa, Entamoeba dispar
QQSLFKPSSQQQTGFTG

SEQ ID NO: 2537397 - protein, 19 aa, Entamoeba dispar
QQSNPLGGFGQPQSNLMGG

SEQ ID NO: 2537398 - protein, 24 aa, Entamoeba dispar
QQSRKVQWNLLPSSYISSYSKEPT

SEQ ID NO: 2537399 - protein, 24 aa, Entamoeba dispar
QQSTNLLDLLTGPLPTNLTPNTTI

SEQ ID NO: 2537400 - protein, 23 aa, Entamoeba dispar
QQTKYYHVFSDLKKYHPSIEDVC

SEQ ID NO: 2537401 - protein, 23 aa, Entamoeba dispar
QQTLWHILMLYNSNYHPEKPKQP

SEQ ID NO: 2537402 - protein, 26 aa, Entamoeba dispar
QQTNDVYFDRWKPIISICNKVGGNLK

SEQ ID NO: 2537403 - protein, 25 aa, Entamoeba dispar
QQTNDVYFDRWSPIISICNKVGGNL

SEQ ID NO: 2537404 - protein, 25 aa, Entamoeba dispar
QQTNDVYFERWKPIISICNKVGGNL

SEQ ID NO: 2537405 - protein, 25 aa, Entamoeba dispar
QQTNQLPILPKPRRIVKKRENGEFL

SEQ ID NO: 2537406 - protein, 30 aa, Entamoeba dispar
QQTYVELLEFQLKKYEEIPWIKELRKEHQE

SEQ ID NO: 2537407 - protein, 19 aa, Entamoeba dispar
QQVFIGKDSSSLISRLFRI

SEQ ID NO: 2537408 - protein, 17 aa, Entamoeba dispar
QQVIQALRRSIYAGIIL

SEQ ID NO: 2537409 - protein, 19 aa, Entamoeba dispar
QQVLYLQKLTEINFNLIFC

SEQ ID NO: 2537410 - protein, 24 aa, Entamoeba dispar
QQYEDVFFLFKEKSSVIARQLALF

SEQ ID NO: 2537411 - protein, 19 aa, Entamoeba dispar
QQYPGYGINPEIQQYNQIN

SEQ ID NO: 2537412 - protein, 20 aa, Entamoeba dispar
QQYPGYPIQQSPTSQQPVST

SEQ ID NO: 2537413 - protein, 17 aa, Entamoeba dispar
QRAMRYPMMIEGLMKVT

SEQ ID NO: 2537414 - protein, 24 aa, Entamoeba dispar
QRANEILPSLPWGKVFEKDVFESP

SEQ ID NO: 2537415 - protein, 24 aa, Entamoeba dispar
QRAQVGVPLCFVYTPLCNEVDRYD

SEQ ID NO: 2537416 - protein, 19 aa, Entamoeba dispar
QRATTLPLLIINLDDIMNT

SEQ ID NO: 2537417 - protein, 19 aa, Entamoeba dispar
QRCDWPLLHLYIISNNDND

SEQ ID NO: 2537418 - protein, 17 aa, Entamoeba dispar
QRDFLSLVANILNINND

SEQ ID NO: 2537419 - protein, 17 aa, Entamoeba dispar
QRDIREYRLIPLTPDNS

SEQ ID NO: 2537420 - protein, 33 aa, Entamoeba dispar
QRENATLFLLFAHALIDYIFYHSSYIYFNTNPP

SEQ ID NO: 2537421 - protein, 21 aa, Entamoeba dispar
QRERVLLYGTYYDAQIFSILQ

SEQ ID NO: 2537422 - protein, 24 aa, Entamoeba dispar
QREVLIKMKYLNGKFAVFDIKRSV

SEQ ID NO: 2537423 - protein, 20 aa, Entamoeba dispar
QRFHLIPSLVHKNYYQLFNL

SEQ ID NO: 2537424 - protein, 20 aa, Entamoeba dispar
QRFKEYRIMPTIGNIPVIEK

SEQ ID NO: 2537425 - protein, 17 aa, Entamoeba dispar
QRFNNWRSFMSKKNKSL

SEQ ID NO: 2537426 - protein, 18 aa, Entamoeba dispar
QRGAVIGIFNFHYEKSFT

SEQ ID NO: 2537427 - protein, 25 aa, Entamoeba dispar
QRGFTPIQTPYFMRRELMAKTAQLS

SEQ ID NO: 2537428 - protein, 19 aa, Entamoeba dispar
QRIAIARALIRKPSILLLD

SEQ ID NO: 2537429 - protein, 18 aa, Entamoeba dispar
QRILFVNCIFNKSIKYVQ

SEQ ID NO: 2537430 - protein, 24 aa, Entamoeba dispar
QRILNWLMAFFDAHITLLITDQQF

SEQ ID NO: 2537431 - protein, 19 aa, Entamoeba dispar
QRILVLIDAWDTTSKYPTG

SEQ ID NO: 2537432 - protein, 22 aa, Entamoeba dispar
QRIQLPLGIDIIEDESFMNCIN

SEQ ID NO: 2537433 - protein, 36 aa, Entamoeba dispar
QRIQSYLIMPIQRIPRYVLLIKDMLKNSPPLSPDTD

SEQ ID NO: 2537434 - protein, 23 aa, Entamoeba dispar
QRITWVYINIHKLYKLYCFEGHT

SEQ ID NO: 2537435 - protein, 19 aa, Entamoeba dispar
QRKAKLLTRLYKKKKNMEP

SEQ ID NO: 2537436 - protein, 19 aa, Entamoeba dispar
QRKEIYPLLLGIREGIKLN

SEQ ID NO: 2537437 - protein, 19 aa, Entamoeba dispar
QRKGTYHFRIALLPPENEI

SEQ ID NO: 2537438 - protein, 17 aa, Entamoeba dispar
QRKIVHQGFLIRKTKKL

SEQ ID NO: 2537439 - protein, 27 aa, Entamoeba dispar
QRKKIADILLFFIPTTKNCLIAKELGK

SEQ ID NO: 2537440 - protein, 17 aa, Entamoeba dispar
QRLLRSCGYIYTTSQQM

SEQ ID NO: 2537441 - protein, 23 aa, Entamoeba dispar
QRLNHLLIFTNIPKVLDNEPCQT

SEQ ID NO: 2537442 - protein, 20 aa, Entamoeba dispar
QRLRRYERNKIALAFNELVE

SEQ ID NO: 2537443 - protein, 23 aa, Entamoeba dispar
QRLSLNKIINRLYDSYITRNPQF

SEQ ID NO: 2537444 - protein, 18 aa, Entamoeba dispar
QRLTEYMNRLVVLPKVHA

SEQ ID NO: 2537445 - protein, 18 aa, Entamoeba dispar
QRMEIVNLMSKIMDFTEE

SEQ ID NO: 2537446 - protein, 27 aa, Entamoeba dispar
QRMKAQYFLEKYFSILYYRNNDKTIQF

SEQ ID NO: 2537447 - protein, 24 aa, Entamoeba dispar
QRNLQHLTELFISYGYCKVEHFMS

SEQ ID NO: 2537448 - protein, 23 aa, Entamoeba dispar
QRNPTFIIWGLYLGSVNSTYDIE

SEQ ID NO: 2537449 - protein, 32 aa, Entamoeba dispar
QRNSFCFFIVCLFLLYKTYPTQFEFNESLLHF

SEQ ID NO: 2537450 - protein, 25 aa, Entamoeba dispar
QRNSFYNFIGRLYPEHSHNIKSRQV

SEQ ID NO: 2537451 - protein, 28 aa, Entamoeba dispar
QRNTIDCGVFMLYFIDKIARTNPTTLSD

SEQ ID NO: 2537452 - protein, 27 aa, Entamoeba dispar
QRPDAVTLLWHPFIVAQSPPSPQPLLD

SEQ ID NO: 2537453 - protein, 28 aa, Entamoeba dispar
QRPDAVTLLWHPFIVAQSPPSPQPLLDL

SEQ ID NO: 2537454 - protein, 26 aa, Entamoeba dispar
QRPQQKKPMILPSVQNNSIPRRGQLR

SEQ ID NO: 2537455 - protein, 29 aa, Entamoeba dispar
QRPVFIKKVKVLFRTISRYPDYTNSGSID

SEQ ID NO: 2537456 - protein, 22 aa, Entamoeba dispar
QRQALYDRLVGFKKNRGKEPFF

SEQ ID NO: 2537457 - protein, 25 aa, Entamoeba dispar
QRQSIYSCSPIGTLNPSYNCNINNS

SEQ ID NO: 2537458 - protein, 27 aa, Entamoeba dispar
QRRNVKCITLPFFQIKRLHFNNKEDYV

SEQ ID NO: 2537459 - protein, 20 aa, Entamoeba dispar
QRSIDRFIIKDWSIDYLVRI

SEQ ID NO: 2537460 - protein, 27 aa, Entamoeba dispar
QRSKKYPFMIYALRLFKILYEMNIVNE

SEQ ID NO: 2537461 - protein, 27 aa, Entamoeba dispar
QRSLMNKSSLYIILFDEKGNVFGGYNR

SEQ ID NO: 2537462 - protein, 18 aa, Entamoeba dispar
QRSLRFGFVTYDKAEDAK

SEQ ID NO: 2537463 - protein, 27 aa, Entamoeba dispar
QRSMKYFEIVTLIYQHIILPCIEEKDV

SEQ ID NO: 2537464 - protein, 18 aa, Entamoeba dispar
QRTAVLLHRLFAHGSTIC

SEQ ID NO: 2537465 - protein, 23 aa, Entamoeba dispar
QRTRQYHILLIIADGQVDAERAT

SEQ ID NO: 2537466 - protein, 17 aa, Entamoeba dispar
QRVCKALALLQTIASHP

SEQ ID NO: 2537467 - protein, 30 aa, Entamoeba dispar
QRVYKWKDCGKIWRMRACCVIYVNFANKKE

SEQ ID NO: 2537468 - protein, 24 aa, Entamoeba dispar
QRYSFAIDLWSVGCILGEIINGKP

SEQ ID NO: 2537469 - protein, 23 aa, Entamoeba dispar
QRYTRKPIRYFQKSSYNNFSITP

SEQ ID NO: 2537470 - protein, 24 aa, Entamoeba dispar
QSCCEAYIIAFKEPFNLDSKSFDN

SEQ ID NO: 2537471 - protein, 35 aa, Entamoeba dispar
QSCEPPLLPPTLYKSIFLFYRDIVRVNLVFLQSLE

SEQ ID NO: 2537472 - protein, 32 aa, Entamoeba dispar
QSCIPPFTCPPTEYYLYKKIQSISSTPILQIE

SEQ ID NO: 2537473 - protein, 25 aa, Entamoeba dispar
QSDIILLNILVLIQPEIKEIIPKKY

SEQ ID NO: 2537474 - protein, 25 aa, Entamoeba dispar
QSDKSISSLIPLIKKHPPSGLSEIV

SEQ ID NO: 2537475 - protein, 35 aa, Entamoeba dispar
QSDLEALKIVYPSIPIITVILNYPEYCLAPPKTNE

SEQ ID NO: 2537476 - protein, 22 aa, Entamoeba dispar
QSDRLKNALSLKDIKYNNDLDK

SEQ ID NO: 2537477 - protein, 24 aa, Entamoeba dispar
QSDSVRAALMKLLQKIFLKECAAP

SEQ ID NO: 2537478 - protein, 21 aa, Entamoeba dispar
QSDVLRFLRRIRCWELRHLPR

SEQ ID NO: 2537479 - protein, 32 aa, Entamoeba dispar
QSDVYSYGIILWELIYRVIYQKYQRPFQEFPE

SEQ ID NO: 2537480 - protein, 25 aa, Entamoeba dispar
QSDYTLLYTLQLVDKILFPEKDNES

SEQ ID NO: 2537481 - protein, 25 aa, Entamoeba dispar
QSEDEAMLFLMKIFPLNCFNEVLVN

SEQ ID NO: 2537482 - protein, 17 aa, Entamoeba dispar
QSEGLFNLSLLINDGGG

SEQ ID NO: 2537483 - protein, 28 aa, Entamoeba dispar
QSEILNKFSPFFIHLVKIIFKRIDQLVE

SEQ ID NO: 2537484 - protein, 24 aa, Entamoeba dispar
QSELYKQIGIDPPRGCLLYGPPGT

SEQ ID NO: 2537485 - protein, 28 aa, Entamoeba dispar
QSEQQCILIALLNLKFDILLEKPRKINT

SEQ ID NO: 2537486 - protein, 33 aa, Entamoeba dispar
QSESSLILLPPYSFSLLPSLHSMGFFFQHPICN

SEQ ID NO: 2537487 - protein, 25 aa, Entamoeba dispar
QSETLPYYDFIELSPLLDSSAMTPK

SEQ ID NO: 2537488 - protein, 28 aa, Entamoeba dispar
QSFEKISFLLFFRITKVIQRLIDSLSNQ

SEQ ID NO: 2537489 - protein, 23 aa, Entamoeba dispar
QSFKNMINFMFQDSQLELNSSFD

SEQ ID NO: 2537490 - protein, 19 aa, Entamoeba dispar
QSFTWAVNALFSCLYEKRL

SEQ ID NO: 2537491 - protein, 21 aa, Entamoeba dispar
QSFWMKRVAYLAAQICLHESD

SEQ ID NO: 2537492 - protein, 24 aa, Entamoeba dispar
QSGVLMPFYDADSSILYLGGKGDS

SEQ ID NO: 2537493 - protein, 27 aa, Entamoeba dispar
QSHAILPYDQYLHRFAAYFQQGDMESN

SEQ ID NO: 2537494 - protein, 24 aa, Entamoeba dispar
QSHKLFKYLRTINPTVPKKYFHFR

SEQ ID NO: 2537495 - protein, 17 aa, Entamoeba dispar
QSHLLLSLGPLNDVHEP

SEQ ID NO: 2537496 - protein, 27 aa, Entamoeba dispar
QSHYISFLNEMARLRFINKQYITDMVN

SEQ ID NO: 2537497 - protein, 26 aa, Entamoeba dispar
QSIENIHLFVLILNYFMIHFTTNKEI

SEQ ID NO: 2537498 - protein, 18 aa, Entamoeba dispar
QSIFIIETLVGLQVFYNG

SEQ ID NO: 2537499 - protein, 31 aa, Entamoeba dispar
QSIFLALLNDYFEIELLPPIKRSNVATQLLR

SEQ ID NO: 2537500 - protein, 20 aa, Entamoeba dispar
QSIFVLTTHLANHTGYPVVG

SEQ ID NO: 2537501 - protein, 17 aa, Entamoeba dispar
QSIGYIKLFKFIEGLNE

SEQ ID NO: 2537502 - protein, 27 aa, Entamoeba dispar
QSIHDKKLYYIFNKDFLIGLIRHNGQV

SEQ ID NO: 2537503 - protein, 21 aa, Entamoeba dispar
QSIILLTKLFSLGIKDLKGQF

SEQ ID NO: 2537504 - protein, 26 aa, Entamoeba dispar
QSIITPNCRLFFSSKTVLLEYYNILL

SEQ ID NO: 2537505 - protein, 33 aa, Entamoeba dispar
QSIKPDEILLLDTYFYLVVFRGNAVAEWMKQKL

SEQ ID NO: 2537506 - protein, 21 aa, Entamoeba dispar
QSIQFVMRKGAVTTFPAILSN

SEQ ID NO: 2537507 - protein, 24 aa, Entamoeba dispar
QSISTFLLFLNSGLTDLFEGLWSS

SEQ ID NO: 2537508 - protein, 25 aa, Entamoeba dispar
QSITALAHLPSCVLYLMDVSGSCGY

SEQ ID NO: 2537509 - protein, 23 aa, Entamoeba dispar
QSIVLAREYNWNKIPFIESNDSK

SEQ ID NO: 2537510 - protein, 19 aa, Entamoeba dispar
QSIYLYINSKLPSPDRIIR

SEQ ID NO: 2537511 - protein, 35 aa, Entamoeba dispar
QSKEAQYLVTTFRPELILPANKWYEIKHQNKVSTI

SEQ ID NO: 2537512 - protein, 26 aa, Entamoeba dispar
QSKKTIEYAPLWLPQSIQNCQLCGKS

SEQ ID NO: 2537513 - protein, 22 aa, Entamoeba dispar
QSKKVIILMNSNKMLYIECTYE

SEQ ID NO: 2537514 - protein, 24 aa, Entamoeba dispar
QSKSALFLLYCSDPLKQKENIEKR

SEQ ID NO: 2537515 - protein, 19 aa, Entamoeba dispar
QSKSPLSPPKSTIKTRLSI

SEQ ID NO: 2537516 - protein, 22 aa, Entamoeba dispar
QSLDILLNCYLKPLNESKYNKS

SEQ ID NO: 2537517 - protein, 21 aa, Entamoeba dispar
QSLDWKLYFPNGKPAEMLDIG

SEQ ID NO: 2537518 - protein, 23 aa, Entamoeba dispar
QSLERSNCYLLKPRKSFSKNIPQ

SEQ ID NO: 2537519 - protein, 34 aa, Entamoeba dispar
QSLIKVNTKWVGIPWIGIGKVAVWPLEKSGKMID

SEQ ID NO: 2537520 - protein, 29 aa, Entamoeba dispar
QSLILTVKGIPFLLKFAEIQLVGAKGEII

SEQ ID NO: 2537521 - protein, 35 aa, Entamoeba dispar
QSLMKKDIAILFLLQQFYPFFDNFLDAKLLQVGRI

SEQ ID NO: 2537522 - protein, 20 aa, Entamoeba dispar
QSLRKMISFIFTELHFHRIE

SEQ ID NO: 2537523 - protein, 17 aa, Entamoeba dispar
QSLSLCYVLSKHSPITS

SEQ ID NO: 2537524 - protein, 24 aa, Entamoeba dispar
QSLTKTYPHFQKKQIPFVQIISDQ

SEQ ID NO: 2537525 - protein, 24 aa, Entamoeba dispar
QSMLHFIHGLLQYDPDSRWTAKQA

SEQ ID NO: 2537526 - protein, 19 aa, Entamoeba dispar
QSMLQSRRYWSTEEHTKFI

SEQ ID NO: 2537527 - protein, 25 aa, Entamoeba dispar
QSMQPSLIHFVSSLPLIPCLTPLNS

SEQ ID NO: 2537528 - protein, 18 aa, Entamoeba dispar
QSMVLLLPAIVSATSKVI

SEQ ID NO: 2537529 - protein, 25 aa, Entamoeba dispar
QSNEDYYFVIISTTSPRLTVFKKID

SEQ ID NO: 2537530 - protein, 27 aa, Entamoeba dispar
QSNELLELVYTLFDSFPIAVRVGTKEL

SEQ ID NO: 2537531 - protein, 29 aa, Entamoeba dispar
QSNELLELVYTLFDSFPIAVRVGTKELGD

SEQ ID NO: 2537532 - protein, 21 aa, Entamoeba dispar
QSNEYLNIVLFVIDCQKNEIK

SEQ ID NO: 2537533 - protein, 28 aa, Entamoeba dispar
QSNIHQILIHLINTFIIFKDYCIKYYCF

SEQ ID NO: 2537534 - protein, 29 aa, Entamoeba dispar
QSNIHQILIHLINTFIIFKDYCIKYYCFR

SEQ ID NO: 2537535 - protein, 18 aa, Entamoeba dispar
QSPLLSLIDRIPNPSLKN

SEQ ID NO: 2537536 - protein, 18 aa, Entamoeba dispar
QSPYFKDLTHRLTALDDK

SEQ ID NO: 2537537 - protein, 25 aa, Entamoeba dispar
QSQLKDILIIPHFSQNKLILVDVIS

SEQ ID NO: 2537538 - protein, 19 aa, Entamoeba dispar
QSQLRYLQSFAFNGDLLPD

SEQ ID NO: 2537539 - protein, 24 aa, Entamoeba dispar
QSQQLPIKVIPPKVSPQHNSINND

SEQ ID NO: 2537540 - protein, 24 aa, Entamoeba dispar
QSQRFMYIVMEYVEGLTLAQYLQL

SEQ ID NO: 2537541 - protein, 27 aa, Entamoeba dispar
QSQSDTLLIFQLLRGISTRPTMLFFEQ

SEQ ID NO: 2537542 - protein, 41 aa, Entamoeba dispar
QSQVFKKYTPLKKYMKCLDPLLEFCRLLTMPMSLEIIQMKD

SEQ ID NO: 2537543 - protein, 23 aa, Entamoeba dispar
QSRLKILTAENEKLRKAGAGARL

SEQ ID NO: 2537544 - protein, 23 aa, Entamoeba dispar
QSRNQFIFLKEFIDYNIQCIEGQ

SEQ ID NO: 2537545 - protein, 18 aa, Entamoeba dispar
QSRVIYDDRNCLSLGFGF

SEQ ID NO: 2537546 - protein, 23 aa, Entamoeba dispar
QSSFLSKVIRVSGIIVSISRVEP

SEQ ID NO: 2537547 - protein, 39 aa, Entamoeba dispar
QSSIQKEAELLFSRAKTLGLDDCIEEWNKDLQSDIKRFQ

SEQ ID NO: 2537548 - protein, 23 aa, Entamoeba dispar
QSSKNLFANFSFDGLKGSENKED

SEQ ID NO: 2537549 - protein, 20 aa, Entamoeba dispar
QSSPSIVPPIKTNPTHKSEP

SEQ ID NO: 2537550 - protein, 24 aa, Entamoeba dispar
QSSSPILSLLSRLIEREHFERPGE

SEQ ID NO: 2537551 - protein, 40 aa, Entamoeba dispar
QSTELFNGPSIFLFIFDENKNAFGWYFPQGINENGTGEYQ

SEQ ID NO: 2537552 - protein, 28 aa, Entamoeba dispar
QSTSVLLHPYGPWSIYMKDAEMYLGYDS

SEQ ID NO: 2537553 - protein, 33 aa, Entamoeba dispar
QSVESDSILLLDTFFYIVVFRGEAVADWMKQKL

SEQ ID NO: 2537554 - protein, 19 aa, Entamoeba dispar
QSVLKFYSTLYVNELFEIN

SEQ ID NO: 2537555 - protein, 28 aa, Entamoeba dispar
QSVSPVTFILPFYTKVLILFKLNNIEFN

SEQ ID NO: 2537556 - protein, 20 aa, Entamoeba dispar
QSWCFGWYSFQYSISENNSY

SEQ ID NO: 2537557 - protein, 19 aa, Entamoeba dispar
QSWLKEIQRYCDPDVDVGV

SEQ ID NO: 2537558 - protein, 21 aa, Entamoeba dispar
QSYKHIFGISNQAKDLRTLCG

SEQ ID NO: 2537559 - protein, 19 aa, Entamoeba dispar
QSYKRIETIHLLIDVLREY

SEQ ID NO: 2537560 - protein, 24 aa, Entamoeba dispar
QSYLTKLVIWNLEQQPLLPNTLKS

SEQ ID NO: 2537561 - protein, 23 aa, Entamoeba dispar
QSYPILLNHFKSIDFLNGKKVTL

SEQ ID NO: 2537562 - protein, 26 aa, Entamoeba dispar
QSYQEVLGKMILIGFSHLLNLNQQSS

SEQ ID NO: 2537563 - protein, 21 aa, Entamoeba dispar
QTALIYFQYQSGHLLTMERKE

SEQ ID NO: 2537564 - protein, 24 aa, Entamoeba dispar
QTDINLPRILKISDLLSLNSPRIA

SEQ ID NO: 2537565 - protein, 21 aa, Entamoeba dispar
QTDVHQLLKQLATQQIITNSR

SEQ ID NO: 2537566 - protein, 30 aa, Entamoeba dispar
QTEDLLYDYYNRLYIYPLEISFGKEKKRNP

SEQ ID NO: 2537567 - protein, 17 aa, Entamoeba dispar
QTEFYVNLLYKKSNSQK

SEQ ID NO: 2537568 - protein, 27 aa, Entamoeba dispar
QTEKEIDLLFRVQPIPRLPNPRRVKTG

SEQ ID NO: 2537569 - protein, 27 aa, Entamoeba dispar
QTENGISEYLVSIPPGIVSGTKVNPIN

SEQ ID NO: 2537570 - protein, 19 aa, Entamoeba dispar
QTENLFKHKLIDFIIEFMQ

SEQ ID NO: 2537571 - protein, 23 aa, Entamoeba dispar
QTEPILFEFLELYSDLKTLQIST

SEQ ID NO: 2537572 - protein, 23 aa, Entamoeba dispar
QTESLTDFIIPQTALNYVASNSK

SEQ ID NO: 2537573 - protein, 23 aa, Entamoeba dispar
QTFLNKRVLKMMKFLYDTKSTVT

SEQ ID NO: 2537574 - protein, 20 aa, Entamoeba dispar
QTFNPLYDIIGTGKSILIPG

SEQ ID NO: 2537575 - protein, 17 aa, Entamoeba dispar
QTFPDINKNTLWLIMRF

SEQ ID NO: 2537576 - protein, 20 aa, Entamoeba dispar
QTFTILLKGFKNKTPEEVCA

SEQ ID NO: 2537577 - protein, 17 aa, Entamoeba dispar
QTFWYSRVNSYTSRTGD

SEQ ID NO: 2537578 - protein, 24 aa, Entamoeba dispar
QTGMKNYIELLDTSNTKRAEEKYN

SEQ ID NO: 2537579 - protein, 19 aa, Entamoeba dispar
QTGVLIETLKALGANLRWA

SEQ ID NO: 2537580 - protein, 17 aa, Entamoeba dispar
QTIIFKYNDKETILNNI

SEQ ID NO: 2537581 - protein, 20 aa, Entamoeba dispar
QTIKYLYCRPTVSALEQPKK

SEQ ID NO: 2537582 - protein, 24 aa, Entamoeba dispar
QTILHLSPILLQKGTTRIALYGMS

SEQ ID NO: 2537583 - protein, 17 aa, Entamoeba dispar
QTILLDPAKKMDIHRDV

SEQ ID NO: 2537584 - protein, 19 aa, Entamoeba dispar
QTILLSPYLQKLPQNCFFN

SEQ ID NO: 2537585 - protein, 20 aa, Entamoeba dispar
QTIRKWLKCAQGNKYRMGNL

SEQ ID NO: 2537586 - protein, 31 aa, Entamoeba dispar
QTISKVFSHIWFLFEVIIHSLIKYLDKQHAL

SEQ ID NO: 2537587 - protein, 25 aa, Entamoeba dispar
QTITKIKGIILPKLSKMKTQLLNTS

SEQ ID NO: 2537588 - protein, 18 aa, Entamoeba dispar
QTIVIPQKYRNQTVDCPI

SEQ ID NO: 2537589 - protein, 28 aa, Entamoeba dispar
QTKPTNYILVIIIHSGIFSPLETGLYCV

SEQ ID NO: 2537590 - protein, 29 aa, Entamoeba dispar
QTKQIGFEMWYFLSAIILDRNFVQETYLV

SEQ ID NO: 2537591 - protein, 21 aa, Entamoeba dispar
QTKSFFPFHLQPFLTHKLLIH

SEQ ID NO: 2537592 - protein, 30 aa, Entamoeba dispar
QTLETEIHPLMFYLNRPLVQTPKYESLIKT

SEQ ID NO: 2537593 - protein, 17 aa, Entamoeba dispar
QTLGNIIAIYSNSCLIF

SEQ ID NO: 2537594 - protein, 24 aa, Entamoeba dispar
QTLKDYVQTYLYLSRVEKKEDRRV

SEQ ID NO: 2537595 - protein, 18 aa, Entamoeba dispar
QTLKFKIFEDIANGVAAC

SEQ ID NO: 2537596 - protein, 32 aa, Entamoeba dispar
QTLQDMIFMLQGVPPLYLLKNNKFPPLTKEVV

SEQ ID NO: 2537597 - protein, 28 aa, Entamoeba dispar
QTLRVYLNYIIRCPYFVDHFPVFSQSKE

SEQ ID NO: 2537598 - protein, 25 aa, Entamoeba dispar
QTLVKYYNGFQWYFQKRIVHCKTQE

SEQ ID NO: 2537599 - protein, 26 aa, Entamoeba dispar
QTMMENVLLVWALRHPACGYVQGMND

SEQ ID NO: 2537600 - protein, 20 aa, Entamoeba dispar
QTNCWIHPDINYKLFEMKNG

SEQ ID NO: 2537601 - protein, 18 aa, Entamoeba dispar
QTNFIWYPEQFSSYRLFP

SEQ ID NO: 2537602 - protein, 18 aa, Entamoeba dispar
QTNNLYQFGYNPFRLLPK

SEQ ID NO: 2537603 - protein, 27 aa, Entamoeba dispar
QTPDYLQLRMLFWRIAKREGIEFDGQF

SEQ ID NO: 2537604 - protein, 22 aa, Entamoeba dispar
QTPKGVLLYGPPGTGKTLMARA

SEQ ID NO: 2537605 - protein, 17 aa, Entamoeba dispar
QTPNIHYIHFKTKYKQL

SEQ ID NO: 2537606 - protein, 33 aa, Entamoeba dispar
QTPNTPLFVNVDSSMIEFLKNKIQSDRLKNALS

SEQ ID NO: 2537607 - protein, 25 aa, Entamoeba dispar
QTPRKSITKPLLLNSLNTSSIDDIV

SEQ ID NO: 2537608 - protein, 24 aa, Entamoeba dispar
QTPTHLVFILDYCAGGELFSYLQK

SEQ ID NO: 2537609 - protein, 22 aa, Entamoeba dispar
QTQGIIPVTPFITTQNGQLRLD

SEQ ID NO: 2537610 - protein, 23 aa, Entamoeba dispar
QTQLNIPITIPLQQQILEDKLEN

SEQ ID NO: 2537611 - protein, 24 aa, Entamoeba dispar
QTQLQNLFLMKEVKLFIDNIYNVE

SEQ ID NO: 2537612 - protein, 27 aa, Entamoeba dispar
QTQPERTFIFKFLMNEINFHLNDKQGD

SEQ ID NO: 2537613 - protein, 17 aa, Entamoeba dispar
QTRLFRPLITISTSKKN

SEQ ID NO: 2537614 - protein, 25 aa, Entamoeba dispar
QTRRPPPPLPNRKVPPTLPSRSDNN

SEQ ID NO: 2537615 - protein, 26 aa, Entamoeba dispar
QTSCKSRVILLLISALKYFTKNGEDF

SEQ ID NO: 2537616 - protein, 20 aa, Entamoeba dispar
QTSHLPPLPTPSHHKTESCQ

SEQ ID NO: 2537617 - protein, 31 aa, Entamoeba dispar
QTSLNHPLLSFLILPFYHPAPEFLEALQFSI

SEQ ID NO: 2537618 - protein, 23 aa, Entamoeba dispar
QTSVPLYNQLFHANPEQLEQIYD

SEQ ID NO: 2537619 - protein, 25 aa, Entamoeba dispar
QTTGISFHIPRLIIPNDRINISPRS

SEQ ID NO: 2537620 - protein, 17 aa, Entamoeba dispar
QTTIKIRRVFAWNIIQL

SEQ ID NO: 2537621 - protein, 23 aa, Entamoeba dispar
QTTILFKNIIRYVKLEGYGRRIK

SEQ ID NO: 2537622 - protein, 25 aa, Entamoeba dispar
QTVCDFFSRLILRHPTSSVIIKENI

SEQ ID NO: 2537623 - protein, 17 aa, Entamoeba dispar
QTVCTLEYEMWKEMVDA

SEQ ID NO: 2537624 - protein, 33 aa, Entamoeba dispar
QTVDCPIKLFDGNTIPVRIIGQEGIQGVCEGYG

SEQ ID NO: 2537625 - protein, 21 aa, Entamoeba dispar
QTVNIHCTLFLTKNGYEEKGL

SEQ ID NO: 2537626 - protein, 21 aa, Entamoeba dispar
QTVYGYLNKKNIFSLKESSVG

SEQ ID NO: 2537627 - protein, 23 aa, Entamoeba dispar
QTWQQQFWEGFKLLSSTTAEPYE

SEQ ID NO: 2537628 - protein, 27 aa, Entamoeba dispar
QTYAVTKLFPLMRIASQPIKKAAVWCV

SEQ ID NO: 2537629 - protein, 28 aa, Entamoeba dispar
QTYDFLSVIFTRLLFSIQTLSQIHFHKL

SEQ ID NO: 2537630 - protein, 18 aa, Entamoeba dispar
QTYEVFYLNRDKINNNQN

SEQ ID NO: 2537631 - protein, 18 aa, Entamoeba dispar
QTYVIPPLTSNKSIFIST

SEQ ID NO: 2537632 - protein, 29 aa, Entamoeba dispar
QVAIHFSVNFILLIPPTALRTSIYVNCLQ

SEQ ID NO: 2537633 - protein, 18 aa, Entamoeba dispar
QVAPIYYGIIDHLCILLK

SEQ ID NO: 2537634 - protein, 22 aa, Entamoeba dispar
QVASWISISQLATSGFAVVGNV

SEQ ID NO: 2537635 - protein, 28 aa, Entamoeba dispar
QVCPEQSFFNYFFPTSQFTLTKIPPKCD

SEQ ID NO: 2537636 - protein, 30 aa, Entamoeba dispar
QVCPEQSFFNYFFPTSQFTLTKIPPKCDLV

SEQ ID NO: 2537637 - protein, 34 aa, Entamoeba dispar
QVDAHYTLKYFLKTWIRFIHLCGTPAQLQDAAVV

SEQ ID NO: 2537638 - protein, 23 aa, Entamoeba dispar
QVDDLLYFYCYTYQKIQEHYKKH

SEQ ID NO: 2537639 - protein, 29 aa, Entamoeba dispar
QVDIWAFGVMLYYLKFGITPFNSSTREVV

SEQ ID NO: 2537640 - protein, 26 aa, Entamoeba dispar
QVDNKPFRLAIWDTAGQEKYRSMVSM

SEQ ID NO: 2537641 - protein, 17 aa, Entamoeba dispar
QVFALSKNFYVVYIAIY

SEQ ID NO: 2537642 - protein, 19 aa, Entamoeba dispar
QVFGINFSFYDYKKPTMLK

SEQ ID NO: 2537643 - protein, 26 aa, Entamoeba dispar
QVFTMNDRILPFIKFLINREFEESHS

SEQ ID NO: 2537644 - protein, 29 aa, Entamoeba dispar
QVGREELYSQPILVEKYRKSKKEVEKMIE

SEQ ID NO: 2537645 - protein, 19 aa, Entamoeba dispar
QVIAFSLGKYRIFGETIDI

SEQ ID NO: 2537646 - protein, 21 aa, Entamoeba dispar
QVIDVLLKAVAYIQTELINGA

SEQ ID NO: 2537647 - protein, 30 aa, Entamoeba dispar
QVIQGRILFYSWCFDLIVISAHTKMKIIAE

SEQ ID NO: 2537648 - protein, 18 aa, Entamoeba dispar
QVIRVPVNKLTYEQIRKL

SEQ ID NO: 2537649 - protein, 29 aa, Entamoeba dispar
QVISGTTKGYFLSARIFTLYSNDKTMRVI

SEQ ID NO: 2537650 - protein, 18 aa, Entamoeba dispar
QVKKITTPIIFISSTACN

SEQ ID NO: 2537651 - protein, 23 aa, Entamoeba dispar
QVKLDLVIGEEIIFSNTGLHYIH

SEQ ID NO: 2537652 - protein, 23 aa, Entamoeba dispar
QVKNFIVLSHFIPEGVTLVKDIS

SEQ ID NO: 2537653 - protein, 17 aa, Entamoeba dispar
QVKVNLFDNSEVLAWYG

SEQ ID NO: 2537654 - protein, 25 aa, Entamoeba dispar
QVKVSSILPFYSFTFDAILKDKTIQ

SEQ ID NO: 2537655 - protein, 17 aa, Entamoeba dispar
QVLFVVFDDGKEVPLTW

SEQ ID NO: 2537656 - protein, 17 aa, Entamoeba dispar
QVLIWRETSNNNYAVVY

SEQ ID NO: 2537657 - protein, 27 aa, Entamoeba dispar
QVLMNQSFYKIVEAVKYYLKFAYPNSG

SEQ ID NO: 2537658 - protein, 21 aa, Entamoeba dispar
QVLRYQFNGKPLWIKSNDIPQ

SEQ ID NO: 2537659 - protein, 33 aa, Entamoeba dispar
QVLSQDNMYSAWNPQLLISLKAPQAVAAMNACT

SEQ ID NO: 2537660 - protein, 26 aa, Entamoeba dispar
QVLSRLTFTSALAYLRKISSPVEGKR

SEQ ID NO: 2537661 - protein, 17 aa, Entamoeba dispar
QVLVALNYLHNKCSLIH

SEQ ID NO: 2537662 - protein, 23 aa, Entamoeba dispar
QVMFNVFNVLWMKSSFLAHPTAF

SEQ ID NO: 2537663 - protein, 19 aa, Entamoeba dispar
QVPLKCDLEDLYNGKTFKR

SEQ ID NO: 2537664 - protein, 20 aa, Entamoeba dispar
QVPLNLFGEVMYLLGVDVGQ

SEQ ID NO: 2537665 - protein, 26 aa, Entamoeba dispar
QVQEFKQILKLLKSGSIRAVRVKTNG

SEQ ID NO: 2537666 - protein, 25 aa, Entamoeba dispar
QVQPVYIQPVQPQFVPLRQRQIQQI

SEQ ID NO: 2537667 - protein, 21 aa, Entamoeba dispar
QVRLRIGNILIYRTILEDAAV

SEQ ID NO: 2537668 - protein, 17 aa, Entamoeba dispar
QVRSHAQKFFKKKGITL

SEQ ID NO: 2537669 - protein, 25 aa, Entamoeba dispar
QVSIRFFKMLLDISGLMTEEIPLYI

SEQ ID NO: 2537670 - protein, 17 aa, Entamoeba dispar
QVSPQSCIQLTNPPPPP

SEQ ID NO: 2537671 - protein, 23 aa, Entamoeba dispar
QVTFNKWKLISDITKLMGNRFYI

SEQ ID NO: 2537672 - protein, 22 aa, Entamoeba dispar
QVTVILFNDIVLLLTADVAASI

SEQ ID NO: 2537673 - protein, 31 aa, Entamoeba dispar
QVVKVISDIFPLKDIWKHVCIVWTKCYNYSQ

SEQ ID NO: 2537674 - protein, 17 aa, Entamoeba dispar
QVVSFLEHLYSFQKLQG

SEQ ID NO: 2537675 - protein, 21 aa, Entamoeba dispar
QVWEPALIKLNAIAAATEAAS

SEQ ID NO: 2537676 - protein, 24 aa, Entamoeba dispar
QVWRALLHDFLKKTLEYDPSKRLT

SEQ ID NO: 2537677 - protein, 24 aa, Entamoeba dispar
QVYFRFGDWDTIRILRVIIKVQPI

SEQ ID NO: 2537678 - protein, 27 aa, Entamoeba dispar
QVYQESILIKLLLPYCDVVFGRPSKRT

SEQ ID NO: 2537679 - protein, 29 aa, Entamoeba dispar
QWDENTIRDIWWKGPIGSDGKYMILGNGF

SEQ ID NO: 2537680 - protein, 24 aa, Entamoeba dispar
QWEIPITKLFGSAPVKILMITPKV

SEQ ID NO: 2537681 - protein, 24 aa, Entamoeba dispar
QWIKRDKLYLLYDSKINGIEKDSL

SEQ ID NO: 2537682 - protein, 20 aa, Entamoeba dispar
QWILTQYIIYIIRCIPYSTK

SEQ ID NO: 2537683 - protein, 37 aa, Entamoeba dispar
QWKEYREKIIIKLRSITPIFNSIYPKTKNKEEYEMIM

SEQ ID NO: 2537684 - protein, 17 aa, Entamoeba dispar
QWLRVCTGAKIFQGYGL

SEQ ID NO: 2537685 - protein, 26 aa, Entamoeba dispar
QWNDEITIFVMLKYKKWQLSQRKYMT

SEQ ID NO: 2537686 - protein, 18 aa, Entamoeba dispar
QWRVPLPIFRAMQYLEEH

SEQ ID NO: 2537687 - protein, 17 aa, Entamoeba dispar
QWYVDTMLLATCLGGEF

SEQ ID NO: 2537688 - protein, 19 aa, Entamoeba dispar
QWYYTMEQVLPQYYNKKQE

SEQ ID NO: 2537689 - protein, 27 aa, Entamoeba dispar
QYASNYLELILRIFKKPYLTFGDKTGI

SEQ ID NO: 2537690 - protein, 30 aa, Entamoeba dispar
QYASNYLELILRIFKKPYLTFGDKTGIIQV

SEQ ID NO: 2537691 - protein, 27 aa, Entamoeba dispar
QYATYIFNKGFILKVKHLLKSNFTDST

SEQ ID NO: 2537692 - protein, 23 aa, Entamoeba dispar
QYAYLVISKSYFYIESYDEAVNY

SEQ ID NO: 2537693 - protein, 29 aa, Entamoeba dispar
QYCFSHNYIIQYIPLFSKLFSIDDESVLI

SEQ ID NO: 2537694 - protein, 24 aa, Entamoeba dispar
QYDDVLRINCQLIEIADGCERCRQ

SEQ ID NO: 2537695 - protein, 26 aa, Entamoeba dispar
QYDYKLLEFSLIYNILETFKHNYKYN

SEQ ID NO: 2537696 - protein, 26 aa, Entamoeba dispar
QYEDALKYYFKSITIIGYIDEEMSEE

SEQ ID NO: 2537697 - protein, 21 aa, Entamoeba dispar
QYEEPKVSSIFILIKMQQKQT

SEQ ID NO: 2537698 - protein, 30 aa, Entamoeba dispar
QYEIGKMLFLLFVDFTIYCSKQPIGQHGIY

SEQ ID NO: 2537699 - protein, 19 aa, Entamoeba dispar
QYFHRPLNPKKLDAIGFST

SEQ ID NO: 2537700 - protein, 17 aa, Entamoeba dispar
QYFLVPNPKIKTTRLCV

SEQ ID NO: 2537701 - protein, 18 aa, Entamoeba dispar
QYFPSVLQRFPTLRTRSQ

SEQ ID NO: 2537702 - protein, 19 aa, Entamoeba dispar
QYFVKKGIAVAKRVSSRDL

SEQ ID NO: 2537703 - protein, 20 aa, Entamoeba dispar
QYGEIIKIIPNIKTLHNLQS

SEQ ID NO: 2537704 - protein, 23 aa, Entamoeba dispar
QYGGWTISFEYIQTLGNIIAIYS

SEQ ID NO: 2537705 - protein, 33 aa, Entamoeba dispar
QYGIDQILHDLFLFAAQNLVVGGRLVFWFPSIF

SEQ ID NO: 2537706 - protein, 22 aa, Entamoeba dispar
QYGTVPPPLSPYGTVPAPVTPY

SEQ ID NO: 2537707 - protein, 17 aa, Entamoeba dispar
QYHFHQRWQFYNGTIES

SEQ ID NO: 2537708 - protein, 17 aa, Entamoeba dispar
QYIALMRKMAEKYPDKE

SEQ ID NO: 2537709 - protein, 28 aa, Entamoeba dispar
QYIDYMIDIVRPRKLLYIAIDGVAPRAK

SEQ ID NO: 2537710 - protein, 17 aa, Entamoeba dispar
QYIEAFNYCRITSFPLT

SEQ ID NO: 2537711 - protein, 20 aa, Entamoeba dispar
QYIEQFFIQGPYKKISSMNN

SEQ ID NO: 2537712 - protein, 18 aa, Entamoeba dispar
QYIGIERHAQYGYYWMMG

SEQ ID NO: 2537713 - protein, 25 aa, Entamoeba dispar
QYIKQGDGFVLIYSITSKESFEVLQ

SEQ ID NO: 2537714 - protein, 18 aa, Entamoeba dispar
QYIMCSTPMIVSDNKLYK

SEQ ID NO: 2537715 - protein, 22 aa, Entamoeba dispar
QYIVGYLRNKGLPEIALQCVRD

SEQ ID NO: 2537716 - protein, 30 aa, Entamoeba dispar
QYKEKFPLIPQTYYPSWSSMSFNTGFPLVA

SEQ ID NO: 2537717 - protein, 28 aa, Entamoeba dispar
QYKIESLPHYLFLQLNRFDSFDVNVMKI

SEQ ID NO: 2537718 - protein, 27 aa, Entamoeba dispar
QYKKNEIILQILFVDSIMKFSEKLFNK

SEQ ID NO: 2537719 - protein, 19 aa, Entamoeba dispar
QYKLYMYLYEQYSPSYKIQ

SEQ ID NO: 2537720 - protein, 28 aa, Entamoeba dispar
QYKYNGYEIILFFLKQILIRNDVININK

SEQ ID NO: 2537721 - protein, 18 aa, Entamoeba dispar
QYMVVGNGFLIVYSIISK

SEQ ID NO: 2537722 - protein, 23 aa, Entamoeba dispar
QYNALKQIFPYSKLFLYNDDDEN

SEQ ID NO: 2537723 - protein, 18 aa, Entamoeba dispar
QYNFFGGKTNAIALAHLI

SEQ ID NO: 2537724 - protein, 26 aa, Entamoeba dispar
QYNIPIMVMFPYDYPMKPPFFFTDPS

SEQ ID NO: 2537725 - protein, 17 aa, Entamoeba dispar
QYNLLRNGKFSGKLIVL

SEQ ID NO: 2537726 - protein, 20 aa, Entamoeba dispar
QYPLLGSDLMILEYQRVFKK

SEQ ID NO: 2537727 - protein, 17 aa, Entamoeba dispar
QYPMLIKEALKYTHPKH

SEQ ID NO: 2537728 - protein, 20 aa, Entamoeba dispar
QYQGYRCGCNFLATILSSES

SEQ ID NO: 2537729 - protein, 26 aa, Entamoeba dispar
QYQQGYIGPMGYWPDTIYHPQEKQKA

SEQ ID NO: 2537730 - protein, 25 aa, Entamoeba dispar
QYQYYHPIIVLFYGLPRYPHEFIDG

SEQ ID NO: 2537731 - protein, 25 aa, Entamoeba dispar
QYSHFLYFIFRCIGTPVKLKCFEIF

SEQ ID NO: 2537732 - protein, 29 aa, Entamoeba dispar
QYSINYYVQAFMNYISSILSRSIMNWDLK

SEQ ID NO: 2537733 - protein, 20 aa, Entamoeba dispar
QYSLDNINIRYIPISGLSGE

SEQ ID NO: 2537734 - protein, 25 aa, Entamoeba dispar
QYSRLNLTAIYIVNSFYIQALMNPE

SEQ ID NO: 2537735 - protein, 30 aa, Entamoeba dispar
QYSTTLPRFKMINALVQYSTTLPRCGLVPR

SEQ ID NO: 2537736 - protein, 17 aa, Entamoeba dispar
QYSYAHKLFPNIQVSFE

SEQ ID NO: 2537737 - protein, 17 aa, Entamoeba dispar
QYTFEKERFYNITDSWD

SEQ ID NO: 2537738 - protein, 20 aa, Entamoeba dispar
QYTQAKLFRNSLKNLKKALD

SEQ ID NO: 2537739 - protein, 24 aa, Entamoeba dispar
QYVCSGFGMTETCGIVYKMPAKST

SEQ ID NO: 2537740 - protein, 27 aa, Entamoeba dispar
QYVELISLLDMFFEYGMSTKYLKYRPQ

SEQ ID NO: 2537741 - protein, 31 aa, Entamoeba dispar
QYVERVNQCISLLFRYNIPTPNVESPTEMVN

SEQ ID NO: 2537742 - protein, 23 aa, Entamoeba dispar
QYYAAYYFVTLIQTIGANQWNLV

SEQ ID NO: 2537743 - protein, 26 aa, Entamoeba dispar
QYYKTDWPLLVICPSSLRANWKNEII

SEQ ID NO: 2537744 - protein, 23 aa, Entamoeba dispar
QYYTQNYPDMYPTTAFKKTQNKT

SEQ ID NO: 2537745 - protein, 26 aa, Entamoeba dispar
RAAGAMYLFPRITLPEKFIQECHERH

SEQ ID NO: 2537746 - protein, 20 aa, Entamoeba dispar
RAATIYVYGSYRLNVYGNNS

SEQ ID NO: 2537747 - protein, 19 aa, Entamoeba dispar
RACELFIKDLTTRAGYLTS

SEQ ID NO: 2537748 - protein, 21 aa, Entamoeba dispar
RACIGLVQHQELMPMLLQICK

SEQ ID NO: 2537749 - protein, 18 aa, Entamoeba dispar
RACLWTDSIYFLQAQKEI

SEQ ID NO: 2537750 - protein, 25 aa, Entamoeba dispar
RAEDKYKFFLEATQLDMIKESYKQA

SEQ ID NO: 2537751 - protein, 18 aa, Entamoeba dispar
RAELYKHVLLSGGTSMLP

SEQ ID NO: 2537752 - protein, 40 aa, Entamoeba dispar
RAFDNGEYFTYLKLFKEAIPKFKVIMKLAIEKVRLKGLML

SEQ ID NO: 2537753 - protein, 25 aa, Entamoeba dispar
RAFIIYGKCLLYYYQFEEARSVFEE

SEQ ID NO: 2537754 - protein, 22 aa, Entamoeba dispar
RAFKKFYNLPDSTEIIIWCPTD

SEQ ID NO: 2537755 - protein, 21 aa, Entamoeba dispar
RAFYCIIIEPTRELAAQVVEV

SEQ ID NO: 2537756 - protein, 20 aa, Entamoeba dispar
RAFYNTVKTPTGPILIVVGD

SEQ ID NO: 2537757 - protein, 17 aa, Entamoeba dispar
RAGIIIVRVGSTFDLKR

SEQ ID NO: 2537758 - protein, 41 aa, Entamoeba dispar
RAGIYPNMLLSLVTSPPLFVVSYYLALDPSLHSLIFCIRGT

SEQ ID NO: 2537759 - protein, 26 aa, Entamoeba dispar
RAHQLIQDGYKWMFNKKIVTVWSAPN

SEQ ID NO: 2537760 - protein, 26 aa, Entamoeba dispar
RAIFLKVVEFLFSPLPTIYAFCSRQS

SEQ ID NO: 2537761 - protein, 30 aa, Entamoeba dispar
RAIPYDRDFLQDQFLLDGFDFLRGYNDIVD

SEQ ID NO: 2537762 - protein, 29 aa, Entamoeba dispar
RAKDIRVNKLYEELTNKLQELKKVTQQNG

SEQ ID NO: 2537763 - protein, 20 aa, Entamoeba dispar
RALELFVPSLGDIDIERILI

SEQ ID NO: 2537764 - protein, 28 aa, Entamoeba dispar
RALFHRVYKFVPLNKRKKYWEIELKINQ

SEQ ID NO: 2537765 - protein, 17 aa, Entamoeba dispar
RALITLRQLYKSQPNVL

SEQ ID NO: 2537766 - protein, 17 aa, Entamoeba dispar
RALKLQHFSLKYLLQKY

SEQ ID NO: 2537767 - protein, 17 aa, Entamoeba dispar
RALKLYKLPEQPNSIGF

SEQ ID NO: 2537768 - protein, 21 aa, Entamoeba dispar
RALLFVQPCEVRILEYLKGEK

SEQ ID NO: 2537769 - protein, 17 aa, Entamoeba dispar
RALLRRLTHLQIVPENG

SEQ ID NO: 2537770 - protein, 30 aa, Entamoeba dispar
RALMEKVMYEMYVIFFIRKGRTSTHFSYNV

SEQ ID NO: 2537771 - protein, 18 aa, Entamoeba dispar
RALRFIECIIQTIKASKL

SEQ ID NO: 2537772 - protein, 18 aa, Entamoeba dispar
RALVLYTSLYHHEYLKRK

SEQ ID NO: 2537773 - protein, 17 aa, Entamoeba dispar
RAMSKEEKQPFFDSYKK

SEQ ID NO: 2537774 - protein, 34 aa, Entamoeba dispar
RANILEDIQIRYIIYQLLKALKYLHSAGIVHRDI

SEQ ID NO: 2537775 - protein, 25 aa, Entamoeba dispar
RAPLDRPPLERTPLDRDPRIPLDRP

SEQ ID NO: 2537776 - protein, 19 aa, Entamoeba dispar
RAQILSMDYLHSAIQPNIT

SEQ ID NO: 2537777 - protein, 27 aa, Entamoeba dispar
RARFIPLRITQPERKMLRLLEAALHVS

SEQ ID NO: 2537778 - protein, 19 aa, Entamoeba dispar
RASELIVTAIRWVAESDSV

SEQ ID NO: 2537779 - protein, 22 aa, Entamoeba dispar
RASIVFGEYQKICKLQLVNERS

SEQ ID NO: 2537780 - protein, 18 aa, Entamoeba dispar
RASTQMYTLIFLKDKEVT

SEQ ID NO: 2537781 - protein, 25 aa, Entamoeba dispar
RATHIVCHNFGRTIKMLKGISDGKW

SEQ ID NO: 2537782 - protein, 17 aa, Entamoeba dispar
RATINQLKRHKFLTQVE

SEQ ID NO: 2537783 - protein, 25 aa, Entamoeba dispar
RATQKFGFPPIPNPILNIFKGLNQY

SEQ ID NO: 2537784 - protein, 28 aa, Entamoeba dispar
RAVLTPSKLIDFIVTKMKTLGTAACPPY

SEQ ID NO: 2537785 - protein, 19 aa, Entamoeba dispar
RAVYIWRVLSGGEKLIKGK

SEQ ID NO: 2537786 - protein, 17 aa, Entamoeba dispar
RAWKTVLEMLRDRGYIT

SEQ ID NO: 2537787 - protein, 18 aa, Entamoeba dispar
RCAKLRVINIPSLVNEIG

SEQ ID NO: 2537788 - protein, 18 aa, Entamoeba dispar
RCAKMPLLLAMPQYQINE

SEQ ID NO: 2537789 - protein, 17 aa, Entamoeba dispar
RCEQYINFISLKFNINK

SEQ ID NO: 2537790 - protein, 24 aa, Entamoeba dispar
RCGKIDIQVLKKISLQLLNGLQYL

SEQ ID NO: 2537791 - protein, 25 aa, Entamoeba dispar
RCGLGEILLPPRQPGSSIMPGKVNP

SEQ ID NO: 2537792 - protein, 27 aa, Entamoeba dispar
RCILQHFFQHAFDGMFKIIVIGDASVG

SEQ ID NO: 2537793 - protein, 17 aa, Entamoeba dispar
RCKSLTSINIPTSVIKI

SEQ ID NO: 2537794 - protein, 19 aa, Entamoeba dispar
RCLEEMDLSYFNGLSIKKL

SEQ ID NO: 2537795 - protein, 19 aa, Entamoeba dispar
RCLGKRRGFLKGTGPLYTS

SEQ ID NO: 2537796 - protein, 18 aa, Entamoeba dispar
RCNELIAKKFDTIFDKMK

SEQ ID NO: 2537797 - protein, 20 aa, Entamoeba dispar
RCPQLRYEYNLYKILMETGE

SEQ ID NO: 2537798 - protein, 27 aa, Entamoeba dispar
RCVGSYKNILFVIKTTKNEVFGGYCSD

SEQ ID NO: 2537799 - protein, 18 aa, Entamoeba dispar
RCVMIRVPLPDKQQMTKI

SEQ ID NO: 2537800 - protein, 21 aa, Entamoeba dispar
RDALESVLIGGLRKVAGDEVV

SEQ ID NO: 2537801 - protein, 20 aa, Entamoeba dispar
RDALMTMVIIQKGDVWNEIE

SEQ ID NO: 2537802 - protein, 29 aa, Entamoeba dispar
RDCHPQDNFLFEIMPLISNPDPCNDILSY

SEQ ID NO: 2537803 - protein, 22 aa, Entamoeba dispar
RDDDKFFVFTCKNSFGIPMTRY

SEQ ID NO: 2537804 - protein, 18 aa, Entamoeba dispar
RDDFMGKVSWTVPQLILG

SEQ ID NO: 2537805 - protein, 31 aa, Entamoeba dispar
RDDLESLAYMFIYFLKGKLPWQGFNRQNNTE

SEQ ID NO: 2537806 - protein, 25 aa, Entamoeba dispar
RDEEIKLYLLFYEKSYEMIKYQQTI

SEQ ID NO: 2537807 - protein, 25 aa, Entamoeba dispar
RDEKEAFWEKKKMWLIEDEEDKKVL

SEQ ID NO: 2537808 - protein, 21 aa, Entamoeba dispar
RDELKIKVIYLEKEIIISNER

SEQ ID NO: 2537809 - protein, 38 aa, Entamoeba dispar
RDFCSLLYKKLPTYNFNTFYYILSFLRELLVHSEKNGL

SEQ ID NO: 2537810 - protein, 24 aa, Entamoeba dispar
RDFLATLETRRKGIHSALCNNFDT

SEQ ID NO: 2537811 - protein, 25 aa, Entamoeba dispar
RDGKKGIYDLFVDILKNLSQQYSDC

SEQ ID NO: 2537812 - protein, 22 aa, Entamoeba dispar
RDGLKWLELFEDELIKRIKELQ

SEQ ID NO: 2537813 - protein, 30 aa, Entamoeba dispar
RDGLRFTKIKFVLLQIIRYEKDYPFGSWRR

SEQ ID NO: 2537814 - protein, 18 aa, Entamoeba dispar
RDGNFTIFLDDVKDYLFI

SEQ ID NO: 2537815 - protein, 20 aa, Entamoeba dispar
RDHRLIGRQQDLFFFHVLSP

SEQ ID NO: 2537816 - protein, 21 aa, Entamoeba dispar
RDHYKLALAQLSIAKKLVDSI

SEQ ID NO: 2537817 - protein, 24 aa, Entamoeba dispar
RDIKRLIHIKGKKNPFARLVECSW

SEQ ID NO: 2537818 - protein, 17 aa, Entamoeba dispar
RDILTLMQKIINLQPSL

SEQ ID NO: 2537819 - protein, 20 aa, Entamoeba dispar
RDINEFIIPTTITKLNDYCF

SEQ ID NO: 2537820 - protein, 22 aa, Entamoeba dispar
RDINKFCRIFNPPTCNCNLLNV

SEQ ID NO: 2537821 - protein, 18 aa, Entamoeba dispar
RDISWKYYQYLNQLSGRV

SEQ ID NO: 2537822 - protein, 34 aa, Entamoeba dispar
RDITNIFSVMKSEKKYWLYLIVSEAGEINVVTFD

SEQ ID NO: 2537823 - protein, 20 aa, Entamoeba dispar
RDKDKTCFYCRQPGHCLKNC

SEQ ID NO: 2537824 - protein, 34 aa, Entamoeba dispar
RDKDTHFAFVLLKYFFLCLPKPMINDSVLKVFEM

SEQ ID NO: 2537825 - protein, 20 aa, Entamoeba dispar
RDKFMFTLSVFGACFYDGIR

SEQ ID NO: 2537826 - protein, 18 aa, Entamoeba dispar
RDKLGIKSMEVYGGVLSV

SEQ ID NO: 2537827 - protein, 17 aa, Entamoeba dispar
RDKRNYKIALESVLIAL

SEQ ID NO: 2537828 - protein, 25 aa, Entamoeba dispar
RDLCDDFIELFKREEKYYLDEERYN

SEQ ID NO: 2537829 - protein, 22 aa, Entamoeba dispar
RDLGIKRWPHRKLQRIEGEIKR

SEQ ID NO: 2537830 - protein, 27 aa, Entamoeba dispar
RDLKLENFLLCTPPKTMKYPRLKIADY

SEQ ID NO: 2537831 - protein, 25 aa, Entamoeba dispar
RDLKYIPFYADLCVSLSIFISSNFT

SEQ ID NO: 2537832 - protein, 26 aa, Entamoeba dispar
RDLNLWKIDFTQFIPLTKVQLQYIVD

SEQ ID NO: 2537833 - protein, 17 aa, Entamoeba dispar
RDLNRAALTFNWLVEYA

SEQ ID NO: 2537834 - protein, 40 aa, Entamoeba dispar
RDLTRYVKYPLYVRIQKEKRLLMKRLKTPPAVNIFANHTL

SEQ ID NO: 2537835 - protein, 20 aa, Entamoeba dispar
RDLVELFLGKWKEGASARDK

SEQ ID NO: 2537836 - protein, 25 aa, Entamoeba dispar
RDMCKIMWVIKKWKISNCFQSREPL

SEQ ID NO: 2537837 - protein, 25 aa, Entamoeba dispar
RDNIHRIHIKLQPWKEENSLVKNSR

SEQ ID NO: 2537838 - protein, 18 aa, Entamoeba dispar
RDPSSPIPLIKLTNLFSL

SEQ ID NO: 2537839 - protein, 23 aa, Entamoeba dispar
RDQYIKYGDGFVLIYSITSKESF

SEQ ID NO: 2537840 - protein, 24 aa, Entamoeba dispar
RDRAHIYWRILFNHPQQTYDIMLK

SEQ ID NO: 2537841 - protein, 21 aa, Entamoeba dispar
RDRERLLRRFLFAENNEHCKE

SEQ ID NO: 2537842 - protein, 18 aa, Entamoeba dispar
RDRGIFGYYYGLISVKIG

SEQ ID NO: 2537843 - protein, 34 aa, Entamoeba dispar
RDTKVLLKISIPCVYLYPCVIPKEALDNSNYNVR

SEQ ID NO: 2537844 - protein, 20 aa, Entamoeba dispar
RDTSEWLDLLFGLVNSVIDV

SEQ ID NO: 2537845 - protein, 32 aa, Entamoeba dispar
RDTSNYPIFYSTLLIYEDPTFSLKFASQLLSK

SEQ ID NO: 2537846 - protein, 24 aa, Entamoeba dispar
RDVAARVKYLKYIETHPTMTWSDF

SEQ ID NO: 2537847 - protein, 22 aa, Entamoeba dispar
RDVLFGRLCTCLALIKAQRVNE

SEQ ID NO: 2537848 - protein, 34 aa, Entamoeba dispar
RDVPNCLFFIDKYSQVPWILSPVLRTTRRMFSHK

SEQ ID NO: 2537849 - protein, 26 aa, Entamoeba dispar
RDVSALCQLFRLLPATSICTCKYLFL

SEQ ID NO: 2537850 - protein, 26 aa, Entamoeba dispar
RDYADYIQIDGLLGLLFCYLNTLDLY

SEQ ID NO: 2537851 - protein, 18 aa, Entamoeba dispar
RDYIYIGGRYRKYSRQLS

SEQ ID NO: 2537852 - protein, 18 aa, Entamoeba dispar
REALHKGFYELTLARDSY

SEQ ID NO: 2537853 - protein, 23 aa, Entamoeba dispar
REAMRFLQDILNEFGYFVEVEIE

SEQ ID NO: 2537854 - protein, 21 aa, Entamoeba dispar
REATLLACKLAGIKNVSLANE

SEQ ID NO: 2537855 - protein, 26 aa, Entamoeba dispar
RECLFRIRKIPYSINFFGVPLDAITS

SEQ ID NO: 2537856 - protein, 19 aa, Entamoeba dispar
RECLLDLLQRILVYDPKER

SEQ ID NO: 2537857 - protein, 18 aa, Entamoeba dispar
REDGFKNNPLLDRLWNNV

SEQ ID NO: 2537858 - protein, 37 aa, Entamoeba dispar
REDIIMVRPTFFGATPTFWYSLYQEFLFETKGLKEQE

SEQ ID NO: 2537859 - protein, 18 aa, Entamoeba dispar
REDTKRRKSDSANIKIEM

SEQ ID NO: 2537860 - protein, 25 aa, Entamoeba dispar
REDVAPHVYAIADGAYRAMLDPASK

SEQ ID NO: 2537861 - protein, 19 aa, Entamoeba dispar
REEDALLAWVRQTTEGYPG

SEQ ID NO: 2537862 - protein, 17 aa, Entamoeba dispar
REEFGKYGKIEIVTILA

SEQ ID NO: 2537863 - protein, 18 aa, Entamoeba dispar
REELFVTTKLWSTDKHKE

SEQ ID NO: 2537864 - protein, 20 aa, Entamoeba dispar
REELMRKVEEILKTLESNNE

SEQ ID NO: 2537865 - protein, 20 aa, Entamoeba dispar
REELTSFDWIDDFIISGSCK

SEQ ID NO: 2537866 - protein, 24 aa, Entamoeba dispar
REENYEFVLAPTKLLQVGATLPSK

SEQ ID NO: 2537867 - protein, 25 aa, Entamoeba dispar
REETNPPLIPKPLLDDIRMGSPMLK

SEQ ID NO: 2537868 - protein, 17 aa, Entamoeba dispar
REFAWLLCIGYYNYKST

SEQ ID NO: 2537869 - protein, 18 aa, Entamoeba dispar
REFGDLVMMGIGGFSPLK

SEQ ID NO: 2537870 - protein, 17 aa, Entamoeba dispar
REFIIEYHSLDNEVCVD

SEQ ID NO: 2537871 - protein, 17 aa, Entamoeba dispar
REFIVEYHSLDNEVCVD

SEQ ID NO: 2537872 - protein, 17 aa, Entamoeba dispar
REFKYKTLTVTKATKIL

SEQ ID NO: 2537873 - protein, 25 aa, Entamoeba dispar
REFSLSNIFRIWDSIFAYPSRKFHL

SEQ ID NO: 2537874 - protein, 37 aa, Entamoeba dispar
REGRDYVVKYGKYLLKKVCAIPAFIVTFTVCIDEVVA

SEQ ID NO: 2537875 - protein, 28 aa, Entamoeba dispar
REGVSDLALHFLAKLKIMVVKDIERDDI

SEQ ID NO: 2537876 - protein, 25 aa, Entamoeba dispar
REIDFNIIITPLFTNVKLCCSESNY

SEQ ID NO: 2537877 - protein, 25 aa, Entamoeba dispar
REIDSNIIITPLFNNFKVYCSESNY

SEQ ID NO: 2537878 - protein, 19 aa, Entamoeba dispar
REIEIRSIALRKQLMKERE

SEQ ID NO: 2537879 - protein, 17 aa, Entamoeba dispar
REIELIKILIHPNIVET

SEQ ID NO: 2537880 - protein, 19 aa, Entamoeba dispar
REIELLNSLKRTPLNDEKL

SEQ ID NO: 2537881 - protein, 20 aa, Entamoeba dispar
REIGWNCFCGCYSLTSITIP

SEQ ID NO: 2537882 - protein, 20 aa, Entamoeba dispar
REIHIFIYKNLCKEVMEYCF

SEQ ID NO: 2537883 - protein, 28 aa, Entamoeba dispar
REKECVEFPCIPPRIKTPPLEHHMAEEE

SEQ ID NO: 2537884 - protein, 23 aa, Entamoeba dispar
REKFIDVYISFKGSIPFLRKTSP

SEQ ID NO: 2537885 - protein, 17 aa, Entamoeba dispar
REKPLPASKEPTKWELF

SEQ ID NO: 2537886 - protein, 27 aa, Entamoeba dispar
REKTIQLLFERFKAPSVYFSIQPILSL

SEQ ID NO: 2537887 - protein, 23 aa, Entamoeba dispar
REKTLFKNITLTVPLKYNIAIQC

SEQ ID NO: 2537888 - protein, 22 aa, Entamoeba dispar
RELEMYVEGIKFLPFELVTKNE

SEQ ID NO: 2537889 - protein, 27 aa, Entamoeba dispar
RELFDLILNGYYQFISPYWDNISLELK

SEQ ID NO: 2537890 - protein, 18 aa, Entamoeba dispar
RELKKIAMKGVVQLFNAI

SEQ ID NO: 2537891 - protein, 26 aa, Entamoeba dispar
RELKKNIFTLIPFLGNSVLNIFYNIP

SEQ ID NO: 2537892 - protein, 23 aa, Entamoeba dispar
RELKLLEEIYYNKYNRILVGTQM

SEQ ID NO: 2537893 - protein, 23 aa, Entamoeba dispar
REMIINIKRIIYNNKINKRIIGK

SEQ ID NO: 2537894 - protein, 21 aa, Entamoeba dispar
REMREIGLIRNLCKDYLLIVR

SEQ ID NO: 2537895 - protein, 24 aa, Entamoeba dispar
RENCIREIILSTLSLKKKVKMEDI

SEQ ID NO: 2537896 - protein, 20 aa, Entamoeba dispar
RENDVIICRCGDSPIYVLTT

SEQ ID NO: 2537897 - protein, 27 aa, Entamoeba dispar
RENGGYSWWRRNSLTVFLDKKIYKDPQ

SEQ ID NO: 2537898 - protein, 18 aa, Entamoeba dispar
REPRYVISIKEFARFVVG

SEQ ID NO: 2537899 - protein, 20 aa, Entamoeba dispar
REQAERIKRAVAERKRQLQE

SEQ ID NO: 2537900 - protein, 26 aa, Entamoeba dispar
REQFIENLLIGIRRLLILGEEMINDE

SEQ ID NO: 2537901 - protein, 26 aa, Entamoeba dispar
REQHPPPEYITLKSVVSKFVVNCLQP

SEQ ID NO: 2537902 - protein, 24 aa, Entamoeba dispar
REQKNKRWIIVQQQAFTHWVNETV

SEQ ID NO: 2537903 - protein, 24 aa, Entamoeba dispar
REQLLKMEMVLGKFPQILSHDSHY

SEQ ID NO: 2537904 - protein, 46 aa, Entamoeba dispar
REQQVAVIVIQRTLKSWVTFRNWAWWKLYVKARPMLKRRNFEEEGK

SEQ ID NO: 2537905 - protein, 25 aa, Entamoeba dispar
RERDNTFYFQYGQRIKYVVVRTSSG

SEQ ID NO: 2537906 - protein, 24 aa, Entamoeba dispar
RERFIELFKKVRKIPWVIPATNDE

SEQ ID NO: 2537907 - protein, 18 aa, Entamoeba dispar
RERFLLKPLMDVNKILHR

SEQ ID NO: 2537908 - protein, 38 aa, Entamoeba dispar
RERIEGALFNYFLTEHWAPLKNILRRYQIYLKEEITNV

SEQ ID NO: 2537909 - protein, 17 aa, Entamoeba dispar
RERILDEFVSSEYTYVI

SEQ ID NO: 2537910 - protein, 19 aa, Entamoeba dispar
RERVLTFNGIRQEEIYEKG

SEQ ID NO: 2537911 - protein, 27 aa, Entamoeba dispar
RESDLFNTVFWLLDLEDIFYPEKLYND

SEQ ID NO: 2537912 - protein, 23 aa, Entamoeba dispar
RESGKRTQPMRACKGKPLIRFRE

SEQ ID NO: 2537913 - protein, 26 aa, Entamoeba dispar
RETDSNIIITPLFNNFKVYCSESNYD

SEQ ID NO: 2537914 - protein, 26 aa, Entamoeba dispar
RETEIQLSIVLLLFKTMKLKEEQINT

SEQ ID NO: 2537915 - protein, 26 aa, Entamoeba dispar
RETKEPWMINSLPYVMSRGPALQAYL

SEQ ID NO: 2537916 - protein, 18 aa, Entamoeba dispar
RETKLWTDYFKIELNEEK

SEQ ID NO: 2537917 - protein, 17 aa, Entamoeba dispar
RETPLEDLPALFEKIQA

SEQ ID NO: 2537918 - protein, 26 aa, Entamoeba dispar
RETQLPLSLVIRPFLHEVQQIPMQLL

SEQ ID NO: 2537919 - protein, 27 aa, Entamoeba dispar
REVNDFIVYWIAKLNKNYYKVTICDSS

SEQ ID NO: 2537920 - protein, 19 aa, Entamoeba dispar
REVNDYLFSLTGLEYICLN

SEQ ID NO: 2537921 - protein, 25 aa, Entamoeba dispar
REVNNKYPTFPFSLGMLENESKAKM

SEQ ID NO: 2537922 - protein, 26 aa, Entamoeba dispar
REVTEIFDSYLPYTNLIGKEYIVWIN

SEQ ID NO: 2537923 - protein, 17 aa, Entamoeba dispar
REVYIHRIGRSGRFGRT

SEQ ID NO: 2537924 - protein, 17 aa, Entamoeba dispar
REWATVPILGKLSKCQV

SEQ ID NO: 2537925 - protein, 18 aa, Entamoeba dispar
REYETVFIKKPKTVMTKS

SEQ ID NO: 2537926 - protein, 21 aa, Entamoeba dispar
REYMTLPHFSSITTAQFIGMA

SEQ ID NO: 2537927 - protein, 26 aa, Entamoeba dispar
REYTTEIITLWYRPPEILLGATHYEA

SEQ ID NO: 2537928 - protein, 21 aa, Entamoeba dispar
REYWENIVYPYIKYPSKEDVV

SEQ ID NO: 2537929 - protein, 21 aa, Entamoeba dispar
RFAPYIFRCYNPTKISPFIHF

SEQ ID NO: 2537930 - protein, 38 aa, Entamoeba dispar
RFAVKLPLDYRLAKLVFFGLYFGVFTETARIAALFGMN

SEQ ID NO: 2537931 - protein, 22 aa, Entamoeba dispar
RFAVRLMELDLLSRVIARREVI

SEQ ID NO: 2537932 - protein, 27 aa, Entamoeba dispar
RFCEEGIMLYLMSLIEFPFKDGVDGEC

SEQ ID NO: 2537933 - protein, 26 aa, Entamoeba dispar
RFDDEIIFTMFTLIAKKVVIINTHTM

SEQ ID NO: 2537934 - protein, 27 aa, Entamoeba dispar
RFDDRIINFFPDYTNPIMFINCDGREQ

SEQ ID NO: 2537935 - protein, 19 aa, Entamoeba dispar
RFDKSILNSFKILRCYIID

SEQ ID NO: 2537936 - protein, 24 aa, Entamoeba dispar
RFEATRILIRLLKENKSIKEILNR

SEQ ID NO: 2537937 - protein, 17 aa, Entamoeba dispar
RFEEDVSLLLKLPSKIK

SEQ ID NO: 2537938 - protein, 17 aa, Entamoeba dispar
RFEELQCENDFLKGSNE

SEQ ID NO: 2537939 - protein, 19 aa, Entamoeba dispar
RFEFFGQYGEIIKIIPNIK

SEQ ID NO: 2537940 - protein, 17 aa, Entamoeba dispar
RFEGFFKTEIEPIKNYK

SEQ ID NO: 2537941 - protein, 17 aa, Entamoeba dispar
RFFKHSNFSSFVRQLNI

SEQ ID NO: 2537942 - protein, 17 aa, Entamoeba dispar
RFFKVSSLFNQSPSQEK

SEQ ID NO: 2537943 - protein, 17 aa, Entamoeba dispar
RFFLNEDLIRIWDSILA

SEQ ID NO: 2537944 - protein, 18 aa, Entamoeba dispar
RFFQQFLFSRFGQHILRV

SEQ ID NO: 2537945 - protein, 17 aa, Entamoeba dispar
RFFTTQREQFIATLFDC

SEQ ID NO: 2537946 - protein, 25 aa, Entamoeba dispar
RFGERVTELYLYKEKLEEYLHSKMT

SEQ ID NO: 2537947 - protein, 17 aa, Entamoeba dispar
RFGTFSQLYEIPEDIDI

SEQ ID NO: 2537948 - protein, 21 aa, Entamoeba dispar
RFHFNPIPLDEYSRKFFPNIE

SEQ ID NO: 2537949 - protein, 18 aa, Entamoeba dispar
RFHFNPIPLNEHSRKFFP

SEQ ID NO: 2537950 - protein, 17 aa, Entamoeba dispar
RFHFNPIPLNEHSRKLF

SEQ ID NO: 2537951 - protein, 18 aa, Entamoeba dispar
RFHFNPIPLNEYSRRLFA

SEQ ID NO: 2537952 - protein, 17 aa, Entamoeba dispar
RFHFNPIPLNHYSRKFF

SEQ ID NO: 2537953 - protein, 17 aa, Entamoeba dispar
RFHFNPIPLNHYSRKLF

SEQ ID NO: 2537954 - protein, 20 aa, Entamoeba dispar
RFHFNPIPLNYCSRKLFTNI

SEQ ID NO: 2537955 - protein, 20 aa, Entamoeba dispar
RFHFNPIQFKSLFKNPQKKE

SEQ ID NO: 2537956 - protein, 22 aa, Entamoeba dispar
RFHFNPLPLNKYSRKLFPNIET

SEQ ID NO: 2537957 - protein, 23 aa, Entamoeba dispar
RFHLPIISLFYPSVEFVVNTIRV

SEQ ID NO: 2537958 - protein, 21 aa, Entamoeba dispar
RFIDQFILSLLNLIPNSSVTI

SEQ ID NO: 2537959 - protein, 33 aa, Entamoeba dispar
RFINKGYAIGERLQGFLLINVKKRVIVNQLHFN

SEQ ID NO: 2537960 - protein, 17 aa, Entamoeba dispar
RFIPMRLTERERGYLEI

SEQ ID NO: 2537961 - protein, 17 aa, Entamoeba dispar
RFIWIHREPVEQIKSMV

SEQ ID NO: 2537962 - protein, 21 aa, Entamoeba dispar
RFIYNIFELLKFDELFVNTSI

SEQ ID NO: 2537963 - protein, 27 aa, Entamoeba dispar
RFKETLLSYYTLSKVLYIIQPKQNFET

SEQ ID NO: 2537964 - protein, 20 aa, Entamoeba dispar
RFLQRPFEEAALKQPLKIIE

SEQ ID NO: 2537965 - protein, 18 aa, Entamoeba dispar
RFLRALLTNCHIAQEAAI

SEQ ID NO: 2537966 - protein, 23 aa, Entamoeba dispar
RFNEMYLFNPISISSLNLFPSIK

SEQ ID NO: 2537967 - protein, 17 aa, Entamoeba dispar
RFNSQGIIPIILEKLSK

SEQ ID NO: 2537968 - protein, 26 aa, Entamoeba dispar
RFPISYNEYLLFKSLGIYCNNIVLTQ

SEQ ID NO: 2537969 - protein, 18 aa, Entamoeba dispar
RFPPMQSPIDILLGKEDC

SEQ ID NO: 2537970 - protein, 23 aa, Entamoeba dispar
RFQRSYFYYRFDFKRCSEPLVII

SEQ ID NO: 2537971 - protein, 17 aa, Entamoeba dispar
RFRERFKRTLKGGVGII

SEQ ID NO: 2537972 - protein, 21 aa, Entamoeba dispar
RFRILTSSFYRKSCGIFLVFD

SEQ ID NO: 2537973 - protein, 33 aa, Entamoeba dispar
RFRILTSSFYRKSCGIFLVFDLSDEESFKNLTN

SEQ ID NO: 2537974 - protein, 20 aa, Entamoeba dispar
RFRSLASNFFRDAQGIIICY

SEQ ID NO: 2537975 - protein, 30 aa, Entamoeba dispar
RFRTIVSSYYRGVMGIVLVYDITSRESFNN

SEQ ID NO: 2537976 - protein, 22 aa, Entamoeba dispar
RFSFHSFFILGMTKNQIIQQTL

SEQ ID NO: 2537977 - protein, 18 aa, Entamoeba dispar
RFTRENCLSILKNKTDII

SEQ ID NO: 2537978 - protein, 18 aa, Entamoeba dispar
RFVEYYCVDPSKKIIKDF

SEQ ID NO: 2537979 - protein, 17 aa, Entamoeba dispar
RFVGNDVVVVVFKEQLN

SEQ ID NO: 2537980 - protein, 17 aa, Entamoeba dispar
RFVQGIFLVKYDPTIED

SEQ ID NO: 2537981 - protein, 17 aa, Entamoeba dispar
RFVSMIINHVSFQVIKN

SEQ ID NO: 2537982 - protein, 18 aa, Entamoeba dispar
RFVVLPEMFKNSPCLKSS

SEQ ID NO: 2537983 - protein, 24 aa, Entamoeba dispar
RGAALVGFDLFKEGLIKKNKFNKD

SEQ ID NO: 2537984 - protein, 25 aa, Entamoeba dispar
RGCFEILHYKKFKYYLNRGLKRNDQ

SEQ ID NO: 2537985 - protein, 22 aa, Entamoeba dispar
RGCFVVFAMEGNVYIWVGSLSH

SEQ ID NO: 2537986 - protein, 27 aa, Entamoeba dispar
RGCIGCFFPHGPFYQIVKKYCKYALHD

SEQ ID NO: 2537987 - protein, 23 aa, Entamoeba dispar
RGCILFCEVALGKQWETPKDKYM

SEQ ID NO: 2537988 - protein, 24 aa, Entamoeba dispar
RGDLYIHFEVVLPSKAQIAQNISQ

SEQ ID NO: 2537989 - protein, 28 aa, Entamoeba dispar
RGEALTQKIFSLMLKVLSEMVSVINGIR

SEQ ID NO: 2537990 - protein, 25 aa, Entamoeba dispar
RGEDKYNFFLQATQLDIIKESYKQA

SEQ ID NO: 2537991 - protein, 25 aa, Entamoeba dispar
RGEDVIVRVIGKKTDFIQIKEVTRI

SEQ ID NO: 2537992 - protein, 39 aa, Entamoeba dispar
RGEFLFPGLIDCHLHAPQYAFIGTAFGKPLLEWLEATVH

SEQ ID NO: 2537993 - protein, 24 aa, Entamoeba dispar
RGFRSIEIVVLVFALKVKYPDRFF

SEQ ID NO: 2537994 - protein, 22 aa, Entamoeba dispar
RGHISKIYAMHWASDSTHLVSA

SEQ ID NO: 2537995 - protein, 33 aa, Entamoeba dispar
RGIDPHLLQKSAMKLYGLIHARFILSPNGMKKM

SEQ ID NO: 2537996 - protein, 31 aa, Entamoeba dispar
RGINSLFPIQVSTYSPIYYRKDVVGKAQTGS

SEQ ID NO: 2537997 - protein, 24 aa, Entamoeba dispar
RGIYGYVYCFLNGISIEILVAQVI

SEQ ID NO: 2537998 - protein, 19 aa, Entamoeba dispar
RGKFISSVPLLNLFSLGEL

SEQ ID NO: 2537999 - protein, 18 aa, Entamoeba dispar
RGKILPPRTTLMEAPILS

SEQ ID NO: 2538000 - protein, 22 aa, Entamoeba dispar
RGKPCHSGMIPWIIKEIARVKE

SEQ ID NO: 2538001 - protein, 18 aa, Entamoeba dispar
RGLCFHPNRPLVVSGGDD

SEQ ID NO: 2538002 - protein, 17 aa, Entamoeba dispar
RGLLISHNLKRERGSKK

SEQ ID NO: 2538003 - protein, 19 aa, Entamoeba dispar
RGLRKDEHGIWRRRSLSSE

SEQ ID NO: 2538004 - protein, 25 aa, Entamoeba dispar
RGMITYRIRQAFETVLRMKPKKMDM

SEQ ID NO: 2538005 - protein, 23 aa, Entamoeba dispar
RGNIERFHFNPIPLNEHSRKLFP

SEQ ID NO: 2538006 - protein, 28 aa, Entamoeba dispar
RGNIERFHFNPIPLNEYSRKFFPNIETF

SEQ ID NO: 2538007 - protein, 29 aa, Entamoeba dispar
RGNIERFHFNPIPLNNYSRRFFPNIETFH

SEQ ID NO: 2538008 - protein, 29 aa, Entamoeba dispar
RGNMERFHFNPIPLNKYSRRFFPNIETFH

SEQ ID NO: 2538009 - protein, 35 aa, Entamoeba dispar
RGNRFCLPLCIMYPYDYPFTPPLFFTDPTPEMEVV

SEQ ID NO: 2538010 - protein, 20 aa, Entamoeba dispar
RGNVPIPKQIRFITHIQLFD

SEQ ID NO: 2538011 - protein, 17 aa, Entamoeba dispar
RGQFEERLKAVIKEVKE

SEQ ID NO: 2538012 - protein, 23 aa, Entamoeba dispar
RGRKKSENTFLQDRIRDFLNSNN

SEQ ID NO: 2538013 - protein, 19 aa, Entamoeba dispar
RGRRSTLRRQAFGNFASAM

SEQ ID NO: 2538014 - protein, 17 aa, Entamoeba dispar
RGSFIKRVSSPRSLIKV

SEQ ID NO: 2538015 - protein, 23 aa, Entamoeba dispar
RGSLEYWIIMEYCSFKSIDEYWK

SEQ ID NO: 2538016 - protein, 22 aa, Entamoeba dispar
RGSLMSLLRQYANLMVEGDRQI

SEQ ID NO: 2538017 - protein, 19 aa, Entamoeba dispar
RGSSFKLVSHFPSIIAYDA

SEQ ID NO: 2538018 - protein, 33 aa, Entamoeba dispar
RGTAGCGMYWMFGLLLGAGFKQIGVIPKGFQCD

SEQ ID NO: 2538019 - protein, 22 aa, Entamoeba dispar
RGTSLCDIAVLVVDLMHGLEPQ

SEQ ID NO: 2538020 - protein, 19 aa, Entamoeba dispar
RGVCLRFPRYIRTRDDKEV

SEQ ID NO: 2538021 - protein, 23 aa, Entamoeba dispar
RGVFIERGIIKIGEKGKIIMKGG

SEQ ID NO: 2538022 - protein, 22 aa, Entamoeba dispar
RGVLMTFQYLISLDGSPNTAKQ

SEQ ID NO: 2538023 - protein, 19 aa, Entamoeba dispar
RGVSSCMIVYDITNRQSFE

SEQ ID NO: 2538024 - protein, 17 aa, Entamoeba dispar
RGVYVFDCPYSERLFKW

SEQ ID NO: 2538025 - protein, 19 aa, Entamoeba dispar
RGWVVGYVVTKFLYQQVEP

SEQ ID NO: 2538026 - protein, 25 aa, Entamoeba dispar
RHAQYGYYWMMGSAKLSDYKDWCLY

SEQ ID NO: 2538027 - protein, 24 aa, Entamoeba dispar
RHAVIHFINFIKIHKQKIFDKIIK

SEQ ID NO: 2538028 - protein, 26 aa, Entamoeba dispar
RHAYFCEIFYSLPHLQLVSPFYDIER

SEQ ID NO: 2538029 - protein, 20 aa, Entamoeba dispar
RHCVRPLETLLTKYKKIVVK

SEQ ID NO: 2538030 - protein, 20 aa, Entamoeba dispar
RHDGKISRRTVSGPKGRRRP

SEQ ID NO: 2538031 - protein, 27 aa, Entamoeba dispar
RHDYVQWVFPTFVKSMFNWNSYALDKE

SEQ ID NO: 2538032 - protein, 26 aa, Entamoeba dispar
RHFKKLKQWIGLSKYKIIFDSCIDHL

SEQ ID NO: 2538033 - protein, 24 aa, Entamoeba dispar
RHGMNIIQLILSIKNPLITECLDK

SEQ ID NO: 2538034 - protein, 20 aa, Entamoeba dispar
RHIPIPLDILDPPASQSLIT

SEQ ID NO: 2538035 - protein, 23 aa, Entamoeba dispar
RHKDVLPLLKLRARKATIPAYTQ

SEQ ID NO: 2538036 - protein, 20 aa, Entamoeba dispar
RHKRDCRMIILSNKELYDFG

SEQ ID NO: 2538037 - protein, 18 aa, Entamoeba dispar
RHLEKGFPLFLIAEKYYR

SEQ ID NO: 2538038 - protein, 17 aa, Entamoeba dispar
RHLLSPVVINSIPDTSS

SEQ ID NO: 2538039 - protein, 32 aa, Entamoeba dispar
RHMSILGHYFNRLVPVLILEIAEKYPRNLKII

SEQ ID NO: 2538040 - protein, 25 aa, Entamoeba dispar
RHPPPSLNFAYLLQVQQQSTCRIKT

SEQ ID NO: 2538041 - protein, 25 aa, Entamoeba dispar
RHPQMFPGFLEMLIEYKKQGGIVCV

SEQ ID NO: 2538042 - protein, 24 aa, Entamoeba dispar
RHVALLIKRDKWAVQLLTAHLNEV

SEQ ID NO: 2538043 - protein, 18 aa, Entamoeba dispar
RHVGNDVVVIVFLDPKRK

SEQ ID NO: 2538044 - protein, 17 aa, Entamoeba dispar
RHWFTKKELYTLFDSSQ

SEQ ID NO: 2538045 - protein, 26 aa, Entamoeba dispar
RIAGKLDHFFPIQKIWNQSGVIMFDE

SEQ ID NO: 2538046 - protein, 25 aa, Entamoeba dispar
RIAGKLNHFFPIQKIWNQNGVIMFD

SEQ ID NO: 2538047 - protein, 23 aa, Entamoeba dispar
RIAKFIITKYGPLLDNFQPEKKT

SEQ ID NO: 2538048 - protein, 18 aa, Entamoeba dispar
RIARLIALKIIKINPNEI

SEQ ID NO: 2538049 - protein, 29 aa, Entamoeba dispar
RICGRSNILIIVLTTKGYVFGSFSSIQIP

SEQ ID NO: 2538050 - protein, 20 aa, Entamoeba dispar
RICLCLDLPGGPFYSTPFIL

SEQ ID NO: 2538051 - protein, 20 aa, Entamoeba dispar
RICLDPYHRTVEGFLGLIEY

SEQ ID NO: 2538052 - protein, 17 aa, Entamoeba dispar
RICQRMNRDWMHYGRRP

SEQ ID NO: 2538053 - protein, 18 aa, Entamoeba dispar
RICSKLSLLLSYISQEDI

SEQ ID NO: 2538054 - protein, 34 aa, Entamoeba dispar
RIDFCSRNIITLLFIKYKVIEGLLQFVIQTFVNK

SEQ ID NO: 2538055 - protein, 18 aa, Entamoeba dispar
RIDLLKNTFSVPSTLLKI

SEQ ID NO: 2538056 - protein, 17 aa, Entamoeba dispar
RIDLMDFIEPTYGNLIP

SEQ ID NO: 2538057 - protein, 24 aa, Entamoeba dispar
RIDPFSCFTYYNPTLHLKLRTSIV

SEQ ID NO: 2538058 - protein, 19 aa, Entamoeba dispar
RIDSSLFSWKHQPTDRNGE

SEQ ID NO: 2538059 - protein, 26 aa, Entamoeba dispar
RIEGILDYLISVTMFDSKRSTFEEGV

SEQ ID NO: 2538060 - protein, 24 aa, Entamoeba dispar
RIEPKYYCPIIPTVLVNGADGIGT

SEQ ID NO: 2538061 - protein, 25 aa, Entamoeba dispar
RIESKYFDETLLGSVPTIEKIGRTE

SEQ ID NO: 2538062 - protein, 26 aa, Entamoeba dispar
RIETIKKIIVLLKPIHLMSTYHYVAL

SEQ ID NO: 2538063 - protein, 34 aa, Entamoeba dispar
RIFDSIFMPSRRHFLRVRRPLPATLSGYALLQKT

SEQ ID NO: 2538064 - protein, 19 aa, Entamoeba dispar
RIFINEPVLVSIKIPDNLQ

SEQ ID NO: 2538065 - protein, 18 aa, Entamoeba dispar
RIFINEPVLVSIQIPENL

SEQ ID NO: 2538066 - protein, 17 aa, Entamoeba dispar
RIFLIASRPDRQNDREE

SEQ ID NO: 2538067 - protein, 21 aa, Entamoeba dispar
RIFMNELVLISIEIPDNLVIN

SEQ ID NO: 2538068 - protein, 25 aa, Entamoeba dispar
RIFMNEPVLFSIKIPESIKKINGGI

SEQ ID NO: 2538069 - protein, 25 aa, Entamoeba dispar
RIFMNEPVLFSIKIPGILQTINGKN

SEQ ID NO: 2538070 - protein, 22 aa, Entamoeba dispar
RIFMNEPVLISIKIPENIQIIN

SEQ ID NO: 2538071 - protein, 20 aa, Entamoeba dispar
RIFMNEPVLISIKIPYTIQI

SEQ ID NO: 2538072 - protein, 19 aa, Entamoeba dispar
RIFMNEPVLVSIKIPDNLQ

SEQ ID NO: 2538073 - protein, 20 aa, Entamoeba dispar
RIFMNEPVLVSIKIPDNLQI

SEQ ID NO: 2538074 - protein, 19 aa, Entamoeba dispar
RIFMNEPVLVSIKIPENLQ

SEQ ID NO: 2538075 - protein, 25 aa, Entamoeba dispar
RIGDTLYYSLTMPSKFQGRNITLII

SEQ ID NO: 2538076 - protein, 24 aa, Entamoeba dispar
RIGHYAMMIVSKYFNDIKDFINLE

SEQ ID NO: 2538077 - protein, 21 aa, Entamoeba dispar
RIGNRDCFFTYCSSLTNITIP

SEQ ID NO: 2538078 - protein, 24 aa, Entamoeba dispar
RIGPTAPAFLTPGVFKYLHDNLNL

SEQ ID NO: 2538079 - protein, 20 aa, Entamoeba dispar
RIGYELIKRIPYGGMICNTA

SEQ ID NO: 2538080 - protein, 22 aa, Entamoeba dispar
RIGYNEIMITSKYFNDIKDFIN

SEQ ID NO: 2538081 - protein, 23 aa, Entamoeba dispar
RIGYNEIMITSKYFNDIKDFINL

SEQ ID NO: 2538082 - protein, 25 aa, Entamoeba dispar
RIGYNEIMITSKYFNDIKDFINLEI

SEQ ID NO: 2538083 - protein, 26 aa, Entamoeba dispar
RIHSYNPIQLLFPVSLRSLSFSCFNV

SEQ ID NO: 2538084 - protein, 18 aa, Entamoeba dispar
RIICLPDVFFERRKLWEQ

SEQ ID NO: 2538085 - protein, 33 aa, Entamoeba dispar
RIIDDLIHCNSFRLTPMWTYLTQIQIKEQFEQN

SEQ ID NO: 2538086 - protein, 22 aa, Entamoeba dispar
RIIEDFFLLGEELGRGAFAVVR

SEQ ID NO: 2538087 - protein, 21 aa, Entamoeba dispar
RIIKRELWYTVSYSIHIEEKE

SEQ ID NO: 2538088 - protein, 19 aa, Entamoeba dispar
RIILFNYMTGVEIKSITMK

SEQ ID NO: 2538089 - protein, 18 aa, Entamoeba dispar
RIINYLYHRTASTGMVFR

SEQ ID NO: 2538090 - protein, 18 aa, Entamoeba dispar
RIIPKQCRLLMRSFEELH

SEQ ID NO: 2538091 - protein, 19 aa, Entamoeba dispar
RIIRALYDLGFINPTEIQQ

SEQ ID NO: 2538092 - protein, 17 aa, Entamoeba dispar
RIKFKRVVFNRLDRIRY

SEQ ID NO: 2538093 - protein, 29 aa, Entamoeba dispar
RIKLEKKPTIIVKFPVTVGWGKGTFEDNC

SEQ ID NO: 2538094 - protein, 23 aa, Entamoeba dispar
RIKMVKELLIKKGEMPFFQFVLN

SEQ ID NO: 2538095 - protein, 26 aa, Entamoeba dispar
RIKNEKFFIKLTLTLVKLGNFNVAST

SEQ ID NO: 2538096 - protein, 18 aa, Entamoeba dispar
RILCPLNFVLLNPQYPLL

SEQ ID NO: 2538097 - protein, 27 aa, Entamoeba dispar
RILDDMLPPFIGKYTRGLLLGETELGL

SEQ ID NO: 2538098 - protein, 19 aa, Entamoeba dispar
RILMNEPVLVSIKIPENLQ

SEQ ID NO: 2538099 - protein, 17 aa, Entamoeba dispar
RILPLINGVQLYYKENI

SEQ ID NO: 2538100 - protein, 19 aa, Entamoeba dispar
RILPYPLNYKSQSGGFLGV

SEQ ID NO: 2538101 - protein, 28 aa, Entamoeba dispar
RILSKLHHPFLVNLYYSFQTPTHLFYII

SEQ ID NO: 2538102 - protein, 28 aa, Entamoeba dispar
RILSKLRHPFLVNLYYSFQTPTHLFYII

SEQ ID NO: 2538103 - protein, 17 aa, Entamoeba dispar
RILSLDGGGIKCIYQCA

SEQ ID NO: 2538104 - protein, 34 aa, Entamoeba dispar
RIMPQPQTQIILYWSFIHLFIICLENHRDIDFRI

SEQ ID NO: 2538105 - protein, 18 aa, Entamoeba dispar
RIMPTIGNIPVIEKSVAI

SEQ ID NO: 2538106 - protein, 25 aa, Entamoeba dispar
RINELEHLILKILNISTKELAIIKC

SEQ ID NO: 2538107 - protein, 19 aa, Entamoeba dispar
RINFIPTYLFVECDQCLIG

SEQ ID NO: 2538108 - protein, 18 aa, Entamoeba dispar
RINGTPISWPITTIKNNI

SEQ ID NO: 2538109 - protein, 28 aa, Entamoeba dispar
RINGYDLFGDTLLYTVSYYDIPKNGSSS

SEQ ID NO: 2538110 - protein, 22 aa, Entamoeba dispar
RINILQLKIEFPNVLDAMVYLI

SEQ ID NO: 2538111 - protein, 26 aa, Entamoeba dispar
RININKKMFYYLDIKDYDLTVKEQEL

SEQ ID NO: 2538112 - protein, 17 aa, Entamoeba dispar
RININQLLPFNTNHIKS

SEQ ID NO: 2538113 - protein, 20 aa, Entamoeba dispar
RINISFIISWLDDNDVTEVV

SEQ ID NO: 2538114 - protein, 22 aa, Entamoeba dispar
RINKAIIWYTVDYSTYLKEKEA

SEQ ID NO: 2538115 - protein, 23 aa, Entamoeba dispar
RINKLVCVNPIRSRYCGNVGDVV

SEQ ID NO: 2538116 - protein, 24 aa, Entamoeba dispar
RINKPDNYPLKRPSVFPHLEVSVE

SEQ ID NO: 2538117 - protein, 25 aa, Entamoeba dispar
RINKQIFHNLSYYVLDTLIQVPENI

SEQ ID NO: 2538118 - protein, 21 aa, Entamoeba dispar
RINQFLFQHSTFRVELAPFAK

SEQ ID NO: 2538119 - protein, 29 aa, Entamoeba dispar
RINRDMFIFIIDFLQFLVPFESLTKMDMD

SEQ ID NO: 2538120 - protein, 26 aa, Entamoeba dispar
RINRSKELFKYVLMYLTKGEIICNDK

SEQ ID NO: 2538121 - protein, 18 aa, Entamoeba dispar
RINYDFLNLLKTTVLMND

SEQ ID NO: 2538122 - protein, 17 aa, Entamoeba dispar
RIPLKEMANKGLLNEKE

SEQ ID NO: 2538123 - protein, 21 aa, Entamoeba dispar
RIPVLTWIHPQTRKVLLRSSQ

SEQ ID NO: 2538124 - protein, 23 aa, Entamoeba dispar
RIQKFDFGFSYKQTFDLQVGDVT

SEQ ID NO: 2538125 - protein, 24 aa, Entamoeba dispar
RIQSSRLVFYPKNSAQLFGVQNAF

SEQ ID NO: 2538126 - protein, 17 aa, Entamoeba dispar
RIRAKPENLRRHLKCCK

SEQ ID NO: 2538127 - protein, 23 aa, Entamoeba dispar
RIRELLRELIFISNELKDVSLLS

SEQ ID NO: 2538128 - protein, 17 aa, Entamoeba dispar
RIRYDYEISWGSQPDQI

SEQ ID NO: 2538129 - protein, 18 aa, Entamoeba dispar
RISDIFTTLIKRINSSNG

SEQ ID NO: 2538130 - protein, 23 aa, Entamoeba dispar
RISELTLIHRMAAWGISLNNSNE

SEQ ID NO: 2538131 - protein, 47 aa, Entamoeba dispar
RISGNQLLVLTGFLPILFNGKKFGIPLLIGFTYEYPISAPEMICNIS

SEQ ID NO: 2538132 - protein, 20 aa, Entamoeba dispar
RISKETICFVYNGEIVDPLL

SEQ ID NO: 2538133 - protein, 21 aa, Entamoeba dispar
RISKPKITVSLYLFPEVDPKT

SEQ ID NO: 2538134 - protein, 24 aa, Entamoeba dispar
RISPSIFRPLADYGILNPVSRKGD

SEQ ID NO: 2538135 - protein, 29 aa, Entamoeba dispar
RISPSILEAFYKFKIPKATDFLHDFIDCF

SEQ ID NO: 2538136 - protein, 23 aa, Entamoeba dispar
RISRMMMQYYPNGQSKGCCFIEF

SEQ ID NO: 2538137 - protein, 30 aa, Entamoeba dispar
RITAYNLDFFIYFSFNNKKITYIRQKKSCT

SEQ ID NO: 2538138 - protein, 21 aa, Entamoeba dispar
RITEVPLFIDSFERLRQFDCS

SEQ ID NO: 2538139 - protein, 24 aa, Entamoeba dispar
RITKEIIWYKVNYSTYLKEKEAGN

SEQ ID NO: 2538140 - protein, 24 aa, Entamoeba dispar
RITKEIIWYKVNYSTYLKEKESGN

SEQ ID NO: 2538141 - protein, 22 aa, Entamoeba dispar
RITLSIAPLYTTTGHIVVSFVI

SEQ ID NO: 2538142 - protein, 27 aa, Entamoeba dispar
RITTKEPSLFWLFQSVMTMLQGFYCSN

SEQ ID NO: 2538143 - protein, 17 aa, Entamoeba dispar
RIVKPRVVLLDCSLEYT

SEQ ID NO: 2538144 - protein, 23 aa, Entamoeba dispar
RIVLEWQEYFLKKFEVKTLYVKT

SEQ ID NO: 2538145 - protein, 19 aa, Entamoeba dispar
RIVPIKPFDKDFQKFVSGS

SEQ ID NO: 2538146 - protein, 20 aa, Entamoeba dispar
RIWLDTILNGNKKRIKTLVL

SEQ ID NO: 2538147 - protein, 30 aa, Entamoeba dispar
RIYKKVMNLWDLKYKLIDWKSYFIITINEL

SEQ ID NO: 2538148 - protein, 19 aa, Entamoeba dispar
RIYKRVLTLKTTPELVKEI

SEQ ID NO: 2538149 - protein, 34 aa, Entamoeba dispar
RIYQKDGIVLALFKKKFVPCHCLLFSDVCIFAQY

SEQ ID NO: 2538150 - protein, 21 aa, Entamoeba dispar
RKACIDLSLTVEPVSIYNSKM

SEQ ID NO: 2538151 - protein, 37 aa, Entamoeba dispar
RKANIKDLNIAGLLIPPINFYIPDEPIFPTEFFISCE

SEQ ID NO: 2538152 - protein, 26 aa, Entamoeba dispar
RKANKERYFVLFNDILIYGEGNEHSV

SEQ ID NO: 2538153 - protein, 32 aa, Entamoeba dispar
RKAPKPRYFVLCTDILFYTLPKKREVNVIVKL

SEQ ID NO: 2538154 - protein, 18 aa, Entamoeba dispar
RKATIRGLFTQPSDAKWF

SEQ ID NO: 2538155 - protein, 17 aa, Entamoeba dispar
RKCFQKVESASRKSRVL

SEQ ID NO: 2538156 - protein, 24 aa, Entamoeba dispar
RKCSPLISINLPSSISNLGYCCFR

SEQ ID NO: 2538157 - protein, 27 aa, Entamoeba dispar
RKCYYGVIFVLKYMMILDLMRKNMIIG

SEQ ID NO: 2538158 - protein, 24 aa, Entamoeba dispar
RKDCFEIMYHVVPLLTERSATKLF

SEQ ID NO: 2538159 - protein, 26 aa, Entamoeba dispar
RKDEIQFLIDFLIKYPSMKAVKNSND

SEQ ID NO: 2538160 - protein, 25 aa, Entamoeba dispar
RKDFKDPFFFKKNKIKKSKKIDNSS

SEQ ID NO: 2538161 - protein, 23 aa, Entamoeba dispar
RKDKPKIDNLFGEYTIKSQENKV

SEQ ID NO: 2538162 - protein, 18 aa, Entamoeba dispar
RKDPLFRMKIPSATVVYR

SEQ ID NO: 2538163 - protein, 25 aa, Entamoeba dispar
RKEDWHPYLLFCKVKRDSVVNDGIS

SEQ ID NO: 2538164 - protein, 24 aa, Entamoeba dispar
RKEFVLTQLLQYKVIPDNNSIAII

SEQ ID NO: 2538165 - protein, 33 aa, Entamoeba dispar
RKEINFFHIEIILQYLKVLLKHQCYKEFQIIIK

SEQ ID NO: 2538166 - protein, 20 aa, Entamoeba dispar
RKFSYSAGACLYIICRRERS

SEQ ID NO: 2538167 - protein, 25 aa, Entamoeba dispar
RKGDNFFSYWVLTKDNIYFYRNQSV

SEQ ID NO: 2538168 - protein, 25 aa, Entamoeba dispar
RKGEIIVAAVVYLLSREYSSKKENG

SEQ ID NO: 2538169 - protein, 25 aa, Entamoeba dispar
RKGEYYRFYQFDSLVSFIDESRKGI

SEQ ID NO: 2538170 - protein, 21 aa, Entamoeba dispar
RKGHIGILEWKTQKLINEFHV

SEQ ID NO: 2538171 - protein, 29 aa, Entamoeba dispar
RKGYKSGGVQLVLLIGGTSKIPKIREKVS

SEQ ID NO: 2538172 - protein, 19 aa, Entamoeba dispar
RKHEVILKALFVDKVKRII

SEQ ID NO: 2538173 - protein, 17 aa, Entamoeba dispar
RKHFSVLREQQVAVIVI

SEQ ID NO: 2538174 - protein, 17 aa, Entamoeba dispar
RKHIFGRIWLKNHKDIN

SEQ ID NO: 2538175 - protein, 28 aa, Entamoeba dispar
RKHSALTHIFLIMFDQFTIRWVHYKLID

SEQ ID NO: 2538176 - protein, 19 aa, Entamoeba dispar
RKIFNYQEFDIFGGKNPYD

SEQ ID NO: 2538177 - protein, 17 aa, Entamoeba dispar
RKIIPFNSQIEKKLEEI

SEQ ID NO: 2538178 - protein, 31 aa, Entamoeba dispar
RKILENIFSSMLFEYIWPPCYDKFQTSKEVI

SEQ ID NO: 2538179 - protein, 24 aa, Entamoeba dispar
RKIRDVLPNIPVHIPPSLDEKYWD

SEQ ID NO: 2538180 - protein, 21 aa, Entamoeba dispar
RKKIEIKDEYGDIIATHYQNT

SEQ ID NO: 2538181 - protein, 17 aa, Entamoeba dispar
RKKIKKGKEIKTIYVKF

SEQ ID NO: 2538182 - protein, 21 aa, Entamoeba dispar
RKKNWKCVFPNCNEPVKTRFN

SEQ ID NO: 2538183 - protein, 20 aa, Entamoeba dispar
RKKPFIQLNDEKYFIKFTPV

SEQ ID NO: 2538184 - protein, 23 aa, Entamoeba dispar
RKKQKLRFILTQKIVDTFSRYVQ

SEQ ID NO: 2538185 - protein, 24 aa, Entamoeba dispar
RKKRKSYVIFIQKRLDLVEQLQNQ

SEQ ID NO: 2538186 - protein, 22 aa, Entamoeba dispar
RKKRNEIFYSLLKELYTSPSSA

SEQ ID NO: 2538187 - protein, 30 aa, Entamoeba dispar
RKLEYRKAFYDFLKRILVWNPHHRLRPIQA

SEQ ID NO: 2538188 - protein, 26 aa, Entamoeba dispar
RKLNLESHMIAWSGIGVVRNCDEVEF

SEQ ID NO: 2538189 - protein, 20 aa, Entamoeba dispar
RKLPSKLLITTLNSIQNVLP

SEQ ID NO: 2538190 - protein, 18 aa, Entamoeba dispar
RKLRKRYSKPRYVKIVYK

SEQ ID NO: 2538191 - protein, 17 aa, Entamoeba dispar
RKMAEFPLEPPLSKMLI

SEQ ID NO: 2538192 - protein, 18 aa, Entamoeba dispar
RKMAVLSGKDRRIVMKNE

SEQ ID NO: 2538193 - protein, 19 aa, Entamoeba dispar
RKMFDQMRVTKVFINIFVE

SEQ ID NO: 2538194 - protein, 27 aa, Entamoeba dispar
RKMHDTHLFLFKAMRKYVSLKSCPNPL

SEQ ID NO: 2538195 - protein, 24 aa, Entamoeba dispar
RKMKNEFMSLWDGLKSKEMERVIV

SEQ ID NO: 2538196 - protein, 24 aa, Entamoeba dispar
RKMKNEFMTLWDGLKSQNLEQIIV

SEQ ID NO: 2538197 - protein, 26 aa, Entamoeba dispar
RKMNPHLKLPTRPFKRMTYADAIKYC

SEQ ID NO: 2538198 - protein, 24 aa, Entamoeba dispar
RKMPLENVTLLRSILKLCSKIDSM

SEQ ID NO: 2538199 - protein, 17 aa, Entamoeba dispar
RKMSVNKTTWRMVFKSK

SEQ ID NO: 2538200 - protein, 23 aa, Entamoeba dispar
RKNLVLLFETTKNALFGCYLEAP

SEQ ID NO: 2538201 - protein, 25 aa, Entamoeba dispar
RKNMVYGIFYCLSKIIKYLKGEEEK

SEQ ID NO: 2538202 - protein, 31 aa, Entamoeba dispar
RKNPKKVEFLIDEYIPYMYLKENTNDQPLKK

SEQ ID NO: 2538203 - protein, 33 aa, Entamoeba dispar
RKPIIEVFSRMNFSYVLLSKRNLNTFVKKGLVD

SEQ ID NO: 2538204 - protein, 17 aa, Entamoeba dispar
RKPIYFLIDETTMSIVS

SEQ ID NO: 2538205 - protein, 25 aa, Entamoeba dispar
RKPPKYERFIRPAAMRFTKAHVTHP

SEQ ID NO: 2538206 - protein, 25 aa, Entamoeba dispar
RKQITKQGFAYRKTLSCETDQSLNK

SEQ ID NO: 2538207 - protein, 20 aa, Entamoeba dispar
RKQLYENAGLVSAPTISVNK

SEQ ID NO: 2538208 - protein, 24 aa, Entamoeba dispar
RKQTTRFEMLRLQSDNIRNEKEFQ

SEQ ID NO: 2538209 - protein, 26 aa, Entamoeba dispar
RKRCGKYLFTLGMISSWNNGEIETAW

SEQ ID NO: 2538210 - protein, 22 aa, Entamoeba dispar
RKRDICLQLYKKGIKDRVTVLY

SEQ ID NO: 2538211 - protein, 22 aa, Entamoeba dispar
RKRKKWKLEQMTQELNFLKGKC

SEQ ID NO: 2538212 - protein, 30 aa, Entamoeba dispar
RKRKSKEVFFNEIAPFQMKKYVISERSKND

SEQ ID NO: 2538213 - protein, 21 aa, Entamoeba dispar
RKRLYVIQLNKMLVEHFRKGN

SEQ ID NO: 2538214 - protein, 20 aa, Entamoeba dispar
RKRPLLTCEPITKCVRDLLV

SEQ ID NO: 2538215 - protein, 29 aa, Entamoeba dispar
RKSDIWALGCLLFEIAIGAPPFSAPLCIS

SEQ ID NO: 2538216 - protein, 27 aa, Entamoeba dispar
RKSFERVRFLLKQLSFLEITKNFIVDK

SEQ ID NO: 2538217 - protein, 45 aa, Entamoeba dispar
RKSNMNMHILFKIILKNTIHLSITNYIILLKLQQLCRLEIYDFRD

SEQ ID NO: 2538218 - protein, 23 aa, Entamoeba dispar
RKSSEICQFLDLVRIYGKNINID

SEQ ID NO: 2538219 - protein, 21 aa, Entamoeba dispar
RKSSLILLKMVSNKLVRTKGD

SEQ ID NO: 2538220 - protein, 24 aa, Entamoeba dispar
RKSSNPWFKWKLTTSFENHRIQLK

SEQ ID NO: 2538221 - protein, 23 aa, Entamoeba dispar
RKSTLDVIPIPNANSLGYAGTNA

SEQ ID NO: 2538222 - protein, 25 aa, Entamoeba dispar
RKTAKVLPVITNKKSYFIFGSSSDE

SEQ ID NO: 2538223 - protein, 18 aa, Entamoeba dispar
RKTEQYILELERSLSQID

SEQ ID NO: 2538224 - protein, 29 aa, Entamoeba dispar
RKTIKPRYFYLFNDILIYGIGDSNNMVIS

SEQ ID NO: 2538225 - protein, 20 aa, Entamoeba dispar
RKTLIPLIVLHLRKGEYPPQ

SEQ ID NO: 2538226 - protein, 17 aa, Entamoeba dispar
RKTVYDLTAYLTNLKVV

SEQ ID NO: 2538227 - protein, 25 aa, Entamoeba dispar
RKTWDPFIIIKARDMLKLLSRGVPA

SEQ ID NO: 2538228 - protein, 24 aa, Entamoeba dispar
RKVDMIENILLSIEKECLKNSTDL

SEQ ID NO: 2538229 - protein, 17 aa, Entamoeba dispar
RKVFLYNELVATLLIPD

SEQ ID NO: 2538230 - protein, 26 aa, Entamoeba dispar
RKVICPRMLIWKLEETHRIVLEVICR

SEQ ID NO: 2538231 - protein, 18 aa, Entamoeba dispar
RKVLLEIVYCYLNFCIAA

SEQ ID NO: 2538232 - protein, 20 aa, Entamoeba dispar
RKYCSFLEFVGKIAGSPIIQ

SEQ ID NO: 2538233 - protein, 22 aa, Entamoeba dispar
RKYEFNLTVLRCCCSILANVGP

SEQ ID NO: 2538234 - protein, 17 aa, Entamoeba dispar
RKYKRMYDSLKPNELKL

SEQ ID NO: 2538235 - protein, 27 aa, Entamoeba dispar
RKYKSGILEMKIGGGIIRVITCQPEIK

SEQ ID NO: 2538236 - protein, 22 aa, Entamoeba dispar
RLAMYLKTRKSSPFNYLKISRT

SEQ ID NO: 2538237 - protein, 27 aa, Entamoeba dispar
RLANNPQIFQIIINSIAPAIYGHDASK

SEQ ID NO: 2538238 - protein, 18 aa, Entamoeba dispar
RLCALGFGRSQCLQAYIA

SEQ ID NO: 2538239 - protein, 17 aa, Entamoeba dispar
RLCKKNTALLLDCKTHQ

SEQ ID NO: 2538240 - protein, 17 aa, Entamoeba dispar
RLCVLILSSLRCLKPLN

SEQ ID NO: 2538241 - protein, 22 aa, Entamoeba dispar
RLDIEHYTRTDLFPWREEMPEV

SEQ ID NO: 2538242 - protein, 20 aa, Entamoeba dispar
RLDIEHYTRTDLLPWKEDME

SEQ ID NO: 2538243 - protein, 28 aa, Entamoeba dispar
RLDINIISLIKLFLLDYRVLIIASKEQV

SEQ ID NO: 2538244 - protein, 26 aa, Entamoeba dispar
RLDRCMRFLPQLQNTGGFFVAVLEKV

SEQ ID NO: 2538245 - protein, 18 aa, Entamoeba dispar
RLDRKIEFGLPDIEGRTE

SEQ ID NO: 2538246 - protein, 20 aa, Entamoeba dispar
RLDYIFQLKRPNEDPVISCK

SEQ ID NO: 2538247 - protein, 19 aa, Entamoeba dispar
RLDYMFHWKKPNENPIITC

SEQ ID NO: 2538248 - protein, 27 aa, Entamoeba dispar
RLEASPALQYLYYLSQIGLAVSPLSNH

SEQ ID NO: 2538249 - protein, 30 aa, Entamoeba dispar
RLEENHFSEYLLLKEITLPSTITSIGNSCF

SEQ ID NO: 2538250 - protein, 27 aa, Entamoeba dispar
RLEIIINKWFIQKWKLEPKKVGEFCFE

SEQ ID NO: 2538251 - protein, 22 aa, Entamoeba dispar
RLEKIGFVFQTYNLLSTMSAYE

SEQ ID NO: 2538252 - protein, 34 aa, Entamoeba dispar
RLEQGYVLEYIKTIKWLLQVPQEIKEYISQNYYL

SEQ ID NO: 2538253 - protein, 19 aa, Entamoeba dispar
RLEQIYRRYEIPLLTNNDV

SEQ ID NO: 2538254 - protein, 25 aa, Entamoeba dispar
RLETDLMCFYMIKGYKSFFQKRYFQ

SEQ ID NO: 2538255 - protein, 18 aa, Entamoeba dispar
RLFAPMLGSFIGCKRAVI

SEQ ID NO: 2538256 - protein, 21 aa, Entamoeba dispar
RLFDHFLYCNHVCIVTELLGI

SEQ ID NO: 2538257 - protein, 18 aa, Entamoeba dispar
RLFFTCFDHIIEGMTGFF

SEQ ID NO: 2538258 - protein, 20 aa, Entamoeba dispar
RLFGAGYIFSASAPTFSCTA

SEQ ID NO: 2538259 - protein, 17 aa, Entamoeba dispar
RLFIVKSADAKNVKKKK

SEQ ID NO: 2538260 - protein, 25 aa, Entamoeba dispar
RLFKDDSVLLLGNKYKLICVSNKIC

SEQ ID NO: 2538261 - protein, 21 aa, Entamoeba dispar
RLFNSLEDLWKLLTGPTVKQV

SEQ ID NO: 2538262 - protein, 18 aa, Entamoeba dispar
RLFPQIKTQYLFNKNDKK

SEQ ID NO: 2538263 - protein, 17 aa, Entamoeba dispar
RLFSVYGQLLNIISDID

SEQ ID NO: 2538264 - protein, 38 aa, Entamoeba dispar
RLGDDGKYWRHIYKSLLLIYYIIINGTPEAVERFKRRQ

SEQ ID NO: 2538265 - protein, 21 aa, Entamoeba dispar
RLGGVFSFLNMLQPYFTHLYP

SEQ ID NO: 2538266 - protein, 18 aa, Entamoeba dispar
RLGPYIFWECNNLKKLEI

SEQ ID NO: 2538267 - protein, 27 aa, Entamoeba dispar
RLGYLCNIFQIPLRPMQLQILSRKQAF

SEQ ID NO: 2538268 - protein, 35 aa, Entamoeba dispar
RLHETPLHRAIQNPSIRMLLVELLLRNGALVNFQT

SEQ ID NO: 2538269 - protein, 30 aa, Entamoeba dispar
RLHIKVILSQFPPQLFPSIQELILKRKKLK

SEQ ID NO: 2538270 - protein, 27 aa, Entamoeba dispar
RLHKKRSLLLPFLFKEDLTYPQNCRRF

SEQ ID NO: 2538271 - protein, 18 aa, Entamoeba dispar
RLIDVIRLYLYTGHVEMA

SEQ ID NO: 2538272 - protein, 24 aa, Entamoeba dispar
RLIERPPLKYLFQTNAFTTIDGIQ

SEQ ID NO: 2538273 - protein, 25 aa, Entamoeba dispar
RLIESFVIFHKSNYVFCVPYAFAIV

SEQ ID NO: 2538274 - protein, 20 aa, Entamoeba dispar
RLIGRIKFELFREVCPKTVE

SEQ ID NO: 2538275 - protein, 26 aa, Entamoeba dispar
RLIGRLPEILKTYPQLIVVLQKVDVI

SEQ ID NO: 2538276 - protein, 23 aa, Entamoeba dispar
RLIRKAEHFIYIEQQYFLSNCGT

SEQ ID NO: 2538277 - protein, 26 aa, Entamoeba dispar
RLIYEQVFPLFPRDAFTYYINTEKHT

SEQ ID NO: 2538278 - protein, 20 aa, Entamoeba dispar
RLKDFPVELLQLPQLIELNL

SEQ ID NO: 2538279 - protein, 19 aa, Entamoeba dispar
RLKFMMRNGLINNVTQCLD

SEQ ID NO: 2538280 - protein, 30 aa, Entamoeba dispar
RLKKELAICNFYRNFLFMSRKTGFEQMEER

SEQ ID NO: 2538281 - protein, 19 aa, Entamoeba dispar
RLKLHLLSINSDFMKGKCL

SEQ ID NO: 2538282 - protein, 26 aa, Entamoeba dispar
RLKPNHPELPMWVSSNLRIVVETSND

SEQ ID NO: 2538283 - protein, 17 aa, Entamoeba dispar
RLKRKQKVSVGSLVYIP

SEQ ID NO: 2538284 - protein, 32 aa, Entamoeba dispar
RLKTRPAFVLFIKHFYIYVLQITPEDITHAVI

SEQ ID NO: 2538285 - protein, 26 aa, Entamoeba dispar
RLLGAGFIFSASAPPFTCRAGKIAFE

SEQ ID NO: 2538286 - protein, 20 aa, Entamoeba dispar
RLLICWIKIFKEIIPNVYDS

SEQ ID NO: 2538287 - protein, 19 aa, Entamoeba dispar
RLLMLLQYHIIPDDEIVAL

SEQ ID NO: 2538288 - protein, 24 aa, Entamoeba dispar
RLLQTLQLEYLINNKLNLQNNSDE

SEQ ID NO: 2538289 - protein, 19 aa, Entamoeba dispar
RLLYKFRSIEQLQNYLNGM

SEQ ID NO: 2538290 - protein, 19 aa, Entamoeba dispar
RLMELECIIITGSLFRKEI

SEQ ID NO: 2538291 - protein, 20 aa, Entamoeba dispar
RLMINTFFWENDVKYEYSLK

SEQ ID NO: 2538292 - protein, 24 aa, Entamoeba dispar
RLMKELIKLYKRAEGTRIKKQLII

SEQ ID NO: 2538293 - protein, 17 aa, Entamoeba dispar
RLMMYKIISTTLCSNVV

SEQ ID NO: 2538294 - protein, 17 aa, Entamoeba dispar
RLMNVLICTPGRLLYHL

SEQ ID NO: 2538295 - protein, 24 aa, Entamoeba dispar
RLNALKMIYINILGYEIDVGIIEI

SEQ ID NO: 2538296 - protein, 25 aa, Entamoeba dispar
RLNDNSLFWITPLISELSNLTFLGL

SEQ ID NO: 2538297 - protein, 18 aa, Entamoeba dispar
RLNEQFLPMQFGPSFAER

SEQ ID NO: 2538298 - protein, 19 aa, Entamoeba dispar
RLNFAKKGWKTIAALQLRN

SEQ ID NO: 2538299 - protein, 17 aa, Entamoeba dispar
RLNFVIEAPKIDIGEVT

SEQ ID NO: 2538300 - protein, 24 aa, Entamoeba dispar
RLNKDKGYAFIKFSKHESATSAIL

SEQ ID NO: 2538301 - protein, 49 aa, Entamoeba dispar
RLNKVQLLNGLKVYLSSFPKKEVIGFKKLEYMFLLRQCGAKIVKDKKES

SEQ ID NO: 2538302 - protein, 26 aa, Entamoeba dispar
RLNVMITLVHQWFKNYEFGNATQAIY

SEQ ID NO: 2538303 - protein, 18 aa, Entamoeba dispar
RLPFKARYFISNSSYSQI

SEQ ID NO: 2538304 - protein, 18 aa, Entamoeba dispar
RLPGIKLGSLKDGLIVPE

SEQ ID NO: 2538305 - protein, 21 aa, Entamoeba dispar
RLPHDSFSLNVIRDKKRRNKL

SEQ ID NO: 2538306 - protein, 18 aa, Entamoeba dispar
RLPKPIGSELYIPSTSNL

SEQ ID NO: 2538307 - protein, 17 aa, Entamoeba dispar
RLPPSTFKTIKKLLING

SEQ ID NO: 2538308 - protein, 17 aa, Entamoeba dispar
RLQFKGWDQRKIVDRET

SEQ ID NO: 2538309 - protein, 21 aa, Entamoeba dispar
RLQLAQQLTLFDQAKLRSIKL

SEQ ID NO: 2538310 - protein, 24 aa, Entamoeba dispar
RLQQDTFLPAIESGTIILIGATTE

SEQ ID NO: 2538311 - protein, 18 aa, Entamoeba dispar
RLRAERAAELERKKKELE

SEQ ID NO: 2538312 - protein, 26 aa, Entamoeba dispar
RLREKLTYSHTFGIYVDLQLIKSRPT

SEQ ID NO: 2538313 - protein, 18 aa, Entamoeba dispar
RLRERKNIGMIDFDREFE

SEQ ID NO: 2538314 - protein, 26 aa, Entamoeba dispar
RLRIDETMPLLLKIMIESCWKQNPQD

SEQ ID NO: 2538315 - protein, 18 aa, Entamoeba dispar
RLRTACERAKRTLSSAAT

SEQ ID NO: 2538316 - protein, 18 aa, Entamoeba dispar
RLSEALARLYLDKQVRDD

SEQ ID NO: 2538317 - protein, 19 aa, Entamoeba dispar
RLSTMYYISYRTIKMFATR

SEQ ID NO: 2538318 - protein, 19 aa, Entamoeba dispar
RLSVMEKWHSKTTMMNISK

SEQ ID NO: 2538319 - protein, 21 aa, Entamoeba dispar
RLTKLFNYFSVFVMQESLDKF

SEQ ID NO: 2538320 - protein, 23 aa, Entamoeba dispar
RLTLNQKYIFRNIIDLFGNDEKE

SEQ ID NO: 2538321 - protein, 19 aa, Entamoeba dispar
RLTRIRFIELRSAIFNFHF

SEQ ID NO: 2538322 - protein, 24 aa, Entamoeba dispar
RLTSINLPITISKLGDYCFYKCIS

SEQ ID NO: 2538323 - protein, 21 aa, Entamoeba dispar
RLVDVIIRLHKKRSLLLPFLF

SEQ ID NO: 2538324 - protein, 22 aa, Entamoeba dispar
RLVHIYLALQPILNQTIESTET

SEQ ID NO: 2538325 - protein, 20 aa, Entamoeba dispar
RLVKYGAIQSKEYGLLVIFL

SEQ ID NO: 2538326 - protein, 24 aa, Entamoeba dispar
RLWDSFISFPKDKLYLFLSATILI

SEQ ID NO: 2538327 - protein, 25 aa, Entamoeba dispar
RLYVELTEKVTLLQALLNGEQPKEV

SEQ ID NO: 2538328 - protein, 17 aa, Entamoeba dispar
RLYYPMCYKEEHQKECL

SEQ ID NO: 2538329 - protein, 20 aa, Entamoeba dispar
RMDCDVPVVLLFVALGYEND

SEQ ID NO: 2538330 - protein, 29 aa, Entamoeba dispar
RMDYYKNQLPYLFPGVPLTFIDHFPRDEN

SEQ ID NO: 2538331 - protein, 18 aa, Entamoeba dispar
RMEKYWKINNIKVDYLIV

SEQ ID NO: 2538332 - protein, 24 aa, Entamoeba dispar
RMELAGQLMSLLFEDLFKQFNTDL

SEQ ID NO: 2538333 - protein, 24 aa, Entamoeba dispar
RMEVSYMRMFHHPNIISFYGTIQT

SEQ ID NO: 2538334 - protein, 22 aa, Entamoeba dispar
RMFLGDRWLRFDPPLGCVINLD

SEQ ID NO: 2538335 - protein, 37 aa, Entamoeba dispar
RMGDLISEDLVWNIFLQITFGLRYLHSIRILHRDMKT

SEQ ID NO: 2538336 - protein, 18 aa, Entamoeba dispar
RMGNLFIVGPTKTGKTEF

SEQ ID NO: 2538337 - protein, 26 aa, Entamoeba dispar
RMHAKIILNALLKRQLIIGPEGQNSF

SEQ ID NO: 2538338 - protein, 22 aa, Entamoeba dispar
RMHPGFSILSNTLFYGGCIMDC

SEQ ID NO: 2538339 - protein, 25 aa, Entamoeba dispar
RMIAKYYHDITLSRFSQLLNISLEE

SEQ ID NO: 2538340 - protein, 17 aa, Entamoeba dispar
RMIDGINIVLLIDLNCP

SEQ ID NO: 2538341 - protein, 25 aa, Entamoeba dispar
RMIENLLNMNLIPEDALRALCDKAK

SEQ ID NO: 2538342 - protein, 19 aa, Entamoeba dispar
RMIGRRFSDPTIQKDMKHW

SEQ ID NO: 2538343 - protein, 19 aa, Entamoeba dispar
RMIRLNPPFKLVRTTPEKA

SEQ ID NO: 2538344 - protein, 25 aa, Entamoeba dispar
RMKDFTCTYATRFLGFKPSVAPMGQ

SEQ ID NO: 2538345 - protein, 24 aa, Entamoeba dispar
RMKLFPNVGLLYPVGMNALAAATD

SEQ ID NO: 2538346 - protein, 17 aa, Entamoeba dispar
RMKLWYHSVMIISVFQG

SEQ ID NO: 2538347 - protein, 17 aa, Entamoeba dispar
RMKWYFKGGNTTNKEYM

SEQ ID NO: 2538348 - protein, 31 aa, Entamoeba dispar
RMLEGACPISLPKLIYIKELGEVMTKLGYED

SEQ ID NO: 2538349 - protein, 18 aa, Entamoeba dispar
RMMISNNPMMGMAGMQQP

SEQ ID NO: 2538350 - protein, 17 aa, Entamoeba dispar
RMMMMKKELYRMEIVID

SEQ ID NO: 2538351 - protein, 25 aa, Entamoeba dispar
RMSKIVLLRSILIRREIYKKNIKDM

SEQ ID NO: 2538352 - protein, 24 aa, Entamoeba dispar
RMSRDYMILTRNDSKIYPLTSKCI

SEQ ID NO: 2538353 - protein, 19 aa, Entamoeba dispar
RMVFWRQDRLNRDIIVLIT

SEQ ID NO: 2538354 - protein, 30 aa, Entamoeba dispar
RNAFTMFDQLFRYFGLKKAEFLQAGFKNLV

SEQ ID NO: 2538355 - protein, 22 aa, Entamoeba dispar
RNAIFTFNYAYVYNPVDQEVVN

SEQ ID NO: 2538356 - protein, 18 aa, Entamoeba dispar
RNAQQLRIMLMEASVNIS

SEQ ID NO: 2538357 - protein, 22 aa, Entamoeba dispar
RNASCVILVFDVSNFQSFKGIK

SEQ ID NO: 2538358 - protein, 25 aa, Entamoeba dispar
RNDINWLSIIYPNPIYYVSDISVPQ

SEQ ID NO: 2538359 - protein, 35 aa, Entamoeba dispar
RNDLNMAYHILRNSYQIIYEVIQSTTPKSVAELNT

SEQ ID NO: 2538360 - protein, 32 aa, Entamoeba dispar
RNDLREMLFRCLSPSLPMSLLQREVRSVIFAS

SEQ ID NO: 2538361 - protein, 17 aa, Entamoeba dispar
RNDVDPIVITQLGPRQN

SEQ ID NO: 2538362 - protein, 30 aa, Entamoeba dispar
  misc_feature (28)..(29): Xaa can be any naturally occurring amino acid
RNELESFIIFNLIMKLIRPLYLIQTNTXXK

SEQ ID NO: 2538363 - protein, 25 aa, Entamoeba dispar
RNETLYVYHLLLPFVQKLSISIDND

SEQ ID NO: 2538364 - protein, 25 aa, Entamoeba dispar
RNEVEFLRKYIWISRQHFQIEIKGE

SEQ ID NO: 2538365 - protein, 22 aa, Entamoeba dispar
RNGDVLMFGYSTREYVLLKEKP

SEQ ID NO: 2538366 - protein, 25 aa, Entamoeba dispar
RNHHKDQLFLSLDLNNTLSISSQPF

SEQ ID NO: 2538367 - protein, 19 aa, Entamoeba dispar
RNIFLNFVSKNIIYRRLDI

SEQ ID NO: 2538368 - protein, 25 aa, Entamoeba dispar
RNIPPTIIELPQLKALILNNNNINT

SEQ ID NO: 2538369 - protein, 17 aa, Entamoeba dispar
RNISVWETSLKKSKGVK

SEQ ID NO: 2538370 - protein, 17 aa, Entamoeba dispar
RNITSSYYRGTHGCLIV

SEQ ID NO: 2538371 - protein, 25 aa, Entamoeba dispar
RNIVRRMFSILARNGWWEKLGGMDG

SEQ ID NO: 2538372 - protein, 18 aa, Entamoeba dispar
RNKFASLYCVFPLVGSEA

SEQ ID NO: 2538373 - protein, 17 aa, Entamoeba dispar
RNKLVRYIGFDIIDLSP

SEQ ID NO: 2538374 - protein, 19 aa, Entamoeba dispar
RNKPPFYGYVKRSMNRAPG

SEQ ID NO: 2538375 - protein, 41 aa, Entamoeba dispar
RNKVYAYGELFYLLNLYSDSIEWFFIGFDPTKSNIKPINLN

SEQ ID NO: 2538376 - protein, 23 aa, Entamoeba dispar
RNLATNLIPIYGQYQGYRCWCNI

SEQ ID NO: 2538377 - protein, 36 aa, Entamoeba dispar
RNLCKDYLLIVRKSIKDLIPKAVIHFLVFKTRDSLQ

SEQ ID NO: 2538378 - protein, 26 aa, Entamoeba dispar
RNLELLVVDIIYNLVKRPSLGHYFTP

SEQ ID NO: 2538379 - protein, 28 aa, Entamoeba dispar
RNLFSLKKEAIPIKLRIKFMIDAANGIQ

SEQ ID NO: 2538380 - protein, 27 aa, Entamoeba dispar
RNMERFHFNPIPLNEYSRRFFPNIETF

SEQ ID NO: 2538381 - protein, 26 aa, Entamoeba dispar
RNMKRYLPDNLLVDKLIQAMKLSGVE

SEQ ID NO: 2538382 - protein, 21 aa, Entamoeba dispar
RNMLSLPIKMSKLTLLTKLNL

SEQ ID NO: 2538383 - protein, 27 aa, Entamoeba dispar
RNNELELLPDLLYINLTQLQDLQVESN

SEQ ID NO: 2538384 - protein, 25 aa, Entamoeba dispar
RNNEVIIDRIIPELSLLDVNEIKDN

SEQ ID NO: 2538385 - protein, 30 aa, Entamoeba dispar
RNQHTFRTDVPFLFRDSFSRLKDLPIRRDF

SEQ ID NO: 2538386 - protein, 26 aa, Entamoeba dispar
RNQLSQEVLFVYYKIPNFNTIIEPTV

SEQ ID NO: 2538387 - protein, 26 aa, Entamoeba dispar
RNQMFQCSIPCIDGDTIPVMITGQEG

SEQ ID NO: 2538388 - protein, 28 aa, Entamoeba dispar
RNRESAFNSFLSWILIEKGIKLMCRISS

SEQ ID NO: 2538389 - protein, 22 aa, Entamoeba dispar
RNRHVMCFCFDITKKASFSSIS

SEQ ID NO: 2538390 - protein, 25 aa, Entamoeba dispar
RNRQRRFGGMRRGFRNSLIDNVTRE

SEQ ID NO: 2538391 - protein, 22 aa, Entamoeba dispar
RNRRKHIRTFILNTQTILKEQR

SEQ ID NO: 2538392 - protein, 26 aa, Entamoeba dispar
RNRRNEWFIKQFHPINLRERRMAKQR

SEQ ID NO: 2538393 - protein, 23 aa, Entamoeba dispar
RNSEYMKWLKKRVVDLMAVFPSY

SEQ ID NO: 2538394 - protein, 26 aa, Entamoeba dispar
RNSIFTRIIRIFLDNELKQFLKEVIN

SEQ ID NO: 2538395 - protein, 22 aa, Entamoeba dispar
RNSIYNKIIRLYMDYDVRDIFQ

SEQ ID NO: 2538396 - protein, 26 aa, Entamoeba dispar
RNSKIIIETIFKYVIVPITLSSSIEL

SEQ ID NO: 2538397 - protein, 22 aa, Entamoeba dispar
RNSSYFPFKNVTIAVVVFNSQD

SEQ ID NO: 2538398 - protein, 23 aa, Entamoeba dispar
RNSTNLVYVIYDSKRIIGKNESD

SEQ ID NO: 2538399 - protein, 22 aa, Entamoeba dispar
RNTELYEIIPKHEKKQSKRRTL

SEQ ID NO: 2538400 - protein, 27 aa, Entamoeba dispar
RNTFSDVLLKTLFLSRSVLVMIDGSAY

SEQ ID NO: 2538401 - protein, 30 aa, Entamoeba dispar
RNTPESCSPAFWKFLDLIGNKIELNGWSGY

SEQ ID NO: 2538402 - protein, 25 aa, Entamoeba dispar
RNVIKRILYCLVAIDKIKYTQGMNE

SEQ ID NO: 2538403 - protein, 19 aa, Entamoeba dispar
RNVKLVILNSGICKIPRIR

SEQ ID NO: 2538404 - protein, 25 aa, Entamoeba dispar
RNVKPFNLRLVQHSTIFLGGPLVKL

SEQ ID NO: 2538405 - protein, 24 aa, Entamoeba dispar
RNVKYLFKIYSSIIPKIPKSSYEQ

SEQ ID NO: 2538406 - protein, 18 aa, Entamoeba dispar
RNVQFFRSAFIYAKIKTA

SEQ ID NO: 2538407 - protein, 28 aa, Entamoeba dispar
RNVVAKYSAILRFLLEKKLYQKELDNTS

SEQ ID NO: 2538408 - protein, 21 aa, Entamoeba dispar
RNVVQHFLLLLKKSGNELKEE

SEQ ID NO: 2538409 - protein, 20 aa, Entamoeba dispar
RNWVIEWAKSSQIKEGDLDK

SEQ ID NO: 2538410 - protein, 19 aa, Entamoeba dispar
RNYCLKCSNGYKIENNQCN

SEQ ID NO: 2538411 - protein, 23 aa, Entamoeba dispar
RNYDVDQQLIYNKAIQLNETTPE

SEQ ID NO: 2538412 - protein, 17 aa, Entamoeba dispar
RNYESLIRELKFSFDCD

SEQ ID NO: 2538413 - protein, 24 aa, Entamoeba dispar
RNYHAICGIVFAFVRIPEIEQLKS

SEQ ID NO: 2538414 - protein, 19 aa, Entamoeba dispar
RNYIPLNQFKWKKQINEKR

SEQ ID NO: 2538415 - protein, 21 aa, Entamoeba dispar
RNYKIALESVLIALLNRHFEI

SEQ ID NO: 2538416 - protein, 24 aa, Entamoeba dispar
RNYQVYQQALFLGILNQSSSMIIQ

SEQ ID NO: 2538417 - protein, 25 aa, Entamoeba dispar
RNYQVYQQALFLGILNQSSSMIIQK

SEQ ID NO: 2538418 - protein, 17 aa, Entamoeba dispar
RPAYYRQAMLEIAVLQV

SEQ ID NO: 2538419 - protein, 24 aa, Entamoeba dispar
RPCCFKFLHIPIQSGSSSVLEAMK

SEQ ID NO: 2538420 - protein, 24 aa, Entamoeba dispar
RPDDIFIRILSICLIKFDSILPSK

SEQ ID NO: 2538421 - protein, 24 aa, Entamoeba dispar
RPGPSNMKLTYLESWKAVELSNAL

SEQ ID NO: 2538422 - protein, 18 aa, Entamoeba dispar
RPIFNHKDGTQQKFWYSC

SEQ ID NO: 2538423 - protein, 28 aa, Entamoeba dispar
RPIKIPLQGLLCDLLWSDPHDLPVDGWM

SEQ ID NO: 2538424 - protein, 26 aa, Entamoeba dispar
RPIKNEQLLQLIFKAIDIDGNGEIDL

SEQ ID NO: 2538425 - protein, 21 aa, Entamoeba dispar
RPIMLLYQSQDAPDLMKLSWS

SEQ ID NO: 2538426 - protein, 31 aa, Entamoeba dispar
RPINLEFEKVFFPYLLISKKRYAGLYFNRVD

SEQ ID NO: 2538427 - protein, 25 aa, Entamoeba dispar
RPIQALHHPFITRELFNGSFEIPRC

SEQ ID NO: 2538428 - protein, 21 aa, Entamoeba dispar
RPIQLTLMKWTKCNDYHLIYS

SEQ ID NO: 2538429 - protein, 18 aa, Entamoeba dispar
RPIVSRIPEFEKLLGQYG

SEQ ID NO: 2538430 - protein, 23 aa, Entamoeba dispar
RPKDLTMRILYYNYNKIQELTGD

SEQ ID NO: 2538431 - protein, 23 aa, Entamoeba dispar
RPKKLFVKLHNRQIQTPRGDTSD

SEQ ID NO: 2538432 - protein, 17 aa, Entamoeba dispar
RPKNLLLIDVLERHILD

SEQ ID NO: 2538433 - protein, 22 aa, Entamoeba dispar
RPKRDIIMGVAYLEWARNKYSQ

SEQ ID NO: 2538434 - protein, 27 aa, Entamoeba dispar
RPLCPRYMLLLNEIIRLSLLIEFDKQR

SEQ ID NO: 2538435 - protein, 18 aa, Entamoeba dispar
RPLIEVPVVLIQEWTKYI

SEQ ID NO: 2538436 - protein, 25 aa, Entamoeba dispar
RPLNQRFKFELIDKTIKTFQVNVTL

SEQ ID NO: 2538437 - protein, 24 aa, Entamoeba dispar
RPLSNVICLWQSSSPYRSLLLNEV

SEQ ID NO: 2538438 - protein, 20 aa, Entamoeba dispar
RPLYQRTFTTFAKLWKLQQT

SEQ ID NO: 2538439 - protein, 28 aa, Entamoeba dispar
RPMQLQILSRKQAFLEMLLFADKHGYKW

SEQ ID NO: 2538440 - protein, 30 aa, Entamoeba dispar
RPNAAQILHYTFLLPVLSELHYQTKSIYIS

SEQ ID NO: 2538441 - protein, 23 aa, Entamoeba dispar
RPNGGYYLIMQKFKTNAILFDTF

SEQ ID NO: 2538442 - protein, 25 aa, Entamoeba dispar
RPNLDKFIVLLLNRIGLPIIKQEGD

SEQ ID NO: 2538443 - protein, 25 aa, Entamoeba dispar
RPQLIFRDSFLQLPTLKEWSYDIRN

SEQ ID NO: 2538444 - protein, 33 aa, Entamoeba dispar
RPSFEDLLIQPVQRLMRYPLLLKEIIKNTGPRH

SEQ ID NO: 2538445 - protein, 18 aa, Entamoeba dispar
RPSNIILSLSRTIKLTNF

SEQ ID NO: 2538446 - protein, 19 aa, Entamoeba dispar
RPTGSFMFLGPSGVGKTEL

SEQ ID NO: 2538447 - protein, 17 aa, Entamoeba dispar
RPTINWYNLFKNTSIGS

SEQ ID NO: 2538448 - protein, 17 aa, Entamoeba dispar
RPTLYLNRNFLPEKMNK

SEQ ID NO: 2538449 - protein, 23 aa, Entamoeba dispar
RPVTFDIPPFITLNEQQKQKCKE

SEQ ID NO: 2538450 - protein, 17 aa, Entamoeba dispar
RQAYELLKKDAINFMNA

SEQ ID NO: 2538451 - protein, 19 aa, Entamoeba dispar
RQEGIFCHIPSIRVIPNWN

SEQ ID NO: 2538452 - protein, 23 aa, Entamoeba dispar
RQELPPHIFALSEETYRNMKNEK

SEQ ID NO: 2538453 - protein, 18 aa, Entamoeba dispar
RQGMLEIAVLQLLNEKFD

SEQ ID NO: 2538454 - protein, 19 aa, Entamoeba dispar
RQGMLEIAVLQLLNEKFDI

SEQ ID NO: 2538455 - protein, 34 aa, Entamoeba dispar
RQINYLPTPFFNNLIISLKTWLSIHPSKASKPCI

SEQ ID NO: 2538456 - protein, 28 aa, Entamoeba dispar
RQIQNSLKHNILYPLKKEIIINQLQKNE

SEQ ID NO: 2538457 - protein, 25 aa, Entamoeba dispar
RQKTSYPFPLVPKILRFWCCDEKII

SEQ ID NO: 2538458 - protein, 27 aa, Entamoeba dispar
RQKVESFFDLFYTPALPENLNLEEMEE

SEQ ID NO: 2538459 - protein, 38 aa, Entamoeba dispar
RQLDIMDFLVKPIQRITKYPLFIREIKPLLVSIDTIEL

SEQ ID NO: 2538460 - protein, 24 aa, Entamoeba dispar
RQLEGIINIYLDPFANFVQLIDSK

SEQ ID NO: 2538461 - protein, 24 aa, Entamoeba dispar
RQLNIQLYPIIFKRDSFISFCDTL

SEQ ID NO: 2538462 - protein, 42 aa, Entamoeba dispar
RQLVKHYEWYYKDFQGKLIPGHLKFHVLLTTYEIVISDWEDL

SEQ ID NO: 2538463 - protein, 25 aa, Entamoeba dispar
RQMGYGCFSYCTSLLFINIPKTVSV

SEQ ID NO: 2538464 - protein, 17 aa, Entamoeba dispar
RQMILKSSEKKPLQNEI

SEQ ID NO: 2538465 - protein, 30 aa, Entamoeba dispar
RQPIDNEVQFYRYGVRPYVPYDRYYKNEEE

SEQ ID NO: 2538466 - protein, 20 aa, Entamoeba dispar
RQQVFELHRSTGLAKIPLIQ

SEQ ID NO: 2538467 - protein, 19 aa, Entamoeba dispar
RQRALSVLAVLFRSIDISN

SEQ ID NO: 2538468 - protein, 27 aa, Entamoeba dispar
RQSVASLLTIPFITQNRFIAILNTLEH

SEQ ID NO: 2538469 - protein, 17 aa, Entamoeba dispar
RQTNIEQFLPILNRFLP

SEQ ID NO: 2538470 - protein, 33 aa, Entamoeba dispar
RQTVMWTATWPQAIQQFALGFMFHPLQINIGNP

SEQ ID NO: 2538471 - protein, 30 aa, Entamoeba dispar
RQVISGTIKGYFLSARIFTLYSNDKTLRVI

SEQ ID NO: 2538472 - protein, 19 aa, Entamoeba dispar
RQYLNDIFTILIKKNKNLI

SEQ ID NO: 2538473 - protein, 25 aa, Entamoeba dispar
RRAGFAYRAPFARFLQTYKKLSPKT

SEQ ID NO: 2538474 - protein, 22 aa, Entamoeba dispar
RRDFVIHLTQFPTTLSALINFY

SEQ ID NO: 2538475 - protein, 20 aa, Entamoeba dispar
RRDGFDLIQTLYFPKKDEGQ

SEQ ID NO: 2538476 - protein, 19 aa, Entamoeba dispar
RRDIKKYRYLKKTLHITLI

SEQ ID NO: 2538477 - protein, 26 aa, Entamoeba dispar
RRDINKFVIPTKQLLKYLDALGVVVN

SEQ ID NO: 2538478 - protein, 22 aa, Entamoeba dispar
RRDNLLKRKYYDSFLFNSFSDE

SEQ ID NO: 2538479 - protein, 25 aa, Entamoeba dispar
RREMKQLDMVYLMKVALHVKDMNDI

SEQ ID NO: 2538480 - protein, 23 aa, Entamoeba dispar
RREREEFYRKAGLKGLEKEMERE

SEQ ID NO: 2538481 - protein, 20 aa, Entamoeba dispar
RRETFESLDYWIDLTRKSGG

SEQ ID NO: 2538482 - protein, 17 aa, Entamoeba dispar
RRFIFNLNVKMCKDFKA

SEQ ID NO: 2538483 - protein, 21 aa, Entamoeba dispar
RRFNHMSSWGVLLMTIRVGAC

SEQ ID NO: 2538484 - protein, 19 aa, Entamoeba dispar
RRFSFHSFFIIGMTKNQII

SEQ ID NO: 2538485 - protein, 25 aa, Entamoeba dispar
RRFSLKTVLMLLNQMLKRLQFVHSK

SEQ ID NO: 2538486 - protein, 27 aa, Entamoeba dispar
RRGCDQLARLLYALDQSKITTVTLQLG

SEQ ID NO: 2538487 - protein, 17 aa, Entamoeba dispar
RRGHYVCYVRRGEKWYF

SEQ ID NO: 2538488 - protein, 18 aa, Entamoeba dispar
RRGKFNHPILLAVDHRRQ

SEQ ID NO: 2538489 - protein, 18 aa, Entamoeba dispar
RRGTIVLYKMPAGEYQFA

SEQ ID NO: 2538490 - protein, 23 aa, Entamoeba dispar
RRHGVNLCYTPMVLSKMFVESKV

SEQ ID NO: 2538491 - protein, 20 aa, Entamoeba dispar
RRIGYNSIMITPKYFNEIKD

SEQ ID NO: 2538492 - protein, 23 aa, Entamoeba dispar
RRINKIEFYKPTQLSYSYQEKTY

SEQ ID NO: 2538493 - protein, 34 aa, Entamoeba dispar
RRINMIMQTVFFKLANVIPFEKAIVLLKEAVQKT

SEQ ID NO: 2538494 - protein, 18 aa, Entamoeba dispar
RRIPICTYFNQITHGAIY

SEQ ID NO: 2538495 - protein, 21 aa, Entamoeba dispar
RRKENYMVQLKRYKDELQKFN

SEQ ID NO: 2538496 - protein, 26 aa, Entamoeba dispar
RRKIMKELLEDLLFEYGIIVIDSTNR

SEQ ID NO: 2538497 - protein, 21 aa, Entamoeba dispar
RRKLAEEAALLMAQFMGDSSE

SEQ ID NO: 2538498 - protein, 22 aa, Entamoeba dispar
RRKNIPLVRKIYGAAIGWCHKD

SEQ ID NO: 2538499 - protein, 43 aa, Entamoeba dispar
RRLGRTFIRFCEELKFDLPFVDPCLYLQRFGEDLAFEKTGDVV

SEQ ID NO: 2538500 - protein, 25 aa, Entamoeba dispar
RRLVKRLYIPLPDIEARMTLVKTLL

SEQ ID NO: 2538501 - protein, 19 aa, Entamoeba dispar
RRMFNINQYISLVKEILES

SEQ ID NO: 2538502 - protein, 22 aa, Entamoeba dispar
RRNAILLFALLNNDSIKREESL

SEQ ID NO: 2538503 - protein, 20 aa, Entamoeba dispar
RRNLFYYECIYKYGSLYIWN

SEQ ID NO: 2538504 - protein, 20 aa, Entamoeba dispar
RRPKNCIVGLKKLIQVHSIE

SEQ ID NO: 2538505 - protein, 26 aa, Entamoeba dispar
RRPMNNDQFLIIKNATLLCVLKNVLS

SEQ ID NO: 2538506 - protein, 21 aa, Entamoeba dispar
RRPRRRLRAAVLPVAESSAGS

SEQ ID NO: 2538507 - protein, 21 aa, Entamoeba dispar
RRQAYELLKKDAANFMNAYDS

SEQ ID NO: 2538508 - protein, 21 aa, Entamoeba dispar
RRQIVDLHKWAPYLKSEEGFG

SEQ ID NO: 2538509 - protein, 27 aa, Entamoeba dispar
RRRHIEALCFYYLNQKGYSLEFKKTST

SEQ ID NO: 2538510 - protein, 24 aa, Entamoeba dispar
RRRIINPHFAAMYVYLLKPGEGCC

SEQ ID NO: 2538511 - protein, 25 aa, Entamoeba dispar
RRRIINPHFAAMYVYLLKPGEGMLY

SEQ ID NO: 2538512 - protein, 24 aa, Entamoeba dispar
RRRKKFERPLESPKRSNSTFSTSS

SEQ ID NO: 2538513 - protein, 25 aa, Entamoeba dispar
RRRLRSYVIDIKQKELNPWNSYVLL

SEQ ID NO: 2538514 - protein, 26 aa, Entamoeba dispar
RRRLVQRLIPATYDGYIVFIIKESLE

SEQ ID NO: 2538515 - protein, 28 aa, Entamoeba dispar
RRRTKDYILLAWYYSPALAVGYYNRFPT

SEQ ID NO: 2538516 - protein, 22 aa, Entamoeba dispar
RRRYKKRATLKRQAFGNFASAM

SEQ ID NO: 2538517 - protein, 23 aa, Entamoeba dispar
RRSAFLDLLENVGGAIFELLMDG

SEQ ID NO: 2538518 - protein, 21 aa, Entamoeba dispar
RRSAFRLCTNLKELIIPNSVK

SEQ ID NO: 2538519 - protein, 26 aa, Entamoeba dispar
RRSFRGNWPVPYIKKILVFSTDEECA

SEQ ID NO: 2538520 - protein, 31 aa, Entamoeba dispar
RRTEEGYRIYTLEELGLDKNKFGGNTPLCPF

SEQ ID NO: 2538521 - protein, 31 aa, Entamoeba dispar
RRTELNNMKFIIPKKIGIIPFKLKMDKELRI

SEQ ID NO: 2538522 - protein, 29 aa, Entamoeba dispar
RRTFEGIITHQIFYDIWPPLIEKTTEVIQ

SEQ ID NO: 2538523 - protein, 17 aa, Entamoeba dispar
RRTLTSFKLLLSSCFRN

SEQ ID NO: 2538524 - protein, 26 aa, Entamoeba dispar
RRTMKQLDMVYLMKVALHVEDMNDIQ

SEQ ID NO: 2538525 - protein, 26 aa, Entamoeba dispar
RRTMKQLDMVYLMKVALHVEDMNDVQ

SEQ ID NO: 2538526 - protein, 22 aa, Entamoeba dispar
RRTRKLFKRPFRGHGISNTSTI

SEQ ID NO: 2538527 - protein, 21 aa, Entamoeba dispar
RRTVPPGFFTPSPTGVLYVEP

SEQ ID NO: 2538528 - protein, 18 aa, Entamoeba dispar
RRVNGIINITRSLGDKEL

SEQ ID NO: 2538529 - protein, 38 aa, Entamoeba dispar
RRVNKSVVFFILNYLLDLLREFGFFFDSIYAKKTCKTL

SEQ ID NO: 2538530 - protein, 19 aa, Entamoeba dispar
RRVTAITRFNLFVVIGLAD

SEQ ID NO: 2538531 - protein, 18 aa, Entamoeba dispar
RRYDEAYLSQNKPTQLQL

SEQ ID NO: 2538532 - protein, 24 aa, Entamoeba dispar
RRYFVGYCILVMKKLYCCCKIKED

SEQ ID NO: 2538533 - protein, 17 aa, Entamoeba dispar
RRYICSGPMFVVPNLKD

SEQ ID NO: 2538534 - protein, 23 aa, Entamoeba dispar
RRYIRVTTICRLFTSISSEGLNR

SEQ ID NO: 2538535 - protein, 21 aa, Entamoeba dispar
RSAAAVGYYPPYQGYADGGIF

SEQ ID NO: 2538536 - protein, 19 aa, Entamoeba dispar
RSCFYGCGYVEELTQNKRI

SEQ ID NO: 2538537 - protein, 24 aa, Entamoeba dispar
RSCIRHNFLYGKERLMASILEGKS

SEQ ID NO: 2538538 - protein, 28 aa, Entamoeba dispar
RSDEKKIWNLNRSLLRQFNSCILHIEDE

SEQ ID NO: 2538539 - protein, 26 aa, Entamoeba dispar
RSDPVTFLLMGSYKLIIKLFQYQLKY

SEQ ID NO: 2538540 - protein, 18 aa, Entamoeba dispar
RSDRFERRGNGNIGYREE

SEQ ID NO: 2538541 - protein, 24 aa, Entamoeba dispar
RSDTKLLWLHYPQRSICQCALMEP

SEQ ID NO: 2538542 - protein, 26 aa, Entamoeba dispar
RSEATIHYVFVVTLILTNKNHYHLLN

SEQ ID NO: 2538543 - protein, 18 aa, Entamoeba dispar
RSEGLNKLYAYLCDEIRA

SEQ ID NO: 2538544 - protein, 24 aa, Entamoeba dispar
RSEKEIEKLIKWARGLPSIDKEEI

SEQ ID NO: 2538545 - protein, 23 aa, Entamoeba dispar
RSEKEIEKLLKWARGLPSIDKEE

SEQ ID NO: 2538546 - protein, 28 aa, Entamoeba dispar
RSENEIISMLSWVRTLPSLKNKEVKSIK

SEQ ID NO: 2538547 - protein, 32 aa, Entamoeba dispar
RSEVVFQKIWRYLVPFYIRCGLHPIEDVAMSV

SEQ ID NO: 2538548 - protein, 23 aa, Entamoeba dispar
RSEVWKLLLLKDLDYKTLQDEFD

SEQ ID NO: 2538549 - protein, 19 aa, Entamoeba dispar
RSFEKYKIILKVSCCLYMG

SEQ ID NO: 2538550 - protein, 20 aa, Entamoeba dispar
RSFNMGGMPREFGGFSGFGM

SEQ ID NO: 2538551 - protein, 24 aa, Entamoeba dispar
RSFRKCFNLITIQLPFTINTIKSS

SEQ ID NO: 2538552 - protein, 24 aa, Entamoeba dispar
RSGKMGHFFKPDSFIFGHGGAGNN

SEQ ID NO: 2538553 - protein, 19 aa, Entamoeba dispar
RSHCIFTVTVQIIRDSDFE

SEQ ID NO: 2538554 - protein, 22 aa, Entamoeba dispar
RSHCITIIRVGKGTLVFVDLAG

SEQ ID NO: 2538555 - protein, 20 aa, Entamoeba dispar
RSHGLIKKAMELSILCDCEV

SEQ ID NO: 2538556 - protein, 33 aa, Entamoeba dispar
RSIDDGLFIEDFFPELLLLDLSNNEIEVLENIG

SEQ ID NO: 2538557 - protein, 17 aa, Entamoeba dispar
RSIILIDLRANTPIKTV

SEQ ID NO: 2538558 - protein, 18 aa, Entamoeba dispar
RSINLPSSIIEIGNYCFC

SEQ ID NO: 2538559 - protein, 35 aa, Entamoeba dispar
RSKEAQINNGLLYLLRTLGYSFSIKQTKKTKCTER

SEQ ID NO: 2538560 - protein, 23 aa, Entamoeba dispar
RSKKGLLHNCELAKILFSNEETS

SEQ ID NO: 2538561 - protein, 18 aa, Entamoeba dispar
RSKPKYYCFYYNVYERGN

SEQ ID NO: 2538562 - protein, 24 aa, Entamoeba dispar
RSKVHTWFKQPFRKVRRHQTRVEK

SEQ ID NO: 2538563 - protein, 36 aa, Entamoeba dispar
RSKYTTRPFYIKPPNSMGYLTLKFSKSGKIIPQYLY

SEQ ID NO: 2538564 - protein, 21 aa, Entamoeba dispar
RSLAFVIQFLECVEPPCCEVE

SEQ ID NO: 2538565 - protein, 22 aa, Entamoeba dispar
RSLDLSFFINKLKEFEYRPTQS

SEQ ID NO: 2538566 - protein, 25 aa, Entamoeba dispar
RSLEIELDKIKRKYIAFKKVFEEHG

SEQ ID NO: 2538567 - protein, 30 aa, Entamoeba dispar
RSLEIELDKIKRKYIAFKKVFEEHGEDVEY

SEQ ID NO: 2538568 - protein, 27 aa, Entamoeba dispar
RSLFLLLREVFFVHSPPKLFGGSLEDI

SEQ ID NO: 2538569 - protein, 34 aa, Entamoeba dispar
RSLFNSCILNKPNLLFLCFSRSMVIGLWSSTEIK

SEQ ID NO: 2538570 - protein, 19 aa, Entamoeba dispar
RSLGRIILSIRDAQTISFH

SEQ ID NO: 2538571 - protein, 23 aa, Entamoeba dispar
RSLLKNMEMMKIYFADPLENEPK

SEQ ID NO: 2538572 - protein, 18 aa, Entamoeba dispar
RSLLTRERMIYSLDLHPI

SEQ ID NO: 2538573 - protein, 21 aa, Entamoeba dispar
RSLTEIHILYGTKTIFINPFI

SEQ ID NO: 2538574 - protein, 21 aa, Entamoeba dispar
RSLVCLAPKLPQSTLNGEVFR

SEQ ID NO: 2538575 - protein, 21 aa, Entamoeba dispar
RSMPTFRFYRQGGLVKEFTGA

SEQ ID NO: 2538576 - protein, 18 aa, Entamoeba dispar
RSMREWATVPILGKLSKC

SEQ ID NO: 2538577 - protein, 18 aa, Entamoeba dispar
RSMYCMYHYYAGMTMLIK

SEQ ID NO: 2538578 - protein, 31 aa, Entamoeba dispar
RSNAIPFRDSQYLYRCFVFEQLSYGIKITDI

SEQ ID NO: 2538579 - protein, 24 aa, Entamoeba dispar
RSNEHLYVFLNKGPLQFCCVSNTK

SEQ ID NO: 2538580 - protein, 35 aa, Entamoeba dispar
RSNIKLAKLLSSKLGFPHELLLHINKEVADLMKSN

SEQ ID NO: 2538581 - protein, 22 aa, Entamoeba dispar
RSNITWKCRSIGAYYGEPSYSA

SEQ ID NO: 2538582 - protein, 17 aa, Entamoeba dispar
RSNLIKLAQGEFVAVEN

SEQ ID NO: 2538583 - protein, 26 aa, Entamoeba dispar
RSNLSSVILLLKTLGIDDILHFDFMD

SEQ ID NO: 2538584 - protein, 19 aa, Entamoeba dispar
RSNPLLQPLIKQGQCNIVS

SEQ ID NO: 2538585 - protein, 23 aa, Entamoeba dispar
RSPKLLNHFLFNSTSLSTRDSQN

SEQ ID NO: 2538586 - protein, 24 aa, Entamoeba dispar
RSQFKTIPQCPLQPPPDLKTYREI

SEQ ID NO: 2538587 - protein, 25 aa, Entamoeba dispar
RSRERYRPSYYSPRRSRSISPRDFH

SEQ ID NO: 2538588 - protein, 19 aa, Entamoeba dispar
RSRFYHEDEWEFFVITERF

SEQ ID NO: 2538589 - protein, 23 aa, Entamoeba dispar
RSRKPAIYRGTPPTFTSTLRCVQ

SEQ ID NO: 2538590 - protein, 21 aa, Entamoeba dispar
RSRLFDYDFLESNSLRVGKKS

SEQ ID NO: 2538591 - protein, 20 aa, Entamoeba dispar
RSRLIIFDLNTKKKSFVSEW

SEQ ID NO: 2538592 - protein, 18 aa, Entamoeba dispar
RSSFLFTTEPTLFDFFNT

SEQ ID NO: 2538593 - protein, 18 aa, Entamoeba dispar
RSSFNPRTAGNFVDLTWV

SEQ ID NO: 2538594 - protein, 32 aa, Entamoeba dispar
RSSGKIHIYQSIPYWVWMILKEENNEVEEIEY

SEQ ID NO: 2538595 - protein, 26 aa, Entamoeba dispar
RSSKPKNFILRSLIDPGYDYDFRGVD

SEQ ID NO: 2538596 - protein, 35 aa, Entamoeba dispar
RSSLILKPGQLPRFVLIKIIPYLENISNVLHFGAV

SEQ ID NO: 2538597 - protein, 25 aa, Entamoeba dispar
RSSPLLHLSWLNNIIEKEIEFGYYL

SEQ ID NO: 2538598 - protein, 22 aa, Entamoeba dispar
RSSPMLMQFTPRFTSGPSPYNP

SEQ ID NO: 2538599 - protein, 17 aa, Entamoeba dispar
RSTGDKFVYISQSQYLE

SEQ ID NO: 2538600 - protein, 27 aa, Entamoeba dispar
RSTGLAKIPLIQAYLDDVLDSGIKKVV

SEQ ID NO: 2538601 - protein, 17 aa, Entamoeba dispar
RSTLLKQKFFASIVDEA

SEQ ID NO: 2538602 - protein, 33 aa, Entamoeba dispar
RSTYQPLHLFNWSLYILLNKQPYRKVFSKEIPL

SEQ ID NO: 2538603 - protein, 23 aa, Entamoeba dispar
RSVCLIITDLKKILVGRDNKIIS

SEQ ID NO: 2538604 - protein, 18 aa, Entamoeba dispar
RSVKYIYPHFLGQDILRL

SEQ ID NO: 2538605 - protein, 20 aa, Entamoeba dispar
RSYYEGCNVVIVVFDISDRT

SEQ ID NO: 2538606 - protein, 27 aa, Entamoeba dispar
RTAKAYLQMDWTKKGNLTPLINRADGD

SEQ ID NO: 2538607 - protein, 25 aa, Entamoeba dispar
RTAKKLDHFFPIQKIWNQNGVIMFD

SEQ ID NO: 2538608 - protein, 30 aa, Entamoeba dispar
RTALTYLNYDIDQLLLYFGTEQWEAAAHAQ

SEQ ID NO: 2538609 - protein, 27 aa, Entamoeba dispar
RTASSIQPEWLFEASPKYFAQLDKFKE

SEQ ID NO: 2538610 - protein, 18 aa, Entamoeba dispar
RTCFKYFFQLCFEDYIQV

SEQ ID NO: 2538611 - protein, 31 aa, Entamoeba dispar
RTCHYPCHVPSLISLFTIRACHCIENGRCTV

SEQ ID NO: 2538612 - protein, 24 aa, Entamoeba dispar
RTDKEVEEFLKWARSLTPISVVEK

SEQ ID NO: 2538613 - protein, 28 aa, Entamoeba dispar
RTEEEIIKLIKWARRLKPIDKEEINKLS

SEQ ID NO: 2538614 - protein, 24 aa, Entamoeba dispar
RTEEEIVKLIKWARGLKPFDKEEI

SEQ ID NO: 2538615 - protein, 19 aa, Entamoeba dispar
RTEIYFFGIDERYGLEYKD

SEQ ID NO: 2538616 - protein, 19 aa, Entamoeba dispar
RTEIYIPSLHINGTLKIQE

SEQ ID NO: 2538617 - protein, 30 aa, Entamoeba dispar
RTFDKIALLGYDYWLYFTNKCPELKQLIIK

SEQ ID NO: 2538618 - protein, 23 aa, Entamoeba dispar
RTFPSLFEPVHGSALDIAGKGIC

SEQ ID NO: 2538619 - protein, 24 aa, Entamoeba dispar
RTGKPIYNAIVWQSKQSGNETSYL

SEQ ID NO: 2538620 - protein, 24 aa, Entamoeba dispar
RTHKIRMDYPKLDKSRLKIKVPVL

SEQ ID NO: 2538621 - protein, 23 aa, Entamoeba dispar
RTIDPRTPYQYPPYPRRYDQDYQ

SEQ ID NO: 2538622 - protein, 17 aa, Entamoeba dispar
RTIKGFIALIEKEWVLM

SEQ ID NO: 2538623 - protein, 31 aa, Entamoeba dispar
RTIKMLKGISDGKWILSEDWIEAIIKNNAII

SEQ ID NO: 2538624 - protein, 17 aa, Entamoeba dispar
RTILVSIDYHRRVNDIK

SEQ ID NO: 2538625 - protein, 27 aa, Entamoeba dispar
RTINNINPLLLNKKLLIIGNPSIANQL

SEQ ID NO: 2538626 - protein, 17 aa, Entamoeba dispar
RTIPRRTIASKFRIGRQ

SEQ ID NO: 2538627 - protein, 30 aa, Entamoeba dispar
RTISTDLLFGLLKDIIRFRSDLKLIIASAT

SEQ ID NO: 2538628 - protein, 24 aa, Entamoeba dispar
RTKNIICEAKRFIGRRVKPSEIEN

SEQ ID NO: 2538629 - protein, 17 aa, Entamoeba dispar
RTKPRLRGIYNFVKFLE

SEQ ID NO: 2538630 - protein, 24 aa, Entamoeba dispar
RTKQLLDRWKFKPKEFPLQLTPSQ

SEQ ID NO: 2538631 - protein, 23 aa, Entamoeba dispar
RTKYYQGVDCILFIVSMEDIGSL

SEQ ID NO: 2538632 - protein, 24 aa, Entamoeba dispar
RTLDMDILNKCTLVFDIGGVYDHK

SEQ ID NO: 2538633 - protein, 27 aa, Entamoeba dispar
RTLEQLLIQPVQRTMRYPMLINELIKA

SEQ ID NO: 2538634 - protein, 34 aa, Entamoeba dispar
RTLKSPVYQAPLIKLLTKCWKDFGDYAQPMCLVA

SEQ ID NO: 2538635 - protein, 18 aa, Entamoeba dispar
RTLPLKKGDTVRFKNEFI

SEQ ID NO: 2538636 - protein, 33 aa, Entamoeba dispar
RTLQDLYMKEGDGFILVFSLVSVATFNDLSSIY

SEQ ID NO: 2538637 - protein, 27 aa, Entamoeba dispar
RTLSYKHLLRLYGRMNLLLSQIDKKQQ

SEQ ID NO: 2538638 - protein, 22 aa, Entamoeba dispar
RTMLIAIYDGALPSAVGGGANL

SEQ ID NO: 2538639 - protein, 18 aa, Entamoeba dispar
RTMTFVHFNALISDQRKT

SEQ ID NO: 2538640 - protein, 19 aa, Entamoeba dispar
RTPFYLVTIAKKIVERHQK

SEQ ID NO: 2538641 - protein, 26 aa, Entamoeba dispar
RTPLMNAVLNKSLNVALLLLTNGDCC

SEQ ID NO: 2538642 - protein, 17 aa, Entamoeba dispar
RTPMMRTTYARPTTTGM

SEQ ID NO: 2538643 - protein, 32 aa, Entamoeba dispar
RTQCNLKKLRLERLKDILLIQRDFIENQEQIK

SEQ ID NO: 2538644 - protein, 27 aa, Entamoeba dispar
RTQGKKLFVLENYPKIVYLQNGSYLQR

SEQ ID NO: 2538645 - protein, 19 aa, Entamoeba dispar
RTQLLILNEKKFGLENSLH

SEQ ID NO: 2538646 - protein, 26 aa, Entamoeba dispar
RTQTVFNAFINLLNNPRIVLSSNTFN

SEQ ID NO: 2538647 - protein, 26 aa, Entamoeba dispar
RTQVAEFSFMALLQQIGKMKKLHEEA

SEQ ID NO: 2538648 - protein, 24 aa, Entamoeba dispar
RTQVIIVVNPLPSSNYRIELWARG

SEQ ID NO: 2538649 - protein, 34 aa, Entamoeba dispar
RTREAQICNGLLYLLRSLGYSFTIRKTKRAKLTE

SEQ ID NO: 2538650 - protein, 17 aa, Entamoeba dispar
RTRLFSSAYNQQTETEL

SEQ ID NO: 2538651 - protein, 23 aa, Entamoeba dispar
RTRTKMLSYWRRNLEDILSGEQL

SEQ ID NO: 2538652 - protein, 19 aa, Entamoeba dispar
RTRYTVNFIQILDSIASGT

SEQ ID NO: 2538653 - protein, 23 aa, Entamoeba dispar
RTSLPIFLANLMPCSSASAFAFY

SEQ ID NO: 2538654 - protein, 26 aa, Entamoeba dispar
RTSSVKIMLFLNEIGSFDKSKIKVTF

SEQ ID NO: 2538655 - protein, 17 aa, Entamoeba dispar
RTSVWSNFYNPENFIIP

SEQ ID NO: 2538656 - protein, 22 aa, Entamoeba dispar
RTTDCTIKLLIPNKLHGQIIGK

SEQ ID NO: 2538657 - protein, 40 aa, Entamoeba dispar
RTTKYPELPFGIFFIYNKNFFGFQIRFRDLARGGLRTVIN

SEQ ID NO: 2538658 - protein, 26 aa, Entamoeba dispar
RTTYQKMMHILQDAILYNPSFIGPEF

SEQ ID NO: 2538659 - protein, 25 aa, Entamoeba dispar
RTVSTDILFGVLKSLLEEREDLKIV

SEQ ID NO: 2538660 - protein, 22 aa, Entamoeba dispar
RVCQMIFMRMDGTAQYKGIFEH

SEQ ID NO: 2538661 - protein, 22 aa, Entamoeba dispar
RVDGTFLIRISTTDPKYPFTLT

SEQ ID NO: 2538662 - protein, 22 aa, Entamoeba dispar
RVDILWLYVNGDEPNWKREFGK

SEQ ID NO: 2538663 - protein, 20 aa, Entamoeba dispar
RVEGFFGYLKKIINHSNLHL

SEQ ID NO: 2538664 - protein, 26 aa, Entamoeba dispar
RVEGVIALSRSLGDRALHPSLSAIPD

SEQ ID NO: 2538665 - protein, 19 aa, Entamoeba dispar
RVEIEWDNIQWCYSGKPCS

SEQ ID NO: 2538666 - protein, 25 aa, Entamoeba dispar
RVEQQLFFILDFQISYKTDICTVPV

SEQ ID NO: 2538667 - protein, 17 aa, Entamoeba dispar
RVFDIIMRTPYGTTYNS

SEQ ID NO: 2538668 - protein, 18 aa, Entamoeba dispar
RVFIFYDYPKEVKGFPYI

SEQ ID NO: 2538669 - protein, 18 aa, Entamoeba dispar
RVFYRQVISGTTKGYFLS

SEQ ID NO: 2538670 - protein, 30 aa, Entamoeba dispar
RVGIMVGGYKMYHKYFIEGSLGFEIENHNT

SEQ ID NO: 2538671 - protein, 21 aa, Entamoeba dispar
RVGMELGIYFDEAYIKKLVIE

SEQ ID NO: 2538672 - protein, 26 aa, Entamoeba dispar
RVIEEDISIPMGYFSRVFLDNDTDFE

SEQ ID NO: 2538673 - protein, 24 aa, Entamoeba dispar
RVIEKYFKITYFINIHSRRCNIYI

SEQ ID NO: 2538674 - protein, 49 aa, Entamoeba dispar
RVINTLYRAWIKLLPQDKLLWMTIIQYHKTWSILLPVAQQWKILMKKIT

SEQ ID NO: 2538675 - protein, 26 aa, Entamoeba dispar
RVIPELKEVIPLLKILGEGQQGEFKK

SEQ ID NO: 2538676 - protein, 20 aa, Entamoeba dispar
RVIRIYFNNKLLFSKDEIQR

SEQ ID NO: 2538677 - protein, 19 aa, Entamoeba dispar
RVKEWILSKHPSALYPEPY

SEQ ID NO: 2538678 - protein, 17 aa, Entamoeba dispar
RVKKMMEILEPKIVDEK

SEQ ID NO: 2538679 - protein, 21 aa, Entamoeba dispar
RVKNFFVWLLECWNHFVKGNA

SEQ ID NO: 2538680 - protein, 23 aa, Entamoeba dispar
RVKRTALLILNQKLTALTPEEMS

SEQ ID NO: 2538681 - protein, 26 aa, Entamoeba dispar
RVKSDIHVVKPKRPKLPNSLQEKRLK

SEQ ID NO: 2538682 - protein, 24 aa, Entamoeba dispar
RVLAEDLLFQRKKLAAAPTGNARD

SEQ ID NO: 2538683 - protein, 26 aa, Entamoeba dispar
RVLDSTPIYLKFTNSYLRVIPNKCFQ

SEQ ID NO: 2538684 - protein, 18 aa, Entamoeba dispar
RVLHPFMPFITEELWQRL

SEQ ID NO: 2538685 - protein, 28 aa, Entamoeba dispar
RVLHPFMPFITEELWQRLPRRNNNEISI

SEQ ID NO: 2538686 - protein, 23 aa, Entamoeba dispar
RVLKLLRLLIRNEGNLQRFCEEG

SEQ ID NO: 2538687 - protein, 17 aa, Entamoeba dispar
RVLNEIKTICHKERIVM

SEQ ID NO: 2538688 - protein, 18 aa, Entamoeba dispar
RVLNKSTINLPYLPSLPY

SEQ ID NO: 2538689 - protein, 19 aa, Entamoeba dispar
RVLNKSTINLPYLPSLPYE

SEQ ID NO: 2538690 - protein, 20 aa, Entamoeba dispar
RVLRRRTRCRRAMAACAAGA

SEQ ID NO: 2538691 - protein, 17 aa, Entamoeba dispar
RVLSFRIVGPIQLYEEM

SEQ ID NO: 2538692 - protein, 27 aa, Entamoeba dispar
RVLYWKNKIFHLIFNLEKEQYKTVTSV

SEQ ID NO: 2538693 - protein, 17 aa, Entamoeba dispar
RVMNKPIEWYLEHLMKE

SEQ ID NO: 2538694 - protein, 20 aa, Entamoeba dispar
RVNDIRIRLSESLKKFEMEE

SEQ ID NO: 2538695 - protein, 25 aa, Entamoeba dispar
RVNKNGITLPFLYKELFIIDSCNCF

SEQ ID NO: 2538696 - protein, 17 aa, Entamoeba dispar
RVNSLYVVALARSNNNA

SEQ ID NO: 2538697 - protein, 25 aa, Entamoeba dispar
RVNSQFLSMFKRKAFLHLYTEEGME

SEQ ID NO: 2538698 - protein, 27 aa, Entamoeba dispar
RVPTNLLGIMLYYIDLRVDTYLQTKTY

SEQ ID NO: 2538699 - protein, 30 aa, Entamoeba dispar
RVQCQIMLDPMLRNNWWWNLVQSISVTQFN

SEQ ID NO: 2538700 - protein, 26 aa, Entamoeba dispar
RVQELAKLRGLMFYEEIKARRQNKIK

SEQ ID NO: 2538701 - protein, 24 aa, Entamoeba dispar
RVQIKLFTLWMDEVLQQRQMGVKD

SEQ ID NO: 2538702 - protein, 28 aa, Entamoeba dispar
RVREKNPDLFIPWIPNNMQLAVCDVPPK

SEQ ID NO: 2538703 - protein, 19 aa, Entamoeba dispar
RVRIMNGLRYILIECWGAI

SEQ ID NO: 2538704 - protein, 17 aa, Entamoeba dispar
RVRLKEFLRTPSADLTL

SEQ ID NO: 2538705 - protein, 17 aa, Entamoeba dispar
RVSIIFGDKNKWGSRSL

SEQ ID NO: 2538706 - protein, 19 aa, Entamoeba dispar
RVSTLVGIPSSCICLGLSY

SEQ ID NO: 2538707 - protein, 17 aa, Entamoeba dispar
RVTPKLVVTIKRFLPNI

SEQ ID NO: 2538708 - protein, 22 aa, Entamoeba dispar
RVTVCFNYWYSGIDSRIIVLHI

SEQ ID NO: 2538709 - protein, 24 aa, Entamoeba dispar
RVVECVFLFATECFKIYNIEPFPQ

SEQ ID NO: 2538710 - protein, 18 aa, Entamoeba dispar
RVVFADLAYKQPHLLLLD

SEQ ID NO: 2538711 - protein, 24 aa, Entamoeba dispar
RVVKYLCGVAKQCWKLLDSNFCLK

SEQ ID NO: 2538712 - protein, 31 aa, Entamoeba dispar
RVVQEDEVVLALRGILTARRQDTNISSSEEE

SEQ ID NO: 2538713 - protein, 21 aa, Entamoeba dispar
RVVVMDIRKPFEPMTQLKIAQ

SEQ ID NO: 2538714 - protein, 17 aa, Entamoeba dispar
RVVWLKNQTFIGDAGLV

SEQ ID NO: 2538715 - protein, 17 aa, Entamoeba dispar
RVYLMNILLYCDSITTI

SEQ ID NO: 2538716 - protein, 22 aa, Entamoeba dispar
RVYPELINLLPYTLRHETHRFV

SEQ ID NO: 2538717 - protein, 26 aa, Entamoeba dispar
RVYQKTWVAPFLFRNKYNQWDRTISN

SEQ ID NO: 2538718 - protein, 20 aa, Entamoeba dispar
RVYTLFGRFGNINRVIMGVN

SEQ ID NO: 2538719 - protein, 18 aa, Entamoeba dispar
RWAVTILNYLIFSNPKNE

SEQ ID NO: 2538720 - protein, 17 aa, Entamoeba dispar
RWCFYWCESLTSITIPT

SEQ ID NO: 2538721 - protein, 21 aa, Entamoeba dispar
RWINCCLLREFKLGTALRLWD

SEQ ID NO: 2538722 - protein, 17 aa, Entamoeba dispar
RWRVPNIIYRCIEFLKN

SEQ ID NO: 2538723 - protein, 32 aa, Entamoeba dispar
RWVKKTLEWPTYKRHFYLPYRLDLDLCYQAKK

SEQ ID NO: 2538724 - protein, 21 aa, Entamoeba dispar
RYADVMVHRLLAQAIGFDQID

SEQ ID NO: 2538725 - protein, 32 aa, Entamoeba dispar
RYCCSIESSLLKWLFNPLSDGSIHIVFKLNDS

SEQ ID NO: 2538726 - protein, 24 aa, Entamoeba dispar
RYCEEEFFEFYPINTLTAKKTGEW

SEQ ID NO: 2538727 - protein, 17 aa, Entamoeba dispar
RYCHSLGRILKVSLRNR

SEQ ID NO: 2538728 - protein, 18 aa, Entamoeba dispar
RYCIIREGSYLKVINSYK

SEQ ID NO: 2538729 - protein, 18 aa, Entamoeba dispar
RYEATVKHFLWRSVKQAD

SEQ ID NO: 2538730 - protein, 28 aa, Entamoeba dispar
RYEECYESFLWLFGKLLQKEELDLIRSR

SEQ ID NO: 2538731 - protein, 23 aa, Entamoeba dispar
RYEKFFQRFIPKTDYCFDGELNT

SEQ ID NO: 2538732 - protein, 17 aa, Entamoeba dispar
RYELVNKFMIKCFKNLN

SEQ ID NO: 2538733 - protein, 17 aa, Entamoeba dispar
RYFGMKYEKYETKPILE

SEQ ID NO: 2538734 - protein, 30 aa, Entamoeba dispar
RYFKTIKIKEKMYWLLGHSFTKYGEIYYCK

SEQ ID NO: 2538735 - protein, 21 aa, Entamoeba dispar
RYFNHLCSRVIKDKWTKEEDS

SEQ ID NO: 2538736 - protein, 22 aa, Entamoeba dispar
RYGKTIILIKAQLTFEEFDSIL

SEQ ID NO: 2538737 - protein, 25 aa, Entamoeba dispar
RYGVLIDKINIIFCYEEKGIKVIDV

SEQ ID NO: 2538738 - protein, 20 aa, Entamoeba dispar
RYGYENLPVDTFMTLGSLAE

SEQ ID NO: 2538739 - protein, 19 aa, Entamoeba dispar
RYHSLTPMYYRGSNAALVV

SEQ ID NO: 2538740 - protein, 19 aa, Entamoeba dispar
RYIKVLNKLEDLFIKIMTT

SEQ ID NO: 2538741 - protein, 24 aa, Entamoeba dispar
RYINGRFLPDKAIDLVDEACATLF

SEQ ID NO: 2538742 - protein, 33 aa, Entamoeba dispar
RYINLQVIQNHFATFYLLPGTYHVCSYSNESLE

SEQ ID NO: 2538743 - protein, 18 aa, Entamoeba dispar
RYKFPIHFILFSSCCNEI

SEQ ID NO: 2538744 - protein, 25 aa, Entamoeba dispar
RYKQFIRCLGWYQSLEDLICDPEFC

SEQ ID NO: 2538745 - protein, 17 aa, Entamoeba dispar
RYKYLLQTIICSFVERP

SEQ ID NO: 2538746 - protein, 18 aa, Entamoeba dispar
RYLALDTFVLLGQANYKN

SEQ ID NO: 2538747 - protein, 18 aa, Entamoeba dispar
RYLKAHFIIIYDSPINCQ

SEQ ID NO: 2538748 - protein, 17 aa, Entamoeba dispar
RYLKLQLLSLHMDDLTK

SEQ ID NO: 2538749 - protein, 17 aa, Entamoeba dispar
RYLTPQSPFHFYNLFSL

SEQ ID NO: 2538750 - protein, 28 aa, Entamoeba dispar
RYLTPQSPFHFYNLFSLYGSIIKVNVLS

SEQ ID NO: 2538751 - protein, 25 aa, Entamoeba dispar
RYNGLPLFPYMCRSAALTYSGKIRL

SEQ ID NO: 2538752 - protein, 26 aa, Entamoeba dispar
RYNLRTIAWKIWLGVLPLPVNSVWTS

SEQ ID NO: 2538753 - protein, 25 aa, Entamoeba dispar
RYNPHIDLLTVPHPFYNERTVCLIC

SEQ ID NO: 2538754 - protein, 18 aa, Entamoeba dispar
RYQFKYGLRPGEDIQQFG

SEQ ID NO: 2538755 - protein, 24 aa, Entamoeba dispar
RYQIQKLNPFWWTHQRHDGKLWNL

SEQ ID NO: 2538756 - protein, 18 aa, Entamoeba dispar
RYRHYLTKVRKICQYYFC

SEQ ID NO: 2538757 - protein, 19 aa, Entamoeba dispar
RYRKGFCKSNPRKMVKMWA

SEQ ID NO: 2538758 - protein, 21 aa, Entamoeba dispar
RYRKWAQPIILKNKVVIAYGS

SEQ ID NO: 2538759 - protein, 17 aa, Entamoeba dispar
RYRWIMHDVILIEKDGQ

SEQ ID NO: 2538760 - protein, 23 aa, Entamoeba dispar
RYSSVFKGVMTEGLYPCAIKCLR

SEQ ID NO: 2538761 - protein, 22 aa, Entamoeba dispar
RYSTIFTMYRSLGKKTIEAFRI

SEQ ID NO: 2538762 - protein, 21 aa, Entamoeba dispar
RYTCCMLFLKEIYGNVVLELG

SEQ ID NO: 2538763 - protein, 17 aa, Entamoeba dispar
RYYPLALKLLIQNVSLH

SEQ ID NO: 2538764 - protein, 23 aa, Entamoeba dispar
SAAQKLHIICFLIPCCTGSIVSY

SEQ ID NO: 2538765 - protein, 25 aa, Entamoeba dispar
SACNYRPIKFMVINRPKLTEVLSHL

SEQ ID NO: 2538766 - protein, 26 aa, Entamoeba dispar
SADDDVLFFVITKTGFIQLVQYNKKT

SEQ ID NO: 2538767 - protein, 22 aa, Entamoeba dispar
SADHSFIVWMRSKEQIFVEEEE

SEQ ID NO: 2538768 - protein, 27 aa, Entamoeba dispar
SADLLLPTIIYCIIYSSPLNLVSTIEY

SEQ ID NO: 2538769 - protein, 24 aa, Entamoeba dispar
SADPNAQWQWYSDKGWLNYEDKQN

SEQ ID NO: 2538770 - protein, 23 aa, Entamoeba dispar
SADTLRELLIFSLDIFDKKEITK

SEQ ID NO: 2538771 - protein, 24 aa, Entamoeba dispar
SADTVVFAELYWTPGVLRQAEDRV

SEQ ID NO: 2538772 - protein, 25 aa, Entamoeba dispar
SAEELWNYVELFGSLELENGKEGND

SEQ ID NO: 2538773 - protein, 23 aa, Entamoeba dispar
SAEQFIWFMEQGVKSFLAIRQYY

SEQ ID NO: 2538774 - protein, 25 aa, Entamoeba dispar
SAFDLLNYISSLPLEQALPPSKVKY

SEQ ID NO: 2538775 - protein, 19 aa, Entamoeba dispar
SAFIYSFEHDITIGILFYL

SEQ ID NO: 2538776 - protein, 19 aa, Entamoeba dispar
SAFQFNFFCEEKSICILYD

SEQ ID NO: 2538777 - protein, 23 aa, Entamoeba dispar
SAFTRLFFYYIESTSTKYLNKVI

SEQ ID NO: 2538778 - protein, 19 aa, Entamoeba dispar
SAGILFKNLFPIKGSHKTQ

SEQ ID NO: 2538779 - protein, 25 aa, Entamoeba dispar
SAGIVLFELLEGYPPHYELRGEELM

SEQ ID NO: 2538780 - protein, 19 aa, Entamoeba dispar
SAGLFWDNFKDIPTQSDES

SEQ ID NO: 2538781 - protein, 25 aa, Entamoeba dispar
SAGNEILLTELLFSGVFSSLNSKQA

SEQ ID NO: 2538782 - protein, 20 aa, Entamoeba dispar
SAGRFLSPQYFTLGDSNQIE

SEQ ID NO: 2538783 - protein, 25 aa, Entamoeba dispar
SAHCTTEWYWTYDSKALVFCGCFPR

SEQ ID NO: 2538784 - protein, 20 aa, Entamoeba dispar
SAHILIDLCAAPGGWCQVAT

SEQ ID NO: 2538785 - protein, 24 aa, Entamoeba dispar
SAIDLNGKCLWTMEKKGVSCVELS

SEQ ID NO: 2538786 - protein, 17 aa, Entamoeba dispar
SAIFQFWASTDDLQIHF

SEQ ID NO: 2538787 - protein, 18 aa, Entamoeba dispar
SAIGLTIMISIGEQGFID

SEQ ID NO: 2538788 - protein, 29 aa, Entamoeba dispar
SAIGSILFNGKYYIASPTKLYLLENKQVK

SEQ ID NO: 2538789 - protein, 27 aa, Entamoeba dispar
SAKLCKRYMKYLMKKYLKKNNLREWLR

SEQ ID NO: 2538790 - protein, 25 aa, Entamoeba dispar
SAKMIDLDMIIGKYTIIQKSSDEVP

SEQ ID NO: 2538791 - protein, 21 aa, Entamoeba dispar
SAKQGLLLWCQKKCEPYPVKV

SEQ ID NO: 2538792 - protein, 23 aa, Entamoeba dispar
SAKQGLLLWCQKKCEPYPVKVEN

SEQ ID NO: 2538793 - protein, 18 aa, Entamoeba dispar
SAKQSFWMKRVAYLAAQI

SEQ ID NO: 2538794 - protein, 24 aa, Entamoeba dispar
SALEDIHTMYLKIGFNKTGSFCDF

SEQ ID NO: 2538795 - protein, 28 aa, Entamoeba dispar
SALKLHKEFGVLVIVTLGDKGCLIVGDE

SEQ ID NO: 2538796 - protein, 24 aa, Entamoeba dispar
SALRSFFIPLTIISLNNNVFSGCT

SEQ ID NO: 2538797 - protein, 18 aa, Entamoeba dispar
SAMELCEKLRIVLEPSLA

SEQ ID NO: 2538798 - protein, 24 aa, Entamoeba dispar
SANDCIIDFYAEWCGPCRFISPIF

SEQ ID NO: 2538799 - protein, 27 aa, Entamoeba dispar
SANDCSPAFWKFLDLIGNKIELNGWTG

SEQ ID NO: 2538800 - protein, 32 aa, Entamoeba dispar
SANETIRLALWQLYLTWTNVFPAQTLNQIRTA

SEQ ID NO: 2538801 - protein, 24 aa, Entamoeba dispar
SANINAIVECPYWLAPEVISGEPF

SEQ ID NO: 2538802 - protein, 20 aa, Entamoeba dispar
SANKAALNKALCLSKGAHPE

SEQ ID NO: 2538803 - protein, 23 aa, Entamoeba dispar
SANSQLFILKFNRKRRAKTVALL

SEQ ID NO: 2538804 - protein, 22 aa, Entamoeba dispar
SAPDFILLVKVIARYCEFIETD

SEQ ID NO: 2538805 - protein, 30 aa, Entamoeba dispar
SAPIEKIKLIGKQVWILQKTGDIKVYDSEK

SEQ ID NO: 2538806 - protein, 19 aa, Entamoeba dispar
SAPVKILMITPKVGIPQLN

SEQ ID NO: 2538807 - protein, 21 aa, Entamoeba dispar
SAQIFIEWCYCKSSPTLEKMA

SEQ ID NO: 2538808 - protein, 26 aa, Entamoeba dispar
SAQKEFAFMKALYTKGFPTPIPVDCN

SEQ ID NO: 2538809 - protein, 19 aa, Entamoeba dispar
SARLILYTDIIILPDNLCG

SEQ ID NO: 2538810 - protein, 17 aa, Entamoeba dispar
SARSRFYHEDEWEFFVI

SEQ ID NO: 2538811 - protein, 27 aa, Entamoeba dispar
SARVPKHPLPPLPKQRILFGQPVQQKP

SEQ ID NO: 2538812 - protein, 23 aa, Entamoeba dispar
SASLFQRLYSLNSPILLNLQYRC

SEQ ID NO: 2538813 - protein, 28 aa, Entamoeba dispar
SASRRYYNRFPALVWYDNKYKNVLMRNS

SEQ ID NO: 2538814 - protein, 31 aa, Entamoeba dispar
SASVDWWTLGVLMYEFLYGCNPFAASSIQET

SEQ ID NO: 2538815 - protein, 23 aa, Entamoeba dispar
SATCGYIPPLLYDVAVECVLSSF

SEQ ID NO: 2538816 - protein, 30 aa, Entamoeba dispar
SATFERIKPIKGFILLFEYNKQAINYIRNE

SEQ ID NO: 2538817 - protein, 24 aa, Entamoeba dispar
SATIGAEFIKFNRTYKGQQVLVSL

SEQ ID NO: 2538818 - protein, 20 aa, Entamoeba dispar
SAVARLFLPSGVPRVMNKPI

SEQ ID NO: 2538819 - protein, 29 aa, Entamoeba dispar
SAVITTLRKLIIILFLPIHTKSTKVNKNN

SEQ ID NO: 2538820 - protein, 22 aa, Entamoeba dispar
SAYADILLYLDNINTLYDMILS

SEQ ID NO: 2538821 - protein, 23 aa, Entamoeba dispar
SAYATMLFRELLKMPTDLDCQKQ

SEQ ID NO: 2538822 - protein, 20 aa, Entamoeba dispar
SAYFSPLTHWICPHSRYYCC

SEQ ID NO: 2538823 - protein, 26 aa, Entamoeba dispar
SAYPENEHILIITPNSLVYQWCDQIQ

SEQ ID NO: 2538824 - protein, 35 aa, Entamoeba dispar
SCAIDVWSAGCICAELILGIPLFPGSSEYNELYKI

SEQ ID NO: 2538825 - protein, 30 aa, Entamoeba dispar
SCAVKKSSWRFPIPVFRSLQYLLTHEGKEL

SEQ ID NO: 2538826 - protein, 33 aa, Entamoeba dispar
SCCPGWLEYLEKKYPDLIPRVSTARSPIACLAG

SEQ ID NO: 2538827 - protein, 17 aa, Entamoeba dispar
SCDLFISVITASIYFSL

SEQ ID NO: 2538828 - protein, 24 aa, Entamoeba dispar
SCENRLFILCKQADEIVIESVWNY

SEQ ID NO: 2538829 - protein, 30 aa, Entamoeba dispar
SCFDECRFKWIKIPISVTRIKPLAFSNCRS

SEQ ID NO: 2538830 - protein, 19 aa, Entamoeba dispar
SCFKSCISLKTIILSTNIK

SEQ ID NO: 2538831 - protein, 19 aa, Entamoeba dispar
SCFNPLNALSSNTSSITSS

SEQ ID NO: 2538832 - protein, 20 aa, Entamoeba dispar
SCFVEVRPLLYTSQEMRNII

SEQ ID NO: 2538833 - protein, 19 aa, Entamoeba dispar
SCFYDQFFCLKQDNDYYKA

SEQ ID NO: 2538834 - protein, 20 aa, Entamoeba dispar
SCGGCFVTYTLHGDLRGCIG

SEQ ID NO: 2538835 - protein, 18 aa, Entamoeba dispar
SCGIDWVKSRILPSVISL

SEQ ID NO: 2538836 - protein, 21 aa, Entamoeba dispar
SCGVLMYTLAVGRNPFEFNGH

SEQ ID NO: 2538837 - protein, 18 aa, Entamoeba dispar
SCHELTLLNISFNSLRNI

SEQ ID NO: 2538838 - protein, 20 aa, Entamoeba dispar
SCIIFFDEIDAIGGTRFQDD

SEQ ID NO: 2538839 - protein, 17 aa, Entamoeba dispar
SCIPPFTCPPTEYYLYK

SEQ ID NO: 2538840 - protein, 18 aa, Entamoeba dispar
SCIQLTNPPPQKPSQQFQ

SEQ ID NO: 2538841 - protein, 27 aa, Entamoeba dispar
SCIQSVNYHYSLFSQLQFMDKTPILPE

SEQ ID NO: 2538842 - protein, 26 aa, Entamoeba dispar
SCITPDKIVLYYIYEKEECDYQSDLE

SEQ ID NO: 2538843 - protein, 19 aa, Entamoeba dispar
SCKDYIFYCKKCGERCIQI

SEQ ID NO: 2538844 - protein, 22 aa, Entamoeba dispar
SCKQRSFSYKGITNALCGKQNP

SEQ ID NO: 2538845 - protein, 34 aa, Entamoeba dispar
SCKVKIIPITKAIPTLSLLKLKSSLSSQYYPLIL

SEQ ID NO: 2538846 - protein, 17 aa, Entamoeba dispar
SCLLQLQGIRKEGKRVI

SEQ ID NO: 2538847 - protein, 18 aa, Entamoeba dispar
SCLNLKICPEFVVKVKEC

SEQ ID NO: 2538848 - protein, 28 aa, Entamoeba dispar
SCLVKLPLILPFIKKKLHYRILGFYAIP

SEQ ID NO: 2538849 - protein, 19 aa, Entamoeba dispar
SCMRLKTINLPPTVTYLGS

SEQ ID NO: 2538850 - protein, 17 aa, Entamoeba dispar
SCPTTSLPFPPTSIKFI

SEQ ID NO: 2538851 - protein, 25 aa, Entamoeba dispar
SCQIDIMPFERLSILIKYIHSRNHH

SEQ ID NO: 2538852 - protein, 22 aa, Entamoeba dispar
SCQITFMKIYYDDIQNEVFVSV

SEQ ID NO: 2538853 - protein, 23 aa, Entamoeba dispar
SCSKPIILITTKTNVLIIQITES

SEQ ID NO: 2538854 - protein, 27 aa, Entamoeba dispar
SCSPKRKRLSLNQFKKLLTRSTISLET

SEQ ID NO: 2538855 - protein, 24 aa, Entamoeba dispar
SCTKLGIRFIVIRSLSDVPSEDGK

SEQ ID NO: 2538856 - protein, 17 aa, Entamoeba dispar
SCVGIWENDRVEIIAND

SEQ ID NO: 2538857 - protein, 18 aa, Entamoeba dispar
SCVILGEYPQLLGGLAIK

SEQ ID NO: 2538858 - protein, 31 aa, Entamoeba dispar
SCVNLDKLILPPHMLTIPSGLCWGCVMLTEV

SEQ ID NO: 2538859 - protein, 18 aa, Entamoeba dispar
SCYALCKPSQFPVGGCCY

SEQ ID NO: 2538860 - protein, 17 aa, Entamoeba dispar
SCYCYGKLIPKYSKCFL

SEQ ID NO: 2538861 - protein, 24 aa, Entamoeba dispar
SCYFTYCYSFMKPAELLFTMNLID

SEQ ID NO: 2538862 - protein, 19 aa, Entamoeba dispar
SCYFWDLNSLNQNKSIKIV

SEQ ID NO: 2538863 - protein, 23 aa, Entamoeba dispar
SCYKCHCFFCWICMQITNDHQHK

SEQ ID NO: 2538864 - protein, 17 aa, Entamoeba dispar
SCYLKRCPKCDLCLEPI

SEQ ID NO: 2538865 - protein, 20 aa, Entamoeba dispar
SCYSILYYDYWPSGSYQNVL

SEQ ID NO: 2538866 - protein, 30 aa, Entamoeba dispar
SDALANLHIILFDVLKNPVHFFKGTMGQYE

SEQ ID NO: 2538867 - protein, 22 aa, Entamoeba dispar
SDASQHFSLLDLLLQEFSNKIE

SEQ ID NO: 2538868 - protein, 21 aa, Entamoeba dispar
SDCCDNFFLFSFKEFQKQTTQ

SEQ ID NO: 2538869 - protein, 21 aa, Entamoeba dispar
SDCIVVCYCPYIPKSFDRVVE

SEQ ID NO: 2538870 - protein, 25 aa, Entamoeba dispar
SDDMMRIIKNMRRRGYKAKEISILT

SEQ ID NO: 2538871 - protein, 24 aa, Entamoeba dispar
SDDSQLFDLYFKTINQFITENPSK

SEQ ID NO: 2538872 - protein, 23 aa, Entamoeba dispar
SDDWFDIRVLLLSIAANTLYELK

SEQ ID NO: 2538873 - protein, 25 aa, Entamoeba dispar
SDECSRLLFFIERHAFDVCKILLEE

SEQ ID NO: 2538874 - protein, 30 aa, Entamoeba dispar
SDEDVNKFYTFWYSFKSWRDPPLDEMYNIE

SEQ ID NO: 2538875 - protein, 28 aa, Entamoeba dispar
SDELTDEIINFLIEFIPELQCYFNGDEL

SEQ ID NO: 2538876 - protein, 32 aa, Entamoeba dispar
SDEPVLLKHPQITVRDSVLKKDIQLIDENEKL

SEQ ID NO: 2538877 - protein, 26 aa, Entamoeba dispar
SDESFPLGTIIILNQKQLSAIRNIIG

SEQ ID NO: 2538878 - protein, 26 aa, Entamoeba dispar
SDESYRFYQLLLFNFSQFIADEEFNR

SEQ ID NO: 2538879 - protein, 17 aa, Entamoeba dispar
SDFDLFIPSFDMYYMIN

SEQ ID NO: 2538880 - protein, 21 aa, Entamoeba dispar
SDFEIHWKTFINLKDITFDLS

SEQ ID NO: 2538881 - protein, 22 aa, Entamoeba dispar
SDFKQALLVAKLALANRVDKIY

SEQ ID NO: 2538882 - protein, 21 aa, Entamoeba dispar
SDFKSPYFAVVAKNADPSKLD

SEQ ID NO: 2538883 - protein, 17 aa, Entamoeba dispar
SDFVTYIGEKAFGGCQS

SEQ ID NO: 2538884 - protein, 32 aa, Entamoeba dispar
SDGAMEIFIEWMYLQRSPLLESQPIDSIAKEV

SEQ ID NO: 2538885 - protein, 17 aa, Entamoeba dispar
SDGDIWTQCKEGIISDV

SEQ ID NO: 2538886 - protein, 26 aa, Entamoeba dispar
SDGESPIIMFLKAINQKIIGPATMRV

SEQ ID NO: 2538887 - protein, 25 aa, Entamoeba dispar
SDGLALFISTILYLQSLASNAPKTI

SEQ ID NO: 2538888 - protein, 37 aa, Entamoeba dispar
SDGNELYIFRSGKYFNFIKEYILSRKLLINETITQAE

SEQ ID NO: 2538889 - protein, 22 aa, Entamoeba dispar
SDGQLRSYMRTPTAYYVSQLMS

SEQ ID NO: 2538890 - protein, 32 aa, Entamoeba dispar
SDGSYIMKIMGYITVRFKQLRSSPLEIVEAYN

SEQ ID NO: 2538891 - protein, 33 aa, Entamoeba dispar
SDGSYIMKIMGYITVRFKQLRSSPLEIVEAYNF

SEQ ID NO: 2538892 - protein, 23 aa, Entamoeba dispar
SDGTRQTFWYSRVNSYTSRTGDI

SEQ ID NO: 2538893 - protein, 24 aa, Entamoeba dispar
SDGTRQTFWYSRVNSYTSRTGDIS

SEQ ID NO: 2538894 - protein, 23 aa, Entamoeba dispar
SDHKRVFFFQNAYVFYSRDENNT

SEQ ID NO: 2538895 - protein, 26 aa, Entamoeba dispar
SDHLKISLWIYGSICSLIHFHSIHSP

SEQ ID NO: 2538896 - protein, 18 aa, Entamoeba dispar
SDHVRFKRGLRGHISKIY

SEQ ID NO: 2538897 - protein, 19 aa, Entamoeba dispar
SDHYNLLREIAAETLTSTT

SEQ ID NO: 2538898 - protein, 24 aa, Entamoeba dispar
SDIEIDGRRLILQKAIKKEQAKET

SEQ ID NO: 2538899 - protein, 28 aa, Entamoeba dispar
SDIFTPNNPWIVPLLQVVCEVSLSPELM

SEQ ID NO: 2538900 - protein, 22 aa, Entamoeba dispar
SDIGIIDLLLHLLSNTKYIPNE

SEQ ID NO: 2538901 - protein, 19 aa, Entamoeba dispar
SDIIHFIKFIQLNPSEKDK

SEQ ID NO: 2538902 - protein, 23 aa, Entamoeba dispar
SDIIQAFFQFLSKYGFDYNSLNN

SEQ ID NO: 2538903 - protein, 26 aa, Entamoeba dispar
SDINISIVMELLPGGTLFSRVSKCES

SEQ ID NO: 2538904 - protein, 27 aa, Entamoeba dispar
SDISSFPWETLASTLKRFVRELPGMLF

SEQ ID NO: 2538905 - protein, 23 aa, Entamoeba dispar
SDITDFINKLKFFGKSILSKNNH

SEQ ID NO: 2538906 - protein, 25 aa, Entamoeba dispar
SDITRRLIELLLVRGYSFNRTADFE

SEQ ID NO: 2538907 - protein, 34 aa, Entamoeba dispar
SDIVMLDDLLWTRHFPIAFLMRQHMLLLGRSEEI

SEQ ID NO: 2538908 - protein, 24 aa, Entamoeba dispar
SDKALVEFIFWNYVEPESTIEDDT

SEQ ID NO: 2538909 - protein, 34 aa, Entamoeba dispar
SDKDKIQHYLNCTLPYYCLPNPFKRLGVPQTVSL

SEQ ID NO: 2538910 - protein, 17 aa, Entamoeba dispar
SDKHDILFTFMFQTQTE

SEQ ID NO: 2538911 - protein, 17 aa, Entamoeba dispar
SDKPILTIEMWYEMLWD

SEQ ID NO: 2538912 - protein, 26 aa, Entamoeba dispar
SDKRIGYLALMLLLDETQEVLTLVTN

SEQ ID NO: 2538913 - protein, 27 aa, Entamoeba dispar
SDKSNYKNFLWKILKTLFDDYVDFADA

SEQ ID NO: 2538914 - protein, 24 aa, Entamoeba dispar
SDKSSFFFHVLPTGKLVVTKDFNL

SEQ ID NO: 2538915 - protein, 25 aa, Entamoeba dispar
SDKTILWKNIPLPYKSNGYTSSQVP

SEQ ID NO: 2538916 - protein, 39 aa, Entamoeba dispar
SDKVSYIKNYIWLDNIPLSIMGWFRLCGGIYNIVEIIPI

SEQ ID NO: 2538917 - protein, 31 aa, Entamoeba dispar
SDLFSITTLIRAVVFLLKQSSIRVKRTALLI

SEQ ID NO: 2538918 - protein, 21 aa, Entamoeba dispar
SDLIYQSCSISPYLSDEELTP

SEQ ID NO: 2538919 - protein, 17 aa, Entamoeba dispar
SDLLKRKLEILEWFNKE

SEQ ID NO: 2538920 - protein, 20 aa, Entamoeba dispar
SDLNAICFVAQSSNARLTAN

SEQ ID NO: 2538921 - protein, 19 aa, Entamoeba dispar
SDLSLLRQWTGKQTFRLLF

SEQ ID NO: 2538922 - protein, 24 aa, Entamoeba dispar
SDLTFIEMLNNIRYGFVTKKTYEL

SEQ ID NO: 2538923 - protein, 26 aa, Entamoeba dispar
SDLTFKLNKSAVFLEMEKYDECIKLC

SEQ ID NO: 2538924 - protein, 26 aa, Entamoeba dispar
SDLVCMSSYYLFRKGIEPKWEDEQNK

SEQ ID NO: 2538925 - protein, 22 aa, Entamoeba dispar
SDMIVPFLIVYIDEYYFESYEK

SEQ ID NO: 2538926 - protein, 20 aa, Entamoeba dispar
SDMSVMMLFECVSKRCEQIV

SEQ ID NO: 2538927 - protein, 24 aa, Entamoeba dispar
SDNCLKALRRQLPISRQKINWANW

SEQ ID NO: 2538928 - protein, 29 aa, Entamoeba dispar
SDNEIKSMLTWIRFLPHINVEEIQEPDSK

SEQ ID NO: 2538929 - protein, 37 aa, Entamoeba dispar
SDNFIILELQFTETYVFLIHLNLPLTLKQILEVIQAK

SEQ ID NO: 2538930 - protein, 25 aa, Entamoeba dispar
SDNQPLIVYSLLNLLEGLMETFPHI

SEQ ID NO: 2538931 - protein, 27 aa, Entamoeba dispar
SDNTEDLFTQMFWKLGMKSFDEFIEKL

SEQ ID NO: 2538932 - protein, 36 aa, Entamoeba dispar
SDPNYLSYYQMGYLQPFQLSQPPPPPPPPAPDKSMQ

SEQ ID NO: 2538933 - protein, 23 aa, Entamoeba dispar
SDPQAFLFTIQINNKIEFNKFDI

SEQ ID NO: 2538934 - protein, 22 aa, Entamoeba dispar
SDQFDYLPITKPPTKTGHTKMN

SEQ ID NO: 2538935 - protein, 23 aa, Entamoeba dispar
SDQISLILSFLFQNIIIDNDPLS

SEQ ID NO: 2538936 - protein, 22 aa, Entamoeba dispar
SDQLSRLFPRVTPKLVVTIKRF

SEQ ID NO: 2538937 - protein, 28 aa, Entamoeba dispar
SDQLTITKYPFNLKLYSPTFETNSFFIS

SEQ ID NO: 2538938 - protein, 23 aa, Entamoeba dispar
SDRAPLYDWVVDTFGMRKPIIEV

SEQ ID NO: 2538939 - protein, 25 aa, Entamoeba dispar
SDREDYLILSAIKLALEQQMSTLTS

SEQ ID NO: 2538940 - protein, 25 aa, Entamoeba dispar
SDRFDPRWLTSHFNSIFLVVTPEKT

SEQ ID NO: 2538941 - protein, 24 aa, Entamoeba dispar
SDRIIPTLKSISLIMKWMLSNELK

SEQ ID NO: 2538942 - protein, 29 aa, Entamoeba dispar
SDRLLKQICHFICYYIIEEMLQRNKINGM

SEQ ID NO: 2538943 - protein, 27 aa, Entamoeba dispar
SDRLRFERKPRLRATFLEDSAHKRIND

SEQ ID NO: 2538944 - protein, 26 aa, Entamoeba dispar
SDSLKKRFLLHKLLLLHQLDTHFEYV

SEQ ID NO: 2538945 - protein, 35 aa, Entamoeba dispar
SDSQKYFSDGLIQRKWYDDVVFKNQAKEPPKQTQY

SEQ ID NO: 2538946 - protein, 28 aa, Entamoeba dispar
SDSTEFLSICQFLLPIELQYSSQLSISL

SEQ ID NO: 2538947 - protein, 24 aa, Entamoeba dispar
SDSTFPFVFTSVDIGYLVNPLLLV

SEQ ID NO: 2538948 - protein, 30 aa, Entamoeba dispar
SDTELIKELKKTNEILLAGIETREQQLTEK

SEQ ID NO: 2538949 - protein, 39 aa, Entamoeba dispar
SDTILTLTSLIYPFVWHHVLIPILPVQLASYPTAPMPYL

SEQ ID NO: 2538950 - protein, 30 aa, Entamoeba dispar
SDTYKGVPAGETWVWYTNPNPRPKTEIGEN

SEQ ID NO: 2538951 - protein, 34 aa, Entamoeba dispar
SDVKLFGEAIIPKAFNIIPLFTKQTLQKVSYVMS

SEQ ID NO: 2538952 - protein, 24 aa, Entamoeba dispar
SDVPYIQILALFGLFNSGQSAMER

SEQ ID NO: 2538953 - protein, 29 aa, Entamoeba dispar
SDVSYLWSLGIILLRFWLGYKEASSPEEY

SEQ ID NO: 2538954 - protein, 21 aa, Entamoeba dispar
SDVVVLKRGEFLFPGLIDCHL

SEQ ID NO: 2538955 - protein, 23 aa, Entamoeba dispar
SDVWAFGCLVYKCLTLHTPFEDS

SEQ ID NO: 2538956 - protein, 27 aa, Entamoeba dispar
SDVWKMCCDLFDLLALSALIDNRILCV

SEQ ID NO: 2538957 - protein, 24 aa, Entamoeba dispar
SDVYSYGMILWELSTLSAPFPQFN

SEQ ID NO: 2538958 - protein, 28 aa, Entamoeba dispar
SDWGRTYIIPIISLYYTHPNYKIRQSTI

SEQ ID NO: 2538959 - protein, 18 aa, Entamoeba dispar
SDYALFYSNNRNSNQMVL

SEQ ID NO: 2538960 - protein, 26 aa, Entamoeba dispar
SDYETKILTLVKVVEQCKIKVNNQTE

SEQ ID NO: 2538961 - protein, 26 aa, Entamoeba dispar
SDYFEHFLTLLGDKVELFGYQGFAGG

SEQ ID NO: 2538962 - protein, 18 aa, Entamoeba dispar
SDYFSLGSMIFEFICGVP

SEQ ID NO: 2538963 - protein, 23 aa, Entamoeba dispar
SDYHKPFCIIVMDVNGIWKKFYG

SEQ ID NO: 2538964 - protein, 24 aa, Entamoeba dispar
SDYINMFVIFPEHIVKIIAMQYIL

SEQ ID NO: 2538965 - protein, 29 aa, Entamoeba dispar
SDYIRSTYFHPTKPWILSCSDDRTIRIWN

SEQ ID NO: 2538966 - protein, 17 aa, Entamoeba dispar
SDYLIFTRVTKGNYKDI

SEQ ID NO: 2538967 - protein, 23 aa, Entamoeba dispar
SDYTFKILIIGESGVGKTAILER

SEQ ID NO: 2538968 - protein, 17 aa, Entamoeba dispar
SDYYYLLHNRTGDIEFV

SEQ ID NO: 2538969 - protein, 35 aa, Entamoeba dispar
SEAATMIQNLKIIIPELIKEIRDELIKIIECGSNE

SEQ ID NO: 2538970 - protein, 32 aa, Entamoeba dispar
SEACKWLNSFKQLLIQFFNVPCSFDPLKQNEQ

SEQ ID NO: 2538971 - protein, 39 aa, Entamoeba dispar
SEADVEPLVLQLKAFLEKHDLDVSVKFKPKKMRGSTSLV

SEQ ID NO: 2538972 - protein, 20 aa, Entamoeba dispar
SEAIPIRYTVTNPDLIKKMS

SEQ ID NO: 2538973 - protein, 24 aa, Entamoeba dispar
SEALHLIFNYSLLVDPRLLQQDVI

SEQ ID NO: 2538974 - protein, 25 aa, Entamoeba dispar
SECFCRCLSLNYINIPRKVKELRKD

SEQ ID NO: 2538975 - protein, 24 aa, Entamoeba dispar
SEDEIVKMLTWVRSLTSINVEEVK

SEQ ID NO: 2538976 - protein, 25 aa, Entamoeba dispar
SEDEIVKMLTWVRSLTSINVEEVKK

SEQ ID NO: 2538977 - protein, 28 aa, Entamoeba dispar
SEDELRTVLMIAPWFPHKSIQQISLRMK

SEQ ID NO: 2538978 - protein, 17 aa, Entamoeba dispar
SEDIFGIQLCVGNSLLA

SEQ ID NO: 2538979 - protein, 23 aa, Entamoeba dispar
SEDIPIGWGLKENVYKEIMDKDK

SEQ ID NO: 2538980 - protein, 24 aa, Entamoeba dispar
SEDKWKWLTVFRDAFYHSAKDKLI

SEQ ID NO: 2538981 - protein, 25 aa, Entamoeba dispar
SEDLDKIFNAALKKTFKFTEAGEMV

SEQ ID NO: 2538982 - protein, 17 aa, Entamoeba dispar
SEDRIFMNEPVLISIKI

SEQ ID NO: 2538983 - protein, 25 aa, Entamoeba dispar
SEDTYKLIHYLIKYSENESDDQLIQ

SEQ ID NO: 2538984 - protein, 36 aa, Entamoeba dispar
SEDYAKLRPLSYPETDIFIVLFSIINYNSYSHVEKL

SEQ ID NO: 2538985 - protein, 31 aa, Entamoeba dispar
SEEDKYINVFYGFELFFIISNQQVIVLNTTN

SEQ ID NO: 2538986 - protein, 25 aa, Entamoeba dispar
SEEEDPYVLLFKRCDVNGDGVLDKK

SEQ ID NO: 2538987 - protein, 24 aa, Entamoeba dispar
SEEEIEKLIKWARGLKPIDKEEIN

SEQ ID NO: 2538988 - protein, 23 aa, Entamoeba dispar
SEEEIVKLIKWARGLSSFDKEEI

SEQ ID NO: 2538989 - protein, 29 aa, Entamoeba dispar
SEEEKVQIIYHYCQGKYGRFKGIYGIPEN

SEQ ID NO: 2538990 - protein, 25 aa, Entamoeba dispar
SEEEQLFAFFKYYEFIISQSDNMVE

SEQ ID NO: 2538991 - protein, 19 aa, Entamoeba dispar
SEEFVSLDKIIPILRDPMA

SEQ ID NO: 2538992 - protein, 30 aa, Entamoeba dispar
SEEGVFKGKLLLVWKWTPSVILNVECKEES

SEQ ID NO: 2538993 - protein, 37 aa, Entamoeba dispar
SEEKEVRMLFILAPHSHLLFKIIPTQIKSITLIEVVT

SEQ ID NO: 2538994 - protein, 23 aa, Entamoeba dispar
SEEKSMMPFGRYKRDITNIFSVM

SEQ ID NO: 2538995 - protein, 22 aa, Entamoeba dispar
SEELQYIIAIPENSLESFRDVI

SEQ ID NO: 2538996 - protein, 19 aa, Entamoeba dispar
SEELWSLALDPFLPEYLTS

SEQ ID NO: 2538997 - protein, 29 aa, Entamoeba dispar
SEERIFMNEPVLISIKIPKNLKRINEKNI

SEQ ID NO: 2538998 - protein, 17 aa, Entamoeba dispar
SEERIFMNEPVLVSIKT

SEQ ID NO: 2538999 - protein, 28 aa, Entamoeba dispar
SEETRQSIIQFLKLMKPNSFKVFDVNLR

SEQ ID NO: 2539000 - protein, 19 aa, Entamoeba dispar
SEEYNIETPIIIIENTEIT

SEQ ID NO: 2539001 - protein, 31 aa, Entamoeba dispar
SEFAEETLPFLIQFIPLFFERCLLTEEIIYK

SEQ ID NO: 2539002 - protein, 28 aa, Entamoeba dispar
SEFCCNITEGVLLRKVLSDLIKQSQSKL

SEQ ID NO: 2539003 - protein, 18 aa, Entamoeba dispar
SEFELLLNAFYIEPNDQS

SEQ ID NO: 2539004 - protein, 21 aa, Entamoeba dispar
SEFFFDLFEYMESNGYLHLNV

SEQ ID NO: 2539005 - protein, 18 aa, Entamoeba dispar
SEFGFSMFNLQIGVKTII

SEQ ID NO: 2539006 - protein, 26 aa, Entamoeba dispar
SEFINHFLQLLRFYHHNQPIAVLCSS

SEQ ID NO: 2539007 - protein, 23 aa, Entamoeba dispar
SEFKFDELLIYLQSLQGFLKTDI

SEQ ID NO: 2539008 - protein, 20 aa, Entamoeba dispar
SEFKRKLSLVGKKIGEETEH

SEQ ID NO: 2539009 - protein, 24 aa, Entamoeba dispar
SEFKVSFFNAMVDKFYSSIIEEQT

SEQ ID NO: 2539010 - protein, 24 aa, Entamoeba dispar
SEFLKVFVIALQRHGPQILLVPGR

SEQ ID NO: 2539011 - protein, 17 aa, Entamoeba dispar
SEFLYLLCSFYNKSIES

SEQ ID NO: 2539012 - protein, 23 aa, Entamoeba dispar
SEFMKSIVLPGIGFIGIADKQIV

SEQ ID NO: 2539013 - protein, 26 aa, Entamoeba dispar
SEFNNFPFILLPHRNGQLQLANEMVI

SEQ ID NO: 2539014 - protein, 26 aa, Entamoeba dispar
SEGNNYLPPIFTIEPIEIDLDTFQTD

SEQ ID NO: 2539015 - protein, 24 aa, Entamoeba dispar
SEGQYGIPKGIFFSMPVVCYGGEY

SEQ ID NO: 2539016 - protein, 18 aa, Entamoeba dispar
SEGYLIVLECNGIIKIYN

SEQ ID NO: 2539017 - protein, 33 aa, Entamoeba dispar
SEHFLFVQQSLKLWWNVMRHMSLLWIMNDKDFL

SEQ ID NO: 2539018 - protein, 19 aa, Entamoeba dispar
SEHSLLKRIICLPDVFFER

SEQ ID NO: 2539019 - protein, 26 aa, Entamoeba dispar
SEHSYILQEFLSTCLVKIPQARPSAY

SEQ ID NO: 2539020 - protein, 24 aa, Entamoeba dispar
SEIETILSKPLFPDQLAATIRNNA

SEQ ID NO: 2539021 - protein, 19 aa, Entamoeba dispar
SEIIITIKTIILGDSCISD

SEQ ID NO: 2539022 - protein, 31 aa, Entamoeba dispar
SEIKDGRIIISLPFRLKYVCSFENIPFVKIG

SEQ ID NO: 2539023 - protein, 25 aa, Entamoeba dispar
SEIKKWYGYILNSFLQYPKNNEIII

SEQ ID NO: 2539024 - protein, 29 aa, Entamoeba dispar
SEIKLPATIQLYCHLYKDGQLKIEWNQSQ

SEQ ID NO: 2539025 - protein, 21 aa, Entamoeba dispar
SEINFIKQQFKFSKPFMTGEV

SEQ ID NO: 2539026 - protein, 20 aa, Entamoeba dispar
SEIRYKIFKGCSSLRLINLG

SEQ ID NO: 2539027 - protein, 24 aa, Entamoeba dispar
SEKDDIVWILSEQGDFAIIEFGKK

SEQ ID NO: 2539028 - protein, 23 aa, Entamoeba dispar
SEKDLQIILVKDTRYYLTLHQQN

SEQ ID NO: 2539029 - protein, 25 aa, Entamoeba dispar
SEKEIERLLTWSYHLTPINKKRNEK

SEQ ID NO: 2539030 - protein, 30 aa, Entamoeba dispar
SEKKLFDFITNTFLASIYKDSIFQKVNVSI

SEQ ID NO: 2539031 - protein, 23 aa, Entamoeba dispar
SEKLGYKFKYRTTKPAKMTKKLE

SEQ ID NO: 2539032 - protein, 23 aa, Entamoeba dispar
SEKNFLIRGIGSLLFENIKGVKN

SEQ ID NO: 2539033 - protein, 26 aa, Entamoeba dispar
SEKNKLLHKLGITTTVPGFFNCQGRL

SEQ ID NO: 2539034 - protein, 22 aa, Entamoeba dispar
SEKQILSHFLFTNKIADYATLK

SEQ ID NO: 2539035 - protein, 17 aa, Entamoeba dispar
SEKRILMNEPVLVSIKI

SEQ ID NO: 2539036 - protein, 27 aa, Entamoeba dispar
SEKRKSIVAPKKPLSPASKKIVRIGGV

SEQ ID NO: 2539037 - protein, 22 aa, Entamoeba dispar
SELDWNGYFPTIIEILRDPRPL

SEQ ID NO: 2539038 - protein, 27 aa, Entamoeba dispar
SELFKHTYGLPICKITAGKNADIHRAI

SEQ ID NO: 2539039 - protein, 29 aa, Entamoeba dispar
SELGTRRRVFVIPYLLYQTMNRASLPGEV

SEQ ID NO: 2539040 - protein, 24 aa, Entamoeba dispar
SELHYGCFYLCLSLTSINIPSSIT

SEQ ID NO: 2539041 - protein, 18 aa, Entamoeba dispar
SELKISIGGILISIPDGT

SEQ ID NO: 2539042 - protein, 31 aa, Entamoeba dispar
SELKTLFALPSLPLVIPYLTLLILSNMNVIV

SEQ ID NO: 2539043 - protein, 25 aa, Entamoeba dispar
SELKVELPFPLKKTHHLLFTITDVS

SEQ ID NO: 2539044 - protein, 21 aa, Entamoeba dispar
SELLSLLMSMIILIVPPTPKK

SEQ ID NO: 2539045 - protein, 19 aa, Entamoeba dispar
SELLYDGTYKLIKALHLIN

SEQ ID NO: 2539046 - protein, 26 aa, Entamoeba dispar
SELPAYCFLCCRALKSINIPSSVREI

SEQ ID NO: 2539047 - protein, 20 aa, Entamoeba dispar
SELPDCCFKWCTSLPSINIP

SEQ ID NO: 2539048 - protein, 24 aa, Entamoeba dispar
SELTMIMLDFIKRGIKRLGVLLSG

SEQ ID NO: 2539049 - protein, 23 aa, Entamoeba dispar
SELYIAYQYYYFYDKDVDFKQFF

SEQ ID NO: 2539050 - protein, 23 aa, Entamoeba dispar
SEMELYHFVYVISIAPGELWKTL

SEQ ID NO: 2539051 - protein, 28 aa, Entamoeba dispar
SEMLGGLQACARAFAARKHFSVLREQQV

SEQ ID NO: 2539052 - protein, 21 aa, Entamoeba dispar
SEMPPLDDLQLLDPRVYSEEF

SEQ ID NO: 2539053 - protein, 24 aa, Entamoeba dispar
SEMRRYICDVLSLDPGRFISIAQH

SEQ ID NO: 2539054 - protein, 24 aa, Entamoeba dispar
SEMRRYICDVLSLDPGRFSELFRN

SEQ ID NO: 2539055 - protein, 18 aa, Entamoeba dispar
SEMRSGLTGLKFYNPETK

SEQ ID NO: 2539056 - protein, 37 aa, Entamoeba dispar
SENINFFKQLYKNEIHFPSLFLFNKNGLTTVLTDEKL

SEQ ID NO: 2539057 - protein, 38 aa, Entamoeba dispar
SENKFITPITIQILPPFTFINKLPLTLSIFIVHQNTFL

SEQ ID NO: 2539058 - protein, 24 aa, Entamoeba dispar
SENKRQCEFYIYGTKPNSIEKIKH

SEQ ID NO: 2539059 - protein, 23 aa, Entamoeba dispar
SENLINEPLVNVVPQIISVNKDY

SEQ ID NO: 2539060 - protein, 27 aa, Entamoeba dispar
SENLNKWIDLIFGYLQRPPAAFDADNV

SEQ ID NO: 2539061 - protein, 32 aa, Entamoeba dispar
SENLVQSWRYCLYYGWLLINSPTTLSFAFLFN

SEQ ID NO: 2539062 - protein, 30 aa, Entamoeba dispar
SENSYFFQSFLITLYVKLSYYTSSYSEQCY

SEQ ID NO: 2539063 - protein, 28 aa, Entamoeba dispar
SENYDFKKKPFPPARIRKITKINTNNKQ

SEQ ID NO: 2539064 - protein, 24 aa, Entamoeba dispar
SEQESVLLALLNKFYDITFTAHKK

SEQ ID NO: 2539065 - protein, 38 aa, Entamoeba dispar
SEQLLSSFLRFHCCLLLLDYFDYINRIQEFAQFHACPL

SEQ ID NO: 2539066 - protein, 28 aa, Entamoeba dispar
SEQLQPYHALFLFKNPEEWINNLVESDE

SEQ ID NO: 2539067 - protein, 23 aa, Entamoeba dispar
SEQLTVIFKNKFLNFLKNYDHKH

SEQ ID NO: 2539068 - protein, 24 aa, Entamoeba dispar
SEQLWKIPMILSCGGYKQTYLLTK

SEQ ID NO: 2539069 - protein, 25 aa, Entamoeba dispar
SEQRNTARFQLPQSILLSGISIKNE

SEQ ID NO: 2539070 - protein, 23 aa, Entamoeba dispar
SEQSMNLLGLCILATKKYSAGIT

SEQ ID NO: 2539071 - protein, 24 aa, Entamoeba dispar
SEQYIKIMPFEVIVLNAYLHMLKD

SEQ ID NO: 2539072 - protein, 22 aa, Entamoeba dispar
SERKQLLEFIIAEAILAKEKVI

SEQ ID NO: 2539073 - protein, 19 aa, Entamoeba dispar
SERLVYLSLNLINNLIASF

SEQ ID NO: 2539074 - protein, 28 aa, Entamoeba dispar
SERRYIPELIGWIRKGFKIVKDSKRKKG

SEQ ID NO: 2539075 - protein, 27 aa, Entamoeba dispar
SERSRIRAVYLCKWFIKNGSNQNVISF

SEQ ID NO: 2539076 - protein, 26 aa, Entamoeba dispar
SERTKLIFFMYFDNGNIMGLYFQKKI

SEQ ID NO: 2539077 - protein, 24 aa, Entamoeba dispar
SERTTIIFRLNWLRDEDIPIIQQV

SEQ ID NO: 2539078 - protein, 26 aa, Entamoeba dispar
SESDLNIILFRILSSGTPLQVIDLHH

SEQ ID NO: 2539079 - protein, 25 aa, Entamoeba dispar
SESIIFPFLYENEIIQWLTQKAILY

SEQ ID NO: 2539080 - protein, 24 aa, Entamoeba dispar
SESIPAWYHALSLIRLLCSDAPEL

SEQ ID NO: 2539081 - protein, 23 aa, Entamoeba dispar
SESKRILVTLTNDFGKILSGLHE

SEQ ID NO: 2539082 - protein, 25 aa, Entamoeba dispar
SESLILLLPSIRYYSQLFSHLSVVD

SEQ ID NO: 2539083 - protein, 27 aa, Entamoeba dispar
SESQNHLVLKVPSLTIPIQPSSTYKPQ

SEQ ID NO: 2539084 - protein, 20 aa, Entamoeba dispar
SESQYEMIRWIASTINFSGK

SEQ ID NO: 2539085 - protein, 22 aa, Entamoeba dispar
SESSIKPIFLRKASTSVSVNAK

SEQ ID NO: 2539086 - protein, 49 aa, Entamoeba dispar
SETEILYRFYQSLKSLLMFSRLYPKNLKQYFILFDALASIGPQACYSLS

SEQ ID NO: 2539087 - protein, 24 aa, Entamoeba dispar
SETLLESFVFITNSFEAAGQEITT

SEQ ID NO: 2539088 - protein, 20 aa, Entamoeba dispar
SETNLLHGLFSRTSTEYLLL

SEQ ID NO: 2539089 - protein, 24 aa, Entamoeba dispar
SETRIKYEFIIDPSAFHELQTLAD

SEQ ID NO: 2539090 - protein, 28 aa, Entamoeba dispar
SETSQNFFYFPFINVLVQPVTVAVESKF

SEQ ID NO: 2539091 - protein, 28 aa, Entamoeba dispar
SETYNPEMRLKFLGGKRKGGTTKENGTF

SEQ ID NO: 2539092 - protein, 20 aa, Entamoeba dispar
SEVMLDSVLVKFSEDYNKLK

SEQ ID NO: 2539093 - protein, 23 aa, Entamoeba dispar
SEVRPLQVLYKSLNYVLTKYKEN

SEQ ID NO: 2539094 - protein, 24 aa, Entamoeba dispar
SEYEVVKMRNILYGLLEKIENLTI

SEQ ID NO: 2539095 - protein, 28 aa, Entamoeba dispar
SEYFDNAPVFIIPGRRFPVTIEYLTEPE

SEQ ID NO: 2539096 - protein, 40 aa, Entamoeba dispar
SEYGVSYVTILHELQKTYNWKKSFGVIKKTKKIVTPIDVD

SEQ ID NO: 2539097 - protein, 23 aa, Entamoeba dispar
SEYNLLFKMIDMLGMLPNEMLKN

SEQ ID NO: 2539098 - protein, 37 aa, Entamoeba dispar
SFAIVMYETFIWGAPYPKDIFPFPWNIAEFISQGNRR

SEQ ID NO: 2539099 - protein, 22 aa, Entamoeba dispar
SFAKLIIWLKTDKEDDLRQVIL

SEQ ID NO: 2539100 - protein, 19 aa, Entamoeba dispar
SFALRCEGHYLNVLKDMKD

SEQ ID NO: 2539101 - protein, 17 aa, Entamoeba dispar
SFAPYCLPLIPKTVEWL

SEQ ID NO: 2539102 - protein, 24 aa, Entamoeba dispar
SFCEGDEMIALSSDLKWVYVQHPE

SEQ ID NO: 2539103 - protein, 17 aa, Entamoeba dispar
SFCVPRKSEIFQDDIFP

SEQ ID NO: 2539104 - protein, 19 aa, Entamoeba dispar
SFDAKLDAFTYTSTPERTG

SEQ ID NO: 2539105 - protein, 32 aa, Entamoeba dispar
SFDDAFIFANYYNLLEPLKWSKSLYYQCILNG

SEQ ID NO: 2539106 - protein, 26 aa, Entamoeba dispar
SFDEFIEKLIKLPRKSLKQSREVLMR

SEQ ID NO: 2539107 - protein, 24 aa, Entamoeba dispar
SFDFKNDYYIGHTGLIYGTTDENN

SEQ ID NO: 2539108 - protein, 21 aa, Entamoeba dispar
SFDLKNTNQLFSEYKTRTNKT

SEQ ID NO: 2539109 - protein, 27 aa, Entamoeba dispar
SFDLLHAGHYELFRKAHELGTYLIVGI

SEQ ID NO: 2539110 - protein, 20 aa, Entamoeba dispar
SFDLVVFSIYLKHLEMNNVF

SEQ ID NO: 2539111 - protein, 23 aa, Entamoeba dispar
SFDNQFITRPIPTISFQILDMRP

SEQ ID NO: 2539112 - protein, 23 aa, Entamoeba dispar
SFDSLVKHITLKDKQYDIVLCDT

SEQ ID NO: 2539113 - protein, 26 aa, Entamoeba dispar
SFDSYEPILLPYYVDALLTSNQQSDE

SEQ ID NO: 2539114 - protein, 24 aa, Entamoeba dispar
SFEAYQYLNLLQSLNIKLPQLDQF

SEQ ID NO: 2539115 - protein, 24 aa, Entamoeba dispar
SFEEMINHYPIELPNESKSLIHSD

SEQ ID NO: 2539116 - protein, 27 aa, Entamoeba dispar
SFEFEINKLPILLKVWEVDCSESYDEF

SEQ ID NO: 2539117 - protein, 18 aa, Entamoeba dispar
SFEFFIGKQKTLIVNFQL

SEQ ID NO: 2539118 - protein, 27 aa, Entamoeba dispar
SFEHDITIGILFYLYTICCGESNYIII

SEQ ID NO: 2539119 - protein, 29 aa, Entamoeba dispar
SFEIKYTKPLYRTILSCILKHIEWNMLDN

SEQ ID NO: 2539120 - protein, 23 aa, Entamoeba dispar
SFETTLTRPILMHFAVESITYEV

SEQ ID NO: 2539121 - protein, 24 aa, Entamoeba dispar
SFEVPCQIALYLPIRGLSYEKKDC

SEQ ID NO: 2539122 - protein, 17 aa, Entamoeba dispar
SFEWRECYKKYTPIMFN

SEQ ID NO: 2539123 - protein, 17 aa, Entamoeba dispar
SFFFRTWEVEENGTYGC

SEQ ID NO: 2539124 - protein, 19 aa, Entamoeba dispar
SFFQKRYFQFLLSNPSQSR

SEQ ID NO: 2539125 - protein, 18 aa, Entamoeba dispar
SFGAALYAYQRISGAFPV

SEQ ID NO: 2539126 - protein, 18 aa, Entamoeba dispar
SFGDIPLTTFSKTIIKHL

SEQ ID NO: 2539127 - protein, 23 aa, Entamoeba dispar
SFGKSCFFNCGFILELKQNMKIP

SEQ ID NO: 2539128 - protein, 31 aa, Entamoeba dispar
SFGVECVLTLFSFMIIYPNSVFLARGNHETR

SEQ ID NO: 2539129 - protein, 19 aa, Entamoeba dispar
SFHLMDDIKLTYNDPFFTS

SEQ ID NO: 2539130 - protein, 27 aa, Entamoeba dispar
SFHNDETIYFMYARPLKINSELLDLML

SEQ ID NO: 2539131 - protein, 21 aa, Entamoeba dispar
SFICFSSLKIFLNFLKKCQIL

SEQ ID NO: 2539132 - protein, 33 aa, Entamoeba dispar
SFICVSPPLDYITILFYKSGPTYFQYHNALLDI

SEQ ID NO: 2539133 - protein, 20 aa, Entamoeba dispar
SFIDFPTILSKLPKLQRLSL

SEQ ID NO: 2539134 - protein, 35 aa, Entamoeba dispar
SFIEFEGKYLLGERFFRLNPKLPYQIDLDYCKDVE

SEQ ID NO: 2539135 - protein, 36 aa, Entamoeba dispar; identical to SEQ ID NO: 2503934

SEQ ID NO: 2539136 - protein, 21 aa, Entamoeba dispar
SFILQSLYDIIHSITTPQLLV

SEQ ID NO: 2539137 - protein, 20 aa, Entamoeba dispar
SFIQKLKIGLLKLKNYKHLF

SEQ ID NO: 2539138 - protein, 26 aa, Entamoeba dispar
SFIQVRGNIPLIWKTKETDLFKPRGK

SEQ ID NO: 2539139 - protein, 19 aa, Entamoeba dispar
SFIRYNFGNWMQRTLKYLF

SEQ ID NO: 2539140 - protein, 17 aa, Entamoeba dispar
SFISFHTLSPYYKTILN

SEQ ID NO: 2539141 - protein, 20 aa, Entamoeba dispar
SFISFHTLSPYYKTILNCIE

SEQ ID NO: 2539142 - protein, 20 aa, Entamoeba dispar
SFISKFLQYQLNSLSPELCP

SEQ ID NO: 2539143 - protein, 18 aa, Entamoeba dispar
SFKFGTPCNYPTQSEWRG

SEQ ID NO: 2539144 - protein, 18 aa, Entamoeba dispar
SFKGLMYNAVQDGLSIPK

SEQ ID NO: 2539145 - protein, 27 aa, Entamoeba dispar
SFKGRYYPYILGIRKDFLSNIFITFPN

SEQ ID NO: 2539146 - protein, 20 aa, Entamoeba dispar
SFKIIKAINSSKFIDFCIIS

SEQ ID NO: 2539147 - protein, 17 aa, Entamoeba dispar
SFKINRLLRMNDLAQIS

SEQ ID NO: 2539148 - protein, 18 aa, Entamoeba dispar
SFKINRLLRMNDLAQIST

SEQ ID NO: 2539149 - protein, 25 aa, Entamoeba dispar
SFKKQNLLLLLLSNHYLNTLLTIIL

SEQ ID NO: 2539150 - protein, 17 aa, Entamoeba dispar
SFKNIEELWLPEVAFYD

SEQ ID NO: 2539151 - protein, 29 aa, Entamoeba dispar
SFKTIEGFSLQYFLIINVHLKDTSNTKTE

SEQ ID NO: 2539152 - protein, 26 aa, Entamoeba dispar
SFKTNEFLIILPFLSSLNTVINICSL

SEQ ID NO: 2539153 - protein, 19 aa, Entamoeba dispar
SFLCALHGNDFFWVHGYNK

SEQ ID NO: 2539154 - protein, 27 aa, Entamoeba dispar
SFLEHLYSFQKLQGPFLIVVPLSMIEH

SEQ ID NO: 2539155 - protein, 26 aa, Entamoeba dispar
SFLETEYIFISFFETIILLNAKNKSK

SEQ ID NO: 2539156 - protein, 17 aa, Entamoeba dispar
SFLFPFAADIRPRANEW

SEQ ID NO: 2539157 - protein, 19 aa, Entamoeba dispar
SFLIKIALSIKGGNVCEVK

SEQ ID NO: 2539158 - protein, 18 aa, Entamoeba dispar
SFLLCFMAEIILENKDRL

SEQ ID NO: 2539159 - protein, 19 aa, Entamoeba dispar
SFLLVHILSVLGKTSHFPL

SEQ ID NO: 2539160 - protein, 22 aa, Entamoeba dispar
SFLQKYDVIPTLFRLMELAIQN

SEQ ID NO: 2539161 - protein, 25 aa, Entamoeba dispar
SFLRMRARGVFLPNVKWNEDDELKY

SEQ ID NO: 2539162 - protein, 23 aa, Entamoeba dispar
SFLTKLQIIFPETINIQKAKSVE

SEQ ID NO: 2539163 - protein, 18 aa, Entamoeba dispar
SFMEGDSIKVVDRMSNGL

SEQ ID NO: 2539164 - protein, 20 aa, Entamoeba dispar
SFMSFMEDPFWRVRLQIASS

SEQ ID NO: 2539165 - protein, 39 aa, Entamoeba dispar
SFNAVRRFYIFLCLQPHVIWLVKALKIIIEFDFGKKLAL

SEQ ID NO: 2539166 - protein, 22 aa, Entamoeba dispar
SFNDGLLICQVIDKIKPGVINW

SEQ ID NO: 2539167 - protein, 23 aa, Entamoeba dispar
SFNDLFIIYINGFEPIQIHLKTS

SEQ ID NO: 2539168 - protein, 19 aa, Entamoeba dispar
SFNDLIIMPVQRLMRYPIL

SEQ ID NO: 2539169 - protein, 27 aa, Entamoeba dispar
SFNDLSQYPIFPWILTDYTSKTIDLND

SEQ ID NO: 2539170 - protein, 28 aa, Entamoeba dispar
SFNDLSQYPIFPWILTDYTSKTIDLNDE

SEQ ID NO: 2539171 - protein, 35 aa, Entamoeba dispar
SFNETLELILYKRAIYLLLTLQPSIELIQFIYLLK

SEQ ID NO: 2539172 - protein, 22 aa, Entamoeba dispar
SFNQFIINQEFYKGIFSIKTQN

SEQ ID NO: 2539173 - protein, 22 aa, Entamoeba dispar
SFNQLLSFGYLFDQSEISYKLF

SEQ ID NO: 2539174 - protein, 35 aa, Entamoeba dispar
SFNRGDVIDLLRKDGLWWFGELNGIKGYFPSNYVQ

SEQ ID NO: 2539175 - protein, 20 aa, Entamoeba dispar
SFPKRPISDTLVKLISALLQ

SEQ ID NO: 2539176 - protein, 25 aa, Entamoeba dispar
SFPSISIVFPFNGVSGQLLTVLKHN

SEQ ID NO: 2539177 - protein, 22 aa, Entamoeba dispar
SFQEYMWLTQLEFVRTVRGQLV

SEQ ID NO: 2539178 - protein, 18 aa, Entamoeba dispar
SFQQNELFRKIPYNEFLG

SEQ ID NO: 2539179 - protein, 19 aa, Entamoeba dispar
SFRCLCHYIRLFCENPLCS

SEQ ID NO: 2539180 - protein, 25 aa, Entamoeba dispar
SFRDSKQFPHLLLCGQPGIGKTTSI

SEQ ID NO: 2539181 - protein, 18 aa, Entamoeba dispar
SFRFGSWPHAGCGIGLER

SEQ ID NO: 2539182 - protein, 20 aa, Entamoeba dispar
SFRHQEAINCFLNALEIDQQ

SEQ ID NO: 2539183 - protein, 21 aa, Entamoeba dispar
SFRHVYNWLSEARRFCNKENV

SEQ ID NO: 2539184 - protein, 41 aa, Entamoeba dispar
SFRLPHELKNLQVSLCLLIYKFMYCGAPYKVYGCYDEKFNV

SEQ ID NO: 2539185 - protein, 19 aa, Entamoeba dispar
SFRYTDVLKKYCYDKILMK

SEQ ID NO: 2539186 - protein, 20 aa, Entamoeba dispar
SFSAYITFKTAESSIQCIRS

SEQ ID NO: 2539187 - protein, 29 aa, Entamoeba dispar
SFSDTLRSYNIIFPHIEYCKILNSSMNTY

SEQ ID NO: 2539188 - protein, 18 aa, Entamoeba dispar
SFSEIFHVNEADANLALL

SEQ ID NO: 2539189 - protein, 19 aa, Entamoeba dispar
SFSEWLELPLRNSTRSKHL

SEQ ID NO: 2539190 - protein, 17 aa, Entamoeba dispar
SFSFQKPKKRSTVNFCF

SEQ ID NO: 2539191 - protein, 17 aa, Entamoeba dispar
SFSIFASKGKKLPIIFE

SEQ ID NO: 2539192 - protein, 22 aa, Entamoeba dispar
SFSKFCEFLKQLGIHFCNGNIS

SEQ ID NO: 2539193 - protein, 24 aa, Entamoeba dispar
SFSPTSYYELYLNALNNGIVLSIQ

SEQ ID NO: 2539194 - protein, 18 aa, Entamoeba dispar
SFSRIHLLDDFFLLQEGD

SEQ ID NO: 2539195 - protein, 25 aa, Entamoeba dispar
SFSRTFLIVVPAMVALQWQTEAKKW

SEQ ID NO: 2539196 - protein, 30 aa, Entamoeba dispar
SFSSPDFTYFPQWILDYLHLQPGDAATVLK

SEQ ID NO: 2539197 - protein, 22 aa, Entamoeba dispar
SFSTAFLPMILNLAFDSTSNVR

SEQ ID NO: 2539198 - protein, 24 aa, Entamoeba dispar
SFSTVYEIMRLDFLCVIRDYPLMI

SEQ ID NO: 2539199 - protein, 27 aa, Entamoeba dispar
SFSVQWNIFMKTGILMLKYLDPTRKEE

SEQ ID NO: 2539200 - protein, 20 aa, Entamoeba dispar
SFTAIFVGSILKGKDIEQAQ

SEQ ID NO: 2539201 - protein, 35 aa, Entamoeba dispar
SFTKELQFFPFLETVKLTFFSPLILRCIPTSVKRI

SEQ ID NO: 2539202 - protein, 20 aa, Entamoeba dispar
SFTPFSSYYQNLSSYYPPCD

SEQ ID NO: 2539203 - protein, 23 aa, Entamoeba dispar
SFTPLTLNLFQDPFEIVGLSKYE

SEQ ID NO: 2539204 - protein, 24 aa, Entamoeba dispar
SFVFNGGKFLGICAGAYFSSSYIK

SEQ ID NO: 2539205 - protein, 19 aa, Entamoeba dispar
SFVQRQRYLREQQDLEAQK

SEQ ID NO: 2539206 - protein, 29 aa, Entamoeba dispar
SFWRNARSKLNAYFLQPMIGELKEELSRQ

SEQ ID NO: 2539207 - protein, 17 aa, Entamoeba dispar
SFWTWKATALGKNMTSV

SEQ ID NO: 2539208 - protein, 21 aa, Entamoeba dispar
SFYFRPSHCLLISNINKNNKY

SEQ ID NO: 2539209 - protein, 17 aa, Entamoeba dispar
SFYQQNLLLLLLSNHYL

SEQ ID NO: 2539210 - protein, 30 aa, Entamoeba dispar
SFYQQTIDILLFSILILLSTNGHPNAIAEQ

SEQ ID NO: 2539211 - protein, 23 aa, Entamoeba dispar
SFYSCKLLESLFIPSSVQNYGSY

SEQ ID NO: 2539212 - protein, 27 aa, Entamoeba dispar
SFYYSRLSFLPVIRPLFLNYPNDQTTY

SEQ ID NO: 2539213 - protein, 19 aa, Entamoeba dispar
SGALLVYDISRKESFEKIP

SEQ ID NO: 2539214 - protein, 24 aa, Entamoeba dispar
SGCAQLKEILLPSSLKYIEEKCFS

SEQ ID NO: 2539215 - protein, 19 aa, Entamoeba dispar
SGCGICKNGYYRNGKGCSK

SEQ ID NO: 2539216 - protein, 21 aa, Entamoeba dispar
SGCMFIFSYIFSLSNTINFKT

SEQ ID NO: 2539217 - protein, 17 aa, Entamoeba dispar
SGCNYLHVLPIPNQFAS

SEQ ID NO: 2539218 - protein, 23 aa, Entamoeba dispar
SGCSYITALTLPGNFPKIDKSIF

SEQ ID NO: 2539219 - protein, 27 aa, Entamoeba dispar
SGDANGKIFIWSWKKGKILKVFEHAHK

SEQ ID NO: 2539220 - protein, 26 aa, Entamoeba dispar
SGDEKGIFRIWDFRTMKTIKAFQAPN

SEQ ID NO: 2539221 - protein, 20 aa, Entamoeba dispar
SGDGFAIVYSITSLTTFLEA

SEQ ID NO: 2539222 - protein, 25 aa, Entamoeba dispar
SGDKFISYEPWLNKLSKSKSNIPRE

SEQ ID NO: 2539223 - protein, 27 aa, Entamoeba dispar
SGDRIGLWIKFQLEPSAYATMLFRELL

SEQ ID NO: 2539224 - protein, 22 aa, Entamoeba dispar
SGDWDLMVEGKYDYIIGGDVTY

SEQ ID NO: 2539225 - protein, 22 aa, Entamoeba dispar
SGEFYLPQQLATCHYCKKRKPV

SEQ ID NO: 2539226 - protein, 26 aa, Entamoeba dispar
SGELRNEIIFKPKIGTEQLLRNAINN

SEQ ID NO: 2539227 - protein, 24 aa, Entamoeba dispar
SGFCDPFDLLPPNLKLIESNEEIK

SEQ ID NO: 2539228 - protein, 19 aa, Entamoeba dispar
SGFNYLKRLGSSDNFDDWG

SEQ ID NO: 2539229 - protein, 25 aa, Entamoeba dispar
SGFPQEFSPFLVKLFEMLNDKESKN

SEQ ID NO: 2539230 - protein, 20 aa, Entamoeba dispar
SGFSFLFAEYVRRQFRKDNK

SEQ ID NO: 2539231 - protein, 30 aa, Entamoeba dispar
SGFTTLPFDSSFFIGLLDLGGKELLKRLVL

SEQ ID NO: 2539232 - protein, 23 aa, Entamoeba dispar
SGGHSLFNWSFVTSKTLPFHNYK

SEQ ID NO: 2539233 - protein, 24 aa, Entamoeba dispar
SGGNVNVIFIDKDGWRLISRNDCY

SEQ ID NO: 2539234 - protein, 33 aa, Entamoeba dispar
SGGVPSFYSELAKWILSFNPLQQYKSLVTLHRV

SEQ ID NO: 2539235 - protein, 21 aa, Entamoeba dispar
SGHIPLYSPKECKLFLQWIKE

SEQ ID NO: 2539236 - protein, 17 aa, Entamoeba dispar
SGHNYLRVTRIFNSLHA

SEQ ID NO: 2539237 - protein, 24 aa, Entamoeba dispar
SGHQRFLMTILDPAVTPGQNQKDI

SEQ ID NO: 2539238 - protein, 25 aa, Entamoeba dispar
SGIFNKYIIMEFVDGYDLFHIVFTN

SEQ ID NO: 2539239 - protein, 24 aa, Entamoeba dispar
SGIGGLVHIILFSTKGKITIVGPK

SEQ ID NO: 2539240 - protein, 21 aa, Entamoeba dispar
SGIIYWNCLPNTTNLLPPTDV

SEQ ID NO: 2539241 - protein, 26 aa, Entamoeba dispar
SGIKYSQYRFLTPDKAFHQKESQVVF

SEQ ID NO: 2539242 - protein, 17 aa, Entamoeba dispar
SGILKKAAYMEEELKKS

SEQ ID NO: 2539243 - protein, 24 aa, Entamoeba dispar
SGIPVISFQWIFDCISERRLFSFN

SEQ ID NO: 2539244 - protein, 23 aa, Entamoeba dispar
SGIRFWEHIFPGSKTMNREARRQ

SEQ ID NO: 2539245 - protein, 29 aa, Entamoeba dispar
SGKADVYLRLPRNLSYQEKIWDHAAGYLI

SEQ ID NO: 2539246 - protein, 52 aa, Entamoeba dispar
SGKEIVLKQLKTLIYYPQFSQIIPNSLLSPIDVFLPIFCSLCKTKRVCILYP

SEQ ID NO: 2539247 - protein, 24 aa, Entamoeba dispar
SGKFDQETFLTIMLEYGQEVDSTE

SEQ ID NO: 2539248 - protein, 30 aa, Entamoeba dispar
SGKIHIYQNIPYWVWMILKEENNEVEEIEY

SEQ ID NO: 2539249 - protein, 31 aa, Entamoeba dispar
SGKIHNYQSIPYWVWMILKEENNSVEEIEYT

SEQ ID NO: 2539250 - protein, 19 aa, Entamoeba dispar
SGKKAPRYFPNGQTVFQIQ

SEQ ID NO: 2539251 - protein, 23 aa, Entamoeba dispar
SGKKFVMVIPPPNVTGKLHLGHA

SEQ ID NO: 2539252 - protein, 29 aa, Entamoeba dispar
SGKLNGTMFFFSDYLIFAKSEKEGYSVIE

SEQ ID NO: 2539253 - protein, 20 aa, Entamoeba dispar
SGKRGRFDGRRGLSRIGRRH

SEQ ID NO: 2539254 - protein, 24 aa, Entamoeba dispar
SGKSALCNFILKKAVFNESDNPQS

SEQ ID NO: 2539255 - protein, 25 aa, Entamoeba dispar
SGKTAAFLFPIISDILKNPPMPRQA

SEQ ID NO: 2539256 - protein, 22 aa, Entamoeba dispar
SGKTISFTLPLMERLRAENERK

SEQ ID NO: 2539257 - protein, 22 aa, Entamoeba dispar
SGKTTLLNSFINALYGIEITDD

SEQ ID NO: 2539258 - protein, 36 aa, Entamoeba dispar
SGKTTLLNSFINALYGIKITDDFRYIIINEGNLEQN

SEQ ID NO: 2539259 - protein, 17 aa, Entamoeba dispar
SGKTTLLNSFVNALYGI

SEQ ID NO: 2539260 - protein, 34 aa, Entamoeba dispar
SGKTTLLNSFVNALYGIKITDDFRYIIINEDNLE

SEQ ID NO: 2539261 - protein, 22 aa, Entamoeba dispar
SGKTTLLNSFVNALYGIKVTDD

SEQ ID NO: 2539262 - protein, 24 aa, Entamoeba dispar
SGKYVSYMFSIRFPEIFYEMLSRD

SEQ ID NO: 2539263 - protein, 30 aa, Entamoeba dispar
SGLNIALYRLNYVMYLFSIEEPFAKIVLNQ

SEQ ID NO: 2539264 - protein, 25 aa, Entamoeba dispar
SGLPKPDIVFFLELSLEDAEQRRKT

SEQ ID NO: 2539265 - protein, 20 aa, Entamoeba dispar
SGLTEYMQRLLRSCGYIYTT

SEQ ID NO: 2539266 - protein, 17 aa, Entamoeba dispar
SGLVKSALPVLCMNQLV

SEQ ID NO: 2539267 - protein, 23 aa, Entamoeba dispar
SGLYMICLPYIDDVLTPLLSEPE

SEQ ID NO: 2539268 - protein, 23 aa, Entamoeba dispar
SGMSFIEAQRFLKDIQWDGKESI

SEQ ID NO: 2539269 - protein, 24 aa, Entamoeba dispar
SGMTLDLLCKVLSSLLIPIQSKEF

SEQ ID NO: 2539270 - protein, 27 aa, Entamoeba dispar
SGMVLSYYLPIHCGIKKIYIEVESVNG

SEQ ID NO: 2539271 - protein, 25 aa, Entamoeba dispar
SGNKTGLFHLILRDYGTLESAKIMA

SEQ ID NO: 2539272 - protein, 27 aa, Entamoeba dispar
SGNLSVDYLGVIPYIVEALKTIHDNSV

SEQ ID NO: 2539273 - protein, 25 aa, Entamoeba dispar
SGNTLLHYISYSPFTDMILLLCKKL

SEQ ID NO: 2539274 - protein, 29 aa, Entamoeba dispar
SGNYAWNAGIFLWTAKTIINQLKQFAPTV

SEQ ID NO: 2539275 - protein, 30 aa, Entamoeba dispar
SGNYSTNLLFLPTDKRFPPIRIKARDPAKL

SEQ ID NO: 2539276 - protein, 25 aa, Entamoeba dispar
SGPDIIVATPGRLTFILEGANISLN

SEQ ID NO: 2539277 - protein, 22 aa, Entamoeba dispar
SGQINYPIKRFGDSDFWEQILL

SEQ ID NO: 2539278 - protein, 22 aa, Entamoeba dispar
SGRTPFHYAVLGGHLGLVRKIG

SEQ ID NO: 2539279 - protein, 26 aa, Entamoeba dispar
SGRVAKILHIYQFTKIFVQCPGVLEN

SEQ ID NO: 2539280 - protein, 17 aa, Entamoeba dispar
SGRYTCCMLFLKEIYGN

SEQ ID NO: 2539281 - protein, 26 aa, Entamoeba dispar
SGSIGFFEFIALYNWVKLCVATFKHF

SEQ ID NO: 2539282 - protein, 25 aa, Entamoeba dispar
SGSLDVSFLHLAKSSKLLAQWIVLC

SEQ ID NO: 2539283 - protein, 37 aa, Entamoeba dispar
SGSLVVYCQYLDKLARLFDYLWKKKCIVYADVIEPFT

SEQ ID NO: 2539284 - protein, 19 aa, Entamoeba dispar
SGSTALHWAVRGDIQIVQM

SEQ ID NO: 2539285 - protein, 28 aa, Entamoeba dispar
SGTKKIRGFFVFPYTKTMSLLQREMEGR

SEQ ID NO: 2539286 - protein, 25 aa, Entamoeba dispar
SGTNKQLIYFTPNPKWYESAIQNGH

SEQ ID NO: 2539287 - protein, 27 aa, Entamoeba dispar
SGTSFDIIFIDSNLFRFESLLTTVINN

SEQ ID NO: 2539288 - protein, 29 aa, Entamoeba dispar
SGTSNEMLVLIHRLMYQRQGSQKERLNNI

SEQ ID NO: 2539289 - protein, 25 aa, Entamoeba dispar
SGTTATLALIYKNKITLIHCGDSTA

SEQ ID NO: 2539290 - protein, 39 aa, Entamoeba dispar
SGTVTFYLDIFSILLRLSIFPFHFNFYNYCVISLESITS

SEQ ID NO: 2539291 - protein, 17 aa, Entamoeba dispar
SGTYPVYIQAFSGNTFG

SEQ ID NO: 2539292 - protein, 17 aa, Entamoeba dispar
SGVGKTGIFKRYITGQY

SEQ ID NO: 2539293 - protein, 31 aa, Entamoeba dispar
SGVIRKFLRDLSTPIWPQSLLQPMLSITMNN

SEQ ID NO: 2539294 - protein, 30 aa, Entamoeba dispar
SGVTPIKKPFRGGFDSCWLCEKGIESINFF

SEQ ID NO: 2539295 - protein, 21 aa, Entamoeba dispar
SGVTYRLTLGVIKNIMPAIAS

SEQ ID NO: 2539296 - protein, 23 aa, Entamoeba dispar
SGVYRMDLKFRDFLMQKMINGER

SEQ ID NO: 2539297 - protein, 27 aa, Entamoeba dispar
SGWKRRWVVLCRGFLFYYNNPKDEIPI

SEQ ID NO: 2539298 - protein, 18 aa, Entamoeba dispar
SGYPSSHLLILKEQTRTL

SEQ ID NO: 2539299 - protein, 24 aa, Entamoeba dispar
SHAELLGLLYRFSGTLGKYAKKLE

SEQ ID NO: 2539300 - protein, 28 aa, Entamoeba dispar
SHARVTSIPTILVLNPGSWKALQQTAKE

SEQ ID NO: 2539301 - protein, 23 aa, Entamoeba dispar
SHCFHILCIKKEFAQHPTLFARS

SEQ ID NO: 2539302 - protein, 25 aa, Entamoeba dispar
SHCLKSLVLALKYVKTLPSSAHLLF

SEQ ID NO: 2539303 - protein, 46 aa, Entamoeba dispar
SHDHAKQFLFVKQTLVLWNIILENMYQLWILAELDLFDPQHPYEMK

SEQ ID NO: 2539304 - protein, 21 aa, Entamoeba dispar
SHDSTLLAVASYDATIRIIDI

SEQ ID NO: 2539305 - protein, 26 aa, Entamoeba dispar
SHEKGKLKIYLYPNEPFNQIDESEAI

SEQ ID NO: 2539306 - protein, 25 aa, Entamoeba dispar
SHEKGKLKIYLYPNEPFNQKEENEA

SEQ ID NO: 2539307 - protein, 25 aa, Entamoeba dispar
SHEKGKLKIYLYPNEQFDQVDESDA

SEQ ID NO: 2539308 - protein, 28 aa, Entamoeba dispar
SHETGKLKIYLYPNKPFNQVEESDAIAI

SEQ ID NO: 2539309 - protein, 17 aa, Entamoeba dispar
SHEYTLINLVFGSGKSL

SEQ ID NO: 2539310 - protein, 30 aa, Entamoeba dispar
SHFIALVTRIPAKIPLIKKVAKPIYNGAKG

SEQ ID NO: 2539311 - protein, 29 aa, Entamoeba dispar
SHHNDIMFYRGYKFVVSLKVSGVALGPKE

SEQ ID NO: 2539312 - protein, 32 aa, Entamoeba dispar
SHIHGYINYNKDAGLFVFMNAGRNGSIVNGKT

SEQ ID NO: 2539313 - protein, 18 aa, Entamoeba dispar
SHIIAPWEDDKLSSTSLF

SEQ ID NO: 2539314 - protein, 18 aa, Entamoeba dispar
SHIIQLESLLFQLKPQQL

SEQ ID NO: 2539315 - protein, 26 aa, Entamoeba dispar
SHIRLTQETLLKLVKFFSVESKYLIT

SEQ ID NO: 2539316 - protein, 23 aa, Entamoeba dispar
SHIYFPFHVIVITETSLFIMDTR

SEQ ID NO: 2539317 - protein, 19 aa, Entamoeba dispar
SHKGGVLSYKYSSKFIKIL

SEQ ID NO: 2539318 - protein, 44 aa, Entamoeba dispar
SHKLPHEYLTLEQKLRLMIGEYICLMNPFKFFPSLTEIKSCVWA

SEQ ID NO: 2539319 - protein, 28 aa, Entamoeba dispar
SHKSSQVHWWYYEDKWVQFRQKESIKIE

SEQ ID NO: 2539320 - protein, 28 aa, Entamoeba dispar
SHKSWKKRWFQTTPRNPFRLDYYTNDSC

SEQ ID NO: 2539321 - protein, 19 aa, Entamoeba dispar
SHLIYTKLPCTPLSLTCNE

SEQ ID NO: 2539322 - protein, 17 aa, Entamoeba dispar
SHLLILKEQTRTLNDKN

SEQ ID NO: 2539323 - protein, 29 aa, Entamoeba dispar
SHNKAIHFTSRYMYLTLWGDEISNQTQFK

SEQ ID NO: 2539324 - protein, 17 aa, Entamoeba dispar
SHPFYDLVVKRFKELYT

SEQ ID NO: 2539325 - protein, 29 aa, Entamoeba dispar
SHQKTFFTPFQYKLFPRVMIYFKQVEDSD

SEQ ID NO: 2539326 - protein, 22 aa, Entamoeba dispar
SHQTNFFNLLDSNVQPHSTVSE

SEQ ID NO: 2539327 - protein, 36 aa, Entamoeba dispar
SHSEHFLFVQQSLRLWWNVMRHMSLLWIMNDKDFLS

SEQ ID NO: 2539328 - protein, 28 aa, Entamoeba dispar
SHSNNFEIMFHVAPLLPLLQNDEQALER

SEQ ID NO: 2539329 - protein, 26 aa, Entamoeba dispar
SHTGLNVIDFGIPLLSMHSIREIGGI

SEQ ID NO: 2539330 - protein, 23 aa, Entamoeba dispar
SHTKSLILSLVKRQGRSWRITEV

SEQ ID NO: 2539331 - protein, 24 aa, Entamoeba dispar
SHVFELLFKLLRKKNTLIITPILK

SEQ ID NO: 2539332 - protein, 27 aa, Entamoeba dispar
SHVYDYVVIRKIMIPFPICSLKNWDCS

SEQ ID NO: 2539333 - protein, 18 aa, Entamoeba dispar
SIADIFIEFFNWKEVYDV

SEQ ID NO: 2539334 - protein, 25 aa, Entamoeba dispar
SIAEDRIRFPWYVAGGVYNEKSATG

SEQ ID NO: 2539335 - protein, 32 aa, Entamoeba dispar
SIAFQILKFLPPFYHCVLLLPHLIHYIPKSAA

SEQ ID NO: 2539336 - protein, 24 aa, Entamoeba dispar
SIAIKIVMQLMISHPLHGIMIPNP

SEQ ID NO: 2539337 - protein, 19 aa, Entamoeba dispar
SIALVKPEKARQVGDMILM

SEQ ID NO: 2539338 - protein, 17 aa, Entamoeba dispar
SIANGAVKLATKAKSLF

SEQ ID NO: 2539339 - protein, 27 aa, Entamoeba dispar
SIAPGELWKTLYSNLILFLNHFCESLC

SEQ ID NO: 2539340 - protein, 31 aa, Entamoeba dispar
SIAQPTPLPLFSKQLLLPKQLKALGMNDFIQ

SEQ ID NO: 2539341 - protein, 23 aa, Entamoeba dispar
SIAQVLGIRETDRWYYGGGLYMG

SEQ ID NO: 2539342 - protein, 22 aa, Entamoeba dispar
SIAQYLIYNKHRFYNRNRAERR

SEQ ID NO: 2539343 - protein, 25 aa, Entamoeba dispar
SIATIISPLIQLPLSNDFIKSFKEN

SEQ ID NO: 2539344 - protein, 38 aa, Entamoeba dispar
SIAWNVLPRPLFYKLFRQDLLIASLYRNFFLAQRVMQS

SEQ ID NO: 2539345 - protein, 17 aa, Entamoeba dispar
SICLMSFSNILLSEKKS

SEQ ID NO: 2539346 - protein, 32 aa, Entamoeba dispar
SICNVPLMNNGIIYNAFYSEGYLIVLECNGII

SEQ ID NO: 2539347 - protein, 23 aa, Entamoeba dispar
SIDDIIKKLFPKAKLFITNIHRF

SEQ ID NO: 2539348 - protein, 22 aa, Entamoeba dispar
SIDGIITLKYIPTLNLQTNSTE

SEQ ID NO: 2539349 - protein, 20 aa, Entamoeba dispar
SIDIFILKQNSSFVKYYLKC

SEQ ID NO: 2539350 - protein, 24 aa, Entamoeba dispar
SIDKAKYFISSFILIQIKEIEQKD

SEQ ID NO: 2539351 - protein, 19 aa, Entamoeba dispar
SIDLFIYNPPYVPTPEEEL

SEQ ID NO: 2539352 - protein, 19 aa, Entamoeba dispar
SIDLTPQLFYANGSLINII

SEQ ID NO: 2539353 - protein, 22 aa, Entamoeba dispar
SIDPQISVFWGWKEGGKVKTIK

SEQ ID NO: 2539354 - protein, 17 aa, Entamoeba dispar
SIDQIPSFPFTIIRDRL

SEQ ID NO: 2539355 - protein, 39 aa, Entamoeba dispar
SIDVIASFIKKLLIKSLYSSPSFICSVLGITSDMLIKYP

SEQ ID NO: 2539356 - protein, 20 aa, Entamoeba dispar
SIDVVGKMNLALKGGLVRTN

SEQ ID NO: 2539357 - protein, 35 aa, Entamoeba dispar
SIEDKAMKELYPLFLWILSGLFPQITNVSSVKSFI

SEQ ID NO: 2539358 - protein, 26 aa, Entamoeba dispar
SIEDMRRVLLFPSISSYSIGIKGVKM

SEQ ID NO: 2539359 - protein, 25 aa, Entamoeba dispar
SIEDTYKNLKFFLDFVSQRKTTLIE

SEQ ID NO: 2539360 - protein, 24 aa, Entamoeba dispar
SIEELFIILSPLLNKYYRDESIPY

SEQ ID NO: 2539361 - protein, 25 aa, Entamoeba dispar
SIEGTYFFVNLNHTILQKICLYLTE

SEQ ID NO: 2539362 - protein, 29 aa, Entamoeba dispar
SIEIEMTSPIGILLRSIKFTENTTAIIVG

SEQ ID NO: 2539363 - protein, 18 aa, Entamoeba dispar
SIEIIKEIKVKSPISIIC

SEQ ID NO: 2539364 - protein, 24 aa, Entamoeba dispar
SIEIKLFPSLFFKSSKCVFGGNIT

SEQ ID NO: 2539365 - protein, 22 aa, Entamoeba dispar
SIEIKLFPSLIFKSSKCVFGGN

SEQ ID NO: 2539366 - protein, 24 aa, Entamoeba dispar
SIEIKLFPSLIFKSSKCVFGGNIT

SEQ ID NO: 2539367 - protein, 21 aa, Entamoeba dispar
SIEIPLKDLALQRSISIDLTP

SEQ ID NO: 2539368 - protein, 48 aa, Entamoeba dispar
SIEKTLKGLQESLKSTIILMVYMQSIQNFIPPHLNPVNLFQMNENAEK

SEQ ID NO: 2539369 - protein, 17 aa, Entamoeba dispar
SIEMIPTSKIGIIGAAD

SEQ ID NO: 2539370 - protein, 26 aa, Entamoeba dispar
SIENLKSLLFPFEWCNICIDSLPYSL

SEQ ID NO: 2539371 - protein, 32 aa, Entamoeba dispar
SIEQDIRSILSKYPKFRFGTLTSRISGNQLLV

SEQ ID NO: 2539372 - protein, 24 aa, Entamoeba dispar
SIERQMIMKAFGANLVLSDGTKGM

SEQ ID NO: 2539373 - protein, 29 aa, Entamoeba dispar
SIETIYSNKIILDKFAFCLYEEPSFKEFL

SEQ ID NO: 2539374 - protein, 23 aa, Entamoeba dispar
SIEVFSFLMKLYGNNISFKISDL

SEQ ID NO: 2539375 - protein, 20 aa, Entamoeba dispar
SIEWCHMIGLNYVSCSSYRI

SEQ ID NO: 2539376 - protein, 19 aa, Entamoeba dispar
SIEWVVYHVNFKNGELVED

SEQ ID NO: 2539377 - protein, 17 aa, Entamoeba dispar
SIEYFISIVIIDSDSRR

SEQ ID NO: 2539378 - protein, 17 aa, Entamoeba dispar
SIEYLIGRSLMNAICNL

SEQ ID NO: 2539379 - protein, 20 aa, Entamoeba dispar
SIFCMSLLRKVSFTGVKQIP

SEQ ID NO: 2539380 - protein, 21 aa, Entamoeba dispar
SIFGGFTFKAPIEPKKYVVDP

SEQ ID NO: 2539381 - protein, 18 aa, Entamoeba dispar
SIFKFDFSSLFGSYPPAL

SEQ ID NO: 2539382 - protein, 18 aa, Entamoeba dispar
SIFKIQIIIDVDPVFTRL

SEQ ID NO: 2539383 - protein, 25 aa, Entamoeba dispar
SIFKKGIWMNLIEKGFMTFQSIEDG

SEQ ID NO: 2539384 - protein, 27 aa, Entamoeba dispar
SIFKLELPQIISFTINCSILAISTSTQ

SEQ ID NO: 2539385 - protein, 19 aa, Entamoeba dispar
SIFKLTNHLYIIFSMNGES

SEQ ID NO: 2539386 - protein, 17 aa, Entamoeba dispar
SIFNLFLNDSLGAFCRM

SEQ ID NO: 2539387 - protein, 27 aa, Entamoeba dispar
SIFVEFSHFFKVYKLIVGNSEAVLAVL

SEQ ID NO: 2539388 - protein, 25 aa, Entamoeba dispar
SIGQDPLLLIRIFHNESYDKNPVLS

SEQ ID NO: 2539389 - protein, 24 aa, Entamoeba dispar
SIGRQCFINCFDLESILLPSSVSS

SEQ ID NO: 2539390 - protein, 20 aa, Entamoeba dispar
SIHCYYVFEQAIFSIIELPW

SEQ ID NO: 2539391 - protein, 27 aa, Entamoeba dispar
SIHDIINTKYLSSDFYFIGCVLEKGDE

SEQ ID NO: 2539392 - protein, 22 aa, Entamoeba dispar
SIHHIVWAILYESSVQLPAALS

SEQ ID NO: 2539393 - protein, 29 aa, Entamoeba dispar
SIHILKEKLPLLEYLFKEKYGRELVGTKM

SEQ ID NO: 2539394 - protein, 22 aa, Entamoeba dispar
SIHKGRIMYYSAFDGYCGITTR

SEQ ID NO: 2539395 - protein, 19 aa, Entamoeba dispar
SIHLIPKPLQAIYNLPEFK

SEQ ID NO: 2539396 - protein, 18 aa, Entamoeba dispar
SIHRLRLTKRFLGEDGNR

SEQ ID NO: 2539397 - protein, 30 aa, Entamoeba dispar
SIHSISNLLKYFFRSLPHGLIPQINMYKMV

SEQ ID NO: 2539398 - protein, 37 aa, Entamoeba dispar
SIHYLGFIDLVHKLLPIFIKNTSLSLFVSFLSDIANI

SEQ ID NO: 2539399 - protein, 20 aa, Entamoeba dispar
SIICCDTIILTQYNNQIKVN

SEQ ID NO: 2539400 - protein, 17 aa, Entamoeba dispar
SIIDIDLDFPYYSHYFK

SEQ ID NO: 2539401 - protein, 26 aa, Entamoeba dispar
SIIDIKIEFGWFYLNVLSTSPIHQIS

SEQ ID NO: 2539402 - protein, 23 aa, Entamoeba dispar
SIIDLLPCFAKYSQVIALNDSDE

SEQ ID NO: 2539403 - protein, 21 aa, Entamoeba dispar
SIIELKSINNLKKLKLHGVNE

SEQ ID NO: 2539404 - protein, 19 aa, Entamoeba dispar
SIIHTPPPLMKSAPIISID

SEQ ID NO: 2539405 - protein, 18 aa, Entamoeba dispar
SIIIPQDISKIRLLGTAY

SEQ ID NO: 2539406 - protein, 20 aa, Entamoeba dispar
SIIIPTTVSRIGKWCFYECR

SEQ ID NO: 2539407 - protein, 21 aa, Entamoeba dispar
SIIKICQMYLPKTIHVRPFTI

SEQ ID NO: 2539408 - protein, 26 aa, Entamoeba dispar
SIIKRTILSDVFWLKSTNYPGRIWVH

SEQ ID NO: 2539409 - protein, 31 aa, Entamoeba dispar
SIIKYSLDDYIWYNFILYQHNIQKIKEFEDS

SEQ ID NO: 2539410 - protein, 21 aa, Entamoeba dispar
SIILFDEEVFTFLFHSFYLEF

SEQ ID NO: 2539411 - protein, 17 aa, Entamoeba dispar
SIILPTTLCSLPHLCFY

SEQ ID NO: 2539412 - protein, 21 aa, Entamoeba dispar
SIINFIDIPINLTLNIHQIIC

SEQ ID NO: 2539413 - protein, 24 aa, Entamoeba dispar
SIIQIANSLFFVSINQPDKNSQVL

SEQ ID NO: 2539414 - protein, 17 aa, Entamoeba dispar
SIIQMPQLVFKQPIQQT

SEQ ID NO: 2539415 - protein, 24 aa, Entamoeba dispar
SIIRIYQPIPYSTFYPRLLEEAEQ

SEQ ID NO: 2539416 - protein, 23 aa, Entamoeba dispar
SIIRRRDFGLEYTAQVWGGMLGE

SEQ ID NO: 2539417 - protein, 19 aa, Entamoeba dispar
SIISLIKDIPEFGALLIYS

SEQ ID NO: 2539418 - protein, 26 aa, Entamoeba dispar
SIISNRLINYLKAKKFPFVKIEKQEE

SEQ ID NO: 2539419 - protein, 25 aa, Entamoeba dispar
SIISTDFVYLIQPIVAHIFEEKTEL

SEQ ID NO: 2539420 - protein, 29 aa, Entamoeba dispar
SIITHLSYFRIPLPDILHWMNIDISSSGK

SEQ ID NO: 2539421 - protein, 32 aa, Entamoeba dispar
SIKDEFKQYLPTIIPILLSELTKIKYSKKEDD

SEQ ID NO: 2539422 - protein, 23 aa, Entamoeba dispar
SIKEGYWFLLEDIDTAPPDVISL

SEQ ID NO: 2539423 - protein, 18 aa, Entamoeba dispar
SIKIINKKKLEKKLLVLC

SEQ ID NO: 2539424 - protein, 25 aa, Entamoeba dispar
SIKKFGYINYFGLQRFGSCGTTHLI

SEQ ID NO: 2539425 - protein, 20 aa, Entamoeba dispar
SIKLFCQVLRCLSYLHSKGI

SEQ ID NO: 2539426 - protein, 25 aa, Entamoeba dispar
SIKNHVLFILVYDYCFRHLQEVERA

SEQ ID NO: 2539427 - protein, 18 aa, Entamoeba dispar
SIKNQLLGILYRMGVKQQ

SEQ ID NO: 2539428 - protein, 23 aa, Entamoeba dispar
SIKNYIIMAKKKKFLGIDLKELC

SEQ ID NO: 2539429 - protein, 17 aa, Entamoeba dispar
SIKPKIYASATGGSNVS

SEQ ID NO: 2539430 - protein, 26 aa, Entamoeba dispar
SIKRVSFIPLKLFIETPRTSSLRRKF

SEQ ID NO: 2539431 - protein, 25 aa, Entamoeba dispar
SIKTINYHILLPTFFGKFDGVKANE

SEQ ID NO: 2539432 - protein, 23 aa, Entamoeba dispar
SIKYLKEPFGWTTYVYQIQTETG

SEQ ID NO: 2539433 - protein, 28 aa, Entamoeba dispar
SIKYLLTIQWCKPFFDNPTLKYIESNKT

SEQ ID NO: 2539434 - protein, 23 aa, Entamoeba dispar
SILIPGCGLARLPYELQKRGNKC

SEQ ID NO: 2539435 - protein, 32 aa, Entamoeba dispar
SILKNMCELYKLLYTIPQFQKVFELHTNAPLL

SEQ ID NO: 2539436 - protein, 28 aa, Entamoeba dispar
SILLDGPMIIEMVRLLQITPVEEFIPDD

SEQ ID NO: 2539437 - protein, 20 aa, Entamoeba dispar
SILLIDNIDLLPNDCYIILH

SEQ ID NO: 2539438 - protein, 20 aa, Entamoeba dispar
SILLIPKVNYVLPNGYTIIL

SEQ ID NO: 2539439 - protein, 17 aa, Entamoeba dispar
SILLQWCHANKFCIIYN

SEQ ID NO: 2539440 - protein, 21 aa, Entamoeba dispar
SILPCWESFESSRLQVICISI

SEQ ID NO: 2539441 - protein, 25 aa, Entamoeba dispar
SILRLPQMYNLCNYYIGFNAWSTEI

SEQ ID NO: 2539442 - protein, 20 aa, Entamoeba dispar
SILSILQFHFDEQLSFYIQS

SEQ ID NO: 2539443 - protein, 26 aa, Entamoeba dispar
SILSRSIMNWDLKGMFYLINNNDYEY

SEQ ID NO: 2539444 - protein, 18 aa, Entamoeba dispar
SILSSLHLPPHFPNPLIL

SEQ ID NO: 2539445 - protein, 28 aa, Entamoeba dispar
SILTQEITFPCIYGMAARRTIPNGFYQN

SEQ ID NO: 2539446 - protein, 17 aa, Entamoeba dispar
SILTYDCPCAIILTCDK

SEQ ID NO: 2539447 - protein, 18 aa, Entamoeba dispar
SILVLFNQKNEITIDEIF

SEQ ID NO: 2539448 - protein, 18 aa, Entamoeba dispar
SIMEKVYLYIQLNKNEKT

SEQ ID NO: 2539449 - protein, 22 aa, Entamoeba dispar
SIMNACCFSPFTPNLLATGHEK

SEQ ID NO: 2539450 - protein, 18 aa, Entamoeba dispar
SIMNTYPSLFLSHIYCND

SEQ ID NO: 2539451 - protein, 26 aa, Entamoeba dispar
SINFERVHVLFNAGLITFRNATSLAS

SEQ ID NO: 2539452 - protein, 21 aa, Entamoeba dispar
SINGLGNWYFKGCTSLTRIDI

SEQ ID NO: 2539453 - protein, 38 aa, Entamoeba dispar
SINIKDVKYICHHKIFLNEPILLSFEIPQNLKKVNGQN

SEQ ID NO: 2539454 - protein, 25 aa, Entamoeba dispar
SINIKIREWLGLSPTTTLYSRIAVT

SEQ ID NO: 2539455 - protein, 25 aa, Entamoeba dispar
SINIPPTIINLRSGCFRYCSSLTTI

SEQ ID NO: 2539456 - protein, 28 aa, Entamoeba dispar
SINKNCLWYLIDFLHLVSINKAINLMSP

SEQ ID NO: 2539457 - protein, 18 aa, Entamoeba dispar
SINKPTIIFIPFTIPDEF

SEQ ID NO: 2539458 - protein, 23 aa, Entamoeba dispar
SINKTILLLPKTKSNQLFLERFL

SEQ ID NO: 2539459 - protein, 20 aa, Entamoeba dispar
SINMMIFNATLIIFRNISIQ

SEQ ID NO: 2539460 - protein, 17 aa, Entamoeba dispar
SINNLKKLKLHGVNEIK

SEQ ID NO: 2539461 - protein, 21 aa, Entamoeba dispar
SINPINITNMIWKIPGNNRCA

SEQ ID NO: 2539462 - protein, 20 aa, Entamoeba dispar
SINPLTYPLVETLNSYLSLP

SEQ ID NO: 2539463 - protein, 19 aa, Entamoeba dispar
SINSILPYGYHLPKRANVI

SEQ ID NO: 2539464 - protein, 32 aa, Entamoeba dispar
SIPEGRKFQIPLWLAITLQNYGYVRIIVNEEF

SEQ ID NO: 2539465 - protein, 28 aa, Entamoeba dispar
SIPESKEFIPFIPFSLHSTLSIANSKVI

SEQ ID NO: 2539466 - protein, 18 aa, Entamoeba dispar
SIPIAPLTFKELYLVNLS

SEQ ID NO: 2539467 - protein, 25 aa, Entamoeba dispar
SIPIIQPKRVLLQPSFKDFVQTNPE

SEQ ID NO: 2539468 - protein, 21 aa, Entamoeba dispar
SIPKIITGELYHWMKQRNKMI

SEQ ID NO: 2539469 - protein, 17 aa, Entamoeba dispar
SIPKQETSLLFGIAFDR

SEQ ID NO: 2539470 - protein, 18 aa, Entamoeba dispar
SIPKVMVCVLYPQINKID

SEQ ID NO: 2539471 - protein, 17 aa, Entamoeba dispar
SIPMVYVKTIGVDFLMV

SEQ ID NO: 2539472 - protein, 18 aa, Entamoeba dispar
SIPPPQIVPPPPITTPTI

SEQ ID NO: 2539473 - protein, 21 aa, Entamoeba dispar
SIPPPVSFQLQPSSIPPVAIP

SEQ ID NO: 2539474 - protein, 18 aa, Entamoeba dispar
SIPQLPGKLILPSSLTSL

SEQ ID NO: 2539475 - protein, 18 aa, Entamoeba dispar
SIPSEWKLNLRKAGIHKK

SEQ ID NO: 2539476 - protein, 30 aa, Entamoeba dispar
SIQINNSILYLFYQLKHWSIQPTNLNAKTL

SEQ ID NO: 2539477 - protein, 17 aa, Entamoeba dispar
SIQLLKQKLSEFEKIDY

SEQ ID NO: 2539478 - protein, 23 aa, Entamoeba dispar
SIQNYDIGILKLLIQKNINDWDN

SEQ ID NO: 2539479 - protein, 23 aa, Entamoeba dispar
SIQNYMNQLKKLRSKRRTQSWSP

SEQ ID NO: 2539480 - protein, 24 aa, Entamoeba dispar
SIQPNLYNNFIKPCSLTPSQIFNS

SEQ ID NO: 2539481 - protein, 26 aa, Entamoeba dispar
SIQPQPIIKNKYDILAQIQLEQQQQP

SEQ ID NO: 2539482 - protein, 18 aa, Entamoeba dispar
SIQQEELPWPNYIQTLFS

SEQ ID NO: 2539483 - protein, 38 aa, Entamoeba dispar
SIRINIYLDIPIVTEEFIKLIYYFGLDPSTLKRNSVIL

SEQ ID NO: 2539484 - protein, 25 aa, Entamoeba dispar
SIRKFSTIYLFNFPETDLSPFIHKL

SEQ ID NO: 2539485 - protein, 27 aa, Entamoeba dispar
SIRLRNYSLKPWLFFNSTNYINDEQLI

SEQ ID NO: 2539486 - protein, 19 aa, Entamoeba dispar
SIRNKLSCFIKADQNLFKV

SEQ ID NO: 2539487 - protein, 21 aa, Entamoeba dispar
SIRNWILEGLLGHYSSHEKYQ

SEQ ID NO: 2539488 - protein, 17 aa, Entamoeba dispar
SIRPSLQPPLRQSLSII

SEQ ID NO: 2539489 - protein, 25 aa, Entamoeba dispar
SIRSLYRIFLLSDHDSQSIIKSALS

SEQ ID NO: 2539490 - protein, 17 aa, Entamoeba dispar
SIRTSVWSNFYNPENFI

SEQ ID NO: 2539491 - protein, 21 aa, Entamoeba dispar
SIRTTFWDEVNPMKFHIITST

SEQ ID NO: 2539492 - protein, 21 aa, Entamoeba dispar
SIRYDIFLRHKYQLKHMLYIK

SEQ ID NO: 2539493 - protein, 23 aa, Entamoeba dispar
SISEEIFNILKYSSKFYIQLQLY

SEQ ID NO: 2539494 - protein, 21 aa, Entamoeba dispar
SISFKINIINKFLLEPISQGR

SEQ ID NO: 2539495 - protein, 34 aa, Entamoeba dispar
SISFRYDWRTLLAVIRMHLPPIEYFVGDQVKTFQ

SEQ ID NO: 2539496 - protein, 21 aa, Entamoeba dispar
SISPFPPYLDSGVYRMDLKFR

SEQ ID NO: 2539497 - protein, 22 aa, Entamoeba dispar
SISSLPLTLYLSPIISPRDSLC

SEQ ID NO: 2539498 - protein, 27 aa, Entamoeba dispar
SITACGALFYCSYLPSGIKRSKQTFKE

SEQ ID NO: 2539499 - protein, 23 aa, Entamoeba dispar
SITALVRIQIKPTEQFWTQISDT

SEQ ID NO: 2539500 - protein, 24 aa, Entamoeba dispar
SITALVRIQIKPTEQFWTQISDTQ

SEQ ID NO: 2539501 - protein, 17 aa, Entamoeba dispar
SITFINNHKKWVKLIKS

SEQ ID NO: 2539502 - protein, 30 aa, Entamoeba dispar
SITINILRVLKKWPIIATYYINETSIILLQ

SEQ ID NO: 2539503 - protein, 25 aa, Entamoeba dispar
SITKIGDWCFSYFLSLKSTNIPSSI

SEQ ID NO: 2539504 - protein, 19 aa, Entamoeba dispar
SITLKRIPFFTSNTIISDN

SEQ ID NO: 2539505 - protein, 28 aa, Entamoeba dispar
SITLSSSWPFLIMWKGSDSEAYIQLQRS

SEQ ID NO: 2539506 - protein, 25 aa, Entamoeba dispar
SITPKQFIRVFNPSLSKPFIPELST

SEQ ID NO: 2539507 - protein, 21 aa, Entamoeba dispar
SITSFGWGCFYKCGCEKELKK

SEQ ID NO: 2539508 - protein, 32 aa, Entamoeba dispar
SITSFGYKCFYRCLSLTLINIPSSINKIGDGC

SEQ ID NO: 2539509 - protein, 27 aa, Entamoeba dispar
SITSFGYKCFYRCLSLTLITIPSSINE

SEQ ID NO: 2539510 - protein, 27 aa, Entamoeba dispar
SITSFRAYFALSLHYGIRYLEKEKFTN

SEQ ID NO: 2539511 - protein, 25 aa, Entamoeba dispar
SITSKYLEEFILKDTQRIIDDLIHC

SEQ ID NO: 2539512 - protein, 24 aa, Entamoeba dispar
SITTINIPSSIISFGRGCFYKCGC

SEQ ID NO: 2539513 - protein, 26 aa, Entamoeba dispar
SITYDIYNLIRYINLNHLKNIHLIYY

SEQ ID NO: 2539514 - protein, 17 aa, Entamoeba dispar
SITYLLHLFKTVNSISS

SEQ ID NO: 2539515 - protein, 17 aa, Entamoeba dispar
SIVDILIHYSDDEALYM

SEQ ID NO: 2539516 - protein, 19 aa, Entamoeba dispar
SIVGTPYWMAPEVIRNKLY

SEQ ID NO: 2539517 - protein, 33 aa, Entamoeba dispar
SIVHKWRVQGYFYDFVGYVLFPVKQINGKKYVS

SEQ ID NO: 2539518 - protein, 29 aa, Entamoeba dispar
SIVKGWLQKELFCDVFGWVVQKIFIELKT

SEQ ID NO: 2539519 - protein, 19 aa, Entamoeba dispar
SIVLAKEFLMKMSYSFDTQ

SEQ ID NO: 2539520 - protein, 41 aa, Entamoeba dispar
SIVNAPRVYFSLKKDIYWWIVDHWYCFGSLQQFKTSPSKWK

SEQ ID NO: 2539521 - protein, 25 aa, Entamoeba dispar
SIVSHKIFEMYCMKSNMLELLRIIK

SEQ ID NO: 2539522 - protein, 19 aa, Entamoeba dispar
SIVYQILQGLAFCHYHQIL

SEQ ID NO: 2539523 - protein, 26 aa, Entamoeba dispar
SIYGKIKTFYIFLPKHPFWSHDGKKS

SEQ ID NO: 2539524 - protein, 17 aa, Entamoeba dispar
SIYLFKRDMASKFVIEK

SEQ ID NO: 2539525 - protein, 17 aa, Entamoeba dispar
SIYNIKRTKRTPPIKII

SEQ ID NO: 2539526 - protein, 27 aa, Entamoeba dispar
SIYNQLRRMIALTYIPSFLASVSIPDE

SEQ ID NO: 2539527 - protein, 20 aa, Entamoeba dispar
SIYRYIFIHHKLSIKEYDLI

SEQ ID NO: 2539528 - protein, 23 aa, Entamoeba dispar
SIYSQWIEKILSPYDDVDMIVSG

SEQ ID NO: 2539529 - protein, 19 aa, Entamoeba dispar
SIYYIKRTKRTPPIKIIDT

SEQ ID NO: 2539530 - protein, 25 aa, Entamoeba dispar
SKAHNISVVKLYYAFQDDINLYLVM

SEQ ID NO: 2539531 - protein, 30 aa, Entamoeba dispar
SKALVFCGCFPRRHFDNFIKVCPINAQESP

SEQ ID NO: 2539532 - protein, 32 aa, Entamoeba dispar
SKAPKEIVFKVKYKLVLQIVQQFYKEGKSIEI

SEQ ID NO: 2539533 - protein, 25 aa, Entamoeba dispar
SKASIKIYLEYFGFNVIFKENIIDY

SEQ ID NO: 2539534 - protein, 27 aa, Entamoeba dispar
SKCYTRLFEIINLKFHKAWETSLNQNC

SEQ ID NO: 2539535 - protein, 21 aa, Entamoeba dispar
SKDCIFSLIIPEIDKPWYLKF

SEQ ID NO: 2539536 - protein, 22 aa, Entamoeba dispar
SKDFDIIFILHDDSNKEVTDKI

SEQ ID NO: 2539537 - protein, 22 aa, Entamoeba dispar
SKDILTTEPFIDRKTIELHQID

SEQ ID NO: 2539538 - protein, 24 aa, Entamoeba dispar
SKDLCLIFYCNNCIFGSFHSIIPF

SEQ ID NO: 2539539 - protein, 29 aa, Entamoeba dispar
SKDLIIGSHNFFVLKHGMCKITNPDQAYT

SEQ ID NO: 2539540 - protein, 32 aa, Entamoeba dispar
SKDPQGLLIFYNFINDLICLITTLTKSHFNIH

SEQ ID NO: 2539541 - protein, 28 aa, Entamoeba dispar
SKEAQINNGLLYLLRTLGYSFDIKQTKK

SEQ ID NO: 2539542 - protein, 26 aa, Entamoeba dispar
SKEAWKNIILAYEPVWAIGTGKTATP

SEQ ID NO: 2539543 - protein, 33 aa, Entamoeba dispar
SKECIFSTIIPYIDEPWYLKFNNSAIYDDNTED

SEQ ID NO: 2539544 - protein, 25 aa, Entamoeba dispar
SKECYVVVLLYKNGIEGCDILSARL

SEQ ID NO: 2539545 - protein, 27 aa, Entamoeba dispar
SKEEFLEYPIFDEYQFNCINDHISSQV

SEQ ID NO: 2539546 - protein, 23 aa, Entamoeba dispar
SKEIMEHIIRWMNYHNEHPHMYN

SEQ ID NO: 2539547 - protein, 45 aa, Entamoeba dispar
SKEKEVHHLISSIPSIWKCLYKQKFEKLRLDCYFDDLCQWTKLNA

SEQ ID NO: 2539548 - protein, 24 aa, Entamoeba dispar
SKEKFLEYPIFDEYQFNCINDHIS

SEQ ID NO: 2539549 - protein, 20 aa, Entamoeba dispar
SKEKPIGLAIFYYQRRKVKE

SEQ ID NO: 2539550 - protein, 25 aa, Entamoeba dispar
SKEKYQIPYSIKIIGSSKFSFKGIL

SEQ ID NO: 2539551 - protein, 26 aa, Entamoeba dispar
SKELFMKGVILYTDSKGLIIVEGTQK

SEQ ID NO: 2539552 - protein, 24 aa, Entamoeba dispar
SKELQIILFRIFGGKDSYLPPKVV

SEQ ID NO: 2539553 - protein, 23 aa, Entamoeba dispar
SKENLLFLCSCLPCISLGMNCKL

SEQ ID NO: 2539554 - protein, 27 aa, Entamoeba dispar
SKENPPYFYYMYYTYANIASLNYYRKQ

SEQ ID NO: 2539555 - protein, 26 aa, Entamoeba dispar
SKERAVYIRIVFQQTFTSLEVKKVEG

SEQ ID NO: 2539556 - protein, 24 aa, Entamoeba dispar
SKERLRFIKVVQSLAPRHKGKANT

SEQ ID NO: 2539557 - protein, 31 aa, Entamoeba dispar
SKESWINNGLLYLLKMYGYNFNIRQTKKAKL

SEQ ID NO: 2539558 - protein, 25 aa, Entamoeba dispar
SKETFVVALGYYKIKLYYDATKDKA

SEQ ID NO: 2539559 - protein, 25 aa, Entamoeba dispar
SKETLYIILLLIKNQILNNSLITKI

SEQ ID NO: 2539560 - protein, 19 aa, Entamoeba dispar
SKEVFTPRLFKTPRLNSTE

SEQ ID NO: 2539561 - protein, 23 aa, Entamoeba dispar
SKEWEPFRKQIFMEYPMIEERYK

SEQ ID NO: 2539562 - protein, 25 aa, Entamoeba dispar
SKEWKKTQKLLGRTNQLIGTINKIE

SEQ ID NO: 2539563 - protein, 25 aa, Entamoeba dispar
SKEWKVDTLILKKYPALVDEILSTP

SEQ ID NO: 2539564 - protein, 17 aa, Entamoeba dispar
SKFFIKLSNKLPNPLFK

SEQ ID NO: 2539565 - protein, 21 aa, Entamoeba dispar
SKFFKGLPQFPEIDFYECYKL

SEQ ID NO: 2539566 - protein, 19 aa, Entamoeba dispar
SKFGYLYHNVESSYKDVVG

SEQ ID NO: 2539567 - protein, 20 aa, Entamoeba dispar
SKFLKYQNYEYGFTITEPLY

SEQ ID NO: 2539568 - protein, 21 aa, Entamoeba dispar
SKFMNIIRKDWRDSIFFFGSN

SEQ ID NO: 2539569 - protein, 42 aa, Entamoeba dispar
SKGHYVPSFLIQPIQRIPRYVLLLESLIKCLPEYLDEAKKIK

SEQ ID NO: 2539570 - protein, 18 aa, Entamoeba dispar
SKGIINCIGLLPPSIHKI

SEQ ID NO: 2539571 - protein, 23 aa, Entamoeba dispar
SKGKKYFLMFDNNEVLLIDEEMN

SEQ ID NO: 2539572 - protein, 23 aa, Entamoeba dispar
SKGRFIIRKVSNINLLSPSENEL

SEQ ID NO: 2539573 - protein, 23 aa, Entamoeba dispar
SKGRTTIIIAHRLSTIQNADKIC

SEQ ID NO: 2539574 - protein, 24 aa, Entamoeba dispar
SKGRTTIIIAHRLSTIQNADKICV

SEQ ID NO: 2539575 - protein, 21 aa, Entamoeba dispar
SKGTNDFYYAFIEYDRPEDAA

SEQ ID NO: 2539576 - protein, 28 aa, Entamoeba dispar
SKGYGSFWCGFMKVLLKDPYAMEYIGLK

SEQ ID NO: 2539577 - protein, 23 aa, Entamoeba dispar
SKHQNICMLFKEESQRKEWKTSL

SEQ ID NO: 2539578 - protein, 22 aa, Entamoeba dispar
SKHSPITSNPFFKVLRKEYLKA

SEQ ID NO: 2539579 - protein, 26 aa, Entamoeba dispar
SKHVNDLCEDKWYGSAPYMAPEVVFK

SEQ ID NO: 2539580 - protein, 22 aa, Entamoeba dispar
SKIADRLGIPYLTKTLNEILMQ

SEQ ID NO: 2539581 - protein, 24 aa, Entamoeba dispar
SKIEPSELLKYQRKAQEWIMKGSN

SEQ ID NO: 2539582 - protein, 19 aa, Entamoeba dispar
SKIFQNYYLRVCHATVSLI

SEQ ID NO: 2539583 - protein, 19 aa, Entamoeba dispar
SKIFSFFIHKLCKHQQLTF

SEQ ID NO: 2539584 - protein, 19 aa, Entamoeba dispar
SKIHLPMTLKKLGIGCFGY

SEQ ID NO: 2539585 - protein, 22 aa, Entamoeba dispar
SKIIELLQTLPDETLFIVLQVI

SEQ ID NO: 2539586 - protein, 25 aa, Entamoeba dispar
SKIKEGYLNLVKKLNGLVIEYNKKT

SEQ ID NO: 2539587 - protein, 26 aa, Entamoeba dispar
SKIKGKYCFISFYNGVTIVCYRMNVS

SEQ ID NO: 2539588 - protein, 26 aa, Entamoeba dispar
SKIKKKLFLTFVHHINQFFDNYGDAS

SEQ ID NO: 2539589 - protein, 23 aa, Entamoeba dispar
SKILQMLELYFTGCIVSLGEMEE

SEQ ID NO: 2539590 - protein, 26 aa, Entamoeba dispar
SKILSKYHYNPIKSFLLFKEVTTQFL

SEQ ID NO: 2539591 - protein, 25 aa, Entamoeba dispar
SKINLKDSLLYYLKMEHSIISSFLY

SEQ ID NO: 2539592 - protein, 40 aa, Entamoeba dispar
SKINQIIKFAIPDEYRHLFFYLISFLKKLIEMGEDKTILI

SEQ ID NO: 2539593 - protein, 21 aa, Entamoeba dispar
SKIRDLFQSASQRAPALLFID

SEQ ID NO: 2539594 - protein, 18 aa, Entamoeba dispar
SKISKGYAFIYFSSLNEA

SEQ ID NO: 2539595 - protein, 25 aa, Entamoeba dispar
SKISPDLRWIWRTNTFEMKATTLKS

SEQ ID NO: 2539596 - protein, 26 aa, Entamoeba dispar
SKISRESLDLLKLRYGKELTQDDIQL

SEQ ID NO: 2539597 - protein, 21 aa, Entamoeba dispar
SKKDEFLPALIKLAKETTGDE

SEQ ID NO: 2539598 - protein, 24 aa, Entamoeba dispar
SKKDNLLYKVGITASAAGFFGCQG

SEQ ID NO: 2539599 - protein, 23 aa, Entamoeba dispar
SKKDQFFEMLNSRPFTLIEEALE

SEQ ID NO: 2539600 - protein, 20 aa, Entamoeba dispar
SKKGFLYVSLHCKKGVTSSL

SEQ ID NO: 2539601 - protein, 22 aa, Entamoeba dispar
SKKIVSLIQVYPPFVTMKWEEV

SEQ ID NO: 2539602 - protein, 23 aa, Entamoeba dispar
SKKKIKMDFSSYTFIKSIKSTNS

SEQ ID NO: 2539603 - protein, 23 aa, Entamoeba dispar
SKKLRDIIPCDGTIIYYSHDPSV

SEQ ID NO: 2539604 - protein, 17 aa, Entamoeba dispar
SKKMAIGDGIKRAFRLF

SEQ ID NO: 2539605 - protein, 29 aa, Entamoeba dispar
SKKPEEYFRFLWELRLVFNSNLTQLEEVT

SEQ ID NO: 2539606 - protein, 24 aa, Entamoeba dispar
SKKREEIVFLTNRLSYFHENIQVA

SEQ ID NO: 2539607 - protein, 49 aa, Entamoeba dispar
SKKSSVADRMKYLAHARKAIKDKNFAMARDDLQKLKKLLTDALDDPELD

SEQ ID NO: 2539608 - protein, 22 aa, Entamoeba dispar
SKKTFPLLTIKFVHRCTPDGNQ

SEQ ID NO: 2539609 - protein, 17 aa, Entamoeba dispar
SKKVGIVIFLKDIIEMS

SEQ ID NO: 2539610 - protein, 18 aa, Entamoeba dispar
SKLELKRFNTQPIDVSSI

SEQ ID NO: 2539611 - protein, 27 aa, Entamoeba dispar
SKLERYKLFEIPFFLNQPSANKYKNLN

SEQ ID NO: 2539612 - protein, 21 aa, Entamoeba dispar
SKLGITLNLFYLCELKENTQI

SEQ ID NO: 2539613 - protein, 24 aa, Entamoeba dispar
SKLGKCFYYCLSLKSINIPTSISE

SEQ ID NO: 2539614 - protein, 28 aa, Entamoeba dispar
SKLGTHFQTIFLPTLQLITRPQTNDLLK

SEQ ID NO: 2539615 - protein, 19 aa, Entamoeba dispar
SKLKYKSKAWIFRKKERQR

SEQ ID NO: 2539616 - protein, 26 aa, Entamoeba dispar
SKLNEELMQIKKEKEITLDELNQIKN

SEQ ID NO: 2539617 - protein, 26 aa, Entamoeba dispar
SKLNKTISPIPLPPSIHGKSVLEQMK

SEQ ID NO: 2539618 - protein, 25 aa, Entamoeba dispar
SKLNPVNVFFFSDALNQIIHETPLS

SEQ ID NO: 2539619 - protein, 27 aa, Entamoeba dispar
SKLPFKPTLVFLPIVLNHLIHSKLQQI

SEQ ID NO: 2539620 - protein, 22 aa, Entamoeba dispar
SKLRYCPIGVCRFISFERLEEM

SEQ ID NO: 2539621 - protein, 20 aa, Entamoeba dispar
SKLTMYKTLQMISNEQLNQP

SEQ ID NO: 2539622 - protein, 25 aa, Entamoeba dispar
SKLTSFYCFGLNCKVLKLNNSKNNI

SEQ ID NO: 2539623 - protein, 23 aa, Entamoeba dispar
SKMSLLYSRLDIVKKIIILGDYF

SEQ ID NO: 2539624 - protein, 26 aa, Entamoeba dispar
SKMYEALFVLLHHSILKYSNEEPVII

SEQ ID NO: 2539625 - protein, 25 aa, Entamoeba dispar
SKNDIIQFCINLRLLLRLTDSKAKP

SEQ ID NO: 2539626 - protein, 20 aa, Entamoeba dispar
SKNERLLRRTVKQNETKEQP

SEQ ID NO: 2539627 - protein, 32 aa, Entamoeba dispar
SKNEYSLCIDFIRFCILSFTSLFPQDIDPVVT

SEQ ID NO: 2539628 - protein, 17 aa, Entamoeba dispar
SKNITYGWWDLNRSDCW

SEQ ID NO: 2539629 - protein, 23 aa, Entamoeba dispar
SKNLIDYHIVLDLLPSIAQAVSH

SEQ ID NO: 2539630 - protein, 24 aa, Entamoeba dispar
SKNNKFYIKVFSIILEQMQDLLAG

SEQ ID NO: 2539631 - protein, 27 aa, Entamoeba dispar
SKNPHKHNIIAYKKLGFKVVLCGHLDT

SEQ ID NO: 2539632 - protein, 28 aa, Entamoeba dispar
SKNTMKLYFKYLHLEKWFSIDQIILYDK

SEQ ID NO: 2539633 - protein, 28 aa, Entamoeba dispar
SKNTQIKIFNLYETVPFDIGFEVSGKRL

SEQ ID NO: 2539634 - protein, 27 aa, Entamoeba dispar
SKNVIHLLTKFLIKCSSYIPSHFKTIL

SEQ ID NO: 2539635 - protein, 31 aa, Entamoeba dispar
SKNYSPFRLKDTLRFILMNKIKDWKCELESP

SEQ ID NO: 2539636 - protein, 30 aa, Entamoeba dispar
SKPEFWQHLCIILTNCYYYIPEKVIEKKIS

SEQ ID NO: 2539637 - protein, 30 aa, Entamoeba dispar
SKPIEMELIQFIKLIIEYFSKEIDFPSIKK

SEQ ID NO: 2539638 - protein, 18 aa, Entamoeba dispar
SKPISIPINISFLNTKTG

SEQ ID NO: 2539639 - protein, 18 aa, Entamoeba dispar
SKPLILILGSMPGTESLK

SEQ ID NO: 2539640 - protein, 17 aa, Entamoeba dispar
SKPLYAYYSFFEDGFIN

SEQ ID NO: 2539641 - protein, 24 aa, Entamoeba dispar
SKPSKYYFIQYSDEFDIVKNIFIT

SEQ ID NO: 2539642 - protein, 20 aa, Entamoeba dispar
SKQIAFLCHVSYLALNGDYS

SEQ ID NO: 2539643 - protein, 21 aa, Entamoeba dispar
SKQVILKLEPFNTLIHSQQIE

SEQ ID NO: 2539644 - protein, 27 aa, Entamoeba dispar
SKRFKKGFLIYYYREMIYSKRNRLLKQ

SEQ ID NO: 2539645 - protein, 23 aa, Entamoeba dispar
SKRGYLYVSLYCKKGISVSTLHP

SEQ ID NO: 2539646 - protein, 20 aa, Entamoeba dispar
SKRLFPAHLREIIKNIFFKV

SEQ ID NO: 2539647 - protein, 25 aa, Entamoeba dispar
SKRTSYIITFLFYNKEIIKRINNKT

SEQ ID NO: 2539648 - protein, 26 aa, Entamoeba dispar
SKRTSYIITFLFYNKEIIKRINNKTK

SEQ ID NO: 2539649 - protein, 27 aa, Entamoeba dispar
SKRYINGRFLPDKAIDLVDEACATLFT

SEQ ID NO: 2539650 - protein, 28 aa, Entamoeba dispar
SKSDVWSFGILIFKLLTGFCPFELIQMD

SEQ ID NO: 2539651 - protein, 25 aa, Entamoeba dispar
SKSELDIMSLFMNSSKNKQVMMFSA

SEQ ID NO: 2539652 - protein, 22 aa, Entamoeba dispar
SKSGWRYPIPIYRGIEYLQKNK

SEQ ID NO: 2539653 - protein, 23 aa, Entamoeba dispar
SKSHVTFYIMTEQNIYCIYFSQF

SEQ ID NO: 2539654 - protein, 27 aa, Entamoeba dispar
SKSINMSLMLLVKIYISKYSITQFDKI

SEQ ID NO: 2539655 - protein, 20 aa, Entamoeba dispar
SKSKILRRKKSSSKLLSSNL

SEQ ID NO: 2539656 - protein, 23 aa, Entamoeba dispar
  misc_feature (22)..(23): Xaa can be any naturally occurring amino acid
SKSLKNFIPSNKLLKNIVQDNXX

SEQ ID NO: 2539657 - protein, 26 aa, Entamoeba dispar
SKSNEKKIILLTQSGLREIECQNKQD

SEQ ID NO: 2539658 - protein, 27 aa, Entamoeba dispar
SKSQTPLIPFIGILTKDLLVGDEMYAS

SEQ ID NO: 2539659 - protein, 24 aa, Entamoeba dispar
SKSVPSLLLELYHTHIFEMLMQKF

SEQ ID NO: 2539660 - protein, 19 aa, Entamoeba dispar
SKTIAEVFYSLGFDGYYDT

SEQ ID NO: 2539661 - protein, 23 aa, Entamoeba dispar
SKTIAPITFIAKDSSFPITRVLK

SEQ ID NO: 2539662 - protein, 22 aa, Entamoeba dispar
SKTICLLYHDYYSICTDKEDEC

SEQ ID NO: 2539663 - protein, 25 aa, Entamoeba dispar
SKTKSLLHQLPIFPSKHSCCAACWS

SEQ ID NO: 2539664 - protein, 20 aa, Entamoeba dispar
SKTLCIYSSKSKDLIIGSHN

SEQ ID NO: 2539665 - protein, 24 aa, Entamoeba dispar
SKTLGVFGYPLSCAVKKSSWRFPI

SEQ ID NO: 2539666 - protein, 36 aa, Entamoeba dispar
SKTLKSLFVPYYAFVLKSILTILNQLPLSLANALVP

SEQ ID NO: 2539667 - protein, 25 aa, Entamoeba dispar
SKTLLGRLLQIFFLEKLDGYGDPMK

SEQ ID NO: 2539668 - protein, 27 aa, Entamoeba dispar
SKTPQKTFKAPKQKGKIALLTKQLTGE

SEQ ID NO: 2539669 - protein, 27 aa, Entamoeba dispar
SKTYKGRIIRIILPVEIDTVKKTIEII

SEQ ID NO: 2539670 - protein, 22 aa, Entamoeba dispar
SKVIFKIICFICSFITEKEEIQ

SEQ ID NO: 2539671 - protein, 19 aa, Entamoeba dispar
SKVIGYGAFGIVFLANNIK

SEQ ID NO: 2539672 - protein, 18 aa, Entamoeba dispar
SKVLPKALNIFSYAGQGI

SEQ ID NO: 2539673 - protein, 35 aa, Entamoeba dispar
SKVLSKFLMLLYPSQYLEDIVPLAQSLFSVTTGLQ

SEQ ID NO: 2539674 - protein, 28 aa, Entamoeba dispar
SKVQRIYIPFCFTSYRYEGELNYVLINT

SEQ ID NO: 2539675 - protein, 30 aa, Entamoeba dispar
SKVWDMLIHHFYLRDALFELKGHDFVKYKV

SEQ ID NO: 2539676 - protein, 26 aa, Entamoeba dispar
SKYATRFNILFPPQSSKQLEQRMEQI

SEQ ID NO: 2539677 - protein, 19 aa, Entamoeba dispar
SKYAYLTLWGDEISNQLQF

SEQ ID NO: 2539678 - protein, 24 aa, Entamoeba dispar
SKYCNYIFTKRVDFSFQLLKNIIK

SEQ ID NO: 2539679 - protein, 25 aa, Entamoeba dispar
SLAHSASLFLIAPATADIIAKLAAG

SEQ ID NO: 2539680 - protein, 17 aa, Entamoeba dispar
SLAIENFALPGDGKFCL

SEQ ID NO: 2539681 - protein, 18 aa, Entamoeba dispar
SLALNYLKKAMTLAEQDG

SEQ ID NO: 2539682 - protein, 17 aa, Entamoeba dispar
SLALQRYKRLIKLYQEK

SEQ ID NO: 2539683 - protein, 24 aa, Entamoeba dispar
SLATLLYCLNINPVIRYINKPNEE

SEQ ID NO: 2539684 - protein, 17 aa, Entamoeba dispar
SLAYGILEALHTMQMID

SEQ ID NO: 2539685 - protein, 21 aa, Entamoeba dispar
SLCCGYGMFPLPQCDNVPLQS

SEQ ID NO: 2539686 - protein, 19 aa, Entamoeba dispar
SLCCKAIISRTLIGALGLV

SEQ ID NO: 2539687 - protein, 21 aa, Entamoeba dispar
SLCIKQIVVLEWELVGSIQEI

SEQ ID NO: 2539688 - protein, 19 aa, Entamoeba dispar
SLCKKGYNTGYLPTKILKK

SEQ ID NO: 2539689 - protein, 19 aa, Entamoeba dispar
SLCMLGVKEFRFETIPFSK

SEQ ID NO: 2539690 - protein, 18 aa, Entamoeba dispar
SLCTFGNLPFRKAVKRFG

SEQ ID NO: 2539691 - protein, 20 aa, Entamoeba dispar
SLCYVLSKHSPITSNPFFKV

SEQ ID NO: 2539692 - protein, 27 aa, Entamoeba dispar
SLDDIKTFLYLNISPQRPLFTKSSIDT

SEQ ID NO: 2539693 - protein, 27 aa, Entamoeba dispar
SLDEFGYQLWKLVHKVPIISLNDKVQS

SEQ ID NO: 2539694 - protein, 29 aa, Entamoeba dispar
SLDEPAAFAGRIYRMVKLGLSLDDKEEEP

SEQ ID NO: 2539695 - protein, 22 aa, Entamoeba dispar
SLDFSILSKFFIKLSNKLPNPL

SEQ ID NO: 2539696 - protein, 26 aa, Entamoeba dispar
SLDGCRPFFNLQRLSVRNNLIESFQN

SEQ ID NO: 2539697 - protein, 24 aa, Entamoeba dispar
SLDNIISFLLGWIKDIPLELEQSF

SEQ ID NO: 2539698 - protein, 29 aa, Entamoeba dispar
SLDPALLRPGRLDRKIEFPLPDRRQKRLI

SEQ ID NO: 2539699 - protein, 29 aa, Entamoeba dispar
SLDPDEFFQFYYLFEYYVDENGEFDCVSI

SEQ ID NO: 2539700 - protein, 22 aa, Entamoeba dispar
SLDTDLLFNFLSQVEGRKIFTQ

SEQ ID NO: 2539701 - protein, 17 aa, Entamoeba dispar
SLDTWKKEFLNGANVTN

SEQ ID NO: 2539702 - protein, 36 aa, Entamoeba dispar
SLDWNNPRFFINKFHLYIINFFIKELTTTFYRLCCY

SEQ ID NO: 2539703 - protein, 25 aa, Entamoeba dispar
SLDYYNDVVGFRRSLRKKEEEFNTL

SEQ ID NO: 2539704 - protein, 25 aa, Entamoeba dispar
SLEDPLLVLSPLNQNLFVQLLDAIF

SEQ ID NO: 2539705 - protein, 26 aa, Entamoeba dispar
SLEEKYRYLVNYFNKYVNFIKVTRKV

SEQ ID NO: 2539706 - protein, 27 aa, Entamoeba dispar
SLEELCFNLYNFIIQKTKQARECKVKR

SEQ ID NO: 2539707 - protein, 17 aa, Entamoeba dispar
SLEIHIARLEYKYGSLI

SEQ ID NO: 2539708 - protein, 26 aa, Entamoeba dispar
SLEKKRIPILQSPVVNRPMFTSPLKS

SEQ ID NO: 2539709 - protein, 27 aa, Entamoeba dispar
SLEKVLKLVLLTLYHRKKYSIISTDFV

SEQ ID NO: 2539710 - protein, 18 aa, Entamoeba dispar
SLELLCEYGFDDSIVLNN

SEQ ID NO: 2539711 - protein, 39 aa, Entamoeba dispar
SLELPPGIYEFPFSFIPPPDLPPASYFGPKGLRARYVID

SEQ ID NO: 2539712 - protein, 25 aa, Entamoeba dispar
SLELYSTNILPRFLEQVLLSRDKVT

SEQ ID NO: 2539713 - protein, 22 aa, Entamoeba dispar
SLEMTFIGNGLLNSATFPSICT

SEQ ID NO: 2539714 - protein, 25 aa, Entamoeba dispar
SLENHANLYVILRGFQKIPTNDEIF

SEQ ID NO: 2539715 - protein, 25 aa, Entamoeba dispar
SLERQMIMKAFGAELILTEGKKGMA

SEQ ID NO: 2539716 - protein, 28 aa, Entamoeba dispar
SLESQHLLLNKWTYWFDSNKYESQSRDN

SEQ ID NO: 2539717 - protein, 25 aa, Entamoeba dispar
SLETNGIILFYPVDTIPLGIDYHFQ

SEQ ID NO: 2539718 - protein, 25 aa, Entamoeba dispar
SLEYHQIFHYLGITHLRLLIQVSKE

SEQ ID NO: 2539719 - protein, 20 aa, Entamoeba dispar
SLEYINIPTTINKIGYECFY

SEQ ID NO: 2539720 - protein, 22 aa, Entamoeba dispar
SLFDEPKVYLKPDIPYISTFSH

SEQ ID NO: 2539721 - protein, 19 aa, Entamoeba dispar
SLFDFIKKSFDGDGLFYLA

SEQ ID NO: 2539722 - protein, 27 aa, Entamoeba dispar
SLFDHNNTLFKCTYKEYLRLLNIDVSI

SEQ ID NO: 2539723 - protein, 18 aa, Entamoeba dispar
SLFGLKPFDIEITITVIQ

SEQ ID NO: 2539724 - protein, 20 aa, Entamoeba dispar
SLFHLVNLQRKFISNIFDHI

SEQ ID NO: 2539725 - protein, 17 aa, Entamoeba dispar
SLFIKGFGKDATRQEII

SEQ ID NO: 2539726 - protein, 17 aa, Entamoeba dispar
SLFKWKPDNTSAASCYE

SEQ ID NO: 2539727 - protein, 19 aa, Entamoeba dispar
SLFLVEWKGFSILRSTWVL

SEQ ID NO: 2539728 - protein, 18 aa, Entamoeba dispar
SLFSKEPLMLLRKKDGKV

SEQ ID NO: 2539729 - protein, 28 aa, Entamoeba dispar
SLFTSVPNFLLIDPLMISRQITLIEWEM

SEQ ID NO: 2539730 - protein, 19 aa, Entamoeba dispar
SLGCMIYEMLVGVPPFNDK

SEQ ID NO: 2539731 - protein, 25 aa, Entamoeba dispar
SLGDKELHPPLSFEPEICSVNIKKG

SEQ ID NO: 2539732 - protein, 32 aa, Entamoeba dispar
SLGGLYLRFAIPILFKRGIFNNLNWIPFSFMT

SEQ ID NO: 2539733 - protein, 17 aa, Entamoeba dispar
SLGLLSKSLVFRELCDC

SEQ ID NO: 2539734 - protein, 24 aa, Entamoeba dispar
SLGMSILHIFSGKKPYRGMNKQQI

SEQ ID NO: 2539735 - protein, 20 aa, Entamoeba dispar
SLGNFILKKNVFSVSVNPNS

SEQ ID NO: 2539736 - protein, 21 aa, Entamoeba dispar
SLGNFILKTIKFDVSSSSAPK

SEQ ID NO: 2539737 - protein, 27 aa, Entamoeba dispar
SLGNKCFALCWMLTSITIPTSVIKIGN

SEQ ID NO: 2539738 - protein, 25 aa, Entamoeba dispar
SLGSLEALLKFLKDSKIPVSGVGLG

SEQ ID NO: 2539739 - protein, 23 aa, Entamoeba dispar
SLGTTIIGVVYNGGVLLGADGRT

SEQ ID NO: 2539740 - protein, 19 aa, Entamoeba dispar
SLHAGICPLPLIKFTRNGV

SEQ ID NO: 2539741 - protein, 18 aa, Entamoeba dispar
SLHFNIPINITVCVIPPL

SEQ ID NO: 2539742 - protein, 20 aa, Entamoeba dispar
SLHITSTLRKVFLSLSLDDL

SEQ ID NO: 2539743 - protein, 23 aa, Entamoeba dispar
SLHLPDRWFVSRKVVLQINNISI

SEQ ID NO: 2539744 - protein, 20 aa, Entamoeba dispar
SLHLPLTKETKGRIGYELIK

SEQ ID NO: 2539745 - protein, 19 aa, Entamoeba dispar
SLHLPPHFPNPLILSQFSS

SEQ ID NO: 2539746 - protein, 21 aa, Entamoeba dispar
SLHNKIEIIQKNNFDDRLTLL

SEQ ID NO: 2539747 - protein, 25 aa, Entamoeba dispar
SLHPDVFQMFINSFAPNIFGHENIK

SEQ ID NO: 2539748 - protein, 23 aa, Entamoeba dispar
SLHTLLHRVHPKEILLLNSISDD

SEQ ID NO: 2539749 - protein, 23 aa, Entamoeba dispar
SLHWKYLDFIFICPKNIENIKLS

SEQ ID NO: 2539750 - protein, 27 aa, Entamoeba dispar
SLICYDRLMWVIPLGFDKTSYSINLEK

SEQ ID NO: 2539751 - protein, 17 aa, Entamoeba dispar
SLIDHLPFSFDSAKFLI

SEQ ID NO: 2539752 - protein, 21 aa, Entamoeba dispar
SLIDSICPCAFFETSALYNVQ

SEQ ID NO: 2539753 - protein, 24 aa, Entamoeba dispar
SLIDVLHLLPLIYDKEYARQLLFY

SEQ ID NO: 2539754 - protein, 27 aa, Entamoeba dispar
SLIFPKNNFRLFFSEKRLPPFGSLKVK

SEQ ID NO: 2539755 - protein, 25 aa, Entamoeba dispar
SLIGIVGMISVFHMFARSQIQPSDL

SEQ ID NO: 2539756 - protein, 24 aa, Entamoeba dispar
SLIHTLFCFSPFDCAKQLTLKQME

SEQ ID NO: 2539757 - protein, 21 aa, Entamoeba dispar
SLIICPTRELALQTIKVFNEL

SEQ ID NO: 2539758 - protein, 35 aa, Entamoeba dispar
SLIKCNILPIKRMLSPLIRVELSKALSLSGCSSDD

SEQ ID NO: 2539759 - protein, 35 aa, Entamoeba dispar
SLIKDIVELRFEDISPLIIMLIFEWNDVVEELNNA

SEQ ID NO: 2539760 - protein, 17 aa, Entamoeba dispar
SLIKHLCLIIITFINEA

SEQ ID NO: 2539761 - protein, 17 aa, Entamoeba dispar
SLILDLDGTIVFTNPEL

SEQ ID NO: 2539762 - protein, 32 aa, Entamoeba dispar
SLILITKNKEILPYHTLLYQLIPTFKENISDV

SEQ ID NO: 2539763 - protein, 26 aa, Entamoeba dispar
SLIMNISHHIIYLLKCDSSDFSVEEK

SEQ ID NO: 2539764 - protein, 18 aa, Entamoeba dispar
SLIMYKKSKPLASGEGIS

SEQ ID NO: 2539765 - protein, 18 aa, Entamoeba dispar
SLIQKYIKIPSYQDLSFL

SEQ ID NO: 2539766 - protein, 20 aa, Entamoeba dispar
SLIRQFIHDVDWGELDYLII

SEQ ID NO: 2539767 - protein, 17 aa, Entamoeba dispar
SLITGLLVQVGNPPSAI

SEQ ID NO: 2539768 - protein, 20 aa, Entamoeba dispar
SLITYLVINAPVTRNLYGNN

SEQ ID NO: 2539769 - protein, 18 aa, Entamoeba dispar
SLKGTFCIPFEFFEDVLP

SEQ ID NO: 2539770 - protein, 33 aa, Entamoeba dispar
SLKHKKILIYITKKITLLLLNKPSLKDNRIQWW

SEQ ID NO: 2539771 - protein, 22 aa, Entamoeba dispar
SLKILFNSFKELKYLNCESCVG

SEQ ID NO: 2539772 - protein, 25 aa, Entamoeba dispar
SLKIRKGIHLFLLKKMGKCQDPSQR

SEQ ID NO: 2539773 - protein, 19 aa, Entamoeba dispar
SLKISPWFTSEKDVNKFCR

SEQ ID NO: 2539774 - protein, 21 aa, Entamoeba dispar
SLKKFFKFFTPETIDSVFLIT

SEQ ID NO: 2539775 - protein, 37 aa, Entamoeba dispar
SLKKLKFYGPIISGKTLFFAYTFIINGITTLTFTCDQ

SEQ ID NO: 2539776 - protein, 17 aa, Entamoeba dispar
SLKKLYYQKYYPSSDCF

SEQ ID NO: 2539777 - protein, 26 aa, Entamoeba dispar
SLKKNSFTPFCFPRLNLLDISNNEIM

SEQ ID NO: 2539778 - protein, 36 aa, Entamoeba dispar
SLKKNWMELFLPTSDFFMTFFYYYGQFVYYSLKGYD

SEQ ID NO: 2539779 - protein, 18 aa, Entamoeba dispar
SLKMICQIPLTKTPLRCI

SEQ ID NO: 2539780 - protein, 26 aa, Entamoeba dispar
SLKNKLLCAEGYYRLVRLNIFNENFH

SEQ ID NO: 2539781 - protein, 23 aa, Entamoeba dispar
SLKQAQILIYLNQTIKRIEVQKG

SEQ ID NO: 2539782 - protein, 28 aa, Entamoeba dispar
SLKRKQSCIFFLYCSDPLQQKRNIETRG

SEQ ID NO: 2539783 - protein, 32 aa, Entamoeba dispar
SLKSNKPLHFTSRYLYRTLWGDEIKNNIQFKE

SEQ ID NO: 2539784 - protein, 31 aa, Entamoeba dispar
SLKTQTISSLKYLILMKLMQQKINEIDFVLS

SEQ ID NO: 2539785 - protein, 19 aa, Entamoeba dispar
SLLACRYIDNLVIGAPRGV

SEQ ID NO: 2539786 - protein, 24 aa, Entamoeba dispar
SLLDDLFVVMSYKNTKSGFMNEYQ

SEQ ID NO: 2539787 - protein, 26 aa, Entamoeba dispar
SLLISCLFDLHVILLPNAPEAQRVKD

SEQ ID NO: 2539788 - protein, 17 aa, Entamoeba dispar
SLLKATVLLKKFGTNEM

SEQ ID NO: 2539789 - protein, 21 aa, Entamoeba dispar
SLLKSILLPSTISELHVRCFE

SEQ ID NO: 2539790 - protein, 33 aa, Entamoeba dispar
SLLKVIITTLSSLSYYFPLLSEYALIQSNSIGI

SEQ ID NO: 2539791 - protein, 21 aa, Entamoeba dispar
SLLLRHFKWNVNKMNDVYFDD

SEQ ID NO: 2539792 - protein, 18 aa, Entamoeba dispar
SLLLSNYSVIYKLVDEFG

SEQ ID NO: 2539793 - protein, 23 aa, Entamoeba dispar
SLLQLILDSKLLYNIPGLIIQRD

SEQ ID NO: 2539794 - protein, 20 aa, Entamoeba dispar
SLLQRWKFERGPFPLELNEY

SEQ ID NO: 2539795 - protein, 20 aa, Entamoeba dispar
SLLTIRSIAENKFELKKQLI

SEQ ID NO: 2539796 - protein, 18 aa, Entamoeba dispar
SLLTISSLPGFGLLLFNN

SEQ ID NO: 2539797 - protein, 21 aa, Entamoeba dispar
SLLTNLFNICEQCGLDLCVVM

SEQ ID NO: 2539798 - protein, 21 aa, Entamoeba dispar
SLLTSVTIPSSISKLGYCCFK

SEQ ID NO: 2539799 - protein, 20 aa, Entamoeba dispar
SLLWIMNDKDFLSGRSYSLV

SEQ ID NO: 2539800 - protein, 31 aa, Entamoeba dispar
SLMAVLEAFVYDPLIVRLLGGKDVDDDDDKM

SEQ ID NO: 2539801 - protein, 20 aa, Entamoeba dispar
SLMILPTVISMYLRAIPVIT

SEQ ID NO: 2539802 - protein, 23 aa, Entamoeba dispar
SLMKRFRTYKLETLPVIESFENE

SEQ ID NO: 2539803 - protein, 20 aa, Entamoeba dispar
SLMVKLEVASIFPLITGNAH

SEQ ID NO: 2539804 - protein, 25 aa, Entamoeba dispar
SLMVNLNIIFSYLHYFREINNKINI

SEQ ID NO: 2539805 - protein, 21 aa, Entamoeba dispar
SLNALKKVLPSGSTPPMKDDK

SEQ ID NO: 2539806 - protein, 17 aa, Entamoeba dispar
SLNEVFPQIPIIEQNTL

SEQ ID NO: 2539807 - protein, 20 aa, Entamoeba dispar
SLNILPIYSIGNIQLDSAND

SEQ ID NO: 2539808 - protein, 24 aa, Entamoeba dispar
SLNKDVMILLTQKLIHKETKKPIS

SEQ ID NO: 2539809 - protein, 19 aa, Entamoeba dispar
SLNLKKAYPLFGIKNFRST

SEQ ID NO: 2539810 - protein, 26 aa, Entamoeba dispar
SLNPFTYFHFILSFNKAISLNYFQIV

SEQ ID NO: 2539811 - protein, 18 aa, Entamoeba dispar
SLNQISSIILLKHSKRLN

SEQ ID NO: 2539812 - protein, 28 aa, Entamoeba dispar
SLNQKYQRPCWFWGVSKFGIEQSDISFV

SEQ ID NO: 2539813 - protein, 27 aa, Entamoeba dispar
SLNSLMIHLCPSRFSHFLMTSYTPLRQ

SEQ ID NO: 2539814 - protein, 22 aa, Entamoeba dispar
SLNSYNAWVKRKYGKTVKKDMK

SEQ ID NO: 2539815 - protein, 33 aa, Entamoeba dispar
SLNTFIPLSTYKYLRPWKIIHYKNIIVLLYNDL

SEQ ID NO: 2539816 - protein, 30 aa, Entamoeba dispar
SLNYHRVLEFLLIFLLNLNDSIIPSSLYEH

SEQ ID NO: 2539817 - protein, 20 aa, Entamoeba dispar
SLPDYLPDGILKKLTKKVGA

SEQ ID NO: 2539818 - protein, 21 aa, Entamoeba dispar
SLPHLLAPELPVNSLKILLSA

SEQ ID NO: 2539819 - protein, 24 aa, Entamoeba dispar
SLPISLFENCFYLKSVQLPSSLQI

SEQ ID NO: 2539820 - protein, 23 aa, Entamoeba dispar
SLPKHIILPFFTTKISYQTISLE

SEQ ID NO: 2539821 - protein, 20 aa, Entamoeba dispar
SLPKPLNLFCNEKYQIGRNP

SEQ ID NO: 2539822 - protein, 26 aa, Entamoeba dispar
SLPNENYSLFFYITVLIRQIVESINN

SEQ ID NO: 2539823 - protein, 20 aa, Entamoeba dispar
SLPNIPPPQRKQLIKISSMY

SEQ ID NO: 2539824 - protein, 26 aa, Entamoeba dispar
SLPNNYFQMFKWMNKLERCCFIACSS

SEQ ID NO: 2539825 - protein, 25 aa, Entamoeba dispar
SLPSKFHLQFLTQFLNPHTYQLVDI

SEQ ID NO: 2539826 - protein, 17 aa, Entamoeba dispar
SLPSWWNKEDLELKNCI

SEQ ID NO: 2539827 - protein, 24 aa, Entamoeba dispar
SLPTLAVFHPQLGFAILLHKNNVS

SEQ ID NO: 2539828 - protein, 28 aa, Entamoeba dispar
SLQGDEYYQFLKTVYRWLVILINEANKG

SEQ ID NO: 2539829 - protein, 30 aa, Entamoeba dispar
SLQILPEDFPLTQLLLPTSLLSLSIESPSV

SEQ ID NO: 2539830 - protein, 24 aa, Entamoeba dispar
SLQKFSIEYLKILVPLCCIHSFDD

SEQ ID NO: 2539831 - protein, 21 aa, Entamoeba dispar
SLQMIQLMNNIWKSAGLDLRM

SEQ ID NO: 2539832 - protein, 20 aa, Entamoeba dispar
SLQPIKKPLSKPTYISLEPL

SEQ ID NO: 2539833 - protein, 32 aa, Entamoeba dispar
SLQVGKYHLKFLIQPFLHWPDTMMTVIEELKV

SEQ ID NO: 2539834 - protein, 24 aa, Entamoeba dispar
SLQVRPMFDCIVTDPPYGIREGAK

SEQ ID NO: 2539835 - protein, 25 aa, Entamoeba dispar
SLREAKFWGIFIGDLMSFVQSQVDT

SEQ ID NO: 2539836 - protein, 17 aa, Entamoeba dispar
SLRFEEEPKYQFWREVF

SEQ ID NO: 2539837 - protein, 20 aa, Entamoeba dispar
SLRLIKLYGEFITMLNSIVP

SEQ ID NO: 2539838 - protein, 21 aa, Entamoeba dispar
SLRRRPIYALTLDISLTYKNE

SEQ ID NO: 2539839 - protein, 25 aa, Entamoeba dispar
SLSAKYIHQVLDGLAFIHDQGIVHR

SEQ ID NO: 2539840 - protein, 23 aa, Entamoeba dispar
SLSECRAFYWDDMRLRKPNTMVV

SEQ ID NO: 2539841 - protein, 26 aa, Entamoeba dispar
SLSGCTSLVYFKIPISITSIENGCFK

SEQ ID NO: 2539842 - protein, 27 aa, Entamoeba dispar
SLSHMLEWFNSFEKRYFAFIDIEKRLP

SEQ ID NO: 2539843 - protein, 26 aa, Entamoeba dispar
SLSKMGLVKSFWYYFLNKNEDTEESV

SEQ ID NO: 2539844 - protein, 18 aa, Entamoeba dispar
SLSLFVSFLSDIANIKPF

SEQ ID NO: 2539845 - protein, 24 aa, Entamoeba dispar
SLSLNNVCFLKLPILNEIKRCFPN

SEQ ID NO: 2539846 - protein, 21 aa, Entamoeba dispar
SLSLPPYLREIPYRSLYNCFY

SEQ ID NO: 2539847 - protein, 26 aa, Entamoeba dispar
SLSLWALQEMYIFLPVMLSSNNYEEL

SEQ ID NO: 2539848 - protein, 34 aa, Entamoeba dispar
SLSNIAREFIPMEDFLLSNLYLEKYYQIHNLYHK

SEQ ID NO: 2539849 - protein, 26 aa, Entamoeba dispar
SLSRPTKPLIKPVPKWNVPVEEEKMT

SEQ ID NO: 2539850 - protein, 21 aa, Entamoeba dispar
SLSSIQFPSLLRSIGIDAFSD

SEQ ID NO: 2539851 - protein, 25 aa, Entamoeba dispar
SLSSKLLLDRFALKKLVKGQPNEEE

SEQ ID NO: 2539852 - protein, 28 aa, Entamoeba dispar
SLSVLKKLKALYLQSNNLFHFPQSIFDL

SEQ ID NO: 2539853 - protein, 21 aa, Entamoeba dispar
SLSYIYIPSSVSELRGWCFKN

SEQ ID NO: 2539854 - protein, 28 aa, Entamoeba dispar
SLTELLLDKYYRTLEGFIVLIEKDWKSF

SEQ ID NO: 2539855 - protein, 19 aa, Entamoeba dispar
SLTIPSIGRQRGFVPLIIV

SEQ ID NO: 2539856 - protein, 20 aa, Entamoeba dispar
SLTLINIPSSIESFGYRCFY

SEQ ID NO: 2539857 - protein, 19 aa, Entamoeba dispar
SLTLISLPTTISKLEDICF

SEQ ID NO: 2539858 - protein, 23 aa, Entamoeba dispar
SLTLQYDLPRMIGIGLFTDVSTS

SEQ ID NO: 2539859 - protein, 27 aa, Entamoeba dispar
SLTNSPYSFSPLFISPHHTSPQSNSPH

SEQ ID NO: 2539860 - protein, 25 aa, Entamoeba dispar
SLTQIHIPSLISKLGLWCFYGCTSL

SEQ ID NO: 2539861 - protein, 22 aa, Entamoeba dispar
SLTQQLYMNPYFRNSIMNVKAT

SEQ ID NO: 2539862 - protein, 25 aa, Entamoeba dispar
SLTRIVRIYKELKFKRLDLPIENEI

SEQ ID NO: 2539863 - protein, 21 aa, Entamoeba dispar
SLTSIIIPLSVKILGDGCFCG

SEQ ID NO: 2539864 - protein, 19 aa, Entamoeba dispar
SLTSIIIPSSLKIIGNECF

SEQ ID NO: 2539865 - protein, 22 aa, Entamoeba dispar
SLTSINIPSSIISFGRSCFYGC

SEQ ID NO: 2539866 - protein, 23 aa, Entamoeba dispar
SLTSINIPSSIISFGRSCFYGCG

SEQ ID NO: 2539867 - protein, 19 aa, Entamoeba dispar
SLTSINIPSSITKLGICCF

SEQ ID NO: 2539868 - protein, 20 aa, Entamoeba dispar
SLTSINIPSSVSKFGWGCFY

SEQ ID NO: 2539869 - protein, 19 aa, Entamoeba dispar
SLTSINIPTTITKIGFGCF

SEQ ID NO: 2539870 - protein, 25 aa, Entamoeba dispar
SLTSINLPLTITKLGEWCFDGCTSL

SEQ ID NO: 2539871 - protein, 20 aa, Entamoeba dispar
SLTSINLPPTITKLGEWCFD

SEQ ID NO: 2539872 - protein, 18 aa, Entamoeba dispar
SLTSITVLTTIRELRKEH

SEQ ID NO: 2539873 - protein, 27 aa, Entamoeba dispar
SLTSLLILRQKATLGVLKLLLSIPDNF

SEQ ID NO: 2539874 - protein, 18 aa, Entamoeba dispar
SLTSVYIPTSVRQMGYGC

SEQ ID NO: 2539875 - protein, 20 aa, Entamoeba dispar
SLTTINIPSSITSIGCDCFY

SEQ ID NO: 2539876 - protein, 22 aa, Entamoeba dispar
SLTTINIPSSVISIGYDCFYEC

SEQ ID NO: 2539877 - protein, 20 aa, Entamoeba dispar
SLTTINIPSSVSKLGYLCFY

SEQ ID NO: 2539878 - protein, 25 aa, Entamoeba dispar
SLTYCTGIPILFVGSGQHYTDLKLL

SEQ ID NO: 2539879 - protein, 32 aa, Entamoeba dispar
SLVDIKKMLDFVPWFIVEITLLKRASDLEFKV

SEQ ID NO: 2539880 - protein, 24 aa, Entamoeba dispar
SLVELMLDPFYRTISGFAVLIEKD

SEQ ID NO: 2539881 - protein, 25 aa, Entamoeba dispar
SLVERIPLELLLLHPRGTDPMSSIS

SEQ ID NO: 2539882 - protein, 26 aa, Entamoeba dispar
SLVHKNYYQLFNLVDQLNLTTIPQDF

SEQ ID NO: 2539883 - protein, 31 aa, Entamoeba dispar
SLVLDVKIWTPELIQLFINFGNKRVNSLLMG

SEQ ID NO: 2539884 - protein, 24 aa, Entamoeba dispar
SLVLHYDSIFILRKDTRQIFDKSK

SEQ ID NO: 2539885 - protein, 17 aa, Entamoeba dispar
SLVLNKLKSIEIISCRE

SEQ ID NO: 2539886 - protein, 20 aa, Entamoeba dispar
SLVLSYLMYANKFTFDEALA

SEQ ID NO: 2539887 - protein, 20 aa, Entamoeba dispar
SLVLVLQILLTRALSIEDKD

SEQ ID NO: 2539888 - protein, 24 aa, Entamoeba dispar
SLVNGKLICNYQAFIRAEITIEYT

SEQ ID NO: 2539889 - protein, 28 aa, Entamoeba dispar
SLVSPFQWQHVFIPVLPLSLVTYCAAPM

SEQ ID NO: 2539890 - protein, 17 aa, Entamoeba dispar
SLVTECGGFWDADFWVH

SEQ ID NO: 2539891 - protein, 25 aa, Entamoeba dispar
SLVTMYYRNTNGCLIVFGLDNRDSF

SEQ ID NO: 2539892 - protein, 30 aa, Entamoeba dispar
SLWNQFNIIFQYLPFCGVIDNKLFCVHGGI

SEQ ID NO: 2539893 - protein, 20 aa, Entamoeba dispar
SLWTMLLSPEEMTPKHVLAI

SEQ ID NO: 2539894 - protein, 18 aa, Entamoeba dispar
SLYDLIVQELKLAKFRNY

SEQ ID NO: 2539895 - protein, 24 aa, Entamoeba dispar
SLYEAPPTVLSPKIKSTSPQILFE

SEQ ID NO: 2539896 - protein, 20 aa, Entamoeba dispar
SLYFCEILHFIKTNKDILFS

SEQ ID NO: 2539897 - protein, 23 aa, Entamoeba dispar
SLYLTIIDLLLSRERKITGTIEI

SEQ ID NO: 2539898 - protein, 17 aa, Entamoeba dispar
SLYLTTYEFIRIHKDIL

SEQ ID NO: 2539899 - protein, 20 aa, Entamoeba dispar
SLYQRSIPFLSLAEANIAWK

SEQ ID NO: 2539900 - protein, 23 aa, Entamoeba dispar
SLYSQFILSFQYYINQSNSIISN

SEQ ID NO: 2539901 - protein, 18 aa, Entamoeba dispar
SLYTLFSKSFFGCTALSS

SEQ ID NO: 2539902 - protein, 17 aa, Entamoeba dispar
SLYVTKALEVKIFGLEY

SEQ ID NO: 2539903 - protein, 32 aa, Entamoeba dispar
SMALGSLPGIIPFLFEKLQKKKSFFLMNAMKE

SEQ ID NO: 2539904 - protein, 38 aa, Entamoeba dispar
SMEQYNFIIQLLNEFYTKIYPFIPIKKSHIIDQIDQFL

SEQ ID NO: 2539905 - protein, 34 aa, Entamoeba dispar
SMERVTLFLNLANHPTIERIVTPRLALTTAEYFA

SEQ ID NO: 2539906 - protein, 36 aa, Entamoeba dispar
SMERVTLFLNLANHPTIERIVTPRLALTTAEYFAYT

SEQ ID NO: 2539907 - protein, 17 aa, Entamoeba dispar
SMEWFNVTFKRGVCKTR

SEQ ID NO: 2539908 - protein, 24 aa, Entamoeba dispar
SMFERDFHFAYEYLKDHLKMHQLE

SEQ ID NO: 2539909 - protein, 17 aa, Entamoeba dispar
SMFIANPSPMMAHLVTI

SEQ ID NO: 2539910 - protein, 24 aa, Entamoeba dispar
SMFNADYLLFMPTDDGQFQPNPMS

SEQ ID NO: 2539911 - protein, 27 aa, Entamoeba dispar
SMFRGTYGQLFECFRKLFICKTDTDSK

SEQ ID NO: 2539912 - protein, 19 aa, Entamoeba dispar
SMGLLAVRQSELLIVLSNE

SEQ ID NO: 2539913 - protein, 18 aa, Entamoeba dispar
SMGRINGYDLFGDTLLYT

SEQ ID NO: 2539914 - protein, 27 aa, Entamoeba dispar
SMIAIETIINWLYENPFTSIKKVIFDV

SEQ ID NO: 2539915 - protein, 17 aa, Entamoeba dispar
SMIINHVSFQVIKNLYL

SEQ ID NO: 2539916 - protein, 27 aa, Entamoeba dispar
SMILNDSLQSTILFGPPGSGKTTIARI

SEQ ID NO: 2539917 - protein, 19 aa, Entamoeba dispar
SMINLSCEILLYVDEWFCY

SEQ ID NO: 2539918 - protein, 18 aa, Entamoeba dispar
SMISIIFNKKQSICVVID

SEQ ID NO: 2539919 - protein, 19 aa, Entamoeba dispar
SMITLIMKPMEQISKMMQK

SEQ ID NO: 2539920 - protein, 36 aa, Entamoeba dispar
SMIYNNFPIVIQENRFWYFKDSQGVGWNIKFKNDID

SEQ ID NO: 2539921 - protein, 18 aa, Entamoeba dispar
SMKDYIFEELFDKCKKLC

SEQ ID NO: 2539922 - protein, 23 aa, Entamoeba dispar
SMKDYIFEELFDKCKKLCIDECE

SEQ ID NO: 2539923 - protein, 23 aa, Entamoeba dispar
SMKDYIFEELFDKCKKLYIDECE

SEQ ID NO: 2539924 - protein, 21 aa, Entamoeba dispar
SMKIEVVKSLRLICKLNGNDS

SEQ ID NO: 2539925 - protein, 17 aa, Entamoeba dispar
SMKILQNKTMYLALNEE

SEQ ID NO: 2539926 - protein, 27 aa, Entamoeba dispar
SMKKRIINSIFLFETPITIDIPHNIDA

SEQ ID NO: 2539927 - protein, 27 aa, Entamoeba dispar
SMKNWSFIPVTLADYPYLPYSSKRVDV

SEQ ID NO: 2539928 - protein, 22 aa, Entamoeba dispar
SMKQCLDVMFPFFQQNLPEDVD

SEQ ID NO: 2539929 - protein, 25 aa, Entamoeba dispar
SMKTKSHMIALPLYSALPQQEQQRV

SEQ ID NO: 2539930 - protein, 26 aa, Entamoeba dispar
SMLKESKLTYIPYPSFFEVTRIVGIE

SEQ ID NO: 2539931 - protein, 18 aa, Entamoeba dispar
SMLNHRIDLWKQEANKDA

SEQ ID NO: 2539932 - protein, 17 aa, Entamoeba dispar
SMLPPGIGSLKSLDTLE

SEQ ID NO: 2539933 - protein, 24 aa, Entamoeba dispar
SMNPKRSFFKKSIKPMIVQQEHTE

SEQ ID NO: 2539934 - protein, 23 aa, Entamoeba dispar
SMPFQHIMRYKIQLNRIMETLPK

SEQ ID NO: 2539935 - protein, 18 aa, Entamoeba dispar
SMRSNVFLPVSGLVDVKE

SEQ ID NO: 2539936 - protein, 29 aa, Entamoeba dispar
SMSAFTANLRFPSTLYNSLNSLMIHLCPS

SEQ ID NO: 2539937 - protein, 24 aa, Entamoeba dispar
SMSKYLRDRLLGMPITEIDRQMEQ

SEQ ID NO: 2539938 - protein, 22 aa, Entamoeba dispar
SMTELCNILFNPSIFSYLNEIT

SEQ ID NO: 2539939 - protein, 18 aa, Entamoeba dispar
SMTIKLITSFLKLVKVPS

SEQ ID NO: 2539940 - protein, 17 aa, Entamoeba dispar
SMTRQMLWFGDYSFYSE

SEQ ID NO: 2539941 - protein, 23 aa, Entamoeba dispar
SMTRRPRNKILYGSTLGSISDIT

SEQ ID NO: 2539942 - protein, 25 aa, Entamoeba dispar
SMVDLVRRGVVPTYVVFQNRPKRDI

SEQ ID NO: 2539943 - protein, 18 aa, Entamoeba dispar
SMVIGLTHFPYIYDFIIP

SEQ ID NO: 2539944 - protein, 20 aa, Entamoeba dispar
SMVNGLRRVIMAETPTIAIQ

SEQ ID NO: 2539945 - protein, 18 aa, Entamoeba dispar
SMYSFSSVKPLFNQFIYS

SEQ ID NO: 2539946 - protein, 35 aa, Entamoeba dispar
SNAFNKFIYCPIVLPYFLRLLTHCLSIQDFTISPF

SEQ ID NO: 2539947 - protein, 19 aa, Entamoeba dispar
SNALIELINTRFEDLVFLS

SEQ ID NO: 2539948 - protein, 24 aa, Entamoeba dispar
SNANGIWYTPITGIWQTVWVEPVH

SEQ ID NO: 2539949 - protein, 23 aa, Entamoeba dispar
SNAPKLIFLTKLRHLKTVFLRVK

SEQ ID NO: 2539950 - protein, 21 aa, Entamoeba dispar
SNAPTLIHLFKKITTLGRQSK

SEQ ID NO: 2539951 - protein, 26 aa, Entamoeba dispar
SNCETFCYIIISYSFGFNIYKSNQTE

SEQ ID NO: 2539952 - protein, 24 aa, Entamoeba dispar
SNCLQKKVVLPQPIQVWLKQRKCD

SEQ ID NO: 2539953 - protein, 20 aa, Entamoeba dispar
SNCYSLPTKVHLNLNCDMKE

SEQ ID NO: 2539954 - protein, 26 aa, Entamoeba dispar
SNDERIVMHLLWLMANIASDGIVPSE

SEQ ID NO: 2539955 - protein, 35 aa, Entamoeba dispar
SNDILVELIYFLNKLFLFEQYLPSYLKLLKENADA

SEQ ID NO: 2539956 - protein, 31 aa, Entamoeba dispar
SNDKNIMVWDYRKPEIPLKILQNHTGEVIFI

SEQ ID NO: 2539957 - protein, 23 aa, Entamoeba dispar
SNDLMKYILAFGFNEDKTFIYTD

SEQ ID NO: 2539958 - protein, 18 aa, Entamoeba dispar
SNDRLLYEYPKESAMKYA

SEQ ID NO: 2539959 - protein, 32 aa, Entamoeba dispar
SNDTIITRKFLCCGPLFIVEKVTEIPQKWMYC

SEQ ID NO: 2539960 - protein, 34 aa, Entamoeba dispar
SNECIFSSIIPYIDKPWYLKFNNSAIYADNTEDE

SEQ ID NO: 2539961 - protein, 17 aa, Entamoeba dispar
SNEFQLKPILRLTQPHL

SEQ ID NO: 2539962 - protein, 33 aa, Entamoeba dispar
SNEGKHLMIQTIKDIFYLFKQVDGKTYISSFPK

SEQ ID NO: 2539963 - protein, 25 aa, Entamoeba dispar
SNEIFIGLTLLRFGIHLEDVLNYVK

SEQ ID NO: 2539964 - protein, 27 aa, Entamoeba dispar
SNEKIYGIGFLFILNDKKTKYDVIMYC

SEQ ID NO: 2539965 - protein, 33 aa, Entamoeba dispar
SNESLSILNTINSLLSHLISSPLAIQCPNSITA

SEQ ID NO: 2539966 - protein, 26 aa, Entamoeba dispar
SNESSPIQILLISKPTSIIIEEKYEK

SEQ ID NO: 2539967 - protein, 24 aa, Entamoeba dispar
SNEYPIQLIFTKNGGYSSQLSYIV

SEQ ID NO: 2539968 - protein, 17 aa, Entamoeba dispar
SNFALFELGIESEKIKK

SEQ ID NO: 2539969 - protein, 27 aa, Entamoeba dispar
SNFFRDAQGIIICYDVTSPKSLTSIPM

SEQ ID NO: 2539970 - protein, 21 aa, Entamoeba dispar
SNFNLFVIFSNPISIDQIPSF

SEQ ID NO: 2539971 - protein, 19 aa, Entamoeba dispar
SNFNYLMYLNIKAGRSFND

SEQ ID NO: 2539972 - protein, 29 aa, Entamoeba dispar
SNFQRLPNLVYFLQSVPFVRLQAMFDMLV

SEQ ID NO: 2539973 - protein, 24 aa, Entamoeba dispar
SNFRRIEVLHLNNAICNKPNVMII

SEQ ID NO: 2539974 - protein, 17 aa, Entamoeba dispar
SNFWIPGTRYLQKKSHS

SEQ ID NO: 2539975 - protein, 23 aa, Entamoeba dispar
SNFYDAIQFVLCDEKFGNLRASD

SEQ ID NO: 2539976 - protein, 24 aa, Entamoeba dispar
SNGFKGMLLVSAKTGFHVEETMEN

SEQ ID NO: 2539977 - protein, 21 aa, Entamoeba dispar
SNGNFFAFDFGGGTLDTTILK

SEQ ID NO: 2539978 - protein, 27 aa, Entamoeba dispar
SNGNLSFVVLYPKIFEIEPTLFVFKAT

SEQ ID NO: 2539979 - protein, 30 aa, Entamoeba dispar
SNGNVIKRWYGLTLISVRGNLFYPRSLELS

SEQ ID NO: 2539980 - protein, 24 aa, Entamoeba dispar
SNGQYAIILWKKQNEWYLSYLKRN

SEQ ID NO: 2539981 - protein, 30 aa, Entamoeba dispar
SNGVDCGVFMLYFIRKFMEYTPSDGIKFKQ

SEQ ID NO: 2539982 - protein, 21 aa, Entamoeba dispar
SNHLTDFLKRVIVEHPELVEG

SEQ ID NO: 2539983 - protein, 23 aa, Entamoeba dispar
SNHYLWVVWDRALELCLLQINNH

SEQ ID NO: 2539984 - protein, 23 aa, Entamoeba dispar
SNHYNYIIHDKWLSLPELTNYNG

SEQ ID NO: 2539985 - protein, 31 aa, Entamoeba dispar
SNIFEQPLIYLSILHSLFYSTVKLPLTLETI

SEQ ID NO: 2539986 - protein, 25 aa, Entamoeba dispar
SNIFHGFQTLFTTGDLFFSCNDTLT

SEQ ID NO: 2539987 - protein, 25 aa, Entamoeba dispar
SNIHQILIHLINTFIIFKDYLYKYY

SEQ ID NO: 2539988 - protein, 32 aa, Entamoeba dispar
SNIKILFQHWESLFPWPNLDVSRFIYTGTKFY

SEQ ID NO: 2539989 - protein, 40 aa, Entamoeba dispar
SNIKNLLSMTDTLAKPARLPFLSLALNLPPELADIQQFPT

SEQ ID NO: 2539990 - protein, 29 aa, Entamoeba dispar
SNIKQVDRRKVAWDLTIETTAFDGNRIVG

SEQ ID NO: 2539991 - protein, 26 aa, Entamoeba dispar
SNIKWRWESIGFLPNSPRNCSFIYGY

SEQ ID NO: 2539992 - protein, 17 aa, Entamoeba dispar
SNILISTFILYSSPHQL

SEQ ID NO: 2539993 - protein, 19 aa, Entamoeba dispar
SNILRALSYFNGTFGFYLI

SEQ ID NO: 2539994 - protein, 33 aa, Entamoeba dispar
SNIRRQVTYILLTKHFLIFDTALRSTLATIDLP

SEQ ID NO: 2539995 - protein, 24 aa, Entamoeba dispar
SNIRTLWMFYNNLTKLKGIEGIKH

SEQ ID NO: 2539996 - protein, 22 aa, Entamoeba dispar
SNISCGLLILRGDEIMVIGGLN

SEQ ID NO: 2539997 - protein, 19 aa, Entamoeba dispar
SNISLFQSLSSYINNLSPI

SEQ ID NO: 2539998 - protein, 24 aa, Entamoeba dispar
SNIYNYLVDFYNSSQIRKIISSLK

SEQ ID NO: 2539999 - protein, 23 aa, Entamoeba dispar
SNKFTFQIAFYERMKDLEKYSIR

SEQ ID NO: 2540000 - protein, 19 aa, Entamoeba dispar
SNKIKKYYYVLEGNKLILY

SEQ ID NO: 2540001 - protein, 26 aa, Entamoeba dispar
SNKIRKLLKIYYSEDNRLLFPRNVSE

SEQ ID NO: 2540002 - protein, 30 aa, Entamoeba dispar
SNKKSIEIIKLPPFNELKLPRLTAISSDNQ

SEQ ID NO: 2540003 - protein, 31 aa, Entamoeba dispar
SNKKVLRIGMRPLKVIPLKSLSPIERKKKAA

SEQ ID NO: 2540004 - protein, 18 aa, Entamoeba dispar
SNKKWIIEPLVEPFDIKG

SEQ ID NO: 2540005 - protein, 22 aa, Entamoeba dispar
SNKMLMFNGMTLMHKVIATKRK

SEQ ID NO: 2540006 - protein, 23 aa, Entamoeba dispar
SNKNIYIYDIYKSKWETIPSPIN

SEQ ID NO: 2540007 - protein, 25 aa, Entamoeba dispar
SNKPSLWCCFYYSTNKISGSPIPLA

SEQ ID NO: 2540008 - protein, 24 aa, Entamoeba dispar
SNKQQNYPQLLIKKLKNLNCPALP

SEQ ID NO: 2540009 - protein, 24 aa, Entamoeba dispar
SNKQQYSILLNGFIRIIACLSIEE

SEQ ID NO: 2540010 - protein, 29 aa, Entamoeba dispar
SNKRGLLISRIFQTKIKILEWLNSSHQMT

SEQ ID NO: 2540011 - protein, 22 aa, Entamoeba dispar
SNKVMIIGLDGFKFEIFHVKGE

SEQ ID NO: 2540012 - protein, 32 aa, Entamoeba dispar
SNLEKYDFLILVLLVLFCKVPKTPSIEKSVKE

SEQ ID NO: 2540013 - protein, 18 aa, Entamoeba dispar
SNLIFKCHQMKASSLYFV

SEQ ID NO: 2540014 - protein, 18 aa, Entamoeba dispar
SNLIFYLHRCKTNDLYFC

SEQ ID NO: 2540015 - protein, 26 aa, Entamoeba dispar
SNLKLQLYRPIFIDLIPLIENEINNI

SEQ ID NO: 2540016 - protein, 22 aa, Entamoeba dispar
SNLLRCFRTLGLFAGNQHATCC

SEQ ID NO: 2540017 - protein, 24 aa, Entamoeba dispar
SNLLSLIKLYHYHGIPLEITKEIS

SEQ ID NO: 2540018 - protein, 23 aa, Entamoeba dispar
SNLLSMVPYVYSHRIKFTNTSFK

SEQ ID NO: 2540019 - protein, 20 aa, Entamoeba dispar
SNLLYPFRKMNCCLFCTQPF

SEQ ID NO: 2540020 - protein, 21 aa, Entamoeba dispar
SNMRHIFNVDIIINLGSAGGM

SEQ ID NO: 2540021 - protein, 30 aa, Entamoeba dispar
SNMYLRIVALDFSYFLLKKANNKTNYGEIA

SEQ ID NO: 2540022 - protein, 18 aa, Entamoeba dispar
SNNDMISEYSWLKFIASC

SEQ ID NO: 2540023 - protein, 24 aa, Entamoeba dispar
SNNGLYLYLASRDGSLYCFELETG

SEQ ID NO: 2540024 - protein, 36 aa, Entamoeba dispar
SNNGNLMSFLIFPVQRIPRYILLMKEYIKNTEKDHP

SEQ ID NO: 2540025 - protein, 28 aa, Entamoeba dispar
SNNIFGDYTFLSNITPYLTPTSLTNYNY

SEQ ID NO: 2540026 - protein, 17 aa, Entamoeba dispar
SNNIIIVKNIAASAIDL

SEQ ID NO: 2540027 - protein, 22 aa, Entamoeba dispar
SNNIIPPRKTLGVGMGGMGMPQ

SEQ ID NO: 2540028 - protein, 25 aa, Entamoeba dispar
SNNITYLLFDKYCNRLRRIINERYS

SEQ ID NO: 2540029 - protein, 24 aa, Entamoeba dispar
SNNKKILEFFFTTTEGKNLIVKKN

SEQ ID NO: 2540030 - protein, 25 aa, Entamoeba dispar
SNNKLTEIPIFFTELINLKKLDVSR

SEQ ID NO: 2540031 - protein, 25 aa, Entamoeba dispar
SNNNPKVIFYISAMILCNMDSKNVS

SEQ ID NO: 2540032 - protein, 32 aa, Entamoeba dispar
SNNPFTCFPFFVPRRNWFVKAIFLTELEQRSL

SEQ ID NO: 2540033 - protein, 18 aa, Entamoeba dispar
SNNPQGYFPILQQNFHTK

SEQ ID NO: 2540034 - protein, 28 aa, Entamoeba dispar
SNNVFAYKWIVLLFKRYISDSYLLRIWD

SEQ ID NO: 2540035 - protein, 24 aa, Entamoeba dispar
SNNYDLYSVLRILSIWFNCKNDNN

SEQ ID NO: 2540036 - protein, 25 aa, Entamoeba dispar
SNNYIIDIIGLFGYSFQTKTIDIYE

SEQ ID NO: 2540037 - protein, 22 aa, Entamoeba dispar
SNPAKLFGIYPEKGCLGIGSDA

SEQ ID NO: 2540038 - protein, 19 aa, Entamoeba dispar
SNPIHYWRYRCHVDMDEII

SEQ ID NO: 2540039 - protein, 27 aa, Entamoeba dispar
SNPKDALDLVYIQYIIGTTSKFSNRNL

SEQ ID NO: 2540040 - protein, 31 aa, Entamoeba dispar
SNPPMFQVQLTQYIPFIFKSILTLEEKEYIS

SEQ ID NO: 2540041 - protein, 22 aa, Entamoeba dispar
SNPTVFIAFQQPIKKAIVCNDL

SEQ ID NO: 2540042 - protein, 28 aa, Entamoeba dispar
SNQLRVLSPLICFLTSLVNLNLSRNKLE

SEQ ID NO: 2540043 - protein, 38 aa, Entamoeba dispar
SNQNFTPPLPQSPAAYLHFPIARLEEYVKFFATTIKQS

SEQ ID NO: 2540044 - protein, 29 aa, Entamoeba dispar
SNRFELYFKGYIFNILFDVPQELALLRMG

SEQ ID NO: 2540045 - protein, 23 aa, Entamoeba dispar
SNRHTFLQIFPFELNKSDDLIKH

SEQ ID NO: 2540046 - protein, 19 aa, Entamoeba dispar
SNRIVFIDSPFLPNEIQIS

SEQ ID NO: 2540047 - protein, 23 aa, Entamoeba dispar
SNRTSIVGTPYWMAPELIRSQRY

SEQ ID NO: 2540048 - protein, 23 aa, Entamoeba dispar
SNSEFIILTFIDIFHQYRSIRQT

SEQ ID NO: 2540049 - protein, 28 aa, Entamoeba dispar
SNSFVCICCNTLFFAEKNVLRYCSFGSD

SEQ ID NO: 2540050 - protein, 21 aa, Entamoeba dispar
SNSLIFERPRYWTLTNYLTTN

SEQ ID NO: 2540051 - protein, 24 aa, Entamoeba dispar
SNSWNDYFPLIIQNFPITDTSNIP

SEQ ID NO: 2540052 - protein, 27 aa, Entamoeba dispar
SNTASMPEIPFSNPFYFSMFNNREIPD

SEQ ID NO: 2540053 - protein, 22 aa, Entamoeba dispar
SNTCWHLYGIILRTEKHYEEAA

SEQ ID NO: 2540054 - protein, 25 aa, Entamoeba dispar
SNTDDFIWKLVRLLVNNGLSPNEQK

SEQ ID NO: 2540055 - protein, 33 aa, Entamoeba dispar
SNTDRMIFYLIIQYSPLYPKLPLVAGRHGLDYK

SEQ ID NO: 2540056 - protein, 33 aa, Entamoeba dispar
SNTEQYKAIIFIGPVWWWGLNAPIKNACNEVVK

SEQ ID NO: 2540057 - protein, 24 aa, Entamoeba dispar
SNTKKFAYLLSRIFYNAQYFERKQ

SEQ ID NO: 2540058 - protein, 19 aa, Entamoeba dispar
SNTPYLSDFAPYKPFYIPD

SEQ ID NO: 2540059 - protein, 27 aa, Entamoeba dispar
SNTYNSYLLFISYYTKKGNLRQLFIGQ

SEQ ID NO: 2540060 - protein, 30 aa, Entamoeba dispar
SNVDGFIKKLRIFFPNIIDLKYVTNQISQT

SEQ ID NO: 2540061 - protein, 18 aa, Entamoeba dispar
SNVKLESFNPFRNNNVSS

SEQ ID NO: 2540062 - protein, 27 aa, Entamoeba dispar
SNVLMTLTPILLFLSNDIQPLHLTSTE

SEQ ID NO: 2540063 - protein, 23 aa, Entamoeba dispar
SNVLQITYLPLFGNSIQIVMLAH

SEQ ID NO: 2540064 - protein, 21 aa, Entamoeba dispar
SNVLYYFNTFTIKKIKMIRCF

SEQ ID NO: 2540065 - protein, 25 aa, Entamoeba dispar
SNVQYVFRKMFNIKSIILDGNDICN

SEQ ID NO: 2540066 - protein, 19 aa, Entamoeba dispar
SNVVVTVPVYFNDKQREAT

SEQ ID NO: 2540067 - protein, 27 aa, Entamoeba dispar
SNYFRNAMGGVIMFDVSNRQSFENISN

SEQ ID NO: 2540068 - protein, 26 aa, Entamoeba dispar
SNYIPKYICESYLPAYKIEVVYIADR

SEQ ID NO: 2540069 - protein, 21 aa, Entamoeba dispar
SNYIQISPLPPQSTLEEPEKR

SEQ ID NO: 2540070 - protein, 17 aa, Entamoeba dispar
SNYKATVDPCRFMGCGP

SEQ ID NO: 2540071 - protein, 23 aa, Entamoeba dispar
SNYKDVIIIPPKSSIPIYGNFSI

SEQ ID NO: 2540072 - protein, 24 aa, Entamoeba dispar
SNYSAWWFLIHITSFKSLRYLTII

SEQ ID NO: 2540073 - protein, 21 aa, Entamoeba dispar
SNYYPFILTSGFYSGIQQYGG

SEQ ID NO: 2540074 - protein, 23 aa, Entamoeba dispar
SNYYSRDRLYRRRTERSRSRERY

SEQ ID NO: 2540075 - protein, 20 aa, Entamoeba dispar
SPAEYLLRKAVMLLQSSDKQ

SEQ ID NO: 2540076 - protein, 21 aa, Entamoeba dispar
SPAGALWWLARELEEAKKYKP

SEQ ID NO: 2540077 - protein, 20 aa, Entamoeba dispar
SPAIRVEYVDFFEDEIFVEE

SEQ ID NO: 2540078 - protein, 23 aa, Entamoeba dispar
SPDIRMTIWRMEKNRKIIFESLA

SEQ ID NO: 2540079 - protein, 18 aa, Entamoeba dispar
SPDSLFLQLYHEYAKEFL

SEQ ID NO: 2540080 - protein, 19 aa, Entamoeba dispar
SPDVVAFQFAVRGKIAIIS

SEQ ID NO: 2540081 - protein, 25 aa, Entamoeba dispar
SPECVLYAAKIFPFGEQMIALCRVL

SEQ ID NO: 2540082 - protein, 32 aa, Entamoeba dispar
SPEERGLFCYCPNVVAFPLASVSPRSASSDRS

SEQ ID NO: 2540083 - protein, 25 aa, Entamoeba dispar
SPEIIKKLIIKRLLQRTKADIKLFA

SEQ ID NO: 2540084 - protein, 35 aa, Entamoeba dispar
SPEIVRTEIPILPLFFLQYCAIEELQFEKLRYQLE

SEQ ID NO: 2540085 - protein, 23 aa, Entamoeba dispar
SPEMLLQDGWSYATDLWSVGCTL

SEQ ID NO: 2540086 - protein, 27 aa, Entamoeba dispar
SPENFPLLFDFIGSYFSFVLPVDKTIV

SEQ ID NO: 2540087 - protein, 19 aa, Entamoeba dispar
SPEVIYDIVPTPIGIELEG

SEQ ID NO: 2540088 - protein, 27 aa, Entamoeba dispar
SPFAKRRLLELSKRIGPYILRRTKKDV

SEQ ID NO: 2540089 - protein, 23 aa, Entamoeba dispar
SPFDIKTFLWKDHPFQLPEFQDG

SEQ ID NO: 2540090 - protein, 23 aa, Entamoeba dispar
SPFIQMCWKGIFEILYIASLDED

SEQ ID NO: 2540091 - protein, 17 aa, Entamoeba dispar
SPFKTRGILLLKMNAIC

SEQ ID NO: 2540092 - protein, 18 aa, Entamoeba dispar
SPFWDNKSLELKDLIKHM

SEQ ID NO: 2540093 - protein, 25 aa, Entamoeba dispar
SPGISPSYILKPYTSPNNTIDIPEK

SEQ ID NO: 2540094 - protein, 26 aa, Entamoeba dispar
SPGSFKMRKPFPQPWRGLRDNALEDV

SEQ ID NO: 2540095 - protein, 17 aa, Entamoeba dispar
SPIGYALFKVKEKEEIG

SEQ ID NO: 2540096 - protein, 24 aa, Entamoeba dispar
SPINSSFFKDAMKQTWKLKQKKLG

SEQ ID NO: 2540097 - protein, 26 aa, Entamoeba dispar
SPIRMKVMGFIRSWVNWRFSDFDDID

SEQ ID NO: 2540098 - protein, 17 aa, Entamoeba dispar
SPISIICCDTIILTQYN

SEQ ID NO: 2540099 - protein, 30 aa, Entamoeba dispar
SPKNILVFLELFLFHDFITDLHTLFQDWFT

SEQ ID NO: 2540100 - protein, 33 aa, Entamoeba dispar
SPKRKPSNLTLPKWFPTQPIPFDFKSNKIEDEF

SEQ ID NO: 2540101 - protein, 25 aa, Entamoeba dispar
SPLEFTLKVFSLVSPIPTPLSNTST

SEQ ID NO: 2540102 - protein, 19 aa, Entamoeba dispar
SPLIKFPYIIDSTKNLLFS

SEQ ID NO: 2540103 - protein, 17 aa, Entamoeba dispar
SPLIKQPIKVVRKDPFY

SEQ ID NO: 2540104 - protein, 20 aa, Entamoeba dispar
SPLLNVFIAKLFTQKAYAPA

SEQ ID NO: 2540105 - protein, 25 aa, Entamoeba dispar
SPLLSRFDLIFVLVDNPDAEADKEL

SEQ ID NO: 2540106 - protein, 17 aa, Entamoeba dispar
SPLPSKESRIFVTNQDN

SEQ ID NO: 2540107 - protein, 27 aa, Entamoeba dispar
SPLTTGLLMTELFFIDGLAISSRLTSL

SEQ ID NO: 2540108 - protein, 18 aa, Entamoeba dispar
SPLYYFNFCIEDTPSYSI

SEQ ID NO: 2540109 - protein, 27 aa, Entamoeba dispar
SPMDAFLCIRGVKTLPMRMKVHMENGL

SEQ ID NO: 2540110 - protein, 25 aa, Entamoeba dispar
SPNERFIDILRGKVRKLFLGTLRDY

SEQ ID NO: 2540111 - protein, 26 aa, Entamoeba dispar
SPNERFIDILRGKVRKLFLGTLRDYC

SEQ ID NO: 2540112 - protein, 28 aa, Entamoeba dispar
SPNKLHFLPNYLFIPNPTKELDGKVLTL

SEQ ID NO: 2540113 - protein, 30 aa, Entamoeba dispar
SPNVLLSPSLPISPLPSLSSLFLYSKHSLH

SEQ ID NO: 2540114 - protein, 30 aa, Entamoeba dispar
SPPLHYISSDFFNLLKLHLSINGKVYFNIL

SEQ ID NO: 2540115 - protein, 21 aa, Entamoeba dispar
SPPVLRIVKQMYFEPVNIPCQ

SEQ ID NO: 2540116 - protein, 19 aa, Entamoeba dispar
SPQEFFFHAMAGRQGIIDT

SEQ ID NO: 2540117 - protein, 33 aa, Entamoeba dispar
SPQLIPHSVLSSYLFTIFLNYSYNSGSSTLILP

SEQ ID NO: 2540118 - protein, 26 aa, Entamoeba dispar
SPQRLKWFLEILGASYLLDKGASAFA

SEQ ID NO: 2540119 - protein, 44 aa, Entamoeba dispar
SPQYKKFKISAFLITPVQRLPRYKLLLADLLKYTPACHPDHENV

SEQ ID NO: 2540120 - protein, 17 aa, Entamoeba dispar
SPRCWWGFYGKLLNRQQ

SEQ ID NO: 2540121 - protein, 25 aa, Entamoeba dispar
SPRNRLLAVIIINKLFTLDKKNRSN

SEQ ID NO: 2540122 - protein, 24 aa, Entamoeba dispar
SPRSLFSPISILSPKTLFSPRTPK

SEQ ID NO: 2540123 - protein, 20 aa, Entamoeba dispar
SPRSLQSPALLPLIKEDPVQ

SEQ ID NO: 2540124 - protein, 19 aa, Entamoeba dispar
SPSAIPPATLPLTAISDLL

SEQ ID NO: 2540125 - protein, 30 aa, Entamoeba dispar
SPSIQPQPIIKNKYDILAQIQLEQQQQPSS

SEQ ID NO: 2540126 - protein, 32 aa, Entamoeba dispar
SPSKEEIPLIILYINKIFPFTFCENLLNDANF

SEQ ID NO: 2540127 - protein, 23 aa, Entamoeba dispar
SPSLRYFSQILRINRFREPPEDG

SEQ ID NO: 2540128 - protein, 22 aa, Entamoeba dispar
SPSPFVTCICRCGGIGLLLSLI

SEQ ID NO: 2540129 - protein, 20 aa, Entamoeba dispar
SPSPTGFILKSAPGIPILVD

SEQ ID NO: 2540130 - protein, 20 aa, Entamoeba dispar
SPSYIYRLVAQLYNPEDTFF

SEQ ID NO: 2540131 - protein, 23 aa, Entamoeba dispar
SPTAFNIFNLMNNFFLAIGNNPK

SEQ ID NO: 2540132 - protein, 29 aa, Entamoeba dispar
SPTEMVNTLDFINNVLLSCITTPISESVN

SEQ ID NO: 2540133 - protein, 21 aa, Entamoeba dispar
SPTFLIVNKSGKSIYFICANE

SEQ ID NO: 2540134 - protein, 25 aa, Entamoeba dispar
SPVAKPILGMLPGGSIITGLYDRGA

SEQ ID NO: 2540135 - protein, 29 aa, Entamoeba dispar
SPVEDKIIEQFQLLIQFIQQQKKEMEEEL

SEQ ID NO: 2540136 - protein, 29 aa, Entamoeba dispar
SPVFHQFIECVFILLQQYPTSFQYNEDFL

SEQ ID NO: 2540137 - protein, 19 aa, Entamoeba dispar
SPVIQYLAAFGIGKLVIVD

SEQ ID NO: 2540138 - protein, 18 aa, Entamoeba dispar
SPVWLATISSNSITGRKC

SEQ ID NO: 2540139 - protein, 19 aa, Entamoeba dispar
SPWIFWFESGKDSDRSTSI

SEQ ID NO: 2540140 - protein, 18 aa, Entamoeba dispar
SPYLYNLDPTLLLHLSQI

SEQ ID NO: 2540141 - protein, 27 aa, Entamoeba dispar
SPYRGNGMVPLIRPSYINNPTQRQSIY

SEQ ID NO: 2540142 - protein, 24 aa, Entamoeba dispar
SPYSNLYCKLLIKKWNKMPNMMEQ

SEQ ID NO: 2540143 - protein, 35 aa, Entamoeba dispar
SQAKLQFSELIRNVTKFLYGLREGLGQLLQKIPEM

SEQ ID NO: 2540144 - protein, 30 aa, Entamoeba dispar
SQALSQWCDDFIGFFTINLSIQPTLLNYIT

SEQ ID NO: 2540145 - protein, 17 aa, Entamoeba dispar
SQAVLINNPIRVLTSSI

SEQ ID NO: 2540146 - protein, 19 aa, Entamoeba dispar
SQCSSLTMINISTSVYKIG

SEQ ID NO: 2540147 - protein, 34 aa, Entamoeba dispar
SQDCIFSTIIPYIDKPWYLKFNNSAIYSDNTEDL

SEQ ID NO: 2540148 - protein, 47 aa, Entamoeba dispar
SQDSPSGEMIPPKKVPIGGVPLFGGFNPGKVALKKTSYPKEEKESST

SEQ ID NO: 2540149 - protein, 17 aa, Entamoeba dispar
SQECAVWRNIYLSGAHD

SEQ ID NO: 2540150 - protein, 30 aa, Entamoeba dispar
SQECIDLITLLLYKGDYLFFKDINSLIPII

SEQ ID NO: 2540151 - protein, 19 aa, Entamoeba dispar
SQEEELYFLELKQKKNDAK

SEQ ID NO: 2540152 - protein, 18 aa, Entamoeba dispar
SQEIIYPSIIKAAERISN

SEQ ID NO: 2540153 - protein, 25 aa, Entamoeba dispar
SQEKKYLFFTIKKIAEYLKGEFAVY

SEQ ID NO: 2540154 - protein, 22 aa, Entamoeba dispar
SQERKQFYAGQLVQFIGKGKRQ

SEQ ID NO: 2540155 - protein, 23 aa, Entamoeba dispar
SQFFSFVTFHLWAYGEYTINYNI

SEQ ID NO: 2540156 - protein, 26 aa, Entamoeba dispar
SQFQVDLYRLFIRKNFQLANLWVGKL

SEQ ID NO: 2540157 - protein, 22 aa, Entamoeba dispar
SQFQYLFISQKYPLLSLSLKQI

SEQ ID NO: 2540158 - protein, 18 aa, Entamoeba dispar
SQFSYFNDTERECIKYIN

SEQ ID NO: 2540159 - protein, 24 aa, Entamoeba dispar
SQFTLYAILNGTKPDFHKSMRAEK

SEQ ID NO: 2540160 - protein, 25 aa, Entamoeba dispar
SQGISLMWSLFDKEMKHQFLGVVAN

SEQ ID NO: 2540161 - protein, 25 aa, Entamoeba dispar
SQHEDMLFKVIFKLTNKMGEEIATL

SEQ ID NO: 2540162 - protein, 26 aa, Entamoeba dispar
SQHLKTLPKYLNSLNLIKLDLSDNQI

SEQ ID NO: 2540163 - protein, 25 aa, Entamoeba dispar
SQICMQIIVLAILCYKMPCYYICDK

SEQ ID NO: 2540164 - protein, 27 aa, Entamoeba dispar
SQIDFSNKPFFFIYGNRESSLKVGFSL

SEQ ID NO: 2540165 - protein, 23 aa, Entamoeba dispar
SQIDMVLEFLIKNGYFLTNEDLT

SEQ ID NO: 2540166 - protein, 18 aa, Entamoeba dispar
SQIFYERCKRIKKIAIFI

SEQ ID NO: 2540167 - protein, 22 aa, Entamoeba dispar
SQILIVCLDLLPSPFINDIPNQ

SEQ ID NO: 2540168 - protein, 28 aa, Entamoeba dispar
SQILNFTYKNLPMQLLYSLQFSGQIHQI

SEQ ID NO: 2540169 - protein, 21 aa, Entamoeba dispar
SQILPFYHLINVYAPLTSSLP

SEQ ID NO: 2540170 - protein, 21 aa, Entamoeba dispar
SQIMIIGMKGITLDSIGYKNC

SEQ ID NO: 2540171 - protein, 25 aa, Entamoeba dispar
SQIQMIIPEMKTVYSQFLLTSYQDT

SEQ ID NO: 2540172 - protein, 17 aa, Entamoeba dispar
SQISFPPYLVSIGDNAF

SEQ ID NO: 2540173 - protein, 23 aa, Entamoeba dispar
SQISPYYLPPYNSTQSPCQEIPL

SEQ ID NO: 2540174 - protein, 24 aa, Entamoeba dispar
SQKKNLLSAPTLYMTDEKADKLKQ

SEQ ID NO: 2540175 - protein, 30 aa, Entamoeba dispar
SQLAKPLELPQMFYMPFTVEDIQQLLQQPQ

SEQ ID NO: 2540176 - protein, 23 aa, Entamoeba dispar
SQLEIEFFLIRTTSSVFDELEKT

SEQ ID NO: 2540177 - protein, 17 aa, Entamoeba dispar
SQLFPRSNILPYKCFSL

SEQ ID NO: 2540178 - protein, 21 aa, Entamoeba dispar
SQLFTLLYQRLVEYSQKGKIT

SEQ ID NO: 2540179 - protein, 24 aa, Entamoeba dispar
SQLIQVICGIYPLSQLREPYSIVR

SEQ ID NO: 2540180 - protein, 27 aa, Entamoeba dispar
SQLKASIKNVLFSLPMNTIVVTGHGSN

SEQ ID NO: 2540181 - protein, 21 aa, Entamoeba dispar
SQLLTFMHKVAPRGMYTSGRG

SEQ ID NO: 2540182 - protein, 20 aa, Entamoeba dispar
SQMILGFFKQIDKLPEFINF

SEQ ID NO: 2540183 - protein, 21 aa, Entamoeba dispar
SQMIRTIPITFYKYKTTTPMN

SEQ ID NO: 2540184 - protein, 24 aa, Entamoeba dispar
SQMRFDDLFIWTLKLEHKIPLQYI

SEQ ID NO: 2540185 - protein, 26 aa, Entamoeba dispar
SQNFLNNWVLILRKLYKTNTLSNIYE

SEQ ID NO: 2540186 - protein, 25 aa, Entamoeba dispar
SQNKRQYIFITPHNLDGVVSSDNVK

SEQ ID NO: 2540187 - protein, 19 aa, Entamoeba dispar
SQNKWNIWSWWSQPNQEFT

SEQ ID NO: 2540188 - protein, 18 aa, Entamoeba dispar
SQNPYPFQQTINLPNCVV

SEQ ID NO: 2540189 - protein, 32 aa, Entamoeba dispar
SQPRLEELLHLPFIHLTQLVPLFNSLKDDFSE

SEQ ID NO: 2540190 - protein, 23 aa, Entamoeba dispar
SQQFAGLFFKCYETQFSSITSVT

SEQ ID NO: 2540191 - protein, 23 aa, Entamoeba dispar
SQQILNRIKWVAGGKKQNWEEFC

SEQ ID NO: 2540192 - protein, 17 aa, Entamoeba dispar
SQQLIPELCLSPRVVRI

SEQ ID NO: 2540193 - protein, 28 aa, Entamoeba dispar
SQQNQIEILPLILPPTKSSDIVPSFTLA

SEQ ID NO: 2540194 - protein, 18 aa, Entamoeba dispar
SQQYRLVQLRNEKGEIIR

SEQ ID NO: 2540195 - protein, 25 aa, Entamoeba dispar
SQRALREIYVEAFRIALQGNPMTLM

SEQ ID NO: 2540196 - protein, 18 aa, Entamoeba dispar
SQREAFIATLFDCSLAAK

SEQ ID NO: 2540197 - protein, 23 aa, Entamoeba dispar
SQRLKLLKAQRNYLNKVLSFTNP

SEQ ID NO: 2540198 - protein, 22 aa, Entamoeba dispar
SQRPYPPQLFLKEDPMAFSRRP

SEQ ID NO: 2540199 - protein, 23 aa, Entamoeba dispar
SQRPYPPQLFLKEDPMAFSRRPS

SEQ ID NO: 2540200 - protein, 25 aa, Entamoeba dispar
SQRSKGFGFVTFEKDEDAKKAIEEM

SEQ ID NO: 2540201 - protein, 27 aa, Entamoeba dispar
SQRWLPEIKHFCPNAPFLLAATKTDLR

SEQ ID NO: 2540202 - protein, 26 aa, Entamoeba dispar
SQRYKQKALMLLKQKKQHEQHRDITE

SEQ ID NO: 2540203 - protein, 25 aa, Entamoeba dispar
SQSENNFSILSLPKKIKTETYSGIS

SEQ ID NO: 2540204 - protein, 24 aa, Entamoeba dispar
SQSIERYFYLIIGSLNAYTGNEQN

SEQ ID NO: 2540205 - protein, 25 aa, Entamoeba dispar
SQSIERYFYLVIGSLNAYTGNEQNN

SEQ ID NO: 2540206 - protein, 26 aa, Entamoeba dispar
SQSQEPLPLPPLLATKLLQVVSNNPN

SEQ ID NO: 2540207 - protein, 25 aa, Entamoeba dispar
SQSRTEYIFIRGNQVRFVVLPEMFK

SEQ ID NO: 2540208 - protein, 27 aa, Entamoeba dispar
SQTIYTLLIRRMKLCSFLILTKNDDEI

SEQ ID NO: 2540209 - protein, 23 aa, Entamoeba dispar
SQTKIYVTQPRRISAVGLSSRVI

SEQ ID NO: 2540210 - protein, 24 aa, Entamoeba dispar
SQTSFRLLFKMIKIVEYIHSKQII

SEQ ID NO: 2540211 - protein, 27 aa, Entamoeba dispar
SQTTPSKQLNFLPPSKYPQSPSQQRKQ

SEQ ID NO: 2540212 - protein, 30 aa, Entamoeba dispar
SQVILSVIKYFSNLILLSPLVLEKEEQVLS

SEQ ID NO: 2540213 - protein, 26 aa, Entamoeba dispar
SQVVPPLIDMSFFSAGLKPQRYQNNI

SEQ ID NO: 2540214 - protein, 18 aa, Entamoeba dispar
SQYFQFPFPICLIDSNQS

SEQ ID NO: 2540215 - protein, 25 aa, Entamoeba dispar
SQYSKQSLFWQLLDKKQIDCSVEKS

SEQ ID NO: 2540216 - protein, 24 aa, Entamoeba dispar
SQYYEKFMVLYQQYKIALHVKCSN

SEQ ID NO: 2540217 - protein, 23 aa, Entamoeba dispar
SRALQFWLDFLKVADIKTDSCDL

SEQ ID NO: 2540218 - protein, 20 aa, Entamoeba dispar
SRALRIQLVNKFKSYFNKAI

SEQ ID NO: 2540219 - protein, 21 aa, Entamoeba dispar
SRAPPEYLFNVNFGDIFVVRS

SEQ ID NO: 2540220 - protein, 17 aa, Entamoeba dispar
SRCSEFKRKLSLVGKKI

SEQ ID NO: 2540221 - protein, 19 aa, Entamoeba dispar
SRDICKIYSLFAETIISTT

SEQ ID NO: 2540222 - protein, 32 aa, Entamoeba dispar
SRDIFQSLDLAWSLLRTFPRDMLKRISNETLD

SEQ ID NO: 2540223 - protein, 26 aa, Entamoeba dispar
SRDRLSQILIYFINNKIQDASDLLDD

SEQ ID NO: 2540224 - protein, 25 aa, Entamoeba dispar
SREFYHQFILSRSPENVWFIVSENF

SEQ ID NO: 2540225 - protein, 19 aa, Entamoeba dispar
SREKWHRRTKYYAQGKTKE

SEQ ID NO: 2540226 - protein, 25 aa, Entamoeba dispar
SRENDVCYLCGKTGHWARDCNEKRY

SEQ ID NO: 2540227 - protein, 17 aa, Entamoeba dispar
SREPLLFKQLFSDWVEP

SEQ ID NO: 2540228 - protein, 22 aa, Entamoeba dispar
SREQLFILHKILNNSLESQEIK

SEQ ID NO: 2540229 - protein, 26 aa, Entamoeba dispar
SREVKLIHQWIATLVGQPIRSMREWA

SEQ ID NO: 2540230 - protein, 18 aa, Entamoeba dispar
SREYGVVVPLVLMNSFST

SEQ ID NO: 2540231 - protein, 24 aa, Entamoeba dispar
SRFGHIVLTFTPLLRVYSDYCQTY

SEQ ID NO: 2540232 - protein, 24 aa, Entamoeba dispar
SRFHRPLFIEIHTISVFVPVINGK

SEQ ID NO: 2540233 - protein, 21 aa, Entamoeba dispar
SRGFGYVEFKSIEGAIKAIEM

SEQ ID NO: 2540234 - protein, 18 aa, Entamoeba dispar
SRGVLFYGPPGCGKTMMA

SEQ ID NO: 2540235 - protein, 22 aa, Entamoeba dispar
SRGYHLYKHILWLIDHCYIDHI

SEQ ID NO: 2540236 - protein, 24 aa, Entamoeba dispar
SRHCVFLCRHGFRLDYTDLSWVPN

SEQ ID NO: 2540237 - protein, 32 aa, Entamoeba dispar
SRHKSSPIKATSGLFVFIISFEPKEAVNFKKA

SEQ ID NO: 2540238 - protein, 26 aa, Entamoeba dispar
SRHPPPSLNFAYLLQVQQQSTCRIKT

SEQ ID NO: 2540239 - protein, 29 aa, Entamoeba dispar
SRIACLRLIIFLLRKDIKMFKFVYAKVGI

SEQ ID NO: 2540240 - protein, 18 aa, Entamoeba dispar
SRIFLKTHPKTKLPESMA

SEQ ID NO: 2540241 - protein, 30 aa, Entamoeba dispar
SRIHFNIYTYLIDSLPPNVLIPLLQKSVPC

SEQ ID NO: 2540242 - protein, 25 aa, Entamoeba dispar
SRIIRDMFALAKSKAPAIIFIDEID

SEQ ID NO: 2540243 - protein, 28 aa, Entamoeba dispar
SRIITLRKKLIEILPKIPKSIDYFEQVN

SEQ ID NO: 2540244 - protein, 20 aa, Entamoeba dispar
SRINGCGFLGYSFDSIVNAF

SEQ ID NO: 2540245 - protein, 31 aa, Entamoeba dispar
SRKALSNALLVYHILLEGATIQFFRSKISHY

SEQ ID NO: 2540246 - protein, 20 aa, Entamoeba dispar
SRKCFQKLESASRKSKVLPE

SEQ ID NO: 2540247 - protein, 18 aa, Entamoeba dispar
SRKFSKDKRVYLGALKFL

SEQ ID NO: 2540248 - protein, 23 aa, Entamoeba dispar
SRKYKHFFEYFKINPNDNILYFP

SEQ ID NO: 2540249 - protein, 23 aa, Entamoeba dispar
SRKYWHFIKVMGRSASHIALEAA

SEQ ID NO: 2540250 - protein, 25 aa, Entamoeba dispar
SRLLNLTKVPLKRVFQRYNPKDNMS

SEQ ID NO: 2540251 - protein, 27 aa, Entamoeba dispar
SRLSWREFFAHQFVYRAMQHHAAQACF

SEQ ID NO: 2540252 - protein, 30 aa, Entamoeba dispar
SRLYSAILEQFGVALLKYAKKFPFQNQFCQ

SEQ ID NO: 2540253 - protein, 18 aa, Entamoeba dispar
SRMLGMLEEYNRQLYQGT

SEQ ID NO: 2540254 - protein, 24 aa, Entamoeba dispar
SRNDTLTLYLFLSKLIQPTELVMA

SEQ ID NO: 2540255 - protein, 21 aa, Entamoeba dispar
SRNIQCIIKRNAVYTGTPDEM

SEQ ID NO: 2540256 - protein, 24 aa, Entamoeba dispar
SRNLPCLMVLKRHSLDQMILLTGK

SEQ ID NO: 2540257 - protein, 25 aa, Entamoeba dispar
SRNRKLWNELFYWNSFNTPLTKELL

SEQ ID NO: 2540258 - protein, 33 aa, Entamoeba dispar
SRNSIIRYILANKSYFFNLSYKPNELSMYLVIP

SEQ ID NO: 2540259 - protein, 30 aa, Entamoeba dispar
SRQEAVSMIPPLFLNVKPYHDVLDLCAAPG

SEQ ID NO: 2540260 - protein, 30 aa, Entamoeba dispar
SRQIRGKVAAFFLFIAPPSMEILEQRLRLR

SEQ ID NO: 2540261 - protein, 23 aa, Entamoeba dispar
SRQLNYFTNLYRPVLAYKEIQEN

SEQ ID NO: 2540262 - protein, 25 aa, Entamoeba dispar
SRQVLKESRLFLWNDKIREHWNSYE

SEQ ID NO: 2540263 - protein, 26 aa, Entamoeba dispar
SRQYDDLNSRFRYLNTISPENLNAVR

SEQ ID NO: 2540264 - protein, 27 aa, Entamoeba dispar
SRQYDDLNSRFRYLNTISPENLNAVRA

SEQ ID NO: 2540265 - protein, 22 aa, Entamoeba dispar
SRRTVPPGFFTPSPTGVLYVEP

SEQ ID NO: 2540266 - protein, 22 aa, Entamoeba dispar
SRRTVPPGFFTPSPTGVSYVEP

SEQ ID NO: 2540267 - protein, 27 aa, Entamoeba dispar
SRSFHPRDLLMLIWDKLKEDGERIVFP

SEQ ID NO: 2540268 - protein, 25 aa, Entamoeba dispar
SRSFIESLPFSKPLSKVLLISNDWK

SEQ ID NO: 2540269 - protein, 39 aa, Entamoeba dispar
SRSSTILIAYLMYKKMWSYKEAVIFIKKKRPIISPNSGF

SEQ ID NO: 2540270 - protein, 27 aa, Entamoeba dispar
SRSTRARPKTMNLTMAGSRLSEKLDLE

SEQ ID NO: 2540271 - protein, 24 aa, Entamoeba dispar
SRTEFVWIPEIVIDFTHAYQVDGR

SEQ ID NO: 2540272 - protein, 28 aa, Entamoeba dispar
SRTIYQSHFLEHILFLLGNRCVNCERHM

SEQ ID NO: 2540273 - protein, 29 aa, Entamoeba dispar
SRTLSYKHLLRLYGRMNLLLSQIDKKQQL

SEQ ID NO: 2540274 - protein, 27 aa, Entamoeba dispar
SRTTPIPIGGYIFVTIIADLKKINSVV

SEQ ID NO: 2540275 - protein, 18 aa, Entamoeba dispar
SRVLLLDERFLSILIHFY

SEQ ID NO: 2540276 - protein, 23 aa, Entamoeba dispar
SRYNEIIQLYLATSAQQEQIPIQ

SEQ ID NO: 2540277 - protein, 33 aa, Entamoeba dispar
SSADALIVGSYFKVDGFWKNELSKERILKLISA

SEQ ID NO: 2540278 - protein, 19 aa, Entamoeba dispar
SSAGLIYKYYGREIIIKLC

SEQ ID NO: 2540279 - protein, 17 aa, Entamoeba dispar
SSAKDMLILYNDSMRRL

SEQ ID NO: 2540280 - protein, 25 aa, Entamoeba dispar
SSALNVIFPYPFISSIILASSRKKP

SEQ ID NO: 2540281 - protein, 34 aa, Entamoeba dispar
SSAREYLSLCTIQHLSLIKTLLKPSLKDTSPSNG

SEQ ID NO: 2540282 - protein, 23 aa, Entamoeba dispar
SSARKFICCGPVFAIQNMNDFPS

SEQ ID NO: 2540283 - protein, 26 aa, Entamoeba dispar
SSCPDIRLVWIHRSPYDIIKSSIPYF

SEQ ID NO: 2540284 - protein, 30 aa, Entamoeba dispar
SSDAWQILTNLFDCLPLSALIDQRYFCVHG

SEQ ID NO: 2540285 - protein, 23 aa, Entamoeba dispar
SSDDDLLFILRSNKDLILSNYEG

SEQ ID NO: 2540286 - protein, 29 aa, Entamoeba dispar
SSDDYCYLHDFYLLPSFRGQGLGHKLMYK

SEQ ID NO: 2540287 - protein, 18 aa, Entamoeba dispar
SSDFHLIYHCIVSLFLQS

SEQ ID NO: 2540288 - protein, 22 aa, Entamoeba dispar
SSDGDMRIIPFIRTMKLVSDAI

SEQ ID NO: 2540289 - protein, 25 aa, Entamoeba dispar
SSDIIQVFFQFLSKYGFDYNSLNNQ

SEQ ID NO: 2540290 - protein, 22 aa, Entamoeba dispar
SSDILFSKIKLLSNNRVSTVNI

SEQ ID NO: 2540291 - protein, 31 aa, Entamoeba dispar
SSDQMLHFYVLISHVILLKDVLLKAPSAEAV

SEQ ID NO: 2540292 - protein, 25 aa, Entamoeba dispar
SSDRSIHIWDPNLPIPTIEKIRNVR

SEQ ID NO: 2540293 - protein, 18 aa, Entamoeba dispar
SSEHYVVYGEPRNEYMDE

SEQ ID NO: 2540294 - protein, 23 aa, Entamoeba dispar
SSEIIIKPFSFIQALFILINSDI

SEQ ID NO: 2540295 - protein, 24 aa, Entamoeba dispar
SSEIKMKLLFPPKLDNDEWKEKPI

SEQ ID NO: 2540296 - protein, 27 aa, Entamoeba dispar
SSEKEKEIILPLLKWKGKCIDLSTSMF

SEQ ID NO: 2540297 - protein, 28 aa, Entamoeba dispar
SSEKREFMRELLLFPTIRELTCDNYFLD

SEQ ID NO: 2540298 - protein, 37 aa, Entamoeba dispar
SSELFPQKRGFFDNLYQMIFHPIEYFSPKETKLGEVK

SEQ ID NO: 2540299 - protein, 26 aa, Entamoeba dispar
SSELSYETKWLLLQRHSPDASQSKLR

SEQ ID NO: 2540300 - protein, 18 aa, Entamoeba dispar
SSEPIAHHPLWEQILKEL

SEQ ID NO: 2540301 - protein, 23 aa, Entamoeba dispar
SSERLFPILKSLNNLVATKSPIE

SEQ ID NO: 2540302 - protein, 17 aa, Entamoeba dispar
SSEWRERRISCLLLGEM

SEQ ID NO: 2540303 - protein, 22 aa, Entamoeba dispar
SSEWYVELFVDYVRNGKMPLVI

SEQ ID NO: 2540304 - protein, 23 aa, Entamoeba dispar
SSFAIGMKVMFPKTLGKISKRGG

SEQ ID NO: 2540305 - protein, 27 aa, Entamoeba dispar
SSFDINNFQYIKSLIDKIIISDELEVH

SEQ ID NO: 2540306 - protein, 20 aa, Entamoeba dispar
SSFEYLLMQIVMNRQKESET

SEQ ID NO: 2540307 - protein, 29 aa, Entamoeba dispar
SSFKDVFNQYLPFNPFLFAQKKQQIEFKP

SEQ ID NO: 2540308 - protein, 17 aa, Entamoeba dispar
SSFKQFTLFNIFSTAFL

SEQ ID NO: 2540309 - protein, 18 aa, Entamoeba dispar
SSFNFRYEVLKKGENPTT

SEQ ID NO: 2540310 - protein, 33 aa, Entamoeba dispar
SSFNKPIPHDFPFPPIFPLYQPSLRSQISAKYS

SEQ ID NO: 2540311 - protein, 19 aa, Entamoeba dispar
SSFNLPVIISKGILKTLEV

SEQ ID NO: 2540312 - protein, 21 aa, Entamoeba dispar
SSFRDGVLLTILFNKLNNITS

SEQ ID NO: 2540313 - protein, 25 aa, Entamoeba dispar
SSGAISWIMKYPGGYIKIIDLITQK

SEQ ID NO: 2540314 - protein, 34 aa, Entamoeba dispar
SSGAPPPLNAPPPPPPLNAPPPPPPPARGTSSGA

SEQ ID NO: 2540315 - protein, 21 aa, Entamoeba dispar
SSGIWSWMGYSNVINSQLTED

SEQ ID NO: 2540316 - protein, 31 aa, Entamoeba dispar
SSGKIHIYQSIPYWVWMILKEENNEVEEIEY

SEQ ID NO: 2540317 - protein, 20 aa, Entamoeba dispar
SSGKIVAAPPPLKKKRVTKP

SEQ ID NO: 2540318 - protein, 33 aa, Entamoeba dispar
SSGYYRVRLMNLLPFDKILGGLAWGISATCYPL

SEQ ID NO: 2540319 - protein, 23 aa, Entamoeba dispar
SSHPLIVLNRLPTTIPTQLLNEE

SEQ ID NO: 2540320 - protein, 22 aa, Entamoeba dispar
SSIELAIKRIFLNGQISIDGSK

SEQ ID NO: 2540321 - protein, 25 aa, Entamoeba dispar
SSIERKFIFLISLQLEIVSCQEMIK

SEQ ID NO: 2540322 - protein, 17 aa, Entamoeba dispar
SSIGKPLTGLIPTVTDK

SEQ ID NO: 2540323 - protein, 26 aa, Entamoeba dispar
SSIIQTFFVIQLLQKKFNEHKIEWKL

SEQ ID NO: 2540324 - protein, 30 aa, Entamoeba dispar
SSIKLLDPIMYLMSQMIHWSITPIKLNPRT

SEQ ID NO: 2540325 - protein, 26 aa, Entamoeba dispar
SSIKRSIRIFWSNKVPKGYFNKEFIR

SEQ ID NO: 2540326 - protein, 19 aa, Entamoeba dispar
SSILPIPRVKFYATELLLA

SEQ ID NO: 2540327 - protein, 30 aa, Entamoeba dispar
SSILSGKLLTFYYHLIEELKFTNKEEAVPN

SEQ ID NO: 2540328 - protein, 24 aa, Entamoeba dispar
SSIMDPFYIVLHFLCLHNVNETTK

SEQ ID NO: 2540329 - protein, 23 aa, Entamoeba dispar
SSINQMIHFLSLSKEYLSLDYFD

SEQ ID NO: 2540330 - protein, 24 aa, Entamoeba dispar
SSIPLSLKKYLYSQLPVLEQFNIS

SEQ ID NO: 2540331 - protein, 25 aa, Entamoeba dispar
SSIPNSKFFYYYPSGTNEFRKVFFS

SEQ ID NO: 2540332 - protein, 17 aa, Entamoeba dispar
SSIQIPPPPRLGDLHVG

SEQ ID NO: 2540333 - protein, 19 aa, Entamoeba dispar
SSISPKKFMRKKLGKTSCV

SEQ ID NO: 2540334 - protein, 23 aa, Entamoeba dispar
SSISYICSRYYRAPELIFDCTHY

SEQ ID NO: 2540335 - protein, 22 aa, Entamoeba dispar
SSITLFFDNKLNMIKIIEVARL

SEQ ID NO: 2540336 - protein, 26 aa, Entamoeba dispar
SSITQRKVFELALLSSNTILLERLSS

SEQ ID NO: 2540337 - protein, 23 aa, Entamoeba dispar
SSITSFGWGCFYKCGCEDELKKN

SEQ ID NO: 2540338 - protein, 24 aa, Entamoeba dispar
SSITSFGWGCFYKCGCEEELMKNE

SEQ ID NO: 2540339 - protein, 20 aa, Entamoeba dispar
SSIVICEYGYYYNGSICTQC

SEQ ID NO: 2540340 - protein, 51 aa, Entamoeba dispar
SSIVTQFSNVFIILRPHQYGILIEIYRKENIPLFGPLVTGSIVCFHEIAKL

SEQ ID NO: 2540341 - protein, 23 aa, Entamoeba dispar
SSKDSHCWWINHRSHYPKLYEES

SEQ ID NO: 2540342 - protein, 25 aa, Entamoeba dispar
SSKEQKIQFMLKKKYQNLRNDRKSD

SEQ ID NO: 2540343 - protein, 23 aa, Entamoeba dispar
SSKFTILLNRELLNNLVIMATAQ

SEQ ID NO: 2540344 - protein, 17 aa, Entamoeba dispar
SSKFYIQLQLYSVPLEN

SEQ ID NO: 2540345 - protein, 25 aa, Entamoeba dispar
SSKHYFIPHFGLLPSLNLLSIESLK

SEQ ID NO: 2540346 - protein, 25 aa, Entamoeba dispar
SSKKFQYLFEYFKSNPIPLNDETIK

SEQ ID NO: 2540347 - protein, 17 aa, Entamoeba dispar
SSKKKPLLLILQNYDPA

SEQ ID NO: 2540348 - protein, 28 aa, Entamoeba dispar
SSKNLFGIFYGYWLKVNKTYIIDPMIYE

SEQ ID NO: 2540349 - protein, 23 aa, Entamoeba dispar
SSKNYLAFIKTLKPFVSDTYQVA

SEQ ID NO: 2540350 - protein, 17 aa, Entamoeba dispar
SSKQPFVPFIGVTLHHI

SEQ ID NO: 2540351 - protein, 47 aa, Entamoeba dispar
SSKQYDVLYIFYRNIKHFLFIQRKLFVSQLFCFYISYEDPINLRIEK

SEQ ID NO: 2540352 - protein, 23 aa, Entamoeba dispar
SSKTALTIRLTIDTPIVAPNIFI

SEQ ID NO: 2540353 - protein, 22 aa, Entamoeba dispar
SSKWLYHINKILKGTYLTTNKF

SEQ ID NO: 2540354 - protein, 22 aa, Entamoeba dispar
SSKYCMKYLRRYCKATPMTIHS

SEQ ID NO: 2540355 - protein, 17 aa, Entamoeba dispar
SSLALDVLYIIYVTLVN

SEQ ID NO: 2540356 - protein, 24 aa, Entamoeba dispar
SSLALKLSVIFLICADFIPEKKDL

SEQ ID NO: 2540357 - protein, 31 aa, Entamoeba dispar
SSLEKINVPAPYWIVGKHLFFNKLKLVGCEL

SEQ ID NO: 2540358 - protein, 24 aa, Entamoeba dispar
SSLKKTYLLSLLPISFSTIKQNEE

SEQ ID NO: 2540359 - protein, 22 aa, Entamoeba dispar
SSLLKKLWENEKLLDKYNLSEE

SEQ ID NO: 2540360 - protein, 18 aa, Entamoeba dispar
SSLLKRFVRDIPGGLIDI

SEQ ID NO: 2540361 - protein, 18 aa, Entamoeba dispar
SSLNAMFLEKNTPKIKKL

SEQ ID NO: 2540362 - protein, 23 aa, Entamoeba dispar
SSLNKIFTTIDLILDVSLAQEFL

SEQ ID NO: 2540363 - protein, 25 aa, Entamoeba dispar
SSLNTTNLGLLKFSNPFSSRLNQNT

SEQ ID NO: 2540364 - protein, 18 aa, Entamoeba dispar
SSLPGFGLLLFNNYDCDI

SEQ ID NO: 2540365 - protein, 20 aa, Entamoeba dispar
SSLSYWKYQINYTNLRLYSR

SEQ ID NO: 2540366 - protein, 21 aa, Entamoeba dispar
SSLTHQLFKIKALIFDNEYFN

SEQ ID NO: 2540367 - protein, 29 aa, Entamoeba dispar
SSLTQIPTNCSVLIYGFLPSLQLNEIPPN

SEQ ID NO: 2540368 - protein, 24 aa, Entamoeba dispar
SSLTTINIPTTIRKLRKKCFSQCK

SEQ ID NO: 2540369 - protein, 22 aa, Entamoeba dispar
SSLTTIYIPTSISKIGYGCFCK

SEQ ID NO: 2540370 - protein, 22 aa, Entamoeba dispar
SSLTTIYIPTSISKIGYGCFEC

SEQ ID NO: 2540371 - protein, 23 aa, Entamoeba dispar
SSLYGSKIFKPVKFMVGRCPLSE

SEQ ID NO: 2540372 - protein, 23 aa, Entamoeba dispar
SSLYHFEKHYKSMDKNHAMIKNA

SEQ ID NO: 2540373 - protein, 27 aa, Entamoeba dispar
SSMKNELPWWKTVFAIVMKYISTNCPQ

SEQ ID NO: 2540374 - protein, 32 aa, Entamoeba dispar
SSMNSFLLYLIQESVITPFLSSPLFFGMLEQV

SEQ ID NO: 2540375 - protein, 30 aa, Entamoeba dispar
SSMNTYKQLFGQKDFGIFCVTKYGNVFGIF

SEQ ID NO: 2540376 - protein, 23 aa, Entamoeba dispar
SSNFNILLLSSKAGGVGLNLIGC

SEQ ID NO: 2540377 - protein, 23 aa, Entamoeba dispar
SSNKFNITIQFIKEIIIKSKEKV

SEQ ID NO: 2540378 - protein, 25 aa, Entamoeba dispar
SSNKRQYIFITPHNLDGVISTDSVK

SEQ ID NO: 2540379 - protein, 17 aa, Entamoeba dispar
SSNPELYLLYVTPEQIK

SEQ ID NO: 2540380 - protein, 22 aa, Entamoeba dispar
SSNQYISLEGFLPIVYERKVFG

SEQ ID NO: 2540381 - protein, 25 aa, Entamoeba dispar
SSNTGIFQTLFPKLEDLNKIILINQ

SEQ ID NO: 2540382 - protein, 22 aa, Entamoeba dispar
SSNYYSYQFSFKPELQSYQEAR

SEQ ID NO: 2540383 - protein, 18 aa, Entamoeba dispar
SSPFSSVSSSSSLSSHLL

SEQ ID NO: 2540384 - protein, 20 aa, Entamoeba dispar
SSPIPLIKLTNLFSLVTDLE

SEQ ID NO: 2540385 - protein, 23 aa, Entamoeba dispar
SSPKPIKLPVPLQDDLPVCKFGK

SEQ ID NO: 2540386 - protein, 24 aa, Entamoeba dispar
SSPKTIPPYSIYPSTYQPPYTSTY

SEQ ID NO: 2540387 - protein, 36 aa, Entamoeba dispar
SSPNKTTASLVLGFIWMLFDKFQEKNIKLSMKEEGA

SEQ ID NO: 2540388 - protein, 25 aa, Entamoeba dispar
SSPNQSFIYYINSKTPFDVWNDDEI

SEQ ID NO: 2540389 - protein, 19 aa, Entamoeba dispar
SSPRRLRALSRESLRALSC

SEQ ID NO: 2540390 - protein, 23 aa, Entamoeba dispar
SSPSFIQYLSSLGGISLTLILPS

SEQ ID NO: 2540391 - protein, 23 aa, Entamoeba dispar
SSPSRLFFFKLESNIFDDLESPK

SEQ ID NO: 2540392 - protein, 24 aa, Entamoeba dispar
SSPVNSLFWNFVKTVKKRLSVTKD

SEQ ID NO: 2540393 - protein, 24 aa, Entamoeba dispar
SSQGLPYTILLDDNLNISNEAISV

SEQ ID NO: 2540394 - protein, 24 aa, Entamoeba dispar
SSQLLLRKVPPILTTLETMKPAAM

SEQ ID NO: 2540395 - protein, 24 aa, Entamoeba dispar
SSQNPAWPMTVINTIFAVAVEEMT

SEQ ID NO: 2540396 - protein, 24 aa, Entamoeba dispar
SSQRPKVILDIFKQIILSSKDESV

SEQ ID NO: 2540397 - protein, 24 aa, Entamoeba dispar
SSQYFDRIYDCAIELIKRGKAYVC

SEQ ID NO: 2540398 - protein, 24 aa, Entamoeba dispar
SSRDKDFGLLPRWENSRNYYHSRS

SEQ ID NO: 2540399 - protein, 31 aa, Entamoeba dispar
SSRDWSDLATLYIILKYRKWQLKDRRTQPLK

SEQ ID NO: 2540400 - protein, 26 aa, Entamoeba dispar
SSRFGHIVLTFTPLLRVYSDYCQTYP

SEQ ID NO: 2540401 - protein, 25 aa, Entamoeba dispar
SSRFGKFIEIQFSNGGKIVGCIMSS

SEQ ID NO: 2540402 - protein, 23 aa, Entamoeba dispar
SSRIQFLTFTAIQSIARAQEIVD

SEQ ID NO: 2540403 - protein, 17 aa, Entamoeba dispar
SSRSHCIFTVTVQIIRD

SEQ ID NO: 2540404 - protein, 17 aa, Entamoeba dispar
SSRWTPYRRAENKLLEE

SEQ ID NO: 2540405 - protein, 23 aa, Entamoeba dispar
SSSFAEYSILYDPQLIAGLTDAL

SEQ ID NO: 2540406 - protein, 23 aa, Entamoeba dispar
SSSFCSFEFMKQKDFIIREEKDK

SEQ ID NO: 2540407 - protein, 32 aa, Entamoeba dispar
SSSFFKQYIEILTLFYSKLVMFLKLNNEHKQT

SEQ ID NO: 2540408 - protein, 28 aa, Entamoeba dispar
SSSHSCWYDLLIKLSAILSFDCCEKIVL

SEQ ID NO: 2540409 - protein, 24 aa, Entamoeba dispar
SSSKLLFVEKLIKIFHSTEKKVVV

SEQ ID NO: 2540410 - protein, 28 aa, Entamoeba dispar
SSSLLYVYLHQYLWINTPIIYQLEQKFQ

SEQ ID NO: 2540411 - protein, 29 aa, Entamoeba dispar
SSSMFNKNPRWILFYELVLTTKEYVRQVS

SEQ ID NO: 2540412 - protein, 24 aa, Entamoeba dispar
SSSNQLPAVPPINSGRRALSQKIN

SEQ ID NO: 2540413 - protein, 23 aa, Entamoeba dispar
SSSRRRHYSRRYSSRSRSRSRSP

SEQ ID NO: 2540414 - protein, 25 aa, Entamoeba dispar
SSSRYFLDTLFQLFNDKKIIVVSSS

SEQ ID NO: 2540415 - protein, 26 aa, Entamoeba dispar
SSSSLLETLKLQLDLFYKTVENKNEN

SEQ ID NO: 2540416 - protein, 24 aa, Entamoeba dispar
SSSTDFLLYDSQGSSFFDEVILPQ

SEQ ID NO: 2540417 - protein, 18 aa, Entamoeba dispar
SSTALLIKSGIKKGYAIQ

SEQ ID NO: 2540418 - protein, 34 aa, Entamoeba dispar
SSTAPIISIKFPDPVIKIFYQPYEAKYPQIPKNL

SEQ ID NO: 2540419 - protein, 35 aa, Entamoeba dispar
SSTGRYLFCGYDDLGCLWWDVLKGDYITKLTGHEN

SEQ ID NO: 2540420 - protein, 30 aa, Entamoeba dispar
SSTKLYQNDLLFKVYLQKYNTHFLSLIGDH

SEQ ID NO: 2540421 - protein, 31 aa, Entamoeba dispar
SSTKLYQNDLLFKVYLQKYNTHFLSLIGDHA

SEQ ID NO: 2540422 - protein, 26 aa, Entamoeba dispar
SSTPLYYIHLTLDRSQFLYSTIMPNY

SEQ ID NO: 2540423 - protein, 24 aa, Entamoeba dispar
SSTPRFKSPRFFGKRGTLFESSRL

SEQ ID NO: 2540424 - protein, 30 aa, Entamoeba dispar
SSVEELELFLKSTCRVLGLNWDEMKQFFNT

SEQ ID NO: 2540425 - protein, 24 aa, Entamoeba dispar
SSVEYFCFKYNKSLLNDFKYALVW

SEQ ID NO: 2540426 - protein, 21 aa, Entamoeba dispar
SSVIARQLALFDQKLIKRVEK

SEQ ID NO: 2540427 - protein, 17 aa, Entamoeba dispar
SSVILYGTFLNGVVYSY

SEQ ID NO: 2540428 - protein, 17 aa, Entamoeba dispar
SSVKLMLKKLQTILLDP

SEQ ID NO: 2540429 - protein, 17 aa, Entamoeba dispar
SSVLPPRQLYSSQLQSL

SEQ ID NO: 2540430 - protein, 36 aa, Entamoeba dispar
SSVQLFYINHIQIHLRLLFALNFKEGCDPLPQTYLN

SEQ ID NO: 2540431 - protein, 22 aa, Entamoeba dispar
SSVQLLYSSTFFLKAGKLDITK

SEQ ID NO: 2540432 - protein, 17 aa, Entamoeba dispar
SSVSELRGWCFKNCKLL

SEQ ID NO: 2540433 - protein, 22 aa, Entamoeba dispar
SSVTILLPHVWPAQQVITPQDQ

SEQ ID NO: 2540434 - protein, 24 aa, Entamoeba dispar
SSVTILYHLIDFLYSINSIEKYHQ

SEQ ID NO: 2540435 - protein, 31 aa, Entamoeba dispar
SSVVDITILPFLFNSLNKSYLHLGVFLSVMN

SEQ ID NO: 2540436 - protein, 32 aa, Entamoeba dispar
SSVYLQRYPTTPLFPMLLNHEISLIRWKVEDG

SEQ ID NO: 2540437 - protein, 23 aa, Entamoeba dispar
SSYDFIKGCLIFIPKTAITKLAS

SEQ ID NO: 2540438 - protein, 17 aa, Entamoeba dispar
SSYFILRSFDEKELQHF

SEQ ID NO: 2540439 - protein, 22 aa, Entamoeba dispar
SSYLCDEFIAHRLGLIPIDSTQ

SEQ ID NO: 2540440 - protein, 19 aa, Entamoeba dispar
SSYTCTYNLIGRYPLLGNW

SEQ ID NO: 2540441 - protein, 21 aa, Entamoeba dispar
STAISVKPYIIQCGILNKIIQ

SEQ ID NO: 2540442 - protein, 21 aa, Entamoeba dispar
STALGPALLISTIIASKEPNG

SEQ ID NO: 2540443 - protein, 25 aa, Entamoeba dispar
STANFLFLNSVMKKGIIHPTLYDVM

SEQ ID NO: 2540444 - protein, 25 aa, Entamoeba dispar
STASQPKLLVNLKSSSTSSSPSNTN

SEQ ID NO: 2540445 - protein, 19 aa, Entamoeba dispar
STCFVKKFKGEKTEIITLT

SEQ ID NO: 2540446 - protein, 24 aa, Entamoeba dispar
STCIVGCYSCYFVETLDNESTVDW

SEQ ID NO: 2540447 - protein, 17 aa, Entamoeba dispar
STCLLVDVPLTSDIRKS

SEQ ID NO: 2540448 - protein, 20 aa, Entamoeba dispar
STCYKCVSGKYFDGSSCVNC

SEQ ID NO: 2540449 - protein, 25 aa, Entamoeba dispar
STDCVHFFPVIMNGLLNVNKILLEP

SEQ ID NO: 2540450 - protein, 21 aa, Entamoeba dispar
STDDFFLFGYNNYTNNPIYRK

SEQ ID NO: 2540451 - protein, 23 aa, Entamoeba dispar
STDGEFWEFTIKNPEIKTDNENI

SEQ ID NO: 2540452 - protein, 20 aa, Entamoeba dispar
STDIIFFLSQQLFDWKKVFR

SEQ ID NO: 2540453 - protein, 38 aa, Entamoeba dispar
STDKIKSMMFNDLNVPFLKIVNPALMALYAEGKETGVV

SEQ ID NO: 2540454 - protein, 29 aa, Entamoeba dispar
STEEEKLLHLIKIFPSQWQTISKSVGRTP

SEQ ID NO: 2540455 - protein, 20 aa, Entamoeba dispar
STEGFLFKTYHACGDNTFLV

SEQ ID NO: 2540456 - protein, 39 aa, Entamoeba dispar
STEIFFALTKLFMSKDLTMRRLLYVVLNDMIPMTSNSFI

SEQ ID NO: 2540457 - protein, 30 aa, Entamoeba dispar
STERLETIYEWLRKMSLLLHSVVVGYEYPG

SEQ ID NO: 2540458 - protein, 17 aa, Entamoeba dispar
STFILYSSPHQLTSNNF

SEQ ID NO: 2540459 - protein, 17 aa, Entamoeba dispar
STFVLNKCYFNFYQLPK

SEQ ID NO: 2540460 - protein, 25 aa, Entamoeba dispar
STGIKMILNMLISHPLHGIMIPIPQ

SEQ ID NO: 2540461 - protein, 35 aa, Entamoeba dispar
STGKSDVFIPYRDSRLTFMLKDSLGGNCKTVIIGT

SEQ ID NO: 2540462 - protein, 23 aa, Entamoeba dispar
STGMLILKPFIQNGMIKQIYKSY

SEQ ID NO: 2540463 - protein, 22 aa, Entamoeba dispar
STHLEDVILEKTCFPKQSLSSI

SEQ ID NO: 2540464 - protein, 36 aa, Entamoeba dispar
STHLFIVLDYMEGGELYYLILTQKALDITTSIKLFC

SEQ ID NO: 2540465 - protein, 19 aa, Entamoeba dispar
STIFATAAILEGCPFVNGS

SEQ ID NO: 2540466 - protein, 25 aa, Entamoeba dispar
STIKHKYFYIEKGILYSQNITWWTQ

SEQ ID NO: 2540467 - protein, 21 aa, Entamoeba dispar
STILPINDFISKDIPLRQCDI

SEQ ID NO: 2540468 - protein, 17 aa, Entamoeba dispar
STILQFIDGRFIETYQP

SEQ ID NO: 2540469 - protein, 29 aa, Entamoeba dispar
STILYESQGLVPLLRLAWNHFDPNFIATF

SEQ ID NO: 2540470 - protein, 30 aa, Entamoeba dispar
STILYESQGLVPLLRLAWNHFDPNFIATFS

SEQ ID NO: 2540471 - protein, 24 aa, Entamoeba dispar
STIMMQLIQSLKFEATPLSDLAIF

SEQ ID NO: 2540472 - protein, 33 aa, Entamoeba dispar
STINLLKISIIRFRKFMRINLGLMFTKVINQIL

SEQ ID NO: 2540473 - protein, 26 aa, Entamoeba dispar
STINLPYLPLLPYENKFLIKFKKQNN

SEQ ID NO: 2540474 - protein, 38 aa, Entamoeba dispar
STIPYPYLEFAKQKSIPIIYLISLYNPSKRIQKFKFNS

SEQ ID NO: 2540475 - protein, 25 aa, Entamoeba dispar
STIRTIFMSQPVFLALEAPLTIVGD

SEQ ID NO: 2540476 - protein, 27 aa, Entamoeba dispar
STISIPYNVLMIKLKTLPSLTGLIHIP

SEQ ID NO: 2540477 - protein, 31 aa, Entamoeba dispar
STISLMCVCPLFPGEFTYKVLLLSDCYIGLD

SEQ ID NO: 2540478 - protein, 17 aa, Entamoeba dispar
STITSLDWHCNGGVLIT

SEQ ID NO: 2540479 - protein, 18 aa, Entamoeba dispar
STITSLDWHCNGGVLITA

SEQ ID NO: 2540480 - protein, 21 aa, Entamoeba dispar
STITSLDWHCNGGVLITASDD

SEQ ID NO: 2540481 - protein, 21 aa, Entamoeba dispar
STITYFLKTYKSYAKFTCFFE

SEQ ID NO: 2540482 - protein, 29 aa, Entamoeba dispar
STIVLASPPPKFFALKNRGITKIKEQNLI

SEQ ID NO: 2540483 - protein, 36 aa, Entamoeba dispar
STKELVVMLKVFDLFIRSEEWYFIKTKKEVIALSTY

SEQ ID NO: 2540484 - protein, 33 aa, Entamoeba dispar
STKKTQKLIKFKWIDPFNEYGFYAFGAAVIEIV

SEQ ID NO: 2540485 - protein, 17 aa, Entamoeba dispar
STKMKKKYQLKDDIIIS

SEQ ID NO: 2540486 - protein, 28 aa, Entamoeba dispar
STKNIYCLKQFFMILYYCFKSSKEVEEF

SEQ ID NO: 2540487 - protein, 20 aa, Entamoeba dispar
STKSNCLLLLLQLTSIDPSV

SEQ ID NO: 2540488 - protein, 20 aa, Entamoeba dispar
STKTFFLDDAIHFSLLDNDC

SEQ ID NO: 2540489 - protein, 18 aa, Entamoeba dispar
STLDFSSLYPSIMISHNL

SEQ ID NO: 2540490 - protein, 17 aa, Entamoeba dispar
STLFALKVNPLLRNDND

SEQ ID NO: 2540491 - protein, 18 aa, Entamoeba dispar
STLFIPASCLMKMTPFEK

SEQ ID NO: 2540492 - protein, 17 aa, Entamoeba dispar
STLFITGGGIDGFVRFW

SEQ ID NO: 2540493 - protein, 30 aa, Entamoeba dispar
STLHPSHLPILLPIIQLIPFDRIPNSTKSN

SEQ ID NO: 2540494 - protein, 24 aa, Entamoeba dispar
STLKALFVILSYDPQIPQANRIYF

SEQ ID NO: 2540495 - protein, 20 aa, Entamoeba dispar
STLKCVIIHIVTVQLDLTTK

SEQ ID NO: 2540496 - protein, 18 aa, Entamoeba dispar
STLNTYLNILYQHYIKKI

SEQ ID NO: 2540497 - protein, 27 aa, Entamoeba dispar
STLNYLYGIVVPQFIFLRKEIIGTPLE

SEQ ID NO: 2540498 - protein, 21 aa, Entamoeba dispar
STLPILMTLVGYDIDTVIKIY

SEQ ID NO: 2540499 - protein, 21 aa, Entamoeba dispar
STLTTINIPTSIKYIGNYCFK

SEQ ID NO: 2540500 - protein, 17 aa, Entamoeba dispar
STMKGCLGLVFGNESNG

SEQ ID NO: 2540501 - protein, 25 aa, Entamoeba dispar
STMKGWEKLRWDDILHIKTIVEDDV

SEQ ID NO: 2540502 - protein, 23 aa, Entamoeba dispar
STMLFQLIIIPKTTFQFKKQITK

SEQ ID NO: 2540503 - protein, 25 aa, Entamoeba dispar
STMQFEYFTLLLQQLDVMVDGASAF

SEQ ID NO: 2540504 - protein, 25 aa, Entamoeba dispar
STNEHLIFNFLLPICSINNSIYNII

SEQ ID NO: 2540505 - protein, 26 aa, Entamoeba dispar
STNEYLRLLCVIFIIIKHDSDNALLM

SEQ ID NO: 2540506 - protein, 25 aa, Entamoeba dispar
STNGIDLIIFLIEKIYKLEKKEKYY

SEQ ID NO: 2540507 - protein, 29 aa, Entamoeba dispar
STNIEGVLYNKFILDQLLSNLNEPSIDKE

SEQ ID NO: 2540508 - protein, 28 aa, Entamoeba dispar
STNIVFSVLPPFVPWVLLSTATTTFELQ

SEQ ID NO: 2540509 - protein, 24 aa, Entamoeba dispar
STNKRKMIIITNNSQWFISQSSLL

SEQ ID NO: 2540510 - protein, 21 aa, Entamoeba dispar
STNLLLHIPAIAHQAGCHIPT

SEQ ID NO: 2540511 - protein, 23 aa, Entamoeba dispar
STNPTLQKLLIQTSIKAAPNRVM

SEQ ID NO: 2540512 - protein, 22 aa, Entamoeba dispar
STNSIIHNIASKPPLPINGNII

SEQ ID NO: 2540513 - protein, 29 aa, Entamoeba dispar
STPAYVVFFLVRLVPEFMLHLQSGVFDKP

SEQ ID NO: 2540514 - protein, 21 aa, Entamoeba dispar
STPCNLLLPQTDSKSKILRRK

SEQ ID NO: 2540515 - protein, 23 aa, Entamoeba dispar
STPLSSIVFGPDYLGVIISQQPN

SEQ ID NO: 2540516 - protein, 18 aa, Entamoeba dispar
STPLSTMKGWEKLRWDDI

SEQ ID NO: 2540517 - protein, 20 aa, Entamoeba dispar
STPPWLMQIPVNHKISLGSD

SEQ ID NO: 2540518 - protein, 28 aa, Entamoeba dispar
STQFMKLPSIYIPVLLNGKVIGKVSPHE

SEQ ID NO: 2540519 - protein, 25 aa, Entamoeba dispar
STQILICYKEQWYLISFNQNILESL

SEQ ID NO: 2540520 - protein, 19 aa, Entamoeba dispar
STQIPKYQKSFIPTRYCHS

SEQ ID NO: 2540521 - protein, 23 aa, Entamoeba dispar
STQQRILAFLSIRKITPTTHQSV

SEQ ID NO: 2540522 - protein, 26 aa, Entamoeba dispar
STQSIIKYFIQRLNYFLSKASQRLGI

SEQ ID NO: 2540523 - protein, 19 aa, Entamoeba dispar
STQWTSLSGFVRYLETKEI

SEQ ID NO: 2540524 - protein, 19 aa, Entamoeba dispar
STRGWFGFGYQIPELSEEA

SEQ ID NO: 2540525 - protein, 23 aa, Entamoeba dispar
STRIPKVVQLLQDFFNGKEPNKS

SEQ ID NO: 2540526 - protein, 31 aa, Entamoeba dispar
STRLFLNLQEQWLYYPWDCVTRKVKKIVLNY

SEQ ID NO: 2540527 - protein, 24 aa, Entamoeba dispar
STRSSLTVFIPIKKTASSSSLELG

SEQ ID NO: 2540528 - protein, 18 aa, Entamoeba dispar
STSFYYGAFQILIDILDV

SEQ ID NO: 2540529 - protein, 22 aa, Entamoeba dispar
STSKFYYWKRRNMTNTIPHKCN

SEQ ID NO: 2540530 - protein, 20 aa, Entamoeba dispar
STSKRLILTCLIKMAKELNE

SEQ ID NO: 2540531 - protein, 24 aa, Entamoeba dispar
STSLFHSISIPQQSHLLLSLGPLN

SEQ ID NO: 2540532 - protein, 27 aa, Entamoeba dispar
STSPRPGFLSLPRPTKLAPKPSTIPPK

SEQ ID NO: 2540533 - protein, 29 aa, Entamoeba dispar
STSSTPFTLYPNGVGIFISISAPGNLLLS

SEQ ID NO: 2540534 - protein, 29 aa, Entamoeba dispar
STTAQEFFYLILIETFPVPLQLVCMPEIL

SEQ ID NO: 2540535 - protein, 26 aa, Entamoeba dispar
STTIKDPCKYLVPIDKLDIDEEIKRI

SEQ ID NO: 2540536 - protein, 23 aa, Entamoeba dispar
STTISLFPNLKVQKLYAWNDTQI

SEQ ID NO: 2540537 - protein, 22 aa, Entamoeba dispar
STTITPLYKLYYYFTEEVLIDF

SEQ ID NO: 2540538 - protein, 26 aa, Entamoeba dispar
STTLYYGIEVLYKMLICSPPESLHFR

SEQ ID NO: 2540539 - protein, 21 aa, Entamoeba dispar
STTMMLFMKYPDIKDIHDVIN

SEQ ID NO: 2540540 - protein, 26 aa, Entamoeba dispar
STTNKGCLLLLRQGIFSVLQDTIVLT

SEQ ID NO: 2540541 - protein, 23 aa, Entamoeba dispar
STTPIYFKIMVKIIKKGGIEIIK

SEQ ID NO: 2540542 - protein, 22 aa, Entamoeba dispar
STTRIVFLSPFNSFVSCWKSQV

SEQ ID NO: 2540543 - protein, 32 aa, Entamoeba dispar
STTSFESFILPFGKFFVIPKNNNRPLSSFQIL

SEQ ID NO: 2540544 - protein, 29 aa, Entamoeba dispar
STTSFLEANGFREQLYRVLDKDVSEHVSI

SEQ ID NO: 2540545 - protein, 30 aa, Entamoeba dispar
STTTFGSLPIPFIVNYSLIMEIIGNKFEKR

SEQ ID NO: 2540546 - protein, 26 aa, Entamoeba dispar
STTYRNYFGIPLKKLLEDEGRVDAQI

SEQ ID NO: 2540547 - protein, 24 aa, Entamoeba dispar
STVIGLLEPLLKDPNDFVKQGAAI

SEQ ID NO: 2540548 - protein, 17 aa, Entamoeba dispar
STVLKGGVLFECAMRKL

SEQ ID NO: 2540549 - protein, 24 aa, Entamoeba dispar
STVNDDWFLETYCGFIISGNEVMF

SEQ ID NO: 2540550 - protein, 24 aa, Entamoeba dispar
STVQIKRWEVFGILACSFFNVQWE

SEQ ID NO: 2540551 - protein, 23 aa, Entamoeba dispar
STWSFGVILYRMITGYIPQHDEN

SEQ ID NO: 2540552 - protein, 27 aa, Entamoeba dispar
STYANSFIRQLFHFSIYSIFEGIVDSH

SEQ ID NO: 2540553 - protein, 21 aa, Entamoeba dispar
STYDLYCFLLTTNCVIYIKKG

SEQ ID NO: 2540554 - protein, 23 aa, Entamoeba dispar
SVAFNWIVKILQNIGYSFEFMNS

SEQ ID NO: 2540555 - protein, 18 aa, Entamoeba dispar
SVAIIDPEFTYTVPKRTF

SEQ ID NO: 2540556 - protein, 18 aa, Entamoeba dispar
SVATNYLSLFKHLNDHFT

SEQ ID NO: 2540557 - protein, 23 aa, Entamoeba dispar
SVAYKNVVGSRRASWRIISSLEQ

SEQ ID NO: 2540558 - protein, 17 aa, Entamoeba dispar
SVCDTFLMLQKQFQDLV

SEQ ID NO: 2540559 - protein, 23 aa, Entamoeba dispar
SVCGCRLDGYLIKNHDLCCVDCY

SEQ ID NO: 2540560 - protein, 31 aa, Entamoeba dispar
SVCMFKPIETSPFFIPQRMNSYYHLKTFVET

SEQ ID NO: 2540561 - protein, 20 aa, Entamoeba dispar
SVCVNPTWVPLCAELLKGTG

SEQ ID NO: 2540562 - protein, 26 aa, Entamoeba dispar
SVDDFFTKLRIFFPNIIDLKHVTNQI

SEQ ID NO: 2540563 - protein, 25 aa, Entamoeba dispar
SVDFYEYLVFCWMKILVVDKKKTFH

SEQ ID NO: 2540564 - protein, 31 aa, Entamoeba dispar
SVDRFDMCLKVVFRLICVHVALCSKMEEFKR

SEQ ID NO: 2540565 - protein, 25 aa, Entamoeba dispar
SVEDFWSVYLSMSSLQVMPKGVDVY

SEQ ID NO: 2540566 - protein, 37 aa, Entamoeba dispar
SVEDMMVLLTRYLDYLIDIVRPRKLLYLAVDGVAPRA

SEQ ID NO: 2540567 - protein, 29 aa, Entamoeba dispar
SVEGQIEFTALLFVPQRAPFDMFETKKKP

SEQ ID NO: 2540568 - protein, 24 aa, Entamoeba dispar
SVEISTLIPLRFGAERCILIGDPQ

SEQ ID NO: 2540569 - protein, 25 aa, Entamoeba dispar
SVELSALKNLIFLRTINSALVHSQS

SEQ ID NO: 2540570 - protein, 32 aa, Entamoeba dispar
SVESSDPLPPRLFRKYLAYARANIHPQLNEEA

SEQ ID NO: 2540571 - protein, 27 aa, Entamoeba dispar
SVETSYNLKYIKLPSSIISLKLYNPPS

SEQ ID NO: 2540572 - protein, 26 aa, Entamoeba dispar
SVEVLILLFVLKINYPNSIYLLRGNH

SEQ ID NO: 2540573 - protein, 17 aa, Entamoeba dispar
SVEYNWRLGGRNYDEAL

SEQ ID NO: 2540574 - protein, 19 aa, Entamoeba dispar
SVFCERIMYKKHIIIIIED

SEQ ID NO: 2540575 - protein, 17 aa, Entamoeba dispar
SVFIKLNQNGRFIEGKT

SEQ ID NO: 2540576 - protein, 23 aa, Entamoeba dispar
SVFSNIKIFLHLKDALKNSIEET

SEQ ID NO: 2540577 - protein, 17 aa, Entamoeba dispar
SVFVFDFGGGTLDISVI

SEQ ID NO: 2540578 - protein, 21 aa, Entamoeba dispar
SVFVKFIQLHPIIACSPNTPM

SEQ ID NO: 2540579 - protein, 21 aa, Entamoeba dispar
SVFVYDFRNLNLRQTFKTCPN

SEQ ID NO: 2540580 - protein, 22 aa, Entamoeba dispar
SVFVYDFRNLNLRQTFKTCPNP

SEQ ID NO: 2540581 - protein, 21 aa, Entamoeba dispar
SVGATIRVYFDKYSKDYKADQ

SEQ ID NO: 2540582 - protein, 23 aa, Entamoeba dispar
SVGCILFEMLAGYPPFVSDDSVQ

SEQ ID NO: 2540583 - protein, 25 aa, Entamoeba dispar
SVGKSALCLLFVKGEFNIEYNPTIE

SEQ ID NO: 2540584 - protein, 23 aa, Entamoeba dispar
SVGKTCIIGRFTSKIFDMSYDAT

SEQ ID NO: 2540585 - protein, 25 aa, Entamoeba dispar
SVGSILYRYCIGIGTLIIISQNYLN

SEQ ID NO: 2540586 - protein, 26 aa, Entamoeba dispar
SVGVIPLDFSNPLRYELQKGLIGAFA

SEQ ID NO: 2540587 - protein, 24 aa, Entamoeba dispar
SVHPNIVCICERWSLIFSHHEKVI

SEQ ID NO: 2540588 - protein, 26 aa, Entamoeba dispar
SVIDNTLWAFYPDLKKLNVYNDKLQV

SEQ ID NO: 2540589 - protein, 27 aa, Entamoeba dispar
SVIDSFILHPLLFHKIEHAHIISSLGS

SEQ ID NO: 2540590 - protein, 21 aa, Entamoeba dispar
SVIITNFLGIGFHLLSLFDGH

SEQ ID NO: 2540591 - protein, 26 aa, Entamoeba dispar
SVIKDYLRLLPNPLIPYNLYEEFIEL

SEQ ID NO: 2540592 - protein, 30 aa, Entamoeba dispar
SVIKRMIITRLYPYLWQPSISVLEGTTINS

SEQ ID NO: 2540593 - protein, 22 aa, Entamoeba dispar
SVIQSMFPQQYTFQPIVNQNNQ

SEQ ID NO: 2540594 - protein, 23 aa, Entamoeba dispar
SVISALKINPWFTSERDINKFCR

SEQ ID NO: 2540595 - protein, 23 aa, Entamoeba dispar
SVISTRWFGKLSLFDCSRSLEYL

SEQ ID NO: 2540596 - protein, 21 aa, Entamoeba dispar
SVIVFIHSQGYIFGSYTSVKI

SEQ ID NO: 2540597 - protein, 24 aa, Entamoeba dispar
SVIYPGIIKYFKDIKENIVTKCVI

SEQ ID NO: 2540598 - protein, 22 aa, Entamoeba dispar
SVKELCELLKKSEMKKITEEWS

SEQ ID NO: 2540599 - protein, 34 aa, Entamoeba dispar
SVKGRSNVMFIFRTIDQHIFGCFNKLIIPSEFTK

SEQ ID NO: 2540600 - protein, 22 aa, Entamoeba dispar
SVKGWLKDVGYYAPKDIIKYLI

SEQ ID NO: 2540601 - protein, 23 aa, Entamoeba dispar
SVKGWLKDVGYYAPKDIIKYLVG

SEQ ID NO: 2540602 - protein, 19 aa, Entamoeba dispar
SVKLKKLYSIPCVVANKTF

SEQ ID NO: 2540603 - protein, 25 aa, Entamoeba dispar
SVKTYEFELIRELPFTLGACTFKPI

SEQ ID NO: 2540604 - protein, 32 aa, Entamoeba dispar
SVKVRRPKDYNPVLPFISGLSQLMEPGTTNPR

SEQ ID NO: 2540605 - protein, 24 aa, Entamoeba dispar
SVKYQIRISDILTTLIKRINSSND

SEQ ID NO: 2540606 - protein, 18 aa, Entamoeba dispar
SVLAEIFKANIIAWEYPG

SEQ ID NO: 2540607 - protein, 26 aa, Entamoeba dispar
SVLEELINFWVFKGLLEMSAKVATAV

SEQ ID NO: 2540608 - protein, 45 aa, Entamoeba dispar
SVLISLCSLFVVTRKVFTMKDFVLSKALRFPMGLQFEELQSYMKA

SEQ ID NO: 2540609 - protein, 20 aa, Entamoeba dispar
SVLLALYKNTVQIYSQNLEH

SEQ ID NO: 2540610 - protein, 23 aa, Entamoeba dispar
SVLRTEVIFRMFKSMEIKATVLH

SEQ ID NO: 2540611 - protein, 20 aa, Entamoeba dispar
SVLSSYVVYYNGSQVKVICI

SEQ ID NO: 2540612 - protein, 21 aa, Entamoeba dispar
SVLYAMKYEPTLRIGFEPCQY

SEQ ID NO: 2540613 - protein, 25 aa, Entamoeba dispar
SVMKLFHPIFIAVMTRIQIVSFKDS

SEQ ID NO: 2540614 - protein, 27 aa, Entamoeba dispar
SVNEEWDLRPLFSQLINSPSIQNSISK

SEQ ID NO: 2540615 - protein, 24 aa, Entamoeba dispar
SVNELGYWCFYKCLSLTTINIPSL

SEQ ID NO: 2540616 - protein, 23 aa, Entamoeba dispar
SVNLLYLMDRYPLLRKINCRLSC

SEQ ID NO: 2540617 - protein, 19 aa, Entamoeba dispar
SVNPPPPPNLNVPPPPNLN

SEQ ID NO: 2540618 - protein, 23 aa, Entamoeba dispar
SVNSPLNIIQPNSTTPQKMVEEP

SEQ ID NO: 2540619 - protein, 24 aa, Entamoeba dispar
SVPEVKPRFYLHPSRPLECSYRQL

SEQ ID NO: 2540620 - protein, 23 aa, Entamoeba dispar
SVPGLCWITNAFKPSLVYRNFSN

SEQ ID NO: 2540621 - protein, 19 aa, Entamoeba dispar
SVPHNYFTAFIRSLKCGYV

SEQ ID NO: 2540622 - protein, 17 aa, Entamoeba dispar
SVPLSLKLMYSHHIKEV

SEQ ID NO: 2540623 - protein, 21 aa, Entamoeba dispar
SVPSQFFCNYILKTCQISSEL

SEQ ID NO: 2540624 - protein, 17 aa, Entamoeba dispar
SVPTLAAIVPYFTKQTL

SEQ ID NO: 2540625 - protein, 18 aa, Entamoeba dispar
SVQALHPMYLRLSSLTED

SEQ ID NO: 2540626 - protein, 28 aa, Entamoeba dispar
SVQEATYFHWILPFPFKRCYVSSSIFAS

SEQ ID NO: 2540627 - protein, 26 aa, Entamoeba dispar
SVQEKLLHYTSFKYNVDVLPQVNSLI

SEQ ID NO: 2540628 - protein, 25 aa, Entamoeba dispar
SVQEKLMSFLFFISQNQSSCDRLIQ

SEQ ID NO: 2540629 - protein, 18 aa, Entamoeba dispar
SVQILLFIRQIYVTYHDS

SEQ ID NO: 2540630 - protein, 24 aa, Entamoeba dispar
SVQPTRFYPLKLGNSVYIFQNDYM

SEQ ID NO: 2540631 - protein, 19 aa, Entamoeba dispar
SVQWSFKRRVSFAKVCLEV

SEQ ID NO: 2540632 - protein, 17 aa, Entamoeba dispar
SVRDGIIPCIRGCVERV

SEQ ID NO: 2540633 - protein, 26 aa, Entamoeba dispar
SVRGLMNCWSTLRLCVEHQFGGVNSQ

SEQ ID NO: 2540634 - protein, 22 aa, Entamoeba dispar
SVRQWAQQWIKPGMSDLFVAEN

SEQ ID NO: 2540635 - protein, 18 aa, Entamoeba dispar
SVRYTAARKFLFPNSYNF

SEQ ID NO: 2540636 - protein, 24 aa, Entamoeba dispar
SVSCHAYFILHFPDKLMARPETVQ

SEQ ID NO: 2540637 - protein, 25 aa, Entamoeba dispar
SVSILRKYCFCWCRSLKTINIPTSV

SEQ ID NO: 2540638 - protein, 19 aa, Entamoeba dispar
SVSIPWFFDNFDAKEYCVY

SEQ ID NO: 2540639 - protein, 18 aa, Entamoeba dispar
SVSKINKLFYIQKINRVK

SEQ ID NO: 2540640 - protein, 27 aa, Entamoeba dispar
SVSLVEKYLRPVIGAKVPGYSEFFTHL

SEQ ID NO: 2540641 - protein, 17 aa, Entamoeba dispar
SVSLYSLIKDIVELRFE

SEQ ID NO: 2540642 - protein, 23 aa, Entamoeba dispar
SVSRKYIYQIINTNTKKIKSIVG

SEQ ID NO: 2540643 - protein, 24 aa, Entamoeba dispar
SVSSSRYIILKNSKINVQSITGSC

SEQ ID NO: 2540644 - protein, 27 aa, Entamoeba dispar
SVTEKYIYLLIVQFINELIKSKQLSLV

SEQ ID NO: 2540645 - protein, 20 aa, Entamoeba dispar
SVTIGLEQEFFLIDEKLARK

SEQ ID NO: 2540646 - protein, 17 aa, Entamoeba dispar
SVTLTAFLPPSYGYPFM

SEQ ID NO: 2540647 - protein, 24 aa, Entamoeba dispar
SVTPLRNGFGLFKLTSGKQTSDIK

SEQ ID NO: 2540648 - protein, 24 aa, Entamoeba dispar
SVTQICIGLLMELTNKISKFDQYV

SEQ ID NO: 2540649 - protein, 28 aa, Entamoeba dispar
SVTVEALTTFFSFTGNVTQVRLSDCPDG

SEQ ID NO: 2540650 - protein, 28 aa, Entamoeba dispar
SVVAKFILIAYGDLKKYDFHFIGGCPVP

SEQ ID NO: 2540651 - protein, 22 aa, Entamoeba dispar
SVVIAYLIRKYQMSLKVAFQYV

SEQ ID NO: 2540652 - protein, 19 aa, Entamoeba dispar
SVVLTLIDILRQGEAEIEE

SEQ ID NO: 2540653 - protein, 33 aa, Entamoeba dispar
SVVLTTFVFDLQWLFNELPILTRVPVQFIHNGN

SEQ ID NO: 2540654 - protein, 27 aa, Entamoeba dispar
SVVSEKLFVSPIPPILVAFEQLSQVKP

SEQ ID NO: 2540655 - protein, 25 aa, Entamoeba dispar
SVVSKFVVNCLQPFYDNGKIQDRDR

SEQ ID NO: 2540656 - protein, 25 aa, Entamoeba dispar
SVVTDIIHFKDFKLTYYPGDYDTFE

SEQ ID NO: 2540657 - protein, 24 aa, Entamoeba dispar
SVVVNFERRLWTCKLWDIEERLRE

SEQ ID NO: 2540658 - protein, 25 aa, Entamoeba dispar
SVVWKKLQYLTISNAGIRSIDDGLF

SEQ ID NO: 2540659 - protein, 18 aa, Entamoeba dispar
SVWSNFYNPENFIIPTNN

SEQ ID NO: 2540660 - protein, 17 aa, Entamoeba dispar
SVYFTKFEKMSPAVFGN

SEQ ID NO: 2540661 - protein, 21 aa, Entamoeba dispar
SVYGAFWITNSFTLKLSSIIN

SEQ ID NO: 2540662 - protein, 25 aa, Entamoeba dispar
SVYGLRMLCGSLLNKALQSADVKTE

SEQ ID NO: 2540663 - protein, 25 aa, Entamoeba dispar
SVYLGRKYLLIFKDNTNPLTDIPFK

SEQ ID NO: 2540664 - protein, 28 aa, Entamoeba dispar
SVYQAKYHLIPQIEILPDNKFAIKYLDK

SEQ ID NO: 2540665 - protein, 25 aa, Entamoeba dispar
SVYQCLIHILRIPNAKSIFLRENGA

SEQ ID NO: 2540666 - protein, 17 aa, Entamoeba dispar
SVYSYPQGLIELLNTVL

SEQ ID NO: 2540667 - protein, 20 aa, Entamoeba dispar
SVYTIVYLQKHGISIDCLLH

SEQ ID NO: 2540668 - protein, 35 aa, Entamoeba dispar
SWAIVIVDQERFIFPSSFICLLSESDKKIKQETAI

SEQ ID NO: 2540669 - protein, 23 aa, Entamoeba dispar
SWCGLVCHQCCVRKAPRQCSYGV

SEQ ID NO: 2540670 - protein, 23 aa, Entamoeba dispar
SWDKEPLHKLIKPKTLQLFNDET

SEQ ID NO: 2540671 - protein, 26 aa, Entamoeba dispar
SWDNDDIIWDYPISQLEQFKPQATEE

SEQ ID NO: 2540672 - protein, 22 aa, Entamoeba dispar
SWEHGKLFLTNYRIKFVPDNCE

SEQ ID NO: 2540673 - protein, 28 aa, Entamoeba dispar
SWKSWKRRWFVIKDRKMWYFAGKNDTEA

SEQ ID NO: 2540674 - protein, 17 aa, Entamoeba dispar
SWLADLIYLNISGCTRI

SEQ ID NO: 2540675 - protein, 18 aa, Entamoeba dispar
SWMPCICNSFQLVCYEMT

SEQ ID NO: 2540676 - protein, 20 aa, Entamoeba dispar
SWQHICRVILFSLTVKESPK

SEQ ID NO: 2540677 - protein, 25 aa, Entamoeba dispar
SWRLRIGQFITFPNYQRKKLGRYLL

SEQ ID NO: 2540678 - protein, 27 aa, Entamoeba dispar
SWRRKDGEVFVPRKAPTEFREHEQREP

SEQ ID NO: 2540679 - protein, 20 aa, Entamoeba dispar
SWTGLEKYKIIFNEKITSLT

SEQ ID NO: 2540680 - protein, 17 aa, Entamoeba dispar
SWVDGIIFNQFLAGLQP

SEQ ID NO: 2540681 - protein, 21 aa, Entamoeba dispar
SWVTKVLKECGCAILVGFDGD

SEQ ID NO: 2540682 - protein, 19 aa, Entamoeba dispar
SYALFFASFCDFQNNVRCN

SEQ ID NO: 2540683 - protein, 25 aa, Entamoeba dispar
SYATIPKYYLLIKNILERIERITEL

SEQ ID NO: 2540684 - protein, 18 aa, Entamoeba dispar
SYCLPLLVITYGNGKPVI

SEQ ID NO: 2540685 - protein, 20 aa, Entamoeba dispar
SYCPSLSEIILPTTISELGD

SEQ ID NO: 2540686 - protein, 19 aa, Entamoeba dispar
SYCYSACSWVTKVLKECGC

SEQ ID NO: 2540687 - protein, 27 aa, Entamoeba dispar
SYDDDQNYRFIIFDDINYDKNLVRLIK

SEQ ID NO: 2540688 - protein, 29 aa, Entamoeba dispar
SYDDPHTKVFLLLSAYFGENTLPIVDFVL

SEQ ID NO: 2540689 - protein, 24 aa, Entamoeba dispar
SYDEIAIRFRPSWYYNEVSKQLEW

SEQ ID NO: 2540690 - protein, 26 aa, Entamoeba dispar
SYDNSIYFILLLCSLDIIIHENSLAF

SEQ ID NO: 2540691 - protein, 27 aa, Entamoeba dispar
SYDYFNSVFGPFKRFVLKGIQMLEHQP

SEQ ID NO: 2540692 - protein, 24 aa, Entamoeba dispar
SYELPFELELMYKDGWERSCDVCL

SEQ ID NO: 2540693 - protein, 22 aa, Entamoeba dispar
SYENISYEILLEELSNYGNEIN

SEQ ID NO: 2540694 - protein, 23 aa, Entamoeba dispar
SYENISYEILLKELNNYGNEINY

SEQ ID NO: 2540695 - protein, 30 aa, Entamoeba dispar
SYFEIVHEKPYFYSLNTFRGEKPQSGLGVI

SEQ ID NO: 2540696 - protein, 36 aa, Entamoeba dispar
SYFFSKIYIDHTLATKFLQYLSFVLYQCSVRNSIST

SEQ ID NO: 2540697 - protein, 18 aa, Entamoeba dispar
SYGLKLFYLSNDIIEDLK

SEQ ID NO: 2540698 - protein, 19 aa, Entamoeba dispar
SYHCELFSEWVLKQANRLS

SEQ ID NO: 2540699 - protein, 23 aa, Entamoeba dispar
SYHIPYYHYNLIISSSPLDLKNI

SEQ ID NO: 2540700 - protein, 23 aa, Entamoeba dispar
SYHLRQFPHPFACSNGISVVHRT

SEQ ID NO: 2540701 - protein, 26 aa, Entamoeba dispar
SYHRVFYLFHCPFCLKFTVLRNQLPE

SEQ ID NO: 2540702 - protein, 18 aa, Entamoeba dispar
SYIHSDFLVHFGHSPLIP

SEQ ID NO: 2540703 - protein, 21 aa, Entamoeba dispar
SYIIINNLMIHIFNKPFKQCV

SEQ ID NO: 2540704 - protein, 21 aa, Entamoeba dispar
SYIIQYTYIKWNNEYHILYFW

SEQ ID NO: 2540705 - protein, 17 aa, Entamoeba dispar
SYILPRFGDVGIPITAS

SEQ ID NO: 2540706 - protein, 23 aa, Entamoeba dispar
SYKGKIIITNKKGNWVWTVSGDI

SEQ ID NO: 2540707 - protein, 19 aa, Entamoeba dispar
SYKLAFISTLGYEVDYGMV

SEQ ID NO: 2540708 - protein, 20 aa, Entamoeba dispar
SYKSILDIIMDRIKQQKSIP

SEQ ID NO: 2540709 - protein, 21 aa, Entamoeba dispar
SYLETFTITGLPELPAGAVRF

SEQ ID NO: 2540710 - protein, 26 aa, Entamoeba dispar
SYLIDPLTIDFILKPLSSIIVSPDCF

SEQ ID NO: 2540711 - protein, 24 aa, Entamoeba dispar
SYLNNYLFSPFQLDSLVQSINNKM

SEQ ID NO: 2540712 - protein, 19 aa, Entamoeba dispar
SYLPDTRFTVTRTVFRDGT

SEQ ID NO: 2540713 - protein, 17 aa, Entamoeba dispar
SYLTNNYFAWMGSVPYI

SEQ ID NO: 2540714 - protein, 25 aa, Entamoeba dispar
SYMIGLRHTIFGEGNLQRYFDINLK

SEQ ID NO: 2540715 - protein, 28 aa, Entamoeba dispar
SYNAVPHPFWLPKFQNGISYSLPIFCDT

SEQ ID NO: 2540716 - protein, 27 aa, Entamoeba dispar
SYNDLTQYPIFPWVLSNYSSSSIDLND

SEQ ID NO: 2540717 - protein, 18 aa, Entamoeba dispar
SYNELMKLLKKIHPIIKE

SEQ ID NO: 2540718 - protein, 22 aa, Entamoeba dispar
SYNGKFLKLKYVLSVHIMSKSH

SEQ ID NO: 2540719 - protein, 18 aa, Entamoeba dispar
SYNIMLYRDFHHSYKLFI

SEQ ID NO: 2540720 - protein, 22 aa, Entamoeba dispar
SYNIVPLSMQIKPRNTLEQPVI

SEQ ID NO: 2540721 - protein, 19 aa, Entamoeba dispar
SYNLNRVPQRVFDYLFEHP

SEQ ID NO: 2540722 - protein, 22 aa, Entamoeba dispar
SYNQLITLSPLLLNTTLKDINI

SEQ ID NO: 2540723 - protein, 24 aa, Entamoeba dispar
SYNQLYASSLFSWLADLIYLNISG

SEQ ID NO: 2540724 - protein, 18 aa, Entamoeba dispar
SYNRIVYARVLEKLTTEG

SEQ ID NO: 2540725 - protein, 39 aa, Entamoeba dispar
SYPKFDEFFTQLHLYCLKNPFFYYEIDNEYLYVKTRLND

SEQ ID NO: 2540726 - protein, 35 aa, Entamoeba dispar
SYQKLSVFSQEYPGIPILMLTATATERVKNDILLS

SEQ ID NO: 2540727 - protein, 18 aa, Entamoeba dispar
SYQNIILETNRPLSYYNF

SEQ ID NO: 2540728 - protein, 23 aa, Entamoeba dispar
SYQNINYEILLEELSNYGNEINY

SEQ ID NO: 2540729 - protein, 25 aa, Entamoeba dispar
SYRNKRIRLLNIPLSEDFDFQRFYK

SEQ ID NO: 2540730 - protein, 30 aa, Entamoeba dispar
SYSDTVQIFYLLRTLSFHPLSRFFEEDFKH

SEQ ID NO: 2540731 - protein, 29 aa, Entamoeba dispar
SYSIEVFTLLMLYKVMYPTRIALMRGNHE

SEQ ID NO: 2540732 - protein, 29 aa, Entamoeba dispar
SYSIEVFTLLMLYKVMYPTRISLMRGNHE

SEQ ID NO: 2540733 - protein, 32 aa, Entamoeba dispar; identical to SEQ ID NO: 2402017

SEQ ID NO: 2540734 - protein, 27 aa, Entamoeba dispar
SYSPAMQIYFSYRFLALHSPEEKRVGI

SEQ ID NO: 2540735 - protein, 17 aa, Entamoeba dispar
SYSSPETLRPEEISAII

SEQ ID NO: 2540736 - protein, 19 aa, Entamoeba dispar
SYSTLLQHPIFSSIYSTSF

SEQ ID NO: 2540737 - protein, 19 aa, Entamoeba dispar
SYSTMRLLTQRKNIVKELI

SEQ ID NO: 2540738 - protein, 19 aa, Entamoeba dispar
SYTFIMNKLSSLFVEQHIP

SEQ ID NO: 2540739 - protein, 22 aa, Entamoeba dispar
SYVFLYSKINSSLIRSLCKQQI

SEQ ID NO: 2540740 - protein, 25 aa, Entamoeba dispar
SYVGRGYFGLMYLNNNPKTIEGEIE

SEQ ID NO: 2540741 - protein, 19 aa, Entamoeba dispar
SYVIWYHRKWSISKMEHPK

SEQ ID NO: 2540742 - protein, 18 aa, Entamoeba dispar
SYVKLIDIGPRLKLHLLS

SEQ ID NO: 2540743 - protein, 30 aa, Entamoeba dispar
SYVMTPENFFFFRMPKFTPFDGKLLDPFKT

SEQ ID NO: 2540744 - protein, 21 aa, Entamoeba dispar
SYVNSLMTLVKLFHSVHDHQS

SEQ ID NO: 2540745 - protein, 28 aa, Entamoeba dispar
SYYPLSKFMEFLTIPYMIDNVILLITGT

SEQ ID NO: 2540746 - protein, 38 aa, Entamoeba dispar
TAADIIKMCMIEIFKKIHSTWLGVQLLLNIHDEIVLEV

SEQ ID NO: 2540747 - protein, 18 aa, Entamoeba dispar
TAALRLLRNITSQVYCKE

SEQ ID NO: 2540748 - protein, 19 aa, Entamoeba dispar
TACGRYFTVSVLSIIDGGD

SEQ ID NO: 2540749 - protein, 22 aa, Entamoeba dispar
TADKSVFKLIASKKLITIPCYH

SEQ ID NO: 2540750 - protein, 26 aa, Entamoeba dispar
TADLLFPLCLFLTIKAQLPYFDSTIY

SEQ ID NO: 2540751 - protein, 27 aa, Entamoeba dispar
TADPRFYELLKMYLPTRLEIQGGIRPD

SEQ ID NO: 2540752 - protein, 22 aa, Entamoeba dispar
TAEHFPISFYLHYNQNGKILTP

SEQ ID NO: 2540753 - protein, 24 aa, Entamoeba dispar
TAEKLLPFVQPLMEGIFKTLNTSN

SEQ ID NO: 2540754 - protein, 26 aa, Entamoeba dispar
TAEQIMALPLFWDFNKKLNFIKSASD

SEQ ID NO: 2540755 - protein, 21 aa, Entamoeba dispar
TAFANHFLRTLFSMPNSVMPE

SEQ ID NO: 2540756 - protein, 24 aa, Entamoeba dispar
TAGNIILWDYFNNTPIISFSNFSN

SEQ ID NO: 2540757 - protein, 26 aa, Entamoeba dispar
TAGQERFATLSSNYFRNAMGGVIMFD

SEQ ID NO: 2540758 - protein, 26 aa, Entamoeba dispar
TAICIVWVQCLVDLHFLMIQEILNVE

SEQ ID NO: 2540759 - protein, 17 aa, Entamoeba dispar
TAIFKSLISIKTRNPIV

SEQ ID NO: 2540760 - protein, 25 aa, Entamoeba dispar
TAINSLKVNPWFKSERDINKFCNIF

SEQ ID NO: 2540761 - protein, 31 aa, Entamoeba dispar
TAITIWDVLSNKLLFSLPIPYEQHNKEFIPV

SEQ ID NO: 2540762 - protein, 34 aa, Entamoeba dispar
TAKFKGIPCFWGRIIKRLPYFTPNTKEYPIIEFI

SEQ ID NO: 2540763 - protein, 24 aa, Entamoeba dispar
TAKGMVGSPYWMPPEVILDKVYNN

SEQ ID NO: 2540764 - protein, 23 aa, Entamoeba dispar
TAKSQLLKFVQMATPIGVYTSGK

SEQ ID NO: 2540765 - protein, 25 aa, Entamoeba dispar
TAKSQLLRYVMSIAPLAVSTNGRGA

SEQ ID NO: 2540766 - protein, 21 aa, Entamoeba dispar
TALARSFALVGKKTGILDIDL

SEQ ID NO: 2540767 - protein, 31 aa, Entamoeba dispar
TALERQFPSLKYFWFKQNKPMMFIAANGKES

SEQ ID NO: 2540768 - protein, 40 aa, Entamoeba dispar
TALKQYQTFFNFHYFNPPQTQFFFICFNTNKNVIVGAPTG

SEQ ID NO: 2540769 - protein, 21 aa, Entamoeba dispar
TALQIPFNKLTSIPSLNGSLI

SEQ ID NO: 2540770 - protein, 18 aa, Entamoeba dispar
TALQQVISIYLLFLHNPM

SEQ ID NO: 2540771 - protein, 21 aa, Entamoeba dispar
TALQYILKYISVPELIESVAI

SEQ ID NO: 2540772 - protein, 21 aa, Entamoeba dispar
TALSIIPATHNGFRRGIVMNK

SEQ ID NO: 2540773 - protein, 19 aa, Entamoeba dispar
TAMALVLGIQHQVKYYLSK

SEQ ID NO: 2540774 - protein, 30 aa, Entamoeba dispar
TAMNRNIFIKKQLELLIPIIEARLSDGCVI

SEQ ID NO: 2540775 - protein, 24 aa, Entamoeba dispar
TANILYFNTKQILVVRNKTVILLN

SEQ ID NO: 2540776 - protein, 26 aa, Entamoeba dispar
TANWELQMLCHCTIKVIPITCYGQVH

SEQ ID NO: 2540777 - protein, 28 aa, Entamoeba dispar
TAPPDVISLILPLLKTRTFFIPNRSESI

SEQ ID NO: 2540778 - protein, 20 aa, Entamoeba dispar
TAQYFLSDGIIITGTSTGVK

SEQ ID NO: 2540779 - protein, 27 aa, Entamoeba dispar
TAQYIRLKELPSFFSKFPSLINLDLDC

SEQ ID NO: 2540780 - protein, 27 aa, Entamoeba dispar
TARYFNDQIIPILKKNASEYPRMVSNF

SEQ ID NO: 2540781 - protein, 27 aa, Entamoeba dispar
TASANILFLLNYLTHGVVRFSPDVPDL

SEQ ID NO: 2540782 - protein, 23 aa, Entamoeba dispar
TASKVFMDVLLKNGIQLKLNSQI

SEQ ID NO: 2540783 - protein, 24 aa, Entamoeba dispar
TASLKLFQLALKRYPNSLPIIKAY

SEQ ID NO: 2540784 - protein, 27 aa, Entamoeba dispar
TASQHQLSIPIAGFKKPSEIKKESSSK

SEQ ID NO: 2540785 - protein, 21 aa, Entamoeba dispar
TASQRYIFGNIINLFGKDVKK

SEQ ID NO: 2540786 - protein, 22 aa, Entamoeba dispar
TASTLMRQIIEKYKKDGQPRAK

SEQ ID NO: 2540787 - protein, 34 aa, Entamoeba dispar
TASVAWTILKLFLISLPTPLLHPISSFISINPIN

SEQ ID NO: 2540788 - protein, 31 aa, Entamoeba dispar
TATKNELLSFLKLHSQYILDLIIKCPHEELL

SEQ ID NO: 2540789 - protein, 17 aa, Entamoeba dispar
TATRAEDKYKFFLEATQ

SEQ ID NO: 2540790 - protein, 27 aa, Entamoeba dispar
TATRVCTYFFNIFLIKEFKEDCELNQI

SEQ ID NO: 2540791 - protein, 24 aa, Entamoeba dispar
TATYFRNRHCILFMFDVTNRESFT

SEQ ID NO: 2540792 - protein, 24 aa, Entamoeba dispar
TAVDYFGKQLLKYGYNYYGSEPLY

SEQ ID NO: 2540793 - protein, 18 aa, Entamoeba dispar
TAVHCVFWSKQLIQKLFG

SEQ ID NO: 2540794 - protein, 18 aa, Entamoeba dispar
TAVILYYSTKTYSAVYIS

SEQ ID NO: 2540795 - protein, 23 aa, Entamoeba dispar
TAVVVMILDMKMYVAWAGDSRAV

SEQ ID NO: 2540796 - protein, 30 aa, Entamoeba dispar
TCDIYAFSMVIWQIFTQRLLYIKYDSMDDL

SEQ ID NO: 2540797 - protein, 20 aa, Entamoeba dispar
TCDMDKVIELALKYKDERTI

SEQ ID NO: 2540798 - protein, 28 aa, Entamoeba dispar
TCEEIIAYFLAMLNTKTLNLIMIMDIDR

SEQ ID NO: 2540799 - protein, 17 aa, Entamoeba dispar
TCEESLIGILFEMLKDE

SEQ ID NO: 2540800 - protein, 27 aa, Entamoeba dispar
TCEKINLWVNLYCAQYIPLTSKFGERD

SEQ ID NO: 2540801 - protein, 24 aa, Entamoeba dispar
TCEPLPDPIIFLRACLKINEMNKE

SEQ ID NO: 2540802 - protein, 28 aa, Entamoeba dispar
TCESRNRLIILLPWLEQRLSEGSPDVSL

SEQ ID NO: 2540803 - protein, 24 aa, Entamoeba dispar
TCGDIILFSFKDPVPERVNALYKS

SEQ ID NO: 2540804 - protein, 20 aa, Entamoeba dispar
TCGNSLVVAPLTLIPHWVSE

SEQ ID NO: 2540805 - protein, 23 aa, Entamoeba dispar
TCHKRVYFNERLTFAGKDYHKIG

SEQ ID NO: 2540806 - protein, 29 aa, Entamoeba dispar
TCIGDLLSLLITYITPYLSFTTDYNIALN

SEQ ID NO: 2540807 - protein, 18 aa, Entamoeba dispar
TCKLWDIEERLREASLAK

SEQ ID NO: 2540808 - protein, 23 aa, Entamoeba dispar
TCLCLVITENIFYIANIGDCRCL

SEQ ID NO: 2540809 - protein, 25 aa, Entamoeba dispar
TCLHLHFVIIQFNSVTDSIICFHKI

SEQ ID NO: 2540810 - protein, 21 aa, Entamoeba dispar
TCMDDFLFEIVHNESLLAIDI

SEQ ID NO: 2540811 - protein, 19 aa, Entamoeba dispar
TCPNPFQLPPMTPDSFRKA

SEQ ID NO: 2540812 - protein, 25 aa, Entamoeba dispar
TCQQPRIFELLKQLELLIKKINPSL

SEQ ID NO: 2540813 - protein, 25 aa, Entamoeba dispar
TCREDLLYGRYLEALYLGKQPEMTL

SEQ ID NO: 2540814 - protein, 19 aa, Entamoeba dispar
TCSLNFPVLPTPLTKNHFF

SEQ ID NO: 2540815 - protein, 23 aa, Entamoeba dispar
TCTIDSYRNAFIIIIPLENEHSF

SEQ ID NO: 2540816 - protein, 18 aa, Entamoeba dispar
TCTPSIYTLLLVSQSGNE

SEQ ID NO: 2540817 - protein, 22 aa, Entamoeba dispar
TCTYLNVYCSRLPFIQLTGLKQ

SEQ ID NO: 2540818 - protein, 18 aa, Entamoeba dispar
TCVIFGPDDTIWESGIFQ

SEQ ID NO: 2540819 - protein, 20 aa, Entamoeba dispar
TCVNKCLNVILYLPKDMDPQ

SEQ ID NO: 2540820 - protein, 24 aa, Entamoeba dispar
TCVRRSLIYPVVRNWELSIKTLEE

SEQ ID NO: 2540821 - protein, 23 aa, Entamoeba dispar
TCYKILGKYLLKKEKDILYILAQ

SEQ ID NO: 2540822 - protein, 18 aa, Entamoeba dispar
TCYLYAAFNKFCYSFFDS

SEQ ID NO: 2540823 - protein, 23 aa, Entamoeba dispar
TDAEEIFVFRRSLARTRVLSSKI

SEQ ID NO: 2540824 - protein, 30 aa, Entamoeba dispar
TDAGLIKKYPILKNSWKLVLSIFDFNSSCR

SEQ ID NO: 2540825 - protein, 18 aa, Entamoeba dispar
TDCAIAINPIFECQQLHG

SEQ ID NO: 2540826 - protein, 21 aa, Entamoeba dispar
TDCFVIVFSYIDKDSLVHAER

SEQ ID NO: 2540827 - protein, 18 aa, Entamoeba dispar
TDCVISVPGYFTENQRIA

SEQ ID NO: 2540828 - protein, 19 aa, Entamoeba dispar
TDDCPVFEGLYPFVQTVVG

SEQ ID NO: 2540829 - protein, 20 aa, Entamoeba dispar
TDDCPVFEGLYPFVQTVVGS

SEQ ID NO: 2540830 - protein, 20 aa, Entamoeba dispar
TDDFDFEEFVEAKPANNPET

SEQ ID NO: 2540831 - protein, 17 aa, Entamoeba dispar
TDDIVLCIVGNKSDLEA

SEQ ID NO: 2540832 - protein, 23 aa, Entamoeba dispar
TDDKLCKVLIQFLSPIKIVNVSF

SEQ ID NO: 2540833 - protein, 17 aa, Entamoeba dispar
TDDLVSAFFIYFENILG

SEQ ID NO: 2540834 - protein, 26 aa, Entamoeba dispar
TDDTPLEIELLLRCILQENPISRPNA

SEQ ID NO: 2540835 - protein, 28 aa, Entamoeba dispar
TDEEICRTLFDIPLIIIINKADLVSDES

SEQ ID NO: 2540836 - protein, 21 aa, Entamoeba dispar
TDEFFWRRRPSPKIVQHENGE

SEQ ID NO: 2540837 - protein, 24 aa, Entamoeba dispar
TDELLTLKLFLYTGDPCYPIQDLI

SEQ ID NO: 2540838 - protein, 28 aa, Entamoeba dispar
TDESYMTKLLRLHPLPTTALKQYQTFFN

SEQ ID NO: 2540839 - protein, 29 aa, Entamoeba dispar
TDFKTGIVLINFFEIISKKILRERYNHAP

SEQ ID NO: 2540840 - protein, 20 aa, Entamoeba dispar
TDFLLRRSIASPATVGYSLF

SEQ ID NO: 2540841 - protein, 19 aa, Entamoeba dispar
TDFTKWIKSILKIEDNSFD

SEQ ID NO: 2540842 - protein, 23 aa, Entamoeba dispar
TDGERFFFLCDLSVAMEYMVQTL

SEQ ID NO: 2540843 - protein, 23 aa, Entamoeba dispar
TDGFVFTLLNPLHLEPLISFNSS

SEQ ID NO: 2540844 - protein, 26 aa, Entamoeba dispar
TDGNKSCFPQFLDGKIHIASGSASDQ

SEQ ID NO: 2540845 - protein, 26 aa, Entamoeba dispar
TDGPFMAPVPFRGKPCHSGMIPWIIK

SEQ ID NO: 2540846 - protein, 23 aa, Entamoeba dispar
TDHCFTLKFTSFTEFSFNNCPSL

SEQ ID NO: 2540847 - protein, 41 aa, Entamoeba dispar
TDIILSNFIPLLKSLLDLFRIILIYRYHFYKESVKDIFLLI

SEQ ID NO: 2540848 - protein, 27 aa, Entamoeba dispar
TDIQIYAFVDIIGPSIFRIPPEKYGEF

SEQ ID NO: 2540849 - protein, 22 aa, Entamoeba dispar
TDIVNYTLLFKQPLQMIDVRSN

SEQ ID NO: 2540850 - protein, 21 aa, Entamoeba dispar
TDIYGCLFLPSFNLRSYLSLE

SEQ ID NO: 2540851 - protein, 25 aa, Entamoeba dispar
TDKDFQKYGKLLGLKGHALYKEKSK

SEQ ID NO: 2540852 - protein, 24 aa, Entamoeba dispar
TDKDWKLLLNYSRSMFRVLNKLLP

SEQ ID NO: 2540853 - protein, 25 aa, Entamoeba dispar
TDKGCLFDLLQGPKLNWEIICGIAI

SEQ ID NO: 2540854 - protein, 17 aa, Entamoeba dispar
TDKLLALNIIQVLLPYL

SEQ ID NO: 2540855 - protein, 23 aa, Entamoeba dispar
TDKTGMMLLFPQENKPIPKTIKE

SEQ ID NO: 2540856 - protein, 26 aa, Entamoeba dispar
TDLAKGIYMKWKGRELIRENPTLTMK

SEQ ID NO: 2540857 - protein, 25 aa, Entamoeba dispar
TDLEKLRLCCLPKVPYFVEMHASEF

SEQ ID NO: 2540858 - protein, 18 aa, Entamoeba dispar
TDLLFNFLSQVEGRKIFT

SEQ ID NO: 2540859 - protein, 33 aa, Entamoeba dispar
TDLNDGLILISLFEALRKQKVQFRYNKKPKMRV

SEQ ID NO: 2540860 - protein, 20 aa, Entamoeba dispar
TDLSPYKYLSFIVSWEQEGV

SEQ ID NO: 2540861 - protein, 21 aa, Entamoeba dispar
TDLYLWFCCAPHGPSIKFFVE

SEQ ID NO: 2540862 - protein, 23 aa, Entamoeba dispar
TDNPVLIKMVNRFKRIFVRDSNP

SEQ ID NO: 2540863 - protein, 37 aa, Entamoeba dispar
TDPKLFMESLPKMNQDTLWYLCSFLYEIQLNEEKTRM

SEQ ID NO: 2540864 - protein, 35 aa, Entamoeba dispar
TDPNFLDKYYLSSRLHHISLWKTIFSDFLSEKVEG

SEQ ID NO: 2540865 - protein, 23 aa, Entamoeba dispar
TDPRHLIEYYRRYIPKQVGTSKL

SEQ ID NO: 2540866 - protein, 31 aa, Entamoeba dispar
TDPVIPPLLKIQLPLMVKISRYFTKEDMTAL

SEQ ID NO: 2540867 - protein, 26 aa, Entamoeba dispar
TDPVPFLFQRIVTSYSLVLLSTHNHY

SEQ ID NO: 2540868 - protein, 25 aa, Entamoeba dispar
TDPVYRYFMKSLLPSQKQPNGRYFD

SEQ ID NO: 2540869 - protein, 26 aa, Entamoeba dispar
TDREKFMFHQMLLKGELPLSIGGGIG

SEQ ID NO: 2540870 - protein, 23 aa, Entamoeba dispar
TDRKVLFNSLALAIKIVVPNRII

SEQ ID NO: 2540871 - protein, 26 aa, Entamoeba dispar
TDSVAWLISFGILNRIKTYILCIAPS

SEQ ID NO: 2540872 - protein, 22 aa, Entamoeba dispar
TDTPNTLFYHPADYQYLTVSAP

SEQ ID NO: 2540873 - protein, 25 aa, Entamoeba dispar
TDTTMDCVPTPYKTIENIKNEEVFS

SEQ ID NO: 2540874 - protein, 24 aa, Entamoeba dispar
TDVDDKIILKARKNLLISKYCTTT

SEQ ID NO: 2540875 - protein, 20 aa, Entamoeba dispar
TDVFLICYAVDDQNSFENIE

SEQ ID NO: 2540876 - protein, 21 aa, Entamoeba dispar
TDVFLVCFSVIAPASYENVEG

SEQ ID NO: 2540877 - protein, 27 aa, Entamoeba dispar
TDVLYGEPLFGSEIWIMEIKKQIDDFY

SEQ ID NO: 2540878 - protein, 27 aa, Entamoeba dispar
TDWRIDPEIILIRRGTHRLKGKTLKEI

SEQ ID NO: 2540879 - protein, 24 aa, Entamoeba dispar
TDYADLFEFFAKDPKVTSILMYIE

SEQ ID NO: 2540880 - protein, 32 aa, Entamoeba dispar
TDYIVRFFGHFFVDKDLWIVMEICGAGSVCDI

SEQ ID NO: 2540881 - protein, 22 aa, Entamoeba dispar
TEAILYCIFYNTRLAITILNSL

SEQ ID NO: 2540882 - protein, 20 aa, Entamoeba dispar
TEAKGWIDLTPGTEVKDLTQ

SEQ ID NO: 2540883 - protein, 21 aa, Entamoeba dispar
TEAKKWCPPVTLYSIHHMSPP

SEQ ID NO: 2540884 - protein, 22 aa, Entamoeba dispar
TEAPANMMFYLPELHALCCADN

SEQ ID NO: 2540885 - protein, 33 aa, Entamoeba dispar
TEARNTFLTLFFLRYCFRPFSKVPSILKILHEA

SEQ ID NO: 2540886 - protein, 18 aa, Entamoeba dispar
TECEFKCVLIYDTPDKRI

SEQ ID NO: 2540887 - protein, 25 aa, Entamoeba dispar
TEDITKNFWLVRRNSTLLIDILQLS

SEQ ID NO: 2540888 - protein, 26 aa, Entamoeba dispar
TEDKEHIIFAFNFFKGIGLVELAKPL

SEQ ID NO: 2540889 - protein, 25 aa, Entamoeba dispar
TEDKFTQMFWELSMKSFDEFIKKLI

SEQ ID NO: 2540890 - protein, 17 aa, Entamoeba dispar
TEDLIKNLRKSLSDLTK

SEQ ID NO: 2540891 - protein, 26 aa, Entamoeba dispar
TEDQRRRFCFFLAAVIQGVDNHADVL

SEQ ID NO: 2540892 - protein, 25 aa, Entamoeba dispar
TEEAMKIIERLGGIKALTKKTNTDP

SEQ ID NO: 2540893 - protein, 24 aa, Entamoeba dispar
TEEDPSVSFIWKYDKTQPKTERIM

SEQ ID NO: 2540894 - protein, 25 aa, Entamoeba dispar
TEEEEYLWLLTERKFMKVKMLQDRD

SEQ ID NO: 2540895 - protein, 26 aa, Entamoeba dispar
TEEIAKFFRIVIVDALFIGYGLTETT

SEQ ID NO: 2540896 - protein, 42 aa, Entamoeba dispar
TEEIYINRLRQFLDYYLKAAIELLPNDKLLKKCKEDIIVILG

SEQ ID NO: 2540897 - protein, 24 aa, Entamoeba dispar
TEELIPPPVPAPRKSKQPRLSANL

SEQ ID NO: 2540898 - protein, 25 aa, Entamoeba dispar
TEEMARFYIAELFLAIDSIHKLSYI

SEQ ID NO: 2540899 - protein, 27 aa, Entamoeba dispar
TEESVIPGIIVLINDADWELVGMLDSE

SEQ ID NO: 2540900 - protein, 19 aa, Entamoeba dispar
TEFAIQEIFMKYNTFLLRG

SEQ ID NO: 2540901 - protein, 20 aa, Entamoeba dispar
TEFAVQEIFMKYNTFMLRGD

SEQ ID NO: 2540902 - protein, 17 aa, Entamoeba dispar
TEFEFLCIAIKPEILFL

SEQ ID NO: 2540903 - protein, 20 aa, Entamoeba dispar
TEFLKTVLRRLIRCDTQSFN

SEQ ID NO: 2540904 - protein, 21 aa, Entamoeba dispar
TEFPFYETYFYNKKTVKHYLD

SEQ ID NO: 2540905 - protein, 25 aa, Entamoeba dispar
TEFQHPSFIPYQPIKREPIDPDTTI

SEQ ID NO: 2540906 - protein, 27 aa, Entamoeba dispar
TEFSTYYPYWRFEIIYMSHNNSFHFFN

SEQ ID NO: 2540907 - protein, 26 aa, Entamoeba dispar
TEGCPAFYNFLNLLGNKIELHGFNKY

SEQ ID NO: 2540908 - protein, 30 aa, Entamoeba dispar
TEGFDYISKAHWYFYPPTPQFIGYVNKINE

SEQ ID NO: 2540909 - protein, 23 aa, Entamoeba dispar
TEGFWEHVCVVWTKCLYNISENE

SEQ ID NO: 2540910 - protein, 23 aa, Entamoeba dispar
TEGKPFKFYQSKRAQWASAEDFV

SEQ ID NO: 2540911 - protein, 23 aa, Entamoeba dispar
TEGKTTFLHVFKYKNEKLVECLT

SEQ ID NO: 2540912 - protein, 22 aa, Entamoeba dispar
TEGMNIEEVIKYAYVEMDSIEN

SEQ ID NO: 2540913 - protein, 25 aa, Entamoeba dispar
TEGSKIIVVILKTPTHTISKEVLIK

SEQ ID NO: 2540914 - protein, 24 aa, Entamoeba dispar
TEGTKVFLCLIQKLPEIKTSLIDV

SEQ ID NO: 2540915 - protein, 48 aa, Entamoeba dispar
TEHQIKKPVPAISINLFNSSILQPRGKRTKTLPCFNSNGRLCSLEKDM

SEQ ID NO: 2540916 - protein, 26 aa, Entamoeba dispar
TEHVEQIWCKLLCYCIGEIFNQHEDV

SEQ ID NO: 2540917 - protein, 26 aa, Entamoeba dispar
TEHWKFLHNYILHRDCILDLACSPWD

SEQ ID NO: 2540918 - protein, 27 aa, Entamoeba dispar
TEIDLPTPAYLKPKKLWTGKQLYGLAL

SEQ ID NO: 2540919 - protein, 24 aa, Entamoeba dispar
TEIELWKILTNCYGKWIINQSVVS

SEQ ID NO: 2540920 - protein, 26 aa, Entamoeba dispar
TEIIITLFCMKINNPKKIIILRGNHE

SEQ ID NO: 2540921 - protein, 34 aa, Entamoeba dispar
TEILLYLCACKINYPHRFFLLRGNHESRVMSENM

SEQ ID NO: 2540922 - protein, 25 aa, Entamoeba dispar
TEIMNIFWVSFFNKLFHNIIILNCD

SEQ ID NO: 2540923 - protein, 24 aa, Entamoeba dispar
TEINYLLHCNTIQTTILMLLNEKS

SEQ ID NO: 2540924 - protein, 24 aa, Entamoeba dispar
TEKDKVNCAFFFKIGACRHGDSCT

SEQ ID NO: 2540925 - protein, 18 aa, Entamoeba dispar
TEKDNVWIIMELCNAGSL

SEQ ID NO: 2540926 - protein, 28 aa, Entamoeba dispar
TEKENYIFLFNDFGKFINWLTQLGLNMK

SEQ ID NO: 2540927 - protein, 22 aa, Entamoeba dispar
TEKIRLMKLEEELHKRVIGQNE

SEQ ID NO: 2540928 - protein, 25 aa, Entamoeba dispar
TEKLEELCFIFTSLSLLSEQAEKEN

SEQ ID NO: 2540929 - protein, 27 aa, Entamoeba dispar
TEKNYKINIPPFIYLSQPSHLVKHKAE

SEQ ID NO: 2540930 - protein, 24 aa, Entamoeba dispar
TEKNYPFAIGELIYFLKEVISWQF

SEQ ID NO: 2540931 - protein, 32 aa, Entamoeba dispar
TEKSISKRKLTLAPKPVAMPKLTLAANEIQNA

SEQ ID NO: 2540932 - protein, 23 aa, Entamoeba dispar
TEKSKLRRYAIKITSKYFNDIED

SEQ ID NO: 2540933 - protein, 25 aa, Entamoeba dispar
TEKTKFWNNFLSKGIIEYVDADEEE

SEQ ID NO: 2540934 - protein, 25 aa, Entamoeba dispar
TEKVNPFIPISFRPPLLTKQDLSLI

SEQ ID NO: 2540935 - protein, 17 aa, Entamoeba dispar
TELCNKCFCKCKTLKLI

SEQ ID NO: 2540936 - protein, 28 aa, Entamoeba dispar
TELIEIKLSFILLTLKNLNIKKVPKTYL

SEQ ID NO: 2540937 - protein, 27 aa, Entamoeba dispar
TELLTRLGCEIIPLNIKPTGDFPHIPE

SEQ ID NO: 2540938 - protein, 21 aa, Entamoeba dispar
TELMIELPIIKHYAEKSIDAY

SEQ ID NO: 2540939 - protein, 27 aa, Entamoeba dispar
TELPSEKQFIFLNILRSNLLKEESIDV

SEQ ID NO: 2540940 - protein, 26 aa, Entamoeba dispar
TELTDKILSMFKIKPTYTFTMLNLEL

SEQ ID NO: 2540941 - protein, 25 aa, Entamoeba dispar
TEMSYWIINKLIPLSTKDITPITRI

SEQ ID NO: 2540942 - protein, 18 aa, Entamoeba dispar
TENDSEMPPLDDLQLLDP

SEQ ID NO: 2540943 - protein, 30 aa, Entamoeba dispar
TENGNLISISPFWHWNFALDLHEVSISRFI

SEQ ID NO: 2540944 - protein, 24 aa, Entamoeba dispar
TENILLATHMLGYGAVWLGVYPEK

SEQ ID NO: 2540945 - protein, 28 aa, Entamoeba dispar
TENNHCKFVWLFLLRNAFYKNCRIVLDL

SEQ ID NO: 2540946 - protein, 22 aa, Entamoeba dispar
TENPLTQNFWELSMKNFDEFIK

SEQ ID NO: 2540947 - protein, 17 aa, Entamoeba dispar
TEPIYVKDPLKAVIPGV

SEQ ID NO: 2540948 - protein, 30 aa, Entamoeba dispar
TEPLQIPTFAFYWIEFITPSFILNRVEYNP

SEQ ID NO: 2540949 - protein, 24 aa, Entamoeba dispar
TEPSIIYIALHKLVEKIKAPDNLK

SEQ ID NO: 2540950 - protein, 34 aa, Entamoeba dispar
TEPSLFFNSKYYIKEHTFLLLYNGTFDEAIIKNH

SEQ ID NO: 2540951 - protein, 19 aa, Entamoeba dispar
TEPYFRAPASFLPIRERRE

SEQ ID NO: 2540952 - protein, 24 aa, Entamoeba dispar
TEQFEPTGFTYFQGGKGKKIELGI

SEQ ID NO: 2540953 - protein, 26 aa, Entamoeba dispar
TEQFHFNPIHFNHYSRILFANIETFH

SEQ ID NO: 2540954 - protein, 23 aa, Entamoeba dispar
TEQGRMLMSFNDFLWNGSKMVIT

SEQ ID NO: 2540955 - protein, 23 aa, Entamoeba dispar
TEQIWQFIPENIQQQLRSEFAFC

SEQ ID NO: 2540956 - protein, 19 aa, Entamoeba dispar
TEQLKLINKQRLKRLNDIE

SEQ ID NO: 2540957 - protein, 17 aa, Entamoeba dispar
TEQLVKISSIILTSGET

SEQ ID NO: 2540958 - protein, 17 aa, Entamoeba dispar
TEQQFELMLKELSYKNY

SEQ ID NO: 2540959 - protein, 26 aa, Entamoeba dispar
TEQQSVFIALLSMVYTIVIDHPRKRS

SEQ ID NO: 2540960 - protein, 25 aa, Entamoeba dispar
TERILIPTINKCQIEWNIKGEIIPK

SEQ ID NO: 2540961 - protein, 35 aa, Entamoeba dispar
TERIPEFCNKFKIPFLFFKSQHPLYKIKEIYSFSK

SEQ ID NO: 2540962 - protein, 20 aa, Entamoeba dispar
TERLVKINSLITPFGDIIER

SEQ ID NO: 2540963 - protein, 31 aa, Entamoeba dispar
TERMTANLPLFYFSPININPPKFKKVDLPQE

SEQ ID NO: 2540964 - protein, 27 aa, Entamoeba dispar
TESELRRLFRRFKKLGMKAKEGASEEY

SEQ ID NO: 2540965 - protein, 32 aa, Entamoeba dispar
TESIELKRKLYKKIIFSLPDANITLLMNLCYL

SEQ ID NO: 2540966 - protein, 24 aa, Entamoeba dispar
TESMIEMIPVQKIEITKKGHLGAS

SEQ ID NO: 2540967 - protein, 32 aa, Entamoeba dispar
TETDKIFEQINWMKMEMEVKFEAIDRGRYYVM

SEQ ID NO: 2540968 - protein, 17 aa, Entamoeba dispar
TETGICYRLFTENTFKY

SEQ ID NO: 2540969 - protein, 23 aa, Entamoeba dispar
TETLHLIMDLLSEFGYFFQTRTT

SEQ ID NO: 2540970 - protein, 24 aa, Entamoeba dispar
TETVILLHFHMDPPVIIQNRPISD

SEQ ID NO: 2540971 - protein, 19 aa, Entamoeba dispar
TEVMDLLKSIYPIVDEYLT

SEQ ID NO: 2540972 - protein, 31 aa, Entamoeba dispar
TEVRELVEYPLLHPEIYKHLGIEPPRGILLH

SEQ ID NO: 2540973 - protein, 24 aa, Entamoeba dispar
TEVTPFSILNLPNGTKKSIKARMF

SEQ ID NO: 2540974 - protein, 29 aa, Entamoeba dispar
TEWKQINSRIIFKPIIQQLADTSKEGFQK

SEQ ID NO: 2540975 - protein, 20 aa, Entamoeba dispar
TEWMLRLFKESRGIKMFSGS

SEQ ID NO: 2540976 - protein, 24 aa, Entamoeba dispar
TEYDELSIRRIVEKNTIEDLDKYK

SEQ ID NO: 2540977 - protein, 25 aa, Entamoeba dispar
TEYNKLWKFIDSNLVLLFSSEPTKI

SEQ ID NO: 2540978 - protein, 26 aa, Entamoeba dispar
TEYVHPYYKHIEWLCGFTGSNATIVV

SEQ ID NO: 2540979 - protein, 37 aa, Entamoeba dispar
TFCQSKFLATFFIYSITHLIFYHKNDIRIMASLCLLE

SEQ ID NO: 2540980 - protein, 19 aa, Entamoeba dispar
TFCYDLINGIIGLCGSSSP

SEQ ID NO: 2540981 - protein, 31 aa, Entamoeba dispar
TFDGLGIKQFLLPTLKQFGIIKPTKIQQLCI

SEQ ID NO: 2540982 - protein, 22 aa, Entamoeba dispar
TFDPSLIQRYDLWDSRNTIFNV

SEQ ID NO: 2540983 - protein, 21 aa, Entamoeba dispar
TFEAIQQALILSILNVNGYGF

SEQ ID NO: 2540984 - protein, 21 aa, Entamoeba dispar
TFECANVFKYFIPSKLTYEEI

SEQ ID NO: 2540985 - protein, 37 aa, Entamoeba dispar
TFEDSIGELFLNFSPFFIVYRNFLINHNKAFTLLTKL

SEQ ID NO: 2540986 - protein, 20 aa, Entamoeba dispar
TFEEDFIMKLIGSKAPDNSI

SEQ ID NO: 2540987 - protein, 24 aa, Entamoeba dispar
TFELQIQFLLQIIEKIPKPIIAND

SEQ ID NO: 2540988 - protein, 19 aa, Entamoeba dispar
TFELVISLLPKYDELIIPH

SEQ ID NO: 2540989 - protein, 30 aa, Entamoeba dispar
TFEPKEWHEEFLELLPKLAHGEKVDKKCFE

SEQ ID NO: 2540990 - protein, 25 aa, Entamoeba dispar
TFEQFQLFMIVYERSLNPDTLSLAL

SEQ ID NO: 2540991 - protein, 27 aa, Entamoeba dispar
TFEYEVFGPIGEFIRLKDNKWNHATEN

SEQ ID NO: 2540992 - protein, 17 aa, Entamoeba dispar
TFFTYFYDKFQALDNGI

SEQ ID NO: 2540993 - protein, 25 aa, Entamoeba dispar
TFGKTDEIILYLKQIKKLFEKNKNP

SEQ ID NO: 2540994 - protein, 29 aa, Entamoeba dispar
TFGMNLFEEFISLIYFILSSQFKMETPDE

SEQ ID NO: 2540995 - protein, 18 aa, Entamoeba dispar
TFHIIEKSFLRGEAFSEL

SEQ ID NO: 2540996 - protein, 25 aa, Entamoeba dispar
TFIENLHHKYIRPLNLHILCNQNIE

SEQ ID NO: 2540997 - protein, 17 aa, Entamoeba dispar
TFIFKYKELENELYIGG

SEQ ID NO: 2540998 - protein, 35 aa, Entamoeba dispar
TFIKHLYDNYNIIGPFLVIVPLSTISNWSKEFNKW

SEQ ID NO: 2540999 - protein, 28 aa, Entamoeba dispar
TFINKKSLMQFLRKTNPRKVFWTAIYRQ

SEQ ID NO: 2541000 - protein, 39 aa, Entamoeba dispar
TFINKKSLMQFLRKTNPRKVFWTAIYRQLNKKGQQNELV

SEQ ID NO: 2541001 - protein, 18 aa, Entamoeba dispar
TFINLRPFTDSKTVSHLH

SEQ ID NO: 2541002 - protein, 17 aa, Entamoeba dispar
TFINYLLNYDYPGSHIG

SEQ ID NO: 2541003 - protein, 19 aa, Entamoeba dispar
TFINYLLNYDYPGSHIGPE

SEQ ID NO: 2541004 - protein, 20 aa, Entamoeba dispar
TFKELYLVNLSLPKRGSIFL

SEQ ID NO: 2541005 - protein, 23 aa, Entamoeba dispar
TFKLLLDYISITIGIIKTFQTNY

SEQ ID NO: 2541006 - protein, 27 aa, Entamoeba dispar
TFKSQVYTFVWCKQVATFFNSPHPEEF

SEQ ID NO: 2541007 - protein, 30 aa, Entamoeba dispar
TFKVIEGMIPFNMNQAIPLVALNCLVEYGS

SEQ ID NO: 2541008 - protein, 22 aa, Entamoeba dispar
TFKWIDCFYTINKERMKIGYNK

SEQ ID NO: 2541009 - protein, 27 aa, Entamoeba dispar
TFLETITLPHFPILLNLKELGISGGLN

SEQ ID NO: 2541010 - protein, 18 aa, Entamoeba dispar
TFLLECHSKYNIKIYDEF

SEQ ID NO: 2541011 - protein, 26 aa, Entamoeba dispar
TFLNNPIIITKWYPFLHSVEKKGEEY

SEQ ID NO: 2541012 - protein, 27 aa, Entamoeba dispar
TFMADKVLRPFIQRGKAIHDLIKSNKT

SEQ ID NO: 2541013 - protein, 37 aa, Entamoeba dispar
TFMANMTYACSILYKTKLPLIIVFTKTDVTPCTKLNQ

SEQ ID NO: 2541014 - protein, 30 aa, Entamoeba dispar
TFNDGRIFKYIIWYLIDYSTYLKEKEQGNI

SEQ ID NO: 2541015 - protein, 30 aa, Entamoeba dispar
TFNLGMNLLKFTRLWNGKGYIYMYVTVEGS

SEQ ID NO: 2541016 - protein, 36 aa, Entamoeba dispar
TFNSYVILPVQRIPRYRLLLQELLKTLPPQHSEYSS

SEQ ID NO: 2541017 - protein, 17 aa, Entamoeba dispar
TFPMCTIASQPRLPEHC

SEQ ID NO: 2541018 - protein, 25 aa, Entamoeba dispar
TFQNKNLYFYMIVAIYEDMGNQLKT

SEQ ID NO: 2541019 - protein, 20 aa, Entamoeba dispar
TFRVLSIDGGGIKGVLECII

SEQ ID NO: 2541020 - protein, 27 aa, Entamoeba dispar
TFSDLWDIFDIILINVEGEYKEIYEPY

SEQ ID NO: 2541021 - protein, 24 aa, Entamoeba dispar
TFSGFFSRLFGFVEPEPVSPRKEQ

SEQ ID NO: 2541022 - protein, 17 aa, Entamoeba dispar
TFSLSLLSEFVPLLYKV

SEQ ID NO: 2541023 - protein, 24 aa, Entamoeba dispar
TFSPAHNILLCGCGLLFKHYGNEI

SEQ ID NO: 2541024 - protein, 18 aa, Entamoeba dispar
TFSQNKKIQVYLIVIRLM

SEQ ID NO: 2541025 - protein, 32 aa, Entamoeba dispar
TFSSNLKTFLYNKLFRYLWPPSISQLENIDYT

SEQ ID NO: 2541026 - protein, 19 aa, Entamoeba dispar
TFSSVAYYDPVKGEPVVLQ

SEQ ID NO: 2541027 - protein, 26 aa, Entamoeba dispar
TFTELVLMVLLTQKGWSFYIKKPHKK

SEQ ID NO: 2541028 - protein, 17 aa, Entamoeba dispar
TFTKLFNPKIGFIIISK

SEQ ID NO: 2541029 - protein, 17 aa, Entamoeba dispar
TFTLIYEPQIISEIIIF

SEQ ID NO: 2541030 - protein, 20 aa, Entamoeba dispar
TFTSLFNTPKTDFSAFLSSD

SEQ ID NO: 2541031 - protein, 25 aa, Entamoeba dispar
TFVCNKSALFIIRRNGMKEYEPIVS

SEQ ID NO: 2541032 - protein, 19 aa, Entamoeba dispar
TFVGFPKNTIHWPASDVLK

SEQ ID NO: 2541033 - protein, 32 aa, Entamoeba dispar
TFVKKINYDFGTHPYIVGTLLFSLKNKKINSY

SEQ ID NO: 2541034 - protein, 18 aa, Entamoeba dispar
TFYFKDCQIITLSAYEPS

SEQ ID NO: 2541035 - protein, 21 aa, Entamoeba dispar
TFYNDANLLIALFDETEKDSI

SEQ ID NO: 2541036 - protein, 23 aa, Entamoeba dispar
TFYPSIFDSLIPNKKRVSSLPKA

SEQ ID NO: 2541037 - protein, 25 aa, Entamoeba dispar
TGAGNPFSTTNLLNSSTTGTQTNGN

SEQ ID NO: 2541038 - protein, 19 aa, Entamoeba dispar
TGALLVYDISRKESFEKIP

SEQ ID NO: 2541039 - protein, 17 aa, Entamoeba dispar
TGCLYSFVKKLLDSDYE

SEQ ID NO: 2541040 - protein, 23 aa, Entamoeba dispar
TGDILWTTLKIVNSIVLIIETTD

SEQ ID NO: 2541041 - protein, 25 aa, Entamoeba dispar
TGDKEILDILGFRPPHHIDLTEFQP

SEQ ID NO: 2541042 - protein, 28 aa, Entamoeba dispar
TGDKKLHLFIPRVPAFSVTLSFLTSLPK

SEQ ID NO: 2541043 - protein, 20 aa, Entamoeba dispar
TGDTTYYEPFWKRISEEPKL

SEQ ID NO: 2541044 - protein, 25 aa, Entamoeba dispar
TGEFKGPVIVQPGSPFFLSFDEYDE

SEQ ID NO: 2541045 - protein, 23 aa, Entamoeba dispar
TGESFIIIQPFGKNPSFISLYGI

SEQ ID NO: 2541046 - protein, 24 aa, Entamoeba dispar
TGFDGSMIYYYEKAADAKFIDELS

SEQ ID NO: 2541047 - protein, 17 aa, Entamoeba dispar
TGGFFTAVFIKKGETLA

SEQ ID NO: 2541048 - protein, 19 aa, Entamoeba dispar
TGGIVLFKWGQGKLRGEPI

SEQ ID NO: 2541049 - protein, 21 aa, Entamoeba dispar
TGHWDVFLMKIGDIKPVAVWR

SEQ ID NO: 2541050 - protein, 17 aa, Entamoeba dispar
TGIFKRYITGQYTGTEK

SEQ ID NO: 2541051 - protein, 41 aa, Entamoeba dispar
TGIIQFSWLRRPIQITCRFYQLGLLMLFNDNKEITYAELGT

SEQ ID NO: 2541052 - protein, 19 aa, Entamoeba dispar
TGITLSEYYRDMGYNVAMM

SEQ ID NO: 2541053 - protein, 22 aa, Entamoeba dispar
TGITTFIFQHGHPVLTCFNSTQ

SEQ ID NO: 2541054 - protein, 19 aa, Entamoeba dispar
TGKCFIMSQKEVKVLISFP

SEQ ID NO: 2541055 - protein, 19 aa, Entamoeba dispar
TGKFKLHITALPYLAQYCQ

SEQ ID NO: 2541056 - protein, 24 aa, Entamoeba dispar
TGKIENLYWREKLAEIVISMKKIS

SEQ ID NO: 2541057 - protein, 23 aa, Entamoeba dispar
TGKIHLLEFFAIKAEYVQEAMSA

SEQ ID NO: 2541058 - protein, 18 aa, Entamoeba dispar
TGKKWTPKVAPAPEVPQP

SEQ ID NO: 2541059 - protein, 24 aa, Entamoeba dispar
TGKQVFTQILPTINFQRGNWSIKE

SEQ ID NO: 2541060 - protein, 18 aa, Entamoeba dispar
TGKSQLLKFASKLGPRHI

SEQ ID NO: 2541061 - protein, 25 aa, Entamoeba dispar
TGLMSACFLVYMLDSLNAHEAIDFY

SEQ ID NO: 2541062 - protein, 28 aa, Entamoeba dispar
TGLMTGPFVPLLLFKTIMNELIESIKLL

SEQ ID NO: 2541063 - protein, 21 aa, Entamoeba dispar
TGLNKKNFLIRIAHGFHDLFI

SEQ ID NO: 2541064 - protein, 17 aa, Entamoeba dispar
TGLRFFTGCVDKTIKMY

SEQ ID NO: 2541065 - protein, 27 aa, Entamoeba dispar
TGLSFVPGGVFVTYKIKGELRGCIGCF

SEQ ID NO: 2541066 - protein, 20 aa, Entamoeba dispar
TGMYYDVALTNPFGIELEKI

SEQ ID NO: 2541067 - protein, 24 aa, Entamoeba dispar
TGNDIIFFWVARMVMMSLELMNCL

SEQ ID NO: 2541068 - protein, 33 aa, Entamoeba dispar
TGNMTGNLPLFYFAPTNINIPKFKKVNLPSQDP

SEQ ID NO: 2541069 - protein, 27 aa, Entamoeba dispar
TGNNNPILLNPLSISSLPIGTNASKDK

SEQ ID NO: 2541070 - protein, 22 aa, Entamoeba dispar
TGNPLDLPRLFQIKGQKRPFVR

SEQ ID NO: 2541071 - protein, 28 aa, Entamoeba dispar
TGNVIKMNLFKPPKFAYSMDYRYWTVEQ

SEQ ID NO: 2541072 - protein, 19 aa, Entamoeba dispar
TGQMVFASSGKIVAAPPPL

SEQ ID NO: 2541073 - protein, 18 aa, Entamoeba dispar
TGRIQPFNRMGLSRGRAG

SEQ ID NO: 2541074 - protein, 26 aa, Entamoeba dispar
TGRIRETYWHIFPTHYSLYTNKTPII

SEQ ID NO: 2541075 - protein, 20 aa, Entamoeba dispar
TGRSIFRGGLEYIRPVGCMR

SEQ ID NO: 2541076 - protein, 34 aa, Entamoeba dispar
TGSFMIRGKKNYLPPVPLVFGIGIMFVVEKEDKE

SEQ ID NO: 2541077 - protein, 30 aa, Entamoeba dispar
TGSGKTISFLIPAIIHILDTPLAQYREGPR

SEQ ID NO: 2541078 - protein, 31 aa, Entamoeba dispar
TGTGKTFAYLIPLIQFVLKLPKLTEETSASG

SEQ ID NO: 2541079 - protein, 29 aa, Entamoeba dispar
TGTKFYLEDIIPESFIKFVIKRGLIEAFI

SEQ ID NO: 2541080 - protein, 25 aa, Entamoeba dispar
TGTLQLIHTLSYYIDKQIIRLQESP

SEQ ID NO: 2541081 - protein, 23 aa, Entamoeba dispar
TGTPHIHCLVLFNSAKRISTLKR

SEQ ID NO: 2541082 - protein, 33 aa, Entamoeba dispar
TGTPLQNTLHELWSLLQFLLPEIFNMKELDEIF

SEQ ID NO: 2541083 - protein, 22 aa, Entamoeba dispar
TGTQFKCYPLYDFGVSIIDSIE

SEQ ID NO: 2541084 - protein, 23 aa, Entamoeba dispar
TGVNRMILLKTVDLYREFLNHLA

SEQ ID NO: 2541085 - protein, 28 aa, Entamoeba dispar
TGWVIPDPLCLMCYLFPEIITHIDVVET

SEQ ID NO: 2541086 - protein, 25 aa, Entamoeba dispar
TGYKPLNMLTVELPLLTSKIESYWG

SEQ ID NO: 2541087 - protein, 19 aa, Entamoeba dispar
THAIVQYDFGTKRWNCILK

SEQ ID NO: 2541088 - protein, 32 aa, Entamoeba dispar
THCHNEFQKTYWKWFISLSEIPRPSYHCELFS

SEQ ID NO: 2541089 - protein, 20 aa, Entamoeba dispar
THCRDKIILPNMIGSVIGVY

SEQ ID NO: 2541090 - protein, 22 aa, Entamoeba dispar
THDRVPLACHPPVRRDGDGRRC

SEQ ID NO: 2541091 - protein, 26 aa, Entamoeba dispar
THEETLEFIQWLYSLGISIISLHGRH

SEQ ID NO: 2541092 - protein, 27 aa, Entamoeba dispar
THEETLEFIQWLYSLGISIISLHGRHH

SEQ ID NO: 2541093 - protein, 25 aa, Entamoeba dispar
THEQFKIIYIAPMKSLVQEIVGTLQ

SEQ ID NO: 2541094 - protein, 27 aa, Entamoeba dispar
THGIVYPYTWIFNGVNKLVFTDKWEKM

SEQ ID NO: 2541095 - protein, 17 aa, Entamoeba dispar
THIIIRNIHDCNIKIRS

SEQ ID NO: 2541096 - protein, 24 aa, Entamoeba dispar
THKFCSKMIEHISKLIGIVQFSSN

SEQ ID NO: 2541097 - protein, 24 aa, Entamoeba dispar
THKKRLSFLGRKSFSKRSSTENTG

SEQ ID NO: 2541098 - protein, 19 aa, Entamoeba dispar
THKLFLTGTPLQNTLHELW

SEQ ID NO: 2541099 - protein, 27 aa, Entamoeba dispar
THKLKISVLMYMKLLMDNGIKGPHLIV

SEQ ID NO: 2541100 - protein, 22 aa, Entamoeba dispar
THKNNMYLTYVIGTCGKCNEND

SEQ ID NO: 2541101 - protein, 23 aa, Entamoeba dispar
THKYGHVTYFWNGNKSGYFDDKL

SEQ ID NO: 2541102 - protein, 21 aa, Entamoeba dispar
THLPGIFNALFPHVKDFENIM

SEQ ID NO: 2541103 - protein, 57 aa, Entamoeba dispar
THLSEATVLYNLRIRYMEDIIHTYSGLFCVVINPYKFFPIYTPFIVSKYQGRRREDV

SEQ ID NO: 2541104 - protein, 19 aa, Entamoeba dispar
THLTMYNILTKFQAIMHIN

SEQ ID NO: 2541105 - protein, 24 aa, Entamoeba dispar
THNGKDMFVQFPRLIFTSTTNDNF

SEQ ID NO: 2541106 - protein, 23 aa, Entamoeba dispar
THNKSYFYRSFSILLEVFEMTHN

SEQ ID NO: 2541107 - protein, 21 aa, Entamoeba dispar
THNNQLFLTSLQIPREENPRD

SEQ ID NO: 2541108 - protein, 18 aa, Entamoeba dispar
THQFIKIKSISFSYKDSI

SEQ ID NO: 2541109 - protein, 25 aa, Entamoeba dispar
THQSCVSKLPFKFTLSFRSENSIKI

SEQ ID NO: 2541110 - protein, 27 aa, Entamoeba dispar
THSDAVSLLLYYLVFNLSIEKRNNLLN

SEQ ID NO: 2541111 - protein, 25 aa, Entamoeba dispar
THSKTMLPLARIIIEYKNLGCIPNL

SEQ ID NO: 2541112 - protein, 24 aa, Entamoeba dispar
THSWSKLWYQNSFERPLILECFAD

SEQ ID NO: 2541113 - protein, 17 aa, Entamoeba dispar
THVWEVNGTIWACKKVE

SEQ ID NO: 2541114 - protein, 26 aa, Entamoeba dispar
THWKQTLFFLKTPLKCKLGDQIKGLY

SEQ ID NO: 2541115 - protein, 18 aa, Entamoeba dispar
THYLAIQFRHPSTNDLHF

SEQ ID NO: 2541116 - protein, 18 aa, Entamoeba dispar
TIACNLNPYLHCQRFIQC

SEQ ID NO: 2541117 - protein, 22 aa, Entamoeba dispar
TIAFMIPYDIRKFLPKIQKESI

SEQ ID NO: 2541118 - protein, 25 aa, Entamoeba dispar
TIAREIMAMWFNLPDRMIWKQCQEE

SEQ ID NO: 2541119 - protein, 27 aa, Entamoeba dispar
TIASLFKLFLRELPTPIIPPIYYDKFV

SEQ ID NO: 2541120 - protein, 34 aa, Entamoeba dispar
TIASYLILPVQRIPRYELFIKQLIKNMPNHHKER

SEQ ID NO: 2541121 - protein, 17 aa, Entamoeba dispar
TICDPCFFTEFRDACMA

SEQ ID NO: 2541122 - protein, 19 aa, Entamoeba dispar
TICRFFINVTPLTGVPKET

SEQ ID NO: 2541123 - protein, 19 aa, Entamoeba dispar
TIDFIKIPTFYKVQYKWDT

SEQ ID NO: 2541124 - protein, 19 aa, Entamoeba dispar
TIDGVIVDFMFTPGAEAPT

SEQ ID NO: 2541125 - protein, 19 aa, Entamoeba dispar
TIDKLVISISFTSFEQYPP

SEQ ID NO: 2541126 - protein, 32 aa, Entamoeba dispar
TIDKRYRVIAIFDYILYLLADSTYILNDFCSI

SEQ ID NO: 2541127 - protein, 22 aa, Entamoeba dispar
TIDLLISNIIITIQRRIIMMDG

SEQ ID NO: 2541128 - protein, 31 aa, Entamoeba dispar
TIDNETKFNLFFSYHYYVDLLCESMADKSVS

SEQ ID NO: 2541129 - protein, 24 aa, Entamoeba dispar
TIECEKLLYLKGDKFKFIGIENNQ

SEQ ID NO: 2541130 - protein, 21 aa, Entamoeba dispar
TIEFNIYKGFNEYVNLYEMEY

SEQ ID NO: 2541131 - protein, 19 aa, Entamoeba dispar
TIEGIYLPDEFFSRKDMHI

SEQ ID NO: 2541132 - protein, 20 aa, Entamoeba dispar
TIEHLPFYTRVTNLMESLGY

SEQ ID NO: 2541133 - protein, 38 aa, Entamoeba dispar
TIEKEFEVIIPIDDLLPFAAMKMFPNALFGNLTLEVKM

SEQ ID NO: 2541134 - protein, 41 aa, Entamoeba dispar
TIEKEFEVIIPIDDLLPFAAMKMFPNALFGNLTLEVKMAIQ

SEQ ID NO: 2541135 - protein, 22 aa, Entamoeba dispar
TIENLFDNILPANLSRALNEYN

SEQ ID NO: 2541136 - protein, 17 aa, Entamoeba dispar
TIEQFMINWVNKALEEE

SEQ ID NO: 2541137 - protein, 27 aa, Entamoeba dispar
TIEQIQQIMIWLIKNGFRHVSELHNGF

SEQ ID NO: 2541138 - protein, 19 aa, Entamoeba dispar
TIERLKQTKLLLIGETCVG

SEQ ID NO: 2541139 - protein, 24 aa, Entamoeba dispar
TIERQLICIYLANIFNKLNVSPNK

SEQ ID NO: 2541140 - protein, 24 aa, Entamoeba dispar
TIESFSIWMENRSLPFKDSEQCLY

SEQ ID NO: 2541141 - protein, 24 aa, Entamoeba dispar
TIETNPFLDPSLNQQPKTPLQENE

SEQ ID NO: 2541142 - protein, 18 aa, Entamoeba dispar
TIEYQLFKALFKTRLIQN

SEQ ID NO: 2541143 - protein, 24 aa, Entamoeba dispar
TIEYSNLNRQFLFRKKDVGRPKSE

SEQ ID NO: 2541144 - protein, 18 aa, Entamoeba dispar
TIFRCIWCSLFVHNTCQP

SEQ ID NO: 2541145 - protein, 22 aa, Entamoeba dispar
TIFRYLPPQYYLSFIAINKRYQ

SEQ ID NO: 2541146 - protein, 26 aa, Entamoeba dispar
TIGDYDLNVWYFSPYPGEYGHVERLY

SEQ ID NO: 2541147 - protein, 23 aa, Entamoeba dispar
TIGEDLMLLSKTQSFVHALESKR

SEQ ID NO: 2541148 - protein, 18 aa, Entamoeba dispar
TIGLLQPPLPIQTTSSIQ

SEQ ID NO: 2541149 - protein, 17 aa, Entamoeba dispar
TIGLYNKIYEFIDDIKK

SEQ ID NO: 2541150 - protein, 31 aa, Entamoeba dispar
TIGNGTYSLVLKFLPNLFNPDVPSLYCRALK

SEQ ID NO: 2541151 - protein, 31 aa, Entamoeba dispar
TIGSIQPLTFYLITPIQRIPRYELLIRDMLK

SEQ ID NO: 2541152 - protein, 18 aa, Entamoeba dispar
TIGSLGLLSKSLVFRELC

SEQ ID NO: 2541153 - protein, 23 aa, Entamoeba dispar
TIGVIHLVPIIIGNTYCITTLNV

SEQ ID NO: 2541154 - protein, 34 aa, Entamoeba dispar
TIGYNQFKRIDTLLYLLYYPQIPMVKTKTIDMIN

SEQ ID NO: 2541155 - protein, 27 aa, Entamoeba dispar
TIHPDQIIIAMLRSFKSSFADGIYGFV

SEQ ID NO: 2541156 - protein, 22 aa, Entamoeba dispar
TIHTLLENFLLEYATSNDQEKI

SEQ ID NO: 2541157 - protein, 19 aa, Entamoeba dispar
TIIASILHKVSIPSKHSAV

SEQ ID NO: 2541158 - protein, 18 aa, Entamoeba dispar
TIIDQYNFLLKGMFTHED

SEQ ID NO: 2541159 - protein, 19 aa, Entamoeba dispar
TIIEMLASMLNIQLYRINL

SEQ ID NO: 2541160 - protein, 18 aa, Entamoeba dispar
TIIETPPMVVAGFVGYKK

SEQ ID NO: 2541161 - protein, 18 aa, Entamoeba dispar
TIIFIPFTIPDEFNQRLI

SEQ ID NO: 2541162 - protein, 17 aa, Entamoeba dispar
TIIFPFLSKNRYGIIAY

SEQ ID NO: 2541163 - protein, 18 aa, Entamoeba dispar
TIIGHFALPLNTLKIRVA

SEQ ID NO: 2541164 - protein, 25 aa, Entamoeba dispar
TIIKEYPIITVFIKGLPNGFETIQV

SEQ ID NO: 2541165 - protein, 17 aa, Entamoeba dispar
TIIKPEYGEYYWVAKVE

SEQ ID NO: 2541166 - protein, 20 aa, Entamoeba dispar
TIILNCQIVQQLSFNIPDTL

SEQ ID NO: 2541167 - protein, 18 aa, Entamoeba dispar
TIILTEEVYPLTSFLQSS

SEQ ID NO: 2541168 - protein, 19 aa, Entamoeba dispar
TIINPVITIPAGFNQKQRK

SEQ ID NO: 2541169 - protein, 24 aa, Entamoeba dispar
TIIQILNYILLGERIVFTSSNNSL

SEQ ID NO: 2541170 - protein, 21 aa, Entamoeba dispar
TIIRRQIVVQALIYFNQRMIK

SEQ ID NO: 2541171 - protein, 30 aa, Entamoeba dispar
TIITDNHIFLITPFLKGGALCHRLFYQSFK

SEQ ID NO: 2541172 - protein, 25 aa, Entamoeba dispar
TIIVNLHIWKALNPSFKTQIATIII

SEQ ID NO: 2541173 - protein, 20 aa, Entamoeba dispar
TIIVNMHIWKSLNASFKIQV

SEQ ID NO: 2541174 - protein, 19 aa, Entamoeba dispar
TIIVNMHIWKSLNASFKTQ

SEQ ID NO: 2541175 - protein, 25 aa, Entamoeba dispar
TIIVSQYFCTLLKDLKKENKHYTNI

SEQ ID NO: 2541176 - protein, 26 aa, Entamoeba dispar
TIIYEKNFDFFPSNKYPKFIDCKKHL

SEQ ID NO: 2541177 - protein, 26 aa, Entamoeba dispar
TIKDSNYMLIIKIYGLLKCTNFTPNN

SEQ ID NO: 2541178 - protein, 25 aa, Entamoeba dispar
TIKEFGYWCFYKCYSLTSISIPPSV

SEQ ID NO: 2541179 - protein, 18 aa, Entamoeba dispar
TIKEFIRFGFIEMSQRCE

SEQ ID NO: 2541180 - protein, 20 aa, Entamoeba dispar
TIKFHFISIKYNIPKHIYAN

SEQ ID NO: 2541181 - protein, 17 aa, Entamoeba dispar
TIKFILKGYQKIGRDIK

SEQ ID NO: 2541182 - protein, 33 aa, Entamoeba dispar
TIKLHPKRFLLIKEFIKLLFINTALHSEESINS

SEQ ID NO: 2541183 - protein, 22 aa, Entamoeba dispar
TIKPHPQFMLFATQNPPNTYGG

SEQ ID NO: 2541184 - protein, 23 aa, Entamoeba dispar
TIKPMWDVIFAFSGRLSLVDHIC

SEQ ID NO: 2541185 - protein, 17 aa, Entamoeba dispar
TIKQFIIPFISIPDQKI

SEQ ID NO: 2541186 - protein, 19 aa, Entamoeba dispar
TIKQLLFYLTPSTKKRASN

SEQ ID NO: 2541187 - protein, 24 aa, Entamoeba dispar
TIKRDYISIMPKPDGLTAAKNLAE

SEQ ID NO: 2541188 - protein, 19 aa, Entamoeba dispar
TIKSYVYKQCEEKKLFIEG

SEQ ID NO: 2541189 - protein, 21 aa, Entamoeba dispar
TIKVEGCTFYFFVSSMIGSRL

SEQ ID NO: 2541190 - protein, 25 aa, Entamoeba dispar
TIKVNIINSYLLPSLLRFSKNLKEK

SEQ ID NO: 2541191 - protein, 18 aa, Entamoeba dispar
TILAPPNLCGACVFMPLI

SEQ ID NO: 2541192 - protein, 29 aa, Entamoeba dispar
TILDKKQFHWLYLYVLFKMVHHSLLSEMQ

SEQ ID NO: 2541193 - protein, 19 aa, Entamoeba dispar
TILHQWIMKYYNSGNSDYV

SEQ ID NO: 2541194 - protein, 45 aa, Entamoeba dispar
TILLMDHFITFFQKLHPRQFPKFTCQWIELFSHRSLLLSLSKPSE

SEQ ID NO: 2541195 - protein, 23 aa, Entamoeba dispar
TILNNIHFFTFRNNNINLCDYKG

SEQ ID NO: 2541196 - protein, 30 aa, Entamoeba dispar
TILQKRLMYSFDLFPLNMLTGIKDFIFQKL

SEQ ID NO: 2541197 - protein, 21 aa, Entamoeba dispar
TILQLGHIAIAIRKDDFKCKY

SEQ ID NO: 2541198 - protein, 21 aa, Entamoeba dispar
TILTMLIENFEYIFPNIQKEI

SEQ ID NO: 2541199 - protein, 31 aa, Entamoeba dispar
TILYESQGLVPLLRLQWNKFDPNFIATFAMD

SEQ ID NO: 2541200 - protein, 27 aa, Entamoeba dispar
TIMKRLSKLYEEFPRVVKQFARNRPLE

SEQ ID NO: 2541201 - protein, 21 aa, Entamoeba dispar
TIMTPIILPPVTSKIINFFIK

SEQ ID NO: 2541202 - protein, 21 aa, Entamoeba dispar
TINDFLNPSLLSSPPPHLSSI

SEQ ID NO: 2541203 - protein, 22 aa, Entamoeba dispar
TINELHQLELLEDMKLTQKRNE

SEQ ID NO: 2541204 - protein, 26 aa, Entamoeba dispar
TINENLDIFSFLLKDFRLIIYEVNTI

SEQ ID NO: 2541205 - protein, 30 aa, Entamoeba dispar
TINEVANLIKLWFRELPTLLLNGLTSTQIQ

SEQ ID NO: 2541206 - protein, 19 aa, Entamoeba dispar
TINFDAMIYLLVKEGYEVI

SEQ ID NO: 2541207 - protein, 19 aa, Entamoeba dispar
TINIIKEFLLQCGLHPHES

SEQ ID NO: 2541208 - protein, 21 aa, Entamoeba dispar
TINIPTLIKEIGRYCFNKCTG

SEQ ID NO: 2541209 - protein, 25 aa, Entamoeba dispar
TINKKPRIIQLTKNFLFIGKEETKE

SEQ ID NO: 2541210 - protein, 17 aa, Entamoeba dispar
TINNLLFSGIWDMANEN

SEQ ID NO: 2541211 - protein, 30 aa, Entamoeba dispar
TINPKLLKSISILFPLLPELVPESKLKLPS

SEQ ID NO: 2541212 - protein, 24 aa, Entamoeba dispar
TINQFINALHRPLYLTSESSESLK

SEQ ID NO: 2541213 - protein, 25 aa, Entamoeba dispar
TINQRPFIFMLNDIDTPFLLNNPKY

SEQ ID NO: 2541214 - protein, 17 aa, Entamoeba dispar
TINTTYFILSMLSQLEI

SEQ ID NO: 2541215 - protein, 33 aa, Entamoeba dispar
TINVNVLQYFIDKLNCYYLNTSHIQNLREISTI

SEQ ID NO: 2541216 - protein, 18 aa, Entamoeba dispar
TINYIDVCISSTLTIWNC

SEQ ID NO: 2541217 - protein, 26 aa, Entamoeba dispar
TINYSTLLLNIFKTAFTDTNKFRVIV

SEQ ID NO: 2541218 - protein, 19 aa, Entamoeba dispar
TIPFNIEYDTFCSDVLPFI

SEQ ID NO: 2541219 - protein, 36 aa, Entamoeba dispar
TIPGEQSKPVPPIPQKKPAPPTPSKCAPPLPTKCAP

SEQ ID NO: 2541220 - protein, 18 aa, Entamoeba dispar
TIPGKLILYPKDSNQLFG

SEQ ID NO: 2541221 - protein, 17 aa, Entamoeba dispar
TIPLPFDYQTYFLHCKI

SEQ ID NO: 2541222 - protein, 30 aa, Entamoeba dispar
TIPNKWVKTMMMFVLLLKNLEEKEKQNENS

SEQ ID NO: 2541223 - protein, 19 aa, Entamoeba dispar
TIPQLKKPENQIILNEIKQ

SEQ ID NO: 2541224 - protein, 18 aa, Entamoeba dispar
TIPRLIPTSAIDSSKLLV

SEQ ID NO: 2541225 - protein, 22 aa, Entamoeba dispar
TIPSSRLLVVKFPATHPGDFVL

SEQ ID NO: 2541226 - protein, 20 aa, Entamoeba dispar
TIPVSTEWKGAMKHLGGRDY

SEQ ID NO: 2541227 - protein, 25 aa, Entamoeba dispar
TIQARSIPLLLMGKDIMAKARTGSG

SEQ ID NO: 2541228 - protein, 31 aa, Entamoeba dispar
TIQILGAEKALFRALKTKKKTPKYGLIFHAA

SEQ ID NO: 2541229 - protein, 19 aa, Entamoeba dispar
TIQKLLKAYLSIVQDYLSS

SEQ ID NO: 2541230 - protein, 22 aa, Entamoeba dispar
TIQKQIYWKLISLSSVLTNDLV

SEQ ID NO: 2541231 - protein, 22 aa, Entamoeba dispar
TIQLYIGFPKQLNIPTICECHS

SEQ ID NO: 2541232 - protein, 26 aa, Entamoeba dispar
TIQRKPTIMCTQPVFRPAINSSSHEN

SEQ ID NO: 2541233 - protein, 34 aa, Entamoeba dispar
TIQYKPDWSRGYSRKAFALLKLEKYEEAEEVCNA

SEQ ID NO: 2541234 - protein, 28 aa, Entamoeba dispar
TIRAHNIRIPIMPGLFAPYSCISSSCTS

SEQ ID NO: 2541235 - protein, 21 aa, Entamoeba dispar
TIRALRFIECIIQTIKASKLT

SEQ ID NO: 2541236 - protein, 38 aa, Entamoeba dispar
TIRDIFKECLNSPNIIWFFKFSLQTICPFTLAKLASFG

SEQ ID NO: 2541237 - protein, 19 aa, Entamoeba dispar
TIREVIPPGLFPTSDHPSA

SEQ ID NO: 2541238 - protein, 20 aa, Entamoeba dispar
TIRGLFTQPSDAKWFKPIEL

SEQ ID NO: 2541239 - protein, 17 aa, Entamoeba dispar
TIRKWIKCASGNKYRMG

SEQ ID NO: 2541240 - protein, 17 aa, Entamoeba dispar
TIRKYCHGVFDQLYRAT

SEQ ID NO: 2541241 - protein, 17 aa, Entamoeba dispar
TIRLFDHFLYCNHVCIV

SEQ ID NO: 2541242 - protein, 27 aa, Entamoeba dispar
TIRRVHPQIFFYYNSFNIVLGKQGTGK

SEQ ID NO: 2541243 - protein, 24 aa, Entamoeba dispar
TISELTIIIDFIQKHYKQIRAYIK

SEQ ID NO: 2541244 - protein, 31 aa, Entamoeba dispar
TISEVVRFAPPLSIIIIKPGTYEETEPIIVD

SEQ ID NO: 2541245 - protein, 20 aa, Entamoeba dispar
TISMFEKKIVYIEAQINEAS

SEQ ID NO: 2541246 - protein, 18 aa, Entamoeba dispar
TISPKIPKPVARPVLKRV

SEQ ID NO: 2541247 - protein, 17 aa, Entamoeba dispar
TISPKKLFEGAIDIYEV

SEQ ID NO: 2541248 - protein, 26 aa, Entamoeba dispar
TISQCLFYKCYSLTKLVLPEVNNIDN

SEQ ID NO: 2541249 - protein, 23 aa, Entamoeba dispar
TISSQNLSILLPTSIRKLTLDCS

SEQ ID NO: 2541250 - protein, 24 aa, Entamoeba dispar
TISTRRRWILLTSLKTVHNINEIV

SEQ ID NO: 2541251 - protein, 22 aa, Entamoeba dispar
TISYIDVLKRCNPKFDFSSIIT

SEQ ID NO: 2541252 - protein, 22 aa, Entamoeba dispar
TISYRNKLLYSIRDINRKASSI

SEQ ID NO: 2541253 - protein, 27 aa, Entamoeba dispar
TITEFHEKLFDLGFNIGMRMLEVINIR

SEQ ID NO: 2541254 - protein, 19 aa, Entamoeba dispar
TITEWVGLSKCKVVYDSLS

SEQ ID NO: 2541255 - protein, 21 aa, Entamoeba dispar
TITHHTGFINTIAFSPDGSIM

SEQ ID NO: 2541256 - protein, 25 aa, Entamoeba dispar
TITHLIKAYPSSLTLKCSCDLYMHF

SEQ ID NO: 2541257 - protein, 24 aa, Entamoeba dispar
TITIKYYNLISHHTLFKDSILTTL

SEQ ID NO: 2541258 - protein, 22 aa, Entamoeba dispar
TITKIRYDCFLGCQSLTSMNMD

SEQ ID NO: 2541259 - protein, 18 aa, Entamoeba dispar
TITLPYQYFLTESNTIVL

SEQ ID NO: 2541260 - protein, 19 aa, Entamoeba dispar
TITMERLRFSSFFVQSVKG

SEQ ID NO: 2541261 - protein, 27 aa, Entamoeba dispar
TITMPIKIMFIKFLANSFITTPPEVYM

SEQ ID NO: 2541262 - protein, 32 aa, Entamoeba dispar
TITTLLNAKIIFFIVKVLFRCDAVDPPDSKKN

SEQ ID NO: 2541263 - protein, 17 aa, Entamoeba dispar
TITTTTDNFLESLLCLE

SEQ ID NO: 2541264 - protein, 27 aa, Entamoeba dispar
TIVDCMGPIYLQYATWMKMKKLDKEIS

SEQ ID NO: 2541265 - protein, 21 aa, Entamoeba dispar
TIVDWNKIIGWCEEWNKIDIQ

SEQ ID NO: 2541266 - protein, 17 aa, Entamoeba dispar
TIVEQFIPVLEKNIYKF

SEQ ID NO: 2541267 - protein, 33 aa, Entamoeba dispar
TIVFYKIHQVFGGKLKYILNGGAPLTEELYEWL

SEQ ID NO: 2541268 - protein, 24 aa, Entamoeba dispar
TIYDNRKGLFGQCNELIVFETSQL

SEQ ID NO: 2541269 - protein, 21 aa, Entamoeba dispar
TIYFLMSLIYDTDVFTIMCID

SEQ ID NO: 2541270 - protein, 17 aa, Entamoeba dispar
TIYGGKNIDILLNDLLK

SEQ ID NO: 2541271 - protein, 18 aa, Entamoeba dispar
TIYLDEMPSVISSALSLI

SEQ ID NO: 2541272 - protein, 18 aa, Entamoeba dispar
TIYNIKRTKKAPPIKIID

SEQ ID NO: 2541273 - protein, 19 aa, Entamoeba dispar
TIYNIKRTKKAPPIKIIDT

SEQ ID NO: 2541274 - protein, 30 aa, Entamoeba dispar
TIYPLRYDNNYFLWFLQKNQMKQTVVVIPT

SEQ ID NO: 2541275 - protein, 26 aa, Entamoeba dispar
TIYRPDILHYTLLTLLDSPLNKAGML

SEQ ID NO: 2541276 - protein, 19 aa, Entamoeba dispar
TIYSSSILLVKPNNETNIK

SEQ ID NO: 2541277 - protein, 18 aa, Entamoeba dispar
TIYYQWEWEEVKGVFFSS

SEQ ID NO: 2541278 - protein, 22 aa, Entamoeba dispar
TKAFGDFKDFLVKMANVRKDYA

SEQ ID NO: 2541279 - protein, 22 aa, Entamoeba dispar
TKAINDFFAPLLNKFIIPNSLV

SEQ ID NO: 2541280 - protein, 27 aa, Entamoeba dispar
TKDCSFDAWKILRRGTIVLYKMPAGEY

SEQ ID NO: 2541281 - protein, 26 aa, Entamoeba dispar
TKDDLEDLFEKCGIILNVNIPINYFT

SEQ ID NO: 2541282 - protein, 24 aa, Entamoeba dispar
TKDEFFLSFIKSLGQYRIFDNSPV

SEQ ID NO: 2541283 - protein, 17 aa, Entamoeba dispar
TKDKNSGILKKAAYMEE

SEQ ID NO: 2541284 - protein, 29 aa, Entamoeba dispar
TKDLEVAADLKYYAIPEAEKRMKELKEQN

SEQ ID NO: 2541285 - protein, 30 aa, Entamoeba dispar
  misc_feature (30)..(30): Xaa can be any naturally occurring amino acid
TKDLEVAADLKYYAIPKAEKRMKELKEQNX

SEQ ID NO: 2541286 - protein, 23 aa, Entamoeba dispar
TKDTFKFFDNYPPALALSTCMQF

SEQ ID NO: 2541287 - protein, 41 aa, Entamoeba dispar
TKEEFQADMLLVFDNALLFNHPDSEVYHWAVKLKKQFETLW

SEQ ID NO: 2541288 - protein, 25 aa, Entamoeba dispar
TKEEIIALLKKICIIKINGGLGTSM

SEQ ID NO: 2541289 - protein, 17 aa, Entamoeba dispar
TKEEISSIFKLICFSHE

SEQ ID NO: 2541290 - protein, 25 aa, Entamoeba dispar
TKEEKLKILPIIKKLEEEKSEWKNI

SEQ ID NO: 2541291 - protein, 24 aa, Entamoeba dispar
TKEELIGLLVKRFNPQRPEGMNWD

SEQ ID NO: 2541292 - protein, 26 aa, Entamoeba dispar
TKEELRIWEPKKLIQEKRNLLTKSIL

SEQ ID NO: 2541293 - protein, 22 aa, Entamoeba dispar
TKEFLMNMSYLFNNQPNLKSQK

SEQ ID NO: 2541294 - protein, 22 aa, Entamoeba dispar
TKEKPVCEFFYKIGACRHGDAC

SEQ ID NO: 2541295 - protein, 25 aa, Entamoeba dispar
TKEMKAWLWNDLLGMESIVDEEKMV

SEQ ID NO: 2541296 - protein, 29 aa, Entamoeba dispar
TKENNVIKLILPNEEIILTALNSHEKTIF

SEQ ID NO: 2541297 - protein, 22 aa, Entamoeba dispar
TKEQWEIIFYEPIKESIELFEF

SEQ ID NO: 2541298 - protein, 32 aa, Entamoeba dispar
TKEVAQMSFLIWALNRKFSFSFQKPKKRSTVN

SEQ ID NO: 2541299 - protein, 26 aa, Entamoeba dispar
TKEVGQFMLATSKSVFLWLCDLNDEK

SEQ ID NO: 2541300 - protein, 23 aa, Entamoeba dispar
TKEVRILLYQFYKVFINYYQATE

SEQ ID NO: 2541301 - protein, 20 aa, Entamoeba dispar
TKEYNTFFLDLLRAMLNIKE

SEQ ID NO: 2541302 - protein, 27 aa, Entamoeba dispar
TKFEEKKWYEFFSFKGKRIGGKIGIES

SEQ ID NO: 2541303 - protein, 18 aa, Entamoeba dispar
TKFFDLAVSGEFKKDFRS

SEQ ID NO: 2541304 - protein, 21 aa, Entamoeba dispar
TKFFSRVGFKTLSPYDLNQLI

SEQ ID NO: 2541305 - protein, 25 aa, Entamoeba dispar
TKFKDLDFAKPTPTIARRVFNVLMG

SEQ ID NO: 2541306 - protein, 23 aa, Entamoeba dispar
TKFKVGYNSSLFRKGNYACIAEM

SEQ ID NO: 2541307 - protein, 19 aa, Entamoeba dispar
TKFTCCHFFNGRTKKYECI

SEQ ID NO: 2541308 - protein, 23 aa, Entamoeba dispar
TKFVPLGILHMRSVNDWVKEMTQ

SEQ ID NO: 2541309 - protein, 26 aa, Entamoeba dispar
TKGCQKFMILYQLNSGELFGTYHSVH

SEQ ID NO: 2541310 - protein, 18 aa, Entamoeba dispar
TKGILQFYILVDDSYDYG

SEQ ID NO: 2541311 - protein, 17 aa, Entamoeba dispar
TKGVITPSYRPPEIWFG

SEQ ID NO: 2541312 - protein, 22 aa, Entamoeba dispar
TKHPFVFVCPATRISMCSLPKK

SEQ ID NO: 2541313 - protein, 19 aa, Entamoeba dispar
TKIIPARDLVPEKILSSCY

SEQ ID NO: 2541314 - protein, 24 aa, Entamoeba dispar
TKIKFDLSLKLLLHSLRKSEDLFE

SEQ ID NO: 2541315 - protein, 26 aa, Entamoeba dispar
TKIKTIMYQIFSALKYLHENNIIHRD

SEQ ID NO: 2541316 - protein, 29 aa, Entamoeba dispar
TKINQIILCLLTQTNTYFIKIGLQFFVGS

SEQ ID NO: 2541317 - protein, 20 aa, Entamoeba dispar
TKIPPKCDLVIQYSYHYEIN

SEQ ID NO: 2541318 - protein, 25 aa, Entamoeba dispar
TKIQKSLVVFLIPHNHSYLVRVITR

SEQ ID NO: 2541319 - protein, 19 aa, Entamoeba dispar
TKIRIITALMKLLKKFNSI

SEQ ID NO: 2541320 - protein, 17 aa, Entamoeba dispar
TKIVHLIDSGFIQECNL

SEQ ID NO: 2541321 - protein, 17 aa, Entamoeba dispar
TKKASFSSISGWLREFQ

SEQ ID NO: 2541322 - protein, 17 aa, Entamoeba dispar
TKKCRNLIKSSFNNNNC

SEQ ID NO: 2541323 - protein, 26 aa, Entamoeba dispar
TKKESNQWLDPLRVFYEQINSEDQLL

SEQ ID NO: 2541324 - protein, 18 aa, Entamoeba dispar
TKKGPLAKVWIAAHWEGK

SEQ ID NO: 2541325 - protein, 23 aa, Entamoeba dispar
TKKGQPIMNNIMNKLLKDIEHQQ

SEQ ID NO: 2541326 - protein, 17 aa, Entamoeba dispar
TKKPKLPLSLRKESNNF

SEQ ID NO: 2541327 - protein, 26 aa, Entamoeba dispar
TKKSNKFVLQCLLTLLTELSTILVKE

SEQ ID NO: 2541328 - protein, 20 aa, Entamoeba dispar
TKKYFAVPVPFVKSIHDAAV

SEQ ID NO: 2541329 - protein, 20 aa, Entamoeba dispar
TKLFNPKIGFIIISKAYCYE

SEQ ID NO: 2541330 - protein, 18 aa, Entamoeba dispar
TKLILPTKSFVLESYDFP

SEQ ID NO: 2541331 - protein, 22 aa, Entamoeba dispar
TKLIPADFIIPANSLNPIGKHH

SEQ ID NO: 2541332 - protein, 25 aa, Entamoeba dispar
TKLLEYLSQFWIAMQGLGNCKLSHM

SEQ ID NO: 2541333 - protein, 21 aa, Entamoeba dispar
TKLPFDSLWLSPYANFNFQSF

SEQ ID NO: 2541334 - protein, 20 aa, Entamoeba dispar
TKLPLYINSTIRFKVHHVIM

SEQ ID NO: 2541335 - protein, 22 aa, Entamoeba dispar
TKLQLQFIASPLSRPEKLEQLK

SEQ ID NO: 2541336 - protein, 19 aa, Entamoeba dispar
TKLSFISFLCEKFDFEEIK

SEQ ID NO: 2541337 - protein, 21 aa, Entamoeba dispar
TKLVFMKLLNEITEWGYGWEL

SEQ ID NO: 2541338 - protein, 26 aa, Entamoeba dispar
TKMENIVILTKAYITYFKERANLENE

SEQ ID NO: 2541339 - protein, 23 aa, Entamoeba dispar
TKMFTDMLDDYYKYFRMGITFIE

SEQ ID NO: 2541340 - protein, 21 aa, Entamoeba dispar
TKMLTQFISALRYIANDFELF

SEQ ID NO: 2541341 - protein, 25 aa, Entamoeba dispar
TKNECDLFFNRTYLTDSIDSKNFCV

SEQ ID NO: 2541342 - protein, 29 aa, Entamoeba dispar
TKNFGMSENWFFAGKFDISLIRQLSEDGN

SEQ ID NO: 2541343 - protein, 23 aa, Entamoeba dispar
TKNFIFFMNLLNKRYNRFIIRIS

SEQ ID NO: 2541344 - protein, 32 aa, Entamoeba dispar
TKNFKTVYVILKDNFFFLYKSSNESSPIQILL

SEQ ID NO: 2541345 - protein, 17 aa, Entamoeba dispar
TKNGFLLQYRWDKNIEL

SEQ ID NO: 2541346 - protein, 30 aa, Entamoeba dispar
TKNKIYFIQNLLIDLLREKGLFFESKLAKI

SEQ ID NO: 2541347 - protein, 24 aa, Entamoeba dispar
TKNLIIHNIFMKLNMVQCFICPSF

SEQ ID NO: 2541348 - protein, 35 aa, Entamoeba dispar
TKNLLPIRYKQNGGYFLFTFINFYGIEPQIFYTSK

SEQ ID NO: 2541349 - protein, 29 aa, Entamoeba dispar
TKNMLFDEAWFPYAHFHPFYASYHSMNKS

SEQ ID NO: 2541350 - protein, 26 aa, Entamoeba dispar
TKNSSLSFTLPLDSSLSQKKTDQANQ

SEQ ID NO: 2541351 - protein, 28 aa, Entamoeba dispar
TKNSYSYFLNFLFPNSFFTDMKKFIVKR

SEQ ID NO: 2541352 - protein, 28 aa, Entamoeba dispar
TKNSYSYFLNFLFPNSFFTDMQKFIVKR

SEQ ID NO: 2541353 - protein, 24 aa, Entamoeba dispar
TKNTELVLIIQPLKRINGTVLPDI

SEQ ID NO: 2541354 - protein, 30 aa, Entamoeba dispar
TKNTRFCLICNYISRILPPISSRCIKFRFS

SEQ ID NO: 2541355 - protein, 21 aa, Entamoeba dispar
TKNVVVKFYVPWCNICKSIQS

SEQ ID NO: 2541356 - protein, 26 aa, Entamoeba dispar
TKNYVTFIYSPIPHYFFLLRILREKE

SEQ ID NO: 2541357 - protein, 23 aa, Entamoeba dispar
TKPEDYVYLIPKTENPSSGVVVF

SEQ ID NO: 2541358 - protein, 35 aa, Entamoeba dispar
TKPIKFTPIIDECYPLWVYKSTPGLFCIQSFCHIS

SEQ ID NO: 2541359 - protein, 19 aa, Entamoeba dispar
TKPITPPKNKTIGSPAQPS

SEQ ID NO: 2541360 - protein, 24 aa, Entamoeba dispar
TKPYIPEHLLLLLSTSEACQVPLI

SEQ ID NO: 2541361 - protein, 18 aa, Entamoeba dispar
TKQPFPVDPYAQLEFAIC

SEQ ID NO: 2541362 - protein, 35 aa, Entamoeba dispar
TKQSMFQLTVKLGQILFVERFIKTWAICFRADGKK

SEQ ID NO: 2541363 - protein, 23 aa, Entamoeba dispar
TKRAIYLGMLKNILELLNVRNKG

SEQ ID NO: 2541364 - protein, 17 aa, Entamoeba dispar
TKRFEFPIPIEIIIDCY

SEQ ID NO: 2541365 - protein, 22 aa, Entamoeba dispar
TKRIGYLALGLLLDENQETLTL

SEQ ID NO: 2541366 - protein, 23 aa, Entamoeba dispar
TKRRRYIICGPRIKRREFVNTTV

SEQ ID NO: 2541367 - protein, 34 aa, Entamoeba dispar
TKRSKYFADLLAEKLRYPILPVIRKQFSDGELYY

SEQ ID NO: 2541368 - protein, 22 aa, Entamoeba dispar
TKRTPPIKIIDTPGLEIQEELN

SEQ ID NO: 2541369 - protein, 35 aa, Entamoeba dispar
TKSDIYSLGIVFWEIFRRVVFGSYTKPWFKEYNIP

SEQ ID NO: 2541370 - protein, 24 aa, Entamoeba dispar
TKSFKLYYDIVSQSTIRSLFQINF

SEQ ID NO: 2541371 - protein, 17 aa, Entamoeba dispar
TKSGFFGLSFKKKNKRK

SEQ ID NO: 2541372 - protein, 20 aa, Entamoeba dispar
TKSIDPIWDGDKSTFIVQLE

SEQ ID NO: 2541373 - protein, 28 aa, Entamoeba dispar
TKSIIYKFHPFYKHLYPTIITGLQNLIH

SEQ ID NO: 2541374 - protein, 26 aa, Entamoeba dispar
TKSIPFTPLRLCDLSLPFGVLSQSDD

SEQ ID NO: 2541375 - protein, 34 aa, Entamoeba dispar
TKSKIEPNTFKTSLKRFSYCPVLFSNNDENIKEI

SEQ ID NO: 2541376 - protein, 23 aa, Entamoeba dispar
TKSKWKIPYQLIDSFGFEGNNID

SEQ ID NO: 2541377 - protein, 24 aa, Entamoeba dispar
TKSLWKNYYVYSDGIIFVVDSTNT

SEQ ID NO: 2541378 - protein, 24 aa, Entamoeba dispar
TKSNDIIMLFLHTFSLCSQETEAQ

SEQ ID NO: 2541379 - protein, 26 aa, Entamoeba dispar
TKSNEFYWSLLHLNPRQLVYSIKDYR

SEQ ID NO: 2541380 - protein, 23 aa, Entamoeba dispar
TKSSILSVFIQWTKSFFGDFEKK

SEQ ID NO: 2541381 - protein, 30 aa, Entamoeba dispar
TKSVKQFTLDPLLINSKRPKITKIIWNEQG

SEQ ID NO: 2541382 - protein, 17 aa, Entamoeba dispar
TKSWEDFDRIFRDVKNE

SEQ ID NO: 2541383 - protein, 23 aa, Entamoeba dispar
TKTDLFQFYLVSHVPRKGLVKPS

SEQ ID NO: 2541384 - protein, 23 aa, Entamoeba dispar
TKTLLGILGAIIFGKPASINKQG

SEQ ID NO: 2541385 - protein, 21 aa, Entamoeba dispar
TKTLNFYTWKSYKAPNGVVIK

SEQ ID NO: 2541386 - protein, 25 aa, Entamoeba dispar
TKTLNLIMIMDIDRSWKNLLENAFG

SEQ ID NO: 2541387 - protein, 26 aa, Entamoeba dispar
TKTLSSSILPFYSQVIELPNELKSIV

SEQ ID NO: 2541388 - protein, 24 aa, Entamoeba dispar
TKTMKTFLTKYLEFERKYGDESKQ

SEQ ID NO: 2541389 - protein, 22 aa, Entamoeba dispar
TKTQFHLIMKFLDSTNGKIEND

SEQ ID NO: 2541390 - protein, 23 aa, Entamoeba dispar
TKTQLWVIMLSIIGLIQRRISPF

SEQ ID NO: 2541391 - protein, 29 aa, Entamoeba dispar
TKTSVAASLIAQGYILANDTFQKAVQFDR

SEQ ID NO: 2541392 - protein, 26 aa, Entamoeba dispar
TKVFDLTAICFVAPSSNARLTANQKY

SEQ ID NO: 2541393 - protein, 21 aa, Entamoeba dispar
TKVFFEFCKAKEAILITTDIA

SEQ ID NO: 2541394 - protein, 46 aa, Entamoeba dispar
TKVIDESISLLYQLWLQLMPSDNLIWGVFSLFHKKWIRISEVATNW

SEQ ID NO: 2541395 - protein, 25 aa, Entamoeba dispar
TKVKNLLMIISYLEKNQNNGKDEIY

SEQ ID NO: 2541396 - protein, 33 aa, Entamoeba dispar
TKVKTIGNENARRIWLGRWTTADYPLPESGNER

SEQ ID NO: 2541397 - protein, 20 aa, Entamoeba dispar
TKYFLYTPQMVEQCIQLMFE

SEQ ID NO: 2541398 - protein, 27 aa, Entamoeba dispar
TKYIHTPMPYFVFSFIGVYSVGIIEGE

SEQ ID NO: 2541399 - protein, 20 aa, Entamoeba dispar
TKYINYAFIRFSRFVGNCIT

SEQ ID NO: 2541400 - protein, 24 aa, Entamoeba dispar
TKYKIFTFRFPLIHSSIYCHVLFI

SEQ ID NO: 2541401 - protein, 26 aa, Entamoeba dispar
TKYLTSKIFDVFYRCSPRLTDPTTGM

SEQ ID NO: 2541402 - protein, 30 aa, Entamoeba dispar
TKYVMLKYRQWQLALRRAISFVDFLKDSSD

SEQ ID NO: 2541403 - protein, 22 aa, Entamoeba dispar
TLAEQFGMKPYLIDIGGGFSQI

SEQ ID NO: 2541404 - protein, 25 aa, Entamoeba dispar
TLAKCYYFKYIINLYNIERKNNDEN

SEQ ID NO: 2541405 - protein, 17 aa, Entamoeba dispar
TLAQILNINLKNLMAIG

SEQ ID NO: 2541406 - protein, 28 aa, Entamoeba dispar
TLASAEILFALCKYYKELKKCQSELFQP

SEQ ID NO: 2541407 - protein, 25 aa, Entamoeba dispar
TLAYRSPEMINLYDYKPIGRKADVW

SEQ ID NO: 2541408 - protein, 20 aa, Entamoeba dispar
TLCPFCGLWISENKFKIHQS

SEQ ID NO: 2541409 - protein, 19 aa, Entamoeba dispar
TLCSTLCNALLQVKARKVS

SEQ ID NO: 2541410 - protein, 17 aa, Entamoeba dispar
TLDIYGEINLGYKIKLA

SEQ ID NO: 2541411 - protein, 29 aa, Entamoeba dispar
TLDKIPIIHHDFWLQLKTTDFLGHPQVIR

SEQ ID NO: 2541412 - protein, 23 aa, Entamoeba dispar
TLDKIVNVFSEDTIRKGLKIYTD

SEQ ID NO: 2541413 - protein, 18 aa, Entamoeba dispar
TLDLKWLKYLIYDETDKL

SEQ ID NO: 2541414 - protein, 28 aa, Entamoeba dispar
TLDSYKKLVILKLPPLTLNSLNLTNCQR

SEQ ID NO: 2541415 - protein, 21 aa, Entamoeba dispar
TLEANLSFYYSKTAKTGTRKD

SEQ ID NO: 2541416 - protein, 22 aa, Entamoeba dispar
TLEANLSFYYSKTAKTGTRKDG

SEQ ID NO: 2541417 - protein, 19 aa, Entamoeba dispar
TLEEIVHVVRLSTTTVRVR

SEQ ID NO: 2541418 - protein, 23 aa, Entamoeba dispar
TLEGTILALYDYDDKMQLVKTSS

SEQ ID NO: 2541419 - protein, 42 aa, Entamoeba dispar
TLEKSIVLKEQELQIWKSETINKYLKSVFGKSIGKKGVKEVV

SEQ ID NO: 2541420 - protein, 24 aa, Entamoeba dispar
TLEQLLIQPVQRAMRYPMMIEGLM

SEQ ID NO: 2541421 - protein, 17 aa, Entamoeba dispar
TLFACKLRYIIELDEIR

SEQ ID NO: 2541422 - protein, 30 aa, Entamoeba dispar
TLFGVFHGAIFMQIPMLIESCARCVAKHLV

SEQ ID NO: 2541423 - protein, 17 aa, Entamoeba dispar
TLFSSAGLIYKYYGREI

SEQ ID NO: 2541424 - protein, 18 aa, Entamoeba dispar
TLGILKKQLELHSEDLQR

SEQ ID NO: 2541425 - protein, 17 aa, Entamoeba dispar
TLGIMRPSVSDSSATTL

SEQ ID NO: 2541426 - protein, 27 aa, Entamoeba dispar
TLGKKSASAWWKKYFSYKGNDIETTVP

SEQ ID NO: 2541427 - protein, 23 aa, Entamoeba dispar
TLGKVYIGILTGYDNPMNIVLKN

SEQ ID NO: 2541428 - protein, 19 aa, Entamoeba dispar
TLHFLDYLIHLEISKSENG

SEQ ID NO: 2541429 - protein, 28 aa, Entamoeba dispar
TLHFLQPSVLFHKMVPLLSGVTKFDIPS

SEQ ID NO: 2541430 - protein, 19 aa, Entamoeba dispar
TLHGQAFVFPLSINQNNNF

SEQ ID NO: 2541431 - protein, 17 aa, Entamoeba dispar
TLHKFESKYWKFKDKRD

SEQ ID NO: 2541432 - protein, 35 aa, Entamoeba dispar
TLHLKRKDVIAIYLPNCIPFIIMEAVIESSGFIMM

SEQ ID NO: 2541433 - protein, 26 aa, Entamoeba dispar
TLHPFQNPFVFPTKSSSIISSDNTIK

SEQ ID NO: 2541434 - protein, 17 aa, Entamoeba dispar
TLHQLSNILIIGSGVIS

SEQ ID NO: 2541435 - protein, 25 aa, Entamoeba dispar
TLIEWEMFKAIKPPELYAWNKKDKE

SEQ ID NO: 2541436 - protein, 20 aa, Entamoeba dispar
TLIFLFRVEPYMKMHIQFFD

SEQ ID NO: 2541437 - protein, 20 aa, Entamoeba dispar
TLIHHITEFKTRNLELLVVD

SEQ ID NO: 2541438 - protein, 26 aa, Entamoeba dispar
TLIHNLKRSLPKKERIFIKEYIDFKP

SEQ ID NO: 2541439 - protein, 19 aa, Entamoeba dispar
TLIHRLKKSLPKKERTFIK

SEQ ID NO: 2541440 - protein, 21 aa, Entamoeba dispar
TLILFYIFSRQQNKTLVSIIK

SEQ ID NO: 2541441 - protein, 36 aa, Entamoeba dispar
TLISILTLRECFPTFLSFFALPLVSAIPYTAVSLRL

SEQ ID NO: 2541442 - protein, 33 aa, Entamoeba dispar
TLITQANWDIIKLQYKILFKEVKPGLFDCFVKA

SEQ ID NO: 2541443 - protein, 25 aa, Entamoeba dispar
TLIVNGLMSIPFLSIAHRIKSLKEI

SEQ ID NO: 2541444 - protein, 29 aa, Entamoeba dispar
TLKCDLIDKIFLNNKLLFNKDDIIKKGKI

SEQ ID NO: 2541445 - protein, 23 aa, Entamoeba dispar
TLKDLNMLFSDIIELSNKADILS

SEQ ID NO: 2541446 - protein, 22 aa, Entamoeba dispar
TLKDVITKYFQPELEKPFQEKK

SEQ ID NO: 2541447 - protein, 17 aa, Entamoeba dispar
TLKFGNIFQLSKLNLID

SEQ ID NO: 2541448 - protein, 26 aa, Entamoeba dispar
TLKGHGDWVLNLDWHYGNKLIASGDK

SEQ ID NO: 2541449 - protein, 27 aa, Entamoeba dispar
TLKGHGDWVLNLDWHYGNKLIASGDKL

SEQ ID NO: 2541450 - protein, 20 aa, Entamoeba dispar
TLKGIIDYIIDYKEKDLISF

SEQ ID NO: 2541451 - protein, 20 aa, Entamoeba dispar
TLKLVLRYQPFLNTSKVEEY

SEQ ID NO: 2541452 - protein, 18 aa, Entamoeba dispar
TLKNFPPQDIIFTTYFRD

SEQ ID NO: 2541453 - protein, 20 aa, Entamoeba dispar
TLKQLFPKYRLALENEIEKM

SEQ ID NO: 2541454 - protein, 25 aa, Entamoeba dispar
TLLERSTYVVLILRVPTTNDNITCT

SEQ ID NO: 2541455 - protein, 17 aa, Entamoeba dispar
TLLFPKVKTIQTLDGDI

SEQ ID NO: 2541456 - protein, 18 aa, Entamoeba dispar
TLLILARQNSKIIDRTIF

SEQ ID NO: 2541457 - protein, 39 aa, Entamoeba dispar
TLLILHRSFDCATPLLIQWTYQAMIHEFLGINSNLVELP

SEQ ID NO: 2541458 - protein, 18 aa, Entamoeba dispar
TLLKMIQNIIDFYQMPDD

SEQ ID NO: 2541459 - protein, 17 aa, Entamoeba dispar
TLLLGLLHKDPIINSYF

SEQ ID NO: 2541460 - protein, 25 aa, Entamoeba dispar
TLLNTLLYEWYELRKLKTVDCRKIK

SEQ ID NO: 2541461 - protein, 27 aa, Entamoeba dispar
TLLNTRMHLWLEYYTINQAMSSNHDSD

SEQ ID NO: 2541462 - protein, 19 aa, Entamoeba dispar
TLLPGQSKLYLLIEGKNEE

SEQ ID NO: 2541463 - protein, 21 aa, Entamoeba dispar
TLLQFKKYFESVKTLPIYQQI

SEQ ID NO: 2541464 - protein, 18 aa, Entamoeba dispar
TLLSCVLFSLIIQKNNDI

SEQ ID NO: 2541465 - protein, 26 aa, Entamoeba dispar
TLLSETYLLTIYIIDKYLSLNKTVER

SEQ ID NO: 2541466 - protein, 27 aa, Entamoeba dispar
TLLTFFDLIHFPLKKPNWIGCNNQLRP

SEQ ID NO: 2541467 - protein, 24 aa, Entamoeba dispar
TLMALLSQYGIKFIIQSPRKSSDT

SEQ ID NO: 2541468 - protein, 18 aa, Entamoeba dispar
TLMEIELSKKTIAYEELE

SEQ ID NO: 2541469 - protein, 20 aa, Entamoeba dispar
TLMNFKVCFIKSISLQVSTD

SEQ ID NO: 2541470 - protein, 23 aa, Entamoeba dispar
TLNETLYQLFKRVVSDSLCNNPV

SEQ ID NO: 2541471 - protein, 23 aa, Entamoeba dispar
TLNEVTVIVTYPSPIKGKDVKCK

SEQ ID NO: 2541472 - protein, 20 aa, Entamoeba dispar
TLNGLKAWKLAKPLAEKGKE

SEQ ID NO: 2541473 - protein, 27 aa, Entamoeba dispar
TLNGTCIFVCFNNYPFSLPKIYPTDIS

SEQ ID NO: 2541474 - protein, 20 aa, Entamoeba dispar
TLNIGDCRSYLYSNSTLRTI

SEQ ID NO: 2541475 - protein, 19 aa, Entamoeba dispar
TLNIQYDKALIKKAVVWLS

SEQ ID NO: 2541476 - protein, 20 aa, Entamoeba dispar
TLNMLTWKGLKFRVEYANPN

SEQ ID NO: 2541477 - protein, 17 aa, Entamoeba dispar
TLNNKLQIFYYNDDHKL

SEQ ID NO: 2541478 - protein, 29 aa, Entamoeba dispar
TLNRTFHLRELLPFDFRPSDLPSIIFPDT

SEQ ID NO: 2541479 - protein, 26 aa, Entamoeba dispar
TLNSLWPTVKPLPGAIRILNYFKKHH

SEQ ID NO: 2541480 - protein, 29 aa, Entamoeba dispar
TLNTPFIIEIFKIIYDMYIITPSLDTNNG

SEQ ID NO: 2541481 - protein, 24 aa, Entamoeba dispar
TLNVMKIFISFNDIQTILSFVDNL

SEQ ID NO: 2541482 - protein, 19 aa, Entamoeba dispar
TLPCELCIGSKLKTYIFID

SEQ ID NO: 2541483 - protein, 25 aa, Entamoeba dispar
TLPDETLFIVLQVIVTNSLCKERLI

SEQ ID NO: 2541484 - protein, 26 aa, Entamoeba dispar
TLPEIKYPFNINFIKQLNIFEISYFN

SEQ ID NO: 2541485 - protein, 19 aa, Entamoeba dispar
TLPGVAVRTSGDPILCDCE

SEQ ID NO: 2541486 - protein, 23 aa, Entamoeba dispar
TLPKPLICNSNTPRLLLSTSGST

SEQ ID NO: 2541487 - protein, 17 aa, Entamoeba dispar
TLPKYIPFAYDPNALKR

SEQ ID NO: 2541488 - protein, 19 aa, Entamoeba dispar
TLQYLYILAQIGISSSPIQ

SEQ ID NO: 2541489 - protein, 26 aa, Entamoeba dispar
TLRFHARFLLVCLLTDKLKMGENVLS

SEQ ID NO: 2541490 - protein, 20 aa, Entamoeba dispar
TLRFQMLGVIPKVSSKQVIL

SEQ ID NO: 2541491 - protein, 25 aa, Entamoeba dispar
TLRGFKHFYAFCRQYKMLGKEDVVP

SEQ ID NO: 2541492 - protein, 19 aa, Entamoeba dispar
TLRIGKIMKLSRITEILKS

SEQ ID NO: 2541493 - protein, 20 aa, Entamoeba dispar
TLRIKGHIFPMALSPFTKRI

SEQ ID NO: 2541494 - protein, 17 aa, Entamoeba dispar
TLRKRWTLAKYIQPRSS

SEQ ID NO: 2541495 - protein, 19 aa, Entamoeba dispar
TLRLTLFNEFLIRIKKQKI

SEQ ID NO: 2541496 - protein, 17 aa, Entamoeba dispar
TLRNVIWMICEYCNHYD

SEQ ID NO: 2541497 - protein, 32 aa, Entamoeba dispar
TLRQEYCFIPFKYRDGYLLSILKETEGKSIII

SEQ ID NO: 2541498 - protein, 18 aa, Entamoeba dispar
TLRVSFVLSFTFKQNPYL

SEQ ID NO: 2541499 - protein, 26 aa, Entamoeba dispar
TLSEPRVTLFPCYWDKEEHIEMVEEK

SEQ ID NO: 2541500 - protein, 24 aa, Entamoeba dispar
TLSGPTSFAPLIKKAIEIVKETKQ

SEQ ID NO: 2541501 - protein, 21 aa, Entamoeba dispar
TLSISFITFVIENYPSIFPDD

SEQ ID NO: 2541502 - protein, 35 aa, Entamoeba dispar
TLSKGQTYAFRYLLQSFPRIQHFSNLIKLLTIMKE

SEQ ID NO: 2541503 - protein, 26 aa, Entamoeba dispar
TLSLIKKPEILPTKEYIKYTPIQRGK

SEQ ID NO: 2541504 - protein, 17 aa, Entamoeba dispar
TLSLNLNPNEIPSSLNF

SEQ ID NO: 2541505 - protein, 30 aa, Entamoeba dispar
TLSLPKISKPLFVFPFQTTTTIPHLSKEQT

SEQ ID NO: 2541506 - protein, 20 aa, Entamoeba dispar
TLSPAVHDLPFTPTAAHFSP

SEQ ID NO: 2541507 - protein, 23 aa, Entamoeba dispar
TLTAFLPPSYGYPFMLASQVVYS

SEQ ID NO: 2541508 - protein, 27 aa, Entamoeba dispar
TLTGALFQLPPVIAAVKRSLRIRTIYN

SEQ ID NO: 2541509 - protein, 25 aa, Entamoeba dispar
TLTGWLAELCYLVNGALVLKGEFIQ

SEQ ID NO: 2541510 - protein, 20 aa, Entamoeba dispar
TLTISYCKSLWLSTLTGFEN

SEQ ID NO: 2541511 - protein, 23 aa, Entamoeba dispar
TLTKIPPKCDLVIQYSYHYEIND

SEQ ID NO: 2541512 - protein, 22 aa, Entamoeba dispar
TLTLGSWEFKLKLGGIMEAIYR

SEQ ID NO: 2541513 - protein, 27 aa, Entamoeba dispar
TLTLKRPNFWKLRRKDCPWVKQKKSSL

SEQ ID NO: 2541514 - protein, 17 aa, Entamoeba dispar
TLTLVKLGNFNVASTIF

SEQ ID NO: 2541515 - protein, 38 aa, Entamoeba dispar
TLTNYKIVFVVKCVIFNVSIPLTKIAYFKKVNSMDKQH

SEQ ID NO: 2541516 - protein, 22 aa, Entamoeba dispar
TLTSEYCLMIKKWFSSIKNGTE

SEQ ID NO: 2541517 - protein, 44 aa, Entamoeba dispar
TLTYTSEGIPYMFPIPYKDEPSYLIYFMRPGYSSDYITIQVIEQ

SEQ ID NO: 2541518 - protein, 29 aa, Entamoeba dispar
TLVDSKVIIKIICFICSFITEKEEIQEIV

SEQ ID NO: 2541519 - protein, 33 aa, Entamoeba dispar
TLVEKEKFIPIYNKIILILVKLDLLSPENFPLL

SEQ ID NO: 2541520 - protein, 19 aa, Entamoeba dispar
TLVLIVTVPLSYFFHRFSN

SEQ ID NO: 2541521 - protein, 20 aa, Entamoeba dispar
TLVNLPLDKGIKKPLLQQVN

SEQ ID NO: 2541522 - protein, 19 aa, Entamoeba dispar
TLVPTVKCLINISDAPYKV

SEQ ID NO: 2541523 - protein, 24 aa, Entamoeba dispar
TLVVRDYLSIRKFDLRKSDGPLSI

SEQ ID NO: 2541524 - protein, 18 aa, Entamoeba dispar
TLYDSLNLIIYKFYVIHF

SEQ ID NO: 2541525 - protein, 19 aa, Entamoeba dispar
TLYILKIKTTFYNFCQRSF

SEQ ID NO: 2541526 - protein, 37 aa, Entamoeba dispar
TLYKDPRTILIFKVNSPINDKWGFPKPFFSNDQEFND

SEQ ID NO: 2541527 - protein, 17 aa, Entamoeba dispar
TLYLTKFEETSIPNVVE

SEQ ID NO: 2541528 - protein, 21 aa, Entamoeba dispar
TLYQLFDIYQRDPNLEKQINF

SEQ ID NO: 2541529 - protein, 23 aa, Entamoeba dispar
TMAATINFLLELLQKMGCEYKEK

SEQ ID NO: 2541530 - protein, 18 aa, Entamoeba dispar
TMALKYLHSLNIIHRDLK

SEQ ID NO: 2541531 - protein, 28 aa, Entamoeba dispar
TMARLENSLRKWTQMTEELTLNLDDETA

SEQ ID NO: 2541532 - protein, 19 aa, Entamoeba dispar
TMCFPWLSMKADTKCFETF

SEQ ID NO: 2541533 - protein, 23 aa, Entamoeba dispar
TMDDIKLVFVHKSMRTEKVLDAI

SEQ ID NO: 2541534 - protein, 39 aa, Entamoeba dispar
TMDNAQVQFGYLRYEMDQTKKFLCVCWCGQAAPDNLKTK

SEQ ID NO: 2541535 - protein, 24 aa, Entamoeba dispar
TMEEKILIKLFNKEVAKKVKCELS

SEQ ID NO: 2541536 - protein, 19 aa, Entamoeba dispar
TMEIKSKLSTQPVIKTTPN

SEQ ID NO: 2541537 - protein, 29 aa, Entamoeba dispar
TMELSLTTALMLCQIADFIQFPLQIHSIG

SEQ ID NO: 2541538 - protein, 21 aa, Entamoeba dispar
TMETGSEVCRFILFCTNPCSV

SEQ ID NO: 2541539 - protein, 24 aa, Entamoeba dispar
TMEWNHLYLIFDANIDGTLTISSS

SEQ ID NO: 2541540 - protein, 20 aa, Entamoeba dispar
TMFGVNSITPLILLGALEHH

SEQ ID NO: 2541541 - protein, 24 aa, Entamoeba dispar
TMGIIPQNILALPSNSLMASIILT

SEQ ID NO: 2541542 - protein, 20 aa, Entamoeba dispar
TMHPTLLGDFYFKGKELYPN

SEQ ID NO: 2541543 - protein, 19 aa, Entamoeba dispar
TMIIVWSYTKHREICKLTG

SEQ ID NO: 2541544 - protein, 23 aa, Entamoeba dispar
TMKGWEKLRWDDILHIKTIVEDD

SEQ ID NO: 2541545 - protein, 30 aa, Entamoeba dispar
TMKQLRNDIPLYTAPPPDGLTLKEFQQYHV

SEQ ID NO: 2541546 - protein, 17 aa, Entamoeba dispar
TMKSGFCPVKRALSKGI

SEQ ID NO: 2541547 - protein, 18 aa, Entamoeba dispar
TMLSDKWKALSEDERSHY

SEQ ID NO: 2541548 - protein, 18 aa, Entamoeba dispar
TMNAAMCALLFSGVDMKG

SEQ ID NO: 2541549 - protein, 18 aa, Entamoeba dispar
TMNIPFVPPSMNSPLIHD

SEQ ID NO: 2541550 - protein, 26 aa, Entamoeba dispar
TMPKLLPHLILTILSGCRITIFQSIP

SEQ ID NO: 2541551 - protein, 21 aa, Entamoeba dispar
TMQFISQERIFINEPVLVSFS

SEQ ID NO: 2541552 - protein, 17 aa, Entamoeba dispar
TMSFILKSINRENKKRI

SEQ ID NO: 2541553 - protein, 24 aa, Entamoeba dispar
TMSFVKIFLRQFLNKASQSPEIFQ

SEQ ID NO: 2541554 - protein, 18 aa, Entamoeba dispar
TMTIMLYQLKRLFEIRNK

SEQ ID NO: 2541555 - protein, 19 aa, Entamoeba dispar
TMVNLLKKSNIALDIVSFG

SEQ ID NO: 2541556 - protein, 25 aa, Entamoeba dispar
TMVQFKNPLLSLRPSLESTHQQEVV

SEQ ID NO: 2541557 - protein, 17 aa, Entamoeba dispar
TMYFMKINDLRKVKELK

SEQ ID NO: 2541558 - protein, 17 aa, Entamoeba dispar
TMYLGRAMMIVYEMCIN

SEQ ID NO: 2541559 - protein, 18 aa, Entamoeba dispar
TMYPSEMIIHGDGDGRWI

SEQ ID NO: 2541560 - protein, 29 aa, Entamoeba dispar
TNALSQILKDPKLVLVFKVNTPIDEKWGF

SEQ ID NO: 2541561 - protein, 25 aa, Entamoeba dispar
TNASVDLIWDLFREANTITPSKISQ

SEQ ID NO: 2541562 - protein, 18 aa, Entamoeba dispar
TNAVYPYQPIHPSIFAHA

SEQ ID NO: 2541563 - protein, 26 aa, Entamoeba dispar
TNAWEEFYMMLHGNIVCLFVNGESAA

SEQ ID NO: 2541564 - protein, 22 aa, Entamoeba dispar
TNDEKVLKASISSLLLSSSSEE

SEQ ID NO: 2541565 - protein, 24 aa, Entamoeba dispar
TNDKDLLILVSGLLRYESTLRWTA

SEQ ID NO: 2541566 - protein, 22 aa, Entamoeba dispar
TNDLTLKDILINNLNKLDAIEV

SEQ ID NO: 2541567 - protein, 29 aa, Entamoeba dispar
TNDLVEIEIPMSILWIGDYCFKDCTRLKS

SEQ ID NO: 2541568 - protein, 29 aa, Entamoeba dispar
TNDMEYIIRTIYPIIPQQIVNTLIQFIKK

SEQ ID NO: 2541569 - protein, 29 aa, Entamoeba dispar
TNDNIINIIKPLFIIIIASYSKNYIENIG

SEQ ID NO: 2541570 - protein, 17 aa, Entamoeba dispar
TNDTVLMHLFIEKFSVF

SEQ ID NO: 2541571 - protein, 27 aa, Entamoeba dispar
TNEAPPVPAPRRGLMLGRRSINETSSE

SEQ ID NO: 2541572 - protein, 25 aa, Entamoeba dispar
TNEAPPVPAPRRGLMLGRRSVQQTT

SEQ ID NO: 2541573 - protein, 30 aa, Entamoeba dispar
TNEFLKGAVKLIFLNKMDLFEEKLTKVPLN

SEQ ID NO: 2541574 - protein, 20 aa, Entamoeba dispar
TNEFRLVAIPNRNIEMNEMT

SEQ ID NO: 2541575 - protein, 24 aa, Entamoeba dispar
TNEIKLMYSINHIQSIVAIPQAKE

SEQ ID NO: 2541576 - protein, 26 aa, Entamoeba dispar
TNELSIFLDMLFKKSINEPKFASLYV

SEQ ID NO: 2541577 - protein, 25 aa, Entamoeba dispar
TNELYYIWDILFAHNNPLSLLNYLC

SEQ ID NO: 2541578 - protein, 27 aa, Entamoeba dispar
TNENVTIPFYPWYIIAVETTNKTKIGE

SEQ ID NO: 2541579 - protein, 27 aa, Entamoeba dispar
TNENVTIPFYPWYIIAVETTNKTNIGE

SEQ ID NO: 2541580 - protein, 27 aa, Entamoeba dispar
TNENVTIPFYPWYIIAVETTNKTNNGE

SEQ ID NO: 2541581 - protein, 25 aa, Entamoeba dispar
TNEQSRINIIKRRKLSIGRVESEVY

SEQ ID NO: 2541582 - protein, 23 aa, Entamoeba dispar
TNEVIYSRWVPHNSKVLKIKFNK

SEQ ID NO: 2541583 - protein, 26 aa, Entamoeba dispar
TNEVKKWKDIAILKDVQQTQSVQQSD

SEQ ID NO: 2541584 - protein, 30 aa, Entamoeba dispar
TNFFNNNLYKKLYYPYLYEGEYNLFLSQLD

SEQ ID NO: 2541585 - protein, 22 aa, Entamoeba dispar
TNFFSLFDIYSLASTLKQYIRE

SEQ ID NO: 2541586 - protein, 19 aa, Entamoeba dispar
TNFIGEEQVKLLGDKIGEL

SEQ ID NO: 2541587 - protein, 19 aa, Entamoeba dispar
TNFIIQPHDRFLVSTGIAV

SEQ ID NO: 2541588 - protein, 21 aa, Entamoeba dispar
TNFIKLLEQILYYSSNEEIQR

SEQ ID NO: 2541589 - protein, 17 aa, Entamoeba dispar
TNFLELPPDVTAAVYKK

SEQ ID NO: 2541590 - protein, 33 aa, Entamoeba dispar
TNGENAFVIKAFTSIPLGIVKPSPFVDGMVGEF

SEQ ID NO: 2541591 - protein, 31 aa, Entamoeba dispar
TNGENAFVIKAFTSIPLGTVKPSPFVDGMVG

SEQ ID NO: 2541592 - protein, 26 aa, Entamoeba dispar
TNHDGIIKKIYILNDIIITIANDKKI

SEQ ID NO: 2541593 - protein, 28 aa, Entamoeba dispar
TNHTVKRLFLMYLSCIKRVDEQGKLLSE

SEQ ID NO: 2541594 - protein, 20 aa, Entamoeba dispar
TNIFNIIFPFHLDESPRNRL

SEQ ID NO: 2541595 - protein, 27 aa, Entamoeba dispar
TNIFTQLIIEFPQLKIVWSYSPQMTVH

SEQ ID NO: 2541596 - protein, 23 aa, Entamoeba dispar
TNIKIPYQYFFPGNVMPFAQTLN

SEQ ID NO: 2541597 - protein, 17 aa, Entamoeba dispar
TNILIICFSIDSRSSFG

SEQ ID NO: 2541598 - protein, 26 aa, Entamoeba dispar
TNIQIPFPETEKLKLYFRCFKTNKKG

SEQ ID NO: 2541599 - protein, 21 aa, Entamoeba dispar
TNISKKLLLSSKLKKKEFIAA

SEQ ID NO: 2541600 - protein, 27 aa, Entamoeba dispar
TNKDSFLHLPLYLNRIYELRKDHSKSI

SEQ ID NO: 2541601 - protein, 35 aa, Entamoeba dispar
TNKYLRQEGMFFDIIGYVIDIIYLEKDNIPINKIV

SEQ ID NO: 2541602 - protein, 18 aa, Entamoeba dispar
TNLFTIFGCYQIGQFECS

SEQ ID NO: 2541603 - protein, 18 aa, Entamoeba dispar
TNLLINRDEKIKLVESYN

SEQ ID NO: 2541604 - protein, 25 aa, Entamoeba dispar
TNLNIPGYHFTIGNRIYFNNAPLIN

SEQ ID NO: 2541605 - protein, 25 aa, Entamoeba dispar
TNLNSFGFARLLTMAYGKFEEKHWK

SEQ ID NO: 2541606 - protein, 18 aa, Entamoeba dispar
TNLSRCTFLILDEADRML

SEQ ID NO: 2541607 - protein, 24 aa, Entamoeba dispar
TNLSTIEAIYYFYRDYYTCMNGKY

SEQ ID NO: 2541608 - protein, 20 aa, Entamoeba dispar
TNLTILLPKSVKYFAPNAFE

SEQ ID NO: 2541609 - protein, 26 aa, Entamoeba dispar
TNMKGNGLFYLIDPKGGVNTIDLLIS

SEQ ID NO: 2541610 - protein, 25 aa, Entamoeba dispar
TNMNGIQIPFFSLQLIHSTAMKSDI

SEQ ID NO: 2541611 - protein, 25 aa, Entamoeba dispar
TNNFTFVLPMVYSLSFFIKKNIEDY

SEQ ID NO: 2541612 - protein, 21 aa, Entamoeba dispar
TNNLIYIILSMVLSGFHHVYD

SEQ ID NO: 2541613 - protein, 20 aa, Entamoeba dispar
TNNMLVIGFLKKGEILIQDF

SEQ ID NO: 2541614 - protein, 23 aa, Entamoeba dispar
TNNPIPILFSGGIDSSLIAYYTL

SEQ ID NO: 2541615 - protein, 24 aa, Entamoeba dispar
TNNQFFPPVPSPSSGIPTLPTIQQ

SEQ ID NO: 2541616 - protein, 22 aa, Entamoeba dispar
TNNTKWLFYNQGIYLLEYKTNG

SEQ ID NO: 2541617 - protein, 25 aa, Entamoeba dispar
TNPDIIIPFIFNFIKPQYIDSIEIL

SEQ ID NO: 2541618 - protein, 22 aa, Entamoeba dispar
TNPIVITFNLHKAFLDEKVILI

SEQ ID NO: 2541619 - protein, 20 aa, Entamoeba dispar
TNQIPPMPTIKDVLLIVRNI

SEQ ID NO: 2541620 - protein, 19 aa, Entamoeba dispar
TNQLFSEYKTRTNKTFESG

SEQ ID NO: 2541621 - protein, 19 aa, Entamoeba dispar
TNQMISTKPIITLGSRKIK

SEQ ID NO: 2541622 - protein, 24 aa, Entamoeba dispar
TNQQFLEQLGTYFFKVFGNVSVIK

SEQ ID NO: 2541623 - protein, 38 aa, Entamoeba dispar
TNQRKNIRSLLKNLDEILWNDQKWRKLGMSDLCDFEGV

SEQ ID NO: 2541624 - protein, 37 aa, Entamoeba dispar
TNRDSFDYLQDWIDDVSMYCPQGVKIVLVGNKVDLEN

SEQ ID NO: 2541625 - protein, 26 aa, Entamoeba dispar
TNREQLLDGLLREMMRTELETKLHQA

SEQ ID NO: 2541626 - protein, 20 aa, Entamoeba dispar
TNRMRYFIKVALECLKHNSF

SEQ ID NO: 2541627 - protein, 29 aa, Entamoeba dispar
TNRNYSTLRFYLQQLLLICSKTLEEIVIY

SEQ ID NO: 2541628 - protein, 25 aa, Entamoeba dispar
TNRRLTRSIAPIKLKKSKKGNEDTE

SEQ ID NO: 2541629 - protein, 21 aa, Entamoeba dispar
TNRSYYLRLSLNKETPKIEVH

SEQ ID NO: 2541630 - protein, 17 aa, Entamoeba dispar
TNSAYFYTLTSKDTREM

SEQ ID NO: 2541631 - protein, 17 aa, Entamoeba dispar
TNSIIHNIASKPPLPIN

SEQ ID NO: 2541632 - protein, 24 aa, Entamoeba dispar
TNSKVCQAILLSPTRELALQTQEV

SEQ ID NO: 2541633 - protein, 28 aa, Entamoeba dispar
TNSLSPQQLDFLFPAPTSARHISQSSSP

SEQ ID NO: 2541634 - protein, 28 aa, Entamoeba dispar
TNSLSSQQLDFLFPAPTSARHISQSSSP

SEQ ID NO: 2541635 - protein, 26 aa, Entamoeba dispar
TNSSLIFFDFIDIVIDLRSDYSPLLE

SEQ ID NO: 2541636 - protein, 29 aa, Entamoeba dispar
TNTFTNGLFIRYCSFIRKWLKWNIVKEND

SEQ ID NO: 2541637 - protein, 27 aa, Entamoeba dispar
TNTGGAFIKFVPFLKSYTQYATNQDNC

SEQ ID NO: 2541638 - protein, 26 aa, Entamoeba dispar
TNTKGCLFPYLLDTKKFAATIYSACG

SEQ ID NO: 2541639 - protein, 22 aa, Entamoeba dispar
TNTLLKGFAPSSFWSSLTSKIS

SEQ ID NO: 2541640 - protein, 25 aa, Entamoeba dispar
TNTQTNGLGFGGFGSATGFGQTNQQ

SEQ ID NO: 2541641 - protein, 28 aa, Entamoeba dispar
TNVPQACIPLRIQIINKMKAYHNKFLPS

SEQ ID NO: 2541642 - protein, 18 aa, Entamoeba dispar
TNWARDITYYASPKCVVV

SEQ ID NO: 2541643 - protein, 25 aa, Entamoeba dispar
TNYDFYCLGIIPPQRIQTEILRFGM

SEQ ID NO: 2541644 - protein, 24 aa, Entamoeba dispar
TNYFSDFVQNIAGYFCPNSRPTQG

SEQ ID NO: 2541645 - protein, 26 aa, Entamoeba dispar
TNYKIVFVVKCVIFNVSIPLTKIADF

SEQ ID NO: 2541646 - protein, 27 aa, Entamoeba dispar
TNYLYSKYLLYLFNSEGLFIHEKQHCL

SEQ ID NO: 2541647 - protein, 23 aa, Entamoeba dispar
TNYSILTFFSFDNIFKIIDKIID

SEQ ID NO: 2541648 - protein, 21 aa, Entamoeba dispar
TPAGILLYGPPGCGKTYCAKA

SEQ ID NO: 2541649 - protein, 43 aa, Entamoeba dispar
TPCGTFDYAPPEMLLHTPQYTQLCDIWSFGVTIFVSMCGYYPF

SEQ ID NO: 2541650 - protein, 24 aa, Entamoeba dispar
TPDEFIQMICQVVRFAIKECARIT

SEQ ID NO: 2541651 - protein, 24 aa, Entamoeba dispar
TPDIYTAVFFGWQNSPTTCVMAIT

SEQ ID NO: 2541652 - protein, 24 aa, Entamoeba dispar
TPDIYTAVFFGWQNSPTTCVMGIT

SEQ ID NO: 2541653 - protein, 23 aa, Entamoeba dispar
TPDQIIPFPRKLNGYIITIPQNY

SEQ ID NO: 2541654 - protein, 20 aa, Entamoeba dispar
TPEEKLALKKPYWSLVYRIA

SEQ ID NO: 2541655 - protein, 21 aa, Entamoeba dispar
TPEEKLALKKPYWSLVYRIAN

SEQ ID NO: 2541656 - protein, 23 aa, Entamoeba dispar
TPEEQIYIHYLNKANWASFPISV

SEQ ID NO: 2541657 - protein, 22 aa, Entamoeba dispar
TPEIFPYLLVNVGSGVSILKVI

SEQ ID NO: 2541658 - protein, 24 aa, Entamoeba dispar
TPEKNIVLIIQYIDKLPLYNKALL

SEQ ID NO: 2541659 - protein, 43 aa, Entamoeba dispar
TPEKNIVLIIQYIDKLPLYNKALLNRLMKLCYRISLNHDDTQM

SEQ ID NO: 2541660 - protein, 23 aa, Entamoeba dispar
TPELKLRIALNKSGILELVDAFL

SEQ ID NO: 2541661 - protein, 27 aa, Entamoeba dispar
TPERLNLFFIDFYRSQAIQQLLVAVSS

SEQ ID NO: 2541662 - protein, 21 aa, Entamoeba dispar
TPEYLAPEILLGNGYGFAVDW

SEQ ID NO: 2541663 - protein, 17 aa, Entamoeba dispar
TPFILKLYELVNNPESQ

SEQ ID NO: 2541664 - protein, 22 aa, Entamoeba dispar
TPGFRILLGHYFKHTTQLYLIK

SEQ ID NO: 2541665 - protein, 20 aa, Entamoeba dispar
TPGMTLFPGAFQQPLPLNEC

SEQ ID NO: 2541666 - protein, 18 aa, Entamoeba dispar
TPHLLLTKNVLNYCQSSP

SEQ ID NO: 2541667 - protein, 21 aa, Entamoeba dispar
TPILTIPLQRTVVSLVASMGD

SEQ ID NO: 2541668 - protein, 20 aa, Entamoeba dispar
TPIPRHKNFRLFANMNPPTD

SEQ ID NO: 2541669 - protein, 28 aa, Entamoeba dispar
TPITNVEQYPFYPLTMEFSPIPSHERPI

SEQ ID NO: 2541670 - protein, 25 aa, Entamoeba dispar
TPIVAKALHLISRLLSKLSGKLANS

SEQ ID NO: 2541671 - protein, 33 aa, Entamoeba dispar
TPIVSSYIDLLIILFVQWKFGSDQWKLLKDDLS

SEQ ID NO: 2541672 - protein, 25 aa, Entamoeba dispar
TPKGHPISVISSPLSLPSTPIVDKG

SEQ ID NO: 2541673 - protein, 20 aa, Entamoeba dispar
TPKGLYISRKKLVNTSPKDS

SEQ ID NO: 2541674 - protein, 21 aa, Entamoeba dispar
TPKIHPIYSYKTNLSYHTSVQ

SEQ ID NO: 2541675 - protein, 20 aa, Entamoeba dispar
TPKKIQPYVPVKINSFIPKT

SEQ ID NO: 2541676 - protein, 17 aa, Entamoeba dispar
TPKKLRTGFSCSTSIFG

SEQ ID NO: 2541677 - protein, 17 aa, Entamoeba dispar
TPKLLRFFPHIQTLSCS

SEQ ID NO: 2541678 - protein, 25 aa, Entamoeba dispar
TPKLSFEQLLILVPLFHDSLGDSEN

SEQ ID NO: 2541679 - protein, 29 aa, Entamoeba dispar
TPKTTELLYRFICKLINRPYVRFNNEIYN

SEQ ID NO: 2541680 - protein, 19 aa, Entamoeba dispar
TPKVLLYFELIIQSWDCLI

SEQ ID NO: 2541681 - protein, 21 aa, Entamoeba dispar
TPLLFEKLVLRHILLDRGMIG

SEQ ID NO: 2541682 - protein, 33 aa, Entamoeba dispar
TPLMYAARFHRNDFLIYLLKKGTNLKTINPNGN

SEQ ID NO: 2541683 - protein, 18 aa, Entamoeba dispar
TPLSLFYAHYMKDPTLPE

SEQ ID NO: 2541684 - protein, 26 aa, Entamoeba dispar
TPLVKPNFNVLPLQQTKQLPLNSSTQ

SEQ ID NO: 2541685 - protein, 17 aa, Entamoeba dispar
TPMRVGTLLLKKEVPLD

SEQ ID NO: 2541686 - protein, 23 aa, Entamoeba dispar
TPMTLIKISLMKEPIRKLYLLHT

SEQ ID NO: 2541687 - protein, 21 aa, Entamoeba dispar
TPNCEELLSMLWRITSKSDDV

SEQ ID NO: 2541688 - protein, 34 aa, Entamoeba dispar
TPNFTKLTIYLRKLFYLYALKYPFDSVDIVHGML

SEQ ID NO: 2541689 - protein, 21 aa, Entamoeba dispar
TPNILAYLNILSKVADIVKPM

SEQ ID NO: 2541690 - protein, 26 aa, Entamoeba dispar
TPNILSFIGAKYLIEKLGLHTIDTCD

SEQ ID NO: 2541691 - protein, 21 aa, Entamoeba dispar
TPNKIFSFQWKKEDRLVLLNI

SEQ ID NO: 2541692 - protein, 24 aa, Entamoeba dispar
TPNPSWASVPYGIFICIQCSGKHR

SEQ ID NO: 2541693 - protein, 24 aa, Entamoeba dispar
TPNRDLAAFILFRVVNLTLQNEVM

SEQ ID NO: 2541694 - protein, 35 aa, Entamoeba dispar
TPPDNYLIRPIQRPPRYKLLLGAVRDSLPSWWNKE

SEQ ID NO: 2541695 - protein, 18 aa, Entamoeba dispar
TPPGYRCVFSQSGKLFTC

SEQ ID NO: 2541696 - protein, 23 aa, Entamoeba dispar
TPPIPKHLFLSTCLHKFKFSQQR

SEQ ID NO: 2541697 - protein, 20 aa, Entamoeba dispar
TPPMIIYNIVARDSQLRKST

SEQ ID NO: 2541698 - protein, 17 aa, Entamoeba dispar
TPQCIAAWKKESLLSLI

SEQ ID NO: 2541699 - protein, 23 aa, Entamoeba dispar
TPQKDVQPLLLFGDLEDEQQSQQ

SEQ ID NO: 2541700 - protein, 25 aa, Entamoeba dispar
TPQPPFHFYNLFSLYWSIIKVNVLS

SEQ ID NO: 2541701 - protein, 26 aa, Entamoeba dispar
TPQSSLMYLAIIYASFEFEKIYQRLP

SEQ ID NO: 2541702 - protein, 17 aa, Entamoeba dispar
TPQVILMASGTEVDIAI

SEQ ID NO: 2541703 - protein, 28 aa, Entamoeba dispar
TPREHVLCICILYGLINRLVKYSSIHMM

SEQ ID NO: 2541704 - protein, 23 aa, Entamoeba dispar
TPRELYDYYLYWNKKDEQIEKLE

SEQ ID NO: 2541705 - protein, 28 aa, Entamoeba dispar
TPSIIKNDICEIQKLLGYFANNFVTRSE

SEQ ID NO: 2541706 - protein, 23 aa, Entamoeba dispar
TPSLAILWLSLLSEPFFSTDFIS

SEQ ID NO: 2541707 - protein, 27 aa, Entamoeba dispar
TPSLLFKYNVNFIFGNNPYLRNNPYLR

SEQ ID NO: 2541708 - protein, 26 aa, Entamoeba dispar
TPSQILYPYYESELLPPGLTFGYYKN

SEQ ID NO: 2541709 - protein, 18 aa, Entamoeba dispar
TPSYRPPEIWFGAIIYGP

SEQ ID NO: 2541710 - protein, 26 aa, Entamoeba dispar
TPTDIVNYTLLFKQPLQMIDVRSNEQ

SEQ ID NO: 2541711 - protein, 22 aa, Entamoeba dispar
TPTHYFLNYLNKLGYISMLFTQ

SEQ ID NO: 2541712 - protein, 21 aa, Entamoeba dispar
TPTLIESIIVFLRNEKWSSQF

SEQ ID NO: 2541713 - protein, 26 aa, Entamoeba dispar
TPTPIQCASIPIALKMRDLIALAETG

SEQ ID NO: 2541714 - protein, 24 aa, Entamoeba dispar
TPTPIVCPYIIKNEILHFVVYSKN

SEQ ID NO: 2541715 - protein, 20 aa, Entamoeba dispar
TPTTFIVKLFELVNDEKSKD

SEQ ID NO: 2541716 - protein, 29 aa, Entamoeba dispar
TPTYEIKPIPQKKLPPLPPPKPNTNSTNP

SEQ ID NO: 2541717 - protein, 20 aa, Entamoeba dispar
TPVDVLVFDEIPDALNCTAE

SEQ ID NO: 2541718 - protein, 26 aa, Entamoeba dispar
TPVSNYPFNVSLLQYIYFSKNKIPCH

SEQ ID NO: 2541719 - protein, 24 aa, Entamoeba dispar
TPYAQLTPNCILPHLFLGSVESTT

SEQ ID NO: 2541720 - protein, 21 aa, Entamoeba dispar
TPYEMSILHLLIQSSSLSEES

SEQ ID NO: 2541721 - protein, 29 aa, Entamoeba dispar
TPYFLEKKQIWIERLITSIFKTSSSMCHF

SEQ ID NO: 2541722 - protein, 22 aa, Entamoeba dispar
TPYRIKIKLQPWKEDNPVVKNS

SEQ ID NO: 2541723 - protein, 24 aa, Entamoeba dispar
TPYVYDLLSKLLVYDHQKRLSAKE

SEQ ID NO: 2541724 - protein, 17 aa, Entamoeba dispar
TQAKPDDFFVFSLNNNH

SEQ ID NO: 2541725 - protein, 17 aa, Entamoeba dispar
TQAVRRSVALRIKEETE

SEQ ID NO: 2541726 - protein, 23 aa, Entamoeba dispar
TQDDTVFDLSPESKPFLGMAAAI

SEQ ID NO: 2541727 - protein, 27 aa, Entamoeba dispar
TQDHRYFYESLFQGLIYTLLKHISVPS

SEQ ID NO: 2541728 - protein, 17 aa, Entamoeba dispar
TQDILLTIPIMNVLTKI

SEQ ID NO: 2541729 - protein, 34 aa, Entamoeba dispar
TQDRRIWPGLIDVALRYLLLFAGYSNENSKKIPS

SEQ ID NO: 2541730 - protein, 28 aa, Entamoeba dispar
TQDSTEVFFKIKKNTPLKKLMEAFCNKQ

SEQ ID NO: 2541731 - protein, 22 aa, Entamoeba dispar
TQEERLIIIKFLIDVANHCKIL

SEQ ID NO: 2541732 - protein, 28 aa, Entamoeba dispar
TQELLSLDRQWIITFGSNIKNLLSMTDT

SEQ ID NO: 2541733 - protein, 24 aa, Entamoeba dispar
TQEYLTILIHTMAKDPTRLQTYLD

SEQ ID NO: 2541734 - protein, 27 aa, Entamoeba dispar
TQFDTFPPSFRQYKLLESFLEIMKTGK

SEQ ID NO: 2541735 - protein, 25 aa, Entamoeba dispar
TQFIPSFIHLLRGCGYLGSLAIICA

SEQ ID NO: 2541736 - protein, 25 aa, Entamoeba dispar
TQFKNSVILLIQLISYSPLMVVREC

SEQ ID NO: 2541737 - protein, 20 aa, Entamoeba dispar
TQFNSVYMWFLSIDTDRSGT

SEQ ID NO: 2541738 - protein, 31 aa, Entamoeba dispar
TQFQQSDPILIVYFLEQIPLVGKVYGTKVFE

SEQ ID NO: 2541739 - protein, 19 aa, Entamoeba dispar
TQFTLFSLKGSQGPLPIKF

SEQ ID NO: 2541740 - protein, 20 aa, Entamoeba dispar
TQFTYGILLSDSWNVLMIKN

SEQ ID NO: 2541741 - protein, 20 aa, Entamoeba dispar
TQFVRILSTINRELLKPGTS

SEQ ID NO: 2541742 - protein, 22 aa, Entamoeba dispar
TQHFTILELFTTIFNVLDKDYK

SEQ ID NO: 2541743 - protein, 18 aa, Entamoeba dispar
TQHKKLLMAYEEAIGFVI

SEQ ID NO: 2541744 - protein, 31 aa, Entamoeba dispar
TQHQTNWFRPLIIPLLKLRPYELLQHMIIIT

SEQ ID NO: 2541745 - protein, 17 aa, Entamoeba dispar
TQIAPNTITVLGIGPDT

SEQ ID NO: 2541746 - protein, 32 aa, Entamoeba dispar
TQIIPMEFDQFLDEIPFALTLPEPTQTIQSSE

SEQ ID NO: 2541747 - protein, 25 aa, Entamoeba dispar
TQIKQYKFLFKSMRTTKPQLAVGWI

SEQ ID NO: 2541748 - protein, 30 aa, Entamoeba dispar
TQIPNWQMIMQQWLNLFPAKSSYDEIVSLL

SEQ ID NO: 2541749 - protein, 25 aa, Entamoeba dispar
TQITRAMMLLMERCKVIIEGAGAVA

SEQ ID NO: 2541750 - protein, 27 aa, Entamoeba dispar
TQKEIRLPFCIKILEIFVEYLTDIEIV

SEQ ID NO: 2541751 - protein, 24 aa, Entamoeba dispar
TQKETIPINIPWTQPLINSKQQDI

SEQ ID NO: 2541752 - protein, 25 aa, Entamoeba dispar
TQKTNPWIEWGKILNLRCMENQKNE

SEQ ID NO: 2541753 - protein, 19 aa, Entamoeba dispar
TQKVYNPTIFSVPLPIEGS

SEQ ID NO: 2541754 - protein, 17 aa, Entamoeba dispar
TQLEICVQLILQYTPGL

SEQ ID NO: 2541755 - protein, 36 aa, Entamoeba dispar
TQLHQQYIIFSKKLALLRNLLLPYDRISNKDPLILK

SEQ ID NO: 2541756 - protein, 26 aa, Entamoeba dispar
TQLKELFFVLFVKRKKYYLNKIDLPS

SEQ ID NO: 2541757 - protein, 35 aa, Entamoeba dispar
TQLQSFVIADILPLKLCVYLFSSISRLIALYETLG

SEQ ID NO: 2541758 - protein, 22 aa, Entamoeba dispar
TQLRIFYREFNVIPINWNSDTI

SEQ ID NO: 2541759 - protein, 19 aa, Entamoeba dispar
TQLTFLRMFHYKKSCIHLP

SEQ ID NO: 2541760 - protein, 21 aa, Entamoeba dispar
TQLTHYVIFKKTAFARLVNAL

SEQ ID NO: 2541761 - protein, 22 aa, Entamoeba dispar
TQLVKIIDYIYRKGLDTPCMLL

SEQ ID NO: 2541762 - protein, 30 aa, Entamoeba dispar
TQLYRHANAKKLFIPFFQRTKTNGDKYVGA

SEQ ID NO: 2541763 - protein, 25 aa, Entamoeba dispar
TQMKEKLLRLNKLCGASVVGEGGEF

SEQ ID NO: 2541764 - protein, 18 aa, Entamoeba dispar
TQMVSGIFKSLYEPTIED

SEQ ID NO: 2541765 - protein, 24 aa, Entamoeba dispar
TQNKFQLEFVLKGLYLNANPVTAI

SEQ ID NO: 2541766 - protein, 19 aa, Entamoeba dispar
TQNKLLPLINKLNWNGIYN

SEQ ID NO: 2541767 - protein, 23 aa, Entamoeba dispar
TQNLIPLLNSCLFSKRSISEYTN

SEQ ID NO: 2541768 - protein, 34 aa, Entamoeba dispar
TQNLLAIANKENLLRFVFPLSRITLLPCNSKKDS

SEQ ID NO: 2541769 - protein, 26 aa, Entamoeba dispar
TQNRLKLYHVVPPNGLIIYCGSVYTE

SEQ ID NO: 2541770 - protein, 25 aa, Entamoeba dispar
TQNVCSFAFPLIKSTHSVFITSFPV

SEQ ID NO: 2541771 - protein, 17 aa, Entamoeba dispar
TQPPGDILFFLTGQEEI

SEQ ID NO: 2541772 - protein, 30 aa, Entamoeba dispar
TQPSKIIYQTLLINYLAVAIKFAINGNNNK

SEQ ID NO: 2541773 - protein, 32 aa, Entamoeba dispar
TQPTFNQELPYFYHTLLIDNLLKDVETYLKDK

SEQ ID NO: 2541774 - protein, 27 aa, Entamoeba dispar
TQPVYNAIYMKYILQVLKCVCPICKRI

SEQ ID NO: 2541775 - protein, 17 aa, Entamoeba dispar
TQQIGSTFFPLDSIEKM

SEQ ID NO: 2541776 - protein, 20 aa, Entamoeba dispar
TQQPSICLFFFILFKSFFLL

SEQ ID NO: 2541777 - protein, 18 aa, Entamoeba dispar
TQQVLRRAIEKQKIMGDS

SEQ ID NO: 2541778 - protein, 23 aa, Entamoeba dispar
TQRIDLINKIKIHFNKVYLWESD

SEQ ID NO: 2541779 - protein, 23 aa, Entamoeba dispar
TQRNLLFEPTIPEIFTFMLTDVN

SEQ ID NO: 2541780 - protein, 25 aa, Entamoeba dispar
TQSGPFENKYYTPQKREFVSFEKPT

SEQ ID NO: 2541781 - protein, 25 aa, Entamoeba dispar
TQSKKLETVLKPKLTQPTKAGCYAV

SEQ ID NO: 2541782 - protein, 26 aa, Entamoeba dispar
TQSQQLPIKVIPPKVSPQHNSINNDS

SEQ ID NO: 2541783 - protein, 17 aa, Entamoeba dispar
TQSVIFCNMKKKVDWLT

SEQ ID NO: 2541784 - protein, 23 aa, Entamoeba dispar
TQSYKIQTLILNSIKSYICQLIQ

SEQ ID NO: 2541785 - protein, 26 aa, Entamoeba dispar
TQTATSNFWKWLRKDWIESHGGLQTV

SEQ ID NO: 2541786 - protein, 19 aa, Entamoeba dispar
TQTCNMLYHFIPMEQSDIT

SEQ ID NO: 2541787 - protein, 27 aa, Entamoeba dispar
TQTDSPLQWLYFAQQEKLPFELPMCES

SEQ ID NO: 2541788 - protein, 23 aa, Entamoeba dispar
TQTKALNILFALSSEPEVIKKII

SEQ ID NO: 2541789 - protein, 32 aa, Entamoeba dispar
TQTKTKLEGIFGNKPIMGGPTPIRPKPVEQKI

SEQ ID NO: 2541790 - protein, 26 aa, Entamoeba dispar
TQVADLSFVSLLQTIGKMKKKHTKVS

SEQ ID NO: 2541791 - protein, 19 aa, Entamoeba dispar
TQVMPYTLGFGLVENKYDV

SEQ ID NO: 2541792 - protein, 32 aa, Entamoeba dispar
TQYKCYLHTGPATAIDFFYDCKMNGAISATDF

SEQ ID NO: 2541793 - protein, 20 aa, Entamoeba dispar
TQYLTDVNPLLLKDNTDKLK

SEQ ID NO: 2541794 - protein, 26 aa, Entamoeba dispar
TQYQYDRSIFYPTTLTFLSCDFNEYH

SEQ ID NO: 2541795 - protein, 19 aa, Entamoeba dispar
TRATTLFCATIFREFKNPD

SEQ ID NO: 2541796 - protein, 27 aa, Entamoeba dispar
TRCKIERLPIILPLIQEDVLSMQIDDA

SEQ ID NO: 2541797 - protein, 22 aa, Entamoeba dispar
TRCSYFYQYFSLEKQPMIELNK

SEQ ID NO: 2541798 - protein, 30 aa, Entamoeba dispar
TRDEIDNMYKYYLYYFYKAGNMSINEDEKE

SEQ ID NO: 2541799 - protein, 18 aa, Entamoeba dispar
TRDKKIFRKTVTIGYMPI

SEQ ID NO: 2541800 - protein, 23 aa, Entamoeba dispar
TRDKVFKLMASSHIVNDMQKEVN

SEQ ID NO: 2541801 - protein, 19 aa, Entamoeba dispar
TRDLPRVIENIHMCLMKNG

SEQ ID NO: 2541802 - protein, 27 aa, Entamoeba dispar
TREAGIYLFIIFYKEGKLFRTVFNQDC

SEQ ID NO: 2541803 - protein, 30 aa, Entamoeba dispar
TREIDFNDYLLPIFPLSSIQKGKLLHGYKI

SEQ ID NO: 2541804 - protein, 17 aa, Entamoeba dispar
TRFLTWNERVQIVTYED

SEQ ID NO: 2541805 - protein, 28 aa, Entamoeba dispar
TRFMKVTRDGVVPISFCVPRKSEIFQDD

SEQ ID NO: 2541806 - protein, 18 aa, Entamoeba dispar
TRFTVTRTVFRDGTSKFM

SEQ ID NO: 2541807 - protein, 19 aa, Entamoeba dispar
TRGLEKKQRFTRVSELNSS

SEQ ID NO: 2541808 - protein, 26 aa, Entamoeba dispar
TRIESVIEIFLKYQIFILSNEQKIEI

SEQ ID NO: 2541809 - protein, 35 aa, Entamoeba dispar
TRILANRYPYFLVRNKYIPLFLQNYLLKTNREEGK

SEQ ID NO: 2541810 - protein, 27 aa, Entamoeba dispar
TRITSILILINRYFIQELPFNKPQEDF

SEQ ID NO: 2541811 - protein, 20 aa, Entamoeba dispar
TRKCFQKLESASRKSKVLPE

SEQ ID NO: 2541812 - protein, 20 aa, Entamoeba dispar
TRKEIYFTCEKNKYHRMCGR

SEQ ID NO: 2541813 - protein, 33 aa, Entamoeba dispar
TRKFREEFGDYNIAKCRIITFKGKSESRGFGYL

SEQ ID NO: 2541814 - protein, 23 aa, Entamoeba dispar
TRKPIYGIGWFRTHQNQSKVVIG

SEQ ID NO: 2541815 - protein, 28 aa, Entamoeba dispar
TRKQSLCVISCLLFGLYSIKLRKDERKF

SEQ ID NO: 2541816 - protein, 17 aa, Entamoeba dispar
TRKRPFADWGDIDIGKA

SEQ ID NO: 2541817 - protein, 18 aa, Entamoeba dispar
TRKSSPFNYLKISRTPIR

SEQ ID NO: 2541818 - protein, 31 aa, Entamoeba dispar
TRLEENYFSEYLLLKEIILPSTITSIGNSCF

SEQ ID NO: 2541819 - protein, 25 aa, Entamoeba dispar
TRLFPNIQIQFLYSDKDKLLPDIHY

SEQ ID NO: 2541820 - protein, 18 aa, Entamoeba dispar
TRLIKLFNNYIFCNTTQS

SEQ ID NO: 2541821 - protein, 27 aa, Entamoeba dispar
TRLNPVEIPFFIPINQHSDTIFKPLKA

SEQ ID NO: 2541822 - protein, 18 aa, Entamoeba dispar
TRLTLIRKNYRDTSLKLE

SEQ ID NO: 2541823 - protein, 17 aa, Entamoeba dispar
TRLTPLKLIVVGDSSVG

SEQ ID NO: 2541824 - protein, 26 aa, Entamoeba dispar
TRNYMACQQAILIGLLNEEFKVIIQK

SEQ ID NO: 2541825 - protein, 17 aa, Entamoeba dispar
TRRFLTVVKKSFPEETS

SEQ ID NO: 2541826 - protein, 26 aa, Entamoeba dispar
TRSEDEIVMLLTWARSLPSINVGKVI

SEQ ID NO: 2541827 - protein, 26 aa, Entamoeba dispar
TRSEEEIIKLIKWARGLPSIDKEEIN

SEQ ID NO: 2541828 - protein, 34 aa, Entamoeba dispar
TRSEIVTCSILERVLASLLHITSYVKKIESKGLV

SEQ ID NO: 2541829 - protein, 17 aa, Entamoeba dispar
TRSLDEITPIEKKPRQP

SEQ ID NO: 2541830 - protein, 27 aa, Entamoeba dispar
TRSTEQYLLKYLPLYTSLAASGTGKYP

SEQ ID NO: 2541831 - protein, 19 aa, Entamoeba dispar
TRTFNEYVLYQPNIIIILI

SEQ ID NO: 2541832 - protein, 28 aa, Entamoeba dispar
TRTTKMEYIYYRILLIIDDRLTVKDLIS

SEQ ID NO: 2541833 - protein, 24 aa, Entamoeba dispar
TRVKQVFMLLKSLPEENYTLLHKI

SEQ ID NO: 2541834 - protein, 17 aa, Entamoeba dispar
TRVLLVNELPRYLTPQS

SEQ ID NO: 2541835 - protein, 18 aa, Entamoeba dispar
TRVVLFEGLSLTINQTIN

SEQ ID NO: 2541836 - protein, 32 aa, Entamoeba dispar
TRVYEPAPPRRLLIRIFGEGDAAWVVLVKCEK

SEQ ID NO: 2541837 - protein, 22 aa, Entamoeba dispar
TRWFGCYDCWIQATPNGTSTIY

SEQ ID NO: 2541838 - protein, 25 aa, Entamoeba dispar
TRYIRVCTIAIPVVSQLHQCLPIDF

SEQ ID NO: 2541839 - protein, 25 aa, Entamoeba dispar
TRYKRNMIFIITDNQLLDILRDFFG

SEQ ID NO: 2541840 - protein, 26 aa, Entamoeba dispar
TSAKERINILESFQALVRDIKKWTTV

SEQ ID NO: 2541841 - protein, 19 aa, Entamoeba dispar
TSALWLMSNLETEKLIDID

SEQ ID NO: 2541842 - protein, 21 aa, Entamoeba dispar
TSALWREKILAAKTIMWNGPC

SEQ ID NO: 2541843 - protein, 25 aa, Entamoeba dispar
TSDASFIMALLQFPGINVNAKNRDE

SEQ ID NO: 2541844 - protein, 26 aa, Entamoeba dispar
TSDFPLHTFMRKWLKSLYEINVENDM

SEQ ID NO: 2541845 - protein, 22 aa, Entamoeba dispar
TSDFRSVLFNGGKSLKEGEKKE

SEQ ID NO: 2541846 - protein, 22 aa, Entamoeba dispar
TSDKCHVHITYLCSINGGYAIV

SEQ ID NO: 2541847 - protein, 25 aa, Entamoeba dispar
TSDLKEIYRLFGELPKDITGLCALQ

SEQ ID NO: 2541848 - protein, 24 aa, Entamoeba dispar
TSDNKFILPTTLKKLLIKSCYNII

SEQ ID NO: 2541849 - protein, 24 aa, Entamoeba dispar
TSDSFYRQLTSFGIHPWYCGDENL

SEQ ID NO: 2541850 - protein, 26 aa, Entamoeba dispar
TSEATFTWVLPRILDKTQFTFVSQKL

SEQ ID NO: 2541851 - protein, 39 aa, Entamoeba dispar
TSEEVMFLTVLRLDSLNLFSKFPYIELLALPDDIEMKDN

SEQ ID NO: 2541852 - protein, 22 aa, Entamoeba dispar
TSELLVLFEAIQYCQRTNQDDW

SEQ ID NO: 2541853 - protein, 19 aa, Entamoeba dispar
TSEMWFRNRYEALVQHYCE

SEQ ID NO: 2541854 - protein, 23 aa, Entamoeba dispar
TSEPSLWINPQFIQGLDAKKEIG

SEQ ID NO: 2541855 - protein, 23 aa, Entamoeba dispar
TSESQYLMKYICSLYNVGVERGI

SEQ ID NO: 2541856 - protein, 24 aa, Entamoeba dispar
TSFHQTVWFEYALVKENYGYWNET

SEQ ID NO: 2541857 - protein, 33 aa, Entamoeba dispar
TSFLKKTFIVNCELFIFEIKMSGITTLEQLKNK

SEQ ID NO: 2541858 - protein, 21 aa, Entamoeba dispar
TSFNLLSRYPKYLTFEAKAQV

SEQ ID NO: 2541859 - protein, 17 aa, Entamoeba dispar
TSFQFEMPPFCGGTTRT

SEQ ID NO: 2541860 - protein, 21 aa, Entamoeba dispar
TSFRLLFKMIKIVEYIHSKQI

SEQ ID NO: 2541861 - protein, 29 aa, Entamoeba dispar
TSGKLVEQWYQLLIKYWSGYSTITPREFK

SEQ ID NO: 2541862 - protein, 18 aa, Entamoeba dispar
TSGKSHIFIGLRSKADKD

SEQ ID NO: 2541863 - protein, 18 aa, Entamoeba dispar
TSGNDISLFILSEHTCVA

SEQ ID NO: 2541864 - protein, 17 aa, Entamoeba dispar
TSGPLSDILWADPLDEP

SEQ ID NO: 2541865 - protein, 27 aa, Entamoeba dispar
TSGYSFEEFFKLFSLLMSMTYSSSSEP

SEQ ID NO: 2541866 - protein, 20 aa, Entamoeba dispar
TSHLYLQPKYFGYDGPIEYL

SEQ ID NO: 2541867 - protein, 24 aa, Entamoeba dispar
TSHQHILLSKLFLKCNEWFGLCEV

SEQ ID NO: 2541868 - protein, 24 aa, Entamoeba dispar
TSHSPYFLGIIDIVKQIFKENNVD

SEQ ID NO: 2541869 - protein, 19 aa, Entamoeba dispar
TSHWKFKPNLRFIKELFMN

SEQ ID NO: 2541870 - protein, 25 aa, Entamoeba dispar
TSIGFFPVLFISQTMRFEGCEWGYL

SEQ ID NO: 2541871 - protein, 27 aa, Entamoeba dispar
TSIGNRWFYGCLSLQSIYIPISVNKIR

SEQ ID NO: 2541872 - protein, 17 aa, Entamoeba dispar
TSIIIPTPISKIGYKCF

SEQ ID NO: 2541873 - protein, 27 aa, Entamoeba dispar
TSINIPSSVIFIGKAAFSHCTSLTSIE

SEQ ID NO: 2541874 - protein, 18 aa, Entamoeba dispar
TSINLPPTITKLGEWCFY

SEQ ID NO: 2541875 - protein, 21 aa, Entamoeba dispar
TSIQFDVVCTCYFIDTAFDII

SEQ ID NO: 2541876 - protein, 25 aa, Entamoeba dispar
TSISKLRKWCFSGCKLLTSIELPTT

SEQ ID NO: 2541877 - protein, 29 aa, Entamoeba dispar
TSKEFMTCVFIFVKALLFISDNQLTEELY

SEQ ID NO: 2541878 - protein, 27 aa, Entamoeba dispar
TSKFFERMYCLFYPLDEKARCVLEEVV

SEQ ID NO: 2541879 - protein, 30 aa, Entamoeba dispar
TSKGKLIISRKLGVSINLGKPKFSAKEAKL

SEQ ID NO: 2541880 - protein, 27 aa, Entamoeba dispar
TSKIESYWGYFPLKEEFGSPQLFDISG

SEQ ID NO: 2541881 - protein, 18 aa, Entamoeba dispar
TSKMLLEYGLLDKILDKS

SEQ ID NO: 2541882 - protein, 17 aa, Entamoeba dispar
TSLDWHCNGGVLITASD

SEQ ID NO: 2541883 - protein, 20 aa, Entamoeba dispar
TSLEVFLTKLKTVFGEFVNN

SEQ ID NO: 2541884 - protein, 17 aa, Entamoeba dispar
TSLFPQISQRLINEVIH

SEQ ID NO: 2541885 - protein, 24 aa, Entamoeba dispar
TSLFVALPPDQFNPYILPSLEFAS

SEQ ID NO: 2541886 - protein, 23 aa, Entamoeba dispar
TSLISISIPTSISKLPFGCFYEC

SEQ ID NO: 2541887 - protein, 18 aa, Entamoeba dispar
TSLKFLQLIIYKTLPKCS

SEQ ID NO: 2541888 - protein, 22 aa, Entamoeba dispar
TSLLPLFDRFHKVSQTNSILIG

SEQ ID NO: 2541889 - protein, 30 aa, Entamoeba dispar
TSLNGFVYFDFIPIKMEPIFDLLSRHWQNP

SEQ ID NO: 2541890 - protein, 23 aa, Entamoeba dispar
TSLPDSILLKIFSYLRIDSIRNV

SEQ ID NO: 2541891 - protein, 18 aa, Entamoeba dispar
TSLPFPPTSIKFIPKSSP

SEQ ID NO: 2541892 - protein, 32 aa, Entamoeba dispar
TSLPSLFCRYKLLPFYIDLFRSNMPEASCAVE

SEQ ID NO: 2541893 - protein, 19 aa, Entamoeba dispar
TSLPVLNNVKFRALEKEDY

SEQ ID NO: 2541894 - protein, 24 aa, Entamoeba dispar
TSLRLQTITKMKYYLKKQISEKEM

SEQ ID NO: 2541895 - protein, 22 aa, Entamoeba dispar
TSLSKMACWLTSLNYKVMIAAC

SEQ ID NO: 2541896 - protein, 21 aa, Entamoeba dispar
TSLTLINIPSSITLFGRGCFY

SEQ ID NO: 2541897 - protein, 35 aa, Entamoeba dispar
TSMIGKMFLIEYSPILFKLVFRADLIVEYITIFNG

SEQ ID NO: 2541898 - protein, 22 aa, Entamoeba dispar
TSMLPTLFVVALPRSGSTFTHT

SEQ ID NO: 2541899 - protein, 25 aa, Entamoeba dispar
TSMRTILFSNYLPTQTRQLQVTIDV

SEQ ID NO: 2541900 - protein, 24 aa, Entamoeba dispar
TSNDLFDVLLKSPSSKSPAHAPET

SEQ ID NO: 2541901 - protein, 25 aa, Entamoeba dispar
TSNNQLLYDLFPWTAEQEAAKTGQK

SEQ ID NO: 2541902 - protein, 30 aa, Entamoeba dispar
TSNQHSKFTFIWVKDLFTYLDKKPFSEEDD

SEQ ID NO: 2541903 - protein, 22 aa, Entamoeba dispar
TSNYFGLLMEYGDKIIQMGKAY

SEQ ID NO: 2541904 - protein, 27 aa, Entamoeba dispar
TSPEFFEFFSFIDNLLMNEAVALNIVY

SEQ ID NO: 2541905 - protein, 25 aa, Entamoeba dispar
TSPINKQYFSGWKSKGLSLFVSKVD

SEQ ID NO: 2541906 - protein, 26 aa, Entamoeba dispar
TSPKGILAYQFPPPISAIKLTPYITP

SEQ ID NO: 2541907 - protein, 22 aa, Entamoeba dispar
TSPLPTPLPTFQYTQNPMATQP

SEQ ID NO: 2541908 - protein, 17 aa, Entamoeba dispar
TSPRTQLFAPRVSKVVF

SEQ ID NO: 2541909 - protein, 21 aa, Entamoeba dispar
TSPYVRKAAALAIPKIYSLDE

SEQ ID NO: 2541910 - protein, 17 aa, Entamoeba dispar
TSQGYVKLFAKNEEKPL

SEQ ID NO: 2541911 - protein, 26 aa, Entamoeba dispar
TSQKDLLKIIFALKDELKKVKEELPL

SEQ ID NO: 2541912 - protein, 24 aa, Entamoeba dispar
TSQKIPYSLIWLIRCISSKVHDEK

SEQ ID NO: 2541913 - protein, 29 aa, Entamoeba dispar
TSQLTSLAMIILDPYYRTIEGLLTLIEKE

SEQ ID NO: 2541914 - protein, 24 aa, Entamoeba dispar
TSQQLINFIVSALPQRTSVDFKVS

SEQ ID NO: 2541915 - protein, 28 aa, Entamoeba dispar
TSQYPTYPSFSPYIPQVVQFTPTSQQPQ

SEQ ID NO: 2541916 - protein, 19 aa, Entamoeba dispar
TSRFQLLLDKSVFTDWQKV

SEQ ID NO: 2541917 - protein, 21 aa, Entamoeba dispar
TSRIKWCQIPSHSRPSWEDYC

SEQ ID NO: 2541918 - protein, 22 aa, Entamoeba dispar
TSRWVVIYPAYIDGELTIAQGR

SEQ ID NO: 2541919 - protein, 29 aa, Entamoeba dispar
TSSDSVRSLLTLKWLFLHNLVNTDCFSHT

SEQ ID NO: 2541920 - protein, 27 aa, Entamoeba dispar
TSSENGIISMLTWVRSLTPINVEEVKK

SEQ ID NO: 2541921 - protein, 25 aa, Entamoeba dispar
TSSFVSHFISIYTSSLLFRNDDTKQ

SEQ ID NO: 2541922 - protein, 27 aa, Entamoeba dispar
TSSIKKRIFILLRLLVLSKIDEDTKIT

SEQ ID NO: 2541923 - protein, 19 aa, Entamoeba dispar
TSSLLKQSLVEKILMTFNV

SEQ ID NO: 2541924 - protein, 29 aa, Entamoeba dispar
TSSLSYYDFKLLFLDHYTLSLPDSLLFSN

SEQ ID NO: 2541925 - protein, 36 aa, Entamoeba dispar
TSSSPSIVVPPPPPTLSMPPPPPTLNITSSPTNTMK

SEQ ID NO: 2541926 - protein, 22 aa, Entamoeba dispar
TSSTPLPPRHLGNEHIVNVATT

SEQ ID NO: 2541927 - protein, 23 aa, Entamoeba dispar
TSSVVKMYYAFQDTHNLFLVMEY

SEQ ID NO: 2541928 - protein, 21 aa, Entamoeba dispar
TSTFFNPPRNNNLPPQQPIQE

SEQ ID NO: 2541929 - protein, 19 aa, Entamoeba dispar
TSTILQFIGGRFIETYQPS

SEQ ID NO: 2541930 - protein, 26 aa, Entamoeba dispar
TSTKKNEWFELKLTGQLKKVKMEECI

SEQ ID NO: 2541931 - protein, 26 aa, Entamoeba dispar
TSTRGLMIPFLKALERHRPSLLFSTP

SEQ ID NO: 2541932 - protein, 24 aa, Entamoeba dispar
TSTRIKGFISSPAQYIALMEQKKG

SEQ ID NO: 2541933 - protein, 28 aa, Entamoeba dispar
TSTTTKLYDLFKLWSNADPDKLGGTVIA

SEQ ID NO: 2541934 - protein, 22 aa, Entamoeba dispar
TSVDEYLFQLPANQVYAVDEHA

SEQ ID NO: 2541935 - protein, 18 aa, Entamoeba dispar
TSVKIFSLIIHRFRSYFK

SEQ ID NO: 2541936 - protein, 26 aa, Entamoeba dispar
TSWEEAWEIIQKGFTLRHTSATLSND

SEQ ID NO: 2541937 - protein, 21 aa, Entamoeba dispar
TSYGLKLFYLSNDIIEDLKSL

SEQ ID NO: 2541938 - protein, 22 aa, Entamoeba dispar
TSYQQIKPFKINTLPLIECIQN

SEQ ID NO: 2541939 - protein, 31 aa, Entamoeba dispar
TTCAISLFVFEGWLNTFIKFINNQRKKYHCE

SEQ ID NO: 2541940 - protein, 18 aa, Entamoeba dispar
TTDPCRFMGCGPSSSTSS

SEQ ID NO: 2541941 - protein, 31 aa, Entamoeba dispar
TTEFISFCDYLSDKLKWYVENQLTKAKEIRK

SEQ ID NO: 2541942 - protein, 23 aa, Entamoeba dispar
TTEKFLYNPIENLKLFPKIQTQY

SEQ ID NO: 2541943 - protein, 19 aa, Entamoeba dispar
TTEKLLGFALKDYIATIKQ

SEQ ID NO: 2541944 - protein, 24 aa, Entamoeba dispar
TTENETVIVPFLKSICLTPTVTDS

SEQ ID NO: 2541945 - protein, 25 aa, Entamoeba dispar
TTENIEFPMYFVDSKGLQGFDNTHS

SEQ ID NO: 2541946 - protein, 26 aa, Entamoeba dispar
TTENIEFPMYFVDSKGLQGFDNTHSE

SEQ ID NO: 2541947 - protein, 19 aa, Entamoeba dispar
TTENIEFPMYFVDSKKIDK

SEQ ID NO: 2541948 - protein, 25 aa, Entamoeba dispar
TTENIEFPMYFVDSRGLHGFDNTSS

SEQ ID NO: 2541949 - protein, 20 aa, Entamoeba dispar
TTEQPPFLRYEISSENPHKT

SEQ ID NO: 2541950 - protein, 21 aa, Entamoeba dispar
TTERGMAFPCGLSVNSCAAHF

SEQ ID NO: 2541951 - protein, 18 aa, Entamoeba dispar
TTERKWKIIITKRNKIEE

SEQ ID NO: 2541952 - protein, 39 aa, Entamoeba dispar
TTESTLVKIFAKCGKVLRVTIPIWRNTNKRRGFAIVEFA

SEQ ID NO: 2541953 - protein, 26 aa, Entamoeba dispar
TTETYQLMKKIIPNYKKLADACEGYF

SEQ ID NO: 2541954 - protein, 19 aa, Entamoeba dispar
TTFPQIFLHYFNTINKDIS

SEQ ID NO: 2541955 - protein, 25 aa, Entamoeba dispar
TTFRNLLFSINILSLLIPVGFCNEV

SEQ ID NO: 2541956 - protein, 18 aa, Entamoeba dispar
TTFSCCHFFNIQTKKYEC

SEQ ID NO: 2541957 - protein, 35 aa, Entamoeba dispar
TTFSEPFIMVVLKFIRLIYKSTPQFKSKYIEILGC

SEQ ID NO: 2541958 - protein, 46 aa, Entamoeba dispar
TTFSLYQGFINRLEFLTPNYYLNLFKSFEILYSIGNSYFVETLFVD

SEQ ID NO: 2541959 - protein, 21 aa, Entamoeba dispar
TTFSSVAYYDPVKGEPVVLQD

SEQ ID NO: 2541960 - protein, 22 aa, Entamoeba dispar
TTFVKFGVLTLYDPETKPKNRN

SEQ ID NO: 2541961 - protein, 23 aa, Entamoeba dispar
TTGDVILYFFKSMSQFINSTCSK

SEQ ID NO: 2541962 - protein, 23 aa, Entamoeba dispar
TTGHIVLSTLILKGYYHVCMDKF

SEQ ID NO: 2541963 - protein, 29 aa, Entamoeba dispar
TTGPRGYRPRRFGPRRFNRKHFGKKTNGS

SEQ ID NO: 2541964 - protein, 23 aa, Entamoeba dispar
TTGTMFLDLALTTYKLTHPDLPF

SEQ ID NO: 2541965 - protein, 26 aa, Entamoeba dispar
TTGTYFKNNKFHIYKSNDIQTSSSSN

SEQ ID NO: 2541966 - protein, 29 aa, Entamoeba dispar
TTHLRKFYFRLCEFLQYPSLPLSCINLNS

SEQ ID NO: 2541967 - protein, 22 aa, Entamoeba dispar
TTHVHILNYLSIANSLVPLEIQ

SEQ ID NO: 2541968 - protein, 20 aa, Entamoeba dispar
TTIDVILVNGFLKRGDRIVV

SEQ ID NO: 2541969 - protein, 26 aa, Entamoeba dispar
TTIESTDYFIFPFPLCLIVTKQLSVE

SEQ ID NO: 2541970 - protein, 29 aa, Entamoeba dispar
TTIIIPIVLKLLTDKVLIIKPALLATKND

SEQ ID NO: 2541971 - protein, 17 aa, Entamoeba dispar
TTINIPSSVSKLGDYCF

SEQ ID NO: 2541972 - protein, 22 aa, Entamoeba dispar
TTINQMQILREKQLLEESSRQN

SEQ ID NO: 2541973 - protein, 28 aa, Entamoeba dispar
TTIRKLTIILFLLIHTKSTKINKNNIKI

SEQ ID NO: 2541974 - protein, 33 aa, Entamoeba dispar
TTITKLVHEWFKEMKFLKTITIPFSIIEIGENC

SEQ ID NO: 2541975 - protein, 17 aa, Entamoeba dispar
TTIYYLCQQIRTVLLSS

SEQ ID NO: 2541976 - protein, 26 aa, Entamoeba dispar
TTKCHQSWFQKYLDKEQERLINKQHT

SEQ ID NO: 2541977 - protein, 18 aa, Entamoeba dispar
TTKFMILNSNRILEKVVI

SEQ ID NO: 2541978 - protein, 32 aa, Entamoeba dispar
TTKIRSIIARLIPRNLVFVSALEPNGIEWFKQ

SEQ ID NO: 2541979 - protein, 28 aa, Entamoeba dispar
TTKKAKKPLSAYILFTQAKREEIAATLK

SEQ ID NO: 2541980 - protein, 31 aa, Entamoeba dispar
TTKKISIIEEIKQKGFRLPQPGDNIDSPTII

SEQ ID NO: 2541981 - protein, 17 aa, Entamoeba dispar
TTKLFYSPNVPLRQLLF

SEQ ID NO: 2541982 - protein, 23 aa, Entamoeba dispar
TTKNHHILIYDSSNNQLLGTLKG

SEQ ID NO: 2541983 - protein, 24 aa, Entamoeba dispar
TTKQKFIFNTFTKTFDYLPIAAII

SEQ ID NO: 2541984 - protein, 24 aa, Entamoeba dispar
TTKSLFKIISPVPYEYGIINVPYE

SEQ ID NO: 2541985 - protein, 24 aa, Entamoeba dispar
TTKVIEDMLFYKRYYEYYRNPEIL

SEQ ID NO: 2541986 - protein, 24 aa, Entamoeba dispar
TTKYIFEQMLPIITPLMSDPFGNY

SEQ ID NO: 2541987 - protein, 23 aa, Entamoeba dispar
TTKYYTFVPHIISGSTIPMIDND

SEQ ID NO: 2541988 - protein, 19 aa, Entamoeba dispar
TTLCKLIKGYFEKSFIELD

SEQ ID NO: 2541989 - protein, 33 aa, Entamoeba dispar
TTLEESMLQPIQTTPFELKFGKNSNEESRRLRV

SEQ ID NO: 2541990 - protein, 25 aa, Entamoeba dispar
TTLELMMVKLNKLKWRLNANPTISK

SEQ ID NO: 2541991 - protein, 25 aa, Entamoeba dispar
TTLINWDAIIFNKIKEMLGGQLDVI

SEQ ID NO: 2541992 - protein, 19 aa, Entamoeba dispar
TTLLNSFVNALYGIKITDD

SEQ ID NO: 2541993 - protein, 17 aa, Entamoeba dispar
TTLLSPSFAFILSQELF

SEQ ID NO: 2541994 - protein, 20 aa, Entamoeba dispar
TTLLSYSSLPFLTESLARLL

SEQ ID NO: 2541995 - protein, 28 aa, Entamoeba dispar
TTLLTICVLLNWTFKPPVTRAFVSFLPK

SEQ ID NO: 2541996 - protein, 19 aa, Entamoeba dispar
TTLNLFNKLEQYYIKIRSN

SEQ ID NO: 2541997 - protein, 20 aa, Entamoeba dispar
TTLNLIHFFTAGHDEVKCWT

SEQ ID NO: 2541998 - protein, 33 aa, Entamoeba dispar
TTLSSLLKKFIRNLKSPIWPEEFLQPLVSCMDS

SEQ ID NO: 2541999 - protein, 24 aa, Entamoeba dispar
TTLTNLIKLYQLKNLRILDAKYLE

SEQ ID NO: 2542000 - protein, 21 aa, Entamoeba dispar
TTLVDFYSTDPGVLSFKKGEI

SEQ ID NO: 2542001 - protein, 25 aa, Entamoeba dispar
TTLVPKIVIVKPPNQFLIISNEILV

SEQ ID NO: 2542002 - protein, 17 aa, Entamoeba dispar
TTLYAPPEFYKRQPYNG

SEQ ID NO: 2542003 - protein, 26 aa, Entamoeba dispar
TTMFEEPFPIERKIANALAAVAIQMT

SEQ ID NO: 2542004 - protein, 25 aa, Entamoeba dispar
TTMSSLLIHLVFDILVLTYNERLVY

SEQ ID NO: 2542005 - protein, 28 aa, Entamoeba dispar
TTNIKLIEPFFEALFSLDDTEYWLKEQA

SEQ ID NO: 2542006 - protein, 22 aa, Entamoeba dispar
TTNKFLEFDFVKSTLPAKEYHY

SEQ ID NO: 2542007 - protein, 25 aa, Entamoeba dispar
TTNKSIFSFLPNDAPCNGFGHVLQR

SEQ ID NO: 2542008 - protein, 26 aa, Entamoeba dispar
TTNLIPAQYYNLYLVLQQCLSVLDMY

SEQ ID NO: 2542009 - protein, 27 aa, Entamoeba dispar
TTNLMCEMYCQLITGMFVFLEDEQNSS

SEQ ID NO: 2542010 - protein, 28 aa, Entamoeba dispar
TTNREEWLYYKKLYQKRLKDRELFKRRC

SEQ ID NO: 2542011 - protein, 26 aa, Entamoeba dispar
TTNSNIFFGIYCQKKIIKNSFGIDDP

SEQ ID NO: 2542012 - protein, 27 aa, Entamoeba dispar
TTNTLMPSLLIIFRVTQDRVGAKNCSS

SEQ ID NO: 2542013 - protein, 22 aa, Entamoeba dispar
TTPCLPFIGTYLTDYTFLDDGN

SEQ ID NO: 2542014 - protein, 24 aa, Entamoeba dispar
TTPDKFFLKLMERLDIPEDFEPEN

SEQ ID NO: 2542015 - protein, 26 aa, Entamoeba dispar
TTPKWSSVNLGIFICIRCAGIHRSMG

SEQ ID NO: 2542016 - protein, 23 aa, Entamoeba dispar
TTPRQTGFLRPTSPVITLGNKSV

SEQ ID NO: 2542017 - protein, 22 aa, Entamoeba dispar
TTPTSPHFQPPSPKQSKSPLSP

SEQ ID NO: 2542018 - protein, 18 aa, Entamoeba dispar
TTQILLKLYDQCCPHSKD

SEQ ID NO: 2542019 - protein, 43 aa, Entamoeba dispar
TTQKLLSLRSFPLTLTKLKAPKWFRDILDKTWAIDPTQRISMT

SEQ ID NO: 2542020 - protein, 26 aa, Entamoeba dispar
TTQLKRLHVFGEIFAENGYLVRSDAR

SEQ ID NO: 2542021 - protein, 18 aa, Entamoeba dispar
TTQQFNYYLGRLQDYFLQ

SEQ ID NO: 2542022 - protein, 17 aa, Entamoeba dispar
TTQQKIFSKILTPKTIS

SEQ ID NO: 2542023 - protein, 34 aa, Entamoeba dispar
TTRRIGLRYVLMKQWFLVIYLFSLFGENILNEFF

SEQ ID NO: 2542024 - protein, 28 aa, Entamoeba dispar
TTRSLVLSKYPLYPIHSYIPHNTIYGRP

SEQ ID NO: 2542025 - protein, 27 aa, Entamoeba dispar
TTSFLEANGFREQLYRVLDKDVSEHVS

SEQ ID NO: 2542026 - protein, 17 aa, Entamoeba dispar
TTSFLEVSGIRDQLFRV

SEQ ID NO: 2542027 - protein, 23 aa, Entamoeba dispar
TTSHYPTNPLIAAIAARANRGGS

SEQ ID NO: 2542028 - protein, 17 aa, Entamoeba dispar
TTSIDIWSVGCIVAELL

SEQ ID NO: 2542029 - protein, 18 aa, Entamoeba dispar
TTSIEELKNYLEVSKGER

SEQ ID NO: 2542030 - protein, 21 aa, Entamoeba dispar
TTSLQALMRIVRQKTERKDAD

SEQ ID NO: 2542031 - protein, 21 aa, Entamoeba dispar
TTSPLLIHLINLLNPTEEPYS

SEQ ID NO: 2542032 - protein, 21 aa, Entamoeba dispar
TTTFIKFYSIFDRRVNRLPRK

SEQ ID NO: 2542033 - protein, 22 aa, Entamoeba dispar
TTTGFSGTKFLLGKTLDPSEID

SEQ ID NO: 2542034 - protein, 25 aa, Entamoeba dispar
TTTLLIIAIVPLETGSYNGIYCSIG

SEQ ID NO: 2542035 - protein, 24 aa, Entamoeba dispar
TTTSNILHLFRAMTLHKAILMEGS

SEQ ID NO: 2542036 - protein, 17 aa, Entamoeba dispar
TTTTDNFLESLLCLECS

SEQ ID NO: 2542037 - protein, 29 aa, Entamoeba dispar
TTTTKLLQLLIILFSPNKPSDMLWNDFIQ

SEQ ID NO: 2542038 - protein, 18 aa, Entamoeba dispar
TTTYFKNASKVFLTYSLT

SEQ ID NO: 2542039 - protein, 22 aa, Entamoeba dispar
TTYFNFRQECLWKYTSQIYDEF

SEQ ID NO: 2542040 - protein, 17 aa, Entamoeba dispar
TTYIYFTLSGIVSYYFV

SEQ ID NO: 2542041 - protein, 17 aa, Entamoeba dispar
TVAIVRKYIPNAPFNLL

SEQ ID NO: 2542042 - protein, 24 aa, Entamoeba dispar
TVALQFALEKISLIRPTKFSFVPI

SEQ ID NO: 2542043 - protein, 23 aa, Entamoeba dispar
TVCGYWLYEDRAFISDWFHSNYQ

SEQ ID NO: 2542044 - protein, 26 aa, Entamoeba dispar
TVDIFCYSLTIFEIFIERSLIYTEEV

SEQ ID NO: 2542045 - protein, 24 aa, Entamoeba dispar
TVDKLLHCLFMKELSFESEKKYDI

SEQ ID NO: 2542046 - protein, 25 aa, Entamoeba dispar
TVDLMKGVISILKKLYKQIEQTDEE

SEQ ID NO: 2542047 - protein, 28 aa, Entamoeba dispar
TVDNKDMLVWIIYPPHFDSTKKYPTLLY

SEQ ID NO: 2542048 - protein, 18 aa, Entamoeba dispar
TVDPCRFMGCGPSSSTSS

SEQ ID NO: 2542049 - protein, 37 aa, Entamoeba dispar
TVEKEFEVIIPIDDLLPFAAMKMFPNALFGNLTLEVK

SEQ ID NO: 2542050 - protein, 38 aa, Entamoeba dispar
TVEKEFEVIIPIDDLLPFAAMKMFPNALFGNLTLEVKM

SEQ ID NO: 2542051 - protein, 18 aa, Entamoeba dispar
TVENPCIYCIYKDGLSKI

SEQ ID NO: 2542052 - protein, 24 aa, Entamoeba dispar
TVEWKTLLQDKIKFLKSSGKRTVI

SEQ ID NO: 2542053 - protein, 23 aa, Entamoeba dispar
TVFDAKRLIGRRFSDPAIQNDMK

SEQ ID NO: 2542054 - protein, 20 aa, Entamoeba dispar
TVFDAKRMIGRRFSDPTIQK

SEQ ID NO: 2542055 - protein, 19 aa, Entamoeba dispar
TVFINPFKLSQFYTFSQIN

SEQ ID NO: 2542056 - protein, 23 aa, Entamoeba dispar
TVGKTCLLISYTKNSFPKKYLPT

SEQ ID NO: 2542057 - protein, 25 aa, Entamoeba dispar
TVGLIRRFVSDAPFDLLTKCPTIGL

SEQ ID NO: 2542058 - protein, 25 aa, Entamoeba dispar
TVGMFLSHTLLLGSAPYFGNGEDFL

SEQ ID NO: 2542059 - protein, 19 aa, Entamoeba dispar
TVGYLPKDLLLLQNDVEAQ

SEQ ID NO: 2542060 - protein, 23 aa, Entamoeba dispar
TVHGLYCDLFVVILTQLSEFIWY

SEQ ID NO: 2542061 - protein, 17 aa, Entamoeba dispar
TVHISSLALLKMLKHGR

SEQ ID NO: 2542062 - protein, 20 aa, Entamoeba dispar
TVHLRKVLYIDRSDWRDEDK

SEQ ID NO: 2542063 - protein, 20 aa, Entamoeba dispar
TVHYVFLSATIPNAFEFASW

SEQ ID NO: 2542064 - protein, 27 aa, Entamoeba dispar
TVIEELKVLLPCDFFAVHYAEPKLFDD

SEQ ID NO: 2542065 - protein, 26 aa, Entamoeba dispar
TVIKSPNYIFFLYNTRNTIDPEVQIP

SEQ ID NO: 2542066 - protein, 17 aa, Entamoeba dispar
TVILILSKLLEILQSFE

SEQ ID NO: 2542067 - protein, 22 aa, Entamoeba dispar
TVININCYIIDGIPITIGNNVM

SEQ ID NO: 2542068 - protein, 17 aa, Entamoeba dispar
TVIPIIEFNPHELTILA

SEQ ID NO: 2542069 - protein, 20 aa, Entamoeba dispar
TVIRALFENAIIASHQILPL

SEQ ID NO: 2542070 - protein, 35 aa, Entamoeba dispar
TVISPDPFLPTNTIGMPLPFAMRLTIAVPVNERNY

SEQ ID NO: 2542071 - protein, 27 aa, Entamoeba dispar
TVIVSEKHLSGWWYASNKETAKAGFVP

SEQ ID NO: 2542072 - protein, 27 aa, Entamoeba dispar
TVKKDWYRLNIYYLKKAGAIVDDSKSS

SEQ ID NO: 2542073 - protein, 21 aa, Entamoeba dispar
TVKMYLPETINLNGTLYDQNT

SEQ ID NO: 2542074 - protein, 21 aa, Entamoeba dispar
TVKMYLPETVNLNGTLYDQNT

SEQ ID NO: 2542075 - protein, 17 aa, Entamoeba dispar
TVKRFMRITKKTEKSHF

SEQ ID NO: 2542076 - protein, 19 aa, Entamoeba dispar
TVLEHVYNLKFVLQVIESK

SEQ ID NO: 2542077 - protein, 23 aa, Entamoeba dispar
TVLHFKLSTIIRVVGGWVRDKLL

SEQ ID NO: 2542078 - protein, 27 aa, Entamoeba dispar
TVLKGLNIFFCFSQTAWFARGPRHHLK

SEQ ID NO: 2542079 - protein, 23 aa, Entamoeba dispar
TVLLEYYNILLSFNLLEEKIAKD

SEQ ID NO: 2542080 - protein, 19 aa, Entamoeba dispar
TVLMHLFIEKFSVFCTSIV

SEQ ID NO: 2542081 - protein, 17 aa, Entamoeba dispar
TVLMQQYTLPDGRVIKL

SEQ ID NO: 2542082 - protein, 20 aa, Entamoeba dispar
TVLRRYCFESYIMKNGISST

SEQ ID NO: 2542083 - protein, 21 aa, Entamoeba dispar
TVLSRFHYLHRHILRFISSVE

SEQ ID NO: 2542084 - protein, 24 aa, Entamoeba dispar
TVNDLYHYILIDTPLGNYLSDCLS

SEQ ID NO: 2542085 - protein, 37 aa, Entamoeba dispar
TVNFIIQHPYIFHSHLPSTLLLTLLDRNKTQLIIPPF

SEQ ID NO: 2542086 - protein, 27 aa, Entamoeba dispar
TVNGKPYPLLYLWGEFFGTYEDVQTGI

SEQ ID NO: 2542087 - protein, 27 aa, Entamoeba dispar
TVNLIANLFELGLVNERLPLTCLQELS

SEQ ID NO: 2542088 - protein, 23 aa, Entamoeba dispar
TVNPSLWRQCQLNRINGLFEVLK

SEQ ID NO: 2542089 - protein, 27 aa, Entamoeba dispar
TVNSTLYLRWLQIQTFFPLFRGNGEIN

SEQ ID NO: 2542090 - protein, 19 aa, Entamoeba dispar
TVNSWILTRGFTVGVGDIV

SEQ ID NO: 2542091 - protein, 23 aa, Entamoeba dispar
TVPDSVKVFSKAAGIFVACTELA

SEQ ID NO: 2542092 - protein, 31 aa, Entamoeba dispar
TVPESALVIHKILIPPTIMGTVTWVAEAGNY

SEQ ID NO: 2542093 - protein, 19 aa, Entamoeba dispar
TVPIYEGFSLPHAILRLDL

SEQ ID NO: 2542094 - protein, 17 aa, Entamoeba dispar
TVPSKKLLLNTVQQFIL

SEQ ID NO: 2542095 - protein, 32 aa, Entamoeba dispar
TVQHHFDLIYQFQLDNIWLITPAINGNQITQL

SEQ ID NO: 2542096 - protein, 28 aa, Entamoeba dispar
TVQIVVIQIVNLLQYLSLNGISYGHLRS

SEQ ID NO: 2542097 - protein, 20 aa, Entamoeba dispar
TVRDIYVTIKQSLKLRTVKY

SEQ ID NO: 2542098 - protein, 24 aa, Entamoeba dispar
TVRFKNEFILDTKGIKVGEKENKT

SEQ ID NO: 2542099 - protein, 20 aa, Entamoeba dispar
TVRFVQGIFLVKYDPTIEDS

SEQ ID NO: 2542100 - protein, 27 aa, Entamoeba dispar
TVRMLDHFLYCNHLCIVFELLGTNLYQ

SEQ ID NO: 2542101 - protein, 26 aa, Entamoeba dispar
TVRQIFHHFVLYKFLFTRRSHLNWSK

SEQ ID NO: 2542102 - protein, 20 aa, Entamoeba dispar
TVSQIYLTISQLNALTASSV

SEQ ID NO: 2542103 - protein, 28 aa, Entamoeba dispar
TVSVQLKDFLFSCFKRNPNQRASSRELL

SEQ ID NO: 2542104 - protein, 20 aa, Entamoeba dispar
TVTFFISPQEHIYYMLRVGR

SEQ ID NO: 2542105 - protein, 17 aa, Entamoeba dispar
TVTSLLPLFDRFHKVSQ

SEQ ID NO: 2542106 - protein, 25 aa, Entamoeba dispar
TVVLMNNICFFLTKKKQKFHKIIEI

SEQ ID NO: 2542107 - protein, 23 aa, Entamoeba dispar
TVVPVLRQTIVALNKKIADNKGS

SEQ ID NO: 2542108 - protein, 20 aa, Entamoeba dispar
TVVRKPFVAGTKTITEIKPT

SEQ ID NO: 2542109 - protein, 19 aa, Entamoeba dispar
TVWIPEIYRVAPGASIILV

SEQ ID NO: 2542110 - protein, 22 aa, Entamoeba dispar
TVWRQCCYLCPSPLNKCKIDDV

SEQ ID NO: 2542111 - protein, 17 aa, Entamoeba dispar
TVYGLTDAQVFLKDATN

SEQ ID NO: 2542112 - protein, 23 aa, Entamoeba dispar
TVYLFEIHFIDQVIKIYTNEILP

SEQ ID NO: 2542113 - protein, 29 aa, Entamoeba dispar
TVYSNHLAKFPLIVLCRKGIHVITTQSNE

SEQ ID NO: 2542114 - protein, 20 aa, Entamoeba dispar
TWDDPIRTGEINRTQLWEIK

SEQ ID NO: 2542115 - protein, 22 aa, Entamoeba dispar
TWKKQIDMEWKRKISQKFQTNE

SEQ ID NO: 2542116 - protein, 23 aa, Entamoeba dispar
TWQKMVYEGLQWAFANRPEQIQN

SEQ ID NO: 2542117 - protein, 21 aa, Entamoeba dispar
TYAKFKIYRGFGKYTNSDGME

SEQ ID NO: 2542118 - protein, 26 aa, Entamoeba dispar
TYDEQPLLYTPRKIIKSNYFPTTVLC

SEQ ID NO: 2542119 - protein, 25 aa, Entamoeba dispar
TYERLIQCGIACPQFIIIQSYQEMM

SEQ ID NO: 2542120 - protein, 19 aa, Entamoeba dispar
TYERVVFPPFKFDLKEYVS

SEQ ID NO: 2542121 - protein, 17 aa, Entamoeba dispar
TYEVDLRWCGYVHWSAG

SEQ ID NO: 2542122 - protein, 17 aa, Entamoeba dispar
TYEVFYLNRDKINNNQD

SEQ ID NO: 2542123 - protein, 19 aa, Entamoeba dispar
TYFANCLQWILPSMGDDIY

SEQ ID NO: 2542124 - protein, 25 aa, Entamoeba dispar
TYGEKLYRFFDDTALNFIALAQHFA

SEQ ID NO: 2542125 - protein, 25 aa, Entamoeba dispar
TYGGGVWTTWFDRDLGICGRVVVEE

SEQ ID NO: 2542126 - protein, 33 aa, Entamoeba dispar
TYIKHREHCPYHFPPGLLIYKDDKKHLAFFEVD

SEQ ID NO: 2542127 - protein, 31 aa, Entamoeba dispar
TYIRQIALLMILSHMGCFIPAKAASIRPLTN

SEQ ID NO: 2542128 - protein, 26 aa, Entamoeba dispar
TYKEELTNFIFEKYITSLPQNEDFGF

SEQ ID NO: 2542129 - protein, 17 aa, Entamoeba dispar
TYKFHYYQTPTNLRFVL

SEQ ID NO: 2542130 - protein, 30 aa, Entamoeba dispar
TYKISEGLHLLIDLLFELGYIFVSRVTKGA

SEQ ID NO: 2542131 - protein, 20 aa, Entamoeba dispar
TYKLIKALHLINGNIRIVVS

SEQ ID NO: 2542132 - protein, 26 aa, Entamoeba dispar
TYLPQNIIPFIPLFAKKSFHLFTNSS

SEQ ID NO: 2542133 - protein, 27 aa, Entamoeba dispar
TYMNNLFKPLFDASLYPEKYPQLAEFL

SEQ ID NO: 2542134 - protein, 23 aa, Entamoeba dispar
TYMTFKAIQLFRKISDEEPLYTP

SEQ ID NO: 2542135 - protein, 22 aa, Entamoeba dispar
TYNELVIMNILNEYYNKYGDIG

SEQ ID NO: 2542136 - protein, 25 aa, Entamoeba dispar
TYNVGIFLNILLKQLKEWNSQETYN

SEQ ID NO: 2542137 - protein, 18 aa, Entamoeba dispar
TYNYLLSHHYIPPNEGEI

SEQ ID NO: 2542138 - protein, 19 aa, Entamoeba dispar
TYPFTLDDFQRLSISCIGQ

SEQ ID NO: 2542139 - protein, 23 aa, Entamoeba dispar
TYPKTKFVLPVPKAVVFKQEKKE

SEQ ID NO: 2542140 - protein, 19 aa, Entamoeba dispar
TYPNIIKIMNLRKHFKCID

SEQ ID NO: 2542141 - protein, 19 aa, Entamoeba dispar
TYPTTYQFIKPRISETIQL

SEQ ID NO: 2542142 - protein, 19 aa, Entamoeba dispar
TYQPAYPREYDLLTSGQFQ

SEQ ID NO: 2542143 - protein, 30 aa, Entamoeba dispar
TYSISDLLSFKPSAIPYTLPLAVICALSEK

SEQ ID NO: 2542144 - protein, 35 aa, Entamoeba dispar
TYSKEVLLCSLLDLYQYILRTIKTNQIYLIGNCEG

SEQ ID NO: 2542145 - protein, 20 aa, Entamoeba dispar
TYTFPLSTLMSWGTDSSKTF

SEQ ID NO: 2542146 - protein, 21 aa, Entamoeba dispar
TYTFPLSTLMSWGTDSSKTFK

SEQ ID NO: 2542147 - protein, 29 aa, Entamoeba dispar
TYTLRRLMKFPPVFALRPLIDMAVSICDR

SEQ ID NO: 2542148 - protein, 26 aa, Entamoeba dispar
TYTTWKWFMMAKWDMKEHKIVYWQEW

SEQ ID NO: 2542149 - protein, 18 aa, Entamoeba dispar
TYVPRYYVPALKDKNGNA

SEQ ID NO: 2542150 - protein, 17 aa, Entamoeba dispar
TYVRIVIENVPAGFIRQ

SEQ ID NO: 2542151 - protein, 25 aa, Entamoeba dispar
TYYNLNERIKWETPLLFSNIFHGFQ

SEQ ID NO: 2542152 - protein, 25 aa, Entamoeba dispar
VAADLKYYGIPEAEKRMKELKGTNK

SEQ ID NO: 2542153 - protein, 19 aa, Entamoeba dispar
VAAELFLGIPLFPGENEYN

SEQ ID NO: 2542154 - protein, 26 aa, Entamoeba dispar
VAAFASLNFIIHFMKNMLDQYFAILL

SEQ ID NO: 2542155 - protein, 27 aa, Entamoeba dispar
VAAGIIKLYLRSLPDSLIPVEFSDKFM

SEQ ID NO: 2542156 - protein, 27 aa, Entamoeba dispar
VAAGLIKLYLRELPDSLIPKSMYNTFL

SEQ ID NO: 2542157 - protein, 36 aa, Entamoeba dispar
VAAIGNEIRFILRILKGVFRIGFTDRSLPPAIAQAV

SEQ ID NO: 2542158 - protein, 25 aa, Entamoeba dispar
VACLHWLKIFKKYTSPKGILAYQFP

SEQ ID NO: 2542159 - protein, 18 aa, Entamoeba dispar
VADILKTSLGPKGMDKMM

SEQ ID NO: 2542160 - protein, 31 aa, Entamoeba dispar
VADIWSLGVVFYVMIFGFMPFPGETDEEFVE

SEQ ID NO: 2542161 - protein, 31 aa, Entamoeba dispar
VADPKFKKIAFIEFLLYKYNQTIKELMARPQ

SEQ ID NO: 2542162 - protein, 21 aa, Entamoeba dispar
VAEEVSCFLVRALIDVVKGTK

SEQ ID NO: 2542163 - protein, 20 aa, Entamoeba dispar
VAEKIFLGRRERTKEVRRAK

SEQ ID NO: 2542164 - protein, 24 aa, Entamoeba dispar
VAEKLEEILKHKVIFLSDCVGEEV

SEQ ID NO: 2542165 - protein, 24 aa, Entamoeba dispar
VAEKLKILVYNYFVMPIDANDNGI

SEQ ID NO: 2542166 - protein, 23 aa, Entamoeba dispar
VAETVLRVLVKQAGLQWDPSKIQ

SEQ ID NO: 2542167 - protein, 24 aa, Entamoeba dispar
VAFDPLNILLFSQCSNAAIIWNVA

SEQ ID NO: 2542168 - protein, 20 aa, Entamoeba dispar
VAFIPPSFISLINYGTQDKI

SEQ ID NO: 2542169 - protein, 36 aa, Entamoeba dispar
VAGETKVWQYITLLKNIYLIDCPGVVYPSGDTESEV

SEQ ID NO: 2542170 - protein, 22 aa, Entamoeba dispar
VAGITHYPLHTITFKSNYCIPL

SEQ ID NO: 2542171 - protein, 17 aa, Entamoeba dispar
VAHDISLLIPEIWSRMR

SEQ ID NO: 2542172 - protein, 35 aa, Entamoeba dispar
VAIEKGGWYVPLPLYRLIPFLEESNYYITPKIMLQ

SEQ ID NO: 2542173 - protein, 37 aa, Entamoeba dispar
VAIENQYIYFIKFYNSIHKLFLYQLSSFEEPNYYSFN

SEQ ID NO: 2542174 - protein, 19 aa, Entamoeba dispar
VAKCKWIEQMFGKGWDMIE

SEQ ID NO: 2542175 - protein, 25 aa, Entamoeba dispar
VAKIKKYRRALLFNYDKETDMVELR

SEQ ID NO: 2542176 - protein, 19 aa, Entamoeba dispar
VAKKCQVLVLWLDCDREGE

SEQ ID NO: 2542177 - protein, 23 aa, Entamoeba dispar
VAKLEHYVLAFKLSLYCGIGACE

SEQ ID NO: 2542178 - protein, 17 aa, Entamoeba dispar
VAKVLLRWHIDLEKTNK

SEQ ID NO: 2542179 - protein, 18 aa, Entamoeba dispar
VALGKAFVLSDYDKLKKD

SEQ ID NO: 2542180 - protein, 26 aa, Entamoeba dispar
VALKKPYWSLVYRIANKKGLMWELPK

SEQ ID NO: 2542181 - protein, 27 aa, Entamoeba dispar
VALKTEIRTLLSILSLLCITQKDINET

SEQ ID NO: 2542182 - protein, 38 aa, Entamoeba dispar
VALLLISVSFIKEDFLKVLHFLLVKKKLPTKPENAEAI

SEQ ID NO: 2542183 - protein, 18 aa, Entamoeba dispar
VALRDQYIKYGDGFVLIY

SEQ ID NO: 2542184 - protein, 23 aa, Entamoeba dispar
VALSGIGWCFYMSKNYVESLKYF

SEQ ID NO: 2542185 - protein, 17 aa, Entamoeba dispar
VALSYFIQALKKQPTNV

SEQ ID NO: 2542186 - protein, 20 aa, Entamoeba dispar
VAMLLHYGVKPDLLFSKVEK

SEQ ID NO: 2542187 - protein, 18 aa, Entamoeba dispar
VAMLTVPNIFIRPKEREK

SEQ ID NO: 2542188 - protein, 29 aa, Entamoeba dispar
VANNPIYEYLRYVIVPYLQKVTLCGKEYT

SEQ ID NO: 2542189 - protein, 30 aa, Entamoeba dispar
VANNPIYEYLRYVIVPYLQKVTLCGKEYTL

SEQ ID NO: 2542190 - protein, 18 aa, Entamoeba dispar
VAPSVFVKFIQLHPIIAC

SEQ ID NO: 2542191 - protein, 17 aa, Entamoeba dispar
VARNFFKQLLSGVKYCH

SEQ ID NO: 2542192 - protein, 25 aa, Entamoeba dispar
VARRFHKYISLYLNQFKTRNDETLS

SEQ ID NO: 2542193 - protein, 23 aa, Entamoeba dispar
VARYLIDIALKRHSFDNITVTIC

SEQ ID NO: 2542194 - protein, 23 aa, Entamoeba dispar
VASATFVLFMKNELEKDVFRTTE

SEQ ID NO: 2542195 - protein, 38 aa, Entamoeba dispar
VASIVSKCFFLKVGKTFIKRYFSKYFSQLLAEKLDFEI

SEQ ID NO: 2542196 - protein, 25 aa, Entamoeba dispar
VASRDFTKLRASWNSNRMAGAKIIA

SEQ ID NO: 2542197 - protein, 24 aa, Entamoeba dispar
VASSRKYCLAAIKALLQTPIKEGI

SEQ ID NO: 2542198 - protein, 33 aa, Entamoeba dispar
VATSIKEGMFIRPTPRRLNVTIVPPPSSNKPHT

SEQ ID NO: 2542199 - protein, 22 aa, Entamoeba dispar
VAVDGILKLVPENKRMEASILL

SEQ ID NO: 2542200 - protein, 24 aa, Entamoeba dispar
VAVSFFDIYSLIQQFKIKDILDYM

SEQ ID NO: 2542201 - protein, 28 aa, Entamoeba dispar
VAVSSETILFLLSLVPGVFFGKPENIEI

SEQ ID NO: 2542202 - protein, 18 aa, Entamoeba dispar
VAVWPLEKSGKMIDPIFC

SEQ ID NO: 2542203 - protein, 18 aa, Entamoeba dispar
VAWNYREFIVEYHSLDNE

SEQ ID NO: 2542204 - protein, 24 aa, Entamoeba dispar
VCAKKFDEIFDKMKIEESMYPSEM

SEQ ID NO: 2542205 - protein, 26 aa, Entamoeba dispar
VCEIRNNNPFFYTSELGYDSIRSCVA

SEQ ID NO: 2542206 - protein, 18 aa, Entamoeba dispar
VCFCLISLRMTYEGVPNI

SEQ ID NO: 2542207 - protein, 24 aa, Entamoeba dispar
VCFPGKFFKFYLLSCPCLFHQNDI

SEQ ID NO: 2542208 - protein, 25 aa, Entamoeba dispar
VCFPTPLYQANKFCKMLNDCGYVEG

SEQ ID NO: 2542209 - protein, 27 aa, Entamoeba dispar
VCGFIAISFLKLIPEKFTLPDRAKADF

SEQ ID NO: 2542210 - protein, 19 aa, Entamoeba dispar
VCGIKITDDFRYIIINEDH

SEQ ID NO: 2542211 - protein, 19 aa, Entamoeba dispar
VCGIKITDDFRYIIINEDN

SEQ ID NO: 2542212 - protein, 19 aa, Entamoeba dispar
VCGWYDGPCLVELLDSIKL

SEQ ID NO: 2542213 - protein, 18 aa, Entamoeba dispar
VCGYLMKQSYIFGTWTER

SEQ ID NO: 2542214 - protein, 33 aa, Entamoeba dispar
VCHVVYTDYRPTPLCHYLFPAGGNGIYLVVDKE

SEQ ID NO: 2542215 - protein, 19 aa, Entamoeba dispar
VCILKRRYLLQNNAIEILT

SEQ ID NO: 2542216 - protein, 17 aa, Entamoeba dispar
VCIVWTKCYNYSQPDED

SEQ ID NO: 2542217 - protein, 48 aa, Entamoeba dispar
VCKDKCEYWYWINKLSYFTHNIGVLGFPLLVAIRKSGWRVPNPIYRCI

SEQ ID NO: 2542218 - protein, 21 aa, Entamoeba dispar
VCKKIYKPLLTLSKNNRLLVE

SEQ ID NO: 2542219 - protein, 17 aa, Entamoeba dispar
VCLIWDIGMLMCLHVIE

SEQ ID NO: 2542220 - protein, 17 aa, Entamoeba dispar
VCLTPHNTINELISVVS

SEQ ID NO: 2542221 - protein, 18 aa, Entamoeba dispar
VCMELLLGINKLETFQEF

SEQ ID NO: 2542222 - protein, 28 aa, Entamoeba dispar
VCNEFALKIIIITFKYMTNIVIRYSAVQ

SEQ ID NO: 2542223 - protein, 25 aa, Entamoeba dispar
VCNKSALFIIRRNGMKEYIPLVSKR

SEQ ID NO: 2542224 - protein, 25 aa, Entamoeba dispar
VCPNPAFIMQLYEWQRKYHSCIGSD

SEQ ID NO: 2542225 - protein, 18 aa, Entamoeba dispar
VCPRLTLYALQSLQFILF

SEQ ID NO: 2542226 - protein, 17 aa, Entamoeba dispar
VCPSINGGLIYCIGVLP

SEQ ID NO: 2542227 - protein, 18 aa, Entamoeba dispar
VCPSINGGLIYCIGVLPK

SEQ ID NO: 2542228 - protein, 17 aa, Entamoeba dispar
VCQMALQSLYIFSKINF

SEQ ID NO: 2542229 - protein, 24 aa, Entamoeba dispar
VCREWKMFLNYFPLQCSIYSKSQI

SEQ ID NO: 2542230 - protein, 28 aa, Entamoeba dispar
VCSLLKHYLRSLPTPLLTYPIGDEIAEL

SEQ ID NO: 2542231 - protein, 25 aa, Entamoeba dispar
VCTKKKQLFIPKYTINLLNASITSN

SEQ ID NO: 2542232 - protein, 20 aa, Entamoeba dispar
VCTLEYEMWKEMVDAVSPNF

SEQ ID NO: 2542233 - protein, 24 aa, Entamoeba dispar
VDAFIHANVDNYIWYKLSSSQDIT

SEQ ID NO: 2542234 - protein, 31 aa, Entamoeba dispar
VDAIAGTLYIYVLDIPLLDKIYLIHQGVESA

SEQ ID NO: 2542235 - protein, 18 aa, Entamoeba dispar
VDALKMYLNEVMYNIGVG

SEQ ID NO: 2542236 - protein, 24 aa, Entamoeba dispar
VDANIRRILIHELSLDEKTPENIL

SEQ ID NO: 2542237 - protein, 26 aa, Entamoeba dispar
VDAVIERYLQIVLKLAQVRFVEKYPP

SEQ ID NO: 2542238 - protein, 17 aa, Entamoeba dispar
VDCAFGRFFSKISTLSS

SEQ ID NO: 2542239 - protein, 25 aa, Entamoeba dispar
VDCRRTLVLQYFGEIFNSKLCNKTC

SEQ ID NO: 2542240 - protein, 28 aa, Entamoeba dispar
VDCVHLLPSHFHQLLRFISVEVGNKKSV

SEQ ID NO: 2542241 - protein, 18 aa, Entamoeba dispar
VDCYCRLYRKLNIDNSQM

SEQ ID NO: 2542242 - protein, 25 aa, Entamoeba dispar
VDDERFVQPWTIPQFVIEGHRLEKP

SEQ ID NO: 2542243 - protein, 29 aa, Entamoeba dispar
VDDIFYQGYLKMSLKMFEKYVGGIVTFNT

SEQ ID NO: 2542244 - protein, 23 aa, Entamoeba dispar
VDDLKLCQPTYFCAVPRVLQRIY

SEQ ID NO: 2542245 - protein, 29 aa, Entamoeba dispar
VDDPTIVMMCLWIMMLKQKNIGSSNIRKI

SEQ ID NO: 2542246 - protein, 20 aa, Entamoeba dispar
VDDWIFAMKSYGLSPDKINE

SEQ ID NO: 2542247 - protein, 27 aa, Entamoeba dispar
VDDYTYYRYCELLITAFIEGNKDFLCR

SEQ ID NO: 2542248 - protein, 23 aa, Entamoeba dispar
VDEDTLYVYYKTGGIRKYINFEE

SEQ ID NO: 2542249 - protein, 20 aa, Entamoeba dispar
VDEIKDWERSLWSFDVVEKY

SEQ ID NO: 2542250 - protein, 28 aa, Entamoeba dispar
VDELLERLILILLSHHYSLILKYIVQKV

SEQ ID NO: 2542251 - protein, 19 aa, Entamoeba dispar
VDEMLFTPLLVSVAGASMS

SEQ ID NO: 2542252 - protein, 19 aa, Entamoeba dispar
VDENKLYRTLFKQLNEESQ

SEQ ID NO: 2542253 - protein, 26 aa, Entamoeba dispar
VDENYHITEYLALGATLAVSYVENIN

SEQ ID NO: 2542254 - protein, 24 aa, Entamoeba dispar
VDESKLNHIPLTETPKKLSKGLKE

SEQ ID NO: 2542255 - protein, 34 aa, Entamoeba dispar
VDFDACSLYPSAIARLYLPMGAPNQMFHPIEWYL

SEQ ID NO: 2542256 - protein, 30 aa, Entamoeba dispar
VDFGESFVSIFPFYNGTYIFNASDKQCFGG

SEQ ID NO: 2542257 - protein, 19 aa, Entamoeba dispar
VDGKEVEYLFWEGICLKES

SEQ ID NO: 2542258 - protein, 23 aa, Entamoeba dispar
VDGRFMQYPLQGPPPPSMFQSRP

SEQ ID NO: 2542259 - protein, 22 aa, Entamoeba dispar
VDGRPLFLDLADGKKGGDKDND

SEQ ID NO: 2542260 - protein, 19 aa, Entamoeba dispar
VDGSFLINQPFAVAKSFFD

SEQ ID NO: 2542261 - protein, 28 aa, Entamoeba dispar
VDGSLLVNNPFYLTYPLVIGENGLNIPK

SEQ ID NO: 2542262 - protein, 25 aa, Entamoeba dispar
VDGVPVYINHLWRKCYGDESCKNYL

SEQ ID NO: 2542263 - protein, 23 aa, Entamoeba dispar
VDGYDLFHIVFTNNLLKEEFIKK

SEQ ID NO: 2542264 - protein, 24 aa, Entamoeba dispar
VDHHKYFMKGLFNVGMWERTEPNP

SEQ ID NO: 2542265 - protein, 30 aa, Entamoeba dispar
VDIKKKIMIFVEKLYWYNPSRLFIITSSFS

SEQ ID NO: 2542266 - protein, 29 aa, Entamoeba dispar
VDIKPKIYKRRVDGILPTLCLWSNENQEN

SEQ ID NO: 2542267 - protein, 41 aa, Entamoeba dispar
VDIKTLRHLMFSLYILNPVLFFIQLETMKLLVWGEDSLFWL

SEQ ID NO: 2542268 - protein, 28 aa, Entamoeba dispar
VDIKYGYEYIFPLIPIIIVNKEDYINFQ

SEQ ID NO: 2542269 - protein, 24 aa, Entamoeba dispar
VDITGTYCFIYKIENPKLIPFGSY

SEQ ID NO: 2542270 - protein, 26 aa, Entamoeba dispar
VDKDFNKLLLFTRDYFRIKNIPHYNK

SEQ ID NO: 2542271 - protein, 21 aa, Entamoeba dispar
VDLFIQMKLALERGERIENEK

SEQ ID NO: 2542272 - protein, 19 aa, Entamoeba dispar
VDLIIQFITLLQSNKFLLN

SEQ ID NO: 2542273 - protein, 23 aa, Entamoeba dispar
VDLKSLIEIFYILLNQSEHPGVI

SEQ ID NO: 2542274 - protein, 23 aa, Entamoeba dispar
VDLTRIPFPVCITQARSFLQNFT

SEQ ID NO: 2542275 - protein, 24 aa, Entamoeba dispar
VDLYREFLNHLAQYNYKNLYIVGS

SEQ ID NO: 2542276 - protein, 29 aa, Entamoeba dispar
VDMEAEGVPICEWPMWINSQIEHTETRPL

SEQ ID NO: 2542277 - protein, 25 aa, Entamoeba dispar
VDMKKFLSFFSLFSKSKSEKFKHAS

SEQ ID NO: 2542278 - protein, 21 aa, Entamoeba dispar
VDMLYPHLSGLSYFTKRHEFS

SEQ ID NO: 2542279 - protein, 27 aa, Entamoeba dispar
VDMSQIGEQLLFKLKPFQIQGVEFGIQ

SEQ ID NO: 2542280 - protein, 19 aa, Entamoeba dispar
VDMVKWFRDGITALGINET

SEQ ID NO: 2542281 - protein, 29 aa, Entamoeba dispar
VDMWSLGCMLFQFLTGEFPFRGKSDKLTF

SEQ ID NO: 2542282 - protein, 22 aa, Entamoeba dispar
VDNCIGFIIISPKYSSKNLYLD

SEQ ID NO: 2542283 - protein, 24 aa, Entamoeba dispar
VDNTIILSFIELPFKNILGKKQFI

SEQ ID NO: 2542284 - protein, 26 aa, Entamoeba dispar
VDNTKEFEWFVQRLGWIVKVADGSYN

SEQ ID NO: 2542285 - protein, 23 aa, Entamoeba dispar
VDPHSSFVFLFDIVNPDTNPLDS

SEQ ID NO: 2542286 - protein, 20 aa, Entamoeba dispar
VDPIVITQLGPRQNIHMVCY

SEQ ID NO: 2542287 - protein, 19 aa, Entamoeba dispar
VDPNHFLFSLRIEQTDFVH

SEQ ID NO: 2542288 - protein, 20 aa, Entamoeba dispar
VDPSGSFWTWKATALGKNMT

SEQ ID NO: 2542289 - protein, 27 aa, Entamoeba dispar
VDPSRILIERVLLTGTPIKIGKRKATI

SEQ ID NO: 2542290 - protein, 26 aa, Entamoeba dispar
VDPYAQLEFAIFDQLLHKNMPANYSE

SEQ ID NO: 2542291 - protein, 18 aa, Entamoeba dispar
VDQLLVTAVRRPKPMQHN

SEQ ID NO: 2542292 - protein, 23 aa, Entamoeba dispar
VDQLPFVDLAPAKDLNFYTSIKE

SEQ ID NO: 2542293 - protein, 25 aa, Entamoeba dispar
VDRARYEIKMALPPKIDPSVSVMQV

SEQ ID NO: 2542294 - protein, 24 aa, Entamoeba dispar
VDRFKIQYRFEKVYFVSSLTGDGV

SEQ ID NO: 2542295 - protein, 37 aa, Entamoeba dispar
VDRGDFGCEVLFYLLAQKLMNPKKFFLLRGNHESRMM

SEQ ID NO: 2542296 - protein, 19 aa, Entamoeba dispar
VDRGFNSVETFLLLVALKV

SEQ ID NO: 2542297 - protein, 34 aa, Entamoeba dispar
VDRGYHCLETVLLLLALKVKFPERIILLRGNHES

SEQ ID NO: 2542298 - protein, 33 aa, Entamoeba dispar
VDRQEALLPLQLRFIQIFVICEPTLSLESPLHN

SEQ ID NO: 2542299 - protein, 18 aa, Entamoeba dispar
VDRYYQIKAFTKETFYKI

SEQ ID NO: 2542300 - protein, 18 aa, Entamoeba dispar
VDSLHKLIEKTDLNEFIK

SEQ ID NO: 2542301 - protein, 26 aa, Entamoeba dispar
VDSQIKIMTLLIGLYPLICSGFEESK

SEQ ID NO: 2542302 - protein, 24 aa, Entamoeba dispar
VDSRTYEYIFPSYAIQKIDSEHPE

SEQ ID NO: 2542303 - protein, 25 aa, Entamoeba dispar
VDTSNYKMWIQLASAPEDFNMIVDK

SEQ ID NO: 2542304 - protein, 21 aa, Entamoeba dispar
VDVAIIVAGIPRKPGMQRSDL

SEQ ID NO: 2542305 - protein, 25 aa, Entamoeba dispar
VDVCLIKIIPYLIQLYPEEEEYFLN

SEQ ID NO: 2542306 - protein, 29 aa, Entamoeba dispar
VDVLLEKIWEIVGLFKVYPKTKTGIIDLD

SEQ ID NO: 2542307 - protein, 33 aa, Entamoeba dispar
VDVNPEFIPYIQLYLNFFHIKNVMRKCKTKFTQ

SEQ ID NO: 2542308 - protein, 31 aa, Entamoeba dispar
VDVTNGIVYFKYFFDLSDLTLEQLRVADFLA

SEQ ID NO: 2542309 - protein, 35 aa, Entamoeba dispar
VDVYALAITMWELFYERLPFEEFLKDPDKFRTFIA

SEQ ID NO: 2542310 - protein, 20 aa, Entamoeba dispar
VDYDAEASCIECISACSSQS

SEQ ID NO: 2542311 - protein, 26 aa, Entamoeba dispar
VEAGKLLYDPYFNTNPIWNQRRERYD

SEQ ID NO: 2542312 - protein, 25 aa, Entamoeba dispar
VECRDLQCFFSLSKDISRFEIFNRE

SEQ ID NO: 2542313 - protein, 24 aa, Entamoeba dispar
VEDALMLMKNKPADLIKPVVRIHY

SEQ ID NO: 2542314 - protein, 22 aa, Entamoeba dispar
VEDGNNLLVYLIKGQDNEVIPE

SEQ ID NO: 2542315 - protein, 25 aa, Entamoeba dispar
VEDYKFRYNRAIERMSDLEKNDSSS

SEQ ID NO: 2542316 - protein, 17 aa, Entamoeba dispar
VEEHIFELFPFPHSYEI

SEQ ID NO: 2542317 - protein, 25 aa, Entamoeba dispar
VEEKSNVMILVITKEGYSFGCFNKK

SEQ ID NO: 2542318 - protein, 18 aa, Entamoeba dispar
VEEMFLSKMTFSDKQHPL

SEQ ID NO: 2542319 - protein, 40 aa, Entamoeba dispar
VEEQLRYFIELPIPVPLFKEYLIFVFNVVSLLLSNNLHEE

SEQ ID NO: 2542320 - protein, 23 aa, Entamoeba dispar
VEERRAWRKDHPPGFIARPIMKK

SEQ ID NO: 2542321 - protein, 24 aa, Entamoeba dispar
VEETIYLMELLKKYNSYDIEAKRS

SEQ ID NO: 2542322 - protein, 25 aa, Entamoeba dispar
VEETKVILLLFMSLLKNLNSKIINK

SEQ ID NO: 2542323 - protein, 35 aa, Entamoeba dispar
VEEWLPKEHWSYFSKATILFAKYICKPNPLCDECP

SEQ ID NO: 2542324 - protein, 22 aa, Entamoeba dispar
VEEYIHMLINEKELKMLKDETI

SEQ ID NO: 2542325 - protein, 27 aa, Entamoeba dispar
VEEYLREIFFITFPKSDYIAQIFGYCI

SEQ ID NO: 2542326 - protein, 20 aa, Entamoeba dispar
VEFFLRNSELYYRSIEFLKQ

SEQ ID NO: 2542327 - protein, 26 aa, Entamoeba dispar
VEFITKMSIKGFPLGPAGSIVFKFKL

SEQ ID NO: 2542328 - protein, 24 aa, Entamoeba dispar
VEFKRKAIFYNDVIFKKGVKFNEK

SEQ ID NO: 2542329 - protein, 26 aa, Entamoeba dispar
VEFMKLKHMIILQNKIDLVKTKEDAQ

SEQ ID NO: 2542330 - protein, 27 aa, Entamoeba dispar
VEFPSALLILQLLINVLLNQLVHNNFN

SEQ ID NO: 2542331 - protein, 23 aa, Entamoeba dispar
VEFVKYCLALNHLFDFSKGGEIT

SEQ ID NO: 2542332 - protein, 17 aa, Entamoeba dispar
VEFWKYWMDSTPQSDAL

SEQ ID NO: 2542333 - protein, 26 aa, Entamoeba dispar
VEGGFTFIIIDYFSLGQLSDYINMFV

SEQ ID NO: 2542334 - protein, 23 aa, Entamoeba dispar
VEGILEHTLFRATFFPTWEGLFW

SEQ ID NO: 2542335 - protein, 35 aa, Entamoeba dispar
VEGKAMLRIGMVNPPYIIKYFKEIVNILLRPCCFK

SEQ ID NO: 2542336 - protein, 34 aa, Entamoeba dispar
VEGRAYHFISIIPYNGILLLLDGLSEGPIIIGGA

SEQ ID NO: 2542337 - protein, 24 aa, Entamoeba dispar
VEHDDYIYIMKRVTKFPPVENLHN

SEQ ID NO: 2542338 - protein, 27 aa, Entamoeba dispar
VEHPKLFWRYILELLLLCELKVVKVYC

SEQ ID NO: 2542339 - protein, 33 aa, Entamoeba dispar
VEHYTKPNYFKYAPAYPLVLYECKYDRVEFLCD

SEQ ID NO: 2542340 - protein, 19 aa, Entamoeba dispar
VEIEFLRNCCHLRNLDLSN

SEQ ID NO: 2542341 - protein, 28 aa, Entamoeba dispar
VEIGRITMIMFYLGAYKILFPEQPINKV

SEQ ID NO: 2542342 - protein, 20 aa, Entamoeba dispar
VEIILQKPLCVDTRVNNDSF

SEQ ID NO: 2542343 - protein, 25 aa, Entamoeba dispar
VEIKDYFMIYGNIPTQIIDLNERYD

SEQ ID NO: 2542344 - protein, 25 aa, Entamoeba dispar
VEILFQEGLIKCLFATETFAMGLNM

SEQ ID NO: 2542345 - protein, 24 aa, Entamoeba dispar
VEINIPFPTFIKKIQLVVVSCFTG

SEQ ID NO: 2542346 - protein, 18 aa, Entamoeba dispar
VEINPFPQTLTKIKLMNI

SEQ ID NO: 2542347 - protein, 25 aa, Entamoeba dispar
VEINSTIHPSFARFALECSEYKCVG

SEQ ID NO: 2542348 - protein, 27 aa, Entamoeba dispar
VEKAFSDLLIQIYKKKNATLKNDSVPS

SEQ ID NO: 2542349 - protein, 23 aa, Entamoeba dispar
VEKLIVWENLPTIRIELKHPQTD

SEQ ID NO: 2542350 - protein, 24 aa, Entamoeba dispar
VEKLVSLLSGYFYLCGETSPDVEK

SEQ ID NO: 2542351 - protein, 25 aa, Entamoeba dispar
VEKQFAQHIFISLTGFFDGIKKLKI

SEQ ID NO: 2542352 - protein, 26 aa, Entamoeba dispar
VEKRKPIPLYLDLNDTGLLLNEAVVP

SEQ ID NO: 2542353 - protein, 26 aa, Entamoeba dispar
VEKVRPICMGAVLRGITFTEESYKRY

SEQ ID NO: 2542354 - protein, 26 aa, Entamoeba dispar
VEKVRPICMGAVLRGITFTEESYKSF

SEQ ID NO: 2542355 - protein, 31 aa, Entamoeba dispar
VEKYPPNMFIHPYDFFPFDRKYEEQRKEDGM

SEQ ID NO: 2542356 - protein, 25 aa, Entamoeba dispar
VELIKKIPCFWGRIMNVADLNYNNL

SEQ ID NO: 2542357 - protein, 22 aa, Entamoeba dispar
VELLRKYRGELTHEKVVRLNRI

SEQ ID NO: 2542358 - protein, 24 aa, Entamoeba dispar
VELLRKYRGELTHEKVVRLNRIVK

SEQ ID NO: 2542359 - protein, 25 aa, Entamoeba dispar
VELLRKYRGELTHEKVVRLNRIVKV

SEQ ID NO: 2542360 - protein, 25 aa, Entamoeba dispar
VELMWNVYRRWKEFIKYLISLQKLT

SEQ ID NO: 2542361 - protein, 20 aa, Entamoeba dispar
VELNILPGWKDGTKIRFEGY

SEQ ID NO: 2542362 - protein, 17 aa, Entamoeba dispar
VELQSVDNLKRLKLQGV

SEQ ID NO: 2542363 - protein, 17 aa, Entamoeba dispar
VELSWYPGGIAYQLNAS

SEQ ID NO: 2542364 - protein, 26 aa, Entamoeba dispar
VELTWTCPSVFLPQQYLSYLTTQQPI

SEQ ID NO: 2542365 - protein, 18 aa, Entamoeba dispar
VELTYVLPKEFPINQITE

SEQ ID NO: 2542366 - protein, 25 aa, Entamoeba dispar
VELYHQYYLGFFKSNSEMYTVQNKQ

SEQ ID NO: 2542367 - protein, 20 aa, Entamoeba dispar
VELYHQYYLGVFKSNSEMYT

SEQ ID NO: 2542368 - protein, 22 aa, Entamoeba dispar
VEMISICFFFVLKNMDDKTLKS

SEQ ID NO: 2542369 - protein, 21 aa, Entamoeba dispar
VEMKWIAQILLNGVIYPMLMK

SEQ ID NO: 2542370 - protein, 33 aa, Entamoeba dispar
VENDKLVNCAKGLQLKFFFSIMEAEMSDIKKLS

SEQ ID NO: 2542371 - protein, 22 aa, Entamoeba dispar
VENHKFFIIAQASKNGLIRIST

SEQ ID NO: 2542372 - protein, 23 aa, Entamoeba dispar
VENIFYTSFLIKEGTAYIVVKNR

SEQ ID NO: 2542373 - protein, 24 aa, Entamoeba dispar
VENKIEWKLLVKKAEKWLEMKQPL

SEQ ID NO: 2542374 - protein, 24 aa, Entamoeba dispar
VENKIEWKLLVKKAEKWLETKQPL

SEQ ID NO: 2542375 - protein, 23 aa, Entamoeba dispar
VENKYDVFAPKGKKLPIGFLGVY

SEQ ID NO: 2542376 - protein, 35 aa, Entamoeba dispar
VENNSFIFWEIARMYDFYLLRLLIRHSSATVIEFW

SEQ ID NO: 2542377 - protein, 23 aa, Entamoeba dispar
VENTPVDVLVFDEIPDALNCTAE

SEQ ID NO: 2542378 - protein, 28 aa, Entamoeba dispar
VEPDEFIPNLYKLTPPLSLPIDTLLSQD

SEQ ID NO: 2542379 - protein, 19 aa, Entamoeba dispar
VEPLQHPGVFPFFIKTECS

SEQ ID NO: 2542380 - protein, 29 aa, Entamoeba dispar
VEPQLFLLRWVRILFCQMFNTNELYYIWD

SEQ ID NO: 2542381 - protein, 31 aa, Entamoeba dispar
VEPTKLNTFLVQLSDEYYLEMTAKEVERRLN

SEQ ID NO: 2542382 - protein, 25 aa, Entamoeba dispar
VEPYNCVLSIHKLLESAAITFCFDN

SEQ ID NO: 2542383 - protein, 21 aa, Entamoeba dispar
VEQHIPLIPIFNEKELSILPE

SEQ ID NO: 2542384 - protein, 28 aa, Entamoeba dispar
VEQLCSILYLLYNELFKITLNQIYKLEA

SEQ ID NO: 2542385 - protein, 22 aa, Entamoeba dispar
VEQLLLYQAMLHKNNLEMKIIQ

SEQ ID NO: 2542386 - protein, 24 aa, Entamoeba dispar
VEQSFTRRVLFNGAMYTVKCQIII

SEQ ID NO: 2542387 - protein, 30 aa, Entamoeba dispar
VERHKAIERLFYLRILMERCKPIEKKLKYQ

SEQ ID NO: 2542388 - protein, 19 aa, Entamoeba dispar
VERRNVVIYFFEKKPLKKD

SEQ ID NO: 2542389 - protein, 27 aa, Entamoeba dispar
VERRRALCFTPLFTTAAHFQIDAIFAA

SEQ ID NO: 2542390 - protein, 21 aa, Entamoeba dispar
VERVINVCKYIIYIPEKDCRM

SEQ ID NO: 2542391 - protein, 27 aa, Entamoeba dispar
VERVNQCFPLVFRYQVSIPNVESPTEM

SEQ ID NO: 2542392 - protein, 18 aa, Entamoeba dispar
VESMLLQALYSKYQMFIK

SEQ ID NO: 2542393 - protein, 22 aa, Entamoeba dispar
VETEIPIVWMPGKDPRVSRPFK

SEQ ID NO: 2542394 - protein, 19 aa, Entamoeba dispar
VETNPFLDPSLTQQPITTH

SEQ ID NO: 2542395 - protein, 27 aa, Entamoeba dispar
VETTLPLRWKVFLSCLPPTPELWKSID

SEQ ID NO: 2542396 - protein, 20 aa, Entamoeba dispar
VETYSFMRWSISDGTHNYSE

SEQ ID NO: 2542397 - protein, 24 aa, Entamoeba dispar
VEVKKPLNYNNLYDILGGINEEPK

SEQ ID NO: 2542398 - protein, 23 aa, Entamoeba dispar
VEVKWKNGMVCQYRWGGENAFDL

SEQ ID NO: 2542399 - protein, 26 aa, Entamoeba dispar
VEVMGNAMLIIPKTLIENSGYDVIER

SEQ ID NO: 2542400 - protein, 19 aa, Entamoeba dispar
VEVSIGKMLLLGCAFGIAQ

SEQ ID NO: 2542401 - protein, 25 aa, Entamoeba dispar
VEYFYPLCVMLFSYADGRSFVWSLD

SEQ ID NO: 2542402 - protein, 25 aa, Entamoeba dispar
VEYLKTLKYLPPTYIEFIKNFHYDP

SEQ ID NO: 2542403 - protein, 19 aa, Entamoeba dispar
VEYNGLKFLIFDSPTDDNV

SEQ ID NO: 2542404 - protein, 28 aa, Entamoeba dispar
VEYPETYFHYYLKYFAIRDKVSARKIVY

SEQ ID NO: 2542405 - protein, 24 aa, Entamoeba dispar
VEYPQWMDDDPLFINIFEAENHLV

SEQ ID NO: 2542406 - protein, 21 aa, Entamoeba dispar
VEYSLPLYSINNPRGILLNCN

SEQ ID NO: 2542407 - protein, 23 aa, Entamoeba dispar
VEYVMKTLFFLANKKSYLCEVST

SEQ ID NO: 2542408 - protein, 30 aa, Entamoeba dispar
VFADSVSSLVLMLVALQEKNRPPKPEMQMS

SEQ ID NO: 2542409 - protein, 18 aa, Entamoeba dispar
VFCFPLEAVVKKSRWRVP

SEQ ID NO: 2542410 - protein, 22 aa, Entamoeba dispar
VFDLNAICFVAQSSNARLTANQ

SEQ ID NO: 2542411 - protein, 18 aa, Entamoeba dispar
VFDLSPEKKPFFGMAAAI

SEQ ID NO: 2542412 - protein, 34 aa, Entamoeba dispar
VFDTIKYRHLWSYILHIIRLFISFSFNNPKLPCF

SEQ ID NO: 2542413 - protein, 24 aa, Entamoeba dispar
VFDVLHNCTPFISKLYSLVNTPEY

SEQ ID NO: 2542414 - protein, 21 aa, Entamoeba dispar
VFEAYQRQYLEKQYSIQEMPY

SEQ ID NO: 2542415 - protein, 17 aa, Entamoeba dispar
VFEDGSRIIFRLSGTGS

SEQ ID NO: 2542416 - protein, 27 aa, Entamoeba dispar
VFEDYGEIWLGFYSQLIISFILTIDEQ

SEQ ID NO: 2542417 - protein, 24 aa, Entamoeba dispar
VFEKYMKLLEKKGYLKDVTEEEKE

SEQ ID NO: 2542418 - protein, 24 aa, Entamoeba dispar
VFELHSFILVITTLNSIRQYNFFG

SEQ ID NO: 2542419 - protein, 19 aa, Entamoeba dispar
VFEMLYVRLPNQIKSNIYK

SEQ ID NO: 2542420 - protein, 25 aa, Entamoeba dispar
VFFYDQRTIFYFFKKNFENKACVVS

SEQ ID NO: 2542421 - protein, 27 aa, Entamoeba dispar
VFGCFIHSPILITNKPIADIFGFIFEI

SEQ ID NO: 2542422 - protein, 25 aa, Entamoeba dispar
VFGDKNHFVFTIKNNVPIKFVKREV

SEQ ID NO: 2542423 - protein, 20 aa, Entamoeba dispar
VFGGDWRYKYLLQTIICSFV

SEQ ID NO: 2542424 - protein, 23 aa, Entamoeba dispar
VFHPNIVLFLGASTEKKIMIVSE

SEQ ID NO: 2542425 - protein, 18 aa, Entamoeba dispar
VFIDFFDYRLSAANRMKI

SEQ ID NO: 2542426 - protein, 21 aa, Entamoeba dispar
VFINEPMLISFKLPENLQTIN

SEQ ID NO: 2542427 - protein, 20 aa, Entamoeba dispar
VFIQNPCTRILFINGTPGTG

SEQ ID NO: 2542428 - protein, 17 aa, Entamoeba dispar
VFITSFPVAPTSCFASW

SEQ ID NO: 2542429 - protein, 29 aa, Entamoeba dispar
VFKDGRIFKYIIWYTISYSTYLKEKEEGS

SEQ ID NO: 2542430 - protein, 22 aa, Entamoeba dispar
VFKEYTRLKGINIYDGIKGEKE

SEQ ID NO: 2542431 - protein, 27 aa, Entamoeba dispar
VFKHCMSLFWCDFLRANSTSIVKSTMN

SEQ ID NO: 2542432 - protein, 18 aa, Entamoeba dispar
VFKRWKKRYCVLASNVIA

SEQ ID NO: 2542433 - protein, 30 aa, Entamoeba dispar
VFLDAIEHAFPPTGGWGLGIDRLSMLLADV

SEQ ID NO: 2542434 - protein, 17 aa, Entamoeba dispar
VFLFIKLGEKEISSTKT

SEQ ID NO: 2542435 - protein, 17 aa, Entamoeba dispar
VFLIGKVKGDNGFISCS

SEQ ID NO: 2542436 - protein, 17 aa, Entamoeba dispar
VFLIKRNSEKKIEKVTI

SEQ ID NO: 2542437 - protein, 19 aa, Entamoeba dispar
VFLQTLLNAFGFVPSEKGS

SEQ ID NO: 2542438 - protein, 25 aa, Entamoeba dispar
VFMNEPVLISIKIPYNLEIINGKNI

SEQ ID NO: 2542439 - protein, 25 aa, Entamoeba dispar
VFNDGKIFKKIIWYEVDYSTYLKEK

SEQ ID NO: 2542440 - protein, 29 aa, Entamoeba dispar
VFNDGRIIKLLIWYAVNYSTYLKEKKKGN

SEQ ID NO: 2542441 - protein, 20 aa, Entamoeba dispar
VFNFILGRRAQQKTAITKAV

SEQ ID NO: 2542442 - protein, 18 aa, Entamoeba dispar
VFNMKRKAVLMEPVSLQK

SEQ ID NO: 2542443 - protein, 18 aa, Entamoeba dispar
VFNNTYGMTLIEAGIIIC

SEQ ID NO: 2542444 - protein, 19 aa, Entamoeba dispar
VFPGLVYRMASPKVTLLVF

SEQ ID NO: 2542445 - protein, 17 aa, Entamoeba dispar
VFPKWSIVDPCHSMSLP

SEQ ID NO: 2542446 - protein, 27 aa, Entamoeba dispar
VFQAAYASTLLLPLDKTVPSIYIPYVV

SEQ ID NO: 2542447 - protein, 17 aa, Entamoeba dispar
VFQLLDDTTLQQVDPKV

SEQ ID NO: 2542448 - protein, 33 aa, Entamoeba dispar
VFQLPSIITHLSYFRIPLPDILHWMNIDISSPS

SEQ ID NO: 2542449 - protein, 36 aa, Entamoeba dispar
VFQLPSIITHLSYFRIPLPDILHWMNIDISSSSGKT

SEQ ID NO: 2542450 - protein, 26 aa, Entamoeba dispar
VFQMVHKILLLIQTPETLCVLLPNKR

SEQ ID NO: 2542451 - protein, 23 aa, Entamoeba dispar
VFQPPSKIDTFINSLSQLFNSET

SEQ ID NO: 2542452 - protein, 25 aa, Entamoeba dispar
VFRGHYPGAWSCRPSFSPDGQYVLS

SEQ ID NO: 2542453 - protein, 29 aa, Entamoeba dispar
VFRLEEFTRSIWPTYRPIVIDIIDCLCDK

SEQ ID NO: 2542454 - protein, 30 aa, Entamoeba dispar
VFRQQTNDVYFARWSPIISICNKVGGNLKI

SEQ ID NO: 2542455 - protein, 18 aa, Entamoeba dispar
VFRSITASYFRNRHVMCF

SEQ ID NO: 2542456 - protein, 22 aa, Entamoeba dispar
VFSCKSFIFKKTSNFKYGIIDI

SEQ ID NO: 2542457 - protein, 29 aa, Entamoeba dispar
VFSFGITMIQIINWKIYKSKELLMTAYEQ

SEQ ID NO: 2542458 - protein, 26 aa, Entamoeba dispar
VFSIGVLMVYLLQFDGNRSHLNVNNT

SEQ ID NO: 2542459 - protein, 28 aa, Entamoeba dispar
VFSIVNDPFIPHPYYVKPFNKTMMIKED

SEQ ID NO: 2542460 - protein, 30 aa, Entamoeba dispar
VFTYNEFEYFLPYLYIVCYYSHLSIPTLSH

SEQ ID NO: 2542461 - protein, 17 aa, Entamoeba dispar
VFVLKGCSPIPGAIIYD

SEQ ID NO: 2542462 - protein, 23 aa, Entamoeba dispar
VFVNAITMIKRLVPLFQMIGCSV

SEQ ID NO: 2542463 - protein, 26 aa, Entamoeba dispar
VFVSSKSIRFIPLPGSALTSGTYIDE

SEQ ID NO: 2542464 - protein, 25 aa, Entamoeba dispar
VFYNLTTQILKLIDQQKYGIFTDSI

SEQ ID NO: 2542465 - protein, 17 aa, Entamoeba dispar
VGACPLPPPPPPSAYAC

SEQ ID NO: 2542466 - protein, 26 aa, Entamoeba dispar
VGADPNFFVYSFQNPFNTEPLKILKK

SEQ ID NO: 2542467 - protein, 18 aa, Entamoeba dispar
VGDIVFVESIIASWAVVH

SEQ ID NO: 2542468 - protein, 24 aa, Entamoeba dispar
VGDKKYIMPYCYIKVLEDYDQKMA

SEQ ID NO: 2542469 - protein, 33 aa, Entamoeba dispar
VGDNDQYLILTGNYLVLFNTVMDAYKKTSPISL

SEQ ID NO: 2542470 - protein, 31 aa, Entamoeba dispar
VGDNTFDNTLYMLLTFANLSNNYVVKKVERD

SEQ ID NO: 2542471 - protein, 24 aa, Entamoeba dispar
VGDQQFEDRYDLLNYCMNTNTEPT

SEQ ID NO: 2542472 - protein, 23 aa, Entamoeba dispar
VGDSPILICTLICDKEANVVIET

SEQ ID NO: 2542473 - protein, 27 aa, Entamoeba dispar
VGDVHGQFFDLIHLFEINGLPSEDNVY

SEQ ID NO: 2542474 - protein, 19 aa, Entamoeba dispar
VGEFRLIFAGRVLKDDEVL

SEQ ID NO: 2542475 - protein, 19 aa, Entamoeba dispar
VGFLNTLGMPFKIGEIAFY

SEQ ID NO: 2542476 - protein, 20 aa, Entamoeba dispar
VGGIALLLALILKSDTKIKF

SEQ ID NO: 2542477 - protein, 36 aa, Entamoeba dispar
VGGSIRTWKKRYFVLKDRRIWYFSSCKDKAAKGYID

SEQ ID NO: 2542478 - protein, 20 aa, Entamoeba dispar
VGGTYFCEFLKKTRFDQVEE

SEQ ID NO: 2542479 - protein, 26 aa, Entamoeba dispar
VGGVLVYHPFVLHSLIRLIHFALNVK

SEQ ID NO: 2542480 - protein, 28 aa, Entamoeba dispar
VGGYDYLLGMKIWTLTYEKAKKLMEDCD

SEQ ID NO: 2542481 - protein, 19 aa, Entamoeba dispar
VGHPFSLKTVLMIVDQCLR

SEQ ID NO: 2542482 - protein, 20 aa, Entamoeba dispar
VGHRFVHGGSYFKRSAIIDE

SEQ ID NO: 2542483 - protein, 19 aa, Entamoeba dispar
VGIEWVHDCLTCQLKVSKA

SEQ ID NO: 2542484 - protein, 18 aa, Entamoeba dispar
VGIIDFIRTYTWDKQLES

SEQ ID NO: 2542485 - protein, 26 aa, Entamoeba dispar
VGIISVHLYRPWSAKHFLGEIPNTVT

SEQ ID NO: 2542486 - protein, 28 aa, Entamoeba dispar
VGISLDRWMYVWDPIKKIPISKTYLHGL

SEQ ID NO: 2542487 - protein, 23 aa, Entamoeba dispar
VGKGFFELELLKKAYLDSVKCSD

SEQ ID NO: 2542488 - protein, 27 aa, Entamoeba dispar
VGKRQTLMFSATFPKQIQRLAADFLDN

SEQ ID NO: 2542489 - protein, 24 aa, Entamoeba dispar
VGKSNLLLRFTRDEFDPEKKSTIG

SEQ ID NO: 2542490 - protein, 26 aa, Entamoeba dispar
VGKTCLLTRYRLNTFPEDYVPTVFEN

SEQ ID NO: 2542491 - protein, 35 aa, Entamoeba dispar
VGKTMLCNLLFEYLDYYTPIAYIKEYIDYNNDGEF

SEQ ID NO: 2542492 - protein, 33 aa, Entamoeba dispar
VGKTMLCNLLFEYLDYYTPIAYVKEYIDYNNDG

SEQ ID NO: 2542493 - protein, 21 aa, Entamoeba dispar
VGLIYICVIVKERIEKRELHL

SEQ ID NO: 2542494 - protein, 20 aa, Entamoeba dispar
VGLIYIPLETVVNHRLNVLI

SEQ ID NO: 2542495 - protein, 20 aa, Entamoeba dispar
VGLTLELRHILKWDQADIQA

SEQ ID NO: 2542496 - protein, 19 aa, Entamoeba dispar
VGLTTFLGCVILKIKGDDD

SEQ ID NO: 2542497 - protein, 17 aa, Entamoeba dispar
VGMYGFKFKLTLSEPSK

SEQ ID NO: 2542498 - protein, 23 aa, Entamoeba dispar
VGNEITMSYLIPALDKYLQDYEE

SEQ ID NO: 2542499 - protein, 29 aa, Entamoeba dispar
VGNEKTFLALITGILNRFIGLSSREVKLI

SEQ ID NO: 2542500 - protein, 23 aa, Entamoeba dispar
VGNFPIVLKLNPKCQSNYICLHH

SEQ ID NO: 2542501 - protein, 23 aa, Entamoeba dispar
VGNQVFLLHYINGTKLSDILELK

SEQ ID NO: 2542502 - protein, 18 aa, Entamoeba dispar
VGNYLYPMLSKSMAPEAT

SEQ ID NO: 2542503 - protein, 17 aa, Entamoeba dispar
VGQFRAPFNGNINQRVP

SEQ ID NO: 2542504 - protein, 21 aa, Entamoeba dispar
VGQHDFPIERLALSRDQNILA

SEQ ID NO: 2542505 - protein, 21 aa, Entamoeba dispar
VGRIVSVGVGFWKVDINGKNN

SEQ ID NO: 2542506 - protein, 31 aa, Entamoeba dispar
VGRPLKGANILFKGRSKLVIGGALVAGGYSD

SEQ ID NO: 2542507 - protein, 17 aa, Entamoeba dispar
VGRRICPLFVTKGFDRI

SEQ ID NO: 2542508 - protein, 20 aa, Entamoeba dispar
VGRRRYGVCGPKKKITQLVN

SEQ ID NO: 2542509 - protein, 22 aa, Entamoeba dispar
VGRYAVLCALQFSLTLCLPHDT

SEQ ID NO: 2542510 - protein, 24 aa, Entamoeba dispar
VGSFVDLIFILYIKWERTNDDWVQ

SEQ ID NO: 2542511 - protein, 26 aa, Entamoeba dispar
VGSKVLFKIICFICSFITENEQIQKM

SEQ ID NO: 2542512 - protein, 33 aa, Entamoeba dispar
VGSLPPVFVELQIKFYLLARLLGVESSDGEALV

SEQ ID NO: 2542513 - protein, 23 aa, Entamoeba dispar
VGSPLMVYVPQSLEIISSESLVN

SEQ ID NO: 2542514 - protein, 24 aa, Entamoeba dispar
VGTKDLIRIFGINKKTIPWSIIKE

SEQ ID NO: 2542515 - protein, 18 aa, Entamoeba dispar
VGVFLIDEDWQFEDLPFK

SEQ ID NO: 2542516 - protein, 18 aa, Entamoeba dispar
VGVGFWKVDINGKNNGLL

SEQ ID NO: 2542517 - protein, 29 aa, Entamoeba dispar
VGVKKSGWRFPLPIYRCLEYLEKNDGLRA

SEQ ID NO: 2542518 - protein, 26 aa, Entamoeba dispar
VGVLELMRILLDIEGLEWNQAWEIVV

SEQ ID NO: 2542519 - protein, 23 aa, Entamoeba dispar
VGVVVYWYLMKQFHFIEHIAISP

SEQ ID NO: 2542520 - protein, 25 aa, Entamoeba dispar
VGYEQFLAPELFFNPEIFSSDFTTP

SEQ ID NO: 2542521 - protein, 24 aa, Entamoeba dispar
VGYRNFCNKLWNAFKFSSMNFRKD

SEQ ID NO: 2542522 - protein, 18 aa, Entamoeba dispar
VGYSSMQGWRKTMEDAHL

SEQ ID NO: 2542523 - protein, 18 aa, Entamoeba dispar
VGYVLYPLQRKNDIICTI

SEQ ID NO: 2542524 - protein, 28 aa, Entamoeba dispar
VGYVVTKFLYQQVEPFILLKYQLEKDEQ

SEQ ID NO: 2542525 - protein, 25 aa, Entamoeba dispar
VHDMELFGLGILDKDKINDTLSCLE

SEQ ID NO: 2542526 - protein, 17 aa, Entamoeba dispar
VHFIKRPIFFNYFTSSQ

SEQ ID NO: 2542527 - protein, 18 aa, Entamoeba dispar
VHGGSYFKRSAIIDEAVL

SEQ ID NO: 2542528 - protein, 25 aa, Entamoeba dispar
VHGKPTIVPLLYNNIELPQSLLESC

SEQ ID NO: 2542529 - protein, 23 aa, Entamoeba dispar
VHGKWYLGIYENSIVWGDELDSI

SEQ ID NO: 2542530 - protein, 17 aa, Entamoeba dispar
VHHAGLIPFLKEIVEVL

SEQ ID NO: 2542531 - protein, 17 aa, Entamoeba dispar
VHHISLAHSASLFLIAP

SEQ ID NO: 2542532 - protein, 23 aa, Entamoeba dispar
VHILASGIKHWCKKTHVISVEID

SEQ ID NO: 2542533 - protein, 19 aa, Entamoeba dispar
VHIPSFLKKKQLQIRKSKS

SEQ ID NO: 2542534 - protein, 19 aa, Entamoeba dispar
VHIVTAPMPPSSKGAVLIA

SEQ ID NO: 2542535 - protein, 21 aa, Entamoeba dispar
VHKEILFFAKAKEDNLLLIKK

SEQ ID NO: 2542536 - protein, 27 aa, Entamoeba dispar
VHKLVPLKTDFIFTVNYKKVCEILSLM

SEQ ID NO: 2542537 - protein, 26 aa, Entamoeba dispar
VHKVLSCMTLFYYISKDKLFKDIVDR

SEQ ID NO: 2542538 - protein, 18 aa, Entamoeba dispar
VHLEARDAYRRFIQNYNT

SEQ ID NO: 2542539 - protein, 19 aa, Entamoeba dispar
VHLIQNLLPVIRKLYVSDT

SEQ ID NO: 2542540 - protein, 17 aa, Entamoeba dispar
VHLLLEKDNKSFNNPFP

SEQ ID NO: 2542541 - protein, 25 aa, Entamoeba dispar
VHMLDLECFSFLNNAIEQEMTPTIV

SEQ ID NO: 2542542 - protein, 22 aa, Entamoeba dispar
VHNYKYPPIRPLNPVLTDTNEI

SEQ ID NO: 2542543 - protein, 26 aa, Entamoeba dispar
VHPIEQLIAVLPPKSIHLIPKPLQAI

SEQ ID NO: 2542544 - protein, 26 aa, Entamoeba dispar
VHQNQKMYNIFLIKLTISNNDDALDK

SEQ ID NO: 2542545 - protein, 22 aa, Entamoeba dispar
VHRDIKIENILFSSTRKFKLID

SEQ ID NO: 2542546 - protein, 19 aa, Entamoeba dispar
VHRDLKLGNLLLQENKRNN

SEQ ID NO: 2542547 - protein, 25 aa, Entamoeba dispar
VHRGQELFILPSKYDPTISNAVDKI

SEQ ID NO: 2542548 - protein, 30 aa, Entamoeba dispar
VHSEKIGTSVYFWAFPSEEFVNKKVESEKI

SEQ ID NO: 2542549 - protein, 27 aa, Entamoeba dispar
VHSLNDFIPAFKAITLLIDKNILIPIS

SEQ ID NO: 2542550 - protein, 32 aa, Entamoeba dispar
VHSWKRRYFVIKNQFIYYFASASPNSTPKGVI

SEQ ID NO: 2542551 - protein, 17 aa, Entamoeba dispar
VHSYHSFFGSIKNLIKT

SEQ ID NO: 2542552 - protein, 22 aa, Entamoeba dispar
VHVPTFILYHNGQELKRIIEPK

SEQ ID NO: 2542553 - protein, 17 aa, Entamoeba dispar
VHVVIKNMFDLKEPKDL

SEQ ID NO: 2542554 - protein, 24 aa, Entamoeba dispar
VHYSSLIHFISNYLFESLIQQDYN

SEQ ID NO: 2542555 - protein, 18 aa, Entamoeba dispar
VIAFGMKEWAEELGASCF

SEQ ID NO: 2542556 - protein, 28 aa, Entamoeba dispar
VIAGSVDGAIWLWNGDNGKLITTLNSGI

SEQ ID NO: 2542557 - protein, 22 aa, Entamoeba dispar
VIAIDPQWLIELAPAFYQKSDG

SEQ ID NO: 2542558 - protein, 27 aa, Entamoeba dispar
VIANTTIISLLKWVTDDFLPTMTRIGI

SEQ ID NO: 2542559 - protein, 25 aa, Entamoeba dispar
VIAQICHDALQGLKYLHELHKIHRD

SEQ ID NO: 2542560 - protein, 33 aa, Entamoeba dispar
VIARREVICLPFYSFIVRYLYVRHENITQLLAY

SEQ ID NO: 2542561 - protein, 27 aa, Entamoeba dispar
VIASFGGLLLMLYGKPEKLSAYNMKDQ

SEQ ID NO: 2542562 - protein, 18 aa, Entamoeba dispar
VICHGVKFVLDFAQCYWN

SEQ ID NO: 2542563 - protein, 25 aa, Entamoeba dispar
VICKRAFQVFLLEQISKEQYIEKTT

SEQ ID NO: 2542564 - protein, 24 aa, Entamoeba dispar
VIDAYLSEKLPFTITALTANNIIY

SEQ ID NO: 2542565 - protein, 17 aa, Entamoeba dispar
VIDLIESKIPAGILAML

SEQ ID NO: 2542566 - protein, 18 aa, Entamoeba dispar
VIDLVKQKTMDWWSCVII

SEQ ID NO: 2542567 - protein, 25 aa, Entamoeba dispar
VIDNEINYELLQRLALSLHSFSKSF

SEQ ID NO: 2542568 - protein, 23 aa, Entamoeba dispar
VIDPFQIILLENEPILDEIEEEL

SEQ ID NO: 2542569 - protein, 23 aa, Entamoeba dispar
VIDSGEVMLLYNIVYSICASQDD

SEQ ID NO: 2542570 - protein, 20 aa, Entamoeba dispar
VIDVQFTRRNLLLAGGIYNS

SEQ ID NO: 2542571 - protein, 26 aa, Entamoeba dispar
VIEIETYRVFYRQVILGQRGHVDVLS

SEQ ID NO: 2542572 - protein, 27 aa, Entamoeba dispar
VIEITKIKWLLSFYKLIFGALEKEIDP

SEQ ID NO: 2542573 - protein, 30 aa, Entamoeba dispar
VIEKNVRIGWLYCQRGFETGYIPQNFTSLY

SEQ ID NO: 2542574 - protein, 29 aa, Entamoeba dispar
VIEKYKSWLIRFPTIQDLAKASLADVLEE

SEQ ID NO: 2542575 - protein, 17 aa, Entamoeba dispar
VIELKNQGYDEEHIRDA

SEQ ID NO: 2542576 - protein, 17 aa, Entamoeba dispar
VIELLRALGKAPTQQQE

SEQ ID NO: 2542577 - protein, 28 aa, Entamoeba dispar
VIELSKKLWCLFKKILKPTIYEIENCGT

SEQ ID NO: 2542578 - protein, 17 aa, Entamoeba dispar
VIELTIKLLPDAMKSGF

SEQ ID NO: 2542579 - protein, 25 aa, Entamoeba dispar
VIERARSVFSLPAQLRSAAANRDDD

SEQ ID NO: 2542580 - protein, 20 aa, Entamoeba dispar
VIERFFDICINIIKDLPKDP

SEQ ID NO: 2542581 - protein, 33 aa, Entamoeba dispar
VIERYQKPNPYPKGMIWIEFGKESKTKNIPFQE

SEQ ID NO: 2542582 - protein, 19 aa, Entamoeba dispar
VIFDFCNTGILFKTIQQTL

SEQ ID NO: 2542583 - protein, 19 aa, Entamoeba dispar
VIFKETVSCLSQMKSVALS

SEQ ID NO: 2542584 - protein, 18 aa, Entamoeba dispar
VIFLIMENLFYGKEPTKT

SEQ ID NO: 2542585 - protein, 18 aa, Entamoeba dispar
VIFPVLSNLFQKFIEVVP

SEQ ID NO: 2542586 - protein, 24 aa, Entamoeba dispar
VIFRQFSKIWPHKFINVTNGVTPR

SEQ ID NO: 2542587 - protein, 21 aa, Entamoeba dispar
VIFSVITRYLPEHAIKFLISI

SEQ ID NO: 2542588 - protein, 32 aa, Entamoeba dispar
VIGFFSSKKFVGAVDLPLWRVVENGIEEWFQL

SEQ ID NO: 2542589 - protein, 18 aa, Entamoeba dispar
VIGFYQEDIIPTLQLNKT

SEQ ID NO: 2542590 - protein, 19 aa, Entamoeba dispar
VIGIFNFHYEKSFTGYGIG

SEQ ID NO: 2542591 - protein, 17 aa, Entamoeba dispar
VIGIGEWYEKFKQLIDS

SEQ ID NO: 2542592 - protein, 24 aa, Entamoeba dispar
VIGKLQQKLFVQKKSTRGYGYDLA

SEQ ID NO: 2542593 - protein, 38 aa, Entamoeba dispar
VIGNFISMTLSFFPPYPFAKQIIINRLSSIKSRQLKID

SEQ ID NO: 2542594 - protein, 26 aa, Entamoeba dispar
VIHSKPSKYYFIQYSDEFDTVKNIFI

SEQ ID NO: 2542595 - protein, 18 aa, Entamoeba dispar
VIHYLVKNKFVDAIVVTA

SEQ ID NO: 2542596 - protein, 17 aa, Entamoeba dispar
VIIGPNGAGKSSIVCAI

SEQ ID NO: 2542597 - protein, 18 aa, Entamoeba dispar
VIINEKNIEVYPDGTLKP

SEQ ID NO: 2542598 - protein, 19 aa, Entamoeba dispar
VIIPIYYQNNQKVELYYNG

SEQ ID NO: 2542599 - protein, 27 aa, Entamoeba dispar
VIIPPIYHDIFFNKRQSVYFTRHRPNQ

SEQ ID NO: 2542600 - protein, 17 aa, Entamoeba dispar
VIIREPISQRSLRFGFV

SEQ ID NO: 2542601 - protein, 27 aa, Entamoeba dispar
VIKDKKKLKIVIIIRLIIEIVEKETDL

SEQ ID NO: 2542602 - protein, 21 aa, Entamoeba dispar
VIKEYMYCVNRIYNLLKRSHG

SEQ ID NO: 2542603 - protein, 24 aa, Entamoeba dispar
VIKKYEFAFCPLFCVGLTEEFDTN

SEQ ID NO: 2542604 - protein, 23 aa, Entamoeba dispar
VIKMYTEPLPIYPKSKLFCTQNL

SEQ ID NO: 2542605 - protein, 29 aa, Entamoeba dispar
VIKNEKLLIRYPDWRLLTPQEADQETETP

SEQ ID NO: 2542606 - protein, 25 aa, Entamoeba dispar
VIKQTLKIFIINKEFKLLLNDSFSI

SEQ ID NO: 2542607 - protein, 43 aa, Entamoeba dispar
VIKTKASRALLPIISILIQRITHVFERLFNVALDVIEKVFGEK

SEQ ID NO: 2542608 - protein, 40 aa, Entamoeba dispar
VIKYTKICQFIDAFIFKYKTFTIAHVAAIAFILLDPSKNL

SEQ ID NO: 2542609 - protein, 22 aa, Entamoeba dispar
VILDFINIICTFSRFGQTPEVN

SEQ ID NO: 2542610 - protein, 17 aa, Entamoeba dispar
VILEVLCNTLSPLNKQE

SEQ ID NO: 2542611 - protein, 18 aa, Entamoeba dispar
VILGYNKMMYQSVLELQK

SEQ ID NO: 2542612 - protein, 26 aa, Entamoeba dispar
VILQLFQCGHLCPCAPSTFPCFPAST

SEQ ID NO: 2542613 - protein, 17 aa, Entamoeba dispar
VILTINYSTLLLNIFKT

SEQ ID NO: 2542614 - protein, 20 aa, Entamoeba dispar
VILTSLFPDISKKQKSSYLT

SEQ ID NO: 2542615 - protein, 19 aa, Entamoeba dispar
VILYGTFLNGVVYSYIPGR

SEQ ID NO: 2542616 - protein, 18 aa, Entamoeba dispar
VINCIYVLMNIYVDFKEI

SEQ ID NO: 2542617 - protein, 19 aa, Entamoeba dispar
VINEFIIPSSISKIGDGCF

SEQ ID NO: 2542618 - protein, 28 aa, Entamoeba dispar
VINGLPGGPYYSAPFVLQAREKRSAKPS

SEQ ID NO: 2542619 - protein, 27 aa, Entamoeba dispar
VININKLTFIISKLSSISFLLSQKIIS

SEQ ID NO: 2542620 - protein, 26 aa, Entamoeba dispar
VININKLTFIISKLSSISFLLTQKII

SEQ ID NO: 2542621 - protein, 26 aa, Entamoeba dispar
VINKQFVQYWKYIVETLKISKRTSYI

SEQ ID NO: 2542622 - protein, 28 aa, Entamoeba dispar
VINKQFVQYWKYIVETLKISKRTSYIIT

SEQ ID NO: 2542623 - protein, 23 aa, Entamoeba dispar
VINLVLSFIYQMLQTVPIEYSDL

SEQ ID NO: 2542624 - protein, 29 aa, Entamoeba dispar
VINQPRIVFVVPPQFFTYHQITPEVNAYI

SEQ ID NO: 2542625 - protein, 19 aa, Entamoeba dispar
VINVGFLLENWRKVPRAFE

SEQ ID NO: 2542626 - protein, 19 aa, Entamoeba dispar
VINVMPGWKDGTKLRYEGY

SEQ ID NO: 2542627 - protein, 17 aa, Entamoeba dispar
VINYLDSFPLQKKPIHC

SEQ ID NO: 2542628 - protein, 18 aa, Entamoeba dispar
VINYRLEYRWFNQLSEKQ

SEQ ID NO: 2542629 - protein, 18 aa, Entamoeba dispar
VIPFLTFYSSRGKVTQLL

SEQ ID NO: 2542630 - protein, 18 aa, Entamoeba dispar
VIPINCSVSQLINQVNYE

SEQ ID NO: 2542631 - protein, 21 aa, Entamoeba dispar
VIQALRRSIYAGIILSSPQLL

SEQ ID NO: 2542632 - protein, 23 aa, Entamoeba dispar
VIQELFNFICTFIAHPFNEKVDC

SEQ ID NO: 2542633 - protein, 25 aa, Entamoeba dispar
VIQKLFEFGVVWQKSQLIKRLTGSF

SEQ ID NO: 2542634 - protein, 18 aa, Entamoeba dispar
VIQLCGKPIQTNLNHLLE

SEQ ID NO: 2542635 - protein, 18 aa, Entamoeba dispar
VIQLLQSKQLTLPFIVKP

SEQ ID NO: 2542636 - protein, 25 aa, Entamoeba dispar
VIRDQLTKEWVLEGGALVLADMGIC

SEQ ID NO: 2542637 - protein, 17 aa, Entamoeba dispar
VIRGQMCGAFQDVAFNA

SEQ ID NO: 2542638 - protein, 27 aa, Entamoeba dispar
VISILPVLNPPYFKQIFSWLISNLESQ

SEQ ID NO: 2542639 - protein, 30 aa, Entamoeba dispar
VISKLFSSLTQWLDYVLLDCCERMVYLTQK

SEQ ID NO: 2542640 - protein, 30 aa, Entamoeba dispar
VISNSHLLLHLYNHLIKIIPLPREEENLPE

SEQ ID NO: 2542641 - protein, 25 aa, Entamoeba dispar
VISSETFINLIKPLTELLTITNKNI

SEQ ID NO: 2542642 - protein, 30 aa, Entamoeba dispar
VISSMRRKSRLFLLIDGRIINKQTGKVLSV

SEQ ID NO: 2542643 - protein, 17 aa, Entamoeba dispar
VITFYEFNIESKTLNLY

SEQ ID NO: 2542644 - protein, 21 aa, Entamoeba dispar
VITKVNFLLNNTIIFVQTASN

SEQ ID NO: 2542645 - protein, 21 aa, Entamoeba dispar
  misc_feature (21)..(21): Xaa can be any naturally occurring amino acid
VITLVRFEGVYGLNLLWNMLX

SEQ ID NO: 2542646 - protein, 18 aa, Entamoeba dispar
VITNGILSPLFNTLMNRL

SEQ ID NO: 2542647 - protein, 17 aa, Entamoeba dispar
VITQLYRHANAKKLFIP

SEQ ID NO: 2542648 - protein, 34 aa, Entamoeba dispar
VITRSQMYFILNYAMKLVYECKTLLPVIPSTCLS

SEQ ID NO: 2542649 - protein, 25 aa, Entamoeba dispar
VITSSYFINYIGLGVKYVLRVIGIK

SEQ ID NO: 2542650 - protein, 17 aa, Entamoeba dispar
VIVDFMFTPGAEAPTEM

SEQ ID NO: 2542651 - protein, 24 aa, Entamoeba dispar
VIVGSFFDYFVPYNLKDFYEDATE

SEQ ID NO: 2542652 - protein, 17 aa, Entamoeba dispar
VIVPRTKGGFSYGYVDS

SEQ ID NO: 2542653 - protein, 23 aa, Entamoeba dispar
VIWSIGVIFFMLVHGHHPLEIGK

SEQ ID NO: 2542654 - protein, 25 aa, Entamoeba dispar
VIYQKLIKMFKEINIPYIIAPGEAE

SEQ ID NO: 2542655 - protein, 19 aa, Entamoeba dispar
VIYSPPLPSQIISVEYFYP

SEQ ID NO: 2542656 - protein, 18 aa, Entamoeba dispar
VIYSRWVPHNSKVLKIKF

SEQ ID NO: 2542657 - protein, 41 aa, Entamoeba dispar
VKADIWALGCTIIELITGNPPYYDLNPTAALYKIVNDDYPP

SEQ ID NO: 2542658 - protein, 24 aa, Entamoeba dispar
VKAHPFFKGFDFNCIEKNIPPYLP

SEQ ID NO: 2542659 - protein, 19 aa, Entamoeba dispar
VKAKLYNETIDFLDSAIIA

SEQ ID NO: 2542660 - protein, 25 aa, Entamoeba dispar
VKAPKGVLLYGPPGTGKTLLARALA

SEQ ID NO: 2542661 - protein, 29 aa, Entamoeba dispar
VKAQSIIRGFLYHKRYITYKAFSATKFQQ

SEQ ID NO: 2542662 - protein, 18 aa, Entamoeba dispar
VKCDYKQMILIQLKDIKQ

SEQ ID NO: 2542663 - protein, 20 aa, Entamoeba dispar
VKCILLIFTIADHHILQQYD

SEQ ID NO: 2542664 - protein, 24 aa, Entamoeba dispar
VKDDQLFTVYNFVQGFGFDGFVFV

SEQ ID NO: 2542665 - protein, 19 aa, Entamoeba dispar
VKDLILEPKFEGCILPRIP

SEQ ID NO: 2542666 - protein, 24 aa, Entamoeba dispar
VKDPDNFIIPPKQYKAIKPMDDDE

SEQ ID NO: 2542667 - protein, 30 aa, Entamoeba dispar
VKEAILLYKYMLQYLIFRKVSNDTIKLILI

SEQ ID NO: 2542668 - protein, 27 aa, Entamoeba dispar
VKEEGKGYIFIFPKNTWSYVNEYCSTE

SEQ ID NO: 2542669 - protein, 26 aa, Entamoeba dispar
VKEGRYIRNMLYETLINEYINKQTLI

SEQ ID NO: 2542670 - protein, 17 aa, Entamoeba dispar
VKEIIISIVNLHKEKEL

SEQ ID NO: 2542671 - protein, 35 aa, Entamoeba dispar
VKEIKIRPLDPYFYCSKNYKIVMKGLLQGFHCVYS

SEQ ID NO: 2542672 - protein, 20 aa, Entamoeba dispar
VKEIMSLKGIYIVQLISEFM

SEQ ID NO: 2542673 - protein, 26 aa, Entamoeba dispar
VKEISPVPKHRLIPQKTKGVPEITTM

SEQ ID NO: 2542674 - protein, 23 aa, Entamoeba dispar
VKEKLPLLVKVQGHLVLASLIFG

SEQ ID NO: 2542675 - protein, 29 aa, Entamoeba dispar
VKEMGINYIIRLLYDGYPNTRYAAFRYIE

SEQ ID NO: 2542676 - protein, 28 aa, Entamoeba dispar
VKENGPKLYYWCIFKPKNKDPKPGILEV

SEQ ID NO: 2542677 - protein, 30 aa, Entamoeba dispar
VKENWIGIYQPIVSQLKLNIRMNPSKKIIQ

SEQ ID NO: 2542678 - protein, 23 aa, Entamoeba dispar
VKERYFYLFNDATVIYGEQQGKK

SEQ ID NO: 2542679 - protein, 19 aa, Entamoeba dispar
VKFLSTLSLILIQNNIHYE

SEQ ID NO: 2542680 - protein, 17 aa, Entamoeba dispar
VKFTFSNGSLCCDDSQL

SEQ ID NO: 2542681 - protein, 18 aa, Entamoeba dispar
VKFVLDFAQCYWNTRLET

SEQ ID NO: 2542682 - protein, 23 aa, Entamoeba dispar
VKGHLIKMMLYKIKQKKDLLKEI

SEQ ID NO: 2542683 - protein, 25 aa, Entamoeba dispar
VKGITHFPVVLHFIQILNSVVSEKL

SEQ ID NO: 2542684 - protein, 23 aa, Entamoeba dispar
VKGPELLTMWFGESEANVRNIFD

SEQ ID NO: 2542685 - protein, 23 aa, Entamoeba dispar
VKGQLLKIFITFPDPHFKNSVKR

SEQ ID NO: 2542686 - protein, 26 aa, Entamoeba dispar
VKGSIPKELILWASTKNVPIVSQDWL

SEQ ID NO: 2542687 - protein, 21 aa, Entamoeba dispar
VKHFDPRLFTSHFNHIFVIVQ

SEQ ID NO: 2542688 - protein, 24 aa, Entamoeba dispar
VKHLGEGKYFIRYSLPAEKGEYHI

SEQ ID NO: 2542689 - protein, 24 aa, Entamoeba dispar
VKIIAMQYILLIEALTNAHIVYNK

SEQ ID NO: 2542690 - protein, 17 aa, Entamoeba dispar
VKIPKGIRVYSSKILLS

SEQ ID NO: 2542691 - protein, 18 aa, Entamoeba dispar
VKIRAVLLHYFIQVSEEM

SEQ ID NO: 2542692 - protein, 22 aa, Entamoeba dispar
VKKAFIITKHGSKECTGNGYAI

SEQ ID NO: 2542693 - protein, 25 aa, Entamoeba dispar
VKKDFVDCQFLYNCILYLVQHNYHS

SEQ ID NO: 2542694 - protein, 26 aa, Entamoeba dispar
VKKENVVVIILYMININLINQISEHF

SEQ ID NO: 2542695 - protein, 23 aa, Entamoeba dispar
VKKFIEAYFINHEKHMLLTQITS

SEQ ID NO: 2542696 - protein, 23 aa, Entamoeba dispar
VKKIHIIGEWKGILDERAMGIVI

SEQ ID NO: 2542697 - protein, 29 aa, Entamoeba dispar
VKKILLKSTYLLTLDIFNQGYYTPISNNQ

SEQ ID NO: 2542698 - protein, 26 aa, Entamoeba dispar
VKKKKYFKLLVILSTIYELILTNKQF

SEQ ID NO: 2542699 - protein, 18 aa, Entamoeba dispar
VKKKNTKALIVGRSFLQE

SEQ ID NO: 2542700 - protein, 38 aa, Entamoeba dispar
VKKLLKYQSGLYYFVHKRKLIIQIFVYEHLSVHVVIRS

SEQ ID NO: 2542701 - protein, 22 aa, Entamoeba dispar
VKKNFIAILTFCDGQTPKILSS

SEQ ID NO: 2542702 - protein, 22 aa, Entamoeba dispar
VKKNFIAMLTFCDGKTPQVIGA

SEQ ID NO: 2542703 - protein, 26 aa, Entamoeba dispar
VKKPDDFFMYCLVSLHRFIIYSTTVN

SEQ ID NO: 2542704 - protein, 24 aa, Entamoeba dispar
VKKPTSYPPALPKTKQLKNYIIKK

SEQ ID NO: 2542705 - protein, 25 aa, Entamoeba dispar
VKKQIPQFILFTTPKNCREVSQDEF

SEQ ID NO: 2542706 - protein, 24 aa, Entamoeba dispar
VKKQSLIIIIPPNLKSLTINSCKS

SEQ ID NO: 2542707 - protein, 22 aa, Entamoeba dispar
VKKRLSEVMSRDIEQLRAEAEK

SEQ ID NO: 2542708 - protein, 29 aa, Entamoeba dispar
VKKSKPQPPPTAFQLHKADTELGNKPWKE

SEQ ID NO: 2542709 - protein, 30 aa, Entamoeba dispar
VKKTFKPEFLNRLDDIIIFSPLSEKELKEI

SEQ ID NO: 2542710 - protein, 33 aa, Entamoeba dispar
VKKTFKPEFLNRLDDIIIFSPLSEKELKEIVKL

SEQ ID NO: 2542711 - protein, 26 aa, Entamoeba dispar
VKKTSLFRIYFLTNDKGNPFIRTLET

SEQ ID NO: 2542712 - protein, 25 aa, Entamoeba dispar
VKKWKKRYVVWKDDKLFFFEKNYGK

SEQ ID NO: 2542713 - protein, 27 aa, Entamoeba dispar
VKKYGFEWDPTGKLLSLFSAPRYEGLD

SEQ ID NO: 2542714 - protein, 18 aa, Entamoeba dispar
VKLAPPPSIPFIGSILTD

SEQ ID NO: 2542715 - protein, 17 aa, Entamoeba dispar
VKLFEMLNDKESKNIVE

SEQ ID NO: 2542716 - protein, 21 aa, Entamoeba dispar
VKLMELIDFAVQFDNKKLANP

SEQ ID NO: 2542717 - protein, 23 aa, Entamoeba dispar
VKLMLKKLQTILLDPAKKMDIHR

SEQ ID NO: 2542718 - protein, 20 aa, Entamoeba dispar
VKLQISILTFYKAYIVSSLW

SEQ ID NO: 2542719 - protein, 28 aa, Entamoeba dispar
VKMDGTRILFLPQLPESLQIFLGPNLRP

SEQ ID NO: 2542720 - protein, 31 aa, Entamoeba dispar
VKMLESYNNLYVLYKSSLSQSLFVNQTQPKT

SEQ ID NO: 2542721 - protein, 17 aa, Entamoeba dispar
VKMSALKIIHVKIIIKP

SEQ ID NO: 2542722 - protein, 31 aa, Entamoeba dispar
VKNIQAISFYLITPIQRIPRYELLIRDMLKD

SEQ ID NO: 2542723 - protein, 22 aa, Entamoeba dispar
VKNKIYIELYFDKLINDTSQTS

SEQ ID NO: 2542724 - protein, 22 aa, Entamoeba dispar
VKNLLEILDTLSGIPNSSHLLI

SEQ ID NO: 2542725 - protein, 22 aa, Entamoeba dispar
VKNLPIFKWIINGSKMPKKGYP

SEQ ID NO: 2542726 - protein, 17 aa, Entamoeba dispar
VKNSRIWLNSALSGRTK

SEQ ID NO: 2542727 - protein, 26 aa, Entamoeba dispar
VKNTDFKCYFTWFYETTQGVIKLGES

SEQ ID NO: 2542728 - protein, 27 aa, Entamoeba dispar
VKPDLMITISLFIGNLLKLQEFIKDET

SEQ ID NO: 2542729 - protein, 41 aa, Entamoeba dispar
VKPFCSCHIDCYVFIFLNLTQWKSYYFKFTSEPSLWINPQF

SEQ ID NO: 2542730 - protein, 29 aa, Entamoeba dispar
VKPFPKALEILKFLKQKGLKIAIATSSAK

SEQ ID NO: 2542731 - protein, 18 aa, Entamoeba dispar
VKPFTLLLSVGDCRAFYI

SEQ ID NO: 2542732 - protein, 24 aa, Entamoeba dispar
VKPIIQYLVLCLIEKAKGAITEIT

SEQ ID NO: 2542733 - protein, 30 aa, Entamoeba dispar
VKPKSPFKKEINWTILEKLDLKEFDREIER

SEQ ID NO: 2542734 - protein, 22 aa, Entamoeba dispar
VKPLQLWMRQMNKKKWQFEASP

SEQ ID NO: 2542735 - protein, 25 aa, Entamoeba dispar
VKPQKFVYYEFYEQTDHIGTEYKTQ

SEQ ID NO: 2542736 - protein, 23 aa, Entamoeba dispar
VKQAVAVALKFGLEKEIWDEMVK

SEQ ID NO: 2542737 - protein, 23 aa, Entamoeba dispar
VKQCVLDWSFKSLFDQYAKGKNY

SEQ ID NO: 2542738 - protein, 25 aa, Entamoeba dispar
VKQEEFYIVLNYMQQLNLTYKKSHE

SEQ ID NO: 2542739 - protein, 31 aa, Entamoeba dispar
VKQVMELIPEFFYFPEFLKNFDHFDLKKRNE

SEQ ID NO: 2542740 - protein, 26 aa, Entamoeba dispar
VKRTEYDDMFLNELKKLIEKKDITSQ

SEQ ID NO: 2542741 - protein, 20 aa, Entamoeba dispar
VKRTLGYHYLFKDNYVMGKR

SEQ ID NO: 2542742 - protein, 24 aa, Entamoeba dispar
VKRTVTFKLSLKRPIPLVGFCTYF

SEQ ID NO: 2542743 - protein, 21 aa, Entamoeba dispar
VKSIDMFCFYKCKSLASIDIP

SEQ ID NO: 2542744 - protein, 25 aa, Entamoeba dispar
VKSLGYHFISIGYWCFYECSSLTSM

SEQ ID NO: 2542745 - protein, 22 aa, Entamoeba dispar
VKSLGYWCFCKCISLTTITIPT

SEQ ID NO: 2542746 - protein, 23 aa, Entamoeba dispar
VKSPNILIEANYIGKLIIVDDVP

SEQ ID NO: 2542747 - protein, 18 aa, Entamoeba dispar
VKSPTGYPVIIFSIGIDL

SEQ ID NO: 2542748 - protein, 23 aa, Entamoeba dispar
VKSRALFYLNIINSEITITLEKC

SEQ ID NO: 2542749 - protein, 22 aa, Entamoeba dispar
VKSTLYVLSQIILEMIRKKGVN

SEQ ID NO: 2542750 - protein, 31 aa, Entamoeba dispar
VKSTPQNTFNLLFFIRTVFPVFHAPQHVMDT

SEQ ID NO: 2542751 - protein, 20 aa, Entamoeba dispar
VKSVLFIHKIALKTQRIDSI

SEQ ID NO: 2542752 - protein, 23 aa, Entamoeba dispar
VKSYIYWHNLISQWVAYEICRHE

SEQ ID NO: 2542753 - protein, 22 aa, Entamoeba dispar
VKTFIDRTVPFAIKNTLNRKVG

SEQ ID NO: 2542754 - protein, 24 aa, Entamoeba dispar
VKTIFDMHLYGPAMLACFPLQDIL

SEQ ID NO: 2542755 - protein, 25 aa, Entamoeba dispar
VKTIMKLFRKTIISGKLSLIERMKK

SEQ ID NO: 2542756 - protein, 30 aa, Entamoeba dispar
VKTLLNTRMHLWLEYYTINQAMSSNHDSDS

SEQ ID NO: 2542757 - protein, 17 aa, Entamoeba dispar
VKTLPINASFHGICLTP

SEQ ID NO: 2542758 - protein, 21 aa, Entamoeba dispar
VKTMRFRTRLFSSAYNQQTET

SEQ ID NO: 2542759 - protein, 24 aa, Entamoeba dispar
VKTNTFIYVTFSLLSEIIIENESS

SEQ ID NO: 2542760 - protein, 30 aa, Entamoeba dispar
VKVISDGFPIKGVWKHICIVWTKCYNCYSQ

SEQ ID NO: 2542761 - protein, 27 aa, Entamoeba dispar
VKVISDTFPIKDIWKHVCIVWTKCYNC

SEQ ID NO: 2542762 - protein, 25 aa, Entamoeba dispar
VKVSYCNIMLYIPIKKFTVRVLNGN

SEQ ID NO: 2542763 - protein, 28 aa, Entamoeba dispar
VKVTSVPTILVLNPGSWKALQTRAKEFE

SEQ ID NO: 2542764 - protein, 21 aa, Entamoeba dispar
VKWISEVTHFCKDAKIVLVAT

SEQ ID NO: 2542765 - protein, 37 aa, Entamoeba dispar
VKYEQKYFITATLPQIMILLLFNTHKVLKISEIALHL

SEQ ID NO: 2542766 - protein, 24 aa, Entamoeba dispar
VKYKKYRFMTIEPIKKNGYNHCIG

SEQ ID NO: 2542767 - protein, 22 aa, Entamoeba dispar
VKYPRWFEFYDMIQVIETLHKK

SEQ ID NO: 2542768 - protein, 49 aa, Entamoeba dispar
VKYQPYKIEIPPVSPPTYLYFKDFQLQPMKFVITFKLGSGLDVLPSNGI

SEQ ID NO: 2542769 - protein, 22 aa, Entamoeba dispar
VKYTPSPKFFTFSPSSLTSNSN

SEQ ID NO: 2542770 - protein, 21 aa, Entamoeba dispar
VLAGMYQIYINPKTPVNKIDE

SEQ ID NO: 2542771 - protein, 20 aa, Entamoeba dispar
VLCLLYALKVKYPGSIFICR

SEQ ID NO: 2542772 - protein, 19 aa, Entamoeba dispar
VLCNSPSFRRQVTDIDFIA

SEQ ID NO: 2542773 - protein, 23 aa, Entamoeba dispar
VLDDIVPCCSVPVRLPSVGFDNL

SEQ ID NO: 2542774 - protein, 26 aa, Entamoeba dispar
VLDIDGKLWSLYFKIKLLSSDQPTKI

SEQ ID NO: 2542775 - protein, 25 aa, Entamoeba dispar
VLDKKEVFDILQSIDPKITIQDVNE

SEQ ID NO: 2542776 - protein, 22 aa, Entamoeba dispar
VLDLNAICFVAQSSNARLTANQ

SEQ ID NO: 2542777 - protein, 24 aa, Entamoeba dispar
VLDLNAICFVAQSSNPRLTASQKY

SEQ ID NO: 2542778 - protein, 24 aa, Entamoeba dispar
VLDLNAICFVAQSSNPRLTTSQKY

SEQ ID NO: 2542779 - protein, 17 aa, Entamoeba dispar
VLDPALLRSGRFDRKIE

SEQ ID NO: 2542780 - protein, 23 aa, Entamoeba dispar
VLDVFPDLKYFVTTLQKVICSCY

SEQ ID NO: 2542781 - protein, 20 aa, Entamoeba dispar
VLEGILRGIPIVEENWVLQS

SEQ ID NO: 2542782 - protein, 31 aa, Entamoeba dispar
VLEKIGTPVYSFLCSYLLKTNTPQSKGLFIG

SEQ ID NO: 2542783 - protein, 17 aa, Entamoeba dispar
VLEKIRFSARTLKRRYD

SEQ ID NO: 2542784 - protein, 18 aa, Entamoeba dispar
VLELPSEIKLPATIQLYC

SEQ ID NO: 2542785 - protein, 20 aa, Entamoeba dispar
VLENMRIISKLLNKWNKMTT

SEQ ID NO: 2542786 - protein, 17 aa, Entamoeba dispar
VLEPIYYHLTFAIDFVG

SEQ ID NO: 2542787 - protein, 18 aa, Entamoeba dispar
VLERVSSIGKPLTGLIPT

SEQ ID NO: 2542788 - protein, 18 aa, Entamoeba dispar
VLEYGFEFAQKKMGIDRL

SEQ ID NO: 2542789 - protein, 24 aa, Entamoeba dispar
VLEYPNDLLIALKALFNSITVKYP

SEQ ID NO: 2542790 - protein, 22 aa, Entamoeba dispar
VLFDFIEHFTIASLVPIKERVE

SEQ ID NO: 2542791 - protein, 42 aa, Entamoeba dispar
VLFEAESYIILYHYKIWAKDMYLLYFWQGRSCAVIDKGTSAR

SEQ ID NO: 2542792 - protein, 18 aa, Entamoeba dispar
VLFVLVMEKIMGRIDLPF

SEQ ID NO: 2542793 - protein, 19 aa, Entamoeba dispar
VLGCDGLWDTLNGIQIKEV

SEQ ID NO: 2542794 - protein, 36 aa, Entamoeba dispar
VLGKFTSLREKVESGLILNVLIEILCKGDGREEHPI

SEQ ID NO: 2542795 - protein, 23 aa, Entamoeba dispar
VLGRIQQRLFVGKSKKGFGYITD

SEQ ID NO: 2542796 - protein, 21 aa, Entamoeba dispar
VLGYQEVITPNIFLSTLWETS

SEQ ID NO: 2542797 - protein, 20 aa, Entamoeba dispar
VLHINPFHFKPLKCGLPTKN

SEQ ID NO: 2542798 - protein, 18 aa, Entamoeba dispar
VLHTKIYGKRNLMLLIIT

SEQ ID NO: 2542799 - protein, 20 aa, Entamoeba dispar
VLIEGYAITFPFKNKKMIAA

SEQ ID NO: 2542800 - protein, 20 aa, Entamoeba dispar
VLIICQYLKTPEDFINIICV

SEQ ID NO: 2542801 - protein, 20 aa, Entamoeba dispar
VLIKSLSSLLLWNLSDEILD

SEQ ID NO: 2542802 - protein, 18 aa, Entamoeba dispar
VLIMSPFLEKGMARRFNN

SEQ ID NO: 2542803 - protein, 18 aa, Entamoeba dispar
VLISIKIPDNLQIINGKN

SEQ ID NO: 2542804 - protein, 18 aa, Entamoeba dispar
VLKGQWIEYFKKGISEGI

SEQ ID NO: 2542805 - protein, 17 aa, Entamoeba dispar
VLKISKYVKTRTSVQVR

SEQ ID NO: 2542806 - protein, 17 aa, Entamoeba dispar
VLKQFLEQVIRDSVTYT

SEQ ID NO: 2542807 - protein, 18 aa, Entamoeba dispar
VLKQFLEQVIRDSVTYTE

SEQ ID NO: 2542808 - protein, 19 aa, Entamoeba dispar
VLKRSIELYPFEETLSLLQ

SEQ ID NO: 2542809 - protein, 17 aa, Entamoeba dispar
VLKSYFDIIIQPALTPE

SEQ ID NO: 2542810 - protein, 28 aa, Entamoeba dispar
VLLDKISLFFGFPITFYKAHCPLQTNGL

SEQ ID NO: 2542811 - protein, 19 aa, Entamoeba dispar
VLLKDPYAMEYIGLKGQHC

SEQ ID NO: 2542812 - protein, 18 aa, Entamoeba dispar
VLLKMILIGDSGVGKSSL

SEQ ID NO: 2542813 - protein, 17 aa, Entamoeba dispar
VLLKPRKIKQKNSKSLA

SEQ ID NO: 2542814 - protein, 23 aa, Entamoeba dispar
VLLNIAVGPLHKQKELEKQRLVE

SEQ ID NO: 2542815 - protein, 18 aa, Entamoeba dispar
VLLPGHLYQTVIKEEIQN

SEQ ID NO: 2542816 - protein, 19 aa, Entamoeba dispar
VLLRIDFAATDIKWSPNET

SEQ ID NO: 2542817 - protein, 19 aa, Entamoeba dispar
VLLSYFFSRGKIVDLLIKL

SEQ ID NO: 2542818 - protein, 17 aa, Entamoeba dispar
VLLTLNTTKWELSCTTG

SEQ ID NO: 2542819 - protein, 19 aa, Entamoeba dispar
VLLVCMNRYRKNCKSELIL

SEQ ID NO: 2542820 - protein, 25 aa, Entamoeba dispar
VLMGRVYPLKLGYIGVVNRSQQDIN

SEQ ID NO: 2542821 - protein, 34 aa, Entamoeba dispar
VLNDYNKFIIPLQKLPLYLFPQDQIDSIWPNKNE

SEQ ID NO: 2542822 - protein, 23 aa, Entamoeba dispar
VLNETITLPLKRSELFFSKLTQG

SEQ ID NO: 2542823 - protein, 27 aa, Entamoeba dispar
VLNKCYFNFYQLPKSIRHLYIDNSLNV

SEQ ID NO: 2542824 - protein, 23 aa, Entamoeba dispar
VLNKIIYQIALKYPQQTLWHILM

SEQ ID NO: 2542825 - protein, 39 aa, Entamoeba dispar
VLNKVPISSYKLYQLTIQSPYVIFGERIVDLAVARLMNN

SEQ ID NO: 2542826 - protein, 17 aa, Entamoeba dispar
VLNRFLELYQKHKDQRN

SEQ ID NO: 2542827 - protein, 26 aa, Entamoeba dispar
VLPQINSLRKVPYAKHILVLLQNYGV

SEQ ID NO: 2542828 - protein, 18 aa, Entamoeba dispar
VLQFIPFYHTTQVVHILK

SEQ ID NO: 2542829 - protein, 19 aa, Entamoeba dispar
VLQFYAIHLSEALRYEEGL

SEQ ID NO: 2542830 - protein, 21 aa, Entamoeba dispar
VLQIKEEYLNLVKLLNGLVIE

SEQ ID NO: 2542831 - protein, 27 aa, Entamoeba dispar
VLQLRSEIQWYFRKYYHDNHFTEIQPP

SEQ ID NO: 2542832 - protein, 18 aa, Entamoeba dispar
VLQPTLERIFTDYKKLTK

SEQ ID NO: 2542833 - protein, 23 aa, Entamoeba dispar
VLQQCLSVLDMYLRTDYIAEGND

SEQ ID NO: 2542834 - protein, 32 aa, Entamoeba dispar
VLQRFPTLRTRSQIMWLFCSLVRRSENKQINS

SEQ ID NO: 2542835 - protein, 24 aa, Entamoeba dispar
VLQSFTHLSFSPMGDMLLATSNDS

SEQ ID NO: 2542836 - protein, 35 aa, Entamoeba dispar
VLQVAEPWIQKGIHPTIIISGFLDALEDALKSLHE

SEQ ID NO: 2542837 - protein, 21 aa, Entamoeba dispar
VLQVNYIPIQYTFTVKPNEVN

SEQ ID NO: 2542838 - protein, 24 aa, Entamoeba dispar
VLREFRCCFILYYGDTTIISKRAG

SEQ ID NO: 2542839 - protein, 18 aa, Entamoeba dispar
VLRNIYIELTPFSEANNL

SEQ ID NO: 2542840 - protein, 27 aa, Entamoeba dispar
VLRSINRNALFRLDIRGLALTRQDAGQ

SEQ ID NO: 2542841 - protein, 19 aa, Entamoeba dispar
VLRSPYIIRYYTSVLRQEE

SEQ ID NO: 2542842 - protein, 20 aa, Entamoeba dispar
VLRTYALYNWRIGYGQGMND

SEQ ID NO: 2542843 - protein, 17 aa, Entamoeba dispar
VLRYKNAFISCIADGCG

SEQ ID NO: 2542844 - protein, 44 aa, Entamoeba dispar
VLRYQNIKGRKRTYPIWRRVNYYDYSWGMTINDFPELKREEEQW

SEQ ID NO: 2542845 - protein, 18 aa, Entamoeba dispar
VLSLMYDYGLNRTKLQER

SEQ ID NO: 2542846 - protein, 30 aa, Entamoeba dispar
VLSMDNMYSAWNPQLLISIKTPQSVNAVNS

SEQ ID NO: 2542847 - protein, 32 aa, Entamoeba dispar
VLSNTLYSHRFFPYYSFSLLAGINSKGKAVTY

SEQ ID NO: 2542848 - protein, 25 aa, Entamoeba dispar
VLSQFFSLWNSFIPKKLPSLSDKKI

SEQ ID NO: 2542849 - protein, 25 aa, Entamoeba dispar
VLSSLRIHYINYIELFLKNNNGIFC

SEQ ID NO: 2542850 - protein, 31 aa, Entamoeba dispar
VLSTRLYINLYEDMLPSLKYLLPLLKVNENQ

SEQ ID NO: 2542851 - protein, 18 aa, Entamoeba dispar
VLTDPIFHFPKVSTGSKA

SEQ ID NO: 2542852 - protein, 19 aa, Entamoeba dispar
VLTKNKYIWKILRNVSDKC

SEQ ID NO: 2542853 - protein, 26 aa, Entamoeba dispar
VLTPEIIKFIPNRLHLLIQTLGDEYG

SEQ ID NO: 2542854 - protein, 17 aa, Entamoeba dispar
VLTSFLPLTIRLLTIPE

SEQ ID NO: 2542855 - protein, 20 aa, Entamoeba dispar
VLTSLRLREFKYKTLTVTKA

SEQ ID NO: 2542856 - protein, 32 aa, Entamoeba dispar
VLTYQEWFKMLWYKGLFTYYREDLHLSEDEIQ

SEQ ID NO: 2542857 - protein, 18 aa, Entamoeba dispar
VLVILDSLNHRLVLFNVD

SEQ ID NO: 2542858 - protein, 26 aa, Entamoeba dispar
VLVKQPPKIPPFIHPNRDKLSQENND

SEQ ID NO: 2542859 - protein, 32 aa, Entamoeba dispar
VLYANAFMHYGTTNIMFLKDNNDWIINASNWG

SEQ ID NO: 2542860 - protein, 19 aa, Entamoeba dispar
VLYGPRGLLNFLEKNDLIC

SEQ ID NO: 2542861 - protein, 18 aa, Entamoeba dispar
VMAATNRPFDLDDAVLRR

SEQ ID NO: 2542862 - protein, 18 aa, Entamoeba dispar
VMAVLLIESSYNGISNKR

SEQ ID NO: 2542863 - protein, 20 aa, Entamoeba dispar
VMDNLVQNIVFGLRGNQNTE

SEQ ID NO: 2542864 - protein, 27 aa, Entamoeba dispar
VMDNQLFKFILKQYEFDELGKGIILLD

SEQ ID NO: 2542865 - protein, 17 aa, Entamoeba dispar
VMEFCAHFSLFDVLNDP

SEQ ID NO: 2542866 - protein, 35 aa, Entamoeba dispar
VMEKFVMGPGKRLRPLSLLLFFIGGGGKIEERKGV

SEQ ID NO: 2542867 - protein, 19 aa, Entamoeba dispar
VMERLLKKLDKIKNGIIVI

SEQ ID NO: 2542868 - protein, 27 aa, Entamoeba dispar
VMGNVFYEYYPGKHLFPFCIPLKNFPH

SEQ ID NO: 2542869 - protein, 21 aa, Entamoeba dispar
VMGNYLLKLIGVAWKETIKKN

SEQ ID NO: 2542870 - protein, 25 aa, Entamoeba dispar
VMGQFDRVLVDAPCTGLGIISRDAA

SEQ ID NO: 2542871 - protein, 29 aa, Entamoeba dispar
VMHEKTYGLDIFKVRIRKVGKAKEIPKIF

SEQ ID NO: 2542872 - protein, 20 aa, Entamoeba dispar
VMIISFLQDYFRKPHSFKID

SEQ ID NO: 2542873 - protein, 26 aa, Entamoeba dispar
VMISEHSHHYWLESIKKLKAEFPNKV

SEQ ID NO: 2542874 - protein, 24 aa, Entamoeba dispar
VMIYSLPQYFQTKTLLSILNESDI

SEQ ID NO: 2542875 - protein, 24 aa, Entamoeba dispar
VMKDNIYIIDILSQNVKKVISAPI

SEQ ID NO: 2542876 - protein, 19 aa, Entamoeba dispar
VMKGLLQGFHCVYSGMVLS

SEQ ID NO: 2542877 - protein, 25 aa, Entamoeba dispar
VMKKSHLFIIVIATNQDIFGGFISH

SEQ ID NO: 2542878 - protein, 25 aa, Entamoeba dispar
VMKYSNLHFIGIMTIGMVGDSKKNF

SEQ ID NO: 2542879 - protein, 22 aa, Entamoeba dispar
VMMALQTIVTCFSLYTSTPFEI

SEQ ID NO: 2542880 - protein, 25 aa, Entamoeba dispar
VMNCKSQVIGLILFTDTRKNTTTII

SEQ ID NO: 2542881 - protein, 24 aa, Entamoeba dispar
VMNIELLHYTLTLYYNILIQLHSA

SEQ ID NO: 2542882 - protein, 25 aa, Entamoeba dispar
VMNKSGYFMVPSISELRELEEDKLN

SEQ ID NO: 2542883 - protein, 17 aa, Entamoeba dispar
VMNLILELNQKIGTTII

SEQ ID NO: 2542884 - protein, 42 aa, Entamoeba dispar
VMNSNFALPIPIKISAHYLLPKGIPFITFLRNDVIITITSIK

SEQ ID NO: 2542885 - protein, 24 aa, Entamoeba dispar
VMRERIILVIGYIVGIFYHAHNYK

SEQ ID NO: 2542886 - protein, 23 aa, Entamoeba dispar
VMRRIFSFAPFPFHPAVPLFQEL

SEQ ID NO: 2542887 - protein, 18 aa, Entamoeba dispar
VMSAFFHPKPNIPLIVSA

SEQ ID NO: 2542888 - protein, 20 aa, Entamoeba dispar
VMSLSFIKRRITIDPVIVTI

SEQ ID NO: 2542889 - protein, 20 aa, Entamoeba dispar
VMTALIPRNSTIPAKKSQVF

SEQ ID NO: 2542890 - protein, 17 aa, Entamoeba dispar
VMVDLFLHRELDAKKDA

SEQ ID NO: 2542891 - protein, 19 aa, Entamoeba dispar
VMVRALEQLYYLNALDDKT

SEQ ID NO: 2542892 - protein, 18 aa, Entamoeba dispar
VMVTIYLSQLVKSVLAVH

SEQ ID NO: 2542893 - protein, 22 aa, Entamoeba dispar
VMYGLRGLLNFLNKNDLICLVR

SEQ ID NO: 2542894 - protein, 28 aa, Entamoeba dispar
VNAEKQIINILKIDDLMDIDLSKTMTAE

SEQ ID NO: 2542895 - protein, 24 aa, Entamoeba dispar
VNALSSYLVFLNGQLLGIHQNPIH

SEQ ID NO: 2542896 - protein, 17 aa, Entamoeba dispar
VNALYGIKITDDFRYII

SEQ ID NO: 2542897 - protein, 18 aa, Entamoeba dispar
VNALYGIKITDDFRYIII

SEQ ID NO: 2542898 - protein, 25 aa, Entamoeba dispar
VNAVFLHFQSVLSINKELLKNMTEL

SEQ ID NO: 2542899 - protein, 25 aa, Entamoeba dispar
VNCIETIFTCSLFESLWPPSYEDNP

SEQ ID NO: 2542900 - protein, 23 aa, Entamoeba dispar
VNCKVYNVTPFWAELITRELPSI

SEQ ID NO: 2542901 - protein, 18 aa, Entamoeba dispar
VNCNQLINFNIPSTLHTL

SEQ ID NO: 2542902 - protein, 18 aa, Entamoeba dispar
VNCTFYTRIFNKSTINLP

SEQ ID NO: 2542903 - protein, 34 aa, Entamoeba dispar
VNDGSVILTINYSTLLLNIFKTAFTDTNKFRVIV

SEQ ID NO: 2542904 - protein, 17 aa, Entamoeba dispar
VNDILDIQIIIQHLSFG

SEQ ID NO: 2542905 - protein, 22 aa, Entamoeba dispar
VNDLLLMWDVTKPKISTLKHSK

SEQ ID NO: 2542906 - protein, 24 aa, Entamoeba dispar
VNDNPFHWIVSFFGFNDNTKIGKD

SEQ ID NO: 2542907 - protein, 24 aa, Entamoeba dispar
VNDPKHFVFAIRNKNKIQGKYEAD

SEQ ID NO: 2542908 - protein, 32 aa, Entamoeba dispar
VNDRVSLPTVWKYFFLFSDILVVTEVIQLQGK

SEQ ID NO: 2542909 - protein, 18 aa, Entamoeba dispar
VNDSEPLRLESFSTIPIS

SEQ ID NO: 2542910 - protein, 25 aa, Entamoeba dispar
VNECRQWIYQQIQSINFLKQTQDIQ

SEQ ID NO: 2542911 - protein, 19 aa, Entamoeba dispar
VNEGFPIIFVFIRNEEVVS

SEQ ID NO: 2542912 - protein, 24 aa, Entamoeba dispar
VNEGYKWCFDKKLVTVWSAPNYCY

SEQ ID NO: 2542913 - protein, 23 aa, Entamoeba dispar
VNEKIITLYHSLSTTTSLTITKM

SEQ ID NO: 2542914 - protein, 20 aa, Entamoeba dispar
VNELYPMHLMNDQNLSMTQT

SEQ ID NO: 2542915 - protein, 24 aa, Entamoeba dispar
VNEMEFFIQLMKDQISFLKRKYTK

SEQ ID NO: 2542916 - protein, 18 aa, Entamoeba dispar
VNEPKKSILPRLSMTRRP

SEQ ID NO: 2542917 - protein, 20 aa, Entamoeba dispar
VNFIVNRTHWMISENSQLFV

SEQ ID NO: 2542918 - protein, 26 aa, Entamoeba dispar
VNFVQRMDPRWELVKAELIRKKEERE

SEQ ID NO: 2542919 - protein, 17 aa, Entamoeba dispar
VNGATLYRILQSGAMKQ

SEQ ID NO: 2542920 - protein, 28 aa, Entamoeba dispar
VNGDSKKNLRFVSNLYQIVNAPQKEISN

SEQ ID NO: 2542921 - protein, 24 aa, Entamoeba dispar
VNGENWYFSLKLIKQISIARDFRY

SEQ ID NO: 2542922 - protein, 19 aa, Entamoeba dispar
VNGKEVEYLFWEGICLKES

SEQ ID NO: 2542923 - protein, 18 aa, Entamoeba dispar
VNGYLKKYQGKCIPMSFR

SEQ ID NO: 2542924 - protein, 17 aa, Entamoeba dispar
VNHCIVPYFSQFQLLSN

SEQ ID NO: 2542925 - protein, 29 aa, Entamoeba dispar
VNHRLNVLIPYFTYLQKWSKCSKFNVLYD

SEQ ID NO: 2542926 - protein, 25 aa, Entamoeba dispar
VNHYGLLFPQLLIPTKIEESSPSLL

SEQ ID NO: 2542927 - protein, 24 aa, Entamoeba dispar
VNIKFISKDRIFINEPVLVSIQIP

SEQ ID NO: 2542928 - protein, 20 aa, Entamoeba dispar
VNIKLFVPTITPLSKKIYTI

SEQ ID NO: 2542929 - protein, 24 aa, Entamoeba dispar
VNIKSKWELIAFSQNAIISGNGLV

SEQ ID NO: 2542930 - protein, 25 aa, Entamoeba dispar
VNILAPLIDNLYINLKPAVYASLHD

SEQ ID NO: 2542931 - protein, 25 aa, Entamoeba dispar
VNKDTYLILEKLPQQYDGRVKSMEV

SEQ ID NO: 2542932 - protein, 24 aa, Entamoeba dispar
VNKIILGCHSVFANGGLVATSGAY

SEQ ID NO: 2542933 - protein, 24 aa, Entamoeba dispar
VNKKELITFLKKTGIHLKKGEVDV

SEQ ID NO: 2542934 - protein, 23 aa, Entamoeba dispar
VNKKTIGIKCPLKIYKEGSPQYF

SEQ ID NO: 2542935 - protein, 17 aa, Entamoeba dispar
VNKLTNEVKKWKDIAIL

SEQ ID NO: 2542936 - protein, 27 aa, Entamoeba dispar
VNKPNQKIQFILQYSDEGIQLHEVKLK

SEQ ID NO: 2542937 - protein, 21 aa, Entamoeba dispar
VNKVLKMKLWDSEDGKRWSKS

SEQ ID NO: 2542938 - protein, 25 aa, Entamoeba dispar
VNKYELIVWVKLDSNQKMIYTRLLR

SEQ ID NO: 2542939 - protein, 25 aa, Entamoeba dispar
VNKYNIPEVLITLSLDKVKIDNLRE

SEQ ID NO: 2542940 - protein, 31 aa, Entamoeba dispar
VNLERLILHFNYLCFLPPAIGSLSKLKLLGL

SEQ ID NO: 2542941 - protein, 25 aa, Entamoeba dispar
VNLKDMFVLLSRFFNDIVPREGPTI

SEQ ID NO: 2542942 - protein, 20 aa, Entamoeba dispar
VNLKPKIFVIPLGTGNDMSI

SEQ ID NO: 2542943 - protein, 32 aa, Entamoeba dispar
VNLLTLLKPMHQIDFLILINVHPSLIKDESVI

SEQ ID NO: 2542944 - protein, 33 aa, Entamoeba dispar
VNLNAHFHELYKTPLYVNVLTSGIWPFSTENSL

SEQ ID NO: 2542945 - protein, 22 aa, Entamoeba dispar
VNLNSYNAWVKKKYGKCAKKDI

SEQ ID NO: 2542946 - protein, 18 aa, Entamoeba dispar
VNLYQSNSILLYDQTQKL

SEQ ID NO: 2542947 - protein, 21 aa, Entamoeba dispar
VNMDLIKLVSKAGGRMEDTEL

SEQ ID NO: 2542948 - protein, 26 aa, Entamoeba dispar
VNNDSFSHFFLRCNKITIGKGVITEL

SEQ ID NO: 2542949 - protein, 17 aa, Entamoeba dispar
VNNFKNLALLDLSFNDL

SEQ ID NO: 2542950 - protein, 26 aa, Entamoeba dispar
VNNIAPDYWLIANQIMINTLKSVEDK

SEQ ID NO: 2542951 - protein, 17 aa, Entamoeba dispar
VNNIAPDYWLIANQIML

SEQ ID NO: 2542952 - protein, 17 aa, Entamoeba dispar
VNNRNRIIRRFIDNHYE

SEQ ID NO: 2542953 - protein, 25 aa, Entamoeba dispar
VNNVGPNIISIYESIKTAKGEELRR

SEQ ID NO: 2542954 - protein, 17 aa, Entamoeba dispar
VNPAPLNFFPSPDFITA

SEQ ID NO: 2542955 - protein, 23 aa, Entamoeba dispar
VNPKTYVIASTLPPKVTTPSVKS

SEQ ID NO: 2542956 - protein, 24 aa, Entamoeba dispar
VNPPIPQPVMPPVPTLGTQSMLPQ

SEQ ID NO: 2542957 - protein, 21 aa, Entamoeba dispar
VNPQPLLRANLYQILAKIIPR

SEQ ID NO: 2542958 - protein, 21 aa, Entamoeba dispar
VNPSTRRPLPSLPPNYSQQPI

SEQ ID NO: 2542959 - protein, 18 aa, Entamoeba dispar
VNPSVIARAFHLASAKSA

SEQ ID NO: 2542960 - protein, 23 aa, Entamoeba dispar
VNQFEFHVYYQRPKLHQFCKEHN

SEQ ID NO: 2542961 - protein, 22 aa, Entamoeba dispar
VNQKYIFNNIINLFGKDVKKNF

SEQ ID NO: 2542962 - protein, 26 aa, Entamoeba dispar
VNQNVLYQLIETLLKLVKDIKDLKEI

SEQ ID NO: 2542963 - protein, 23 aa, Entamoeba dispar
VNQRLPIFSNLTIIESLRSDHKF

SEQ ID NO: 2542964 - protein, 18 aa, Entamoeba dispar
VNRLFKKIADYDKKKYCM

SEQ ID NO: 2542965 - protein, 20 aa, Entamoeba dispar
VNRYGLVIFDYNGDSRFHLN

SEQ ID NO: 2542966 - protein, 30 aa, Entamoeba dispar
VNSDILLKVKLPPLLLKLNSTTLSSYNNNN

SEQ ID NO: 2542967 - protein, 23 aa, Entamoeba dispar
VNSYKMEYITTLCIDRTHNGKSR

SEQ ID NO: 2542968 - protein, 29 aa, Entamoeba dispar
VNTKVIQYGGFELSLWDIGGTASFRNVWK

SEQ ID NO: 2542969 - protein, 26 aa, Entamoeba dispar
VNTPAIYIKWNYKAEEFSLPITFTCW

SEQ ID NO: 2542970 - protein, 22 aa, Entamoeba dispar
VNTVLTINKVGYRFTFNDCNGD

SEQ ID NO: 2542971 - protein, 24 aa, Entamoeba dispar
VNVADWVIIYLLEGNLYPDSPLLR

SEQ ID NO: 2542972 - protein, 29 aa, Entamoeba dispar
VNVLQYFIDKLNCYYLNVSHIQNLRELST

SEQ ID NO: 2542973 - protein, 33 aa, Entamoeba dispar
VNVTNFHYSWKNGLAFCALIHSFHPEAIDFNSL

SEQ ID NO: 2542974 - protein, 17 aa, Entamoeba dispar
VNWLNKHYSLNGSSVLF

SEQ ID NO: 2542975 - protein, 39 aa, Entamoeba dispar
VNYELIMDLLHYLITNKPIGCILVFLPGIYEITSLQKEI

SEQ ID NO: 2542976 - protein, 25 aa, Entamoeba dispar
VNYERSYAFLEFRTLEEAVKALSLD

SEQ ID NO: 2542977 - protein, 20 aa, Entamoeba dispar
VNYYISCVIFYITHIRNSKR

SEQ ID NO: 2542978 - protein, 22 aa, Entamoeba dispar
VPCGVAWPYLIGAKGIGIDPKD

SEQ ID NO: 2542979 - protein, 25 aa, Entamoeba dispar
VPDDEAIYRILPPPSVSPGTAYADN

SEQ ID NO: 2542980 - protein, 28 aa, Entamoeba dispar
VPDGKMEGFYPLKRTRFLTWNERVQIVT

SEQ ID NO: 2542981 - protein, 18 aa, Entamoeba dispar
VPEDITVIAWGFGLERPT

SEQ ID NO: 2542982 - protein, 26 aa, Entamoeba dispar
VPEEELFFMEILACTYIFGTSMPRWE

SEQ ID NO: 2542983 - protein, 27 aa, Entamoeba dispar
VPEEVTWNFILLIQQNIELQSYAVHKL

SEQ ID NO: 2542984 - protein, 40 aa, Entamoeba dispar
VPEKTRPPGVPGGQPLFGGFNPGTFKLKKTAQKKENTPEK

SEQ ID NO: 2542985 - protein, 30 aa, Entamoeba dispar
VPEVLRPYVGGVEKIPFIAPKPVWAKEEKK

SEQ ID NO: 2542986 - protein, 32 aa, Entamoeba dispar
VPEVLRPYVGGVEKIPFIAPKPVWAKEEKKST

SEQ ID NO: 2542987 - protein, 20 aa, Entamoeba dispar
VPFELYTKFYLENKPNKPAI

SEQ ID NO: 2542988 - protein, 18 aa, Entamoeba dispar
VPFTNFNHHFYYDDKTYN

SEQ ID NO: 2542989 - protein, 18 aa, Entamoeba dispar
VPGIYDVQVLLKNPENPE

SEQ ID NO: 2542990 - protein, 37 aa, Entamoeba dispar
VPGQYVIIPMTILPNFFGKFTIVIHELLRSTFENPSV

SEQ ID NO: 2542991 - protein, 20 aa, Entamoeba dispar
VPGYYPSWFVGIRQKDNHEL

SEQ ID NO: 2542992 - protein, 24 aa, Entamoeba dispar
VPHREIIKFFSNILPIIEAYRDTT

SEQ ID NO: 2542993 - protein, 32 aa, Entamoeba dispar
VPIDYNIFEQILFNYWSFILYDNTDDSLISLI

SEQ ID NO: 2542994 - protein, 26 aa, Entamoeba dispar
VPIELGQFFMAINIESFRPLADFEKQ

SEQ ID NO: 2542995 - protein, 17 aa, Entamoeba dispar
VPIFRNKVLMVVGGGDA

SEQ ID NO: 2542996 - protein, 19 aa, Entamoeba dispar
VPINLIIDLLPSQWHNKEL

SEQ ID NO: 2542997 - protein, 22 aa, Entamoeba dispar
VPINLMDRIKYKLEIPVMWNED

SEQ ID NO: 2542998 - protein, 19 aa, Entamoeba dispar
VPIPLNQPLLHPLERSHQL

SEQ ID NO: 2542999 - protein, 21 aa, Entamoeba dispar
VPKEYMKCSYCLNCGAFVCDN

SEQ ID NO: 2543000 - protein, 23 aa, Entamoeba dispar
VPKMKGLVLIPKFVEEREKQRKK

SEQ ID NO: 2543001 - protein, 18 aa, Entamoeba dispar
VPKSFIFCIGNFGGILDL

SEQ ID NO: 2543002 - protein, 37 aa, Entamoeba dispar
VPLIKTFDELIIIDIFKILFSQSYYEKIALLARDCIL

SEQ ID NO: 2543003 - protein, 17 aa, Entamoeba dispar
VPLLKIIAPKIISLSIH

SEQ ID NO: 2543004 - protein, 20 aa, Entamoeba dispar
VPMFETNPILVYYSIEEGIL

SEQ ID NO: 2543005 - protein, 25 aa, Entamoeba dispar
VPNAQAIHVLPYIDTIEGLTGDLFD

SEQ ID NO: 2543006 - protein, 22 aa, Entamoeba dispar
VPPATMLVWVLTPTSESTKGIT

SEQ ID NO: 2543007 - protein, 28 aa, Entamoeba dispar
VPPKKELYGMYILVKGTPKYLGSSISEW

SEQ ID NO: 2543008 - protein, 26 aa, Entamoeba dispar
VPPQPGFQPPPFRYPQQFVGQFRAPF

SEQ ID NO: 2543009 - protein, 33 aa, Entamoeba dispar
VPPVLLRNPDDTTFFFLLLLQQYEQAVSTQIER

SEQ ID NO: 2543010 - protein, 23 aa, Entamoeba dispar
VPQTDFDFLWKKINSFIKSNMSK

SEQ ID NO: 2543011 - protein, 40 aa, Entamoeba dispar
VPQTIQLFMADPFARMLILRFVFCRLVLLSLKLPGDSDNF

SEQ ID NO: 2543012 - protein, 17 aa, Entamoeba dispar
VPRLLDVEDFVLLEKPE

SEQ ID NO: 2543013 - protein, 26 aa, Entamoeba dispar
VPRTVTVILERYLVVGLTAGQRICIE

SEQ ID NO: 2543014 - protein, 24 aa, Entamoeba dispar
VPRYELFIRGVLKVLPRTHKEYKG

SEQ ID NO: 2543015 - protein, 23 aa, Entamoeba dispar
VPSEIIIFCPKKHKFTIRSLKQK

SEQ ID NO: 2543016 - protein, 33 aa, Entamoeba dispar
VPSKELFFKHYPEQPMYLVKWQNFSIVESTWIL

SEQ ID NO: 2543017 - protein, 19 aa, Entamoeba dispar
VPSMLFSTIKKCPLTSRRP

SEQ ID NO: 2543018 - protein, 18 aa, Entamoeba dispar
VPSNDKCIMYAVGKDFAQ

SEQ ID NO: 2543019 - protein, 29 aa, Entamoeba dispar
VPTEFSDNLIFVKNLAYAIKDEDLKEIFK

SEQ ID NO: 2543020 - protein, 24 aa, Entamoeba dispar
VPTQNLDFFYIDLVSVTTMKGCVF

SEQ ID NO: 2543021 - protein, 27 aa, Entamoeba dispar
VPVDHFTQFYLVCKSILMSNIHAIPIG

SEQ ID NO: 2543022 - protein, 34 aa, Entamoeba dispar
VQCEKSIYHVDIKKYAIILYDYEGDTRFHLKGEV

SEQ ID NO: 2543023 - protein, 19 aa, Entamoeba dispar
VQCFSIIKHLIEKRVLKNN

SEQ ID NO: 2543024 - protein, 17 aa, Entamoeba dispar
VQDTLNVLLPLISDPNA

SEQ ID NO: 2543025 - protein, 33 aa, Entamoeba dispar
VQDYFGELTYPILYSSLIFVSHACLLSLGAHRF

SEQ ID NO: 2543026 - protein, 35 aa, Entamoeba dispar
VQEDCSCRLLRLGFFLFDCTNALRYFFDICGLVSQ

SEQ ID NO: 2543027 - protein, 28 aa, Entamoeba dispar
VQEFKSQLFLFFINFFSKDSDAKEEVNK

SEQ ID NO: 2543028 - protein, 27 aa, Entamoeba dispar
VQEITPPPMLINLSFLEIQPIIGDFKI

SEQ ID NO: 2543029 - protein, 17 aa, Entamoeba dispar
VQELFYQINIIDGLRNR

SEQ ID NO: 2543030 - protein, 19 aa, Entamoeba dispar
VQFGWKVVIEWIKNNNQLY

SEQ ID NO: 2543031 - protein, 21 aa, Entamoeba dispar
VQFHDIEKPLRFICNDSYKQG

SEQ ID NO: 2543032 - protein, 18 aa, Entamoeba dispar
VQFIISEASIETCGFIMI

SEQ ID NO: 2543033 - protein, 28 aa, Entamoeba dispar
VQGIISYLNAFIQTKTNLGISIEKTLKG

SEQ ID NO: 2543034 - protein, 17 aa, Entamoeba dispar
VQGIPYRWNDNDLQFYF

SEQ ID NO: 2543035 - protein, 22 aa, Entamoeba dispar
VQGLKLCIKYYYEPLNENKGII

SEQ ID NO: 2543036 - protein, 17 aa, Entamoeba dispar
VQGMSDLCGFLILILQE

SEQ ID NO: 2543037 - protein, 27 aa, Entamoeba dispar
VQHFYFQKLPKLIPSSQIPTFPILSYR

SEQ ID NO: 2543038 - protein, 23 aa, Entamoeba dispar
VQHPTVPLMRERGGKKCICVLCD

SEQ ID NO: 2543039 - protein, 19 aa, Entamoeba dispar
VQHQELMPMLLQICKELRG

SEQ ID NO: 2543040 - protein, 22 aa, Entamoeba dispar
VQHVVFCSLTPLQKKIYTALCT

SEQ ID NO: 2543041 - protein, 18 aa, Entamoeba dispar
VQIQSQLKDILIIPHFSQ

SEQ ID NO: 2543042 - protein, 24 aa, Entamoeba dispar
VQKHPQLIYLAKRKSTIVAQRLSE

SEQ ID NO: 2543043 - protein, 17 aa, Entamoeba dispar
VQKLPKTLKLPVTVDHS

SEQ ID NO: 2543044 - protein, 29 aa, Entamoeba dispar
VQKRRKLLYYGLLIPINEEFPKKGPRLCF

SEQ ID NO: 2543045 - protein, 24 aa, Entamoeba dispar
VQKVVISPLLELKKMYNVLSARHA

SEQ ID NO: 2543046 - protein, 17 aa, Entamoeba dispar
VQLDLTTKYLFKKSTDI

SEQ ID NO: 2543047 - protein, 18 aa, Entamoeba dispar
VQLKLMQRLGVFELIGNN

SEQ ID NO: 2543048 - protein, 20 aa, Entamoeba dispar
VQMIALMDNLLKKDLMDLKL

SEQ ID NO: 2543049 - protein, 19 aa, Entamoeba dispar
VQMTLQCTNLLRDQLELKA

SEQ ID NO: 2543050 - protein, 27 aa, Entamoeba dispar
VQNHEILPPLFDLFGGLCLKCLDSVKY

SEQ ID NO: 2543051 - protein, 22 aa, Entamoeba dispar
VQNMKFLWTLTSDKSSFFFHVL

SEQ ID NO: 2543052 - protein, 30 aa, Entamoeba dispar
VQPNDFTILQLFKKYVMKTFNKLSAFTPVK

SEQ ID NO: 2543053 - protein, 24 aa, Entamoeba dispar
VQQRLFFLNKPIKVLDLFCCVGGD

SEQ ID NO: 2543054 - protein, 27 aa, Entamoeba dispar
VQQSDGGWFSSWWKTDKDEVNMIKKVV

SEQ ID NO: 2543055 - protein, 25 aa, Entamoeba dispar
VQRDTTLYILTKLKEQNPGYFKAYE

SEQ ID NO: 2543056 - protein, 20 aa, Entamoeba dispar
VQREFVAQLFLLIGVKQNED

SEQ ID NO: 2543057 - protein, 28 aa, Entamoeba dispar
VQRGEWKVPLPIYRAIQYLLEGDNLQTD

SEQ ID NO: 2543058 - protein, 27 aa, Entamoeba dispar
VQRRRFELNIDPLYIKESYRQKGYSSD

SEQ ID NO: 2543059 - protein, 27 aa, Entamoeba dispar
VQRYQYLMEFVPIWSKGWEKLTPIKTE

SEQ ID NO: 2543060 - protein, 17 aa, Entamoeba dispar
VQSILTYDCPCAIILTC

SEQ ID NO: 2543061 - protein, 21 aa, Entamoeba dispar
VQTFPSTIRWFISKQIYSVGI

SEQ ID NO: 2543062 - protein, 30 aa, Entamoeba dispar
VQTQAMWDWLDLLLPALSQLPYLKTSRSCS

SEQ ID NO: 2543063 - protein, 25 aa, Entamoeba dispar
VQVMRAFDYFLRSTSQKLFITKIHL

SEQ ID NO: 2543064 - protein, 18 aa, Entamoeba dispar
VQWPLRFKEQLDKFHIRP

SEQ ID NO: 2543065 - protein, 25 aa, Entamoeba dispar
VQYHATRLFFYIKQNDQHSLLRFIT

SEQ ID NO: 2543066 - protein, 20 aa, Entamoeba dispar
VQYLIRYVYRQNIQFARNAV

SEQ ID NO: 2543067 - protein, 23 aa, Entamoeba dispar
VQYPSLYKKFGVDTPAGILLYGP

SEQ ID NO: 2543068 - protein, 18 aa, Entamoeba dispar
VQYSTTLPRCGLVPRSLD

SEQ ID NO: 2543069 - protein, 30 aa, Entamoeba dispar
VRAGIQKLVTTFYAVLDRTLKQLAYAKQVG

SEQ ID NO: 2543070 - protein, 22 aa, Entamoeba dispar
VRCKAQGLCPLELILTATSQID

SEQ ID NO: 2543071 - protein, 18 aa, Entamoeba dispar
VRCQACGEYMYKGKKFNS

SEQ ID NO: 2543072 - protein, 18 aa, Entamoeba dispar
VRDFIYDPNSFLFSLESN

SEQ ID NO: 2543073 - protein, 24 aa, Entamoeba dispar
VRDKDLFICGSSQKLVICDFTENV

SEQ ID NO: 2543074 - protein, 20 aa, Entamoeba dispar
VRDLYALLCKRTGKSCNIIS

SEQ ID NO: 2543075 - protein, 23 aa, Entamoeba dispar
VREAYFDIVYFNVVSRLSQMKEN

SEQ ID NO: 2543076 - protein, 23 aa, Entamoeba dispar
VREDFNVFLFTDNSLQVFFTGTN

SEQ ID NO: 2543077 - protein, 18 aa, Entamoeba dispar
VREIWTNIALAAYSWEGE

SEQ ID NO: 2543078 - protein, 18 aa, Entamoeba dispar
VRERFDIIICDWMGINLY

SEQ ID NO: 2543079 - protein, 23 aa, Entamoeba dispar
VRERFKFHYEKFSQYLPDFWGKK

SEQ ID NO: 2543080 - protein, 18 aa, Entamoeba dispar
VRERLTSWEFIQTLPEKI

SEQ ID NO: 2543081 - protein, 21 aa, Entamoeba dispar
VREYTTFMKQLNCPSIMAGEV

SEQ ID NO: 2543082 - protein, 22 aa, Entamoeba dispar
VRFVKSTWTLKTNILFVNATSY

SEQ ID NO: 2543083 - protein, 27 aa, Entamoeba dispar
VRGKGNMVFLFLRKGIYTCQALVMKSE

SEQ ID NO: 2543084 - protein, 34 aa, Entamoeba dispar
VRHEEHTTFFGKDPGFFVFTLRNPHNIQPIKFIK

SEQ ID NO: 2543085 - protein, 17 aa, Entamoeba dispar
VRHYSMKWLLEDIDINK

SEQ ID NO: 2543086 - protein, 25 aa, Entamoeba dispar
VRILDLILMEGWEIVFSIFSAILHY

SEQ ID NO: 2543087 - protein, 19 aa, Entamoeba dispar
VRKEKSTPPRIKRAKKEIL

SEQ ID NO: 2543088 - protein, 22 aa, Entamoeba dispar
VRKESFIIINQKNFETVGREIN

SEQ ID NO: 2543089 - protein, 17 aa, Entamoeba dispar
VRKISVMMVLKKLINQT

SEQ ID NO: 2543090 - protein, 27 aa, Entamoeba dispar
VRKTRVELMRTLYKLVGKLSVPQQGRL

SEQ ID NO: 2543091 - protein, 19 aa, Entamoeba dispar
VRKVILQMFLNYHKSVKHI

SEQ ID NO: 2543092 - protein, 28 aa, Entamoeba dispar
VRKVYVSILVMFPLWEWNRLLVHSIEIP

SEQ ID NO: 2543093 - protein, 19 aa, Entamoeba dispar
VRLDLKSFTFINKKSLMQF

SEQ ID NO: 2543094 - protein, 30 aa, Entamoeba dispar
VRLLEKFFQVYSSWDWLRAPVMLGTNDDFN

SEQ ID NO: 2543095 - protein, 25 aa, Entamoeba dispar
VRMQEGPLILLKLTTNPYSMVIKGI

SEQ ID NO: 2543096 - protein, 23 aa, Entamoeba dispar
VRNFLGIADRFVSDDGFLRCIIG

SEQ ID NO: 2543097 - protein, 22 aa, Entamoeba dispar
VRNNSIRMLLVSKLLERGVDVN

SEQ ID NO: 2543098 - protein, 19 aa, Entamoeba dispar
VRNRYKALSIRNKLSCFIK

SEQ ID NO: 2543099 - protein, 19 aa, Entamoeba dispar
VRQEIPFSKLVLAVGGEPN

SEQ ID NO: 2543100 - protein, 18 aa, Entamoeba dispar
VRQRREAKISSRREEAIA

SEQ ID NO: 2543101 - protein, 18 aa, Entamoeba dispar
VRRCHLTMPLCCSGGMLT

SEQ ID NO: 2543102 - protein, 17 aa, Entamoeba dispar
VRRLHHRRPRHQLRERR

SEQ ID NO: 2543103 - protein, 53 aa, Entamoeba dispar
VRTIENFKLLLFPLQWVCVCVPILPRILLEYLTSPFPYILGLPSSYRAEADTI

SEQ ID NO: 2543104 - protein, 25 aa, Entamoeba dispar
VRTNVVPYYILFNREPKYVCGQPRK

SEQ ID NO: 2543105 - protein, 26 aa, Entamoeba dispar
VRVAKYLIPYNLVSYTEVFVRLGYTT

SEQ ID NO: 2543106 - protein, 24 aa, Entamoeba dispar
VRVDWRNMLLFYKDIESLEYAVNS

SEQ ID NO: 2543107 - protein, 29 aa, Entamoeba dispar
VRWEFSHPYPFIRTREFLWQEGHTAFATQ

SEQ ID NO: 2543108 - protein, 24 aa, Entamoeba dispar
VRYKFDCCGTPIDGRIRDLIVIAQ

SEQ ID NO: 2543109 - protein, 24 aa, Entamoeba dispar
VRYKYEKIVFEALFKPGCALKVRE

SEQ ID NO: 2543110 - protein, 28 aa, Entamoeba dispar
VSALEQPKKWWKFAFIATRDYLREREEE

SEQ ID NO: 2543111 - protein, 21 aa, Entamoeba dispar
VSAVLCCLSVMTSLEIPHLNV

SEQ ID NO: 2543112 - protein, 24 aa, Entamoeba dispar
VSCSVIELEFQIGKLKMIKKEVEE

SEQ ID NO: 2543113 - protein, 28 aa, Entamoeba dispar
VSCYNYHKYKKIYIVEWARSPIHRASQA

SEQ ID NO: 2543114 - protein, 28 aa, Entamoeba dispar
VSDGRKRALRLFGNYLGNSLYDTDYVRK

SEQ ID NO: 2543115 - protein, 22 aa, Entamoeba dispar
VSDLSFLGLEKFIRVCGDEVVP

SEQ ID NO: 2543116 - protein, 29 aa, Entamoeba dispar
VSDMEMLGLLYIWVLKNLNKEMLKEWIEN

SEQ ID NO: 2543117 - protein, 26 aa, Entamoeba dispar
VSDYKDWCLYWLGLSEQKPPIVGESP

SEQ ID NO: 2543118 - protein, 26 aa, Entamoeba dispar
VSEDRIFMNEPVLISIKIPDNLQIIN

SEQ ID NO: 2543119 - protein, 26 aa, Entamoeba dispar
VSEGECFIHSFALQQEDLDEKEENNE

SEQ ID NO: 2543120 - protein, 32 aa, Entamoeba dispar
VSEIGIYCFSRCLLILINIPSSISKIGNYCFD

SEQ ID NO: 2543121 - protein, 19 aa, Entamoeba dispar
VSEIPSFKPSLRYNKSRGS

SEQ ID NO: 2543122 - protein, 20 aa, Entamoeba dispar
VSEKLLNRIKFLLQSSTMDF

SEQ ID NO: 2543123 - protein, 24 aa, Entamoeba dispar
VSEMFKKWAIERNAFIDKFDSTRK

SEQ ID NO: 2543124 - protein, 22 aa, Entamoeba dispar
VSEPMVPPPMTQSYIPPVNQPT

SEQ ID NO: 2543125 - protein, 25 aa, Entamoeba dispar
VSFAVPTHIFIIEKMPLNSFGKVYN

SEQ ID NO: 2543126 - protein, 24 aa, Entamoeba dispar
VSFDKYIFIKYSTSKPLGIICLFN

SEQ ID NO: 2543127 - protein, 18 aa, Entamoeba dispar
VSFESFCSYFADKNFKKI

SEQ ID NO: 2543128 - protein, 25 aa, Entamoeba dispar
VSFEVPLLRGYLTRRDPKGTHSWSK

SEQ ID NO: 2543129 - protein, 23 aa, Entamoeba dispar
VSFKFRLSVLDHPNFFIDPNNDS

SEQ ID NO: 2543130 - protein, 18 aa, Entamoeba dispar
VSFLMRFSQRSLTISPND

SEQ ID NO: 2543131 - protein, 34 aa, Entamoeba dispar
VSFMPSNILTPFIRRVIFFLAPTTEMRTITVSHN

SEQ ID NO: 2543132 - protein, 22 aa, Entamoeba dispar
VSFNTVWNTNYAYRVSTDNGVN

SEQ ID NO: 2543133 - protein, 20 aa, Entamoeba dispar
VSFQYSRCSDYFSLGSMIFE

SEQ ID NO: 2543134 - protein, 29 aa, Entamoeba dispar
VSFVITKGYYYIFLDKFDVEKIFQIIEED

SEQ ID NO: 2543135 - protein, 21 aa, Entamoeba dispar
VSFYSRMTTLMADLGYDEDFL

SEQ ID NO: 2543136 - protein, 23 aa, Entamoeba dispar
VSFYTLIMPIYLASISEGVPTQP

SEQ ID NO: 2543137 - protein, 27 aa, Entamoeba dispar
VSGDKSILLDEIYAKHYGELDKKHDQV

SEQ ID NO: 2543138 - protein, 26 aa, Entamoeba dispar
VSGITHPFLQTKLIQLLGILGHNDKA

SEQ ID NO: 2543139 - protein, 27 aa, Entamoeba dispar
VSGKNNFFIIVRLFSGELFGSYYSKTV

SEQ ID NO: 2543140 - protein, 17 aa, Entamoeba dispar
VSGKYFDGSSCVNCPLK

SEQ ID NO: 2543141 - protein, 29 aa, Entamoeba dispar
VSGWKRRWVVLCRGFLFYYNNPKDEIPIG

SEQ ID NO: 2543142 - protein, 21 aa, Entamoeba dispar
VSHDLIYEPLERYRYEASLRS

SEQ ID NO: 2543143 - protein, 29 aa, Entamoeba dispar
VSHNEKMLLSLFISVATKFVPLGILHMRS

SEQ ID NO: 2543144 - protein, 26 aa, Entamoeba dispar
VSIERLICIFAYFHVMIEIDEKTLQE

SEQ ID NO: 2543145 - protein, 25 aa, Entamoeba dispar
VSIHSLTFFLYELQPFNSSLTTMKS

SEQ ID NO: 2543146 - protein, 34 aa, Entamoeba dispar
VSIKYETILLISRMGYIYGFYSGDGTLFFQGRVI

SEQ ID NO: 2543147 - protein, 19 aa, Entamoeba dispar
VSIPLPSEWKSPILVNECS

SEQ ID NO: 2543148 - protein, 18 aa, Entamoeba dispar
VSIVPFKMKECMNSLIVA

SEQ ID NO: 2543149 - protein, 32 aa, Entamoeba dispar
VSIYMTEHILRRIKMLYPHLWYEGICCVHTVC

SEQ ID NO: 2543150 - protein, 29 aa, Entamoeba dispar
VSKAQVHDWWFYPWLTEIVEDPSEKELKE

SEQ ID NO: 2543151 - protein, 17 aa, Entamoeba dispar
VSKERIFMNEPVLISCE

SEQ ID NO: 2543152 - protein, 18 aa, Entamoeba dispar
VSKERIFMNEPVLVSIKI

SEQ ID NO: 2543153 - protein, 29 aa, Entamoeba dispar
VSKGDTYIPFRSSPLTRILQDALGGASIT

SEQ ID NO: 2543154 - protein, 17 aa, Entamoeba dispar
VSKNWIINGMKKDEFKY

SEQ ID NO: 2543155 - protein, 23 aa, Entamoeba dispar
VSKPVGFGISKRLLFDKVKSQLG

SEQ ID NO: 2543156 - protein, 28 aa, Entamoeba dispar
VSKQAIELVFVLCAFDGFFSFMCAAKNY

SEQ ID NO: 2543157 - protein, 22 aa, Entamoeba dispar
VSKSLDKILLLLDKERLSGQEE

SEQ ID NO: 2543158 - protein, 24 aa, Entamoeba dispar
VSKWNINFNIFKPLSSKMIQDIVN

SEQ ID NO: 2543159 - protein, 20 aa, Entamoeba dispar
VSLEYLQYLLEFAGTSIQKH

SEQ ID NO: 2543160 - protein, 22 aa, Entamoeba dispar
VSLKQLIYLYISAYASTDDQQA

SEQ ID NO: 2543161 - protein, 18 aa, Entamoeba dispar
VSLNCTLEDLYNGKTFKR

SEQ ID NO: 2543162 - protein, 40 aa, Entamoeba dispar
VSLNTFIPLSTYKYLRPWKIIHYKNIIVLLYNDLNKIRGI

SEQ ID NO: 2543163 - protein, 24 aa, Entamoeba dispar
VSLPTIQLIIIMEIPYLAIHFNVG

SEQ ID NO: 2543164 - protein, 30 aa, Entamoeba dispar
VSLRVYEMMGFIDELLFNSLPDIKQPIFDF

SEQ ID NO: 2543165 - protein, 24 aa, Entamoeba dispar
VSMIGQFGVGFYSSYLVAEKVTVI

SEQ ID NO: 2543166 - protein, 18 aa, Entamoeba dispar
VSMLKMTRSLLIRDRLIE

SEQ ID NO: 2543167 - protein, 19 aa, Entamoeba dispar
VSNILALHNSLYIASNTKD

SEQ ID NO: 2543168 - protein, 22 aa, Entamoeba dispar
VSNLWDDFLYYVYDTYDSDDEK

SEQ ID NO: 2543169 - protein, 24 aa, Entamoeba dispar
VSPKINKVITQLPLVEEQSLIKSQ

SEQ ID NO: 2543170 - protein, 22 aa, Entamoeba dispar
VSPKVFLIKNVMEAKIPLVSSM

SEQ ID NO: 2543171 - protein, 27 aa, Entamoeba dispar
VSPLINTVMMIITFINPYQQPTEITKD

SEQ ID NO: 2543172 - protein, 21 aa, Entamoeba dispar
VSPLNKEVMVLTWGNLKGEFR

SEQ ID NO: 2543173 - protein, 25 aa, Entamoeba dispar
VSPRKTHPQFATPSPFITSSSPRSS

SEQ ID NO: 2543174 - protein, 29 aa, Entamoeba dispar
VSPSGRYITVWQLIPLQYTQGVNGSGPVK

SEQ ID NO: 2543175 - protein, 28 aa, Entamoeba dispar
VSPSSIITLQFQPLIEWSINNDHHYYPI

SEQ ID NO: 2543176 - protein, 26 aa, Entamoeba dispar
VSPVAKPILGMLPGGSIITGLYDRGA

SEQ ID NO: 2543177 - protein, 24 aa, Entamoeba dispar
VSQAVLLQKLKINPFKYGAVIDVV

SEQ ID NO: 2543178 - protein, 25 aa, Entamoeba dispar
VSQQKPIILPIKTPSLHSYKVSIPN

SEQ ID NO: 2543179 - protein, 24 aa, Entamoeba dispar
VSRERLLSFMFKRKTNEKTTISES

SEQ ID NO: 2543180 - protein, 20 aa, Entamoeba dispar
VSRNIEIFKPKKIERRDPRF

SEQ ID NO: 2543181 - protein, 17 aa, Entamoeba dispar
VSRNKLLNLSFASTLRK

SEQ ID NO: 2543182 - protein, 23 aa, Entamoeba dispar
VSRRSIIVRCFSCKWNQWIKENI

SEQ ID NO: 2543183 - protein, 24 aa, Entamoeba dispar
VSRSVLLSFLFLITCFINNGNDEN

SEQ ID NO: 2543184 - protein, 25 aa, Entamoeba dispar
VSSCKLMELLTIRFNPTYPQGISFE

SEQ ID NO: 2543185 - protein, 29 aa, Entamoeba dispar
VSSKDKVPYLFLANSYKISYWKTDIENYN

SEQ ID NO: 2543186 - protein, 18 aa, Entamoeba dispar
VSSKRPIKNEQLLQLIFK

SEQ ID NO: 2543187 - protein, 30 aa, Entamoeba dispar
VSSLEITIKQPWHLPNTLQCRLKELKVWNM

SEQ ID NO: 2543188 - protein, 27 aa, Entamoeba dispar
VSSLILLHLIISFNWNRNYLIWNDIVE

SEQ ID NO: 2543189 - protein, 22 aa, Entamoeba dispar
VSSLLKERLFLASDKYQIYVCD

SEQ ID NO: 2543190 - protein, 34 aa, Entamoeba dispar
VSSNLRPVIPPPTPPRLATLLRLCVLKEPETRPT

SEQ ID NO: 2543191 - protein, 23 aa, Entamoeba dispar
VSSVELYPLPTIPSNLAIISSSL

SEQ ID NO: 2543192 - protein, 17 aa, Entamoeba dispar
VSTLPVSFTTLSNLRHL

SEQ ID NO: 2543193 - protein, 29 aa, Entamoeba dispar
VSTSLISQQKILKPIKIRRLSTGRVESNI

SEQ ID NO: 2543194 - protein, 21 aa, Entamoeba dispar
VSTVFSDWYPAIQPSGFTQFT

SEQ ID NO: 2543195 - protein, 44 aa, Entamoeba dispar
VSTYYKMTERLKWESPLLFTNIFHAFQTLFSIGDLFFSCNDTLT

SEQ ID NO: 2543196 - protein, 26 aa, Entamoeba dispar
VSVGLRQSILQYIFRFFTCVNIGEYA

SEQ ID NO: 2543197 - protein, 17 aa, Entamoeba dispar
VSVKFKPKKMRGSTSLV

SEQ ID NO: 2543198 - protein, 28 aa, Entamoeba dispar
VSVQGMDKPYWVGVYKSVLSSVSNNDYL

SEQ ID NO: 2543199 - protein, 19 aa, Entamoeba dispar
VSVSEFYYLVFKNSGILDY

SEQ ID NO: 2543200 - protein, 36 aa, Entamoeba dispar
VSVTILSYPLILDLPLPGVEMLYPHYIRYIYEVVTK

SEQ ID NO: 2543201 - protein, 23 aa, Entamoeba dispar
VSYIRCLINFYASRGKVIELLET

SEQ ID NO: 2543202 - protein, 24 aa, Entamoeba dispar
VSYKLLHSLLVFQSAVLRKDENKI

SEQ ID NO: 2543203 - protein, 25 aa, Entamoeba dispar
VSYNNLFISSFSKPIKFIISTQVQN

SEQ ID NO: 2543204 - protein, 20 aa, Entamoeba dispar
VSYPPNFPMVVSAGIPITTP

SEQ ID NO: 2543205 - protein, 25 aa, Entamoeba dispar
VTAAVYKKFLRELPNHIFNLSQTME

SEQ ID NO: 2543206 - protein, 28 aa, Entamoeba dispar
VTADILLPSFIYIVIRANTTHLASTLSY

SEQ ID NO: 2543207 - protein, 20 aa, Entamoeba dispar
VTARYHLNYFRAIKKALDQS

SEQ ID NO: 2543208 - protein, 21 aa, Entamoeba dispar
VTCYSFRWVSMLFIDDFSIKD

SEQ ID NO: 2543209 - protein, 22 aa, Entamoeba dispar
VTDGLRRQLKNSVGKKKQQFVL

SEQ ID NO: 2543210 - protein, 25 aa, Entamoeba dispar
VTDQSHFIFIITQNGLNTFSLKKNW

SEQ ID NO: 2543211 - protein, 23 aa, Entamoeba dispar
VTEGIFQYDYSISPLKEISKLRS

SEQ ID NO: 2543212 - protein, 29 aa, Entamoeba dispar
VTEIPQKWMYCFLFNDRLVETMPISIDNK

SEQ ID NO: 2543213 - protein, 17 aa, Entamoeba dispar
VTELLQELLILNTLSYS

SEQ ID NO: 2543214 - protein, 22 aa, Entamoeba dispar
VTELNLELLLSDDYYDIGINID

SEQ ID NO: 2543215 - protein, 41 aa, Entamoeba dispar
VTEPITRNILERIVVIMKSFTIITLLKTLGIKNKNEVCGFL

SEQ ID NO: 2543216 - protein, 26 aa, Entamoeba dispar
VTEVLDYFNIPIDNPCILLMQETSKS

SEQ ID NO: 2543217 - protein, 19 aa, Entamoeba dispar
VTFKGWAYHIRKARKTLIF

SEQ ID NO: 2543218 - protein, 20 aa, Entamoeba dispar
VTFPLILESLFEKAKKEISE

SEQ ID NO: 2543219 - protein, 25 aa, Entamoeba dispar
VTGYRRDFIDSFKKLQLDNSQVEHA

SEQ ID NO: 2543220 - protein, 19 aa, Entamoeba dispar
VTHCIWPVEKQVLSSSLDG

SEQ ID NO: 2543221 - protein, 24 aa, Entamoeba dispar
VTHGYPFNTITFYDTQHWNKTGEF

SEQ ID NO: 2543222 - protein, 18 aa, Entamoeba dispar
VTIDTLMGFVKVKELTEN

SEQ ID NO: 2543223 - protein, 25 aa, Entamoeba dispar
VTITPDIWEIESLGLIVSARIQLPL

SEQ ID NO: 2543224 - protein, 19 aa, Entamoeba dispar
VTKHFNKYLKRTHLTPEEA

SEQ ID NO: 2543225 - protein, 31 aa, Entamoeba dispar
VTKMIHLNYLPIFTSYLLPLMNYINNENRPR

SEQ ID NO: 2543226 - protein, 23 aa, Entamoeba dispar
VTKPPVRMDSQCKYMAIASGKAD

SEQ ID NO: 2543227 - protein, 25 aa, Entamoeba dispar
VTLIDLPAFFLQPELPMLMIIRTSH

SEQ ID NO: 2543228 - protein, 23 aa, Entamoeba dispar
VTLKDVITKYFQPELEKPFQEKK

SEQ ID NO: 2543229 - protein, 24 aa, Entamoeba dispar
VTLKDVITKYFQPELEKPFQEKKE

SEQ ID NO: 2543230 - protein, 25 aa, Entamoeba dispar
VTLLNGFVRMNFVGPFNLEIEKESK

SEQ ID NO: 2543231 - protein, 20 aa, Entamoeba dispar
VTLPYSINALGRRVFSDCCS

SEQ ID NO: 2543232 - protein, 30 aa, Entamoeba dispar
VTLSNDFPHLFIIFPKSFGFYINNQPNQIV

SEQ ID NO: 2543233 - protein, 25 aa, Entamoeba dispar
VTLYSINNWKVLYKFESSSPIIDAK

SEQ ID NO: 2543234 - protein, 24 aa, Entamoeba dispar
VTLYYLIRCEPFSHFGIELQGGKF

SEQ ID NO: 2543235 - protein, 27 aa, Entamoeba dispar
VTMGINEQYFKKIGIWRLNSFLKEEVI

SEQ ID NO: 2543236 - protein, 18 aa, Entamoeba dispar
VTMWYRPPELIQKYNIYG

SEQ ID NO: 2543237 - protein, 24 aa, Entamoeba dispar
VTNGFMSVLLFQITVAPILDNPSI

SEQ ID NO: 2543238 - protein, 29 aa, Entamoeba dispar
VTNLEEALQWFQYTYLYVCLKQSPGGISY

SEQ ID NO: 2543239 - protein, 18 aa, Entamoeba dispar
VTNLLKLKNFAISYNMLT

SEQ ID NO: 2543240 - protein, 25 aa, Entamoeba dispar
VTNSYIKELFNFRGLLKAQLDMAYR

SEQ ID NO: 2543241 - protein, 20 aa, Entamoeba dispar
VTPIYVMDFTKKLQLPILSS

SEQ ID NO: 2543242 - protein, 25 aa, Entamoeba dispar
VTPQIPVSPLKQRRLRNLTFASRDE

SEQ ID NO: 2543243 - protein, 24 aa, Entamoeba dispar
VTPRVPTHLPPQKPLQQPQVSVNI

SEQ ID NO: 2543244 - protein, 26 aa, Entamoeba dispar
VTQEITFPCIYGMAARRTIPNGFYQN

SEQ ID NO: 2543245 - protein, 24 aa, Entamoeba dispar
VTQFFEKIFVVDPFERINTFQLMD

SEQ ID NO: 2543246 - protein, 20 aa, Entamoeba dispar
VTQFFKFEHFILIEIFTQMG

SEQ ID NO: 2543247 - protein, 28 aa, Entamoeba dispar
VTQFRSPLRKYFDVLVLKQLVCAMEHEN

SEQ ID NO: 2543248 - protein, 23 aa, Entamoeba dispar
VTQICIGLLMELTNKISKFDQYV

SEQ ID NO: 2543249 - protein, 18 aa, Entamoeba dispar
VTQKKGYKKGNVKLILLI

SEQ ID NO: 2543250 - protein, 26 aa, Entamoeba dispar
VTQLNMVIFLFKKPLEDANGKILPKL

SEQ ID NO: 2543251 - protein, 34 aa, Entamoeba dispar
VTQNIRFICIVLHALQIIRPTPIVILKKFEDTAV

SEQ ID NO: 2543252 - protein, 18 aa, Entamoeba dispar
VTQRKGYKSGGVQLVLLI

SEQ ID NO: 2543253 - protein, 29 aa, Entamoeba dispar
VTQTFFSAPNPLFSRLQTLSPEPLNTQQR

SEQ ID NO: 2543254 - protein, 23 aa, Entamoeba dispar
VTQYKKYLNTAIGKEWTSLLTHN

SEQ ID NO: 2543255 - protein, 24 aa, Entamoeba dispar
VTQYKKYLNTAIGKEWTSLLTHNK

SEQ ID NO: 2543256 - protein, 21 aa, Entamoeba dispar
VTQYPVMPWVISDYSSQELDL

SEQ ID NO: 2543257 - protein, 28 aa, Entamoeba dispar
VTSDFPLHTFMRKWLKSLYEINVENDMK

SEQ ID NO: 2543258 - protein, 19 aa, Entamoeba dispar
VTSIFFFEKKLLKRKVFFL

SEQ ID NO: 2543259 - protein, 17 aa, Entamoeba dispar
VTTAIITGLPPGLKEGE

SEQ ID NO: 2543260 - protein, 25 aa, Entamoeba dispar
VTTIRGWFVELAHPFPLCLISRKEP

SEQ ID NO: 2543261 - protein, 26 aa, Entamoeba dispar
VTTLSDHIFMFLLNKGGATVIETYDY

SEQ ID NO: 2543262 - protein, 24 aa, Entamoeba dispar
VTTNILSIINFDFMKIYDLQEYLR

SEQ ID NO: 2543263 - protein, 20 aa, Entamoeba dispar
VTTNWLYLSRLSAQKEFAFM

SEQ ID NO: 2543264 - protein, 25 aa, Entamoeba dispar
VTTPEKLLELLSILFDPSIPDGMEW

SEQ ID NO: 2543265 - protein, 27 aa, Entamoeba dispar
VTTSTLNIVQVFWGLDKKLAQRKHFPA

SEQ ID NO: 2543266 - protein, 28 aa, Entamoeba dispar
VTVGKYKYEMILAGIYYIVLDLINQYQI

SEQ ID NO: 2543267 - protein, 19 aa, Entamoeba dispar
VTVRIYLNGKPLIKNEFNK

SEQ ID NO: 2543268 - protein, 19 aa, Entamoeba dispar
VTYYLKRTLRGFARKVLTP

SEQ ID NO: 2543269 - protein, 17 aa, Entamoeba dispar
VVAEFFRYFLDECYSYL

SEQ ID NO: 2543270 - protein, 25 aa, Entamoeba dispar
VVAFGMKEWAEELGAVCFAHWFQPL

SEQ ID NO: 2543271 - protein, 22 aa, Entamoeba dispar
VVAKNLLLGKKIVLIRCEDLQV

SEQ ID NO: 2543272 - protein, 30 aa, Entamoeba dispar
VVAKYVQKIFKFRISNFYSVYVYKGYDEDP

SEQ ID NO: 2543273 - protein, 19 aa, Entamoeba dispar
VVAPLTLIPHWVSEAHRFV

SEQ ID NO: 2543274 - protein, 25 aa, Entamoeba dispar
VVAPTITLPLFFNDKESPFIKMKLG

SEQ ID NO: 2543275 - protein, 18 aa, Entamoeba dispar
VVCNLFSSWNSLMNFEWN

SEQ ID NO: 2543276 - protein, 26 aa, Entamoeba dispar
VVDCFKRFIPYLKVYKMFIGNNEICL

SEQ ID NO: 2543277 - protein, 20 aa, Entamoeba dispar
VVDDVLKKAIDLASEIIGEN

SEQ ID NO: 2543278 - protein, 26 aa, Entamoeba dispar
VVDLMAVFPSYMRIKRFIIVKDSVTD

SEQ ID NO: 2543279 - protein, 31 aa, Entamoeba dispar
VVDLYDIYLEDKFLYLVFEFCDEDLYQFMTR

SEQ ID NO: 2543280 - protein, 18 aa, Entamoeba dispar
VVDVFNFILGRRAQQKTA

SEQ ID NO: 2543281 - protein, 27 aa, Entamoeba dispar
VVEKIKSFLPDDVKLFQFNALTQKEDI

SEQ ID NO: 2543282 - protein, 30 aa, Entamoeba dispar
VVEQTEWVYLYLQLLRKIFKYNPRIGFDFA

SEQ ID NO: 2543283 - protein, 20 aa, Entamoeba dispar
VVETLYFDIYNQCFQLIPLA

SEQ ID NO: 2543284 - protein, 25 aa, Entamoeba dispar
VVFDDGKEVPLTWTEGHYWVGNYNY

SEQ ID NO: 2543285 - protein, 18 aa, Entamoeba dispar
VVFKYIEACARSGQFQEL

SEQ ID NO: 2543286 - protein, 27 aa, Entamoeba dispar
VVFNCQVVLPPCSITYLLDTNGSVEIG

SEQ ID NO: 2543287 - protein, 27 aa, Entamoeba dispar
VVGCIEIITFIFIDYPHIYPNDVDVNV

SEQ ID NO: 2543288 - protein, 18 aa, Entamoeba dispar
VVGGHEVHIPSFLKKKQL

SEQ ID NO: 2543289 - protein, 27 aa, Entamoeba dispar
VVGIVTRVTAIFPQLKAVKYICSVCQA

SEQ ID NO: 2543290 - protein, 18 aa, Entamoeba dispar
VVGLAFLHENQIIHRDVK

SEQ ID NO: 2543291 - protein, 23 aa, Entamoeba dispar
VVGRPLELNILLSDSFGNVIKEF

SEQ ID NO: 2543292 - protein, 20 aa, Entamoeba dispar
VVGTPYWMAPELIRGHDYGV

SEQ ID NO: 2543293 - protein, 18 aa, Entamoeba dispar
VVGVATRRPATSAIGICL

SEQ ID NO: 2543294 - protein, 19 aa, Entamoeba dispar
VVGVATRRPATSAIGICLC

SEQ ID NO: 2543295 - protein, 21 aa, Entamoeba dispar
VVGVLLGFIRKGVVDVMNSFA

SEQ ID NO: 2543296 - protein, 24 aa, Entamoeba dispar
VVHEILLFLYHSLLFENEYFEDKP

SEQ ID NO: 2543297 - protein, 19 aa, Entamoeba dispar
VVHGGIPPMYISLDDIKKI

SEQ ID NO: 2543298 - protein, 17 aa, Entamoeba dispar
VVHQLMVFIYHQSTNKL

SEQ ID NO: 2543299 - protein, 25 aa, Entamoeba dispar
VVHSKIIHSILPLFKDIEKGIFPNE

SEQ ID NO: 2543300 - protein, 28 aa, Entamoeba dispar
VVHVNDKKYVFPSLYLHIFNNEVEMKIS

SEQ ID NO: 2543301 - protein, 18 aa, Entamoeba dispar
VVHVSGKRYLVPEEVKTG

SEQ ID NO: 2543302 - protein, 17 aa, Entamoeba dispar
VVIDFGGGTLDVTCCKI

SEQ ID NO: 2543303 - protein, 24 aa, Entamoeba dispar
VVIDSKAFIFALSNGLKTFKNIDS

SEQ ID NO: 2543304 - protein, 18 aa, Entamoeba dispar
VVIVLDFNKEVLSDNVER

SEQ ID NO: 2543305 - protein, 23 aa, Entamoeba dispar
VVKDLYWVGVFDKELRVFDIIMR

SEQ ID NO: 2543306 - protein, 22 aa, Entamoeba dispar
VVKNSRIWLNSALSGRTKRIKT

SEQ ID NO: 2543307 - protein, 24 aa, Entamoeba dispar
VVKNSRIWLNSALSGRTKRIKTLV

SEQ ID NO: 2543308 - protein, 20 aa, Entamoeba dispar
VVKNSRIWLSSALSGRTKRV

SEQ ID NO: 2543309 - protein, 32 aa, Entamoeba dispar
VVKQGHIIWNWYNRWLVLTKEQLYYYDESKQK

SEQ ID NO: 2543310 - protein, 31 aa, Entamoeba dispar
VVKSCIGTTFMNTWNDILCKLAIEAVTICAG

SEQ ID NO: 2543311 - protein, 17 aa, Entamoeba dispar
VVKYDELFQSYIKYKKA

SEQ ID NO: 2543312 - protein, 30 aa, Entamoeba dispar
VVLFNKLIQKILILPLSLPKELFNEDTFSN

SEQ ID NO: 2543313 - protein, 27 aa, Entamoeba dispar
VVLGKILLPAFFIDANYIYSMGIDKLQ

SEQ ID NO: 2543314 - protein, 18 aa, Entamoeba dispar
VVLIDFGGGTLDVSCCKI

SEQ ID NO: 2543315 - protein, 17 aa, Entamoeba dispar
VVLLFVALGYENDQKIV

SEQ ID NO: 2543316 - protein, 18 aa, Entamoeba dispar
VVLMLHKENIDDPFVNFL

SEQ ID NO: 2543317 - protein, 20 aa, Entamoeba dispar
VVLNCYCAFWMNDKGLIQFN

SEQ ID NO: 2543318 - protein, 17 aa, Entamoeba dispar
VVLNDWYKISTNQVIIF

SEQ ID NO: 2543319 - protein, 25 aa, Entamoeba dispar
VVLTFIDQEKLLHYVKPIEKKLKGD

SEQ ID NO: 2543320 - protein, 32 aa, Entamoeba dispar
VVMKLCGWIIGRACLVLPSLYLGLMKNIEIPD

SEQ ID NO: 2543321 - protein, 26 aa, Entamoeba dispar
VVMMEPSNFYMWQFAGEIALQLNAVK

SEQ ID NO: 2543322 - protein, 23 aa, Entamoeba dispar
VVMSKFLFIGPIYGNYIKGELKS

SEQ ID NO: 2543323 - protein, 23 aa, Entamoeba dispar
VVMSLYQTILYNLSLNESPFTFE

SEQ ID NO: 2543324 - protein, 17 aa, Entamoeba dispar
VVNITCPNPFQLPPMTP

SEQ ID NO: 2543325 - protein, 44 aa, Entamoeba dispar
VVNNDYFFIVNGMLEYLKFFNIHKIIPIFVFDGATLPSKKLIEE

SEQ ID NO: 2543326 - protein, 29 aa, Entamoeba dispar
VVNQFQLATNLLWSLWGFVDASLSSIEWD

SEQ ID NO: 2543327 - protein, 27 aa, Entamoeba dispar
VVNYKSLPLYLYCFKLDSFICSFATYD

SEQ ID NO: 2543328 - protein, 18 aa, Entamoeba dispar
VVPDRRPPPTPIARSTPS

SEQ ID NO: 2543329 - protein, 25 aa, Entamoeba dispar
VVPLNCNQFPFLDYSQCIPLSITGS

SEQ ID NO: 2543330 - protein, 44 aa, Entamoeba dispar
VVQCITLIIIKLKSLLTRGLMIKYLHLLITLVTLTPEVATKHFT

SEQ ID NO: 2543331 - protein, 34 aa, Entamoeba dispar
VVQNIILSLVKLKHRIFAIEFFIKVAEYLKKLNN

SEQ ID NO: 2543332 - protein, 24 aa, Entamoeba dispar
VVQQLNILQKHPFSFKGHSLSSIK

SEQ ID NO: 2543333 - protein, 23 aa, Entamoeba dispar
VVQSLLRPYIQKCNTKPLFIFKS

SEQ ID NO: 2543334 - protein, 50 aa, Entamoeba dispar
VVRDWLEVNPLWDGKIIFCCYNLTDLNIYSKFLPYYFPTTEFEDNESKNI

SEQ ID NO: 2543335 - protein, 34 aa, Entamoeba dispar
VVRKGKIVVVYPRKLNYLILLQQSIWNNQQSKYI

SEQ ID NO: 2543336 - protein, 29 aa, Entamoeba dispar
VVRNTSSSPLLFYQKRQKINNTFEIIICC

SEQ ID NO: 2543337 - protein, 29 aa, Entamoeba dispar
VVRPMFENLSLLFKIFCTPKDQVVLIANA

SEQ ID NO: 2543338 - protein, 37 aa, Entamoeba dispar
VVSGRLPPPPPSAYACPLPPPPPVVGACPLPPPPPPS

SEQ ID NO: 2543339 - protein, 19 aa, Entamoeba dispar
VVSKILPISKTITSIIPGG

SEQ ID NO: 2543340 - protein, 20 aa, Entamoeba dispar
VVSLPSWELFNQQPVEYRES

SEQ ID NO: 2543341 - protein, 26 aa, Entamoeba dispar
VVSLQKTFKYFVPSKELFFKHYPEQP

SEQ ID NO: 2543342 - protein, 23 aa, Entamoeba dispar
VVTDIIHFKDFKLTYYPGDYDTF

SEQ ID NO: 2543343 - protein, 19 aa, Entamoeba dispar
VVTGTLLIERKFIHCGGLV

SEQ ID NO: 2543344 - protein, 26 aa, Entamoeba dispar
VVVEKKIHFGILLVDAIFPITDIPED

SEQ ID NO: 2543345 - protein, 19 aa, Entamoeba dispar
VVVFERLSRSLTLKNFDMV

SEQ ID NO: 2543346 - protein, 19 aa, Entamoeba dispar
VVVFFAKGKFYELYENDAD

SEQ ID NO: 2543347 - protein, 18 aa, Entamoeba dispar
VVVLLFNILPTVSQYPMS

SEQ ID NO: 2543348 - protein, 21 aa, Entamoeba dispar
VVWEESIILLPDTVHYVFLSA

SEQ ID NO: 2543349 - protein, 19 aa, Entamoeba dispar
VVYAMWDLYLLISNLQNNV

SEQ ID NO: 2543350 - protein, 19 aa, Entamoeba dispar
VVYKNTFVLPTPPSCNKLK

SEQ ID NO: 2543351 - protein, 17 aa, Entamoeba dispar
VVYSEPFAVYGINLPNQ

SEQ ID NO: 2543352 - protein, 24 aa, Entamoeba dispar
VVYSEPFYVYGVNLPNQSGATAES

SEQ ID NO: 2543353 - protein, 17 aa, Entamoeba dispar
VVYVLTSLRLREFKYKT

SEQ ID NO: 2543354 - protein, 21 aa, Entamoeba dispar
VVYYHVLMMVPKHDKFFNSMK

SEQ ID NO: 2543355 - protein, 24 aa, Entamoeba dispar
VWDHPLFKYLTDPGWRQVLEPVFK

SEQ ID NO: 2543356 - protein, 30 aa, Entamoeba dispar
VWDTHRIRELWLLLFKFIDHPLKLNNIEII

SEQ ID NO: 2543357 - protein, 18 aa, Entamoeba dispar
VWEAFAECLFLENGIWHK

SEQ ID NO: 2543358 - protein, 18 aa, Entamoeba dispar
VWFGLLHENANITPLFTL

SEQ ID NO: 2543359 - protein, 32 aa, Entamoeba dispar
VWINYCYWITCDNIIYLWHHFPDNYIDTTGFG

SEQ ID NO: 2543360 - protein, 29 aa, Entamoeba dispar
VWKSETVKNYILYFGSVKSNEQLEKEKQE

SEQ ID NO: 2543361 - protein, 26 aa, Entamoeba dispar
VWKVRHKSMRFISAAKIIKLNKSSSE

SEQ ID NO: 2543362 - protein, 18 aa, Entamoeba dispar
VWQNSWGLSTRSIGVTIM

SEQ ID NO: 2543363 - protein, 24 aa, Entamoeba dispar
VWSSGVLLFVMVCGYPPFSRINNQ

SEQ ID NO: 2543364 - protein, 26 aa, Entamoeba dispar
VWSTGVVLYVMACGFPPFVEGENDGN

SEQ ID NO: 2543365 - protein, 17 aa, Entamoeba dispar
VWTRVEKALRKEGVDEL

SEQ ID NO: 2543366 - protein, 17 aa, Entamoeba dispar
VYAILMGSVSNALRIYS

SEQ ID NO: 2543367 - protein, 25 aa, Entamoeba dispar
VYAYLIKNGLKKTAKSFLKEKKIEI

SEQ ID NO: 2543368 - protein, 28 aa, Entamoeba dispar
VYDPLIEGPFGFVPRKSIPKGKNWLNCE

SEQ ID NO: 2543369 - protein, 26 aa, Entamoeba dispar
VYDSYFIFYERIVSVMPKILKELPQL

SEQ ID NO: 2543370 - protein, 23 aa, Entamoeba dispar
VYDTINHWFGINGMITIGSTYWN

SEQ ID NO: 2543371 - protein, 21 aa, Entamoeba dispar
VYEGLYWILFKNQSNDFIEKQ

SEQ ID NO: 2543372 - protein, 24 aa, Entamoeba dispar
VYEISLFLGMLSKWCNITIERFNK

SEQ ID NO: 2543373 - protein, 23 aa, Entamoeba dispar
VYERAILRGYFVYLGVIKSLSRN

SEQ ID NO: 2543374 - protein, 27 aa, Entamoeba dispar
VYETTRYLFLVMELLEGGELFDYIISK

SEQ ID NO: 2543375 - protein, 20 aa, Entamoeba dispar
VYEYLPIGCKSDVWAFGCLV

SEQ ID NO: 2543376 - protein, 20 aa, Entamoeba dispar
VYFKPMLVHKKKGVFEAIND

SEQ ID NO: 2543377 - protein, 19 aa, Entamoeba dispar
VYFSIQPILSLFASEKTDG

SEQ ID NO: 2543378 - protein, 20 aa, Entamoeba dispar
VYGRMQLQLFYPNLYLRLNS

SEQ ID NO: 2543379 - protein, 18 aa, Entamoeba dispar
VYGYCLLSFGLCYDENCL

SEQ ID NO: 2543380 - protein, 26 aa, Entamoeba dispar
VYHCKIVLRFVFNLIQIAFTSQHKLL

SEQ ID NO: 2543381 - protein, 24 aa, Entamoeba dispar
VYHILSEVIRLCERSRWVNNFVQE

SEQ ID NO: 2543382 - protein, 27 aa, Entamoeba dispar
VYHKLCIALYASEHFFPKLPKKIKINK

SEQ ID NO: 2543383 - protein, 18 aa, Entamoeba dispar
VYIGEFRGNQVAIKKMKE

SEQ ID NO: 2543384 - protein, 17 aa, Entamoeba dispar
VYIPYHTKFKLIEQSHN

SEQ ID NO: 2543385 - protein, 34 aa, Entamoeba dispar
VYKKFKYQEVGLNRLYHLIANNLELMSQVQHTRI

SEQ ID NO: 2543386 - protein, 22 aa, Entamoeba dispar
VYKLNLLRRPMNNDQFLIIKNA

SEQ ID NO: 2543387 - protein, 18 aa, Entamoeba dispar
VYLAKILLKFSTSNDVKN

SEQ ID NO: 2543388 - protein, 27 aa, Entamoeba dispar
VYLASILICLPLLPPHRRVILRIAKNI

SEQ ID NO: 2543389 - protein, 17 aa, Entamoeba dispar
VYLFIQQHWNILSNITI

SEQ ID NO: 2543390 - protein, 17 aa, Entamoeba dispar
VYLPIKGGYIVSNGLQR

SEQ ID NO: 2543391 - protein, 28 aa, Entamoeba dispar
VYLTSERFMFIPQFLQMPYFMNNQEIKM

SEQ ID NO: 2543392 - protein, 26 aa, Entamoeba dispar
VYLVTRKMEFFIVDFPEMVKAYGENG

SEQ ID NO: 2543393 - protein, 18 aa, Entamoeba dispar
VYNFVMGFGFDKFVLIDG

SEQ ID NO: 2543394 - protein, 32 aa, Entamoeba dispar
VYNLCDHFKYTVPFLNYWTFDNTVFHFKNLDI

SEQ ID NO: 2543395 - protein, 19 aa, Entamoeba dispar
VYQPGYALSYILPNNLYGV

SEQ ID NO: 2543396 - protein, 21 aa, Entamoeba dispar
VYQPYNYLYSQLKSLSVTIPL

SEQ ID NO: 2543397 - protein, 24 aa, Entamoeba dispar
VYRCHNYFASYIIFSTLQKVLDET

SEQ ID NO: 2543398 - protein, 19 aa, Entamoeba dispar
VYRIMRQNALLLERKPAVP

SEQ ID NO: 2543399 - protein, 20 aa, Entamoeba dispar
VYSEPFIVYGVNLPNQSGGT

SEQ ID NO: 2543400 - protein, 24 aa, Entamoeba dispar
VYSFIQIHYMGWPDFGVPSNPKDA

SEQ ID NO: 2543401 - protein, 18 aa, Entamoeba dispar
VYSLFIDEIGFPKIYHYG

SEQ ID NO: 2543402 - protein, 17 aa, Entamoeba dispar
VYSSLIPNLVYPNKRLI

SEQ ID NO: 2543403 - protein, 19 aa, Entamoeba dispar
VYSTYGKLLPFLLNEMTLA

SEQ ID NO: 2543404 - protein, 30 aa, Entamoeba dispar
VYTKEEFLKSLPLPKTVLTDGTIPSKGILT

SEQ ID NO: 2543405 - protein, 22 aa, Entamoeba dispar
VYTYPNQWLKYESSNQITFNIC

SEQ ID NO: 2543406 - protein, 17 aa, Entamoeba dispar
VYVINNSIIPIMWNELK

SEQ ID NO: 2543407 - protein, 19 aa, Entamoeba dispar
VYYNGLPLRFGYSIEDFCE

SEQ ID NO: 2543408 - protein, 21 aa, Entamoeba dispar
VYYQIVDFLYDYFIDMISTKD

SEQ ID NO: 2543409 - protein, 21 aa, Entamoeba dispar
WAAGIMMYFLATGKHPFEQLV

SEQ ID NO: 2543410 - protein, 39 aa, Entamoeba dispar
WAGQCLILANFLILPVQRLPRYVLLLESLLKATPPIEEY

SEQ ID NO: 2543411 - protein, 25 aa, Entamoeba dispar
WANHGKMILLVGLEGFLACIEYSNE

SEQ ID NO: 2543412 - protein, 19 aa, Entamoeba dispar
WAVKLKYINRLCSLFIHTD

SEQ ID NO: 2543413 - protein, 18 aa, Entamoeba dispar
WAYHIRKARKTLIFVELR

SEQ ID NO: 2543414 - protein, 19 aa, Entamoeba dispar
WCDGEFNVICATIAFGMGI

SEQ ID NO: 2543415 - protein, 18 aa, Entamoeba dispar
WCFLRIDIASTVPESFYQ

SEQ ID NO: 2543416 - protein, 17 aa, Entamoeba dispar
WCHANKFCIIYNSENQE

SEQ ID NO: 2543417 - protein, 20 aa, Entamoeba dispar
WDAIFAYGNNLEFVDYLFLA

SEQ ID NO: 2543418 - protein, 19 aa, Entamoeba dispar
WDDFFIHPFIQRCRDYKVE

SEQ ID NO: 2543419 - protein, 20 aa, Entamoeba dispar
WDIIYQQIVLWCIGSTISYY

SEQ ID NO: 2543420 - protein, 17 aa, Entamoeba dispar
WDKRYLIESLSDSTIYM

SEQ ID NO: 2543421 - protein, 17 aa, Entamoeba dispar
WDLASMKVAHQLNHHQG

SEQ ID NO: 2543422 - protein, 18 aa, Entamoeba dispar
WDLFKMWTGKACCHVLYD

SEQ ID NO: 2543423 - protein, 40 aa, Entamoeba dispar
WDTAGQERFATLTGNYFRNAMATIIMFDVSNKESFENVSN

SEQ ID NO: 2543424 - protein, 19 aa, Entamoeba dispar
WDTELFMMKDLHIDYVVHG

SEQ ID NO: 2543425 - protein, 27 aa, Entamoeba dispar
WEAIQQSILMYLLIENGYVITIDRPDK

SEQ ID NO: 2543426 - protein, 24 aa, Entamoeba dispar
WEDYEFAPFSYQKEIKYLFIAQEG

SEQ ID NO: 2543427 - protein, 22 aa, Entamoeba dispar
WEEGRIYITNLPFNCTEDDIRK

SEQ ID NO: 2543428 - protein, 26 aa, Entamoeba dispar
WEEKKRSIPIPRKFIKFIEGPEVKNK

SEQ ID NO: 2543429 - protein, 27 aa, Entamoeba dispar
WEELPPHALSFIQAYTNHWNLNEKKEF

SEQ ID NO: 2543430 - protein, 22 aa, Entamoeba dispar
WEEWYEKELIPLARIERKYDYD

SEQ ID NO: 2543431 - protein, 18 aa, Entamoeba dispar
WEFFDIIFGIPMDCYDEN

SEQ ID NO: 2543432 - protein, 17 aa, Entamoeba dispar
WEGKLTKQQILAIDLKE

SEQ ID NO: 2543433 - protein, 20 aa, Entamoeba dispar
WEHVCIVWTKCFNYTPLKKI

SEQ ID NO: 2543434 - protein, 17 aa, Entamoeba dispar
WEIFVKGLKNKDSTISE

SEQ ID NO: 2543435 - protein, 17 aa, Entamoeba dispar
WEIILENVDLIKEGKYH

SEQ ID NO: 2543436 - protein, 18 aa, Entamoeba dispar
WENKKFHYHFPEKHKNIN

SEQ ID NO: 2543437 - protein, 26 aa, Entamoeba dispar
WESRKLEVNFLLLCQIKQIEEWTNRK

SEQ ID NO: 2543438 - protein, 25 aa, Entamoeba dispar
WEVLYKQWETILPKTINLFNQLIEL

SEQ ID NO: 2543439 - protein, 31 aa, Entamoeba dispar
WEVNKGMKRNIRKTIFVGNLPFKMEEEQLRH

SEQ ID NO: 2543440 - protein, 18 aa, Entamoeba dispar
WFDHWGIVPGDPLDKEIK

SEQ ID NO: 2543441 - protein, 23 aa, Entamoeba dispar
WFNKLIGQFWGGNDYYLVAHDFA

SEQ ID NO: 2543442 - protein, 27 aa, Entamoeba dispar
WFPEKTCPFILSYLLSEQSNVVHLLTD

SEQ ID NO: 2543443 - protein, 28 aa, Entamoeba dispar
WFTEQTIQFLPLIPSQIKIIRLPVISPE

SEQ ID NO: 2543444 - protein, 29 aa, Entamoeba dispar
WGCTLRSIQMLFLNSLIRLQEPNPGFGED

SEQ ID NO: 2543445 - protein, 27 aa, Entamoeba dispar
WGDIEFSKYFKKYHPIIGQVIKRKRGN

SEQ ID NO: 2543446 - protein, 27 aa, Entamoeba dispar
WGDIMTTYVMLKYRKWQIKDRRTMSLH

SEQ ID NO: 2543447 - protein, 34 aa, Entamoeba dispar
WGELEYIRVLPIRNIAFIRYKLRGSAEFAKVAMS

SEQ ID NO: 2543448 - protein, 17 aa, Entamoeba dispar
WGFDDEANHLLLSNGIN

SEQ ID NO: 2543449 - protein, 17 aa, Entamoeba dispar
WGKWNIMRGINLHKTQC

SEQ ID NO: 2543450 - protein, 19 aa, Entamoeba dispar
WGMYGIPLKSAIKKSQWRV

SEQ ID NO: 2543451 - protein, 18 aa, Entamoeba dispar
WGYGIRYQYGMFKQGIVG

SEQ ID NO: 2543452 - protein, 18 aa, Entamoeba dispar
WGYGIRYQYGMFKQQISH

SEQ ID NO: 2543453 - protein, 19 aa, Entamoeba dispar
WIAKMFDHIPVEFYHTEIE

SEQ ID NO: 2543454 - protein, 18 aa, Entamoeba dispar
WICGGVPLTIMMNMEQRN

SEQ ID NO: 2543455 - protein, 17 aa, Entamoeba dispar
WIDLTPGTEVKDLTQPG

SEQ ID NO: 2543456 - protein, 19 aa, Entamoeba dispar
WIDRKRVLYWKNKIFHLIF

SEQ ID NO: 2543457 - protein, 27 aa, Entamoeba dispar
WIGMDSNLRVVFLALKEFDSMPLEFNQ

SEQ ID NO: 2543458 - protein, 17 aa, Entamoeba dispar
WIIIDCMSTIASSSKAF

SEQ ID NO: 2543459 - protein, 18 aa, Entamoeba dispar
WIKCAQGDRYRMGNLFIV

SEQ ID NO: 2543460 - protein, 18 aa, Entamoeba dispar
WIKCASGDRYRMGNLFIV

SEQ ID NO: 2543461 - protein, 17 aa, Entamoeba dispar
WILFKNQSNDFIEKQIK

SEQ ID NO: 2543462 - protein, 17 aa, Entamoeba dispar
WILLIEMLNMVEHNNIL

SEQ ID NO: 2543463 - protein, 17 aa, Entamoeba dispar
WIPGMKDLLQKALAKIL

SEQ ID NO: 2543464 - protein, 18 aa, Entamoeba dispar
WIQLNYFDIIYNSEIEEL

SEQ ID NO: 2543465 - protein, 18 aa, Entamoeba dispar
WISPAFQIATSKIDKEKP

SEQ ID NO: 2543466 - protein, 18 aa, Entamoeba dispar
WISYFYSNFNILFEKDIE

SEQ ID NO: 2543467 - protein, 27 aa, Entamoeba dispar
WKDIVTPFKLKLFFYSKQTQEANMGIL

SEQ ID NO: 2543468 - protein, 28 aa, Entamoeba dispar
WKEHDVLEYFKEFHPLKALIIYDKESKI

SEQ ID NO: 2543469 - protein, 19 aa, Entamoeba dispar
WKEIQENIYTFQNLELLRL

SEQ ID NO: 2543470 - protein, 34 aa, Entamoeba dispar
WKEIQENIYTFQNLELLRLNYCSNLNVSLISNKL

SEQ ID NO: 2543471 - protein, 17 aa, Entamoeba dispar
WKFIERNAIIYPEQKEE

SEQ ID NO: 2543472 - protein, 18 aa, Entamoeba dispar
WKIIFVDGFIRSTKFEYG

SEQ ID NO: 2543473 - protein, 24 aa, Entamoeba dispar
WKKENILNYLPFYANAKQIGVLAC

SEQ ID NO: 2543474 - protein, 28 aa, Entamoeba dispar
WKKESLLSLILNYSPYPISRQLNYFTNL

SEQ ID NO: 2543475 - protein, 29 aa, Entamoeba dispar
WKNEESLTVALQLKLALAIDELERSAQVI

SEQ ID NO: 2543476 - protein, 26 aa, Entamoeba dispar
WKNIRKNILFVFGTLDFCPHQKVNGT

SEQ ID NO: 2543477 - protein, 27 aa, Entamoeba dispar
WKRFNATFAYLPILALINKKILCVHGG

SEQ ID NO: 2543478 - protein, 19 aa, Entamoeba dispar
WKRLACEVVNIPTGSFFSK

SEQ ID NO: 2543479 - protein, 21 aa, Entamoeba dispar
WKSQPVDSLSLPVANTIRVMR

SEQ ID NO: 2543480 - protein, 26 aa, Entamoeba dispar
WKTYMLEYFMLWFCRCFHPEFEVRIL

SEQ ID NO: 2543481 - protein, 20 aa, Entamoeba dispar
WKYVDYIREFWEWDSPQNRK

SEQ ID NO: 2543482 - protein, 21 aa, Entamoeba dispar
WLHLTMKSPILISLLSGKELR

SEQ ID NO: 2543483 - protein, 17 aa, Entamoeba dispar
WLKDLDAFVKKYPQWLE

SEQ ID NO: 2543484 - protein, 24 aa, Entamoeba dispar
WLKPYHALRFLMYQPSFCSAQTQR

SEQ ID NO: 2543485 - protein, 18 aa, Entamoeba dispar
WLNLIDGSVYCGREQMMI

SEQ ID NO: 2543486 - protein, 17 aa, Entamoeba dispar
WLNSALSGRTKRIKTLV

SEQ ID NO: 2543487 - protein, 23 aa, Entamoeba dispar
WLPKEEWSLFNKSIVAFGQCCCR

SEQ ID NO: 2543488 - protein, 17 aa, Entamoeba dispar
WLPSIKVALMGGTRESR

SEQ ID NO: 2543489 - protein, 17 aa, Entamoeba dispar
WLSQKFPKIIDSCQGSF

SEQ ID NO: 2543490 - protein, 18 aa, Entamoeba dispar
WMGYNLMFESMLASVIYA

SEQ ID NO: 2543491 - protein, 19 aa, Entamoeba dispar
WMKYPLMEFLSTYVIIMID

SEQ ID NO: 2543492 - protein, 27 aa, Entamoeba dispar
WMNQYKQEILYSVAWKSFLKGSYKKEA

SEQ ID NO: 2543493 - protein, 17 aa, Entamoeba dispar
WMPPEVILDKVYNNKID

SEQ ID NO: 2543494 - protein, 22 aa, Entamoeba dispar
WNDLMEFQKFLFKLLHVTSDFN

SEQ ID NO: 2543495 - protein, 18 aa, Entamoeba dispar
WNELLINMFTLGNDLDIE

SEQ ID NO: 2543496 - protein, 24 aa, Entamoeba dispar
WNFVSLFCDSVPQPLFTYTSHSLP

SEQ ID NO: 2543497 - protein, 26 aa, Entamoeba dispar
WNFVTKQLVFFVITTNMAALFSIDQT

SEQ ID NO: 2543498 - protein, 22 aa, Entamoeba dispar
WNGWIPNFLINTIGIDVCPSVL

SEQ ID NO: 2543499 - protein, 19 aa, Entamoeba dispar
WNHEELIKFLLESIGIDSE

SEQ ID NO: 2543500 - protein, 18 aa, Entamoeba dispar
WNKELYANEYFEGKWNGE

SEQ ID NO: 2543501 - protein, 31 aa, Entamoeba dispar
WNKSVNPAYFIYMYYLYANIVSLNVYRMSRG

SEQ ID NO: 2543502 - protein, 30 aa, Entamoeba dispar
WNLMVESYSFNWLFPEIYVLEGGFKSFYKR

SEQ ID NO: 2543503 - protein, 24 aa, Entamoeba dispar
WNNRDPILIDLIKRMLVVDVNQRI

SEQ ID NO: 2543504 - protein, 23 aa, Entamoeba dispar
WNQETHSWVPRFGMGSAKQIKKK

SEQ ID NO: 2543505 - protein, 17 aa, Entamoeba dispar
WNQIKKDLKFVSKGAQG

SEQ ID NO: 2543506 - protein, 25 aa, Entamoeba dispar
WNSLLNVLSIVCTTLYVIEVDPNKK

SEQ ID NO: 2543507 - protein, 18 aa, Entamoeba dispar
WNSMTWEPPCELLDCGKT

SEQ ID NO: 2543508 - protein, 25 aa, Entamoeba dispar
WNSSTDLLILLEGLLAYFGSVPPVR

SEQ ID NO: 2543509 - protein, 23 aa, Entamoeba dispar
WNTALIGLMMYFREATIHTQELL

SEQ ID NO: 2543510 - protein, 18 aa, Entamoeba dispar
WNVVGFPSFRFCEHLIEI

SEQ ID NO: 2543511 - protein, 28 aa, Entamoeba dispar
WPDYQLRPNFLITLVEAPNLFIDHLDKV

SEQ ID NO: 2543512 - protein, 18 aa, Entamoeba dispar
WPNYTQRIKMVRKVFDNY

SEQ ID NO: 2543513 - protein, 18 aa, Entamoeba dispar
WQFTETLSVLKHKVFPSP

SEQ ID NO: 2543514 - protein, 20 aa, Entamoeba dispar
WQHDHFIVHTSKAGYLAQSI

SEQ ID NO: 2543515 - protein, 25 aa, Entamoeba dispar
WQLGCVYIQMILRAPPFKGHSVNSI

SEQ ID NO: 2543516 - protein, 23 aa, Entamoeba dispar
WQQSDFLWSGRCLVTRSPEHCIV

SEQ ID NO: 2543517 - protein, 18 aa, Entamoeba dispar
WRDDNGFNFITFSSNLKT

SEQ ID NO: 2543518 - protein, 20 aa, Entamoeba dispar
WRLDIVLSYKNVYKLIQPQF

SEQ ID NO: 2543519 - protein, 29 aa, Entamoeba dispar
WRPINEFCTYILFFLKAIPSVPEVAGLAI

SEQ ID NO: 2543520 - protein, 26 aa, Entamoeba dispar
WRRKEGEVFVPRKAPTEFREHEQREP

SEQ ID NO: 2543521 - protein, 23 aa, Entamoeba dispar
WRRTQFCFVINRVNYFLTREEEL

SEQ ID NO: 2543522 - protein, 30 aa, Entamoeba dispar
WRTDIKNFVFYDLKPLDRWTAIVPSQCMSE

SEQ ID NO: 2543523 - protein, 18 aa, Entamoeba dispar
WSFGCIAAELILGIPIFP

SEQ ID NO: 2543524 - protein, 21 aa, Entamoeba dispar
WSGCYFLRLNLMKKAEFMFRN

SEQ ID NO: 2543525 - protein, 20 aa, Entamoeba dispar
WSHACMIFELLTGDFLFAPK

SEQ ID NO: 2543526 - protein, 19 aa, Entamoeba dispar
WSHGCMIFEMLTGDYLFKP

SEQ ID NO: 2543527 - protein, 25 aa, Entamoeba dispar
WSKRSILTPFYAPINYIRVKNDDCI

SEQ ID NO: 2543528 - protein, 37 aa, Entamoeba dispar
WSLALDPFLPEYLTSIFVYVAPLFTSLEFIVDHLQME

SEQ ID NO: 2543529 - protein, 26 aa, Entamoeba dispar
WSLGILIYEMIVGIPPFYDDDVSLMY

SEQ ID NO: 2543530 - protein, 17 aa, Entamoeba dispar
WSMYLEKKMCIAIEFAP

SEQ ID NO: 2543531 - protein, 18 aa, Entamoeba dispar
WTCSEIFRLLPGMCQSLL

SEQ ID NO: 2543532 - protein, 18 aa, Entamoeba dispar
WTDLYWRDVMSDEAIVVK

SEQ ID NO: 2543533 - protein, 38 aa, Entamoeba dispar
WTEKYIKIVTDFFPSLPLTIFQICNVYRELVIKHLPTL

SEQ ID NO: 2543534 - protein, 17 aa, Entamoeba dispar
WTKEECLAFEKIIKFLN

SEQ ID NO: 2543535 - protein, 23 aa, Entamoeba dispar
WTKQRAFKVLYNSNYEGLNCEHL

SEQ ID NO: 2543536 - protein, 20 aa, Entamoeba dispar
WTLNFLKDTLSFYGFEIHEK

SEQ ID NO: 2543537 - protein, 24 aa, Entamoeba dispar
WTLNYHVMIITYGLKFYLYNLDGE

SEQ ID NO: 2543538 - protein, 20 aa, Entamoeba dispar
WTPKVAPAPEVPQPTYQRPT

SEQ ID NO: 2543539 - protein, 40 aa, Entamoeba dispar
WTQSCIVLPNFLILPVQRLPRYILLLETLLKSTPEIVQDE

SEQ ID NO: 2543540 - protein, 18 aa, Entamoeba dispar
WTSFSFDEYMEGLMAPIP

SEQ ID NO: 2543541 - protein, 32 aa, Entamoeba dispar
WVEENIKSIDFWENFDLQRPKGVIVICNKIKE

SEQ ID NO: 2543542 - protein, 23 aa, Entamoeba dispar
WVFWDVCGQAKFRSLWKSYYTNV

SEQ ID NO: 2543543 - protein, 17 aa, Entamoeba dispar
WVGNYNYEAPKHYTWHY

SEQ ID NO: 2543544 - protein, 28 aa, Entamoeba dispar
WVKEDWFQKKFIFIPQYQGDGKSGHWYL

SEQ ID NO: 2543545 - protein, 17 aa, Entamoeba dispar
WVLIKDLLNNRQMKGIS

SEQ ID NO: 2543546 - protein, 19 aa, Entamoeba dispar
WVMEVIGCGFTLPVDDHKT

SEQ ID NO: 2543547 - protein, 19 aa, Entamoeba dispar
WVNKMALVSKTLGVFGYPL

SEQ ID NO: 2543548 - protein, 17 aa, Entamoeba dispar
WVNPFNQTTTNNPFIQE

SEQ ID NO: 2543549 - protein, 18 aa, Entamoeba dispar
WVPIRRKMAADNSCLFHC

SEQ ID NO: 2543550 - protein, 18 aa, Entamoeba dispar
WVTDDFLPTMTRIGIPSD

SEQ ID NO: 2543551 - protein, 20 aa, Entamoeba dispar
WVTSLSYCSSFLFAGIANQS

SEQ ID NO: 2543552 - protein, 27 aa, Entamoeba dispar
WVVFEHKLFFFHFFLDTTNEQSISTFL

SEQ ID NO: 2543553 - protein, 17 aa, Entamoeba dispar
WVVKLYYSFQDNDYLYL

SEQ ID NO: 2543554 - protein, 29 aa, Entamoeba dispar
WYESSNHIILIMKLLPLVLPSLSNNILES

SEQ ID NO: 2543555 - protein, 26 aa, Entamoeba dispar
WYHSHPGFGCWLSSIDISTQQSFEKL

SEQ ID NO: 2543556 - protein, 20 aa, Entamoeba dispar
WYINNQLIYVPIPDSIQDFK

SEQ ID NO: 2543557 - protein, 17 aa, Entamoeba dispar
WYLKFNNAAIYDDDIKD

SEQ ID NO: 2543558 - protein, 17 aa, Entamoeba dispar
WYSARGSKHQGGINYVP

SEQ ID NO: 2543559 - protein, 21 aa, Entamoeba dispar
WYTSLINPWKQYEEKIPLEIN

SEQ ID NO: 2543560 - protein, 25 aa, Entamoeba dispar
  misc_feature (1)..(1): Xaa can be any naturally occurring amino acid
XKRVWDFILAKPEDKMFLFVMAAIL

SEQ ID NO: 2543561 - protein, 34 aa, Entamoeba dispar
  misc_feature (1)..(2): Xaa can be any naturally occurring amino acid
XXCLHEFLSFYVVLMKFINYKLYTNAGLNYPPQI

SEQ ID NO: 2543562 - protein, 26 aa, Entamoeba dispar
  misc_feature (1)..(2): Xaa can be any naturally occurring amino acid
XXIKKEMFFFDAFPLATKVSIFEIQR

SEQ ID NO: 2543563 - protein, 25 aa, Entamoeba dispar
  misc_feature (1)..(2): Xaa can be any naturally occurring amino acid
XXYYSSVFGIRWIKMLFACEFHIED

SEQ ID NO: 2543564 - protein, 20 aa, Entamoeba dispar
YAAFNKFCYSFFDSAFKAED

SEQ ID NO: 2543565 - protein, 35 aa, Entamoeba dispar
YAAFRYIELRTESIWKFLIPFISRILDCLEDEDEG

SEQ ID NO: 2543566 - protein, 21 aa, Entamoeba dispar
YAASRRIKGYAYYTALEYSNT

SEQ ID NO: 2543567 - protein, 28 aa, Entamoeba dispar
YAAVDNPLFFYSNTRMFLSDCKKGFEEL

SEQ ID NO: 2543568 - protein, 21 aa, Entamoeba dispar
YACEFEIFITIKCTTKIKEQI

SEQ ID NO: 2543569 - protein, 23 aa, Entamoeba dispar
YACEFEIFITIKCTTKIKEQIMI

SEQ ID NO: 2543570 - protein, 18 aa, Entamoeba dispar
YACKDTVRMVLGGNNLIE

SEQ ID NO: 2543571 - protein, 22 aa, Entamoeba dispar
YAEAFEIIPYTLAENAGLNPME

SEQ ID NO: 2543572 - protein, 18 aa, Entamoeba dispar
YAEALYQLKSWKELHALA

SEQ ID NO: 2543573 - protein, 18 aa, Entamoeba dispar
YAEVFICFGYISQDDLFS

SEQ ID NO: 2543574 - protein, 18 aa, Entamoeba dispar
YAFLALARVMAKYGRQDP

SEQ ID NO: 2543575 - protein, 19 aa, Entamoeba dispar
YAFLPPQNKYPINAFEICH

SEQ ID NO: 2543576 - protein, 28 aa, Entamoeba dispar
YAGFEQQPKLFYKPKILCLNIELELKKE

SEQ ID NO: 2543577 - protein, 26 aa, Entamoeba dispar
YAGQRIIDDLLKREWGFIIFDEVHGS

SEQ ID NO: 2543578 - protein, 24 aa, Entamoeba dispar
YAHGKVLELLLWMFEKELTENPPE

SEQ ID NO: 2543579 - protein, 20 aa, Entamoeba dispar
YAIHLALYSAFYPNYFTTEC

SEQ ID NO: 2543580 - protein, 18 aa, Entamoeba dispar
YAITFPFKNKKMIAADVM

SEQ ID NO: 2543581 - protein, 25 aa, Entamoeba dispar
YAKEIKMLKLLSSKVLKNLKNEEEE

SEQ ID NO: 2543582 - protein, 17 aa, Entamoeba dispar
YAKRRLDNQIRDLELKK

SEQ ID NO: 2543583 - protein, 20 aa, Entamoeba dispar
YALCVKYRSSPLLHLSWLNN

SEQ ID NO: 2543584 - protein, 19 aa, Entamoeba dispar
YALIVDVILRMIRVLERQF

SEQ ID NO: 2543585 - protein, 17 aa, Entamoeba dispar
YALKARYPQQFFIIRGN

SEQ ID NO: 2543586 - protein, 18 aa, Entamoeba dispar
YALSCGKYVQYYGPLPSA

SEQ ID NO: 2543587 - protein, 19 aa, Entamoeba dispar
YANALIFISPSKKSVNDLC

SEQ ID NO: 2543588 - protein, 24 aa, Entamoeba dispar
YANNKVIIYTLIDFDMISRYKGMT

SEQ ID NO: 2543589 - protein, 17 aa, Entamoeba dispar
YAPDYYVADSKGIVIDP

SEQ ID NO: 2543590 - protein, 19 aa, Entamoeba dispar
YAPMMQFIEVIFPTCLRIL

SEQ ID NO: 2543591 - protein, 30 aa, Entamoeba dispar
YAQDPTIQFQWWYPLVQNLSANDFRELQDW

SEQ ID NO: 2543592 - protein, 27 aa, Entamoeba dispar
YAQLEFAICAVFRSWMGKRAVDYRREF

SEQ ID NO: 2543593 - protein, 26 aa, Entamoeba dispar
YARGDTHYLLYIIDQLRNECIDVGIL

SEQ ID NO: 2543594 - protein, 17 aa, Entamoeba dispar
YARILQRLGYNVKFNHF

SEQ ID NO: 2543595 - protein, 25 aa, Entamoeba dispar
YARKRIKENSFLSEPKRSSFVVYGT

SEQ ID NO: 2543596 - protein, 24 aa, Entamoeba dispar
YASGKYFMFRAINTPCLQKLSDEI

SEQ ID NO: 2543597 - protein, 26 aa, Entamoeba dispar
YASNYLELILRIFKKPYLTFGDKTGI

SEQ ID NO: 2543598 - protein, 25 aa, Entamoeba dispar
YASTEFIHIFAFTGNILCEPKFIIN

SEQ ID NO: 2543599 - protein, 25 aa, Entamoeba dispar
YASVYEDLLAVPVIRGKKSKGETFP

SEQ ID NO: 2543600 - protein, 24 aa, Entamoeba dispar
YATDPFRFFEEMFGGFGMFAGGPS

SEQ ID NO: 2543601 - protein, 18 aa, Entamoeba dispar
YATSGLIHIFIGSEINPT

SEQ ID NO: 2543602 - protein, 17 aa, Entamoeba dispar
YAYYSFFEDGFINESKK

SEQ ID NO: 2543603 - protein, 22 aa, Entamoeba dispar
YCAGGDFWRLLNKQPGNCFREV

SEQ ID NO: 2543604 - protein, 19 aa, Entamoeba dispar
YCARWIAKSLVHAGLCHRV

SEQ ID NO: 2543605 - protein, 17 aa, Entamoeba dispar
YCCRYYDREIREIRIEE

SEQ ID NO: 2543606 - protein, 27 aa, Entamoeba dispar
YCDISNIFNPFPRDYLKNGKYLNMYVL

SEQ ID NO: 2543607 - protein, 26 aa, Entamoeba dispar
YCEGKLCIYCVARFSFRIGERYYSQS

SEQ ID NO: 2543608 - protein, 18 aa, Entamoeba dispar
YCEKRCTMFVPVPKVLQK

SEQ ID NO: 2543609 - protein, 17 aa, Entamoeba dispar
YCELFIKNVLNQLEIVF

SEQ ID NO: 2543610 - protein, 18 aa, Entamoeba dispar
YCFYGCEKLKLKSKNIPS

SEQ ID NO: 2543611 - protein, 19 aa, Entamoeba dispar
YCGKRYTSLWSLENDCGGH

SEQ ID NO: 2543612 - protein, 25 aa, Entamoeba dispar
YCGNTNLLMLPYTTTLSTIDSFIVM

SEQ ID NO: 2543613 - protein, 20 aa, Entamoeba dispar
YCGYGRIIRYINILSNGIGS

SEQ ID NO: 2543614 - protein, 26 aa, Entamoeba dispar
YCIDLSLPIQFCLPKVFKLTNMITDT

SEQ ID NO: 2543615 - protein, 17 aa, Entamoeba dispar
YCIKRIRELLRELIFIS

SEQ ID NO: 2543616 - protein, 21 aa, Entamoeba dispar
YCIRTMEIIGIIFINNKKQPN

SEQ ID NO: 2543617 - protein, 23 aa, Entamoeba dispar
YCIYDMKLAVLQFIPFYHTTQVV

SEQ ID NO: 2543618 - protein, 25 aa, Entamoeba dispar
YCKGAAYLAYLKRGNYAHEVIYDNV

SEQ ID NO: 2543619 - protein, 20 aa, Entamoeba dispar
YCLEYFLDNIEWFEEQLGDY

SEQ ID NO: 2543620 - protein, 20 aa, Entamoeba dispar
YCMKSNMLELLRIIKDPQQI

SEQ ID NO: 2543621 - protein, 27 aa, Entamoeba dispar
YCNANAFFRYDCFEDKIMVSSALSTLY

SEQ ID NO: 2543622 - protein, 18 aa, Entamoeba dispar
YCNFFSLDKYWQGNQIQQ

SEQ ID NO: 2543623 - protein, 26 aa, Entamoeba dispar
YCNGKQSAFIRFEGLKRGKYCVRVFL

SEQ ID NO: 2543624 - protein, 37 aa, Entamoeba dispar
YCNVPLFKEMLLPALKYGCTLLLPHTIYPSIEFYLTH

SEQ ID NO: 2543625 - protein, 17 aa, Entamoeba dispar
YCPGGEFYYYLQKNGKV

SEQ ID NO: 2543626 - protein, 18 aa, Entamoeba dispar
YCPLLFSKTSFKYRIMNR

SEQ ID NO: 2543627 - protein, 18 aa, Entamoeba dispar
YCPLLKKIHIPSSLNKLS

SEQ ID NO: 2543628 - protein, 23 aa, Entamoeba dispar
YCPQCHKFIQLPFGSPEILPTPY

SEQ ID NO: 2543629 - protein, 17 aa, Entamoeba dispar
YCRRLINSIKRGDDITT

SEQ ID NO: 2543630 - protein, 18 aa, Entamoeba dispar
YCSEEVINPMIQPTTFLP

SEQ ID NO: 2543631 - protein, 23 aa, Entamoeba dispar
YCSKIYVETLLNTDAFKAGNYQQ

SEQ ID NO: 2543632 - protein, 17 aa, Entamoeba dispar
YCTEAFDYLGLAAIIDQ

SEQ ID NO: 2543633 - protein, 22 aa, Entamoeba dispar
YCTSLKTITLPSSLLSLHDFCF

SEQ ID NO: 2543634 - protein, 21 aa, Entamoeba dispar
YCVIKLNRWYTKPKTIKYGNV

SEQ ID NO: 2543635 - protein, 17 aa, Entamoeba dispar
YCVKYYHKLKKGYNILL

SEQ ID NO: 2543636 - protein, 17 aa, Entamoeba dispar
YCVYFSKYKFELNQPMQ

SEQ ID NO: 2543637 - protein, 17 aa, Entamoeba dispar
YCWVKTGEKIKFELIFK

SEQ ID NO: 2543638 - protein, 18 aa, Entamoeba dispar
YCYESMFSVERIICIQML

SEQ ID NO: 2543639 - protein, 19 aa, Entamoeba dispar
YCYHSFGWDENGIVCYCRV

SEQ ID NO: 2543640 - protein, 26 aa, Entamoeba dispar
YDASVMQAYRWLQEHKGLFEEEVYGP

SEQ ID NO: 2543641 - protein, 26 aa, Entamoeba dispar
YDAVKKIVLFLRKFLRQLEGVVSNYA

SEQ ID NO: 2543642 - protein, 22 aa, Entamoeba dispar
YDAYNIPRFDDCHFTRVDSCKY

SEQ ID NO: 2543643 - protein, 26 aa, Entamoeba dispar
YDDEQHYKFILFDDINYDKNTIRLIK

SEQ ID NO: 2543644 - protein, 26 aa, Entamoeba dispar
YDDEQHYRFILLDDINYDKNTVRLIK

SEQ ID NO: 2543645 - protein, 27 aa, Entamoeba dispar
YDDEQHYRFILLDDINYDKNTVRLIKA

SEQ ID NO: 2543646 - protein, 27 aa, Entamoeba dispar
YDDEQNYKFILFDDINYDRNLIRLIKA

SEQ ID NO: 2543647 - protein, 26 aa, Entamoeba dispar
YDDEQPYRFIIFDDINYDRNLIRLIK

SEQ ID NO: 2543648 - protein, 29 aa, Entamoeba dispar
YDDIIKILQTTHLLLNLFEKFSSSEPTIS

SEQ ID NO: 2543649 - protein, 20 aa, Entamoeba dispar
YDDKYYIDPTITRKEFEEEC

SEQ ID NO: 2543650 - protein, 21 aa, Entamoeba dispar
YDDREHWPFKIKGKDNGSAYI

SEQ ID NO: 2543651 - protein, 22 aa, Entamoeba dispar
YDDVLRINCQLVEIADGCERCR

SEQ ID NO: 2543652 - protein, 26 aa, Entamoeba dispar
YDEDPDFFWKYLFKCYDAYDQITNSF

SEQ ID NO: 2543653 - protein, 28 aa, Entamoeba dispar
YDEEEHYKFILFDDINYDKSLIRLIKAI

SEQ ID NO: 2543654 - protein, 26 aa, Entamoeba dispar
YDEGILQVNLPRKQQTRRSMYPRFGM

SEQ ID NO: 2543655 - protein, 27 aa, Entamoeba dispar
YDEGILQVNLPRKQQTRRSMYPRFGMN

SEQ ID NO: 2543656 - protein, 25 aa, Entamoeba dispar
YDEILAQIVYFIISYNFNDCFDQKK

SEQ ID NO: 2543657 - protein, 18 aa, Entamoeba dispar
YDELQWVNHIRLPCIIIP

SEQ ID NO: 2543658 - protein, 20 aa, Entamoeba dispar
YDESVWKRFNATFAYLPILA

SEQ ID NO: 2543659 - protein, 19 aa, Entamoeba dispar
YDFSINFIKEQKKWFPEKT

SEQ ID NO: 2543660 - protein, 19 aa, Entamoeba dispar
YDFVVKDIPFHLIDVGGQR

SEQ ID NO: 2543661 - protein, 19 aa, Entamoeba dispar
YDFYVLSDKFKFIVCSFNE

SEQ ID NO: 2543662 - protein, 28 aa, Entamoeba dispar
YDGRFLAKFGIINIIMRGKMIYKMVVKY

SEQ ID NO: 2543663 - protein, 20 aa, Entamoeba dispar
YDHFSVYGLVEKVTVVGKGA

SEQ ID NO: 2543664 - protein, 17 aa, Entamoeba dispar
YDIAWTGDNQRICVVGE

SEQ ID NO: 2543665 - protein, 18 aa, Entamoeba dispar
YDIKKQNYLTVLNVITIS

SEQ ID NO: 2543666 - protein, 21 aa, Entamoeba dispar
YDINRRLYVIKLSKTDCKEFI

SEQ ID NO: 2543667 - protein, 26 aa, Entamoeba dispar
YDIVAIPQIICFIKNYYFDDGILTDE

SEQ ID NO: 2543668 - protein, 23 aa, Entamoeba dispar
YDKALAVRALTSELIVLAGTIAK

SEQ ID NO: 2543669 - protein, 29 aa, Entamoeba dispar
YDKCLNSYHFILISYFDLRDVKTVYRLLQ

SEQ ID NO: 2543670 - protein, 21 aa, Entamoeba dispar
YDKFMNNIIFPNYGDEKSLPD

SEQ ID NO: 2543671 - protein, 27 aa, Entamoeba dispar
YDKKFRKDLLLLLKEKTSIDSQALLQS

SEQ ID NO: 2543672 - protein, 43 aa, Entamoeba dispar
YDKLYQFICPNYIEYSSWLNIIPLKMRCNEVFGVPLSVGVKKS

SEQ ID NO: 2543673 - protein, 25 aa, Entamoeba dispar
YDKQQRIVWCINRLSSIALNGRINS

SEQ ID NO: 2543674 - protein, 18 aa, Entamoeba dispar
YDLAIRWISSEEFNQETL

SEQ ID NO: 2543675 - protein, 21 aa, Entamoeba dispar
YDLEGYFPGFNEYRELVSCSN

SEQ ID NO: 2543676 - protein, 18 aa, Entamoeba dispar
YDLEILYMLEIAALATDL

SEQ ID NO: 2543677 - protein, 27 aa, Entamoeba dispar
YDLKCAQIILRLLTKYISYIKKDDQHV

SEQ ID NO: 2543678 - protein, 31 aa, Entamoeba dispar
YDLLSRKIYQSFLCTPILIAAHRTLNLYSFV

SEQ ID NO: 2543679 - protein, 17 aa, Entamoeba dispar
YDLMINEKILISSIITL

SEQ ID NO: 2543680 - protein, 34 aa, Entamoeba dispar
YDLQRQLYPYMKELVPLPSIYYKSYIAANQDDRA

SEQ ID NO: 2543681 - protein, 23 aa, Entamoeba dispar
YDLTLYCHSLLTSTMTFLDPIVV

SEQ ID NO: 2543682 - protein, 20 aa, Entamoeba dispar
YDLTYILPNLIAMGIPTTGI

SEQ ID NO: 2543683 - protein, 24 aa, Entamoeba dispar
YDMNKSCRRFIVSGYCKYLDMESP

SEQ ID NO: 2543684 - protein, 19 aa, Entamoeba dispar
YDMVFLFQNRLVGIDFRAS

SEQ ID NO: 2543685 - protein, 17 aa, Entamoeba dispar
YDNIYEILYIFNTPEKV

SEQ ID NO: 2543686 - protein, 25 aa, Entamoeba dispar
YDNKRIIEMLWQAIVTSPLATKIVC

SEQ ID NO: 2543687 - protein, 17 aa, Entamoeba dispar
YDNRSLLVGFYSEKKYA

SEQ ID NO: 2543688 - protein, 27 aa, Entamoeba dispar
YDNVTDFEWYLKLLSRLSTQQLEQSVF

SEQ ID NO: 2543689 - protein, 18 aa, Entamoeba dispar
YDNYKFVNKKPYTYQRVY

SEQ ID NO: 2543690 - protein, 25 aa, Entamoeba dispar
YDPNVACIWGWWGTLMSNHELKRYL

SEQ ID NO: 2543691 - protein, 17 aa, Entamoeba dispar
YDRAYLLSTKLGDNSSA

SEQ ID NO: 2543692 - protein, 23 aa, Entamoeba dispar
YDRLRPMSYPDTNMLIICFAIDS

SEQ ID NO: 2543693 - protein, 21 aa, Entamoeba dispar
YDRRKCVLKMAYIEVLGYEVD

SEQ ID NO: 2543694 - protein, 27 aa, Entamoeba dispar
YDSSLFGLAELLLFFLHCKVDKEVVEV

SEQ ID NO: 2543695 - protein, 23 aa, Entamoeba dispar
YDTINHWFGINQMITIGSSYWND

SEQ ID NO: 2543696 - protein, 18 aa, Entamoeba dispar
YDVLYPAPYGSTYNSYLL

SEQ ID NO: 2543697 - protein, 24 aa, Entamoeba dispar
YDYKPLEFSLSYSILETFKHNYKY

SEQ ID NO: 2543698 - protein, 58 aa, Entamoeba dispar
YEADNDFLLKLMNETLFTYLLLKSSDSDLFHSSLACIILFDVLNELKFNSAPHSNTEM

SEQ ID NO: 2543699 - protein, 20 aa, Entamoeba dispar
YECFKYCYSITSINIPITNT

SEQ ID NO: 2543700 - protein, 28 aa, Entamoeba dispar
YECFRECTSLVYIKFPTSITSIGNECFK

SEQ ID NO: 2543701 - protein, 21 aa, Entamoeba dispar
YECFYNCRLLTTINIPSSISE

SEQ ID NO: 2543702 - protein, 20 aa, Entamoeba dispar
YECGLVCDTLLHRLGDDGKY

SEQ ID NO: 2543703 - protein, 17 aa, Entamoeba dispar
YECSSLVNITIPTTIRL

SEQ ID NO: 2543704 - protein, 24 aa, Entamoeba dispar
YECTSLISINIPSSIIKLGDYCFY

SEQ ID NO: 2543705 - protein, 22 aa, Entamoeba dispar
YEDALKYYFKSITIIGYIDEEM

SEQ ID NO: 2543706 - protein, 28 aa, Entamoeba dispar
YEDDCVYGLFRILQLLHKEKDGFTLAIQ

SEQ ID NO: 2543707 - protein, 18 aa, Entamoeba dispar
YEDIYYGDSYYGDDGYYY

SEQ ID NO: 2543708 - protein, 23 aa, Entamoeba dispar
YEDPIDVYCLKGCNVKPVLDKGP

SEQ ID NO: 2543709 - protein, 28 aa, Entamoeba dispar
YEDVMKRFDYLLQPPPLKKKKAIVPPDQ

SEQ ID NO: 2543710 - protein, 34 aa, Entamoeba dispar
YEEDRDYGALPLPTVIRDELHFIPARALKKDGER

SEQ ID NO: 2543711 - protein, 31 aa, Entamoeba dispar
YEEDRDYGALPLPTVIRDELHFVPARVLKKD

SEQ ID NO: 2543712 - protein, 20 aa, Entamoeba dispar
YEEKLIKLSLTKFKDDKKKK

SEQ ID NO: 2543713 - protein, 23 aa, Entamoeba dispar
YEELRTIILTDFFKHAFDGSGAD

SEQ ID NO: 2543714 - protein, 17 aa, Entamoeba dispar
YEFDYFIMTRDNSVFWK

SEQ ID NO: 2543715 - protein, 18 aa, Entamoeba dispar
YEFIPFFVKGNTILLLKK

SEQ ID NO: 2543716 - protein, 17 aa, Entamoeba dispar
YEFLYDVAVNCQVYQIV

SEQ ID NO: 2543717 - protein, 43 aa, Entamoeba dispar
YEFRKVFVQFILVIQKNYLLHYKTLLIIPITPPLISNCPFGTI

SEQ ID NO: 2543718 - protein, 19 aa, Entamoeba dispar
YEGAKQPIFRDLQFGIYLK

SEQ ID NO: 2543719 - protein, 19 aa, Entamoeba dispar
YEGFYYYKHFKLCKVNIEK

SEQ ID NO: 2543720 - protein, 27 aa, Entamoeba dispar
YEGKDVLYIIAINYLKYLKSDLMKVTS

SEQ ID NO: 2543721 - protein, 17 aa, Entamoeba dispar
YEHHFYSILKGGGELYL

SEQ ID NO: 2543722 - protein, 20 aa, Entamoeba dispar
YEHKIFVQGCIWNVNSFDQW

SEQ ID NO: 2543723 - protein, 21 aa, Entamoeba dispar
YEHNVMLIIDFLKDCIKKRTE

SEQ ID NO: 2543724 - protein, 24 aa, Entamoeba dispar
YEHSPIPLMIGFEGIITNIQIKLN

SEQ ID NO: 2543725 - protein, 19 aa, Entamoeba dispar
YEIELLVHSYEWYSLLTSG

SEQ ID NO: 2543726 - protein, 26 aa, Entamoeba dispar
YEIFEPYHAFFIPPNYPHGYIEGECV

SEQ ID NO: 2543727 - protein, 24 aa, Entamoeba dispar
YEIFKDRLIIYNKGLDLDTNHLEN

SEQ ID NO: 2543728 - protein, 19 aa, Entamoeba dispar
YEIHLYNRFQIISSLPYKT

SEQ ID NO: 2543729 - protein, 17 aa, Entamoeba dispar
YEIIPRCAPKLRIDIAG

SEQ ID NO: 2543730 - protein, 21 aa, Entamoeba dispar
YEIIYIYAILNRMANIGINNI

SEQ ID NO: 2543731 - protein, 24 aa, Entamoeba dispar
YEISFIDFLFPRTTIVTDPVIPSL

SEQ ID NO: 2543732 - protein, 18 aa, Entamoeba dispar
YEIWIGEDIDYKVVDEYA

SEQ ID NO: 2543733 - protein, 18 aa, Entamoeba dispar
YEKALYNAFLKTDQEVLK

SEQ ID NO: 2543734 - protein, 19 aa, Entamoeba dispar
YEKDHPKVLFLESSAIHDM

SEQ ID NO: 2543735 - protein, 23 aa, Entamoeba dispar
YEKDICMRIMKIWINQKDRIMHL

SEQ ID NO: 2543736 - protein, 26 aa, Entamoeba dispar
YEKFMPALMQYYKQPQEKHLLIILED

SEQ ID NO: 2543737 - protein, 17 aa, Entamoeba dispar
YEKIALLARDCILEKKV

SEQ ID NO: 2543738 - protein, 23 aa, Entamoeba dispar
YEKILVYLLELFPKKIETKNVIG

SEQ ID NO: 2543739 - protein, 31 aa, Entamoeba dispar
YEKMISGIYMGWFSRLAIRELIEKKVIFERY

SEQ ID NO: 2543740 - protein, 21 aa, Entamoeba dispar
YEKSLNPFWCEEFPAVIEDGE

SEQ ID NO: 2543741 - protein, 24 aa, Entamoeba dispar
YEKVKRIILHPYPFDIERDLITPS

SEQ ID NO: 2543742 - protein, 20 aa, Entamoeba dispar
YELIFIYSILNRVMNIGIDN

SEQ ID NO: 2543743 - protein, 23 aa, Entamoeba dispar
YELKKLICFISRSVMWRTEFVES

SEQ ID NO: 2543744 - protein, 25 aa, Entamoeba dispar
YELSTRFLELFLTKIIRNDETLISV

SEQ ID NO: 2543745 - protein, 27 aa, Entamoeba dispar
YELVDGYYNSLFILSLKGKSILEDPLS

SEQ ID NO: 2543746 - protein, 17 aa, Entamoeba dispar
YELVKLNPQTTFIGYVF

SEQ ID NO: 2543747 - protein, 25 aa, Entamoeba dispar
YELYDPVTVMFFYRKKHIQVDLGTG

SEQ ID NO: 2543748 - protein, 19 aa, Entamoeba dispar
YELYLEEIGNRNGNLGRFT

SEQ ID NO: 2543749 - protein, 25 aa, Entamoeba dispar
YEMKNGALYIFPQKQNSLFSLKQGY

SEQ ID NO: 2543750 - protein, 25 aa, Entamoeba dispar
YENDYMYFDIYIRGPKSTWTVEIGT

SEQ ID NO: 2543751 - protein, 24 aa, Entamoeba dispar
YENDYMYFDIYIRKPNENWNNAIT

SEQ ID NO: 2543752 - protein, 25 aa, Entamoeba dispar
YENDYMYFDIYIRKPNESWNSAITN

SEQ ID NO: 2543753 - protein, 25 aa, Entamoeba dispar
YENEYMYFDIYIRKPNEKWSDVIAD

SEQ ID NO: 2543754 - protein, 17 aa, Entamoeba dispar
YENGFITPTPSPTPDIL

SEQ ID NO: 2543755 - protein, 21 aa, Entamoeba dispar
YENRIMICLLGASSGVEGIGK

SEQ ID NO: 2543756 - protein, 34 aa, Entamoeba dispar
YEPEAKPKYRSVYLFLFNDTIILTKIISPGTSHK

SEQ ID NO: 2543757 - protein, 30 aa, Entamoeba dispar
YEPKKDFLRKFLFEPFPLESYFETVMADQL

SEQ ID NO: 2543758 - protein, 26 aa, Entamoeba dispar
YEPTKNLILLYPNYIKTIYTSLTSFY

SEQ ID NO: 2543759 - protein, 17 aa, Entamoeba dispar
YEQLPDELRRHIRTDFS

SEQ ID NO: 2543760 - protein, 18 aa, Entamoeba dispar
YEQLPDELRRHIRTDFSV

SEQ ID NO: 2543761 - protein, 26 aa, Entamoeba dispar
YEQNFYFTDPILLNLFRFEELKQMYL

SEQ ID NO: 2543762 - protein, 17 aa, Entamoeba dispar
YEQTISMFEKKIVYIEA

SEQ ID NO: 2543763 - protein, 17 aa, Entamoeba dispar
YEQVDGQVIYPIKDKMI

SEQ ID NO: 2543764 - protein, 24 aa, Entamoeba dispar
YEQVQYIYYAVPRLYLMCCVGAAA

SEQ ID NO: 2543765 - protein, 19 aa, Entamoeba dispar
YERAFAIRYFISVAHYLKQ

SEQ ID NO: 2543766 - protein, 36 aa, Entamoeba dispar
YEREDTVVSLFLFEFLRVFQCQLVIPIHVVCNEISR

SEQ ID NO: 2543767 - protein, 17 aa, Entamoeba dispar
YERNFDFLRTNASMLLY

SEQ ID NO: 2543768 - protein, 27 aa, Entamoeba dispar
YERNQLISNYFIPPVDLFLSQDMCSPA

SEQ ID NO: 2543769 - protein, 19 aa, Entamoeba dispar
YERPFKFIKNYGSNFVAVI

SEQ ID NO: 2543770 - protein, 18 aa, Entamoeba dispar
YERTHLSVSTLYEQIKNK

SEQ ID NO: 2543771 - protein, 17 aa, Entamoeba dispar
YERTYPFRLIITEKEKG

SEQ ID NO: 2543772 - protein, 18 aa, Entamoeba dispar
YERTYPFRLIITEKEKGY

SEQ ID NO: 2543773 - protein, 18 aa, Entamoeba dispar
YESFAFCARLKEVVLQGS

SEQ ID NO: 2543774 - protein, 20 aa, Entamoeba dispar
YESIINYYINIPHNDPRLFT

SEQ ID NO: 2543775 - protein, 24 aa, Entamoeba dispar
YESLIRELKFSFDCDSVTLELPYV

SEQ ID NO: 2543776 - protein, 25 aa, Entamoeba dispar
YESNKNGCIIWSVKYPMLCMTVEEG

SEQ ID NO: 2543777 - protein, 29 aa, Entamoeba dispar
YESNQSFPLPLMYGKNLIFKTGGVDAIHC

SEQ ID NO: 2543778 - protein, 19 aa, Entamoeba dispar
YESSIEGILYNPTPTKTDS

SEQ ID NO: 2543779 - protein, 28 aa, Entamoeba dispar
YESVKGWLKDVGYYAPKDIIKYLVGNKT

SEQ ID NO: 2543780 - protein, 23 aa, Entamoeba dispar
YETIKLLHLFYDIKYLTKRKNNN

SEQ ID NO: 2543781 - protein, 22 aa, Entamoeba dispar
YEVDGIKLLKIRNPWGCCEWKG

SEQ ID NO: 2543782 - protein, 21 aa, Entamoeba dispar
YEVHNLLQWLSSISNEFVALY

SEQ ID NO: 2543783 - protein, 33 aa, Entamoeba dispar
YEYGFTITEPLYTYLFDLCYLPVIGNPGEDSYQ

SEQ ID NO: 2543784 - protein, 17 aa, Entamoeba dispar
YEYIQFISEDRIFVNKQ

SEQ ID NO: 2543785 - protein, 29 aa, Entamoeba dispar
YEYKSLNAIILLIRIFQQIGDFPFNSFFK

SEQ ID NO: 2543786 - protein, 19 aa, Entamoeba dispar
YEYPIDDLLKLRTLGNLRA

SEQ ID NO: 2543787 - protein, 26 aa, Entamoeba dispar
YEYYRNPEILAFIRKIEIRCLTMGEK

SEQ ID NO: 2543788 - protein, 20 aa, Entamoeba dispar
YEYYTPYVLPDKVTYLRLLQ

SEQ ID NO: 2543789 - protein, 18 aa, Entamoeba dispar
YFCFRYCYELTSIDIPTS

SEQ ID NO: 2543790 - protein, 18 aa, Entamoeba dispar
YFCTKAITTDLFVKYSVQ

SEQ ID NO: 2543791 - protein, 39 aa, Entamoeba dispar
YFDIYNQCFQLIPLAQEYYQLLVRALATMLKFLPDNDTQ

SEQ ID NO: 2543792 - protein, 17 aa, Entamoeba dispar
YFDLPQQFKQASVQHYF

SEQ ID NO: 2543793 - protein, 18 aa, Entamoeba dispar
YFEDVDNFKLDTVIEDPK

SEQ ID NO: 2543794 - protein, 33 aa, Entamoeba dispar
YFEQASIDYFFCYKWNALLFKRFFLNEDLIRIW

SEQ ID NO: 2543795 - protein, 20 aa, Entamoeba dispar
YFEQLWEIKGSIEWNRIGVA

SEQ ID NO: 2543796 - protein, 18 aa, Entamoeba dispar
YFGTILKWANEIKKIGVF

SEQ ID NO: 2543797 - protein, 25 aa, Entamoeba dispar
YFHDDIFRDFILRKLINGERTAMFS

SEQ ID NO: 2543798 - protein, 18 aa, Entamoeba dispar
YFHNLGYDGRFLAKFGII

SEQ ID NO: 2543799 - protein, 21 aa, Entamoeba dispar
YFHSTVLYKGALYIYGGRTNS

SEQ ID NO: 2543800 - protein, 20 aa, Entamoeba dispar
YFIDIFSLEIQQNIIIDCLK

SEQ ID NO: 2543801 - protein, 26 aa, Entamoeba dispar
YFINTKYQSLLPKYLYQNIIDLLDKG

SEQ ID NO: 2543802 - protein, 19 aa, Entamoeba dispar
YFINVLASEPPTDYVWKCV

SEQ ID NO: 2543803 - protein, 18 aa, Entamoeba dispar
YFKAYEIRLTIKGQIARF

SEQ ID NO: 2543804 - protein, 17 aa, Entamoeba dispar
YFKDYNNLKMKIYDSNN

SEQ ID NO: 2543805 - protein, 17 aa, Entamoeba dispar
YFKKYTKEIYLYSFGDS

SEQ ID NO: 2543806 - protein, 19 aa, Entamoeba dispar
YFKTVMPLVKISGRMIRDA

SEQ ID NO: 2543807 - protein, 19 aa, Entamoeba dispar
YFLIPYIKEREDIDKVVVI

SEQ ID NO: 2543808 - protein, 17 aa, Entamoeba dispar
YFLLIFHGDFTKTTEYI

SEQ ID NO: 2543809 - protein, 20 aa, Entamoeba dispar
YFMFVGGCWCIIITDEKIGI

SEQ ID NO: 2543810 - protein, 20 aa, Entamoeba dispar
YFMTNTMSILLPTLERYREI

SEQ ID NO: 2543811 - protein, 34 aa, Entamoeba dispar
YFNAYRIDHILGFFRIWAIPAIHRTGLLGRFSPD

SEQ ID NO: 2543812 - protein, 27 aa, Entamoeba dispar
YFNDDPYTFFIIYKRAPKLLKKVIYSI

SEQ ID NO: 2543813 - protein, 20 aa, Entamoeba dispar
YFNELTYINPFLMHNDCCNE

SEQ ID NO: 2543814 - protein, 23 aa, Entamoeba dispar
YFNFKQTIIYTYSNHLRKVTVVK

SEQ ID NO: 2543815 - protein, 27 aa, Entamoeba dispar
YFNHDRLYLIATPNQLQCRSSCAYETV

SEQ ID NO: 2543816 - protein, 18 aa, Entamoeba dispar
YFNILITNSFIEKEVIHF

SEQ ID NO: 2543817 - protein, 23 aa, Entamoeba dispar
YFNKIGIHTLSPKELFYTITNAS

SEQ ID NO: 2543818 - protein, 19 aa, Entamoeba dispar
YFNNAPLINMVIPSSVKTI

SEQ ID NO: 2543819 - protein, 24 aa, Entamoeba dispar
YFNRYIPIIYQDDYHRIWIKLFNE

SEQ ID NO: 2543820 - protein, 18 aa, Entamoeba dispar
YFPNLGGESALRLWYCFY

SEQ ID NO: 2543821 - protein, 24 aa, Entamoeba dispar
YFQKPQAMHLTLTTLSICTDQQIE

SEQ ID NO: 2543822 - protein, 20 aa, Entamoeba dispar
YFQQIQVSSLLIPLQSIYDM

SEQ ID NO: 2543823 - protein, 17 aa, Entamoeba dispar
YFRGSIGAIIVYDISNR

SEQ ID NO: 2543824 - protein, 33 aa, Entamoeba dispar
YFSLKYDVHWFIVDHWYLFSQLGQFRTNPNKWK

SEQ ID NO: 2543825 - protein, 19 aa, Entamoeba dispar
YFSQFLLSDLGYIPLKENS

SEQ ID NO: 2543826 - protein, 20 aa, Entamoeba dispar
YFSVLSIHNGNRTMFHFFER

SEQ ID NO: 2543827 - protein, 18 aa, Entamoeba dispar
YFTEKKIVSLSSVRYLIF

SEQ ID NO: 2543828 - protein, 23 aa, Entamoeba dispar
YFTINEFIYCSLHLKYFQTYLNE

SEQ ID NO: 2543829 - protein, 24 aa, Entamoeba dispar
YFTQHLCYEIMFHVSTLLPEQPGD

SEQ ID NO: 2543830 - protein, 17 aa, Entamoeba dispar
YFTSLQKISFIYCEIMA

SEQ ID NO: 2543831 - protein, 25 aa, Entamoeba dispar
YFVDPYNMILTILKSPNEKYTCAVD

SEQ ID NO: 2543832 - protein, 18 aa, Entamoeba dispar
YFVICYSVYNKESFIAVT

SEQ ID NO: 2543833 - protein, 19 aa, Entamoeba dispar
YFVKLLLSFHDVKRKRRGK

SEQ ID NO: 2543834 - protein, 20 aa, Entamoeba dispar
YFVQTTYLLKTLSIGPLPDQ

SEQ ID NO: 2543835 - protein, 18 aa, Entamoeba dispar
YFYNESYLDYLDSIGLLV

SEQ ID NO: 2543836 - protein, 17 aa, Entamoeba dispar
YGCFYECLSLTTINIPT

SEQ ID NO: 2543837 - protein, 27 aa, Entamoeba dispar
YGCSSLKHIKPQLMPVIEMGKSCFYGC

SEQ ID NO: 2543838 - protein, 26 aa, Entamoeba dispar
YGCTVSLFTHWLPRFGIEVDLVDTSD

SEQ ID NO: 2543839 - protein, 18 aa, Entamoeba dispar
YGDRVVVMDIRKPFEPMT

SEQ ID NO: 2543840 - protein, 25 aa, Entamoeba dispar
YGDVYTRIFWLHRAGGICVCSDPVF

SEQ ID NO: 2543841 - protein, 30 aa, Entamoeba dispar
YGELFFEKFETPGLYFELTGNCALIPLDLE

SEQ ID NO: 2543842 - protein, 28 aa, Entamoeba dispar
YGERTINLFLIRWKNNFHYVIDEKVAIT

SEQ ID NO: 2543843 - protein, 20 aa, Entamoeba dispar
YGFFYGIFQTTIESAFFGQV

SEQ ID NO: 2543844 - protein, 22 aa, Entamoeba dispar
YGFKGNPFVFPIPNEEPTVPYS

SEQ ID NO: 2543845 - protein, 23 aa, Entamoeba dispar
YGFRNSISLLPYSKRKILASDIV

SEQ ID NO: 2543846 - protein, 17 aa, Entamoeba dispar
YGFYEVKEYICCEQLFL

SEQ ID NO: 2543847 - protein, 18 aa, Entamoeba dispar
YGGLIAYGSTFFVFSDYC

SEQ ID NO: 2543848 - protein, 20 aa, Entamoeba dispar
YGGLIAYGSTFFVFSDYCRP

SEQ ID NO: 2543849 - protein, 22 aa, Entamoeba dispar
YGGVLFNLLVKPDGLGIGILTN

SEQ ID NO: 2543850 - protein, 25 aa, Entamoeba dispar
YGGWTFIYQILYSVLKYNSSSILPL

SEQ ID NO: 2543851 - protein, 17 aa, Entamoeba dispar
YGHYFSYILNDRKWIEF

SEQ ID NO: 2543852 - protein, 18 aa, Entamoeba dispar
YGIDFDDYEILFPKQDET

SEQ ID NO: 2543853 - protein, 23 aa, Entamoeba dispar
YGIGFFLSFNLNDSFFLFGENSY

SEQ ID NO: 2543854 - protein, 18 aa, Entamoeba dispar
YGIGYLKERITLKIISSF

SEQ ID NO: 2543855 - protein, 18 aa, Entamoeba dispar
YGIPYNWNELENNEYSLF

SEQ ID NO: 2543856 - protein, 25 aa, Entamoeba dispar
YGKKMFTCLKCIKIIGDIMYWEAAL

SEQ ID NO: 2543857 - protein, 19 aa, Entamoeba dispar
YGKMKDLLRYDFGAPMHCL

SEQ ID NO: 2543858 - protein, 25 aa, Entamoeba dispar
YGKMQDLFIWAFEKEYLEKKNARDE

SEQ ID NO: 2543859 - protein, 25 aa, Entamoeba dispar
YGKNRKIFFSSFDPDTIALLNKKQM

SEQ ID NO: 2543860 - protein, 23 aa, Entamoeba dispar
YGKQLLEIYLKLINSTLEYPMHE

SEQ ID NO: 2543861 - protein, 23 aa, Entamoeba dispar
YGKRNLMLLIITESGCSFGSFNE

SEQ ID NO: 2543862 - protein, 27 aa, Entamoeba dispar
YGKRRVNLFLLRWKNNNHYIIDDVVEV

SEQ ID NO: 2543863 - protein, 33 aa, Entamoeba dispar
YGKRTTVLCYLLFRLRTLNYPKPQLIVCDETSL

SEQ ID NO: 2543864 - protein, 30 aa, Entamoeba dispar
YGKSRSASLLTFYLLKKYQITINAAKELFK

SEQ ID NO: 2543865 - protein, 22 aa, Entamoeba dispar
YGLIAIAFNSIIYIINPLSCNM

SEQ ID NO: 2543866 - protein, 18 aa, Entamoeba dispar
YGLKFWLRILHCCGNPTS

SEQ ID NO: 2543867 - protein, 30 aa, Entamoeba dispar
YGLSIDVRHLLLLSDLMTFKGVILGITRYG

SEQ ID NO: 2543868 - protein, 27 aa, Entamoeba dispar
YGNEGFLMMILYYLGCTIKMKRIIKEG

SEQ ID NO: 2543869 - protein, 25 aa, Entamoeba dispar
YGNKKILHFWKTKRDLYKYIHDQTL

SEQ ID NO: 2543870 - protein, 29 aa, Entamoeba dispar
YGNNLEFVDYLFLAMMIQIREPILESSQY

SEQ ID NO: 2543871 - protein, 20 aa, Entamoeba dispar
YGNQLVIPLLQLSYSLNTNI

SEQ ID NO: 2543872 - protein, 26 aa, Entamoeba dispar
YGPDEHSFFPQLPITALKKICEYLDE

SEQ ID NO: 2543873 - protein, 34 aa, Entamoeba dispar
YGQLLKITSIKTMDYFNLLLKKKPGCSGKIRLDH

SEQ ID NO: 2543874 - protein, 24 aa, Entamoeba dispar
YGQVKLRGKIYHAAISVGKNPTFC

SEQ ID NO: 2543875 - protein, 19 aa, Entamoeba dispar
YGSLRPFGCSLLIGGVDQH

SEQ ID NO: 2543876 - protein, 19 aa, Entamoeba dispar
YGSLYIWNAFVSTFNVMPF

SEQ ID NO: 2543877 - protein, 19 aa, Entamoeba dispar
YGSTFFVFSDYCRPTIRLA

SEQ ID NO: 2543878 - protein, 20 aa, Entamoeba dispar
YGSTFFVFSDYCRPTIRLAA

SEQ ID NO: 2543879 - protein, 25 aa, Entamoeba dispar
YGTIGRIRYIIKCTIQRFSKVVKEI

SEQ ID NO: 2543880 - protein, 24 aa, Entamoeba dispar
YGTINICVPPLPTLPTQFPNEKQN

SEQ ID NO: 2543881 - protein, 17 aa, Entamoeba dispar
YGTKPCIFFMQNGYCKK

SEQ ID NO: 2543882 - protein, 25 aa, Entamoeba dispar
YGTKRAMYFYTKTICLLIKSIKENV

SEQ ID NO: 2543883 - protein, 27 aa, Entamoeba dispar
YGTKVFELHFYPLLQQYLYSTHEYLVY

SEQ ID NO: 2543884 - protein, 26 aa, Entamoeba dispar
YGTLNSLYLLPKYSEKLRFLGASKVT

SEQ ID NO: 2543885 - protein, 22 aa, Entamoeba dispar
YGVPINYAFDGIQNLYFHGGNG

SEQ ID NO: 2543886 - protein, 17 aa, Entamoeba dispar
YGVPVLCLINKNKFFLR

SEQ ID NO: 2543887 - protein, 19 aa, Entamoeba dispar
YGVSAWAYLNGVQKIKLLK

SEQ ID NO: 2543888 - protein, 19 aa, Entamoeba dispar
YGYENLPVDTFMTLGSLAE

SEQ ID NO: 2543889 - protein, 17 aa, Entamoeba dispar
YGYESIMKYLDGIRYKK

SEQ ID NO: 2543890 - protein, 23 aa, Entamoeba dispar
YGYNPLFVDLSLSTNIITLPGCI

SEQ ID NO: 2543891 - protein, 17 aa, Entamoeba dispar
YGYSFIFEKKDYNDYLQ

SEQ ID NO: 2543892 - protein, 28 aa, Entamoeba dispar
YHCEHQIVILLIPEYYKEYLKGFSYLLK

SEQ ID NO: 2543893 - protein, 21 aa, Entamoeba dispar
YHCKRLKRIKIPSLLFDSFKQ

SEQ ID NO: 2543894 - protein, 18 aa, Entamoeba dispar
YHEFLYEKMFTLSKLPTT

SEQ ID NO: 2543895 - protein, 20 aa, Entamoeba dispar
YHFIFTLQTSLSNVPTRWFP

SEQ ID NO: 2543896 - protein, 18 aa, Entamoeba dispar
YHFKRYPITPTFITIEHN

SEQ ID NO: 2543897 - protein, 19 aa, Entamoeba dispar
YHFKTISKFQLFNKVKINA

SEQ ID NO: 2543898 - protein, 18 aa, Entamoeba dispar
YHFRSFILNIKTKSNITL

SEQ ID NO: 2543899 - protein, 17 aa, Entamoeba dispar
YHIYDRWDNPQSSVSPL

SEQ ID NO: 2543900 - protein, 17 aa, Entamoeba dispar
YHKFFKELPNIKYVIMP

SEQ ID NO: 2543901 - protein, 19 aa, Entamoeba dispar
YHLEKVLSKVFCEFIRCAY

SEQ ID NO: 2543902 - protein, 27 aa, Entamoeba dispar
YHLGTLILTALDDIAWLFNIRGTDIPF

SEQ ID NO: 2543903 - protein, 20 aa, Entamoeba dispar
YHLMIVCKYLRTVEDYLNII

SEQ ID NO: 2543904 - protein, 20 aa, Entamoeba dispar
YHLMIVCKYLTTVEDYLNII

SEQ ID NO: 2543905 - protein, 18 aa, Entamoeba dispar
YHLSRFISRLIIKCKNIE

SEQ ID NO: 2543906 - protein, 33 aa, Entamoeba dispar
YHNECFKCHICGQKLFSFAKFYNDNGEIMCHPC

SEQ ID NO: 2543907 - protein, 17 aa, Entamoeba dispar
YHNPIIQYQIEEINGIR

SEQ ID NO: 2543908 - protein, 17 aa, Entamoeba dispar
YHPFNHQDSLFPHYPFS

SEQ ID NO: 2543909 - protein, 22 aa, Entamoeba dispar
YHPLPLIHSLHLRFNKNNSYYV

SEQ ID NO: 2543910 - protein, 26 aa, Entamoeba dispar
YHQLDISYLALYYYEYALSVLPNNQN

SEQ ID NO: 2543911 - protein, 19 aa, Entamoeba dispar
YHRMCGRCMKKFPGVVVCP

SEQ ID NO: 2543912 - protein, 22 aa, Entamoeba dispar
YHRRKVIIEFISWIFGEVKSMD

SEQ ID NO: 2543913 - protein, 20 aa, Entamoeba dispar
YHRTFSEYVPIPQYMMRIVS

SEQ ID NO: 2543914 - protein, 24 aa, Entamoeba dispar
YHSEPYFLSLTFKNDIAKDGTEKA

SEQ ID NO: 2543915 - protein, 28 aa, Entamoeba dispar
YHSSELFPERWFDLIVVLRTDNTVLYDR

SEQ ID NO: 2543916 - protein, 17 aa, Entamoeba dispar
YHTKIVHLIDSGFIQEC

SEQ ID NO: 2543917 - protein, 26 aa, Entamoeba dispar
YHVDHCASLPYLILERQFKGKVLMTP

SEQ ID NO: 2543918 - protein, 24 aa, Entamoeba dispar
YHVGFYWLNVFMSPRTMDSIIASH

SEQ ID NO: 2543919 - protein, 18 aa, Entamoeba dispar
YHVKFIETINKTIPLVRS

SEQ ID NO: 2543920 - protein, 18 aa, Entamoeba dispar
YHYLFKDNYVMGKRELFL

SEQ ID NO: 2543921 - protein, 18 aa, Entamoeba dispar
YHYNPIPITLKMKKYFPN

SEQ ID NO: 2543922 - protein, 18 aa, Entamoeba dispar
YIALYLHDLLRKHHSHSL

SEQ ID NO: 2543923 - protein, 20 aa, Entamoeba dispar
YICLQARMPNLIIDDKQLEY

SEQ ID NO: 2543924 - protein, 17 aa, Entamoeba dispar
YICLYDGQSFCEECLHL

SEQ ID NO: 2543925 - protein, 21 aa, Entamoeba dispar
YIDGFRLSMPYLFDKLQIACD

SEQ ID NO: 2543926 - protein, 27 aa, Entamoeba dispar
YIDHQSIFLFMNFLFNVSNPETIEKVF

SEQ ID NO: 2543927 - protein, 22 aa, Entamoeba dispar
YIDILTLNCSYFRTFKTHQIME

SEQ ID NO: 2543928 - protein, 26 aa, Entamoeba dispar
YIDPPVPIQYVNLFLEVYFNKNQKLS

SEQ ID NO: 2543929 - protein, 23 aa, Entamoeba dispar
YIDSLIELFPSIKLLFTDIYEKD

SEQ ID NO: 2543930 - protein, 22 aa, Entamoeba dispar
YIDVYRLLYPELPRLEFIDFVK

SEQ ID NO: 2543931 - protein, 32 aa, Entamoeba dispar
YIEDAVYPIIPINIIFNKVLELILFKNQSLTG

SEQ ID NO: 2543932 - protein, 25 aa, Entamoeba dispar
YIEFRQTYIHLIPQNIFLGRDPSSP

SEQ ID NO: 2543933 - protein, 24 aa, Entamoeba dispar
YIEIHRVIYDILYPMTMTLSSKQN

SEQ ID NO: 2543934 - protein, 17 aa, Entamoeba dispar
YIEKVITSILLIEEFND

SEQ ID NO: 2543935 - protein, 25 aa, Entamoeba dispar
YIELGYYQLCGVVLYVFFDERLKSH

SEQ ID NO: 2543936 - protein, 19 aa, Entamoeba dispar
YIEQFFIQGPYKKISSMNN

SEQ ID NO: 2543937 - protein, 19 aa, Entamoeba dispar
YIETEYLQMLKKAMPIIFE

SEQ ID NO: 2543938 - protein, 25 aa, Entamoeba dispar
YIFDGIKHVLIWNIGKNDPKIVPTI

SEQ ID NO: 2543939 - protein, 20 aa, Entamoeba dispar
YIFDNLFVVIEYAKAVNQVY

SEQ ID NO: 2543940 - protein, 23 aa, Entamoeba dispar
YIFNEPIYYPKIYNSGVTFYDGK

SEQ ID NO: 2543941 - protein, 36 aa, Entamoeba dispar
YIGEWKEMELILTNDLMIIIYQKQIEYISLYIDCNI

SEQ ID NO: 2543942 - protein, 18 aa, Entamoeba dispar
YIHKYYVDPATDKPHPII

SEQ ID NO: 2543943 - protein, 19 aa, Entamoeba dispar
YIHNNNIWNKYYVPVGYKK

SEQ ID NO: 2543944 - protein, 19 aa, Entamoeba dispar
YIHVFSLHPSNIILTVIPE

SEQ ID NO: 2543945 - protein, 19 aa, Entamoeba dispar
YIIHFYGAVFIPNKICMIT

SEQ ID NO: 2543946 - protein, 18 aa, Entamoeba dispar
YIIRYYTSVLRQEEFWIV

SEQ ID NO: 2543947 - protein, 21 aa, Entamoeba dispar
YIISFSLAIGGYLWVPINHTS

SEQ ID NO: 2543948 - protein, 20 aa, Entamoeba dispar
YIISQLASSLYYLHINNFIH

SEQ ID NO: 2543949 - protein, 36 aa, Entamoeba dispar
YIIYRNTYSIAPTPKIPILPLWLGDIIHAHTAFSSN

SEQ ID NO: 2543950 - protein, 20 aa, Entamoeba dispar
YIIYTTLAWRNVKYGNCSQF

SEQ ID NO: 2543951 - protein, 23 aa, Entamoeba dispar
YIKGDYALVLPNLSYRVFDEDSR

SEQ ID NO: 2543952 - protein, 28 aa, Entamoeba dispar
YIKHCICIPLDLPPMPLYPDQMKEKIIP

SEQ ID NO: 2543953 - protein, 22 aa, Entamoeba dispar
YIKKVIVHPLVLLSISDHQTRA

SEQ ID NO: 2543954 - protein, 18 aa, Entamoeba dispar
YIKLFKFIEGLNELEYKI

SEQ ID NO: 2543955 - protein, 18 aa, Entamoeba dispar
YIKQLLSVSSLLYRDIPS

SEQ ID NO: 2543956 - protein, 25 aa, Entamoeba dispar
YIKTLLTEFPLARTLSLFIKFLLFQ

SEQ ID NO: 2543957 - protein, 30 aa, Entamoeba dispar
YIKWNNEYHILYFWQGRKCPILDKGTSARL

SEQ ID NO: 2543958 - protein, 19 aa, Entamoeba dispar
YILFIHSLSFSRYSTSKIS

SEQ ID NO: 2543959 - protein, 17 aa, Entamoeba dispar
YILWKDKTFQRRTVYLQ

SEQ ID NO: 2543960 - protein, 22 aa, Entamoeba dispar
YIMEIPCTLIIISKGNEIPISI

SEQ ID NO: 2543961 - protein, 36 aa, Entamoeba dispar
YINATKRIRIGKFPKYLLIKLERQIILNYQDIRKVD

SEQ ID NO: 2543962 - protein, 31 aa, Entamoeba dispar
YINELDIPEGFYDLAMILYGALHQSHPSVYT

SEQ ID NO: 2543963 - protein, 17 aa, Entamoeba dispar
YINPILQGELDIYSGFI

SEQ ID NO: 2543964 - protein, 17 aa, Entamoeba dispar
YIPGYWKAQATGYASDA

SEQ ID NO: 2543965 - protein, 28 aa, Entamoeba dispar
YIPIDDIIPLFYILYQNITGMFNHSLIP

SEQ ID NO: 2543966 - protein, 19 aa, Entamoeba dispar
YIPLKKYMKEEDLKIAFNC

SEQ ID NO: 2543967 - protein, 19 aa, Entamoeba dispar
YIPLLDHLIQNDFIISIFS

SEQ ID NO: 2543968 - protein, 19 aa, Entamoeba dispar
YIPTLKIFIEVMSSPILHV

SEQ ID NO: 2543969 - protein, 18 aa, Entamoeba dispar
YIPTSVTCIIPGAFSDCV

SEQ ID NO: 2543970 - protein, 18 aa, Entamoeba dispar
YIQGLNTFYQLIPIDLTT

SEQ ID NO: 2543971 - protein, 23 aa, Entamoeba dispar
YIQHREFIIKVYGLEIKQIESFT

SEQ ID NO: 2543972 - protein, 19 aa, Entamoeba dispar
YIQTLILINMYSPTQIIIS

SEQ ID NO: 2543973 - protein, 26 aa, Entamoeba dispar
YIRALTLKFILTISEKELIQPLTHAV

SEQ ID NO: 2543974 - protein, 24 aa, Entamoeba dispar
YIRDTQITHLLFNNNVRHVTVFFE

SEQ ID NO: 2543975 - protein, 18 aa, Entamoeba dispar
YIRKLYSLIQNKGGLGVI

SEQ ID NO: 2543976 - protein, 18 aa, Entamoeba dispar
YIRLLPVLKELLNTKGLT

SEQ ID NO: 2543977 - protein, 17 aa, Entamoeba dispar
YIRNAIVDLWNKEKPKY

SEQ ID NO: 2543978 - protein, 19 aa, Entamoeba dispar
YIRSIPPKCFLECISLQNI

SEQ ID NO: 2543979 - protein, 19 aa, Entamoeba dispar
YISAIIQNILLFIPEDTNR

SEQ ID NO: 2543980 - protein, 19 aa, Entamoeba dispar
YISEITMALKYLHSLNIIH

SEQ ID NO: 2543981 - protein, 19 aa, Entamoeba dispar
YISKERIFLNEPVLVSIEI

SEQ ID NO: 2543982 - protein, 23 aa, Entamoeba dispar
YISKERIFMNEPVLVRIKIPENL

SEQ ID NO: 2543983 - protein, 18 aa, Entamoeba dispar
YISKERIFMNKPVLVSTE

SEQ ID NO: 2543984 - protein, 20 aa, Entamoeba dispar
YISLEDLKACKFTRVGYVWD

SEQ ID NO: 2543985 - protein, 32 aa, Entamoeba dispar
YISLREQYYIKGDGFVLVYSIDNKNSFHALKN

SEQ ID NO: 2543986 - protein, 22 aa, Entamoeba dispar
YISSIGMEFITTLRVDGIPSGK

SEQ ID NO: 2543987 - protein, 29 aa, Entamoeba dispar
YISSYFIDLIQFIPYKFGQLRSIILTSIP

SEQ ID NO: 2543988 - protein, 29 aa, Entamoeba dispar
YISVCVQGIPKQWNTRKFREEFGDYNIAK

SEQ ID NO: 2543989 - protein, 32 aa, Entamoeba dispar
YITQIQRPEFTPLLLQLILIPNTTNSPQQMMQ

SEQ ID NO: 2543990 - protein, 17 aa, Entamoeba dispar
YITSAVGNITFPIDRRL

SEQ ID NO: 2543991 - protein, 17 aa, Entamoeba dispar
YITVQSGKKIRIADKDS

SEQ ID NO: 2543992 - protein, 18 aa, Entamoeba dispar
YITYFKERANLENEYGKG

SEQ ID NO: 2543993 - protein, 19 aa, Entamoeba dispar
YIVDKLLISLPPIDPQLTK

SEQ ID NO: 2543994 - protein, 19 aa, Entamoeba dispar
YIVIAPNRRGLPGFGMEWL

SEQ ID NO: 2543995 - protein, 21 aa, Entamoeba dispar
YIVKIDKLKWVPIRRKMAADN

SEQ ID NO: 2543996 - protein, 26 aa, Entamoeba dispar
YIVPRSRFLPVKACNDLFIIQSTLFG

SEQ ID NO: 2543997 - protein, 18 aa, Entamoeba dispar
YIVTGGLYLKPSKFTTQP

SEQ ID NO: 2543998 - protein, 17 aa, Entamoeba dispar
YIWGYCDAHFKKDMTFE

SEQ ID NO: 2543999 - protein, 19 aa, Entamoeba dispar
YIYDIQKYIQLPTEKEINL

SEQ ID NO: 2544000 - protein, 17 aa, Entamoeba dispar
YIYFTLSGIVSYYFVVQ

SEQ ID NO: 2544001 - protein, 31 aa, Entamoeba dispar
YIYQQKDIVFLLICDQYFFGFFNSQCLQTYS

SEQ ID NO: 2544002 - protein, 25 aa, Entamoeba dispar
YKALKNYLPYFLINGNGNIQKLQCL

SEQ ID NO: 2544003 - protein, 27 aa, Entamoeba dispar
YKDGKIFKQLIWYPVSYDEFLKQKESG

SEQ ID NO: 2544004 - protein, 24 aa, Entamoeba dispar
YKDKRYISYILKKSDRYAVELYCT

SEQ ID NO: 2544005 - protein, 23 aa, Entamoeba dispar
YKDLCASTLYYWIKSSEHKTSNL

SEQ ID NO: 2544006 - protein, 27 aa, Entamoeba dispar
YKDPKEEIKFFYWQGKHTSIKSKGKTS

SEQ ID NO: 2544007 - protein, 25 aa, Entamoeba dispar
YKDSTLIMQLLRDNLTLWTSDTADE

SEQ ID NO: 2544008 - protein, 24 aa, Entamoeba dispar
YKDTFKNWTGMTHHSILYDSSKDE

SEQ ID NO: 2544009 - protein, 33 aa, Entamoeba dispar
YKEAKVIIVIGPLLAREGEIAWKTALKALQQKE

SEQ ID NO: 2544010 - protein, 24 aa, Entamoeba dispar
YKEEKYIIFIKKIEGIKKIKQGRI

SEQ ID NO: 2544011 - protein, 25 aa, Entamoeba dispar
YKEETRECIECEKGYYLNSNKECQL

SEQ ID NO: 2544012 - protein, 21 aa, Entamoeba dispar
YKEILETAIKYTQKSSLWKKK

SEQ ID NO: 2544013 - protein, 23 aa, Entamoeba dispar
YKEKCVFMIKYSLELRQWKEVQN

SEQ ID NO: 2544014 - protein, 25 aa, Entamoeba dispar
YKELKYDVLTLKSLDFTPQSLVLVE

SEQ ID NO: 2544015 - protein, 25 aa, Entamoeba dispar
YKESINFVVDLLIELGYCITFFETS

SEQ ID NO: 2544016 - protein, 26 aa, Entamoeba dispar
YKFSEELFIKYLPLTLSYTSSQDRGK

SEQ ID NO: 2544017 - protein, 24 aa, Entamoeba dispar
YKGKKRIEFLKSFNLDDLTPYTYI

SEQ ID NO: 2544018 - protein, 20 aa, Entamoeba dispar
YKGNIIMPLGIWDEYFILEL

SEQ ID NO: 2544019 - protein, 23 aa, Entamoeba dispar
YKHSLIRYIPGYKCIKLLHERNA

SEQ ID NO: 2544020 - protein, 30 aa, Entamoeba dispar
YKIIYEKFQHFLKKVQFIVRTQKLLDLINQ

SEQ ID NO: 2544021 - protein, 18 aa, Entamoeba dispar
YKILFPEQPINKVIDTEK

SEQ ID NO: 2544022 - protein, 19 aa, Entamoeba dispar
YKILLDIILQFIKEQKILN

SEQ ID NO: 2544023 - protein, 27 aa, Entamoeba dispar
YKIMNKPNLYFINFDEFGYVFGAFVSV

SEQ ID NO: 2544024 - protein, 33 aa, Entamoeba dispar
YKKFEALATKFAGYLNPPKPLPPKAPYQKGDKF

SEQ ID NO: 2544025 - protein, 18 aa, Entamoeba dispar
YKKGNVQLVLLIGGTCKM

SEQ ID NO: 2544026 - protein, 40 aa, Entamoeba dispar
YKKIDNLPTILPETATQGPLPTTFNLPLTAKKKSRIRQDM

SEQ ID NO: 2544027 - protein, 23 aa, Entamoeba dispar
YKKIIGIVWKKYGVTKGFELSVG

SEQ ID NO: 2544028 - protein, 25 aa, Entamoeba dispar
YKKMAPLIKELFVEGLKFIKKENDP

SEQ ID NO: 2544029 - protein, 24 aa, Entamoeba dispar
YKKVLFNPIIKKGCNDIYVYLSGF

SEQ ID NO: 2544030 - protein, 29 aa, Entamoeba dispar
YKKYKGPSILILPHFFKKIIQDQILFSLF

SEQ ID NO: 2544031 - protein, 24 aa, Entamoeba dispar
YKKYLIYKQIQFDRKHWKEVLISK

SEQ ID NO: 2544032 - protein, 19 aa, Entamoeba dispar
YKLETIPSKIKFLSIFKKN

SEQ ID NO: 2544033 - protein, 35 aa, Entamoeba dispar
YKLHLIFNREHLLPGDWFGLFKKSSMSQKSPIFQI

SEQ ID NO: 2544034 - protein, 32 aa, Entamoeba dispar
YKLLLKDDIKLDLHADLYFLIHAMYQDNNKTI

SEQ ID NO: 2544035 - protein, 20 aa, Entamoeba dispar
YKLNVIMKTAIFFKTTACIG

SEQ ID NO: 2544036 - protein, 19 aa, Entamoeba dispar
YKLPFKCFNNCKSLIKINI

SEQ ID NO: 2544037 - protein, 17 aa, Entamoeba dispar
YKLPKLDTIMGLSDENG

SEQ ID NO: 2544038 - protein, 23 aa, Entamoeba dispar
YKLYPFTRHVFLSGGLAVGKTTI

SEQ ID NO: 2544039 - protein, 21 aa, Entamoeba dispar
YKMIIYETLINQRITCGLHKP

SEQ ID NO: 2544040 - protein, 20 aa, Entamoeba dispar
YKMLHVINKSEFYIPGYWKA

SEQ ID NO: 2544041 - protein, 23 aa, Entamoeba dispar
YKNDVHFYFMPHGIGHLIGIDTH

SEQ ID NO: 2544042 - protein, 31 aa, Entamoeba dispar
YKNELRLRLCVLFLRTLYEELLKHKSSDLNL

SEQ ID NO: 2544043 - protein, 29 aa, Entamoeba dispar
YKNLDHKFTYIYLTVLPKQKDRSSLSQNE

SEQ ID NO: 2544044 - protein, 23 aa, Entamoeba dispar
YKNRPFIQIDKRPRIDLTKAIVS

SEQ ID NO: 2544045 - protein, 32 aa, Entamoeba dispar
YKNVIEGCKWYQFLHSILVGAVLIVNKIKEGN

SEQ ID NO: 2544046 - protein, 26 aa, Entamoeba dispar
YKNYKKLFMVVRPVELVFFKEKDLKE

SEQ ID NO: 2544047 - protein, 20 aa, Entamoeba dispar
YKNYYHCLSLFNQNKLKESY

SEQ ID NO: 2544048 - protein, 24 aa, Entamoeba dispar
YKPSLIMSKFFPALQGSMGKMSAS

SEQ ID NO: 2544049 - protein, 22 aa, Entamoeba dispar
YKQINFIIILNEYGFTINNLLK

SEQ ID NO: 2544050 - protein, 25 aa, Entamoeba dispar
YKRGLQYSPFINALGSIIFFDYTNE

SEQ ID NO: 2544051 - protein, 19 aa, Entamoeba dispar
YKRYTEVITFVLMSIADAA

SEQ ID NO: 2544052 - protein, 18 aa, Entamoeba dispar
YKRYYEYYRNPEILAFIR

SEQ ID NO: 2544053 - protein, 24 aa, Entamoeba dispar
YKTFERYVIPIKLFKDVEKKIPEE

SEQ ID NO: 2544054 - protein, 23 aa, Entamoeba dispar
YKTILNCIKLFDSNEYPIQVILP

SEQ ID NO: 2544055 - protein, 21 aa, Entamoeba dispar
YKTYKLPEKIIFYIKSHLNDE

SEQ ID NO: 2544056 - protein, 17 aa, Entamoeba dispar
YKVLLMRDIIKGGKELA

SEQ ID NO: 2544057 - protein, 27 aa, Entamoeba dispar
YKVNKKYIEFLFKMKRINMVTAQNVID

SEQ ID NO: 2544058 - protein, 32 aa, Entamoeba dispar
YKVQVSFFTQFLYFNYLPVRRIATETILQVLK

SEQ ID NO: 2544059 - protein, 19 aa, Entamoeba dispar
YKVSVLFMGEKPITIGKKA

SEQ ID NO: 2544060 - protein, 20 aa, Entamoeba dispar
YKYFSIKKICDLAEALLLAV

SEQ ID NO: 2544061 - protein, 23 aa, Entamoeba dispar
YKYSNLFSQFLIAKLINAERSAQ

SEQ ID NO: 2544062 - protein, 25 aa, Entamoeba dispar
YKYTKKKMEFLWTGDMKLNTVHVHD

SEQ ID NO: 2544063 - protein, 18 aa, Entamoeba dispar
YLAPTEFFNKLIGLYNEN

SEQ ID NO: 2544064 - protein, 25 aa, Entamoeba dispar
YLAQYSMFHLASPKILMLKKKLTEE

SEQ ID NO: 2544065 - protein, 25 aa, Entamoeba dispar
YLCDELLRQSILIGKYPFDIHHNYK

SEQ ID NO: 2544066 - protein, 30 aa, Entamoeba dispar
YLCEFCDDFKYFEPTFIYILHALHENEVIS

SEQ ID NO: 2544067 - protein, 34 aa, Entamoeba dispar
YLDAPLPMDGKLKEPVFNLLLSKPQLSNILNTFF

SEQ ID NO: 2544068 - protein, 19 aa, Entamoeba dispar
YLDDFDPHFALLSINNKYV

SEQ ID NO: 2544069 - protein, 29 aa, Entamoeba dispar
YLDEFDYLLRNSILFRKETFDSAIDDIMV

SEQ ID NO: 2544070 - protein, 18 aa, Entamoeba dispar
YLDGRVVSKPFSWPTTDF

SEQ ID NO: 2544071 - protein, 18 aa, Entamoeba dispar
YLDMIQIIEYLPIFCEIK

SEQ ID NO: 2544072 - protein, 18 aa, Entamoeba dispar
YLEFCSIKGISYVSVDEP

SEQ ID NO: 2544073 - protein, 31 aa, Entamoeba dispar
YLEHDTKLPAVFFIFSRRLVMDYAKKLAKAT

SEQ ID NO: 2544074 - protein, 25 aa, Entamoeba dispar
YLEIKNFLLHSPLKYTGINLRTLTD

SEQ ID NO: 2544075 - protein, 27 aa, Entamoeba dispar
YLELSYLKKTYPDIPIIALTATATPKV

SEQ ID NO: 2544076 - protein, 24 aa, Entamoeba dispar
YLESKIYFGYIRMSIMDDSSNIHE

SEQ ID NO: 2544077 - protein, 17 aa, Entamoeba dispar
YLFCYYEITTDQLTSLT

SEQ ID NO: 2544078 - protein, 20 aa, Entamoeba dispar
YLFDFFLVEEDIHIGGYSAF

SEQ ID NO: 2544079 - protein, 19 aa, Entamoeba dispar
YLFNVNFGDIFVVRSAGGV

SEQ ID NO: 2544080 - protein, 24 aa, Entamoeba dispar
YLGFRHFYVFCREYDLLSKEDISP

SEQ ID NO: 2544081 - protein, 17 aa, Entamoeba dispar
YLHCDCIHFSISKLNIE

SEQ ID NO: 2544082 - protein, 17 aa, Entamoeba dispar
YLHDAGIVYRDLKPENI

SEQ ID NO: 2544083 - protein, 23 aa, Entamoeba dispar
YLHLPESIILPRGLTFSDTLSIQ

SEQ ID NO: 2544084 - protein, 29 aa, Entamoeba dispar
YLHSLGIKHILCVAPLIPSLFPNEFDYKN

SEQ ID NO: 2544085 - protein, 20 aa, Entamoeba dispar
YLHTFEILNMYKGDIESLIS

SEQ ID NO: 2544086 - protein, 18 aa, Entamoeba dispar
YLHVLPIPNQFASLESYG

SEQ ID NO: 2544087 - protein, 20 aa, Entamoeba dispar
YLIESLSDSTIYMAYYTIAH

SEQ ID NO: 2544088 - protein, 19 aa, Entamoeba dispar
YLIGFLEFVLNRDPTKRPQ

SEQ ID NO: 2544089 - protein, 20 aa, Entamoeba dispar
YLIGNCEGCFPVMLLVESCR

SEQ ID NO: 2544090 - protein, 18 aa, Entamoeba dispar
YLIIMSSLNRPRDDIYTD

SEQ ID NO: 2544091 - protein, 25 aa, Entamoeba dispar
YLINYDDLPSFAFKSKQTRINWTDK

SEQ ID NO: 2544092 - protein, 22 aa, Entamoeba dispar
YLINYDELPSFAFKSKQTRINW

SEQ ID NO: 2544093 - protein, 18 aa, Entamoeba dispar
YLIPYNLVEFTDEFVTCG

SEQ ID NO: 2544094 - protein, 17 aa, Entamoeba dispar
YLIQTHAVLFLPQANVL

SEQ ID NO: 2544095 - protein, 25 aa, Entamoeba dispar
YLISKKGFWNILKKEKCVFKIGFFL

SEQ ID NO: 2544096 - protein, 17 aa, Entamoeba dispar
YLISSYEGSINKITTKF

SEQ ID NO: 2544097 - protein, 33 aa, Entamoeba dispar
YLITPIQRIPRYVLLISDLLRNISMLFGDAPRL

SEQ ID NO: 2544098 - protein, 17 aa, Entamoeba dispar
YLIVDITSDFNYFNKFV

SEQ ID NO: 2544099 - protein, 21 aa, Entamoeba dispar
YLKALDSLVKLASLQTAFLTL

SEQ ID NO: 2544100 - protein, 25 aa, Entamoeba dispar
YLKDGIMFMYFQKTEIIQPILCVPT

SEQ ID NO: 2544101 - protein, 19 aa, Entamoeba dispar
YLKDITNEDIRTAMLGLGH

SEQ ID NO: 2544102 - protein, 27 aa, Entamoeba dispar
YLKSFSSKMIKFFGTQALKKLIVVSMN

SEQ ID NO: 2544103 - protein, 19 aa, Entamoeba dispar
YLLCSFYNKSIESPYSLLM

SEQ ID NO: 2544104 - protein, 21 aa, Entamoeba dispar
YLLKENVIQIIFIPKNSEREV

SEQ ID NO: 2544105 - protein, 22 aa, Entamoeba dispar
YLLKFLIIGDTAVGKTAMLLRY

SEQ ID NO: 2544106 - protein, 18 aa, Entamoeba dispar
YLLLKHEVDATRITSILI

SEQ ID NO: 2544107 - protein, 20 aa, Entamoeba dispar
YLLLNGICVALKMGNPDYER

SEQ ID NO: 2544108 - protein, 25 aa, Entamoeba dispar
YLMKQSYIFGTWTERYVIIKDNVLV

SEQ ID NO: 2544109 - protein, 27 aa, Entamoeba dispar
YLMLRRNIGFLTRIISLLFSFDENFTD

SEQ ID NO: 2544110 - protein, 18 aa, Entamoeba dispar
YLMVVLKYLDSVDTLCRF

SEQ ID NO: 2544111 - protein, 32 aa, Entamoeba dispar
YLNEACPMEMTFAEVILVLKANYEWSYPQYVC

SEQ ID NO: 2544112 - protein, 19 aa, Entamoeba dispar
YLNGKIVSKPFSWPSTDFI

SEQ ID NO: 2544113 - protein, 17 aa, Entamoeba dispar
YLNGLKKKYKDMPEIRR

SEQ ID NO: 2544114 - protein, 18 aa, Entamoeba dispar
YLNILYQHYIKKIGEKEK

SEQ ID NO: 2544115 - protein, 20 aa, Entamoeba dispar
YLNKILTVPIKFFRKIDAVR

SEQ ID NO: 2544116 - protein, 27 aa, Entamoeba dispar
YLNKLRSFGYKIGILRPAFISGNSVSG

SEQ ID NO: 2544117 - protein, 18 aa, Entamoeba dispar
YLNLFRIYIKHYRIIKTY

SEQ ID NO: 2544118 - protein, 18 aa, Entamoeba dispar
YLNLLQSLNIKLPQLDQF

SEQ ID NO: 2544119 - protein, 17 aa, Entamoeba dispar
YLNLVKLLNGLVIEYNG

SEQ ID NO: 2544120 - protein, 18 aa, Entamoeba dispar
YLNQHQIAVPLQPSQPNQ

SEQ ID NO: 2544121 - protein, 23 aa, Entamoeba dispar
YLNRILQDIFAYGKNRKIFFSSF

SEQ ID NO: 2544122 - protein, 28 aa, Entamoeba dispar
YLNYHDCKQYYHTYYPLIRLEAEADRQK

SEQ ID NO: 2544123 - protein, 17 aa, Entamoeba dispar
YLPFFGETQDELFQKIM

SEQ ID NO: 2544124 - protein, 17 aa, Entamoeba dispar
YLPKHLGILLDTIDIKT

SEQ ID NO: 2544125 - protein, 17 aa, Entamoeba dispar
YLPTLKDVGRFAQVCKS

SEQ ID NO: 2544126 - protein, 25 aa, Entamoeba dispar
YLQDSSPMWWLNNGKKFRDAWREKH

SEQ ID NO: 2544127 - protein, 23 aa, Entamoeba dispar
YLQHCMIHCYGFSPLPNAEDLKK

SEQ ID NO: 2544128 - protein, 19 aa, Entamoeba dispar
YLQKFPLKYFCISDVPLPL

SEQ ID NO: 2544129 - protein, 18 aa, Entamoeba dispar
YLQRCVIKMLESLHVEYD

SEQ ID NO: 2544130 - protein, 24 aa, Entamoeba dispar
YLRELRSLWISLLVGDSIVVLGDD

SEQ ID NO: 2544131 - protein, 19 aa, Entamoeba dispar
YLRIIVNQVSLLESLNSEE

SEQ ID NO: 2544132 - protein, 25 aa, Entamoeba dispar
YLRKPDMIHFLKYLQYWKQPNYIKF

SEQ ID NO: 2544133 - protein, 23 aa, Entamoeba dispar
YLRNTLILSTLYQRSIDQWDNEE

SEQ ID NO: 2544134 - protein, 20 aa, Entamoeba dispar
YLRTLMRAVAQLTGGQYAAL

SEQ ID NO: 2544135 - protein, 23 aa, Entamoeba dispar
YLSDFAPYKPFYIPDDNPYDLNF

SEQ ID NO: 2544136 - protein, 22 aa, Entamoeba dispar
YLSEPTQALLSLIIKDIHSGNN

SEQ ID NO: 2544137 - protein, 27 aa, Entamoeba dispar
YLSIGLERWFYCYQPYDIVIDDNDNYV

SEQ ID NO: 2544138 - protein, 31 aa, Entamoeba dispar
YLSKSFELQVYYLRDYFSNILLDTPSKPYYI

SEQ ID NO: 2544139 - protein, 19 aa, Entamoeba dispar
YLSLIKDIKYQPLIVLLFQ

SEQ ID NO: 2544140 - protein, 29 aa, Entamoeba dispar
YLSNCVQIPYCYYNLNLIGGILPNDYYKG

SEQ ID NO: 2544141 - protein, 26 aa, Entamoeba dispar
YLSSYHFDLFLKLMVKMQLCVKETYK

SEQ ID NO: 2544142 - protein, 26 aa, Entamoeba dispar
YLSTDIFRRILEDYFGYQVIQCMNIT

SEQ ID NO: 2544143 - protein, 17 aa, Entamoeba dispar
YLSYEIMFHVSTLLPEQ

SEQ ID NO: 2544144 - protein, 17 aa, Entamoeba dispar
YLTFTYPTYDVPVLMDA

SEQ ID NO: 2544145 - protein, 17 aa, Entamoeba dispar
YLTPNSPIVIPNAQVRY

SEQ ID NO: 2544146 - protein, 18 aa, Entamoeba dispar
YLTRHMMILDRLIHLINI

SEQ ID NO: 2544147 - protein, 17 aa, Entamoeba dispar
YLTYGCQFVYQNKPQKA

SEQ ID NO: 2544148 - protein, 19 aa, Entamoeba dispar
YLVECRKIMVFKASLLQEE

SEQ ID NO: 2544149 - protein, 30 aa, Entamoeba dispar
YLVEDLAITSMRFLREYKKIINIMKNCSTN

SEQ ID NO: 2544150 - protein, 18 aa, Entamoeba dispar
YLVLHSINYTPKLYLIFD

SEQ ID NO: 2544151 - protein, 17 aa, Entamoeba dispar
YLVSSEIGFIILRLLKQ

SEQ ID NO: 2544152 - protein, 17 aa, Entamoeba dispar
YLWAYMAGKLPTGGDME

SEQ ID NO: 2544153 - protein, 17 aa, Entamoeba dispar
YLYTGRGPSSDALHLGH

SEQ ID NO: 2544154 - protein, 35 aa, Entamoeba dispar
YMDAISLITSWQHKPWICCFCKQVCYWEDIELNIR

SEQ ID NO: 2544155 - protein, 25 aa, Entamoeba dispar
YMDLLDLYTFIHGLSTPPPISFIRY

SEQ ID NO: 2544156 - protein, 25 aa, Entamoeba dispar
YMDPPMYNTLISALHHLYAISALDD

SEQ ID NO: 2544157 - protein, 27 aa, Entamoeba dispar
YMEIIYNTIWEHYFMIYCLKNNNQKDI

SEQ ID NO: 2544158 - protein, 26 aa, Entamoeba dispar
YMENTLFPLYCHSLVSSLNTLVHSHK

SEQ ID NO: 2544159 - protein, 22 aa, Entamoeba dispar
YMHGYFMHIKLYQRAMALKQND

SEQ ID NO: 2544160 - protein, 17 aa, Entamoeba dispar
YMIALKNLCLLHCNLHF

SEQ ID NO: 2544161 - protein, 24 aa, Entamoeba dispar
YMIKKKYYDSFLFTPENINLVFDE

SEQ ID NO: 2544162 - protein, 17 aa, Entamoeba dispar
YMLQTRNGKMNATATVR

SEQ ID NO: 2544163 - protein, 19 aa, Entamoeba dispar
YMMILDLMRKNMIIGNVRL

SEQ ID NO: 2544164 - protein, 19 aa, Entamoeba dispar
YMQFIYNDSLDYNSLSFKC

SEQ ID NO: 2544165 - protein, 26 aa, Entamoeba dispar
YMQRVDLLSILLLYGADINIPNKQGE

SEQ ID NO: 2544166 - protein, 17 aa, Entamoeba dispar
YMTDGMLLRELMGDPKI

SEQ ID NO: 2544167 - protein, 26 aa, Entamoeba dispar
YMTNGMLLREYLIDKDLPQYKVLILD

SEQ ID NO: 2544168 - protein, 26 aa, Entamoeba dispar
YMVNRLNVLLLQHIQKCLPGLKQQIT

SEQ ID NO: 2544169 - protein, 17 aa, Entamoeba dispar
YMVRELHDQLIQLKSII

SEQ ID NO: 2544170 - protein, 21 aa, Entamoeba dispar
YMVSPECVIKMFASLKSIFPI

SEQ ID NO: 2544171 - protein, 22 aa, Entamoeba dispar
YNAYGHIIYLILTKLNKEITYE

SEQ ID NO: 2544172 - protein, 24 aa, Entamoeba dispar
YNCLPIQFCMMLYSLLSVKYSVIR

SEQ ID NO: 2544173 - protein, 18 aa, Entamoeba dispar
YNCNSLTNIIIPTSVNKL

SEQ ID NO: 2544174 - protein, 22 aa, Entamoeba dispar
YNDFRMVVWGFDQNIREIFKKL

SEQ ID NO: 2544175 - protein, 33 aa, Entamoeba dispar
YNDSIKPLHFVIVSKIPIALLKAKSLCDNLISH

SEQ ID NO: 2544176 - protein, 28 aa, Entamoeba dispar
YNDSIRFLFLLELAHWYYMDNWTKKLNY

SEQ ID NO: 2544177 - protein, 27 aa, Entamoeba dispar
YNEEKPYIPGFLPPLPDARTYKNTPIY

SEQ ID NO: 2544178 - protein, 24 aa, Entamoeba dispar
YNEEKYIVFIKKIEGIKKIKQGRI

SEQ ID NO: 2544179 - protein, 22 aa, Entamoeba dispar
YNEIMITSMYFNNIKDFINLEI

SEQ ID NO: 2544180 - protein, 24 aa, Entamoeba dispar
YNEKDIMIPPKINTSIMVTPTEIQ

SEQ ID NO: 2544181 - protein, 23 aa, Entamoeba dispar
YNEKTTLLLFPSPDAQPLDKIEH

SEQ ID NO: 2544182 - protein, 20 aa, Entamoeba dispar
YNELFDDCILYYSSNIHTFN

SEQ ID NO: 2544183 - protein, 24 aa, Entamoeba dispar
YNELHPKFIAQYIDQLLRGVGVGK

SEQ ID NO: 2544184 - protein, 26 aa, Entamoeba dispar
YNENENGFYTIYNNLFNSILEEEGGG

SEQ ID NO: 2544185 - protein, 29 aa, Entamoeba dispar
YNENVYLAFSDVFMQLPYCHVIDSKVFVV

SEQ ID NO: 2544186 - protein, 25 aa, Entamoeba dispar
YNESSIQIQWLWEILAEYGKEDHVK

SEQ ID NO: 2544187 - protein, 31 aa, Entamoeba dispar
YNEYSKLFLMDYLKHVLTPVLDLIVSSTLNI

SEQ ID NO: 2544188 - protein, 18 aa, Entamoeba dispar
YNFFKINCFTKDMLFEYT

SEQ ID NO: 2544189 - protein, 20 aa, Entamoeba dispar
YNFKSYYDKVELGPFHESFT

SEQ ID NO: 2544190 - protein, 18 aa, Entamoeba dispar
YNFLLDKCKSISDIITGD

SEQ ID NO: 2544191 - protein, 18 aa, Entamoeba dispar
YNFSIFICGNGNDAQHVI

SEQ ID NO: 2544192 - protein, 20 aa, Entamoeba dispar
YNFTFFVFHSAEKDIKEIEE

SEQ ID NO: 2544193 - protein, 17 aa, Entamoeba dispar
YNFVYLSYSYDADKFNG

SEQ ID NO: 2544194 - protein, 24 aa, Entamoeba dispar
YNGGYNWWKRNSLKVFIDKKLYKD

SEQ ID NO: 2544195 - protein, 25 aa, Entamoeba dispar
YNGGYNWWKRNSLTVFINKKLYKDP

SEQ ID NO: 2544196 - protein, 26 aa, Entamoeba dispar
YNGQKPRKLAMWPKYNFYKADQRYME

SEQ ID NO: 2544197 - protein, 34 aa, Entamoeba dispar
YNGTGIPGFPVNFLQYFQLFPSVFNTSINRQPKP

SEQ ID NO: 2544198 - protein, 22 aa, Entamoeba dispar
YNGTYSIMFHVAPLLPNQEGDA

SEQ ID NO: 2544199 - protein, 19 aa, Entamoeba dispar
YNHCIGSVYFTKFEKMSPA

SEQ ID NO: 2544200 - protein, 25 aa, Entamoeba dispar
YNHKGKIICHPCMLKKLPKCTHCNN

SEQ ID NO: 2544201 - protein, 18 aa, Entamoeba dispar
YNHLYAEFLTKVKEKDIP

SEQ ID NO: 2544202 - protein, 25 aa, Entamoeba dispar
YNIEMIDMMNCQYLSTINEEKPIKQ

SEQ ID NO: 2544203 - protein, 17 aa, Entamoeba dispar
YNIERIGIIPMNEIMYG

SEQ ID NO: 2544204 - protein, 26 aa, Entamoeba dispar
YNIKKYKMTVFIPMHFPRFSTMQGNR

SEQ ID NO: 2544205 - protein, 18 aa, Entamoeba dispar
YNILLRTKAKEKKERELN

SEQ ID NO: 2544206 - protein, 35 aa, Entamoeba dispar
YNINIYYEFCESFNYLPLGVIIKRKIGKFFCCHGG

SEQ ID NO: 2544207 - protein, 19 aa, Entamoeba dispar
YNITLCSIPIMVSRYLMIY

SEQ ID NO: 2544208 - protein, 28 aa, Entamoeba dispar
YNKALKAIGLHKCYCACWGVMSEKSRAK

SEQ ID NO: 2544209 - protein, 24 aa, Entamoeba dispar
YNKETILYKLLDLVNKKFDNKAVP

SEQ ID NO: 2544210 - protein, 23 aa, Entamoeba dispar
YNKIYFNSFPILFGKQITCSEIM

SEQ ID NO: 2544211 - protein, 23 aa, Entamoeba dispar
YNKLFQVRWFYVSCSRVQSRGTE

SEQ ID NO: 2544212 - protein, 23 aa, Entamoeba dispar
YNKLLIHIRYVLQTIYAVEKMAN

SEQ ID NO: 2544213 - protein, 24 aa, Entamoeba dispar
YNKQEINYYWNPIDTFIHLMVNDA

SEQ ID NO: 2544214 - protein, 29 aa, Entamoeba dispar
YNKTQGTMFLFNDIFIFTKPERNEYIFGS

SEQ ID NO: 2544215 - protein, 22 aa, Entamoeba dispar
YNLKQNNLFISFGRKSIDCSAI

SEQ ID NO: 2544216 - protein, 30 aa, Entamoeba dispar
YNLLYESMLGSVLYARDKWLIKGGLILPDK

SEQ ID NO: 2544217 - protein, 17 aa, Entamoeba dispar
YNLSEMESYRKCGIKLP

SEQ ID NO: 2544218 - protein, 24 aa, Entamoeba dispar
YNNEGEVLIIKQIVDGLLKNKVKE

SEQ ID NO: 2544219 - protein, 40 aa, Entamoeba dispar
YNNLRFSTNLKYIIKFIYDIFEFKDIWKHVCIVWTKCYND

SEQ ID NO: 2544220 - protein, 26 aa, Entamoeba dispar
YNNRRIIKKVIWYKVSYSTYLQEKEQ

SEQ ID NO: 2544221 - protein, 17 aa, Entamoeba dispar
YNNYEKVKFTQNPTKYF

SEQ ID NO: 2544222 - protein, 31 aa, Entamoeba dispar
YNNYLDQIYSLLPYLLSIHLQPQEIIDLIWL

SEQ ID NO: 2544223 - protein, 17 aa, Entamoeba dispar
YNPVRLIYGKGSLDEIE

SEQ ID NO: 2544224 - protein, 29 aa, Entamoeba dispar
YNQKSWEFYEHPPFYLTTPSTILISSDCC

SEQ ID NO: 2544225 - protein, 31 aa, Entamoeba dispar
YNQLGYFSQVMFNIGYYYKLNAIKNKSWNYI

SEQ ID NO: 2544226 - protein, 30 aa, Entamoeba dispar
YNRDELFAHGLFYFIGLDSFFFQKSPNAFD

SEQ ID NO: 2544227 - protein, 19 aa, Entamoeba dispar
YNRIAPLDPITKPFIFVDC

SEQ ID NO: 2544228 - protein, 30 aa, Entamoeba dispar
YNRNGTNFLFKKLLGLLYFELNRRDEAKEL

SEQ ID NO: 2544229 - protein, 48 aa, Entamoeba dispar
YNRNVYMEFINLFNYLPLCVLLLQPIGTFFLCHGGISPSLRYFSQILR

SEQ ID NO: 2544230 - protein, 26 aa, Entamoeba dispar
YNRTKSLMLGFFKVIANSDAQPVTLE

SEQ ID NO: 2544231 - protein, 21 aa, Entamoeba dispar
YNSEIPFFREVPQGKFNPQKD

SEQ ID NO: 2544232 - protein, 22 aa, Entamoeba dispar
YNSILTLRRLITECQSVVVFDN

SEQ ID NO: 2544233 - protein, 36 aa, Entamoeba dispar
YNSKYHLKYCFFNKLGFLIEIPLFYNSFDSNWNLIF

SEQ ID NO: 2544234 - protein, 42 aa, Entamoeba dispar
YNSLKMPNAPQKKYKYLINDPKFFVFSLKAYNSSISPKKFMR

SEQ ID NO: 2544235 - protein, 17 aa, Entamoeba dispar
YNSLQFKFELFKMLYRE

SEQ ID NO: 2544236 - protein, 24 aa, Entamoeba dispar
YNSTFRPTMLSPFKNYLLHSSQNN

SEQ ID NO: 2544237 - protein, 21 aa, Entamoeba dispar
YNSVKLLTYPFSTSTLTQPLS

SEQ ID NO: 2544238 - protein, 45 aa, Entamoeba dispar
YNSYMGFCINLLPRGWHGLLSLTHMILLYYFPDVTIHLDKMKLTT

SEQ ID NO: 2544239 - protein, 23 aa, Entamoeba dispar
YNTAILKLFNQFLQKEFLEMLDD

SEQ ID NO: 2544240 - protein, 23 aa, Entamoeba dispar
YNTAPLQSLFPRLLSNNTSDCDT

SEQ ID NO: 2544241 - protein, 23 aa, Entamoeba dispar
YNTWKSIIQVLFIINKNKFPLPS

SEQ ID NO: 2544242 - protein, 23 aa, Entamoeba dispar
YNVSINIVLKWFDKLEMTIPKDL

SEQ ID NO: 2544243 - protein, 21 aa, Entamoeba dispar
YNYEAPKHYTWHYVVRSYDSG

SEQ ID NO: 2544244 - protein, 20 aa, Entamoeba dispar
YNYIKLINFIRKNKISIEEV

SEQ ID NO: 2544245 - protein, 19 aa, Entamoeba dispar
YNYNSPLTTPRRTPKKQSK

SEQ ID NO: 2544246 - protein, 26 aa, Entamoeba dispar
YPAFQPLVHLPFDILIEQIKMELRDI

SEQ ID NO: 2544247 - protein, 19 aa, Entamoeba dispar
YPAISRFLKYISGDCLCGI

SEQ ID NO: 2544248 - protein, 20 aa, Entamoeba dispar
YPALTSLIYFVYRSNFSALP

SEQ ID NO: 2544249 - protein, 27 aa, Entamoeba dispar
YPCSVPSIVSFFTMKFCHCIEDGYCNV

SEQ ID NO: 2544250 - protein, 20 aa, Entamoeba dispar
YPDALYLAAIELLQKGTSND

SEQ ID NO: 2544251 - protein, 24 aa, Entamoeba dispar
YPDTSIFIYLPRNYNFVNQCIDRM

SEQ ID NO: 2544252 - protein, 20 aa, Entamoeba dispar
YPEIKISYGLVKKVLEQQGL

SEQ ID NO: 2544253 - protein, 19 aa, Entamoeba dispar
YPELLNHTSFFPKDVINHA

SEQ ID NO: 2544254 - protein, 24 aa, Entamoeba dispar
YPENKLYFFIAASLLVQHKEIIMK

SEQ ID NO: 2544255 - protein, 28 aa, Entamoeba dispar
YPEQSDIILLNILVLIQPEIKEIIPKKY

SEQ ID NO: 2544256 - protein, 26 aa, Entamoeba dispar
YPEVSVPIIFLLMRDTVIALKGETTE

SEQ ID NO: 2544257 - protein, 22 aa, Entamoeba dispar
YPFLGTSHFYPPFSMQGFAQLS

SEQ ID NO: 2544258 - protein, 17 aa, Entamoeba dispar
YPHCILFDENELIVIDN

SEQ ID NO: 2544259 - protein, 19 aa, Entamoeba dispar
YPHKEVFAELQRLRKIFFP

SEQ ID NO: 2544260 - protein, 20 aa, Entamoeba dispar
YPHLTWEIPSLTVSSDEIKQ

SEQ ID NO: 2544261 - protein, 18 aa, Entamoeba dispar
YPKFFDNIKPSKKLIPLI

SEQ ID NO: 2544262 - protein, 29 aa, Entamoeba dispar
YPKGRHDFKARLFQFYTSEDNELLCNELR

SEQ ID NO: 2544263 - protein, 17 aa, Entamoeba dispar
YPKIVYLQNGSYLQRSG

SEQ ID NO: 2544264 - protein, 27 aa, Entamoeba dispar
YPKKEIEWLMRISWNKGNKSRYKQDNR

SEQ ID NO: 2544265 - protein, 24 aa, Entamoeba dispar
YPKLHHVYRYKVDYSFYLKHREDN

SEQ ID NO: 2544266 - protein, 25 aa, Entamoeba dispar
YPKNTITYIIHRSFELFYSNIVDDI

SEQ ID NO: 2544267 - protein, 19 aa, Entamoeba dispar
YPLEDIVLNALHDYYVDLE

SEQ ID NO: 2544268 - protein, 20 aa, Entamoeba dispar
YPLENGIIKSWDDMELLWNY

SEQ ID NO: 2544269 - protein, 18 aa, Entamoeba dispar
YPMQKIVQQFIFTTDTDI

SEQ ID NO: 2544270 - protein, 21 aa, Entamoeba dispar
YPMVGPMFVPPPIYYPSQQLF

SEQ ID NO: 2544271 - protein, 24 aa, Entamoeba dispar
YPNKKILPILPFQLRQQLITTLCL

SEQ ID NO: 2544272 - protein, 25 aa, Entamoeba dispar
YPPKKIYFAVHQYYKFIFSDQQILT

SEQ ID NO: 2544273 - protein, 21 aa, Entamoeba dispar
YPPPTFKPQFIMPGHYINGYL

SEQ ID NO: 2544274 - protein, 33 aa, Entamoeba dispar
YPQSKLLPFTMVGGFLFLRIICPSLAAPEASGI

SEQ ID NO: 2544275 - protein, 29 aa, Entamoeba dispar
YPQYKKQFPDLKISEIGKKIGVEWKELPE

SEQ ID NO: 2544276 - protein, 18 aa, Entamoeba dispar
YPRPNAFPQNSYLPSSIG

SEQ ID NO: 2544277 - protein, 18 aa, Entamoeba dispar
YPSIFKKDGKYYLNNNYG

SEQ ID NO: 2544278 - protein, 17 aa, Entamoeba dispar
YPSIRSSILFTDYCKAI

SEQ ID NO: 2544279 - protein, 19 aa, Entamoeba dispar
YPSLIPYSKEFKEVFPMVT

SEQ ID NO: 2544280 - protein, 26 aa, Entamoeba dispar
YPSPNIQCPFFLTSSKINQILQSFNQ

SEQ ID NO: 2544281 - protein, 17 aa, Entamoeba dispar
YPSQRLLLVLYNPRIIK

SEQ ID NO: 2544282 - protein, 25 aa, Entamoeba dispar
YPSYQLYLNYLFIIHGLNEYIGDIP

SEQ ID NO: 2544283 - protein, 25 aa, Entamoeba dispar
YPTKRILQFYILVDDSYNFGISYGD

SEQ ID NO: 2544284 - protein, 24 aa, Entamoeba dispar
YPTPQQPVDLLNAKAPKYSPKTSP

SEQ ID NO: 2544285 - protein, 17 aa, Entamoeba dispar
YPTSYPSDPSMFGRTIN

SEQ ID NO: 2544286 - protein, 33 aa, Entamoeba dispar
YPVEIDSITVGNKLFYCSYLPSGQARLTKKFTE

SEQ ID NO: 2544287 - protein, 23 aa, Entamoeba dispar
YPYEYFHQIITLFLNTRPLSNTF

SEQ ID NO: 2544288 - protein, 24 aa, Entamoeba dispar
YQADLQAILIALLTQFSTISVGRP

SEQ ID NO: 2544289 - protein, 22 aa, Entamoeba dispar
YQALTPIYYRDSQGAILVYDIT

SEQ ID NO: 2544290 - protein, 34 aa, Entamoeba dispar
YQCDCVCFYFVPRIIKMMKPKILEYLRADHSRRC

SEQ ID NO: 2544291 - protein, 24 aa, Entamoeba dispar
YQCLSFSLVQIFKRLLTEPTSEVM

SEQ ID NO: 2544292 - protein, 18 aa, Entamoeba dispar
YQCVLMSDSFFVLTQNKK

SEQ ID NO: 2544293 - protein, 21 aa, Entamoeba dispar
YQDGSIRIWSPKTQESIKMSV

SEQ ID NO: 2544294 - protein, 18 aa, Entamoeba dispar
YQDIIDAFYERRLHRMEA

SEQ ID NO: 2544295 - protein, 35 aa, Entamoeba dispar
YQEANPFLVIVLLKYFFLSLPQSFFCDKLIIELLS

SEQ ID NO: 2544296 - protein, 30 aa, Entamoeba dispar
YQEARNIIFDYFRGKLFYVYHNNIYLNEPI

SEQ ID NO: 2544297 - protein, 25 aa, Entamoeba dispar
YQEIIKDNPWYFDARIRRCYHLWDE

SEQ ID NO: 2544298 - protein, 26 aa, Entamoeba dispar
YQEKKQYYCLLQTISQKRFIGVVGGV

SEQ ID NO: 2544299 - protein, 25 aa, Entamoeba dispar
YQEKTRTFPVLYVRGDLVVLISPQK

SEQ ID NO: 2544300 - protein, 19 aa, Entamoeba dispar
YQFCWLCMQEYTSSHFKNG

SEQ ID NO: 2544301 - protein, 18 aa, Entamoeba dispar
YQFQKYVLGCYRKQFMKQ

SEQ ID NO: 2544302 - protein, 20 aa, Entamoeba dispar
YQGKYMITILSASDLSLMSQ

SEQ ID NO: 2544303 - protein, 18 aa, Entamoeba dispar
YQGLLNTIAPFAKKISTV

SEQ ID NO: 2544304 - protein, 28 aa, Entamoeba dispar
YQHPPNFYQPFTIPPDKQPLPYQLNTPF

SEQ ID NO: 2544305 - protein, 26 aa, Entamoeba dispar
YQIGEYIIIVMEYLPGGSLQSILKRC

SEQ ID NO: 2544306 - protein, 17 aa, Entamoeba dispar
YQIIEKEFNPIWDVLQI

SEQ ID NO: 2544307 - protein, 21 aa, Entamoeba dispar
YQIKENVVFIQESLTETEQKL

SEQ ID NO: 2544308 - protein, 32 aa, Entamoeba dispar
YQIKPLINEFPKLQWFFLLNCTSPKQERLTKN

SEQ ID NO: 2544309 - protein, 17 aa, Entamoeba dispar
YQILDGYNTLRSPSLSS

SEQ ID NO: 2544310 - protein, 24 aa, Entamoeba dispar
YQKAGFLKWAPRTLDLFQYSRRDM

SEQ ID NO: 2544311 - protein, 24 aa, Entamoeba dispar
YQKIGELCIQCWKGLIKYKEIQTK

SEQ ID NO: 2544312 - protein, 24 aa, Entamoeba dispar
YQKPQEILNLILGKIFFSKQQESC

SEQ ID NO: 2544313 - protein, 20 aa, Entamoeba dispar
YQLYIGWYDGNPAHLNELPP

SEQ ID NO: 2544314 - protein, 21 aa, Entamoeba dispar
YQMIDILLSIYAKVFCRLFKY

SEQ ID NO: 2544315 - protein, 25 aa, Entamoeba dispar
YQMKSVFLNGLTLFLIQVIKNKYTQ

SEQ ID NO: 2544316 - protein, 25 aa, Entamoeba dispar
YQMNEVVMILRFLKKQSTHLSQIEF

SEQ ID NO: 2544317 - protein, 19 aa, Entamoeba dispar
YQMTFGLQKLFVDMLKGIN

SEQ ID NO: 2544318 - protein, 22 aa, Entamoeba dispar
YQNIHNPYLPYYHPQYTPNQYP

SEQ ID NO: 2544319 - protein, 23 aa, Entamoeba dispar
YQNLDSFSYFIYLREFVNCQNFI

SEQ ID NO: 2544320 - protein, 27 aa, Entamoeba dispar
YQNLMERNINCLLLHGGIDQIDRQNTI

SEQ ID NO: 2544321 - protein, 27 aa, Entamoeba dispar
YQNLMNELITPLRAYGQQFKELLGRCK

SEQ ID NO: 2544322 - protein, 19 aa, Entamoeba dispar
YQNVSYFCKLYLLKKEYLS

SEQ ID NO: 2544323 - protein, 19 aa, Entamoeba dispar
YQPLFYTQDIGIPGTIYPL

SEQ ID NO: 2544324 - protein, 25 aa, Entamoeba dispar
YQQCKNPLKIYLFSLVSQSNSMERI

SEQ ID NO: 2544325 - protein, 32 aa, Entamoeba dispar
YQQDHPPFKEIPYYLLHPFRSLFIKENSSSNC

SEQ ID NO: 2544326 - protein, 31 aa, Entamoeba dispar
YQQYEILRREFLSALAFVEPTFDLSSALAGE

SEQ ID NO: 2544327 - protein, 20 aa, Entamoeba dispar
YQQYTLPYISTIPSSTLQWI

SEQ ID NO: 2544328 - protein, 20 aa, Entamoeba dispar
YQQYYNTPLILDEGFEPEGE

SEQ ID NO: 2544329 - protein, 17 aa, Entamoeba dispar
YQRERLPLPAARDFENA

SEQ ID NO: 2544330 - protein, 19 aa, Entamoeba dispar
YQRGLLLGQTYAGFIYSAM

SEQ ID NO: 2544331 - protein, 30 aa, Entamoeba dispar
YQSFRDKTLFYLIHTDLEAITYLHKTYKTL

SEQ ID NO: 2544332 - protein, 17 aa, Entamoeba dispar
YQSKMPGAPMHLSLDIQ

SEQ ID NO: 2544333 - protein, 21 aa, Entamoeba dispar
YQTKILIWNSTSQLLLQIVST

SEQ ID NO: 2544334 - protein, 18 aa, Entamoeba dispar
YQTLRKLVTGFEKVGAVA

SEQ ID NO: 2544335 - protein, 24 aa, Entamoeba dispar
YQTTRYLYMIIELVSGGELFDQIV

SEQ ID NO: 2544336 - protein, 18 aa, Entamoeba dispar
YQVSQQAVLLALINRHFS

SEQ ID NO: 2544337 - protein, 17 aa, Entamoeba dispar
YQVTEWMLRLFKESRGI

SEQ ID NO: 2544338 - protein, 18 aa, Entamoeba dispar
YQYCQLVMHEKTYGLDIF

SEQ ID NO: 2544339 - protein, 20 aa, Entamoeba dispar
YQYIRLRCPHAQFTEAKSSE

SEQ ID NO: 2544340 - protein, 24 aa, Entamoeba dispar
YQYPPRVPQLYQQRPPQQNPTETT

SEQ ID NO: 2544341 - protein, 18 aa, Entamoeba dispar
YQYYFERFMNHKVQIRLF

SEQ ID NO: 2544342 - protein, 19 aa, Entamoeba dispar
YRALRSICWSSIQSPRPSL

SEQ ID NO: 2544343 - protein, 17 aa, Entamoeba dispar
YRCISLCRSPRYDTKQK

SEQ ID NO: 2544344 - protein, 29 aa, Entamoeba dispar
YRDICLSYGFFNSFLRLYTSLYMLQTMVN

SEQ ID NO: 2544345 - protein, 17 aa, Entamoeba dispar
YRDIPSKSLWNAFIDSN

SEQ ID NO: 2544346 - protein, 33 aa, Entamoeba dispar
YRDLQTGIWEPCYLMLIGSILYIYKNPVDIFNG

SEQ ID NO: 2544347 - protein, 25 aa, Entamoeba dispar
YRETQGALIVYDITNRDSFDYLQDW

SEQ ID NO: 2544348 - protein, 20 aa, Entamoeba dispar
YRFYHYPDSWRLRIGQFITF

SEQ ID NO: 2544349 - protein, 19 aa, Entamoeba dispar
YRHYCENKMLLPSQLHTGL

SEQ ID NO: 2544350 - protein, 19 aa, Entamoeba dispar
YRIQCQCGCYINPWCSRDT

SEQ ID NO: 2544351 - protein, 26 aa, Entamoeba dispar
YRLADPKMVLLIFASGKIVFTGGKEI

SEQ ID NO: 2544352 - protein, 17 aa, Entamoeba dispar
YRMAILAMIFCPSHLDR

SEQ ID NO: 2544353 - protein, 21 aa, Entamoeba dispar
YRMGNLFIVGPTKTGKTEFAV

SEQ ID NO: 2544354 - protein, 28 aa, Entamoeba dispar
YRMNAALTVALPLIRKTVFPSLKNQTQK

SEQ ID NO: 2544355 - protein, 22 aa, Entamoeba dispar
YRNDLLPYFIQSTNKMIDVMNK

SEQ ID NO: 2544356 - protein, 25 aa, Entamoeba dispar
YRNKWCFINLFTNQISYVDPRPPQQ

SEQ ID NO: 2544357 - protein, 18 aa, Entamoeba dispar
YRNPFPDVMNFLDTFHGG

SEQ ID NO: 2544358 - protein, 20 aa, Entamoeba dispar
YRNVEYIPIIYVIGLKNEMT

SEQ ID NO: 2544359 - protein, 21 aa, Entamoeba dispar
YRNVPGACSLLINTMQHDLQN

SEQ ID NO: 2544360 - protein, 26 aa, Entamoeba dispar
YRNVSLPSLFVFSMKDQYIPLDNTQY

SEQ ID NO: 2544361 - protein, 19 aa, Entamoeba dispar
YRQRREEAIASLERKRRNT

SEQ ID NO: 2544362 - protein, 17 aa, Entamoeba dispar
YRRLREFFQDRTVIINY

SEQ ID NO: 2544363 - protein, 25 aa, Entamoeba dispar
YRSHSPFILSVFQSSITNTINSLNQ

SEQ ID NO: 2544364 - protein, 22 aa, Entamoeba dispar
YRSIRLIMAPLKKGKGLFDQVI

SEQ ID NO: 2544365 - protein, 17 aa, Entamoeba dispar
YRSTLKMIIYLESLIDI

SEQ ID NO: 2544366 - protein, 30 aa, Entamoeba dispar
YRTATRLMLLAEQFALPVITLVDTPGAYPS

SEQ ID NO: 2544367 - protein, 17 aa, Entamoeba dispar
YRTITLSDFTQLLEGIE

SEQ ID NO: 2544368 - protein, 32 aa, Entamoeba dispar
YRTLSILHQKYPHLPFFFHCRKSWSDLCQLNK

SEQ ID NO: 2544369 - protein, 19 aa, Entamoeba dispar
YRVEICKNLPPFMFEEDED

SEQ ID NO: 2544370 - protein, 20 aa, Entamoeba dispar
YRVFYRQVISGTIKGYFLSA

SEQ ID NO: 2544371 - protein, 20 aa, Entamoeba dispar
YRVLKIVGWGTFGIVVGVID

SEQ ID NO: 2544372 - protein, 23 aa, Entamoeba dispar
YRVRLCDFLQKIFIIDPTQRMTP

SEQ ID NO: 2544373 - protein, 26 aa, Entamoeba dispar
YRVSEQLHILMNLLRDVGFEIESKKT

SEQ ID NO: 2544374 - protein, 24 aa, Entamoeba dispar
YSCNEYFIKLLLTKHFNVNENQLV

SEQ ID NO: 2544375 - protein, 29 aa, Entamoeba dispar
YSCPITMLQIITWKEPFPKEIYNFPWDIA

SEQ ID NO: 2544376 - protein, 18 aa, Entamoeba dispar
YSCYFGNFLFNCVEPINP

SEQ ID NO: 2544377 - protein, 26 aa, Entamoeba dispar
YSDIKKAILLMLVGSTPKIRLRSRVR

SEQ ID NO: 2544378 - protein, 20 aa, Entamoeba dispar
YSDITLIYRGYKLSDDSLFS

SEQ ID NO: 2544379 - protein, 31 aa, Entamoeba dispar
YSDKENYFLFTCFCAFWVTSDGQLRIHQLLK

SEQ ID NO: 2544380 - protein, 22 aa, Entamoeba dispar
YSDMLQLAINIYFQPIQKSNIL

SEQ ID NO: 2544381 - protein, 25 aa, Entamoeba dispar
YSEELLHYLEGHIMFFHFSYEQSKF

SEQ ID NO: 2544382 - protein, 25 aa, Entamoeba dispar
YSEFEVFYLFQGILELIKEFYGEEG

SEQ ID NO: 2544383 - protein, 27 aa, Entamoeba dispar
YSEKSDLLIFMLQKLFALVHGEIDEEG

SEQ ID NO: 2544384 - protein, 18 aa, Entamoeba dispar
YSERLFKWFIKRNEIIKK

SEQ ID NO: 2544385 - protein, 17 aa, Entamoeba dispar
YSFFERAVLTHKSYLYL

SEQ ID NO: 2544386 - protein, 30 aa, Entamoeba dispar
YSFIPPRSYNILFQPPLRIVKKQKIISTWS

SEQ ID NO: 2544387 - protein, 17 aa, Entamoeba dispar
YSFLRNEPKTPRLTPRK

SEQ ID NO: 2544388 - protein, 18 aa, Entamoeba dispar
YSFLTNQLLNSLALHIFM

SEQ ID NO: 2544389 - protein, 22 aa, Entamoeba dispar
YSFTSFLIERMIGLGLLSDNIV

SEQ ID NO: 2544390 - protein, 31 aa, Entamoeba dispar
YSGGWRMRISLATALFLQPDLLILDEPTNHL

SEQ ID NO: 2544391 - protein, 24 aa, Entamoeba dispar
YSGYNKIYILADKELKVFDSSFLL

SEQ ID NO: 2544392 - protein, 29 aa, Entamoeba dispar
YSHARVISVPTILVLNPGSWKSLQNTAKE

SEQ ID NO: 2544393 - protein, 32 aa, Entamoeba dispar
YSHARVTSIPTILVLNPGSWKALQKTAKEYED

SEQ ID NO: 2544394 - protein, 30 aa, Entamoeba dispar
YSHARVTSIPTILVLNPGSWKAPQQTAKEY

SEQ ID NO: 2544395 - protein, 18 aa, Entamoeba dispar
YSHVVPRLYLMCTIGSIC

SEQ ID NO: 2544396 - protein, 20 aa, Entamoeba dispar
YSHYIICYIIKNYQKESKVY

SEQ ID NO: 2544397 - protein, 26 aa, Entamoeba dispar
YSIAGWFKGILYITNYRILLDCDDTS

SEQ ID NO: 2544398 - protein, 20 aa, Entamoeba dispar
YSIAYGARPMRRYIEKTVVT

SEQ ID NO: 2544399 - protein, 30 aa, Entamoeba dispar
YSIENLKSLLFPFEWCNICIDSLPYSLIDY

SEQ ID NO: 2544400 - protein, 29 aa, Entamoeba dispar
YSIFDRRVNRLPRKYLELALIELSSHSSL

SEQ ID NO: 2544401 - protein, 24 aa, Entamoeba dispar
YSIHFRFLMYYSEENCILLRNNHM

SEQ ID NO: 2544402 - protein, 26 aa, Entamoeba dispar
YSIKIIEPIIAYMLFKNIIIREKRIH

SEQ ID NO: 2544403 - protein, 23 aa, Entamoeba dispar
YSIPSDLPYYPFGKDLKALPISV

SEQ ID NO: 2544404 - protein, 24 aa, Entamoeba dispar
YSIRSVYNFAPFIKHYFIVTMGQT

SEQ ID NO: 2544405 - protein, 23 aa, Entamoeba dispar
YSIRSVYNFAPYIKNYYIVTMGQ

SEQ ID NO: 2544406 - protein, 26 aa, Entamoeba dispar
YSISRRFIIMFTELIRLINRIIPSNC

SEQ ID NO: 2544407 - protein, 28 aa, Entamoeba dispar
YSITQFDKIFYYKLYYSLSKCLTSSNVI

SEQ ID NO: 2544408 - protein, 24 aa, Entamoeba dispar
YSITYYVQAFMNYISSILSRSIMN

SEQ ID NO: 2544409 - protein, 19 aa, Entamoeba dispar
YSKAIIYMHEYFKQFFTEY

SEQ ID NO: 2544410 - protein, 18 aa, Entamoeba dispar
YSKEPTFVGFPKNTIHWP

SEQ ID NO: 2544411 - protein, 28 aa, Entamoeba dispar
YSLDSLCQILLYFNLIYANSSKRNQNNF

SEQ ID NO: 2544412 - protein, 18 aa, Entamoeba dispar
YSLFLQEKLFLHECTVKS

SEQ ID NO: 2544413 - protein, 17 aa, Entamoeba dispar
YSLIDYVSSPMTYLMGV

SEQ ID NO: 2544414 - protein, 24 aa, Entamoeba dispar
YSLPIILNGFLKKLNQWNSESSLC

SEQ ID NO: 2544415 - protein, 23 aa, Entamoeba dispar
YSLRRLMKYPPVEDIKLLIELAV

SEQ ID NO: 2544416 - protein, 18 aa, Entamoeba dispar
YSLSIRKYVQIDNQILEI

SEQ ID NO: 2544417 - protein, 21 aa, Entamoeba dispar
YSLSYCIYAMLILPKLRDPDS

SEQ ID NO: 2544418 - protein, 21 aa, Entamoeba dispar
YSLTSIIIPSSVIKLGYRCFF

SEQ ID NO: 2544419 - protein, 19 aa, Entamoeba dispar
YSNGIPPVVTLLTTSAKYS

SEQ ID NO: 2544420 - protein, 24 aa, Entamoeba dispar
YSNHLIPIYPLINNTIWYIDIFIN

SEQ ID NO: 2544421 - protein, 40 aa, Entamoeba dispar
YSNKRYIHKPIIPYINNYYNKPFTHKIYKKVIKSIQKPIK

SEQ ID NO: 2544422 - protein, 25 aa, Entamoeba dispar
YSNKSACLVMIKKFQEALTSIQKCL

SEQ ID NO: 2544423 - protein, 24 aa, Entamoeba dispar
YSNLIPREWLTKFDIVFQCGIPEE

SEQ ID NO: 2544424 - protein, 20 aa, Entamoeba dispar
YSNSSWIYVRGVCSGFVIVR

SEQ ID NO: 2544425 - protein, 26 aa, Entamoeba dispar
YSNTENFPMFFTSSLTRLTNFHCTMN

SEQ ID NO: 2544426 - protein, 18 aa, Entamoeba dispar
YSPELIVHPFFKEDYDTN

SEQ ID NO: 2544427 - protein, 21 aa, Entamoeba dispar
YSPEYLANITTSPLLIHLINL

SEQ ID NO: 2544428 - protein, 27 aa, Entamoeba dispar
YSPFRLKDTLRFILMNKIKDWKCELES

SEQ ID NO: 2544429 - protein, 25 aa, Entamoeba dispar
YSPFTDMILLLCKKLIEEYPVFINM

SEQ ID NO: 2544430 - protein, 25 aa, Entamoeba dispar
YSPNNQLYFAYRFLALGTIEEKKIG

SEQ ID NO: 2544431 - protein, 22 aa, Entamoeba dispar
YSPSFQIHILEKLNLYRNPREK

SEQ ID NO: 2544432 - protein, 20 aa, Entamoeba dispar
YSPYIDLWFLRDGIVQAHTV

SEQ ID NO: 2544433 - protein, 21 aa, Entamoeba dispar
YSPYIQLIEKCKEKMKIGQEA

SEQ ID NO: 2544434 - protein, 18 aa, Entamoeba dispar
YSQILKYKQILSQDAFEF

SEQ ID NO: 2544435 - protein, 17 aa, Entamoeba dispar
YSQIYKWIPEHYSIDDS

SEQ ID NO: 2544436 - protein, 20 aa, Entamoeba dispar
YSQKFYFKDYNNLKMKIYDS

SEQ ID NO: 2544437 - protein, 19 aa, Entamoeba dispar
YSQLIISFILTIDEQNIKD

SEQ ID NO: 2544438 - protein, 17 aa, Entamoeba dispar
YSQLKSLSVTIPLLKQI

SEQ ID NO: 2544439 - protein, 29 aa, Entamoeba dispar
YSQMYDRYISKGVLFPLLDFDDPEDVAAI

SEQ ID NO: 2544440 - protein, 24 aa, Entamoeba dispar
YSQQSIFDIILEKGIKFPSITSRN

SEQ ID NO: 2544441 - protein, 25 aa, Entamoeba dispar
YSRNDFLLLNKIYSNHIPYFALSCC

SEQ ID NO: 2544442 - protein, 18 aa, Entamoeba dispar
YSRQQWVMGRVRIQLKDE

SEQ ID NO: 2544443 - protein, 23 aa, Entamoeba dispar
YSRRLYSLFRSWLEMHAEYFSRE

SEQ ID NO: 2544444 - protein, 22 aa, Entamoeba dispar
YSRTMKIIKHIGWWGNGKLDDG

SEQ ID NO: 2544445 - protein, 24 aa, Entamoeba dispar
YSSCFPNILFSLLSGLQCIVYSSE

SEQ ID NO: 2544446 - protein, 29 aa, Entamoeba dispar
YSSFKTQRLFFLFYLSCMTKIIRCKRRPN

SEQ ID NO: 2544447 - protein, 24 aa, Entamoeba dispar
YSSGDVGLLLRWSGGEIKDVIPKG

SEQ ID NO: 2544448 - protein, 25 aa, Entamoeba dispar
YSSGISLLLKYKPLKDITDYLIIVT

SEQ ID NO: 2544449 - protein, 22 aa, Entamoeba dispar
YSSKFIKILANKIFQDKRLCDL

SEQ ID NO: 2544450 - protein, 19 aa, Entamoeba dispar
YSSLYIRLLPVLKELLNTK

SEQ ID NO: 2544451 - protein, 18 aa, Entamoeba dispar
YSSMPIEKFISNSGLPEI

SEQ ID NO: 2544452 - protein, 17 aa, Entamoeba dispar
YSSMYSFSSVKPLFNQF

SEQ ID NO: 2544453 - protein, 24 aa, Entamoeba dispar
YSSSQFISWFYSSLIQKINTKRKV

SEQ ID NO: 2544454 - protein, 29 aa, Entamoeba dispar
YSTIPERYQLPPQPNFLSPLSLQTKLSQV

SEQ ID NO: 2544455 - protein, 28 aa, Entamoeba dispar
YSTNNEIFKFLFFVADIHNQGFITKTQF

SEQ ID NO: 2544456 - protein, 31 aa, Entamoeba dispar
YSTSNLYQLIPFIPVDYFSSSLRSLIDHYKE

SEQ ID NO: 2544457 - protein, 22 aa, Entamoeba dispar
YSTVQFGFIVVIFYDIRSSRSA

SEQ ID NO: 2544458 - protein, 23 aa, Entamoeba dispar
YSTYLQYLLLNTTNEVYLSIIFL

SEQ ID NO: 2544459 - protein, 40 aa, Entamoeba dispar
YSYGKPIIFSFIIRSTYSYTFELWFIFKNEDNSLRMSFVS

SEQ ID NO: 2544460 - protein, 24 aa, Entamoeba dispar
YSYSITILQIITWEDPFPKTSYPH

SEQ ID NO: 2544461 - protein, 41 aa, Entamoeba dispar
YSYSITMLQIITWKEPFPKTLYPHPWLIADAITTGKRPTII

SEQ ID NO: 2544462 - protein, 25 aa, Entamoeba dispar
YTANNIIQLVTYNGTIYYISQTSDS

SEQ ID NO: 2544463 - protein, 19 aa, Entamoeba dispar
YTCDMHVLVILTDMSSYAD

SEQ ID NO: 2544464 - protein, 20 aa, Entamoeba dispar
YTCDMHVLVILTDMSSYADA

SEQ ID NO: 2544465 - protein, 27 aa, Entamoeba dispar
YTCSQGLMLMIPNMIKIAGEHLPCVFH

SEQ ID NO: 2544466 - protein, 26 aa, Entamoeba dispar
YTCSSLALFLLKRALKNRGDMGQLFY

SEQ ID NO: 2544467 - protein, 30 aa, Entamoeba dispar
YTDIKRMDEAIWSEIYLHELDKCGFIGLYY

SEQ ID NO: 2544468 - protein, 17 aa, Entamoeba dispar
YTDKLFSVDRLKNPPAP

SEQ ID NO: 2544469 - protein, 24 aa, Entamoeba dispar
YTDRLVTFLSYMGKNQPFSQFFHV

SEQ ID NO: 2544470 - protein, 27 aa, Entamoeba dispar
YTEQYLFDENIFYSFLLELYQHIEICT

SEQ ID NO: 2544471 - protein, 23 aa, Entamoeba dispar
YTFAQLLEKLLVIDPTKRFNSIQ

SEQ ID NO: 2544472 - protein, 17 aa, Entamoeba dispar
YTFLPIITKNEIKEMEQ

SEQ ID NO: 2544473 - protein, 17 aa, Entamoeba dispar
YTFYKYCELLISSFIER

SEQ ID NO: 2544474 - protein, 27 aa, Entamoeba dispar
YTGFMHPYSYGLFYPKQFENAKLIEEE

SEQ ID NO: 2544475 - protein, 18 aa, Entamoeba dispar
YTHFAMINPFITIDHTTN

SEQ ID NO: 2544476 - protein, 18 aa, Entamoeba dispar
YTHKESIYPQYFFTTFGI

SEQ ID NO: 2544477 - protein, 28 aa, Entamoeba dispar
YTHLPQNTLAIIWSLSVPPKKPMELSQF

SEQ ID NO: 2544478 - protein, 18 aa, Entamoeba dispar
YTIFIGNLSKKQANQKII

SEQ ID NO: 2544479 - protein, 19 aa, Entamoeba dispar
YTIHCLLNNRDIKGSPWVQ

SEQ ID NO: 2544480 - protein, 17 aa, Entamoeba dispar
YTILEECNCSVNSALKE

SEQ ID NO: 2544481 - protein, 18 aa, Entamoeba dispar
YTIPPKIKNIPQPVPVVN

SEQ ID NO: 2544482 - protein, 21 aa, Entamoeba dispar
YTITERRFILKLASEPNEIEL

SEQ ID NO: 2544483 - protein, 24 aa, Entamoeba dispar
YTKDRIFFKIAKDWDLLYVVGEGK

SEQ ID NO: 2544484 - protein, 27 aa, Entamoeba dispar
YTKKTKLNTIIWPSPKLSSGVVEPYNA

SEQ ID NO: 2544485 - protein, 27 aa, Entamoeba dispar
YTKKTKLNTVIWPSPKLSSGVVEPYNA

SEQ ID NO: 2544486 - protein, 25 aa, Entamoeba dispar
YTKMEEVPILPIRKSLILAQENNEN

SEQ ID NO: 2544487 - protein, 17 aa, Entamoeba dispar
YTKNSLFILGRDSRMSG

SEQ ID NO: 2544488 - protein, 18 aa, Entamoeba dispar
YTLAVGRNPFEFNGHFEQ

SEQ ID NO: 2544489 - protein, 18 aa, Entamoeba dispar
YTLIMKAGAIVTFRKSKR

SEQ ID NO: 2544490 - protein, 17 aa, Entamoeba dispar
YTLRILPHQQNTGGFFT

SEQ ID NO: 2544491 - protein, 20 aa, Entamoeba dispar
YTMLSLFSIGSRRGKSATLV

SEQ ID NO: 2544492 - protein, 28 aa, Entamoeba dispar
YTNENVTIPFYPWYIIAVETTNKTNEGE

SEQ ID NO: 2544493 - protein, 26 aa, Entamoeba dispar
YTNIGPVLIVINPFKDLGLTTDEYVH

SEQ ID NO: 2544494 - protein, 27 aa, Entamoeba dispar
YTNKHSFLLNFLGGLLNIKGIKFVNAV

SEQ ID NO: 2544495 - protein, 20 aa, Entamoeba dispar
YTNMFQSKLFVKTLSAVTNT

SEQ ID NO: 2544496 - protein, 24 aa, Entamoeba dispar
YTNNIMFLTPSRKLDHLKFCRNND

SEQ ID NO: 2544497 - protein, 18 aa, Entamoeba dispar
YTPLHRRKRKFQNITYEK

SEQ ID NO: 2544498 - protein, 17 aa, Entamoeba dispar
YTPVHWAIINNIPLKEE

SEQ ID NO: 2544499 - protein, 25 aa, Entamoeba dispar
YTQECLAWKYIYATGAFELRRKQNK

SEQ ID NO: 2544500 - protein, 17 aa, Entamoeba dispar
YTQLSDSMLLFSEYCPY

SEQ ID NO: 2544501 - protein, 24 aa, Entamoeba dispar
YTQNAKLFMRIGNAYFKQDKYTEA

SEQ ID NO: 2544502 - protein, 30 aa, Entamoeba dispar
YTRKDAMAVFHFLFRYDTGSHLPFIVSWGK

SEQ ID NO: 2544503 - protein, 20 aa, Entamoeba dispar
YTRWQLKNGVLYAYLQEEKN

SEQ ID NO: 2544504 - protein, 24 aa, Entamoeba dispar
YTSEFTYVVPYEDYFLVSTSKGEI

SEQ ID NO: 2544505 - protein, 18 aa, Entamoeba dispar
YTVPPTYIAHQLFQYWVN

SEQ ID NO: 2544506 - protein, 31 aa, Entamoeba dispar
YVALREQYYLKGDGFVLVYSIENKSSFMAIG

SEQ ID NO: 2544507 - protein, 21 aa, Entamoeba dispar
YVARLLYLILDKENKNDFLPE

SEQ ID NO: 2544508 - protein, 18 aa, Entamoeba dispar
YVCYVNPTLPTYRFEAIV

SEQ ID NO: 2544509 - protein, 18 aa, Entamoeba dispar
YVCYVRRGEKWYFCNDES

SEQ ID NO: 2544510 - protein, 17 aa, Entamoeba dispar
YVDFYKQLQTILLSTRE

SEQ ID NO: 2544511 - protein, 23 aa, Entamoeba dispar
YVDYNFEFKYKKSIPFRPFEQLM

SEQ ID NO: 2544512 - protein, 23 aa, Entamoeba dispar
YVEDILPPFFKALVKYVHKGKYS

SEQ ID NO: 2544513 - protein, 24 aa, Entamoeba dispar
YVELQFDSLLRYLKSNRLTHYITF

SEQ ID NO: 2544514 - protein, 18 aa, Entamoeba dispar
YVERLNWMYEAPTGFEEQ

SEQ ID NO: 2544515 - protein, 18 aa, Entamoeba dispar
YVETSDVLIRIIDTLSSY

SEQ ID NO: 2544516 - protein, 19 aa, Entamoeba dispar
YVEYYLFCCEKHLSGTRIV

SEQ ID NO: 2544517 - protein, 17 aa, Entamoeba dispar
YVFFDQRIFLKGTVNDE

SEQ ID NO: 2544518 - protein, 17 aa, Entamoeba dispar
YVFQMLEFLFITLQANP

SEQ ID NO: 2544519 - protein, 17 aa, Entamoeba dispar
YVGDFACRYPNLLEGWI

SEQ ID NO: 2544520 - protein, 25 aa, Entamoeba dispar
YVGFDKFMKGISLYLKKYMYGNAVS

SEQ ID NO: 2544521 - protein, 17 aa, Entamoeba dispar
YVGKILKEQKREFQIKS

SEQ ID NO: 2544522 - protein, 17 aa, Entamoeba dispar
YVIFAIKIKENRLFQVI

SEQ ID NO: 2544523 - protein, 19 aa, Entamoeba dispar
YVIGCDCCFYIRSNCPCHV

SEQ ID NO: 2544524 - protein, 17 aa, Entamoeba dispar
YVIIRNIHDHNIKIRSN

SEQ ID NO: 2544525 - protein, 17 aa, Entamoeba dispar
YVIIRNIHDRKIKIRSD

SEQ ID NO: 2544526 - protein, 17 aa, Entamoeba dispar
YVIIRNIHDRNIKIRSN

SEQ ID NO: 2544527 - protein, 27 aa, Entamoeba dispar
YVIKQGNESEWFFSTRKGKFEVSEELG

SEQ ID NO: 2544528 - protein, 25 aa, Entamoeba dispar
YVIPSPYRRTTWQGLPLAQLPKRIE

SEQ ID NO: 2544529 - protein, 17 aa, Entamoeba dispar
YVIQHLLEFGNDIIREA

SEQ ID NO: 2544530 - protein, 30 aa, Entamoeba dispar
YVKEQRSRVVLTFLCLKELKTKDFFELDEE

SEQ ID NO: 2544531 - protein, 19 aa, Entamoeba dispar
YVKIILNPFYELQTPIESE

SEQ ID NO: 2544532 - protein, 20 aa, Entamoeba dispar
YVKKFGLPMILVGGGGYTVS

SEQ ID NO: 2544533 - protein, 22 aa, Entamoeba dispar
YVKKFGLPMILVGGGGYTVSNT

SEQ ID NO: 2544534 - protein, 17 aa, Entamoeba dispar
YVKLGDGFIIVYSIIEQ

SEQ ID NO: 2544535 - protein, 19 aa, Entamoeba dispar
YVKLNYGLMEGVALWALRK

SEQ ID NO: 2544536 - protein, 22 aa, Entamoeba dispar
YVKLYSFNLSQIIQAALMNVSI

SEQ ID NO: 2544537 - protein, 19 aa, Entamoeba dispar
YVKRISLQSEWFSQGLYSI

SEQ ID NO: 2544538 - protein, 20 aa, Entamoeba dispar
YVLAHYIYQQKDIVFLLICD

SEQ ID NO: 2544539 - protein, 23 aa, Entamoeba dispar
YVLKCCGGFFASPYNTLEYWMIC

SEQ ID NO: 2544540 - protein, 22 aa, Entamoeba dispar
YVLPSLLNLLTNYINHFNKLFP

SEQ ID NO: 2544541 - protein, 25 aa, Entamoeba dispar
YVMGKRELFLILRALSQEIPEVGYT

SEQ ID NO: 2544542 - protein, 18 aa, Entamoeba dispar
YVMNILHTNPFHFKPLKV

SEQ ID NO: 2544543 - protein, 17 aa, Entamoeba dispar
YVMYYYRNKWCFINLFT

SEQ ID NO: 2544544 - protein, 26 aa, Entamoeba dispar
YVNKLQQFLDFYLKVALTVYPTDKIL

SEQ ID NO: 2544545 - protein, 18 aa, Entamoeba dispar
YVNTIRRKVFKKNYLTMV

SEQ ID NO: 2544546 - protein, 17 aa, Entamoeba dispar
YVPKFFEKVNDTTYKYL

SEQ ID NO: 2544547 - protein, 19 aa, Entamoeba dispar
YVPNFANHQERQQRQPRAE

SEQ ID NO: 2544548 - protein, 28 aa, Entamoeba dispar
YVPVPGIDTVFITLLNQGIKGNPYQCKV

SEQ ID NO: 2544549 - protein, 19 aa, Entamoeba dispar
YVPVTPFFIKQYELNLIGK

SEQ ID NO: 2544550 - protein, 19 aa, Entamoeba dispar
YVRKTAVLCVLKLYCMEPN

SEQ ID NO: 2544551 - protein, 23 aa, Entamoeba dispar
YVRLDLKSFTFINKKSLMQFLRK

SEQ ID NO: 2544552 - protein, 20 aa, Entamoeba dispar
YVRLHESVLSGLKYFEKNPI

SEQ ID NO: 2544553 - protein, 21 aa, Entamoeba dispar
YVRLHESVLSGLKYFEKNPIP

SEQ ID NO: 2544554 - protein, 30 aa, Entamoeba dispar
YVSDQRSLYLYRDNIRPISPDPYFPYSSFE

SEQ ID NO: 2544555 - protein, 18 aa, Entamoeba dispar
YVSMIIRKDFEMSQELIK

SEQ ID NO: 2544556 - protein, 25 aa, Entamoeba dispar
YVSQRSFYVNRIGILYGIFKEDRVQ

SEQ ID NO: 2544557 - protein, 17 aa, Entamoeba dispar
YVSSFYSMFYPSPSIHL

SEQ ID NO: 2544558 - protein, 28 aa, Entamoeba dispar
YVSYALSDVSFIFPITPSSPMAENADVW

SEQ ID NO: 2544559 - protein, 24 aa, Entamoeba dispar
YVSYQYPPQYYPLSVQIQPPNNHS

SEQ ID NO: 2544560 - protein, 18 aa, Entamoeba dispar
YVTIKQSLKLRTVKYAMK

SEQ ID NO: 2544561 - protein, 25 aa, Entamoeba dispar
YVTKERDIYRLISEQLRQIIQKKTE

SEQ ID NO: 2544562 - protein, 18 aa, Entamoeba dispar
YVTVPDQVLFVVFDDGKE

SEQ ID NO: 2544563 - protein, 30 aa, Entamoeba dispar
YVTYNDIIQYQWSLLTKIKVELLNLSSIEI

SEQ ID NO: 2544564 - protein, 26 aa, Entamoeba dispar
YVVDRAIEIYPSFRIPAELAKPSGKR

SEQ ID NO: 2544565 - protein, 17 aa, Entamoeba dispar
YVVFKRCFSLQNIIIEN

SEQ ID NO: 2544566 - protein, 18 aa, Entamoeba dispar
YVVYYNGSQVKVICIGYC

SEQ ID NO: 2544567 - protein, 18 aa, Entamoeba dispar
YVWMGDESIPLQQKYAIK

SEQ ID NO: 2544568 - protein, 26 aa, Entamoeba dispar
YVYKKLFIRIKPVELLYYLDKTKKDQ

SEQ ID NO: 2544569 - protein, 25 aa, Entamoeba dispar
YVYSYITSILHKPTSRLILCGKGVG

SEQ ID NO: 2544570 - protein, 17 aa, Entamoeba dispar
YWGMEYWMKQSIFDNEN

SEQ ID NO: 2544571 - protein, 26 aa, Entamoeba dispar
YYAGLCQFIPEASFDAAKALFKITDT

SEQ ID NO: 2544572 - protein, 20 aa, Entamoeba dispar
YYALSCGKYVQYYGPLPSAP

SEQ ID NO: 2544573 - protein, 18 aa, Entamoeba dispar
YYCFYYNVYERGNIDDIL

SEQ ID NO: 2544574 - protein, 18 aa, Entamoeba dispar
YYCLCFMDYAVKRNSNFR

SEQ ID NO: 2544575 - protein, 17 aa, Entamoeba dispar
YYCLRDVLVLREGFLKY

SEQ ID NO: 2544576 - protein, 17 aa, Entamoeba dispar
YYCLRDVMVLREGFLKY

SEQ ID NO: 2544577 - protein, 21 aa, Entamoeba dispar
YYDEVFPAIKYSSAPPTPDFL

SEQ ID NO: 2544578 - protein, 19 aa, Entamoeba dispar
YYDGFFGHRINPVVNMAIT

SEQ ID NO: 2544579 - protein, 26 aa, Entamoeba dispar
YYDKFNFEIVYHVAPLLPYYNGEEQL

SEQ ID NO: 2544580 - protein, 17 aa, Entamoeba dispar
YYDLISVNDFDLFLNLH

SEQ ID NO: 2544581 - protein, 19 aa, Entamoeba dispar
YYDLVELPELFKSNFIEIC

SEQ ID NO: 2544582 - protein, 18 aa, Entamoeba dispar
YYDLYRLYEYKELKRIKV

SEQ ID NO: 2544583 - protein, 26 aa, Entamoeba dispar
YYDNKINFWRNVYGFNMTPMRAEVLK

SEQ ID NO: 2544584 - protein, 19 aa, Entamoeba dispar
YYDTLFTDPKPESPDWEKL

SEQ ID NO: 2544585 - protein, 18 aa, Entamoeba dispar
YYEEKLIQFILESTSGKK

SEQ ID NO: 2544586 - protein, 17 aa, Entamoeba dispar
YYEGCNVVIVVFDISDR

SEQ ID NO: 2544587 - protein, 17 aa, Entamoeba dispar
YYELFPDFSDRKSLRLS

SEQ ID NO: 2544588 - protein, 27 aa, Entamoeba dispar
YYENCMVNAYYRMDWLLCNYHIKDNSG

SEQ ID NO: 2544589 - protein, 37 aa, Entamoeba dispar
YYEQRFDVIDPCILLYMKLVIGLTGEKIGLFKKLLYD

SEQ ID NO: 2544590 - protein, 17 aa, Entamoeba dispar
YYEVLSDLLYLILNCKS

SEQ ID NO: 2544591 - protein, 17 aa, Entamoeba dispar
YYEVVFNLVIFSPFQGE

SEQ ID NO: 2544592 - protein, 20 aa, Entamoeba dispar
YYGCNNSFFMKSELIAHVKE

SEQ ID NO: 2544593 - protein, 26 aa, Entamoeba dispar
YYGETYIILNVYYKQYLIPLMDILRQ

SEQ ID NO: 2544594 - protein, 18 aa, Entamoeba dispar
YYGIIDHLCILLKKEKFT

SEQ ID NO: 2544595 - protein, 25 aa, Entamoeba dispar
YYGKQCYLLNMLLETKEWTLLLDSS

SEQ ID NO: 2544596 - protein, 18 aa, Entamoeba dispar
YYGNIYHILVDRFSSENQ

SEQ ID NO: 2544597 - protein, 28 aa, Entamoeba dispar
YYGTIKIDENTLWILMDMCGVGSVKDLM

SEQ ID NO: 2544598 - protein, 17 aa, Entamoeba dispar
YYITLSKLFLYCNNTTL

SEQ ID NO: 2544599 - protein, 20 aa, Entamoeba dispar
YYITPKIMLQQVAPLDLCRY

SEQ ID NO: 2544600 - protein, 27 aa, Entamoeba dispar
YYKHQRKIVSLLWNKIPPLKNNKDKLI

SEQ ID NO: 2544601 - protein, 19 aa, Entamoeba dispar
YYKIKLYYDATKDKAMVLL

SEQ ID NO: 2544602 - protein, 17 aa, Entamoeba dispar
YYLDSLTILFDSGSNVA

SEQ ID NO: 2544603 - protein, 26 aa, Entamoeba dispar
YYLQKSCDFFISTYWPSYILNELDSN

SEQ ID NO: 2544604 - protein, 24 aa, Entamoeba dispar
YYNASFLSFFKRPMKIQSISVVIP

SEQ ID NO: 2544605 - protein, 19 aa, Entamoeba dispar
YYNERSAFKWVNPASRSIQ

SEQ ID NO: 2544606 - protein, 24 aa, Entamoeba dispar
YYNNQINKYYISMLPHVICEDYET

SEQ ID NO: 2544607 - protein, 19 aa, Entamoeba dispar
YYPEYLGIFTFVNNGLRVA

SEQ ID NO: 2544608 - protein, 18 aa, Entamoeba dispar
YYPGARWGITRRLIASSL

SEQ ID NO: 2544609 - protein, 17 aa, Entamoeba dispar
YYPLLNSFQTEIAIRKI

SEQ ID NO: 2544610 - protein, 21 aa, Entamoeba dispar
YYQEGILYVKLLKVSNSSWVN

SEQ ID NO: 2544611 - protein, 24 aa, Entamoeba dispar
YYQGGKWSFLFECPRDYPNNPPKV

SEQ ID NO: 2544612 - protein, 22 aa, Entamoeba dispar
YYQIHNLYHKWSVDGISFCLLK

SEQ ID NO: 2544613 - protein, 24 aa, Entamoeba dispar
YYQPIQTHPLFKLLAQTLHIVSVS

SEQ ID NO: 2544614 - protein, 18 aa, Entamoeba dispar
YYQSPIINITYKSSSIKN

SEQ ID NO: 2544615 - protein, 26 aa, Entamoeba dispar
YYRKSNAVIMVYDISRKETFEQLEYW

SEQ ID NO: 2544616 - protein, 21 aa, Entamoeba dispar
YYRPPEVMIGYPFDGSFDNWS

SEQ ID NO: 2544617 - protein, 19 aa, Entamoeba dispar
YYRQTIIYSRYQTPLLNSV

SEQ ID NO: 2544618 - protein, 34 aa, Entamoeba dispar
YYRTMSNWCNFVTPRVLYFNNSFERFDLKEFNQS

SEQ ID NO: 2544619 - protein, 30 aa, Entamoeba dispar
YYTETFHFPFYFEYLSKWPEMCFIAKDCNG

SEQ ID NO: 2544620 - protein, 34 aa, Entamoeba dispar
YYTMNKMLLTFYRYPQAWIICAQYFQRRGNIELA

SEQ ID NO: 2544621 - protein, 24 aa, Entamoeba dispar
YYTPEYIVDFFLKGIESIQYYERC

SEQ ID NO: 2544622 - protein, 21 aa, Entamoeba dispar
YYVHDTSLQALILPPINDSMN

SEQ ID NO: 2544623 - protein, 19 aa, Entamoeba dispar
YYVQAHCAIIMFDVTSRDT

SEQ ID NO: 2544624 - protein, 20 aa, Entamoeba dispar
YYVQTFMNYISSILSRSIMN

SEQ ID NO: 2544625 - protein, 30 aa, Entamoeba dispar
YYVRQAFHHFILYKFLFTRRSHLNWARFDK

SEQ ID NO: 2544626 - protein, 18 aa, Entamoeba dispar
YYYLFNKESFFNAKALNC

SEQ ID NO: 2544627 - protein, 18 aa, Entamoeba dispar
YYYNNPKSLIRILKYITF

SEQ ID NO: 2544628 - protein, 19 aa, Entamoeba dispar
YYYPVNSISFYNETIFLTA

SEQ ID NO: 2544629 - protein, 25 aa, Entamoeba dispar
VKESKIPIILFIDEIHTVLGAGATG

SEQ ID NO: 2544630 - protein, 24 aa, Entamoeba dispar
YKGKYVVLLFYPLDWTFVCPTEMI

SEQ ID NO: 2544631 - protein, 26 aa, Entamoeba dispar
EYKGKYVVLLFYPLDWTFVCPTEMIG

SEQ ID NO: 2544632 - protein, 20 aa, Entamoeba dispar
STLYAAWNPDFLLSVLLGNQ

SEQ ID NO: 2544633 - protein, 27 aa, Entamoeba dispar
TATCQTLVFNLTWSWVVSLRGLRKSTL

SEQ ID NO: 2544634 - protein, 25 aa, Entamoeba dispar
TLSSSWPFLIMWKGSDNEAYIQLQR

SEQ ID NO: 2544635 - protein, 23 aa, Entamoeba dispar
YRYAKLLNIQLPRELLTGSNDDY

SEQ ID NO: 2544636 - protein, 20 aa, Entamoeba dispar
GCYYLITKGWSFLFSKEKRI

SEQ ID NO: 2544637 - protein, 26 aa, Entamoeba dispar
IITHLSYFRIPLPDILHWMNIDISSS

SEQ ID NO: 2544638 - protein, 24 aa, Entamoeba dispar
KDCLMIFHGLKLTTDKLRSIVKKW

SEQ ID NO: 2544639 - protein, 24 aa, Entamoeba dispar
KFYDDPFVMLNYNDLPLLQNGLIP

SEQ ID NO: 2544640 - protein, 18 aa, Entamoeba dispar
RVTSIPTILVLNPGSWKA

SEQ ID NO: 2544641 - protein, 24 aa, Entamoeba dispar
VEPLEMVVYLPYLCKKLQVPYCIV

SEQ ID NO: 2544642 - protein, 24 aa, Entamoeba dispar
VKESKIPIILFIDEIHTVLGAGAT

SEQ ID NO: 2544643 - protein, 26 aa, Entamoeba dispar
ATCQTLVFNLTWSWVVSLRGLRKSTL

SEQ ID NO: 2544644 - protein, 25 aa, Entamoeba dispar
EYKGKYVVLLFYPLDWTFVCPTEMI

SEQ ID NO: 2544645 - protein, 17 aa, Entamoeba dispar
FLKKFYYTMKEPSYIDW

SEQ ID NO: 2544646 - protein, 17 aa, Entamoeba dispar
HMKIPLNDLLKDLLEEQ

SEQ ID NO: 2544647 - protein, 28 aa, Entamoeba dispar
IEIDPAPFRLWFLKFYGKDIASTEYYKS

SEQ ID NO: 2544648 - protein, 17 aa, Entamoeba dispar
IIQLLDGIKFQNEKIFE

SEQ ID NO: 2544649 - protein, 24 aa, Entamoeba dispar
KECLPLILILRNRLNYALNGREVT

SEQ ID NO: 2544650 - protein, 18 aa, Entamoeba dispar
LRIKVFEPLFIVGKENYA

SEQ ID NO: 2544651 - protein, 17 aa, Entamoeba dispar
LSMDNMYSAWNPQLLIS

SEQ ID NO: 2544652 - protein, 19 aa, Entamoeba dispar
NITPQKNIIIFPYRLNYND

SEQ ID NO: 2544653 - protein, 23 aa, Entamoeba dispar
QNGRFIPCILYGAKAQLPGMTGD

SEQ ID NO: 2544654 - protein, 26 aa, Entamoeba dispar
SDESYRFYQLLLFNFSQFIADEDFNR

SEQ ID NO: 2544655 - protein, 18 aa, Entamoeba dispar
VVLLFYPLDWTFVCPTEM

SEQ ID NO: 2544656 - protein, 20 aa, Entamoeba dispar
AIYSFWLYDFCDVYLEASKV

SEQ ID NO: 2544657 - protein, 23 aa, Entamoeba dispar
ALETWPVDLFGQLLPRHLQLAYQ

SEQ ID NO: 2544658 - protein, 17 aa, Entamoeba dispar
ARNNLFFIIHKSILYHP

SEQ ID NO: 2544659 - protein, 17 aa, Entamoeba dispar
AVGKTCLLLAFSKGEIP

SEQ ID NO: 2544660 - protein, 18 aa, Entamoeba dispar
CQVIEPMKIFIEQWNVYY

SEQ ID NO: 2544661 - protein, 22 aa, Entamoeba dispar
CTVSLFTHWLPRFGIEVDLVDT

SEQ ID NO: 2544662 - protein, 18 aa, Entamoeba dispar
CYYLITKGWSFLFSKEKR

SEQ ID NO: 2544663 - protein, 22 aa, Entamoeba dispar
DEQHYRFILLDDINYDKNTVRL

SEQ ID NO: 2544664 - protein, 19 aa, Entamoeba dispar
DGRIFKKVIWYLVSYSKYL

SEQ ID NO: 2544665 - protein, 26 aa, Entamoeba dispar
DLGNYHLKFLIQPFLHWPDTMMTVIE

SEQ ID NO: 2544666 - protein, 24 aa, Entamoeba dispar
EADKLLVYLIFYIQSLLLQFNGHT

SEQ ID NO: 2544667 - protein, 23 aa, Entamoeba dispar
ECPKIAFLRMLKAAFYGAPADHL

SEQ ID NO: 2544668 - protein, 24 aa, Entamoeba dispar
EDQIYRTIFIQNLSFRTTEEELKE

SEQ ID NO: 2544669 - protein, 25 aa, Entamoeba dispar
EELIGIRRWLLVDSLLRAKSRIQEE

SEQ ID NO: 2544670 - protein, 19 aa, Entamoeba dispar
EFIPYIPTLSKFLSYQKCH

SEQ ID NO: 2544671 - protein, 23 aa, Entamoeba dispar
EIHFPYQFIYPEQYQFIKTVTSG

SEQ ID NO: 2544672 - protein, 18 aa, Entamoeba dispar
ELLLQYYLHTILPIKKLD

SEQ ID NO: 2544673 - protein, 17 aa, Entamoeba dispar
EVFVPRKAPTEFREHEQ

SEQ ID NO: 2544674 - protein, 17 aa, Entamoeba dispar
EVQFYRYGVRPYVPYDR

SEQ ID NO: 2544675 - protein, 19 aa, Entamoeba dispar
FIHELVKITFYDYPLQHCR

SEQ ID NO: 2544676 - protein, 19 aa, Entamoeba dispar
FKGFDWEGLFQKKLSPPFV

SEQ ID NO: 2544677 - protein, 17 aa, Entamoeba dispar
FNQFPQQQNQFSQFSKL

SEQ ID NO: 2544678 - protein, 18 aa, Entamoeba dispar
FRILKPNGLMIIAEPISR

SEQ ID NO: 2544679 - protein, 18 aa, Entamoeba dispar
FSLGHFFIAINVEAFRDL

SEQ ID NO: 2544680 - protein, 27 aa, Entamoeba dispar
FSTLMFLRYLFVPFLKHPYILKSLQKC

SEQ ID NO: 2544681 - protein, 17 aa, Entamoeba dispar
FVPFLSKADLLGGYGFN

SEQ ID NO: 2544682 - protein, 23 aa, Entamoeba dispar
FVPPAQIMFKWFNTIYKVGGDGC

SEQ ID NO: 2544683 - protein, 25 aa, Entamoeba dispar
GERTINLFLIRWKNNFHYVIDEKVP

SEQ ID NO: 2544684 - protein, 18 aa, Entamoeba dispar
GFIREGWGCLLMNSRIWE

SEQ ID NO: 2544685 - protein, 18 aa, Entamoeba dispar
GHHFNPCLFERGADGWKF

SEQ ID NO: 2544686 - protein, 18 aa, Entamoeba dispar
GIPCFWLHVLKNSGIFDG

SEQ ID NO: 2544687 - protein, 20 aa, Entamoeba dispar
GKTCLLLAFSKGEIPTAYVP

SEQ ID NO: 2544688 - protein, 20 aa, Entamoeba dispar
GMCQSLLLRIIFLKERITIH

SEQ ID NO: 2544689 - protein, 19 aa, Entamoeba dispar
GMYTFLKLMGREPIIINLD

SEQ ID NO: 2544690 - protein, 23 aa, Entamoeba dispar
GNNAYMKLLVRLYGFLARRTQSK

SEQ ID NO: 2544691 - protein, 23 aa, Entamoeba dispar
HQTLLLLSLITPYLHHYLSPNVI

SEQ ID NO: 2544692 - protein, 18 aa, Entamoeba dispar
HRQIFFYYNSFNIIIGKQ

SEQ ID NO: 2544693 - protein, 21 aa, Entamoeba dispar
IAAALAKKRAERAKKFAISDS

SEQ ID NO: 2544694 - protein, 24 aa, Entamoeba dispar
IAGKLDHFFPIQKIWNQSGVIMFD

SEQ ID NO: 2544695 - protein, 24 aa, Entamoeba dispar
IFKLACNHYILPYIKIKEFPNNQR

SEQ ID NO: 2544696 - protein, 19 aa, Entamoeba dispar
IKRFWPGALTIIFPRNETV

SEQ ID NO: 2544697 - protein, 17 aa, Entamoeba dispar
ILYHPFIQNILLNSKVS

SEQ ID NO: 2544698 - protein, 17 aa, Entamoeba dispar
IQPLSYLPQLPVLVKIS

SEQ ID NO: 2544699 - protein, 22 aa, Entamoeba dispar
ITTLRKLIIILFLPIHTKSTKV

SEQ ID NO: 2544700 - protein, 25 aa, Entamoeba dispar
KELLKTVMKLWLPAGVTLLEMIVLH

SEQ ID NO: 2544701 - protein, 20 aa, Entamoeba dispar
KFSFRALSGPIYDIAWTGDN

SEQ ID NO: 2544702 - protein, 22 aa, Entamoeba dispar
KIFYIKALRMFTIFQVKSLLEP

SEQ ID NO: 2544703 - protein, 20 aa, Entamoeba dispar
KIIVLIPPPLQYCTFESWKS

SEQ ID NO: 2544704 - protein, 25 aa, Entamoeba dispar
KIRDALKFILQYYGINGIIIDNFTD

SEQ ID NO: 2544705 - protein, 22 aa, Entamoeba dispar
KPKRIIFKLIKEYIKVPLKEAE

SEQ ID NO: 2544706 - protein, 17 aa, Entamoeba dispar
KVMGYITVRFKQLRTTR

SEQ ID NO: 2544707 - protein, 18 aa, Entamoeba dispar
KVPYLFLANSYKISYWKT

SEQ ID NO: 2544708 - protein, 24 aa, Entamoeba dispar
LDHQKPLHFTSRYAYLTLWGDEVQ

SEQ ID NO: 2544709 - protein, 18 aa, Entamoeba dispar
LEFIQWLYSLGISIISLH

SEQ ID NO: 2544710 - protein, 19 aa, Entamoeba dispar
LELPFVPFLSKADLLGGYG

SEQ ID NO: 2544711 - protein, 21 aa, Entamoeba dispar
LFLKEGFRILKPNGLMIIAEP

SEQ ID NO: 2544712 - protein, 23 aa, Entamoeba dispar
LIGKLLNYNLYYSKIILLNNIEY

SEQ ID NO: 2544713 - protein, 20 aa, Entamoeba dispar
LIMFINHYIYFFPLLDQITP

SEQ ID NO: 2544714 - protein, 20 aa, Entamoeba dispar
LKEFLIGCIQLKQKVNATKE

SEQ ID NO: 2544715 - protein, 19 aa, Entamoeba dispar
LKGNVRVFCRVRPPLKNEG

SEQ ID NO: 2544716 - protein, 22 aa, Entamoeba dispar
LNPDWIYIRAAAIARKVYLNNG

SEQ ID NO: 2544717 - protein, 22 aa, Entamoeba dispar
LPPVYTYFYLCVIVSSEGFVKI

SEQ ID NO: 2544718 - protein, 17 aa, Entamoeba dispar
LRCYLRALDYLDNDYRI

SEQ ID NO: 2544719 - protein, 25 aa, Entamoeba dispar
LTLGLVWTLILRFAISELSAEGLSA

SEQ ID NO: 2544720 - protein, 17 aa, Entamoeba dispar
LVPLLRLAWNHFDPNFI

SEQ ID NO: 2544721 - protein, 17 aa, Entamoeba dispar
LVYTLFDSFPIAVRVGT

SEQ ID NO: 2544722 - protein, 18 aa, Entamoeba dispar
LWETLPFYLDEDKPLHGT

SEQ ID NO: 2544723 - protein, 19 aa, Entamoeba dispar
LYDEYIMMQIPSVLPIQKG

SEQ ID NO: 2544724 - protein, 24 aa, Entamoeba dispar
MDNMYSAWNPQLLISIKTPQSVNA

SEQ ID NO: 2544725 - protein, 19 aa, Entamoeba dispar
MFYYFGWNSWNGWIPAWCV

SEQ ID NO: 2544726 - protein, 24 aa, Entamoeba dispar
MNRTILFMVSLWRMNGYKCSIRKS

SEQ ID NO: 2544727 - protein, 27 aa, Entamoeba dispar
NALRNMLQLFLRQLPLKSKFEIISFGS

SEQ ID NO: 2544728 - protein, 25 aa, Entamoeba dispar
NDGRIIKLLIWYTVNYSTYLKEKKK

SEQ ID NO: 2544729 - protein, 23 aa, Entamoeba dispar
NEFVTISLFKILSSMIIKLNRQM

SEQ ID NO: 2544730 - protein, 23 aa, Entamoeba dispar
NGGYSWWRRNSLTVFLDKKIYKD

SEQ ID NO: 2544731 - protein, 20 aa, Entamoeba dispar
NKWIIELRKYAPTVPVIVVG

SEQ ID NO: 2544732 - protein, 18 aa, Entamoeba dispar
NPCLFERGADGWKFVKEL

SEQ ID NO: 2544733 - protein, 17 aa, Entamoeba dispar
NRRSWWHNPEMTEFIIF

SEQ ID NO: 2544734 - protein, 17 aa, Entamoeba dispar
NVGKTCLLLTYTTNSFP

SEQ ID NO: 2544735 - protein, 24 aa, Entamoeba dispar
PEKSYFYIMRNCNMLRFLDSNNTA

SEQ ID NO: 2544736 - protein, 23 aa, Entamoeba dispar
PYYLFNRFVLFNRELIGIKLPTS

SEQ ID NO: 2544737 - protein, 25 aa, Entamoeba dispar
QDNMYSAWNPQLLISLKAPQAVVAM

SEQ ID NO: 2544738 - protein, 18 aa, Entamoeba dispar
QFFKVFLYPIIRHSIHQN

SEQ ID NO: 2544739 - protein, 23 aa, Entamoeba dispar
QIKITLVFRHYATMGLTGQVQFS

SEQ ID NO: 2544740 - protein, 23 aa, Entamoeba dispar
QPKFYLTGVFYFTLMYSGSNLKE

SEQ ID NO: 2544741 - protein, 17 aa, Entamoeba dispar
QQIYFYILEMPISLLMK

SEQ ID NO: 2544742 - protein, 25 aa, Entamoeba dispar
QSEYGRFFQEWYFDLLLSHTDKVLS

SEQ ID NO: 2544743 - protein, 22 aa, Entamoeba dispar
QYSTFFIPFYNQFVRYYFKNYL

SEQ ID NO: 2544744 - protein, 23 aa, Entamoeba dispar
RNDFIVYWITKLGKRKYHLVTIC

SEQ ID NO: 2544745 - protein, 17 aa, Entamoeba dispar
RVHRQIFFYYNSFNIII

SEQ ID NO: 2544746 - protein, 18 aa, Entamoeba dispar
SCGFIMFAIPKKGLEKKF

SEQ ID NO: 2544747 - protein, 21 aa, Entamoeba dispar
SEEYFRFLWELRLVFNKEMTQ

SEQ ID NO: 2544748 - protein, 17 aa, Entamoeba dispar
SLKWLCQCIYYNELIIP

SEQ ID NO: 2544749 - protein, 19 aa, Entamoeba dispar
TITFLLLHKVKYPDRIHLL

SEQ ID NO: 2544750 - protein, 18 aa, Entamoeba dispar
TLTIHWQFDVTLRGLRKV

SEQ ID NO: 2544751 - protein, 20 aa, Entamoeba dispar
TMKQLDMVYLMKVALHVEDM

SEQ ID NO: 2544752 - protein, 17 aa, Entamoeba dispar
TYLIKRIKGLNKLKLIN

SEQ ID NO: 2544753 - protein, 22 aa, Entamoeba dispar
VESFSFLHWYISDGSSVLNEMI

SEQ ID NO: 2544754 - protein, 17 aa, Entamoeba dispar
VILIRDQIFKLACNHYI

SEQ ID NO: 2544755 - protein, 25 aa, Entamoeba dispar
VKTWKKRWFVLKENRLWYFASKTAE

SEQ ID NO: 2544756 - protein, 20 aa, Entamoeba dispar
VLSYYLPIHCGIKKIYIEVE

SEQ ID NO: 2544757 - protein, 19 aa, Entamoeba dispar
VRMFFNRFFTLLREGDIED

SEQ ID NO: 2544758 - protein, 17 aa, Entamoeba dispar
VRVFCRVRPPLKNEGIS

SEQ ID NO: 2544759 - protein, 21 aa, Entamoeba dispar
VVFAFPIYYFNMPGPIKTLLD

SEQ ID NO: 2544760 - protein, 24 aa, Entamoeba dispar
YDRLRPLSYPQTDVFLICFSVVSP

SEQ ID NO: 2544761 - protein, 24 aa, Entamoeba dispar
YEQLRPLSYPNTDLFLLCFSVISR

SEQ ID NO: 2544762 - protein, 24 aa, Entamoeba dispar
YIMKIMGYITVRFKQLRSSPLEIV

SEQ ID NO: 2544763 - protein, 21 aa, Entamoeba dispar
YQYKMRVVYAHFPVTLVIADD

SEQ ID NO: 2544764 - protein, 20 aa, Entamoeba dispar
AAFNMKLFPRIMIYFGQTDN

SEQ ID NO: 2544765 - protein, 25 aa, Entamoeba dispar
AARIFRALFELLLIKRWARPALKAL

SEQ ID NO: 2544766 - protein, 21 aa, Entamoeba dispar
ACGALFYCSYLPSGIKRSKQT

SEQ ID NO: 2544767 - protein, 18 aa, Entamoeba dispar
ACPAICRPCTGRPASPSA

SEQ ID NO: 2544768 - protein, 21 aa, Entamoeba dispar
ADALLSILQFLLIRSKIQHPF

SEQ ID NO: 2544769 - protein, 23 aa, Entamoeba dispar
ADGKKFYRFLYDEKYEKNKGFVN

SEQ ID NO: 2544770 - protein, 17 aa, Entamoeba dispar
ADVYSFGIILWEIAHRL

SEQ ID NO: 2544771 - protein, 24 aa, Entamoeba dispar
AEDQFFWVYKFLKGVQERDVFRIS

SEQ ID NO: 2544772 - protein, 20 aa, Entamoeba dispar
AEGVPICEWPMWINSQIEHT

SEQ ID NO: 2544773 - protein, 24 aa, Entamoeba dispar
AELVYFNYFIPFPIPIDKNKKMYL

SEQ ID NO: 2544774 - protein, 19 aa, Entamoeba dispar
AEWLGVLKPTVSLISCGHG

SEQ ID NO: 2544775 - protein, 24 aa, Entamoeba dispar
AFNAMYKLLFFPMSINDFNAVLDT

SEQ ID NO: 2544776 - protein, 18 aa, Entamoeba dispar
AFSDLLIQIYKKKNATLK

SEQ ID NO: 2544777 - protein, 25 aa, Entamoeba dispar
AFVFLRLINPVLLTPLKFSSKLTKP

SEQ ID NO: 2544778 - protein, 20 aa, Entamoeba dispar
AGFSLIRLLAEPSAAAYAYG

SEQ ID NO: 2544779 - protein, 24 aa, Entamoeba dispar
AGKGTLFLWFAYTPLKNSRKEFTE

SEQ ID NO: 2544780 - protein, 30 aa, Entamoeba dispar
AGLVLFNQYWYWYPFTLCLSLSFIPTTIIG

SEQ ID NO: 2544781 - protein, 25 aa, Entamoeba dispar
AGTLYIYVLDIPLLDKIYLIHQGVE

SEQ ID NO: 2544782 - protein, 20 aa, Entamoeba dispar
AILEQFGVALLKYAKKFPFQ

SEQ ID NO: 2544783 - protein, 23 aa, Entamoeba dispar
AINVDIFCRCIRLIETIQKASCR

SEQ ID NO: 2544784 - protein, 18 aa, Entamoeba dispar
AIPILFKRGIFNNLNWIP

SEQ ID NO: 2544785 - protein, 22 aa, Entamoeba dispar
AKAYLQMDWTKKGNLTPLINRA

SEQ ID NO: 2544786 - protein, 22 aa, Entamoeba dispar
AKFALVQPIRRIPKLIWICYQQ

SEQ ID NO: 2544787 - protein, 24 aa, Entamoeba dispar
AKKVEVIVGVPFIYIPKVQQILAG

SEQ ID NO: 2544788 - protein, 19 aa, Entamoeba dispar
AKLFKPRHLFCGYYIFIEF

SEQ ID NO: 2544789 - protein, 26 aa, Entamoeba dispar
AKPKYRSVYLFLFNDTIILTKIISPG

SEQ ID NO: 2544790 - protein, 22 aa, Entamoeba dispar
AKQHGCLTLWNPAPAPKEINRN

SEQ ID NO: 2544791 - protein, 22 aa, Entamoeba dispar
AKSIFYYHYFVPELNLNDVKRF

SEQ ID NO: 2544792 - protein, 27 aa, Entamoeba dispar
AKVDKVDLLIFFTELRRFCLDIINWID

SEQ ID NO: 2544793 - protein, 17 aa, Entamoeba dispar
ALEYIHRMYLKVGFYLT

SEQ ID NO: 2544794 - protein, 19 aa, Entamoeba dispar
ALGCMLYEFVVGYPPFNAS

SEQ ID NO: 2544795 - protein, 17 aa, Entamoeba dispar
ALGYMFVYFMKGSLPWQ

SEQ ID NO: 2544796 - protein, 18 aa, Entamoeba dispar
ALHFLAKLKIMVVKDIER

SEQ ID NO: 2544797 - protein, 22 aa, Entamoeba dispar
ALHRIGLIPIPLYATLGVQSIN

SEQ ID NO: 2544798 - protein, 19 aa, Entamoeba dispar
ALIHYILLRGLSDPTHLIR

SEQ ID NO: 2544799 - protein, 19 aa, Entamoeba dispar
ALLKLFLPEPVLSTSIIIL

SEQ ID NO: 2544800 - protein, 29 aa, Entamoeba dispar
ALLRPGRLDQLLFIPLPDKASRVSILRAK

SEQ ID NO: 2544801 - protein, 23 aa, Entamoeba dispar
ALQYLRLNPPFKFLNPAYEGIFL

SEQ ID NO: 2544802 - protein, 24 aa, Entamoeba dispar
ALRNMLQLFLRQLPLKSKFEIISF

SEQ ID NO: 2544803 - protein, 18 aa, Entamoeba dispar
ALRTTAPYTLYFAAGTNA

SEQ ID NO: 2544804 - protein, 18 aa, Entamoeba dispar
ALTCWRRIVWHCVLPLAL

SEQ ID NO: 2544805 - protein, 19 aa, Entamoeba dispar
AMKGFMIPLLKNIINDFKT

SEQ ID NO: 2544806 - protein, 18 aa, Entamoeba dispar
AMLWRVDPLVSMGAYACA

SEQ ID NO: 2544807 - protein, 18 aa, Entamoeba dispar
AMQIYFSYRFLALHSPEE

SEQ ID NO: 2544808 - protein, 24 aa, Entamoeba dispar
ANKENLLRFVFPLSRITLLPCNSK

SEQ ID NO: 2544809 - protein, 24 aa, Entamoeba dispar
ANLIKLWFRELPTLLLNGLTSTQI

SEQ ID NO: 2544810 - protein, 18 aa, Entamoeba dispar
APAFFRISNLFWMTYRSG

SEQ ID NO: 2544811 - protein, 17 aa, Entamoeba dispar
APFIITCKLLPLIRKTL

SEQ ID NO: 2544812 - protein, 24 aa, Entamoeba dispar
APPDVISLILPLLKTRTFFIPNRS

SEQ ID NO: 2544813 - protein, 24 aa, Entamoeba dispar
APQKKYKYLINDPKFFVFSLKAYN

SEQ ID NO: 2544814 - protein, 24 aa, Entamoeba dispar
AQEFFYLILIETFPVPLQLVCMPE

SEQ ID NO: 2544815 - protein, 19 aa, Entamoeba dispar
AQILHYTFLLPVLSELHYQ

SEQ ID NO: 2544816 - protein, 24 aa, Entamoeba dispar
AQINNGLLYLLRTLGYSFSIKQTK

SEQ ID NO: 2544817 - protein, 20 aa, Entamoeba dispar
AQITKLPWKAAISYFKAAFI

SEQ ID NO: 2544818 - protein, 17 aa, Entamoeba dispar
AQRYCYYPYFYSILIED

SEQ ID NO: 2544819 - protein, 24 aa, Entamoeba dispar
AQSIAIPFELWYLEANYTCIIFIG

SEQ ID NO: 2544820 - protein, 24 aa, Entamoeba dispar
AQVHDWWFYPWLTEIVEDPSEKEL

SEQ ID NO: 2544821 - protein, 25 aa, Entamoeba dispar
ARNTFLTLFFLRYCFRPFSKVPSIL

SEQ ID NO: 2544822 - protein, 24 aa, Entamoeba dispar
ASAEILFALCKYYKELKKCQSELF

SEQ ID NO: 2544823 - protein, 22 aa, Entamoeba dispar
ASFMNYLWRGYSVDGLPQNVSQ

SEQ ID NO: 2544824 - protein, 24 aa, Entamoeba dispar
ASGKTCLYNIWRGLSIPDEYIKTT

SEQ ID NO: 2544825 - protein, 24 aa, Entamoeba dispar
ASIDYFFCYKWNALLFKRFFLNED

SEQ ID NO: 2544826 - protein, 22 aa, Entamoeba dispar
ASLPFMHFFDGFRTSHEIQKIH

SEQ ID NO: 2544827 - protein, 23 aa, Entamoeba dispar
ASNYLELILRIFKKPYLTFGDKT

SEQ ID NO: 2544828 - protein, 17 aa, Entamoeba dispar
ASWIFTFDTYDFRLFVG

SEQ ID NO: 2544829 - protein, 21 aa, Entamoeba dispar
ATKTMLLFNQYLEKKPGCKGK

SEQ ID NO: 2544830 - protein, 27 aa, Entamoeba dispar
ATLKAIYHRLFVFIVNKVNEVMGKAGA

SEQ ID NO: 2544831 - protein, 17 aa, Entamoeba dispar
ATWVAFFKKAGIKKKDL

SEQ ID NO: 2544832 - protein, 25 aa, Entamoeba dispar
AVCYDLRFPVWLRNTLENHYDILII

SEQ ID NO: 2544833 - protein, 17 aa, Entamoeba dispar
AVICMFLRIVVSEVQLQ

SEQ ID NO: 2544834 - protein, 19 aa, Entamoeba dispar
AVILPIKFPQLFTDKRKPW

SEQ ID NO: 2544835 - protein, 19 aa, Entamoeba dispar
AVLYCWCVSLLLEKLNNTE

SEQ ID NO: 2544836 - protein, 23 aa, Entamoeba dispar
AVRRFYIFLCLQPHVIWLVKALK

SEQ ID NO: 2544837 - protein, 17 aa, Entamoeba dispar
AVTLLWHPFIVAQSPPS

SEQ ID NO: 2544838 - protein, 18 aa, Entamoeba dispar
AVVLIIGRFLICANVGDS

SEQ ID NO: 2544839 - protein, 25 aa, Entamoeba dispar
AWTILKLFLISLPTPLLHPISSFIS

SEQ ID NO: 2544840 - protein, 17 aa, Entamoeba dispar
AYEKKIHWLNQKDTQKS

SEQ ID NO: 2544841 - protein, 17 aa, Entamoeba dispar
AYFLAMLNTKTLNLIMI

SEQ ID NO: 2544842 - protein, 26 aa, Entamoeba dispar
AYLNSTLSWICIYLTKSLRNERNEKV

SEQ ID NO: 2544843 - protein, 19 aa, Entamoeba dispar
AYLVISKSYFYIESYDEAV

SEQ ID NO: 2544844 - protein, 24 aa, Entamoeba dispar
AYNLDFFIYFSFNNKKITYIRQKK

SEQ ID NO: 2544845 - protein, 25 aa, Entamoeba dispar
AYRIDHILGFFRIWAIPAIHRTGLL

SEQ ID NO: 2544846 - protein, 18 aa, Entamoeba dispar
AYSEIINHALHYEKPIIN

SEQ ID NO: 2544847 - protein, 17 aa, Entamoeba dispar
CAGLHRGLGVHLTFVRS

SEQ ID NO: 2544848 - protein, 22 aa, Entamoeba dispar
CAPYLQIKLLRLLRVMNPSTKY

SEQ ID NO: 2544849 - protein, 18 aa, Entamoeba dispar
CDGLLLRAMKSGSWVLLD

SEQ ID NO: 2544850 - protein, 21 aa, Entamoeba dispar
CDIFLIYLPTLSSSSFILLKQ

SEQ ID NO: 2544851 - protein, 23 aa, Entamoeba dispar
CDKYIQKWIAISAPFIGTGVVPK

SEQ ID NO: 2544852 - protein, 17 aa, Entamoeba dispar
CEILGKPEYFIFGRILI

SEQ ID NO: 2544853 - protein, 17 aa, Entamoeba dispar
CELLRCFIKILKRIKDI

SEQ ID NO: 2544854 - protein, 23 aa, Entamoeba dispar
CEQFNFYQFKYLSSLTLSCCELY

SEQ ID NO: 2544855 - protein, 25 aa, Entamoeba dispar
CESRNRLIILLPWLEQRLSEGSPDV

SEQ ID NO: 2544856 - protein, 25 aa, Entamoeba dispar
CETEFYPIMKYVFGNVLIADDAETA

SEQ ID NO: 2544857 - protein, 20 aa, Entamoeba dispar
CFIKHWILYIKDKEWLDVFQ

SEQ ID NO: 2544858 - protein, 17 aa, Entamoeba dispar
CFVSRQLIYPIPEQFFN

SEQ ID NO: 2544859 - protein, 18 aa, Entamoeba dispar
CFVWCRNLQYIKLPDGIT

SEQ ID NO: 2544860 - protein, 22 aa, Entamoeba dispar
CGNTFSWKWGYKPHYAPLLCHF

SEQ ID NO: 2544861 - protein, 23 aa, Entamoeba dispar
CHIDCYVFIFLNLTQWKSYYFKF

SEQ ID NO: 2544862 - protein, 19 aa, Entamoeba dispar
CHIYRLYPDLIPNASKLIY

SEQ ID NO: 2544863 - protein, 23 aa, Entamoeba dispar
CIRKNFFLWLLENKPSSALSYLQ

SEQ ID NO: 2544864 - protein, 17 aa, Entamoeba dispar
CISLPFRLILPPISLRK

SEQ ID NO: 2544865 - protein, 21 aa, Entamoeba dispar
CISRQLWWGHRIPAYLIKNKK

SEQ ID NO: 2544866 - protein, 26 aa, Entamoeba dispar
CIWRYPPQYFYLLLNPRFVAQKLTEA

SEQ ID NO: 2544867 - protein, 21 aa, Entamoeba dispar
CLDCIISLFPPQKTFPMCTIA

SEQ ID NO: 2544868 - protein, 22 aa, Entamoeba dispar
CLDDFIFFCFLVGNDFLPRIPS

SEQ ID NO: 2544869 - protein, 17 aa, Entamoeba dispar
CLFYERYPEAVSEVMFP

SEQ ID NO: 2544870 - protein, 31 aa, Entamoeba dispar
CLHSFQTHYLFFSQYLYSKLYLLSPNQYPSV

SEQ ID NO: 2544871 - protein, 17 aa, Entamoeba dispar
CLLLFRKGLSQGILDLC

SEQ ID NO: 2544872 - protein, 18 aa, Entamoeba dispar
CLLLLVALKLRFPQRISL

SEQ ID NO: 2544873 - protein, 17 aa, Entamoeba dispar
CLPLILILRNRLNYALN

SEQ ID NO: 2544874 - protein, 24 aa, Entamoeba dispar
CLQPHVIWLVKALKIIIEFDFGKK

SEQ ID NO: 2544875 - protein, 24 aa, Entamoeba dispar
CMKKNEEIMLLENKLKTIDKHCIS

SEQ ID NO: 2544876 - protein, 23 aa, Entamoeba dispar
CMPWLVIDLIKLIPLICIEKREI

SEQ ID NO: 2544877 - protein, 23 aa, Entamoeba dispar
CPEQSFFNYFFPTSQFTLTKIPP

SEQ ID NO: 2544878 - protein, 24 aa, Entamoeba dispar
CPEQSFFNYFFPTSQFTLTKIPPK

SEQ ID NO: 2544879 - protein, 17 aa, Entamoeba dispar
CRTLFDIPLIIIINKAD

SEQ ID NO: 2544880 - protein, 17 aa, Entamoeba dispar
CSIPIVRRLICGMFSKD

SEQ ID NO: 2544881 - protein, 24 aa, Entamoeba dispar
CTLRSIQMLFLNSLIRLQEPNPGF

SEQ ID NO: 2544882 - protein, 21 aa, Entamoeba dispar
CVCIGLYYWTYDITSFITINN

SEQ ID NO: 2544883 - protein, 17 aa, Entamoeba dispar
CVCPTIVLSLFYENGFK

SEQ ID NO: 2544884 - protein, 17 aa, Entamoeba dispar
CVEDCVCIGLYYWTYDI

SEQ ID NO: 2544885 - protein, 31 aa, Entamoeba dispar
CVSHPFWLPKFANAFYYTLPLLIQQMNTIAS

SEQ ID NO: 2544886 - protein, 18 aa, Entamoeba dispar
CWNRVIPYCYYLTTVHRQ

SEQ ID NO: 2544887 - protein, 25 aa, Entamoeba dispar
CWRRSESALFLLFCSDPLMQKENIE

SEQ ID NO: 2544888 - protein, 19 aa, Entamoeba dispar
CYDRLMWVIPLGFDKTSYS

SEQ ID NO: 2544889 - protein, 17 aa, Entamoeba dispar
CYILYVKMHFFPEMTEE

SEQ ID NO: 2544890 - protein, 17 aa, Entamoeba dispar
DAFLCIRGVKTLPMRMK

SEQ ID NO: 2544891 - protein, 25 aa, Entamoeba dispar
DAHYTLKYFLKTWIRFIHLCGTPAQ

SEQ ID NO: 2544892 - protein, 22 aa, Entamoeba dispar
DANAWFVALAYTIKLSPRLNES

SEQ ID NO: 2544893 - protein, 24 aa, Entamoeba dispar
DAVELVPIIYYPVSKKPTSLVFIR

SEQ ID NO: 2544894 - protein, 27 aa, Entamoeba dispar
DAVLRFCYLWFNFMPLTRGTAGCGMYW

SEQ ID NO: 2544895 - protein, 22 aa, Entamoeba dispar
DAVTLLWHPFIVAQSPPSPQPL

SEQ ID NO: 2544896 - protein, 17 aa, Entamoeba dispar
DAVWLWVNGSDPVFRKA

SEQ ID NO: 2544897 - protein, 18 aa, Entamoeba dispar
DAWKILRRGTIVLYKMPA

SEQ ID NO: 2544898 - protein, 23 aa, Entamoeba dispar
DCFKRFIPYLKVYKMFIGNNEIC

SEQ ID NO: 2544899 - protein, 19 aa, Entamoeba dispar
DCIDFILKLLPKDKLLALR

SEQ ID NO: 2544900 - protein, 24 aa, Entamoeba dispar
DCTGYLYRMTLWEVPLLAIVSELY

SEQ ID NO: 2544901 - protein, 20 aa, Entamoeba dispar
DDCIYLFKTAGYLVTKKFLK

SEQ ID NO: 2544902 - protein, 24 aa, Entamoeba dispar
DDEQNYRFILFDDINYDKNLLRLI

SEQ ID NO: 2544903 - protein, 18 aa, Entamoeba dispar
DDFINVIIFLILRSHVKN

SEQ ID NO: 2544904 - protein, 27 aa, Entamoeba dispar
DDGLFIEDFFPELLLLDLSNNEIEVLE

SEQ ID NO: 2544905 - protein, 22 aa, Entamoeba dispar
DDGTLYMWMPLQSQKPIHRLVG

SEQ ID NO: 2544906 - protein, 17 aa, Entamoeba dispar
DDKTKALIIFLEKTKRP

SEQ ID NO: 2544907 - protein, 21 aa, Entamoeba dispar
DDNDHFLFVLRKKGVSDVKKF

SEQ ID NO: 2544908 - protein, 26 aa, Entamoeba dispar
DDRKSLFISIALAIKLALNTKVSNDL

SEQ ID NO: 2544909 - protein, 23 aa, Entamoeba dispar
DDRRVFKYVIWYLVSYSEYLKKK

SEQ ID NO: 2544910 - protein, 18 aa, Entamoeba dispar
DDSYLYFINLLTNDLEIA

SEQ ID NO: 2544911 - protein, 26 aa, Entamoeba dispar
DDVSPFGMLIIFKTSFRSSFCASLSN

SEQ ID NO: 2544912 - protein, 23 aa, Entamoeba dispar
DEEQNYRFILFDDINYDKNLIRL

SEQ ID NO: 2544913 - protein, 20 aa, Entamoeba dispar
DEFFPFGDTALIKNNLKPSP

SEQ ID NO: 2544914 - protein, 17 aa, Entamoeba dispar
DEIVMLLTWARSLPSIN

SEQ ID NO: 2544915 - protein, 18 aa, Entamoeba dispar
DEKKLFQPLLWKPKNEKY

SEQ ID NO: 2544916 - protein, 17 aa, Entamoeba dispar
DELLQETIDLWKKLRER

SEQ ID NO: 2544917 - protein, 23 aa, Entamoeba dispar
DENYHITEYLALGATLAVSYVEN

SEQ ID NO: 2544918 - protein, 20 aa, Entamoeba dispar
DEQLLLLLLKTTLKLCNFDY

SEQ ID NO: 2544919 - protein, 23 aa, Entamoeba dispar
DEQNYRFILFDDINYDKNLLRLI

SEQ ID NO: 2544920 - protein, 22 aa, Entamoeba dispar
DEWIYYLFILIKNILKKYPSLL

SEQ ID NO: 2544921 - protein, 19 aa, Entamoeba dispar
DFFDLFKQSPYFKDLTHRL

SEQ ID NO: 2544922 - protein, 18 aa, Entamoeba dispar
DFHLYVYEKMSIVAYLDL

SEQ ID NO: 2544923 - protein, 21 aa, Entamoeba dispar
DFHSYIFNRFSADTYLACVRC

SEQ ID NO: 2544924 - protein, 21 aa, Entamoeba dispar
DFINLLKLKLALLEELPFGEI

SEQ ID NO: 2544925 - protein, 25 aa, Entamoeba dispar
DFNKEYVFLIDAGKIWLWFGSKALN

SEQ ID NO: 2544926 - protein, 19 aa, Entamoeba dispar
DFRQSVLELLLWCNEKNLP

SEQ ID NO: 2544927 - protein, 18 aa, Entamoeba dispar
DFSKFRVLLYINSSYQPL

SEQ ID NO: 2544928 - protein, 18 aa, Entamoeba dispar
DFSKWIKCILKINNPLFD

SEQ ID NO: 2544929 - protein, 26 aa, Entamoeba dispar
DFVLYYPEYLWYPFLTLIISKLEQPN

SEQ ID NO: 2544930 - protein, 24 aa, Entamoeba dispar
DFYSDPILLIDFKSLYPSIIMEFG

SEQ ID NO: 2544931 - protein, 24 aa, Entamoeba dispar
DGAMEIFIEWMYLQRSPLLESQPI

SEQ ID NO: 2544932 - protein, 23 aa, Entamoeba dispar
DGCSGLVYVFYNKMLYFAQCGSI

SEQ ID NO: 2544933 - protein, 19 aa, Entamoeba dispar
DGEKLFLHGLHLYSKKLQD

SEQ ID NO: 2544934 - protein, 19 aa, Entamoeba dispar
DGFTQMFWELGMKSFDEFI

SEQ ID NO: 2544935 - protein, 25 aa, Entamoeba dispar
DGKIFKYVIWFLVEYPTYLKEKEAG

SEQ ID NO: 2544936 - protein, 25 aa, Entamoeba dispar
DGKIFKYVIWYLVEYSKYLQEKEKR

SEQ ID NO: 2544937 - protein, 23 aa, Entamoeba dispar
DGKIFKYVIWYLVSYSKYLQEKE

SEQ ID NO: 2544938 - protein, 25 aa, Entamoeba dispar
DGKIFKYVIWYTVKYLTYLKEKKKG

SEQ ID NO: 2544939 - protein, 24 aa, Entamoeba dispar
DGKIFKYVIWYYVDYWEYLQEKEK

SEQ ID NO: 2544940 - protein, 20 aa, Entamoeba dispar
DGLIKLWNLIDGHLIATLRG

SEQ ID NO: 2544941 - protein, 25 aa, Entamoeba dispar
DGNLTLILGLLWTLILKYQIAQNKM

SEQ ID NO: 2544942 - protein, 20 aa, Entamoeba dispar
DGRIFKEVIWYAISYSKYLK

SEQ ID NO: 2544943 - protein, 17 aa, Entamoeba dispar
DGTKTCFIVLFIAMLFM

SEQ ID NO: 2544944 - protein, 22 aa, Entamoeba dispar
DHDQIYYLMIKLEYSRLIIKIR

SEQ ID NO: 2544945 - protein, 25 aa, Entamoeba dispar
DHLKGFIPIFKQKWILKLKEMMLFV

SEQ ID NO: 2544946 - protein, 22 aa, Entamoeba dispar
DHNPYFDSFIRWQFLKLKEMGK

SEQ ID NO: 2544947 - protein, 22 aa, Entamoeba dispar
DIAAALAKKRAERAKKFAISDS

SEQ ID NO: 2544948 - protein, 25 aa, Entamoeba dispar
DICYQQAFLILLLNQYLAITLKKQS

SEQ ID NO: 2544949 - protein, 17 aa, Entamoeba dispar
DIHLKFIYQPFLHWPDT

SEQ ID NO: 2544950 - protein, 29 aa, Entamoeba dispar
DIIHAPIIKHFFIILGYPNQPYQSVYVSS

SEQ ID NO: 2544951 - protein, 18 aa, Entamoeba dispar
DIILLNILVLIQPEIKEI

SEQ ID NO: 2544952 - protein, 24 aa, Entamoeba dispar
DIKDIWIGIYFWYWHSDGRDYQEK

SEQ ID NO: 2544953 - protein, 25 aa, Entamoeba dispar
DIKKMLDFVPWFIVEITLLKRASDL

SEQ ID NO: 2544954 - protein, 19 aa, Entamoeba dispar
DIKLLIRKYNFFNYNIKLK

SEQ ID NO: 2544955 - protein, 26 aa, Entamoeba dispar
DILHRGLKKFWWKAMDYLSFKTLNKR

SEQ ID NO: 2544956 - protein, 17 aa, Entamoeba dispar
DILLRFLYENNLKFIVR

SEQ ID NO: 2544957 - protein, 25 aa, Entamoeba dispar
DILPLKLCVYLFSSISRLIALYETL

SEQ ID NO: 2544958 - protein, 18 aa, Entamoeba dispar
DIPALWFKCSMKSSTSIE

SEQ ID NO: 2544959 - protein, 17 aa, Entamoeba dispar
DIPHPITPPLRPKYFLG

SEQ ID NO: 2544960 - protein, 21 aa, Entamoeba dispar
DIPLELMRILRIVNLSIIESN

SEQ ID NO: 2544961 - protein, 25 aa, Entamoeba dispar
DIQIRYIIYQLLKALKYLHSAGIVH

SEQ ID NO: 2544962 - protein, 21 aa, Entamoeba dispar
DITLFFYRLLGPDPSFKKGFE

SEQ ID NO: 2544963 - protein, 18 aa, Entamoeba dispar
DIVDVAFWRGLLVSASQD

SEQ ID NO: 2544964 - protein, 22 aa, Entamoeba dispar
DKEFNLLFWKYLMKTKPLPSRE

SEQ ID NO: 2544965 - protein, 22 aa, Entamoeba dispar
DKELNQMLSIKRLAPYDERKIT

SEQ ID NO: 2544966 - protein, 24 aa, Entamoeba dispar
DKGHKIFFKLPLIKKVELKGELIQ

SEQ ID NO: 2544967 - protein, 24 aa, Entamoeba dispar
DKLARLFDYLWKKKCIVYADVIEP

SEQ ID NO: 2544968 - protein, 23 aa, Entamoeba dispar
DKRKPWTGILLFGPPGTGKSFLA

SEQ ID NO: 2544969 - protein, 21 aa, Entamoeba dispar
DKVPYLFLANSYKISYWKTDI

SEQ ID NO: 2544970 - protein, 17 aa, Entamoeba dispar
DLALHFLAKLKIMVVKD

SEQ ID NO: 2544971 - protein, 24 aa, Entamoeba dispar
DLASLCYFFIFLQPKYVIHSLPFQ

SEQ ID NO: 2544972 - protein, 18 aa, Entamoeba dispar
DLDYLIGPILYQENWKDL

SEQ ID NO: 2544973 - protein, 27 aa, Entamoeba dispar
DLESLAYMFIYFLKGKLPWQGFNRQNN

SEQ ID NO: 2544974 - protein, 22 aa, Entamoeba dispar
DLFCEFFNTIPLAALFKCSLGS

SEQ ID NO: 2544975 - protein, 17 aa, Entamoeba dispar
DLIFSSILLQQQHQIAI

SEQ ID NO: 2544976 - protein, 32 aa, Entamoeba dispar
DLKTEFSDGILFARILNYYKPNIIAYNTLTRD

SEQ ID NO: 2544977 - protein, 18 aa, Entamoeba dispar
DLLSLLTFSLLNSTMRHP

SEQ ID NO: 2544978 - protein, 20 aa, Entamoeba dispar
DLMIIIYQKQIEYISLYIDC

SEQ ID NO: 2544979 - protein, 18 aa, Entamoeba dispar
DLMKGVISILKKLYKQIE

SEQ ID NO: 2544980 - protein, 20 aa, Entamoeba dispar
DLNIILFRILSSGTPLQVID

SEQ ID NO: 2544981 - protein, 20 aa, Entamoeba dispar
DLNWFIFSIIVSDISFIFVM

SEQ ID NO: 2544982 - protein, 21 aa, Entamoeba dispar
DLQDGIIFRDLLRALGVPCGN

SEQ ID NO: 2544983 - protein, 23 aa, Entamoeba dispar
DLRDYLIMPVQRLPRYNLLLTDL

SEQ ID NO: 2544984 - protein, 22 aa, Entamoeba dispar
DLRIKIFLWKTIQCDKSLGTVR

SEQ ID NO: 2544985 - protein, 31 aa, Entamoeba dispar
DLRSFLIMPVQRLPRYVLLLKELQKNTPKDH

SEQ ID NO: 2544986 - protein, 31 aa, Entamoeba dispar
DLRSYLIMPVQRLPRYKLLLTDLIKHTDDGF

SEQ ID NO: 2544987 - protein, 20 aa, Entamoeba dispar
DLSEYNLLWWKNKVYVIDVG

SEQ ID NO: 2544988 - protein, 17 aa, Entamoeba dispar
DLSIRIFKKSKFNLYLS

SEQ ID NO: 2544989 - protein, 25 aa, Entamoeba dispar
DLTLFELPRLPEYIKYLCVYSTNSN

SEQ ID NO: 2544990 - protein, 19 aa, Entamoeba dispar
DLVTMKWWNDLWLNEGFAS

SEQ ID NO: 2544991 - protein, 17 aa, Entamoeba dispar
DLYQYILRTIKTNQIYL

SEQ ID NO: 2544992 - protein, 19 aa, Entamoeba dispar
DMILWGLFSLANAIHFLNI

SEQ ID NO: 2544993 - protein, 18 aa, Entamoeba dispar
DMNKLLKFMLVNKIVRAT

SEQ ID NO: 2544994 - protein, 18 aa, Entamoeba dispar
DMNQLIYRIFPIGVDSPK

SEQ ID NO: 2544995 - protein, 18 aa, Entamoeba dispar
DMVALYEYLYAGNPLIID

SEQ ID NO: 2544996 - protein, 21 aa, Entamoeba dispar
DNINLLLSLYLPSLQSFNLPS

SEQ ID NO: 2544997 - protein, 23 aa, Entamoeba dispar
DNKDMLVWIIYPPHFDSTKKYPT

SEQ ID NO: 2544998 - protein, 24 aa, Entamoeba dispar
DNKKRILMELLWPIIKYRSSNELI

SEQ ID NO: 2544999 - protein, 17 aa, Entamoeba dispar
DNLIFVKNLAYAIKDED

SEQ ID NO: 2545000 - protein, 24 aa, Entamoeba dispar
DNNNLFIVYLMRAFAHGYYRKPTF

SEQ ID NO: 2545001 - protein, 17 aa, Entamoeba dispar
DNNSCLISMLLILSIIL

SEQ ID NO: 2545002 - protein, 17 aa, Entamoeba dispar
DNSFLQKFLLFDFHLKS

SEQ ID NO: 2545003 - protein, 20 aa, Entamoeba dispar
DNSIYFILLLCSLDIIIHEN

SEQ ID NO: 2545004 - protein, 24 aa, Entamoeba dispar
DNSLVLYLSYFIIKDNRFGPNDMK

SEQ ID NO: 2545005 - protein, 24 aa, Entamoeba dispar
DNTEDLFTQMFWKLGMKSFDEFIE

SEQ ID NO: 2545006 - protein, 20 aa, Entamoeba dispar
DNTLYMLLTFANLSNNYVVK

SEQ ID NO: 2545007 - protein, 17 aa, Entamoeba dispar
DPCLYLQRFGEDLAFEK

SEQ ID NO: 2545008 - protein, 23 aa, Entamoeba dispar
DPFARMLILRFVFCRLVLLSLKL

SEQ ID NO: 2545009 - protein, 17 aa, Entamoeba dispar
DPHYFIFSLINKSQYGA

SEQ ID NO: 2545010 - protein, 28 aa, Entamoeba dispar
DPIVQRFRWSILILFRVITNLYDCLDKN

SEQ ID NO: 2545011 - protein, 24 aa, Entamoeba dispar
DPLPPRLFRKYLAYARANIHPQLN

SEQ ID NO: 2545012 - protein, 21 aa, Entamoeba dispar
DPQIYYLRILQLLLRNEELHH

SEQ ID NO: 2545013 - protein, 23 aa, Entamoeba dispar
DPSYYLFRWLTLLGASELPMDVT

SEQ ID NO: 2545014 - protein, 23 aa, Entamoeba dispar
DPTIQFQWWYPLVQNLSANDFRE

SEQ ID NO: 2545015 - protein, 20 aa, Entamoeba dispar
DPYVLLFKRCDVNGDGVLDK

SEQ ID NO: 2545016 - protein, 21 aa, Entamoeba dispar
DQIWLHAWKYSFNSHNWIAEI

SEQ ID NO: 2545017 - protein, 26 aa, Entamoeba dispar
DQQITFKFIRIYRLFINFLGGDIVDL

SEQ ID NO: 2545018 - protein, 17 aa, Entamoeba dispar
DQSIFWKLYYKSTVYNN

SEQ ID NO: 2545019 - protein, 21 aa, Entamoeba dispar
DRLGINTLKLFKICYNSTTFN

SEQ ID NO: 2545020 - protein, 20 aa, Entamoeba dispar
DSFCYFSFNKEKYFLVGDHS

SEQ ID NO: 2545021 - protein, 24 aa, Entamoeba dispar
DSIKPLHFVIVSKIPIALLKAKSL

SEQ ID NO: 2545022 - protein, 21 aa, Entamoeba dispar
DSNHPSIFIIKARIKIIKTND

SEQ ID NO: 2545023 - protein, 25 aa, Entamoeba dispar
DSSDIEWSLPAFLPKRIKSISKEEE

SEQ ID NO: 2545024 - protein, 23 aa, Entamoeba dispar
DSSTPWILYWSLNPLRLFGYNVD

SEQ ID NO: 2545025 - protein, 23 aa, Entamoeba dispar
DSTEVFFKIKKNTPLKKLMEAFC

SEQ ID NO: 2545026 - protein, 28 aa, Entamoeba dispar
DTLAKPARLPFLSLALNLPPELADIQQF

SEQ ID NO: 2545027 - protein, 26 aa, Entamoeba dispar
DTNKYTLWYLCDFLVDVLNHQSVNQM

SEQ ID NO: 2545028 - protein, 26 aa, Entamoeba dispar
DTSAPWLQILLFRLLSTIDLETTTQK

SEQ ID NO: 2545029 - protein, 21 aa, Entamoeba dispar
DTYLPLPFMPKLQTLTIRFTQ

SEQ ID NO: 2545030 - protein, 17 aa, Entamoeba dispar
DVAPHVYAIADGAYRAM

SEQ ID NO: 2545031 - protein, 23 aa, Entamoeba dispar
DVEPLVLQLKAFLEKHDLDVSVK

SEQ ID NO: 2545032 - protein, 18 aa, Entamoeba dispar
DVIALYEYLYAGNPIPLI

SEQ ID NO: 2545033 - protein, 31 aa, Entamoeba dispar
DVKKMRKRFWFEKFHWFLSSENFIIISGKDA

SEQ ID NO: 2545034 - protein, 22 aa, Entamoeba dispar
DVLPGYLPTASALPFFISLFSE

SEQ ID NO: 2545035 - protein, 25 aa, Entamoeba dispar
DVMKRFDYLLQPPPLKKKKAIVPPD

SEQ ID NO: 2545036 - protein, 23 aa, Entamoeba dispar
DVVIKICWLIDKFGPDIKWKFDS

SEQ ID NO: 2545037 - protein, 18 aa, Entamoeba dispar
DVVLLTNLFYTFLESSQS

SEQ ID NO: 2545038 - protein, 22 aa, Entamoeba dispar
DVWSFGILIFKLLTGFCPFELI

SEQ ID NO: 2545039 - protein, 20 aa, Entamoeba dispar
DWTTIKLYKFLIPLIFHYQE

SEQ ID NO: 2545040 - protein, 18 aa, Entamoeba dispar
DWWYYPDLTYVTDVLHEQ

SEQ ID NO: 2545041 - protein, 22 aa, Entamoeba dispar
DYDIRGWFQWYCRYYIGRRGPS

SEQ ID NO: 2545042 - protein, 23 aa, Entamoeba dispar
DYGSLIPIPILYDIIRTAIDHKR

SEQ ID NO: 2545043 - protein, 21 aa, Entamoeba dispar
DYIQIDGLLGLLFCYLNTLDL

SEQ ID NO: 2545044 - protein, 24 aa, Entamoeba dispar
DYISKAHWYFYPPTPQFIGYVNKI

SEQ ID NO: 2545045 - protein, 17 aa, Entamoeba dispar
DYKLLEFSLIYNILETF

SEQ ID NO: 2545046 - protein, 17 aa, Entamoeba dispar
DYLPLLPLSLIEVHETT

SEQ ID NO: 2545047 - protein, 20 aa, Entamoeba dispar
DYRPTPLCHYLFPAGGNGIY

SEQ ID NO: 2545048 - protein, 19 aa, Entamoeba dispar
DYVYIIMEFINGGNLLRGV

SEQ ID NO: 2545049 - protein, 17 aa, Entamoeba dispar
DYYFLLYCSNIDIQFKR

SEQ ID NO: 2545050 - protein, 27 aa, Entamoeba dispar
DYYIQLWQLLIIPKLLLEPNLFKFLYF

SEQ ID NO: 2545051 - protein, 18 aa, Entamoeba dispar
EADFPFYKEFFYGNDQVK

SEQ ID NO: 2545052 - protein, 22 aa, Entamoeba dispar
EAEGVPICEWPMWINSQIEHTE

SEQ ID NO: 2545053 - protein, 25 aa, Entamoeba dispar
EAVIWPMLRPDIFTGLRAPPKGLLL

SEQ ID NO: 2545054 - protein, 19 aa, Entamoeba dispar
EAYLYLLHHLNNSCSLEAL

SEQ ID NO: 2545055 - protein, 24 aa, Entamoeba dispar
ECFNLMYYMYKFPFSVLDLNIYKQ

SEQ ID NO: 2545056 - protein, 23 aa, Entamoeba dispar
ECVEFPCIPPRIKTPPLEHHMAE

SEQ ID NO: 2545057 - protein, 29 aa, Entamoeba dispar
EDEKKILRLFLFGLYKMKALSPPVLRIVK

SEQ ID NO: 2545058 - protein, 22 aa, Entamoeba dispar
EDEQLWYWNYDGTKLPLYINST

SEQ ID NO: 2545059 - protein, 19 aa, Entamoeba dispar
EDFLKVLHFLLVKKKLPTK

SEQ ID NO: 2545060 - protein, 30 aa, Entamoeba dispar
EDKAMKELYPLFLWILSGLFPQITNVSSVK

SEQ ID NO: 2545061 - protein, 23 aa, Entamoeba dispar
EDKKVLFNSLALGIKMVMPKEVL

SEQ ID NO: 2545062 - protein, 17 aa, Entamoeba dispar
EDKLILVYGISLSAFLC

SEQ ID NO: 2545063 - protein, 23 aa, Entamoeba dispar
EDKPIFIDLSWRLDIVLSYKNVY

SEQ ID NO: 2545064 - protein, 24 aa, Entamoeba dispar
EDLIEFYMFFINALLPLTQSFQGQ

SEQ ID NO: 2545065 - protein, 23 aa, Entamoeba dispar
EDLITIPFNMFLKPLSLSPTTSS

SEQ ID NO: 2545066 - protein, 24 aa, Entamoeba dispar
EDLIYDSIFFIPLNRRINIVLKEL

SEQ ID NO: 2545067 - protein, 18 aa, Entamoeba dispar
EDNDHFVFCLYPSNDERT

SEQ ID NO: 2545068 - protein, 22 aa, Entamoeba dispar
EDQIYRTIFIQNLSFKTTEEEL

SEQ ID NO: 2545069 - protein, 18 aa, Entamoeba dispar
EDSKHFIFTLRNPHLVPP

SEQ ID NO: 2545070 - protein, 21 aa, Entamoeba dispar
EDVLLTCRWFFYIREKDSSIS

SEQ ID NO: 2545071 - protein, 26 aa, Entamoeba dispar
EDVNKFYTFWYSFKSWRDPPLDEMYN

SEQ ID NO: 2545072 - protein, 17 aa, Entamoeba dispar
EEDPYVLLFKRCDVNGD

SEQ ID NO: 2545073 - protein, 23 aa, Entamoeba dispar
EEGKGYIFIFPKNTWSYVNEYCS

SEQ ID NO: 2545074 - protein, 18 aa, Entamoeba dispar
EEGKLKIYLYPNKPFNPK

SEQ ID NO: 2545075 - protein, 21 aa, Entamoeba dispar
EEIIIPMLGIFFNFSQTDSKE

SEQ ID NO: 2545076 - protein, 18 aa, Entamoeba dispar
EEIKLYLLFYEKSYEMIK

SEQ ID NO: 2545077 - protein, 21 aa, Entamoeba dispar
EEKLFILISEKLTFLKNLSTI

SEQ ID NO: 2545078 - protein, 17 aa, Entamoeba dispar
EEKLKILPIIKKLEEEK

SEQ ID NO: 2545079 - protein, 25 aa, Entamoeba dispar
EEKSEEVIPFRLPPELVQASIQQEK

SEQ ID NO: 2545080 - protein, 17 aa, Entamoeba dispar
EELHFWPSFYLHAVLFN

SEQ ID NO: 2545081 - protein, 26 aa, Entamoeba dispar
EELIGIRRWLLVDSLLRAKSRIQEEI

SEQ ID NO: 2545082 - protein, 21 aa, Entamoeba dispar
EELKTLFIHLLRLCNKIAQNE

SEQ ID NO: 2545083 - protein, 25 aa, Entamoeba dispar
EENRLYKLLCWTGKDIWACIKPTNN

SEQ ID NO: 2545084 - protein, 27 aa, Entamoeba dispar
EENSYELCIIFILINEGFPENIIREAI

SEQ ID NO: 2545085 - protein, 18 aa, Entamoeba dispar
EENYFSEYLLLKEIILPS

SEQ ID NO: 2545086 - protein, 28 aa, Entamoeba dispar
EEQILHLKFDIGLLLRLILCLSRSLNYD

SEQ ID NO: 2545087 - protein, 17 aa, Entamoeba dispar
EESAVIEPCKYSYEGKI

SEQ ID NO: 2545088 - protein, 22 aa, Entamoeba dispar
EESLIILHILNYLLLWNKINNE

SEQ ID NO: 2545089 - protein, 19 aa, Entamoeba dispar
EEVTWNFILLIQQNIELQS

SEQ ID NO: 2545090 - protein, 19 aa, Entamoeba dispar
EEWLYYKKLYQKRLKDREL

SEQ ID NO: 2545091 - protein, 17 aa, Entamoeba dispar
EEWVFNRSFIPLKFSLD

SEQ ID NO: 2545092 - protein, 25 aa, Entamoeba dispar
EFCNKFKIPFLFFKSQHPLYKIKEI

SEQ ID NO: 2545093 - protein, 22 aa, Entamoeba dispar
EFCTYILFFLKAIPSVPEVAGL

SEQ ID NO: 2545094 - protein, 17 aa, Entamoeba dispar
EFFIAMACLNHYVLFKK

SEQ ID NO: 2545095 - protein, 19 aa, Entamoeba dispar
EFGWLFIKVLSLSDHFPYN

SEQ ID NO: 2545096 - protein, 30 aa, Entamoeba dispar
EFINLFNYLPLCVLLLQPIGTFFLCHGGIS

SEQ ID NO: 2545097 - protein, 17 aa, Entamoeba dispar
EFKLYQLLHVGLTVDIF

SEQ ID NO: 2545098 - protein, 20 aa, Entamoeba dispar
EFLHLFYCYSIHTQKGFFKI

SEQ ID NO: 2545099 - protein, 18 aa, Entamoeba dispar
EFLLVGWTPFLRCLFEIE

SEQ ID NO: 2545100 - protein, 19 aa, Entamoeba dispar
EFLTPNYYLNLFKSFEILY

SEQ ID NO: 2545101 - protein, 18 aa, Entamoeba dispar
EFMDIGCTCTLIYIWEEN

SEQ ID NO: 2545102 - protein, 23 aa, Entamoeba dispar
EFMKLKHMIILQNKIDLVKTKED

SEQ ID NO: 2545103 - protein, 25 aa, Entamoeba dispar
EFNSLMTPFIPILRFRMLKDIKQLP

SEQ ID NO: 2545104 - protein, 23 aa, Entamoeba dispar
EFWQHLCIILTNCYYYIPEKVIE

SEQ ID NO: 2545105 - protein, 17 aa, Entamoeba dispar
EFYFCDLNLIQDTFLKG

SEQ ID NO: 2545106 - protein, 23 aa, Entamoeba dispar
EGDPPYMEFPPLRALFLITTKGI

SEQ ID NO: 2545107 - protein, 17 aa, Entamoeba dispar
EGIHLVIFGTRWLRLLF

SEQ ID NO: 2545108 - protein, 23 aa, Entamoeba dispar
EGIPYMFPIPYKDEPSYLIYFMR

SEQ ID NO: 2545109 - protein, 22 aa, Entamoeba dispar
EGKVKCFGIFPKGFEKAAGPSF

SEQ ID NO: 2545110 - protein, 17 aa, Entamoeba dispar
EGLFYYFEIKDVLIFIV

SEQ ID NO: 2545111 - protein, 17 aa, Entamoeba dispar
EGLMAPIPLQQPIYKEP

SEQ ID NO: 2545112 - protein, 21 aa, Entamoeba dispar
EGLNWLVFNWCRGKGCILADE

SEQ ID NO: 2545113 - protein, 23 aa, Entamoeba dispar
EGLQSIIILTHLLYEVTKTWSTE

SEQ ID NO: 2545114 - protein, 19 aa, Entamoeba dispar
EGMFIRPTPRRLNVTIVPP

SEQ ID NO: 2545115 - protein, 25 aa, Entamoeba dispar
EGRKFQIPLWLAITLQNYGYVRIIV

SEQ ID NO: 2545116 - protein, 17 aa, Entamoeba dispar
EGRRNIFLALQYKRLFT

SEQ ID NO: 2545117 - protein, 17 aa, Entamoeba dispar
EGTAYMPLLKKLKVMFL

SEQ ID NO: 2545118 - protein, 18 aa, Entamoeba dispar
EHKIEWKLLIKKAENWLS

SEQ ID NO: 2545119 - protein, 20 aa, Entamoeba dispar
EHLLPGDWFGLFKKSSMSQK

SEQ ID NO: 2545120 - protein, 20 aa, Entamoeba dispar
EHMKIPLNDLLKDLLEEQEP

SEQ ID NO: 2545121 - protein, 18 aa, Entamoeba dispar
EHNSVFWAIKFYHTDTKT

SEQ ID NO: 2545122 - protein, 22 aa, Entamoeba dispar
EHSLLFILLIINYWLNLERKEY

SEQ ID NO: 2545123 - protein, 17 aa, Entamoeba dispar
EIAKFFRIVIVDALFIG

SEQ ID NO: 2545124 - protein, 22 aa, Entamoeba dispar
EIEKEMVCHVLTFKYPFNSEIT

SEQ ID NO: 2545125 - protein, 21 aa, Entamoeba dispar
EIETIYYWKYYLNLVLPQQMS

SEQ ID NO: 2545126 - protein, 21 aa, Entamoeba dispar
EIILTFKFLRECDEWYQMVLK

SEQ ID NO: 2545127 - protein, 24 aa, Entamoeba dispar
EIKKFIHNRLFKWKLKEITAKQLD

SEQ ID NO: 2545128 - protein, 23 aa, Entamoeba dispar
EIKNLLNWAYYLTPLDKKRSEKN

SEQ ID NO: 2545129 - protein, 18 aa, Entamoeba dispar
EILKSILFFIFKEKKEKI

SEQ ID NO: 2545130 - protein, 28 aa, Entamoeba dispar
EILNKYLKQLPLRYFIIPTIISKNNKAT

SEQ ID NO: 2545131 - protein, 19 aa, Entamoeba dispar
EILQYKFLIPIIPKLQANH

SEQ ID NO: 2545132 - protein, 22 aa, Entamoeba dispar
EILRLFEEELLDSSLKDFRDVI

SEQ ID NO: 2545133 - protein, 20 aa, Entamoeba dispar
EINFVWLYEAYFIHMSFHTE

SEQ ID NO: 2545134 - protein, 23 aa, Entamoeba dispar
EIQRQFLMKVIDWKIQMDLMINK

SEQ ID NO: 2545135 - protein, 17 aa, Entamoeba dispar
EIRTLLSILSLLCITQK

SEQ ID NO: 2545136 - protein, 19 aa, Entamoeba dispar
EIVAFPRLYYKTIPLPFDY

SEQ ID NO: 2545137 - protein, 23 aa, Entamoeba dispar
EIVKFIMILFESFILNKVKVQKS

SEQ ID NO: 2545138 - protein, 22 aa, Entamoeba dispar
EKDLLLFLPLYTTVLARGSTQP

SEQ ID NO: 2545139 - protein, 23 aa, Entamoeba dispar
EKEGIFFTPRYYGKFKAADALSK

SEQ ID NO: 2545140 - protein, 18 aa, Entamoeba dispar
EKEKEIILPLLKWKGKCI

SEQ ID NO: 2545141 - protein, 19 aa, Entamoeba dispar
EKFMFHQMLLKGELPLSIG

SEQ ID NO: 2545142 - protein, 22 aa, Entamoeba dispar
EKISFLLFFRITKVIQRLIDSL

SEQ ID NO: 2545143 - protein, 22 aa, Entamoeba dispar
EKKPILPKYLIKKIERQEEIKK

SEQ ID NO: 2545144 - protein, 23 aa, Entamoeba dispar
EKKPVFQLLLYFLVLDIDNENEE

SEQ ID NO: 2545145 - protein, 24 aa, Entamoeba dispar
EKLPSTCFLGRLRKFILPARLVME

SEQ ID NO: 2545146 - protein, 19 aa, Entamoeba dispar
EKLYYNPIPLNDYSRKLFP

SEQ ID NO: 2545147 - protein, 18 aa, Entamoeba dispar
EKTRTFPVLYVRGDLVVL

SEQ ID NO: 2545148 - protein, 29 aa, Entamoeba dispar
EKWAYPLCSQVYYYPIKSLVIELDNEPLK

SEQ ID NO: 2545149 - protein, 23 aa, Entamoeba dispar
EKYHIPYLFPIPYLSDEKYSIAF

SEQ ID NO: 2545150 - protein, 19 aa, Entamoeba dispar
EKYIYLLIVQFINELIKSK

SEQ ID NO: 2545151 - protein, 20 aa, Entamoeba dispar
EKYMKLLEKKGYLKDVTEEE

SEQ ID NO: 2545152 - protein, 17 aa, Entamoeba dispar
ELAPLPPLPPKVHGKRK

SEQ ID NO: 2545153 - protein, 31 aa, Entamoeba dispar
ELDKCGFIGLYYNQLHQWTGLTAPRVIYSCS

SEQ ID NO: 2545154 - protein, 18 aa, Entamoeba dispar
ELEFPLCFTVFSASLYSL

SEQ ID NO: 2545155 - protein, 19 aa, Entamoeba dispar
ELEGRPIILKWDRGLQSKV

SEQ ID NO: 2545156 - protein, 20 aa, Entamoeba dispar
ELEGRPIILKWDRGLQSKVS

SEQ ID NO: 2545157 - protein, 19 aa, Entamoeba dispar
ELFFRYFSLIQNSVYHRFA

SEQ ID NO: 2545158 - protein, 25 aa, Entamoeba dispar
ELGDPFYFISDALRFALVPFLDAAK

SEQ ID NO: 2545159 - protein, 21 aa, Entamoeba dispar
ELHPLLLKPSLFLLFNEAATK

SEQ ID NO: 2545160 - protein, 17 aa, Entamoeba dispar
ELIKQICFFLIPSVSLG

SEQ ID NO: 2545161 - protein, 22 aa, Entamoeba dispar
ELIPIFLERLVAFPLDKLTINY

SEQ ID NO: 2545162 - protein, 24 aa, Entamoeba dispar
ELLKTVMKLWLPAGVTLLEMIVLH

SEQ ID NO: 2545163 - protein, 26 aa, Entamoeba dispar
ELMKKYFGILFIKLPQEFIEFLEERD

SEQ ID NO: 2545164 - protein, 20 aa, Entamoeba dispar
ELNLLLIDILNMLGYTFTTT

SEQ ID NO: 2545165 - protein, 20 aa, Entamoeba dispar
ELNYFITWFADLFIDVFPVR

SEQ ID NO: 2545166 - protein, 26 aa, Entamoeba dispar
ELPFQIHKIFYFLYTIGYSSTGIFRL

SEQ ID NO: 2545167 - protein, 21 aa, Entamoeba dispar
ELPIELILKLFFYCFNHSPSI

SEQ ID NO: 2545168 - protein, 21 aa, Entamoeba dispar
ELPLFKRCIWRYPPQYFYLLL

SEQ ID NO: 2545169 - protein, 17 aa, Entamoeba dispar
ELPLLIIGSYYFRQRIQ

SEQ ID NO: 2545170 - protein, 23 aa, Entamoeba dispar
ELPVFHIGFFRPIIQVLQCVCKN

SEQ ID NO: 2545171 - protein, 19 aa, Entamoeba dispar
ELREIYYLLHPLKYTSKGI

SEQ ID NO: 2545172 - protein, 24 aa, Entamoeba dispar
ELRVPYWKLVYSLADKLRFNAFST

SEQ ID NO: 2545173 - protein, 17 aa, Entamoeba dispar
ELRVYLVYFYDDNLQRN

SEQ ID NO: 2545174 - protein, 17 aa, Entamoeba dispar
ELSLLHQWTGKQKLHVF

SEQ ID NO: 2545175 - protein, 21 aa, Entamoeba dispar
ELWYNFYYLFEGIFNHSLNES

SEQ ID NO: 2545176 - protein, 19 aa, Entamoeba dispar
ELYCFDLCILCNKAILINS

SEQ ID NO: 2545177 - protein, 17 aa, Entamoeba dispar
ELYSFYNSLPIIKTQTL

SEQ ID NO: 2545178 - protein, 24 aa, Entamoeba dispar
EMKKRLEMMFGKIKIGILGLEEMK

SEQ ID NO: 2545179 - protein, 20 aa, Entamoeba dispar
EMKQLDMVYLMKVALHVKDM

SEQ ID NO: 2545180 - protein, 19 aa, Entamoeba dispar
EMQLFLLRWVRLLFCQVYP

SEQ ID NO: 2545181 - protein, 18 aa, Entamoeba dispar
EMVFWYKYFSFLFKSENQ

SEQ ID NO: 2545182 - protein, 21 aa, Entamoeba dispar
ENALFLFRWMSLLLTEELPIN

SEQ ID NO: 2545183 - protein, 23 aa, Entamoeba dispar
ENDLIRLFYIYLLNSNESNLLQK

SEQ ID NO: 2545184 - protein, 17 aa, Entamoeba dispar
ENFFYNYALKKYAKKDK

SEQ ID NO: 2545185 - protein, 20 aa, Entamoeba dispar
ENFVLGNWFYWYLTVECGCT

SEQ ID NO: 2545186 - protein, 25 aa, Entamoeba dispar
ENGPKLYYWCIFKPKNKDPKPGILE

SEQ ID NO: 2545187 - protein, 21 aa, Entamoeba dispar
ENIEFPMYFVDSKGLQGFDNT

SEQ ID NO: 2545188 - protein, 19 aa, Entamoeba dispar
ENLPATWVAFFKKAGIKKK

SEQ ID NO: 2545189 - protein, 17 aa, Entamoeba dispar
ENLRFWPSILLHVVIKN

SEQ ID NO: 2545190 - protein, 24 aa, Entamoeba dispar
ENNTLMFFIPLINKGIYFLKYFRK

SEQ ID NO: 2545191 - protein, 17 aa, Entamoeba dispar
ENPPYFYYMYYTYANIA

SEQ ID NO: 2545192 - protein, 23 aa, Entamoeba dispar
ENSNTFIPILPFISKTFSKKLSF

SEQ ID NO: 2545193 - protein, 21 aa, Entamoeba dispar
EPFPRQYLIQRLQPIFDVFEI

SEQ ID NO: 2545194 - protein, 24 aa, Entamoeba dispar
EPSDWILFYLFNCVDREQYAMSSW

SEQ ID NO: 2545195 - protein, 17 aa, Entamoeba dispar
EPTPLILVLKLLLSLKL

SEQ ID NO: 2545196 - protein, 19 aa, Entamoeba dispar
EQDIRSILSKYPKFRFGTL

SEQ ID NO: 2545197 - protein, 22 aa, Entamoeba dispar
EQELFLMQYPTRLAWRPFDLSQ

SEQ ID NO: 2545198 - protein, 18 aa, Entamoeba dispar
EQENLIVLQLFKENVRCF

SEQ ID NO: 2545199 - protein, 19 aa, Entamoeba dispar
EQKTKLRDLFRKHGANWKM

SEQ ID NO: 2545200 - protein, 21 aa, Entamoeba dispar
EQLIFLIFYHFTVINDIFILD

SEQ ID NO: 2545201 - protein, 17 aa, Entamoeba dispar
EQLIKVVLLPQYPKDQL

SEQ ID NO: 2545202 - protein, 20 aa, Entamoeba dispar
EQLLKLHTLFYKKLTDRIDQ

SEQ ID NO: 2545203 - protein, 17 aa, Entamoeba dispar
EQLVFYNILQWLDNFDG

SEQ ID NO: 2545204 - protein, 25 aa, Entamoeba dispar
EQSKPVPPIPQKKPAPPTPSKCAPP

SEQ ID NO: 2545205 - protein, 24 aa, Entamoeba dispar
EQTEWVYLYLQLLRKIFKYNPRIG

SEQ ID NO: 2545206 - protein, 25 aa, Entamoeba dispar
EQVPKRWWKFAFDSLLIEVKKKNYK

SEQ ID NO: 2545207 - protein, 27 aa, Entamoeba dispar
EQYKAIIFIGPVWWWGLNAPIKNACNE

SEQ ID NO: 2545208 - protein, 20 aa, Entamoeba dispar
ERAMMLYISLFSQVFKTKEM

SEQ ID NO: 2545209 - protein, 22 aa, Entamoeba dispar
ERFHFNPIPLNEYSRKLFPNIE

SEQ ID NO: 2545210 - protein, 23 aa, Entamoeba dispar
ERFHFNPIPLNKYSRRFFPNIET

SEQ ID NO: 2545211 - protein, 22 aa, Entamoeba dispar
ERFMKVLYLERVLSEMLIANSH

SEQ ID NO: 2545212 - protein, 24 aa, Entamoeba dispar
ERQRFARMYLLNTPILYGKINVSK

SEQ ID NO: 2545213 - protein, 25 aa, Entamoeba dispar
ERRYIPELIGWIRKGFKIVKDSKRK

SEQ ID NO: 2545214 - protein, 24 aa, Entamoeba dispar
ERVNQCISLLFRYNIPTPNVESPT

SEQ ID NO: 2545215 - protein, 24 aa, Entamoeba dispar
ERVWQLIFNFLARKGCFMNYEKTK

SEQ ID NO: 2545216 - protein, 17 aa, Entamoeba dispar
ESALRLWYCFYSLLSDI

SEQ ID NO: 2545217 - protein, 21 aa, Entamoeba dispar
ESFILPFGKFFVIPKNNNRPL

SEQ ID NO: 2545218 - protein, 20 aa, Entamoeba dispar
ESFSFLHWYISDGSSVLNEM

SEQ ID NO: 2545219 - protein, 17 aa, Entamoeba dispar
ESFSFLHWYISDGSTVL

SEQ ID NO: 2545220 - protein, 25 aa, Entamoeba dispar
ESIKYIYELILSPPLSDRFTTFMEL

SEQ ID NO: 2545221 - protein, 22 aa, Entamoeba dispar
ESKEFIPFIPFSLHSTLSIANS

SEQ ID NO: 2545222 - protein, 24 aa, Entamoeba dispar
ESKIKDIFLLMKRMLINLDMDQIE

SEQ ID NO: 2545223 - protein, 23 aa, Entamoeba dispar
ESLGYLFVYLLKGTLPWQDLSSS

SEQ ID NO: 2545224 - protein, 28 aa, Entamoeba dispar
ESNPLLQFRLYQLLFKLLSEKKYPIDNY

SEQ ID NO: 2545225 - protein, 23 aa, Entamoeba dispar
ESRGFGYLDFFNINEAQRCIDEM

SEQ ID NO: 2545226 - protein, 18 aa, Entamoeba dispar
ESRKLEVNFLLLCQIKQI

SEQ ID NO: 2545227 - protein, 22 aa, Entamoeba dispar
ESTPLMIYLCKMKSILSELPIA

SEQ ID NO: 2545228 - protein, 17 aa, Entamoeba dispar
ESTVVCLRWLMGAEFIV

SEQ ID NO: 2545229 - protein, 24 aa, Entamoeba dispar
ESVKPIIIFWGLRICGLMLYSTAE

SEQ ID NO: 2545230 - protein, 22 aa, Entamoeba dispar
ETEGLEFILLNPPLEEMEKQME

SEQ ID NO: 2545231 - protein, 23 aa, Entamoeba dispar
ETENFEYILLFYKVFNKCSNSNE

SEQ ID NO: 2545232 - protein, 22 aa, Entamoeba dispar
ETFWLMYKLIELLSRYVIILLD

SEQ ID NO: 2545233 - protein, 23 aa, Entamoeba dispar
ETFWLMYKLIELLSRYVIILLDE

SEQ ID NO: 2545234 - protein, 22 aa, Entamoeba dispar
ETGKLKIYLYPNKPFNQVEESD

SEQ ID NO: 2545235 - protein, 23 aa, Entamoeba dispar
ETIQTYILMIRTIQRNRDRTMID

SEQ ID NO: 2545236 - protein, 23 aa, Entamoeba dispar
ETKVWQYITLLKNIYLIDCPGVV

SEQ ID NO: 2545237 - protein, 24 aa, Entamoeba dispar
ETRKLLFNYVALGVKLMNASNSNK

SEQ ID NO: 2545238 - protein, 23 aa, Entamoeba dispar
ETWPVPMFENLLPRHLQICYEIN

SEQ ID NO: 2545239 - protein, 24 aa, Entamoeba dispar
ETYVQYLPFIYKLNFIQKDNIFDL

SEQ ID NO: 2545240 - protein, 17 aa, Entamoeba dispar
EVFALIAALRILCPLNF

SEQ ID NO: 2545241 - protein, 21 aa, Entamoeba dispar
EVFIRFFPIIPLKNTKTQRDW

SEQ ID NO: 2545242 - protein, 24 aa, Entamoeba dispar
EVGLNRLYHLIANNLELMSQVQHT

SEQ ID NO: 2545243 - protein, 18 aa, Entamoeba dispar
EVHKKAVVMMYQSLIRDL

SEQ ID NO: 2545244 - protein, 21 aa, Entamoeba dispar
EVIIFPYIHYYNLNDFLLIKL

SEQ ID NO: 2545245 - protein, 18 aa, Entamoeba dispar
EVILLRRFVSFLQQRAEN

SEQ ID NO: 2545246 - protein, 24 aa, Entamoeba dispar
EVIQTFFVIQLLKEKFPENKVEWK

SEQ ID NO: 2545247 - protein, 17 aa, Entamoeba dispar
EVKFIQSIIPFKAIERK

SEQ ID NO: 2545248 - protein, 18 aa, Entamoeba dispar
EVLFYLLAQKLMNPKKFF

SEQ ID NO: 2545249 - protein, 17 aa, Entamoeba dispar
EVNFLLLCQIKQIEEWT

SEQ ID NO: 2545250 - protein, 22 aa, Entamoeba dispar
EVPRIMVCVLYPKIIKIDAAFI

SEQ ID NO: 2545251 - protein, 20 aa, Entamoeba dispar
EWFPPQWKVNFAKRLPIGNV

SEQ ID NO: 2545252 - protein, 17 aa, Entamoeba dispar
EWKFPVVVLHKIEFSPF

SEQ ID NO: 2545253 - protein, 20 aa, Entamoeba dispar
EWKLCLLFNDILLIAKIDVT

SEQ ID NO: 2545254 - protein, 25 aa, Entamoeba dispar
EYDRLRPLSYPSTDVFLICYSIMSK

SEQ ID NO: 2545255 - protein, 23 aa, Entamoeba dispar
EYERIRFLFLTSALLKAVDEHYD

SEQ ID NO: 2545256 - protein, 19 aa, Entamoeba dispar
EYIIHFYGVFIPNKICMIT

SEQ ID NO: 2545257 - protein, 17 aa, Entamoeba dispar
EYLKVQTPLFFVDYFRV

SEQ ID NO: 2545258 - protein, 17 aa, Entamoeba dispar
EYLTPFLKYPPFEESRK

SEQ ID NO: 2545259 - protein, 20 aa, Entamoeba dispar
EYRKAFYDFLKRILVWNPHH

SEQ ID NO: 2545260 - protein, 19 aa, Entamoeba dispar
EYSFYCLWILQSIVQNNPI

SEQ ID NO: 2545261 - protein, 17 aa, Entamoeba dispar
EYYQLLVRALATMLKFL

SEQ ID NO: 2545262 - protein, 30 aa, Entamoeba dispar
FAALFVPDEPIRFLPPIEKHWFPNYSGVSS

SEQ ID NO: 2545263 - protein, 25 aa, Entamoeba dispar
FADIPVLLMIPWKDDPLYKVYYFVS

SEQ ID NO: 2545264 - protein, 18 aa, Entamoeba dispar
FAIFILSNKITLQALIIS

SEQ ID NO: 2545265 - protein, 17 aa, Entamoeba dispar
FAKQKSIPIIYLISLYN

SEQ ID NO: 2545266 - protein, 17 aa, Entamoeba dispar
FALAYYVQQRKIVIELS

SEQ ID NO: 2545267 - protein, 17 aa, Entamoeba dispar
FATPFFLLKKAFECCVI

SEQ ID NO: 2545268 - protein, 21 aa, Entamoeba dispar
FAYKWIVLLFKRYISDSYLLR

SEQ ID NO: 2545269 - protein, 27 aa, Entamoeba dispar
FCSRNIITLLFIKYKVIEGLLQFVIQT

SEQ ID NO: 2545270 - protein, 19 aa, Entamoeba dispar
FCYCPNVVAFPLASVSPRS

SEQ ID NO: 2545271 - protein, 18 aa, Entamoeba dispar
FDDSLITIILDKIKQRIG

SEQ ID NO: 2545272 - protein, 17 aa, Entamoeba dispar
FDFFPSNKYPKFIDCKK

SEQ ID NO: 2545273 - protein, 23 aa, Entamoeba dispar
FDKLYLLLEALLSFIYPHFADQA

SEQ ID NO: 2545274 - protein, 24 aa, Entamoeba dispar
FDSLRPLSYPGTDIFLLCFAVIYE

SEQ ID NO: 2545275 - protein, 22 aa, Entamoeba dispar
FDTIIYFPNEPGKYIRAHSFIL

SEQ ID NO: 2545276 - protein, 17 aa, Entamoeba dispar
FDVFLDFGVKLDLGLTG

SEQ ID NO: 2545277 - protein, 17 aa, Entamoeba dispar
FEDRYDLLNYCMNTNTE

SEQ ID NO: 2545278 - protein, 18 aa, Entamoeba dispar
FEEKKWYEFFSFKGKRIG

SEQ ID NO: 2545279 - protein, 18 aa, Entamoeba dispar
FEHKYDSLKLNMKKVPFI

SEQ ID NO: 2545280 - protein, 17 aa, Entamoeba dispar
FEIVFDKEYYFVCKDKC

SEQ ID NO: 2545281 - protein, 17 aa, Entamoeba dispar
FEKTIHFILITFPSLET

SEQ ID NO: 2545282 - protein, 20 aa, Entamoeba dispar
FEMYPMRVLMLIAQNPPPKL

SEQ ID NO: 2545283 - protein, 17 aa, Entamoeba dispar
FENRYHRLFIKLALKKF

SEQ ID NO: 2545284 - protein, 17 aa, Entamoeba dispar
FERINGLILIRFIEEIS

SEQ ID NO: 2545285 - protein, 19 aa, Entamoeba dispar
FERMYCLFYPLDEKARCVL

SEQ ID NO: 2545286 - protein, 17 aa, Entamoeba dispar
FETYSSRNWGRCILQHF

SEQ ID NO: 2545287 - protein, 19 aa, Entamoeba dispar
FEVQWLPWHNEHVLEKFIM

SEQ ID NO: 2545288 - protein, 17 aa, Entamoeba dispar
FFFLYKSSNESSPIQIL

SEQ ID NO: 2545289 - protein, 25 aa, Entamoeba dispar
FFMDNFMMPIYLHDSLLRAQNFSAL

SEQ ID NO: 2545290 - protein, 17 aa, Entamoeba dispar
FFNSKYYIKEHTFLLLY

SEQ ID NO: 2545291 - protein, 18 aa, Entamoeba dispar
FFQNFLKNVLELLTKSTI

SEQ ID NO: 2545292 - protein, 18 aa, Entamoeba dispar
FFSSLYQLIFHPIKFFTP

SEQ ID NO: 2545293 - protein, 21 aa, Entamoeba dispar
FFTLSFLILSYTIQVTPEHLN

SEQ ID NO: 2545294 - protein, 19 aa, Entamoeba dispar
FFTQFLYFNYLPVRRIATE

SEQ ID NO: 2545295 - protein, 20 aa, Entamoeba dispar
FGAPMHCLLIPAPQIDDPEL

SEQ ID NO: 2545296 - protein, 24 aa, Entamoeba dispar
FGATPTFWYSLYQEFLFETKGLKE

SEQ ID NO: 2545297 - protein, 21 aa, Entamoeba dispar
FGDLWVEFLLRESGSLDAQKP

SEQ ID NO: 2545298 - protein, 20 aa, Entamoeba dispar
FGFPLQFKIPLAFSLSVVAN

SEQ ID NO: 2545299 - protein, 23 aa, Entamoeba dispar
FGFRNICEWIKKIKTPYYLYAFS

SEQ ID NO: 2545300 - protein, 17 aa, Entamoeba dispar
FGGLIAWLRMYATDEFL

SEQ ID NO: 2545301 - protein, 18 aa, Entamoeba dispar
FGIFMYEILYGRTPFFSR

SEQ ID NO: 2545302 - protein, 25 aa, Entamoeba dispar
FGKKMKFKWYKLKIPSFITSACVLK

SEQ ID NO: 2545303 - protein, 17 aa, Entamoeba dispar
FGLLQLIMFLKGVGLSM

SEQ ID NO: 2545304 - protein, 17 aa, Entamoeba dispar
FGMMRGFIPNNMPMGGF

SEQ ID NO: 2545305 - protein, 18 aa, Entamoeba dispar
FGWLFIKVLSLSDHFPYN

SEQ ID NO: 2545306 - protein, 17 aa, Entamoeba dispar
FHLLFTLKQGLTRFIDE

SEQ ID NO: 2545307 - protein, 18 aa, Entamoeba dispar
FHPFLPWIYSTGADGTIQ

SEQ ID NO: 2545308 - protein, 18 aa, Entamoeba dispar
FHPRDLLMLIWDKLKEDG

SEQ ID NO: 2545309 - protein, 26 aa, Entamoeba dispar
FHTWKKRWFVMKDQYIWYFPKNTGSA

SEQ ID NO: 2545310 - protein, 17 aa, Entamoeba dispar
FHYLQPYSNFISLIDFG

SEQ ID NO: 2545311 - protein, 17 aa, Entamoeba dispar
FIFIQKYPQKEIALEEY

SEQ ID NO: 2545312 - protein, 18 aa, Entamoeba dispar
FIFLISLQLEIVSCQEMI

SEQ ID NO: 2545313 - protein, 17 aa, Entamoeba dispar
FIFVTYSIPVELSIKIK

SEQ ID NO: 2545314 - protein, 22 aa, Entamoeba dispar
  misc_feature (22)..(22): Xaa can be any naturally occurring amino acid
FIIFNLIMKLIRPLYLIQTNTX

SEQ ID NO: 2545315 - protein, 18 aa, Entamoeba dispar
FIIIDGILQFLKFEKITE

SEQ ID NO: 2545316 - protein, 20 aa, Entamoeba dispar
FIITCKLLPLIRKTLNSRII

SEQ ID NO: 2545317 - protein, 17 aa, Entamoeba dispar
FILIKNILKKYPSLLIE

SEQ ID NO: 2545318 - protein, 19 aa, Entamoeba dispar
FILISYFDLRDAKTVYRLL

SEQ ID NO: 2545319 - protein, 18 aa, Entamoeba dispar
FILISYFDLRDVKTVYRL

SEQ ID NO: 2545320 - protein, 18 aa, Entamoeba dispar
FILKLLPKDKLLALRVIE

SEQ ID NO: 2545321 - protein, 26 aa, Entamoeba dispar
FILMSLEYLYFDSVWVTLKMELLDEE

SEQ ID NO: 2545322 - protein, 18 aa, Entamoeba dispar
FIPYIPTLSKFLSYQKCH

SEQ ID NO: 2545323 - protein, 18 aa, Entamoeba dispar
FIREGWGCLLMNSGIWER

SEQ ID NO: 2545324 - protein, 18 aa, Entamoeba dispar
FIRIGMPIPFYVLKRNIA

SEQ ID NO: 2545325 - protein, 19 aa, Entamoeba dispar
FISFKILTLLYPQPIWNLT

SEQ ID NO: 2545326 - protein, 17 aa, Entamoeba dispar
FISLFKYSTPEDLFDLL

SEQ ID NO: 2545327 - protein, 20 aa, Entamoeba dispar
FITSLQPCFPRYLSLLFPND

SEQ ID NO: 2545328 - protein, 17 aa, Entamoeba dispar
FIWSWKKGKILKVFEHA

SEQ ID NO: 2545329 - protein, 20 aa, Entamoeba dispar
FIYFENILGTLPWNSLTDSP

SEQ ID NO: 2545330 - protein, 18 aa, Entamoeba dispar
FIYMYQWFKSFVNESEHQ

SEQ ID NO: 2545331 - protein, 22 aa, Entamoeba dispar
FKEMKPWFRGWTGQLRKNKDGS

SEQ ID NO: 2545332 - protein, 20 aa, Entamoeba dispar
FKEVIWYPVSYLTYLKEKEA

SEQ ID NO: 2545333 - protein, 25 aa, Entamoeba dispar
FKFDLYIFEYYLMIQLYSITKDDLS

SEQ ID NO: 2545334 - protein, 22 aa, Entamoeba dispar
FKFNFSFRLIEILTLVALCRDE

SEQ ID NO: 2545335 - protein, 25 aa, Entamoeba dispar
FKKIAFIEFLLYKYNQTIKELMARP

SEQ ID NO: 2545336 - protein, 19 aa, Entamoeba dispar
FKKLEYMFLLRQCGAKIVK

SEQ ID NO: 2545337 - protein, 17 aa, Entamoeba dispar
FKKQILMYLVPLKLRCG

SEQ ID NO: 2545338 - protein, 17 aa, Entamoeba dispar
FKLLLIGDSGVGKSCLL

SEQ ID NO: 2545339 - protein, 27 aa, Entamoeba dispar
FKRIDTLLYLLYYPQIPMVKTKTIDMI

SEQ ID NO: 2545340 - protein, 20 aa, Entamoeba dispar
FKTFPKYFIMSIKLFEMGYY

SEQ ID NO: 2545341 - protein, 24 aa, Entamoeba dispar
FKTQRLFFLFYLSCMTKIIRCKRR

SEQ ID NO: 2545342 - protein, 23 aa, Entamoeba dispar
FKTVYVILKDNFFFLYKSSNESS

SEQ ID NO: 2545343 - protein, 17 aa, Entamoeba dispar
FKYFEPTFIYILHALHE

SEQ ID NO: 2545344 - protein, 17 aa, Entamoeba dispar
FKYLIKKINLFNILINI

SEQ ID NO: 2545345 - protein, 18 aa, Entamoeba dispar
FLDMLFKKSINEPKFASL

SEQ ID NO: 2545346 - protein, 22 aa, Entamoeba dispar
FLFEWYMVWFCRILPCDFCYAI

SEQ ID NO: 2545347 - protein, 19 aa, Entamoeba dispar
FLGEICNGLWYLHFTKRLI

SEQ ID NO: 2545348 - protein, 18 aa, Entamoeba dispar
FLIGLLATFGYELKINKL

SEQ ID NO: 2545349 - protein, 17 aa, Entamoeba dispar
FLIILPFLSSLNTVINI

SEQ ID NO: 2545350 - protein, 18 aa, Entamoeba dispar
FLIYLLKKGTNLKTINPN

SEQ ID NO: 2545351 - protein, 20 aa, Entamoeba dispar
FLMVFSKFLHLLSASYLHPN

SEQ ID NO: 2545352 - protein, 20 aa, Entamoeba dispar
FLNFSPFFIVYRNFLINHNK

SEQ ID NO: 2545353 - protein, 17 aa, Entamoeba dispar
FLNNWVLILRKLYKTNT

SEQ ID NO: 2545354 - protein, 26 aa, Entamoeba dispar
FLPILFNGKKFGIPLLIGFTYEYPIS

SEQ ID NO: 2545355 - protein, 17 aa, Entamoeba dispar
FLSLVFFIAKKSNTRIE

SEQ ID NO: 2545356 - protein, 19 aa, Entamoeba dispar
FLTFLKICNYLLTSPLYSQ

SEQ ID NO: 2545357 - protein, 17 aa, Entamoeba dispar
FMDLLKKLSLQKEVKNL

SEQ ID NO: 2545358 - protein, 17 aa, Entamoeba dispar
FMEILACTYIFGTSMPR

SEQ ID NO: 2545359 - protein, 24 aa, Entamoeba dispar
FMFEWNYLWFIHSLKFELAIRVFD

SEQ ID NO: 2545360 - protein, 18 aa, Entamoeba dispar
FMIFAGILIRNSPQQPPL

SEQ ID NO: 2545361 - protein, 20 aa, Entamoeba dispar
FMKRVFYLMKEPQYLDWRLN

SEQ ID NO: 2545362 - protein, 21 aa, Entamoeba dispar
FMKRVFYLMKEPQYLDWRLNS

SEQ ID NO: 2545363 - protein, 23 aa, Entamoeba dispar
FNCQIPIIHLLFPIALKYSLIQC

SEQ ID NO: 2545364 - protein, 28 aa, Entamoeba dispar
FNDGRIFTYVIWYPVSYLTYLKEKGTGN

SEQ ID NO: 2545365 - protein, 30 aa, Entamoeba dispar
FNKPIPHDFPFPPIFPLYQPSLRSQISAKY

SEQ ID NO: 2545366 - protein, 22 aa, Entamoeba dispar
FNLCWWIYTYGYLVEGIFRVSG

SEQ ID NO: 2545367 - protein, 19 aa, Entamoeba dispar
FNLDLCEFIFWGMVRYCTD

SEQ ID NO: 2545368 - protein, 18 aa, Entamoeba dispar
FNLFFSYHYYVDLLCESM

SEQ ID NO: 2545369 - protein, 20 aa, Entamoeba dispar
FNNFPFILLPHRNGQLQLAN

SEQ ID NO: 2545370 - protein, 17 aa, Entamoeba dispar
FNPFPLNYYSRKLFPNI

SEQ ID NO: 2545371 - protein, 23 aa, Entamoeba dispar
FNPISTIIFLPLANLQSFVMQFC

SEQ ID NO: 2545372 - protein, 21 aa, Entamoeba dispar
FNPKRILLVGGVLRSEEQLTV

SEQ ID NO: 2545373 - protein, 19 aa, Entamoeba dispar
FNVYFFLNVIIENGFTIVP

SEQ ID NO: 2545374 - protein, 21 aa, Entamoeba dispar
FPDGFYLYFYKRFPGLLILVY

SEQ ID NO: 2545375 - protein, 17 aa, Entamoeba dispar
FPFIQYQPPNTSKVLCL

SEQ ID NO: 2545376 - protein, 20 aa, Entamoeba dispar
FPFPHYIILHDLNTLPNVLA

SEQ ID NO: 2545377 - protein, 18 aa, Entamoeba dispar
FPHYIILHDLNTLPNVLA

SEQ ID NO: 2545378 - protein, 17 aa, Entamoeba dispar
FPLCFTVFSASLYSLNN

SEQ ID NO: 2545379 - protein, 23 aa, Entamoeba dispar
FPSNIVYLFLFNDIIVETKVIRF

SEQ ID NO: 2545380 - protein, 26 aa, Entamoeba dispar
FPVIIKWIYELTPWEILIFPQGVHRI

SEQ ID NO: 2545381 - protein, 26 aa, Entamoeba dispar
FPYYLEASYPFWILRLVWKKQNKSFN

SEQ ID NO: 2545382 - protein, 18 aa, Entamoeba dispar
FQCELEPKEWLNISLIIL

SEQ ID NO: 2545383 - protein, 21 aa, Entamoeba dispar
FQENILFRFYLKFIGSPIATK

SEQ ID NO: 2545384 - protein, 24 aa, Entamoeba dispar
FQEQAIWMLNAMWPKDQGKSAEEL

SEQ ID NO: 2545385 - protein, 20 aa, Entamoeba dispar
FQFKTLPVQVLLKLQQRKLD

SEQ ID NO: 2545386 - protein, 20 aa, Entamoeba dispar
FQKIWRYLVPFYIRCGLHPI

SEQ ID NO: 2545387 - protein, 17 aa, Entamoeba dispar
FQPLLWKPKNEKYSKKK

SEQ ID NO: 2545388 - protein, 24 aa, Entamoeba dispar
FQQSDPILIVYFLEQIPLVGKVYG

SEQ ID NO: 2545389 - protein, 17 aa, Entamoeba dispar
FQTLNDLLIDKITWWAG

SEQ ID NO: 2545390 - protein, 20 aa, Entamoeba dispar
FQTLQYWTGFNHIQIIYDSN

SEQ ID NO: 2545391 - protein, 18 aa, Entamoeba dispar
FQYNCYGLYFAHCMALPQ

SEQ ID NO: 2545392 - protein, 21 aa, Entamoeba dispar
FRGFRMLLTICYDTRFPMFVR

SEQ ID NO: 2545393 - protein, 18 aa, Entamoeba dispar
FRISNLFWMTYRSGYEKL

SEQ ID NO: 2545394 - protein, 18 aa, Entamoeba dispar
FRNAMGGVIMFDVSNRQS

SEQ ID NO: 2545395 - protein, 18 aa, Entamoeba dispar
FRNLLTEQPFLFTLTEYF

SEQ ID NO: 2545396 - protein, 17 aa, Entamoeba dispar
FRPKFGKLQLVNGKIIE

SEQ ID NO: 2545397 - protein, 17 aa, Entamoeba dispar
FSEPRDFIDLYFFYPTI

SEQ ID NO: 2545398 - protein, 18 aa, Entamoeba dispar
FSFMIIYPNSVFLARGNH

SEQ ID NO: 2545399 - protein, 20 aa, Entamoeba dispar
FSGGFIFMYDIRYITDLIRS

SEQ ID NO: 2545400 - protein, 18 aa, Entamoeba dispar
FSICALLCSLFKFYHKLT

SEQ ID NO: 2545401 - protein, 20 aa, Entamoeba dispar
FSILPQFMYHLRRSHFLQVF

SEQ ID NO: 2545402 - protein, 21 aa, Entamoeba dispar
FSKLQIYYIPSLGIAPSWCSF

SEQ ID NO: 2545403 - protein, 17 aa, Entamoeba dispar
FSKYVINLSYLCIMACC

SEQ ID NO: 2545404 - protein, 26 aa, Entamoeba dispar
FSLLDNVLMDIPKWVKVYSSEIVISK

SEQ ID NO: 2545405 - protein, 23 aa, Entamoeba dispar
FSSNRFFLFVFNGALNSTFKRKT

SEQ ID NO: 2545406 - protein, 24 aa, Entamoeba dispar
FTETTICLLFPSPFFQLIPNKIDE

SEQ ID NO: 2545407 - protein, 17 aa, Entamoeba dispar
FTFPDGHSILLLAEGRL

SEQ ID NO: 2545408 - protein, 23 aa, Entamoeba dispar
FTKLPPYNSPIIDIPFFLKEDQI

SEQ ID NO: 2545409 - protein, 20 aa, Entamoeba dispar
FTKYLIKYQGKPSIFQGRKG

SEQ ID NO: 2545410 - protein, 24 aa, Entamoeba dispar
FTMKDFVLSKALRFPMGLQFEELQ

SEQ ID NO: 2545411 - protein, 24 aa, Entamoeba dispar
FTTQYIEMVLFYIQVFRTPKLTKF

SEQ ID NO: 2545412 - protein, 18 aa, Entamoeba dispar
FVCVAIAGWIFSAKIPET

SEQ ID NO: 2545413 - protein, 21 aa, Entamoeba dispar
FVDLIEICRLFCLGGASKEKT

SEQ ID NO: 2545414 - protein, 21 aa, Entamoeba dispar
FVDPLHWLQYFPPLGVEDLKL

SEQ ID NO: 2545415 - protein, 17 aa, Entamoeba dispar
FVFFLFKPFYFRIFLMY

SEQ ID NO: 2545416 - protein, 17 aa, Entamoeba dispar
FVFSLRSKELTQPVMIQ

SEQ ID NO: 2545417 - protein, 24 aa, Entamoeba dispar
FVFVYQWLILLFKREFSLSNIFRI

SEQ ID NO: 2545418 - protein, 17 aa, Entamoeba dispar
FVKNLPFDLTDESFKKL

SEQ ID NO: 2545419 - protein, 19 aa, Entamoeba dispar
FVQQSLRLWWNVMRHMSLL

SEQ ID NO: 2545420 - protein, 22 aa, Entamoeba dispar
FVRYNWIYPFLTKESFYKFGRD

SEQ ID NO: 2545421 - protein, 18 aa, Entamoeba dispar
FVVSYYLALDPSLHSLIF

SEQ ID NO: 2545422 - protein, 18 aa, Entamoeba dispar
FWEIARMYDFYLLRLLIR

SEQ ID NO: 2545423 - protein, 22 aa, Entamoeba dispar
FWQHLCIIWTNCYYHIPKLVKE

SEQ ID NO: 2545424 - protein, 18 aa, Entamoeba dispar
FYDFLKRILVWNPHHRLR

SEQ ID NO: 2545425 - protein, 17 aa, Entamoeba dispar
FYGYWLKVNKTYIIDPM

SEQ ID NO: 2545426 - protein, 17 aa, Entamoeba dispar
FYIFKVNAKGRWIGRTI

SEQ ID NO: 2545427 - protein, 19 aa, Entamoeba dispar
FYKVLPLRQPMLMVGLGGC

SEQ ID NO: 2545428 - protein, 17 aa, Entamoeba dispar
FYLIKNADTIRLMDQNN

SEQ ID NO: 2545429 - protein, 21 aa, Entamoeba dispar
FYLSLLFLKYAQVFTPQYGDI

SEQ ID NO: 2545430 - protein, 17 aa, Entamoeba dispar
FYNYLLPLYLENKFHVQ

SEQ ID NO: 2545431 - protein, 17 aa, Entamoeba dispar
FYSYVYYQIFFSKGINL

SEQ ID NO: 2545432 - protein, 23 aa, Entamoeba dispar
GAINCFFYPIIPFKWIADETVTS

SEQ ID NO: 2545433 - protein, 18 aa, Entamoeba dispar
GAPLPIEFKWKIPITKKK

SEQ ID NO: 2545434 - protein, 29 aa, Entamoeba dispar
GATASQVLGLLWQLIDYDLRKTLGSMDCE

SEQ ID NO: 2545435 - protein, 22 aa, Entamoeba dispar
GCGMYWMFGLLLGAGFKQIGVI

SEQ ID NO: 2545436 - protein, 22 aa, Entamoeba dispar
GCSMLTFVYIPSSVKKIGSYCF

SEQ ID NO: 2545437 - protein, 18 aa, Entamoeba dispar
GCTCTLIYIWEENNKIYI

SEQ ID NO: 2545438 - protein, 20 aa, Entamoeba dispar
GCYYLITKGWSFLFSKEKRT

SEQ ID NO: 2545439 - protein, 23 aa, Entamoeba dispar
GDAKWKVEQLLNNQWKKLELEIN

SEQ ID NO: 2545440 - protein, 34 aa, Entamoeba dispar
GDDGKYWRHIYKSLLLIYYIIINGTPEAVERFKR

SEQ ID NO: 2545441 - protein, 27 aa, Entamoeba dispar
GDDGRPIPFWLYKLHGLGTEFKCEICG

SEQ ID NO: 2545442 - protein, 18 aa, Entamoeba dispar
GDESLPFVLLNYKDNQQL

SEQ ID NO: 2545443 - protein, 25 aa, Entamoeba dispar
GDLFDPFLRPYFANGYIPVTQGDVI

SEQ ID NO: 2545444 - protein, 17 aa, Entamoeba dispar
GEIQQFLSLIFFIGQKS

SEQ ID NO: 2545445 - protein, 24 aa, Entamoeba dispar
GEMKQLDMVYLMKVALHVFDMNDI

SEQ ID NO: 2545446 - protein, 25 aa, Entamoeba dispar
GERTINLFLIRWKNNFHYVIDEKVA

SEQ ID NO: 2545447 - protein, 25 aa, Entamoeba dispar
GFFDNLYQMIFHPIEYFSPKETKLG

SEQ ID NO: 2545448 - protein, 19 aa, Entamoeba dispar
GFLPSFFMITVIRELLKDC

SEQ ID NO: 2545449 - protein, 20 aa, Entamoeba dispar
GFMHPYSYGLFYPKQFENAK

SEQ ID NO: 2545450 - protein, 19 aa, Entamoeba dispar
GFVFLRLFCPALAAPEGSN

SEQ ID NO: 2545451 - protein, 31 aa, Entamoeba dispar
GFWAPMWRVWIFLLRGLIPILERWLGNLLAR

SEQ ID NO: 2545452 - protein, 24 aa, Entamoeba dispar
GGHSLFNWSFFPPSTFISNVSSHP

SEQ ID NO: 2545453 - protein, 25 aa, Entamoeba dispar
GGSDALFFFQYTKLPMNILSKIWSL

SEQ ID NO: 2545454 - protein, 17 aa, Entamoeba dispar
GGYSWWRRNSLTVFLDK

SEQ ID NO: 2545455 - protein, 22 aa, Entamoeba dispar
GHHFNPCLFERGADGWKFVKEL

SEQ ID NO: 2545456 - protein, 17 aa, Entamoeba dispar
GHHWTLISQFIPGRAPN

SEQ ID NO: 2545457 - protein, 24 aa, Entamoeba dispar
GHVPKLMCPLFYLGFCPYGKKCKF

SEQ ID NO: 2545458 - protein, 19 aa, Entamoeba dispar
GIHGYPTITFFPKDFKYGK

SEQ ID NO: 2545459 - protein, 18 aa, Entamoeba dispar
GIIFKEVIWYPVSYLTYL

SEQ ID NO: 2545460 - protein, 26 aa, Entamoeba dispar
GIITKYIYFFFIKSPLPFISHKLFLV

SEQ ID NO: 2545461 - protein, 18 aa, Entamoeba dispar
GILLLLFGGVHKTTKEGI

SEQ ID NO: 2545462 - protein, 19 aa, Entamoeba dispar
GINPWYIWQIIPNINENDK

SEQ ID NO: 2545463 - protein, 28 aa, Entamoeba dispar
GIPGFPVNFLQYFQLFPSVFNTSINRQP

SEQ ID NO: 2545464 - protein, 18 aa, Entamoeba dispar
GIPVFWFQVLKNSMLFDS

SEQ ID NO: 2545465 - protein, 18 aa, Entamoeba dispar
GIVLFELLEGYPPHYELR

SEQ ID NO: 2545466 - protein, 20 aa, Entamoeba dispar
GIVPYFFLVERKAVIQYASV

SEQ ID NO: 2545467 - protein, 21 aa, Entamoeba dispar
GIYAYLLFLLTKIEPLKKLSN

SEQ ID NO: 2545468 - protein, 22 aa, Entamoeba dispar
GIYCFSRCLLILINIPSSISKI

SEQ ID NO: 2545469 - protein, 19 aa, Entamoeba dispar
GKEILTVKLLLLFGDRIFS

SEQ ID NO: 2545470 - protein, 22 aa, Entamoeba dispar
GKEKLCFEIFYDKVYTFCCPSQ

SEQ ID NO: 2545471 - protein, 22 aa, Entamoeba dispar
GKFDIIYSSPLRRALVTAKKIA

SEQ ID NO: 2545472 - protein, 18 aa, Entamoeba dispar
GKFNEIFLLNSWFSSNPN

SEQ ID NO: 2545473 - protein, 22 aa, Entamoeba dispar
GKGFFPKLLNFICNPNGVIVMV

SEQ ID NO: 2545474 - protein, 22 aa, Entamoeba dispar
GKIFKQLIWYPVSYDEFLKQKE

SEQ ID NO: 2545475 - protein, 23 aa, Entamoeba dispar
GKIFKYVIWYLVEYSKYLQEKEK

SEQ ID NO: 2545476 - protein, 19 aa, Entamoeba dispar
GKIPLISKFFRDVSLIDPQ

SEQ ID NO: 2545477 - protein, 21 aa, Entamoeba dispar
GKLFVWEWDNWEYPKNSLKGH

SEQ ID NO: 2545478 - protein, 22 aa, Entamoeba dispar
GKPVKLFLDTLSSYKIIFPRIQ

SEQ ID NO: 2545479 - protein, 21 aa, Entamoeba dispar
GKTCIFFRWTSDMKQPHIDRI

SEQ ID NO: 2545480 - protein, 20 aa, Entamoeba dispar
GKTCLLLTYTTNSFPDSYVP

SEQ ID NO: 2545481 - protein, 18 aa, Entamoeba dispar
GKYFIKYMRNIPIHFQWF

SEQ ID NO: 2545482 - protein, 18 aa, Entamoeba dispar
GKYFNFIKEYILSRKLLI

SEQ ID NO: 2545483 - protein, 25 aa, Entamoeba dispar
GLEKALKYLFLNGLNKEGLFRLSST

SEQ ID NO: 2545484 - protein, 18 aa, Entamoeba dispar
GLFFIRLLGNYFVTNLES

SEQ ID NO: 2545485 - protein, 17 aa, Entamoeba dispar
GLIILYHYIKVDPLPLL

SEQ ID NO: 2545486 - protein, 18 aa, Entamoeba dispar
GLLIPPINFYIPDEPIFP

SEQ ID NO: 2545487 - protein, 22 aa, Entamoeba dispar
GLLKRYFYLMKEPSYIDWKLNN

SEQ ID NO: 2545488 - protein, 17 aa, Entamoeba dispar
GLMNCWSTLRLCVEHQF

SEQ ID NO: 2545489 - protein, 24 aa, Entamoeba dispar
GLRQKIIFYLWTPEGCKIREKMLY

SEQ ID NO: 2545490 - protein, 21 aa, Entamoeba dispar
GLWISILLVMKTGGDVFFCTD

SEQ ID NO: 2545491 - protein, 20 aa, Entamoeba dispar
GLYVLMLLDYIFKYIERYPS

SEQ ID NO: 2545492 - protein, 18 aa, Entamoeba dispar
GMCFFWHSKVDLPFRIVI

SEQ ID NO: 2545493 - protein, 17 aa, Entamoeba dispar
GMMMLNKLKNIYQVINE

SEQ ID NO: 2545494 - protein, 24 aa, Entamoeba dispar
GMQMGGIRMGIPVGFNPASVQLKA

SEQ ID NO: 2545495 - protein, 24 aa, Entamoeba dispar
GNEIRFILRILKGVFRIGFTDRSL

SEQ ID NO: 2545496 - protein, 24 aa, Entamoeba dispar
GNEKRIILLLKLLSKWEFESLNEE

SEQ ID NO: 2545497 - protein, 23 aa, Entamoeba dispar
GNGGLVQWAPFLADLFMLARRDE

SEQ ID NO: 2545498 - protein, 18 aa, Entamoeba dispar
GNIQQFLSLVFFIAKKSN

SEQ ID NO: 2545499 - protein, 22 aa, Entamoeba dispar
GNKKWIITLLYELSVYKDQLLN

SEQ ID NO: 2545500 - protein, 23 aa, Entamoeba dispar
GNLFINYLYLLLKEYSYIMEIPC

SEQ ID NO: 2545501 - protein, 22 aa, Entamoeba dispar
GNQLLVLTGFLPILFNGKKFGI

SEQ ID NO: 2545502 - protein, 24 aa, Entamoeba dispar
GNVLKKYLNLMPNKLPISLQTVDV

SEQ ID NO: 2545503 - protein, 22 aa, Entamoeba dispar
GNYFRNAMATIIMFDVSNKESF

SEQ ID NO: 2545504 - protein, 18 aa, Entamoeba dispar
GPSFHFKLFNLMKPKDIK

SEQ ID NO: 2545505 - protein, 31 aa, Entamoeba dispar
GQKSLLALSLILAILLYKPSPLYILDEVDAA

SEQ ID NO: 2545506 - protein, 21 aa, Entamoeba dispar
GQMNGVPRFDQMPGYSQMGGM

SEQ ID NO: 2545507 - protein, 25 aa, Entamoeba dispar
GQYDTLHFILLMRSLIITPFNKQNG

SEQ ID NO: 2545508 - protein, 20 aa, Entamoeba dispar
GRFYPIIPLKFTEGEFKWLG

SEQ ID NO: 2545509 - protein, 20 aa, Entamoeba dispar
GRIFKEIIWYLVDYSTYLKE

SEQ ID NO: 2545510 - protein, 23 aa, Entamoeba dispar
GRIFKYVIWYKVDYSRYLQEKKQ

SEQ ID NO: 2545511 - protein, 29 aa, Entamoeba dispar
GRSLGYYVVPLLLILPFGKGSTTVTLNGI

SEQ ID NO: 2545512 - protein, 24 aa, Entamoeba dispar
GRSNILIIVLTTKGYVFGSFSSIQ

SEQ ID NO: 2545513 - protein, 22 aa, Entamoeba dispar
GRSNVMFIFRTIDQHIFGCFNK

SEQ ID NO: 2545514 - protein, 23 aa, Entamoeba dispar
GSIGFFEFLALWNFMNLCNETFK

SEQ ID NO: 2545515 - protein, 26 aa, Entamoeba dispar
GSKVYWKWFLALDEIPRRSGAREAPS

SEQ ID NO: 2545516 - protein, 17 aa, Entamoeba dispar
GSKYWIYGVIPLNNISA

SEQ ID NO: 2545517 - protein, 22 aa, Entamoeba dispar
GSLFIYLFRLMLATGIPELKNE

SEQ ID NO: 2545518 - protein, 22 aa, Entamoeba dispar
GSLFIYLFRLMLATGIPELQHE

SEQ ID NO: 2545519 - protein, 26 aa, Entamoeba dispar
GTGKTFAYLIPLIQFVLKLPKLTEET

SEQ ID NO: 2545520 - protein, 24 aa, Entamoeba dispar
GTKQLLNFIKICENKPVCFGLLFS

SEQ ID NO: 2545521 - protein, 21 aa, Entamoeba dispar
GTMFFFSDYLIFAKSEKEGYS

SEQ ID NO: 2545522 - protein, 25 aa, Entamoeba dispar
GTNCIKLLQIVYGATFKKLAAEQEK

SEQ ID NO: 2545523 - protein, 31 aa, Entamoeba dispar
GTSNPNQLFALRALFLCFFYIINEVSDEFRQ

SEQ ID NO: 2545524 - protein, 25 aa, Entamoeba dispar
GVFKGKLLLVWKWTPSVILNVECKE

SEQ ID NO: 2545525 - protein, 24 aa, Entamoeba dispar
GVPGGQPLFGGFNPGTFKLKKTAQ

SEQ ID NO: 2545526 - protein, 19 aa, Entamoeba dispar
GVTPLLMKPVIKKDLRQQT

SEQ ID NO: 2545527 - protein, 26 aa, Entamoeba dispar
GVTVHFLRLPYFFNYLQIAAGEEEVW

SEQ ID NO: 2545528 - protein, 23 aa, Entamoeba dispar
GVVHFLDLYYDYTKQLLGGIEAS

SEQ ID NO: 2545529 - protein, 21 aa, Entamoeba dispar
GYEYIFPLIPIIIVNKEDYIN

SEQ ID NO: 2545530 - protein, 19 aa, Entamoeba dispar
GYLDAFLPKINRIVNTPQQ

SEQ ID NO: 2545531 - protein, 20 aa, Entamoeba dispar
GYPKTAPLMKYLVTLHVLFG

SEQ ID NO: 2545532 - protein, 21 aa, Entamoeba dispar
GYPWWPAKIIIMDKLNEKKKR

SEQ ID NO: 2545533 - protein, 24 aa, Entamoeba dispar
GYTIKFYYSGMFMEGLMSEMIDSV

SEQ ID NO: 2545534 - protein, 18 aa, Entamoeba dispar
HCMSLFWCDFLRANSTSI

SEQ ID NO: 2545535 - protein, 18 aa, Entamoeba dispar
HDYFDILIFTHKYSPYIQ

SEQ ID NO: 2545536 - protein, 22 aa, Entamoeba dispar
HEEHTTFFGKDPGFFVFTLRNP

SEQ ID NO: 2545537 - protein, 23 aa, Entamoeba dispar
HEFLSFYVVLMKFINYKLYTNAG

SEQ ID NO: 2545538 - protein, 21 aa, Entamoeba dispar
HELHFFCWIVLLVQLKVINEE

SEQ ID NO: 2545539 - protein, 25 aa, Entamoeba dispar
HESRYRWFFRPLRKISPYHMYLFKA

SEQ ID NO: 2545540 - protein, 19 aa, Entamoeba dispar
HETKWFIMAKTSFGLEVMN

SEQ ID NO: 2545541 - protein, 31 aa, Entamoeba dispar
HFEGKQYVLTFPRKVIKIYPLNVPFSLEYVV

SEQ ID NO: 2545542 - protein, 17 aa, Entamoeba dispar
HFGILLVDAIFPITDIP

SEQ ID NO: 2545543 - protein, 20 aa, Entamoeba dispar
HFILISYFDLRDAKTVYRLL

SEQ ID NO: 2545544 - protein, 18 aa, Entamoeba dispar
HFPQSIFDLITLKTLFIS

SEQ ID NO: 2545545 - protein, 18 aa, Entamoeba dispar
HFQTIFLPTLQLITRPQT

SEQ ID NO: 2545546 - protein, 23 aa, Entamoeba dispar
HFSVNFILLIPPTALRTSIYVNC

SEQ ID NO: 2545547 - protein, 18 aa, Entamoeba dispar
HFYYRFLIILTDYKMYIY

SEQ ID NO: 2545548 - protein, 24 aa, Entamoeba dispar
HGKPVKLFLDTLSSYKIIFPRIQY

SEQ ID NO: 2545549 - protein, 17 aa, Entamoeba dispar
HHDILMPNIPLTTSYLD

SEQ ID NO: 2545550 - protein, 17 aa, Entamoeba dispar
HHLISSIPSIWKCLYKQ

SEQ ID NO: 2545551 - protein, 17 aa, Entamoeba dispar
HIARYLVYWGKAKIIEA

SEQ ID NO: 2545552 - protein, 25 aa, Entamoeba dispar
HIFNCAYFFVLKRKEGKFFDSFDKA

SEQ ID NO: 2545553 - protein, 17 aa, Entamoeba dispar
HIGLLLITPTKGNLFQL

SEQ ID NO: 2545554 - protein, 17 aa, Entamoeba dispar
HIQAVCAITVWLKERNY

SEQ ID NO: 2545555 - protein, 24 aa, Entamoeba dispar
HIYSFESMKLLPLKPLLTPHNRTI

SEQ ID NO: 2545556 - protein, 24 aa, Entamoeba dispar
HKAIERLFYLRILMERCKPIEKKL

SEQ ID NO: 2545557 - protein, 17 aa, Entamoeba dispar
HKHYLCTGFDLFTTHEP

SEQ ID NO: 2545558 - protein, 22 aa, Entamoeba dispar
HKKFDIFKFTRQVATKFFDLAV

SEQ ID NO: 2545559 - protein, 24 aa, Entamoeba dispar
HKKTKLHYKLLIQTLLMLRHYNES

SEQ ID NO: 2545560 - protein, 23 aa, Entamoeba dispar
HKVLSCMTLFYYISKDKLFKDIV

SEQ ID NO: 2545561 - protein, 17 aa, Entamoeba dispar
HLEWYYLVKVHNKIQRI

SEQ ID NO: 2545562 - protein, 24 aa, Entamoeba dispar
HLFCGYYIFIEFIVTSSSLEGLTT

SEQ ID NO: 2545563 - protein, 19 aa, Entamoeba dispar
HLFQFLNIKKNKFPSVVYV

SEQ ID NO: 2545564 - protein, 17 aa, Entamoeba dispar
HLIKIFPSQWQTISKSV

SEQ ID NO: 2545565 - protein, 20 aa, Entamoeba dispar
HLKFIYQPFLHWPDTMITLI

SEQ ID NO: 2545566 - protein, 19 aa, Entamoeba dispar
HLMLLFSDIVLFIPATKPS

SEQ ID NO: 2545567 - protein, 20 aa, Entamoeba dispar
HLYDNYNIIGPFLVIVPLST

SEQ ID NO: 2545568 - protein, 23 aa, Entamoeba dispar
HMGDRLFFVPPKVLSKNGSEYFV

SEQ ID NO: 2545569 - protein, 25 aa, Entamoeba dispar
HMHIPFPLILIWALNQWRKEKNQTG

SEQ ID NO: 2545570 - protein, 17 aa, Entamoeba dispar
HMNFLLHRDLKPANILI

SEQ ID NO: 2545571 - protein, 25 aa, Entamoeba dispar
HNEKMLLSLFISVATKFVPLGILHM

SEQ ID NO: 2545572 - protein, 20 aa, Entamoeba dispar
HNIRIPIMPGLFAPYSCISS

SEQ ID NO: 2545573 - protein, 23 aa, Entamoeba dispar
HNRIPQFTIIPFSYCFYKPLPLN

SEQ ID NO: 2545574 - protein, 22 aa, Entamoeba dispar
HNRLYQLPPYLPLSLRTLLINS

SEQ ID NO: 2545575 - protein, 18 aa, Entamoeba dispar
HPFIVQLYYAFQTPEKLY

SEQ ID NO: 2545576 - protein, 18 aa, Entamoeba dispar
HPFNFPGLILHDIILRFI

SEQ ID NO: 2545577 - protein, 17 aa, Entamoeba dispar
HPIEVFALIAALRILCP

SEQ ID NO: 2545578 - protein, 26 aa, Entamoeba dispar
HPPFKEIPYYLLHPFRSLFIKENSSS

SEQ ID NO: 2545579 - protein, 20 aa, Entamoeba dispar
HPYYKHIEWLCGFTGSNATI

SEQ ID NO: 2545580 - protein, 21 aa, Entamoeba dispar
HQELIELKGFYYTLAMQQFGT

SEQ ID NO: 2545581 - protein, 26 aa, Entamoeba dispar
HQKSMILLIVIWLYHKVQLDMHLNFL

SEQ ID NO: 2545582 - protein, 18 aa, Entamoeba dispar
HQLSIPIAGFKKPSEIKK

SEQ ID NO: 2545583 - protein, 22 aa, Entamoeba dispar
HQRLILIFQCVIRRVYLRFETE

SEQ ID NO: 2545584 - protein, 20 aa, Entamoeba dispar
HQSFWSRAFLVIYPQPFGEV

SEQ ID NO: 2545585 - protein, 31 aa, Entamoeba dispar
HQSYYLERIFSLYLPMLFGYQIYISSKSVYQ

SEQ ID NO: 2545586 - protein, 27 aa, Entamoeba dispar
HQTNWFRPLIIPLLKLRPYELLQHMII

SEQ ID NO: 2545587 - protein, 17 aa, Entamoeba dispar
HRFYTLKSLNLLNDLNQ

SEQ ID NO: 2545588 - protein, 18 aa, Entamoeba dispar
HRLGLIPILADPRKFKFP

SEQ ID NO: 2545589 - protein, 24 aa, Entamoeba dispar
HRRALVILLCWTLNIPYSKASEID

SEQ ID NO: 2545590 - protein, 17 aa, Entamoeba dispar
HSCDFLFPMNFPQSLQS

SEQ ID NO: 2545591 - protein, 23 aa, Entamoeba dispar
HSENILFILFDNGKIRVYRTNEL

SEQ ID NO: 2545592 - protein, 17 aa, Entamoeba dispar
HSHPGFGCWLSSIDIST

SEQ ID NO: 2545593 - protein, 21 aa, Entamoeba dispar
HSYILIFLKFNYGNILGIFFQ

SEQ ID NO: 2545594 - protein, 25 aa, Entamoeba dispar
HVLHAWFHIKILRLFTDSVLHYGLP

SEQ ID NO: 2545595 - protein, 25 aa, Entamoeba dispar
HVSAPHCWSFMLGSLTWLKDAGDVV

SEQ ID NO: 2545596 - protein, 17 aa, Entamoeba dispar
HVYAIADGAYRAMLDPA

SEQ ID NO: 2545597 - protein, 19 aa, Entamoeba dispar
HYFIFSLINKSQYGAFSMS

SEQ ID NO: 2545598 - protein, 17 aa, Entamoeba dispar
HYLEGHIMFFHFSYEQS

SEQ ID NO: 2545599 - protein, 25 aa, Entamoeba dispar
HYTKPNYFKYAPAYPLVLYECKYDR

SEQ ID NO: 2545600 - protein, 24 aa, Entamoeba dispar
IACLRLIIFLLRKDIKMFKFVYAK

SEQ ID NO: 2545601 - protein, 18 aa, Entamoeba dispar
IAFIIIVGNKIDLPSKVT

SEQ ID NO: 2545602 - protein, 17 aa, Entamoeba dispar
IAIIIFHRLITPALVSP

SEQ ID NO: 2545603 - protein, 24 aa, Entamoeba dispar
IANTTIISLLKWVTDDFLPTMTRI

SEQ ID NO: 2545604 - protein, 24 aa, Entamoeba dispar
IASESHFVIKLLDLIFSSILLQQQ

SEQ ID NO: 2545605 - protein, 24 aa, Entamoeba dispar
IATDVIISIFLHPAIYINNFSESE

SEQ ID NO: 2545606 - protein, 23 aa, Entamoeba dispar
IATWFELYSWWKDNEDAQTFTNI

SEQ ID NO: 2545607 - protein, 17 aa, Entamoeba dispar
IAVIKLFLVLFKSLHKI

SEQ ID NO: 2545608 - protein, 18 aa, Entamoeba dispar
IAWLFSNFCRFKPSIPEQ

SEQ ID NO: 2545609 - protein, 18 aa, Entamoeba dispar
IAYLMYKKMWSYKEAVIF

SEQ ID NO: 2545610 - protein, 22 aa, Entamoeba dispar
ICFHWLSIPFRRKRMALLDFCR

SEQ ID NO: 2545611 - protein, 25 aa, Entamoeba dispar
ICNKPNVMIIIVTKDGSIFGTFNSL

SEQ ID NO: 2545612 - protein, 19 aa, Entamoeba dispar
ICNTFGRGHPRFRKPRIGG

SEQ ID NO: 2545613 - protein, 25 aa, Entamoeba dispar
IDCHPKFMIFTLIPVPPLCVRPSIV

SEQ ID NO: 2545614 - protein, 24 aa, Entamoeba dispar
IDEDKIFSLLLYKTGNVIITKSMI

SEQ ID NO: 2545615 - protein, 25 aa, Entamoeba dispar
IDFNDYLLPIFPLSSIQKGKLLHGY

SEQ ID NO: 2545616 - protein, 23 aa, Entamoeba dispar
IDGNIYYELFLVKTLPIFKDLIN

SEQ ID NO: 2545617 - protein, 19 aa, Entamoeba dispar
IDILLFSILILLSTNGHPN

SEQ ID NO: 2545618 - protein, 17 aa, Entamoeba dispar
IDLWPNFQFFLNEQAKE

SEQ ID NO: 2545619 - protein, 21 aa, Entamoeba dispar
IDNMYKYYLYYFYKAGNMSIN

SEQ ID NO: 2545620 - protein, 19 aa, Entamoeba dispar
IDNRSWILGAHCCFYIGSK

SEQ ID NO: 2545621 - protein, 20 aa, Entamoeba dispar
IDSINRQYLDLKSKYDQLKS

SEQ ID NO: 2545622 - protein, 22 aa, Entamoeba dispar
IDVLSRILALIPPWVRVHRIQR

SEQ ID NO: 2545623 - protein, 24 aa, Entamoeba dispar
IEDDKLFEIALEKGLQMINGININ

SEQ ID NO: 2545624 - protein, 17 aa, Entamoeba dispar
IEEQFKLLKSYVDKFND

SEQ ID NO: 2545625 - protein, 19 aa, Entamoeba dispar
IEFKWKIPITKKKTGLFSI

SEQ ID NO: 2545626 - protein, 17 aa, Entamoeba dispar
IEFLFKMKRINMVTAQN

SEQ ID NO: 2545627 - protein, 19 aa, Entamoeba dispar
IEFTALLFVPQRAPFDMFE

SEQ ID NO: 2545628 - protein, 18 aa, Entamoeba dispar
IEGNICAIIYYNGKVYIG

SEQ ID NO: 2545629 - protein, 22 aa, Entamoeba dispar
IEIFNKFLMFILNRNKREEAIL

SEQ ID NO: 2545630 - protein, 24 aa, Entamoeba dispar
IEITKIKWLLSFYKLIFGALEKEI

SEQ ID NO: 2545631 - protein, 27 aa, Entamoeba dispar
IEKGGWYVPLPLYRLIPFLEESNYYIT

SEQ ID NO: 2545632 - protein, 27 aa, Entamoeba dispar
IEKGRREYWRIVNNKVRIWDRSGKIEE

SEQ ID NO: 2545633 - protein, 17 aa, Entamoeba dispar
IEKKPMFHFLPQTMTYS

SEQ ID NO: 2545634 - protein, 18 aa, Entamoeba dispar
IELGQFFMAINIESFRPL

SEQ ID NO: 2545635 - protein, 19 aa, Entamoeba dispar
IELLHLLIDLLIIRGGYEF

SEQ ID NO: 2545636 - protein, 25 aa, Entamoeba dispar
IELMKTLFPIIKFDSISFFFRTWEV

SEQ ID NO: 2545637 - protein, 25 aa, Entamoeba dispar
IELPKYFFCFRFIKTPDLIELHWSK

SEQ ID NO: 2545638 - protein, 17 aa, Entamoeba dispar
IENLWQFDISNLIWRKL

SEQ ID NO: 2545639 - protein, 24 aa, Entamoeba dispar
IENQYIYFIKFYNSIHKLFLYQLS

SEQ ID NO: 2545640 - protein, 19 aa, Entamoeba dispar
IEQIKNEKVCLFLLIYCEC

SEQ ID NO: 2545641 - protein, 25 aa, Entamoeba dispar
IEQIQQIMIWLIKNGFRHVSELHNG

SEQ ID NO: 2545642 - protein, 18 aa, Entamoeba dispar
IEQYLQYYYTYQQIIFEL

SEQ ID NO: 2545643 - protein, 17 aa, Entamoeba dispar
IERKFIFLISLQLEIVS

SEQ ID NO: 2545644 - protein, 17 aa, Entamoeba dispar
IERLFKYLDKFIEVSIE

SEQ ID NO: 2545645 - protein, 22 aa, Entamoeba dispar
IERLICIFAYFHVMIEIDEKTL

SEQ ID NO: 2545646 - protein, 17 aa, Entamoeba dispar
IERPLPLCFTIFSAPNY

SEQ ID NO: 2545647 - protein, 25 aa, Entamoeba dispar
IFGTFNSLPIPNAPLKPGKGIDDCE

SEQ ID NO: 2545648 - protein, 19 aa, Entamoeba dispar
IFIHNLLIDILIEKGYFFD

SEQ ID NO: 2545649 - protein, 19 aa, Entamoeba dispar
IFKILLFPLEWVCISIALL

SEQ ID NO: 2545650 - protein, 24 aa, Entamoeba dispar
IFKKQEFFIPVVLLLRVYGGMSDR

SEQ ID NO: 2545651 - protein, 17 aa, Entamoeba dispar
IFQFMPFIDKMKYLQEL

SEQ ID NO: 2545652 - protein, 17 aa, Entamoeba dispar
IFTCSLFESLWPPSYED

SEQ ID NO: 2545653 - protein, 18 aa, Entamoeba dispar
IFTGLRAPPKGLLLFGPP

SEQ ID NO: 2545654 - protein, 24 aa, Entamoeba dispar
IFTQSLSLILFYYENNKLSDLEII

SEQ ID NO: 2545655 - protein, 20 aa, Entamoeba dispar
IFVQLTPFQKVWYRKVLMGD

SEQ ID NO: 2545656 - protein, 18 aa, Entamoeba dispar
IFYLIIQYSPLYPKLPLV

SEQ ID NO: 2545657 - protein, 18 aa, Entamoeba dispar
IFYSTLLIYEDPTFSLKF

SEQ ID NO: 2545658 - protein, 24 aa, Entamoeba dispar
IGDKHFIISLFNKPIHKDNCIYVT

SEQ ID NO: 2545659 - protein, 19 aa, Entamoeba dispar
IGHSLIFLSPLEKSFILLM

SEQ ID NO: 2545660 - protein, 17 aa, Entamoeba dispar
IGILLNEKPLIKKQLNK

SEQ ID NO: 2545661 - protein, 24 aa, Entamoeba dispar
IGIYAYELFNFYGVKRIIRIGSAG

SEQ ID NO: 2545662 - protein, 19 aa, Entamoeba dispar
IGKLYIQGAVVCRLPLICC

SEQ ID NO: 2545663 - protein, 24 aa, Entamoeba dispar
IGKMLFLLFVDFTIYCSKQPIGQH

SEQ ID NO: 2545664 - protein, 25 aa, Entamoeba dispar
IGMKELPFVILRPAIIYGPGDVTGI

SEQ ID NO: 2545665 - protein, 23 aa, Entamoeba dispar
IGMRPLKVIPLKSLSPIERKKKA

SEQ ID NO: 2545666 - protein, 17 aa, Entamoeba dispar
IGQYKYNWIIRNYLRAI

SEQ ID NO: 2545667 - protein, 22 aa, Entamoeba dispar
IGRITMIMFYLGAYKILFPEQP

SEQ ID NO: 2545668 - protein, 23 aa, Entamoeba dispar
IGSILFNGKYYIASPTKLYLLEN

SEQ ID NO: 2545669 - protein, 26 aa, Entamoeba dispar
IGSIRIALLLWKHFFLSLPNPVIEED

SEQ ID NO: 2545670 - protein, 23 aa, Entamoeba dispar
IGTPIYSFLCSYLLKTNTPQSKG

SEQ ID NO: 2545671 - protein, 26 aa, Entamoeba dispar
IGYSFMYKWLILLFRRDFVSEKCIRL

SEQ ID NO: 2545672 - protein, 17 aa, Entamoeba dispar
IHHILYNTSYQVPQFGV

SEQ ID NO: 2545673 - protein, 24 aa, Entamoeba dispar
IHINDSIILCYFFSKLNQLKGTDI

SEQ ID NO: 2545674 - protein, 18 aa, Entamoeba dispar
IHIWDPNLPIPTIEKIRN

SEQ ID NO: 2545675 - protein, 17 aa, Entamoeba dispar
IHKDILSEYPWFCIVLD

SEQ ID NO: 2545676 - protein, 25 aa, Entamoeba dispar
IHKNRYLVLNLLTRQLESLTQPTTE

SEQ ID NO: 2545677 - protein, 17 aa, Entamoeba dispar
IHLLTKFLIKCSSYIPS

SEQ ID NO: 2545678 - protein, 24 aa, Entamoeba dispar
IHLNYLPIFTSYLLPLMNYINNEN

SEQ ID NO: 2545679 - protein, 17 aa, Entamoeba dispar
IHLTLDRSQFLYSTIMP

SEQ ID NO: 2545680 - protein, 19 aa, Entamoeba dispar
IICDVLLFRKTLFDCYNEY

SEQ ID NO: 2545681 - protein, 18 aa, Entamoeba dispar
IICKRTCRFVDAGKYFFE

SEQ ID NO: 2545682 - protein, 27 aa, Entamoeba dispar
IIDGMRWVVPYVYWFEVIVKERWIGKE

SEQ ID NO: 2545683 - protein, 21 aa, Entamoeba dispar
IIDLFARYRYLKEITALILDT

SEQ ID NO: 2545684 - protein, 17 aa, Entamoeba dispar
IIDWFSRFGIEVGDFKT

SEQ ID NO: 2545685 - protein, 18 aa, Entamoeba dispar
IIEFLSYRQFPLLAFTDF

SEQ ID NO: 2545686 - protein, 20 aa, Entamoeba dispar
IIFDLLLFKEIIEKGYGMYK

SEQ ID NO: 2545687 - protein, 18 aa, Entamoeba dispar
IIFNILIDHINIDTIAVA

SEQ ID NO: 2545688 - protein, 21 aa, Entamoeba dispar
IIGKYIIVLCFDMLFCFDQEI

SEQ ID NO: 2545689 - protein, 17 aa, Entamoeba dispar
IIGWVISYFLPCKETLY

SEQ ID NO: 2545690 - protein, 19 aa, Entamoeba dispar
IIHMPCGPSFHFKLFNLMK

SEQ ID NO: 2545691 - protein, 17 aa, Entamoeba dispar
IIIFHRLITPALVSPAN

SEQ ID NO: 2545692 - protein, 17 aa, Entamoeba dispar
IIIKLRSITPIFNSIYP

SEQ ID NO: 2545693 - protein, 18 aa, Entamoeba dispar
IIINKWFIQKWKLEPKKV

SEQ ID NO: 2545694 - protein, 22 aa, Entamoeba dispar
IIINYIMYLIMKIKIEIEKINQ

SEQ ID NO: 2545695 - protein, 26 aa, Entamoeba dispar
IIIPSYHIFFVEVLPIPPSRFRQLNK

SEQ ID NO: 2545696 - protein, 17 aa, Entamoeba dispar
IIIVWFFHYEEKEVLYY

SEQ ID NO: 2545697 - protein, 19 aa, Entamoeba dispar
IIKLIKWARRLKPIDKEEI

SEQ ID NO: 2545698 - protein, 19 aa, Entamoeba dispar
IIKMFPFKFDLIYKWLRRE

SEQ ID NO: 2545699 - protein, 17 aa, Entamoeba dispar
IIKSFIPSLQQWTGMQK

SEQ ID NO: 2545700 - protein, 18 aa, Entamoeba dispar
IIKWLINTVKTNNFWEVF

SEQ ID NO: 2545701 - protein, 17 aa, Entamoeba dispar
IIKYLVYFVSKQPFCES

SEQ ID NO: 2545702 - protein, 24 aa, Entamoeba dispar
IILDGLNCFYYFATKMFFALSPTT

SEQ ID NO: 2545703 - protein, 17 aa, Entamoeba dispar
IILFFLKQILIRNDVIN

SEQ ID NO: 2545704 - protein, 23 aa, Entamoeba dispar
IILKHFIFIIIYDEIFNDGKIFK

SEQ ID NO: 2545705 - protein, 17 aa, Entamoeba dispar
IILLNILVLIQPEIKEI

SEQ ID NO: 2545706 - protein, 17 aa, Entamoeba dispar
IILPIKTPSLHSYKVSI

SEQ ID NO: 2545707 - protein, 17 aa, Entamoeba dispar
IILYHYIKVDPLPLLRE

SEQ ID NO: 2545708 - protein, 18 aa, Entamoeba dispar
IIQPKIKAGLEIIERHLS

SEQ ID NO: 2545709 - protein, 19 aa, Entamoeba dispar
IIQVKPICALALLDGGETD

SEQ ID NO: 2545710 - protein, 20 aa, Entamoeba dispar
IIRGFLYHKRYITYKAFSAT

SEQ ID NO: 2545711 - protein, 21 aa, Entamoeba dispar
IIRVCFLFNTMFIITKIKTFQ

SEQ ID NO: 2545712 - protein, 21 aa, Entamoeba dispar
IIRYDAIQDFLFYSLKSSLER

SEQ ID NO: 2545713 - protein, 23 aa, Entamoeba dispar
IISDLTWPAIYKLLQERIKSLEK

SEQ ID NO: 2545714 - protein, 20 aa, Entamoeba dispar
IISLIKLFLLDYRVLIIASK

SEQ ID NO: 2545715 - protein, 18 aa, Entamoeba dispar
IISMLTWVRSLTPINVEE

SEQ ID NO: 2545716 - protein, 25 aa, Entamoeba dispar
IITHLSYFRIPLPDILHWMNIDISS

SEQ ID NO: 2545717 - protein, 19 aa, Entamoeba dispar
IITRLYPYLWQPSISVLEG

SEQ ID NO: 2545718 - protein, 20 aa, Entamoeba dispar
IIVIFIMKEWDTIWFTFSED

SEQ ID NO: 2545719 - protein, 17 aa, Entamoeba dispar
IIVLINDADWELVGMLD

SEQ ID NO: 2545720 - protein, 17 aa, Entamoeba dispar
IKCKLLQKTLFPSTLKR

SEQ ID NO: 2545721 - protein, 20 aa, Entamoeba dispar
IKFTPIIDECYPLWVYKSTP

SEQ ID NO: 2545722 - protein, 28 aa, Entamoeba dispar
IKGLLINYFHTFWPSLLKIDNFLVEFIT

SEQ ID NO: 2545723 - protein, 17 aa, Entamoeba dispar
IKHLYDNYNIIGPFLVI

SEQ ID NO: 2545724 - protein, 24 aa, Entamoeba dispar
IKIMTRFCLLYSYFPLQETIDVYE

SEQ ID NO: 2545725 - protein, 18 aa, Entamoeba dispar
IKIPIYFINFLKKRFNDV

SEQ ID NO: 2545726 - protein, 24 aa, Entamoeba dispar
IKIPKFYFLIDLIDRLIPKKTQSK

SEQ ID NO: 2545727 - protein, 23 aa, Entamoeba dispar
IKKIKLRFTVRYDLLLTIFCDKL

SEQ ID NO: 2545728 - protein, 19 aa, Entamoeba dispar
IKKLRIFFPNIIDLKYVTN

SEQ ID NO: 2545729 - protein, 17 aa, Entamoeba dispar
IKNALIYYIQYNQPISS

SEQ ID NO: 2545730 - protein, 23 aa, Entamoeba dispar
IKNDFFILVRVYGIYCSCYNLDI

SEQ ID NO: 2545731 - protein, 24 aa, Entamoeba dispar
IKNILRPIFHFINDLNPEAINDQN

SEQ ID NO: 2545732 - protein, 23 aa, Entamoeba dispar
IKNKDFYYLITKLSRHVTAAYGS

SEQ ID NO: 2545733 - protein, 23 aa, Entamoeba dispar
IKNKKIPLCQWPLYVSTSFDNEI

SEQ ID NO: 2545734 - protein, 27 aa, Entamoeba dispar
IKQEKLECPLLFLWGNLYGNLQFVKEQ

SEQ ID NO: 2545735 - protein, 22 aa, Entamoeba dispar
IKRMDEAIWSEIYLHELDKCGF

SEQ ID NO: 2545736 - protein, 18 aa, Entamoeba dispar
IKRWYGLTLISVRGNLFY

SEQ ID NO: 2545737 - protein, 24 aa, Entamoeba dispar
IKTTKLCVLILRSLKMLHPEMECY

SEQ ID NO: 2545738 - protein, 23 aa, Entamoeba dispar
IKVVPLTNWFVYCKSSLITKVKQ

SEQ ID NO: 2545739 - protein, 19 aa, Entamoeba dispar
ILCYNFYFQVYPIHPEYTY

SEQ ID NO: 2545740 - protein, 20 aa, Entamoeba dispar
ILDNFFMPFFLLCVDDPVPN

SEQ ID NO: 2545741 - protein, 18 aa, Entamoeba dispar
ILEEFICYFIIDKSLNEN

SEQ ID NO: 2545742 - protein, 17 aa, Entamoeba dispar
ILFIRRFVELLKSNGCK

SEQ ID NO: 2545743 - protein, 25 aa, Entamoeba dispar
ILFPMCLQLKRLYAKLLFQSSGIGS

SEQ ID NO: 2545744 - protein, 19 aa, Entamoeba dispar
ILFYSWCFDLIVISAHTKM

SEQ ID NO: 2545745 - protein, 18 aa, Entamoeba dispar
ILHPLLFHKIEHAHIISS

SEQ ID NO: 2545746 - protein, 20 aa, Entamoeba dispar
ILICLPLLPPHRRVILRIAK

SEQ ID NO: 2545747 - protein, 17 aa, Entamoeba dispar
ILKESLNALCKIASLFN

SEQ ID NO: 2545748 - protein, 17 aa, Entamoeba dispar
ILKLLKKHPEIPIERMP

SEQ ID NO: 2545749 - protein, 17 aa, Entamoeba dispar
ILKLLKSGSIRAVRVKT

SEQ ID NO: 2545750 - protein, 20 aa, Entamoeba dispar
ILMPILFEYFFKRKAFIEER

SEQ ID NO: 2545751 - protein, 18 aa, Entamoeba dispar
ILMTRISLLLPLFLEFIK

SEQ ID NO: 2545752 - protein, 19 aa, Entamoeba dispar
ILNNCPLYQLLPLQTFCDL

SEQ ID NO: 2545753 - protein, 18 aa, Entamoeba dispar
ILNRLLLLSFPSQEIIYP

SEQ ID NO: 2545754 - protein, 19 aa, Entamoeba dispar
ILPCRATVKQLYQPHSDKE

SEQ ID NO: 2545755 - protein, 17 aa, Entamoeba dispar
ILQILFVDSIMKFSEKL

SEQ ID NO: 2545756 - protein, 17 aa, Entamoeba dispar
ILRLLTKYISYIKKDDQ

SEQ ID NO: 2545757 - protein, 23 aa, Entamoeba dispar
ILSKYYFEHLLKNSYAQFLEILK

SEQ ID NO: 2545758 - protein, 18 aa, Entamoeba dispar
ILSTLWQMSLIDMKYSMR

SEQ ID NO: 2545759 - protein, 19 aa, Entamoeba dispar
ILTFLQHKFPRIDAQTLLP

SEQ ID NO: 2545760 - protein, 18 aa, Entamoeba dispar
ILTFYHYNPIAITSGMEE

SEQ ID NO: 2545761 - protein, 19 aa, Entamoeba dispar
ILTNDLMIIIYQKQIEYIS

SEQ ID NO: 2545762 - protein, 18 aa, Entamoeba dispar
ILVLFKPLDYAMANGASL

SEQ ID NO: 2545763 - protein, 17 aa, Entamoeba dispar
ILVYGISLSAFLCIFET

SEQ ID NO: 2545764 - protein, 17 aa, Entamoeba dispar
ILWDYYFAKGCFNVVYI

SEQ ID NO: 2545765 - protein, 26 aa, Entamoeba dispar
IMCNVFPFYPFWKHVCIVWTKCYCYT

SEQ ID NO: 2545766 - protein, 17 aa, Entamoeba dispar
IMCTQPVFRPAINSSSH

SEQ ID NO: 2545767 - protein, 25 aa, Entamoeba dispar
IMDDYKQCVWLLIGIKDLGGKIRKS

SEQ ID NO: 2545768 - protein, 21 aa, Entamoeba dispar
IMEVWHFIRLTGTTAFISDDF

SEQ ID NO: 2545769 - protein, 22 aa, Entamoeba dispar
IMKIMGYITVRFKQLRSSPLEI

SEQ ID NO: 2545770 - protein, 18 aa, Entamoeba dispar
IMNLYLVFGTSSSFNKKF

SEQ ID NO: 2545771 - protein, 17 aa, Entamoeba dispar
IMQLLRDNLTLWTSDTA

SEQ ID NO: 2545772 - protein, 21 aa, Entamoeba dispar
INDILYFQLFNGIIITSKKIT

SEQ ID NO: 2545773 - protein, 18 aa, Entamoeba dispar
INDSFYFFFTHWSDIVRQ

SEQ ID NO: 2545774 - protein, 23 aa, Entamoeba dispar
INELFMTLEKRGLRYRMRVTHVE

SEQ ID NO: 2545775 - protein, 24 aa, Entamoeba dispar
INFFHIEIILQYLKVLLKHQCYKE

SEQ ID NO: 2545776 - protein, 17 aa, Entamoeba dispar
INFSPFWKKKDGTKIPE

SEQ ID NO: 2545777 - protein, 17 aa, Entamoeba dispar
INGPIHLEWYYLVKVHN

SEQ ID NO: 2545778 - protein, 23 aa, Entamoeba dispar
INHFLLFYTFIGDKFIYSSPLND

SEQ ID NO: 2545779 - protein, 19 aa, Entamoeba dispar
INHLLQLPKVVPFDFIVGG

SEQ ID NO: 2545780 - protein, 18 aa, Entamoeba dispar
INIPSSVIFIGKAAFSHC

SEQ ID NO: 2545781 - protein, 19 aa, Entamoeba dispar
INISLLPEYIKNLYIYSSD

SEQ ID NO: 2545782 - protein, 25 aa, Entamoeba dispar
INKNTLWLIMRFLSKVIQNTSVNQM

SEQ ID NO: 2545783 - protein, 17 aa, Entamoeba dispar
INKYVIWYQVEYSRCLK

SEQ ID NO: 2545784 - protein, 24 aa, Entamoeba dispar
INLLKISIIRFRKFMRINLGLMFT

SEQ ID NO: 2545785 - protein, 25 aa, Entamoeba dispar
INNLRIPFGFYKRTLPHYWKEDYGF

SEQ ID NO: 2545786 - protein, 20 aa, Entamoeba dispar
INNYWSFHFQEDHSSLKDLN

SEQ ID NO: 2545787 - protein, 28 aa, Entamoeba dispar
INPPLIKSPLLFVTLRKWIINVPTEYVD

SEQ ID NO: 2545788 - protein, 22 aa, Entamoeba dispar
INSPLYCLTLLQLGLTSITIPS

SEQ ID NO: 2545789 - protein, 17 aa, Entamoeba dispar
INTLFFLRYLFIPFKET

SEQ ID NO: 2545790 - protein, 19 aa, Entamoeba dispar
IPDPLCLMCYLFPEIITHI

SEQ ID NO: 2545791 - protein, 18 aa, Entamoeba dispar
IPFLLKFAEIQLVGAKGE

SEQ ID NO: 2545792 - protein, 23 aa, Entamoeba dispar
IPFSIRYIIWKYLLRYIPVENKR

SEQ ID NO: 2545793 - protein, 18 aa, Entamoeba dispar
IPGFWYTVLHNAGLFDYY

SEQ ID NO: 2545794 - protein, 19 aa, Entamoeba dispar
IPHIYYIIRKSEMNVFYIV

SEQ ID NO: 2545795 - protein, 17 aa, Entamoeba dispar
IPIFVFDGATLPSKKLI

SEQ ID NO: 2545796 - protein, 19 aa, Entamoeba dispar
IPIILFIDEIHTVLGAGAT

SEQ ID NO: 2545797 - protein, 19 aa, Entamoeba dispar
IPLLKYPVRIPFMAILPRP

SEQ ID NO: 2545798 - protein, 22 aa, Entamoeba dispar
IPLNRILMFISIFYLECFRCSQ

SEQ ID NO: 2545799 - protein, 24 aa, Entamoeba dispar
IPLPPSNVPSFVPPPPPLSEDAYT

SEQ ID NO: 2545800 - protein, 23 aa, Entamoeba dispar
IPMEDFLLSNLYLEKYYQIHNLY

SEQ ID NO: 2545801 - protein, 25 aa, Entamoeba dispar
IPNSHYNLFIYLLSFIKEILRQNPS

SEQ ID NO: 2545802 - protein, 23 aa, Entamoeba dispar
IPRKIRGFVWYALLLRPKTTQEI

SEQ ID NO: 2545803 - protein, 21 aa, Entamoeba dispar
IPTIQLIKFYTLLLSSPLLNN

SEQ ID NO: 2545804 - protein, 18 aa, Entamoeba dispar
IPTNCSVLIYGFLPSLQL

SEQ ID NO: 2545805 - protein, 18 aa, Entamoeba dispar
IQFIYRSPRLRVLFLSNT

SEQ ID NO: 2545806 - protein, 20 aa, Entamoeba dispar
IQHLSLIKTLLKPSLKDTSP

SEQ ID NO: 2545807 - protein, 18 aa, Entamoeba dispar
IQHYLNCTLPYYCLPNPF

SEQ ID NO: 2545808 - protein, 22 aa, Entamoeba dispar
IQILPPFTFINKLPLTLSIFIV

SEQ ID NO: 2545809 - protein, 17 aa, Entamoeba dispar
IQLLIPQNKLPAVEAWI

SEQ ID NO: 2545810 - protein, 23 aa, Entamoeba dispar
IQNSLKHNILYPLKKEIIINQLQ

SEQ ID NO: 2545811 - protein, 18 aa, Entamoeba dispar
IQPILQKPTILQKPILPI

SEQ ID NO: 2545812 - protein, 20 aa, Entamoeba dispar
IQPRAFYLQDNESKTLCIYS

SEQ ID NO: 2545813 - protein, 21 aa, Entamoeba dispar
IQQFLSLIFFIGQKSGTRIQK

SEQ ID NO: 2545814 - protein, 17 aa, Entamoeba dispar
IQQLYQYQCKCTELIQT

SEQ ID NO: 2545815 - protein, 18 aa, Entamoeba dispar
IQQSILMYLLIENGYVIT

SEQ ID NO: 2545816 - protein, 25 aa, Entamoeba dispar
IQQTKLIYEKFKPITPTPLSNQIEI

SEQ ID NO: 2545817 - protein, 21 aa, Entamoeba dispar
IQRQFLMKVIDWKIQMDLMIN

SEQ ID NO: 2545818 - protein, 18 aa, Entamoeba dispar
IQSVNYHYSLFSQLQFMD

SEQ ID NO: 2545819 - protein, 17 aa, Entamoeba dispar
IQYIPLFSKLFSIDDES

SEQ ID NO: 2545820 - protein, 17 aa, Entamoeba dispar
IRAVYLCKWFIKNGSNQ

SEQ ID NO: 2545821 - protein, 19 aa, Entamoeba dispar
IRFLFLLELAHWYYMDNWT

SEQ ID NO: 2545822 - protein, 22 aa, Entamoeba dispar
IRMKVMGFIRSWVNWRFSDFDD

SEQ ID NO: 2545823 - protein, 23 aa, Entamoeba dispar
IRRSLMLLSRYPLPLFKDLEPEV

SEQ ID NO: 2545824 - protein, 24 aa, Entamoeba dispar
IRTWKKRYFVLKDRRIWYFSSCKD

SEQ ID NO: 2545825 - protein, 20 aa, Entamoeba dispar
IRVLQYSYVKVFFLPKEDLS

SEQ ID NO: 2545826 - protein, 18 aa, Entamoeba dispar
ISCKFNVSLLPPPSSPKL

SEQ ID NO: 2545827 - protein, 17 aa, Entamoeba dispar
ISDGKWILSEDWIEAII

SEQ ID NO: 2545828 - protein, 18 aa, Entamoeba dispar
ISDIFPLKDIWKHVCIVW

SEQ ID NO: 2545829 - protein, 23 aa, Entamoeba dispar
ISDLLRYFFHFVKSTCPYIVEYN

SEQ ID NO: 2545830 - protein, 26 aa, Entamoeba dispar
ISGTEWLLRVLSGMLFVPLIQRVFEN

SEQ ID NO: 2545831 - protein, 23 aa, Entamoeba dispar
ISGTKFILYCWSRPDLRGYLNSQ

SEQ ID NO: 2545832 - protein, 17 aa, Entamoeba dispar
ISINLFNSSILQPRGKR

SEQ ID NO: 2545833 - protein, 20 aa, Entamoeba dispar
ISIPYNVLMIKLKTLPSLTG

SEQ ID NO: 2545834 - protein, 17 aa, Entamoeba dispar
ISLILLIDTFRIAEAKK

SEQ ID NO: 2545835 - protein, 18 aa, Entamoeba dispar
ISLILLIDTFRIAEAKKS

SEQ ID NO: 2545836 - protein, 25 aa, Entamoeba dispar
ISLKKLWIILGWYYFYENIKESELE

SEQ ID NO: 2545837 - protein, 26 aa, Entamoeba dispar
ISLKKLWIILGWYYFYENIKESELEK

SEQ ID NO: 2545838 - protein, 25 aa, Entamoeba dispar
ISLLYQLWLQLMPSDNLIWGVFSLF

SEQ ID NO: 2545839 - protein, 25 aa, Entamoeba dispar
ISLRSYLFSIPMFHYLQPYSNFISL

SEQ ID NO: 2545840 - protein, 19 aa, Entamoeba dispar
ISMLSWVRTLPSLKNKEVK

SEQ ID NO: 2545841 - protein, 24 aa, Entamoeba dispar
ISMVRFVDPPLYLAHVMQDFLWDN

SEQ ID NO: 2545842 - protein, 17 aa, Entamoeba dispar
ISNRLINYLKAKKFPFV

SEQ ID NO: 2545843 - protein, 24 aa, Entamoeba dispar
ISNTRSFICPLTKKLFVNPVKAQV

SEQ ID NO: 2545844 - protein, 19 aa, Entamoeba dispar
ISSYKLYQLTIQSPYVIFG

SEQ ID NO: 2545845 - protein, 19 aa, Entamoeba dispar
ISVFPLFRKIIEILYVQKT

SEQ ID NO: 2545846 - protein, 32 aa, Entamoeba dispar
ISYQNLMYQYPYFYFPYVYYPQPYNVNGIPPY

SEQ ID NO: 2545847 - protein, 17 aa, Entamoeba dispar
ITDYLILESFRKYFRGI

SEQ ID NO: 2545848 - protein, 18 aa, Entamoeba dispar
ITEPYVCGVLKRIISIMK

SEQ ID NO: 2545849 - protein, 18 aa, Entamoeba dispar
ITFFYMGKERHIVIDDLI

SEQ ID NO: 2545850 - protein, 19 aa, Entamoeba dispar
ITKIQMIPLKFRKQKSSVT

SEQ ID NO: 2545851 - protein, 23 aa, Entamoeba dispar
ITLQTPLVFWKWANEHILAIVTS

SEQ ID NO: 2545852 - protein, 24 aa, Entamoeba dispar
ITNKPIGCILVFLPGIYEITSLQK

SEQ ID NO: 2545853 - protein, 17 aa, Entamoeba dispar
ITNLYPFYNITSLIRYS

SEQ ID NO: 2545854 - protein, 21 aa, Entamoeba dispar
ITPILLTWDFPTPRVLPLIDS

SEQ ID NO: 2545855 - protein, 26 aa, Entamoeba dispar
ITSFRWQYIKYLFKMSYNALHYTHLK

SEQ ID NO: 2545856 - protein, 21 aa, Entamoeba dispar
ITTLRKLIIILFLPIHTKSTK

SEQ ID NO: 2545857 - protein, 26 aa, Entamoeba dispar
ITVNTPCLLFILLKITKLLIEIVEEG

SEQ ID NO: 2545858 - protein, 20 aa, Entamoeba dispar
ITYVLLCGYPPFFGDTLGEI

SEQ ID NO: 2545859 - protein, 22 aa, Entamoeba dispar
IVAKMVLYDFQRGRLPYFVTPP

SEQ ID NO: 2545860 - protein, 17 aa, Entamoeba dispar
IVFLMKLTELLNIAFMR

SEQ ID NO: 2545861 - protein, 20 aa, Entamoeba dispar
IVGGFLFLRLFCPAIASPEN

SEQ ID NO: 2545862 - protein, 19 aa, Entamoeba dispar
IVGLLKLFNYLSINFDRLL

SEQ ID NO: 2545863 - protein, 24 aa, Entamoeba dispar
IVKFKTIVPFLKAYKQFVSYNEKA

SEQ ID NO: 2545864 - protein, 18 aa, Entamoeba dispar
IVLAGVYLFLYKSTLDFI

SEQ ID NO: 2545865 - protein, 19 aa, Entamoeba dispar
IVLALFKKKFVPCHCLLFS

SEQ ID NO: 2545866 - protein, 26 aa, Entamoeba dispar
IVLEKYFPVYLLIRQYLLISQKPTVL

SEQ ID NO: 2545867 - protein, 19 aa, Entamoeba dispar
IVLINFFEIISKKILRERY

SEQ ID NO: 2545868 - protein, 17 aa, Entamoeba dispar
IVLIPPPLQYCTFESWK

SEQ ID NO: 2545869 - protein, 17 aa, Entamoeba dispar
IVLQLFKENVRCFDSNS

SEQ ID NO: 2545870 - protein, 18 aa, Entamoeba dispar
IVMLLTWARSLPSINVGK

SEQ ID NO: 2545871 - protein, 17 aa, Entamoeba dispar
IVTEEFIKLIYYFGLDP

SEQ ID NO: 2545872 - protein, 26 aa, Entamoeba dispar
IVTQFSNVFIILRPHQYGILIEIYRK

SEQ ID NO: 2545873 - protein, 25 aa, Entamoeba dispar
IVVPPPPPTLSMPPPPPTLNITSSP

SEQ ID NO: 2545874 - protein, 18 aa, Entamoeba dispar
IVYFKYFFDLSDLTLEQL

SEQ ID NO: 2545875 - protein, 18 aa, Entamoeba dispar
IVYGFRPYMKEFIRKIDQ

SEQ ID NO: 2545876 - protein, 17 aa, Entamoeba dispar
IVYPYTWIFNGVNKLVF

SEQ ID NO: 2545877 - protein, 19 aa, Entamoeba dispar
IWALGCLLFEIAIGAPPFS

SEQ ID NO: 2545878 - protein, 18 aa, Entamoeba dispar
IWKSETINKYLKSVFGKS

SEQ ID NO: 2545879 - protein, 20 aa, Entamoeba dispar
IWNWYNRWLVLTKEQLYYYD

SEQ ID NO: 2545880 - protein, 17 aa, Entamoeba dispar
IWSLGCCIYWMATGHPI

SEQ ID NO: 2545881 - protein, 17 aa, Entamoeba dispar
IYDKITPNPLYTSVKEC

SEQ ID NO: 2545882 - protein, 17 aa, Entamoeba dispar
IYIRDLYLNLSTSAVPI

SEQ ID NO: 2545883 - protein, 18 aa, Entamoeba dispar
IYIVSKYYPKINTNIGFL

SEQ ID NO: 2545884 - protein, 24 aa, Entamoeba dispar
IYLRKLFYLYALKYPFDSVDIVHG

SEQ ID NO: 2545885 - protein, 18 aa, Entamoeba dispar
IYMGWFSRLAIRELIEKK

SEQ ID NO: 2545886 - protein, 23 aa, Entamoeba dispar
IYNMFQLFFFKIFHNYFQCFKAN

SEQ ID NO: 2545887 - protein, 18 aa, Entamoeba dispar
IYPQFMFHLRRSHFLKVF

SEQ ID NO: 2545888 - protein, 18 aa, Entamoeba dispar
IYQQIISLLLPNENSKKA

SEQ ID NO: 2545889 - protein, 19 aa, Entamoeba dispar
IYQSFLCTPILIAAHRTLN

SEQ ID NO: 2545890 - protein, 19 aa, Entamoeba dispar
IYQTLLINYLAVAIKFAIN

SEQ ID NO: 2545891 - protein, 17 aa, Entamoeba dispar
IYRIFCDILYQTIIYKD

SEQ ID NO: 2545892 - protein, 20 aa, Entamoeba dispar
IYTLLIRRMKLCSFLILTKN

SEQ ID NO: 2545893 - protein, 18 aa, Entamoeba dispar
IYYLLHPLKYTSKGIQIQ

SEQ ID NO: 2545894 - protein, 19 aa, Entamoeba dispar
KAEKEIEELKKLKSLKNLF

SEQ ID NO: 2545895 - protein, 18 aa, Entamoeba dispar
KALEILKFLKQKGLKIAI

SEQ ID NO: 2545896 - protein, 22 aa, Entamoeba dispar
KANKPLHFTSRYLYLTLWGDEI

SEQ ID NO: 2545897 - protein, 20 aa, Entamoeba dispar
KCAQIILRLLTKYISYIKKD

SEQ ID NO: 2545898 - protein, 21 aa, Entamoeba dispar
KCFYVKLFLDLFSIPSVVLNS

SEQ ID NO: 2545899 - protein, 23 aa, Entamoeba dispar
KCKPIQWINPFAQASLCCDLSKL

SEQ ID NO: 2545900 - protein, 23 aa, Entamoeba dispar
KCLKKRMTFIPLNKIAPQMPNLN

SEQ ID NO: 2545901 - protein, 18 aa, Entamoeba dispar
KCNYPYPKVIKIPFQSME

SEQ ID NO: 2545902 - protein, 25 aa, Entamoeba dispar
KCQNIKTFWKRMKRYGFKKRRIRGI

SEQ ID NO: 2545903 - protein, 22 aa, Entamoeba dispar
KDFYLMFMLFFDDDNTKFITQL

SEQ ID NO: 2545904 - protein, 20 aa, Entamoeba dispar
KDGFTQMFWQLGMKSFDEFI

SEQ ID NO: 2545905 - protein, 18 aa, Entamoeba dispar
KDGIVLALFKKKFVPCHC

SEQ ID NO: 2545906 - protein, 18 aa, Entamoeba dispar
KDGLILIRFLTNISGKEV

SEQ ID NO: 2545907 - protein, 18 aa, Entamoeba dispar
KDGLVLIRLLRNLSGCDI

SEQ ID NO: 2545908 - protein, 23 aa, Entamoeba dispar
KDGTLFYCYTYLVKNKGGDEHPQ

SEQ ID NO: 2545909 - protein, 20 aa, Entamoeba dispar
KDIAILFLLQQFYPFFDNFL

SEQ ID NO: 2545910 - protein, 22 aa, Entamoeba dispar
KDKLIYHYILKSIPSFIEHFNC

SEQ ID NO: 2545911 - protein, 26 aa, Entamoeba dispar
KDKPKDLYYFFLFKDIFVQTKVKKLH

SEQ ID NO: 2545912 - protein, 30 aa, Entamoeba dispar
KDLELALTTLQYYLPLFRMAEHLKRSHEDR

SEQ ID NO: 2545913 - protein, 21 aa, Entamoeba dispar
KDLQRLMELIFNKSLMSCDEL

SEQ ID NO: 2545914 - protein, 19 aa, Entamoeba dispar
KDLTVHFVFVSLNILCFRT

SEQ ID NO: 2545915 - protein, 19 aa, Entamoeba dispar
KDMKFYIYFVRAKNIIAND

SEQ ID NO: 2545916 - protein, 25 aa, Entamoeba dispar
KDNKERYFYLFNDLLVYGIGDENKI

SEQ ID NO: 2545917 - protein, 18 aa, Entamoeba dispar
KDRFRLLYTFLRKNKNKK

SEQ ID NO: 2545918 - protein, 24 aa, Entamoeba dispar
KDSFLHLPLYLNRIYELRKDHSKS

SEQ ID NO: 2545919 - protein, 25 aa, Entamoeba dispar
KDTDQLFFDRWFRKKLISKETYLAA

SEQ ID NO: 2545920 - protein, 24 aa, Entamoeba dispar
KDTHFAFVLLKYFFLCLPKPMIND

SEQ ID NO: 2545921 - protein, 21 aa, Entamoeba dispar
KDYLRLLPNPLIPYNLYEEFI

SEQ ID NO: 2545922 - protein, 18 aa, Entamoeba dispar
KECIQCEYGYYLNSNKEC

SEQ ID NO: 2545923 - protein, 21 aa, Entamoeba dispar
KEDYMIFLTSFLLILHRVNPT

SEQ ID NO: 2545924 - protein, 19 aa, Entamoeba dispar
KEIEWLMRISWNKGNKSRY

SEQ ID NO: 2545925 - protein, 20 aa, Entamoeba dispar
KEIILPLLKWKGKCIDLSTS

SEQ ID NO: 2545926 - protein, 17 aa, Entamoeba dispar
KEKLLRLNKLCGASVVG

SEQ ID NO: 2545927 - protein, 19 aa, Entamoeba dispar
KELALLINEKERRLRQLEI

SEQ ID NO: 2545928 - protein, 21 aa, Entamoeba dispar
KELHKTYLMLVQKSNIQLQVL

SEQ ID NO: 2545929 - protein, 17 aa, Entamoeba dispar
KELRSMIYLLFSVANEL

SEQ ID NO: 2545930 - protein, 20 aa, Entamoeba dispar
KEPKKWWKYAFNVILEDVRK

SEQ ID NO: 2545931 - protein, 23 aa, Entamoeba dispar
KERAVYIRIVFQQTFTSLEVKKV

SEQ ID NO: 2545932 - protein, 17 aa, Entamoeba dispar
KERLASIALVKPEKARQ

SEQ ID NO: 2545933 - protein, 18 aa, Entamoeba dispar
KESLLPLMRNILGILLHI

SEQ ID NO: 2545934 - protein, 25 aa, Entamoeba dispar
KEVLIQTFKIMRIILLDASETLCDN

SEQ ID NO: 2545935 - protein, 22 aa, Entamoeba dispar
KEWTNEFIWWCYDYDFEFGYDV

SEQ ID NO: 2545936 - protein, 18 aa, Entamoeba dispar
KEYREKIIIKLRSITPIF

SEQ ID NO: 2545937 - protein, 19 aa, Entamoeba dispar
KFCKLYVRFIQTLRQQNGL

SEQ ID NO: 2545938 - protein, 20 aa, Entamoeba dispar
KFEIPTIKLPVMFSLSESRL

SEQ ID NO: 2545939 - protein, 23 aa, Entamoeba dispar
KFELRFIVLMKYDILWKSQKPDI

SEQ ID NO: 2545940 - protein, 18 aa, Entamoeba dispar
KFIHLMEVILLMGNFLNS

SEQ ID NO: 2545941 - protein, 25 aa, Entamoeba dispar
KFLTFTYYFRRLLKNPNYYGYDGKE

SEQ ID NO: 2545942 - protein, 17 aa, Entamoeba dispar
KFSLMIKYLLIGISLKL

SEQ ID NO: 2545943 - protein, 24 aa, Entamoeba dispar
KFYDDPFVMLNYNDLPLLQNGLFH

SEQ ID NO: 2545944 - protein, 19 aa, Entamoeba dispar
KGCLLLLRQGIFSVLQDTI

SEQ ID NO: 2545945 - protein, 23 aa, Entamoeba dispar
KGDTYIPFRSSPLTRILQDALGG

SEQ ID NO: 2545946 - protein, 23 aa, Entamoeba dispar
KGFQFKFFMTYMDMLSLEDEYKI

SEQ ID NO: 2545947 - protein, 19 aa, Entamoeba dispar
KGIITWFSLHNCQTRFEGT

SEQ ID NO: 2545948 - protein, 19 aa, Entamoeba dispar
KGLNLWYYPKLKGGTMMII

SEQ ID NO: 2545949 - protein, 31 aa, Entamoeba dispar
KGNENVMIFFFLKRNIIVGIYFITPLQPDKQ

SEQ ID NO: 2545950 - protein, 22 aa, Entamoeba dispar
KGQTYAFRYLLQSFPRIQHFSN

SEQ ID NO: 2545951 - protein, 18 aa, Entamoeba dispar
KHFIMFYHPYCEWCKEMR

SEQ ID NO: 2545952 - protein, 18 aa, Entamoeba dispar
KHFLFIQRKLFVSQLFCF

SEQ ID NO: 2545953 - protein, 23 aa, Entamoeba dispar
KHPDLAIPLWYSYGTVVILLEEI

SEQ ID NO: 2545954 - protein, 19 aa, Entamoeba dispar
KHVFFKYLIKKINLFNILI

SEQ ID NO: 2545955 - protein, 17 aa, Entamoeba dispar
KHVGYLVFVLLFSNVPE

SEQ ID NO: 2545956 - protein, 21 aa, Entamoeba dispar
KHYFDCIFGPYTSFVLKGINI

SEQ ID NO: 2545957 - protein, 23 aa, Entamoeba dispar
KIDFLRFYITNYKLYFIACQKIS

SEQ ID NO: 2545958 - protein, 24 aa, Entamoeba dispar
KIESYWGYFPLKEEFGSPQLFDIS

SEQ ID NO: 2545959 - protein, 17 aa, Entamoeba dispar
KIFIWSWKKGKILKVFE

SEQ ID NO: 2545960 - protein, 23 aa, Entamoeba dispar
KIFKKIIWYKVEYWRYLFEKKQG

SEQ ID NO: 2545961 - protein, 23 aa, Entamoeba dispar
KIGTSVYFWAFPSEEFVNKKVES

SEQ ID NO: 2545962 - protein, 17 aa, Entamoeba dispar
KIIIYSSPIFMDIVKGE

SEQ ID NO: 2545963 - protein, 18 aa, Entamoeba dispar
KIILIYQMSYRKTKDLKK

SEQ ID NO: 2545964 - protein, 19 aa, Entamoeba dispar
KIITKLLRKALLDQQIVLS

SEQ ID NO: 2545965 - protein, 17 aa, Entamoeba dispar
KIKTPYYLYAFSVIQYI

SEQ ID NO: 2545966 - protein, 18 aa, Entamoeba dispar
KILTLVKVVEQCKIKVNN

SEQ ID NO: 2545967 - protein, 25 aa, Entamoeba dispar
KILVRLCSLFPLIKKYVLACELFRE

SEQ ID NO: 2545968 - protein, 17 aa, Entamoeba dispar
KIMGYITVRFKQLRSSP

SEQ ID NO: 2545969 - protein, 25 aa, Entamoeba dispar
KINKPRFIYLFNDMLMYGIGDERKL

SEQ ID NO: 2545970 - protein, 19 aa, Entamoeba dispar
KIQLVSWLNQQLLTDKKIT

SEQ ID NO: 2545971 - protein, 18 aa, Entamoeba dispar
KIQYRMHPLIREFPSKQF

SEQ ID NO: 2545972 - protein, 24 aa, Entamoeba dispar
KISFKLPFYSLKPFTICTWFYIHS

SEQ ID NO: 2545973 - protein, 23 aa, Entamoeba dispar
KISKPLFVFPFQTTTTIPHLSKE

SEQ ID NO: 2545974 - protein, 24 aa, Entamoeba dispar
KISNILPLSNFYGLERLWLANNQI

SEQ ID NO: 2545975 - protein, 29 aa, Entamoeba dispar
KISQLPNNLFLFLPYLKILKLGINQLTTI

SEQ ID NO: 2545976 - protein, 19 aa, Entamoeba dispar
KITPFSGGFIFMYDIRYIT

SEQ ID NO: 2545977 - protein, 22 aa, Entamoeba dispar
KITTLRLGFIPLSPIEESFSKA

SEQ ID NO: 2545978 - protein, 20 aa, Entamoeba dispar
KIVFVVKCVIFNVSIPLTKI

SEQ ID NO: 2545979 - protein, 19 aa, Entamoeba dispar
KIYCIIKLNLWYTKPKTIK

SEQ ID NO: 2545980 - protein, 20 aa, Entamoeba dispar
KIYQSFLCTPILIAAHRTLN

SEQ ID NO: 2545981 - protein, 21 aa, Entamoeba dispar
KKDIKILKGIKLYLPNIVLLD

SEQ ID NO: 2545982 - protein, 19 aa, Entamoeba dispar
KKIMIFVEKLYWYNPSRLF

SEQ ID NO: 2545983 - protein, 21 aa, Entamoeba dispar
KKKLKIVIIIRLIIEIVEKET

SEQ ID NO: 2545984 - protein, 22 aa, Entamoeba dispar
KKLEEFCCFLLSDYFLMTKVKR

SEQ ID NO: 2545985 - protein, 19 aa, Entamoeba dispar
KKLFALCVFLAWHYKMPLK

SEQ ID NO: 2545986 - protein, 21 aa, Entamoeba dispar
KKLFIPQFIPTIKILPELLNP

SEQ ID NO: 2545987 - protein, 20 aa, Entamoeba dispar
KKNFAMLLKSLIKANPKPSE

SEQ ID NO: 2545988 - protein, 21 aa, Entamoeba dispar
KKPMFHFLPQTMTYSIATVGC

SEQ ID NO: 2545989 - protein, 20 aa, Entamoeba dispar
KKPMILPSVQNNSIPRRGQL

SEQ ID NO: 2545990 - protein, 24 aa, Entamoeba dispar
KKPTIDYFFFVHGLLALSINPKEH

SEQ ID NO: 2545991 - protein, 19 aa, Entamoeba dispar
KKRIFILLRLLVLSKIDED

SEQ ID NO: 2545992 - protein, 18 aa, Entamoeba dispar
KKRLIPIKNFQKIRKHNL

SEQ ID NO: 2545993 - protein, 23 aa, Entamoeba dispar
KKRSLLLPFLFKEDLTYPQNCRR

SEQ ID NO: 2545994 - protein, 19 aa, Entamoeba dispar
KKRYLIWKGMVLYFYDKKG

SEQ ID NO: 2545995 - protein, 17 aa, Entamoeba dispar
KKTYLLNIWKSTYSINF

SEQ ID NO: 2545996 - protein, 19 aa, Entamoeba dispar
KKVIWYLVSYSKYLQEKEA

SEQ ID NO: 2545997 - protein, 18 aa, Entamoeba dispar
KKWKFMQKYYHIGSFFRD

SEQ ID NO: 2545998 - protein, 22 aa, Entamoeba dispar
KKYGGDYLLTLPTLVFLYGMNI

SEQ ID NO: 2545999 - protein, 17 aa, Entamoeba dispar
KLFDIFPLLLKQTLSLL

SEQ ID NO: 2546000 - protein, 20 aa, Entamoeba dispar
KLFLFEQYLPSYLKLLKENA

SEQ ID NO: 2546001 - protein, 24 aa, Entamoeba dispar
KLGGMMILCIPPYRLPRDKLDEDI

SEQ ID NO: 2546002 - protein, 18 aa, Entamoeba dispar
KLHVFFNNKKERFTRENC

SEQ ID NO: 2546003 - protein, 19 aa, Entamoeba dispar
KLKIYLYPNKPFNPKDEND

SEQ ID NO: 2546004 - protein, 18 aa, Entamoeba dispar
KLKYYFAVAVFDSIETAN

SEQ ID NO: 2546005 - protein, 18 aa, Entamoeba dispar
KLLELLGILFDPTIPEGM

SEQ ID NO: 2546006 - protein, 18 aa, Entamoeba dispar
KLLKYQSGLYYFVHKRKL

SEQ ID NO: 2546007 - protein, 19 aa, Entamoeba dispar
KLLPIFIKNTSLSLFVSFL

SEQ ID NO: 2546008 - protein, 21 aa, Entamoeba dispar
KLLQLLIILFSPNKPSDMLWN

SEQ ID NO: 2546009 - protein, 18 aa, Entamoeba dispar
KLPTMQFYLSLYGHNLPV

SEQ ID NO: 2546010 - protein, 20 aa, Entamoeba dispar
KLQIALIYYKKEEIEKYRFN

SEQ ID NO: 2546011 - protein, 20 aa, Entamoeba dispar
KLVHHLIMEYGIYKRLNIYK

SEQ ID NO: 2546012 - protein, 17 aa, Entamoeba dispar
KLWTKKRGIYGYVYCFL

SEQ ID NO: 2546013 - protein, 24 aa, Entamoeba dispar
KMCLYDKCRIIKILVGWMKEATEK

SEQ ID NO: 2546014 - protein, 17 aa, Entamoeba dispar
KMEIFYPSIVIHVVKKK

SEQ ID NO: 2546015 - protein, 22 aa, Entamoeba dispar
KMGFLLLKNYLLNLPVPLLSSN

SEQ ID NO: 2546016 - protein, 17 aa, Entamoeba dispar
KMGLVKSFWYYFLNKNE

SEQ ID NO: 2546017 - protein, 17 aa, Entamoeba dispar
KMLLDGLYYLSGLFFCL

SEQ ID NO: 2546018 - protein, 17 aa, Entamoeba dispar
KMWIQLASAPEDFNMIV

SEQ ID NO: 2546019 - protein, 23 aa, Entamoeba dispar
KNEDILFTVWWVLQSIVQNNPIG

SEQ ID NO: 2546020 - protein, 19 aa, Entamoeba dispar
KNHPFFERIRWNTLLSESR

SEQ ID NO: 2546021 - protein, 18 aa, Entamoeba dispar
KNIMVWDYRKPEIPLKIL

SEQ ID NO: 2546022 - protein, 17 aa, Entamoeba dispar
KNKRFMDLLKKLSLQKE

SEQ ID NO: 2546023 - protein, 23 aa, Entamoeba dispar
KNLFRHALFFWLGKNASILHRGK

SEQ ID NO: 2546024 - protein, 24 aa, Entamoeba dispar
KNQHQLFYPLVSYIFSTYVKVFKT

SEQ ID NO: 2546025 - protein, 24 aa, Entamoeba dispar
KNSYSYFLNFLFPNSFFTDMKKFI

SEQ ID NO: 2546026 - protein, 24 aa, Entamoeba dispar
KNSYSYFLNFLFPNSFFTDMQKFI

SEQ ID NO: 2546027 - protein, 20 aa, Entamoeba dispar
KNVMFIIITKTGYAFGCFCH

SEQ ID NO: 2546028 - protein, 32 aa, Entamoeba dispar
KNYIIKKSMKFLVFMIIFVVSKGLEPIEVATE

SEQ ID NO: 2546029 - protein, 24 aa, Entamoeba dispar
KPKEDWFFYAFSKFYFEAALKFSD

SEQ ID NO: 2546030 - protein, 17 aa, Entamoeba dispar
KPKILPCRATVKQLYQP

SEQ ID NO: 2546031 - protein, 24 aa, Entamoeba dispar
KPKKPKNAYLLFSSEKYPQYKKQF

SEQ ID NO: 2546032 - protein, 24 aa, Entamoeba dispar
KPNKLPFMPMILNISPDIVTIPQE

SEQ ID NO: 2546033 - protein, 26 aa, Entamoeba dispar
KPNSELFYIIYFLPFTINIDNDRKVY

SEQ ID NO: 2546034 - protein, 20 aa, Entamoeba dispar
KPQNGMLWQRTFFRWLRRWL

SEQ ID NO: 2546035 - protein, 20 aa, Entamoeba dispar
KPRYFYLFNDVMVYGIGHQR

SEQ ID NO: 2546036 - protein, 24 aa, Entamoeba dispar
KPSSLPFLKLVLSIPPSLAQQINQ

SEQ ID NO: 2546037 - protein, 17 aa, Entamoeba dispar
KPSTIFDLWRQCHQPYS

SEQ ID NO: 2546038 - protein, 25 aa, Entamoeba dispar
KPTKAFIMTLWLKSIFEQDLAYLMS

SEQ ID NO: 2546039 - protein, 20 aa, Entamoeba dispar
KPYPLLYLWGEFFGTYEDVQ

SEQ ID NO: 2546040 - protein, 22 aa, Entamoeba dispar
KQIGFEMWYFLSAIILDRNFVQ

SEQ ID NO: 2546041 - protein, 25 aa, Entamoeba dispar
KQIILYPPIIIKKLKYIVKLNYLRD

SEQ ID NO: 2546042 - protein, 18 aa, Entamoeba dispar
KQKHLPLKSLFQKSYESL

SEQ ID NO: 2546043 - protein, 21 aa, Entamoeba dispar
KQKILRLLTDKNPNLLLKADN

SEQ ID NO: 2546044 - protein, 23 aa, Entamoeba dispar
KQKRDGCFLWVLVQSFFSEICQK

SEQ ID NO: 2546045 - protein, 23 aa, Entamoeba dispar
KQMKFLLHRLNTLSSLPFVEDPL

SEQ ID NO: 2546046 - protein, 18 aa, Entamoeba dispar
KQTKIIVLIPPPLQYCTF

SEQ ID NO: 2546047 - protein, 19 aa, Entamoeba dispar
KQVIWYQVEYWRYLFEKKQ

SEQ ID NO: 2546048 - protein, 20 aa, Entamoeba dispar
KQYDCIWIQWSILYLRDDDL

SEQ ID NO: 2546049 - protein, 24 aa, Entamoeba dispar
KQYDVLYIFYRNIKHFLFIQRKLF

SEQ ID NO: 2546050 - protein, 17 aa, Entamoeba dispar
KRFMDLLKKLSLQKEVK

SEQ ID NO: 2546051 - protein, 17 aa, Entamoeba dispar
KRFYELMFLIAEKIKLE

SEQ ID NO: 2546052 - protein, 21 aa, Entamoeba dispar
KRIGYLALMLLLDETQEVLTL

SEQ ID NO: 2546053 - protein, 17 aa, Entamoeba dispar
KRINDMQFMLNQSLKKV

SEQ ID NO: 2546054 - protein, 23 aa, Entamoeba dispar
KRKQSCIFFLYCSDPLQQKRNIE

SEQ ID NO: 2546055 - protein, 17 aa, Entamoeba dispar
KRKVLQILPLTPVKSLK

SEQ ID NO: 2546056 - protein, 26 aa, Entamoeba dispar
KRKYDKLIAYIYLLLSFFPSNNETTI

SEQ ID NO: 2546057 - protein, 22 aa, Entamoeba dispar
KRRDIFFLLLHGIKLKNLDYPI

SEQ ID NO: 2546058 - protein, 20 aa, Entamoeba dispar
KRRIFVIPYLMYSTMERAVH

SEQ ID NO: 2546059 - protein, 25 aa, Entamoeba dispar
KRRKLLYYGLLIPINEEFPKKGPRL

SEQ ID NO: 2546060 - protein, 22 aa, Entamoeba dispar
KRSFCIKFIPIIFQFKFKTGMN

SEQ ID NO: 2546061 - protein, 20 aa, Entamoeba dispar
KRSQIPLQLAWAISIHKSQG

SEQ ID NO: 2546062 - protein, 27 aa, Entamoeba dispar
KRVGMLHFLTYYYGMDWHKVANAPQGD

SEQ ID NO: 2546063 - protein, 18 aa, Entamoeba dispar
KRYYFIHHILYNTSYQVP

SEQ ID NO: 2546064 - protein, 25 aa, Entamoeba dispar
KSDIYSLGIVFWEIFRRVVFGSYTK

SEQ ID NO: 2546065 - protein, 25 aa, Entamoeba dispar
KSGNCTAFIRGLPLKWGDIEFSKYF

SEQ ID NO: 2546066 - protein, 20 aa, Entamoeba dispar
KSILFFIFKEKKEKIINFIC

SEQ ID NO: 2546067 - protein, 19 aa, Entamoeba dispar
KSITLPTIYSRAFYLCLEK

SEQ ID NO: 2546068 - protein, 27 aa, Entamoeba dispar
KSLLDLFRIILIYRYHFYKESVKDIFL

SEQ ID NO: 2546069 - protein, 25 aa, Entamoeba dispar
KSLRAYFFCILLKIFRVYMKIARYQ

SEQ ID NO: 2546070 - protein, 24 aa, Entamoeba dispar
KSNEKKIILLTQSGLREIECQNKQ

SEQ ID NO: 2546071 - protein, 24 aa, Entamoeba dispar
KSWKLVWVVIKYTFIFVFKSRDDT

SEQ ID NO: 2546072 - protein, 24 aa, Entamoeba dispar
KSWKRRWFVIKDRKMWYFAGKNDT

SEQ ID NO: 2546073 - protein, 26 aa, Entamoeba dispar
KTCHYPCHVPFFISALTMRGCSCIVN

SEQ ID NO: 2546074 - protein, 19 aa, Entamoeba dispar
KTCLLLTYTTNSFPDTYVP

SEQ ID NO: 2546075 - protein, 19 aa, Entamoeba dispar
KTFYKITIGFNFLSNFIII

SEQ ID NO: 2546076 - protein, 18 aa, Entamoeba dispar
KTMDYFNLLLKKKPGCSG

SEQ ID NO: 2546077 - protein, 18 aa, Entamoeba dispar
KTMMMFVLLLKNLEEKEK

SEQ ID NO: 2546078 - protein, 19 aa, Entamoeba dispar
KTNEFLIILPFLSSLNTVI

SEQ ID NO: 2546079 - protein, 19 aa, Entamoeba dispar
KTNLLPPLIYILNSLNTLT

SEQ ID NO: 2546080 - protein, 26 aa, Entamoeba dispar
KTQTHVFLIYPNFLFPTTATIDILIE

SEQ ID NO: 2546081 - protein, 22 aa, Entamoeba dispar
KTSLFRIYFFTNDKGNPFIRTL

SEQ ID NO: 2546082 - protein, 22 aa, Entamoeba dispar
KTSLFRIYFLTNDKGNPFIRTL

SEQ ID NO: 2546083 - protein, 22 aa, Entamoeba dispar
KTSLKRFSYCPVLFSNNDENIK

SEQ ID NO: 2546084 - protein, 29 aa, Entamoeba dispar
KTTASLVLGFIWMLFDKFQEKNIKLSMKE

SEQ ID NO: 2546085 - protein, 17 aa, Entamoeba dispar
KTTKLCILILRSLKKLH

SEQ ID NO: 2546086 - protein, 22 aa, Entamoeba dispar
KTTKLCVLILRSLKMLHPEMEC

SEQ ID NO: 2546087 - protein, 19 aa, Entamoeba dispar
KTTPFYPYLILSINRSRLN

SEQ ID NO: 2546088 - protein, 22 aa, Entamoeba dispar
KTWENYFYKFLPPFPRHLIQPH

SEQ ID NO: 2546089 - protein, 17 aa, Entamoeba dispar
KVFELHFYPLLQQYLYS

SEQ ID NO: 2546090 - protein, 23 aa, Entamoeba dispar
KVILQFFPVLFEKIIFRQIMVTH

SEQ ID NO: 2546091 - protein, 28 aa, Entamoeba dispar
KVKRIFHILFPYFLKQSFRRIILLLWKG

SEQ ID NO: 2546092 - protein, 23 aa, Entamoeba dispar
KVLGWLKIIFYPRNYFRTKYNDN

SEQ ID NO: 2546093 - protein, 18 aa, Entamoeba dispar
KVLLPFISRYYTLTSKLY

SEQ ID NO: 2546094 - protein, 23 aa, Entamoeba dispar
KVPGRIWPLMINPTTVIISSYDT

SEQ ID NO: 2546095 - protein, 22 aa, Entamoeba dispar
KVPIIYIRLFSYELIRGLAYIH

SEQ ID NO: 2546096 - protein, 18 aa, Entamoeba dispar
KVTATKTMLLFNQYLEKK

SEQ ID NO: 2546097 - protein, 25 aa, Entamoeba dispar
KVTHWIWYVFPVIQGLWGGRNNDLY

SEQ ID NO: 2546098 - protein, 28 aa, Entamoeba dispar
KVYAYGELFYLLNLYSDSIEWFFIGFDP

SEQ ID NO: 2546099 - protein, 17 aa, Entamoeba dispar
KVYLIPKYSQIPYYVCF

SEQ ID NO: 2546100 - protein, 22 aa, Entamoeba dispar
KWAEFEYCILFPFNVLKMKSIK

SEQ ID NO: 2546101 - protein, 19 aa, Entamoeba dispar
KWILKLKEMMLFVVDLTEI

SEQ ID NO: 2546102 - protein, 20 aa, Entamoeba dispar
KWMYCFLFNDRLVETMPISI

SEQ ID NO: 2546103 - protein, 18 aa, Entamoeba dispar
KWVLLEDSFAQKDYIKTL

SEQ ID NO: 2546104 - protein, 23 aa, Entamoeba dispar
KYATRFNILFPPQSSKQLEQRME

SEQ ID NO: 2546105 - protein, 21 aa, Entamoeba dispar
KYDVHWFIVDHWYLFSQLGQF

SEQ ID NO: 2546106 - protein, 17 aa, Entamoeba dispar
KYFPLDKIPQLPPQEGE

SEQ ID NO: 2546107 - protein, 20 aa, Entamoeba dispar
KYHIPYLFPIPYLSDEKYSI

SEQ ID NO: 2546108 - protein, 19 aa, Entamoeba dispar
KYHYKGLFFLFIKTFKQRI

SEQ ID NO: 2546109 - protein, 18 aa, Entamoeba dispar
KYIEIQIKLLYPIAPHFC

SEQ ID NO: 2546110 - protein, 18 aa, Entamoeba dispar
KYIIGEAFLIKNYPRIQT

SEQ ID NO: 2546111 - protein, 17 aa, Entamoeba dispar
KYIYTIIKGIRSLNGIY

SEQ ID NO: 2546112 - protein, 24 aa, Entamoeba dispar
KYKSWLIRFPTIQDLAKASLADVL

SEQ ID NO: 2546113 - protein, 28 aa, Entamoeba dispar
KYKTSYFTVWRYYGIFLIPMRCYISQGA

SEQ ID NO: 2546114 - protein, 19 aa, Entamoeba dispar
KYMKYILTYLPINSKRAKN

SEQ ID NO: 2546115 - protein, 18 aa, Entamoeba dispar
KYMRNIPIHFQWFTQQKQ

SEQ ID NO: 2546116 - protein, 25 aa, Entamoeba dispar
KYNESDWVLMFYNPSVPLEQWMVKD

SEQ ID NO: 2546117 - protein, 26 aa, Entamoeba dispar
KYPELPFGIFFIYNKNFFGFQIRFRD

SEQ ID NO: 2546118 - protein, 21 aa, Entamoeba dispar
KYPVRIPFMAILPRPISEPWE

SEQ ID NO: 2546119 - protein, 18 aa, Entamoeba dispar
KYVIWYQVEYSRCLKEKE

SEQ ID NO: 2546120 - protein, 19 aa, Entamoeba dispar
KYYRNLIPRPLFEEYFNNI

SEQ ID NO: 2546121 - protein, 17 aa, Entamoeba dispar
LAKFPLIVLCRKGIHVI

SEQ ID NO: 2546122 - protein, 17 aa, Entamoeba dispar
LANFLILPVQRLPRYVL

SEQ ID NO: 2546123 - protein, 17 aa, Entamoeba dispar
LATLYIILKYRKWQLKD

SEQ ID NO: 2546124 - protein, 18 aa, Entamoeba dispar
LAVIFQPFKQFYLEKFPS

SEQ ID NO: 2546125 - protein, 18 aa, Entamoeba dispar
LAYFLLRRALRNKNIIGH

SEQ ID NO: 2546126 - protein, 19 aa, Entamoeba dispar
LAYMFIYFMKGNLPWQGIK

SEQ ID NO: 2546127 - protein, 20 aa, Entamoeba dispar
LCEKFFFNYQIPKQTTIYKQ

SEQ ID NO: 2546128 - protein, 17 aa, Entamoeba dispar
LCEVFTDSILRNSNVVL

SEQ ID NO: 2546129 - protein, 26 aa, Entamoeba dispar
LCFACQFHLLRLLYYKNLSIPIENAC

SEQ ID NO: 2546130 - protein, 17 aa, Entamoeba dispar
LCFTVFSASLYSLNNQS

SEQ ID NO: 2546131 - protein, 17 aa, Entamoeba dispar
LCLIFPYSPPHFSYSLD

SEQ ID NO: 2546132 - protein, 18 aa, Entamoeba dispar
LCNFILKKSFFKESNNPQ

SEQ ID NO: 2546133 - protein, 24 aa, Entamoeba dispar
LCSYGVFILLTPKTKFIWKGKFRN

SEQ ID NO: 2546134 - protein, 19 aa, Entamoeba dispar
LCVLYVLYKNLFIDQFKIQ

SEQ ID NO: 2546135 - protein, 18 aa, Entamoeba dispar
LCWFLPQIAIATNSGVVL

SEQ ID NO: 2546136 - protein, 25 aa, Entamoeba dispar
LDDEVLTMYLVYYVLKDKNIRDDEE

SEQ ID NO: 2546137 - protein, 17 aa, Entamoeba dispar
LDDLDSFIILMKKWWCD

SEQ ID NO: 2546138 - protein, 19 aa, Entamoeba dispar
LDEKVDLLSLRKLSNQSSE

SEQ ID NO: 2546139 - protein, 22 aa, Entamoeba dispar
LDIQMYMRIAPELYLKELIVGG

SEQ ID NO: 2546140 - protein, 22 aa, Entamoeba dispar
LDLAWSLLRTFPRDMLKRISNE

SEQ ID NO: 2546141 - protein, 19 aa, Entamoeba dispar
LDNQLYLHLKYEGIHLVIF

SEQ ID NO: 2546142 - protein, 26 aa, Entamoeba dispar
LDRFIQYRKITISLVESWNGVMKGYI

SEQ ID NO: 2546143 - protein, 20 aa, Entamoeba dispar
LDSGLPNLLFFGPPGSGKTT

SEQ ID NO: 2546144 - protein, 18 aa, Entamoeba dispar
LEEKLIIDWFSRFGIEVG

SEQ ID NO: 2546145 - protein, 20 aa, Entamoeba dispar
LEFEKVFFPYLLISKKRYAG

SEQ ID NO: 2546146 - protein, 17 aa, Entamoeba dispar
LEFILSTALNFSPETFQ

SEQ ID NO: 2546147 - protein, 20 aa, Entamoeba dispar
LEFLPRRESYFWLLDALDMY

SEQ ID NO: 2546148 - protein, 18 aa, Entamoeba dispar
LEFSLIYNILETFKHNYK

SEQ ID NO: 2546149 - protein, 23 aa, Entamoeba dispar
LEGYNKSLFWKPQFKKSPKLSER

SEQ ID NO: 2546150 - protein, 21 aa, Entamoeba dispar
LEHLTLFKYIMKLSYKISAYE

SEQ ID NO: 2546151 - protein, 24 aa, Entamoeba dispar
LEINPIYQRLWFALGICCLQISDI

SEQ ID NO: 2546152 - protein, 20 aa, Entamoeba dispar
LEKIWEIVGLFKVYPKTKTG

SEQ ID NO: 2546153 - protein, 25 aa, Entamoeba dispar
LEKYDFLILVLLVLFCKVPKTPSIE

SEQ ID NO: 2546154 - protein, 18 aa, Entamoeba dispar
LELFCLFIEIGLTEEVLN

SEQ ID NO: 2546155 - protein, 22 aa, Entamoeba dispar
LEPHLPFFFKYPILFEPHSFVL

SEQ ID NO: 2546156 - protein, 17 aa, Entamoeba dispar
LEQWMIKDLLEGIDVKA

SEQ ID NO: 2546157 - protein, 24 aa, Entamoeba dispar
LESYNNLYVLYKSSLSQSLFVNQT

SEQ ID NO: 2546158 - protein, 18 aa, Entamoeba dispar
LEYFPLLKDNLITCSLCF

SEQ ID NO: 2546159 - protein, 22 aa, Entamoeba dispar
LEYIRVLPIRNIAFIRYKLRGS

SEQ ID NO: 2546160 - protein, 19 aa, Entamoeba dispar
LFAHGLFYFIGLDSFFFQK

SEQ ID NO: 2546161 - protein, 25 aa, Entamoeba dispar
LFCSYCLPFLFYKQIILVNRDLLMK

SEQ ID NO: 2546162 - protein, 27 aa, Entamoeba dispar
LFEMKQFPVIILKDNPVIFLLRSHREA

SEQ ID NO: 2546163 - protein, 19 aa, Entamoeba dispar
LFFIIHKSILYHPFIQNIL

SEQ ID NO: 2546164 - protein, 20 aa, Entamoeba dispar
LFFIIHKSILYHPFIQNILL

SEQ ID NO: 2546165 - protein, 17 aa, Entamoeba dispar
LFFMEILACTYIFGTSM

SEQ ID NO: 2546166 - protein, 24 aa, Entamoeba dispar
LFFYDLPSTLFKYLLYPIIFKDSF

SEQ ID NO: 2546167 - protein, 17 aa, Entamoeba dispar
LFIALMESDIELSQKYI

SEQ ID NO: 2546168 - protein, 18 aa, Entamoeba dispar
LFLMDYLKHVLTPVLDLI

SEQ ID NO: 2546169 - protein, 18 aa, Entamoeba dispar
LFMKGVILYTDSKGLIIV

SEQ ID NO: 2546170 - protein, 21 aa, Entamoeba dispar
LFNHFYVLWPHKFINVTNGVT

SEQ ID NO: 2546171 - protein, 21 aa, Entamoeba dispar
LFRSYFILNNIPTIASSPFVP

SEQ ID NO: 2546172 - protein, 17 aa, Entamoeba dispar
LFTQMYWKIGMKNFDKF

SEQ ID NO: 2546173 - protein, 23 aa, Entamoeba dispar
LFVEFLTKKWFFTLFTHWNYYVR

SEQ ID NO: 2546174 - protein, 17 aa, Entamoeba dispar
LFVLRKKGVSDVKKFTR

SEQ ID NO: 2546175 - protein, 20 aa, Entamoeba dispar
LFWMFKYVMDFLQPFYFCKG

SEQ ID NO: 2546176 - protein, 17 aa, Entamoeba dispar
LFWRYILELLLLCELKV

SEQ ID NO: 2546177 - protein, 18 aa, Entamoeba dispar
LFYYFEIKDVLIFIVVEV

SEQ ID NO: 2546178 - protein, 24 aa, Entamoeba dispar
LGDGSYKLGPFLNTLFTVQDEDFK

SEQ ID NO: 2546179 - protein, 23 aa, Entamoeba dispar
LGDKELHPPLSFEPEICSVNIKK

SEQ ID NO: 2546180 - protein, 18 aa, Entamoeba dispar
LGFRMQWICPFNASQKTA

SEQ ID NO: 2546181 - protein, 19 aa, Entamoeba dispar
LGILYIYHIKFNIEGFKII

SEQ ID NO: 2546182 - protein, 30 aa, Entamoeba dispar
LGPEFYYNLYLFPYLVFIGFTHCHLPISGV

SEQ ID NO: 2546183 - protein, 28 aa, Entamoeba dispar
LGQIFKLFTPFFKVYFLYISHYDDSNQV

SEQ ID NO: 2546184 - protein, 24 aa, Entamoeba dispar
LGQYTLNFFIQPFLHWPDTMMTVI

SEQ ID NO: 2546185 - protein, 23 aa, Entamoeba dispar
LGTLFLVELSPILFKLIWKTENE

SEQ ID NO: 2546186 - protein, 17 aa, Entamoeba dispar
LHELWSLLQFLLPEIFN

SEQ ID NO: 2546187 - protein, 18 aa, Entamoeba dispar
LHFIFYHYNSRVFKDFNQ

SEQ ID NO: 2546188 - protein, 18 aa, Entamoeba dispar
LHFWPSFYLHAVLFNKTD

SEQ ID NO: 2546189 - protein, 20 aa, Entamoeba dispar
LHHLPNSYYLERLFCFYIPI

SEQ ID NO: 2546190 - protein, 19 aa, Entamoeba dispar
LHLFIPRVPAFSVTLSFLT

SEQ ID NO: 2546191 - protein, 20 aa, Entamoeba dispar
LHLYPFLEKIVPAKLLVPTK

SEQ ID NO: 2546192 - protein, 24 aa, Entamoeba dispar
LHQKYPHLPFFFHCRKSWSDLCQL

SEQ ID NO: 2546193 - protein, 23 aa, Entamoeba dispar
LHRSFDCATPLLIQWTYQAMIHE

SEQ ID NO: 2546194 - protein, 17 aa, Entamoeba dispar
LHTFMRKWLKSLYEINV

SEQ ID NO: 2546195 - protein, 20 aa, Entamoeba dispar
LHTLAILYIGTIRPFCSIRN

SEQ ID NO: 2546196 - protein, 17 aa, Entamoeba dispar
LHYFEMVNWLLAKGAYV

SEQ ID NO: 2546197 - protein, 18 aa, Entamoeba dispar
LIDIIHFLPHILTSFLES

SEQ ID NO: 2546198 - protein, 17 aa, Entamoeba dispar
LIFQRPYLCGLYNESTT

SEQ ID NO: 2546199 - protein, 19 aa, Entamoeba dispar
LIGALPLFKLNFGNNLISI

SEQ ID NO: 2546200 - protein, 23 aa, Entamoeba dispar
LIIEKFFFFLLETINTIKSFEYK

SEQ ID NO: 2546201 - protein, 25 aa, Entamoeba dispar
LIIKQLYHFLAYYVLDTLFTQPEKI

SEQ ID NO: 2546202 - protein, 18 aa, Entamoeba dispar
LIILFVQWKFGSDQWKLL

SEQ ID NO: 2546203 - protein, 17 aa, Entamoeba dispar
LIKLFCRLINGININCG

SEQ ID NO: 2546204 - protein, 25 aa, Entamoeba dispar
LILGKEKHFLLKKLTFNLIKDISEH

SEQ ID NO: 2546205 - protein, 21 aa, Entamoeba dispar
LILNHPVILSPLYKITIVKAE

SEQ ID NO: 2546206 - protein, 25 aa, Entamoeba dispar
LILYKRAIYLLLTLQPSIELIQFIY

SEQ ID NO: 2546207 - protein, 18 aa, Entamoeba dispar
LINWFKIRGIGNLIKELM

SEQ ID NO: 2546208 - protein, 20 aa, Entamoeba dispar
LIPEFFFLPQFLINFNTIDF

SEQ ID NO: 2546209 - protein, 17 aa, Entamoeba dispar
LIPFIFTKYLQDAFDCQ

SEQ ID NO: 2546210 - protein, 18 aa, Entamoeba dispar
LIPLFEFLLMFIENNISG

SEQ ID NO: 2546211 - protein, 19 aa, Entamoeba dispar
LIQKILILPLSLPKELFNE

SEQ ID NO: 2546212 - protein, 17 aa, Entamoeba dispar
LISINIPSSIIKLGDYC

SEQ ID NO: 2546213 - protein, 17 aa, Entamoeba dispar
LISINIPSSISKLGYCC

SEQ ID NO: 2546214 - protein, 17 aa, Entamoeba dispar
LISLFEALRKQKVQFRY

SEQ ID NO: 2546215 - protein, 19 aa, Entamoeba dispar
LITNFFYFYVPNGSNLMNK

SEQ ID NO: 2546216 - protein, 18 aa, Entamoeba dispar
LIYPFVWHHVLIPILPVQ

SEQ ID NO: 2546217 - protein, 21 aa, Entamoeba dispar
LIYSDNFPLLYPPKLRKGNNF

SEQ ID NO: 2546218 - protein, 17 aa, Entamoeba dispar
LIYYIQYNQPISSVFLK

SEQ ID NO: 2546219 - protein, 18 aa, Entamoeba dispar
LKCQEIHIFYYRGQELNL

SEQ ID NO: 2546220 - protein, 23 aa, Entamoeba dispar
LKELFFVLFVKRKKYYLNKIDLP

SEQ ID NO: 2546221 - protein, 23 aa, Entamoeba dispar
LKHKKILIYITKKITLLLLNKPS

SEQ ID NO: 2546222 - protein, 19 aa, Entamoeba dispar
LKIFKIFFMAIVEKELQYI

SEQ ID NO: 2546223 - protein, 18 aa, Entamoeba dispar
LKIIIITFKYMTNIVIRY

SEQ ID NO: 2546224 - protein, 18 aa, Entamoeba dispar
LKILFMLSKWMSSFPHDF

SEQ ID NO: 2546225 - protein, 31 aa, Entamoeba dispar
LKNLQVSLCLLIYKFMYCGAPYKVYGCYDEK

SEQ ID NO: 2546226 - protein, 17 aa, Entamoeba dispar
LKNPFFYYEIDNEYLYV

SEQ ID NO: 2546227 - protein, 17 aa, Entamoeba dispar
LKSPTKIIIILPPLTVG

SEQ ID NO: 2546228 - protein, 23 aa, Entamoeba dispar
LKSTIILMVYMQSIQNFIPPHLN

SEQ ID NO: 2546229 - protein, 17 aa, Entamoeba dispar
LKTMWLPDIFLYCNIDT

SEQ ID NO: 2546230 - protein, 20 aa, Entamoeba dispar
LKTYLLLIKLLPHSQEQLLK

SEQ ID NO: 2546231 - protein, 31 aa, Entamoeba dispar
LKYVPEFLFKFLLWLRKWLYPRNFLGGLFVD

SEQ ID NO: 2546232 - protein, 17 aa, Entamoeba dispar
LLDIRINLIAPVIYFYY

SEQ ID NO: 2546233 - protein, 21 aa, Entamoeba dispar
LLERLILILLSHHYSLILKYI

SEQ ID NO: 2546234 - protein, 19 aa, Entamoeba dispar
LLFDTLINCYLKRVTQPIE

SEQ ID NO: 2546235 - protein, 19 aa, Entamoeba dispar
LLGQFYPITFPISKFLVLQ

SEQ ID NO: 2546236 - protein, 20 aa, Entamoeba dispar
LLHYKTLLIIPITPPLISNC

SEQ ID NO: 2546237 - protein, 17 aa, Entamoeba dispar
LLICSKYFRYKSDFINV

SEQ ID NO: 2546238 - protein, 18 aa, Entamoeba dispar
LLIFMLQKLFALVHGEID

SEQ ID NO: 2546239 - protein, 19 aa, Entamoeba dispar
LLIIFPKKYGFFIVPNPIY

SEQ ID NO: 2546240 - protein, 18 aa, Entamoeba dispar
LLKLLRLLSSNEIKRIET

SEQ ID NO: 2546241 - protein, 25 aa, Entamoeba dispar
LLKNLDEILWNDQKWRKLGMSDLCD

SEQ ID NO: 2546242 - protein, 17 aa, Entamoeba dispar
LLKPRTFLIWQNSSYPS

SEQ ID NO: 2546243 - protein, 17 aa, Entamoeba dispar
LLKVMGYITVRFKQLRT

SEQ ID NO: 2546244 - protein, 18 aa, Entamoeba dispar
LLLARRLLQKLGMDKQFV

SEQ ID NO: 2546245 - protein, 19 aa, Entamoeba dispar
LLLHLYNHLIKIIPLPREE

SEQ ID NO: 2546246 - protein, 18 aa, Entamoeba dispar
LLLPKRKDIWYYFNKVIV

SEQ ID NO: 2546247 - protein, 17 aa, Entamoeba dispar
LLMLPTSNAILLLRWVV

SEQ ID NO: 2546248 - protein, 25 aa, Entamoeba dispar
LLNTRMHLWLEYYTINQAMSSNHDS

SEQ ID NO: 2546249 - protein, 22 aa, Entamoeba dispar
LLRLGFFLFDCTNALRYFFDIC

SEQ ID NO: 2546250 - protein, 17 aa, Entamoeba dispar
LLRYKFLLAFEREMLHL

SEQ ID NO: 2546251 - protein, 23 aa, Entamoeba dispar
LLSDFYRSVVLLLFKPYDYTVIP

SEQ ID NO: 2546252 - protein, 18 aa, Entamoeba dispar
LLSILPFGEERIKGINGL

SEQ ID NO: 2546253 - protein, 26 aa, Entamoeba dispar
LLSLTHMILLYYFPDVTIHLDKMKLT

SEQ ID NO: 2546254 - protein, 18 aa, Entamoeba dispar
LLSPIFHFLLPFLTSTTK

SEQ ID NO: 2546255 - protein, 19 aa, Entamoeba dispar
LLSVLCILLASLNYKVLIC

SEQ ID NO: 2546256 - protein, 20 aa, Entamoeba dispar
LLSVLCILLASLNYKVLICA

SEQ ID NO: 2546257 - protein, 17 aa, Entamoeba dispar
LLTEAFPGLLVTSQERK

SEQ ID NO: 2546258 - protein, 24 aa, Entamoeba dispar
LLTEDGIYIIWFSNIQFNEIISIC

SEQ ID NO: 2546259 - protein, 24 aa, Entamoeba dispar
LLTFFDLIHFPLKKPNWIGCNNQL

SEQ ID NO: 2546260 - protein, 24 aa, Entamoeba dispar
LLTKMLIPLLKKSTIIPYIIFVHA

SEQ ID NO: 2546261 - protein, 17 aa, Entamoeba dispar
LLVALKLRFPQRISLLR

SEQ ID NO: 2546262 - protein, 23 aa, Entamoeba dispar
LLVRTLIPSLLYRVLCSPTPDIM

SEQ ID NO: 2546263 - protein, 18 aa, Entamoeba dispar
LLYRFICKLINRPYVRFN

SEQ ID NO: 2546264 - protein, 18 aa, Entamoeba dispar
LMGFFRALMVWETSLKKS

SEQ ID NO: 2546265 - protein, 19 aa, Entamoeba dispar
LMIQTIKDIFYLFKQVDGK

SEQ ID NO: 2546266 - protein, 17 aa, Entamoeba dispar
LMKPVIKKDLRQQTQEM

SEQ ID NO: 2546267 - protein, 18 aa, Entamoeba dispar
LMKYKFAELALLFVRDVH

SEQ ID NO: 2546268 - protein, 18 aa, Entamoeba dispar
LMLTEIPYFRDILLAHFQ

SEQ ID NO: 2546269 - protein, 25 aa, Entamoeba dispar
LMQLHHPFIVKLYYAFQTADKLYMV

SEQ ID NO: 2546270 - protein, 17 aa, Entamoeba dispar
LMQSLIQQFKQLEIIKK

SEQ ID NO: 2546271 - protein, 17 aa, Entamoeba dispar
LMRIIMIVRPRNLLYIA

SEQ ID NO: 2546272 - protein, 25 aa, Entamoeba dispar
LNDPTLIKLFLQNGMFKEFFEKHPE

SEQ ID NO: 2546273 - protein, 29 aa, Entamoeba dispar
LNEIRHFYLYLLWILKNMDLRTLTNLLNK

SEQ ID NO: 2546274 - protein, 24 aa, Entamoeba dispar
LNIYEFIAIYRYLEICYALFNAYN

SEQ ID NO: 2546275 - protein, 17 aa, Entamoeba dispar
LNLFYEFTKTLLNTTEQ

SEQ ID NO: 2546276 - protein, 25 aa, Entamoeba dispar
LNLKKPYRNIFKWAPLLALVNSLTN

SEQ ID NO: 2546277 - protein, 23 aa, Entamoeba dispar
LNLNKPLHFTSRYLYLTLWGDEV

SEQ ID NO: 2546278 - protein, 18 aa, Entamoeba dispar
LNNCPLYQLLPLQTFCDL

SEQ ID NO: 2546279 - protein, 26 aa, Entamoeba dispar
LNNKPIFIFGYLDQGYWPDGLYTAPT

SEQ ID NO: 2546280 - protein, 23 aa, Entamoeba dispar
LNNPKYFLHFLPRIISSLPTCRF

SEQ ID NO: 2546281 - protein, 24 aa, Entamoeba dispar
LNQKLIILFILYTVYMTQPKDKSP

SEQ ID NO: 2546282 - protein, 23 aa, Entamoeba dispar
LNSGLHFLVLYRYYLRHVPKNIA

SEQ ID NO: 2546283 - protein, 24 aa, Entamoeba dispar
LNSNPFFLQPMTPPALIRINQQEE

SEQ ID NO: 2546284 - protein, 18 aa, Entamoeba dispar
LNVLKKWTGLEHFDIVFE

SEQ ID NO: 2546285 - protein, 34 aa, Entamoeba dispar
LNVLQPFMWQHILIPILPLFLSSYLSSILPCIIG

SEQ ID NO: 2546286 - protein, 17 aa, Entamoeba dispar
LNYLYGIVVPQFIFLRK

SEQ ID NO: 2546287 - protein, 23 aa, Entamoeba dispar
LPEKHFIAFEKVKWWLDDKALDG

SEQ ID NO: 2546288 - protein, 18 aa, Entamoeba dispar
LPFLKYYSLIIELLFINS

SEQ ID NO: 2546289 - protein, 24 aa, Entamoeba dispar
LPGIIPFLFEKLQKKKSFFLMNAM

SEQ ID NO: 2546290 - protein, 17 aa, Entamoeba dispar
LPGLYVLMLLDYIFKYI

SEQ ID NO: 2546291 - protein, 19 aa, Entamoeba dispar
LPIQRIPRYRLLLKELMKT

SEQ ID NO: 2546292 - protein, 22 aa, Entamoeba dispar
LPLNLIIPVLYFAFNNMLNHEK

SEQ ID NO: 2546293 - protein, 18 aa, Entamoeba dispar
LPREVILWVLLPADEEAY

SEQ ID NO: 2546294 - protein, 20 aa, Entamoeba dispar
LPRFVLIKIIPYLENISNVL

SEQ ID NO: 2546295 - protein, 18 aa, Entamoeba dispar
LPSLPLVIPYLTLLILSN

SEQ ID NO: 2546296 - protein, 20 aa, Entamoeba dispar
LPTEFLPYAFNWLLQFTSVP

SEQ ID NO: 2546297 - protein, 21 aa, Entamoeba dispar
LPTTLPLIFRGIDSRFFQQFL

SEQ ID NO: 2546298 - protein, 17 aa, Entamoeba dispar
LPTVWKYFFLFSDILVV

SEQ ID NO: 2546299 - protein, 20 aa, Entamoeba dispar
LQELLPFLYQRYPTTFPMDC

SEQ ID NO: 2546300 - protein, 17 aa, Entamoeba dispar
LQHFFQHAFDGMFKIIV

SEQ ID NO: 2546301 - protein, 18 aa, Entamoeba dispar
LQHQFFEVLKYLHSLHIV

SEQ ID NO: 2546302 - protein, 22 aa, Entamoeba dispar
LQKKWYFPIIQSIKPQQFSQII

SEQ ID NO: 2546303 - protein, 23 aa, Entamoeba dispar
LQLYFLHLKFPRLVSHLFPFFND

SEQ ID NO: 2546304 - protein, 19 aa, Entamoeba dispar
LQLYGNLFYLLQSDPVYVA

SEQ ID NO: 2546305 - protein, 24 aa, Entamoeba dispar
LQPYHALFLFKNPEEWINNLVESD

SEQ ID NO: 2546306 - protein, 17 aa, Entamoeba dispar
LQRLRKIFFPDFFMKHQ

SEQ ID NO: 2546307 - protein, 22 aa, Entamoeba dispar
LQRQMMFLTRFFKTLVDLPSNI

SEQ ID NO: 2546308 - protein, 20 aa, Entamoeba dispar
LRAFKLFDNLWRMNGLDWRI

SEQ ID NO: 2546309 - protein, 21 aa, Entamoeba dispar
LRAYVWYALLLRPSNPWEIKH

SEQ ID NO: 2546310 - protein, 25 aa, Entamoeba dispar
LRECFPTFLSFFALPLVSAIPYTAV

SEQ ID NO: 2546311 - protein, 20 aa, Entamoeba dispar
LRFMNPPFTAVLMLIKVMQY

SEQ ID NO: 2546312 - protein, 18 aa, Entamoeba dispar
LRFTHPQLSFRFIEWCIL

SEQ ID NO: 2546313 - protein, 23 aa, Entamoeba dispar
LRKFYFRLCEFLQYPSLPLSCIN

SEQ ID NO: 2546314 - protein, 19 aa, Entamoeba dispar
LRKISPYHMYLFKALRNYF

SEQ ID NO: 2546315 - protein, 24 aa, Entamoeba dispar
LRLKVMNFVRIWIKNAWRDFEGQT

SEQ ID NO: 2546316 - protein, 17 aa, Entamoeba dispar
LRMFLYIHPKGYFQGLN

SEQ ID NO: 2546317 - protein, 24 aa, Entamoeba dispar
LRNKLVHHLIMEYGIYKRLNIYKP

SEQ ID NO: 2546318 - protein, 20 aa, Entamoeba dispar
LRNLVFFKYPKWTGGLYCSP

SEQ ID NO: 2546319 - protein, 20 aa, Entamoeba dispar
LRPLAWKIFLKVIKPQASEE

SEQ ID NO: 2546320 - protein, 23 aa, Entamoeba dispar
LRRAFMSRMFPPETIKKLGIKHV

SEQ ID NO: 2546321 - protein, 20 aa, Entamoeba dispar
LRRLFRRFKKLGMKAKEGAS

SEQ ID NO: 2546322 - protein, 25 aa, Entamoeba dispar
LRTESIWKFLIPFISRILDCLEDED

SEQ ID NO: 2546323 - protein, 21 aa, Entamoeba dispar
LRVTIPIWRNTNKRRGFAIVE

SEQ ID NO: 2546324 - protein, 19 aa, Entamoeba dispar
LSDYCFYLEELYGTADLNI

SEQ ID NO: 2546325 - protein, 21 aa, Entamoeba dispar
LSEHWFIIPDILKSDIRRITQ

SEQ ID NO: 2546326 - protein, 17 aa, Entamoeba dispar
LSFFTYFFSVNSPIIRR

SEQ ID NO: 2546327 - protein, 18 aa, Entamoeba dispar
LSFYVVLMKFINYKLYTN

SEQ ID NO: 2546328 - protein, 21 aa, Entamoeba dispar
LSHLLSLRFRFPSTSDLRFVL

SEQ ID NO: 2546329 - protein, 20 aa, Entamoeba dispar
LSICRNVCFFTWAYELLIYD

SEQ ID NO: 2546330 - protein, 18 aa, Entamoeba dispar
LSLQEWYRMLWDYDYFEY

SEQ ID NO: 2546331 - protein, 17 aa, Entamoeba dispar
LSMIQPSPPPPPPNKEI

SEQ ID NO: 2546332 - protein, 26 aa, Entamoeba dispar
LSNDFPHLFIIFPKSFGFYINNQPNQ

SEQ ID NO: 2546333 - protein, 17 aa, Entamoeba dispar
LSNFKMIGKFDGKIKFF

SEQ ID NO: 2546334 - protein, 17 aa, Entamoeba dispar
LSQDNMYSAWNPQLLIS

SEQ ID NO: 2546335 - protein, 23 aa, Entamoeba dispar
LSQIIFMRYFLYNSLNSCDPLYV

SEQ ID NO: 2546336 - protein, 18 aa, Entamoeba dispar
LSRKQAFLEMLLFADKHG

SEQ ID NO: 2546337 - protein, 20 aa, Entamoeba dispar
LSSCFLYLNDDMLLGKKLDI

SEQ ID NO: 2546338 - protein, 23 aa, Entamoeba dispar
LSSSWAFIIMWKGSDNEAYIQLQ

SEQ ID NO: 2546339 - protein, 23 aa, Entamoeba dispar
LTCRKIITVPYISGFLGFREVEV

SEQ ID NO: 2546340 - protein, 18 aa, Entamoeba dispar
LTGRYYAKKILAPNFCRV

SEQ ID NO: 2546341 - protein, 19 aa, Entamoeba dispar
LTHMILLYYFPDVTIHLDK

SEQ ID NO: 2546342 - protein, 18 aa, Entamoeba dispar
LTIEMWYEMLWDIGLSEY

SEQ ID NO: 2546343 - protein, 19 aa, Entamoeba dispar
LTIPFWWKDDLFPYIVEHR

SEQ ID NO: 2546344 - protein, 18 aa, Entamoeba dispar
LTMKIKYMELQMSAPQKE

SEQ ID NO: 2546345 - protein, 17 aa, Entamoeba dispar
LTNALKKVLLVIKELQT

SEQ ID NO: 2546346 - protein, 18 aa, Entamoeba dispar
LTQQFLYPVLLSLIQQQP

SEQ ID NO: 2546347 - protein, 19 aa, Entamoeba dispar
LTQYIPFIFKSILTLEEKE

SEQ ID NO: 2546348 - protein, 21 aa, Entamoeba dispar
LTRLNLPILDVFWLSQYPAVL

SEQ ID NO: 2546349 - protein, 18 aa, Entamoeba dispar
LTRPILLQLLRKVLYTEN

SEQ ID NO: 2546350 - protein, 24 aa, Entamoeba dispar
LTSRRPLLNHIILSGGSTLFPGLP

SEQ ID NO: 2546351 - protein, 25 aa, Entamoeba dispar
LTYQEWFKMLWYKGLFTYYREDLHL

SEQ ID NO: 2546352 - protein, 17 aa, Entamoeba dispar
LVFAFPSDEGFPFCLDC

SEQ ID NO: 2546353 - protein, 18 aa, Entamoeba dispar
LVFVLLFSNVPESTRMII

SEQ ID NO: 2546354 - protein, 19 aa, Entamoeba dispar
LVHHQPFPLLKITDFGFGR

SEQ ID NO: 2546355 - protein, 24 aa, Entamoeba dispar
LVIFAFPIYWYAMPGQLKLFIDRT

SEQ ID NO: 2546356 - protein, 17 aa, Entamoeba dispar
LVIHKILIPPTIMGTVT

SEQ ID NO: 2546357 - protein, 24 aa, Entamoeba dispar
LVKKIYSQLKLVPPENGRYISTEE

SEQ ID NO: 2546358 - protein, 17 aa, Entamoeba dispar
LVKSFWYYFLNKNEDTE

SEQ ID NO: 2546359 - protein, 17 aa, Entamoeba dispar
LVSYIFSTYVKVFKTCT

SEQ ID NO: 2546360 - protein, 17 aa, Entamoeba dispar
LVTVPFFRILTLDGPVD

SEQ ID NO: 2546361 - protein, 21 aa, Entamoeba dispar
LVWLLNLGILWVDDQFSLDGK

SEQ ID NO: 2546362 - protein, 17 aa, Entamoeba dispar
LVYIILSLVLSGFQQVY

SEQ ID NO: 2546363 - protein, 23 aa, Entamoeba dispar
LVYLMNVVLFFPTYRDVYRFIKV

SEQ ID NO: 2546364 - protein, 33 aa, Entamoeba dispar
LVYSNLWRYWCPWLMWFVSPFFKIFWKTPEEAC

SEQ ID NO: 2546365 - protein, 19 aa, Entamoeba dispar
LWKKYFFEQQIYKIKEMEN

SEQ ID NO: 2546366 - protein, 23 aa, Entamoeba dispar
LYCTYIHSLLIKPTFDWINEAIQ

SEQ ID NO: 2546367 - protein, 20 aa, Entamoeba dispar
LYDILRFWGIYSLYSSIDPS

SEQ ID NO: 2546368 - protein, 21 aa, Entamoeba dispar
LYESQGLVPLLRLAWNHFDPN

SEQ ID NO: 2546369 - protein, 18 aa, Entamoeba dispar
LYEYLYYGGILSFDLSEG

SEQ ID NO: 2546370 - protein, 20 aa, Entamoeba dispar
LYFKGYIFNILFDVPQELAL

SEQ ID NO: 2546371 - protein, 17 aa, Entamoeba dispar
LYHYIKVDPLPLLRERI

SEQ ID NO: 2546372 - protein, 17 aa, Entamoeba dispar
LYIKLNIPIHTSTNGIS

SEQ ID NO: 2546373 - protein, 18 aa, Entamoeba dispar
LYLLPKYSEKLRFLGASK

SEQ ID NO: 2546374 - protein, 19 aa, Entamoeba dispar
LYLTRVPWKISINQFAPAV

SEQ ID NO: 2546375 - protein, 18 aa, Entamoeba dispar
LYPYLWQPSISVLEGTTI

SEQ ID NO: 2546376 - protein, 19 aa, Entamoeba dispar
LYQNDLLFKVYLQKYNTHF

SEQ ID NO: 2546377 - protein, 17 aa, Entamoeba dispar
LYTIPQFQKVFELHTNA

SEQ ID NO: 2546378 - protein, 17 aa, Entamoeba dispar
LYTLQLVDKILFPEKDN

SEQ ID NO: 2546379 - protein, 21 aa, Entamoeba dispar
MAGFSLIRLLAEPSAAAYAYG

SEQ ID NO: 2546380 - protein, 25 aa, Entamoeba dispar
MANMTYACSILYKTKLPLIIVFTKT

SEQ ID NO: 2546381 - protein, 20 aa, Entamoeba dispar
MAVFHFLFRYDTGSHLPFIV

SEQ ID NO: 2546382 - protein, 24 aa, Entamoeba dispar
MDLTSDYYWALFTNLYNTIRIRNT

SEQ ID NO: 2546383 - protein, 25 aa, Entamoeba dispar
MDNMYSAWNPQLLISIKTPQSVNAV

SEQ ID NO: 2546384 - protein, 21 aa, Entamoeba dispar
MDTFAYLPFFLTSFKDIKSLK

SEQ ID NO: 2546385 - protein, 18 aa, Entamoeba dispar
MEEYSILNLFMKKLISSP

SEQ ID NO: 2546386 - protein, 18 aa, Entamoeba dispar
MEHYFQALFFFPISYDVK

SEQ ID NO: 2546387 - protein, 18 aa, Entamoeba dispar
MEIKIFVQLTPFQKVWYR

SEQ ID NO: 2546388 - protein, 17 aa, Entamoeba dispar
MEMTFAEVILVLKANYE

SEQ ID NO: 2546389 - protein, 26 aa, Entamoeba dispar
MENVFPFIFHILLNCQINFSSKNDKL

SEQ ID NO: 2546390 - protein, 17 aa, Entamoeba dispar
MEQLILQAQNELKKRIY

SEQ ID NO: 2546391 - protein, 17 aa, Entamoeba dispar
MEQLILQAQNEVKKRIY

SEQ ID NO: 2546392 - protein, 18 aa, Entamoeba dispar
MERKDFFDLFKQSPYFKD

SEQ ID NO: 2546393 - protein, 21 aa, Entamoeba dispar
MFHFFERFLLCNNLYLTTYRI

SEQ ID NO: 2546394 - protein, 18 aa, Entamoeba dispar
MFLIEYSPILFKLVFRAD

SEQ ID NO: 2546395 - protein, 17 aa, Entamoeba dispar
MGCLLLFPRIQIDYQTF

SEQ ID NO: 2546396 - protein, 24 aa, Entamoeba dispar
MGDRAIFVFGFHALQFLYLDPHIV

SEQ ID NO: 2546397 - protein, 24 aa, Entamoeba dispar
MGFPDYICIFALKKYKWNVEESIP

SEQ ID NO: 2546398 - protein, 22 aa, Entamoeba dispar
MGINYIIRLLYDGYPNTRYAAF

SEQ ID NO: 2546399 - protein, 18 aa, Entamoeba dispar
MHNNIPMRGFIPDNMPMG

SEQ ID NO: 2546400 - protein, 18 aa, Entamoeba dispar
MIALKILRIGFNKLSGNI

SEQ ID NO: 2546401 - protein, 18 aa, Entamoeba dispar
MIKVIWNVFPIADFWRHV

SEQ ID NO: 2546402 - protein, 18 aa, Entamoeba dispar
MIKVIWNVFPITDFWRHV

SEQ ID NO: 2546403 - protein, 19 aa, Entamoeba dispar
MIKYLHLLITLVTLTPEVA

SEQ ID NO: 2546404 - protein, 17 aa, Entamoeba dispar
MILLLKQNNIILKERKT

SEQ ID NO: 2546405 - protein, 17 aa, Entamoeba dispar
MINSLPYVMSRGPALQA

SEQ ID NO: 2546406 - protein, 18 aa, Entamoeba dispar
MIPFLWIQLTFGCDGCIG

SEQ ID NO: 2546407 - protein, 17 aa, Entamoeba dispar
MIPIPQYPLYSAAISQF

SEQ ID NO: 2546408 - protein, 22 aa, Entamoeba dispar
MISGIYMGWLARLAIRELIEKK

SEQ ID NO: 2546409 - protein, 21 aa, Entamoeba dispar
MKAIFYFFVVNGKVLELMEWV

SEQ ID NO: 2546410 - protein, 17 aa, Entamoeba dispar
MKALYQKAIFINKNNVR

SEQ ID NO: 2546411 - protein, 24 aa, Entamoeba dispar
MKCLDPLLEFCRLLTMPMSLEIIQ

SEQ ID NO: 2546412 - protein, 25 aa, Entamoeba dispar
MKECLPLILILRNRLNYALNGREVT

SEQ ID NO: 2546413 - protein, 22 aa, Entamoeba dispar
MKIKLLPYHSLPFAWNNPIKER

SEQ ID NO: 2546414 - protein, 19 aa, Entamoeba dispar
MKIMGYITVRFKQLRSSPL

SEQ ID NO: 2546415 - protein, 18 aa, Entamoeba dispar
MLDYFLFHGHVCIVTELL

SEQ ID NO: 2546416 - protein, 19 aa, Entamoeba dispar
MLGLLYIWVLKNLNKEMLK

SEQ ID NO: 2546417 - protein, 21 aa, Entamoeba dispar
MLQIITWKEPFPKTLYPHPWL

SEQ ID NO: 2546418 - protein, 24 aa, Entamoeba dispar
MLWFVVDHWFLFGKLYQFRTNPNK

SEQ ID NO: 2546419 - protein, 19 aa, Entamoeba dispar
MLYFIRKFMEYTPSDGIKF

SEQ ID NO: 2546420 - protein, 19 aa, Entamoeba dispar
MMIICKYFINIKDIINVEL

SEQ ID NO: 2546421 - protein, 19 aa, Entamoeba dispar
MMRGFIPNNMPMGGFGGGF

SEQ ID NO: 2546422 - protein, 23 aa, Entamoeba dispar
MNDLRETILASLIKFAKVEQDEG

SEQ ID NO: 2546423 - protein, 17 aa, Entamoeba dispar
MNIAIPPTIPFIGSTLT

SEQ ID NO: 2546424 - protein, 17 aa, Entamoeba dispar
MNLAHFAILPDLSSLAK

SEQ ID NO: 2546425 - protein, 18 aa, Entamoeba dispar
MNLFFFPIHPSFPILNGI

SEQ ID NO: 2546426 - protein, 25 aa, Entamoeba dispar
MNLYNHWYYFYLSLVRYPLSLDISM

SEQ ID NO: 2546427 - protein, 20 aa, Entamoeba dispar
MNMHILFKIILKNTIHLSIT

SEQ ID NO: 2546428 - protein, 17 aa, Entamoeba dispar
MNPSPIPIAFFLDDMDD

SEQ ID NO: 2546429 - protein, 21 aa, Entamoeba dispar
MNQDTLWYLCSFLYEIQLNEE

SEQ ID NO: 2546430 - protein, 23 aa, Entamoeba dispar
MNRQGIIPIFLYATLGAEALDYI

SEQ ID NO: 2546431 - protein, 18 aa, Entamoeba dispar
MQNYTLYGSLRPFGCSLL

SEQ ID NO: 2546432 - protein, 23 aa, Entamoeba dispar
MQRFPQMPIIPPNRQFPPYVIPE

SEQ ID NO: 2546433 - protein, 27 aa, Entamoeba dispar
MRGANKHLFIAYYTLFVKPVFEIYQKT

SEQ ID NO: 2546434 - protein, 17 aa, Entamoeba dispar
MRGFIPNNMPMGGFGGG

SEQ ID NO: 2546435 - protein, 19 aa, Entamoeba dispar
MRNFIYFLPYVMKHRDVYA

SEQ ID NO: 2546436 - protein, 25 aa, Entamoeba dispar
MRQGQTLISFFYPAKNLKLLDLAVK

SEQ ID NO: 2546437 - protein, 18 aa, Entamoeba dispar
MSFILYNDYLYSEAMYFI

SEQ ID NO: 2546438 - protein, 18 aa, Entamoeba dispar
MSFLIWALNRKFSFSFQK

SEQ ID NO: 2546439 - protein, 19 aa, Entamoeba dispar
MSKPFPFIPLLLDENYRVA

SEQ ID NO: 2546440 - protein, 17 aa, Entamoeba dispar
MSNWCNFVTPRVLYFNN

SEQ ID NO: 2546441 - protein, 17 aa, Entamoeba dispar
MSQIGEQLLFKLKPFQI

SEQ ID NO: 2546442 - protein, 21 aa, Entamoeba dispar
MSYELFISCFPQLKTKSFNKD

SEQ ID NO: 2546443 - protein, 25 aa, Entamoeba dispar
MTELDAHLYFLIPISIYLNNLTQDI

SEQ ID NO: 2546444 - protein, 18 aa, Entamoeba dispar
MTGPFVPLLLFKTIMNEL

SEQ ID NO: 2546445 - protein, 26 aa, Entamoeba dispar
MTKDDGFFCFILKSPLIKQPIKVVRK

SEQ ID NO: 2546446 - protein, 20 aa, Entamoeba dispar
MTNNLMILLLKQNNIILKER

SEQ ID NO: 2546447 - protein, 18 aa, Entamoeba dispar
MVIWQIFTQRLLYIKYDS

SEQ ID NO: 2546448 - protein, 17 aa, Entamoeba dispar
MVMFPYDYPMKPPFFFT

SEQ ID NO: 2546449 - protein, 23 aa, Entamoeba dispar
MVNTLDFINNVLLSCITLPISEG

SEQ ID NO: 2546450 - protein, 22 aa, Entamoeba dispar
MVRELYCGLIQLFCNLFEKEKN

SEQ ID NO: 2546451 - protein, 19 aa, Entamoeba dispar
MVWDYRKPEIPLKILQNHT

SEQ ID NO: 2546452 - protein, 17 aa, Entamoeba dispar
MWFGDLVTMKWWNDLWL

SEQ ID NO: 2546453 - protein, 25 aa, Entamoeba dispar
MYLGDSTIIIFLFLDGRQEEIRLRN

SEQ ID NO: 2546454 - protein, 18 aa, Entamoeba dispar
MYLLYYFCSALKERFSDF

SEQ ID NO: 2546455 - protein, 21 aa, Entamoeba dispar
NAAYVRFLMKLFRILGRSEVM

SEQ ID NO: 2546456 - protein, 19 aa, Entamoeba dispar
NAEKLIRMAKSFGLEVTCS

SEQ ID NO: 2546457 - protein, 24 aa, Entamoeba dispar
NAEKQIINILKIDDLMDIDLSKTM

SEQ ID NO: 2546458 - protein, 26 aa, Entamoeba dispar
NAFNKFIYCPIVLPYFLRLLTHCLSI

SEQ ID NO: 2546459 - protein, 23 aa, Entamoeba dispar
NALQGGFFAILFKVTEGTTNMEK

SEQ ID NO: 2546460 - protein, 23 aa, Entamoeba dispar
NAQQYFLVTPKLLSDLPFGENMT

SEQ ID NO: 2546461 - protein, 26 aa, Entamoeba dispar
NASKCYFFKRLPWVLPIQLKRFTWDE

SEQ ID NO: 2546462 - protein, 17 aa, Entamoeba dispar
NATKRIRIGKFPKYLLI

SEQ ID NO: 2546463 - protein, 19 aa, Entamoeba dispar
NAVQLFIPFRPMLAKPKKS

SEQ ID NO: 2546464 - protein, 17 aa, Entamoeba dispar
NCMLTFTDFILFGRTKL

SEQ ID NO: 2546465 - protein, 17 aa, Entamoeba dispar
NCSPLLQTLFKMIFIRN

SEQ ID NO: 2546466 - protein, 18 aa, Entamoeba dispar
NCVWLKEIILPTSISKIE

SEQ ID NO: 2546467 - protein, 23 aa, Entamoeba dispar
NDEKMMLAFFTIVAQKYLKLKRT

SEQ ID NO: 2546468 - protein, 18 aa, Entamoeba dispar
NDFILPITKLIISIISHP

SEQ ID NO: 2546469 - protein, 17 aa, Entamoeba dispar
NDFIVYWIAKLNKNYYK

SEQ ID NO: 2546470 - protein, 22 aa, Entamoeba dispar
NDFIVYWIAKLNKNYYKVTICD

SEQ ID NO: 2546471 - protein, 30 aa, Entamoeba dispar
NDFLLKLMNETLFTYLLLKSSDSDLFHSSL

SEQ ID NO: 2546472 - protein, 26 aa, Entamoeba dispar
NDGRIFKYIIWYLIDYSTYLKEKEQG

SEQ ID NO: 2546473 - protein, 25 aa, Entamoeba dispar
NDGRIIKLLIWYAVNYSTYLKEKKK

SEQ ID NO: 2546474 - protein, 27 aa, Entamoeba dispar
NDGYFSIFFYVFALKYIPKFFQSAIHL

SEQ ID NO: 2546475 - protein, 24 aa, Entamoeba dispar
NDGYLAFIERLFRLLHLIEMKKEI

SEQ ID NO: 2546476 - protein, 18 aa, Entamoeba dispar
NDKDFFVFSLRSKELTQP

SEQ ID NO: 2546477 - protein, 27 aa, Entamoeba dispar
NDLLIDKITWWAGRLFFNEFEMLMKVL

SEQ ID NO: 2546478 - protein, 24 aa, Entamoeba dispar
NDLPSLLLLPIKFLPQFYSLIKEY

SEQ ID NO: 2546479 - protein, 25 aa, Entamoeba dispar
NDLPSLLLLPIKFLPQFYSLIKEYH

SEQ ID NO: 2546480 - protein, 17 aa, Entamoeba dispar
NDNPRRWYFDLRPEHED

SEQ ID NO: 2546481 - protein, 24 aa, Entamoeba dispar
NDSVWLKYLVTLPYQFYKEGLEIN

SEQ ID NO: 2546482 - protein, 24 aa, Entamoeba dispar
NDVDLLKCSILKRPWVNPFNQTTT

SEQ ID NO: 2546483 - protein, 22 aa, Entamoeba dispar
NDYHSFLLNRHRRFKILGIEVP

SEQ ID NO: 2546484 - protein, 17 aa, Entamoeba dispar
NEDVFFYFTKYISFQAN

SEQ ID NO: 2546485 - protein, 23 aa, Entamoeba dispar
NEGFLMMILYYLGCTIKMKRIIK

SEQ ID NO: 2546486 - protein, 19 aa, Entamoeba dispar
NEHMFGVEDLLFRALLNGG

SEQ ID NO: 2546487 - protein, 25 aa, Entamoeba dispar
NEIKSMLTWIRFLPHINVEEIQEPD

SEQ ID NO: 2546488 - protein, 25 aa, Entamoeba dispar
NELRLRLCVLFLRTLYEELLKHKSS

SEQ ID NO: 2546489 - protein, 22 aa, Entamoeba dispar
NEPPFVYILLGWLTHLIVMNPS

SEQ ID NO: 2546490 - protein, 21 aa, Entamoeba dispar
NEPVLIWIEIPRNLKIINGKN

SEQ ID NO: 2546491 - protein, 26 aa, Entamoeba dispar
NEQPLFVIHVLWLRILYKISLPDDNN

SEQ ID NO: 2546492 - protein, 17 aa, Entamoeba dispar
NESLLHFIFYHYNSRVF

SEQ ID NO: 2546493 - protein, 20 aa, Entamoeba dispar
NEVQFYRYGVRPYVPYDSYY

SEQ ID NO: 2546494 - protein, 21 aa, Entamoeba dispar
NFHCWGYYLWILEQGKISQED

SEQ ID NO: 2546495 - protein, 22 aa, Entamoeba dispar
NFISFLFEILPFKPPLTYEKIN

SEQ ID NO: 2546496 - protein, 21 aa, Entamoeba dispar
NFPELFLPYTLPKSSAALFTF

SEQ ID NO: 2546497 - protein, 24 aa, Entamoeba dispar
NFPQKFYFFILKSLQFIYQKEFVV

SEQ ID NO: 2546498 - protein, 17 aa, Entamoeba dispar
NFPYLPLLPYEPEILMN

SEQ ID NO: 2546499 - protein, 20 aa, Entamoeba dispar
NFYTILFTWKQKKIWKTTPK

SEQ ID NO: 2546500 - protein, 32 aa, Entamoeba dispar
NGEPKPIITLMFYLMYRFRLNDTPVRIIDFSK

SEQ ID NO: 2546501 - protein, 23 aa, Entamoeba dispar
NGGYSWWRRNSLTVFIDDKLYKD

SEQ ID NO: 2546502 - protein, 25 aa, Entamoeba dispar
NGHELFWIYYCSLPLFTSKVPVVDF

SEQ ID NO: 2546503 - protein, 22 aa, Entamoeba dispar
NGILNFLLFKIGGESFQTLYDS

SEQ ID NO: 2546504 - protein, 17 aa, Entamoeba dispar
NGKIFIWSWKKGKILKV

SEQ ID NO: 2546505 - protein, 17 aa, Entamoeba dispar
NGKPYPLLYLWGEFFGT

SEQ ID NO: 2546506 - protein, 22 aa, Entamoeba dispar
NGKQKIYWYNQSKLTNITPEVI

SEQ ID NO: 2546507 - protein, 21 aa, Entamoeba dispar
NGKQSAFIRFEGLKRGKYCVR

SEQ ID NO: 2546508 - protein, 19 aa, Entamoeba dispar
NGLVWKKIIYMLLFERNLG

SEQ ID NO: 2546509 - protein, 22 aa, Entamoeba dispar
NGPEWIWPYGYYVMAILIYNPD

SEQ ID NO: 2546510 - protein, 22 aa, Entamoeba dispar
NGSQLIRFPLLKNVYADTVLSN

SEQ ID NO: 2546511 - protein, 19 aa, Entamoeba dispar
NGYEIILFFLKQILIRNDV

SEQ ID NO: 2546512 - protein, 25 aa, Entamoeba dispar
NHEELIFFLLFVDFTIYCSKQPIGQ

SEQ ID NO: 2546513 - protein, 18 aa, Entamoeba dispar
NHPFVQSPRYSPLGLHVQ

SEQ ID NO: 2546514 - protein, 17 aa, Entamoeba dispar
NHPLLSFLILPFYHPAP

SEQ ID NO: 2546515 - protein, 19 aa, Entamoeba dispar
NHYVLFKKLPIKIPIYFIN

SEQ ID NO: 2546516 - protein, 18 aa, Entamoeba dispar
NIDCGFRPKFGKLQLVNG

SEQ ID NO: 2546517 - protein, 17 aa, Entamoeba dispar
NIEFPMYFVDSKGLQGF

SEQ ID NO: 2546518 - protein, 24 aa, Entamoeba dispar
NIEVTVEIGFLLQTYNKTLKVPSQ

SEQ ID NO: 2546519 - protein, 17 aa, Entamoeba dispar
NIFFCFSQTAWFARGPR

SEQ ID NO: 2546520 - protein, 17 aa, Entamoeba dispar
NIFGWYNTKKIPSNGFI

SEQ ID NO: 2546521 - protein, 18 aa, Entamoeba dispar
NIFLALQYKRLFTQEEFL

SEQ ID NO: 2546522 - protein, 20 aa, Entamoeba dispar
NIFSSMLFEYIWPPCYDKFQ

SEQ ID NO: 2546523 - protein, 20 aa, Entamoeba dispar
NIHKIIPIFVFDGATLPSKK

SEQ ID NO: 2546524 - protein, 19 aa, Entamoeba dispar
NIIFYKLSPKKVDLINKIH

SEQ ID NO: 2546525 - protein, 17 aa, Entamoeba dispar
NIIGHQFFWFLKAEMHD

SEQ ID NO: 2546526 - protein, 19 aa, Entamoeba dispar
NIIGHQFFWFLKAEMHDNR

SEQ ID NO: 2546527 - protein, 19 aa, Entamoeba dispar
NIILPFQFCNFVHLKQLIV

SEQ ID NO: 2546528 - protein, 30 aa, Entamoeba dispar
NIKGRKRTYPIWRRVNYYDYSWGMTINDFP

SEQ ID NO: 2546529 - protein, 17 aa, Entamoeba dispar
NIKLVFTALPFIRTFLL

SEQ ID NO: 2546530 - protein, 23 aa, Entamoeba dispar
NIKYIFRDILFLLISYSLKERCE

SEQ ID NO: 2546531 - protein, 21 aa, Entamoeba dispar
NINWLLEMIVYIALSPNINKE

SEQ ID NO: 2546532 - protein, 24 aa, Entamoeba dispar
NIPFKNLLPFYYNLKHPLIPIYLT

SEQ ID NO: 2546533 - protein, 20 aa, Entamoeba dispar
NIPIIPLYWNILRNITYSTS

SEQ ID NO: 2546534 - protein, 22 aa, Entamoeba dispar
NIQKYIILCVLLRSIHPIYIEM

SEQ ID NO: 2546535 - protein, 18 aa, Entamoeba dispar
NIRFICIVLHALQIIRPT

SEQ ID NO: 2546536 - protein, 18 aa, Entamoeba dispar
NITPQKNIIIFPYRLNYN

SEQ ID NO: 2546537 - protein, 25 aa, Entamoeba dispar
NIVIDIMCILPNGKQIWININKDDD

SEQ ID NO: 2546538 - protein, 19 aa, Entamoeba dispar
NIYCVIKLNLWYIKPKTIK

SEQ ID NO: 2546539 - protein, 19 aa, Entamoeba dispar
NIYSKFLPYYFPTTEFEDN

SEQ ID NO: 2546540 - protein, 27 aa, Entamoeba dispar
NKAKILHYILLLFFPTALNFCEQMSVG

SEQ ID NO: 2546541 - protein, 25 aa, Entamoeba dispar
NKDYKILTPVRIPILVDLKPGEYVT

SEQ ID NO: 2546542 - protein, 21 aa, Entamoeba dispar
NKFCKLYVRFIQTLRQQNGLT

SEQ ID NO: 2546543 - protein, 21 aa, Entamoeba dispar
NKFKLTFFFFQCFIKSCVVAD

SEQ ID NO: 2546544 - protein, 27 aa, Entamoeba dispar
NKIEDEFLMFLFYYAQGTELQLQAAEM

SEQ ID NO: 2546545 - protein, 24 aa, Entamoeba dispar
NKISYFSIYLFYLQTKKIKMDEGK

SEQ ID NO: 2546546 - protein, 20 aa, Entamoeba dispar
NKLLLYHSFFLSLPPESIHY

SEQ ID NO: 2546547 - protein, 18 aa, Entamoeba dispar
NKLYPQIYFHDKSSYYFP

SEQ ID NO: 2546548 - protein, 23 aa, Entamoeba dispar
NKNIAPDYWLIGSLLMVALVNSV

SEQ ID NO: 2546549 - protein, 17 aa, Entamoeba dispar
NKQLKEPPLLPPKPKRL

SEQ ID NO: 2546550 - protein, 28 aa, Entamoeba dispar
NKRIFTQNFLFDLCLEYGFWFESKPSRK

SEQ ID NO: 2546551 - protein, 17 aa, Entamoeba dispar
NKSFFHIGLLLITPTKG

SEQ ID NO: 2546552 - protein, 23 aa, Entamoeba dispar
NKSNKLIILYKPLIEWGKELYEY

SEQ ID NO: 2546553 - protein, 24 aa, Entamoeba dispar
NKSVVFFILNYLLDLLREFGFFFD

SEQ ID NO: 2546554 - protein, 22 aa, Entamoeba dispar
NKYDWALNFIKFLKEMVVYIKQ

SEQ ID NO: 2546555 - protein, 21 aa, Entamoeba dispar
NLFEEFISLIYFILSSQFKME

SEQ ID NO: 2546556 - protein, 20 aa, Entamoeba dispar
NLFGIFYGYWLKVNKTYIID

SEQ ID NO: 2546557 - protein, 21 aa, Entamoeba dispar
NLFTIQFFFQVARILKLDGIF

SEQ ID NO: 2546558 - protein, 18 aa, Entamoeba dispar
NLFVFKYLFMFLTKVMAE

SEQ ID NO: 2546559 - protein, 20 aa, Entamoeba dispar
NLIKLWFRELPRPILNVLSC

SEQ ID NO: 2546560 - protein, 22 aa, Entamoeba dispar
NLISISPFWHWNFALDLHEVSI

SEQ ID NO: 2546561 - protein, 18 aa, Entamoeba dispar
NLLFLPTDKRFPPIRIKA

SEQ ID NO: 2546562 - protein, 19 aa, Entamoeba dispar
NLLICFIDLFTPPSLIKGK

SEQ ID NO: 2546563 - protein, 20 aa, Entamoeba dispar
NLLLIKKIVILTGIIRQISL

SEQ ID NO: 2546564 - protein, 20 aa, Entamoeba dispar
NLLTIPLWTKYYLRYSFPKI

SEQ ID NO: 2546565 - protein, 23 aa, Entamoeba dispar
NLNECLLNKLWFNKLLDIDIKNT

SEQ ID NO: 2546566 - protein, 21 aa, Entamoeba dispar
NLPIEQFALLKSRMLGMLEEY

SEQ ID NO: 2546567 - protein, 17 aa, Entamoeba dispar
NLPLFYFSPININPPKF

SEQ ID NO: 2546568 - protein, 17 aa, Entamoeba dispar
NLPYLPLLPYENKFLIK

SEQ ID NO: 2546569 - protein, 19 aa, Entamoeba dispar
NLQCRVILYPVLHSIRCTI

SEQ ID NO: 2546570 - protein, 23 aa, Entamoeba dispar
NLQEQWLYYPWDCVTRKVKKIVL

SEQ ID NO: 2546571 - protein, 22 aa, Entamoeba dispar
NLQLMKWQLFRNLDLPAIQATK

SEQ ID NO: 2546572 - protein, 20 aa, Entamoeba dispar
NLQQTLLMLPTSNAILLLRW

SEQ ID NO: 2546573 - protein, 23 aa, Entamoeba dispar
NLTTISFPVYPLSSLINLSSLDI

SEQ ID NO: 2546574 - protein, 23 aa, Entamoeba dispar
NLVQSWRYCLYYGWLLINSPTTL

SEQ ID NO: 2546575 - protein, 18 aa, Entamoeba dispar
NLVYIILSLVLSGFQQVY

SEQ ID NO: 2546576 - protein, 17 aa, Entamoeba dispar
NLWLEYLLLCRNSNDFK

SEQ ID NO: 2546577 - protein, 21 aa, Entamoeba dispar
NLWQFDISNLIWRKLGNLENF

SEQ ID NO: 2546578 - protein, 18 aa, Entamoeba dispar
NLWVNLYCAQYIPLTSKF

SEQ ID NO: 2546579 - protein, 20 aa, Entamoeba dispar
NLYPFYNITSLIRYSSTDPI

SEQ ID NO: 2546580 - protein, 19 aa, Entamoeba dispar
NLYVLLKLNMIHGKVLIFV

SEQ ID NO: 2546581 - protein, 17 aa, Entamoeba dispar
NLYWENILYLFSIIPQE

SEQ ID NO: 2546582 - protein, 26 aa, Entamoeba dispar
NMEQLLIFLYPLFFDLYRSPTLSSSM

SEQ ID NO: 2546583 - protein, 25 aa, Entamoeba dispar
NMFQAFLIRLVIPFPLSLIVNEEAT

SEQ ID NO: 2546584 - protein, 21 aa, Entamoeba dispar
NMIYRAFINLPYKTFPNYQSN

SEQ ID NO: 2546585 - protein, 19 aa, Entamoeba dispar
NMYSAWNPQLLISIKTPQS

SEQ ID NO: 2546586 - protein, 20 aa, Entamoeba dispar
NMYSAWNPQLLISLKAPQAV

SEQ ID NO: 2546587 - protein, 17 aa, Entamoeba dispar
NNAEWLGVLKPTVSLIS

SEQ ID NO: 2546588 - protein, 24 aa, Entamoeba dispar
NNAFEQFIFLYLRHPYDIEEIDKI

SEQ ID NO: 2546589 - protein, 27 aa, Entamoeba dispar
NNENKLFRTFWFYCVVLKFVIKEEYNE

SEQ ID NO: 2546590 - protein, 25 aa, Entamoeba dispar
NNHCKFVWLFLLRNAFYKNCRIVLD

SEQ ID NO: 2546591 - protein, 21 aa, Entamoeba dispar
NNIILLNLLFPSYASLHSHLP

SEQ ID NO: 2546592 - protein, 20 aa, Entamoeba dispar
NNITFEFIVKWLLMLFKREF

SEQ ID NO: 2546593 - protein, 26 aa, Entamoeba dispar
NNKGVPFFWIRALSAVSLFLSYNTVE

SEQ ID NO: 2546594 - protein, 23 aa, Entamoeba dispar
NNLSFLPFDLSFSASLIPLIYQG

SEQ ID NO: 2546595 - protein, 24 aa, Entamoeba dispar
NNNPILLNPLSISSLPIGTNASKD

SEQ ID NO: 2546596 - protein, 24 aa, Entamoeba dispar
NNPNWLIEFLIGSSLRKGSQEHAI

SEQ ID NO: 2546597 - protein, 22 aa, Entamoeba dispar
NNVICPYFFFPLTTFNEYSIAG

SEQ ID NO: 2546598 - protein, 29 aa, Entamoeba dispar
NPDKPVEIEFFKPLTLITGPNGAGKTTII

SEQ ID NO: 2546599 - protein, 22 aa, Entamoeba dispar
NPEFIPYIPTLSKFLSYQKCHE

SEQ ID NO: 2546600 - protein, 23 aa, Entamoeba dispar
NPEFIPYIQLYLNFFHIKNVMRK

SEQ ID NO: 2546601 - protein, 24 aa, Entamoeba dispar
NPLTFFFKIIYFISIASFGEIIQL

SEQ ID NO: 2546602 - protein, 22 aa, Entamoeba dispar
NPPYEYYLYYLYANITVLNGFR

SEQ ID NO: 2546603 - protein, 24 aa, Entamoeba dispar
NPQNPILFIAPSIPYLPTTAEKHL

SEQ ID NO: 2546604 - protein, 22 aa, Entamoeba dispar
NPQTLLFILILIEKQPKDKIKE

SEQ ID NO: 2546605 - protein, 18 aa, Entamoeba dispar
NPYIIFCNTKREEVRAAN

SEQ ID NO: 2546606 - protein, 21 aa, Entamoeba dispar
NQCFPLVFRYQVSIPNVESPT

SEQ ID NO: 2546607 - protein, 25 aa, Entamoeba dispar
NQELPYFYHTLLIDNLLKDVETYLK

SEQ ID NO: 2546608 - protein, 24 aa, Entamoeba dispar
NQNTLWYIFSFLRRVLEQQNINKM

SEQ ID NO: 2546609 - protein, 23 aa, Entamoeba dispar
NQSLKILPKEPLIWIAAARIEEI

SEQ ID NO: 2546610 - protein, 17 aa, Entamoeba dispar
NRDQIISILIRLEDSMQ

SEQ ID NO: 2546611 - protein, 23 aa, Entamoeba dispar
NRKRIVNEFLLKNKNHQLLIKSA

SEQ ID NO: 2546612 - protein, 18 aa, Entamoeba dispar
NRLEAFILMIYRMIDLYS

SEQ ID NO: 2546613 - protein, 18 aa, Entamoeba dispar
NRNFVVTPPILIIQILRF

SEQ ID NO: 2546614 - protein, 21 aa, Entamoeba dispar
NRYHRLFIKLALKKFFNVDIT

SEQ ID NO: 2546615 - protein, 19 aa, Entamoeba dispar
NSFKKLFLQAFTPTFSQVL

SEQ ID NO: 2546616 - protein, 20 aa, Entamoeba dispar
NSFLKKFYYTMKEPSYIDWK

SEQ ID NO: 2546617 - protein, 17 aa, Entamoeba dispar
NSFYKVLPLRQPMLMVG

SEQ ID NO: 2546618 - protein, 17 aa, Entamoeba dispar
NSLIYVEKLYPQVFPLI

SEQ ID NO: 2546619 - protein, 25 aa, Entamoeba dispar
NSPNIIWFFKFSLQTICPFTLAKLA

SEQ ID NO: 2546620 - protein, 23 aa, Entamoeba dispar
NSYYLERLFCFYIPIITRCSISI

SEQ ID NO: 2546621 - protein, 20 aa, Entamoeba dispar
NTDFKCYFTWFYETTQGVIK

SEQ ID NO: 2546622 - protein, 17 aa, Entamoeba dispar
NTDFYILDKFPAAIRPF

SEQ ID NO: 2546623 - protein, 22 aa, Entamoeba dispar
NTFLHWMIKVLRIVLIIGEKYK

SEQ ID NO: 2546624 - protein, 24 aa, Entamoeba dispar
NTKWVGIPWIGIGKVAVWPLEKSG

SEQ ID NO: 2546625 - protein, 23 aa, Entamoeba dispar
NTLEPLMTFLINTLPNPLHTKIL

SEQ ID NO: 2546626 - protein, 23 aa, Entamoeba dispar
NTMKLYFKYLHLEKWFSIDQIIL

SEQ ID NO: 2546627 - protein, 17 aa, Entamoeba dispar
NTNRFFLITKESTYLVA

SEQ ID NO: 2546628 - protein, 29 aa, Entamoeba dispar
NTQLLDLEYFFFIKAIVASTMKLNGFLES

SEQ ID NO: 2546629 - protein, 26 aa, Entamoeba dispar
NTTNYIFILRFLWILIVHRRARGITT

SEQ ID NO: 2546630 - protein, 27 aa, Entamoeba dispar
NTVDDYCLYFYLTFFIMKETHFEDNEM

SEQ ID NO: 2546631 - protein, 17 aa, Entamoeba dispar
NVFIRYLSYYTTYMNIY

SEQ ID NO: 2546632 - protein, 18 aa, Entamoeba dispar
NVFKILIISSIKLGKDVT

SEQ ID NO: 2546633 - protein, 18 aa, Entamoeba dispar
NVFPITDFWRHVCIVWTK

SEQ ID NO: 2546634 - protein, 18 aa, Entamoeba dispar
NVFPITDFWRHVCVVWTK

SEQ ID NO: 2546635 - protein, 20 aa, Entamoeba dispar
NVIDGLLFVFGRRAKQIRQQ

SEQ ID NO: 2546636 - protein, 18 aa, Entamoeba dispar
NVIDLYEYLYYGGILSFD

SEQ ID NO: 2546637 - protein, 20 aa, Entamoeba dispar
NVILPPWAKGSYRKFVRTNM

SEQ ID NO: 2546638 - protein, 17 aa, Entamoeba dispar
NVNFYTILFTWKQKKIW

SEQ ID NO: 2546639 - protein, 22 aa, Entamoeba dispar
NVNYLFCYRWIVLLFKRDFNSR

SEQ ID NO: 2546640 - protein, 17 aa, Entamoeba dispar
NVPLMNNGIIYNAFYSE

SEQ ID NO: 2546641 - protein, 20 aa, Entamoeba dispar
NVYLLLCLLTNKIIGIWKTN

SEQ ID NO: 2546642 - protein, 25 aa, Entamoeba dispar
NWCNFVTPRVLYFNNSFERFDLKEF

SEQ ID NO: 2546643 - protein, 19 aa, Entamoeba dispar
NWDIIKLQYKILFKEVKPG

SEQ ID NO: 2546644 - protein, 25 aa, Entamoeba dispar
NWREIYKSLLVLDNILKNGSEEAVN

SEQ ID NO: 2546645 - protein, 19 aa, Entamoeba dispar
NYAFRWFNCFLLREFSPEQ

SEQ ID NO: 2546646 - protein, 18 aa, Entamoeba dispar
NYFGILSNLFLIAGNIIS

SEQ ID NO: 2546647 - protein, 21 aa, Entamoeba dispar
NYFLFTCFCAFWVTSDGQLRI

SEQ ID NO: 2546648 - protein, 18 aa, Entamoeba dispar
NYHIFYQLLAGATAQQKS

SEQ ID NO: 2546649 - protein, 24 aa, Entamoeba dispar
NYHQIRLFKFTFWITSVDIEEIEQ

SEQ ID NO: 2546650 - protein, 17 aa, Entamoeba dispar
NYILDTYLFVRKYFTLD

SEQ ID NO: 2546651 - protein, 17 aa, Entamoeba dispar
NYLDLYLSDDFSQNKPV

SEQ ID NO: 2546652 - protein, 21 aa, Entamoeba dispar
NYLNIFPFRKWSDKEIPEFHE

SEQ ID NO: 2546653 - protein, 24 aa, Entamoeba dispar
NYNFKFFLMYPFLNIPPNYPNHGY

SEQ ID NO: 2546654 - protein, 23 aa, Entamoeba dispar
NYPKLPILFVWMGDLFHTNELPV

SEQ ID NO: 2546655 - protein, 17 aa, Entamoeba dispar
NYRFIIFDDINYDKNLV

SEQ ID NO: 2546656 - protein, 18 aa, Entamoeba dispar
NYRFILFDDINYDRNLIR

SEQ ID NO: 2546657 - protein, 19 aa, Entamoeba dispar
NYRVIPSLHFPLLSSDWGA

SEQ ID NO: 2546658 - protein, 18 aa, Entamoeba dispar
PAYLLAGLYLIDSLIRYL

SEQ ID NO: 2546659 - protein, 18 aa, Entamoeba dispar
PDDTTFFFLLLLQQYEQA

SEQ ID NO: 2546660 - protein, 24 aa, Entamoeba dispar
PDEFFQFYYLFEYYVDENGEFDCV

SEQ ID NO: 2546661 - protein, 26 aa, Entamoeba dispar
PDEYRHLFFYLISFLKKLIEMGEDKT

SEQ ID NO: 2546662 - protein, 20 aa, Entamoeba dispar
PDYLQLRMLFWRIAKREGIE

SEQ ID NO: 2546663 - protein, 23 aa, Entamoeba dispar
PEDFPLTQLLLPTSLLSLSIESP

SEQ ID NO: 2546664 - protein, 19 aa, Entamoeba dispar
PEDILYAGLRMRVLKVRTT

SEQ ID NO: 2546665 - protein, 18 aa, Entamoeba dispar
PEDLLPFLRKPMLLIIDS

SEQ ID NO: 2546666 - protein, 24 aa, Entamoeba dispar
PEKSYFYIMRNCDMLRFLDSNNTP

SEQ ID NO: 2546667 - protein, 25 aa, Entamoeba dispar
PEKSYFYIMRNCNMLRFLDSNNTAL

SEQ ID NO: 2546668 - protein, 19 aa, Entamoeba dispar
PEKSYFYLIKNADTIRLMD

SEQ ID NO: 2546669 - protein, 35 aa, Entamoeba dispar
PERPQGEFILWQPTRHTLFLPSQILAAAGYDSTET

SEQ ID NO: 2546670 - protein, 19 aa, Entamoeba dispar
PERTFIFKFLMNEINFHLN

SEQ ID NO: 2546671 - protein, 17 aa, Entamoeba dispar
PEWISLNLGIVICLECC

SEQ ID NO: 2546672 - protein, 17 aa, Entamoeba dispar
PEWLFEASPKYFAQLDK

SEQ ID NO: 2546673 - protein, 18 aa, Entamoeba dispar
PEYITLKSVVSKFVVNCL

SEQ ID NO: 2546674 - protein, 17 aa, Entamoeba dispar
PFCQLLCGLLNFVKGIT

SEQ ID NO: 2546675 - protein, 17 aa, Entamoeba dispar
PFFIPKEIYRLIDYIIQ

SEQ ID NO: 2546676 - protein, 20 aa, Entamoeba dispar
PFFIVYRNFLINHNKAFTLL

SEQ ID NO: 2546677 - protein, 19 aa, Entamoeba dispar
PFIFFMLEFAHNKFYITYR

SEQ ID NO: 2546678 - protein, 18 aa, Entamoeba dispar
PFPSLLRNYLRELRSLWI

SEQ ID NO: 2546679 - protein, 21 aa, Entamoeba dispar
PFVCVAIAGWIFSAKIPETIA

SEQ ID NO: 2546680 - protein, 19 aa, Entamoeba dispar
PFVPLLLFKTIMNELIESI

SEQ ID NO: 2546681 - protein, 17 aa, Entamoeba dispar
PFYPWYIIAVETTNKTK

SEQ ID NO: 2546682 - protein, 17 aa, Entamoeba dispar
PFYPWYIIAVETTNKTN

SEQ ID NO: 2546683 - protein, 19 aa, Entamoeba dispar
PGFLSLPRPTKLAPKPSTI

SEQ ID NO: 2546684 - protein, 17 aa, Entamoeba dispar
PGKLLELLGILFDPTIP

SEQ ID NO: 2546685 - protein, 21 aa, Entamoeba dispar
PHKHNIIAYKKLGFKVVLCGH

SEQ ID NO: 2546686 - protein, 18 aa, Entamoeba dispar
PHPFWLPKFQNGISYSLP

SEQ ID NO: 2546687 - protein, 24 aa, Entamoeba dispar
PHQHMLIVLKRPRSFKARPIITHS

SEQ ID NO: 2546688 - protein, 17 aa, Entamoeba dispar
PIDFIILPPLKLKDQQS

SEQ ID NO: 2546689 - protein, 20 aa, Entamoeba dispar
PIDIFNIINPLPFVLSSIHL

SEQ ID NO: 2546690 - protein, 20 aa, Entamoeba dispar
PIIFSFIIRSTYSYTFELWF

SEQ ID NO: 2546691 - protein, 21 aa, Entamoeba dispar
PIKHQNFLIKPISVFIQFGNC

SEQ ID NO: 2546692 - protein, 18 aa, Entamoeba dispar
PILQIYILQKLVQKFPMF

SEQ ID NO: 2546693 - protein, 25 aa, Entamoeba dispar
PINIKLPFLLKFLSIKNPLSLQIHP

SEQ ID NO: 2546694 - protein, 19 aa, Entamoeba dispar
PIQRLPRYRLLLKDLLKHL

SEQ ID NO: 2546695 - protein, 17 aa, Entamoeba dispar
PITIQILPPFTFINKLP

SEQ ID NO: 2546696 - protein, 18 aa, Entamoeba dispar
PITPPLRPKYFLGDKPLY

SEQ ID NO: 2546697 - protein, 17 aa, Entamoeba dispar
PIVIQENRFWYFKDSQG

SEQ ID NO: 2546698 - protein, 18 aa, Entamoeba dispar
PIVVIAYLELPRFDKKQN

SEQ ID NO: 2546699 - protein, 19 aa, Entamoeba dispar
PKEWLNISLIILSNIETQC

SEQ ID NO: 2546700 - protein, 23 aa, Entamoeba dispar
PKIYRFRPFIIKLTINTSFGIQF

SEQ ID NO: 2546701 - protein, 25 aa, Entamoeba dispar
PKKDFLRKFLFEPFPLESYFETVMA

SEQ ID NO: 2546702 - protein, 24 aa, Entamoeba dispar
PKKELYGMYILVKGTPKYLGSSIS

SEQ ID NO: 2546703 - protein, 18 aa, Entamoeba dispar
PKRSMVGIFFPNRAEWII

SEQ ID NO: 2546704 - protein, 24 aa, Entamoeba dispar
PKSSIPYFLGWYDSLKQLEKNSEP

SEQ ID NO: 2546705 - protein, 18 aa, Entamoeba dispar
PKYLLIKLERQIILNYQD

SEQ ID NO: 2546706 - protein, 17 aa, Entamoeba dispar
PKYQQLLNIIKASSEPG

SEQ ID NO: 2546707 - protein, 20 aa, Entamoeba dispar
PLCIMYPYDYPFTPPLFFTD

SEQ ID NO: 2546708 - protein, 22 aa, Entamoeba dispar
PLDCPWYICYFMGRPQAHFVCT

SEQ ID NO: 2546709 - protein, 17 aa, Entamoeba dispar
PLDWSYSYCLPLFIVSY

SEQ ID NO: 2546710 - protein, 18 aa, Entamoeba dispar
PLDYITILFYKSGPTYFQ

SEQ ID NO: 2546711 - protein, 17 aa, Entamoeba dispar
PLIDPLPFNYFVYCISD

SEQ ID NO: 2546712 - protein, 19 aa, Entamoeba dispar
PLILVLKLLLSLKLTEECS

SEQ ID NO: 2546713 - protein, 18 aa, Entamoeba dispar
PLIWYPDIFVLNGGYRYF

SEQ ID NO: 2546714 - protein, 20 aa, Entamoeba dispar
PLKLFYDFLIPKILNEKSLY

SEQ ID NO: 2546715 - protein, 19 aa, Entamoeba dispar
PLLIGFTYEYPISAPEMIC

SEQ ID NO: 2546716 - protein, 20 aa, Entamoeba dispar
PLLIIGSYYFRQRIQENNII

SEQ ID NO: 2546717 - protein, 20 aa, Entamoeba dispar
PLLSFLILPFYHPAPEFLEA

SEQ ID NO: 2546718 - protein, 21 aa, Entamoeba dispar
PLMNNGIIYNAFYSEGYLIVL

SEQ ID NO: 2546719 - protein, 20 aa, Entamoeba dispar
PLNYRINFIGTFYISKDNVK

SEQ ID NO: 2546720 - protein, 20 aa, Entamoeba dispar
PLPDPLLFLRACMLRIDLNG

SEQ ID NO: 2546721 - protein, 17 aa, Entamoeba dispar
PLVLLKKVSMKKATSDV

SEQ ID NO: 2546722 - protein, 18 aa, Entamoeba dispar
PLVLQLKAFLEKHDLDVS

SEQ ID NO: 2546723 - protein, 19 aa, Entamoeba dispar
PLVLQLKAFLEKHDLDVSV

SEQ ID NO: 2546724 - protein, 23 aa, Entamoeba dispar
PLVYRLIWICFVERKLRLVRHRK

SEQ ID NO: 2546725 - protein, 20 aa, Entamoeba dispar
PLYQPLLLPELVKLLRSICM

SEQ ID NO: 2546726 - protein, 22 aa, Entamoeba dispar
PLYRFFDWIFNKSPLMMLILIS

SEQ ID NO: 2546727 - protein, 17 aa, Entamoeba dispar
PMRGFIPDNMPMGEDSE

SEQ ID NO: 2546728 - protein, 24 aa, Entamoeba dispar
PNCKLIPFYFIPTETFYTLLLPIQ

SEQ ID NO: 2546729 - protein, 24 aa, Entamoeba dispar
PNKPAIFLPLITSLTKFFSNHLNA

SEQ ID NO: 2546730 - protein, 32 aa, Entamoeba dispar; identical to SEQ ID NO: 2536174

SEQ ID NO: 2546731 - protein, 21 aa, Entamoeba dispar
PNLNEIPLQPLLPSKIYTTKR

SEQ ID NO: 2546732 - protein, 17 aa, Entamoeba dispar
PNRDIKLLIRKYNFFNY

SEQ ID NO: 2546733 - protein, 24 aa, Entamoeba dispar
PPFDLFKNIFLLLNAIKSPYVLVA

SEQ ID NO: 2546734 - protein, 27 aa, Entamoeba dispar
PPGIYEFPFSFIPPPDLPPASYFGPKG

SEQ ID NO: 2546735 - protein, 18 aa, Entamoeba dispar
PPKGLLLFGPPGTGKTMI

SEQ ID NO: 2546736 - protein, 17 aa, Entamoeba dispar
PPLFVVSYYLALDPSLH

SEQ ID NO: 2546737 - protein, 17 aa, Entamoeba dispar
PPLLDIRINLIAPVIYF

SEQ ID NO: 2546738 - protein, 22 aa, Entamoeba dispar
PPLLSRFDIILLLLDDRSKIWD

SEQ ID NO: 2546739 - protein, 17 aa, Entamoeba dispar
PPLTFCYLLKPGEDVIK

SEQ ID NO: 2546740 - protein, 20 aa, Entamoeba dispar
PPYFYYMYYTYANIASLNYY

SEQ ID NO: 2546741 - protein, 17 aa, Entamoeba dispar
PQFLIPPQKSYLPRKVR

SEQ ID NO: 2546742 - protein, 20 aa, Entamoeba dispar
PQIGFLFYTLRLKIINGYPS

SEQ ID NO: 2546743 - protein, 25 aa, Entamoeba dispar
PQIRYCYYFYYYLSVFPREVPFKPI

SEQ ID NO: 2546744 - protein, 24 aa, Entamoeba dispar
PQKTLWIIRMRVLRRLLLKYRTTG

SEQ ID NO: 2546745 - protein, 25 aa, Entamoeba dispar
PQKTLWIIRMRVLRRLLLKYRTTGK

SEQ ID NO: 2546746 - protein, 24 aa, Entamoeba dispar
PQNKYLIWLFNNFSFLSPKINFDL

SEQ ID NO: 2546747 - protein, 26 aa, Entamoeba dispar
PQQYFFDYLQTLLLTTPLLLTHSNTV

SEQ ID NO: 2546748 - protein, 21 aa, Entamoeba dispar
PQSNWWLVYKQKSFGYVPAAY

SEQ ID NO: 2546749 - protein, 26 aa, Entamoeba dispar
PQVVFNLCWWIYTYGYLVEGVFRVSG

SEQ ID NO: 2546750 - protein, 18 aa, Entamoeba dispar
PRKFLIVMPKFFYEPIQQ

SEQ ID NO: 2546751 - protein, 21 aa, Entamoeba dispar
PRSYNILFQPPLRIVKKQKII

SEQ ID NO: 2546752 - protein, 20 aa, Entamoeba dispar
PRYFYLFNDILIYGIGDSNN

SEQ ID NO: 2546753 - protein, 21 aa, Entamoeba dispar
PSALLILQLLINVLLNQLVHN

SEQ ID NO: 2546754 - protein, 18 aa, Entamoeba dispar
PSDIVFLKGWIPVKINKF

SEQ ID NO: 2546755 - protein, 22 aa, Entamoeba dispar
PSFILFIKYYFIHVLQLEVNET

SEQ ID NO: 2546756 - protein, 25 aa, Entamoeba dispar
PSKEEIPLIILYINKIFPFTFCENL

SEQ ID NO: 2546757 - protein, 24 aa, Entamoeba dispar
PSLFCRYKLLPFYIDLFRSNMPEA

SEQ ID NO: 2546758 - protein, 17 aa, Entamoeba dispar
PSNIAIKALWIAIGFFR

SEQ ID NO: 2546759 - protein, 26 aa, Entamoeba dispar
PSNLTLPKWFPTQPIPFDFKSNKIED

SEQ ID NO: 2546760 - protein, 23 aa, Entamoeba dispar
PSPVDTMLTLFTPLPPILQQYNT

SEQ ID NO: 2546761 - protein, 18 aa, Entamoeba dispar
PSQLVGGILFLRVLSSFI

SEQ ID NO: 2546762 - protein, 22 aa, Entamoeba dispar
PSSDFFPLFWQIASQFINNPLP

SEQ ID NO: 2546763 - protein, 25 aa, Entamoeba dispar
PSVYTFMSMIFLAVRFSTLGWDKIN

SEQ ID NO: 2546764 - protein, 21 aa, Entamoeba dispar
PSYLIYFMRPGYSSDYITIQV

SEQ ID NO: 2546765 - protein, 26 aa, Entamoeba dispar
PTILQKPILPILPKTTPIYSTPTIQP

SEQ ID NO: 2546766 - protein, 24 aa, Entamoeba dispar
PTIVMMCLWIMMLKQKNIGSSNIR

SEQ ID NO: 2546767 - protein, 21 aa, Entamoeba dispar
PTKLLVFDFGGGTLDITCIEM

SEQ ID NO: 2546768 - protein, 20 aa, Entamoeba dispar
PTPEAIFLDWFPYDLENYII

SEQ ID NO: 2546769 - protein, 23 aa, Entamoeba dispar
PTPKIPILPLWLGDIIHAHTAFS

SEQ ID NO: 2546770 - protein, 18 aa, Entamoeba dispar
PTVKPLPGAIRILNYFKK

SEQ ID NO: 2546771 - protein, 23 aa, Entamoeba dispar
PTVRSLLVVLIFKIILNGYNGNK

SEQ ID NO: 2546772 - protein, 18 aa, Entamoeba dispar
PTYPSFSPYIPQVVQFTP

SEQ ID NO: 2546773 - protein, 25 aa, Entamoeba dispar
PVGKSYLLLMERLFRLLQMIDKNSG

SEQ ID NO: 2546774 - protein, 17 aa, Entamoeba dispar
PVPKHRLIPQKTKGVPE

SEQ ID NO: 2546775 - protein, 17 aa, Entamoeba dispar
PVQTDMLLFLKLVDYFQ

SEQ ID NO: 2546776 - protein, 23 aa, Entamoeba dispar
PVSWILICRVILYSLMELHKGTV

SEQ ID NO: 2546777 - protein, 19 aa, Entamoeba dispar
PWYLKFNCLYIYKDNTENP

SEQ ID NO: 2546778 - protein, 18 aa, Entamoeba dispar
PYIPKILEYCKNKLIGCT

SEQ ID NO: 2546779 - protein, 19 aa, Entamoeba dispar
PYLYFYNTDRMKLYKKVPI

SEQ ID NO: 2546780 - protein, 20 aa, Entamoeba dispar
PYMELPPLRALFLITTKGIP

SEQ ID NO: 2546781 - protein, 25 aa, Entamoeba dispar
PYSIVRFFLERLPLDKIYSIELTPN

SEQ ID NO: 2546782 - protein, 24 aa, Entamoeba dispar
PYYEKYFFLFLRCLKSFGRLESVE

SEQ ID NO: 2546783 - protein, 23 aa, Entamoeba dispar
PYYYNQLPFLFPGVPITYIVNPS

SEQ ID NO: 2546784 - protein, 24 aa, Entamoeba dispar
QAMWDWLDLLLPALSQLPYLKTSR

SEQ ID NO: 2546785 - protein, 17 aa, Entamoeba dispar
QANWDIIKLQYKILFKE

SEQ ID NO: 2546786 - protein, 19 aa, Entamoeba dispar
QATKYPFLPNFLKLEEFST

SEQ ID NO: 2546787 - protein, 17 aa, Entamoeba dispar
QAVCAITVWLKERNYNF

SEQ ID NO: 2546788 - protein, 24 aa, Entamoeba dispar
QDAFIKAAPFFLYMREFIGNNSHA

SEQ ID NO: 2546789 - protein, 21 aa, Entamoeba dispar
QDICYACLPLEFLKKEEYLTL

SEQ ID NO: 2546790 - protein, 26 aa, Entamoeba dispar
QDNMYSAWNPQLLISLKAPQAVAAMN

SEQ ID NO: 2546791 - protein, 23 aa, Entamoeba dispar
QDTLRLLTILFKFGKYYEVEHAI

SEQ ID NO: 2546792 - protein, 18 aa, Entamoeba dispar
QEALLPLQLRFIQIFVIC

SEQ ID NO: 2546793 - protein, 28 aa, Entamoeba dispar
QEANPFLVIVLLKYFFLSLPQSFFCDKL

SEQ ID NO: 2546794 - protein, 24 aa, Entamoeba dispar
QEATYFHWILPFPFKRCYVSSSIF

SEQ ID NO: 2546795 - protein, 23 aa, Entamoeba dispar
QECALICLLIYEGFNMQFSVPRK

SEQ ID NO: 2546796 - protein, 18 aa, Entamoeba dispar
QECREIMDFLYKRLSEDG

SEQ ID NO: 2546797 - protein, 25 aa, Entamoeba dispar
QEETLEFHYYLWKVFEFEMKKLNLD

SEQ ID NO: 2546798 - protein, 22 aa, Entamoeba dispar
QEFKQILKLLKSGSIRAVRVKT

SEQ ID NO: 2546799 - protein, 20 aa, Entamoeba dispar
QELIELKGFYYTLAMQQFGT

SEQ ID NO: 2546800 - protein, 17 aa, Entamoeba dispar
QEMNLFFFPIHPSFPIL

SEQ ID NO: 2546801 - protein, 19 aa, Entamoeba dispar
QENYKWVLLEDSFAQKDYI

SEQ ID NO: 2546802 - protein, 31 aa, Entamoeba dispar
QETKKHLHKIKWLLPSLRELFRRNDRRCSKK

SEQ ID NO: 2546803 - protein, 25 aa, Entamoeba dispar
QETSLLFGIAFDRRLEKLKEQYAEQ

SEQ ID NO: 2546804 - protein, 17 aa, Entamoeba dispar
QFCRTFVLILSPNPIIL

SEQ ID NO: 2546805 - protein, 18 aa, Entamoeba dispar
QFFNYLLPLLIELIKEKD

SEQ ID NO: 2546806 - protein, 18 aa, Entamoeba dispar
QFGYLRYEMDQTKKFLCV

SEQ ID NO: 2546807 - protein, 24 aa, Entamoeba dispar
QFIIDHWYFFSKLEQFRVSQEQWT

SEQ ID NO: 2546808 - protein, 23 aa, Entamoeba dispar
QFIQKKMMLISWMESILKVPINP

SEQ ID NO: 2546809 - protein, 28 aa, Entamoeba dispar
QFKGYPFTEWFWMIEFQDKYFGFQTIFT

SEQ ID NO: 2546810 - protein, 21 aa, Entamoeba dispar
QFPSLKYFWFKQNKPMMFIAA

SEQ ID NO: 2546811 - protein, 19 aa, Entamoeba dispar
QFQLATNLLWSLWGFVDAS

SEQ ID NO: 2546812 - protein, 18 aa, Entamoeba dispar
QFYFHHNFMLFLMQVRQG

SEQ ID NO: 2546813 - protein, 20 aa, Entamoeba dispar
QGFVIQFKFNNGLYIPACEY

SEQ ID NO: 2546814 - protein, 19 aa, Entamoeba dispar
QGPFNLRYLRRIIIYLNNT

SEQ ID NO: 2546815 - protein, 23 aa, Entamoeba dispar
QHFLIGIDIIYFLTPIFALTQVE

SEQ ID NO: 2546816 - protein, 18 aa, Entamoeba dispar
QHGTIFYKVKLPKKIFSV

SEQ ID NO: 2546817 - protein, 17 aa, Entamoeba dispar
QHKTILKILFMLSKWMS

SEQ ID NO: 2546818 - protein, 22 aa, Entamoeba dispar
QHMLIVLKRPKSFKARPIITHA

SEQ ID NO: 2546819 - protein, 22 aa, Entamoeba dispar
QHMLIVLKRPKSFKARPIITHS

SEQ ID NO: 2546820 - protein, 23 aa, Entamoeba dispar
QIAKFYTWINKWEKVIPDRRAVL

SEQ ID NO: 2546821 - protein, 19 aa, Entamoeba dispar
QIDLWPNFQFFLNEQAKEK

SEQ ID NO: 2546822 - protein, 18 aa, Entamoeba dispar
QIEIIKWIRGIAPEIIKK

SEQ ID NO: 2546823 - protein, 20 aa, Entamoeba dispar
QIGEQLLFKLKPFQIQGVEF

SEQ ID NO: 2546824 - protein, 19 aa, Entamoeba dispar
QIHLRLLFALNFKEGCDPL

SEQ ID NO: 2546825 - protein, 17 aa, Entamoeba dispar
QIKLFYLYLINKLDQYV

SEQ ID NO: 2546826 - protein, 17 aa, Entamoeba dispar
QILILWEVKTNLFGWNN

SEQ ID NO: 2546827 - protein, 24 aa, Entamoeba dispar
QILLIPYFCDIIDKLFPMQGKSVL

SEQ ID NO: 2546828 - protein, 19 aa, Entamoeba dispar
QILLLNLYEQLIKVVLLPQ

SEQ ID NO: 2546829 - protein, 19 aa, Entamoeba dispar
QILMYLVPLKLRCGMYLPM

SEQ ID NO: 2546830 - protein, 21 aa, Entamoeba dispar
QILSALFFHKIITPAIVTPSK

SEQ ID NO: 2546831 - protein, 17 aa, Entamoeba dispar
QINNGLLYLLRTLGYSF

SEQ ID NO: 2546832 - protein, 25 aa, Entamoeba dispar
QINNSILYLFYQLKHWSIQPTNLNA

SEQ ID NO: 2546833 - protein, 23 aa, Entamoeba dispar
QINRLFSFILKNILTIFPSSKRC

SEQ ID NO: 2546834 - protein, 18 aa, Entamoeba dispar
QIPPLKWINPITGTGKIT

SEQ ID NO: 2546835 - protein, 20 aa, Entamoeba dispar
QIRKPISWLVGRKVKRGTDW

SEQ ID NO: 2546836 - protein, 22 aa, Entamoeba dispar
QITNLCPFGIFLQLRYLSLKNN

SEQ ID NO: 2546837 - protein, 19 aa, Entamoeba dispar
QITVLPYIPISPKQPGLSS

SEQ ID NO: 2546838 - protein, 23 aa, Entamoeba dispar
QKCPPFLIGPLKKNILPIESVEM

SEQ ID NO: 2546839 - protein, 24 aa, Entamoeba dispar
QKEIRLPFCIKILEIFVEYLTDIE

SEQ ID NO: 2546840 - protein, 19 aa, Entamoeba dispar
QKFLLFDFHLKSIEGSLSF

SEQ ID NO: 2546841 - protein, 24 aa, Entamoeba dispar
QKKFPFIPLILKYIEAMTFYSNDF

SEQ ID NO: 2546842 - protein, 17 aa, Entamoeba dispar
QKKIALDKFLFLYAKEL

SEQ ID NO: 2546843 - protein, 23 aa, Entamoeba dispar
QKKLMVVVFPIYYEPFGCYINHP

SEQ ID NO: 2546844 - protein, 21 aa, Entamoeba dispar
QKSIPIIYLISLYNPSKRIQK

SEQ ID NO: 2546845 - protein, 21 aa, Entamoeba dispar
QKTYWKWFISLSEIPRPSYHC

SEQ ID NO: 2546846 - protein, 20 aa, Entamoeba dispar
QKVKHPFLVNLYYSFQSATH

SEQ ID NO: 2546847 - protein, 22 aa, Entamoeba dispar
QKYQRPCWFWGVSKFGIEQSDI

SEQ ID NO: 2546848 - protein, 20 aa, Entamoeba dispar
QLEFAICAVFRSWMGKRAVD

SEQ ID NO: 2546849 - protein, 19 aa, Entamoeba dispar
QLFAFFKYYEFIISQSDNM

SEQ ID NO: 2546850 - protein, 21 aa, Entamoeba dispar
QLIKKIPLVLLKKVSMKKATS

SEQ ID NO: 2546851 - protein, 18 aa, Entamoeba dispar
QLLAYFMGRTFKFLTELG

SEQ ID NO: 2546852 - protein, 17 aa, Entamoeba dispar
QLLNIIKASSEPGEEFF

SEQ ID NO: 2546853 - protein, 27 aa, Entamoeba dispar
QLPKQNTLPPKPAAPAALPPKHHQSLN

SEQ ID NO: 2546854 - protein, 30 aa, Entamoeba dispar
QLREIIKTIPKFWYFTLKNSGYLDIVFANQ

SEQ ID NO: 2546855 - protein, 23 aa, Entamoeba dispar
QLVVLELPRPLLTPGYEAVIHIH

SEQ ID NO: 2546856 - protein, 17 aa, Entamoeba dispar
QLWIFTQPIYPISIHSY

SEQ ID NO: 2546857 - protein, 21 aa, Entamoeba dispar
QLYLFPSIFIIQLSFTIDGSN

SEQ ID NO: 2546858 - protein, 19 aa, Entamoeba dispar
QMFVHLFQFLNIKKNKFPS

SEQ ID NO: 2546859 - protein, 18 aa, Entamoeba dispar
QMIPLKFRKQKSSVTHQK

SEQ ID NO: 2546860 - protein, 18 aa, Entamoeba dispar
QMKLSLYLNLALCYLKVD

SEQ ID NO: 2546861 - protein, 20 aa, Entamoeba dispar
QNLIHILLLYHDPILSIHLD

SEQ ID NO: 2546862 - protein, 22 aa, Entamoeba dispar
QNPPLFLYFATILETSSLNALE

SEQ ID NO: 2546863 - protein, 20 aa, Entamoeba dispar
QNTLWYIFSFLRRVLEQQNI

SEQ ID NO: 2546864 - protein, 23 aa, Entamoeba dispar
QNVMNLYLRILLRKTGDHSKKCI

SEQ ID NO: 2546865 - protein, 19 aa, Entamoeba dispar
QPCFPRYLSLLFPNDLPTT

SEQ ID NO: 2546866 - protein, 22 aa, Entamoeba dispar
QPPILVFDILQLKFKGLLISTK

SEQ ID NO: 2546867 - protein, 24 aa, Entamoeba dispar
QPQTQIILYWSFIHLFIICLENHR

SEQ ID NO: 2546868 - protein, 24 aa, Entamoeba dispar
QQDLFFFHVLSPGSCFWLPHGTRI

SEQ ID NO: 2546869 - protein, 22 aa, Entamoeba dispar
QQGFFICPLINCLLTHNNKLYS

SEQ ID NO: 2546870 - protein, 18 aa, Entamoeba dispar
QQIFFIIDIKMIALHKTK

SEQ ID NO: 2546871 - protein, 23 aa, Entamoeba dispar
QQKDIVFLLICDQYFFGFFNSQC

SEQ ID NO: 2546872 - protein, 25 aa, Entamoeba dispar
QQLDILIQSLILIPETLIKEETNSD

SEQ ID NO: 2546873 - protein, 19 aa, Entamoeba dispar
QQRPWCLRFEYWKQILPMS

SEQ ID NO: 2546874 - protein, 27 aa, Entamoeba dispar
QRANALKWIIQLLLHDCPITEKIRIVD

SEQ ID NO: 2546875 - protein, 17 aa, Entamoeba dispar
QRFPRYILLLESLIKAT

SEQ ID NO: 2546876 - protein, 20 aa, Entamoeba dispar
QRKQRELENLRLQEQLRKQK

SEQ ID NO: 2546877 - protein, 23 aa, Entamoeba dispar
QRLPNLVYFLQSVPFVRLQAMFD

SEQ ID NO: 2546878 - protein, 18 aa, Entamoeba dispar
QRLPRYQLLLKDLLKHTQ

SEQ ID NO: 2546879 - protein, 23 aa, Entamoeba dispar
QSFKHFFFFCREFNFLSKDDIAP

SEQ ID NO: 2546880 - protein, 20 aa, Entamoeba dispar
QSFRRIILLLWKGIDWRNVP

SEQ ID NO: 2546881 - protein, 18 aa, Entamoeba dispar
QSGLYYFVHKRKLIIQIF

SEQ ID NO: 2546882 - protein, 19 aa, Entamoeba dispar
QSIIQFLKLMKPNSFKVFD

SEQ ID NO: 2546883 - protein, 23 aa, Entamoeba dispar
QSIQNFIPPHLNPVNLFQMNENA

SEQ ID NO: 2546884 - protein, 25 aa, Entamoeba dispar
QSKEYGLLVIFLLSDVLLVHRAKQE

SEQ ID NO: 2546885 - protein, 21 aa, Entamoeba dispar
QSLLFLTDELAKPSSLPFLKL

SEQ ID NO: 2546886 - protein, 22 aa, Entamoeba dispar
QSPFIYFLRFHDEPTIVECLEA

SEQ ID NO: 2546887 - protein, 22 aa, Entamoeba dispar
QSQTLLHLFLQNFPFPFLDLMQ

SEQ ID NO: 2546888 - protein, 21 aa, Entamoeba dispar
QSQYKFVYFVSFLLGYYLFET

SEQ ID NO: 2546889 - protein, 23 aa, Entamoeba dispar
QSTKTMRRPLPPLPIQETKTRST

SEQ ID NO: 2546890 - protein, 18 aa, Entamoeba dispar
QSWDWYYPYLYAPFAEDM

SEQ ID NO: 2546891 - protein, 19 aa, Entamoeba dispar
QSWDWYYPYLYAPFAEDMG

SEQ ID NO: 2546892 - protein, 17 aa, Entamoeba dispar
QTFNDFFYALSVILPRS

SEQ ID NO: 2546893 - protein, 24 aa, Entamoeba dispar
QTHVFLIYPNFLFPTTATIDILIE

SEQ ID NO: 2546894 - protein, 24 aa, Entamoeba dispar
QTISSLKYLILMKLMQQKINEIDF

SEQ ID NO: 2546895 - protein, 17 aa, Entamoeba dispar
QTKIIVLIPPPLQYCTF

SEQ ID NO: 2546896 - protein, 24 aa, Entamoeba dispar
QTKKKRWCILTKNKLFYFNCKPEN

SEQ ID NO: 2546897 - protein, 18 aa, Entamoeba dispar
QTLPLLSHRFQPKVLAPL

SEQ ID NO: 2546898 - protein, 19 aa, Entamoeba dispar
QTVILCELLMILSGARYVG

SEQ ID NO: 2546899 - protein, 26 aa, Entamoeba dispar
QVGKYHLKFLIQPFLHWPDTMMTVIE

SEQ ID NO: 2546900 - protein, 17 aa, Entamoeba dispar
QVHWWYYEDKWVQFRQK

SEQ ID NO: 2546901 - protein, 25 aa, Entamoeba dispar
QVIQNHFATFYLLPGTYHVCSYSNE

SEQ ID NO: 2546902 - protein, 22 aa, Entamoeba dispar
QVLDMLWMIWNFDEEYSIFCKE

SEQ ID NO: 2546903 - protein, 18 aa, Entamoeba dispar
QVRLIFMHWKGPAVKRMV

SEQ ID NO: 2546904 - protein, 24 aa, Entamoeba dispar
QVSDIMRMLPPTRQILLFSATLPR

SEQ ID NO: 2546905 - protein, 18 aa, Entamoeba dispar
QVVFNLCWWIYTYGYLVE

SEQ ID NO: 2546906 - protein, 18 aa, Entamoeba dispar
QVVHIHCTLFLTKNGYDE

SEQ ID NO: 2546907 - protein, 23 aa, Entamoeba dispar
QVVPPLIDMSFFSAGLKPQRYQN

SEQ ID NO: 2546908 - protein, 18 aa, Entamoeba dispar
QWCDDFIGFFTINLSIQP

SEQ ID NO: 2546909 - protein, 18 aa, Entamoeba dispar
QWYLILCELSETLQKHKI

SEQ ID NO: 2546910 - protein, 17 aa, Entamoeba dispar
QYGGFELSLWDIGGTAS

SEQ ID NO: 2546911 - protein, 22 aa, Entamoeba dispar
QYGILIEIYRKENIPLFGPLVT

SEQ ID NO: 2546912 - protein, 24 aa, Entamoeba dispar
QYKMPLSWIILKRVVQGRDWHYGR

SEQ ID NO: 2546913 - protein, 19 aa, Entamoeba dispar
QYKYNWIIRNYLRAIEYSN

SEQ ID NO: 2546914 - protein, 22 aa, Entamoeba dispar
QYLDLYLIHWPIALKVGTSNTP

SEQ ID NO: 2546915 - protein, 17 aa, Entamoeba dispar
QYPIFPWILTDYTSKTI

SEQ ID NO: 2546916 - protein, 26 aa, Entamoeba dispar
QYTIPFPYYLFIPKCYKMIAKLCGGY

SEQ ID NO: 2546917 - protein, 20 aa, Entamoeba dispar
QYWIFQLVAAILHLGNVYFT

SEQ ID NO: 2546918 - protein, 20 aa, Entamoeba dispar
QYYCLLQTISQKRFIGVVGG

SEQ ID NO: 2546919 - protein, 24 aa, Entamoeba dispar
RAGSKFVINQPAVYKLPSSEHYVV

SEQ ID NO: 2546920 - protein, 17 aa, Entamoeba dispar
RAKIWKLLLRYYTAEQK

SEQ ID NO: 2546921 - protein, 17 aa, Entamoeba dispar
RAKTFLPYYIQPLLNLI

SEQ ID NO: 2546922 - protein, 20 aa, Entamoeba dispar
RALLYAHFQRRVITDGRMVS

SEQ ID NO: 2546923 - protein, 17 aa, Entamoeba dispar
RALSFIRIGMPIPFYVL

SEQ ID NO: 2546924 - protein, 25 aa, Entamoeba dispar
RATNLLPMVYKLWFKYVRLEETVEN

SEQ ID NO: 2546925 - protein, 23 aa, Entamoeba dispar
RCVDDFIFFCFLVGNDFLPHIPS

SEQ ID NO: 2546926 - protein, 23 aa, Entamoeba dispar
RCVDDFIFFCFLVGNDFLPRIPS

SEQ ID NO: 2546927 - protein, 23 aa, Entamoeba dispar
RDGNLLCLILLLQTFPSIQESSV

SEQ ID NO: 2546928 - protein, 18 aa, Entamoeba dispar
RDLFSLFFNVEFFERVWS

SEQ ID NO: 2546929 - protein, 17 aa, Entamoeba dispar
RDWYYLNIYYLKKVGAI

SEQ ID NO: 2546930 - protein, 18 aa, Entamoeba dispar
REAQICNGLLYLLRSLGY

SEQ ID NO: 2546931 - protein, 23 aa, Entamoeba dispar
RECTSLVYIKFPTSITSIGNECF

SEQ ID NO: 2546932 - protein, 23 aa, Entamoeba dispar
REEKILCKIFPLYFSYIQENPQT

SEQ ID NO: 2546933 - protein, 17 aa, Entamoeba dispar
REIAIQNIELWKQNDEL

SEQ ID NO: 2546934 - protein, 17 aa, Entamoeba dispar
REIFNDIFLLADGKGLF

SEQ ID NO: 2546935 - protein, 17 aa, Entamoeba dispar
REKIQLVSWLNQQLLTD

SEQ ID NO: 2546936 - protein, 23 aa, Entamoeba dispar
RFAPPLSIIIIKPGTYEETEPII

SEQ ID NO: 2546937 - protein, 20 aa, Entamoeba dispar
RFATLTGNYFRNAMATIIMF

SEQ ID NO: 2546938 - protein, 17 aa, Entamoeba dispar
RFCFFLAAVIQGVDNHA

SEQ ID NO: 2546939 - protein, 18 aa, Entamoeba dispar
RFCLPLCIMYPYDYPFTP

SEQ ID NO: 2546940 - protein, 23 aa, Entamoeba dispar
RFCLPLCIMYPYDYSFTPPLFFT

SEQ ID NO: 2546941 - protein, 26 aa, Entamoeba dispar
RFFFETFKKLRVGAVLYLLYGRQSQN

SEQ ID NO: 2546942 - protein, 18 aa, Entamoeba dispar
RFHFNPIPLNDYSRKLFP

SEQ ID NO: 2546943 - protein, 21 aa, Entamoeba dispar
RFHFNPIPLNKYSRKLFPNIE

SEQ ID NO: 2546944 - protein, 22 aa, Entamoeba dispar
RFHFNPIPLNNYSRRFFPNIET

SEQ ID NO: 2546945 - protein, 20 aa, Entamoeba dispar
RFHFNPIPLNYYSRRFFPNI

SEQ ID NO: 2546946 - protein, 21 aa, Entamoeba dispar
RFHRNDFLIYLLKKGTNLKTI

SEQ ID NO: 2546947 - protein, 18 aa, Entamoeba dispar
RFQRDAILALHFIAEDFL

SEQ ID NO: 2546948 - protein, 18 aa, Entamoeba dispar
RFVFTCFSAFWVLSDGIA

SEQ ID NO: 2546949 - protein, 18 aa, Entamoeba dispar
RFYHRLPIFLREESFRKK

SEQ ID NO: 2546950 - protein, 26 aa, Entamoeba dispar
RGANKHLFIAYYTLFVKPVFEIYQKT

SEQ ID NO: 2546951 - protein, 19 aa, Entamoeba dispar
RGDFGCEVLFYLLAQKLMN

SEQ ID NO: 2546952 - protein, 21 aa, Entamoeba dispar
RGDTHYLLYIIDQLRNECIDV

SEQ ID NO: 2546953 - protein, 21 aa, Entamoeba dispar
RGFLPIAEYLLFHSNGLAPTA

SEQ ID NO: 2546954 - protein, 17 aa, Entamoeba dispar
RGHPRFRKPRIGGDGVY

SEQ ID NO: 2546955 - protein, 22 aa, Entamoeba dispar
RGHYGLECLLLLVALKLRFPQR

SEQ ID NO: 2546956 - protein, 18 aa, Entamoeba dispar
RGIFIDWKGPKCKGIAKV

SEQ ID NO: 2546957 - protein, 24 aa, Entamoeba dispar
RGKGNMVFLFLRKGIYTCQALVMK

SEQ ID NO: 2546958 - protein, 24 aa, Entamoeba dispar
RGKKNYLPPVPLVFGIGIMFVVEK

SEQ ID NO: 2546959 - protein, 24 aa, Entamoeba dispar
RGKVAAFFLFIAPPSMEILEQRLR

SEQ ID NO: 2546960 - protein, 21 aa, Entamoeba dispar
RGRLPYFVTPPLPEKNDTIDT

SEQ ID NO: 2546961 - protein, 18 aa, Entamoeba dispar
RICYLFNDSILFVRERGK

SEQ ID NO: 2546962 - protein, 17 aa, Entamoeba dispar
RIFKKSKFNLYLSNSIQ

SEQ ID NO: 2546963 - protein, 17 aa, Entamoeba dispar
RIGFLNSFFFTKLSKNW

SEQ ID NO: 2546964 - protein, 17 aa, Entamoeba dispar
RIGHQFFWFLKAELHDN

SEQ ID NO: 2546965 - protein, 18 aa, Entamoeba dispar
RIIDYTTRIPIRDLRHCH

SEQ ID NO: 2546966 - protein, 19 aa, Entamoeba dispar
RIIISLPFRLKYVCSFENI

SEQ ID NO: 2546967 - protein, 18 aa, Entamoeba dispar
RIINKLLISYITKPHQRM

SEQ ID NO: 2546968 - protein, 32 aa, Entamoeba dispar
RIKIIKEMFPELLQRILLASKISFEKSKEGGV

SEQ ID NO: 2546969 - protein, 21 aa, Entamoeba dispar
RIPKPAILKPIPKWTGKQVIT

SEQ ID NO: 2546970 - protein, 22 aa, Entamoeba dispar
RIPRYRLLLQELLKTLPPQHSE

SEQ ID NO: 2546971 - protein, 19 aa, Entamoeba dispar
RIRETYWHIFPTHYSLYTN

SEQ ID NO: 2546972 - protein, 21 aa, Entamoeba dispar
RIRLLLMNIIQMMESGWTVSP

SEQ ID NO: 2546973 - protein, 18 aa, Entamoeba dispar
RITNILINLFLDKPSNAA

SEQ ID NO: 2546974 - protein, 17 aa, Entamoeba dispar
RKFATPFFLLKKAFECC

SEQ ID NO: 2546975 - protein, 26 aa, Entamoeba dispar
RKHGPLFIYLFRLMLATGIPELQSAK

SEQ ID NO: 2546976 - protein, 27 aa, Entamoeba dispar
RKKLTPLELFWLLNEFADLLGPSPLIV

SEQ ID NO: 2546977 - protein, 18 aa, Entamoeba dispar
RKLIIILFLLIHTKSTKI

SEQ ID NO: 2546978 - protein, 26 aa, Entamoeba dispar
RKMTMRTLHFFVWKKYILPNGKIITS

SEQ ID NO: 2546979 - protein, 22 aa, Entamoeba dispar
RKYSTLFFALLPESLYDVDAIS

SEQ ID NO: 2546980 - protein, 19 aa, Entamoeba dispar
RLFGIPFMKVAKPQMRVII

SEQ ID NO: 2546981 - protein, 19 aa, Entamoeba dispar
RLFKKWEVILFRKQDRKKK

SEQ ID NO: 2546982 - protein, 23 aa, Entamoeba dispar
RLLINKLFKYLWPPMIALKEGQC

SEQ ID NO: 2546983 - protein, 17 aa, Entamoeba dispar
RLLLMNIIQMMESGWTV

SEQ ID NO: 2546984 - protein, 21 aa, Entamoeba dispar
RLLTVVSLLELYRSLKVLFVK

SEQ ID NO: 2546985 - protein, 23 aa, Entamoeba dispar
RLNVLIPYFTYLQKWSKCSKFNV

SEQ ID NO: 2546986 - protein, 18 aa, Entamoeba dispar
RLPKANKFIWLFPVHIGE

SEQ ID NO: 2546987 - protein, 17 aa, Entamoeba dispar
RLRKIFFPDFFMKHQNI

SEQ ID NO: 2546988 - protein, 22 aa, Entamoeba dispar
RLSIGLMWWMLTREILRYQGKL

SEQ ID NO: 2546989 - protein, 18 aa, Entamoeba dispar
RLWYCFYSLLSDINEHPK

SEQ ID NO: 2546990 - protein, 24 aa, Entamoeba dispar
RLYGEYCHLCLLPYLRAVTKEVIQ

SEQ ID NO: 2546991 - protein, 34 aa, Entamoeba dispar
RMGYPNRMIYSEFLKRYYFLGDKINRRASDEKAT

SEQ ID NO: 2546992 - protein, 17 aa, Entamoeba dispar
RMIGLCVIMAQIGMFIP

SEQ ID NO: 2546993 - protein, 18 aa, Entamoeba dispar
RMIGLCVIMAQIGMFIPC

SEQ ID NO: 2546994 - protein, 18 aa, Entamoeba dispar
RMLIWKLEETHRIVLEVI

SEQ ID NO: 2546995 - protein, 17 aa, Entamoeba dispar
RMRISIAKAIYMHPDLL

SEQ ID NO: 2546996 - protein, 21 aa, Entamoeba dispar
RMTIARPIMSSLLVCYTKYLK

SEQ ID NO: 2546997 - protein, 23 aa, Entamoeba dispar
RNDGYISYWRLFRNGRWKPVKEV

SEQ ID NO: 2546998 - protein, 18 aa, Entamoeba dispar
RNFCEVFRYLPVSALIEG

SEQ ID NO: 2546999 - protein, 17 aa, Entamoeba dispar
RNKLVHHLIMEYGIYKR

SEQ ID NO: 2547000 - protein, 21 aa, Entamoeba dispar
RNMFPFFILASQINGLPLFLH

SEQ ID NO: 2547001 - protein, 19 aa, Entamoeba dispar
RPELILPANKWYEIKHQNK

SEQ ID NO: 2547002 - protein, 18 aa, Entamoeba dispar
RPIYAVICMFLRIVVSEV

SEQ ID NO: 2547003 - protein, 19 aa, Entamoeba dispar
RPKDYNPVLPFISGLSQLM

SEQ ID NO: 2547004 - protein, 20 aa, Entamoeba dispar
RPKKPQSAYFLYLNEHRASI

SEQ ID NO: 2547005 - protein, 24 aa, Entamoeba dispar
RPKRPQTPYFLYLHEHRASIKEEH

SEQ ID NO: 2547006 - protein, 18 aa, Entamoeba dispar
RPSTGYNAIFRKCQPCRG

SEQ ID NO: 2547007 - protein, 22 aa, Entamoeba dispar
RPVSWILICRIIIYSLMEIHKG

SEQ ID NO: 2547008 - protein, 18 aa, Entamoeba dispar
RQELCSMFPPLVIESLIN

SEQ ID NO: 2547009 - protein, 18 aa, Entamoeba dispar
RQERLKQIQAAREAARRE

SEQ ID NO: 2547010 - protein, 20 aa, Entamoeba dispar
RQEYCFIPFKYRDGYLLSIL

SEQ ID NO: 2547011 - protein, 24 aa, Entamoeba dispar
RQHFHYFILYRSTLCWIKDIYNNK

SEQ ID NO: 2547012 - protein, 22 aa, Entamoeba dispar
RQYLDLKSKYDQLKSDNLMVLS

SEQ ID NO: 2547013 - protein, 22 aa, Entamoeba dispar
RREVICLPFYSFIVRYLYVRHE

SEQ ID NO: 2547014 - protein, 18 aa, Entamoeba dispar
RRISTLWRICQTYDYFFV

SEQ ID NO: 2547015 - protein, 19 aa, Entamoeba dispar
RRIVWHCVLPLALSERKYL

SEQ ID NO: 2547016 - protein, 20 aa, Entamoeba dispar
RRKDGEVFVPRKAPTEFREH

SEQ ID NO: 2547017 - protein, 20 aa, Entamoeba dispar
RRKEGEVFVPRKAPTEFREH

SEQ ID NO: 2547018 - protein, 17 aa, Entamoeba dispar
RRNIFLALQYKRLFTQE

SEQ ID NO: 2547019 - protein, 23 aa, Entamoeba dispar
RRNNLQWFRVPPKIFFEPHSIRY

SEQ ID NO: 2547020 - protein, 20 aa, Entamoeba dispar
RRPIQITCRFYQLGLLMLFN

SEQ ID NO: 2547021 - protein, 19 aa, Entamoeba dispar
RRPSGICGVALYLAGRLHG

SEQ ID NO: 2547022 - protein, 19 aa, Entamoeba dispar
RRRVFVIPYLLYQTMNRAS

SEQ ID NO: 2547023 - protein, 24 aa, Entamoeba dispar
RRTFIHNFLFDILLEKSYFFNSKL

SEQ ID NO: 2547024 - protein, 21 aa, Entamoeba dispar
RRVLPYFYIFKVNAKGRWIGR

SEQ ID NO: 2547025 - protein, 24 aa, Entamoeba dispar
RSASLLTFYLLKKYQITINAAKEL

SEQ ID NO: 2547026 - protein, 19 aa, Entamoeba dispar
RSFEEYFQWFIAGLKNVMN

SEQ ID NO: 2547027 - protein, 19 aa, Entamoeba dispar
RSFIQAFLFIFRNSIDTAN

SEQ ID NO: 2547028 - protein, 20 aa, Entamoeba dispar
RSILSKYPKFRFGTLTSRIS

SEQ ID NO: 2547029 - protein, 19 aa, Entamoeba dispar
RSLLLTDLRFSPDGSYLNV

SEQ ID NO: 2547030 - protein, 23 aa, Entamoeba dispar
RSTVYVLLKYFYWKYTEPSVMSL

SEQ ID NO: 2547031 - protein, 21 aa, Entamoeba dispar
RSYRKLLTIPFLQIQRLCFSD

SEQ ID NO: 2547032 - protein, 22 aa, Entamoeba dispar
RTEYRMLWFRFDIRKLYFLRHG

SEQ ID NO: 2547033 - protein, 28 aa, Entamoeba dispar
RTISTLLYLRYLFIPFATYPSLLVEIQK

SEQ ID NO: 2547034 - protein, 24 aa, Entamoeba dispar
RTKDYILLAWYYSPALAVGYYNRF

SEQ ID NO: 2547035 - protein, 17 aa, Entamoeba dispar
RTLLSILSLLCITQKDI

SEQ ID NO: 2547036 - protein, 24 aa, Entamoeba dispar
RTTVLCYLLFRLRTLNYPKPQLIV

SEQ ID NO: 2547037 - protein, 19 aa, Entamoeba dispar
RVCIACKLCINILIITNQI

SEQ ID NO: 2547038 - protein, 24 aa, Entamoeba dispar
RVKEALSLLLIWQTRQILPVQIEA

SEQ ID NO: 2547039 - protein, 24 aa, Entamoeba dispar
RVLEFLLIFLLNLNDSIIPSSLYE

SEQ ID NO: 2547040 - protein, 19 aa, Entamoeba dispar
RVLFLWALRHPASGYVQGI

SEQ ID NO: 2547041 - protein, 17 aa, Entamoeba dispar
RVNLFLLRWKNNNHYII

SEQ ID NO: 2547042 - protein, 19 aa, Entamoeba dispar
RVTSIPTILVLNPGSWKAL

SEQ ID NO: 2547043 - protein, 19 aa, Entamoeba dispar
RVTSLPTILVLNPGSWKAL

SEQ ID NO: 2547044 - protein, 17 aa, Entamoeba dispar
RVYLVYFYDDNLQRNGN

SEQ ID NO: 2547045 - protein, 18 aa, Entamoeba dispar
RWLLVQHPVYGLGYVPLS

SEQ ID NO: 2547046 - protein, 18 aa, Entamoeba dispar
RWVRLLFCQVYPINTIKP

SEQ ID NO: 2547047 - protein, 19 aa, Entamoeba dispar
RWYPKFSIYPVNEITIFFN

SEQ ID NO: 2547048 - protein, 20 aa, Entamoeba dispar
RYCNNFIYMYQWFKSFVNES

SEQ ID NO: 2547049 - protein, 19 aa, Entamoeba dispar
RYCYYPYFYSILIEDELVN

SEQ ID NO: 2547050 - protein, 18 aa, Entamoeba dispar
RYFKQCEFKLWRKQPQPI

SEQ ID NO: 2547051 - protein, 19 aa, Entamoeba dispar
RYFKQCEFKLWRKQPQPIK

SEQ ID NO: 2547052 - protein, 18 aa, Entamoeba dispar
RYFVLFNDILIYGEGNEH

SEQ ID NO: 2547053 - protein, 26 aa, Entamoeba dispar
RYGESDYVLMFWNPSQPLEQWMIKDL

SEQ ID NO: 2547054 - protein, 17 aa, Entamoeba dispar
RYHPMFHYYYYNNNYLD

SEQ ID NO: 2547055 - protein, 20 aa, Entamoeba dispar
RYLDYLIDIVRPRKLLYLAV

SEQ ID NO: 2547056 - protein, 18 aa, Entamoeba dispar
RYLIIYKYYSDKSVILAL

SEQ ID NO: 2547057 - protein, 24 aa, Entamoeba dispar
RYQYLMEFVPIWSKGWEKLTPIKT

SEQ ID NO: 2547058 - protein, 21 aa, Entamoeba dispar
SADFIIYRGFGRYVTSIGMET

SEQ ID NO: 2547059 - protein, 18 aa, Entamoeba dispar
SAFFIYFENILGTLPWNS

SEQ ID NO: 2547060 - protein, 23 aa, Entamoeba dispar
SANILFLLNYLTHGVVRFSPDVP

SEQ ID NO: 2547061 - protein, 23 aa, Entamoeba dispar
SAPTFFKYFMAFIRKIVTENSDY

SEQ ID NO: 2547062 - protein, 24 aa, Entamoeba dispar
SAQQSFLFRILVDNGFTIFLKKLY

SEQ ID NO: 2547063 - protein, 23 aa, Entamoeba dispar
SARIQLPLTYAWGLSIHKSQGLT

SEQ ID NO: 2547064 - protein, 24 aa, Entamoeba dispar
SARPNIHFFLYKPRLIGSKCVGFY

SEQ ID NO: 2547065 - protein, 28 aa, Entamoeba dispar
SCGVMLYNMLFLFPFKKPKNMYELQLTD

SEQ ID NO: 2547066 - protein, 22 aa, Entamoeba dispar
SCSLILFYYLPNNYPFEEIPRF

SEQ ID NO: 2547067 - protein, 19 aa, Entamoeba dispar
SCSPAFWKFLDLIGNKIEL

SEQ ID NO: 2547068 - protein, 24 aa, Entamoeba dispar
SDDGTLYMWMPLQSQKPIHRLVGH

SEQ ID NO: 2547069 - protein, 23 aa, Entamoeba dispar
SDINIVIIHYLELIWKIPDAHII

SEQ ID NO: 2547070 - protein, 23 aa, Entamoeba dispar
SDIYSLGIVFWEIFRRVVFGSYT

SEQ ID NO: 2547071 - protein, 29 aa, Entamoeba dispar
SDLFHSSLACIILFDVLNELKFNSAPHSN

SEQ ID NO: 2547072 - protein, 25 aa, Entamoeba dispar
SDVWSFGMLIFKLLVGRLPFELMQM

SEQ ID NO: 2547073 - protein, 25 aa, Entamoeba dispar
SDYKDWCLYWLGLNNFEPPLTGETP

SEQ ID NO: 2547074 - protein, 24 aa, Entamoeba dispar
SDYKDWCLYWLGLSEQKPPIVGES

SEQ ID NO: 2547075 - protein, 23 aa, Entamoeba dispar
SDYKPILIDGFKLSLQLLVKEVS

SEQ ID NO: 2547076 - protein, 25 aa, Entamoeba dispar
SEAKKKWLINRNPSLPLPKPNDIEN

SEQ ID NO: 2547077 - protein, 17 aa, Entamoeba dispar
SEDEIVMLLTWARSLPS

SEQ ID NO: 2547078 - protein, 22 aa, Entamoeba dispar
SEEEIIKLIKWARGLPSIDKEE

SEQ ID NO: 2547079 - protein, 17 aa, Entamoeba dispar
SEEGWFFGCWQPKDILS

SEQ ID NO: 2547080 - protein, 25 aa, Entamoeba dispar
SEFKRLTLLLTKLPRKRLRDVSARL

SEQ ID NO: 2547081 - protein, 24 aa, Entamoeba dispar
SEINFIPLLRTVFYKFFGERNLTG

SEQ ID NO: 2547082 - protein, 23 aa, Entamoeba dispar
SEKVWIYPYIKDADFVYSTFLTT

SEQ ID NO: 2547083 - protein, 21 aa, Entamoeba dispar
SELDIMSLFMNSSKNKQVMMF

SEQ ID NO: 2547084 - protein, 25 aa, Entamoeba dispar
SELYLRWTPLFWNFLRNPNISFDNK

SEQ ID NO: 2547085 - protein, 17 aa, Entamoeba dispar
SENGIISMLTWVRSLTP

SEQ ID NO: 2547086 - protein, 18 aa, Entamoeba dispar
SEQLLWQKVLNSKILYKV

SEQ ID NO: 2547087 - protein, 23 aa, Entamoeba dispar
SEQMKIFQLFRQLERLSYDDICS

SEQ ID NO: 2547088 - protein, 23 aa, Entamoeba dispar
SERVTLFVFRILTNLLAFQQLQT

SEQ ID NO: 2547089 - protein, 28 aa, Entamoeba dispar
SFCFFIVCLFLLYKTYPTQFEFNESLLH

SEQ ID NO: 2547090 - protein, 21 aa, Entamoeba dispar
SFDHNRFLFNGNAKIIDESAM

SEQ ID NO: 2547091 - protein, 22 aa, Entamoeba dispar
SFDIIQWLFFGIPFTKDTIISF

SEQ ID NO: 2547092 - protein, 20 aa, Entamoeba dispar
SFEEFFKLFSLLMSMTYSSS

SEQ ID NO: 2547093 - protein, 18 aa, Entamoeba dispar
SFIRQLFHFSIYSIFEGI

SEQ ID NO: 2547094 - protein, 21 aa, Entamoeba dispar
SFIVWLVCILPHSLKIHQGMI

SEQ ID NO: 2547095 - protein, 17 aa, Entamoeba dispar
SFKLHRLPMPRPGQILG

SEQ ID NO: 2547096 - protein, 19 aa, Entamoeba dispar
SFLKKFYYTMKEPSYIDWK

SEQ ID NO: 2547097 - protein, 21 aa, Entamoeba dispar
SFLKTYYFTMRDPQYLEWRLN

SEQ ID NO: 2547098 - protein, 22 aa, Entamoeba dispar
SFLRFHCCLLLLDYFDYINRIQ

SEQ ID NO: 2547099 - protein, 24 aa, Entamoeba dispar
SFMYKWIILLFRRDFPHSACVRLW

SEQ ID NO: 2547100 - protein, 24 aa, Entamoeba dispar
SFNAYFFRILLKIFRVYLKIARYQ

SEQ ID NO: 2547101 - protein, 21 aa, Entamoeba dispar
SFPKYIHLLILLIRTRSRITK

SEQ ID NO: 2547102 - protein, 21 aa, Entamoeba dispar
SFVIQYYGLILDILLLGPRRA

SEQ ID NO: 2547103 - protein, 19 aa, Entamoeba dispar
SFVSIFPFYNGTYIFNASD

SEQ ID NO: 2547104 - protein, 20 aa, Entamoeba dispar
SGCFYLCYSLTYINIPSSIS

SEQ ID NO: 2547105 - protein, 28 aa, Entamoeba dispar
SGEMIPPKKVPIGGVPLFGGFNPGKVAL

SEQ ID NO: 2547106 - protein, 17 aa, Entamoeba dispar
SGGWRMRISIAKAIYMH

SEQ ID NO: 2547107 - protein, 24 aa, Entamoeba dispar
SGKLLTFYYHLIEELKFTNKEEAV

SEQ ID NO: 2547108 - protein, 19 aa, Entamoeba dispar
SGKLVLLDKLLPKLYADHH

SEQ ID NO: 2547109 - protein, 24 aa, Entamoeba dispar
SGKTEAYFPYRLPSRAIYGGQNIE

SEQ ID NO: 2547110 - protein, 24 aa, Entamoeba dispar
SGKTLAYTLPLLKLINPLFNHIQT

SEQ ID NO: 2547111 - protein, 32 aa, Entamoeba dispar
SGLFCVVINPYKFFPIYTPFIVSKYQGRRRED

SEQ ID NO: 2547112 - protein, 22 aa, Entamoeba dispar
SGNEFIFKSFKVTLIDNKNTIP

SEQ ID NO: 2547113 - protein, 23 aa, Entamoeba dispar
SGRTEAYFPYKIPTRTIYGGKNI

SEQ ID NO: 2547114 - protein, 19 aa, Entamoeba dispar
SGRVTINLHFTWYDTYLQE

SEQ ID NO: 2547115 - protein, 22 aa, Entamoeba dispar
SGRYITVWQLIPLQYTQGVNGS

SEQ ID NO: 2547116 - protein, 23 aa, Entamoeba dispar
SHDGYLIFYSFEGKVKSYDCFDR

SEQ ID NO: 2547117 - protein, 17 aa, Entamoeba dispar
SHFFLRCNKITIGKGVI

SEQ ID NO: 2547118 - protein, 25 aa, Entamoeba dispar
SHHSQYLLYLPLLLRHIVIQPRSEY

SEQ ID NO: 2547119 - protein, 23 aa, Entamoeba dispar
SHQSFPCIPFFGVYLQDLTFIHE

SEQ ID NO: 2547120 - protein, 22 aa, Entamoeba dispar
SHRIWLWIVNMPQIIHAMNVLA

SEQ ID NO: 2547121 - protein, 18 aa, Entamoeba dispar
SHYYLFSLIGWIANQLMT

SEQ ID NO: 2547122 - protein, 24 aa, Entamoeba dispar
SIDQIYRNLICKILIRNVGKSELP

SEQ ID NO: 2547123 - protein, 22 aa, Entamoeba dispar
SIGVLMVYLLQFDGNRSHLNVN

SEQ ID NO: 2547124 - protein, 25 aa, Entamoeba dispar
SIHDKKLYYIFNKDFLIGLIRHNGQ

SEQ ID NO: 2547125 - protein, 17 aa, Entamoeba dispar
SIKEGMFIRPTPRRLNV

SEQ ID NO: 2547126 - protein, 24 aa, Entamoeba dispar
SIKPDEILLLDTYFYLVVFRGNAV

SEQ ID NO: 2547127 - protein, 23 aa, Entamoeba dispar
SIKRSIRIFWSNKVPKGYFNKEF

SEQ ID NO: 2547128 - protein, 21 aa, Entamoeba dispar
SILFIINIKFFLTSQLVIEGE

SEQ ID NO: 2547129 - protein, 17 aa, Entamoeba dispar
SILMYLLIENGYVITID

SEQ ID NO: 2547130 - protein, 18 aa, Entamoeba dispar
SILPLFEMIGIDGVLAVW

SEQ ID NO: 2547131 - protein, 26 aa, Entamoeba dispar
SIQKEAELLFSRAKTLGLDDCIEEWN

SEQ ID NO: 2547132 - protein, 20 aa, Entamoeba dispar
SISLLPYRYSFIAITTPPIS

SEQ ID NO: 2547133 - protein, 21 aa, Entamoeba dispar
SISYKWKLFTIWDTIKGEIVA

SEQ ID NO: 2547134 - protein, 24 aa, Entamoeba dispar
SKGKMAHNILLPWKVYVYDGGNDV

SEQ ID NO: 2547135 - protein, 17 aa, Entamoeba dispar
SKGYGFIYFYTSIIANN

SEQ ID NO: 2547136 - protein, 17 aa, Entamoeba dispar
SKHLPFITVFQDPTFGG

SEQ ID NO: 2547137 - protein, 24 aa, Entamoeba dispar
SKIQLFFVQLYMQILKSLRYNTSS

SEQ ID NO: 2547138 - protein, 26 aa, Entamoeba dispar
SKIVLPPLKVLPKGLFYNCGFKEFDV

SEQ ID NO: 2547139 - protein, 22 aa, Entamoeba dispar
SKKLWCLFKKILKPTIYEIENC

SEQ ID NO: 2547140 - protein, 23 aa, Entamoeba dispar
SKKYPFMIYALRLFKILYEMNIV

SEQ ID NO: 2547141 - protein, 22 aa, Entamoeba dispar
SKQAIELVFVLCAFDGFFSFMC

SEQ ID NO: 2547142 - protein, 27 aa, Entamoeba dispar
SKVFSHIWFLFEVIIHSLIKYLDKQHA

SEQ ID NO: 2547143 - protein, 20 aa, Entamoeba dispar
SLCLFIKILSFFVKEWRYRN

SEQ ID NO: 2547144 - protein, 17 aa, Entamoeba dispar
SLCTIQHLSLIKTLLKP

SEQ ID NO: 2547145 - protein, 21 aa, Entamoeba dispar
SLCYQLPSYFIKGITVVVSPL

SEQ ID NO: 2547146 - protein, 24 aa, Entamoeba dispar
SLDQWYIIIVCFLDFSLQDISKTT

SEQ ID NO: 2547147 - protein, 17 aa, Entamoeba dispar
SLDRQWIITFGSNIKNL

SEQ ID NO: 2547148 - protein, 17 aa, Entamoeba dispar
SLDRWMYVWDPIKKIPI

SEQ ID NO: 2547149 - protein, 23 aa, Entamoeba dispar
SLELRYVKNLKKLKLRGVNKLKI

SEQ ID NO: 2547150 - protein, 26 aa, Entamoeba dispar
SLENRWFTFPILLHQYILLQTPVFYY

SEQ ID NO: 2547151 - protein, 17 aa, Entamoeba dispar
SLEYVVMIFWNGISINH

SEQ ID NO: 2547152 - protein, 23 aa, Entamoeba dispar
SLFNHFYVLWPHKFINVTNGVTP

SEQ ID NO: 2547153 - protein, 19 aa, Entamoeba dispar
SLFWCDFLRANSTSIVKST

SEQ ID NO: 2547154 - protein, 17 aa, Entamoeba dispar
SLGKVFIELLRIIKWSS

SEQ ID NO: 2547155 - protein, 19 aa, Entamoeba dispar
SLHVRLIPRIIPIITKFQS

SEQ ID NO: 2547156 - protein, 18 aa, Entamoeba dispar
SLILYRQFCSLFDSLPLV

SEQ ID NO: 2547157 - protein, 23 aa, Entamoeba dispar
SLLFEYNMYLAYYCWIKSSGSNV

SEQ ID NO: 2547158 - protein, 22 aa, Entamoeba dispar
SLLKWLFNPLSDGSIHIVFKLN

SEQ ID NO: 2547159 - protein, 18 aa, Entamoeba dispar
SLLLYPKIYHHLKSSLLL

SEQ ID NO: 2547160 - protein, 24 aa, Entamoeba dispar
SLLSHYIQLYFLPAVRSLVIEEIR

SEQ ID NO: 2547161 - protein, 23 aa, Entamoeba dispar
SLLSRFDLIYLILDQPNPERDRK

SEQ ID NO: 2547162 - protein, 22 aa, Entamoeba dispar
SLPKHILFVIRAKKFKPIYELV

SEQ ID NO: 2547163 - protein, 24 aa, Entamoeba dispar
SLSKFVFVPLLYQEVFIYSCCEEY

SEQ ID NO: 2547164 - protein, 19 aa, Entamoeba dispar
SLTCFLFLMKTSFSVARIV

SEQ ID NO: 2547165 - protein, 24 aa, Entamoeba dispar
SLYILNPVLFFIQLETMKLLVWGE

SEQ ID NO: 2547166 - protein, 26 aa, Entamoeba dispar
SLYTQPIVFPSVFFFNGAGLQKVFIK

SEQ ID NO: 2547167 - protein, 23 aa, Entamoeba dispar
SMFNKNPRWILFYELVLTTKEYV

SEQ ID NO: 2547168 - protein, 24 aa, Entamoeba dispar
SMIERYIFYPFFLVTDFEGFEGPY

SEQ ID NO: 2547169 - protein, 20 aa, Entamoeba dispar
SMNIYLVYLYEKRKEIEALN

SEQ ID NO: 2547170 - protein, 20 aa, Entamoeba dispar
SMTLSFFPPYPFAKQIIINR

SEQ ID NO: 2547171 - protein, 25 aa, Entamoeba dispar
SMTPKYLLLFYMKFMHLIGNICNIQ

SEQ ID NO: 2547172 - protein, 21 aa, Entamoeba dispar
SNALLYLLLKKGWTIQLTKTK

SEQ ID NO: 2547173 - protein, 20 aa, Entamoeba dispar
SNFIFFVNLFQRSTLDMAKE

SEQ ID NO: 2547174 - protein, 20 aa, Entamoeba dispar
SNIYTFIRSLVLQPIVLYFS

SEQ ID NO: 2547175 - protein, 22 aa, Entamoeba dispar
SNKPLHFTSRYLYRTLWGDEIK

SEQ ID NO: 2547176 - protein, 19 aa, Entamoeba dispar
SNLLLLINKLLFAPTIGKC

SEQ ID NO: 2547177 - protein, 23 aa, Entamoeba dispar
SNNFEIMFHVAPLLPLLQNDEQA

SEQ ID NO: 2547178 - protein, 23 aa, Entamoeba dispar
SNNTFLWDIFLDNLNLLFFEFQL

SEQ ID NO: 2547179 - protein, 24 aa, Entamoeba dispar
SNQHSKFTFIWVKDLFTYLDKKPF

SEQ ID NO: 2547180 - protein, 22 aa, Entamoeba dispar
SNQIPGWPALLIPFIQQISSLK

SEQ ID NO: 2547181 - protein, 19 aa, Entamoeba dispar
SNSCLIFQRPYLCGLYNES

SEQ ID NO: 2547182 - protein, 25 aa, Entamoeba dispar
SNTLYSHRFFPYYSFSLLAGINSKG

SEQ ID NO: 2547183 - protein, 22 aa, Entamoeba dispar
SNYFILFLLCINFLYRQNNYAF

SEQ ID NO: 2547184 - protein, 20 aa, Entamoeba dispar
SNYKNFLWKILKTLFDDYVD

SEQ ID NO: 2547185 - protein, 24 aa, Entamoeba dispar
SNYNFERPFLWIARKLTGNPNLVF

SEQ ID NO: 2547186 - protein, 26 aa, Entamoeba dispar
SPEMYSWFPLFFPLISPIEVKRGDVL

SEQ ID NO: 2547187 - protein, 21 aa, Entamoeba dispar
SPIRLALFKQPDFLNNPKIII

SEQ ID NO: 2547188 - protein, 21 aa, Entamoeba dispar
SPLLQTLFKMIFIRNPTQRAD

SEQ ID NO: 2547189 - protein, 23 aa, Entamoeba dispar
SPRQPNCPLALSTPLPLPSNTLT

SEQ ID NO: 2547190 - protein, 19 aa, Entamoeba dispar
SPRRRPVYGGSPMPCMMIA

SEQ ID NO: 2547191 - protein, 20 aa, Entamoeba dispar
SQFFLLFPSNIKITSTDFTC

SEQ ID NO: 2547192 - protein, 25 aa, Entamoeba dispar
SQFWSYRWNFLLMASEGYIVIAPNR

SEQ ID NO: 2547193 - protein, 24 aa, Entamoeba dispar
SQKYFSDGLIQRKWYDDVVFKNQA

SEQ ID NO: 2547194 - protein, 23 aa, Entamoeba dispar
SQLYWLRHNLLATLGLSIGFSSF

SEQ ID NO: 2547195 - protein, 18 aa, Entamoeba dispar
SQQKPIILPIKTPSLHSY

SEQ ID NO: 2547196 - protein, 25 aa, Entamoeba dispar
SQVVPPLIDMSFFSAGLKPQRYQNN

SEQ ID NO: 2547197 - protein, 19 aa, Entamoeba dispar
SQYPIFPWILTDYTSKTID

SEQ ID NO: 2547198 - protein, 23 aa, Entamoeba dispar
SRDVFESLFWKTLYGRIVSGKIK

SEQ ID NO: 2547199 - protein, 19 aa, Entamoeba dispar
SRERLLSFMFKRKTNEKTT

SEQ ID NO: 2547200 - protein, 20 aa, Entamoeba dispar
SRLKYYLSFLPENIKKVSFV

SEQ ID NO: 2547201 - protein, 26 aa, Entamoeba dispar
SRLRYILVVDALNFCFWPTEGFEYDD

SEQ ID NO: 2547202 - protein, 24 aa, Entamoeba dispar
SRLSIGLMWWMLTREILRYQGKLA

SEQ ID NO: 2547203 - protein, 17 aa, Entamoeba dispar
SRNGLFLPKLPPKIKEI

SEQ ID NO: 2547204 - protein, 17 aa, Entamoeba dispar
SRSRNIIFIWKSFSKNG

SEQ ID NO: 2547205 - protein, 20 aa, Entamoeba dispar
SSDNFLIYDLVICTVRLAKN

SEQ ID NO: 2547206 - protein, 23 aa, Entamoeba dispar
SSIIKLMKLLLLPFKTVVYSSKP

SEQ ID NO: 2547207 - protein, 18 aa, Entamoeba dispar
SSILGILFLQIKILANMI

SEQ ID NO: 2547208 - protein, 24 aa, Entamoeba dispar
SSKLLAQWIVLCPSSVIPVFSEAA

SEQ ID NO: 2547209 - protein, 18 aa, Entamoeba dispar
SSLALIHYILLRGLSDPT

SEQ ID NO: 2547210 - protein, 27 aa, Entamoeba dispar
SSLFFLRYCFLPLVKYPSLLKILQKGV

SEQ ID NO: 2547211 - protein, 23 aa, Entamoeba dispar
SSLKGIITVRIFNIPFTWKEHDV

SEQ ID NO: 2547212 - protein, 19 aa, Entamoeba dispar
SSLKPVMYEGFMAGGVAAG

SEQ ID NO: 2547213 - protein, 24 aa, Entamoeba dispar
SSPDFTYFPQWILDYLHLQPGDAA

SEQ ID NO: 2547214 - protein, 20 aa, Entamoeba dispar
SSWINLALLIIFKSPFPNKF

SEQ ID NO: 2547215 - protein, 21 aa, Entamoeba dispar
SSYLFDLYELFFPLNDNSKKM

SEQ ID NO: 2547216 - protein, 23 aa, Entamoeba dispar
STAAALLWVFYIRQSFIKQHGFD

SEQ ID NO: 2547217 - protein, 25 aa, Entamoeba dispar
STDHKMYIFQFMFIPNTDSYSTKKT

SEQ ID NO: 2547218 - protein, 19 aa, Entamoeba dispar
STFKRILPYALLKYLESEE

SEQ ID NO: 2547219 - protein, 17 aa, Entamoeba dispar
STHFLPPSIIDPLKEKG

SEQ ID NO: 2547220 - protein, 20 aa, Entamoeba dispar
STLSLKINTLWRNNLKYLEM

SEQ ID NO: 2547221 - protein, 18 aa, Entamoeba dispar
SVAIFHKKLTWLKKFPKE

SEQ ID NO: 2547222 - protein, 19 aa, Entamoeba dispar
SVDDDFMAAYLGMQHNRIG

SEQ ID NO: 2547223 - protein, 18 aa, Entamoeba dispar
SVDWWTLGVLMYEFLYGC

SEQ ID NO: 2547224 - protein, 23 aa, Entamoeba dispar
SVFHLAWLSFLLYKSFKDSSEKS

SEQ ID NO: 2547225 - protein, 24 aa, Entamoeba dispar
SVFKKFLRNLPIHIFDRITTKKIF

SEQ ID NO: 2547226 - protein, 24 aa, Entamoeba dispar
SVFPDSLLLLFYYSLCYVFEKEVK

SEQ ID NO: 2547227 - protein, 18 aa, Entamoeba dispar
SVFQWKEEFLKWSTIKPD

SEQ ID NO: 2547228 - protein, 17 aa, Entamoeba dispar
SVHLYRPWSAKHFLGEI

SEQ ID NO: 2547229 - protein, 28 aa, Entamoeba dispar
SVKNWKKRWFVLKPTRLWYFKAKNSTSA

SEQ ID NO: 2547230 - protein, 20 aa, Entamoeba dispar
SVLHLWLMVSIPKLDTNKSF

SEQ ID NO: 2547231 - protein, 18 aa, Entamoeba dispar
SVLPFPFSVPISSPTPSP

SEQ ID NO: 2547232 - protein, 24 aa, Entamoeba dispar
SVMHLRWFNMHLLRVEYYPESKIP

SEQ ID NO: 2547233 - protein, 28 aa, Entamoeba dispar
SVRWQMARNFILWVPLTAIANNYSTSTS

SEQ ID NO: 2547234 - protein, 25 aa, Entamoeba dispar
SVSSLVLMLVALQEKNRPPKPEMQM

SEQ ID NO: 2547235 - protein, 23 aa, Entamoeba dispar
SWKAIPAMRLMPLLETALGYEVI

SEQ ID NO: 2547236 - protein, 18 aa, Entamoeba dispar
SWKFVRLERLVLSWLDIM

SEQ ID NO: 2547237 - protein, 22 aa, Entamoeba dispar
SWLNIIPLKMRCNEVFGVPLSV

SEQ ID NO: 2547238 - protein, 23 aa, Entamoeba dispar
SYDPYHLLYYLLNLFISSYSDNC

SEQ ID NO: 2547239 - protein, 20 aa, Entamoeba dispar
SYGIILWELIYRVIYQKYQR

SEQ ID NO: 2547240 - protein, 17 aa, Entamoeba dispar
SYGLFYPKQFENAKLIE

SEQ ID NO: 2547241 - protein, 17 aa, Entamoeba dispar
SYIIFDLLLFKEIIEKG

SEQ ID NO: 2547242 - protein, 21 aa, Entamoeba dispar
SYKHLLRLYGRMNLLLSQIDK

SEQ ID NO: 2547243 - protein, 27 aa, Entamoeba dispar
SYKKELLLFILTYVFYPNIIIPQQIIG

SEQ ID NO: 2547244 - protein, 25 aa, Entamoeba dispar
SYKSINFMSQFKNKSLIEIRTEDYK

SEQ ID NO: 2547245 - protein, 21 aa, Entamoeba dispar
SYLWSLGIILLRFWLGYKEAS

SEQ ID NO: 2547246 - protein, 23 aa, Entamoeba dispar
SYNKYIIFLVFNESINDLIIQKI

SEQ ID NO: 2547247 - protein, 25 aa, Entamoeba dispar
SYPHVFLEWLYALLLFLQSPFEPEV

SEQ ID NO: 2547248 - protein, 23 aa, Entamoeba dispar
SYTGYFMFYRFVGNYIASSSNET

SEQ ID NO: 2547249 - protein, 18 aa, Entamoeba dispar
TAFLEYLFKPVSFKEFNG

SEQ ID NO: 2547250 - protein, 27 aa, Entamoeba dispar
TAFTILYNYFTTLLIPKTIIINGTFGE

SEQ ID NO: 2547251 - protein, 23 aa, Entamoeba dispar
TAIDLIPIFFTLQSNNYFTKVTV

SEQ ID NO: 2547252 - protein, 20 aa, Entamoeba dispar
TASSIQPEWLFEASPKYFAQ

SEQ ID NO: 2547253 - protein, 26 aa, Entamoeba dispar
TATLPQIMILLLFNTHKVLKISEIAL

SEQ ID NO: 2547254 - protein, 21 aa, Entamoeba dispar
TCPFPIDFNLILQRLINDNYY

SEQ ID NO: 2547255 - protein, 19 aa, Entamoeba dispar
TCRKIVTVPYISGFLGFRE

SEQ ID NO: 2547256 - protein, 20 aa, Entamoeba dispar
TCVFIFVKALLFISDNQLTE

SEQ ID NO: 2547257 - protein, 21 aa, Entamoeba dispar
TDGLHLLMDLLNELGFEFNTK

SEQ ID NO: 2547258 - protein, 24 aa, Entamoeba dispar
TDHKMYIFQFMFIPNTDSYSTKKT

SEQ ID NO: 2547259 - protein, 18 aa, Entamoeba dispar
TDIFRRILEDYFGYQVIQ

SEQ ID NO: 2547260 - protein, 24 aa, Entamoeba dispar
TDIKNFVFYDLKPLDRWTAIVPSQ

SEQ ID NO: 2547261 - protein, 23 aa, Entamoeba dispar
TDNHIFLITPFLKGGALCHRLFY

SEQ ID NO: 2547262 - protein, 23 aa, Entamoeba dispar
TEEGYRIYTLEELGLDKNKFGGN

SEQ ID NO: 2547263 - protein, 24 aa, Entamoeba dispar
TEIHPLMFYLNRPLVQTPKYESLI

SEQ ID NO: 2547264 - protein, 24 aa, Entamoeba dispar
TEKPLFPLFLCDAGLIIISRFPIV

SEQ ID NO: 2547265 - protein, 23 aa, Entamoeba dispar
TEKPLFPLFLCDAGLVIISRFPI

SEQ ID NO: 2547266 - protein, 20 aa, Entamoeba dispar
TELILKFMTFYLNLFFSRIE

SEQ ID NO: 2547267 - protein, 17 aa, Entamoeba dispar
TEMVNTLDFINNVLLSC

SEQ ID NO: 2547268 - protein, 25 aa, Entamoeba dispar
TEPLYTYLFDLCYLPVIGNPGEDSY

SEQ ID NO: 2547269 - protein, 22 aa, Entamoeba dispar
TEQYCVMLYHQLLEKIKKGTPV

SEQ ID NO: 2547270 - protein, 20 aa, Entamoeba dispar
TEQYLLKYLPLYTSLAASGT

SEQ ID NO: 2547271 - protein, 25 aa, Entamoeba dispar
TETRKLLFNYVALGVKLMNASNSNK

SEQ ID NO: 2547272 - protein, 18 aa, Entamoeba dispar
TFDKSQFFLLFPSNIKIT

SEQ ID NO: 2547273 - protein, 22 aa, Entamoeba dispar
TFESVLHYFSFFGKVRAITQDG

SEQ ID NO: 2547274 - protein, 19 aa, Entamoeba dispar
TFFGHLIHLFGVFYKSKDV

SEQ ID NO: 2547275 - protein, 25 aa, Entamoeba dispar
TFFNFHYFNPPQTQFFFICFNTNKN

SEQ ID NO: 2547276 - protein, 21 aa, Entamoeba dispar
TFFTPFQYKLFPRVMIYFKQV

SEQ ID NO: 2547277 - protein, 22 aa, Entamoeba dispar
TFGSLPIPFIVNYSLIMEIIGN

SEQ ID NO: 2547278 - protein, 17 aa, Entamoeba dispar
TFIISKLSSISFLLSQK

SEQ ID NO: 2547279 - protein, 19 aa, Entamoeba dispar
TFLYNKLFRYLWPPSISQL

SEQ ID NO: 2547280 - protein, 17 aa, Entamoeba dispar
TFPVLYVRGDLVVLISP

SEQ ID NO: 2547281 - protein, 19 aa, Entamoeba dispar
TFRTDVPFLFRDSFSRLKD

SEQ ID NO: 2547282 - protein, 25 aa, Entamoeba dispar
TFSDWKLILYFINLLGKFGGEPNYE

SEQ ID NO: 2547283 - protein, 31 aa, Entamoeba dispar
TFSEPFIMVVLKFIRLIYKSTPQFKSKYIEI

SEQ ID NO: 2547284 - protein, 18 aa, Entamoeba dispar
TFSGFFSRLFGFVEPEPV

SEQ ID NO: 2547285 - protein, 17 aa, Entamoeba dispar
TGCKLLYQLLIQPDERI

SEQ ID NO: 2547286 - protein, 22 aa, Entamoeba dispar
TGDEFTQIFWKLGMKNFDDFIE

SEQ ID NO: 2547287 - protein, 18 aa, Entamoeba dispar
TGLLMTELFFIDGLAISS

SEQ ID NO: 2547288 - protein, 24 aa, Entamoeba dispar
TGNLPLFYFAPTNINIPKFKKVNL

SEQ ID NO: 2547289 - protein, 25 aa, Entamoeba dispar
THRIRELWLLLFKFIDHPLKLNNIE

SEQ ID NO: 2547290 - protein, 29 aa, Entamoeba dispar
TIAALALLFAVQSYYPSPFFILDEIDAAL

SEQ ID NO: 2547291 - protein, 26 aa, Entamoeba dispar
TIAVVTIFFVLRYYNVLNGSIEKIIT

SEQ ID NO: 2547292 - protein, 17 aa, Entamoeba dispar
TIFRYLPPQYYLSFIAI

SEQ ID NO: 2547293 - protein, 22 aa, Entamoeba dispar
TIGSTLFLYLYKKNINNKKQEG

SEQ ID NO: 2547294 - protein, 17 aa, Entamoeba dispar
TIILDKIKQRIGDTEFQ

SEQ ID NO: 2547295 - protein, 17 aa, Entamoeba dispar
TIIPYIDKPWYLKFNNS

SEQ ID NO: 2547296 - protein, 20 aa, Entamoeba dispar
TILKTMFWYLMESKIDPKYK

SEQ ID NO: 2547297 - protein, 17 aa, Entamoeba dispar
TILYFQVLVRLLQVFDQ

SEQ ID NO: 2547298 - protein, 20 aa, Entamoeba dispar
TINKIFLYDLPLEELIQPLL

SEQ ID NO: 2547299 - protein, 19 aa, Entamoeba dispar
TIPFYPWYIIAVETTNKTK

SEQ ID NO: 2547300 - protein, 23 aa, Entamoeba dispar
TIPSTILYLDNSVLFWGSKGGDS

SEQ ID NO: 2547301 - protein, 24 aa, Entamoeba dispar
TIQAVTLIWTLLRQGPNGEPTCKK

SEQ ID NO: 2547302 - protein, 18 aa, Entamoeba dispar
TIQLYCHLYKDGQLKIEW

SEQ ID NO: 2547303 - protein, 21 aa, Entamoeba dispar
TIQMYFSFRFLKQESAEEKRI

SEQ ID NO: 2547304 - protein, 20 aa, Entamoeba dispar
TIRKFLFQLLRALRTLSHAN

SEQ ID NO: 2547305 - protein, 22 aa, Entamoeba dispar
TIRNGLLYLLFFLRQKESPRRK

SEQ ID NO: 2547306 - protein, 23 aa, Entamoeba dispar
TIRTKLMRILPPRIKLDIYLTKG

SEQ ID NO: 2547307 - protein, 21 aa, Entamoeba dispar
TITHPILCGYYYILYEEKDST

SEQ ID NO: 2547308 - protein, 19 aa, Entamoeba dispar
TIYWLQRLIEMGENPKYIV

SEQ ID NO: 2547309 - protein, 26 aa, Entamoeba dispar
TKDPKHFIFSLLNPSGIQPRAFYLQD

SEQ ID NO: 2547310 - protein, 22 aa, Entamoeba dispar
TKEPSLFWLFQSVMTMLQGFYC

SEQ ID NO: 2547311 - protein, 19 aa, Entamoeba dispar
TKIIIILPPLTVGLVTIRI

SEQ ID NO: 2547312 - protein, 24 aa, Entamoeba dispar
TKKIRGFFVFPYTKTMSLLQREME

SEQ ID NO: 2547313 - protein, 22 aa, Entamoeba dispar
TKKNEWFELKLTGQLKKVKMEE

SEQ ID NO: 2547314 - protein, 22 aa, Entamoeba dispar
TKLEGIFGNKPIMGGPTPIRPK

SEQ ID NO: 2547315 - protein, 22 aa, Entamoeba dispar
TKLPAVFFIFSRRLVMDYAKKL

SEQ ID NO: 2547316 - protein, 23 aa, Entamoeba dispar
TKNQPFLPIFEIKLKKTSPIKKY

SEQ ID NO: 2547317 - protein, 28 aa, Entamoeba dispar
TKRASFMNYLWRGYSVDGLPQNVSKDLS

SEQ ID NO: 2547318 - protein, 23 aa, Entamoeba dispar
TKRIRIGKFPKYLLIKLERQIIL

SEQ ID NO: 2547319 - protein, 22 aa, Entamoeba dispar
TLAGFNWFNAYYTPGVSRISTN

SEQ ID NO: 2547320 - protein, 19 aa, Entamoeba dispar
TLAQIKLWREKLPIDCITL

SEQ ID NO: 2547321 - protein, 24 aa, Entamoeba dispar
TLDTPFIVFPLLDILEVYENMKAD

SEQ ID NO: 2547322 - protein, 24 aa, Entamoeba dispar
TLEELHFWPSFYLHAVLFNKTDPS

SEQ ID NO: 2547323 - protein, 20 aa, Entamoeba dispar
TLFYLYNNLWYKTMFQIKRD

SEQ ID NO: 2547324 - protein, 18 aa, Entamoeba dispar
TLKLMFRRYLKLENPLVA

SEQ ID NO: 2547325 - protein, 22 aa, Entamoeba dispar
TLLLRSALYYIQKMLKVFGIEE

SEQ ID NO: 2547326 - protein, 26 aa, Entamoeba dispar
TLLNAKIIFFIVKVLFRCDAVDPPDS

SEQ ID NO: 2547327 - protein, 17 aa, Entamoeba dispar
TLLWHPFIVAQSPPSPQ

SEQ ID NO: 2547328 - protein, 30 aa, Entamoeba dispar
TLMRELNGIYYMFYEIIFNTFVSLHHDQRY

SEQ ID NO: 2547329 - protein, 18 aa, Entamoeba dispar
TLPEPNLFVFKYLFMFLT

SEQ ID NO: 2547330 - protein, 18 aa, Entamoeba dispar
TLPPIYWKYSFEDGIWSD

SEQ ID NO: 2547331 - protein, 27 aa, Entamoeba dispar
TLSPQYFLFNILIQILLMIVGREQNII

SEQ ID NO: 2547332 - protein, 25 aa, Entamoeba dispar
TLSSLALIFALHHYKPTPIYVMDEI

SEQ ID NO: 2547333 - protein, 24 aa, Entamoeba dispar
TLSSSWPFLIMWKGSDSEAYIQLQ

SEQ ID NO: 2547334 - protein, 17 aa, Entamoeba dispar
TLTIHWQFDVTLRGLRK

SEQ ID NO: 2547335 - protein, 18 aa, Entamoeba dispar
TLTKLKAPKWFRDILDKT

SEQ ID NO: 2547336 - protein, 20 aa, Entamoeba dispar
TLVLNKLRGLPIAAVRAPGF

SEQ ID NO: 2547337 - protein, 18 aa, Entamoeba dispar
TLYAAWNPDFLLSVLLGN

SEQ ID NO: 2547338 - protein, 23 aa, Entamoeba dispar
TLYKSIFLFYRDIVRVNLVFLQS

SEQ ID NO: 2547339 - protein, 20 aa, Entamoeba dispar
TLYLRWLQIQTFFPLFRGNG

SEQ ID NO: 2547340 - protein, 23 aa, Entamoeba dispar
TLYRAWIKLLPQDKLLWMTIIQY

SEQ ID NO: 2547341 - protein, 19 aa, Entamoeba dispar
TLYSAWNPDFLLSVLLGNQ

SEQ ID NO: 2547342 - protein, 18 aa, Entamoeba dispar
TMHHICLLRGKLVKYRKM

SEQ ID NO: 2547343 - protein, 26 aa, Entamoeba dispar
TMIETMCFIFPFFDFWDHVCIVWTKC

SEQ ID NO: 2547344 - protein, 24 aa, Entamoeba dispar
TMKYYYYHLLLWPSITYLAESVDG

SEQ ID NO: 2547345 - protein, 24 aa, Entamoeba dispar
TMNKMLLTFYRYPQAWIICAQYFQ

SEQ ID NO: 2547346 - protein, 23 aa, Entamoeba dispar
TMPIKIMFIKFLANSFITTPPEV

SEQ ID NO: 2547347 - protein, 21 aa, Entamoeba dispar
TNDVYFARWSPIISICNKVGG

SEQ ID NO: 2547348 - protein, 20 aa, Entamoeba dispar
TNFLFKKLLGLLYFELNRRD

SEQ ID NO: 2547349 - protein, 20 aa, Entamoeba dispar
TNKIILLLKDFIETFQESYF

SEQ ID NO: 2547350 - protein, 21 aa, Entamoeba dispar
TNKPLHFTSRYLYLTLWGDEI

SEQ ID NO: 2547351 - protein, 19 aa, Entamoeba dispar
TNLPRYLPYIIETCIPFLE

SEQ ID NO: 2547352 - protein, 18 aa, Entamoeba dispar
TNPLVFAFPSDEGFPFCL

SEQ ID NO: 2547353 - protein, 23 aa, Entamoeba dispar
TNQRLYILLWRIFGLTEYCLDSN

SEQ ID NO: 2547354 - protein, 19 aa, Entamoeba dispar
TNQYLFALAYYVQQRKIVI

SEQ ID NO: 2547355 - protein, 23 aa, Entamoeba dispar
TNTLLPLCLPFKPLFFFNRENYL

SEQ ID NO: 2547356 - protein, 23 aa, Entamoeba dispar
TNYTRFHRIIYYMIRKRGLDEMR

SEQ ID NO: 2547357 - protein, 23 aa, Entamoeba dispar
TPATPMEQPPIPPKPAHLTSKEE

SEQ ID NO: 2547358 - protein, 18 aa, Entamoeba dispar
TPFILQNPFDLIPVRFDP

SEQ ID NO: 2547359 - protein, 22 aa, Entamoeba dispar
TPFIRFYNFYLFFYCNEYLTKT

SEQ ID NO: 2547360 - protein, 23 aa, Entamoeba dispar
TPFIRLYSYYLFFYCSDFMNKTT

SEQ ID NO: 2547361 - protein, 22 aa, Entamoeba dispar
TPFIRRVIFFLAPTTEMRTITV

SEQ ID NO: 2547362 - protein, 24 aa, Entamoeba dispar
TPIELPRLPEYIKYLCVHSINSNI

SEQ ID NO: 2547363 - protein, 17 aa, Entamoeba dispar
TPLIGALPLFKLNFGNN

SEQ ID NO: 2547364 - protein, 24 aa, Entamoeba dispar
TPLKEECIWFYQSNFRLLEKYGNF

SEQ ID NO: 2547365 - protein, 25 aa, Entamoeba dispar
TPPSKLMYIFLFNDVLLETKPLKIA

SEQ ID NO: 2547366 - protein, 24 aa, Entamoeba dispar
TPQNTFNLLFFIRTVFPVFHAPQH

SEQ ID NO: 2547367 - protein, 22 aa, Entamoeba dispar
TPSKQLNFLPPSKYPQSPSQQR

SEQ ID NO: 2547368 - protein, 25 aa, Entamoeba dispar
TPVYKFLCPYLLKTNKHQPKGLFIG

SEQ ID NO: 2547369 - protein, 24 aa, Entamoeba dispar
TPVYKFLCSYLLKTNTHQSKGLFV

SEQ ID NO: 2547370 - protein, 24 aa, Entamoeba dispar
TPVYNFLCSYLLKTYKHQSKGLFI

SEQ ID NO: 2547371 - protein, 25 aa, Entamoeba dispar
TPYRQQLLLIKIAIESSPLLKEMSK

SEQ ID NO: 2547372 - protein, 19 aa, Entamoeba dispar
TPYYLYAFSVIQYILAKTN

SEQ ID NO: 2547373 - protein, 20 aa, Entamoeba dispar
TQEILPTPTQFTKLPEFSKV

SEQ ID NO: 2547374 - protein, 22 aa, Entamoeba dispar
TQFDKIFYYKLYYSLSKCLTSS

SEQ ID NO: 2547375 - protein, 19 aa, Entamoeba dispar
TQGLIWKKLKTLKCIKCKV

SEQ ID NO: 2547376 - protein, 21 aa, Entamoeba dispar
TQLFEIIGYLFIYHSEYCEIY

SEQ ID NO: 2547377 - protein, 33 aa, Entamoeba dispar
TQQMFDMSLFPQSFIQFLAWQRLMQIYSKLDAS

SEQ ID NO: 2547378 - protein, 28 aa, Entamoeba dispar
TRQEEYYYLFQIVSYLYFAPFRQEGLSI

SEQ ID NO: 2547379 - protein, 21 aa, Entamoeba dispar
TRQFWFCSFADDLQDFKLIGI

SEQ ID NO: 2547380 - protein, 24 aa, Entamoeba dispar
TRVARYWPMFPRTFGLFKKLFEEE

SEQ ID NO: 2547381 - protein, 23 aa, Entamoeba dispar
TRVCTYFFNIFLIKEFKEDCELN

SEQ ID NO: 2547382 - protein, 21 aa, Entamoeba dispar
TSIGYRWFYGCKSLKSINIPS

SEQ ID NO: 2547383 - protein, 21 aa, Entamoeba dispar
TSLALLWVFYIRQSFIGSYDH

SEQ ID NO: 2547384 - protein, 20 aa, Entamoeba dispar
TSLFRIYFFTNDKRNPFIKT

SEQ ID NO: 2547385 - protein, 25 aa, Entamoeba dispar
TSNLYQLIPFIPVDYFSSSLRSLID

SEQ ID NO: 2547386 - protein, 27 aa, Entamoeba dispar
TSPDFSDLFFRRTFFYSFPSFAKAKEV

SEQ ID NO: 2547387 - protein, 23 aa, Entamoeba dispar
TSQNFFYFPFINVLVQPVTVAVE

SEQ ID NO: 2547388 - protein, 20 aa, Entamoeba dispar
TSRRPLLNHIVLAGGSTLFP

SEQ ID NO: 2547389 - protein, 25 aa, Entamoeba dispar
TSSTNQIRIFPYPTKPISPNSSHQV

SEQ ID NO: 2547390 - protein, 24 aa, Entamoeba dispar
TSYDPYHLLYYLLNLFISSYSDNS

SEQ ID NO: 2547391 - protein, 22 aa, Entamoeba dispar
TSYNYMYIIPSFRKIVIQLVSQ

SEQ ID NO: 2547392 - protein, 18 aa, Entamoeba dispar
TTDKLLRRFIFNLNVKMC

SEQ ID NO: 2547393 - protein, 23 aa, Entamoeba dispar
TTEKPPIISLLFTTKSRLYISSH

SEQ ID NO: 2547394 - protein, 25 aa, Entamoeba dispar
TTESNFSVFYLPPGIYEICAYNDQS

SEQ ID NO: 2547395 - protein, 26 aa, Entamoeba dispar
TTFKTIFFLRFLFPALNHAEKYIPSE

SEQ ID NO: 2547396 - protein, 23 aa, Entamoeba dispar
TTPQLLVEIIWILSRFSCTKEEI

SEQ ID NO: 2547397 - protein, 21 aa, Entamoeba dispar
TTTQPQFGTTPSFGGFNTNQT

SEQ ID NO: 2547398 - protein, 23 aa, Entamoeba dispar
TVAKLIMIIKLIKDIIIMADIDI

SEQ ID NO: 2547399 - protein, 25 aa, Entamoeba dispar
TVDDYCLYFYLTFFIMKENVFDDNE

SEQ ID NO: 2547400 - protein, 24 aa, Entamoeba dispar
TVFDYFHFSLIRIPFNSLSFTLSF

SEQ ID NO: 2547401 - protein, 24 aa, Entamoeba dispar
TVFSSFFSILFSLSGKYLQMEMLS

SEQ ID NO: 2547402 - protein, 25 aa, Entamoeba dispar
TVIYSDGFLFFYKIKRKPSLILNIG

SEQ ID NO: 2547403 - protein, 18 aa, Entamoeba dispar
TVKGIPFLLKFAEIQLVG

SEQ ID NO: 2547404 - protein, 22 aa, Entamoeba dispar
TVKNYILYFGSVKSNEQLEKEK

SEQ ID NO: 2547405 - protein, 21 aa, Entamoeba dispar
TVKRLFLMYLSCIKRVDEQGK

SEQ ID NO: 2547406 - protein, 24 aa, Entamoeba dispar
TVKYYKIYYSLRPIFKRLYLNYTQ

SEQ ID NO: 2547407 - protein, 19 aa, Entamoeba dispar
TVNMIPYPRLHFFSSSIAP

SEQ ID NO: 2547408 - protein, 22 aa, Entamoeba dispar
TVQEYWECTLKALKFGENQGPQ

SEQ ID NO: 2547409 - protein, 25 aa, Entamoeba dispar
TVTNYILSFLFYFIQKNALIDCAAN

SEQ ID NO: 2547410 - protein, 19 aa, Entamoeba dispar
TVVSLFLFEFLRVFQCQLV

SEQ ID NO: 2547411 - protein, 17 aa, Entamoeba dispar
TWRLMDNGWYFIGKYPG

SEQ ID NO: 2547412 - protein, 18 aa, Entamoeba dispar
TYFSVIKRPMDLGTIKHN

SEQ ID NO: 2547413 - protein, 19 aa, Entamoeba dispar
TYLFSTLCPTPWTAFAVGY

SEQ ID NO: 2547414 - protein, 23 aa, Entamoeba dispar
TYLNIFIQQLYSWLQDLLHICRV

SEQ ID NO: 2547415 - protein, 26 aa, Entamoeba dispar
TYQRMVFLWMIWLIMNQHPQVFGFNY

SEQ ID NO: 2547416 - protein, 19 aa, Entamoeba dispar
TYVLLCGYPPFFGDTLGEI

SEQ ID NO: 2547417 - protein, 18 aa, Entamoeba dispar
TYWHIFPTHYSLYTNKTP

SEQ ID NO: 2547418 - protein, 17 aa, Entamoeba dispar
VAFFKKAGIKKKDLSDK

SEQ ID NO: 2547419 - protein, 17 aa, Entamoeba dispar
VAHSLIIPLLKYPVRIP

SEQ ID NO: 2547420 - protein, 18 aa, Entamoeba dispar
VCHSPVMMFLYDSGGDGK

SEQ ID NO: 2547421 - protein, 26 aa, Entamoeba dispar
VCPEQSFFIYFFPTSQFTLTKIPPKC

SEQ ID NO: 2547422 - protein, 27 aa, Entamoeba dispar
VCPEQSFFIYFFPTSQFTLTKIPPKCD

SEQ ID NO: 2547423 - protein, 22 aa, Entamoeba dispar
VDAYGFYLGTYFLAKKLNYKQT

SEQ ID NO: 2547424 - protein, 18 aa, Entamoeba dispar
VDEQYWIFQLVAAILHLG

SEQ ID NO: 2547425 - protein, 25 aa, Entamoeba dispar
VDGKAFLALLCSLDKDQKTFDKYAT

SEQ ID NO: 2547426 - protein, 27 aa, Entamoeba dispar
VDGNLTLILGLLWTLILKYQIAQNKMD

SEQ ID NO: 2547427 - protein, 18 aa, Entamoeba dispar
VDIPYACKLLFQELMSMA

SEQ ID NO: 2547428 - protein, 17 aa, Entamoeba dispar
VDNVILPPWAKGSYRKF

SEQ ID NO: 2547429 - protein, 19 aa, Entamoeba dispar
VDRAIEIYPSFRIPAELAK

SEQ ID NO: 2547430 - protein, 17 aa, Entamoeba dispar
VDYFIYDKITPNPLYTS

SEQ ID NO: 2547431 - protein, 17 aa, Entamoeba dispar
VDYLGVIPYIVEALKTI

SEQ ID NO: 2547432 - protein, 23 aa, Entamoeba dispar
VEALTTFFSFTGNVTQVRLSDCP

SEQ ID NO: 2547433 - protein, 18 aa, Entamoeba dispar
VECYLINDMLWLVTELMD

SEQ ID NO: 2547434 - protein, 22 aa, Entamoeba dispar
VEEMAQALYIYWKSRDIVKAGE

SEQ ID NO: 2547435 - protein, 17 aa, Entamoeba dispar
VEKKIHFGILLVDAIFP

SEQ ID NO: 2547436 - protein, 18 aa, Entamoeba dispar
VENKNVVFPLTALSFIHT

SEQ ID NO: 2547437 - protein, 19 aa, Entamoeba dispar
VEQLKSFIPLLIATKGRFE

SEQ ID NO: 2547438 - protein, 19 aa, Entamoeba dispar
VEQWYQLLIKYWSGYSTIT

SEQ ID NO: 2547439 - protein, 24 aa, Entamoeba dispar
VESDSILLLDTFFYIVVFRGEAVA

SEQ ID NO: 2547440 - protein, 20 aa, Entamoeba dispar
VEYRLLCEVFTDSILRNSNV

SEQ ID NO: 2547441 - protein, 22 aa, Entamoeba dispar
VEYRLLCEVFTDSILRNSNVVL

SEQ ID NO: 2547442 - protein, 24 aa, Entamoeba dispar
VFGQWGFLIYYILSKGGSVTIRPS

SEQ ID NO: 2547443 - protein, 17 aa, Entamoeba dispar
VFIPYRDSRLTFMLKDS

SEQ ID NO: 2547444 - protein, 19 aa, Entamoeba dispar
VFLIYPNFLFPTTATIDIL

SEQ ID NO: 2547445 - protein, 23 aa, Entamoeba dispar
VFNKCIRLILVELLLKAGAEVDA

SEQ ID NO: 2547446 - protein, 17 aa, Entamoeba dispar
VFPFIEIPFIPIQVIRV

SEQ ID NO: 2547447 - protein, 17 aa, Entamoeba dispar
VFTALPFIRTFLLNETE

SEQ ID NO: 2547448 - protein, 18 aa, Entamoeba dispar
VFTTSLFNFLWPPIIERN

SEQ ID NO: 2547449 - protein, 23 aa, Entamoeba dispar
VFVELQIKFYLLARLLGVESSDG

SEQ ID NO: 2547450 - protein, 17 aa, Entamoeba dispar
VGAFVFLRLINPVLLTP

SEQ ID NO: 2547451 - protein, 18 aa, Entamoeba dispar
VGGKALITVWAKEQKKFE

SEQ ID NO: 2547452 - protein, 24 aa, Entamoeba dispar
VGKYKYEMILAGIYYIVLDLINQY

SEQ ID NO: 2547453 - protein, 19 aa, Entamoeba dispar
VHFVFVSLNILCFRTCYKI

SEQ ID NO: 2547454 - protein, 17 aa, Entamoeba dispar
VHKLLPIFIKNTSLSLF

SEQ ID NO: 2547455 - protein, 19 aa, Entamoeba dispar
VHLEWDFETPFYYIFVMTY

SEQ ID NO: 2547456 - protein, 17 aa, Entamoeba dispar
VIALYEYLYAGNPIPLI

SEQ ID NO: 2547457 - protein, 24 aa, Entamoeba dispar
VIDMNLLLRYIFGLIGYVPTVSFG

SEQ ID NO: 2547458 - protein, 18 aa, Entamoeba dispar
VIFAYPVYWYAIPGEIKN

SEQ ID NO: 2547459 - protein, 20 aa, Entamoeba dispar
VIIIFEFSLLDNVLMDIPKW

SEQ ID NO: 2547460 - protein, 19 aa, Entamoeba dispar
VIIKIICFICSFITEKEEI

SEQ ID NO: 2547461 - protein, 18 aa, Entamoeba dispar
VIITWYSMYQNILKQKLR

SEQ ID NO: 2547462 - protein, 17 aa, Entamoeba dispar
VIIVIGPLLAREGEIAW

SEQ ID NO: 2547463 - protein, 17 aa, Entamoeba dispar
VILLLKTLGIDDILHFD

SEQ ID NO: 2547464 - protein, 17 aa, Entamoeba dispar
VILLRRFVSFLQQRAEN

SEQ ID NO: 2547465 - protein, 17 aa, Entamoeba dispar
VIMAQIGMFIPCSEADI

SEQ ID NO: 2547466 - protein, 23 aa, Entamoeba dispar
VIMKSFTIITLLKTLGIKNKNEV

SEQ ID NO: 2547467 - protein, 19 aa, Entamoeba dispar
VINSYFAFLPFIQMGRIIQ

SEQ ID NO: 2547468 - protein, 21 aa, Entamoeba dispar
VIQLFQYFGLNWKGLNSFKRP

SEQ ID NO: 2547469 - protein, 35 aa, Entamoeba dispar
VIQRTLKSWVTFRNWAWWKLYVKARPMLKRRNFEE

SEQ ID NO: 2547470 - protein, 18 aa, Entamoeba dispar
VIRRQHEVLLKLKKEREI

SEQ ID NO: 2547471 - protein, 20 aa, Entamoeba dispar
VISYIPWWTIVEMANNIFGD

SEQ ID NO: 2547472 - protein, 22 aa, Entamoeba dispar
VITLLLLYKLKYPHSIFLLRGN

SEQ ID NO: 2547473 - protein, 21 aa, Entamoeba dispar
VIVDQERFIFPSSFICLLSES

SEQ ID NO: 2547474 - protein, 27 aa, Entamoeba dispar
VIVTNQRIYFFKPKKFKIPKYHSHLFD

SEQ ID NO: 2547475 - protein, 21 aa, Entamoeba dispar
VKCIYQCILLKRIIKEIPDFF

SEQ ID NO: 2547476 - protein, 23 aa, Entamoeba dispar
VKEIRASLYDFLLRCFVYNPKDR

SEQ ID NO: 2547477 - protein, 23 aa, Entamoeba dispar
VKLILGLLYTLYRKYRLSVLVDK

SEQ ID NO: 2547478 - protein, 18 aa, Entamoeba dispar
VKMHFFPEMTEEAELVIQ

SEQ ID NO: 2547479 - protein, 18 aa, Entamoeba dispar
VKRAAYLAYLKQENRISP

SEQ ID NO: 2547480 - protein, 23 aa, Entamoeba dispar
VKREYLIYSWIFINTLDEKPFEI

SEQ ID NO: 2547481 - protein, 26 aa, Entamoeba dispar
VKTIKRRWFVLTTNKLFYFTSQNATE

SEQ ID NO: 2547482 - protein, 18 aa, Entamoeba dispar
VKYLWTQQIKPLDALMLL

SEQ ID NO: 2547483 - protein, 25 aa, Entamoeba dispar
VLDSFQFIFLFLHLSFAFNHHISHP

SEQ ID NO: 2547484 - protein, 23 aa, Entamoeba dispar
VLEELINFWVFKGLLEMSAKVAT

SEQ ID NO: 2547485 - protein, 18 aa, Entamoeba dispar
VLEYIKTIKWLLQVPQEI

SEQ ID NO: 2547486 - protein, 18 aa, Entamoeba dispar
VLGFPLLVAIRKSGWRVP

SEQ ID NO: 2547487 - protein, 18 aa, Entamoeba dispar
VLTLFSFMIIYPNSVFLA

SEQ ID NO: 2547488 - protein, 24 aa, Entamoeba dispar
VMCLLYLFKIQFPNQFFLLRGNHE

SEQ ID NO: 2547489 - protein, 23 aa, Entamoeba dispar
VMELIPEFFYFPEFLKNFDHFDL

SEQ ID NO: 2547490 - protein, 21 aa, Entamoeba dispar
VMEPVMFYDLLTSLEIMKNAF

SEQ ID NO: 2547491 - protein, 27 aa, Entamoeba dispar
VMGPGKRLRPLSLLLFFIGGGGKIEER

SEQ ID NO: 2547492 - protein, 23 aa, Entamoeba dispar
VMQALVLKHRWFPKLVKSKEPIV

SEQ ID NO: 2547493 - protein, 17 aa, Entamoeba dispar
VMTLYKVFLLENSNIQE

SEQ ID NO: 2547494 - protein, 26 aa, Entamoeba dispar
VMTPENFFFFRMPKFTPFDGKLLDPF

SEQ ID NO: 2547495 - protein, 30 aa, Entamoeba dispar
VMTPNFFLDFYKTFKIFFSLGNTFFSDNPF

SEQ ID NO: 2547496 - protein, 18 aa, Entamoeba dispar
VMVSRWFGGILLGPDRFK

SEQ ID NO: 2547497 - protein, 29 aa, Entamoeba dispar
VNAPRVYFSLKKDIYWWIVDHWYCFGSLQ

SEQ ID NO: 2547498 - protein, 23 aa, Entamoeba dispar
VNKLSFVFGLHRLSLDKKVPEEV

SEQ ID NO: 2547499 - protein, 24 aa, Entamoeba dispar
VNPAYFIYMYYLYANIVSLNVYRM

SEQ ID NO: 2547500 - protein, 25 aa, Entamoeba dispar
VNSQLLLLLLKLHPTPFIPITFHSQ

SEQ ID NO: 2547501 - protein, 23 aa, Entamoeba dispar
VNTEKLLFTFKFPEKIVGIAQSP

SEQ ID NO: 2547502 - protein, 20 aa, Entamoeba dispar
VPFNCRLYFEVILPNEQRKA

SEQ ID NO: 2547503 - protein, 19 aa, Entamoeba dispar
VPFSIIIPIVPHPSLHLKG

SEQ ID NO: 2547504 - protein, 20 aa, Entamoeba dispar
VPIPAILKPVPKWTGKQVFT

SEQ ID NO: 2547505 - protein, 20 aa, Entamoeba dispar
VPSFFPLPIPLLRSNAGYIT

SEQ ID NO: 2547506 - protein, 25 aa, Entamoeba dispar
VPSQRPMILFEYYETFIVKSSVYKA

SEQ ID NO: 2547507 - protein, 26 aa, Entamoeba dispar
VQKKRLDLVLLLLKFGARIYIANNAG

SEQ ID NO: 2547508 - protein, 18 aa, Entamoeba dispar
VQLLINKFSQNQNVSEGE

SEQ ID NO: 2547509 - protein, 21 aa, Entamoeba dispar
VQRLPRYELLLKDLLKNTKPD

SEQ ID NO: 2547510 - protein, 27 aa, Entamoeba dispar
VQYFPKLKRLILYNLLLSSSILHIIKN

SEQ ID NO: 2547511 - protein, 17 aa, Entamoeba dispar
VQYLFFTSKIPSLIELV

SEQ ID NO: 2547512 - protein, 26 aa, Entamoeba dispar
VREKNPDLFIPWIPNNMQLAVCDVPP

SEQ ID NO: 2547513 - protein, 22 aa, Entamoeba dispar
VRICLWVLYQLLCQIKTIIEME

SEQ ID NO: 2547514 - protein, 22 aa, Entamoeba dispar
VRIGWLYCQRGFETGYIPQNFT

SEQ ID NO: 2547515 - protein, 22 aa, Entamoeba dispar
VRLKGLMLLFMSIGGVIEVKDV

SEQ ID NO: 2547516 - protein, 17 aa, Entamoeba dispar
VRRNAVLGLLKLLHIPN

SEQ ID NO: 2547517 - protein, 17 aa, Entamoeba dispar
VRSLLTLKWLFLHNLVN

SEQ ID NO: 2547518 - protein, 26 aa, Entamoeba dispar
VRTEIPILPLFFLQYCAIEELQFEKL

SEQ ID NO: 2547519 - protein, 18 aa, Entamoeba dispar
VSCRRLFHPFISPRGICI

SEQ ID NO: 2547520 - protein, 22 aa, Entamoeba dispar
VSDLALHFLAKLKIMVVKDIER

SEQ ID NO: 2547521 - protein, 19 aa, Entamoeba dispar
VSFVMPKFHDITIAQIVEG

SEQ ID NO: 2547522 - protein, 17 aa, Entamoeba dispar
VSKCFFLKVGKTFIKRY

SEQ ID NO: 2547523 - protein, 25 aa, Entamoeba dispar
VSKPTQWNYFFLFSDRLIGTVIKKY

SEQ ID NO: 2547524 - protein, 24 aa, Entamoeba dispar
VSRERLLSFMFKRKTNEKTTISES

SEQ ID NO: 2547525 - protein, 24 aa, Entamoeba dispar
VSRFDLWLNKYYPFGQLKLKELFL

SEQ ID NO: 2547526 - protein, 22 aa, Entamoeba dispar
VSTLFYYMRLCVLSYGKWVYIQ

SEQ ID NO: 2547527 - protein, 17 aa, Entamoeba dispar
VSTLLFFNILKLSPVCL

SEQ ID NO: 2547528 - protein, 25 aa, Entamoeba dispar
VTITLTFIIPFKKFDLLLCFVSQSE

SEQ ID NO: 2547529 - protein, 24 aa, Entamoeba dispar
VTNQISMFFAFAAPMILCLCEALN

SEQ ID NO: 2547530 - protein, 31 aa, Entamoeba dispar
VTSFKKISMINFLIFIYGYDLHEVVNAPQGA

SEQ ID NO: 2547531 - protein, 17 aa, Entamoeba dispar
VTVPYISGFLGFREVEV

SEQ ID NO: 2547532 - protein, 23 aa, Entamoeba dispar
VVCLLFPWIIRPQQNIMFIHSTM

SEQ ID NO: 2547533 - protein, 18 aa, Entamoeba dispar
VVFPLTALSFIHTESNNK

SEQ ID NO: 2547534 - protein, 18 aa, Entamoeba dispar
VVKLYYAFQDKCSLFLVM

SEQ ID NO: 2547535 - protein, 20 aa, Entamoeba dispar
VVKMNFAFLAALMKWKKEQD

SEQ ID NO: 2547536 - protein, 18 aa, Entamoeba dispar
VVKWLWEILHSYSIELKK

SEQ ID NO: 2547537 - protein, 19 aa, Entamoeba dispar
VVNLFFFEDCDSFIGSFSS

SEQ ID NO: 2547538 - protein, 20 aa, Entamoeba dispar
VVNRPMFTSPLKSVVIPFTP

SEQ ID NO: 2547539 - protein, 19 aa, Entamoeba dispar
VWDFRQFDFPYATFNWHKK

SEQ ID NO: 2547540 - protein, 18 aa, Entamoeba dispar
VWFNTWFVKGTTLTLTKL

SEQ ID NO: 2547541 - protein, 18 aa, Entamoeba dispar
VYAYLIKNGLKKTAKSFL

SEQ ID NO: 2547542 - protein, 25 aa, Entamoeba dispar
VYDFFVTDGLFYKILKKTKASGGLL

SEQ ID NO: 2547543 - protein, 17 aa, Entamoeba dispar
VYQRYYHVFIKGELEQV

SEQ ID NO: 2547544 - protein, 18 aa, Entamoeba dispar
VYVSILVMFPLWEWNRLL

SEQ ID NO: 2547545 - protein, 21 aa, Entamoeba dispar
WAEFEYCILFPFNVLKMKSIK

SEQ ID NO: 2547546 - protein, 21 aa, Entamoeba dispar
WAFGVMLYYLKFGITPFNSST

SEQ ID NO: 2547547 - protein, 20 aa, Entamoeba dispar
WCKAYLIGLLILCETRNSLS

SEQ ID NO: 2547548 - protein, 17 aa, Entamoeba dispar
WCLRFEYWKQILPMSAS

SEQ ID NO: 2547549 - protein, 17 aa, Entamoeba dispar
WEDGYAIKFIFADDHPF

SEQ ID NO: 2547550 - protein, 17 aa, Entamoeba dispar
WEEAWEIIQKGFTLRHT

SEQ ID NO: 2547551 - protein, 18 aa, Entamoeba dispar
WEYAKSAILVLFKPLDYA

SEQ ID NO: 2547552 - protein, 17 aa, Entamoeba dispar
WFGLFKKSSMSQKSPIF

SEQ ID NO: 2547553 - protein, 32 aa, Entamoeba dispar
WFRKVIFIDPSYGDAWIWIYKILYEQKGKIID

SEQ ID NO: 2547554 - protein, 18 aa, Entamoeba dispar
WFSSWWKTDKDEVNMIKK

SEQ ID NO: 2547555 - protein, 17 aa, Entamoeba dispar
WFYGCKSLKSINIPSSI

SEQ ID NO: 2547556 - protein, 17 aa, Entamoeba dispar
WHEEFLELLPKLAHGEK

SEQ ID NO: 2547557 - protein, 17 aa, Entamoeba dispar
WIEIPRNLKIINGKNIE

SEQ ID NO: 2547558 - protein, 17 aa, Entamoeba dispar
WIEPIMSNFLYESPMIL

SEQ ID NO: 2547559 - protein, 18 aa, Entamoeba dispar
WIFTFDTYDFRLFVGNQE

SEQ ID NO: 2547560 - protein, 17 aa, Entamoeba dispar
WIKNPFLQISMIKFGIK

SEQ ID NO: 2547561 - protein, 17 aa, Entamoeba dispar
WIYGVIPLNNISALKQF

SEQ ID NO: 2547562 - protein, 18 aa, Entamoeba dispar
WKALLRVYILNSIDNFGY

SEQ ID NO: 2547563 - protein, 17 aa, Entamoeba dispar
WKLLIKKAENWLSNKPT

SEQ ID NO: 2547564 - protein, 25 aa, Entamoeba dispar
WKSWKRRFFVLKDRKLWYFESENST

SEQ ID NO: 2547565 - protein, 17 aa, Entamoeba dispar
WLFKTFPNINTIQGPFN

SEQ ID NO: 2547566 - protein, 18 aa, Entamoeba dispar
WLFPKILHEIFDQCEKDA

SEQ ID NO: 2547567 - protein, 18 aa, Entamoeba dispar
WLPFILAVLDAEKKTFVI

SEQ ID NO: 2547568 - protein, 23 aa, Entamoeba dispar
WLTMTYYYICILRSPLLYGLQPN

SEQ ID NO: 2547569 - protein, 19 aa, Entamoeba dispar
WNFILLIQQNIELQSYAVH

SEQ ID NO: 2547570 - protein, 20 aa, Entamoeba dispar
WNVFPIADFWRHVCIVWTKC

SEQ ID NO: 2547571 - protein, 25 aa, Entamoeba dispar
WNVLPRPLFYKLFRQDLLIASLYRN

SEQ ID NO: 2547572 - protein, 17 aa, Entamoeba dispar
WPVPYIKKILVFSTDEE

SEQ ID NO: 2547573 - protein, 17 aa, Entamoeba dispar
WRICQTYDYFFVKTVVR

SEQ ID NO: 2547574 - protein, 17 aa, Entamoeba dispar
WSMLVHHFYLRDALFEL

SEQ ID NO: 2547575 - protein, 17 aa, Entamoeba dispar
WTIICKYILKALANINE

SEQ ID NO: 2547576 - protein, 28 aa, Entamoeba dispar
WVFQQLFFVRFLFPLLENPLFILDGVKQ

SEQ ID NO: 2547577 - protein, 18 aa, Entamoeba dispar
WVNMRSWWFNEDKSLYII

SEQ ID NO: 2547578 - protein, 18 aa, Entamoeba dispar
WVVLARYLLPYTTDYNYA

SEQ ID NO: 2547579 - protein, 17 aa, Entamoeba dispar
WWTLGVLMYEFLYGCNP

SEQ ID NO: 2547580 - protein, 17 aa, Entamoeba dispar
WYEFFSFKGKRIGGKIG

SEQ ID NO: 2547581 - protein, 18 aa, Entamoeba dispar
WYLEYICSFLIKIILEEK

SEQ ID NO: 2547582 - protein, 17 aa, Entamoeba dispar
  misc_feature (1)..(2): Xaa can be any naturally occurring amino acid
XXFNDYLLLWKMFFLMK

SEQ ID NO: 2547583 - protein, 17 aa, Entamoeba dispar
  misc_feature (1)..(2): Xaa can be any naturally occurring amino acid
XXGFLYGWYLYLVDIVI

SEQ ID NO: 2547584 - protein, 17 aa, Entamoeba dispar
YAKLRPLSYPETDIFIV

SEQ ID NO: 2547585 - protein, 24 aa, Entamoeba dispar
YALGLIMWQTFTQKQLFPEYDDFD

SEQ ID NO: 2547586 - protein, 27 aa, Entamoeba dispar
YCDVYTKLLLVFLPYIKEFNSTLITMN

SEQ ID NO: 2547587 - protein, 23 aa, Entamoeba dispar
YCHTPTYLPLYDADGLIIKQEGA

SEQ ID NO: 2547588 - protein, 23 aa, Entamoeba dispar
YCLKDTYLPIKLLEKLMSLVNGF

SEQ ID NO: 2547589 - protein, 17 aa, Entamoeba dispar
YCLLQTISQKRFIGVVG

SEQ ID NO: 2547590 - protein, 25 aa, Entamoeba dispar
YCYALGYTAFILLALKKTGQICCIS

SEQ ID NO: 2547591 - protein, 17 aa, Entamoeba dispar
YDDLNSRFRYLNTISPE

SEQ ID NO: 2547592 - protein, 18 aa, Entamoeba dispar
YDFYLLRLLIRHSSATVI

SEQ ID NO: 2547593 - protein, 25 aa, Entamoeba dispar
YDMLDPIILLYMKLVVNLTGEKAVS

SEQ ID NO: 2547594 - protein, 24 aa, Entamoeba dispar
YDRIRPLSYPQTDVFLLCFSVVSP

SEQ ID NO: 2547595 - protein, 23 aa, Entamoeba dispar
YDRLRPLSYPSTDVFLVCFSVIA

SEQ ID NO: 2547596 - protein, 17 aa, Entamoeba dispar
YDYYNRLYIYPLEISFG

SEQ ID NO: 2547597 - protein, 20 aa, Entamoeba dispar
YEFIAIYRYLEICYALFNAY

SEQ ID NO: 2547598 - protein, 17 aa, Entamoeba dispar
YEFIRIHKDILSEYPWF

SEQ ID NO: 2547599 - protein, 18 aa, Entamoeba dispar
YEGLHTLAILYIGTIRPF

SEQ ID NO: 2547600 - protein, 20 aa, Entamoeba dispar
YEHNSVFWAIKFYHTDTKTS

SEQ ID NO: 2547601 - protein, 18 aa, Entamoeba dispar
YEIILKWLQDILSLYEID

SEQ ID NO: 2547602 - protein, 23 aa, Entamoeba dispar
YEKMKFGIWLKKLQLVLTEESKE

SEQ ID NO: 2547603 - protein, 19 aa, Entamoeba dispar
YEKNFDFFPSNKYPKFIDC

SEQ ID NO: 2547604 - protein, 19 aa, Entamoeba dispar
YEMMGFIDELLFNSLPDIK

SEQ ID NO: 2547605 - protein, 23 aa, Entamoeba dispar
YESIRPLSYPSTDVFLLCYSVVQ

SEQ ID NO: 2547606 - protein, 20 aa, Entamoeba dispar
YESQGLVPLLRLAWNHFDPN

SEQ ID NO: 2547607 - protein, 23 aa, Entamoeba dispar
YESQGLVPLLRLQWNKFDPNFIA

SEQ ID NO: 2547608 - protein, 24 aa, Entamoeba dispar
YESQGLVPLLRLQWNKFDPNFIAT

SEQ ID NO: 2547609 - protein, 17 aa, Entamoeba dispar
YEYLYAGNPLIIDLAKY

SEQ ID NO: 2547610 - protein, 23 aa, Entamoeba dispar
YFDYFSVFILYKLVIKQLSLIVQ

SEQ ID NO: 2547611 - protein, 21 aa, Entamoeba dispar
YFIDKLNCYYLNTSHIQNLRE

SEQ ID NO: 2547612 - protein, 17 aa, Entamoeba dispar
YFINLLTNDLEIARIFG

SEQ ID NO: 2547613 - protein, 22 aa, Entamoeba dispar
YFNIPRQYFYLIKNGKLKYEGH

SEQ ID NO: 2547614 - protein, 20 aa, Entamoeba dispar
YFSEYLLLKEIILPSTITSI

SEQ ID NO: 2547615 - protein, 17 aa, Entamoeba dispar
YGDLYIHFKIQNPTYLS

SEQ ID NO: 2547616 - protein, 26 aa, Entamoeba dispar
YGNKLILGLLYTLYRIYRMNPVDLVG

SEQ ID NO: 2547617 - protein, 28 aa, Entamoeba dispar
YGNKLILGLLYTLYRIYRMNPVDLVGTE

SEQ ID NO: 2547618 - protein, 22 aa, Entamoeba dispar
YGQLRAFPWNSLALMTTTGAKG

SEQ ID NO: 2547619 - protein, 19 aa, Entamoeba dispar
YGTLIYEMLLGLPPFFDND

SEQ ID NO: 2547620 - protein, 20 aa, Entamoeba dispar
YHFENLFLPSFFKKFGMDYS

SEQ ID NO: 2547621 - protein, 18 aa, Entamoeba dispar
YHILYFWQGRKCPILDKG

SEQ ID NO: 2547622 - protein, 29 aa, Entamoeba dispar
YHYKIWAKDMYLLYFWQGRSCAVIDKGTS

SEQ ID NO: 2547623 - protein, 20 aa, Entamoeba dispar
YICKRVLQGLVYLHKMGIIH

SEQ ID NO: 2547624 - protein, 18 aa, Entamoeba dispar
YIDVYRLLYPELPRLEFI

SEQ ID NO: 2547625 - protein, 18 aa, Entamoeba dispar
YIEFLFKMKRINMVTAQN

SEQ ID NO: 2547626 - protein, 19 aa, Entamoeba dispar
YIFPYKTLPLLRKLRNIIG

SEQ ID NO: 2547627 - protein, 17 aa, Entamoeba dispar
YIHYYNLNDFLLIKLFK

SEQ ID NO: 2547628 - protein, 18 aa, Entamoeba dispar
YIIHFYGAVFIPNKICIV

SEQ ID NO: 2547629 - protein, 23 aa, Entamoeba dispar
YIIKFIYDIFEFKDIWKHVCIVW

SEQ ID NO: 2547630 - protein, 17 aa, Entamoeba dispar
YIILKYRKWQLKDRRTQ

SEQ ID NO: 2547631 - protein, 19 aa, Entamoeba dispar
YIINIIFFNQYFLLESFLK

SEQ ID NO: 2547632 - protein, 21 aa, Entamoeba dispar
YIKILLRSAISSSPYKALEIY

SEQ ID NO: 2547633 - protein, 19 aa, Entamoeba dispar
YILILLEYFQIIFVLRKSF

SEQ ID NO: 2547634 - protein, 17 aa, Entamoeba dispar
YILLTKHFLIFDTALRS

SEQ ID NO: 2547635 - protein, 19 aa, Entamoeba dispar
YILTYKLIENYLQRIIYQP

SEQ ID NO: 2547636 - protein, 20 aa, Entamoeba dispar
YINLINYFRTFFSIATESAI

SEQ ID NO: 2547637 - protein, 24 aa, Entamoeba dispar
YIPLLRHPIIFPTMKLKILELLNF

SEQ ID NO: 2547638 - protein, 20 aa, Entamoeba dispar
YIQKYILVNLKYQTIIPFDK

SEQ ID NO: 2547639 - protein, 17 aa, Entamoeba dispar
YIYFVRAKNIIANDLGG

SEQ ID NO: 2547640 - protein, 17 aa, Entamoeba dispar
YKCSLLTLINIPPSITA

SEQ ID NO: 2547641 - protein, 24 aa, Entamoeba dispar
YKEEKYIIFIKKIEGIKKIKQGRI

SEQ ID NO: 2547642 - protein, 20 aa, Entamoeba dispar
YKFILGMMFSLYRKYCICRS

SEQ ID NO: 2547643 - protein, 23 aa, Entamoeba dispar
YKFKIKSLPFFKVKTLYNVYESI

SEQ ID NO: 2547644 - protein, 24 aa, Entamoeba dispar
YKGKWFMYVYGVVDKLLTKVQSEP

SEQ ID NO: 2547645 - protein, 17 aa, Entamoeba dispar
YKKGNVKLILLIGGTCK

SEQ ID NO: 2547646 - protein, 17 aa, Entamoeba dispar
YKKLVILKLPPLTLNSL

SEQ ID NO: 2547647 - protein, 26 aa, Entamoeba dispar
YKNWKKRYFVLKDKKLWYFDSKDSVS

SEQ ID NO: 2547648 - protein, 23 aa, Entamoeba dispar
YKRLRFLQIKLFNTSLKSYSKLP

SEQ ID NO: 2547649 - protein, 26 aa, Entamoeba dispar
YKTFSKIWPCNLFPPSLPTPNIENEE

SEQ ID NO: 2547650 - protein, 21 aa, Entamoeba dispar
YKTKILFVFETKSGVIGFYQE

SEQ ID NO: 2547651 - protein, 17 aa, Entamoeba dispar
YLAYYCWIKSSGSNVER

SEQ ID NO: 2547652 - protein, 19 aa, Entamoeba dispar
YLCTGFDLFTTHEPCLMCG

SEQ ID NO: 2547653 - protein, 19 aa, Entamoeba dispar
YLDYLIDIVRPRKLLYLAV

SEQ ID NO: 2547654 - protein, 17 aa, Entamoeba dispar
YLGVIPYIVEALKTIHD

SEQ ID NO: 2547655 - protein, 17 aa, Entamoeba dispar
YLIWFKRELFSSKGRLF

SEQ ID NO: 2547656 - protein, 23 aa, Entamoeba dispar
YLKDTDFVIFFLKSSFNSSLIQR

SEQ ID NO: 2547657 - protein, 17 aa, Entamoeba dispar
YLLIVQFINELIKSKQL

SEQ ID NO: 2547658 - protein, 17 aa, Entamoeba dispar
YLLKFLIIGDTAVGKTA

SEQ ID NO: 2547659 - protein, 20 aa, Entamoeba dispar
YLLKKVCAIPAFIVTFTVCI

SEQ ID NO: 2547660 - protein, 18 aa, Entamoeba dispar
YLLNIWKSTYSINFSKFI

SEQ ID NO: 2547661 - protein, 18 aa, Entamoeba dispar
YLLRNSILFRKETFDSAI

SEQ ID NO: 2547662 - protein, 20 aa, Entamoeba dispar
YLNDYRFFSFEFTGTEQRPV

SEQ ID NO: 2547663 - protein, 18 aa, Entamoeba dispar
YLPYIIETCIPFLESITC

SEQ ID NO: 2547664 - protein, 19 aa, Entamoeba dispar
YLRGLHGVLFCFDITKKET

SEQ ID NO: 2547665 - protein, 17 aa, Entamoeba dispar
YLRLPRNLSYQEKIWDH

SEQ ID NO: 2547666 - protein, 20 aa, Entamoeba dispar
YLSTFFPINAIFKSALQTQS

SEQ ID NO: 2547667 - protein, 21 aa, Entamoeba dispar
YLVTTFRPELILPANKWYEIK

SEQ ID NO: 2547668 - protein, 18 aa, Entamoeba dispar
YLYFVYKGVYRNITVAIK

SEQ ID NO: 2547669 - protein, 17 aa, Entamoeba dispar
YLYFYNTDRMKLYKKVP

SEQ ID NO: 2547670 - protein, 17 aa, Entamoeba dispar
YMEGLMAPIPLQQPIYK

SEQ ID NO: 2547671 - protein, 17 aa, Entamoeba dispar
YMPLALNLILFLGKHHK

SEQ ID NO: 2547672 - protein, 19 aa, Entamoeba dispar
YNFNTFYYILSFLRELLVH

SEQ ID NO: 2547673 - protein, 18 aa, Entamoeba dispar
YNFWICCLHFIGTPLISN

SEQ ID NO: 2547674 - protein, 17 aa, Entamoeba dispar
YNILQWLDNFDGTVPIP

SEQ ID NO: 2547675 - protein, 17 aa, Entamoeba dispar
YNIVIPRYTLHPTSLSV

SEQ ID NO: 2547676 - protein, 20 aa, Entamoeba dispar
YNKFIIPLQKLPLYLFPQDQ

SEQ ID NO: 2547677 - protein, 23 aa, Entamoeba dispar
YNKQLFIDYILPKHFPNVKQESF

SEQ ID NO: 2547678 - protein, 19 aa, Entamoeba dispar
YNLCFLIGRGFLFDCDVIL

SEQ ID NO: 2547679 - protein, 17 aa, Entamoeba dispar
YNLLFLIAHGLMFGPNQ

SEQ ID NO: 2547680 - protein, 20 aa, Entamoeba dispar
YNPIQLLFPVSLRSLSFSCF

SEQ ID NO: 2547681 - protein, 26 aa, Entamoeba dispar
YNPQLGNWLFLWKQSLPLPLPSSSST

SEQ ID NO: 2547682 - protein, 23 aa, Entamoeba dispar
YNSLRPLSYPQTDIFLLCFSVVY

SEQ ID NO: 2547683 - protein, 19 aa, Entamoeba dispar
YNTSLNNAILPFGSPRNTV

SEQ ID NO: 2547684 - protein, 24 aa, Entamoeba dispar
YPETYFHYYLKYFAIRDKVSARKI

SEQ ID NO: 2547685 - protein, 19 aa, Entamoeba dispar
YPFVIMKYKEQIIQISHLS

SEQ ID NO: 2547686 - protein, 20 aa, Entamoeba dispar
YPKFLIPTYFTAFIKKIYNF

SEQ ID NO: 2547687 - protein, 17 aa, Entamoeba dispar
YPNFLFPTTATIDILIE

SEQ ID NO: 2547688 - protein, 22 aa, Entamoeba dispar
YPSSKIYLIYLYKKNKLQHVDS

SEQ ID NO: 2547689 - protein, 17 aa, Entamoeba dispar
YQLCGVVLYVFFNKKIQ

SEQ ID NO: 2547690 - protein, 19 aa, Entamoeba dispar
YQLIFHPIKFFTPTEKKVG

SEQ ID NO: 2547691 - protein, 19 aa, Entamoeba dispar
YQLLVRALATMLKFLPDND

SEQ ID NO: 2547692 - protein, 20 aa, Entamoeba dispar
YQPFNFFIQPLPSVNDRLGI

SEQ ID NO: 2547693 - protein, 18 aa, Entamoeba dispar
YQPWRRSLDLKPCDIHIV

SEQ ID NO: 2547694 - protein, 23 aa, Entamoeba dispar
YQQGVMIYLLVKSGFEVRVKRLD

SEQ ID NO: 2547695 - protein, 20 aa, Entamoeba dispar
YQSHFLEHILFLLGNRCVNC

SEQ ID NO: 2547696 - protein, 17 aa, Entamoeba dispar
YQSIPYWVWMILKEENN

SEQ ID NO: 2547697 - protein, 18 aa, Entamoeba dispar
YQSIPYWVWMILKEENNS

SEQ ID NO: 2547698 - protein, 26 aa, Entamoeba dispar
YQSKYYYYHFLSWPYLMYVAETINKK

SEQ ID NO: 2547699 - protein, 18 aa, Entamoeba dispar
YRAITNAYYRGALGAILV

SEQ ID NO: 2547700 - protein, 18 aa, Entamoeba dispar
YREIFLLMYRLYTSPECV

SEQ ID NO: 2547701 - protein, 23 aa, Entamoeba dispar
YRHLWSYILHIIRLFISFSFNNP

SEQ ID NO: 2547702 - protein, 19 aa, Entamoeba dispar
YRKLFDILASPLKFTLPIN

SEQ ID NO: 2547703 - protein, 17 aa, Entamoeba dispar
YRNYFGIPLKKLLEDEG

SEQ ID NO: 2547704 - protein, 23 aa, Entamoeba dispar
YSDLLLILFHRALCSCLGSFISS

SEQ ID NO: 2547705 - protein, 25 aa, Entamoeba dispar
YSDTVQIFYLLRTLSFHPLSRFFEE

SEQ ID NO: 2547706 - protein, 18 aa, Entamoeba dispar
YSELAKWILSFNPLQQYK

SEQ ID NO: 2547707 - protein, 17 aa, Entamoeba dispar
YSIPFFFHLKKLKIGYS

SEQ ID NO: 2547708 - protein, 20 aa, Entamoeba dispar
YSWWRRNSLTVFLDKKIYKD

SEQ ID NO: 2547709 - protein, 20 aa, Entamoeba dispar
YSYPFVMQLPKGIPSSCFFN

SEQ ID NO: 2547710 - protein, 18 aa, Entamoeba dispar
YTCKFVFFLFKPFYFRIF

SEQ ID NO: 2547711 - protein, 22 aa, Entamoeba dispar
YTDDYWLLPSFITLPEITLLHS

SEQ ID NO: 2547712 - protein, 19 aa, Entamoeba dispar
YTILYFQVLVRLLQVFDQK

SEQ ID NO: 2547713 - protein, 18 aa, Entamoeba dispar
YTTYMNIYFPLKTFYESD

SEQ ID NO: 2547714 - protein, 17 aa, Entamoeba dispar
YVEKLYPQVFPLIKFTD

SEQ ID NO: 2547715 - protein, 17 aa, Entamoeba dispar
YVFPSLYLHIFNNEVEM

SEQ ID NO: 2547716 - protein, 23 aa, Entamoeba dispar
YVIIPMTILPNFFGKFTIVIHEL

SEQ ID NO: 2547717 - protein, 20 aa, Entamoeba dispar
YVINNPLDWSYSYCLPLFIV

SEQ ID NO: 2547718 - protein, 27 aa, Entamoeba dispar
YVLKLKLYIPFILIKDKTLLVLSLEIE

SEQ ID NO: 2547719 - protein, 25 aa, Entamoeba dispar
YVLMKQWFLVIYLFSLFGENILNEF

SEQ ID NO: 2547720 - protein, 18 aa, Entamoeba dispar
YVMDFLQPFYFCKGDIIM

SEQ ID NO: 2547721 - protein, 20 aa, Entamoeba dispar
YVSRMLLYHRNIPLNECFVS

SEQ ID NO: 2547722 - protein, 17 aa, Entamoeba dispar
YWGLGDLLYHPFFDSLR

SEQ ID NO: 2547723 - protein, 17 aa, Entamoeba dispar
YYAFCILLKGIDLNLFT

SEQ ID NO: 2547724 - protein, 17 aa, Entamoeba dispar
YYEPFGCYINHPFKKEG

SEQ ID NO: 2547725 - protein, 24 aa, Entamoeba dispar
YYFNLTDWYIGYLIQLYKNGDKSI

SEQ ID NO: 2547726 - protein, 17 aa, Entamoeba dispar
YYIKGDGFVLVYSIDNK

SEQ ID NO: 2547727 - protein, 20 aa, Entamoeba dispar
YYMLRPLIYPNTDVFLLCYS

SEQ ID NO: 2547728 - protein, 18 aa, Entamoeba dispar
YYNRFPALVWYDNKYKNV

SEQ ID NO: 2547729 - protein, 28 aa, Entamoeba dispar
YYRVRLMNLLPFDKILGGLAWGISATCY

SEQ ID NO: 2547730 - protein, 17 aa, Entamoeba dispar
YYSLIIELLFINSQLQI

SEQ ID NO: 2547731 - protein, 8 aa, Entamoeba dispar
GGNVGDSV

SEQ ID NO: 2547732 - protein, 5 aa, Entamoeba dispar
DGTIN

SEQ ID NO: 2547733 - protein, 8 aa, Entamoeba dispar
KIKSGGVA

SEQ ID NO: 2547734 - protein, 12 aa, Entamoeba dispar
LPTTNTKQVLSQ

SEQ ID NO: 2547735 - protein, 11 aa, Entamoeba dispar
PCGETRYPSYP

SEQ ID NO: 2547736 - protein, 10 aa, Entamoeba dispar
SYSSANEKTL

SEQ ID NO: 2547737 - protein, 4 aa, Entamoeba dispar
TQED

SEQ ID NO: 2547738 - protein, 7 aa, Entamoeba dispar
TSPRNYN

SEQ ID NO: 2547739 - protein, 8 aa, Entamoeba dispar
VENNDKSI

SEQ ID NO: 2547740 - protein, 7 aa, Entamoeba dispar
APQNVAA

SEQ ID NO: 2547741 - protein, 10 aa, Entamoeba dispar
CNDGKSKELL

SEQ ID NO: 2547742 - protein, 5 aa, Entamoeba dispar
DCKGR

SEQ ID NO: 2547743 - protein, 25 aa, Entamoeba dispar
DKDKKREYYTCNKGKKSCVSKCPNE

SEQ ID NO: 2547744 - protein, 8 aa, Entamoeba dispar
DNENNVNN

SEQ ID NO: 2547745 - protein, 5 aa, Entamoeba dispar
ESSNQ

SEQ ID NO: 2547746 - protein, 21 aa, Entamoeba dispar
GYYNSNGNDAYKTLSNTFKNN

SEQ ID NO: 2547747 - protein, 8 aa, Entamoeba dispar
MQQRDSTN

SEQ ID NO: 2547748 - protein, 8 aa, Entamoeba dispar
NAGAANDA

SEQ ID NO: 2547749 - protein, 6 aa, Entamoeba dispar
NYQSEY

SEQ ID NO: 2547750 - protein, 5 aa, Entamoeba dispar
PNESH

SEQ ID NO: 2547751 - protein, 7 aa, Entamoeba dispar
SHAAEMT

SEQ ID NO: 2547752 - protein, 6 aa, Entamoeba dispar
SIFEGR

SEQ ID NO: 2547753 - protein, 16 aa, Entamoeba dispar
VNSNGVNNKGQLQNDL

SEQ ID NO: 2547754 - protein, 10 aa, Entamoeba dispar
VPANGSEGTL

SEQ ID NO: 2547755 - protein, 4 aa, Entamoeba dispar
DGNA

SEQ ID NO: 2547756 - protein, 7 aa, Entamoeba dispar
EESKNTE

SEQ ID NO: 2547757 - protein, 6 aa, Entamoeba dispar
EGFTGE

SEQ ID NO: 2547758 - protein, 9 aa, Entamoeba dispar
EQSNEGTTL

SEQ ID NO: 2547759 - protein, 9 aa, Entamoeba dispar
FKKDEEDDF

SEQ ID NO: 2547760 - protein, 6 aa, Entamoeba dispar
GCNTNG

SEQ ID NO: 2547761 - protein, 7 aa, Entamoeba dispar
GDPAGQV

SEQ ID NO: 2547762 - protein, 6 aa, Entamoeba dispar
GKCGEN

SEQ ID NO: 2547763 - protein, 10 aa, Entamoeba dispar
GNSPTRITGD

SEQ ID NO: 2547764 - protein, 12 aa, Entamoeba dispar
GNSRTSYSIPPS

SEQ ID NO: 2547765 - protein, 6 aa, Entamoeba dispar
KFGSTY

SEQ ID NO: 2547766 - protein, 33 aa, Entamoeba dispar; identical to SEQ ID NO: 2408755

SEQ ID NO: 2547767 - protein, 7 aa, Entamoeba dispar
KKEPYQK

SEQ ID NO: 2547768 - protein, 6 aa, Entamoeba dispar
KNNTGL

SEQ ID NO: 2547769 - protein, 7 aa, Entamoeba dispar
NAAGTVG

SEQ ID NO: 2547770 - protein, 9 aa, Entamoeba dispar
PDNYEKDTF

SEQ ID NO: 2547771 - protein, 17 aa, Entamoeba dispar
PKGTTCHTKDNGYNSPC

SEQ ID NO: 2547772 - protein, 12 aa, Entamoeba dispar
PLPTPTPNKYPV

SEQ ID NO: 2547773 - protein, 8 aa, Entamoeba dispar
SANQENYV

SEQ ID NO: 2547774 - protein, 6 aa, Entamoeba dispar
STLEIN

SEQ ID NO: 2547775 - protein, 5 aa, Entamoeba dispar
SYSGN

SEQ ID NO: 2547776 - protein, 10 aa, Entamoeba dispar
VPSSSDASGY

SEQ ID NO: 2547777 - protein, 7 aa, Entamoeba dispar
AAFPGNN

SEQ ID NO: 2547778 - protein, 8 aa, Entamoeba dispar
ADEINEKR

SEQ ID NO: 2547779 - protein, 8 aa, Entamoeba dispar
ADISDTAL

SEQ ID NO: 2547780 - protein, 5 aa, Entamoeba dispar
AEEIK

SEQ ID NO: 2547781 - protein, 15 aa, Entamoeba dispar
AEGKVTPIKDQGSCG

SEQ ID NO: 2547782 - protein, 6 aa, Entamoeba dispar
AGFSAK

SEQ ID NO: 2547783 - protein, 7 aa, Entamoeba dispar
ALPKNTA

SEQ ID NO: 2547784 - protein, 11 aa, Entamoeba dispar
ANMKQNEELRK

SEQ ID NO: 2547785 - protein, 8 aa, Entamoeba dispar
AQAEQMRN

SEQ ID NO: 2547786 - protein, 15 aa, Entamoeba dispar
AQTPLCQPYSDATNN

SEQ ID NO: 2547787 - protein, 7 aa, Entamoeba dispar
ARKGEEY

SEQ ID NO: 2547788 - protein, 6 aa, Entamoeba dispar
ASGGYG

SEQ ID NO: 2547789 - protein, 4 aa, Entamoeba dispar
ASLS

SEQ ID NO: 2547790 - protein, 6 aa, Entamoeba dispar
ATHNPK

SEQ ID NO: 2547791 - protein, 4 aa, Entamoeba dispar
ATTF

SEQ ID NO: 2547792 - protein, 14 aa, Entamoeba dispar
AWNEAKKNKEKINI

SEQ ID NO: 2547793 - protein, 5 aa, Entamoeba dispar
CDKES

SEQ ID NO: 2547794 - protein, 5 aa, Entamoeba dispar
CESDD

SEQ ID NO: 2547795 - protein, 6 aa, Entamoeba dispar
CGGSKR

SEQ ID NO: 2547796 - protein, 6 aa, Entamoeba dispar
CSTKDH

SEQ ID NO: 2547797 - protein, 20 aa, Entamoeba dispar
DAEVTRNALKEQTKKARKAL

SEQ ID NO: 2547798 - protein, 9 aa, Entamoeba dispar
DAGGYTVEG

SEQ ID NO: 2547799 - protein, 15 aa, Entamoeba dispar
DALPENYQDESKSSL

SEQ ID NO: 2547800 - protein, 7 aa, Entamoeba dispar
DDKEFQE

SEQ ID NO: 2547801 - protein, 5 aa, Entamoeba dispar
DDMVG

SEQ ID NO: 2547802 - protein, 9 aa, Entamoeba dispar
DEEFSNKDK

SEQ ID NO: 2547803 - protein, 5 aa, Entamoeba dispar
DIKPN

SEQ ID NO: 2547804 - protein, 13 aa, Entamoeba dispar
DKMRSKVKYESKK

SEQ ID NO: 2547805 - protein, 8 aa, Entamoeba dispar
DKQLSKNP

SEQ ID NO: 2547806 - protein, 9 aa, Entamoeba dispar
DKYTEENKK

SEQ ID NO: 2547807 - protein, 11 aa, Entamoeba dispar
DLKRKRKIEAT

SEQ ID NO: 2547808 - protein, 6 aa, Entamoeba dispar
DLSPNS

SEQ ID NO: 2547809 - protein, 10 aa, Entamoeba dispar
DPLNTNETQK

SEQ ID NO: 2547810 - protein, 9 aa, Entamoeba dispar
DQNNNEVRE

SEQ ID NO: 2547811 - protein, 6 aa, Entamoeba dispar
DQPQDN

SEQ ID NO: 2547812 - protein, 11 aa, Entamoeba dispar
DYIETKGSSKI

SEQ ID NO: 2547813 - protein, 8 aa, Entamoeba dispar
DYSAAYGY

SEQ ID NO: 2547814 - protein, 10 aa, Entamoeba dispar
EAVQKQKNRN

SEQ ID NO: 2547815 - protein, 8 aa, Entamoeba dispar
EENKEKYD

SEQ ID NO: 2547816 - protein, 16 aa, Entamoeba dispar
EENKERSQEARKIEGK

SEQ ID NO: 2547817 - protein, 6 aa, Entamoeba dispar
EFGEKD

SEQ ID NO: 2547818 - protein, 8 aa, Entamoeba dispar
EGNCNGSK

SEQ ID NO: 2547819 - protein, 24 aa, Entamoeba dispar
EGRKMDRLKKQKKEWKTQKNGEKR

SEQ ID NO: 2547820 - protein, 12 aa, Entamoeba dispar
EHPRNSEKDCYK

SEQ ID NO: 2547821 - protein, 4 aa, Entamoeba dispar
EIKR

SEQ ID NO: 2547822 - protein, 8 aa, Entamoeba dispar
EITDKNER

SEQ ID NO: 2547823 - protein, 5 aa, Entamoeba dispar
EKASF

SEQ ID NO: 2547824 - protein, 9 aa, Entamoeba dispar
EKCDTQKKD

SEQ ID NO: 2547825 - protein, 9 aa, Entamoeba dispar
EKDGENKRC

SEQ ID NO: 2547826 - protein, 21 aa, Entamoeba dispar
EKKDKKDSTSQQDSLNSHDSE

SEQ ID NO: 2547827 - protein, 4 aa, Entamoeba dispar
ELGV

SEQ ID NO: 2547828 - protein, 12 aa, Entamoeba dispar
EMENESYDSDSK

SEQ ID NO: 2547829 - protein, 16 aa, Entamoeba dispar
ENAESRSIDQSVKTTQ

SEQ ID NO: 2547830 - protein, 5 aa, Entamoeba dispar
ENDPE

SEQ ID NO: 2547831 - protein, 9 aa, Entamoeba dispar
ENDRHGSQV

SEQ ID NO: 2547832 - protein, 7 aa, Entamoeba dispar
ENPTDGV

SEQ ID NO: 2547833 - protein, 8 aa, Entamoeba dispar
EPPEPNFS

SEQ ID NO: 2547834 - protein, 7 aa, Entamoeba dispar
EQENKKH

SEQ ID NO: 2547835 - protein, 14 aa, Entamoeba dispar
ESFPSGSPKVEGEW

SEQ ID NO: 2547836 - protein, 7 aa, Entamoeba dispar
ESISTSS

SEQ ID NO: 2547837 - protein, 9 aa, Entamoeba dispar
ESSNEGTTL

SEQ ID NO: 2547838 - protein, 13 aa, Entamoeba dispar
ETYKNYKSTFSQL

SEQ ID NO: 2547839 - protein, 5 aa, Entamoeba dispar
FKTGE

SEQ ID NO: 2547840 - protein, 4 aa, Entamoeba dispar
FQRA

SEQ ID NO: 2547841 - protein, 7 aa, Entamoeba dispar
FSQESPT

SEQ ID NO: 2547842 - protein, 8 aa, Entamoeba dispar
GAGASGIR

SEQ ID NO: 2547843 - protein, 10 aa, Entamoeba dispar
GAGNGPDKEN

SEQ ID NO: 2547844 - protein, 8 aa, Entamoeba dispar
GASTPSLE

SEQ ID NO: 2547845 - protein, 7 aa, Entamoeba dispar
GCNTNGF

SEQ ID NO: 2547846 - protein, 7 aa, Entamoeba dispar
GECKPCT

SEQ ID NO: 2547847 - protein, 6 aa, Entamoeba dispar
GEENQE

SEQ ID NO: 2547848 - protein, 6 aa, Entamoeba dispar
GEITSK

SEQ ID NO: 2547849 - protein, 5 aa, Entamoeba dispar
GFNGD

SEQ ID NO: 2547850 - protein, 27 aa, Entamoeba dispar
GGGDNASKPSINPDTVYNAADQSYTNG

SEQ ID NO: 2547851 - protein, 7 aa, Entamoeba dispar
GGKKPCV

SEQ ID NO: 2547852 - protein, 4 aa, Entamoeba dispar
GGTF

SEQ ID NO: 2547853 - protein, 4 aa, Entamoeba dispar
GGWT

SEQ ID NO: 2547854 - protein, 7 aa, Entamoeba dispar
GKKTFSD

SEQ ID NO: 2547855 - protein, 7 aa, Entamoeba dispar
GLDNETG

SEQ ID NO: 2547856 - protein, 9 aa, Entamoeba dispar
GNSTNNYKK

SEQ ID NO: 2547857 - protein, 5 aa, Entamoeba dispar
GNSWG

SEQ ID NO: 2547858 - protein, 31 aa, Entamoeba dispar
GNYKEGSDPNTVCRSGEGTARKIGDYSCDTT

SEQ ID NO: 2547859 - protein, 11 aa, Entamoeba dispar
GPYAALTSEEY

SEQ ID NO: 2547860 - protein, 7 aa, Entamoeba dispar
GSATSME

SEQ ID NO: 2547861 - protein, 14 aa, Entamoeba dispar
GSFDPNAKSINENA

SEQ ID NO: 2547862 - protein, 4 aa, Entamoeba dispar
GSGK

SEQ ID NO: 2547863 - protein, 6 aa, Entamoeba dispar
GSGKMN

SEQ ID NO: 2547864 - protein, 11 aa, Entamoeba dispar
GVEKQEGKFDE

SEQ ID NO: 2547865 - protein, 4 aa, Entamoeba dispar
GVTK

SEQ ID NO: 2547866 - protein, 5 aa, Entamoeba dispar
HIRPD

SEQ ID NO: 2547867 - protein, 4 aa, Entamoeba dispar
HQKL

SEQ ID NO: 2547868 - protein, 5 aa, Entamoeba dispar
HRYNA

SEQ ID NO: 2547869 - protein, 9 aa, Entamoeba dispar
IAKEYNKRS

SEQ ID NO: 2547870 - protein, 14 aa, Entamoeba dispar
ICDKDNTDGAEPKM

SEQ ID NO: 2547871 - protein, 7 aa, Entamoeba dispar
IDAERRR

SEQ ID NO: 2547872 - protein, 7 aa, Entamoeba dispar
IDKVNDA

SEQ ID NO: 2547873 - protein, 4 aa, Entamoeba dispar
IDPN

SEQ ID NO: 2547874 - protein, 12 aa, Entamoeba dispar
IDSTASGKTLGP

SEQ ID NO: 2547875 - protein, 8 aa, Entamoeba dispar
IEEAEKEA

SEQ ID NO: 2547876 - protein, 6 aa, Entamoeba dispar
IEETQK

SEQ ID NO: 2547877 - protein, 8 aa, Entamoeba dispar
IENQPRKF

SEQ ID NO: 2547878 - protein, 8 aa, Entamoeba dispar
IEYNQGGR

SEQ ID NO: 2547879 - protein, 7 aa, Entamoeba dispar
IGNENKN

SEQ ID NO: 2547880 - protein, 9 aa, Entamoeba dispar
IGNSVSTIG

SEQ ID NO: 2547881 - protein, 11 aa, Entamoeba dispar
IGSERTKAHQR

SEQ ID NO: 2547882 - protein, 19 aa, Entamoeba dispar
IKEMGDKISSEDKKKAEEI

SEQ ID NO: 2547883 - protein, 4 aa, Entamoeba dispar
IKTD

SEQ ID NO: 2547884 - protein, 10 aa, Entamoeba dispar
IRGGANEGST

SEQ ID NO: 2547885 - protein, 4 aa, Entamoeba dispar
IRGR

SEQ ID NO: 2547886 - protein, 15 aa, Entamoeba dispar
ISKTPLPEKCDTQVE

SEQ ID NO: 2547887 - protein, 4 aa, Entamoeba dispar
ISSY

SEQ ID NO: 2547888 - protein, 46 aa, Entamoeba dispar
IVDPNAKKPEEWNDEDDGEWEAPTIENPEYKGEWKPKRIPNPAYKG

SEQ ID NO: 2547889 - protein, 13 aa, Entamoeba dispar
KALNKKRKEMEKK

SEQ ID NO: 2547890 - protein, 10 aa, Entamoeba dispar
KAQHEKEDKA

SEQ ID NO: 2547891 - protein, 11 aa, Entamoeba dispar
KAQSQDFEKRE

SEQ ID NO: 2547892 - protein, 18 aa, Entamoeba dispar
KASAEESRWQTPPRGSED

SEQ ID NO: 2547893 - protein, 8 aa, Entamoeba dispar
KASHHPPI

SEQ ID NO: 2547894 - protein, 7 aa, Entamoeba dispar
KCQIPPN

SEQ ID NO: 2547895 - protein, 13 aa, Entamoeba dispar
KCSGEGKCTSCEE

SEQ ID NO: 2547896 - protein, 9 aa, Entamoeba dispar
KDKGGCEMT

SEQ ID NO: 2547897 - protein, 6 aa, Entamoeba dispar
KECPAK

SEQ ID NO: 2547898 - protein, 9 aa, Entamoeba dispar
KEEPNLSEN

SEQ ID NO: 2547899 - protein, 16 aa, Entamoeba dispar
KEIDDPNDKKPEGWDD

SEQ ID NO: 2547900 - protein, 15 aa, Entamoeba dispar
KEIDDPNVSKPADWV

SEQ ID NO: 2547901 - protein, 8 aa, Entamoeba dispar
KERKLRKD

SEQ ID NO: 2547902 - protein, 6 aa, Entamoeba dispar
KGERTF

SEQ ID NO: 2547903 - protein, 5 aa, Entamoeba dispar
KHGTC

SEQ ID NO: 2547904 - protein, 5 aa, Entamoeba dispar
KIDNG

SEQ ID NO: 2547905 - protein, 9 aa, Entamoeba dispar
KIKSDGIGK

SEQ ID NO: 2547906 - protein, 7 aa, Entamoeba dispar
KKARHNE

SEQ ID NO: 2547907 - protein, 7 aa, Entamoeba dispar
KKEPYQR

SEQ ID NO: 2547908 - protein, 25 aa, Entamoeba dispar
KKGIQSRRERKAAIRTATIRSERTK

SEQ ID NO: 2547909 - protein, 13 aa, Entamoeba dispar
KKITRNSSNINLT

SEQ ID NO: 2547910 - protein, 7 aa, Entamoeba dispar
KKKLEQL

SEQ ID NO: 2547911 - protein, 7 aa, Entamoeba dispar
KKQAPKK

SEQ ID NO: 2547912 - protein, 15 aa, Entamoeba dispar
KKSIESEEKFTPESE

SEQ ID NO: 2547913 - protein, 9 aa, Entamoeba dispar
KLQRQLTQN

SEQ ID NO: 2547914 - protein, 12 aa, Entamoeba dispar
KMAKEMSKSISK

SEQ ID NO: 2547915 - protein, 4 aa, Entamoeba dispar
KNNL

SEQ ID NO: 2547916 - protein, 11 aa, Entamoeba dispar
KNPPQPSFSNN

SEQ ID NO: 2547917 - protein, 4 aa, Entamoeba dispar
KPGK

SEQ ID NO: 2547918 - protein, 5 aa, Entamoeba dispar
KQGNE

SEQ ID NO: 2547919 - protein, 8 aa, Entamoeba dispar
KRASSYKK

SEQ ID NO: 2547920 - protein, 7 aa, Entamoeba dispar
KRGGYYT

SEQ ID NO: 2547921 - protein, 6 aa, Entamoeba dispar
KRIANQ

SEQ ID NO: 2547922 - protein, 12 aa, Entamoeba dispar
KRSVRYPNGNYE

SEQ ID NO: 2547923 - protein, 19 aa, Entamoeba dispar
KRYNKKQANLKKNLEKRIE

SEQ ID NO: 2547924 - protein, 8 aa, Entamoeba dispar
KSIPKRQA

SEQ ID NO: 2547925 - protein, 16 aa, Entamoeba dispar
KSIRPLSSNEIPTRLQ

SEQ ID NO: 2547926 - protein, 6 aa, Entamoeba dispar
KSLTGI

SEQ ID NO: 2547927 - protein, 7 aa, Entamoeba dispar
KSNPRRI

SEQ ID NO: 2547928 - protein, 8 aa, Entamoeba dispar
KSPYTDAQ

SEQ ID NO: 2547929 - protein, 6 aa, Entamoeba dispar
KTKIIN

SEQ ID NO: 2547930 - protein, 11 aa, Entamoeba dispar
KWSSSKSSNRK

SEQ ID NO: 2547931 - protein, 6 aa, Entamoeba dispar
KYTHTG

SEQ ID NO: 2547932 - protein, 8 aa, Entamoeba dispar
KYTSNYDD

SEQ ID NO: 2547933 - protein, 5 aa, Entamoeba dispar
LDNAT

SEQ ID NO: 2547934 - protein, 5 aa, Entamoeba dispar
LEEQE

SEQ ID NO: 2547935 - protein, 14 aa, Entamoeba dispar
LEQKKKLQITKPEL

SEQ ID NO: 2547936 - protein, 9 aa, Entamoeba dispar
LGTGEEEKT

SEQ ID NO: 2547937 - protein, 14 aa, Entamoeba dispar
LKANSYEGFDSANY

SEQ ID NO: 2547938 - protein, 13 aa, Entamoeba dispar
LKTETKEETGTGL

SEQ ID NO: 2547939 - protein, 10 aa, Entamoeba dispar
LNTGESTILS

SEQ ID NO: 2547940 - protein, 20 aa, Entamoeba dispar
MTPDEVRNNIKSNLRGELTI

SEQ ID NO: 2547941 - protein, 11 aa, Entamoeba dispar
MTTTEEGRKEL

SEQ ID NO: 2547942 - protein, 9 aa, Entamoeba dispar
NAKKEIETN

SEQ ID NO: 2547943 - protein, 7 aa, Entamoeba dispar
NAKKVKA

SEQ ID NO: 2547944 - protein, 7 aa, Entamoeba dispar
NATQEYN

SEQ ID NO: 2547945 - protein, 12 aa, Entamoeba dispar
NDATNTSKPIPV

SEQ ID NO: 2547946 - protein, 20 aa, Entamoeba dispar
NDDHDQQKPGSSSRDMHDQG

SEQ ID NO: 2547947 - protein, 27 aa, Entamoeba dispar
NDKKKGVSLPTSLESSPGKTTSSASKL

SEQ ID NO: 2547948 - protein, 5 aa, Entamoeba dispar
NEAAA

SEQ ID NO: 2547949 - protein, 4 aa, Entamoeba dispar
NEEY

SEQ ID NO: 2547950 - protein, 7 aa, Entamoeba dispar
NEQKRIN

SEQ ID NO: 2547951 - protein, 5 aa, Entamoeba dispar
NGDMT

SEQ ID NO: 2547952 - protein, 6 aa, Entamoeba dispar
NGESVT

SEQ ID NO: 2547953 - protein, 4 aa, Entamoeba dispar
NGYQ

SEQ ID NO: 2547954 - protein, 6 aa, Entamoeba dispar
NKNNQC

SEQ ID NO: 2547955 - protein, 6 aa, Entamoeba dispar
NKPAYF

SEQ ID NO: 2547956 - protein, 8 aa, Entamoeba dispar
NKSKEVRK

SEQ ID NO: 2547957 - protein, 13 aa, Entamoeba dispar
NLAPNYNKGQKGG

SEQ ID NO: 2547958 - protein, 7 aa, Entamoeba dispar
NPECSSA

SEQ ID NO: 2547959 - protein, 15 aa, Entamoeba dispar
NPKVNATEKKQSSID

SEQ ID NO: 2547960 - protein, 13 aa, Entamoeba dispar
NPPLSDAPGTQNQ

SEQ ID NO: 2547961 - protein, 6 aa, Entamoeba dispar
NQPRSM

SEQ ID NO: 2547962 - protein, 4 aa, Entamoeba dispar
NSNE

SEQ ID NO: 2547963 - protein, 4 aa, Entamoeba dispar
NTFK

SEQ ID NO: 2547964 - protein, 6 aa, Entamoeba dispar
NTTNQR

SEQ ID NO: 2547965 - protein, 7 aa, Entamoeba dispar
NVDPSTV

SEQ ID NO: 2547966 - protein, 5 aa, Entamoeba dispar
NYNDY

SEQ ID NO: 2547967 - protein, 7 aa, Entamoeba dispar
NYTEEEM

SEQ ID NO: 2547968 - protein, 4 aa, Entamoeba dispar
PDPS

SEQ ID NO: 2547969 - protein, 9 aa, Entamoeba dispar
PIKPPSLGD

SEQ ID NO: 2547970 - protein, 8 aa, Entamoeba dispar
PKFGTNDE

SEQ ID NO: 2547971 - protein, 11 aa, Entamoeba dispar
PKRSDSMGSIK

SEQ ID NO: 2547972 - protein, 9 aa, Entamoeba dispar
PLDPGTNNQ

SEQ ID NO: 2547973 - protein, 6 aa, Entamoeba dispar
PNSEAI

SEQ ID NO: 2547974 - protein, 11 aa, Entamoeba dispar
PSGATKQETCG

SEQ ID NO: 2547975 - protein, 5 aa, Entamoeba dispar
PSIPM

SEQ ID NO: 2547976 - protein, 8 aa, Entamoeba dispar
PSSLEDPG

SEQ ID NO: 2547977 - protein, 13 aa, Entamoeba dispar
QCSEYTTNEIDTV

SEQ ID NO: 2547978 - protein, 5 aa, Entamoeba dispar
QEENN

SEQ ID NO: 2547979 - protein, 4 aa, Entamoeba dispar
QKNL

SEQ ID NO: 2547980 - protein, 6 aa, Entamoeba dispar
QLRKYS

SEQ ID NO: 2547981 - protein, 7 aa, Entamoeba dispar
QNGIPNA

SEQ ID NO: 2547982 - protein, 12 aa, Entamoeba dispar
QNNSTKDNTIEC

SEQ ID NO: 2547983 - protein, 12 aa, Entamoeba dispar
QQKMKKAEEKAK

SEQ ID NO: 2547984 - protein, 9 aa, Entamoeba dispar
QQTEELAKE

SEQ ID NO: 2547985 - protein, 22 aa, Entamoeba dispar
QRAQGNKAATNIRKTKETFREE

SEQ ID NO: 2547986 - protein, 9 aa, Entamoeba dispar
QSKDKKKTV

SEQ ID NO: 2547987 - protein, 11 aa, Entamoeba dispar
QTQDPKQKVQL

SEQ ID NO: 2547988 - protein, 13 aa, Entamoeba dispar
RDVSTGATSANSG

SEQ ID NO: 2547989 - protein, 5 aa, Entamoeba dispar
REQVE

SEQ ID NO: 2547990 - protein, 5 aa, Entamoeba dispar
RESKL

SEQ ID NO: 2547991 - protein, 7 aa, Entamoeba dispar
RKQRARA

SEQ ID NO: 2547992 - protein, 4 aa, Entamoeba dispar
RPLK

SEQ ID NO: 2547993 - protein, 10 aa, Entamoeba dispar
RRRGRRSALR

SEQ ID NO: 2547994 - protein, 10 aa, Entamoeba dispar
RRRGRRSTLR

SEQ ID NO: 2547995 - protein, 5 aa, Entamoeba dispar
RSQKR

SEQ ID NO: 2547996 - protein, 5 aa, Entamoeba dispar
RSTRD

SEQ ID NO: 2547997 - protein, 9 aa, Entamoeba dispar
SCKTNPNVC

SEQ ID NO: 2547998 - protein, 5 aa, Entamoeba dispar
SDDDT

SEQ ID NO: 2547999 - protein, 8 aa, Entamoeba dispar
SECTSATE

SEQ ID NO: 2548000 - protein, 7 aa, Entamoeba dispar
SELEARS

SEQ ID NO: 2548001 - protein, 6 aa, Entamoeba dispar
SENGCS

SEQ ID NO: 2548002 - protein, 9 aa, Entamoeba dispar
SETTLTTKK

SEQ ID NO: 2548003 - protein, 6 aa, Entamoeba dispar
SFELSG

SEQ ID NO: 2548004 - protein, 5 aa, Entamoeba dispar
SGGDM

SEQ ID NO: 2548005 - protein, 8 aa, Entamoeba dispar
SGKGCNSC

SEQ ID NO: 2548006 - protein, 14 aa, Entamoeba dispar
SGTDGNCGSSPANL

SEQ ID NO: 2548007 - protein, 14 aa, Entamoeba dispar
SGTDGSCGSSPANL

SEQ ID NO: 2548008 - protein, 14 aa, Entamoeba dispar
SHVGSDGKCSCGDG

SEQ ID NO: 2548009 - protein, 14 aa, Entamoeba dispar
SKDQIDKKRIPKLA

SEQ ID NO: 2548010 - protein, 9 aa, Entamoeba dispar
SKTPVPGKL

SEQ ID NO: 2548011 - protein, 8 aa, Entamoeba dispar
SLVTGSNE

SEQ ID NO: 2548012 - protein, 4 aa, Entamoeba dispar
SNKK

SEQ ID NO: 2548013 - protein, 8 aa, Entamoeba dispar
SNKQVPAS

SEQ ID NO: 2548014 - protein, 7 aa, Entamoeba dispar
SPIDEGK

SEQ ID NO: 2548015 - protein, 12 aa, Entamoeba dispar
SPLRGTITPPSL

SEQ ID NO: 2548016 - protein, 5 aa, Entamoeba dispar
SQTSF

SEQ ID NO: 2548017 - protein, 4 aa, Entamoeba dispar
SRAG

SEQ ID NO: 2548018 - protein, 16 aa, Entamoeba dispar
SRCSATESRQIFIPVF

SEQ ID NO: 2548019 - protein, 7 aa, Entamoeba dispar
SSAMTPK

SEQ ID NO: 2548020 - protein, 10 aa, Entamoeba dispar
STGKTYNADQ

SEQ ID NO: 2548021 - protein, 4 aa, Entamoeba dispar
STIN

SEQ ID NO: 2548022 - protein, 8 aa, Entamoeba dispar
STSKEQID

SEQ ID NO: 2548023 - protein, 6 aa, Entamoeba dispar
SVECQG

SEQ ID NO: 2548024 - protein, 8 aa, Entamoeba dispar
SVQEGTIN

SEQ ID NO: 2548025 - protein, 7 aa, Entamoeba dispar
SYDCGTD

SEQ ID NO: 2548026 - protein, 7 aa, Entamoeba dispar
TDEEIPN

SEQ ID NO: 2548027 - protein, 4 aa, Entamoeba dispar
TDRN

SEQ ID NO: 2548028 - protein, 9 aa, Entamoeba dispar
TENDTDPIE

SEQ ID NO: 2548029 - protein, 12 aa, Entamoeba dispar
TENSTEIAKEPT

SEQ ID NO: 2548030 - protein, 9 aa, Entamoeba dispar
TESDHQEGN

SEQ ID NO: 2548031 - protein, 17 aa, Entamoeba dispar
TIGMKQGEQGWEPQPGY

SEQ ID NO: 2548032 - protein, 5 aa, Entamoeba dispar
TISIE

SEQ ID NO: 2548033 - protein, 6 aa, Entamoeba dispar
TKKIQE

SEQ ID NO: 2548034 - protein, 5 aa, Entamoeba dispar
TKNVP

SEQ ID NO: 2548035 - protein, 4 aa, Entamoeba dispar
TLAY

SEQ ID NO: 2548036 - protein, 8 aa, Entamoeba dispar
TNGNTDPW

SEQ ID NO: 2548037 - protein, 17 aa, Entamoeba dispar
TPNNNDIYNKENKTKGF

SEQ ID NO: 2548038 - protein, 11 aa, Entamoeba dispar
TRLEEEKSEEI

SEQ ID NO: 2548039 - protein, 6 aa, Entamoeba dispar
TSVNGI

SEQ ID NO: 2548040 - protein, 8 aa, Entamoeba dispar
TSVTSIGN

SEQ ID NO: 2548041 - protein, 7 aa, Entamoeba dispar
TTAGDIP

SEQ ID NO: 2548042 - protein, 10 aa, Entamoeba dispar
TTESKKDGLI

SEQ ID NO: 2548043 - protein, 9 aa, Entamoeba dispar
TTSTKANPQ

SEQ ID NO: 2548044 - protein, 4 aa, Entamoeba dispar
TVKG

SEQ ID NO: 2548045 - protein, 10 aa, Entamoeba dispar
TYRKRNPHKI

SEQ ID NO: 2548046 - protein, 11 aa, Entamoeba dispar
VDTSNPSYSSL

SEQ ID NO: 2548047 - protein, 6 aa, Entamoeba dispar
VKAEKK

SEQ ID NO: 2548048 - protein, 5 aa, Entamoeba dispar
VNPKY

SEQ ID NO: 2548049 - protein, 8 aa, Entamoeba dispar
VSEQSSVK

SEQ ID NO: 2548050 - protein, 6 aa, Entamoeba dispar
VYDEPK

SEQ ID NO: 2548051 - protein, 8 aa, Entamoeba dispar
WASSAPVE

SEQ ID NO: 2548052 - protein, 7 aa, Entamoeba dispar
YDNSPHS

SEQ ID NO: 2548053 - protein, 6 aa, Entamoeba dispar
YEEKTN

SEQ ID NO: 2548054 - protein, 10 aa, Entamoeba dispar
YEGTKEITNI

SEQ ID NO: 2548055 - protein, 4 aa, Entamoeba dispar
YESI

SEQ ID NO: 2548056 - protein, 15 aa, Entamoeba dispar
YGDANNKGLQTSEDN

SEQ ID NO: 2548057 - protein, 9 aa, Entamoeba dispar
YGDGDETVN

SEQ ID NO: 2548058 - protein, 12 aa, Entamoeba dispar
YGYGRDNNDYWG

SEQ ID NO: 2548059 - protein, 10 aa, Entamoeba dispar
YKDTSRTAAT

SEQ ID NO: 2548060 - protein, 11 aa, Entamoeba dispar
YNGATGPKDYA

SEQ ID NO: 2548061 - protein, 11 aa, Entamoeba dispar
YNGVPSESEVY

SEQ ID NO: 2548062 - protein, 38 aa, Entamoeba dispar
YNPEWGDKECTSSSQEESYKTLQSTSTYAEGNEGAAGR

SEQ ID NO: 2548063 - protein, 16 aa, Entamoeba dispar
YNSSNWKSSYESTDSI

SEQ ID NO: 2548064 - protein, 20 aa, Entamoeba dispar
YNYKTQRQFTDADDINGDTR

SEQ ID NO: 2548065 - protein, 4 aa, Entamoeba dispar
YQQR

SEQ ID NO: 2548066 - protein, 9 aa, Entamoeba dispar
YQSSDKKHN

SEQ ID NO: 2548067 - protein, 11 aa, Entamoeba dispar
YSEKETDVPEL

SEQ ID NO: 2548068 - protein, 34 aa, Entamoeba dispar
AAAASAAGHSEWGYSSPSNAGNYNSKPPSSTGFF

SEQ ID NO: 2548069 - protein, 16 aa, Entamoeba dispar
AAAGAIAAGAKAVQGV

SEQ ID NO: 2548070 - protein, 6 aa, Entamoeba dispar
AAAGDI

SEQ ID NO: 2548071 - protein, 9 aa, Entamoeba dispar
AAANQEGQF

SEQ ID NO: 2548072 - protein, 12 aa, Entamoeba dispar
AAAPADKPQISQ

SEQ ID NO: 2548073 - protein, 27 aa, Entamoeba dispar
AADGASKPSINPDTVYNANDSSYTNGG

SEQ ID NO: 2548074 - protein, 9 aa, Entamoeba dispar
AAEAKSHSE

SEQ ID NO: 2548075 - protein, 6 aa, Entamoeba dispar
AAEERI

SEQ ID NO: 2548076 - protein, 5 aa, Entamoeba dispar
AAEIR

SEQ ID NO: 2548077 - protein, 4 aa, Entamoeba dispar
AAGI

SEQ ID NO: 2548078 - protein, 11 aa, Entamoeba dispar
AAKKANKMNNY

SEQ ID NO: 2548079 - protein, 6 aa, Entamoeba dispar
AAKKIS

SEQ ID NO: 2548080 - protein, 19 aa, Entamoeba dispar
AAKKSMKKYSKKFTKKSVN

SEQ ID NO: 2548081 - protein, 8 aa, Entamoeba dispar
AAKNNKHF

SEQ ID NO: 2548082 - protein, 13 aa, Entamoeba dispar
AAKNQIAQNPENT

SEQ ID NO: 2548083 - protein, 21 aa, Entamoeba dispar
AAKTENTKWKAAEGFYLPASS

SEQ ID NO: 2548084 - protein, 12 aa, Entamoeba dispar
AAPESQKGTIQK

SEQ ID NO: 2548085 - protein, 15 aa, Entamoeba dispar
AARLRRDKQRQEQRR

SEQ ID NO: 2548086 - protein, 6 aa, Entamoeba dispar
AASYGV

SEQ ID NO: 2548087 - protein, 12 aa, Entamoeba dispar
AATEHDNVSKQQ

SEQ ID NO: 2548088 - protein, 9 aa, Entamoeba dispar
AATVGPAFG

SEQ ID NO: 2548089 - protein, 11 aa, Entamoeba dispar
ACDAPTVNEHS

SEQ ID NO: 2548090 - protein, 14 aa, Entamoeba dispar
ACVDPNKCSEQDFK

SEQ ID NO: 2548091 - protein, 10 aa, Entamoeba dispar
ADDESTLENK

SEQ ID NO: 2548092 - protein, 5 aa, Entamoeba dispar
ADDHA

SEQ ID NO: 2548093 - protein, 15 aa, Entamoeba dispar
ADEASNEGAIAGEAA

SEQ ID NO: 2548094 - protein, 21 aa, Entamoeba dispar
ADFEEAQRQRVVQSNEQKKVD

SEQ ID NO: 2548095 - protein, 5 aa, Entamoeba dispar
ADGTD

SEQ ID NO: 2548096 - protein, 4 aa, Entamoeba dispar
ADKG

SEQ ID NO: 2548097 - protein, 10 aa, Entamoeba dispar
ADKSGNLDAN

SEQ ID NO: 2548098 - protein, 8 aa, Entamoeba dispar
ADKTDEEF

SEQ ID NO: 2548099 - protein, 6 aa, Entamoeba dispar
ADMDPC

SEQ ID NO: 2548100 - protein, 4 aa, Entamoeba dispar
ADNI

SEQ ID NO: 2548101 - protein, 14 aa, Entamoeba dispar
ADRSNNNWTEKTTQ

SEQ ID NO: 2548102 - protein, 6 aa, Entamoeba dispar
ADSGAT

SEQ ID NO: 2548103 - protein, 9 aa, Entamoeba dispar
ADSLTGVER

SEQ ID NO: 2548104 - protein, 9 aa, Entamoeba dispar
ADTASTYLG

SEQ ID NO: 2548105 - protein, 11 aa, Entamoeba dispar
ADYVEKEKARI

SEQ ID NO: 2548106 - protein, 7 aa, Entamoeba dispar
AECGERK

SEQ ID NO: 2548107 - protein, 8 aa, Entamoeba dispar
AEDEETKK

SEQ ID NO: 2548108 - protein, 25 aa, Entamoeba dispar
AEDKTTGKKNKITITNDKGRLSKEE

SEQ ID NO: 2548109 - protein, 25 aa, Entamoeba dispar
AEDKTTRKKNKITITNDKGRLSKEE

SEQ ID NO: 2548110 - protein, 8 aa, Entamoeba dispar
AEEFSEKN

SEQ ID NO: 2548111 - protein, 17 aa, Entamoeba dispar
AEELKNQRLDNIKEAKD

SEQ ID NO: 2548112 - protein, 23 aa, Entamoeba dispar
AEERAEDDKKIKEQVEAKNQLEN

SEQ ID NO: 2548113 - protein, 69 aa, Entamoeba dispar
AEESEAELENEYGIESNNSVDENDNEEEVIEAEDDGEDEYDLEEEDNEDDDDGEYELEDDDDDKRRRRR

SEQ ID NO: 2548114 - protein, 13 aa, Entamoeba dispar
AEGIYSEAKSEVK

SEQ ID NO: 2548115 - protein, 5 aa, Entamoeba dispar
AEGNY

SEQ ID NO: 2548116 - protein, 4 aa, Entamoeba dispar
AEGP

SEQ ID NO: 2548117 - protein, 15 aa, Entamoeba dispar
AEGPNPFAPKDPEKL

SEQ ID NO: 2548118 - protein, 6 aa, Entamoeba dispar
AEGYQD

SEQ ID NO: 2548119 - protein, 9 aa, Entamoeba dispar
AEIGKGING

SEQ ID NO: 2548120 - protein, 5 aa, Entamoeba dispar
AEIRR

SEQ ID NO: 2548121 - protein, 17 aa, Entamoeba dispar
AEKDTDPEQLKQQRIET

SEQ ID NO: 2548122 - protein, 11 aa, Entamoeba dispar
AEKETKKAKIN

SEQ ID NO: 2548123 - protein, 12 aa, Entamoeba dispar
AEKGSSCDSTIR

SEQ ID NO: 2548124 - protein, 13 aa, Entamoeba dispar
AEKLTQPKTKDIA

SEQ ID NO: 2548125 - protein, 9 aa, Entamoeba dispar
AEKQATRAT

SEQ ID NO: 2548126 - protein, 7 aa, Entamoeba dispar
AEKQIAK

SEQ ID NO: 2548127 - protein, 20 aa, Entamoeba dispar
AEKYKAEDDENKARIETKNQ

SEQ ID NO: 2548128 - protein, 18 aa, Entamoeba dispar
AELEAARKYYKNKKAIAK

SEQ ID NO: 2548129 - protein, 8 aa, Entamoeba dispar
AENGEKIS

SEQ ID NO: 2548130 - protein, 6 aa, Entamoeba dispar
AENQAT

SEQ ID NO: 2548131 - protein, 12 aa, Entamoeba dispar
AERGNQPQYKQV

SEQ ID NO: 2548132 - protein, 6 aa, Entamoeba dispar
AESGPC

SEQ ID NO: 2548133 - protein, 8 aa, Entamoeba dispar
AETANKKK

SEQ ID NO: 2548134 - protein, 8 aa, Entamoeba dispar
AEYRPDKN

SEQ ID NO: 2548135 - protein, 9 aa, Entamoeba dispar
AFAGTYDKN

SEQ ID NO: 2548136 - protein, 6 aa, Entamoeba dispar
AFGTSL

SEQ ID NO: 2548137 - protein, 13 aa, Entamoeba dispar
AGAVADGKTKISK

SEQ ID NO: 2548138 - protein, 7 aa, Entamoeba dispar
AGDIPTQ

SEQ ID NO: 2548139 - protein, 7 aa, Entamoeba dispar
AGESAGA

SEQ ID NO: 2548140 - protein, 6 aa, Entamoeba dispar
AGFRSD

SEQ ID NO: 2548141 - protein, 7 aa, Entamoeba dispar
AGHQPNK

SEQ ID NO: 2548142 - protein, 4 aa, Entamoeba dispar
AGHS

SEQ ID NO: 2548143 - protein, 4 aa, Entamoeba dispar
AGIS

SEQ ID NO: 2548144 - protein, 6 aa, Entamoeba dispar
AGKGEK

SEQ ID NO: 2548145 - protein, 7 aa, Entamoeba dispar
AGKLPPS

SEQ ID NO: 2548146 - protein, 7 aa, Entamoeba dispar
AGNERFQ

SEQ ID NO: 2548147 - protein, 6 aa, Entamoeba dispar
AGNGLN

SEQ ID NO: 2548148 - protein, 10 aa, Entamoeba dispar
AGPTHDKQPY

SEQ ID NO: 2548149 - protein, 7 aa, Entamoeba dispar
AGRGMTR

SEQ ID NO: 2548150 - protein, 6 aa, Entamoeba dispar
AGSSLS

SEQ ID NO: 2548151 - protein, 22 aa, Entamoeba dispar
AGTAQRQLDKVQGASKQSQNSI

SEQ ID NO: 2548152 - protein, 5 aa, Entamoeba dispar
AGTCK

SEQ ID NO: 2548153 - protein, 11 aa, Entamoeba dispar
AGVGEKCKADN

SEQ ID NO: 2548154 - protein, 5 aa, Entamoeba dispar
AGWKD

SEQ ID NO: 2548155 - protein, 5 aa, Entamoeba dispar
AGYPG

SEQ ID NO: 2548156 - protein, 12 aa, Entamoeba dispar
AHAAAGATRAVT

SEQ ID NO: 2548157 - protein, 8 aa, Entamoeba dispar
AHASHPTV

SEQ ID NO: 2548158 - protein, 11 aa, Entamoeba dispar
AIEKANEKTQV

SEQ ID NO: 2548159 - protein, 9 aa, Entamoeba dispar
AIESEEDQI

SEQ ID NO: 2548160 - protein, 10 aa, Entamoeba dispar
AIGRDGVNNY

SEQ ID NO: 2548161 - protein, 12 aa, Entamoeba dispar
AINKEKITKGNL

SEQ ID NO: 2548162 - protein, 9 aa, Entamoeba dispar
AISKRGKES

SEQ ID NO: 2548163 - protein, 6 aa, Entamoeba dispar
AITKRE

SEQ ID NO: 2548164 - protein, 32 aa, Entamoeba dispar
AKAKKEQKKANKLAKKGDNKAAKKAAKKAKKL

SEQ ID NO: 2548165 - protein, 7 aa, Entamoeba dispar
AKALSDA

SEQ ID NO: 2548166 - protein, 8 aa, Entamoeba dispar
AKALSDAV

SEQ ID NO: 2548167 - protein, 9 aa, Entamoeba dispar
AKDHQSLSA

SEQ ID NO: 2548168 - protein, 5 aa, Entamoeba dispar
AKDLQ

SEQ ID NO: 2548169 - protein, 5 aa, Entamoeba dispar
AKELR

SEQ ID NO: 2548170 - protein, 5 aa, Entamoeba dispar
AKFNK

SEQ ID NO: 2548171 - protein, 7 aa, Entamoeba dispar
AKFPGGI

SEQ ID NO: 2548172 - protein, 6 aa, Entamoeba dispar
AKGPQF

SEQ ID NO: 2548173 - protein, 5 aa, Entamoeba dispar
AKGTP

SEQ ID NO: 2548174 - protein, 4 aa, Entamoeba dispar
AKIE

SEQ ID NO: 2548175 - protein, 12 aa, Entamoeba dispar
AKIQNKKENVKE

SEQ ID NO: 2548176 - protein, 11 aa, Entamoeba dispar
AKKASDGRSVW

SEQ ID NO: 2548177 - protein, 13 aa, Entamoeba dispar
AKKASDSRSVWTG

SEQ ID NO: 2548178 - protein, 13 aa, Entamoeba dispar
AKKKGKKIANTLT

SEQ ID NO: 2548179 - protein, 14 aa, Entamoeba dispar
AKKKTDGRSTWTGN

SEQ ID NO: 2548180 - protein, 48 aa, Entamoeba dispar
AKKLTGKKPVSKESIKKTVKKVAKKQTKKQAKKQAKKVVKKAAKKQVK

SEQ ID NO: 2548181 - protein, 6 aa, Entamoeba dispar
AKKNDN

SEQ ID NO: 2548182 - protein, 9 aa, Entamoeba dispar
AKKTGKVDA

SEQ ID NO: 2548183 - protein, 22 aa, Entamoeba dispar
AKKVNSKVKKITKKEASDKKKL

SEQ ID NO: 2548184 - protein, 8 aa, Entamoeba dispar
AKLENQNS

SEQ ID NO: 2548185 - protein, 16 aa, Entamoeba dispar
AKLNQSKTKKASQGIL

SEQ ID NO: 2548186 - protein, 4 aa, Entamoeba dispar
AKMA

SEQ ID NO: 2548187 - protein, 11 aa, Entamoeba dispar
AKNGDAISNTL

SEQ ID NO: 2548188 - protein, 4 aa, Entamoeba dispar
AKNL

SEQ ID NO: 2548189 - protein, 7 aa, Entamoeba dispar
AKNRGIE

SEQ ID NO: 2548190 - protein, 10 aa, Entamoeba dispar
AKPAESNKCV

SEQ ID NO: 2548191 - protein, 11 aa, Entamoeba dispar
AKQDSKITKKL

SEQ ID NO: 2548192 - protein, 6 aa, Entamoeba dispar
AKQEIP

SEQ ID NO: 2548193 - protein, 7 aa, Entamoeba dispar
AKQIREA

SEQ ID NO: 2548194 - protein, 9 aa, Entamoeba dispar
AKQKERPVV

SEQ ID NO: 2548195 - protein, 8 aa, Entamoeba dispar
AKRETDIH

SEQ ID NO: 2548196 - protein, 14 aa, Entamoeba dispar
AKSEGQQRSTWTGN

SEQ ID NO: 2548197 - protein, 14 aa, Entamoeba dispar
AKSKNEKNAKYADQ

SEQ ID NO: 2548198 - protein, 18 aa, Entamoeba dispar
AKSNEITSIKGNSCPRGA

SEQ ID NO: 2548199 - protein, 51 aa, Entamoeba dispar
AKSSTQAPQVITKSTSKAASPVKKETVKTEEKKTEVKAAVKKAEKKAEKKV

SEQ ID NO: 2548200 - protein, 6 aa, Entamoeba dispar
AKTDIK

SEQ ID NO: 2548201 - protein, 14 aa, Entamoeba dispar
AKTLTTSGDLTVTG

SEQ ID NO: 2548202 - protein, 7 aa, Entamoeba dispar
AKTNNNI

SEQ ID NO: 2548203 - protein, 9 aa, Entamoeba dispar
AKVPQYSSC

SEQ ID NO: 2548204 - protein, 7 aa, Entamoeba dispar
AKYGTRK

SEQ ID NO: 2548205 - protein, 6 aa, Entamoeba dispar
ALATKD

SEQ ID NO: 2548206 - protein, 8 aa, Entamoeba dispar
ALDSTKNN

SEQ ID NO: 2548207 - protein, 15 aa, Entamoeba dispar
ALEEKKRTKEEIEER

SEQ ID NO: 2548208 - protein, 7 aa, Entamoeba dispar
ALEETER

SEQ ID NO: 2548209 - protein, 28 aa, Entamoeba dispar
ALEGGESDDEEEDNEEEIEEIDETEDIE

SEQ ID NO: 2548210 - protein, 14 aa, Entamoeba dispar
ALHPEGKKCNKQTD

SEQ ID NO: 2548211 - protein, 6 aa, Entamoeba dispar
ALKTNP

SEQ ID NO: 2548212 - protein, 6 aa, Entamoeba dispar
ALPDRD

SEQ ID NO: 2548213 - protein, 7 aa, Entamoeba dispar
ALQREKK

SEQ ID NO: 2548214 - protein, 10 aa, Entamoeba dispar
ALRKSDEIKS

SEQ ID NO: 2548215 - protein, 5 aa, Entamoeba dispar
ALYSG

SEQ ID NO: 2548216 - protein, 17 aa, Entamoeba dispar
AMKSQKVVQKSQKKTIK

SEQ ID NO: 2548217 - protein, 11 aa, Entamoeba dispar
AMTPKGSNPSL

SEQ ID NO: 2548218 - protein, 7 aa, Entamoeba dispar
AMTTGGV

SEQ ID NO: 2548219 - protein, 9 aa, Entamoeba dispar
ANAHAGGMS

SEQ ID NO: 2548220 - protein, 6 aa, Entamoeba dispar
ANDLEK

SEQ ID NO: 2548221 - protein, 16 aa, Entamoeba dispar
ANEAGNLAGKVAGKFG

SEQ ID NO: 2548222 - protein, 13 aa, Entamoeba dispar
ANEAQIEQDTLNA

SEQ ID NO: 2548223 - protein, 7 aa, Entamoeba dispar
ANEQKKT

SEQ ID NO: 2548224 - protein, 13 aa, Entamoeba dispar
ANEYENGQPSDTL

SEQ ID NO: 2548225 - protein, 12 aa, Entamoeba dispar
ANFDDYNSGKYK

SEQ ID NO: 2548226 - protein, 9 aa, Entamoeba dispar
ANGLGGESI

SEQ ID NO: 2548227 - protein, 7 aa, Entamoeba dispar
ANKNHQI

SEQ ID NO: 2548228 - protein, 10 aa, Entamoeba dispar
ANKPINEKKG

SEQ ID NO: 2548229 - protein, 6 aa, Entamoeba dispar
ANKTNA

SEQ ID NO: 2548230 - protein, 7 aa, Entamoeba dispar
ANMDPEP

SEQ ID NO: 2548231 - protein, 7 aa, Entamoeba dispar
ANNNKHF

SEQ ID NO: 2548232 - protein, 6 aa, Entamoeba dispar
ANNQND

SEQ ID NO: 2548233 - protein, 5 aa, Entamoeba dispar
ANPKE

SEQ ID NO: 2548234 - protein, 7 aa, Entamoeba dispar
ANPTSRV

SEQ ID NO: 2548235 - protein, 7 aa, Entamoeba dispar
ANQENYV

SEQ ID NO: 2548236 - protein, 10 aa, Entamoeba dispar
ANQLRKERKR

SEQ ID NO: 2548237 - protein, 6 aa, Entamoeba dispar
ANSEGL

SEQ ID NO: 2548238 - protein, 16 aa, Entamoeba dispar
ANTKTDEEGNRLASTR

SEQ ID NO: 2548239 - protein, 8 aa, Entamoeba dispar
ANYKPDNK

SEQ ID NO: 2548240 - protein, 6 aa, Entamoeba dispar
APAGPW

SEQ ID NO: 2548241 - protein, 7 aa, Entamoeba dispar
APDFGKT

SEQ ID NO: 2548242 - protein, 8 aa, Entamoeba dispar
APDSDNWQ

SEQ ID NO: 2548243 - protein, 7 aa, Entamoeba dispar
APEAVGA

SEQ ID NO: 2548244 - protein, 4 aa, Entamoeba dispar
APES

SEQ ID NO: 2548245 - protein, 7 aa, Entamoeba dispar
APESVDW

SEQ ID NO: 2548246 - protein, 5 aa, Entamoeba dispar
APEVE

SEQ ID NO: 2548247 - protein, 6 aa, Entamoeba dispar
APGIEV

SEQ ID NO: 2548248 - protein, 18 aa, Entamoeba dispar
APISNGPNPNPIQKTNVN

SEQ ID NO: 2548249 - protein, 9 aa, Entamoeba dispar
APKCAQTNV

SEQ ID NO: 2548250 - protein, 10 aa, Entamoeba dispar
APQASSYDSK

SEQ ID NO: 2548251 - protein, 6 aa, Entamoeba dispar
APQAVA

SEQ ID NO: 2548252 - protein, 9 aa, Entamoeba dispar
APRCTPTTV

SEQ ID NO: 2548253 - protein, 8 aa, Entamoeba dispar
APSHNDQE

SEQ ID NO: 2548254 - protein, 25 aa, Entamoeba dispar
APSPIQKPELAAYSPGIQRNQIRPS

SEQ ID NO: 2548255 - protein, 5 aa, Entamoeba dispar
APTYE

SEQ ID NO: 2548256 - protein, 6 aa, Entamoeba dispar
APVSKG

SEQ ID NO: 2548257 - protein, 9 aa, Entamoeba dispar
APVTSRSNI

SEQ ID NO: 2548258 - protein, 11 aa, Entamoeba dispar
APYTNPRHKYY

SEQ ID NO: 2548259 - protein, 14 aa, Entamoeba dispar
AQAKVNAARRSVKR

SEQ ID NO: 2548260 - protein, 25 aa, Entamoeba dispar
AQDKKSGKKEEITITSEKGRLTEEQ

SEQ ID NO: 2548261 - protein, 5 aa, Entamoeba dispar
AQEDQ

SEQ ID NO: 2548262 - protein, 28 aa, Entamoeba dispar
AQEIQEEMKKEQNKLNERIQKASNRIKA

SEQ ID NO: 2548263 - protein, 7 aa, Entamoeba dispar
AQEKRTF

SEQ ID NO: 2548264 - protein, 5 aa, Entamoeba dispar
AQELK

SEQ ID NO: 2548265 - protein, 6 aa, Entamoeba dispar
AQFGRN

SEQ ID NO: 2548266 - protein, 13 aa, Entamoeba dispar
AQGKVTPIRDQAQ

SEQ ID NO: 2548267 - protein, 10 aa, Entamoeba dispar
AQGQTTGYVS

SEQ ID NO: 2548268 - protein, 7 aa, Entamoeba dispar
AQHDHSI

SEQ ID NO: 2548269 - protein, 8 aa, Entamoeba dispar
AQIANQKE

SEQ ID NO: 2548270 - protein, 14 aa, Entamoeba dispar
AQKKRSNEKEFINK

SEQ ID NO: 2548271 - protein, 9 aa, Entamoeba dispar
AQKPPSCGC

SEQ ID NO: 2548272 - protein, 7 aa, Entamoeba dispar
AQNNEKE

SEQ ID NO: 2548273 - protein, 7 aa, Entamoeba dispar
AQNNNKD

SEQ ID NO: 2548274 - protein, 13 aa, Entamoeba dispar
AQPMSFASSPGLI

SEQ ID NO: 2548275 - protein, 14 aa, Entamoeba dispar
AQPSVEAADKVAQN

SEQ ID NO: 2548276 - protein, 23 aa, Entamoeba dispar
AQQGHQRRTPRDYNGPREARAIS

SEQ ID NO: 2548277 - protein, 10 aa, Entamoeba dispar
AQSDLKTTQI

SEQ ID NO: 2548278 - protein, 6 aa, Entamoeba dispar
AQSSGF

SEQ ID NO: 2548279 - protein, 5 aa, Entamoeba dispar
AQTIA

SEQ ID NO: 2548280 - protein, 7 aa, Entamoeba dispar
AQTYQGE

SEQ ID NO: 2548281 - protein, 6 aa, Entamoeba dispar
ARAAGI

SEQ ID NO: 2548282 - protein, 7 aa, Entamoeba dispar
ARGYSPT

SEQ ID NO: 2548283 - protein, 13 aa, Entamoeba dispar
ARKARKSGMSKKA

SEQ ID NO: 2548284 - protein, 6 aa, Entamoeba dispar
ARKNGE

SEQ ID NO: 2548285 - protein, 4 aa, Entamoeba dispar
ARKV

SEQ ID NO: 2548286 - protein, 10 aa, Entamoeba dispar
ARLSSQPNSI

SEQ ID NO: 2548287 - protein, 10 aa, Entamoeba dispar
ARNGKSKNKI

SEQ ID NO: 2548288 - protein, 7 aa, Entamoeba dispar
ARNPKNL

SEQ ID NO: 2548289 - protein, 12 aa, Entamoeba dispar
ARNQITENPKNT

SEQ ID NO: 2548290 - protein, 8 aa, Entamoeba dispar
ARNSFSRS

SEQ ID NO: 2548291 - protein, 5 aa, Entamoeba dispar
ARPIY

SEQ ID NO: 2548292 - protein, 66 aa, Entamoeba dispar
ARRSNKKSSARKAAPRRSLKSNSFSTKIRRTKRKVTAKAAQIRRRNTQKRLKATRQISDIRKKGKK

SEQ ID NO: 2548293 - protein, 6 aa, Entamoeba dispar
ARRVQS

SEQ ID NO: 2548294 - protein, 4 aa, Entamoeba dispar
ARSS

SEQ ID NO: 2548295 - protein, 5 aa, Entamoeba dispar
ARVSG

SEQ ID NO: 2548296 - protein, 10 aa, Entamoeba dispar
ASANDQLTQL

SEQ ID NO: 2548297 - protein, 10 aa, Entamoeba dispar
ASDDNENSFD

SEQ ID NO: 2548298 - protein, 7 aa, Entamoeba dispar
ASFSTTK

SEQ ID NO: 2548299 - protein, 5 aa, Entamoeba dispar
ASGIS

SEQ ID NO: 2548300 - protein, 9 aa, Entamoeba dispar
ASGSNVQCT

SEQ ID NO: 2548301 - protein, 6 aa, Entamoeba dispar
ASGSPF

SEQ ID NO: 2548302 - protein, 4 aa, Entamoeba dispar
ASIS

SEQ ID NO: 2548303 - protein, 4 aa, Entamoeba dispar
ASKE

SEQ ID NO: 2548304 - protein, 4 aa, Entamoeba dispar
ASKI

SEQ ID NO: 2548305 - protein, 6 aa, Entamoeba dispar
ASKKTQ

SEQ ID NO: 2548306 - protein, 20 aa, Entamoeba dispar
ASKLSELRGEYNSNDNEMRK

SEQ ID NO: 2548307 - protein, 8 aa, Entamoeba dispar
ASKNGKEF

SEQ ID NO: 2548308 - protein, 7 aa, Entamoeba dispar
ASKRSER

SEQ ID NO: 2548309 - protein, 6 aa, Entamoeba dispar
ASLAGT

SEQ ID NO: 2548310 - protein, 7 aa, Entamoeba dispar
ASNANAT

SEQ ID NO: 2548311 - protein, 15 aa, Entamoeba dispar
ASNEKRNALDKSATL

SEQ ID NO: 2548312 - protein, 6 aa, Entamoeba dispar
ASNINN

SEQ ID NO: 2548313 - protein, 19 aa, Entamoeba dispar
ASNNSTNQTNTTISAPKLD

SEQ ID NO: 2548314 - protein, 8 aa, Entamoeba dispar
ASNPALYQ

SEQ ID NO: 2548315 - protein, 9 aa, Entamoeba dispar
ASPAEEELP

SEQ ID NO: 2548316 - protein, 8 aa, Entamoeba dispar
ASPKNQDQ

SEQ ID NO: 2548317 - protein, 7 aa, Entamoeba dispar
ASQAFTG

SEQ ID NO: 2548318 - protein, 9 aa, Entamoeba dispar
ASQAPIEEV

SEQ ID NO: 2548319 - protein, 12 aa, Entamoeba dispar
ASRTSKKKNERK

SEQ ID NO: 2548320 - protein, 5 aa, Entamoeba dispar
ASTIQ

SEQ ID NO: 2548321 - protein, 9 aa, Entamoeba dispar
ASVKELKST

SEQ ID NO: 2548322 - protein, 21 aa, Entamoeba dispar
ATDPTDITNYPYEKSQYFDTN

SEQ ID NO: 2548323 - protein, 9 aa, Entamoeba dispar
ATDPTGAEI

SEQ ID NO: 2548324 - protein, 33 aa, Entamoeba dispar
ATDSSQGVENYPYGKVNKQANFGKAFDSSYNSY

SEQ ID NO: 2548325 - protein, 7 aa, Entamoeba dispar
ATENEYV

SEQ ID NO: 2548326 - protein, 7 aa, Entamoeba dispar
ATESINN

SEQ ID NO: 2548327 - protein, 4 aa, Entamoeba dispar
ATIA

SEQ ID NO: 2548328 - protein, 6 aa, Entamoeba dispar
ATIQSH

SEQ ID NO: 2548329 - protein, 41 aa, Entamoeba dispar
ATKKQVKKAVKKQLNKASKLIKQAKEARKEEKVAKQNGNIQ

SEQ ID NO: 2548330 - protein, 6 aa, Entamoeba dispar
ATLGDK

SEQ ID NO: 2548331 - protein, 14 aa, Entamoeba dispar
ATPLRATNDGYYDP

SEQ ID NO: 2548332 - protein, 9 aa, Entamoeba dispar
ATPTVSPTI

SEQ ID NO: 2548333 - protein, 7 aa, Entamoeba dispar
ATRSHGF

SEQ ID NO: 2548334 - protein, 8 aa, Entamoeba dispar
ATSLSDRI

SEQ ID NO: 2548335 - protein, 6 aa, Entamoeba dispar
ATTFDN

SEQ ID NO: 2548336 - protein, 12 aa, Entamoeba dispar
ATTSFEKDSYSR

SEQ ID NO: 2548337 - protein, 4 aa, Entamoeba dispar
ATTV

SEQ ID NO: 2548338 - protein, 87 aa, Entamoeba dispar
AVAQKKAEKAKKEAKKSGKKAEKKAAKVAKKAEKKAAEAKKVATKSATKATEKAKKSIEKAKSESKKAAKKVEKKLSESKKSLKSKI

SEQ ID NO: 2548339 - protein, 15 aa, Entamoeba dispar
AVENGVARNNVETVA

SEQ ID NO: 2548340 - protein, 5 aa, Entamoeba dispar
AVHNG

SEQ ID NO: 2548341 - protein, 23 aa, Entamoeba dispar
AVNKAQKKVEKKIKKVTKKHAIK

SEQ ID NO: 2548342 - protein, 19 aa, Entamoeba dispar
AVTNPNTPVDTTLEGKQYG

SEQ ID NO: 2548343 - protein, 6 aa, Entamoeba dispar
AYASST

SEQ ID NO: 2548344 - protein, 5 aa, Entamoeba dispar
AYDNI

SEQ ID NO: 2548345 - protein, 16 aa, Entamoeba dispar
AYKAAGSAGIGKCGEN

SEQ ID NO: 2548346 - protein, 6 aa, Entamoeba dispar
AYKNKQ

SEQ ID NO: 2548347 - protein, 16 aa, Entamoeba dispar
AYKSAASAGLGKCGEN

SEQ ID NO: 2548348 - protein, 13 aa, Entamoeba dispar
AYNAKKRNIEGRI

SEQ ID NO: 2548349 - protein, 12 aa, Entamoeba dispar
AYNQQTETELKP

SEQ ID NO: 2548350 - protein, 14 aa, Entamoeba dispar
AYNSEAKKNHGHSL

SEQ ID NO: 2548351 - protein, 10 aa, Entamoeba dispar
AYSGLNSTKA

SEQ ID NO: 2548352 - protein, 11 aa, Entamoeba dispar
CAVQGNEKYCS

SEQ ID NO: 2548353 - protein, 7 aa, Entamoeba dispar
CDDNGTC

SEQ ID NO: 2548354 - protein, 8 aa, Entamoeba dispar
CDDSGETE

SEQ ID NO: 2548355 - protein, 9 aa, Entamoeba dispar
CDETKKIST

SEQ ID NO: 2548356 - protein, 9 aa, Entamoeba dispar
CDNKDHKDL

SEQ ID NO: 2548357 - protein, 16 aa, Entamoeba dispar
CDSSDNGCEGGHPSNS

SEQ ID NO: 2548358 - protein, 26 aa, Entamoeba dispar
CEDGKEVDDSSTSSTDKCTCRNSVST

SEQ ID NO: 2548359 - protein, 16 aa, Entamoeba dispar
CEEEKCAVDTSNSKEF

SEQ ID NO: 2548360 - protein, 15 aa, Entamoeba dispar
CEEGESGCNSEKKKV

SEQ ID NO: 2548361 - protein, 13 aa, Entamoeba dispar
CEESGKGGYDAEN

SEQ ID NO: 2548362 - protein, 14 aa, Entamoeba dispar
CEESGKGGYDASNL

SEQ ID NO: 2548363 - protein, 17 aa, Entamoeba dispar
CEKGTDLITGKSYSGTC

SEQ ID NO: 2548364 - protein, 4 aa, Entamoeba dispar
CEND

SEQ ID NO: 2548365 - protein, 114 aa, Entamoeba dispar
CENGTTYKCGNKTTNQENSSDDRSDEKSNDYSEGSNNKESSSNNNGQSEDTSNSNSEESKNKEDDSKSQSDEKSMNHSEDGSKGHSEDSSSAHSDGNSKTHSEDDSKDSIDSAP

SEQ ID NO: 2548366 - protein, 6 aa, Entamoeba dispar
CETCYG

SEQ ID NO: 2548367 - protein, 16 aa, Entamoeba dispar
CGESNTYNLPNPTSIN

SEQ ID NO: 2548368 - protein, 4 aa, Entamoeba dispar
CGTY

SEQ ID NO: 2548369 - protein, 10 aa, Entamoeba dispar
CHGKGTVTKS

SEQ ID NO: 2548370 - protein, 9 aa, Entamoeba dispar
CIPSPTNPT

SEQ ID NO: 2548371 - protein, 6 aa, Entamoeba dispar
CKDNCR

SEQ ID NO: 2548372 - protein, 15 aa, Entamoeba dispar
CKDTSTSQRGGIKQR

SEQ ID NO: 2548373 - protein, 4 aa, Entamoeba dispar
CKEA

SEQ ID NO: 2548374 - protein, 15 aa, Entamoeba dispar
CKENQLPTVTIPESS

SEQ ID NO: 2548375 - protein, 5 aa, Entamoeba dispar
CKFEG

SEQ ID NO: 2548376 - protein, 6 aa, Entamoeba dispar
CKIGNE

SEQ ID NO: 2548377 - protein, 8 aa, Entamoeba dispar
CKIPPNKS

SEQ ID NO: 2548378 - protein, 6 aa, Entamoeba dispar
CKNSSI

SEQ ID NO: 2548379 - protein, 8 aa, Entamoeba dispar
CKPAEHNK

SEQ ID NO: 2548380 - protein, 4 aa, Entamoeba dispar
CKRC

SEQ ID NO: 2548381 - protein, 18 aa, Entamoeba dispar
CKSTTTIKGCKGEIDKEY

SEQ ID NO: 2548382 - protein, 7 aa, Entamoeba dispar
CKTCEGS

SEQ ID NO: 2548383 - protein, 11 aa, Entamoeba dispar
CNAGSSGYPWK

SEQ ID NO: 2548384 - protein, 5 aa, Entamoeba dispar
CNATT

SEQ ID NO: 2548385 - protein, 7 aa, Entamoeba dispar
CNDCASS

SEQ ID NO: 2548386 - protein, 11 aa, Entamoeba dispar
CNDKVNNTKYY

SEQ ID NO: 2548387 - protein, 48 aa, Entamoeba dispar
CNETNCSTTETNSTKDSNEFIQSKNKKKHKRSLKEKNKDNQTKETKNL

SEQ ID NO: 2548388 - protein, 8 aa, Entamoeba dispar
CNEYGEPD

SEQ ID NO: 2548389 - protein, 10 aa, Entamoeba dispar
CNGPDNNPYT

SEQ ID NO: 2548390 - protein, 6 aa, Entamoeba dispar
CNKNNK

SEQ ID NO: 2548391 - protein, 5 aa, Entamoeba dispar
CNPGS

SEQ ID NO: 2548392 - protein, 4 aa, Entamoeba dispar
CNQC

SEQ ID NO: 2548393 - protein, 13 aa, Entamoeba dispar
CPDGSDEKNTGVC

SEQ ID NO: 2548394 - protein, 7 aa, Entamoeba dispar
CQGKAVT

SEQ ID NO: 2548395 - protein, 8 aa, Entamoeba dispar
CQKEEGNN

SEQ ID NO: 2548396 - protein, 6 aa, Entamoeba dispar
CQRFED

SEQ ID NO: 2548397 - protein, 4 aa, Entamoeba dispar
CRPL

SEQ ID NO: 2548398 - protein, 44 aa, Entamoeba dispar
CSDKNSLSKLASAASSAGHSEWGHASPSNAGNYNSKPPSSTGFF

SEQ ID NO: 2548399 - protein, 17 aa, Entamoeba dispar
CSDSTLNSKELTGDYTK

SEQ ID NO: 2548400 - protein, 14 aa, Entamoeba dispar
CSEDFNGRSPYSNC

SEQ ID NO: 2548401 - protein, 5 aa, Entamoeba dispar
CSGKS

SEQ ID NO: 2548402 - protein, 5 aa, Entamoeba dispar
CSKCG

SEQ ID NO: 2548403 - protein, 9 aa, Entamoeba dispar
CSLSDKKSN

SEQ ID NO: 2548404 - protein, 12 aa, Entamoeba dispar
CSLSGKEEEGRF

SEQ ID NO: 2548405 - protein, 8 aa, Entamoeba dispar
CSNGKDVF

SEQ ID NO: 2548406 - protein, 15 aa, Entamoeba dispar
CSNKAYNKQEDEKMN

SEQ ID NO: 2548407 - protein, 16 aa, Entamoeba dispar
CSQCSSSAFKDSNNKC

SEQ ID NO: 2548408 - protein, 10 aa, Entamoeba dispar
CSQITTTSKT

SEQ ID NO: 2548409 - protein, 7 aa, Entamoeba dispar
CSSCSTN

SEQ ID NO: 2548410 - protein, 7 aa, Entamoeba dispar
CSSNSTY

SEQ ID NO: 2548411 - protein, 11 aa, Entamoeba dispar
CSSSDTCTQCE

SEQ ID NO: 2548412 - protein, 9 aa, Entamoeba dispar
CTDSTLTSD

SEQ ID NO: 2548413 - protein, 10 aa, Entamoeba dispar
CTENQETCNK

SEQ ID NO: 2548414 - protein, 5 aa, Entamoeba dispar
CTGTR

SEQ ID NO: 2548415 - protein, 9 aa, Entamoeba dispar
CTNANQPPF

SEQ ID NO: 2548416 - protein, 5 aa, Entamoeba dispar
CTPNQ

SEQ ID NO: 2548417 - protein, 10 aa, Entamoeba dispar
CTPSRAPYKD

SEQ ID NO: 2548418 - protein, 5 aa, Entamoeba dispar
CTQNQ

SEQ ID NO: 2548419 - protein, 5 aa, Entamoeba dispar
CTRRG

SEQ ID NO: 2548420 - protein, 4 aa, Entamoeba dispar
CTSC

SEQ ID NO: 2548421 - protein, 5 aa, Entamoeba dispar
CTTYR

SEQ ID NO: 2548422 - protein, 10 aa, Entamoeba dispar
CTVQQGNSIE

SEQ ID NO: 2548423 - protein, 112 aa, Entamoeba dispar
DAAKKMDDFQKKTNNAVDNAQSKIANAQSKANNMIDKTQSKVKEVQTKVNKGLDKGQEISRKAQNKANKAINAVGNAAKKVGKFSDKIGKTADKIANAAGKFAGKGGKLGKF

SEQ ID NO: 2548424 - protein, 7 aa, Entamoeba dispar
DAELDED

SEQ ID NO: 2548425 - protein, 13 aa, Entamoeba dispar
DAEQIKAERITTN

SEQ ID NO: 2548426 - protein, 5 aa, Entamoeba dispar
DAFKT

SEQ ID NO: 2548427 - protein, 7 aa, Entamoeba dispar
DAGQSPT

SEQ ID NO: 2548428 - protein, 11 aa, Entamoeba dispar
DAGRTQVEPGS

SEQ ID NO: 2548429 - protein, 8 aa, Entamoeba dispar
DAKTAPKV

SEQ ID NO: 2548430 - protein, 5 aa, Entamoeba dispar
DALKN

SEQ ID NO: 2548431 - protein, 15 aa, Entamoeba dispar
DALKSTKWSSKADAL

SEQ ID NO: 2548432 - protein, 5 aa, Entamoeba dispar
DALKT

SEQ ID NO: 2548433 - protein, 8 aa, Entamoeba dispar
DAPNINTY

SEQ ID NO: 2548434 - protein, 4 aa, Entamoeba dispar
DAPR

SEQ ID NO: 2548435 - protein, 7 aa, Entamoeba dispar
DAPTNIE

SEQ ID NO: 2548436 - protein, 14 aa, Entamoeba dispar
DAQRQATKDAGKIA

SEQ ID NO: 2548437 - protein, 14 aa, Entamoeba dispar
DAQRQATKDAGTIA

SEQ ID NO: 2548438 - protein, 7 aa, Entamoeba dispar
DASRPSF

SEQ ID NO: 2548439 - protein, 8 aa, Entamoeba dispar
DASVGKTG

SEQ ID NO: 2548440 - protein, 7 aa, Entamoeba dispar
DATKYKI

SEQ ID NO: 2548441 - protein, 5 aa, Entamoeba dispar
DATNF

SEQ ID NO: 2548442 - protein, 6 aa, Entamoeba dispar
DCDGDD

SEQ ID NO: 2548443 - protein, 5 aa, Entamoeba dispar
DCDRS

SEQ ID NO: 2548444 - protein, 9 aa, Entamoeba dispar
DCEKKPGDF

SEQ ID NO: 2548445 - protein, 4 aa, Entamoeba dispar
DCKT

SEQ ID NO: 2548446 - protein, 10 aa, Entamoeba dispar
DCNGQKTCMD

SEQ ID NO: 2548447 - protein, 8 aa, Entamoeba dispar
DCSSCEDG

SEQ ID NO: 2548448 - protein, 9 aa, Entamoeba dispar
DCSSGSKLT

SEQ ID NO: 2548449 - protein, 12 aa, Entamoeba dispar
DCTSKNKELKSM

SEQ ID NO: 2548450 - protein, 4 aa, Entamoeba dispar
DCTV

SEQ ID NO: 2548451 - protein, 14 aa, Entamoeba dispar
DDAPKRPRVSNGHQ

SEQ ID NO: 2548452 - protein, 61 aa, Entamoeba dispar
DDAPTPKNSKKTQKPKPANKVSTKSVDPPKSKQKVKQNKNTQAPQPKKTTQNTTKKPNVVS

SEQ ID NO: 2548453 - protein, 5 aa, Entamoeba dispar
DDDVR

SEQ ID NO: 2548454 - protein, 73 aa, Entamoeba dispar
DDEDDFNDFEEDKLEDLNNEENDEYELEQDAGGADPNAAQQGGADQSAGGAQGGAAGSWSQEAESQGGQSPNA

SEQ ID NO: 2548455 - protein, 10 aa, Entamoeba dispar
DDEDEEYHTN

SEQ ID NO: 2548456 - protein, 32 aa, Entamoeba dispar
DDEDEGSQETTSEQDDNNNDMTRSMSMFNFHH

SEQ ID NO: 2548457 - protein, 6 aa, Entamoeba dispar
DDEEDF

SEQ ID NO: 2548458 - protein, 8 aa, Entamoeba dispar
DDEPKKKQ

SEQ ID NO: 2548459 - protein, 10 aa, Entamoeba dispar
DDGCGKTSYS

SEQ ID NO: 2548460 - protein, 9 aa, Entamoeba dispar
DDGKGNTGD

SEQ ID NO: 2548461 - protein, 9 aa, Entamoeba dispar
DDGLTTKQD

SEQ ID NO: 2548462 - protein, 13 aa, Entamoeba dispar
DDIEDESNDSTFE

SEQ ID NO: 2548463 - protein, 6 aa, Entamoeba dispar
DDIKSI

SEQ ID NO: 2548464 - protein, 4 aa, Entamoeba dispar
DDIP

SEQ ID NO: 2548465 - protein, 6 aa, Entamoeba dispar
DDIPSG

SEQ ID NO: 2548466 - protein, 7 aa, Entamoeba dispar
DDKEVQR

SEQ ID NO: 2548467 - protein, 8 aa, Entamoeba dispar
DDKINKRK

SEQ ID NO: 2548468 - protein, 15 aa, Entamoeba dispar
DDKNELLGNDKSING

SEQ ID NO: 2548469 - protein, 5 aa, Entamoeba dispar
DDLDD

SEQ ID NO: 2548470 - protein, 7 aa, Entamoeba dispar
DDLKQQI

SEQ ID NO: 2548471 - protein, 4 aa, Entamoeba dispar
DDQY

SEQ ID NO: 2548472 - protein, 17 aa, Entamoeba dispar
DDQYDYNAAKQTLTDLG

SEQ ID NO: 2548473 - protein, 9 aa, Entamoeba dispar
DDSASKTLE

SEQ ID NO: 2548474 - protein, 9 aa, Entamoeba dispar
DDSFTGCGS

SEQ ID NO: 2548475 - protein, 6 aa, Entamoeba dispar
DDSHIE

SEQ ID NO: 2548476 - protein, 35 aa, Entamoeba dispar
DDSIEKEENEKEMEKRKSEMKEEDDWGEYDQFKEE

SEQ ID NO: 2548477 - protein, 8 aa, Entamoeba dispar
DDTTNPQF

SEQ ID NO: 2548478 - protein, 16 aa, Entamoeba dispar
DDYQPWPKSGKCEKNK

SEQ ID NO: 2548479 - protein, 11 aa, Entamoeba dispar
DECSTETGCNA

SEQ ID NO: 2548480 - protein, 8 aa, Entamoeba dispar
DEDWTGDN

SEQ ID NO: 2548481 - protein, 6 aa, Entamoeba dispar
DEEGIS

SEQ ID NO: 2548482 - protein, 7 aa, Entamoeba dispar
DEEKPSR

SEQ ID NO: 2548483 - protein, 10 aa, Entamoeba dispar
DEEMKDNSIV

SEQ ID NO: 2548484 - protein, 6 aa, Entamoeba dispar
DEFDDT

SEQ ID NO: 2548485 - protein, 12 aa, Entamoeba dispar
DEFKQTGSCGDG

SEQ ID NO: 2548486 - protein, 8 aa, Entamoeba dispar
DEGKNGNY

SEQ ID NO: 2548487 - protein, 4 aa, Entamoeba dispar
DEGV

SEQ ID NO: 2548488 - protein, 6 aa, Entamoeba dispar
DEIPNT

SEQ ID NO: 2548489 - protein, 9 aa, Entamoeba dispar
DEKGEAEGY

SEQ ID NO: 2548490 - protein, 30 aa, Entamoeba dispar
DELFSEEDEYNEEDEYNLEDDLEEEDDEME

SEQ ID NO: 2548491 - protein, 7 aa, Entamoeba dispar
DELPPEY

SEQ ID NO: 2548492 - protein, 6 aa, Entamoeba dispar
DELQEI

SEQ ID NO: 2548493 - protein, 20 aa, Entamoeba dispar
DENGKLKEITQRPGESKKSF

SEQ ID NO: 2548494 - protein, 9 aa, Entamoeba dispar
DENKTYASD

SEQ ID NO: 2548495 - protein, 11 aa, Entamoeba dispar
DENSINPSIER

SEQ ID NO: 2548496 - protein, 6 aa, Entamoeba dispar
DEQHSI

SEQ ID NO: 2548497 - protein, 8 aa, Entamoeba dispar
DEQSIGNQ

SEQ ID NO: 2548498 - protein, 8 aa, Entamoeba dispar
DEQSSTRF

SEQ ID NO: 2548499 - protein, 10 aa, Entamoeba dispar
DERDKLRSTI

SEQ ID NO: 2548500 - protein, 11 aa, Entamoeba dispar
DESTESTSGTD

SEQ ID NO: 2548501 - protein, 5 aa, Entamoeba dispar
DETNK

SEQ ID NO: 2548502 - protein, 6 aa, Entamoeba dispar
DETSVS

SEQ ID NO: 2548503 - protein, 6 aa, Entamoeba dispar
DEYKNG

SEQ ID NO: 2548504 - protein, 6 aa, Entamoeba dispar
DFGSSR

SEQ ID NO: 2548505 - protein, 5 aa, Entamoeba dispar
DFLKG

SEQ ID NO: 2548506 - protein, 6 aa, Entamoeba dispar
DFPSTK

SEQ ID NO: 2548507 - protein, 6 aa, Entamoeba dispar
DFPYPL

SEQ ID NO: 2548508 - protein, 13 aa, Entamoeba dispar
DGAEIKESALSDV

SEQ ID NO: 2548509 - protein, 13 aa, Entamoeba dispar
DGANGNDGFPDGF

SEQ ID NO: 2548510 - protein, 13 aa, Entamoeba dispar
DGANGNDGFPDGL

SEQ ID NO: 2548511 - protein, 14 aa, Entamoeba dispar
DGASGAGKSPNYNN

SEQ ID NO: 2548512 - protein, 5 aa, Entamoeba dispar
DGDEL

SEQ ID NO: 2548513 - protein, 7 aa, Entamoeba dispar
DGDLSDL

SEQ ID NO: 2548514 - protein, 8 aa, Entamoeba dispar
DGDSPKEV

SEQ ID NO: 2548515 - protein, 4 aa, Entamoeba dispar
DGDV

SEQ ID NO: 2548516 - protein, 5 aa, Entamoeba dispar
DGEEQ

SEQ ID NO: 2548517 - protein, 5 aa, Entamoeba dispar
DGESI

SEQ ID NO: 2548518 - protein, 16 aa, Entamoeba dispar
DGFESGKDKQCESLSN

SEQ ID NO: 2548519 - protein, 17 aa, Entamoeba dispar
DGIKSTLETEKKALEGL

SEQ ID NO: 2548520 - protein, 7 aa, Entamoeba dispar
DGKQYRS

SEQ ID NO: 2548521 - protein, 7 aa, Entamoeba dispar
DGLETDK

SEQ ID NO: 2548522 - protein, 6 aa, Entamoeba dispar
DGNTIT

SEQ ID NO: 2548523 - protein, 7 aa, Entamoeba dispar
DGNYEES

SEQ ID NO: 2548524 - protein, 8 aa, Entamoeba dispar
DGQKKVST

SEQ ID NO: 2548525 - protein, 10 aa, Entamoeba dispar
DGRNKEVEQK

SEQ ID NO: 2548526 - protein, 7 aa, Entamoeba dispar
DGRRDDL

SEQ ID NO: 2548527 - protein, 9 aa, Entamoeba dispar
DGSDEREGL

SEQ ID NO: 2548528 - protein, 4 aa, Entamoeba dispar
DGSI

SEQ ID NO: 2548529 - protein, 7 aa, Entamoeba dispar
DGSYKAD

SEQ ID NO: 2548530 - protein, 4 aa, Entamoeba dispar
DGTA

SEQ ID NO: 2548531 - protein, 7 aa, Entamoeba dispar
DGTCQSN

SEQ ID NO: 2548532 - protein, 4 aa, Entamoeba dispar
DGTI

SEQ ID NO: 2548533 - protein, 8 aa, Entamoeba dispar
DGYGGHTT

SEQ ID NO: 2548534 - protein, 8 aa, Entamoeba dispar
DGYKLKPG

SEQ ID NO: 2548535 - protein, 18 aa, Entamoeba dispar
DHGGEEALKNNGGGPHMN

SEQ ID NO: 2548536 - protein, 9 aa, Entamoeba dispar
DHKKEGDIL

SEQ ID NO: 2548537 - protein, 22 aa, Entamoeba dispar
DHKPIEISSDGDGNGDGSEKEI

SEQ ID NO: 2548538 - protein, 6 aa, Entamoeba dispar
DHPSNK

SEQ ID NO: 2548539 - protein, 8 aa, Entamoeba dispar
DIDEYRKA

SEQ ID NO: 2548540 - protein, 7 aa, Entamoeba dispar
DIDNRAK

SEQ ID NO: 2548541 - protein, 6 aa, Entamoeba dispar
DIETTE

SEQ ID NO: 2548542 - protein, 7 aa, Entamoeba dispar
DINGEDD

SEQ ID NO: 2548543 - protein, 26 aa, Entamoeba dispar
DINKSIKKTKKGIKNDIKKSKKKVKK

SEQ ID NO: 2548544 - protein, 8 aa, Entamoeba dispar
DIPTGTTE

SEQ ID NO: 2548545 - protein, 5 aa, Entamoeba dispar
DISGE

SEQ ID NO: 2548546 - protein, 4 aa, Entamoeba dispar
DISQ

SEQ ID NO: 2548547 - protein, 13 aa, Entamoeba dispar
DKASYEAVYPYVC

SEQ ID NO: 2548548 - protein, 13 aa, Entamoeba dispar
DKASYESVYPYVC

SEQ ID NO: 2548549 - protein, 7 aa, Entamoeba dispar
DKCNSCD

SEQ ID NO: 2548550 - protein, 14 aa, Entamoeba dispar
DKDKLADKLQESDK

SEQ ID NO: 2548551 - protein, 14 aa, Entamoeba dispar
DKDNTCKKCPDSCS

SEQ ID NO: 2548552 - protein, 7 aa, Entamoeba dispar
DKDSPLY

SEQ ID NO: 2548553 - protein, 10 aa, Entamoeba dispar
DKEAGNGKSK

SEQ ID NO: 2548554 - protein, 12 aa, Entamoeba dispar
DKEDECNSKKLP

SEQ ID NO: 2548555 - protein, 9 aa, Entamoeba dispar
DKEGAANEF

SEQ ID NO: 2548556 - protein, 9 aa, Entamoeba dispar
DKENKEEII

SEQ ID NO: 2548557 - protein, 18 aa, Entamoeba dispar
DKETDEVEKQKKKMEEVE

SEQ ID NO: 2548558 - protein, 5 aa, Entamoeba dispar
DKETM

SEQ ID NO: 2548559 - protein, 6 aa, Entamoeba dispar
DKFAEN

SEQ ID NO: 2548560 - protein, 13 aa, Entamoeba dispar
DKFETIGATGRCN

SEQ ID NO: 2548561 - protein, 7 aa, Entamoeba dispar
DKFKPSQ

SEQ ID NO: 2548562 - protein, 20 aa, Entamoeba dispar
DKGLGKASKYIGKGASEWLG

SEQ ID NO: 2548563 - protein, 14 aa, Entamoeba dispar
DKHVPTSIDKSSDC

SEQ ID NO: 2548564 - protein, 8 aa, Entamoeba dispar
DKHYTSEE

SEQ ID NO: 2548565 - protein, 14 aa, Entamoeba dispar
DKIDQFQKKGKEMV

SEQ ID NO: 2548566 - protein, 10 aa, Entamoeba dispar
DKKCRSDKPT

SEQ ID NO: 2548567 - protein, 10 aa, Entamoeba dispar
DKKESNSFDE

SEQ ID NO: 2548568 - protein, 5 aa, Entamoeba dispar
DKKKR

SEQ ID NO: 2548569 - protein, 7 aa, Entamoeba dispar
DKKQKLS

SEQ ID NO: 2548570 - protein, 6 aa, Entamoeba dispar
DKKSIK

SEQ ID NO: 2548571 - protein, 56 aa, Entamoeba dispar
DKKVTRTKKRDKPTTQESEKGKESKETPAVKGSSETVGSKQKKEEMKESEKHPMEK

SEQ ID NO: 2548572 - protein, 13 aa, Entamoeba dispar
DKLKDKSLQKDER

SEQ ID NO: 2548573 - protein, 8 aa, Entamoeba dispar
DKLVNEES

SEQ ID NO: 2548574 - protein, 4 aa, Entamoeba dispar
DKNM

SEQ ID NO: 2548575 - protein, 6 aa, Entamoeba dispar
DKPITI

SEQ ID NO: 2548576 - protein, 7 aa, Entamoeba dispar
DKPKTEI

SEQ ID NO: 2548577 - protein, 6 aa, Entamoeba dispar
DKQTAQ

SEQ ID NO: 2548578 - protein, 10 aa, Entamoeba dispar
DKRAKEIESK

SEQ ID NO: 2548579 - protein, 7 aa, Entamoeba dispar
DKRSVRY

SEQ ID NO: 2548580 - protein, 5 aa, Entamoeba dispar
DKSGF

SEQ ID NO: 2548581 - protein, 6 aa, Entamoeba dispar
DKSNNK

SEQ ID NO: 2548582 - protein, 16 aa, Entamoeba dispar
DKSYPVKDTKYSSDEV

SEQ ID NO: 2548583 - protein, 17 aa, Entamoeba dispar
DKTGKPLLKDKQTQQTI

SEQ ID NO: 2548584 - protein, 9 aa, Entamoeba dispar
DKTNVSSIR

SEQ ID NO: 2548585 - protein, 19 aa, Entamoeba dispar
DKTSQEDTLAEEQKKIQMQ

SEQ ID NO: 2548586 - protein, 7 aa, Entamoeba dispar
DKVGKKV

SEQ ID NO: 2548587 - protein, 18 aa, Entamoeba dispar
DKYLRNDKTCQSNKELNG

SEQ ID NO: 2548588 - protein, 6 aa, Entamoeba dispar
DKYPEF

SEQ ID NO: 2548589 - protein, 7 aa, Entamoeba dispar
DLEEQRQ

SEQ ID NO: 2548590 - protein, 11 aa, Entamoeba dispar
DLEQPTYNTVS

SEQ ID NO: 2548591 - protein, 11 aa, Entamoeba dispar
DLGKGEHGTVI

SEQ ID NO: 2548592 - protein, 7 aa, Entamoeba dispar
DLGPYQS

SEQ ID NO: 2548593 - protein, 9 aa, Entamoeba dispar
DLKKESNKL

SEQ ID NO: 2548594 - protein, 11 aa, Entamoeba dispar
DLNPKQPVGTN

SEQ ID NO: 2548595 - protein, 6 aa, Entamoeba dispar
DLNPTN

SEQ ID NO: 2548596 - protein, 7 aa, Entamoeba dispar
DLNRADD

SEQ ID NO: 2548597 - protein, 8 aa, Entamoeba dispar
DLPASGNQ

SEQ ID NO: 2548598 - protein, 10 aa, Entamoeba dispar
DLPKKEAPEV

SEQ ID NO: 2548599 - protein, 6 aa, Entamoeba dispar
DLPTIT

SEQ ID NO: 2548600 - protein, 5 aa, Entamoeba dispar
DLPTV

SEQ ID NO: 2548601 - protein, 4 aa, Entamoeba dispar
DLSE

SEQ ID NO: 2548602 - protein, 5 aa, Entamoeba dispar
DLSGY

SEQ ID NO: 2548603 - protein, 9 aa, Entamoeba dispar
DLSKGDECS

SEQ ID NO: 2548604 - protein, 15 aa, Entamoeba dispar
DLTNPKKNKPGYKPS

SEQ ID NO: 2548605 - protein, 7 aa, Entamoeba dispar
DMSTEGL

SEQ ID NO: 2548606 - protein, 5 aa, Entamoeba dispar
DMTSN

SEQ ID NO: 2548607 - protein, 21 aa, Entamoeba dispar
DMTTETVDYPSKFAKEIKKII

SEQ ID NO: 2548608 - protein, 10 aa, Entamoeba dispar
DNAAQEDKRP

SEQ ID NO: 2548609 - protein, 10 aa, Entamoeba dispar
DNAPYTLGQA

SEQ ID NO: 2548610 - protein, 31 aa, Entamoeba dispar
DNDMNEDAAKLGSSRVDRAKSLTKMKSELEQ

SEQ ID NO: 2548611 - protein, 5 aa, Entamoeba dispar
DNEAV

SEQ ID NO: 2548612 - protein, 6 aa, Entamoeba dispar
DNEKEK

SEQ ID NO: 2548613 - protein, 5 aa, Entamoeba dispar
DNEKY

SEQ ID NO: 2548614 - protein, 12 aa, Entamoeba dispar
DNESTEFESART

SEQ ID NO: 2548615 - protein, 14 aa, Entamoeba dispar
DNIHTDGNKTYEHR

SEQ ID NO: 2548616 - protein, 6 aa, Entamoeba dispar
DNISED

SEQ ID NO: 2548617 - protein, 5 aa, Entamoeba dispar
DNKCG

SEQ ID NO: 2548618 - protein, 4 aa, Entamoeba dispar
DNKP

SEQ ID NO: 2548619 - protein, 6 aa, Entamoeba dispar
DNLFDN

SEQ ID NO: 2548620 - protein, 8 aa, Entamoeba dispar
DNQPNEMK

SEQ ID NO: 2548621 - protein, 6 aa, Entamoeba dispar
DNQSLR

SEQ ID NO: 2548622 - protein, 6 aa, Entamoeba dispar
DNRPIT

SEQ ID NO: 2548623 - protein, 9 aa, Entamoeba dispar
DNSNASSPK

SEQ ID NO: 2548624 - protein, 6 aa, Entamoeba dispar
DNSNIT

SEQ ID NO: 2548625 - protein, 8 aa, Entamoeba dispar
DNSPSFSD

SEQ ID NO: 2548626 - protein, 14 aa, Entamoeba dispar
DNSQVTSSTGLQLN

SEQ ID NO: 2548627 - protein, 6 aa, Entamoeba dispar
DNTDKA

SEQ ID NO: 2548628 - protein, 13 aa, Entamoeba dispar
DNTDYQKPQPAFS

SEQ ID NO: 2548629 - protein, 11 aa, Entamoeba dispar
DNTQQNPTEQE

SEQ ID NO: 2548630 - protein, 4 aa, Entamoeba dispar
DPGV

SEQ ID NO: 2548631 - protein, 11 aa, Entamoeba dispar
DPKERLTPDQA

SEQ ID NO: 2548632 - protein, 15 aa, Entamoeba dispar
DPNNNFEKLKDTSDR

SEQ ID NO: 2548633 - protein, 7 aa, Entamoeba dispar
DPPTSDF

SEQ ID NO: 2548634 - protein, 58 aa, Entamoeba dispar
DPRKPSKYGVKDDTKNSPVNGNNDNKQKKDKPIEDNQPPSDVEEINSKYREPIGGKEH

SEQ ID NO: 2548635 - protein, 6 aa, Entamoeba dispar
DPRTGK

SEQ ID NO: 2548636 - protein, 6 aa, Entamoeba dispar
DPTKDI

SEQ ID NO: 2548637 - protein, 8 aa, Entamoeba dispar
DPTNCSAR

SEQ ID NO: 2548638 - protein, 23 aa, Entamoeba dispar
DPTSFNQQEISTKDFSFNELFEK

SEQ ID NO: 2548639 - protein, 6 aa, Entamoeba dispar
DPTTTG

SEQ ID NO: 2548640 - protein, 14 aa, Entamoeba dispar
DPYHKSNDCLEKSN

SEQ ID NO: 2548641 - protein, 13 aa, Entamoeba dispar
DQEINRKVSTKDL

SEQ ID NO: 2548642 - protein, 9 aa, Entamoeba dispar
DQFSGDPIQ

SEQ ID NO: 2548643 - protein, 4 aa, Entamoeba dispar
DQIE

SEQ ID NO: 2548644 - protein, 6 aa, Entamoeba dispar
DQLETN

SEQ ID NO: 2548645 - protein, 5 aa, Entamoeba dispar
DQLYE

SEQ ID NO: 2548646 - protein, 16 aa, Entamoeba dispar
DQNGTCSTENNEEQLK

SEQ ID NO: 2548647 - protein, 9 aa, Entamoeba dispar
DQSHEQGSY

SEQ ID NO: 2548648 - protein, 6 aa, Entamoeba dispar
DQSNER

SEQ ID NO: 2548649 - protein, 7 aa, Entamoeba dispar
DQSSFNS

SEQ ID NO: 2548650 - protein, 6 aa, Entamoeba dispar
DQSSLD

SEQ ID NO: 2548651 - protein, 7 aa, Entamoeba dispar
DQSSTGY

SEQ ID NO: 2548652 - protein, 9 aa, Entamoeba dispar
DQSYEDNSH

SEQ ID NO: 2548653 - protein, 12 aa, Entamoeba dispar
DQTRSDKCTQCR

SEQ ID NO: 2548654 - protein, 5 aa, Entamoeba dispar
DQTSV

SEQ ID NO: 2548655 - protein, 7 aa, Entamoeba dispar
DQYEQRK

SEQ ID NO: 2548656 - protein, 5 aa, Entamoeba dispar
DRCKT

SEQ ID NO: 2548657 - protein, 5 aa, Entamoeba dispar
DRDGN

SEQ ID NO: 2548658 - protein, 8 aa, Entamoeba dispar
DRENFEKA

SEQ ID NO: 2548659 - protein, 11 aa, Entamoeba dispar
DRKEKTKIKRD

SEQ ID NO: 2548660 - protein, 5 aa, Entamoeba dispar
DRPIQ

SEQ ID NO: 2548661 - protein, 6 aa, Entamoeba dispar
DRPSED

SEQ ID NO: 2548662 - protein, 15 aa, Entamoeba dispar
DRQLARQKIREEKRA

SEQ ID NO: 2548663 - protein, 5 aa, Entamoeba dispar
DRSPW

SEQ ID NO: 2548664 - protein, 9 aa, Entamoeba dispar
DRTFDEDEF

SEQ ID NO: 2548665 - protein, 12 aa, Entamoeba dispar
DSANFKGSRPAG

SEQ ID NO: 2548666 - protein, 5 aa, Entamoeba dispar
DSASY

SEQ ID NO: 2548667 - protein, 14 aa, Entamoeba dispar
DSCLTPSQGSGDIA

SEQ ID NO: 2548668 - protein, 7 aa, Entamoeba dispar
DSDFQEK

SEQ ID NO: 2548669 - protein, 5 aa, Entamoeba dispar
DSDPE

SEQ ID NO: 2548670 - protein, 6 aa, Entamoeba dispar
DSDPIF

SEQ ID NO: 2548671 - protein, 4 aa, Entamoeba dispar
DSEL

SEQ ID NO: 2548672 - protein, 10 aa, Entamoeba dispar
DSGNETQPFA

SEQ ID NO: 2548673 - protein, 8 aa, Entamoeba dispar
DSGVGKTS

SEQ ID NO: 2548674 - protein, 9 aa, Entamoeba dispar
DSIKNHSNE

SEQ ID NO: 2548675 - protein, 13 aa, Entamoeba dispar
DSLPQKEKERFKS

SEQ ID NO: 2548676 - protein, 8 aa, Entamoeba dispar
DSNGNVND

SEQ ID NO: 2548677 - protein, 10 aa, Entamoeba dispar
DSNKQNKFEC

SEQ ID NO: 2548678 - protein, 9 aa, Entamoeba dispar
DSNKTKVIN

SEQ ID NO: 2548679 - protein, 5 aa, Entamoeba dispar
DSNNY

SEQ ID NO: 2548680 - protein, 13 aa, Entamoeba dispar
DSQYKSTLDGEKQ

SEQ ID NO: 2548681 - protein, 8 aa, Entamoeba dispar
DSSDNSPH

SEQ ID NO: 2548682 - protein, 9 aa, Entamoeba dispar
DSSKCAKCD

SEQ ID NO: 2548683 - protein, 5 aa, Entamoeba dispar
DSSNE

SEQ ID NO: 2548684 - protein, 10 aa, Entamoeba dispar
DSSSMSPSDW

SEQ ID NO: 2548685 - protein, 6 aa, Entamoeba dispar
DSSTCI

SEQ ID NO: 2548686 - protein, 4 aa, Entamoeba dispar
DSTA

SEQ ID NO: 2548687 - protein, 7 aa, Entamoeba dispar
DSTDHQQ

SEQ ID NO: 2548688 - protein, 15 aa, Entamoeba dispar
DSTLTSNELTGDYTK

SEQ ID NO: 2548689 - protein, 10 aa, Entamoeba dispar
DSTPQGNETI

SEQ ID NO: 2548690 - protein, 17 aa, Entamoeba dispar
DSTTFSEEIKKNEKEWD

SEQ ID NO: 2548691 - protein, 10 aa, Entamoeba dispar
DSVPKGNNFE

SEQ ID NO: 2548692 - protein, 8 aa, Entamoeba dispar
DSVPNKEV

SEQ ID NO: 2548693 - protein, 4 aa, Entamoeba dispar
DSVT

SEQ ID NO: 2548694 - protein, 8 aa, Entamoeba dispar
DSVTGPHT

SEQ ID NO: 2548695 - protein, 11 aa, Entamoeba dispar
DSWSSNVATNR

SEQ ID NO: 2548696 - protein, 10 aa, Entamoeba dispar
DTCETINKKT

SEQ ID NO: 2548697 - protein, 8 aa, Entamoeba dispar
DTCGQEQY

SEQ ID NO: 2548698 - protein, 7 aa, Entamoeba dispar
DTDEALN

SEQ ID NO: 2548699 - protein, 7 aa, Entamoeba dispar
DTFDKNS

SEQ ID NO: 2548700 - protein, 12 aa, Entamoeba dispar
DTFQGKEKCTTS

SEQ ID NO: 2548701 - protein, 12 aa, Entamoeba dispar
DTGCSSCEENKD

SEQ ID NO: 2548702 - protein, 7 aa, Entamoeba dispar
DTKRREP

SEQ ID NO: 2548703 - protein, 19 aa, Entamoeba dispar
DTLKAKKNSGILDQEYSSL

SEQ ID NO: 2548704 - protein, 11 aa, Entamoeba dispar
DTLPKSNNQEG

SEQ ID NO: 2548705 - protein, 6 aa, Entamoeba dispar
DTMQYT

SEQ ID NO: 2548706 - protein, 8 aa, Entamoeba dispar
DTNDPNAP

SEQ ID NO: 2548707 - protein, 7 aa, Entamoeba dispar
DTPAHTA

SEQ ID NO: 2548708 - protein, 9 aa, Entamoeba dispar
DTPAHTASW

SEQ ID NO: 2548709 - protein, 7 aa, Entamoeba dispar
DTPGFTC

SEQ ID NO: 2548710 - protein, 17 aa, Entamoeba dispar
DTPNKNYSLPEQGHDVG

SEQ ID NO: 2548711 - protein, 8 aa, Entamoeba dispar
DTPQQEFP

SEQ ID NO: 2548712 - protein, 7 aa, Entamoeba dispar
DTQERDI

SEQ ID NO: 2548713 - protein, 15 aa, Entamoeba dispar
DTQKLDKECTYSGDG

SEQ ID NO: 2548714 - protein, 11 aa, Entamoeba dispar
DTRDTTTYEDT

SEQ ID NO: 2548715 - protein, 8 aa, Entamoeba dispar
DTTAPKRG

SEQ ID NO: 2548716 - protein, 5 aa, Entamoeba dispar
DTTEV

SEQ ID NO: 2548717 - protein, 9 aa, Entamoeba dispar
DTVQKEMAA

SEQ ID NO: 2548718 - protein, 5 aa, Entamoeba dispar
DTVTS

SEQ ID NO: 2548719 - protein, 8 aa, Entamoeba dispar
DTYPSQKG

SEQ ID NO: 2548720 - protein, 6 aa, Entamoeba dispar
DVDGES

SEQ ID NO: 2548721 - protein, 12 aa, Entamoeba dispar
DVDTSNPSYSSL

SEQ ID NO: 2548722 - protein, 9 aa, Entamoeba dispar
DVENKGEEY

SEQ ID NO: 2548723 - protein, 7 aa, Entamoeba dispar
DVETLGK

SEQ ID NO: 2548724 - protein, 9 aa, Entamoeba dispar
DVKGTPDSL

SEQ ID NO: 2548725 - protein, 7 aa, Entamoeba dispar
DVKSTAI

SEQ ID NO: 2548726 - protein, 4 aa, Entamoeba dispar
DVNK

SEQ ID NO: 2548727 - protein, 6 aa, Entamoeba dispar
DVNTFQ

SEQ ID NO: 2548728 - protein, 7 aa, Entamoeba dispar
DVPNRGR

SEQ ID NO: 2548729 - protein, 4 aa, Entamoeba dispar
DVQE

SEQ ID NO: 2548730 - protein, 11 aa, Entamoeba dispar
DVSQPTSASSI

SEQ ID NO: 2548731 - protein, 11 aa, Entamoeba dispar
DYATKQNVLGG

SEQ ID NO: 2548732 - protein, 8 aa, Entamoeba dispar
DYEDNSEG

SEQ ID NO: 2548733 - protein, 22 aa, Entamoeba dispar
DYKNEPLSKDPTTELQDPGATI

SEQ ID NO: 2548734 - protein, 46 aa, Entamoeba dispar
DYPEKKPKAPSIDGASFDPSTTQPHQTNPADDPKYKRRPEIRRFEF

SEQ ID NO: 2548735 - protein, 8 aa, Entamoeba dispar
DYSSWPPY

SEQ ID NO: 2548736 - protein, 8 aa, Entamoeba dispar
DYTDTPEY

SEQ ID NO: 2548737 - protein, 6 aa, Entamoeba dispar
DYTNYQ

SEQ ID NO: 2548738 - protein, 18 aa, Entamoeba dispar
DYTTQAKVENVAEKSKKV

SEQ ID NO: 2548739 - protein, 6 aa, Entamoeba dispar
DYYSKS

SEQ ID NO: 2548740 - protein, 10 aa, Entamoeba dispar
DYYTVNAEDT

SEQ ID NO: 2548741 - protein, 9 aa, Entamoeba dispar
EAAEDNKNL

SEQ ID NO: 2548742 - protein, 6 aa, Entamoeba dispar
EAATAG

SEQ ID NO: 2548743 - protein, 7 aa, Entamoeba dispar
EADDQIR

SEQ ID NO: 2548744 - protein, 4 aa, Entamoeba dispar
EAER

SEQ ID NO: 2548745 - protein, 8 aa, Entamoeba dispar
EAGSSMDK

SEQ ID NO: 2548746 - protein, 6 aa, Entamoeba dispar
EAIEGG

SEQ ID NO: 2548747 - protein, 35 aa, Entamoeba dispar
EAIESSSSLSGSGTVSPALSPRIQTTKKGAERNEQ

SEQ ID NO: 2548748 - protein, 7 aa, Entamoeba dispar
EAKGYNE

SEQ ID NO: 2548749 - protein, 7 aa, Entamoeba dispar
EAKKVNP

SEQ ID NO: 2548750 - protein, 24 aa, Entamoeba dispar
EAKRRNTETKEAVEKVRQTEHKER

SEQ ID NO: 2548751 - protein, 4 aa, Entamoeba dispar
EAMN

SEQ ID NO: 2548752 - protein, 19 aa, Entamoeba dispar
EANERTRIRKQANKFAKEI

SEQ ID NO: 2548753 - protein, 4 aa, Entamoeba dispar
EAQA

SEQ ID NO: 2548754 - protein, 24 aa, Entamoeba dispar
EAQERSGEDNKAKKMIESRNELEN

SEQ ID NO: 2548755 - protein, 4 aa, Entamoeba dispar
EAQR

SEQ ID NO: 2548756 - protein, 4 aa, Entamoeba dispar
EART

SEQ ID NO: 2548757 - protein, 6 aa, Entamoeba dispar
EATAET

SEQ ID NO: 2548758 - protein, 17 aa, Entamoeba dispar
EAVKKGSLDQQEANRRI

SEQ ID NO: 2548759 - protein, 7 aa, Entamoeba dispar
EAYQDDV

SEQ ID NO: 2548760 - protein, 4 aa, Entamoeba dispar
ECEK

SEQ ID NO: 2548761 - protein, 12 aa, Entamoeba dispar
ECEKKTPNGLEG

SEQ ID NO: 2548762 - protein, 5 aa, Entamoeba dispar
ECFTE

SEQ ID NO: 2548763 - protein, 6 aa, Entamoeba dispar
ECNKCE

SEQ ID NO: 2548764 - protein, 8 aa, Entamoeba dispar
ECPESPKK

SEQ ID NO: 2548765 - protein, 6 aa, Entamoeba dispar
ECQVPT

SEQ ID NO: 2548766 - protein, 10 aa, Entamoeba dispar
ECSGKGNGTI

SEQ ID NO: 2548767 - protein, 7 aa, Entamoeba dispar
ECSQSLP

SEQ ID NO: 2548768 - protein, 11 aa, Entamoeba dispar
ECSRNDTGNIS

SEQ ID NO: 2548769 - protein, 8 aa, Entamoeba dispar
ECSRTNKG

SEQ ID NO: 2548770 - protein, 23 aa, Entamoeba dispar
ECTESDKTTCEGKDKDSCRKCNS

SEQ ID NO: 2548771 - protein, 11 aa, Entamoeba dispar
ECTKCNKGYEL

SEQ ID NO: 2548772 - protein, 4 aa, Entamoeba dispar
ECTS

SEQ ID NO: 2548773 - protein, 5 aa, Entamoeba dispar
ECTSC

SEQ ID NO: 2548774 - protein, 9 aa, Entamoeba dispar
ECTTDGYYK

SEQ ID NO: 2548775 - protein, 9 aa, Entamoeba dispar
EDDEEEQVR

SEQ ID NO: 2548776 - protein, 6 aa, Entamoeba dispar
EDEGNF

SEQ ID NO: 2548777 - protein, 7 aa, Entamoeba dispar
EDGATKK

SEQ ID NO: 2548778 - protein, 4 aa, Entamoeba dispar
EDGF

SEQ ID NO: 2548779 - protein, 4 aa, Entamoeba dispar
EDGI

SEQ ID NO: 2548780 - protein, 5 aa, Entamoeba dispar
EDGIQ

SEQ ID NO: 2548781 - protein, 11 aa, Entamoeba dispar
EDGSVEEKQKD

SEQ ID NO: 2548782 - protein, 12 aa, Entamoeba dispar
EDITDPESHEVR

SEQ ID NO: 2548783 - protein, 8 aa, Entamoeba dispar
EDKKEQAI

SEQ ID NO: 2548784 - protein, 10 aa, Entamoeba dispar
EDKNKLEGIP

SEQ ID NO: 2548785 - protein, 4 aa, Entamoeba dispar
EDLQ

SEQ ID NO: 2548786 - protein, 6 aa, Entamoeba dispar
EDLSDQ

SEQ ID NO: 2548787 - protein, 8 aa, Entamoeba dispar
EDPQSKWQ

SEQ ID NO: 2548788 - protein, 6 aa, Entamoeba dispar
EDQRAY

SEQ ID NO: 2548789 - protein, 9 aa, Entamoeba dispar
EDSGMSKGS

SEQ ID NO: 2548790 - protein, 10 aa, Entamoeba dispar
EDTEKAKKEY

SEQ ID NO: 2548791 - protein, 11 aa, Entamoeba dispar
EDTEMATTRKD

SEQ ID NO: 2548792 - protein, 13 aa, Entamoeba dispar
EDTKQEEQKVDGP

SEQ ID NO: 2548793 - protein, 4 aa, Entamoeba dispar
EDTL

SEQ ID NO: 2548794 - protein, 59 aa, Entamoeba dispar
EDVDELNEEDNEEDEINLDEEEEEDDDDTADEYELTDDDDEDRRRRRRRYRRYRPKRRH

SEQ ID NO: 2548795 - protein, 14 aa, Entamoeba dispar
EDYPETSEKGVCQY

SEQ ID NO: 2548796 - protein, 9 aa, Entamoeba dispar
EEASEEVRK

SEQ ID NO: 2548797 - protein, 10 aa, Entamoeba dispar
EEATAEGVVN

SEQ ID NO: 2548798 - protein, 9 aa, Entamoeba dispar
EECDGNDGC

SEQ ID NO: 2548799 - protein, 5 aa, Entamoeba dispar
EEDEF

SEQ ID NO: 2548800 - protein, 9 aa, Entamoeba dispar
EEDERQLQT

SEQ ID NO: 2548801 - protein, 13 aa, Entamoeba dispar
EEDGSVKEKQKSI

SEQ ID NO: 2548802 - protein, 8 aa, Entamoeba dispar
EEDPEQQW

SEQ ID NO: 2548803 - protein, 30 aa, Entamoeba dispar
EEDPITNLENSTEPKTQGNDKNETTKPKTE

SEQ ID NO: 2548804 - protein, 16 aa, Entamoeba dispar
EEDTFEVNENNDFEDY

SEQ ID NO: 2548805 - protein, 5 aa, Entamoeba dispar
EEDYP

SEQ ID NO: 2548806 - protein, 4 aa, Entamoeba dispar
EEEE

SEQ ID NO: 2548807 - protein, 6 aa, Entamoeba dispar
EEEGTV

SEQ ID NO: 2548808 - protein, 7 aa, Entamoeba dispar
EEELKEF

SEQ ID NO: 2548809 - protein, 10 aa, Entamoeba dispar
EEENKTKHSL

SEQ ID NO: 2548810 - protein, 34 aa, Entamoeba dispar
EEETKFKKEDKKLEKEIKELEEKQKELENKKEVI

SEQ ID NO: 2548811 - protein, 15 aa, Entamoeba dispar
EEGATPITACSQINK

SEQ ID NO: 2548812 - protein, 14 aa, Entamoeba dispar
EEGESGCNSEKKKV

SEQ ID NO: 2548813 - protein, 7 aa, Entamoeba dispar
EEGNSKS

SEQ ID NO: 2548814 - protein, 27 aa, Entamoeba dispar
EEGVDKVKDKVTSKLGDAMGVDPSTGV

SEQ ID NO: 2548815 - protein, 4 aa, Entamoeba dispar
EEIA

SEQ ID NO: 2548816 - protein, 11 aa, Entamoeba dispar
EEIATTKKGGY

SEQ ID NO: 2548817 - protein, 12 aa, Entamoeba dispar
EEIGSTNRRGAQ

SEQ ID NO: 2548818 - protein, 14 aa, Entamoeba dispar
EEIKRKQNTFDTPK

SEQ ID NO: 2548819 - protein, 23 aa, Entamoeba dispar
EEINNNETENQNKTKKTKITPKV

SEQ ID NO: 2548820 - protein, 9 aa, Entamoeba dispar
EEKDDKMSE

SEQ ID NO: 2548821 - protein, 10 aa, Entamoeba dispar
EEKEQKIKEL

SEQ ID NO: 2548822 - protein, 20 aa, Entamoeba dispar
EEKIQKEQERNEERRKEIEE

SEQ ID NO: 2548823 - protein, 11 aa, Entamoeba dispar
EELDNSIEKTI

SEQ ID NO: 2548824 - protein, 12 aa, Entamoeba dispar
EELSIKQKERIK

SEQ ID NO: 2548825 - protein, 13 aa, Entamoeba dispar
EELSKSGDKYEKS

SEQ ID NO: 2548826 - protein, 5 aa, Entamoeba dispar
EEMKQ

SEQ ID NO: 2548827 - protein, 6 aa, Entamoeba dispar
EENGQM

SEQ ID NO: 2548828 - protein, 14 aa, Entamoeba dispar
EENGRKGGAGRYRD

SEQ ID NO: 2548829 - protein, 9 aa, Entamoeba dispar
EENKCAKCD

SEQ ID NO: 2548830 - protein, 6 aa, Entamoeba dispar
EENNDL

SEQ ID NO: 2548831 - protein, 13 aa, Entamoeba dispar
EEPNEEPPTEQQI

SEQ ID NO: 2548832 - protein, 10 aa, Entamoeba dispar
EEPQPNPPII

SEQ ID NO: 2548833 - protein, 6 aa, Entamoeba dispar
EEPVFE

SEQ ID NO: 2548834 - protein, 8 aa, Entamoeba dispar
EEQNTYGC

SEQ ID NO: 2548835 - protein, 6 aa, Entamoeba dispar
EEQTDE

SEQ ID NO: 2548836 - protein, 4 aa, Entamoeba dispar
EERK

SEQ ID NO: 2548837 - protein, 4 aa, Entamoeba dispar
EESA

SEQ ID NO: 2548838 - protein, 23 aa, Entamoeba dispar
EESISEEDDYGEEDDYYDDYYDD

SEQ ID NO: 2548839 - protein, 36 aa, Entamoeba dispar
EESKKRVDETNEALEKVKQEEHKKRLEAIKKTKEYL

SEQ ID NO: 2548840 - protein, 19 aa, Entamoeba dispar
EESSKKEIQELKKRKKEIR

SEQ ID NO: 2548841 - protein, 6 aa, Entamoeba dispar
EESTPF

SEQ ID NO: 2548842 - protein, 4 aa, Entamoeba dispar
EESY

SEQ ID NO: 2548843 - protein, 10 aa, Entamoeba dispar
EETQVPTQAL

SEQ ID NO: 2548844 - protein, 5 aa, Entamoeba dispar
EETSH

SEQ ID NO: 2548845 - protein, 8 aa, Entamoeba dispar
EETSLKES

SEQ ID NO: 2548846 - protein, 14 aa, Entamoeba dispar
EEWDPEIQYPASKL

SEQ ID NO: 2548847 - protein, 11 aa, Entamoeba dispar
EEYKENKTDSL

SEQ ID NO: 2548848 - protein, 5 aa, Entamoeba dispar
EEYQP

SEQ ID NO: 2548849 - protein, 8 aa, Entamoeba dispar
EFEGETKK

SEQ ID NO: 2548850 - protein, 5 aa, Entamoeba dispar
EFSDK

SEQ ID NO: 2548851 - protein, 12 aa, Entamoeba dispar
EFTTPSKKIELT

SEQ ID NO: 2548852 - protein, 10 aa, Entamoeba dispar
EGDPENENSL

SEQ ID NO: 2548853 - protein, 7 aa, Entamoeba dispar
EGDYTKY

SEQ ID NO: 2548854 - protein, 7 aa, Entamoeba dispar
EGERFAS

SEQ ID NO: 2548855 - protein, 7 aa, Entamoeba dispar
EGETNMT

SEQ ID NO: 2548856 - protein, 4 aa, Entamoeba dispar
EGEY

SEQ ID NO: 2548857 - protein, 5 aa, Entamoeba dispar
EGFSL

SEQ ID NO: 2548858 - protein, 6 aa, Entamoeba dispar
EGGNND

SEQ ID NO: 2548859 - protein, 7 aa, Entamoeba dispar
EGGRTPV

SEQ ID NO: 2548860 - protein, 14 aa, Entamoeba dispar
EGGSAKLICGLIHA

SEQ ID NO: 2548861 - protein, 4 aa, Entamoeba dispar
EGIP

SEQ ID NO: 2548862 - protein, 4 aa, Entamoeba dispar
EGIS

SEQ ID NO: 2548863 - protein, 8 aa, Entamoeba dispar
EGKCSPNL

SEQ ID NO: 2548864 - protein, 5 aa, Entamoeba dispar
EGKWS

SEQ ID NO: 2548865 - protein, 9 aa, Entamoeba dispar
EGNKKEICD

SEQ ID NO: 2548866 - protein, 4 aa, Entamoeba dispar
EGNT

SEQ ID NO: 2548867 - protein, 6 aa, Entamoeba dispar
EGQTIE

SEQ ID NO: 2548868 - protein, 29 aa, Entamoeba dispar
EGRNKINSFKQKAKSLLGGLKQKQKKSSF

SEQ ID NO: 2548869 - protein, 17 aa, Entamoeba dispar
EGSINKITSKSSNDKYF

SEQ ID NO: 2548870 - protein, 7 aa, Entamoeba dispar
EGTCKSS

SEQ ID NO: 2548871 - protein, 5 aa, Entamoeba dispar
EGTFV

SEQ ID NO: 2548872 - protein, 30 aa, Entamoeba dispar; identical to SEQ ID NO: 2420365

SEQ ID NO: 2548873 - protein, 6 aa, Entamoeba dispar
EGYKMD

SEQ ID NO: 2548874 - protein, 7 aa, Entamoeba dispar
EGYPHTH

SEQ ID NO: 2548875 - protein, 8 aa, Entamoeba dispar
EHKSESNT

SEQ ID NO: 2548876 - protein, 4 aa, Entamoeba dispar
EIAS

SEQ ID NO: 2548877 - protein, 5 aa, Entamoeba dispar
EICQT

SEQ ID NO: 2548878 - protein, 8 aa, Entamoeba dispar
EIDDNQNI

SEQ ID NO: 2548879 - protein, 9 aa, Entamoeba dispar
EIDETNKDD

SEQ ID NO: 2548880 - protein, 12 aa, Entamoeba dispar
EIDSKNNQGRIS

SEQ ID NO: 2548881 - protein, 33 aa, Entamoeba dispar
EIENCQREEENEDSIEKQEKENKNESNEDIKKS

SEQ ID NO: 2548882 - protein, 40 aa, Entamoeba dispar
EIENEYETNEEDNELNDDNEDDGEYELEEDDDDDKRRRRR

SEQ ID NO: 2548883 - protein, 8 aa, Entamoeba dispar
EIEPEGGH

SEQ ID NO: 2548884 - protein, 4 aa, Entamoeba dispar
EIEQ

SEQ ID NO: 2548885 - protein, 5 aa, Entamoeba dispar
EIEQQ

SEQ ID NO: 2548886 - protein, 16 aa, Entamoeba dispar
EIERKNSSSIKRYEEA

SEQ ID NO: 2548887 - protein, 8 aa, Entamoeba dispar
EIKANTDI

SEQ ID NO: 2548888 - protein, 9 aa, Entamoeba dispar
EIKKYEGKM

SEQ ID NO: 2548889 - protein, 6 aa, Entamoeba dispar
EINDSS

SEQ ID NO: 2548890 - protein, 15 aa, Entamoeba dispar
EINENESLENEKKEE

SEQ ID NO: 2548891 - protein, 37 aa, Entamoeba dispar
EIPESQLPPLEEEDDDEDIEDDIDEELEEEEERKPKI

SEQ ID NO: 2548892 - protein, 5 aa, Entamoeba dispar
EIPGS

SEQ ID NO: 2548893 - protein, 5 aa, Entamoeba dispar
EIQEE

SEQ ID NO: 2548894 - protein, 6 aa, Entamoeba dispar
EIQGSE

SEQ ID NO: 2548895 - protein, 8 aa, Entamoeba dispar
EIQSETAV

SEQ ID NO: 2548896 - protein, 64 aa, Entamoeba dispar
EITKKSAKDLKKQEKKALDKITKTEKTVNVKTTSKTEKKTSTSAKQSKLATEQKKATKQVQTKK

SEQ ID NO: 2548897 - protein, 72 aa, Entamoeba dispar
EKAKKEAKKLTKASKKAVKKDSKKASSLKKSMKALKKSLKAKVKKAEKKAKAQAKKQAKKIAKKQAGKIQKA

SEQ ID NO: 2548898 - protein, 6 aa, Entamoeba dispar
EKCTPE

SEQ ID NO: 2548899 - protein, 10 aa, Entamoeba dispar
EKDGETKKVE

SEQ ID NO: 2548900 - protein, 8 aa, Entamoeba dispar
EKDLKNDK

SEQ ID NO: 2548901 - protein, 8 aa, Entamoeba dispar
EKDPNNPA

SEQ ID NO: 2548902 - protein, 14 aa, Entamoeba dispar
EKDYSTCKQSNQYA

SEQ ID NO: 2548903 - protein, 19 aa, Entamoeba dispar
EKEEFKKQYSPNNEYGYNN

SEQ ID NO: 2548904 - protein, 7 aa, Entamoeba dispar
EKEIAEQ

SEQ ID NO: 2548905 - protein, 6 aa, Entamoeba dispar
EKEIKQ

SEQ ID NO: 2548906 - protein, 10 aa, Entamoeba dispar
EKEKTKSYPE

SEQ ID NO: 2548907 - protein, 11 aa, Entamoeba dispar
EKEQLERAATK

SEQ ID NO: 2548908 - protein, 5 aa, Entamoeba dispar
EKERI

SEQ ID NO: 2548909 - protein, 14 aa, Entamoeba dispar
EKFKKVSKKAYNKY

SEQ ID NO: 2548910 - protein, 7 aa, Entamoeba dispar
EKFKPET

SEQ ID NO: 2548911 - protein, 9 aa, Entamoeba dispar
EKGAQIGQK

SEQ ID NO: 2548912 - protein, 8 aa, Entamoeba dispar
EKGEKTLR

SEQ ID NO: 2548913 - protein, 4 aa, Entamoeba dispar
EKGI

SEQ ID NO: 2548914 - protein, 6 aa, Entamoeba dispar
EKGIST

SEQ ID NO: 2548915 - protein, 9 aa, Entamoeba dispar
EKGKESNPQ

SEQ ID NO: 2548916 - protein, 17 aa, Entamoeba dispar
EKGPSGGPRYMGGLQIT

SEQ ID NO: 2548917 - protein, 5 aa, Entamoeba dispar
EKGQY

SEQ ID NO: 2548918 - protein, 8 aa, Entamoeba dispar
EKIATNED

SEQ ID NO: 2548919 - protein, 5 aa, Entamoeba dispar
EKIEA

SEQ ID NO: 2548920 - protein, 9 aa, Entamoeba dispar
EKINDNQLN

SEQ ID NO: 2548921 - protein, 31 aa, Entamoeba dispar
EKISIKNKNKERKARELKQLREKQKKLEGFN

SEQ ID NO: 2548922 - protein, 29 aa, Entamoeba dispar
EKKAEKTVKKAEKEAKKVAESVKKEAKKL

SEQ ID NO: 2548923 - protein, 18 aa, Entamoeba dispar
EKKAMRKGIKKGKFNKKA

SEQ ID NO: 2548924 - protein, 9 aa, Entamoeba dispar
EKKARDLGI

SEQ ID NO: 2548925 - protein, 19 aa, Entamoeba dispar
EKKCPQTVKQEKNSTTTSV

SEQ ID NO: 2548926 - protein, 27 aa, Entamoeba dispar
EKKEEMKDKAIEKKEAKERAIKERKRK

SEQ ID NO: 2548927 - protein, 35 aa, Entamoeba dispar
EKKPLDNKGKAKLAKVTKQLKEAEKTQKKEAKKVE

SEQ ID NO: 2548928 - protein, 39 aa, Entamoeba dispar
EKKQEKQVQKAEIKKAEKKVAKMEKKTQQKATKKAEKIV

SEQ ID NO: 2548929 - protein, 10 aa, Entamoeba dispar
EKKQKAKEDK

SEQ ID NO: 2548930 - protein, 11 aa, Entamoeba dispar
EKKRKRRVKTA

SEQ ID NO: 2548931 - protein, 7 aa, Entamoeba dispar
EKKRRVV

SEQ ID NO: 2548932 - protein, 7 aa, Entamoeba dispar
EKMPDME

SEQ ID NO: 2548933 - protein, 14 aa, Entamoeba dispar
EKMTEVKSKHGKRI

SEQ ID NO: 2548934 - protein, 9 aa, Entamoeba dispar
EKNDDPDLK

SEQ ID NO: 2548935 - protein, 9 aa, Entamoeba dispar
EKNKDLTPK

SEQ ID NO: 2548936 - protein, 18 aa, Entamoeba dispar
EKNKMNELNKNKPSNSNS

SEQ ID NO: 2548937 - protein, 9 aa, Entamoeba dispar
EKNKTKGKL

SEQ ID NO: 2548938 - protein, 4 aa, Entamoeba dispar
EKNP

SEQ ID NO: 2548939 - protein, 22 aa, Entamoeba dispar
EKPCNAPKPTQNKTVTDKLSSD

SEQ ID NO: 2548940 - protein, 14 aa, Entamoeba dispar
EKPESSMSMTQTEA

SEQ ID NO: 2548941 - protein, 4 aa, Entamoeba dispar
EKPI

SEQ ID NO: 2548942 - protein, 17 aa, Entamoeba dispar
EKRKISGRGVVSKQEKK

SEQ ID NO: 2548943 - protein, 9 aa, Entamoeba dispar
EKRQSSGMV

SEQ ID NO: 2548944 - protein, 5 aa, Entamoeba dispar
EKRRD

SEQ ID NO: 2548945 - protein, 9 aa, Entamoeba dispar
EKSTDDEKE

SEQ ID NO: 2548946 - protein, 8 aa, Entamoeba dispar
EKSTQSEV

SEQ ID NO: 2548947 - protein, 12 aa, Entamoeba dispar
EKTVQAARKSRE

SEQ ID NO: 2548948 - protein, 19 aa, Entamoeba dispar
EKYKEKERNKIEKKKGEII

SEQ ID NO: 2548949 - protein, 8 aa, Entamoeba dispar
EKYTKAEG

SEQ ID NO: 2548950 - protein, 4 aa, Entamoeba dispar
ELDT

SEQ ID NO: 2548951 - protein, 26 aa, Entamoeba dispar
ELEDDNKYEREKAQISEKMRSSIEKK

SEQ ID NO: 2548952 - protein, 15 aa, Entamoeba dispar
ELEESGIKEELNEEA

SEQ ID NO: 2548953 - protein, 5 aa, Entamoeba dispar
ELEPR

SEQ ID NO: 2548954 - protein, 10 aa, Entamoeba dispar
ELERSEKNHM

SEQ ID NO: 2548955 - protein, 9 aa, Entamoeba dispar
ELIDTTNSQ

SEQ ID NO: 2548956 - protein, 12 aa, Entamoeba dispar
ELIKNSSLKTYD

SEQ ID NO: 2548957 - protein, 5 aa, Entamoeba dispar
ELKAL

SEQ ID NO: 2548958 - protein, 15 aa, Entamoeba dispar
ELKEQTNATTKNATQ

SEQ ID NO: 2548959 - protein, 7 aa, Entamoeba dispar
ELKPGKY

SEQ ID NO: 2548960 - protein, 14 aa, Entamoeba dispar
ELKSREDDLSNEAS

SEQ ID NO: 2548961 - protein, 6 aa, Entamoeba dispar
ELNKED

SEQ ID NO: 2548962 - protein, 12 aa, Entamoeba dispar
ELPNSCEGNCRK

SEQ ID NO: 2548963 - protein, 6 aa, Entamoeba dispar
ELRSER

SEQ ID NO: 2548964 - protein, 18 aa, Entamoeba dispar
ELSESKEDEETIPSVAPN

SEQ ID NO: 2548965 - protein, 6 aa, Entamoeba dispar
ELSPKE

SEQ ID NO: 2548966 - protein, 13 aa, Entamoeba dispar
ELSSDSSNTQKCT

SEQ ID NO: 2548967 - protein, 23 aa, Entamoeba dispar
EMEKTLQDAENAEKIAHDTASKT

SEQ ID NO: 2548968 - protein, 6 aa, Entamoeba dispar
EMRRNS

SEQ ID NO: 2548969 - protein, 4 aa, Entamoeba dispar
EMRS

SEQ ID NO: 2548970 - protein, 11 aa, Entamoeba dispar
EMYQTKTNGVV

SEQ ID NO: 2548971 - protein, 7 aa, Entamoeba dispar
ENAGIDG

SEQ ID NO: 2548972 - protein, 13 aa, Entamoeba dispar
ENCNQEGKYEISN

SEQ ID NO: 2548973 - protein, 5 aa, Entamoeba dispar
ENDEK

SEQ ID NO: 2548974 - protein, 4 aa, Entamoeba dispar
ENEF

SEQ ID NO: 2548975 - protein, 5 aa, Entamoeba dispar
ENEHD

SEQ ID NO: 2548976 - protein, 12 aa, Entamoeba dispar
ENENGTSIPSSK

SEQ ID NO: 2548977 - protein, 7 aa, Entamoeba dispar
ENEQRKK

SEQ ID NO: 2548978 - protein, 6 aa, Entamoeba dispar
ENGEKD

SEQ ID NO: 2548979 - protein, 7 aa, Entamoeba dispar
ENGGNRE

SEQ ID NO: 2548980 - protein, 12 aa, Entamoeba dispar
ENGKCTKKNEKI

SEQ ID NO: 2548981 - protein, 5 aa, Entamoeba dispar
ENGPV

SEQ ID NO: 2548982 - protein, 12 aa, Entamoeba dispar
ENGYYKSPFDGK

SEQ ID NO: 2548983 - protein, 6 aa, Entamoeba dispar
ENHPTS

SEQ ID NO: 2548984 - protein, 10 aa, Entamoeba dispar
ENIESQLSKE

SEQ ID NO: 2548985 - protein, 32 aa, Entamoeba dispar
ENIPKSAGARGNGDEADIAKQKANEGKQISEQ

SEQ ID NO: 2548986 - protein, 9 aa, Entamoeba dispar
ENKANAPTN

SEQ ID NO: 2548987 - protein, 8 aa, Entamoeba dispar
ENKGKYDR

SEQ ID NO: 2548988 - protein, 7 aa, Entamoeba dispar
ENKKRLH

SEQ ID NO: 2548989 - protein, 21 aa, Entamoeba dispar
  misc_feature (19)..(20): Xaa can be any naturally occurring amino acid
ENKKTCKVASLYCDGMECXXA

SEQ ID NO: 2548990 - protein, 10 aa, Entamoeba dispar
ENKQTAIKKA

SEQ ID NO: 2548991 - protein, 10 aa, Entamoeba dispar
ENMNKPNSEL

SEQ ID NO: 2548992 - protein, 8 aa, Entamoeba dispar
ENNCNSQK

SEQ ID NO: 2548993 - protein, 7 aa, Entamoeba dispar
ENNQIES

SEQ ID NO: 2548994 - protein, 6 aa, Entamoeba dispar
ENNQNY

SEQ ID NO: 2548995 - protein, 4 aa, Entamoeba dispar
ENNR

SEQ ID NO: 2548996 - protein, 8 aa, Entamoeba dispar
ENPEDKQM

SEQ ID NO: 2548997 - protein, 22 aa, Entamoeba dispar
ENPSMKAKKIDDFTRNLNVLEV

SEQ ID NO: 2548998 - protein, 7 aa, Entamoeba dispar
ENSCTNP

SEQ ID NO: 2548999 - protein, 5 aa, Entamoeba dispar
ENSND

SEQ ID NO: 2549000 - protein, 10 aa, Entamoeba dispar
ENTVSIEGEE

SEQ ID NO: 2549001 - protein, 6 aa, Entamoeba dispar
ENVEGT

SEQ ID NO: 2549002 - protein, 13 aa, Entamoeba dispar
EPIPSHTKKPHQK

SEQ ID NO: 2549003 - protein, 11 aa, Entamoeba dispar
EPLKKSNLLRN

SEQ ID NO: 2549004 - protein, 9 aa, Entamoeba dispar
EPQTSELVT

SEQ ID NO: 2549005 - protein, 9 aa, Entamoeba dispar
EPSFSGSST

SEQ ID NO: 2549006 - protein, 5 aa, Entamoeba dispar
EPSVF

SEQ ID NO: 2549007 - protein, 5 aa, Entamoeba dispar
EPTAA

SEQ ID NO: 2549008 - protein, 6 aa, Entamoeba dispar
EPTAAS

SEQ ID NO: 2549009 - protein, 13 aa, Entamoeba dispar
EQENLKAAQRAQI

SEQ ID NO: 2549010 - protein, 5 aa, Entamoeba dispar
EQETF

SEQ ID NO: 2549011 - protein, 19 aa, Entamoeba dispar
EQGAEFKTVTEEELTSEGC

SEQ ID NO: 2549012 - protein, 17 aa, Entamoeba dispar
EQKASKKVFNGNKNVAK

SEQ ID NO: 2549013 - protein, 7 aa, Entamoeba dispar
EQKEGEI

SEQ ID NO: 2549014 - protein, 4 aa, Entamoeba dispar
EQKQ

SEQ ID NO: 2549015 - protein, 19 aa, Entamoeba dispar
EQKRKRNDFNADYQERYNS

SEQ ID NO: 2549016 - protein, 12 aa, Entamoeba dispar
EQLEKNKKYIGE

SEQ ID NO: 2549017 - protein, 7 aa, Entamoeba dispar
EQLKSKN

SEQ ID NO: 2549018 - protein, 17 aa, Entamoeba dispar
EQLPNSESSPSKKELKI

SEQ ID NO: 2549019 - protein, 4 aa, Entamoeba dispar
EQNE

SEQ ID NO: 2549020 - protein, 6 aa, Entamoeba dispar
EQRIQE

SEQ ID NO: 2549021 - protein, 4 aa, Entamoeba dispar
EQSY

SEQ ID NO: 2549022 - protein, 18 aa, Entamoeba dispar
EQTASHARLGESFANVRS

SEQ ID NO: 2549023 - protein, 7 aa, Entamoeba dispar
EQTIPRK

SEQ ID NO: 2549024 - protein, 8 aa, Entamoeba dispar
EQVINNGK

SEQ ID NO: 2549025 - protein, 9 aa, Entamoeba dispar
EQWKRNKPQ

SEQ ID NO: 2549026 - protein, 6 aa, Entamoeba dispar
EQYAEQ

SEQ ID NO: 2549027 - protein, 8 aa, Entamoeba dispar
ERAQESKV

SEQ ID NO: 2549028 - protein, 25 aa, Entamoeba dispar
ERCPRNSDELASASPETKLRCKNIK

SEQ ID NO: 2549029 - protein, 5 aa, Entamoeba dispar
ERDAK

SEQ ID NO: 2549030 - protein, 24 aa, Entamoeba dispar
ERENSIRRREEKEMKIKGAQKITQ

SEQ ID NO: 2549031 - protein, 5 aa, Entamoeba dispar
ERETT

SEQ ID NO: 2549032 - protein, 6 aa, Entamoeba dispar
ERISQA

SEQ ID NO: 2549033 - protein, 6 aa, Entamoeba dispar
ERITPN

SEQ ID NO: 2549034 - protein, 6 aa, Entamoeba dispar
ERKHEI

SEQ ID NO: 2549035 - protein, 6 aa, Entamoeba dispar
ERKPPE

SEQ ID NO: 2549036 - protein, 12 aa, Entamoeba dispar
ERKRGKLSSRRE

SEQ ID NO: 2549037 - protein, 4 aa, Entamoeba dispar
ERLN

SEQ ID NO: 2549038 - protein, 6 aa, Entamoeba dispar
ERQKMQ

SEQ ID NO: 2549039 - protein, 9 aa, Entamoeba dispar
ERQQSEVNM

SEQ ID NO: 2549040 - protein, 8 aa, Entamoeba dispar
ERQSPPLA

SEQ ID NO: 2549041 - protein, 8 aa, Entamoeba dispar
ERRNKAER

SEQ ID NO: 2549042 - protein, 10 aa, Entamoeba dispar
ERSGFEESSE

SEQ ID NO: 2549043 - protein, 8 aa, Entamoeba dispar
ERSLTKDN

SEQ ID NO: 2549044 - protein, 4 aa, Entamoeba dispar
ERSR

SEQ ID NO: 2549045 - protein, 5 aa, Entamoeba dispar
ERSRF

SEQ ID NO: 2549046 - protein, 7 aa, Entamoeba dispar
ERTMTKD

SEQ ID NO: 2549047 - protein, 8 aa, Entamoeba dispar
ESASTNYN

SEQ ID NO: 2549048 - protein, 5 aa, Entamoeba dispar
ESDPA

SEQ ID NO: 2549049 - protein, 4 aa, Entamoeba dispar
ESFK

SEQ ID NO: 2549050 - protein, 12 aa, Entamoeba dispar
ESGETEESEMKD

SEQ ID NO: 2549051 - protein, 9 aa, Entamoeba dispar
ESGIPEGTL

SEQ ID NO: 2549052 - protein, 8 aa, Entamoeba dispar
ESGNRSDQ

SEQ ID NO: 2549053 - protein, 4 aa, Entamoeba dispar
ESIP

SEQ ID NO: 2549054 - protein, 5 aa, Entamoeba dispar
ESKFD

SEQ ID NO: 2549055 - protein, 15 aa, Entamoeba dispar
ESKISNAETAKSAYD

SEQ ID NO: 2549056 - protein, 4 aa, Entamoeba dispar
ESNI

SEQ ID NO: 2549057 - protein, 14 aa, Entamoeba dispar
ESNKEGDGTVQKES

SEQ ID NO: 2549058 - protein, 4 aa, Entamoeba dispar
ESPC

SEQ ID NO: 2549059 - protein, 9 aa, Entamoeba dispar
ESPKNNTLK

SEQ ID NO: 2549060 - protein, 7 aa, Entamoeba dispar
ESRRRMK

SEQ ID NO: 2549061 - protein, 14 aa, Entamoeba dispar
ESSDGWTGNSLPTQ

SEQ ID NO: 2549062 - protein, 4 aa, Entamoeba dispar
ESSI

SEQ ID NO: 2549063 - protein, 7 aa, Entamoeba dispar
ESSIPSD

SEQ ID NO: 2549064 - protein, 20 aa, Entamoeba dispar
ESSNEGTTSIKEVENNDKSI

SEQ ID NO: 2549065 - protein, 11 aa, Entamoeba dispar
ESTASVEVDDA

SEQ ID NO: 2549066 - protein, 5 aa, Entamoeba dispar
ESTNQ

SEQ ID NO: 2549067 - protein, 7 aa, Entamoeba dispar
ESTNQTK

SEQ ID NO: 2549068 - protein, 9 aa, Entamoeba dispar
ESTSTDDAI

SEQ ID NO: 2549069 - protein, 10 aa, Entamoeba dispar
ESTTPKSERK

SEQ ID NO: 2549070 - protein, 26 aa, Entamoeba dispar
ESVQPSSERCQSYTSQKIERSKSAPK

SEQ ID NO: 2549071 - protein, 4 aa, Entamoeba dispar
ETAD

SEQ ID NO: 2549072 - protein, 8 aa, Entamoeba dispar
ETANYDGN

SEQ ID NO: 2549073 - protein, 10 aa, Entamoeba dispar
ETEAAADSVY

SEQ ID NO: 2549074 - protein, 8 aa, Entamoeba dispar
ETEEPTYG

SEQ ID NO: 2549075 - protein, 6 aa, Entamoeba dispar
ETEGAE

SEQ ID NO: 2549076 - protein, 21 aa, Entamoeba dispar
ETEKYKAEDDENKARIETKNQ

SEQ ID NO: 2549077 - protein, 4 aa, Entamoeba dispar
ETFK

SEQ ID NO: 2549078 - protein, 4 aa, Entamoeba dispar
ETGI

SEQ ID NO: 2549079 - protein, 14 aa, Entamoeba dispar
ETIDKNASKDGAHA

SEQ ID NO: 2549080 - protein, 13 aa, Entamoeba dispar
ETIPEENTITKKT

SEQ ID NO: 2549081 - protein, 4 aa, Entamoeba dispar
ETKD

SEQ ID NO: 2549082 - protein, 8 aa, Entamoeba dispar
ETKIEDGV

SEQ ID NO: 2549083 - protein, 7 aa, Entamoeba dispar
ETKYDSV

SEQ ID NO: 2549084 - protein, 4 aa, Entamoeba dispar
ETMR

SEQ ID NO: 2549085 - protein, 4 aa, Entamoeba dispar
ETNP

SEQ ID NO: 2549086 - protein, 14 aa, Entamoeba dispar
ETNYTNGITEDDVN

SEQ ID NO: 2549087 - protein, 4 aa, Entamoeba dispar
ETRE

SEQ ID NO: 2549088 - protein, 5 aa, Entamoeba dispar
ETSND

SEQ ID NO: 2549089 - protein, 5 aa, Entamoeba dispar
ETTDT

SEQ ID NO: 2549090 - protein, 10 aa, Entamoeba dispar
ETTEKENEDI

SEQ ID NO: 2549091 - protein, 10 aa, Entamoeba dispar
ETTEKENKDI

SEQ ID NO: 2549092 - protein, 10 aa, Entamoeba dispar
ETTEKENNDI

SEQ ID NO: 2549093 - protein, 10 aa, Entamoeba dispar
ETTEKENNSI

SEQ ID NO: 2549094 - protein, 8 aa, Entamoeba dispar
ETTSQSKV

SEQ ID NO: 2549095 - protein, 16 aa, Entamoeba dispar
ETTTPTKLNKKKKSIF

SEQ ID NO: 2549096 - protein, 11 aa, Entamoeba dispar
ETVEQDNITQK

SEQ ID NO: 2549097 - protein, 11 aa, Entamoeba dispar
ETVSNNDKQYH

SEQ ID NO: 2549098 - protein, 8 aa, Entamoeba dispar
EVAGPSDI

SEQ ID NO: 2549099 - protein, 12 aa, Entamoeba dispar
EVASRESSQFRT

SEQ ID NO: 2549100 - protein, 4 aa, Entamoeba dispar
EVDK

SEQ ID NO: 2549101 - protein, 6 aa, Entamoeba dispar
EVEDLN

SEQ ID NO: 2549102 - protein, 11 aa, Entamoeba dispar
EVEGNTPSTIF

SEQ ID NO: 2549103 - protein, 17 aa, Entamoeba dispar
EVKKEERKRKKNTKEII

SEQ ID NO: 2549104 - protein, 7 aa, Entamoeba dispar
EVNDNGT

SEQ ID NO: 2549105 - protein, 24 aa, Entamoeba dispar
EVNETEINSTENIPKTENESITEE

SEQ ID NO: 2549106 - protein, 6 aa, Entamoeba dispar
EVPEDM

SEQ ID NO: 2549107 - protein, 11 aa, Entamoeba dispar
EVSGETSEEVL

SEQ ID NO: 2549108 - protein, 8 aa, Entamoeba dispar
EWNSENGM

SEQ ID NO: 2549109 - protein, 6 aa, Entamoeba dispar
EYDCSK

SEQ ID NO: 2549110 - protein, 40 aa, Entamoeba dispar
EYDDDSSNSSTTHTPSLPEDGEGKFIPSSTSLLPKPPIVR

SEQ ID NO: 2549111 - protein, 17 aa, Entamoeba dispar
EYDGTTCAEARKSNKEA

SEQ ID NO: 2549112 - protein, 47 aa, Entamoeba dispar
EYENDEEENDDEYEIEDSEEEITEENNEEEETEENNEENEEEEDIED

SEQ ID NO: 2549113 - protein, 4 aa, Entamoeba dispar
EYER

SEQ ID NO: 2549114 - protein, 4 aa, Entamoeba dispar
EYKA

SEQ ID NO: 2549115 - protein, 5 aa, Entamoeba dispar
EYKHG

SEQ ID NO: 2549116 - protein, 13 aa, Entamoeba dispar
EYNRRNKKFSERK

SEQ ID NO: 2549117 - protein, 7 aa, Entamoeba dispar
EYPELSK

SEQ ID NO: 2549118 - protein, 5 aa, Entamoeba dispar
EYQVT

SEQ ID NO: 2549119 - protein, 8 aa, Entamoeba dispar
FAEEEQGV

SEQ ID NO: 2549120 - protein, 4 aa, Entamoeba dispar
FAEN

SEQ ID NO: 2549121 - protein, 4 aa, Entamoeba dispar
FAEQ

SEQ ID NO: 2549122 - protein, 15 aa, Entamoeba dispar
FAGGLDTKHQLTGEY

SEQ ID NO: 2549123 - protein, 7 aa, Entamoeba dispar
FAHNPST

SEQ ID NO: 2549124 - protein, 13 aa, Entamoeba dispar
FAKASKSERKSLK

SEQ ID NO: 2549125 - protein, 9 aa, Entamoeba dispar
FAQKNQDLE

SEQ ID NO: 2549126 - protein, 12 aa, Entamoeba dispar
FDEAGHNNDELT

SEQ ID NO: 2549127 - protein, 10 aa, Entamoeba dispar
FDEEKDEEAL

SEQ ID NO: 2549128 - protein, 9 aa, Entamoeba dispar
FDKGSQRKV

SEQ ID NO: 2549129 - protein, 17 aa, Entamoeba dispar
FDNDEYEEYQLGDNEED

SEQ ID NO: 2549130 - protein, 11 aa, Entamoeba dispar
FDSKSKTMYGY

SEQ ID NO: 2549131 - protein, 6 aa, Entamoeba dispar
FDVNGD

SEQ ID NO: 2549132 - protein, 10 aa, Entamoeba dispar
FEDAKTRTGV

SEQ ID NO: 2549133 - protein, 14 aa, Entamoeba dispar
FEETTKKIKQLQNK

SEQ ID NO: 2549134 - protein, 5 aa, Entamoeba dispar
FEGTT

SEQ ID NO: 2549135 - protein, 11 aa, Entamoeba dispar
FENRNKTRASC

SEQ ID NO: 2549136 - protein, 6 aa, Entamoeba dispar
FESGTS

SEQ ID NO: 2549137 - protein, 9 aa, Entamoeba dispar
FETAEYGKY

SEQ ID NO: 2549138 - protein, 5 aa, Entamoeba dispar
FGASR

SEQ ID NO: 2549139 - protein, 11 aa, Entamoeba dispar
FGDEKPDWKTG

SEQ ID NO: 2549140 - protein, 12 aa, Entamoeba dispar
FGESEEVKTKGF

SEQ ID NO: 2549141 - protein, 5 aa, Entamoeba dispar
FGGCQ

SEQ ID NO: 2549142 - protein, 11 aa, Entamoeba dispar
FGGDPNGSVDE

SEQ ID NO: 2549143 - protein, 11 aa, Entamoeba dispar
FGGLDSKTINY

SEQ ID NO: 2549144 - protein, 6 aa, Entamoeba dispar
FGKEPM

SEQ ID NO: 2549145 - protein, 6 aa, Entamoeba dispar
FGQQRT

SEQ ID NO: 2549146 - protein, 23 aa, Entamoeba dispar
FGSGKNVHQPLPLTDKSKGAFTE

SEQ ID NO: 2549147 - protein, 14 aa, Entamoeba dispar
FHSNSTNVQFYNHT

SEQ ID NO: 2549148 - protein, 7 aa, Entamoeba dispar
FIETQND

SEQ ID NO: 2549149 - protein, 4 aa, Entamoeba dispar
FIKK

SEQ ID NO: 2549150 - protein, 11 aa, Entamoeba dispar
FKEGEGIPQKM

SEQ ID NO: 2549151 - protein, 7 aa, Entamoeba dispar
FKEKPEL

SEQ ID NO: 2549152 - protein, 5 aa, Entamoeba dispar
FKGEK

SEQ ID NO: 2549153 - protein, 7 aa, Entamoeba dispar
FKGKKKE

SEQ ID NO: 2549154 - protein, 5 aa, Entamoeba dispar
FKIPN

SEQ ID NO: 2549155 - protein, 8 aa, Entamoeba dispar
FKKDDEDD

SEQ ID NO: 2549156 - protein, 8 aa, Entamoeba dispar
FKKDEEDD

SEQ ID NO: 2549157 - protein, 12 aa, Entamoeba dispar
FKKDPSNNPRAM

SEQ ID NO: 2549158 - protein, 8 aa, Entamoeba dispar
FKKNEEDD

SEQ ID NO: 2549159 - protein, 5 aa, Entamoeba dispar
FKNGE

SEQ ID NO: 2549160 - protein, 5 aa, Entamoeba dispar
FKNND

SEQ ID NO: 2549161 - protein, 4 aa, Entamoeba dispar
FKNP

SEQ ID NO: 2549162 - protein, 11 aa, Entamoeba dispar
FKPGKRPQPGT

SEQ ID NO: 2549163 - protein, 7 aa, Entamoeba dispar
FKPQNEP

SEQ ID NO: 2549164 - protein, 9 aa, Entamoeba dispar
FKQATCPNG

SEQ ID NO: 2549165 - protein, 9 aa, Entamoeba dispar
FKTSAKEEC

SEQ ID NO: 2549166 - protein, 12 aa, Entamoeba dispar
FLDEKNGGYNYS

SEQ ID NO: 2549167 - protein, 13 aa, Entamoeba dispar
FNANTKTSIGSDV

SEQ ID NO: 2549168 - protein, 10 aa, Entamoeba dispar
FNDDSENDWS

SEQ ID NO: 2549169 - protein, 6 aa, Entamoeba dispar
FNDGDD

SEQ ID NO: 2549170 - protein, 5 aa, Entamoeba dispar
FNGEK

SEQ ID NO: 2549171 - protein, 27 aa, Entamoeba dispar
FNHEKGKLEATQTANKKVNSTTSKSHK

SEQ ID NO: 2549172 - protein, 9 aa, Entamoeba dispar
FNKKDKKQF

SEQ ID NO: 2549173 - protein, 10 aa, Entamoeba dispar
FNKQKKAYIK

SEQ ID NO: 2549174 - protein, 24 aa, Entamoeba dispar
FNKTIKKAANEKKKAKAAKKQVKE

SEQ ID NO: 2549175 - protein, 16 aa, Entamoeba dispar
FNPAGKEVGEASPPWG

SEQ ID NO: 2549176 - protein, 12 aa, Entamoeba dispar
FNPEKEMIDPQE

SEQ ID NO: 2549177 - protein, 13 aa, Entamoeba dispar
FNRPEESKSTFTE

SEQ ID NO: 2549178 - protein, 48 aa, Entamoeba dispar
FNRSEEVLDDAEAVKSVKPKKANSVAKKIAKSVTKKQTKKVEKEVKIA

SEQ ID NO: 2549179 - protein, 12 aa, Entamoeba dispar
FPEDDSNSYDQR

SEQ ID NO: 2549180 - protein, 4 aa, Entamoeba dispar
FPNN

SEQ ID NO: 2549181 - protein, 5 aa, Entamoeba dispar
FPVEP

SEQ ID NO: 2549182 - protein, 20 aa, Entamoeba dispar
FQDGDSGRGYCTGYGPSRHC

SEQ ID NO: 2549183 - protein, 20 aa, Entamoeba dispar
FQDGDSSRGYCTGYGPSTHC

SEQ ID NO: 2549184 - protein, 11 aa, Entamoeba dispar
FSRTTSTTKKS

SEQ ID NO: 2549185 - protein, 9 aa, Entamoeba dispar
FSSDDSDVD

SEQ ID NO: 2549186 - protein, 6 aa, Entamoeba dispar
FSSDEE

SEQ ID NO: 2549187 - protein, 8 aa, Entamoeba dispar
FSSSPGLI

SEQ ID NO: 2549188 - protein, 7 aa, Entamoeba dispar
FTAQYKA

SEQ ID NO: 2549189 - protein, 14 aa, Entamoeba dispar
FTEAKDDLVEGKSL

SEQ ID NO: 2549190 - protein, 4 aa, Entamoeba dispar
FTKF

SEQ ID NO: 2549191 - protein, 4 aa, Entamoeba dispar
FTND

SEQ ID NO: 2549192 - protein, 6 aa, Entamoeba dispar
FTQENG

SEQ ID NO: 2549193 - protein, 7 aa, Entamoeba dispar
FTTGRGR

SEQ ID NO: 2549194 - protein, 6 aa, Entamoeba dispar
FTVDTS

SEQ ID NO: 2549195 - protein, 12 aa, Entamoeba dispar
FWGPKDSTTHKP

SEQ ID NO: 2549196 - protein, 42 aa, Entamoeba dispar
GAATTASKAYQDIKNGKTPSLGNSNSSGSSKSTVKSRSKKSK

SEQ ID NO: 2549197 - protein, 27 aa, Entamoeba dispar
GADNASKPSINPDTVYNAADQSYSNGG

SEQ ID NO: 2549198 - protein, 6 aa, Entamoeba dispar
GADYDN

SEQ ID NO: 2549199 - protein, 11 aa, Entamoeba dispar
GAENSHDAENC

SEQ ID NO: 2549200 - protein, 10 aa, Entamoeba dispar
GAFKTEAKRP

SEQ ID NO: 2549201 - protein, 5 aa, Entamoeba dispar
GAIRG

SEQ ID NO: 2549202 - protein, 18 aa, Entamoeba dispar
GAKRFGYNGGDNNEVQED

SEQ ID NO: 2549203 - protein, 12 aa, Entamoeba dispar
GANLNKEDKTKL

SEQ ID NO: 2549204 - protein, 6 aa, Entamoeba dispar
GANVNA

SEQ ID NO: 2549205 - protein, 12 aa, Entamoeba dispar
GANVNQITENGT

SEQ ID NO: 2549206 - protein, 5 aa, Entamoeba dispar
GATGA

SEQ ID NO: 2549207 - protein, 7 aa, Entamoeba dispar
GATSGFG

SEQ ID NO: 2549208 - protein, 12 aa, Entamoeba dispar
GAVADGKTSYKK

SEQ ID NO: 2549209 - protein, 6 aa, Entamoeba dispar
GCGDEH

SEQ ID NO: 2549210 - protein, 9 aa, Entamoeba dispar
GCNGGTLQA

SEQ ID NO: 2549211 - protein, 4 aa, Entamoeba dispar
GCSE

SEQ ID NO: 2549212 - protein, 9 aa, Entamoeba dispar
GCSGGWPTS

SEQ ID NO: 2549213 - protein, 10 aa, Entamoeba dispar
GDEKIYSPEE

SEQ ID NO: 2549214 - protein, 6 aa, Entamoeba dispar
GDGDGV

SEQ ID NO: 2549215 - protein, 4 aa, Entamoeba dispar
GDGK

SEQ ID NO: 2549216 - protein, 7 aa, Entamoeba dispar
GDGTVLS

SEQ ID NO: 2549217 - protein, 7 aa, Entamoeba dispar
GDHKPAR

SEQ ID NO: 2549218 - protein, 18 aa, Entamoeba dispar
GDISNKNGEKSNKFNFNG

SEQ ID NO: 2549219 - protein, 6 aa, Entamoeba dispar
GDKCSQ

SEQ ID NO: 2549220 - protein, 12 aa, Entamoeba dispar
GDKECTEPIPGT

SEQ ID NO: 2549221 - protein, 13 aa, Entamoeba dispar
GDKEIKESKKRLK

SEQ ID NO: 2549222 - protein, 8 aa, Entamoeba dispar
GDKKQYSY

SEQ ID NO: 2549223 - protein, 9 aa, Entamoeba dispar
GDKSFKESN

SEQ ID NO: 2549224 - protein, 21 aa, Entamoeba dispar
GDLDGSYSRSFDNSINDVENA

SEQ ID NO: 2549225 - protein, 7 aa, Entamoeba dispar
GDMGNND

SEQ ID NO: 2549226 - protein, 4 aa, Entamoeba dispar
GDNA

SEQ ID NO: 2549227 - protein, 7 aa, Entamoeba dispar
GDNKEYI

SEQ ID NO: 2549228 - protein, 8 aa, Entamoeba dispar
GDNKQYSY

SEQ ID NO: 2549229 - protein, 10 aa, Entamoeba dispar
GDPYGKDEEF

SEQ ID NO: 2549230 - protein, 5 aa, Entamoeba dispar
GDPYV

SEQ ID NO: 2549231 - protein, 7 aa, Entamoeba dispar
GDQATYD

SEQ ID NO: 2549232 - protein, 7 aa, Entamoeba dispar
GDQNPSV

SEQ ID NO: 2549233 - protein, 7 aa, Entamoeba dispar
GDSDATW

SEQ ID NO: 2549234 - protein, 6 aa, Entamoeba dispar
GDSFDS

SEQ ID NO: 2549235 - protein, 9 aa, Entamoeba dispar
GDTFDSKST

SEQ ID NO: 2549236 - protein, 7 aa, Entamoeba dispar
GDTVPKT

SEQ ID NO: 2549237 - protein, 20 aa, Entamoeba dispar
GDVESIEKKTRNASKGNKKY

SEQ ID NO: 2549238 - protein, 8 aa, Entamoeba dispar
GDYGENGN

SEQ ID NO: 2549239 - protein, 8 aa, Entamoeba dispar
GDYNPTPN

SEQ ID NO: 2549240 - protein, 6 aa, Entamoeba dispar
GDYTKY

SEQ ID NO: 2549241 - protein, 9 aa, Entamoeba dispar
GECEDGSTP

SEQ ID NO: 2549242 - protein, 4 aa, Entamoeba dispar
GEDM

SEQ ID NO: 2549243 - protein, 8 aa, Entamoeba dispar
GEDNFNGA

SEQ ID NO: 2549244 - protein, 4 aa, Entamoeba dispar
GEDS

SEQ ID NO: 2549245 - protein, 14 aa, Entamoeba dispar
GEESKKFQEQRTVE

SEQ ID NO: 2549246 - protein, 8 aa, Entamoeba dispar
GEETKAAG

SEQ ID NO: 2549247 - protein, 10 aa, Entamoeba dispar
GEGNAPENKD

SEQ ID NO: 2549248 - protein, 10 aa, Entamoeba dispar
GEGPASPKVL

SEQ ID NO: 2549249 - protein, 10 aa, Entamoeba dispar
GEGPEDATGL

SEQ ID NO: 2549250 - protein, 5 aa, Entamoeba dispar
GEKAY

SEQ ID NO: 2549251 - protein, 15 aa, Entamoeba dispar
GEKCGNAWKEATESI

SEQ ID NO: 2549252 - protein, 8 aa, Entamoeba dispar
GEKGIGKY

SEQ ID NO: 2549253 - protein, 14 aa, Entamoeba dispar
GEKGMGKSGKPLHY

SEQ ID NO: 2549254 - protein, 5 aa, Entamoeba dispar
GELSS

SEQ ID NO: 2549255 - protein, 4 aa, Entamoeba dispar
GEMN

SEQ ID NO: 2549256 - protein, 4 aa, Entamoeba dispar
GENQ

SEQ ID NO: 2549257 - protein, 4 aa, Entamoeba dispar
GERL

SEQ ID NO: 2549258 - protein, 6 aa, Entamoeba dispar
GETSKC

SEQ ID NO: 2549259 - protein, 10 aa, Entamoeba dispar
GETVSKLSSV

SEQ ID NO: 2549260 - protein, 12 aa, Entamoeba dispar
GEVEGVSETIPK

SEQ ID NO: 2549261 - protein, 5 aa, Entamoeba dispar
GEYSG

SEQ ID NO: 2549262 - protein, 7 aa, Entamoeba dispar
GFDETSN

SEQ ID NO: 2549263 - protein, 4 aa, Entamoeba dispar
GFEN

SEQ ID NO: 2549264 - protein, 7 aa, Entamoeba dispar
GFKKGDK

SEQ ID NO: 2549265 - protein, 4 aa, Entamoeba dispar
GFTG

SEQ ID NO: 2549266 - protein, 13 aa, Entamoeba dispar
GFTTSAKTECQPG

SEQ ID NO: 2549267 - protein, 12 aa, Entamoeba dispar
GFYRSNKTGEYK

SEQ ID NO: 2549268 - protein, 6 aa, Entamoeba dispar
GGATEH

SEQ ID NO: 2549269 - protein, 5 aa, Entamoeba dispar
GGCTT

SEQ ID NO: 2549270 - protein, 6 aa, Entamoeba dispar
GGDLGT

SEQ ID NO: 2549271 - protein, 12 aa, Entamoeba dispar
GGEGPQKAAAVG

SEQ ID NO: 2549272 - protein, 9 aa, Entamoeba dispar
GGGYTDLES

SEQ ID NO: 2549273 - protein, 8 aa, Entamoeba dispar
GGKITKKY

SEQ ID NO: 2549274 - protein, 7 aa, Entamoeba dispar
GGMTPQT

SEQ ID NO: 2549275 - protein, 10 aa, Entamoeba dispar
GGNLKIDKDE

SEQ ID NO: 2549276 - protein, 7 aa, Entamoeba dispar
GGNVGDT

SEQ ID NO: 2549277 - protein, 6 aa, Entamoeba dispar
GGPDEV

SEQ ID NO: 2549278 - protein, 8 aa, Entamoeba dispar
GGPESPWT

SEQ ID NO: 2549279 - protein, 18 aa, Entamoeba dispar
GGPSGLAAAKAALDTKKD

SEQ ID NO: 2549280 - protein, 9 aa, Entamoeba dispar
GGQAKLTIS

SEQ ID NO: 2549281 - protein, 4 aa, Entamoeba dispar
GGQL

SEQ ID NO: 2549282 - protein, 15 aa, Entamoeba dispar
GGRMTFSKSKQSNYA

SEQ ID NO: 2549283 - protein, 5 aa, Entamoeba dispar
GGSDY

SEQ ID NO: 2549284 - protein, 21 aa, Entamoeba dispar
GGSRYDPKKKSLYVGNSECSP

SEQ ID NO: 2549285 - protein, 7 aa, Entamoeba dispar
GGSSGIG

SEQ ID NO: 2549286 - protein, 27 aa, Entamoeba dispar
GGWSTPAIKQYQGTTSMCSASVDLSYQ

SEQ ID NO: 2549287 - protein, 13 aa, Entamoeba dispar
GGWTSPSMKQYRG

SEQ ID NO: 2549288 - protein, 21 aa, Entamoeba dispar
GHAEGKFYTDDGISVDNSDNY

SEQ ID NO: 2549289 - protein, 14 aa, Entamoeba dispar
GHGGYECGDNGEWS

SEQ ID NO: 2549290 - protein, 7 aa, Entamoeba dispar
GHVGTTY

SEQ ID NO: 2549291 - protein, 12 aa, Entamoeba dispar
GHYQGVNNSNAI

SEQ ID NO: 2549292 - protein, 6 aa, Entamoeba dispar
GIEQGA

SEQ ID NO: 2549293 - protein, 7 aa, Entamoeba dispar
GIETAAS

SEQ ID NO: 2549294 - protein, 11 aa, Entamoeba dispar
GINHAKRDLSG

SEQ ID NO: 2549295 - protein, 6 aa, Entamoeba dispar
GINSSI

SEQ ID NO: 2549296 - protein, 5 aa, Entamoeba dispar
GINTL

SEQ ID NO: 2549297 - protein, 5 aa, Entamoeba dispar
GIPNV

SEQ ID NO: 2549298 - protein, 9 aa, Entamoeba dispar
GIQAQKQGL

SEQ ID NO: 2549299 - protein, 10 aa, Entamoeba dispar
GIQPAPRGVP

SEQ ID NO: 2549300 - protein, 6 aa, Entamoeba dispar
GIRPNV

SEQ ID NO: 2549301 - protein, 4 aa, Entamoeba dispar
GISK

SEQ ID NO: 2549302 - protein, 5 aa, Entamoeba dispar
GISKD

SEQ ID NO: 2549303 - protein, 5 aa, Entamoeba dispar
GISKS

SEQ ID NO: 2549304 - protein, 7 aa, Entamoeba dispar
GITGKTV

SEQ ID NO: 2549305 - protein, 8 aa, Entamoeba dispar
GITTDSTK

SEQ ID NO: 2549306 - protein, 7 aa, Entamoeba dispar
GKCTNCK

SEQ ID NO: 2549307 - protein, 8 aa, Entamoeba dispar
GKDFTKKE

SEQ ID NO: 2549308 - protein, 8 aa, Entamoeba dispar
GKDGLTAN

SEQ ID NO: 2549309 - protein, 5 aa, Entamoeba dispar
GKDPF

SEQ ID NO: 2549310 - protein, 9 aa, Entamoeba dispar
GKDTKAIKK

SEQ ID NO: 2549311 - protein, 7 aa, Entamoeba dispar
GKDYERT

SEQ ID NO: 2549312 - protein, 10 aa, Entamoeba dispar
GKECTPPSQL

SEQ ID NO: 2549313 - protein, 12 aa, Entamoeba dispar
GKEHGKKHKTTV

SEQ ID NO: 2549314 - protein, 4 aa, Entamoeba dispar
GKEI

SEQ ID NO: 2549315 - protein, 15 aa, Entamoeba dispar
GKEPNKGVNPDEAVA

SEQ ID NO: 2549316 - protein, 14 aa, Entamoeba dispar
GKEPSRGINPDEAV

SEQ ID NO: 2549317 - protein, 9 aa, Entamoeba dispar
GKEYPGNSR

SEQ ID NO: 2549318 - protein, 6 aa, Entamoeba dispar
GKGGDF

SEQ ID NO: 2549319 - protein, 5 aa, Entamoeba dispar
GKIQT

SEQ ID NO: 2549320 - protein, 7 aa, Entamoeba dispar
GKKGGMA

SEQ ID NO: 2549321 - protein, 9 aa, Entamoeba dispar
GKKSTQYKA

SEQ ID NO: 2549322 - protein, 8 aa, Entamoeba dispar
GKKYYPKD

SEQ ID NO: 2549323 - protein, 5 aa, Entamoeba dispar
GKLNG

SEQ ID NO: 2549324 - protein, 4 aa, Entamoeba dispar
GKNS

SEQ ID NO: 2549325 - protein, 27 aa, Entamoeba dispar
GKNSQFSVNAGKSAAKGGYVGAGFKLN

SEQ ID NO: 2549326 - protein, 6 aa, Entamoeba dispar
GKPLGG

SEQ ID NO: 2549327 - protein, 4 aa, Entamoeba dispar
GKQF

SEQ ID NO: 2549328 - protein, 11 aa, Entamoeba dispar
GKRNNEGKAGY

SEQ ID NO: 2549329 - protein, 7 aa, Entamoeba dispar
GKSSDPF

SEQ ID NO: 2549330 - protein, 4 aa, Entamoeba dispar
GKST

SEQ ID NO: 2549331 - protein, 17 aa, Entamoeba dispar
GKTSDNRDQFSTNYPYG

SEQ ID NO: 2549332 - protein, 35 aa, Entamoeba dispar
GKTSDNRDQFSTNYPYGMENRNTNFNSEFTSDVNS

SEQ ID NO: 2549333 - protein, 12 aa, Entamoeba dispar
GKVTPIRDQAQC

SEQ ID NO: 2549334 - protein, 11 aa, Entamoeba dispar
GKWSKKASGSK

SEQ ID NO: 2549335 - protein, 5 aa, Entamoeba dispar
GKYDS

SEQ ID NO: 2549336 - protein, 12 aa, Entamoeba dispar
GKYINNNKCIEC

SEQ ID NO: 2549337 - protein, 12 aa, Entamoeba dispar
GLDDKDETNMSN

SEQ ID NO: 2549338 - protein, 114 aa, Entamoeba dispar
GLDKDKKSKSNKSKSNKSKSNKSKSKKVSPQSNSKRKSSTPKRNTKSRKSSTSKRNTKPKKLSVSKRNNKSKKSPTSKRNNKPKRRQTTKRNTRPRPSPKRRQTNKQSSSQKKK

SEQ ID NO: 2549339 - protein, 7 aa, Entamoeba dispar
GLDMSDG

SEQ ID NO: 2549340 - protein, 5 aa, Entamoeba dispar
GLGNN

SEQ ID NO: 2549341 - protein, 4 aa, Entamoeba dispar
GLGT

SEQ ID NO: 2549342 - protein, 8 aa, Entamoeba dispar
GLKERGSA

SEQ ID NO: 2549343 - protein, 9 aa, Entamoeba dispar
GLKSSGQFD

SEQ ID NO: 2549344 - protein, 7 aa, Entamoeba dispar
GLKTAAG

SEQ ID NO: 2549345 - protein, 8 aa, Entamoeba dispar
GLNPRARN

SEQ ID NO: 2549346 - protein, 15 aa, Entamoeba dispar
GLQEQRAKRRMQDQR

SEQ ID NO: 2549347 - protein, 7 aa, Entamoeba dispar
GLREKGN

SEQ ID NO: 2549348 - protein, 10 aa, Entamoeba dispar
GLSGVEAGRI

SEQ ID NO: 2549349 - protein, 15 aa, Entamoeba dispar
GLTEEGNHGGSTLEE

SEQ ID NO: 2549350 - protein, 7 aa, Entamoeba dispar
GMTKEEL

SEQ ID NO: 2549351 - protein, 6 aa, Entamoeba dispar
GMYTNE

SEQ ID NO: 2549352 - protein, 7 aa, Entamoeba dispar
GNAAGQV

SEQ ID NO: 2549353 - protein, 4 aa, Entamoeba dispar
GNCD

SEQ ID NO: 2549354 - protein, 11 aa, Entamoeba dispar
GNCKKEEENLY

SEQ ID NO: 2549355 - protein, 8 aa, Entamoeba dispar
GNDESYSL

SEQ ID NO: 2549356 - protein, 9 aa, Entamoeba dispar
GNDKYTGKI

SEQ ID NO: 2549357 - protein, 7 aa, Entamoeba dispar
GNEDIQG

SEQ ID NO: 2549358 - protein, 13 aa, Entamoeba dispar
GNEHTGLKSPHGR

SEQ ID NO: 2549359 - protein, 6 aa, Entamoeba dispar
GNEIQN

SEQ ID NO: 2549360 - protein, 9 aa, Entamoeba dispar
GNEKTGKNN

SEQ ID NO: 2549361 - protein, 6 aa, Entamoeba dispar
GNGENT

SEQ ID NO: 2549362 - protein, 11 aa, Entamoeba dispar
GNGNDNYKSAY

SEQ ID NO: 2549363 - protein, 11 aa, Entamoeba dispar
GNGNDNYKSEY

SEQ ID NO: 2549364 - protein, 13 aa, Entamoeba dispar
GNGNQTKGAKNEW

SEQ ID NO: 2549365 - protein, 7 aa, Entamoeba dispar
GNGYTQN

SEQ ID NO: 2549366 - protein, 5 aa, Entamoeba dispar
GNKRL

SEQ ID NO: 2549367 - protein, 4 aa, Entamoeba dispar
GNKS

SEQ ID NO: 2549368 - protein, 4 aa, Entamoeba dispar
GNKT

SEQ ID NO: 2549369 - protein, 8 aa, Entamoeba dispar
GNKTFEDN

SEQ ID NO: 2549370 - protein, 7 aa, Entamoeba dispar
GNKYPLK

SEQ ID NO: 2549371 - protein, 6 aa, Entamoeba dispar
GNNEHK

SEQ ID NO: 2549372 - protein, 6 aa, Entamoeba dispar
GNSIEI

SEQ ID NO: 2549373 - protein, 9 aa, Entamoeba dispar
GNSKPADEL

SEQ ID NO: 2549374 - protein, 7 aa, Entamoeba dispar
GNSPTRI

SEQ ID NO: 2549375 - protein, 15 aa, Entamoeba dispar
GNSPTRIIGGVNELW

SEQ ID NO: 2549376 - protein, 39 aa, Entamoeba dispar
GNSQTSLTEGLENSSVIKTEGIENRNSGNSDTHSNGTIE

SEQ ID NO: 2549377 - protein, 14 aa, Entamoeba dispar
GNSRTSYSIPPSVT

SEQ ID NO: 2549378 - protein, 6 aa, Entamoeba dispar
GNTPGY

SEQ ID NO: 2549379 - protein, 6 aa, Entamoeba dispar
GNTSLG

SEQ ID NO: 2549380 - protein, 9 aa, Entamoeba dispar
GNVKNALKQ

SEQ ID NO: 2549381 - protein, 12 aa, Entamoeba dispar
GNYKSNNGKWDI

SEQ ID NO: 2549382 - protein, 9 aa, Entamoeba dispar
GNYSNPHEK

SEQ ID NO: 2549383 - protein, 8 aa, Entamoeba dispar
GPEVTMPK

SEQ ID NO: 2549384 - protein, 6 aa, Entamoeba dispar
GPIPPL

SEQ ID NO: 2549385 - protein, 8 aa, Entamoeba dispar
GPKGTVRF

SEQ ID NO: 2549386 - protein, 4 aa, Entamoeba dispar
GPKP

SEQ ID NO: 2549387 - protein, 5 aa, Entamoeba dispar
GPKVT

SEQ ID NO: 2549388 - protein, 6 aa, Entamoeba dispar
GPSQKP

SEQ ID NO: 2549389 - protein, 7 aa, Entamoeba dispar
GPSWGSN

SEQ ID NO: 2549390 - protein, 10 aa, Entamoeba dispar
GPTHEGGLPP

SEQ ID NO: 2549391 - protein, 12 aa, Entamoeba dispar
GPVGSSMDASRS

SEQ ID NO: 2549392 - protein, 11 aa, Entamoeba dispar
GPYAAMTNTEY

SEQ ID NO: 2549393 - protein, 12 aa, Entamoeba dispar
GQKFTDKVQGGF

SEQ ID NO: 2549394 - protein, 12 aa, Entamoeba dispar
GQNDITSEIPND

SEQ ID NO: 2549395 - protein, 14 aa, Entamoeba dispar
GQQQPQRPKKTPDI

SEQ ID NO: 2549396 - protein, 4 aa, Entamoeba dispar
GQSS

SEQ ID NO: 2549397 - protein, 9 aa, Entamoeba dispar
GQTSAPSAT

SEQ ID NO: 2549398 - protein, 13 aa, Entamoeba dispar
GQWSSDKTLNQQT

SEQ ID NO: 2549399 - protein, 13 aa, Entamoeba dispar
GRDKDIVPKDPDY

SEQ ID NO: 2549400 - protein, 12 aa, Entamoeba dispar
GRDSNYPTGVKL

SEQ ID NO: 2549401 - protein, 10 aa, Entamoeba dispar
GREAASSFAK

SEQ ID NO: 2549402 - protein, 9 aa, Entamoeba dispar
GRETDKSDV

SEQ ID NO: 2549403 - protein, 6 aa, Entamoeba dispar
GRSSRD

SEQ ID NO: 2549404 - protein, 13 aa, Entamoeba dispar
GRTGRAGKKGTAI

SEQ ID NO: 2549405 - protein, 5 aa, Entamoeba dispar
GRTQY

SEQ ID NO: 2549406 - protein, 6 aa, Entamoeba dispar
GRVNKD

SEQ ID NO: 2549407 - protein, 8 aa, Entamoeba dispar
GSAASQVN

SEQ ID NO: 2549408 - protein, 11 aa, Entamoeba dispar
GSDISKEYRKV

SEQ ID NO: 2549409 - protein, 8 aa, Entamoeba dispar
GSDNGNYH

SEQ ID NO: 2549410 - protein, 6 aa, Entamoeba dispar
GSDQAT

SEQ ID NO: 2549411 - protein, 9 aa, Entamoeba dispar
GSDYSNSNY

SEQ ID NO: 2549412 - protein, 8 aa, Entamoeba dispar
GSEETEIK

SEQ ID NO: 2549413 - protein, 5 aa, Entamoeba dispar
GSGCG

SEQ ID NO: 2549414 - protein, 6 aa, Entamoeba dispar
GSGTIT

SEQ ID NO: 2549415 - protein, 7 aa, Entamoeba dispar
GSGVGKT

SEQ ID NO: 2549416 - protein, 19 aa, Entamoeba dispar
GSHGPNTYDSLGRVDRNNK

SEQ ID NO: 2549417 - protein, 6 aa, Entamoeba dispar
GSIAST

SEQ ID NO: 2549418 - protein, 8 aa, Entamoeba dispar
GSIDETNC

SEQ ID NO: 2549419 - protein, 4 aa, Entamoeba dispar
GSIG

SEQ ID NO: 2549420 - protein, 5 aa, Entamoeba dispar
GSKDK

SEQ ID NO: 2549421 - protein, 5 aa, Entamoeba dispar
GSKDM

SEQ ID NO: 2549422 - protein, 70 aa, Entamoeba dispar
GSKIAQKGKSIAKKGMSAAKGKISSIKKGGKELVNKGKTMINKGKDALQKGKDTLKKSVNNLKNKGQTIM

SEQ ID NO: 2549423 - protein, 10 aa, Entamoeba dispar
GSNGNDTFSD

SEQ ID NO: 2549424 - protein, 4 aa, Entamoeba dispar
GSNH

SEQ ID NO: 2549425 - protein, 7 aa, Entamoeba dispar
GSNTVEE

SEQ ID NO: 2549426 - protein, 9 aa, Entamoeba dispar
GSQTYTADN

SEQ ID NO: 2549427 - protein, 8 aa, Entamoeba dispar
GSRYKIED

SEQ ID NO: 2549428 - protein, 28 aa, Entamoeba dispar
GSSGSSAASSASSAASSASSAASSIPSI

SEQ ID NO: 2549429 - protein, 14 aa, Entamoeba dispar
GSSLGSKKVSKSQF

SEQ ID NO: 2549430 - protein, 7 aa, Entamoeba dispar
GSTEGGE

SEQ ID NO: 2549431 - protein, 7 aa, Entamoeba dispar
GSTRIPK

SEQ ID NO: 2549432 - protein, 26 aa, Entamoeba dispar
GSVKNNKLDLSANAEFGKNNKKADLT

SEQ ID NO: 2549433 - protein, 15 aa, Entamoeba dispar
GSVPRANAAGALAAT

SEQ ID NO: 2549434 - protein, 4 aa, Entamoeba dispar
GSYC

SEQ ID NO: 2549435 - protein, 5 aa, Entamoeba dispar
GTAPM

SEQ ID NO: 2549436 - protein, 8 aa, Entamoeba dispar
GTASGKTT

SEQ ID NO: 2549437 - protein, 19 aa, Entamoeba dispar
GTDKYTGKINTAEFPGAAY

SEQ ID NO: 2549438 - protein, 5 aa, Entamoeba dispar
GTENF

SEQ ID NO: 2549439 - protein, 11 aa, Entamoeba dispar
GTGGDTPDDVK

SEQ ID NO: 2549440 - protein, 5 aa, Entamoeba dispar
GTGKI

SEQ ID NO: 2549441 - protein, 4 aa, Entamoeba dispar
GTGP

SEQ ID NO: 2549442 - protein, 7 aa, Entamoeba dispar
GTGWGDK

SEQ ID NO: 2549443 - protein, 5 aa, Entamoeba dispar
GTHCE

SEQ ID NO: 2549444 - protein, 4 aa, Entamoeba dispar
GTHG

SEQ ID NO: 2549445 - protein, 5 aa, Entamoeba dispar
GTHGM

SEQ ID NO: 2549446 - protein, 9 aa, Entamoeba dispar
GTHVPTKKS

SEQ ID NO: 2549447 - protein, 10 aa, Entamoeba dispar
GTIAKSGTAE

SEQ ID NO: 2549448 - protein, 12 aa, Entamoeba dispar
GTIQNEKTDKGL

SEQ ID NO: 2549449 - protein, 6 aa, Entamoeba dispar
GTIYSD

SEQ ID NO: 2549450 - protein, 7 aa, Entamoeba dispar
GTNSDVN

SEQ ID NO: 2549451 - protein, 10 aa, Entamoeba dispar
GTPATRMNSG

SEQ ID NO: 2549452 - protein, 7 aa, Entamoeba dispar
GTPDEYR

SEQ ID NO: 2549453 - protein, 36 aa, Entamoeba dispar
GTQYTSPKLNASASYQQTNNAAGKNTKVNLDSTYRI

SEQ ID NO: 2549454 - protein, 9 aa, Entamoeba dispar
GTSPSIRKY

SEQ ID NO: 2549455 - protein, 6 aa, Entamoeba dispar
GTSPVE

SEQ ID NO: 2549456 - protein, 7 aa, Entamoeba dispar
GTSPVTE

SEQ ID NO: 2549457 - protein, 15 aa, Entamoeba dispar
GTSTCKETNCSTPSL

SEQ ID NO: 2549458 - protein, 7 aa, Entamoeba dispar
GTTGYTA

SEQ ID NO: 2549459 - protein, 9 aa, Entamoeba dispar
GTTGYTAQT

SEQ ID NO: 2549460 - protein, 6 aa, Entamoeba dispar
GTTTND

SEQ ID NO: 2549461 - protein, 31 aa, Entamoeba dispar
GTTYTGSKFNGNAKYNIKRDPIGKSSSFQYN

SEQ ID NO: 2549462 - protein, 8 aa, Entamoeba dispar
GVADESEY

SEQ ID NO: 2549463 - protein, 14 aa, Entamoeba dispar
GVDDNYQPFPQKCS

SEQ ID NO: 2549464 - protein, 33 aa, Entamoeba dispar
GVHKDSETAKYEATFSPETYQLNETSSEDAKGQ

SEQ ID NO: 2549465 - protein, 20 aa, Entamoeba dispar
GVNASSGNEQPEKPKEDDIP

SEQ ID NO: 2549466 - protein, 5 aa, Entamoeba dispar
GVPST

SEQ ID NO: 2549467 - protein, 7 aa, Entamoeba dispar
GVQSGSL

SEQ ID NO: 2549468 - protein, 9 aa, Entamoeba dispar
GVSNNTETC

SEQ ID NO: 2549469 - protein, 12 aa, Entamoeba dispar
GVTTRDKDKKCA

SEQ ID NO: 2549470 - protein, 11 aa, Entamoeba dispar
GVTTRDKNSQC

SEQ ID NO: 2549471 - protein, 7 aa, Entamoeba dispar
GVYDEPK

SEQ ID NO: 2549472 - protein, 7 aa, Entamoeba dispar
GVYTKSQ

SEQ ID NO: 2549473 - protein, 4 aa, Entamoeba dispar
GWNT

SEQ ID NO: 2549474 - protein, 5 aa, Entamoeba dispar
GYEEV

SEQ ID NO: 2549475 - protein, 13 aa, Entamoeba dispar
GYGLNEEGKCTNV

SEQ ID NO: 2549476 - protein, 14 aa, Entamoeba dispar
GYGNSTGKPSEQGF

SEQ ID NO: 2549477 - protein, 9 aa, Entamoeba dispar
GYGSNSNGK

SEQ ID NO: 2549478 - protein, 10 aa, Entamoeba dispar
GYGSQDGKDY

SEQ ID NO: 2549479 - protein, 10 aa, Entamoeba dispar
GYGTQDGKDY

SEQ ID NO: 2549480 - protein, 9 aa, Entamoeba dispar
GYKGSKAIP

SEQ ID NO: 2549481 - protein, 8 aa, Entamoeba dispar
GYNHETDH

SEQ ID NO: 2549482 - protein, 6 aa, Entamoeba dispar
GYNTPQ

SEQ ID NO: 2549483 - protein, 6 aa, Entamoeba dispar
GYPEYA

SEQ ID NO: 2549484 - protein, 12 aa, Entamoeba dispar
GYPNDPLVNDPG

SEQ ID NO: 2549485 - protein, 4 aa, Entamoeba dispar
GYQL

SEQ ID NO: 2549486 - protein, 21 aa, Entamoeba dispar
GYQPKATNVAYTSGSTDPWSP

SEQ ID NO: 2549487 - protein, 9 aa, Entamoeba dispar
GYRKTGQRA

SEQ ID NO: 2549488 - protein, 6 aa, Entamoeba dispar
GYSTYS

SEQ ID NO: 2549489 - protein, 11 aa, Entamoeba dispar
GYTVTDSNEYA

SEQ ID NO: 2549490 - protein, 12 aa, Entamoeba dispar
GYYGAGDRTEEL

SEQ ID NO: 2549491 - protein, 12 aa, Entamoeba dispar
GYYNTNNQNAYA

SEQ ID NO: 2549492 - protein, 4 aa, Entamoeba dispar
HADT

SEQ ID NO: 2549493 - protein, 11 aa, Entamoeba dispar
HATANKKDFNL

SEQ ID NO: 2549494 - protein, 13 aa, Entamoeba dispar
HCKKESKLKCQEC

SEQ ID NO: 2549495 - protein, 4 aa, Entamoeba dispar
HCNQ

SEQ ID NO: 2549496 - protein, 9 aa, Entamoeba dispar
HDENRAVQN

SEQ ID NO: 2549497 - protein, 4 aa, Entamoeba dispar
HDGN

SEQ ID NO: 2549498 - protein, 6 aa, Entamoeba dispar
HDQTGS

SEQ ID NO: 2549499 - protein, 4 aa, Entamoeba dispar
HDTS

SEQ ID NO: 2549500 - protein, 14 aa, Entamoeba dispar
HEDRRKLEKKAEQK

SEQ ID NO: 2549501 - protein, 6 aa, Entamoeba dispar
HEEEKV

SEQ ID NO: 2549502 - protein, 7 aa, Entamoeba dispar
HEGKTNV

SEQ ID NO: 2549503 - protein, 5 aa, Entamoeba dispar
HESIS

SEQ ID NO: 2549504 - protein, 6 aa, Entamoeba dispar
HETLPS

SEQ ID NO: 2549505 - protein, 10 aa, Entamoeba dispar
HFKGNKKNGG

SEQ ID NO: 2549506 - protein, 6 aa, Entamoeba dispar
HGDRNS

SEQ ID NO: 2549507 - protein, 11 aa, Entamoeba dispar
HGECKRKSCSK

SEQ ID NO: 2549508 - protein, 6 aa, Entamoeba dispar
HGEKRG

SEQ ID NO: 2549509 - protein, 5 aa, Entamoeba dispar
HGGEF

SEQ ID NO: 2549510 - protein, 73 aa, Entamoeba dispar
HGHISSGSVSDSLSITGSSSSGSTTGSSSSGSTTGSSSSGSTTGSSSGASTSTSITGLGGSGSVGTSSSSVSV

SEQ ID NO: 2549511 - protein, 6 aa, Entamoeba dispar
HGNHTR

SEQ ID NO: 2549512 - protein, 16 aa, Entamoeba dispar
HGNQKEFKTRDNETLK

SEQ ID NO: 2549513 - protein, 9 aa, Entamoeba dispar
HGSGSYGDE

SEQ ID NO: 2549514 - protein, 11 aa, Entamoeba dispar
HGSRYPTANDI

SEQ ID NO: 2549515 - protein, 9 aa, Entamoeba dispar
HGTSQSQLS

SEQ ID NO: 2549516 - protein, 11 aa, Entamoeba dispar
HHGSQTSNTAG

SEQ ID NO: 2549517 - protein, 7 aa, Entamoeba dispar
HKAEKKE

SEQ ID NO: 2549518 - protein, 6 aa, Entamoeba dispar
HKEPYA

SEQ ID NO: 2549519 - protein, 8 aa, Entamoeba dispar
HKGEYVKQ

SEQ ID NO: 2549520 - protein, 6 aa, Entamoeba dispar
HKITQP

SEQ ID NO: 2549521 - protein, 10 aa, Entamoeba dispar
HKKDTNGVNN

SEQ ID NO: 2549522 - protein, 6 aa, Entamoeba dispar
HKNDID

SEQ ID NO: 2549523 - protein, 27 aa, Entamoeba dispar
HKSGNVAASPNGKYPEGGNNPVSYPGS

SEQ ID NO: 2549524 - protein, 27 aa, Entamoeba dispar
HKSGNVAASPSGKYPTGGNDPVSYPGS

SEQ ID NO: 2549525 - protein, 8 aa, Entamoeba dispar
HKVSQPSK

SEQ ID NO: 2549526 - protein, 5 aa, Entamoeba dispar
HLGKG

SEQ ID NO: 2549527 - protein, 10 aa, Entamoeba dispar
HLTTTSTSYQ

SEQ ID NO: 2549528 - protein, 11 aa, Entamoeba dispar
HLTTTSTSYQI

SEQ ID NO: 2549529 - protein, 7 aa, Entamoeba dispar
HMENTRN

SEQ ID NO: 2549530 - protein, 7 aa, Entamoeba dispar
HNGVTGS

SEQ ID NO: 2549531 - protein, 6 aa, Entamoeba dispar
HNNEET

SEQ ID NO: 2549532 - protein, 6 aa, Entamoeba dispar
HNPHSF

SEQ ID NO: 2549533 - protein, 6 aa, Entamoeba dispar
HNPKNF

SEQ ID NO: 2549534 - protein, 6 aa, Entamoeba dispar
HNPSFS

SEQ ID NO: 2549535 - protein, 6 aa, Entamoeba dispar
HNQTAH

SEQ ID NO: 2549536 - protein, 16 aa, Entamoeba dispar
HPDKPTGDKKKYEQIN

SEQ ID NO: 2549537 - protein, 10 aa, Entamoeba dispar
HPDKPTGDKV

SEQ ID NO: 2549538 - protein, 8 aa, Entamoeba dispar
HPDTNNIS

SEQ ID NO: 2549539 - protein, 9 aa, Entamoeba dispar
HPEKGRRVR

SEQ ID NO: 2549540 - protein, 10 aa, Entamoeba dispar
HPKDSTYKHP

SEQ ID NO: 2549541 - protein, 4 aa, Entamoeba dispar
HPSM

SEQ ID NO: 2549542 - protein, 8 aa, Entamoeba dispar
HQIGGDSR

SEQ ID NO: 2549543 - protein, 5 aa, Entamoeba dispar
HQKHQ

SEQ ID NO: 2549544 - protein, 7 aa, Entamoeba dispar
HQNPTNP

SEQ ID NO: 2549545 - protein, 6 aa, Entamoeba dispar
HQPSPW

SEQ ID NO: 2549546 - protein, 13 aa, Entamoeba dispar
HQRDGPGITYGRS

SEQ ID NO: 2549547 - protein, 5 aa, Entamoeba dispar
HQSES

SEQ ID NO: 2549548 - protein, 4 aa, Entamoeba dispar
HQTR

SEQ ID NO: 2549549 - protein, 5 aa, Entamoeba dispar
HRDTM

SEQ ID NO: 2549550 - protein, 22 aa, Entamoeba dispar
HRPANENGQVVTTPQIKRELPK

SEQ ID NO: 2549551 - protein, 44 aa, Entamoeba dispar
HRRHSRRQSTTEDTHGDITESTTEDTHGDITEKLQEETTRSTEN

SEQ ID NO: 2549552 - protein, 8 aa, Entamoeba dispar
HSDHASGI

SEQ ID NO: 2549553 - protein, 7 aa, Entamoeba dispar
HSESPNQ

SEQ ID NO: 2549554 - protein, 8 aa, Entamoeba dispar
HSFKDPNN

SEQ ID NO: 2549555 - protein, 6 aa, Entamoeba dispar
HSFKET

SEQ ID NO: 2549556 - protein, 11 aa, Entamoeba dispar
HSGEYPKTDPG

SEQ ID NO: 2549557 - protein, 6 aa, Entamoeba dispar
HSNRYG

SEQ ID NO: 2549558 - protein, 7 aa, Entamoeba dispar
HSRENKE

SEQ ID NO: 2549559 - protein, 5 aa, Entamoeba dispar
HSSHC

SEQ ID NO: 2549560 - protein, 9 aa, Entamoeba dispar
HSSKQAKYS

SEQ ID NO: 2549561 - protein, 6 aa, Entamoeba dispar
HSTTGQ

SEQ ID NO: 2549562 - protein, 5 aa, Entamoeba dispar
HTDDK

SEQ ID NO: 2549563 - protein, 4 aa, Entamoeba dispar
HTDY

SEQ ID NO: 2549564 - protein, 24 aa, Entamoeba dispar
HTENENLDDGDDEKKDKDEIQPRQ

SEQ ID NO: 2549565 - protein, 6 aa, Entamoeba dispar
HTKLEN

SEQ ID NO: 2549566 - protein, 10 aa, Entamoeba dispar
HTLNSQTMDR

SEQ ID NO: 2549567 - protein, 4 aa, Entamoeba dispar
HTNT

SEQ ID NO: 2549568 - protein, 4 aa, Entamoeba dispar
HTQP

SEQ ID NO: 2549569 - protein, 7 aa, Entamoeba dispar
HTTPPHT

SEQ ID NO: 2549570 - protein, 17 aa, Entamoeba dispar
HVTPNEDALTSALEQGP

SEQ ID NO: 2549571 - protein, 7 aa, Entamoeba dispar
IAEEKRQ

SEQ ID NO: 2549572 - protein, 18 aa, Entamoeba dispar
IAEQNGLKQEVKKANIKK

SEQ ID NO: 2549573 - protein, 4 aa, Entamoeba dispar
IAGG

SEQ ID NO: 2549574 - protein, 17 aa, Entamoeba dispar
IAGGEEKKLTEEEYPSW

SEQ ID NO: 2549575 - protein, 18 aa, Entamoeba dispar
IAGTVGKVAGTVSSVAGK

SEQ ID NO: 2549576 - protein, 120 aa, Entamoeba dispar
IAKAAKKRVKKSTKKVVRPSQKTNLNKTNKANNQQAVQPTNKVNNQPVAQPNNKVTNQQAVQPNNQQAVQPNNQPVAQPNNQQVTQPVEKQKQPNEKQNNEPNIQKTNNQNSQTQRGKEI

SEQ ID NO: 2549577 - protein, 12 aa, Entamoeba dispar
IAKDNNKDKTLT

SEQ ID NO: 2549578 - protein, 16 aa, Entamoeba dispar
IAKKPKEKKCENGVCT

SEQ ID NO: 2549579 - protein, 9 aa, Entamoeba dispar
IAKRNRKAA

SEQ ID NO: 2549580 - protein, 7 aa, Entamoeba dispar
IAKTSSL

SEQ ID NO: 2549581 - protein, 10 aa, Entamoeba dispar
IANEPNADQE

SEQ ID NO: 2549582 - protein, 5 aa, Entamoeba dispar
IAPAD

SEQ ID NO: 2549583 - protein, 9 aa, Entamoeba dispar
IAPTQEEPL

SEQ ID NO: 2549584 - protein, 8 aa, Entamoeba dispar
IAQAKGNS

SEQ ID NO: 2549585 - protein, 9 aa, Entamoeba dispar
IAQKGTDTD

SEQ ID NO: 2549586 - protein, 7 aa, Entamoeba dispar
IDASSAK

SEQ ID NO: 2549587 - protein, 12 aa, Entamoeba dispar
IDDEQSQDNLNN

SEQ ID NO: 2549588 - protein, 7 aa, Entamoeba dispar
IDDKKDY

SEQ ID NO: 2549589 - protein, 12 aa, Entamoeba dispar
IDDSISRRTEYN

SEQ ID NO: 2549590 - protein, 10 aa, Entamoeba dispar
IDEDDIEDLQ

SEQ ID NO: 2549591 - protein, 8 aa, Entamoeba dispar
IDESQSNL

SEQ ID NO: 2549592 - protein, 11 aa, Entamoeba dispar
IDGEDVSSDEV

SEQ ID NO: 2549593 - protein, 10 aa, Entamoeba dispar
IDGHKSLTAN

SEQ ID NO: 2549594 - protein, 13 aa, Entamoeba dispar
IDGNTTTEPNKSC

SEQ ID NO: 2549595 - protein, 8 aa, Entamoeba dispar
IDGVGGEE

SEQ ID NO: 2549596 - protein, 4 aa, Entamoeba dispar
IDKD

SEQ ID NO: 2549597 - protein, 6 aa, Entamoeba dispar
IDKRQR

SEQ ID NO: 2549598 - protein, 10 aa, Entamoeba dispar
IDNGYSNEAA

SEQ ID NO: 2549599 - protein, 4 aa, Entamoeba dispar
IDNT

SEQ ID NO: 2549600 - protein, 21 aa, Entamoeba dispar
IDPSYENLTKNNGLNHMKPKL

SEQ ID NO: 2549601 - protein, 8 aa, Entamoeba dispar
IDPVTNQS

SEQ ID NO: 2549602 - protein, 14 aa, Entamoeba dispar
IDQPAPQAQKSDCT

SEQ ID NO: 2549603 - protein, 6 aa, Entamoeba dispar
IDSKEG

SEQ ID NO: 2549604 - protein, 10 aa, Entamoeba dispar
IDSNKQKHAV

SEQ ID NO: 2549605 - protein, 8 aa, Entamoeba dispar
IDSSQPSF

SEQ ID NO: 2549606 - protein, 4 aa, Entamoeba dispar
IDSY

SEQ ID NO: 2549607 - protein, 9 aa, Entamoeba dispar
IDTGDGTWK

SEQ ID NO: 2549608 - protein, 9 aa, Entamoeba dispar
IEARRKSEM

SEQ ID NO: 2549609 - protein, 5 aa, Entamoeba dispar
IEEEE

SEQ ID NO: 2549610 - protein, 5 aa, Entamoeba dispar
IEENE

SEQ ID NO: 2549611 - protein, 24 aa, Entamoeba dispar
IEEYQKNKKEMERLTEKREELNEA

SEQ ID NO: 2549612 - protein, 7 aa, Entamoeba dispar
IEGDQQK

SEQ ID NO: 2549613 - protein, 9 aa, Entamoeba dispar
IEGTSDAEW

SEQ ID NO: 2549614 - protein, 9 aa, Entamoeba dispar
IEKETLDDI

SEQ ID NO: 2549615 - protein, 11 aa, Entamoeba dispar
IEKKERERSLR

SEQ ID NO: 2549616 - protein, 9 aa, Entamoeba dispar
IEKNAQRKK

SEQ ID NO: 2549617 - protein, 9 aa, Entamoeba dispar
IEKWGTDQA

SEQ ID NO: 2549618 - protein, 16 aa, Entamoeba dispar
IENDKSEETISSKCEK

SEQ ID NO: 2549619 - protein, 12 aa, Entamoeba dispar
IENGKEQINEES

SEQ ID NO: 2549620 - protein, 4 aa, Entamoeba dispar
IENK

SEQ ID NO: 2549621 - protein, 18 aa, Entamoeba dispar
IEPKGVIQSTDPKKKKLN

SEQ ID NO: 2549622 - protein, 9 aa, Entamoeba dispar
IEPPRFGST

SEQ ID NO: 2549623 - protein, 9 aa, Entamoeba dispar
IEQQSAKVN

SEQ ID NO: 2549624 - protein, 13 aa, Entamoeba dispar
IESNEDFPQIKEE

SEQ ID NO: 2549625 - protein, 7 aa, Entamoeba dispar
IETINKN

SEQ ID NO: 2549626 - protein, 8 aa, Entamoeba dispar
IETTDEPI

SEQ ID NO: 2549627 - protein, 5 aa, Entamoeba dispar
IETTV

SEQ ID NO: 2549628 - protein, 17 aa, Entamoeba dispar
IGGSTIGPHVASTTGMT

SEQ ID NO: 2549629 - protein, 7 aa, Entamoeba dispar
IGKKQMN

SEQ ID NO: 2549630 - protein, 9 aa, Entamoeba dispar
IGKSSHNDI

SEQ ID NO: 2549631 - protein, 8 aa, Entamoeba dispar
IGNSVSTI

SEQ ID NO: 2549632 - protein, 7 aa, Entamoeba dispar
IGPTGIK

SEQ ID NO: 2549633 - protein, 15 aa, Entamoeba dispar
IGSAIGNAVDKGTKW

SEQ ID NO: 2549634 - protein, 12 aa, Entamoeba dispar
IGSGSSTPRRES

SEQ ID NO: 2549635 - protein, 6 aa, Entamoeba dispar
IGSKKM

SEQ ID NO: 2549636 - protein, 4 aa, Entamoeba dispar
IGST

SEQ ID NO: 2549637 - protein, 11 aa, Entamoeba dispar
IGTEGKIPTNV

SEQ ID NO: 2549638 - protein, 4 aa, Entamoeba dispar
IGVE

SEQ ID NO: 2549639 - protein, 4 aa, Entamoeba dispar
IGYH

SEQ ID NO: 2549640 - protein, 4 aa, Entamoeba dispar
IGYK

SEQ ID NO: 2549641 - protein, 7 aa, Entamoeba dispar
IHTGTKE

SEQ ID NO: 2549642 - protein, 8 aa, Entamoeba dispar
IKAAPESV

SEQ ID NO: 2549643 - protein, 8 aa, Entamoeba dispar
IKANPEDQ

SEQ ID NO: 2549644 - protein, 11 aa, Entamoeba dispar
IKDQNGKCNNN

SEQ ID NO: 2549645 - protein, 10 aa, Entamoeba dispar
IKEDNVNSDE

SEQ ID NO: 2549646 - protein, 4 aa, Entamoeba dispar
IKEK

SEQ ID NO: 2549647 - protein, 4 aa, Entamoeba dispar
IKEL

SEQ ID NO: 2549648 - protein, 10 aa, Entamoeba dispar
IKEVDQKNKI

SEQ ID NO: 2549649 - protein, 26 aa, Entamoeba dispar
IKGETQISTRLDPDEIKEEHKIGEGS

SEQ ID NO: 2549650 - protein, 5 aa, Entamoeba dispar
IKGTE

SEQ ID NO: 2549651 - protein, 9 aa, Entamoeba dispar
IKKDPIYKQ

SEQ ID NO: 2549652 - protein, 19 aa, Entamoeba dispar
IKKEKNRERYQEELQEEMQ

SEQ ID NO: 2549653 - protein, 4 aa, Entamoeba dispar
IKLN

SEQ ID NO: 2549654 - protein, 4 aa, Entamoeba dispar
IKNI

SEQ ID NO: 2549655 - protein, 31 aa, Entamoeba dispar
IKNSVESEKKGIDTLKDKAVKSQQERQGLKA

SEQ ID NO: 2549656 - protein, 8 aa, Entamoeba dispar
IKPEKTVK

SEQ ID NO: 2549657 - protein, 10 aa, Entamoeba dispar
IKPPQPKYKN

SEQ ID NO: 2549658 - protein, 6 aa, Entamoeba dispar
IKPSIS

SEQ ID NO: 2549659 - protein, 15 aa, Entamoeba dispar
IKPTIRSSKITQQDP

SEQ ID NO: 2549660 - protein, 29 aa, Entamoeba dispar
IKRSEKKVERKIRKNTYKASTSSTTSKKC

SEQ ID NO: 2549661 - protein, 5 aa, Entamoeba dispar
IKRSR

SEQ ID NO: 2549662 - protein, 8 aa, Entamoeba dispar
IKSEDEIT

SEQ ID NO: 2549663 - protein, 14 aa, Entamoeba dispar
IKSGNVDDETNTSV

SEQ ID NO: 2549664 - protein, 6 aa, Entamoeba dispar
IKSGSA

SEQ ID NO: 2549665 - protein, 6 aa, Entamoeba dispar
IKSKYE

SEQ ID NO: 2549666 - protein, 7 aa, Entamoeba dispar
IKSKYED

SEQ ID NO: 2549667 - protein, 17 aa, Entamoeba dispar
IKTQQNKSHKKHITKRR

SEQ ID NO: 2549668 - protein, 27 aa, Entamoeba dispar
IKYDTTLKSKNELEQKYKEEEIDKKQR

SEQ ID NO: 2549669 - protein, 4 aa, Entamoeba dispar
ILGR

SEQ ID NO: 2549670 - protein, 8 aa, Entamoeba dispar
INEDRERV

SEQ ID NO: 2549671 - protein, 5 aa, Entamoeba dispar
INEND

SEQ ID NO: 2549672 - protein, 5 aa, Entamoeba dispar
INETI

SEQ ID NO: 2549673 - protein, 11 aa, Entamoeba dispar
INETQNSEKLE

SEQ ID NO: 2549674 - protein, 11 aa, Entamoeba dispar
INETQNTEKME

SEQ ID NO: 2549675 - protein, 5 aa, Entamoeba dispar
INGKK

SEQ ID NO: 2549676 - protein, 13 aa, Entamoeba dispar
INGTKYDATATKK

SEQ ID NO: 2549677 - protein, 6 aa, Entamoeba dispar
INKNDR

SEQ ID NO: 2549678 - protein, 5 aa, Entamoeba dispar
INKNI

SEQ ID NO: 2549679 - protein, 10 aa, Entamoeba dispar
INKNPNDHYL

SEQ ID NO: 2549680 - protein, 19 aa, Entamoeba dispar
INKQKRYHKGSVEYSGLAE

SEQ ID NO: 2549681 - protein, 7 aa, Entamoeba dispar
INKQKTA

SEQ ID NO: 2549682 - protein, 9 aa, Entamoeba dispar
INKREKDTY

SEQ ID NO: 2549683 - protein, 10 aa, Entamoeba dispar
INKRKTAGKS

SEQ ID NO: 2549684 - protein, 4 aa, Entamoeba dispar
INNM

SEQ ID NO: 2549685 - protein, 17 aa, Entamoeba dispar
INNSTNPPTNITQINNS

SEQ ID NO: 2549686 - protein, 16 aa, Entamoeba dispar
INNSTSVNKTQEVNEQ

SEQ ID NO: 2549687 - protein, 11 aa, Entamoeba dispar
INQRTKNHTTI

SEQ ID NO: 2549688 - protein, 18 aa, Entamoeba dispar
INRRNRKAALKVNKAENK

SEQ ID NO: 2549689 - protein, 5 aa, Entamoeba dispar
INSNT

SEQ ID NO: 2549690 - protein, 7 aa, Entamoeba dispar
INSTDDY

SEQ ID NO: 2549691 - protein, 14 aa, Entamoeba dispar
INVQSITGSCDNTE

SEQ ID NO: 2549692 - protein, 8 aa, Entamoeba dispar
INYADSTN

SEQ ID NO: 2549693 - protein, 11 aa, Entamoeba dispar
IPAENRTEAIR

SEQ ID NO: 2549694 - protein, 7 aa, Entamoeba dispar
IPDPKNT

SEQ ID NO: 2549695 - protein, 7 aa, Entamoeba dispar
IPDSVTE

SEQ ID NO: 2549696 - protein, 5 aa, Entamoeba dispar
IPIGS

SEQ ID NO: 2549697 - protein, 10 aa, Entamoeba dispar
IPINRDDNRF

SEQ ID NO: 2549698 - protein, 12 aa, Entamoeba dispar
IPKGYEKKTYEG

SEQ ID NO: 2549699 - protein, 10 aa, Entamoeba dispar
IPKKGKEDFI

SEQ ID NO: 2549700 - protein, 11 aa, Entamoeba dispar
IPNSVENIGDN

SEQ ID NO: 2549701 - protein, 19 aa, Entamoeba dispar
IPQQKIDQAKLTAQHKNDI

SEQ ID NO: 2549702 - protein, 5 aa, Entamoeba dispar
IPQVP

SEQ ID NO: 2549703 - protein, 4 aa, Entamoeba dispar
IPTS

SEQ ID NO: 2549704 - protein, 6 aa, Entamoeba dispar
IQDSSV

SEQ ID NO: 2549705 - protein, 10 aa, Entamoeba dispar
IQEGETNHQI

SEQ ID NO: 2549706 - protein, 5 aa, Entamoeba dispar
IQKEY

SEQ ID NO: 2549707 - protein, 10 aa, Entamoeba dispar
IQKGKTDDAV

SEQ ID NO: 2549708 - protein, 17 aa, Entamoeba dispar
IQKNKELATSSTEPWKR

SEQ ID NO: 2549709 - protein, 5 aa, Entamoeba dispar
IQNTR

SEQ ID NO: 2549710 - protein, 10 aa, Entamoeba dispar
IQPKAPSNVV

SEQ ID NO: 2549711 - protein, 6 aa, Entamoeba dispar
IQPNES

SEQ ID NO: 2549712 - protein, 4 aa, Entamoeba dispar
IQRV

SEQ ID NO: 2549713 - protein, 6 aa, Entamoeba dispar
IQSEQM

SEQ ID NO: 2549714 - protein, 5 aa, Entamoeba dispar
IQSVG

SEQ ID NO: 2549715 - protein, 7 aa, Entamoeba dispar
IQTSERI

SEQ ID NO: 2549716 - protein, 10 aa, Entamoeba dispar
IRAADKAKIS

SEQ ID NO: 2549717 - protein, 9 aa, Entamoeba dispar
IRGGANKGA

SEQ ID NO: 2549718 - protein, 36 aa, Entamoeba dispar
IRIKEKKNNIKEGIKTEKEIKRESKKKIEKQEEEEI

SEQ ID NO: 2549719 - protein, 12 aa, Entamoeba dispar
IRKLEKKKNAEM

SEQ ID NO: 2549720 - protein, 11 aa, Entamoeba dispar
IRRENDNTKRL

SEQ ID NO: 2549721 - protein, 4 aa, Entamoeba dispar
IRRI

SEQ ID NO: 2549722 - protein, 11 aa, Entamoeba dispar
IRSSKEKTVIP

SEQ ID NO: 2549723 - protein, 4 aa, Entamoeba dispar
ISDD

SEQ ID NO: 2549724 - protein, 7 aa, Entamoeba dispar
ISESDNI

SEQ ID NO: 2549725 - protein, 7 aa, Entamoeba dispar
ISGTTIN

SEQ ID NO: 2549726 - protein, 12 aa, Entamoeba dispar
ISHKADTKKTLK

SEQ ID NO: 2549727 - protein, 7 aa, Entamoeba dispar
ISKEREE

SEQ ID NO: 2549728 - protein, 4 aa, Entamoeba dispar
ISKR

SEQ ID NO: 2549729 - protein, 7 aa, Entamoeba dispar
ISKTEDI

SEQ ID NO: 2549730 - protein, 10 aa, Entamoeba dispar
ISNQNNSPYD

SEQ ID NO: 2549731 - protein, 4 aa, Entamoeba dispar
ISNT

SEQ ID NO: 2549732 - protein, 5 aa, Entamoeba dispar
ISPGF

SEQ ID NO: 2549733 - protein, 11 aa, Entamoeba dispar
ISPKSASVKGR

SEQ ID NO: 2549734 - protein, 5 aa, Entamoeba dispar
ISPSF

SEQ ID NO: 2549735 - protein, 9 aa, Entamoeba dispar
ISPSSTPIE

SEQ ID NO: 2549736 - protein, 10 aa, Entamoeba dispar
ISQTPLQSDC

SEQ ID NO: 2549737 - protein, 13 aa, Entamoeba dispar
ISQTSNKLEKSGL

SEQ ID NO: 2549738 - protein, 14 aa, Entamoeba dispar
ISSPQYENQPPYEF

SEQ ID NO: 2549739 - protein, 7 aa, Entamoeba dispar
ISSQEIK

SEQ ID NO: 2549740 - protein, 6 aa, Entamoeba dispar
ISTGST

SEQ ID NO: 2549741 - protein, 4 aa, Entamoeba dispar
ITET

SEQ ID NO: 2549742 - protein, 7 aa, Entamoeba dispar
ITNQKDY

SEQ ID NO: 2549743 - protein, 9 aa, Entamoeba dispar
ITNTGNSPL

SEQ ID NO: 2549744 - protein, 6 aa, Entamoeba dispar
ITPSGR

SEQ ID NO: 2549745 - protein, 14 aa, Entamoeba dispar
ITQKEQKMDFENKQ

SEQ ID NO: 2549746 - protein, 4 aa, Entamoeba dispar
ITQL

SEQ ID NO: 2549747 - protein, 9 aa, Entamoeba dispar
ITQPTPLTQ

SEQ ID NO: 2549748 - protein, 12 aa, Entamoeba dispar
ITQYNDSGCTLY

SEQ ID NO: 2549749 - protein, 9 aa, Entamoeba dispar
ITRTTTNDL

SEQ ID NO: 2549750 - protein, 6 aa, Entamoeba dispar
ITSTSS

SEQ ID NO: 2549751 - protein, 16 aa, Entamoeba dispar
ITTNTTNTKRNEGIRT

SEQ ID NO: 2549752 - protein, 7 aa, Entamoeba dispar
ITTPSDY

SEQ ID NO: 2549753 - protein, 22 aa, Entamoeba dispar
ITTPTTTPAQVNVTSSNNTIPF

SEQ ID NO: 2549754 - protein, 4 aa, Entamoeba dispar
ITYP

SEQ ID NO: 2549755 - protein, 5 aa, Entamoeba dispar
IVKQP

SEQ ID NO: 2549756 - protein, 17 aa, Entamoeba dispar
IVSGNNFGGKFTESNEG

SEQ ID NO: 2549757 - protein, 17 aa, Entamoeba dispar
IVSGNNFGGKFTESSEG

SEQ ID NO: 2549758 - protein, 22 aa, Entamoeba dispar
KAAAEGQSIEDITEAQNQANVE

SEQ ID NO: 2549759 - protein, 37 aa, Entamoeba dispar
KAASKKTTKKVETAKKEVKKDQKKAKKYVKKAEKIQK

SEQ ID NO: 2549760 - protein, 11 aa, Entamoeba dispar
KAAVKPTSSCN

SEQ ID NO: 2549761 - protein, 9 aa, Entamoeba dispar
KADSKSPMN

SEQ ID NO: 2549762 - protein, 8 aa, Entamoeba dispar
KAEAAYTK

SEQ ID NO: 2549763 - protein, 28 aa, Entamoeba dispar
KAEEKQYYENKRIKAEKKAFKRLSDNVK

SEQ ID NO: 2549764 - protein, 12 aa, Entamoeba dispar
KAEQQANSMEAE

SEQ ID NO: 2549765 - protein, 25 aa, Entamoeba dispar
KAETELSTRLDPDELKEEKKIGEGS

SEQ ID NO: 2549766 - protein, 6 aa, Entamoeba dispar
KAFQKQ

SEQ ID NO: 2549767 - protein, 17 aa, Entamoeba dispar
KAGLKIGPTEKKLAQKA

SEQ ID NO: 2549768 - protein, 8 aa, Entamoeba dispar
KAGTNIKA

SEQ ID NO: 2549769 - protein, 8 aa, Entamoeba dispar
KAIASRKD

SEQ ID NO: 2549770 - protein, 9 aa, Entamoeba dispar
KAITASGEL

SEQ ID NO: 2549771 - protein, 8 aa, Entamoeba dispar
KAKDYPKS

SEQ ID NO: 2549772 - protein, 12 aa, Entamoeba dispar
KAKEAKSPERDE

SEQ ID NO: 2549773 - protein, 6 aa, Entamoeba dispar
KAKEYP

SEQ ID NO: 2549774 - protein, 8 aa, Entamoeba dispar
KAKRDIPI

SEQ ID NO: 2549775 - protein, 13 aa, Entamoeba dispar
KAKVQTVAKQKCL

SEQ ID NO: 2549776 - protein, 10 aa, Entamoeba dispar
KAKVRRQLQK

SEQ ID NO: 2549777 - protein, 9 aa, Entamoeba dispar
KALEENDRI

SEQ ID NO: 2549778 - protein, 6 aa, Entamoeba dispar
KALKGE

SEQ ID NO: 2549779 - protein, 7 aa, Entamoeba dispar
KANDTGI

SEQ ID NO: 2549780 - protein, 12 aa, Entamoeba dispar
KANERMGKSEKY

SEQ ID NO: 2549781 - protein, 10 aa, Entamoeba dispar
KANGLSDEDV

SEQ ID NO: 2549782 - protein, 5 aa, Entamoeba dispar
KANSF

SEQ ID NO: 2549783 - protein, 13 aa, Entamoeba dispar
KANVNTNKTSVSI

SEQ ID NO: 2549784 - protein, 10 aa, Entamoeba dispar
KAPAETNKCQ

SEQ ID NO: 2549785 - protein, 6 aa, Entamoeba dispar
KAPALD

SEQ ID NO: 2549786 - protein, 11 aa, Entamoeba dispar
KAPPQPSFSGT

SEQ ID NO: 2549787 - protein, 15 aa, Entamoeba dispar
KAQEKGKTEKVTELQ

SEQ ID NO: 2549788 - protein, 37 aa, Entamoeba dispar
  misc_feature (28)..(29): Xaa can be any naturally occurring amino acid
KAQEYRKPFGSKRGRKGGFNRRGAGRFXXYYLLYLPF

SEQ ID NO: 2549789 - protein, 23 aa, Entamoeba dispar
KAQIADSDLDEYAERTEKRFNDY

SEQ ID NO: 2549790 - protein, 14 aa, Entamoeba dispar
KAQKQQLERDATRS

SEQ ID NO: 2549791 - protein, 7 aa, Entamoeba dispar
KASDDTY

SEQ ID NO: 2549792 - protein, 9 aa, Entamoeba dispar
KASDKPHTC

SEQ ID NO: 2549793 - protein, 7 aa, Entamoeba dispar
KASDNTY

SEQ ID NO: 2549794 - protein, 4 aa, Entamoeba dispar
KASF

SEQ ID NO: 2549795 - protein, 7 aa, Entamoeba dispar
KASRTFE

SEQ ID NO: 2549796 - protein, 7 aa, Entamoeba dispar
KATSSLK

SEQ ID NO: 2549797 - protein, 7 aa, Entamoeba dispar
KATTNPI

SEQ ID NO: 2549798 - protein, 20 aa, Entamoeba dispar
KAVESSKKMNQKRKRLQESL

SEQ ID NO: 2549799 - protein, 14 aa, Entamoeba dispar
KAVGEKAQKEISKK

SEQ ID NO: 2549800 - protein, 9 aa, Entamoeba dispar
KAVKEQQKA

SEQ ID NO: 2549801 - protein, 10 aa, Entamoeba dispar
KCDSTCNECE

SEQ ID NO: 2549802 - protein, 8 aa, Entamoeba dispar
KCEENSDY

SEQ ID NO: 2549803 - protein, 9 aa, Entamoeba dispar
KCESSSNPA

SEQ ID NO: 2549804 - protein, 8 aa, Entamoeba dispar
KCGSIRTG

SEQ ID NO: 2549805 - protein, 5 aa, Entamoeba dispar
KCKET

SEQ ID NO: 2549806 - protein, 8 aa, Entamoeba dispar
KCKSNNEL

SEQ ID NO: 2549807 - protein, 7 aa, Entamoeba dispar
KCNENDE

SEQ ID NO: 2549808 - protein, 8 aa, Entamoeba dispar
KCNSNGKF

SEQ ID NO: 2549809 - protein, 5 aa, Entamoeba dispar
KCPAN

SEQ ID NO: 2549810 - protein, 16 aa, Entamoeba dispar
KCPDSCSSCSYDSNKK

SEQ ID NO: 2549811 - protein, 6 aa, Entamoeba dispar
KCPEKR

SEQ ID NO: 2549812 - protein, 5 aa, Entamoeba dispar
KCQTQ

SEQ ID NO: 2549813 - protein, 4 aa, Entamoeba dispar
KCSE

SEQ ID NO: 2549814 - protein, 12 aa, Entamoeba dispar
KCSNGRKPDNGF

SEQ ID NO: 2549815 - protein, 6 aa, Entamoeba dispar
KCSSKP

SEQ ID NO: 2549816 - protein, 5 aa, Entamoeba dispar
KDDSF

SEQ ID NO: 2549817 - protein, 7 aa, Entamoeba dispar
KDEADKI

SEQ ID NO: 2549818 - protein, 8 aa, Entamoeba dispar
KDEKGNYV

SEQ ID NO: 2549819 - protein, 15 aa, Entamoeba dispar
KDENANRQVTSNEGK

SEQ ID NO: 2549820 - protein, 6 aa, Entamoeba dispar
KDENGM

SEQ ID NO: 2549821 - protein, 4 aa, Entamoeba dispar
KDFM

SEQ ID NO: 2549822 - protein, 15 aa, Entamoeba dispar
KDGFGVETDDKEYDE

SEQ ID NO: 2549823 - protein, 6 aa, Entamoeba dispar
KDIDRH

SEQ ID NO: 2549824 - protein, 19 aa, Entamoeba dispar
KDIQAKKESAEASEDPKQI

SEQ ID NO: 2549825 - protein, 6 aa, Entamoeba dispar
KDKCSN

SEQ ID NO: 2549826 - protein, 9 aa, Entamoeba dispar
KDKEQQSSL

SEQ ID NO: 2549827 - protein, 9 aa, Entamoeba dispar
KDKSGTLEI

SEQ ID NO: 2549828 - protein, 9 aa, Entamoeba dispar
KDKTREKGQ

SEQ ID NO: 2549829 - protein, 12 aa, Entamoeba dispar
KDKYYDGTSCVN

SEQ ID NO: 2549830 - protein, 7 aa, Entamoeba dispar
KDNCGDE

SEQ ID NO: 2549831 - protein, 8 aa, Entamoeba dispar
KDNKNKYN

SEQ ID NO: 2549832 - protein, 4 aa, Entamoeba dispar
KDNL

SEQ ID NO: 2549833 - protein, 5 aa, Entamoeba dispar
KDNND

SEQ ID NO: 2549834 - protein, 12 aa, Entamoeba dispar
KDNTKPITKSNF

SEQ ID NO: 2549835 - protein, 23 aa, Entamoeba dispar
KDNTTVSGNHKGEIPAPSENDYS

SEQ ID NO: 2549836 - protein, 13 aa, Entamoeba dispar
KDPDAPDAGKCYN

SEQ ID NO: 2549837 - protein, 11 aa, Entamoeba dispar
KDPQGNKNDEY

SEQ ID NO: 2549838 - protein, 9 aa, Entamoeba dispar
KDQTPSEDN

SEQ ID NO: 2549839 - protein, 8 aa, Entamoeba dispar
KDRSQYEE

SEQ ID NO: 2549840 - protein, 9 aa, Entamoeba dispar
KDSDVNDNN

SEQ ID NO: 2549841 - protein, 6 aa, Entamoeba dispar
KDSYYN

SEQ ID NO: 2549842 - protein, 13 aa, Entamoeba dispar
KDTKDKYQNAQNG

SEQ ID NO: 2549843 - protein, 10 aa, Entamoeba dispar
KDVKGQIKRD

SEQ ID NO: 2549844 - protein, 16 aa, Entamoeba dispar
KDYPYTATNGTCQYDT

SEQ ID NO: 2549845 - protein, 4 aa, Entamoeba dispar
KEAD

SEQ ID NO: 2549846 - protein, 10 aa, Entamoeba dispar
KEAEDRKKEG

SEQ ID NO: 2549847 - protein, 9 aa, Entamoeba dispar
KEAKETKAL

SEQ ID NO: 2549848 - protein, 7 aa, Entamoeba dispar
KEAKQQR

SEQ ID NO: 2549849 - protein, 8 aa, Entamoeba dispar
KEAVENSF

SEQ ID NO: 2549850 - protein, 15 aa, Entamoeba dispar
KECKTLSGGESATAV

SEQ ID NO: 2549851 - protein, 12 aa, Entamoeba dispar
KEDETPMEEQGT

SEQ ID NO: 2549852 - protein, 5 aa, Entamoeba dispar
KEDHA

SEQ ID NO: 2549853 - protein, 8 aa, Entamoeba dispar
KEDNKINE

SEQ ID NO: 2549854 - protein, 9 aa, Entamoeba dispar
KEEEEHKRR

SEQ ID NO: 2549855 - protein, 5 aa, Entamoeba dispar
KEEEK

SEQ ID NO: 2549856 - protein, 6 aa, Entamoeba dispar
KEEEKK

SEQ ID NO: 2549857 - protein, 12 aa, Entamoeba dispar
KEEFSRNIEERQ

SEQ ID NO: 2549858 - protein, 14 aa, Entamoeba dispar
KEEKNETLPKQQKE

SEQ ID NO: 2549859 - protein, 8 aa, Entamoeba dispar
KEEKTVNK

SEQ ID NO: 2549860 - protein, 5 aa, Entamoeba dispar
KEEKV

SEQ ID NO: 2549861 - protein, 12 aa, Entamoeba dispar
KEENEKYSIRTN

SEQ ID NO: 2549862 - protein, 131 aa, Entamoeba dispar
KEENIDDNNDEYELEDDEYELEDEEEEEEDDDEEDEDEDEEDDDDEDEEDEEDEDEEDDEEEEDDDDEDEEEDDEDEEEDDEDEEEDDDEEEDEEEDEEEEDEEDEEDEDEEEDDEEEEEDDDDDDDERWR

SEQ ID NO: 2549863 - protein, 6 aa, Entamoeba dispar
KEERGD

SEQ ID NO: 2549864 - protein, 17 aa, Entamoeba dispar
KEETVKEEKGKKKGKKI

SEQ ID NO: 2549865 - protein, 6 aa, Entamoeba dispar
KEGKRV

SEQ ID NO: 2549866 - protein, 5 aa, Entamoeba dispar
KEGPV

SEQ ID NO: 2549867 - protein, 9 aa, Entamoeba dispar
KEIETTRNT

SEQ ID NO: 2549868 - protein, 10 aa, Entamoeba dispar
KEIKDEDGIK

SEQ ID NO: 2549869 - protein, 8 aa, Entamoeba dispar
KEIQNTSS

SEQ ID NO: 2549870 - protein, 9 aa, Entamoeba dispar
KEKALAEEH

SEQ ID NO: 2549871 - protein, 5 aa, Entamoeba dispar
KEKDY

SEQ ID NO: 2549872 - protein, 6 aa, Entamoeba dispar
KEKEIR

SEQ ID NO: 2549873 - protein, 7 aa, Entamoeba dispar
KEKEMNV

SEQ ID NO: 2549874 - protein, 6 aa, Entamoeba dispar
KEKILT

SEQ ID NO: 2549875 - protein, 6 aa, Entamoeba dispar
KEKMPK

SEQ ID NO: 2549876 - protein, 21 aa, Entamoeba dispar
KEKTQSNDDNWRNQLRNQSDN

SEQ ID NO: 2549877 - protein, 22 aa, Entamoeba dispar
KEKVQKGKDMYKKGKDTINKGK

SEQ ID NO: 2549878 - protein, 15 aa, Entamoeba dispar
KELESLEKRSLEDAH

SEQ ID NO: 2549879 - protein, 17 aa, Entamoeba dispar
KELKRAESQRDKLAKET

SEQ ID NO: 2549880 - protein, 5 aa, Entamoeba dispar
KELKY

SEQ ID NO: 2549881 - protein, 10 aa, Entamoeba dispar
KELMKKREER

SEQ ID NO: 2549882 - protein, 8 aa, Entamoeba dispar
KELNKQQK

SEQ ID NO: 2549883 - protein, 4 aa, Entamoeba dispar
KELP

SEQ ID NO: 2549884 - protein, 8 aa, Entamoeba dispar
KELPENQA

SEQ ID NO: 2549885 - protein, 5 aa, Entamoeba dispar
KELPS

SEQ ID NO: 2549886 - protein, 15 aa, Entamoeba dispar
KELPSIPVKTPTYKY

SEQ ID NO: 2549887 - protein, 10 aa, Entamoeba dispar
KELTKEEKAK

SEQ ID NO: 2549888 - protein, 13 aa, Entamoeba dispar
KEMKGKRCSVSRN

SEQ ID NO: 2549889 - protein, 20 aa, Entamoeba dispar
KENAIKKGKAVIESAKNKGR

SEQ ID NO: 2549890 - protein, 7 aa, Entamoeba dispar
KENEKPF

SEQ ID NO: 2549891 - protein, 7 aa, Entamoeba dispar
KENERRL

SEQ ID NO: 2549892 - protein, 19 aa, Entamoeba dispar
KENGECKEIDNKCNKSERN

SEQ ID NO: 2549893 - protein, 13 aa, Entamoeba dispar
KENIDLKRNQQQF

SEQ ID NO: 2549894 - protein, 9 aa, Entamoeba dispar
KENNDGTYI

SEQ ID NO: 2549895 - protein, 7 aa, Entamoeba dispar
KENPFKN

SEQ ID NO: 2549896 - protein, 6 aa, Entamoeba dispar
KENQTE

SEQ ID NO: 2549897 - protein, 8 aa, Entamoeba dispar
KENSQQII

SEQ ID NO: 2549898 - protein, 11 aa, Entamoeba dispar
KENSSGKTIKY

SEQ ID NO: 2549899 - protein, 4 aa, Entamoeba dispar
KEPL

SEQ ID NO: 2549900 - protein, 7 aa, Entamoeba dispar
KEPNKMP

SEQ ID NO: 2549901 - protein, 6 aa, Entamoeba dispar
KEPPND

SEQ ID NO: 2549902 - protein, 11 aa, Entamoeba dispar
KEPPPQDLQNE

SEQ ID NO: 2549903 - protein, 14 aa, Entamoeba dispar
KEQIEQAEKERQSK

SEQ ID NO: 2549904 - protein, 27 aa, Entamoeba dispar
KEQLDKDLRQTIQNAKKQKIKSENEQK

SEQ ID NO: 2549905 - protein, 10 aa, Entamoeba dispar
KEQYNTEPSF

SEQ ID NO: 2549906 - protein, 9 aa, Entamoeba dispar
KEREYGDRY

SEQ ID NO: 2549907 - protein, 15 aa, Entamoeba dispar
KERFDEERKIENKKI

SEQ ID NO: 2549908 - protein, 28 aa, Entamoeba dispar
KERGNEDNKKEKERNQNKVNRKQEIRKT

SEQ ID NO: 2549909 - protein, 8 aa, Entamoeba dispar
KERHSQHY

SEQ ID NO: 2549910 - protein, 9 aa, Entamoeba dispar
KERKRRASE

SEQ ID NO: 2549911 - protein, 9 aa, Entamoeba dispar
KERQQRKVE

SEQ ID NO: 2549912 - protein, 4 aa, Entamoeba dispar
KESF

SEQ ID NO: 2549913 - protein, 6 aa, Entamoeba dispar
KETELN

SEQ ID NO: 2549914 - protein, 5 aa, Entamoeba dispar
KETIT

SEQ ID NO: 2549915 - protein, 6 aa, Entamoeba dispar
KETKGK

SEQ ID NO: 2549916 - protein, 7 aa, Entamoeba dispar
KETKKSI

SEQ ID NO: 2549917 - protein, 8 aa, Entamoeba dispar
KETLPEED

SEQ ID NO: 2549918 - protein, 6 aa, Entamoeba dispar
KEVEGL

SEQ ID NO: 2549919 - protein, 20 aa, Entamoeba dispar
KEVEKKGENERHHFFPMDSH

SEQ ID NO: 2549920 - protein, 18 aa, Entamoeba dispar
KEVRNKMNKQEEEYKQKK

SEQ ID NO: 2549921 - protein, 6 aa, Entamoeba dispar
KEVTRN

SEQ ID NO: 2549922 - protein, 10 aa, Entamoeba dispar
KEYKNNTKEC

SEQ ID NO: 2549923 - protein, 4 aa, Entamoeba dispar
KEYQ

SEQ ID NO: 2549924 - protein, 7 aa, Entamoeba dispar
KFAEGGY
